United States Patent 7,888,497 (BIOINFORMATICALLY DETECTABLE GROUP OF NOVEL REGULATORY OLIGONUCLEOTIDES AND USES THEREOF) - sequence listing, part 135

SEQ ID NO: 5723222 - DNA, 21 bp, Homo sapiens
cttatgaaaagaattgttggg

SEQ ID NO: 5723223 - DNA, 21 bp, Homo sapiens
cttatgaatagacataaattg

SEQ ID NO: 5723224 - DNA, 15 bp, Homo sapiens
cttatgaatatattt

SEQ ID NO: 5723225 - DNA, 18 bp, Homo sapiens
cttatgaatgatttgcat

SEQ ID NO: 5723226 - DNA, 17 bp, Homo sapiens
cttatgaatgtttccgg

SEQ ID NO: 5723227 - DNA, 17 bp, Homo sapiens
cttatgactaaaaatat

SEQ ID NO: 5723228 - DNA, 20 bp, Homo sapiens
cttatgagaacatggtgtgt

SEQ ID NO: 5723229 - DNA, 19 bp, Homo sapiens
cttatgaggtcaagaaatg

SEQ ID NO: 5723230 - DNA, 21 bp, Homo sapiens
cttatgagtataatgaacact

SEQ ID NO: 5723231 - DNA, 23 bp, Homo sapiens
cttatgagtataatgaacactca

SEQ ID NO: 5723232 - DNA, 19 bp, Homo sapiens
cttatgatgggctccccag

SEQ ID NO: 5723233 - DNA, 20 bp, Homo sapiens
cttatgatgggctccccagg

SEQ ID NO: 5723234 - DNA, 15 bp, Homo sapiens
cttatgcaaaatgga

SEQ ID NO: 5723235 - DNA, 22 bp, Homo sapiens
cttatgcaaggggaaacctgtg

SEQ ID NO: 5723236 - DNA, 14 bp, Homo sapiens
cttatgcatgaaat

SEQ ID NO: 5723237 - DNA, 16 bp, Homo sapiens
cttatgcatgaaatga

SEQ ID NO: 5723238 - DNA, 19 bp, Homo sapiens
cttatgcatgaaatgaatg

SEQ ID NO: 5723239 - DNA, 22 bp, Homo sapiens
cttatgcatgaaatgaatgtct

SEQ ID NO: 5723240 - DNA, 14 bp, Homo sapiens
cttatgccacggga

SEQ ID NO: 5723241 - DNA, 21 bp, Homo sapiens
cttatgccatgttaatttcat

SEQ ID NO: 5723242 - DNA, 17 bp, Homo sapiens
cttatgccatttgttta

SEQ ID NO: 5723243 - DNA, 18 bp, Homo sapiens
cttatgcggttaattttg

SEQ ID NO: 5723244 - DNA, 20 bp, Homo sapiens
cttatgctcagaagccagtc

SEQ ID NO: 5723245 - DNA, 15 bp, Homo sapiens
cttatgctgatttat

SEQ ID NO: 5723246 - DNA, 14 bp, Homo sapiens
cttatgctgctgtg

SEQ ID NO: 5723247 - DNA, 15 bp, Homo sapiens
cttatgctgctgtga

SEQ ID NO: 5723248 - DNA, 13 bp, Homo sapiens
cttatgcttatga

SEQ ID NO: 5723249 - DNA, 13 bp, Homo sapiens
cttatgcttccag

SEQ ID NO: 5723250 - DNA, 16 bp, Homo sapiens
cttatggaacactctg

SEQ ID NO: 5723251 - DNA, 19 bp, Homo sapiens
cttatggaacactctgaga

SEQ ID NO: 5723252 - DNA, 14 bp, Homo sapiens
cttatggaacaggg

SEQ ID NO: 5723253 - DNA, 17 bp, Homo sapiens
cttatggacactgcctt

SEQ ID NO: 5723254 - DNA, 20 bp, Homo sapiens
cttatggagtgtgcctctct

SEQ ID NO: 5723255 - DNA, 21 bp, Homo sapiens
cttatggatgtccccagcaga

SEQ ID NO: 5723256 - DNA, 18 bp, Homo sapiens
cttatggattcatttata

SEQ ID NO: 5723257 - DNA, 16 bp, Homo sapiens
cttatggcatgactct

SEQ ID NO: 5723258 - DNA, 14 bp, Homo sapiens
cttatgggctgggt

SEQ ID NO: 5723259 - DNA, 21 bp, Homo sapiens
cttatgggtccccctcagcaa

SEQ ID NO: 5723260 - DNA, 17 bp, Homo sapiens
cttatgggtggctttca

SEQ ID NO: 5723261 - DNA, 19 bp, Homo sapiens
cttatgggtggctttcaag

SEQ ID NO: 5723262 - DNA, 21 bp, Homo sapiens
cttatggtatgtagccagctg

SEQ ID NO: 5723263 - DNA, 12 bp, Homo sapiens
cttatggtccag

SEQ ID NO: 5723264 - DNA, 14 bp, Homo sapiens
cttatggtccagaa

SEQ ID NO: 5723265 - DNA, 14 bp, Homo sapiens
cttatggtggaaga

SEQ ID NO: 5723266 - DNA, 12 bp, Homo sapiens
cttatgtaaagt

SEQ ID NO: 5723267 - DNA, 15 bp, Homo sapiens
cttatgtaaagtatg

SEQ ID NO: 5723268 - DNA, 15 bp, Homo sapiens
cttatgtaattattt

SEQ ID NO: 5723269 - DNA, 14 bp, Homo sapiens
cttatgtacttgat

SEQ ID NO: 5723270 - DNA, 20 bp, Homo sapiens
cttatgtagaaactgaggcc

SEQ ID NO: 5723271 - DNA, 21 bp, Homo sapiens
cttatgtagaaactgaggccc

SEQ ID NO: 5723272 - DNA, 15 bp, Homo sapiens
cttatgtagatattt

SEQ ID NO: 5723273 - DNA, 19 bp, Homo sapiens
cttatgtagcaggaaataa

SEQ ID NO: 5723274 - DNA, 13 bp, Homo sapiens
cttatgtattatt

SEQ ID NO: 5723275 - DNA, 17 bp, Homo sapiens
cttatgtattattttct

SEQ ID NO: 5723276 - DNA, 14 bp, Homo sapiens
cttatgtcatttct

SEQ ID NO: 5723277 - DNA, 15 bp, Homo sapiens
cttatgtccaccact

SEQ ID NO: 5723278 - DNA, 12 bp, Homo sapiens
cttatgtctctg

SEQ ID NO: 5723279 - DNA, 13 bp, Homo sapiens
cttatgtctctgc

SEQ ID NO: 5723280 - DNA, 17 bp, Homo sapiens
cttatgtgaaaaattaa

SEQ ID NO: 5723281 - DNA, 20 bp, Homo sapiens
cttatgtgggttgcctggtg

SEQ ID NO: 5723282 - DNA, 20 bp, Homo sapiens
cttatgtgtaggtgaacagt

SEQ ID NO: 5723283 - DNA, 13 bp, Homo sapiens
cttatgtgttaca

SEQ ID NO: 5723284 - DNA, 14 bp, Homo sapiens
cttatgtgttgcat

SEQ ID NO: 5723285 - DNA, 19 bp, Homo sapiens
cttatgttaatagtaattc

SEQ ID NO: 5723286 - DNA, 13 bp, Homo sapiens
cttatgttccaga

SEQ ID NO: 5723287 - DNA, 14 bp, Homo sapiens
cttatgttgaaaaa

SEQ ID NO: 5723288 - DNA, 18 bp, Homo sapiens
cttatgttgaaaaaattt

SEQ ID NO: 5723289 - DNA, 20 bp, Homo sapiens
cttatgttgatcgatgttaa

SEQ ID NO: 5723290 - DNA, 19 bp, Homo sapiens
cttatgtttcttattctct

SEQ ID NO: 5723291 - DNA, 16 bp, Homo sapiens
cttattaaaaaatttg

SEQ ID NO: 5723292 - DNA, 18 bp, Homo sapiens
cttattaaaacacttcat

SEQ ID NO: 5723293 - DNA, 13 bp, Homo sapiens
cttattaaagttc

SEQ ID NO: 5723294 - DNA, 14 bp, Homo sapiens
cttattaaagttct

SEQ ID NO: 5723295 - DNA, 14 bp, Homo sapiens
cttattaaagtttc

SEQ ID NO: 5723296 - DNA, 16 bp, Homo sapiens
cttattaacaactgtg

SEQ ID NO: 5723297 - DNA, 18 bp, Homo sapiens
cttattaacaactgtgaa

SEQ ID NO: 5723298 - DNA, 19 bp, Homo sapiens
cttattaacaactgtgaat

SEQ ID NO: 5723299 - DNA, 16 bp, Homo sapiens
cttattaagaccaaag

SEQ ID NO: 5723300 - DNA, 17 bp, Homo sapiens
cttattaagaccaaaga

SEQ ID NO: 5723301 - DNA, 19 bp, Homo sapiens
cttattaagaccaaagact

SEQ ID NO: 5723302 - DNA, 19 bp, Homo sapiens
cttattaagagcaaacttt

SEQ ID NO: 5723303 - DNA, 20 bp, Homo sapiens
cttattaagagcaaacttta

SEQ ID NO: 5723304 - DNA, 16 bp, Homo sapiens
cttattaatgctaagg

SEQ ID NO: 5723305 - DNA, 19 bp, Homo sapiens
cttattaatgctaagggca

SEQ ID NO: 5723306 - DNA, 23 bp, Homo sapiens
cttattaattcttcacctgttat

SEQ ID NO: 5723307 - DNA, 23 bp, Homo sapiens
cttattacagagggaaaggctga

SEQ ID NO: 5723308 - DNA, 14 bp, Homo sapiens
cttattacataact

SEQ ID NO: 5723309 - DNA, 24 bp, Homo sapiens
cttattacccaaacccatggctct

SEQ ID NO: 5723310 - DNA, 18 bp, Homo sapiens
cttattacctcaggtgcc

SEQ ID NO: 5723311 - DNA, 15 bp, Homo sapiens
cttattactattatt

SEQ ID NO: 5723312 - DNA, 13 bp, Homo sapiens
cttattactgaga

SEQ ID NO: 5723313 - DNA, 14 bp, Homo sapiens
cttattactgagag

SEQ ID NO: 5723314 - DNA, 20 bp, Homo sapiens
cttattagagtgtctttcca

SEQ ID NO: 5723315 - DNA, 21 bp, Homo sapiens
cttattagagtgtctttccac

SEQ ID NO: 5723316 - DNA, 18 bp, Homo sapiens
cttattaggataatacat

SEQ ID NO: 5723317 - DNA, 15 bp, Homo sapiens
cttattcaaagatga

SEQ ID NO: 5723318 - DNA, 13 bp, Homo sapiens
cttattcactttt

SEQ ID NO: 5723319 - DNA, 21 bp, Homo sapiens
cttattcaggaaaagcctctg

SEQ ID NO: 5723320 - DNA, 13 bp, Homo sapiens
cttattcagtgaa

SEQ ID NO: 5723321 - DNA, 23 bp, Homo sapiens
cttattcagtgaaaaagatattt

SEQ ID NO: 5723322 - DNA, 20 bp, Homo sapiens
cttattcatgctttctcctt

SEQ ID NO: 5723323 - DNA, 13 bp, Homo sapiens
cttattcattcct

SEQ ID NO: 5723324 - DNA, 19 bp, Homo sapiens
cttattcattgtggttatt

SEQ ID NO: 5723325 - DNA, 16 bp, Homo sapiens
cttattcattttctct

SEQ ID NO: 5723326 - DNA, 18 bp, Homo sapiens
cttattcattttctctaa

SEQ ID NO: 5723327 - DNA, 12 bp, Homo sapiens
cttattccacag

SEQ ID NO: 5723328 - DNA, 16 bp, Homo sapiens
cttattccacagatat

SEQ ID NO: 5723329 - DNA, 17 bp, Homo sapiens
cttattccatgactgct

SEQ ID NO: 5723330 - DNA, 19 bp, Homo sapiens
cttattccatgactgcttg

SEQ ID NO: 5723331 - DNA, 20 bp, Homo sapiens
cttattcccaaactacagaa

SEQ ID NO: 5723332 - DNA, 20 bp, Homo sapiens
cttattcccaactgctctgc

SEQ ID NO: 5723333 - DNA, 16 bp, Homo sapiens
cttattcctaattcct

SEQ ID NO: 5723334 - DNA, 15 bp, Homo sapiens
cttattcctttttat

SEQ ID NO: 5723335 - DNA, 15 bp, Homo sapiens
cttattctcaaagca

SEQ ID NO: 5723336 - DNA, 12 bp, Homo sapiens
cttattctctca

SEQ ID NO: 5723337 - DNA, 17 bp, Homo sapiens
cttattctctgtttgct

SEQ ID NO: 5723338 - DNA, 18 bp, Homo sapiens
cttattctgacataaaat

SEQ ID NO: 5723339 - DNA, 12 bp, Homo sapiens
cttattctgtag

SEQ ID NO: 5723340 - DNA, 14 bp, Homo sapiens
cttattctgtagat

SEQ ID NO: 5723341 - DNA, 19 bp, Homo sapiens
cttattcttgtgcacttta

SEQ ID NO: 5723342 - DNA, 17 bp, Homo sapiens
cttattcttgtggttaa

SEQ ID NO: 5723343 - DNA, 20 bp, Homo sapiens
cttattcttgtggttaaaaa

SEQ ID NO: 5723344 - DNA, 13 bp, Homo sapiens
cttattctttaca

SEQ ID NO: 5723345 - DNA, 16 bp, Homo sapiens
cttattgaccattttt

SEQ ID NO: 5723346 - DNA, 20 bp, Homo sapiens
cttattgatcccacatttcc

SEQ ID NO: 5723347 - DNA, 20 bp, Homo sapiens
cttattgattaagtatatct

SEQ ID NO: 5723348 - DNA, 13 bp, Homo sapiens
cttattgcccacg

SEQ ID NO: 5723349 - DNA, 18 bp, Homo sapiens
cttattgcccacgctgga

SEQ ID NO: 5723350 - DNA, 20 bp, Homo sapiens
cttattgcctagcctataaa

SEQ ID NO: 5723351 - DNA, 13 bp, Homo sapiens
cttattgcctcac

SEQ ID NO: 5723352 - DNA, 16 bp, Homo sapiens
cttattgcgctgctac

SEQ ID NO: 5723353 - DNA, 14 bp, Homo sapiens
cttattgctgccaa

SEQ ID NO: 5723354 - DNA, 20 bp, Homo sapiens
cttattgctgccaaaaccac

SEQ ID NO: 5723355 - DNA, 19 bp, Homo sapiens
cttattgcttcatctgtaa

SEQ ID NO: 5723356 - DNA, 15 bp, Homo sapiens
cttattgcttgcttt

SEQ ID NO: 5723357 - DNA, 17 bp, Homo sapiens
cttattggaaatgtact

SEQ ID NO: 5723358 - DNA, 15 bp, Homo sapiens
cttattggaactctg

SEQ ID NO: 5723359 - DNA, 18 bp, Homo sapiens
cttattggaactctgctt

SEQ ID NO: 5723360 - DNA, 21 bp, Homo sapiens
cttattggatatttgatattt

SEQ ID NO: 5723361 - DNA, 18 bp, Homo sapiens
cttattggcagctctact

SEQ ID NO: 5723362 - DNA, 20 bp, Homo sapiens
cttattgggatatcatttta

SEQ ID NO: 5723363 - DNA, 22 bp, Homo sapiens
cttattgggatatcattttaaa

SEQ ID NO: 5723364 - DNA, 14 bp, Homo sapiens
cttattgtacctct

SEQ ID NO: 5723365 - DNA, 22 bp, Homo sapiens
cttattgtgtgcgctgcctggc

SEQ ID NO: 5723366 - DNA, 12 bp, Homo sapiens
cttattgttcca

SEQ ID NO: 5723367 - DNA, 13 bp, Homo sapiens
cttattgttccaa

SEQ ID NO: 5723368 - DNA, 17 bp, Homo sapiens
cttattgttccaagaca

SEQ ID NO: 5723369 - DNA, 20 bp, Homo sapiens
cttattgttccaagacattg

SEQ ID NO: 5723370 - DNA, 19 bp, Homo sapiens
cttattgttgctgaaaact

SEQ ID NO: 5723371 - DNA, 16 bp, Homo sapiens
cttatttaaaaatatt

SEQ ID NO: 5723372 - DNA, 22 bp, Homo sapiens
cttatttaaaaatatttcagat

SEQ ID NO: 5723373 - DNA, 13 bp, Homo sapiens
cttatttaaaatt

SEQ ID NO: 5723374 - DNA, 17 bp, Homo sapiens
cttatttaaaattccat

SEQ ID NO: 5723375 - DNA, 18 bp, Homo sapiens
cttatttaaagctttcaa

SEQ ID NO: 5723376 - DNA, 13 bp, Homo sapiens
cttatttaaatag

SEQ ID NO: 5723377 - DNA, 19 bp, Homo sapiens
cttatttaaatagatgaca

SEQ ID NO: 5723378 - DNA, 12 bp, Homo sapiens
cttatttaacca

SEQ ID NO: 5723379 - DNA, 15 bp, Homo sapiens
cttatttaactgatt

SEQ ID NO: 5723380 - DNA, 20 bp, Homo sapiens
cttatttaagtaactttaaa

SEQ ID NO: 5723381 - DNA, 22 bp, Homo sapiens
cttatttaatcttttcttattt

SEQ ID NO: 5723382 - DNA, 17 bp, Homo sapiens
cttatttaatgaaagac

SEQ ID NO: 5723383 - DNA, 18 bp, Homo sapiens
cttatttaatttttgcaa

SEQ ID NO: 5723384 - DNA, 15 bp, Homo sapiens
cttatttaccctttt

SEQ ID NO: 5723385 - DNA, 18 bp, Homo sapiens
cttatttagtattctgcc

SEQ ID NO: 5723386 - DNA, 13 bp, Homo sapiens
cttatttatatat

SEQ ID NO: 5723387 - DNA, 15 bp, Homo sapiens
cttatttatatatga

SEQ ID NO: 5723388 - DNA, 14 bp, Homo sapiens
cttatttatatctt

SEQ ID NO: 5723389 - DNA, 17 bp, Homo sapiens
cttatttatatgaagca

SEQ ID NO: 5723390 - DNA, 18 bp, Homo sapiens
cttatttatatgaagcaa

SEQ ID NO: 5723391 - DNA, 20 bp, Homo sapiens
cttatttatatgaagcaagc

SEQ ID NO: 5723392 - DNA, 22 bp, Homo sapiens
cttatttatatgaagcaagctg

SEQ ID NO: 5723393 - DNA, 21 bp, Homo sapiens
cttatttatcctagtattcct

SEQ ID NO: 5723394 - DNA, 16 bp, Homo sapiens
cttatttatgtaacaa

SEQ ID NO: 5723395 - DNA, 18 bp, Homo sapiens
cttatttatgtgaacaac

SEQ ID NO: 5723396 - DNA, 19 bp, Homo sapiens
cttatttatgttaaaagat

SEQ ID NO: 5723397 - DNA, 21 bp, Homo sapiens
cttatttattcatattttctt

SEQ ID NO: 5723398 - DNA, 19 bp, Homo sapiens
cttatttattgtattctgg

SEQ ID NO: 5723399 - DNA, 17 bp, Homo sapiens
cttatttattttagcaa

SEQ ID NO: 5723400 - DNA, 14 bp, Homo sapiens
cttatttcatctgt

SEQ ID NO: 5723401 - DNA, 15 bp, Homo sapiens
cttatttcctcattt

SEQ ID NO: 5723402 - DNA, 16 bp, Homo sapiens
cttatttctatgacaa

SEQ ID NO: 5723403 - DNA, 17 bp, Homo sapiens
cttatttctatgacaaa

SEQ ID NO: 5723404 - DNA, 18 bp, Homo sapiens
cttatttctatgacaaat

SEQ ID NO: 5723405 - DNA, 17 bp, Homo sapiens
cttatttctcagctgtg

SEQ ID NO: 5723406 - DNA, 16 bp, Homo sapiens
cttatttctctctcct

SEQ ID NO: 5723407 - DNA, 18 bp, Homo sapiens
cttatttctgaaaaagag

SEQ ID NO: 5723408 - DNA, 11 bp, Homo sapiens
cttatttctgc

SEQ ID NO: 5723409 - DNA, 11 bp, Homo sapiens
cttatttctgt

SEQ ID NO: 5723410 - DNA, 20 bp, Homo sapiens
cttatttcttaaagcttttt

SEQ ID NO: 5723411 - DNA, 13 bp, Homo sapiens
cttatttctttcc

SEQ ID NO: 5723412 - DNA, 20 bp, Homo sapiens
cttatttctttcctttaaaa

SEQ ID NO: 5723413 - DNA, 16 bp, Homo sapiens
cttatttgaaagtgtt

SEQ ID NO: 5723414 - DNA, 19 bp, Homo sapiens
cttatttgccttctactcc

SEQ ID NO: 5723415 - DNA, 21 bp, Homo sapiens
cttatttgccttctactcccc

SEQ ID NO: 5723416 - DNA, 23 bp, Homo sapiens
cttatttgctcataagtaaatgt

SEQ ID NO: 5723417 - DNA, 23 bp, Homo sapiens
cttatttgctgccacacctgagc

SEQ ID NO: 5723418 - DNA, 17 bp, Homo sapiens
cttatttgcttcattgt

SEQ ID NO: 5723419 - DNA, 14 bp, Homo sapiens
cttatttggaaatt

SEQ ID NO: 5723420 - DNA, 14 bp, Homo sapiens
cttatttgtataat

SEQ ID NO: 5723421 - DNA, 20 bp, Homo sapiens
cttatttgtttggtcactgc

SEQ ID NO: 5723422 - DNA, 20 bp, Homo sapiens
cttattttaagcattgtgag

SEQ ID NO: 5723423 - DNA, 12 bp, Homo sapiens
cttattttaatg

SEQ ID NO: 5723424 - DNA, 17 bp, Homo sapiens
cttattttaatgtgatg

SEQ ID NO: 5723425 - DNA, 13 bp, Homo sapiens
cttattttacaaa

SEQ ID NO: 5723426 - DNA, 13 bp, Homo sapiens
cttattttacatt

SEQ ID NO: 5723427 - DNA, 17 bp, Homo sapiens
cttattttagattgcta

SEQ ID NO: 5723428 - DNA, 11 bp, Homo sapiens
cttattttatg

SEQ ID NO: 5723429 - DNA, 21 bp, Homo sapiens
cttattttattatttctaaat

SEQ ID NO: 5723430 - DNA, 13 bp, Homo sapiens
cttattttcataa

SEQ ID NO: 5723431 - DNA, 17 bp, Homo sapiens
cttattttcataattca

SEQ ID NO: 5723432 - DNA, 20 bp, Homo sapiens
cttattttcataattcattt

SEQ ID NO: 5723433 - DNA, 17 bp, Homo sapiens
cttattttccaataaaa

SEQ ID NO: 5723434 - DNA, 13 bp, Homo sapiens
cttattttctgaa

SEQ ID NO: 5723435 - DNA, 22 bp, Homo sapiens
cttattttctgaattcataaaa

SEQ ID NO: 5723436 - DNA, 23 bp, Homo sapiens
cttattttctgttcagattaaaa

SEQ ID NO: 5723437 - DNA, 19 bp, Homo sapiens
cttattttgcattccagaa

SEQ ID NO: 5723438 - DNA, 23 bp, Homo sapiens
cttattttgcattccagaatctt

SEQ ID NO: 5723439 - DNA, 13 bp, Homo sapiens
cttattttgtaag

SEQ ID NO: 5723440 - DNA, 13 bp, Homo sapiens
cttattttgtaat

SEQ ID NO: 5723441 - DNA, 15 bp, Homo sapiens
cttattttgtaataa

SEQ ID NO: 5723442 - DNA, 15 bp, Homo sapiens
cttattttgtattac

SEQ ID NO: 5723443 - DNA, 18 bp, Homo sapiens
cttattttgtcttattct

SEQ ID NO: 5723444 - DNA, 16 bp, Homo sapiens
cttatttttaaaataa

SEQ ID NO: 5723445 - DNA, 18 bp, Homo sapiens
cttatttttaatttttcc

SEQ ID NO: 5723446 - DNA, 13 bp, Homo sapiens
cttatttttactt

SEQ ID NO: 5723447 - DNA, 23 bp, Homo sapiens
cttatttttataacatctttatt

SEQ ID NO: 5723448 - DNA, 15 bp, Homo sapiens
cttatttttatgtgg

SEQ ID NO: 5723449 - DNA, 12 bp, Homo sapiens
cttatttttcct

SEQ ID NO: 5723450 - DNA, 20 bp, Homo sapiens
cttatttttctagtcagtaa

SEQ ID NO: 5723451 - DNA, 23 bp, Homo sapiens
cttatttttctagtcagtaaaca

SEQ ID NO: 5723452 - DNA, 22 bp, Homo sapiens
cttatttttcttaccaattgtg

SEQ ID NO: 5723453 - DNA, 15 bp, Homo sapiens
cttatttttgaattc

SEQ ID NO: 5723454 - DNA, 17 bp, Homo sapiens
cttatttttgaattctt

SEQ ID NO: 5723455 - DNA, 17 bp, Homo sapiens
cttatttttgtaccata

SEQ ID NO: 5723456 - DNA, 22 bp, Homo sapiens
cttatttttgtaccatattgct

SEQ ID NO: 5723457 - DNA, 21 bp, Homo sapiens
cttatttttttaagaaaaaag

SEQ ID NO: 5723458 - DNA, 17 bp, Homo sapiens
cttatttttttcccaag

SEQ ID NO: 5723459 - DNA, 16 bp, Homo sapiens
cttatttttttctgat

SEQ ID NO: 5723460 - DNA, 17 bp, Homo sapiens
cttatttttttctgatt

SEQ ID NO: 5723461 - DNA, 20 bp, Homo sapiens
cttcaaaaactaaaatcatt

SEQ ID NO: 5723462 - DNA, 23 bp, Homo sapiens
cttcaaaaagcaatctggaagaa

SEQ ID NO: 5723463 - DNA, 18 bp, Homo sapiens
cttcaaaaagcattttaa

SEQ ID NO: 5723464 - DNA, 16 bp, Homo sapiens
cttcaaaaagccacag

SEQ ID NO: 5723465 - DNA, 18 bp, Homo sapiens
cttcaaaaagccacagca

SEQ ID NO: 5723466 - DNA, 15 bp, Homo sapiens
cttcaaaaataatgt

SEQ ID NO: 5723467 - DNA, 20 bp, Homo sapiens
cttcaaaacattctcctttg

SEQ ID NO: 5723468 - DNA, 20 bp, Homo sapiens
cttcaaaaggtgattaaata

SEQ ID NO: 5723469 - DNA, 15 bp, Homo sapiens
cttcaaaagtaatgc

SEQ ID NO: 5723470 - DNA, 19 bp, Homo sapiens
cttcaaaatatttgtcctt

SEQ ID NO: 5723471 - DNA, 19 bp, Homo sapiens
cttcaaaatcagtgatggg

SEQ ID NO: 5723472 - DNA, 23 bp, Homo sapiens
cttcaaaatgttatcttctcaag

SEQ ID NO: 5723473 - DNA, 17 bp, Homo sapiens
cttcaaaatgttctatt

SEQ ID NO: 5723474 - DNA, 14 bp, Homo sapiens
cttcaaacaaataa

SEQ ID NO: 5723475 - DNA, 22 bp, Homo sapiens
cttcaaacagaactgcagtcag

SEQ ID NO: 5723476 - DNA, 21 bp, Homo sapiens
cttcaaactaggggacaaagc

SEQ ID NO: 5723477 - DNA, 15 bp, Homo sapiens
cttcaaactgagaca

SEQ ID NO: 5723478 - DNA, 13 bp, Homo sapiens
cttcaaagaaact

SEQ ID NO: 5723479 - DNA, 12 bp, Homo sapiens
cttcaaagcaga

SEQ ID NO: 5723480 - DNA, 20 bp, Homo sapiens
cttcaaagcagagtgggact

SEQ ID NO: 5723481 - DNA, 20 bp, Homo sapiens
cttcaaaggattttggaaaa

SEQ ID NO: 5723482 - DNA, 20 bp, Homo sapiens
cttcaaaggccaagagaatt

SEQ ID NO: 5723483 - DNA, 20 bp, Homo sapiens
cttcaaagtctcaatgaaat

SEQ ID NO: 5723484 - DNA, 22 bp, Homo sapiens
cttcaaagtgcctgggctcagc

SEQ ID NO: 5723485 - DNA, 18 bp, Homo sapiens
cttcaaagtgtgtctggg

SEQ ID NO: 5723486 - DNA, 15 bp, Homo sapiens
cttcaaagtttatat

SEQ ID NO: 5723487 - DNA, 17 bp, Homo sapiens
cttcaaagtttatatgc

SEQ ID NO: 5723488 - DNA, 23 bp, Homo sapiens
cttcaaataattggctttgcaga

SEQ ID NO: 5723489 - DNA, 13 bp, Homo sapiens
cttcaaatacatt

SEQ ID NO: 5723490 - DNA, 19 bp, Homo sapiens
cttcaaatatagagatatt

SEQ ID NO: 5723491 - DNA, 19 bp, Homo sapiens
cttcaaatattatgcaggg

SEQ ID NO: 5723492 - DNA, 14 bp, Homo sapiens
cttcaaatcagagc

SEQ ID NO: 5723493 - DNA, 14 bp, Homo sapiens
cttcaaatgaaaat

SEQ ID NO: 5723494 - DNA, 13 bp, Homo sapiens
cttcaaatgcaaa

SEQ ID NO: 5723495 - DNA, 13 bp, Homo sapiens
cttcaaatgtgta

SEQ ID NO: 5723496 - DNA, 13 bp, Homo sapiens
cttcaaattaaag

SEQ ID NO: 5723497 - DNA, 20 bp, Homo sapiens
cttcaaattaaagtgctgtt

SEQ ID NO: 5723498 - DNA, 16 bp, Homo sapiens
cttcaaattatagaaa

SEQ ID NO: 5723499 - DNA, 16 bp, Homo sapiens
cttcaaattcaaggcc

SEQ ID NO: 5723500 - DNA, 21 bp, Homo sapiens
cttcaaattcaaggccttcca

SEQ ID NO: 5723501 - DNA, 22 bp, Homo sapiens
cttcaaattcttcacatgttta

SEQ ID NO: 5723502 - DNA, 19 bp, Homo sapiens
cttcaacaaggcttgctgc

SEQ ID NO: 5723503 - DNA, 20 bp, Homo sapiens
cttcaacaattctaaaatga

SEQ ID NO: 5723504 - DNA, 24 bp, Homo sapiens
cttcaacagaccccctctagaaat

SEQ ID NO: 5723505 - DNA, 19 bp, Homo sapiens
cttcaacagggaaaacagc

SEQ ID NO: 5723506 - DNA, 18 bp, Homo sapiens
cttcaacatcaatgttca

SEQ ID NO: 5723507 - DNA, 19 bp, Homo sapiens
cttcaacatcaatgttcat

SEQ ID NO: 5723508 - DNA, 12 bp, Homo sapiens
cttcaacatgac

SEQ ID NO: 5723509 - DNA, 22 bp, Homo sapiens
cttcaacattaaggcagtatga

SEQ ID NO: 5723510 - DNA, 14 bp, Homo sapiens
cttcaacccagtgg

SEQ ID NO: 5723511 - DNA, 15 bp, Homo sapiens
cttcaacccagtggg

SEQ ID NO: 5723512 - DNA, 14 bp, Homo sapiens
cttcaaccccactt

SEQ ID NO: 5723513 - DNA, 19 bp, Homo sapiens
cttcaaccctgccctgcac

SEQ ID NO: 5723514 - DNA, 22 bp, Homo sapiens
cttcaaccctgccctgcacctt

SEQ ID NO: 5723515 - DNA, 21 bp, Homo sapiens
cttcaacgtttcttcactttt

SEQ ID NO: 5723516 - DNA, 14 bp, Homo sapiens
cttcaactacttct

SEQ ID NO: 5723517 - DNA, 22 bp, Homo sapiens
cttcaactcctcgacatcactg

SEQ ID NO: 5723518 - DNA, 17 bp, Homo sapiens
cttcaactcctggctcc

SEQ ID NO: 5723519 - DNA, 14 bp, Homo sapiens
cttcaactcctggg

SEQ ID NO: 5723520 - DNA, 17 bp, Homo sapiens
cttcaactcctgggctc

SEQ ID NO: 5723521 - DNA, 14 bp, Homo sapiens
cttcaactgcccag

SEQ ID NO: 5723522 - DNA, 16 bp, Homo sapiens
cttcaactgcccagca

SEQ ID NO: 5723523 - DNA, 20 bp, Homo sapiens
cttcaactggttagtgtgaa

SEQ ID NO: 5723524 - DNA, 15 bp, Homo sapiens
cttcaacttggaaat

SEQ ID NO: 5723525 - DNA, 22 bp, Homo sapiens
cttcaagaaagaattcctgcag

SEQ ID NO: 5723526 - DNA, 18 bp, Homo sapiens
cttcaagatgagcctggg

SEQ ID NO: 5723527 - DNA, 20 bp, Homo sapiens
cttcaagatgcctcttctac

SEQ ID NO: 5723528 - DNA, 17 bp, Homo sapiens
cttcaagcaaagacagt

SEQ ID NO: 5723529 - DNA, 14 bp, Homo sapiens
cttcaagcatcctc

SEQ ID NO: 5723530 - DNA, 21 bp, Homo sapiens
cttcaagcatcctcagaagcc

SEQ ID NO: 5723531 - DNA, 13 bp, Homo sapiens
cttcaagcctggc

SEQ ID NO: 5723532 - DNA, 14 bp, Homo sapiens
cttcaagcctggcc

SEQ ID NO: 5723533 - DNA, 20 bp, Homo sapiens
cttcaagcgctccagggccg

SEQ ID NO: 5723534 - DNA, 14 bp, Homo sapiens
cttcaagctctgag

SEQ ID NO: 5723535 - DNA, 22 bp, Homo sapiens
cttcaagctgttatttcttccc

SEQ ID NO: 5723536 - DNA, 13 bp, Homo sapiens
cttcaaggaaaat

SEQ ID NO: 5723537 - DNA, 16 bp, Homo sapiens
cttcaaggaaaataag

SEQ ID NO: 5723538 - DNA, 20 bp, Homo sapiens
cttcaaggaaaataagtgaa

SEQ ID NO: 5723539 - DNA, 18 bp, Homo sapiens
cttcaaggacattggtga

SEQ ID NO: 5723540 - DNA, 13 bp, Homo sapiens
cttcaaggatcct

SEQ ID NO: 5723541 - DNA, 15 bp, Homo sapiens
cttcaaggatcctga

SEQ ID NO: 5723542 - DNA, 16 bp, Homo sapiens
cttcaaggatcctgag

SEQ ID NO: 5723543 - DNA, 23 bp, Homo sapiens
cttcaaggatcctgagccagatt

SEQ ID NO: 5723544 - DNA, 12 bp, Homo sapiens
cttcaaggccaa

SEQ ID NO: 5723545 - DNA, 13 bp, Homo sapiens
cttcaaggccaag

SEQ ID NO: 5723546 - DNA, 14 bp, Homo sapiens
cttcaaggcctccc

SEQ ID NO: 5723547 - DNA, 15 bp, Homo sapiens
cttcaaggcctcccc

SEQ ID NO: 5723548 - DNA, 19 bp, Homo sapiens
cttcaaggctcttcttcct

SEQ ID NO: 5723549 - DNA, 23 bp, Homo sapiens
cttcaaggctcttcttcctcacc

SEQ ID NO: 5723550 - DNA, 18 bp, Homo sapiens
cttcaagggtcagggtga

SEQ ID NO: 5723551 - DNA, 19 bp, Homo sapiens
cttcaagggtcagggtgag

SEQ ID NO: 5723552 - DNA, 17 bp, Homo sapiens
cttcaaggtggcagctg

SEQ ID NO: 5723553 - DNA, 17 bp, Homo sapiens
cttcaaggtgtaaaata

SEQ ID NO: 5723554 - DNA, 22 bp, Homo sapiens
cttcaagtagattggctgggca

SEQ ID NO: 5723555 - DNA, 15 bp, Homo sapiens
cttcaagtctgtgcc

SEQ ID NO: 5723556 - DNA, 16 bp, Homo sapiens
cttcaagtgatatatg

SEQ ID NO: 5723557 - DNA, 18 bp, Homo sapiens
cttcaagtgatatatgta

SEQ ID NO: 5723558 - DNA, 19 bp, Homo sapiens
cttcaagtgatatatgtat

SEQ ID NO: 5723559 - DNA, 22 bp, Homo sapiens
cttcaagtgatatatgtattta

SEQ ID NO: 5723560 - DNA, 20 bp, Homo sapiens
cttcaagtgccttttgctgc

SEQ ID NO: 5723561 - DNA, 22 bp, Homo sapiens
cttcaagtgccttttgctgcgc

SEQ ID NO: 5723562 - DNA, 18 bp, Homo sapiens
cttcaagttaaagtgaat

SEQ ID NO: 5723563 - DNA, 16 bp, Homo sapiens
cttcaagttagctcag

SEQ ID NO: 5723564 - DNA, 18 bp, Homo sapiens
cttcaagttagctcagga

SEQ ID NO: 5723565 - DNA, 13 bp, Homo sapiens
cttcaagttgtaa

SEQ ID NO: 5723566 - DNA, 11 bp, Homo sapiens
cttcaataaac

SEQ ID NO: 5723567 - DNA, 12 bp, Homo sapiens
cttcaataaacc

SEQ ID NO: 5723568 - DNA, 13 bp, Homo sapiens
cttcaataaacca

SEQ ID NO: 5723569 - DNA, 14 bp, Homo sapiens
cttcaataaaccac

SEQ ID NO: 5723570 - DNA, 22 bp, Homo sapiens
cttcaataaaccacaagcatct

SEQ ID NO: 5723571 - DNA, 21 bp, Homo sapiens
cttcaataaatggtatagcaa

SEQ ID NO: 5723572 - DNA, 16 bp, Homo sapiens
cttcaataaattaagt

SEQ ID NO: 5723573 - DNA, 22 bp, Homo sapiens
cttcaatacccaaatcctctcc

SEQ ID NO: 5723574 - DNA, 15 bp, Homo sapiens
cttcaatagaactgt

SEQ ID NO: 5723575 - DNA, 19 bp, Homo sapiens
cttcaatagttcaaggaac

SEQ ID NO: 5723576 - DNA, 23 bp, Homo sapiens
cttcaatcaataacagccgctcc

SEQ ID NO: 5723577 - DNA, 21 bp, Homo sapiens
cttcaatcactgtaacctgat

SEQ ID NO: 5723578 - DNA, 14 bp, Homo sapiens
cttcaatcccagcc

SEQ ID NO: 5723579 - DNA, 23 bp, Homo sapiens
cttcaatccccataatgcttctt

SEQ ID NO: 5723580 - DNA, 20 bp, Homo sapiens
cttcaatctacgatgttaaa

SEQ ID NO: 5723581 - DNA, 21 bp, Homo sapiens
cttcaatctcgtttagtgcca

SEQ ID NO: 5723582 - DNA, 12 bp, Homo sapiens
cttcaatctctg

SEQ ID NO: 5723583 - DNA, 21 bp, Homo sapiens
cttcaatctctggaaaaataa

SEQ ID NO: 5723584 - DNA, 16 bp, Homo sapiens
cttcaatgacttctaa

SEQ ID NO: 5723585 - DNA, 15 bp, Homo sapiens
cttcaatgatcaaat

SEQ ID NO: 5723586 - DNA, 20 bp, Homo sapiens
cttcaatgctagaaaatcga

SEQ ID NO: 5723587 - DNA, 13 bp, Homo sapiens
cttcaatgctgca

SEQ ID NO: 5723588 - DNA, 17 bp, Homo sapiens
cttcaatggaatacagt

SEQ ID NO: 5723589 - DNA, 18 bp, Homo sapiens
cttcaatggaatacagtc

SEQ ID NO: 5723590 - DNA, 23 bp, Homo sapiens
cttcaatggcaccttcattctcc

SEQ ID NO: 5723591 - DNA, 19 bp, Homo sapiens
cttcaatgggctcttccaa

SEQ ID NO: 5723592 - DNA, 13 bp, Homo sapiens
cttcaatgtgaaa

SEQ ID NO: 5723593 - DNA, 14 bp, Homo sapiens
cttcaatgtgaaac

SEQ ID NO: 5723594 - DNA, 15 bp, Homo sapiens
cttcaatgtgtcatt

SEQ ID NO: 5723595 - DNA, 19 bp, Homo sapiens
cttcaatgtgtcatttccg

SEQ ID NO: 5723596 - DNA, 13 bp, Homo sapiens
cttcaatgttaaa

SEQ ID NO: 5723597 - DNA, 14 bp, Homo sapiens
cttcaatgttaaat

SEQ ID NO: 5723598 - DNA, 14 bp, Homo sapiens
cttcaattaaaatt

SEQ ID NO: 5723599 - DNA, 18 bp, Homo sapiens
cttcaattagttccccta

SEQ ID NO: 5723600 - DNA, 16 bp, Homo sapiens
cttcaattcctgggcc

SEQ ID NO: 5723601 - DNA, 19 bp, Homo sapiens
cttcaatttattgcacaaa

SEQ ID NO: 5723602 - DNA, 15 bp, Homo sapiens
cttcaatttcccacc

SEQ ID NO: 5723603 - DNA, 17 bp, Homo sapiens
cttcaatttcccaccca

SEQ ID NO: 5723604 - DNA, 19 bp, Homo sapiens
cttcaatttcccacccatc

SEQ ID NO: 5723605 - DNA, 13 bp, Homo sapiens
cttcaatttgaaa

SEQ ID NO: 5723606 - DNA, 19 bp, Homo sapiens
cttcaatttgtataaaatg

SEQ ID NO: 5723607 - DNA, 21 bp, Homo sapiens
cttcaatttgttaacagagca

SEQ ID NO: 5723608 - DNA, 22 bp, Homo sapiens
cttcaatttgttaacagagcaa

SEQ ID NO: 5723609 - DNA, 13 bp, Homo sapiens
cttcacaaaatgc

SEQ ID NO: 5723610 - DNA, 16 bp, Homo sapiens
cttcacaaaatgcact

SEQ ID NO: 5723611 - DNA, 23 bp, Homo sapiens
cttcacaaagcccaagggatctg

SEQ ID NO: 5723612 - DNA, 16 bp, Homo sapiens
cttcacaaatgtcatt

SEQ ID NO: 5723613 - DNA, 12 bp, Homo sapiens
cttcacaacaga

SEQ ID NO: 5723614 - DNA, 16 bp, Homo sapiens
cttcacaaccagccac

SEQ ID NO: 5723615 - DNA, 18 bp, Homo sapiens
cttcacaaccagccacac

SEQ ID NO: 5723616 - DNA, 13 bp, Homo sapiens
cttcacaactttg

SEQ ID NO: 5723617 - DNA, 21 bp, Homo sapiens
cttcacaatggtgctcatttc

SEQ ID NO: 5723618 - DNA, 17 bp, Homo sapiens
cttcacacacaggcaac

SEQ ID NO: 5723619 - DNA, 16 bp, Homo sapiens
cttcacacatttataa

SEQ ID NO: 5723620 - DNA, 17 bp, Homo sapiens
cttcacaccccaggccc

SEQ ID NO: 5723621 - DNA, 19 bp, Homo sapiens
cttcacaccccaggccctt

SEQ ID NO: 5723622 - DNA, 15 bp, Homo sapiens
cttcacacccctcag

SEQ ID NO: 5723623 - DNA, 19 bp, Homo sapiens
cttcacacctaccctcctt

SEQ ID NO: 5723624 - DNA, 19 bp, Homo sapiens
cttcacactatcaacactg

SEQ ID NO: 5723625 - DNA, 19 bp, Homo sapiens
cttcacactgaactcagga

SEQ ID NO: 5723626 - DNA, 15 bp, Homo sapiens
cttcacactgcaaga

SEQ ID NO: 5723627 - DNA, 14 bp, Homo sapiens
cttcacactgcgca

SEQ ID NO: 5723628 - DNA, 19 bp, Homo sapiens
cttcacactgcgcaggtct

SEQ ID NO: 5723629 - DNA, 20 bp, Homo sapiens
cttcacactgcgcaggtctc

SEQ ID NO: 5723630 - DNA, 20 bp, Homo sapiens
cttcacagaggaagaaacct

SEQ ID NO: 5723631 - DNA, 22 bp, Homo sapiens
cttcacagagtgtgctggagga

SEQ ID NO: 5723632 - DNA, 17 bp, Homo sapiens
cttcacagatgcctact

SEQ ID NO: 5723633 - DNA, 16 bp, Homo sapiens
cttcacagcgtctgct

SEQ ID NO: 5723634 - DNA, 17 bp, Homo sapiens
cttcacagcgtctgctc

SEQ ID NO: 5723635 - DNA, 19 bp, Homo sapiens
cttcacagcgtctgctcat

SEQ ID NO: 5723636 - DNA, 14 bp, Homo sapiens
cttcacagctggag

SEQ ID NO: 5723637 - DNA, 14 bp, Homo sapiens
cttcacagggacag

SEQ ID NO: 5723638 - DNA, 19 bp, Homo sapiens
cttcacagtagagccagct

SEQ ID NO: 5723639 - DNA, 21 bp, Homo sapiens
cttcacagtagagccagcttg

SEQ ID NO: 5723640 - DNA, 13 bp, Homo sapiens
cttcacagtctgg

SEQ ID NO: 5723641 - DNA, 21 bp, Homo sapiens
cttcacagtgacactggacca

SEQ ID NO: 5723642 - DNA, 23 bp, Homo sapiens
cttcacagtgacactggaccagg

SEQ ID NO: 5723643 - DNA, 13 bp, Homo sapiens
cttcacagtgcag

SEQ ID NO: 5723644 - DNA, 17 bp, Homo sapiens
cttcacagtgcagcttg

SEQ ID NO: 5723645 - DNA, 23 bp, Homo sapiens
cttcacatattgatttccgttaa

SEQ ID NO: 5723646 - DNA, 13 bp, Homo sapiens
cttcacatccacc

SEQ ID NO: 5723647 - DNA, 20 bp, Homo sapiens
cttcacatcctgtgtttcta

SEQ ID NO: 5723648 - DNA, 21 bp, Homo sapiens
cttcacatcctgtgtttctag

SEQ ID NO: 5723649 - DNA, 12 bp, Homo sapiens
cttcacatctcc

SEQ ID NO: 5723650 - DNA, 12 bp, Homo sapiens
cttcacatgaaa

SEQ ID NO: 5723651 - DNA, 16 bp, Homo sapiens
cttcacatgtttaact

SEQ ID NO: 5723652 - DNA, 15 bp, Homo sapiens
cttcacattaaaaaa

SEQ ID NO: 5723653 - DNA, 15 bp, Homo sapiens
cttcacatttagaat

SEQ ID NO: 5723654 - DNA, 21 bp, Homo sapiens
cttcaccaagcttagaagcca

SEQ ID NO: 5723655 - DNA, 19 bp, Homo sapiens
cttcaccaagtgcaataga

SEQ ID NO: 5723656 - DNA, 23 bp, Homo sapiens
cttcaccaatagtctctctgcaa

SEQ ID NO: 5723657 - DNA, 19 bp, Homo sapiens
cttcaccaccccctgtccc

SEQ ID NO: 5723658 - DNA, 23 bp, Homo sapiens
cttcaccacctcatgtcatttct

SEQ ID NO: 5723659 - DNA, 16 bp, Homo sapiens
cttcaccagagcccat

SEQ ID NO: 5723660 - DNA, 12 bp, Homo sapiens
cttcaccaggaa

SEQ ID NO: 5723661 - DNA, 20 bp, Homo sapiens
cttcaccaggtgcatgcatg

SEQ ID NO: 5723662 - DNA, 20 bp, Homo sapiens
cttcaccagtctgtctactg

SEQ ID NO: 5723663 - DNA, 23 bp, Homo sapiens
cttcacccaccacccccatcatc

SEQ ID NO: 5723664 - DNA, 22 bp, Homo sapiens
cttcacccaccaggccagctca

SEQ ID NO: 5723665 - DNA, 17 bp, Homo sapiens
cttcacccaccccatgg

SEQ ID NO: 5723666 - DNA, 13 bp, Homo sapiens
cttcacccagcac

SEQ ID NO: 5723667 - DNA, 21 bp, Homo sapiens
cttcacccagcacccatgccc

SEQ ID NO: 5723668 - DNA, 24 bp, Homo sapiens
cttcacccagctaatctgtagggc

SEQ ID NO: 5723669 - DNA, 14 bp, Homo sapiens
cttcacccaggcct

SEQ ID NO: 5723670 - DNA, 15 bp, Homo sapiens
cttcaccccggcagg

SEQ ID NO: 5723671 - DNA, 22 bp, Homo sapiens
cttcaccccggcaggccctgca

SEQ ID NO: 5723672 - DNA, 23 bp, Homo sapiens
cttcaccccggcaggccctgcag

SEQ ID NO: 5723673 - DNA, 22 bp, Homo sapiens
cttcacccctacactgtgaagg

SEQ ID NO: 5723674 - DNA, 13 bp, Homo sapiens
cttcacccctgca

SEQ ID NO: 5723675 - DNA, 14 bp, Homo sapiens
cttcacccctgcac

SEQ ID NO: 5723676 - DNA, 22 bp, Homo sapiens
cttcacccgagttcctctgggt

SEQ ID NO: 5723677 - DNA, 16 bp, Homo sapiens
cttcacccgctgcagc

SEQ ID NO: 5723678 - DNA, 16 bp, Homo sapiens
cttcaccctcatcctt

SEQ ID NO: 5723679 - DNA, 15 bp, Homo sapiens
cttcaccctgagttt

SEQ ID NO: 5723680 - DNA, 15 bp, Homo sapiens
cttcaccctggagcc

SEQ ID NO: 5723681 - DNA, 16 bp, Homo sapiens
cttcaccgcattccag

SEQ ID NO: 5723682 - DNA, 20 bp, Homo sapiens
cttcaccgtgacattccagc

SEQ ID NO: 5723683 - DNA, 18 bp, Homo sapiens
cttcacctaagtctctgt

SEQ ID NO: 5723684 - DNA, 19 bp, Homo sapiens
cttcacctaagtctctgtg

SEQ ID NO: 5723685 - DNA, 12 bp, Homo sapiens
cttcacctcaga

SEQ ID NO: 5723686 - DNA, 20 bp, Homo sapiens
cttcacctccaggttcaagt

SEQ ID NO: 5723687 - DNA, 14 bp, Homo sapiens
cttcacctccttct

SEQ ID NO: 5723688 - DNA, 16 bp, Homo sapiens
cttcacctccttctgc

SEQ ID NO: 5723689 - DNA, 17 bp, Homo sapiens
cttcacctccttctgca

SEQ ID NO: 5723690 - DNA, 19 bp, Homo sapiens
cttcacctccttctgcagt

SEQ ID NO: 5723691 - DNA, 16 bp, Homo sapiens
cttcacctcctttcaa

SEQ ID NO: 5723692 - DNA, 15 bp, Homo sapiens
cttcacctctatcca

SEQ ID NO: 5723693 - DNA, 14 bp, Homo sapiens
cttcacctctgcta

SEQ ID NO: 5723694 - DNA, 14 bp, Homo sapiens
cttcacctcttcca

SEQ ID NO: 5723695 - DNA, 18 bp, Homo sapiens
cttcacctgattcaacta

SEQ ID NO: 5723696 - DNA, 20 bp, Homo sapiens
cttcacctgattcaactaaa

SEQ ID NO: 5723697 - DNA, 21 bp, Homo sapiens
cttcacctgattcaactaaaa

SEQ ID NO: 5723698 - DNA, 22 bp, Homo sapiens
cttcacctgggcgccaactgct

SEQ ID NO: 5723699 - DNA, 13 bp, Homo sapiens
cttcaccttctgt

SEQ ID NO: 5723700 - DNA, 23 bp, Homo sapiens
cttcaccttggagcctgaacatg

SEQ ID NO: 5723701 - DNA, 20 bp, Homo sapiens
cttcacctttcccactttct

SEQ ID NO: 5723702 - DNA, 18 bp, Homo sapiens
cttcacctttggtgcaga

SEQ ID NO: 5723703 - DNA, 14 bp, Homo sapiens
cttcacctttgtcc

SEQ ID NO: 5723704 - DNA, 23 bp, Homo sapiens
cttcacgattcttaccctttctt

SEQ ID NO: 5723705 - DNA, 15 bp, Homo sapiens
cttcacgctggcttc

SEQ ID NO: 5723706 - DNA, 19 bp, Homo sapiens
cttcacggaagagccttgc

SEQ ID NO: 5723707 - DNA, 13 bp, Homo sapiens
cttcacggcagga

SEQ ID NO: 5723708 - DNA, 21 bp, Homo sapiens
cttcacgtagaacattggtat

SEQ ID NO: 5723709 - DNA, 14 bp, Homo sapiens
cttcactacaacat

SEQ ID NO: 5723710 - DNA, 15 bp, Homo sapiens
cttcactaccctgat

SEQ ID NO: 5723711 - DNA, 23 bp, Homo sapiens
cttcactaccctgattcttgatt

SEQ ID NO: 5723712 - DNA, 18 bp, Homo sapiens
cttcactacgtgttcaca

SEQ ID NO: 5723713 - DNA, 18 bp, Homo sapiens
cttcactactttaataaa

SEQ ID NO: 5723714 - DNA, 20 bp, Homo sapiens
cttcactagggaatcctgcg

SEQ ID NO: 5723715 - DNA, 23 bp, Homo sapiens
cttcactagggaatcctgcggca

SEQ ID NO: 5723716 - DNA, 15 bp, Homo sapiens
cttcactatgactac

SEQ ID NO: 5723717 - DNA, 16 bp, Homo sapiens
cttcactattcctagg

SEQ ID NO: 5723718 - DNA, 15 bp, Homo sapiens
cttcactcactgtca

SEQ ID NO: 5723719 - DNA, 16 bp, Homo sapiens
cttcactcagccacac

SEQ ID NO: 5723720 - DNA, 21 bp, Homo sapiens
cttcactcatgcaaactgctt

SEQ ID NO: 5723721 - DNA, 23 bp, Homo sapiens
cttcactcatgcaaactgcttta

SEQ ID NO: 5723722 - DNA, 13 bp, Homo sapiens
cttcactccaaag

SEQ ID NO: 5723723 - DNA, 20 bp, Homo sapiens
cttcactccagcctgggtga

SEQ ID NO: 5723724 - DNA, 13 bp, Homo sapiens
cttcactcctgct

SEQ ID NO: 5723725 - DNA, 17 bp, Homo sapiens
cttcactctaagatgtt

SEQ ID NO: 5723726 - DNA, 16 bp, Homo sapiens
cttcactctggcttca

SEQ ID NO: 5723727 - DNA, 14 bp, Homo sapiens
cttcactcttcact

SEQ ID NO: 5723728 - DNA, 16 bp, Homo sapiens
cttcactgaatatcat

SEQ ID NO: 5723729 - DNA, 17 bp, Homo sapiens
cttcactgaatatcata

SEQ ID NO: 5723730 - DNA, 14 bp, Homo sapiens
cttcactgaccagc

SEQ ID NO: 5723731 - DNA, 14 bp, Homo sapiens
cttcactgcagcct

SEQ ID NO: 5723732 - DNA, 13 bp, Homo sapiens
cttcactgccatg

SEQ ID NO: 5723733 - DNA, 15 bp, Homo sapiens
cttcactgcccaggg

SEQ ID NO: 5723734 - DNA, 15 bp, Homo sapiens
cttcactgccccctc

SEQ ID NO: 5723735 - DNA, 13 bp, Homo sapiens
cttcactgccttt

SEQ ID NO: 5723736 - DNA, 17 bp, Homo sapiens
cttcactggagaccgga

SEQ ID NO: 5723737 - DNA, 18 bp, Homo sapiens
cttcactggcgccttctc

SEQ ID NO: 5723738 - DNA, 19 bp, Homo sapiens
cttcactggcgccttctcg

SEQ ID NO: 5723739 - DNA, 22 bp, Homo sapiens
cttcactggcgccttctcggag

SEQ ID NO: 5723740 - DNA, 17 bp, Homo sapiens
cttcactgggccagtca

SEQ ID NO: 5723741 - DNA, 16 bp, Homo sapiens
cttcactgtataaata

SEQ ID NO: 5723742 - DNA, 12 bp, Homo sapiens
cttcactgtcac

SEQ ID NO: 5723743 - DNA, 19 bp, Homo sapiens
cttcactgtgaggggaagg

SEQ ID NO: 5723744 - DNA, 22 bp, Homo sapiens
cttcactgtgaggggaaggcct

SEQ ID NO: 5723745 - DNA, 23 bp, Homo sapiens
cttcactgtgaggggaaggcctt

SEQ ID NO: 5723746 - DNA, 13 bp, Homo sapiens
cttcactgtgctg

SEQ ID NO: 5723747 - DNA, 16 bp, Homo sapiens
cttcactgtggccaca

SEQ ID NO: 5723748 - DNA, 14 bp, Homo sapiens
cttcactgttccct

SEQ ID NO: 5723749 - DNA, 19 bp, Homo sapiens
cttcactgttccctctggc

SEQ ID NO: 5723750 - DNA, 16 bp, Homo sapiens
cttcactgttgaaaat

SEQ ID NO: 5723751 - DNA, 18 bp, Homo sapiens
cttcactgttgaaaatta

SEQ ID NO: 5723752 - DNA, 19 bp, Homo sapiens
cttcactgttgaaaattat

SEQ ID NO: 5723753 - DNA, 21 bp, Homo sapiens
cttcacttacaagaaaggcct

SEQ ID NO: 5723754 - DNA, 14 bp, Homo sapiens
cttcacttcaagct

SEQ ID NO: 5723755 - DNA, 21 bp, Homo sapiens
cttcacttcctccagaagcct

SEQ ID NO: 5723756 - DNA, 13 bp, Homo sapiens
cttcacttctccc

SEQ ID NO: 5723757 - DNA, 21 bp, Homo sapiens
cttcacttctgaccacacttc

SEQ ID NO: 5723758 - DNA, 14 bp, Homo sapiens
cttcacttctgact

SEQ ID NO: 5723759 - DNA, 22 bp, Homo sapiens
cttcacttgagttggctgtgtt

SEQ ID NO: 5723760 - DNA, 16 bp, Homo sapiens
cttcactttaattctc

SEQ ID NO: 5723761 - DNA, 21 bp, Homo sapiens
cttcactttaattctcatgtg

SEQ ID NO: 5723762 - DNA, 21 bp, Homo sapiens
cttcactttcatctgagcttt

SEQ ID NO: 5723763 - DNA, 15 bp, Homo sapiens
cttcactttcctcag

SEQ ID NO: 5723764 - DNA, 17 bp, Homo sapiens
cttcactttcctcagtt

SEQ ID NO: 5723765 - DNA, 18 bp, Homo sapiens
cttcactttcttaagcaa

SEQ ID NO: 5723766 - DNA, 14 bp, Homo sapiens
cttcacttttgcaa

SEQ ID NO: 5723767 - DNA, 22 bp, Homo sapiens
cttcagaaacccggcttcctgt

SEQ ID NO: 5723768 - DNA, 16 bp, Homo sapiens
cttcagaaagagctca

SEQ ID NO: 5723769 - DNA, 16 bp, Homo sapiens
cttcagaacacacaga

SEQ ID NO: 5723770 - DNA, 20 bp, Homo sapiens
cttcagaacacacagacttt

SEQ ID NO: 5723771 - DNA, 15 bp, Homo sapiens
cttcagaacatgctg

SEQ ID NO: 5723772 - DNA, 19 bp, Homo sapiens
cttcagaacatgctggata

SEQ ID NO: 5723773 - DNA, 16 bp, Homo sapiens
cttcagaactgccctt

SEQ ID NO: 5723774 - DNA, 18 bp, Homo sapiens
cttcagaactgcccttgc

SEQ ID NO: 5723775 - DNA, 19 bp, Homo sapiens
cttcagaactgcccttgct

SEQ ID NO: 5723776 - DNA, 23 bp, Homo sapiens
cttcagaactgcccttgctgccc

SEQ ID NO: 5723777 - DNA, 17 bp, Homo sapiens
cttcagaagctattttt

SEQ ID NO: 5723778 - DNA, 17 bp, Homo sapiens
cttcagaagtttgcttc

SEQ ID NO: 5723779 - DNA, 16 bp, Homo sapiens
cttcagaatgtgattt

SEQ ID NO: 5723780 - DNA, 20 bp, Homo sapiens
cttcagaattatccattacg

SEQ ID NO: 5723781 - DNA, 20 bp, Homo sapiens
cttcagaattccatatcttg

SEQ ID NO: 5723782 - DNA, 23 bp, Homo sapiens
cttcagaattgtttttagaaatt

SEQ ID NO: 5723783 - DNA, 22 bp, Homo sapiens
cttcagacacaggaaaaataaa

SEQ ID NO: 5723784 - DNA, 18 bp, Homo sapiens
cttcagacacatgctatg

SEQ ID NO: 5723785 - DNA, 22 bp, Homo sapiens
cttcagacacgcacttctgggg

SEQ ID NO: 5723786 - DNA, 23 bp, Homo sapiens
cttcagacacgcacttctggggc

SEQ ID NO: 5723787 - DNA, 19 bp, Homo sapiens
cttcagacagagaggactg

SEQ ID NO: 5723788 - DNA, 14 bp, Homo sapiens
cttcagactcaagt

SEQ ID NO: 5723789 - DNA, 12 bp, Homo sapiens
cttcagactctc

SEQ ID NO: 5723790 - DNA, 15 bp, Homo sapiens
cttcagactggccct

SEQ ID NO: 5723791 - DNA, 14 bp, Homo sapiens
cttcagactttgct

SEQ ID NO: 5723792 - DNA, 15 bp, Homo sapiens
cttcagactttgctt

SEQ ID NO: 5723793 - DNA, 13 bp, Homo sapiens
cttcagagaagtc

SEQ ID NO: 5723794 - DNA, 14 bp, Homo sapiens
cttcagagaagtca

SEQ ID NO: 5723795 - DNA, 16 bp, Homo sapiens
cttcagagactcctgc

SEQ ID NO: 5723796 - DNA, 22 bp, Homo sapiens
cttcagagactcctgcaggcag

SEQ ID NO: 5723797 - DNA, 24 bp, Homo sapiens
cttcagagactcctgcaggcagcc

SEQ ID NO: 5723798 - DNA, 14 bp, Homo sapiens
cttcagagagcagt

SEQ ID NO: 5723799 - DNA, 22 bp, Homo sapiens
cttcagagagcagtgcttttgg

SEQ ID NO: 5723800 - DNA, 14 bp, Homo sapiens
cttcagagagctgg

SEQ ID NO: 5723801 - DNA, 22 bp, Homo sapiens
cttcagagagctggtagttagt

SEQ ID NO: 5723802 - DNA, 15 bp, Homo sapiens
cttcagagcctagcc

SEQ ID NO: 5723803 - DNA, 17 bp, Homo sapiens
cttcagagcctagccac

SEQ ID NO: 5723804 - DNA, 19 bp, Homo sapiens
cttcagagcctagccacct

SEQ ID NO: 5723805 - DNA, 22 bp, Homo sapiens
cttcagagcctagccacctccc

SEQ ID NO: 5723806 - DNA, 23 bp, Homo sapiens
cttcagagcctagccacctccca

SEQ ID NO: 5723807 - DNA, 13 bp, Homo sapiens
cttcagagctctt

SEQ ID NO: 5723808 - DNA, 20 bp, Homo sapiens
cttcagagctgacacaggat

SEQ ID NO: 5723809 - DNA, 17 bp, Homo sapiens
cttcagaggctcatcta

SEQ ID NO: 5723810 - DNA, 13 bp, Homo sapiens
cttcagaggctga

SEQ ID NO: 5723811 - DNA, 12 bp, Homo sapiens
cttcagagggaa

SEQ ID NO: 5723812 - DNA, 21 bp, Homo sapiens
cttcagagtacgtcctgcctg

SEQ ID NO: 5723813 - DNA, 19 bp, Homo sapiens
cttcagagtagagggcttg

SEQ ID NO: 5723814 - DNA, 14 bp, Homo sapiens
cttcagagtgaaga

SEQ ID NO: 5723815 - DNA, 15 bp, Homo sapiens
cttcagagtttgtgt

SEQ ID NO: 5723816 - DNA, 18 bp, Homo sapiens
cttcagagtttgtgtgta

SEQ ID NO: 5723817 - DNA, 19 bp, Homo sapiens
cttcagatacttgtgaaca

SEQ ID NO: 5723818 - DNA, 22 bp, Homo sapiens
cttcagatacttgtgaacatgc

SEQ ID NO: 5723819 - DNA, 18 bp, Homo sapiens
cttcagatattattgctt

SEQ ID NO: 5723820 - DNA, 14 bp, Homo sapiens
cttcagatattttg

SEQ ID NO: 5723821 - DNA, 17 bp, Homo sapiens
cttcagatcagtgcttg

SEQ ID NO: 5723822 - DNA, 14 bp, Homo sapiens
cttcagatcctacc

SEQ ID NO: 5723823 - DNA, 22 bp, Homo sapiens
cttcagatccttttattctcca

SEQ ID NO: 5723824 - DNA, 15 bp, Homo sapiens
cttcagatctgaggt

SEQ ID NO: 5723825 - DNA, 14 bp, Homo sapiens
cttcagatgtttcc

SEQ ID NO: 5723826 - DNA, 17 bp, Homo sapiens
cttcagattatttccag

SEQ ID NO: 5723827 - DNA, 23 bp, Homo sapiens
cttcagattccccactcagcctt

SEQ ID NO: 5723828 - DNA, 21 bp, Homo sapiens
cttcagcaaccctacagtata

SEQ ID NO: 5723829 - DNA, 15 bp, Homo sapiens
cttcagcaagagaga

SEQ ID NO: 5723830 - DNA, 21 bp, Homo sapiens
cttcagcacaggaattctcaa

SEQ ID NO: 5723831 - DNA, 10 bp, Homo sapiens
cttcagcacc

SEQ ID NO: 5723832 - DNA, 14 bp, Homo sapiens
cttcagcacggcgt

SEQ ID NO: 5723833 - DNA, 15 bp, Homo sapiens
cttcagcagcagctc

SEQ ID NO: 5723834 - DNA, 16 bp, Homo sapiens
cttcagcagcagctca

SEQ ID NO: 5723835 - DNA, 18 bp, Homo sapiens
cttcagcaggaagggtgg

SEQ ID NO: 5723836 - DNA, 11 bp, Homo sapiens
cttcagcaggg

SEQ ID NO: 5723837 - DNA, 18 bp, Homo sapiens
cttcagcatatttatagc

SEQ ID NO: 5723838 - DNA, 17 bp, Homo sapiens
cttcagcattccctccc

SEQ ID NO: 5723839 - DNA, 16 bp, Homo sapiens
cttcagcattgtaatt

SEQ ID NO: 5723840 - DNA, 23 bp, Homo sapiens
cttcagcattgtaattatgtaaa

SEQ ID NO: 5723841 - DNA, 18 bp, Homo sapiens
cttcagcatttacttgaa

SEQ ID NO: 5723842 - DNA, 21 bp, Homo sapiens
cttcagccaccctttctggca

SEQ ID NO: 5723843 - DNA, 11 bp, Homo sapiens
cttcagccagg

SEQ ID NO: 5723844 - DNA, 11 bp, Homo sapiens
cttcagccagt

SEQ ID NO: 5723845 - DNA, 12 bp, Homo sapiens
cttcagcccagg

SEQ ID NO: 5723846 - DNA, 14 bp, Homo sapiens
cttcagcccccacc

SEQ ID NO: 5723847 - DNA, 14 bp, Homo sapiens
cttcagcccccagc

SEQ ID NO: 5723848 - DNA, 13 bp, Homo sapiens
cttcagcccctgg

SEQ ID NO: 5723849 - DNA, 22 bp, Homo sapiens
cttcagccccttctcccctccc

SEQ ID NO: 5723850 - DNA, 22 bp, Homo sapiens
cttcagccctaacatagtgtct

SEQ ID NO: 5723851 - DNA, 15 bp, Homo sapiens
cttcagccctggcca

SEQ ID NO: 5723852 - DNA, 19 bp, Homo sapiens
cttcagccctggccaagct

SEQ ID NO: 5723853 - DNA, 20 bp, Homo sapiens
cttcagccctttggcttcaa

SEQ ID NO: 5723854 - DNA, 17 bp, Homo sapiens
cttcagccgagcccaga

SEQ ID NO: 5723855 - DNA, 13 bp, Homo sapiens
cttcagcctccca

SEQ ID NO: 5723856 - DNA, 17 bp, Homo sapiens
cttcagcctcccacagt

SEQ ID NO: 5723857 - DNA, 20 bp, Homo sapiens
cttcagcctcccgagtagct

SEQ ID NO: 5723858 - DNA, 17 bp, Homo sapiens
cttcagcctccctcagc

SEQ ID NO: 5723859 - DNA, 20 bp, Homo sapiens
cttcagcctctttctgtccc

SEQ ID NO: 5723860 - DNA, 14 bp, Homo sapiens
cttcagcctgaggc

SEQ ID NO: 5723861 - DNA, 14 bp, Homo sapiens
cttcagcctgtgca

SEQ ID NO: 5723862 - DNA, 13 bp, Homo sapiens
cttcagccttaat

SEQ ID NO: 5723863 - DNA, 15 bp, Homo sapiens
cttcagcgagaccct

SEQ ID NO: 5723864 - DNA, 16 bp, Homo sapiens
cttcagcggtttatat

SEQ ID NO: 5723865 - DNA, 20 bp, Homo sapiens
cttcagctaaagtaacagag

SEQ ID NO: 5723866 - DNA, 20 bp, Homo sapiens
cttcagctagcttttaggaa

SEQ ID NO: 5723867 - DNA, 20 bp, Homo sapiens
cttcagctcacgcttcacag

SEQ ID NO: 5723868 - DNA, 11 bp, Homo sapiens
cttcagctcca

SEQ ID NO: 5723869 - DNA, 21 bp, Homo sapiens
cttcagctcccatagcgctgg

SEQ ID NO: 5723870 - DNA, 14 bp, Homo sapiens
cttcagctctgaaa

SEQ ID NO: 5723871 - DNA, 14 bp, Homo sapiens
cttcagctgatcct

SEQ ID NO: 5723872 - DNA, 18 bp, Homo sapiens
cttcagctgcctgaaaca

SEQ ID NO: 5723873 - DNA, 16 bp, Homo sapiens
cttcagctgctgacaa

SEQ ID NO: 5723874 - DNA, 14 bp, Homo sapiens
cttcagctggtgga

SEQ ID NO: 5723875 - DNA, 18 bp, Homo sapiens
cttcagcttcttcatctt

SEQ ID NO: 5723876 - DNA, 14 bp, Homo sapiens
cttcagcttgcttc

SEQ ID NO: 5723877 - DNA, 20 bp, Homo sapiens
cttcaggaagcaggtgtcct

SEQ ID NO: 5723878 - DNA, 18 bp, Homo sapiens
cttcaggacccttctact

SEQ ID NO: 5723879 - DNA, 14 bp, Homo sapiens
cttcaggactctgc

SEQ ID NO: 5723880 - DNA, 18 bp, Homo sapiens
cttcaggagatgatgtga

SEQ ID NO: 5723881 - DNA, 12 bp, Homo sapiens
cttcaggagcct

SEQ ID NO: 5723882 - DNA, 21 bp, Homo sapiens
cttcaggagcctggccaggca

SEQ ID NO: 5723883 - DNA, 22 bp, Homo sapiens
cttcaggaggccctggtgtcag

SEQ ID NO: 5723884 - DNA, 22 bp, Homo sapiens
cttcaggagtttcatgttggat

SEQ ID NO: 5723885 - DNA, 20 bp, Homo sapiens
cttcaggatattggttcttc

SEQ ID NO: 5723886 - DNA, 15 bp, Homo sapiens
cttcaggcaccagca

SEQ ID NO: 5723887 - DNA, 16 bp, Homo sapiens
cttcaggcactaagag

SEQ ID NO: 5723888 - DNA, 14 bp, Homo sapiens
cttcaggccccagg

SEQ ID NO: 5723889 - DNA, 21 bp, Homo sapiens
cttcaggcccccgccttggcc

SEQ ID NO: 5723890 - DNA, 18 bp, Homo sapiens
cttcaggctctgcccagg

SEQ ID NO: 5723891 - DNA, 14 bp, Homo sapiens
cttcaggctcttct

SEQ ID NO: 5723892 - DNA, 19 bp, Homo sapiens
cttcaggctcttctccttt

SEQ ID NO: 5723893 - DNA, 22 bp, Homo sapiens
cttcaggctcttctcctttcac

SEQ ID NO: 5723894 - DNA, 21 bp, Homo sapiens
cttcaggcttcctgcaatttt

SEQ ID NO: 5723895 - DNA, 16 bp, Homo sapiens
cttcagggagagctgg

SEQ ID NO: 5723896 - DNA, 17 bp, Homo sapiens
cttcagggagagctggg

SEQ ID NO: 5723897 - DNA, 20 bp, Homo sapiens
cttcagggagtcagctgttt

SEQ ID NO: 5723898 - DNA, 15 bp, Homo sapiens
cttcagggagtgagg

SEQ ID NO: 5723899 - DNA, 19 bp, Homo sapiens
cttcagggattccctgtcc

SEQ ID NO: 5723900 - DNA, 19 bp, Homo sapiens
cttcagggcactgctgctg

SEQ ID NO: 5723901 - DNA, 15 bp, Homo sapiens
cttcagggcagattt

SEQ ID NO: 5723902 - DNA, 16 bp, Homo sapiens
cttcagggcagatttt

SEQ ID NO: 5723903 - DNA, 17 bp, Homo sapiens
cttcagggcagggctct

SEQ ID NO: 5723904 - DNA, 15 bp, Homo sapiens
cttcagggcaggtgg

SEQ ID NO: 5723905 - DNA, 11 bp, Homo sapiens
cttcagggctg

SEQ ID NO: 5723906 - DNA, 23 bp, Homo sapiens
cttcagggctgagttctgggttt

SEQ ID NO: 5723907 - DNA, 21 bp, Homo sapiens
cttcagggctgggcaggtcct

SEQ ID NO: 5723908 - DNA, 22 bp, Homo sapiens
cttcaggggactgttctcacct

SEQ ID NO: 5723909 - DNA, 23 bp, Homo sapiens
cttcaggggactgttctcacctt

SEQ ID NO: 5723910 - DNA, 15 bp, Homo sapiens
cttcaggggaggcca

SEQ ID NO: 5723911 - DNA, 22 bp, Homo sapiens
cttcaggggagtcccgtcagga

SEQ ID NO: 5723912 - DNA, 15 bp, Homo sapiens
cttcaggggatgggt

SEQ ID NO: 5723913 - DNA, 17 bp, Homo sapiens
cttcaggggatgggtgt

SEQ ID NO: 5723914 - DNA, 22 bp, Homo sapiens
cttcaggggatgggtgtggatg

SEQ ID NO: 5723915 - DNA, 20 bp, Homo sapiens
cttcaggggctgcccgctcc

SEQ ID NO: 5723916 - DNA, 14 bp, Homo sapiens
cttcagggggccag

SEQ ID NO: 5723917 - DNA, 16 bp, Homo sapiens
cttcaggggtcacctc

SEQ ID NO: 5723918 - DNA, 18 bp, Homo sapiens
cttcaggggtcacctcct

SEQ ID NO: 5723919 - DNA, 19 bp, Homo sapiens
cttcagggtgagtgaatgg

SEQ ID NO: 5723920 - DNA, 20 bp, Homo sapiens
cttcagggttctaacctttc

SEQ ID NO: 5723921 - DNA, 20 bp, Homo sapiens
cttcagggttctcctctccc

SEQ ID NO: 5723922 - DNA, 23 bp, Homo sapiens
cttcagggttctcctctcccctc

SEQ ID NO: 5723923 - DNA, 22 bp, Homo sapiens
cttcaggtaaagggcaaataat

SEQ ID NO: 5723924 - DNA, 17 bp, Homo sapiens
cttcaggtccaggctgt

SEQ ID NO: 5723925 - DNA, 14 bp, Homo sapiens
cttcaggtccgtgg

SEQ ID NO: 5723926 - DNA, 21 bp, Homo sapiens
cttcaggtgcttttgatgtga

SEQ ID NO: 5723927 - DNA, 16 bp, Homo sapiens
cttcaggtggaaaaac

SEQ ID NO: 5723928 - DNA, 18 bp, Homo sapiens
cttcaggtggagagcact

SEQ ID NO: 5723929 - DNA, 14 bp, Homo sapiens
cttcaggtgtgact

SEQ ID NO: 5723930 - DNA, 22 bp, Homo sapiens
cttcaggttatcgaaataacaa

SEQ ID NO: 5723931 - DNA, 15 bp, Homo sapiens
cttcaggttcctcct

SEQ ID NO: 5723932 - DNA, 16 bp, Homo sapiens
cttcaggttcctccta

SEQ ID NO: 5723933 - DNA, 15 bp, Homo sapiens
cttcaggttcttagt

SEQ ID NO: 5723934 - DNA, 15 bp, Homo sapiens
cttcaggttgcattg

SEQ ID NO: 5723935 - DNA, 18 bp, Homo sapiens
cttcaggttggtttaatc

SEQ ID NO: 5723936 - DNA, 16 bp, Homo sapiens
cttcaggttgttctgt

SEQ ID NO: 5723937 - DNA, 15 bp, Homo sapiens
cttcagtaaaaggac

SEQ ID NO: 5723938 - DNA, 20 bp, Homo sapiens
cttcagtaacccccactgga

SEQ ID NO: 5723939 - DNA, 22 bp, Homo sapiens
cttcagtaacccccactggact

SEQ ID NO: 5723940 - DNA, 20 bp, Homo sapiens
cttcagtatcaaggctgcct

SEQ ID NO: 5723941 - DNA, 21 bp, Homo sapiens
cttcagtatcaaggctgcctg

SEQ ID NO: 5723942 - DNA, 23 bp, Homo sapiens
cttcagtatcaaggctgcctgga

SEQ ID NO: 5723943 - DNA, 21 bp, Homo sapiens
cttcagtatgtgtcaactgag

SEQ ID NO: 5723944 - DNA, 23 bp, Homo sapiens
cttcagtatgtgtcaactgagag

SEQ ID NO: 5723945 - DNA, 23 bp, Homo sapiens
cttcagtatgttgtcaaagagag

SEQ ID NO: 5723946 - DNA, 13 bp, Homo sapiens
cttcagtcattaa

SEQ ID NO: 5723947 - DNA, 17 bp, Homo sapiens
cttcagtcccttcccca

SEQ ID NO: 5723948 - DNA, 15 bp, Homo sapiens
cttcagtcctgctcc

SEQ ID NO: 5723949 - DNA, 17 bp, Homo sapiens
cttcagtcctgctccag

SEQ ID NO: 5723950 - DNA, 13 bp, Homo sapiens
cttcagtcctggg

SEQ ID NO: 5723951 - DNA, 12 bp, Homo sapiens
cttcagtccttt

SEQ ID NO: 5723952 - DNA, 15 bp, Homo sapiens
cttcagtctcacaga

SEQ ID NO: 5723953 - DNA, 18 bp, Homo sapiens
cttcagtctcacagagaa

SEQ ID NO: 5723954 - DNA, 13 bp, Homo sapiens
cttcagtctgctc

SEQ ID NO: 5723955 - DNA, 14 bp, Homo sapiens
cttcagtctgctcc

SEQ ID NO: 5723956 - DNA, 18 bp, Homo sapiens
cttcagtctgctccacca

SEQ ID NO: 5723957 - DNA, 14 bp, Homo sapiens
cttcagtgaacata

SEQ ID NO: 5723958 - DNA, 19 bp, Homo sapiens
cttcagtgaatatttttgt

SEQ ID NO: 5723959 - DNA, 21 bp, Homo sapiens
cttcagtgaatatttttgtat

SEQ ID NO: 5723960 - DNA, 19 bp, Homo sapiens
cttcagtgacaagtagggc

SEQ ID NO: 5723961 - DNA, 20 bp, Homo sapiens
cttcagtgactcctgctggt

SEQ ID NO: 5723962 - DNA, 16 bp, Homo sapiens
cttcagtgagcccctc

SEQ ID NO: 5723963 - DNA, 19 bp, Homo sapiens
cttcagtgagcccctcccc

SEQ ID NO: 5723964 - DNA, 22 bp, Homo sapiens
cttcagtgcaaattgtatctta

SEQ ID NO: 5723965 - DNA, 19 bp, Homo sapiens
cttcagtgcatctgggaag

SEQ ID NO: 5723966 - DNA, 11 bp, Homo sapiens
cttcagtgccc

SEQ ID NO: 5723967 - DNA, 11 bp, Homo sapiens
cttcagtgcct

SEQ ID NO: 5723968 - DNA, 15 bp, Homo sapiens
cttcagtgcctagct

SEQ ID NO: 5723969 - DNA, 12 bp, Homo sapiens
cttcagtgcctt

SEQ ID NO: 5723970 - DNA, 22 bp, Homo sapiens
cttcagtgccttatggaacact

SEQ ID NO: 5723971 - DNA, 18 bp, Homo sapiens
cttcagtgctacattttg

SEQ ID NO: 5723972 - DNA, 19 bp, Homo sapiens
cttcagtggaacacaaatg

SEQ ID NO: 5723973 - DNA, 23 bp, Homo sapiens
cttcagtggaacacaaatgaaaa

SEQ ID NO: 5723974 - DNA, 17 bp, Homo sapiens
cttcagtggcagctgct

SEQ ID NO: 5723975 - DNA, 18 bp, Homo sapiens
cttcagtgggagaaaaca

SEQ ID NO: 5723976 - DNA, 23 bp, Homo sapiens
cttcagtgtaatgtgacttcatg

SEQ ID NO: 5723977 - DNA, 20 bp, Homo sapiens
cttcagtgtatggaaataaa

SEQ ID NO: 5723978 - DNA, 19 bp, Homo sapiens
cttcagtgtcccaccttga

SEQ ID NO: 5723979 - DNA, 17 bp, Homo sapiens
cttcagtgtctctgttt

SEQ ID NO: 5723980 - DNA, 14 bp, Homo sapiens
cttcagtgtgttga

SEQ ID NO: 5723981 - DNA, 17 bp, Homo sapiens
cttcagttaccgctggc

SEQ ID NO: 5723982 - DNA, 19 bp, Homo sapiens
cttcagttattggtggaat

SEQ ID NO: 5723983 - DNA, 19 bp, Homo sapiens
cttcagttctcatcttgta

SEQ ID NO: 5723984 - DNA, 15 bp, Homo sapiens
cttcagttgcttgtc

SEQ ID NO: 5723985 - DNA, 19 bp, Homo sapiens
cttcagttggtgtgttttt

SEQ ID NO: 5723986 - DNA, 22 bp, Homo sapiens
cttcagttggtgtgtttttggg

SEQ ID NO: 5723987 - DNA, 15 bp, Homo sapiens
cttcagttggttgtg

SEQ ID NO: 5723988 - DNA, 20 bp, Homo sapiens
cttcagttggttgtgtcttt

SEQ ID NO: 5723989 - DNA, 21 bp, Homo sapiens
cttcagttggttgtgtctttt

SEQ ID NO: 5723990 - DNA, 22 bp, Homo sapiens
cttcagttggttgtgtcttttt

SEQ ID NO: 5723991 - DNA, 13 bp, Homo sapiens
cttcagttgtctc

SEQ ID NO: 5723992 - DNA, 14 bp, Homo sapiens
cttcagttgtctct

SEQ ID NO: 5723993 - DNA, 18 bp, Homo sapiens
cttcagttgtggcctcat

SEQ ID NO: 5723994 - DNA, 16 bp, Homo sapiens
cttcagttgttcttta

SEQ ID NO: 5723995 - DNA, 19 bp, Homo sapiens
cttcagtttaatgtctcct

SEQ ID NO: 5723996 - DNA, 22 bp, Homo sapiens
cttcagtttgaaggctgcacac

SEQ ID NO: 5723997 - DNA, 15 bp, Homo sapiens
cttcagtttgtaaag

SEQ ID NO: 5723998 - DNA, 15 bp, Homo sapiens
cttcagttttactgc

SEQ ID NO: 5723999 - DNA, 20 bp, Homo sapiens
cttcagttttactgcatttt

SEQ ID NO: 5724000 - DNA, 21 bp, Homo sapiens
cttcataagatattctttaca

SEQ ID NO: 5724001 - DNA, 17 bp, Homo sapiens
cttcataatataacaac

SEQ ID NO: 5724002 - DNA, 15 bp, Homo sapiens
cttcataatggcctg

SEQ ID NO: 5724003 - DNA, 15 bp, Homo sapiens
cttcatacagaaggc

SEQ ID NO: 5724004 - DNA, 21 bp, Homo sapiens
cttcatacagaaggcaacagg

SEQ ID NO: 5724005 - DNA, 14 bp, Homo sapiens
cttcatacatccct

SEQ ID NO: 5724006 - DNA, 14 bp, Homo sapiens
cttcatagctcctt

SEQ ID NO: 5724007 - DNA, 16 bp, Homo sapiens
cttcataggcagagcc

SEQ ID NO: 5724008 - DNA, 17 bp, Homo sapiens
cttcataggcagagccc

SEQ ID NO: 5724009 - DNA, 16 bp, Homo sapiens
cttcatatcatccaca

SEQ ID NO: 5724010 - DNA, 15 bp, Homo sapiens
cttcatatctaattt

SEQ ID NO: 5724011 - DNA, 16 bp, Homo sapiens
cttcatatctaattta

SEQ ID NO: 5724012 - DNA, 15 bp, Homo sapiens
cttcatatctctccc

SEQ ID NO: 5724013 - DNA, 22 bp, Homo sapiens
cttcatatgaaaggtgccatgg

SEQ ID NO: 5724014 - DNA, 22 bp, Homo sapiens
cttcatattaatataagtttct

SEQ ID NO: 5724015 - DNA, 15 bp, Homo sapiens
cttcatcaatcaaat

SEQ ID NO: 5724016 - DNA, 16 bp, Homo sapiens
cttcatcaatcaaata

SEQ ID NO: 5724017 - DNA, 13 bp, Homo sapiens
cttcatcaatttt

SEQ ID NO: 5724018 - DNA, 19 bp, Homo sapiens
cttcatcaatttttataca

SEQ ID NO: 5724019 - DNA, 20 bp, Homo sapiens
cttcatcaatttttatacat

SEQ ID NO: 5724020 - DNA, 21 bp, Homo sapiens
cttcatcaatttttatacata

SEQ ID NO: 5724021 - DNA, 14 bp, Homo sapiens
cttcatcacagcat

SEQ ID NO: 5724022 - DNA, 14 bp, Homo sapiens
cttcatcagaactc

SEQ ID NO: 5724023 - DNA, 19 bp, Homo sapiens
cttcatcagaactcttcct

SEQ ID NO: 5724024 - DNA, 18 bp, Homo sapiens
cttcatcattccctctca

SEQ ID NO: 5724025 - DNA, 17 bp, Homo sapiens
cttcatccaacttccaa

SEQ ID NO: 5724026 - DNA, 19 bp, Homo sapiens
cttcatccaacttccaaga

SEQ ID NO: 5724027 - DNA, 13 bp, Homo sapiens
cttcatccatcct

SEQ ID NO: 5724028 - DNA, 17 bp, Homo sapiens
cttcatcccagctgctg

SEQ ID NO: 5724029 - DNA, 20 bp, Homo sapiens
cttcatcccagctgctgagg

SEQ ID NO: 5724030 - DNA, 15 bp, Homo sapiens
cttcatcccattcca

SEQ ID NO: 5724031 - DNA, 16 bp, Homo sapiens
cttcatcccattccag

SEQ ID NO: 5724032 - DNA, 23 bp, Homo sapiens
cttcatcccattccaggcagcct

SEQ ID NO: 5724033 - DNA, 16 bp, Homo sapiens
cttcatcccctcagaa

SEQ ID NO: 5724034 - DNA, 13 bp, Homo sapiens
cttcatccctttc

SEQ ID NO: 5724035 - DNA, 14 bp, Homo sapiens
cttcatccctttcc

SEQ ID NO: 5724036 - DNA, 16 bp, Homo sapiens
cttcatccgcctgtgg

SEQ ID NO: 5724037 - DNA, 13 bp, Homo sapiens
cttcatcctcctc

SEQ ID NO: 5724038 - DNA, 20 bp, Homo sapiens
cttcatccttagcaacagcc

SEQ ID NO: 5724039 - DNA, 20 bp, Homo sapiens
cttcatcgaacaaactgatg

SEQ ID NO: 5724040 - DNA, 18 bp, Homo sapiens
cttcatcgcagtggactg

SEQ ID NO: 5724041 - DNA, 19 bp, Homo sapiens
cttcatcgcagtggactgt

SEQ ID NO: 5724042 - DNA, 18 bp, Homo sapiens
cttcatcgcattttgatt

SEQ ID NO: 5724043 - DNA, 13 bp, Homo sapiens
cttcatctccagg

SEQ ID NO: 5724044 - DNA, 13 bp, Homo sapiens
cttcatctcccac

SEQ ID NO: 5724045 - DNA, 20 bp, Homo sapiens
cttcatctcccacctagcag

SEQ ID NO: 5724046 - DNA, 17 bp, Homo sapiens
cttcatctccctgccat

SEQ ID NO: 5724047 - DNA, 15 bp, Homo sapiens
cttcatctgcaaagg

SEQ ID NO: 5724048 - DNA, 14 bp, Homo sapiens
cttcatctgcccaa

SEQ ID NO: 5724049 - DNA, 17 bp, Homo sapiens
cttcatctggagtccct

SEQ ID NO: 5724050 - DNA, 20 bp, Homo sapiens
cttcatctggagtccctcct

SEQ ID NO: 5724051 - DNA, 19 bp, Homo sapiens
cttcatctggattccagag

SEQ ID NO: 5724052 - DNA, 14 bp, Homo sapiens
cttcatctggcaac

SEQ ID NO: 5724053 - DNA, 23 bp, Homo sapiens
cttcatctggcaacatctttatc

SEQ ID NO: 5724054 - DNA, 15 bp, Homo sapiens
cttcatcttcctgtg

SEQ ID NO: 5724055 - DNA, 16 bp, Homo sapiens
cttcatcttcctgtgt

SEQ ID NO: 5724056 - DNA, 21 bp, Homo sapiens
cttcatcttcctgtgtcctga

SEQ ID NO: 5724057 - DNA, 20 bp, Homo sapiens
cttcatcttgagcctgagcc

SEQ ID NO: 5724058 - DNA, 15 bp, Homo sapiens
cttcatcttttaaag

SEQ ID NO: 5724059 - DNA, 19 bp, Homo sapiens
cttcatgaaaatcctacca

SEQ ID NO: 5724060 - DNA, 11 bp, Homo sapiens
cttcatgaaat

SEQ ID NO: 5724061 - DNA, 19 bp, Homo sapiens
cttcatgaccttacatagc

SEQ ID NO: 5724062 - DNA, 21 bp, Homo sapiens
cttcatgagcattcataatta

SEQ ID NO: 5724063 - DNA, 12 bp, Homo sapiens
cttcatgcaatg

SEQ ID NO: 5724064 - DNA, 22 bp, Homo sapiens
cttcatgcaatgacatcttcaa

SEQ ID NO: 5724065 - DNA, 16 bp, Homo sapiens
cttcatgccagctact

SEQ ID NO: 5724066 - DNA, 18 bp, Homo sapiens
cttcatgccagtgcatgc

SEQ ID NO: 5724067 - DNA, 18 bp, Homo sapiens
cttcatgcccttctgatt

SEQ ID NO: 5724068 - DNA, 14 bp, Homo sapiens
cttcatgcctcagt

SEQ ID NO: 5724069 - DNA, 15 bp, Homo sapiens
cttcatgcctcagtt

SEQ ID NO: 5724070 - DNA, 16 bp, Homo sapiens
cttcatgcctcagttt

SEQ ID NO: 5724071 - DNA, 20 bp, Homo sapiens
cttcatgcctcagtttcccc

SEQ ID NO: 5724072 - DNA, 21 bp, Homo sapiens
cttcatgcctcagtttcccca

SEQ ID NO: 5724073 - DNA, 17 bp, Homo sapiens
cttcatgcctgatgaaa

SEQ ID NO: 5724074 - DNA, 19 bp, Homo sapiens
cttcatgcctgatgaaagc

SEQ ID NO: 5724075 - DNA, 15 bp, Homo sapiens
cttcatgcctttgta

SEQ ID NO: 5724076 - DNA, 17 bp, Homo sapiens
cttcatgcctttgtaag

SEQ ID NO: 5724077 - DNA, 15 bp, Homo sapiens
cttcatgctcagccc

SEQ ID NO: 5724078 - DNA, 14 bp, Homo sapiens
cttcatgctgtctg

SEQ ID NO: 5724079 - DNA, 21 bp, Homo sapiens
cttcatggaactcagctgtct

SEQ ID NO: 5724080 - DNA, 21 bp, Homo sapiens
cttcatggaattcacaaagta

SEQ ID NO: 5724081 - DNA, 15 bp, Homo sapiens
cttcatggaccaaga

SEQ ID NO: 5724082 - DNA, 23 bp, Homo sapiens
cttcatggatgggggaactcaga

SEQ ID NO: 5724083 - DNA, 19 bp, Homo sapiens
cttcatggccatagctttt

SEQ ID NO: 5724084 - DNA, 14 bp, Homo sapiens
cttcatggtgacat

SEQ ID NO: 5724085 - DNA, 18 bp, Homo sapiens
cttcatggtgactaacag

SEQ ID NO: 5724086 - DNA, 13 bp, Homo sapiens
cttcatgtaaatt

SEQ ID NO: 5724087 - DNA, 21 bp, Homo sapiens
cttcatgtaattttattttaa

SEQ ID NO: 5724088 - DNA, 21 bp, Homo sapiens
cttcatgtccagtgagcagtg

SEQ ID NO: 5724089 - DNA, 17 bp, Homo sapiens
cttcatgtcctaaagaa

SEQ ID NO: 5724090 - DNA, 16 bp, Homo sapiens
cttcatgtctattcca

SEQ ID NO: 5724091 - DNA, 23 bp, Homo sapiens
cttcatgtctattccattccctt

SEQ ID NO: 5724092 - DNA, 23 bp, Homo sapiens
cttcatgtgatgtcatgaaactg

SEQ ID NO: 5724093 - DNA, 15 bp, Homo sapiens
cttcatgtggacatt

SEQ ID NO: 5724094 - DNA, 21 bp, Homo sapiens
cttcatgtggcattctctctg

SEQ ID NO: 5724095 - DNA, 14 bp, Homo sapiens
cttcatgtgtccca

SEQ ID NO: 5724096 - DNA, 23 bp, Homo sapiens
cttcatgttttaacttattgttg

SEQ ID NO: 5724097 - DNA, 16 bp, Homo sapiens
cttcattaaaacaaga

SEQ ID NO: 5724098 - DNA, 21 bp, Homo sapiens
cttcattaaaacaagagacca

SEQ ID NO: 5724099 - DNA, 23 bp, Homo sapiens
cttcattaaaacaagagaccact

SEQ ID NO: 5724100 - DNA, 13 bp, Homo sapiens
cttcattaaagtc

SEQ ID NO: 5724101 - DNA, 19 bp, Homo sapiens
cttcattaatttcaatcaa

SEQ ID NO: 5724102 - DNA, 21 bp, Homo sapiens
cttcattattcaagaatgaaa

SEQ ID NO: 5724103 - DNA, 19 bp, Homo sapiens
cttcattcaatattgacat

SEQ ID NO: 5724104 - DNA, 14 bp, Homo sapiens
cttcattcagatct

SEQ ID NO: 5724105 - DNA, 14 bp, Homo sapiens
cttcattccagcag

SEQ ID NO: 5724106 - DNA, 15 bp, Homo sapiens
cttcattccagcagc

SEQ ID NO: 5724107 - DNA, 17 bp, Homo sapiens
cttcattccagcagctg

SEQ ID NO: 5724108 - DNA, 22 bp, Homo sapiens
cttcattccggactggcagaag

SEQ ID NO: 5724109 - DNA, 18 bp, Homo sapiens
cttcattctaaaccaaaa

SEQ ID NO: 5724110 - DNA, 14 bp, Homo sapiens
cttcattctccgtt

SEQ ID NO: 5724111 - DNA, 13 bp, Homo sapiens
cttcattctcctt

SEQ ID NO: 5724112 - DNA, 22 bp, Homo sapiens
cttcattctccttgttgttggt

SEQ ID NO: 5724113 - DNA, 18 bp, Homo sapiens
cttcattctgagaccaaa

SEQ ID NO: 5724114 - DNA, 15 bp, Homo sapiens
cttcattctgcaggg

SEQ ID NO: 5724115 - DNA, 20 bp, Homo sapiens
cttcattcttgaaagctgtg

SEQ ID NO: 5724116 - DNA, 15 bp, Homo sapiens
cttcattctttactg

SEQ ID NO: 5724117 - DNA, 13 bp, Homo sapiens
cttcattgaaagc

SEQ ID NO: 5724118 - DNA, 17 bp, Homo sapiens
cttcattgatttcctgt

SEQ ID NO: 5724119 - DNA, 20 bp, Homo sapiens
cttcattgatttcctgtgtc

SEQ ID NO: 5724120 - DNA, 20 bp, Homo sapiens
cttcattgggaagtatgatt

SEQ ID NO: 5724121 - DNA, 23 bp, Homo sapiens
cttcattgggagttcctagcaag

SEQ ID NO: 5724122 - DNA, 15 bp, Homo sapiens
cttcattgtccctct

SEQ ID NO: 5724123 - DNA, 17 bp, Homo sapiens
cttcattgtccctcttc

SEQ ID NO: 5724124 - DNA, 18 bp, Homo sapiens
cttcattgttacatgtaa

SEQ ID NO: 5724125 - DNA, 21 bp, Homo sapiens
cttcattgtttggacctgcat

SEQ ID NO: 5724126 - DNA, 14 bp, Homo sapiens
cttcattgttttaa

SEQ ID NO: 5724127 - DNA, 14 bp, Homo sapiens
cttcatttaaaaaa

SEQ ID NO: 5724128 - DNA, 15 bp, Homo sapiens
cttcatttaaactaa

SEQ ID NO: 5724129 - DNA, 13 bp, Homo sapiens
cttcatttaacac

SEQ ID NO: 5724130 - DNA, 18 bp, Homo sapiens
cttcatttaactctttga

SEQ ID NO: 5724131 - DNA, 15 bp, Homo sapiens
cttcatttattttga

SEQ ID NO: 5724132 - DNA, 18 bp, Homo sapiens
cttcatttcaatcattga

SEQ ID NO: 5724133 - DNA, 14 bp, Homo sapiens
cttcatttcatcct

SEQ ID NO: 5724134 - DNA, 16 bp, Homo sapiens
cttcatttcatcctgt

SEQ ID NO: 5724135 - DNA, 18 bp, Homo sapiens
cttcatttcatcctgttg

SEQ ID NO: 5724136 - DNA, 16 bp, Homo sapiens
cttcatttcattgtat

SEQ ID NO: 5724137 - DNA, 23 bp, Homo sapiens
cttcatttctatagccaaagctg

SEQ ID NO: 5724138 - DNA, 15 bp, Homo sapiens
cttcatttggaggaa

SEQ ID NO: 5724139 - DNA, 24 bp, Homo sapiens
cttcatttgggatgctactctagt

SEQ ID NO: 5724140 - DNA, 11 bp, Homo sapiens
cttcatttgtg

SEQ ID NO: 5724141 - DNA, 14 bp, Homo sapiens
cttcatttgtgcca

SEQ ID NO: 5724142 - DNA, 15 bp, Homo sapiens
cttcatttgtgccac

SEQ ID NO: 5724143 - DNA, 13 bp, Homo sapiens
cttcattttacat

SEQ ID NO: 5724144 - DNA, 14 bp, Homo sapiens
cttcattttatatt

SEQ ID NO: 5724145 - DNA, 19 bp, Homo sapiens
cttcattttatatttaaaa

SEQ ID NO: 5724146 - DNA, 22 bp, Homo sapiens
cttcattttattaatatttttc

SEQ ID NO: 5724147 - DNA, 16 bp, Homo sapiens
cttcattttcagagtg

SEQ ID NO: 5724148 - DNA, 19 bp, Homo sapiens
cttcattttcagagtgaca

SEQ ID NO: 5724149 - DNA, 17 bp, Homo sapiens
cttcattttcattacca

SEQ ID NO: 5724150 - DNA, 20 bp, Homo sapiens
cttcattttctaattctctt

SEQ ID NO: 5724151 - DNA, 19 bp, Homo sapiens
cttcattttgagtctcagg

SEQ ID NO: 5724152 - DNA, 19 bp, Homo sapiens
cttcattttggtttatttt

SEQ ID NO: 5724153 - DNA, 12 bp, Homo sapiens
cttcatttttaa

SEQ ID NO: 5724154 - DNA, 18 bp, Homo sapiens
cttcatttttaagaaagg

SEQ ID NO: 5724155 - DNA, 16 bp, Homo sapiens
cttcatttttcctaac

SEQ ID NO: 5724156 - DNA, 17 bp, Homo sapiens
cttcatttttcctaaca

SEQ ID NO: 5724157 - DNA, 17 bp, Homo sapiens
cttcatttttctttctt

SEQ ID NO: 5724158 - DNA, 15 bp, Homo sapiens
cttcatttttgtaat

SEQ ID NO: 5724159 - DNA, 18 bp, Homo sapiens
cttcatttttgtaataac

SEQ ID NO: 5724160 - DNA, 14 bp, Homo sapiens
cttcattttttaaa

SEQ ID NO: 5724161 - DNA, 17 bp, Homo sapiens
cttcattttttattcct

SEQ ID NO: 5724162 - DNA, 21 bp, Homo sapiens
cttccaaaacctgcttccttc

SEQ ID NO: 5724163 - DNA, 22 bp, Homo sapiens
cttccaaaacctgcttccttca

SEQ ID NO: 5724164 - DNA, 15 bp, Homo sapiens
cttccaaacagtgtg

SEQ ID NO: 5724165 - DNA, 21 bp, Homo sapiens
cttccaaacagtgtgttggtg

SEQ ID NO: 5724166 - DNA, 16 bp, Homo sapiens
cttccaaactaatttt

SEQ ID NO: 5724167 - DNA, 14 bp, Homo sapiens
cttccaaagaatgt

SEQ ID NO: 5724168 - DNA, 13 bp, Homo sapiens
cttccaaagccta

SEQ ID NO: 5724169 - DNA, 22 bp, Homo sapiens
cttccaaagcttcgtcttgtgt

SEQ ID NO: 5724170 - DNA, 15 bp, Homo sapiens
cttccaaaggcagcg

SEQ ID NO: 5724171 - DNA, 22 bp, Homo sapiens
cttccaaaggcagcgtgccgag

SEQ ID NO: 5724172 - DNA, 21 bp, Homo sapiens
cttccaaagtaaaattgctgt

SEQ ID NO: 5724173 - DNA, 15 bp, Homo sapiens
cttccaaataaataa

SEQ ID NO: 5724174 - DNA, 20 bp, Homo sapiens
cttccaaataataaagtcta

SEQ ID NO: 5724175 - DNA, 18 bp, Homo sapiens
cttccaaatcaggctggg

SEQ ID NO: 5724176 - DNA, 16 bp, Homo sapiens
cttccaaatcccctaa

SEQ ID NO: 5724177 - DNA, 20 bp, Homo sapiens
cttccaaatcccctaagcag

SEQ ID NO: 5724178 - DNA, 18 bp, Homo sapiens
cttccaaatcctggaagg

SEQ ID NO: 5724179 - DNA, 19 bp, Homo sapiens
cttccaaatgcaatttgat

SEQ ID NO: 5724180 - DNA, 18 bp, Homo sapiens
cttccaacaaggacagcc

SEQ ID NO: 5724181 - DNA, 20 bp, Homo sapiens
cttccaacaaggacagccct

SEQ ID NO: 5724182 - DNA, 13 bp, Homo sapiens
cttccaaccccag

SEQ ID NO: 5724183 - DNA, 14 bp, Homo sapiens
cttccaaccccagc

SEQ ID NO: 5724184 - DNA, 18 bp, Homo sapiens
cttccaaccccagctggc

SEQ ID NO: 5724185 - DNA, 21 bp, Homo sapiens
cttccaaccccagctggcctc

SEQ ID NO: 5724186 - DNA, 17 bp, Homo sapiens
cttccaactatgtccag

SEQ ID NO: 5724187 - DNA, 15 bp, Homo sapiens
cttccaagaagacca

SEQ ID NO: 5724188 - DNA, 17 bp, Homo sapiens
cttccaagacctgactc

SEQ ID NO: 5724189 - DNA, 16 bp, Homo sapiens
cttccaagactgaaga

SEQ ID NO: 5724190 - DNA, 21 bp, Homo sapiens
cttccaagactgaagactgca

SEQ ID NO: 5724191 - DNA, 14 bp, Homo sapiens
cttccaagagcctg

SEQ ID NO: 5724192 - DNA, 15 bp, Homo sapiens
cttccaagagcctga

SEQ ID NO: 5724193 - DNA, 16 bp, Homo sapiens
cttccaagcatgacaa

SEQ ID NO: 5724194 - DNA, 12 bp, Homo sapiens
cttccaaggaga

SEQ ID NO: 5724195 - DNA, 14 bp, Homo sapiens
cttccaaggagacc

SEQ ID NO: 5724196 - DNA, 18 bp, Homo sapiens
cttccaaggagaccaagt

SEQ ID NO: 5724197 - DNA, 21 bp, Homo sapiens
cttccaaggagaccaagtcct

SEQ ID NO: 5724198 - DNA, 14 bp, Homo sapiens
cttccaaggagcag

SEQ ID NO: 5724199 - DNA, 12 bp, Homo sapiens
cttccaaggccc

SEQ ID NO: 5724200 - DNA, 18 bp, Homo sapiens
cttccaaggccctgcttt

SEQ ID NO: 5724201 - DNA, 18 bp, Homo sapiens
cttccaaggtggtctgct

SEQ ID NO: 5724202 - DNA, 21 bp, Homo sapiens
cttccaaggtggtctgctcgg

SEQ ID NO: 5724203 - DNA, 15 bp, Homo sapiens
cttccaagtccttta

SEQ ID NO: 5724204 - DNA, 18 bp, Homo sapiens
cttccaagttcattcata

SEQ ID NO: 5724205 - DNA, 20 bp, Homo sapiens
cttccaagtttgacttgtat

SEQ ID NO: 5724206 - DNA, 20 bp, Homo sapiens
cttccaatagttagatctac

SEQ ID NO: 5724207 - DNA, 15 bp, Homo sapiens
cttccaatgatgctt

SEQ ID NO: 5724208 - DNA, 16 bp, Homo sapiens
cttccacaaagaaaat

SEQ ID NO: 5724209 - DNA, 14 bp, Homo sapiens
cttccacaagagcc

SEQ ID NO: 5724210 - DNA, 17 bp, Homo sapiens
cttccacaagagcccag

SEQ ID NO: 5724211 - DNA, 21 bp, Homo sapiens
cttccacaagagcccaggcct

SEQ ID NO: 5724212 - DNA, 14 bp, Homo sapiens
cttccacaccccca

SEQ ID NO: 5724213 - DNA, 14 bp, Homo sapiens
cttccacagctggc

SEQ ID NO: 5724214 - DNA, 18 bp, Homo sapiens
cttccacagggtcccaca

SEQ ID NO: 5724215 - DNA, 22 bp, Homo sapiens
cttccacagggtcccacagcca

SEQ ID NO: 5724216 - DNA, 21 bp, Homo sapiens
cttccacaggtctcagaatct

SEQ ID NO: 5724217 - DNA, 16 bp, Homo sapiens
cttccacatgttactg

SEQ ID NO: 5724218 - DNA, 16 bp, Homo sapiens
cttccaccagagcagg

SEQ ID NO: 5724219 - DNA, 18 bp, Homo sapiens
cttccaccagagcagggg

SEQ ID NO: 5724220 - DNA, 20 bp, Homo sapiens
cttccaccagagcaggggct

SEQ ID NO: 5724221 - DNA, 22 bp, Homo sapiens
cttccaccagagcaggggctgc

SEQ ID NO: 5724222 - DNA, 15 bp, Homo sapiens
cttccaccagcctgc

SEQ ID NO: 5724223 - DNA, 16 bp, Homo sapiens
cttccaccagcctgca

SEQ ID NO: 5724224 - DNA, 21 bp, Homo sapiens
cttccacccacaaactccagg

SEQ ID NO: 5724225 - DNA, 22 bp, Homo sapiens
cttccacccattcccccatgtg

SEQ ID NO: 5724226 - DNA, 17 bp, Homo sapiens
cttccaccctgccctgg

SEQ ID NO: 5724227 - DNA, 16 bp, Homo sapiens
cttccaccggcactca

SEQ ID NO: 5724228 - DNA, 17 bp, Homo sapiens
cttccaccggcactcat

SEQ ID NO: 5724229 - DNA, 23 bp, Homo sapiens
cttccaccgggcctgaaccacag

SEQ ID NO: 5724230 - DNA, 20 bp, Homo sapiens
cttccacctcaccccactta

SEQ ID NO: 5724231 - DNA, 22 bp, Homo sapiens
cttccacctcatggattgccac

SEQ ID NO: 5724232 - DNA, 16 bp, Homo sapiens
cttccacctccagcct

SEQ ID NO: 5724233 - DNA, 13 bp, Homo sapiens
cttccacctccct

SEQ ID NO: 5724234 - DNA, 12 bp, Homo sapiens
cttccacctgcc

SEQ ID NO: 5724235 - DNA, 15 bp, Homo sapiens
cttccacctgctctg

SEQ ID NO: 5724236 - DNA, 11 bp, Homo sapiens
cttccacctgt

SEQ ID NO: 5724237 - DNA, 15 bp, Homo sapiens
cttccacctgtgccc

SEQ ID NO: 5724238 - DNA, 16 bp, Homo sapiens
cttccacgctgtctcc

SEQ ID NO: 5724239 - DNA, 22 bp, Homo sapiens
cttccacgctgtctccagaccc

SEQ ID NO: 5724240 - DNA, 22 bp, Homo sapiens
cttccacgggggctgtggctct

SEQ ID NO: 5724241 - DNA, 19 bp, Homo sapiens
cttccactcgatgatgctt

SEQ ID NO: 5724242 - DNA, 20 bp, Homo sapiens
cttccactgaggtgggagca

SEQ ID NO: 5724243 - DNA, 13 bp, Homo sapiens
cttccactgagtc

SEQ ID NO: 5724244 - DNA, 14 bp, Homo sapiens
cttccactggctcc

SEQ ID NO: 5724245 - DNA, 12 bp, Homo sapiens
cttccactgtag

SEQ ID NO: 5724246 - DNA, 14 bp, Homo sapiens
cttccactgtagct

SEQ ID NO: 5724247 - DNA, 18 bp, Homo sapiens
cttccactgtagctatta

SEQ ID NO: 5724248 - DNA, 17 bp, Homo sapiens
cttccactgtcagccct

SEQ ID NO: 5724249 - DNA, 21 bp, Homo sapiens
cttccactgtcagccctcact

SEQ ID NO: 5724250 - DNA, 17 bp, Homo sapiens
cttccactgtgtgttga

SEQ ID NO: 5724251 - DNA, 21 bp, Homo sapiens
cttccactgtgtgttgacact

SEQ ID NO: 5724252 - DNA, 20 bp, Homo sapiens
cttccacttctccaagaatg

SEQ ID NO: 5724253 - DNA, 13 bp, Homo sapiens
cttccacttctgg

SEQ ID NO: 5724254 - DNA, 16 bp, Homo sapiens
cttccacttgagtgtc

SEQ ID NO: 5724255 - DNA, 21 bp, Homo sapiens
cttccactttgtataaatttt

SEQ ID NO: 5724256 - DNA, 21 bp, Homo sapiens
cttccacttttttttgtatgt

SEQ ID NO: 5724257 - DNA, 13 bp, Homo sapiens
cttccagaaatac

SEQ ID NO: 5724258 - DNA, 17 bp, Homo sapiens
cttccagaactgtgaga

SEQ ID NO: 5724259 - DNA, 20 bp, Homo sapiens
cttccagaagatgccctcca

SEQ ID NO: 5724260 - DNA, 12 bp, Homo sapiens
cttccagaatgc

SEQ ID NO: 5724261 - DNA, 15 bp, Homo sapiens
cttccagaatgctga

SEQ ID NO: 5724262 - DNA, 17 bp, Homo sapiens
cttccagacctgcttcc

SEQ ID NO: 5724263 - DNA, 21 bp, Homo sapiens
cttccagacctgcttcctgaa

SEQ ID NO: 5724264 - DNA, 17 bp, Homo sapiens
cttccagagaacctgtg

SEQ ID NO: 5724265 - DNA, 16 bp, Homo sapiens
cttccagagaggacct

SEQ ID NO: 5724266 - DNA, 22 bp, Homo sapiens
cttccagagaggacctatccca

SEQ ID NO: 5724267 - DNA, 14 bp, Homo sapiens
cttccagagccaga

SEQ ID NO: 5724268 - DNA, 23 bp, Homo sapiens
cttccagagctctgacccacagc

SEQ ID NO: 5724269 - DNA, 18 bp, Homo sapiens
cttccagaggacagctct

SEQ ID NO: 5724270 - DNA, 13 bp, Homo sapiens
cttccagaggaga

SEQ ID NO: 5724271 - DNA, 13 bp, Homo sapiens
cttccagatcact

SEQ ID NO: 5724272 - DNA, 17 bp, Homo sapiens
cttccagatcactgcca

SEQ ID NO: 5724273 - DNA, 20 bp, Homo sapiens
cttccagatcactgccacac

SEQ ID NO: 5724274 - DNA, 12 bp, Homo sapiens
cttccagatcct

SEQ ID NO: 5724275 - DNA, 19 bp, Homo sapiens
cttccagatcctggaaatc

SEQ ID NO: 5724276 - DNA, 19 bp, Homo sapiens
cttccagatggtcatccag

SEQ ID NO: 5724277 - DNA, 19 bp, Homo sapiens
cttccagattgggggccct

SEQ ID NO: 5724278 - DNA, 12 bp, Homo sapiens
cttccagattgt

SEQ ID NO: 5724279 - DNA, 23 bp, Homo sapiens
cttccagattttaaattttatgt

SEQ ID NO: 5724280 - DNA, 19 bp, Homo sapiens
cttccagcaaaatccaaac

SEQ ID NO: 5724281 - DNA, 13 bp, Homo sapiens
cttccagcattta

SEQ ID NO: 5724282 - DNA, 22 bp, Homo sapiens
cttccagccacattgagacttt

SEQ ID NO: 5724283 - DNA, 18 bp, Homo sapiens
cttccagcccagacatcc

SEQ ID NO: 5724284 - DNA, 21 bp, Homo sapiens
cttccagcccagacccccagt

SEQ ID NO: 5724285 - DNA, 17 bp, Homo sapiens
cttccagcctgggacac

SEQ ID NO: 5724286 - DNA, 15 bp, Homo sapiens
cttccagcgggccct

SEQ ID NO: 5724287 - DNA, 17 bp, Homo sapiens
cttccagcgggccctct

SEQ ID NO: 5724288 - DNA, 23 bp, Homo sapiens
cttccagcgggccctctgccgac

SEQ ID NO: 5724289 - DNA, 19 bp, Homo sapiens
cttccagctcagtcccaca

SEQ ID NO: 5724290 - DNA, 14 bp, Homo sapiens
cttccagctgctgt

SEQ ID NO: 5724291 - DNA, 15 bp, Homo sapiens
cttccagcttcaggc

SEQ ID NO: 5724292 - DNA, 18 bp, Homo sapiens
cttccagcttcaggcacc

SEQ ID NO: 5724293 - DNA, 21 bp, Homo sapiens
cttccagcttcaggcaccagc

SEQ ID NO: 5724294 - DNA, 16 bp, Homo sapiens
cttccaggaaaaagga

SEQ ID NO: 5724295 - DNA, 18 bp, Homo sapiens
cttccaggaaactccaca

SEQ ID NO: 5724296 - DNA, 22 bp, Homo sapiens
cttccaggaaactccacatctg

SEQ ID NO: 5724297 - DNA, 23 bp, Homo sapiens
cttccaggaaactccacatctgc

SEQ ID NO: 5724298 - DNA, 20 bp, Homo sapiens
cttccaggaaagtgtgaaga

SEQ ID NO: 5724299 - DNA, 22 bp, Homo sapiens
cttccaggaaagtgtgaagacc

SEQ ID NO: 5724300 - DNA, 18 bp, Homo sapiens
cttccaggaagcacaggc

SEQ ID NO: 5724301 - DNA, 19 bp, Homo sapiens
cttccaggaagcacaggcc

SEQ ID NO: 5724302 - DNA, 21 bp, Homo sapiens
cttccaggaagcacaggccag

SEQ ID NO: 5724303 - DNA, 21 bp, Homo sapiens
cttccaggagcaatttgcaca

SEQ ID NO: 5724304 - DNA, 21 bp, Homo sapiens
cttccaggagccaccttgcca

SEQ ID NO: 5724305 - DNA, 11 bp, Homo sapiens
cttccaggccc

SEQ ID NO: 5724306 - DNA, 22 bp, Homo sapiens
cttccaggcccagtccactggg

SEQ ID NO: 5724307 - DNA, 18 bp, Homo sapiens
cttccaggccccaggctg

SEQ ID NO: 5724308 - DNA, 20 bp, Homo sapiens
cttccaggccccaggctgga

SEQ ID NO: 5724309 - DNA, 24 bp, Homo sapiens
cttccaggccccaggctggatgct

SEQ ID NO: 5724310 - DNA, 22 bp, Homo sapiens
cttccaggcgtagggccagggc

SEQ ID NO: 5724311 - DNA, 23 bp, Homo sapiens
cttccaggcgtagggccagggct

SEQ ID NO: 5724312 - DNA, 13 bp, Homo sapiens
cttccaggctctt

SEQ ID NO: 5724313 - DNA, 17 bp, Homo sapiens
cttccaggctcttcctg

SEQ ID NO: 5724314 - DNA, 21 bp, Homo sapiens
cttccaggctcttcctggacc

SEQ ID NO: 5724315 - DNA, 21 bp, Homo sapiens
cttccaggctgagagccggcc

SEQ ID NO: 5724316 - DNA, 12 bp, Homo sapiens
cttccaggctgg

SEQ ID NO: 5724317 - DNA, 22 bp, Homo sapiens
cttccagggacgaagaagagcc

SEQ ID NO: 5724318 - DNA, 20 bp, Homo sapiens
cttccagggatttgcctcac

SEQ ID NO: 5724319 - DNA, 19 bp, Homo sapiens
cttccagggctcttccaga

SEQ ID NO: 5724320 - DNA, 15 bp, Homo sapiens
cttccaggggaacct

SEQ ID NO: 5724321 - DNA, 24 bp, Homo sapiens
cttccaggggtgggacaccctgtg

SEQ ID NO: 5724322 - DNA, 19 bp, Homo sapiens
cttccaggtatctccagga

SEQ ID NO: 5724323 - DNA, 21 bp, Homo sapiens
cttccaggtccaaacccttca

SEQ ID NO: 5724324 - DNA, 18 bp, Homo sapiens
cttccaggtctgcctggt

SEQ ID NO: 5724325 - DNA, 16 bp, Homo sapiens
cttccaggtgcctggc

SEQ ID NO: 5724326 - DNA, 16 bp, Homo sapiens
cttccaggtggcagga

SEQ ID NO: 5724327 - DNA, 18 bp, Homo sapiens
cttccaggtggcccttcc

SEQ ID NO: 5724328 - DNA, 23 bp, Homo sapiens
cttccaggttctggttagctcag

SEQ ID NO: 5724329 - DNA, 13 bp, Homo sapiens
cttccagtcagga

SEQ ID NO: 5724330 - DNA, 21 bp, Homo sapiens
cttccagtctcactgacacag

SEQ ID NO: 5724331 - DNA, 12 bp, Homo sapiens
cttccagtctgg

SEQ ID NO: 5724332 - DNA, 19 bp, Homo sapiens
cttccagtctggagagctg

SEQ ID NO: 5724333 - DNA, 20 bp, Homo sapiens
cttccagtctggagagctgt

SEQ ID NO: 5724334 - DNA, 21 bp, Homo sapiens
cttccagtgaacattcccagc

SEQ ID NO: 5724335 - DNA, 15 bp, Homo sapiens
cttccagtgaggctc

SEQ ID NO: 5724336 - DNA, 20 bp, Homo sapiens
cttccagtgaggctctgccc

SEQ ID NO: 5724337 - DNA, 21 bp, Homo sapiens
cttccagtgaggctctgccct

SEQ ID NO: 5724338 - DNA, 22 bp, Homo sapiens
cttccagtgaggctctgccctt

SEQ ID NO: 5724339 - DNA, 15 bp, Homo sapiens
cttccagtgcatgtt

SEQ ID NO: 5724340 - DNA, 22 bp, Homo sapiens
cttccagtggctggtttctgag

SEQ ID NO: 5724341 - DNA, 16 bp, Homo sapiens
cttccagtggcttctc

SEQ ID NO: 5724342 - DNA, 14 bp, Homo sapiens
cttccagtggtacc

SEQ ID NO: 5724343 - DNA, 16 bp, Homo sapiens
cttccagtggtaccag

SEQ ID NO: 5724344 - DNA, 23 bp, Homo sapiens
cttccagtggtaccagctcactc

SEQ ID NO: 5724345 - DNA, 19 bp, Homo sapiens
cttccagtgtccttagaac

SEQ ID NO: 5724346 - DNA, 19 bp, Homo sapiens
cttccagttggactgtggc

SEQ ID NO: 5724347 - DNA, 23 bp, Homo sapiens
cttccagtttattccagagctgc

SEQ ID NO: 5724348 - DNA, 23 bp, Homo sapiens
cttccataatgtataaagaacaa

SEQ ID NO: 5724349 - DNA, 17 bp, Homo sapiens
cttccatacacagagga

SEQ ID NO: 5724350 - DNA, 14 bp, Homo sapiens
cttccatagcctaa

SEQ ID NO: 5724351 - DNA, 23 bp, Homo sapiens
cttccataggacatactgcatgt

SEQ ID NO: 5724352 - DNA, 20 bp, Homo sapiens
cttccatatccctgcccagc

SEQ ID NO: 5724353 - DNA, 21 bp, Homo sapiens
cttccatatccctgcccagcc

SEQ ID NO: 5724354 - DNA, 14 bp, Homo sapiens
cttccatatggatc

SEQ ID NO: 5724355 - DNA, 16 bp, Homo sapiens
cttccatatttggaag

SEQ ID NO: 5724356 - DNA, 16 bp, Homo sapiens
cttccatcagagatgg

SEQ ID NO: 5724357 - DNA, 13 bp, Homo sapiens
cttccatcagcag

SEQ ID NO: 5724358 - DNA, 14 bp, Homo sapiens
cttccatcagcagt

SEQ ID NO: 5724359 - DNA, 20 bp, Homo sapiens
cttccatcagcagtgattga

SEQ ID NO: 5724360 - DNA, 23 bp, Homo sapiens
cttccatcagcgggtctcctccc

SEQ ID NO: 5724361 - DNA, 23 bp, Homo sapiens
cttccatcatcactgtaaagaca

SEQ ID NO: 5724362 - DNA, 12 bp, Homo sapiens
cttccatcatgt

SEQ ID NO: 5724363 - DNA, 16 bp, Homo sapiens
cttccatccaaagaat

SEQ ID NO: 5724364 - DNA, 17 bp, Homo sapiens
cttccatcccaaccagt

SEQ ID NO: 5724365 - DNA, 21 bp, Homo sapiens
cttccatcccaaccagtgcca

SEQ ID NO: 5724366 - DNA, 22 bp, Homo sapiens
cttccatcccaaccagtgccaa

SEQ ID NO: 5724367 - DNA, 22 bp, Homo sapiens
cttccatcccaggacaccacac

SEQ ID NO: 5724368 - DNA, 16 bp, Homo sapiens
cttccatccctacccc

SEQ ID NO: 5724369 - DNA, 17 bp, Homo sapiens
cttccatctagcagctg

SEQ ID NO: 5724370 - DNA, 17 bp, Homo sapiens
cttccatctagtcacaa

SEQ ID NO: 5724371 - DNA, 18 bp, Homo sapiens
cttccatctcttccttca

SEQ ID NO: 5724372 - DNA, 19 bp, Homo sapiens
cttccatcttgtggggcca

SEQ ID NO: 5724373 - DNA, 22 bp, Homo sapiens
cttccatcttgtggggccagga

SEQ ID NO: 5724374 - DNA, 18 bp, Homo sapiens
cttccatctttcctgatg

SEQ ID NO: 5724375 - DNA, 20 bp, Homo sapiens
cttccatgaattttaaaatc

SEQ ID NO: 5724376 - DNA, 15 bp, Homo sapiens
cttccatgacctccc

SEQ ID NO: 5724377 - DNA, 17 bp, Homo sapiens
cttccatgagaacagca

SEQ ID NO: 5724378 - DNA, 21 bp, Homo sapiens
cttccatgagaacagcagggt

SEQ ID NO: 5724379 - DNA, 22 bp, Homo sapiens
cttccatgatagatataaagga

SEQ ID NO: 5724380 - DNA, 18 bp, Homo sapiens
cttccatgatgcacagta

SEQ ID NO: 5724381 - DNA, 21 bp, Homo sapiens
cttccatgatgcacagtatct

SEQ ID NO: 5724382 - DNA, 14 bp, Homo sapiens
cttccatgattcta

SEQ ID NO: 5724383 - DNA, 14 bp, Homo sapiens
cttccatgatttta

SEQ ID NO: 5724384 - DNA, 16 bp, Homo sapiens
cttccatgccctggga

SEQ ID NO: 5724385 - DNA, 14 bp, Homo sapiens
cttccatgctccca

SEQ ID NO: 5724386 - DNA, 15 bp, Homo sapiens
cttccatgctcccaa

SEQ ID NO: 5724387 - DNA, 19 bp, Homo sapiens
cttccatgctcccaactcc

SEQ ID NO: 5724388 - DNA, 17 bp, Homo sapiens
cttccatggactttgtt

SEQ ID NO: 5724389 - DNA, 22 bp, Homo sapiens
cttccatgggcatggccgttgc

SEQ ID NO: 5724390 - DNA, 22 bp, Homo sapiens
cttccatggtactgtagcaggg

SEQ ID NO: 5724391 - DNA, 16 bp, Homo sapiens
cttccatgtcaggcca

SEQ ID NO: 5724392 - DNA, 18 bp, Homo sapiens
cttccatgtcaggccagc

SEQ ID NO: 5724393 - DNA, 17 bp, Homo sapiens
cttccatgtcgcctctg

SEQ ID NO: 5724394 - DNA, 18 bp, Homo sapiens
cttccatgtcgcctctgc

SEQ ID NO: 5724395 - DNA, 19 bp, Homo sapiens
cttccatgtcgcctctgca

SEQ ID NO: 5724396 - DNA, 14 bp, Homo sapiens
cttccatgtgcctt

SEQ ID NO: 5724397 - DNA, 14 bp, Homo sapiens
cttccatgtggaga

SEQ ID NO: 5724398 - DNA, 15 bp, Homo sapiens
cttccatgtggagaa

SEQ ID NO: 5724399 - DNA, 18 bp, Homo sapiens
cttccatgtggagaaagg

SEQ ID NO: 5724400 - DNA, 18 bp, Homo sapiens
cttccattaaattgcctt

SEQ ID NO: 5724401 - DNA, 23 bp, Homo sapiens
cttccattaaattgcctttgtaa

SEQ ID NO: 5724402 - DNA, 18 bp, Homo sapiens
cttccattaacaaatgct

SEQ ID NO: 5724403 - DNA, 14 bp, Homo sapiens
cttccattaatttt

SEQ ID NO: 5724404 - DNA, 16 bp, Homo sapiens
cttccattagaatgct

SEQ ID NO: 5724405 - DNA, 17 bp, Homo sapiens
cttccattccttcatgt

SEQ ID NO: 5724406 - DNA, 19 bp, Homo sapiens
cttccattctttcttcctc

SEQ ID NO: 5724407 - DNA, 22 bp, Homo sapiens
cttccattctttcttcctccag

SEQ ID NO: 5724408 - DNA, 23 bp, Homo sapiens
cttccattgcatgtattgtaaac

SEQ ID NO: 5724409 - DNA, 21 bp, Homo sapiens
cttccattggttcttcctttc

SEQ ID NO: 5724410 - DNA, 12 bp, Homo sapiens
cttccatttata

SEQ ID NO: 5724411 - DNA, 18 bp, Homo sapiens
cttccatttcttccacga

SEQ ID NO: 5724412 - DNA, 22 bp, Homo sapiens
cttccatttgtattcaaatttg

SEQ ID NO: 5724413 - DNA, 14 bp, Homo sapiens
cttcccaaacccag

SEQ ID NO: 5724414 - DNA, 20 bp, Homo sapiens
cttcccaaacccagtctcct

SEQ ID NO: 5724415 - DNA, 16 bp, Homo sapiens
cttcccaaactcccag

SEQ ID NO: 5724416 - DNA, 18 bp, Homo sapiens
cttcccaaaggactccac

SEQ ID NO: 5724417 - DNA, 21 bp, Homo sapiens
cttcccaaaggactccaccca

SEQ ID NO: 5724418 - DNA, 23 bp, Homo sapiens
cttcccaaagtcctgggattaca

SEQ ID NO: 5724419 - DNA, 21 bp, Homo sapiens
cttcccaaatcaaaataaaag

SEQ ID NO: 5724420 - DNA, 13 bp, Homo sapiens
cttcccaacaata

SEQ ID NO: 5724421 - DNA, 16 bp, Homo sapiens
cttcccaacagcctta

SEQ ID NO: 5724422 - DNA, 22 bp, Homo sapiens
cttcccaacctcccctggtcct

SEQ ID NO: 5724423 - DNA, 19 bp, Homo sapiens
cttcccaactcactgtgct

SEQ ID NO: 5724424 - DNA, 20 bp, Homo sapiens
cttcccaactcactgtgctc

SEQ ID NO: 5724425 - DNA, 21 bp, Homo sapiens
cttcccaactcactgtgctcc

SEQ ID NO: 5724426 - DNA, 15 bp, Homo sapiens
cttcccaacttccct

SEQ ID NO: 5724427 - DNA, 21 bp, Homo sapiens
cttcccaacttccctgttctt

SEQ ID NO: 5724428 - DNA, 19 bp, Homo sapiens
cttcccaaggtacagctgt

SEQ ID NO: 5724429 - DNA, 21 bp, Homo sapiens
cttcccaagtaagaggctgga

SEQ ID NO: 5724430 - DNA, 20 bp, Homo sapiens
cttcccaagtagctgcaaca

SEQ ID NO: 5724431 - DNA, 19 bp, Homo sapiens
cttcccaagtcctcgcccc

SEQ ID NO: 5724432 - DNA, 22 bp, Homo sapiens
cttcccaagtcctcgccccccg

SEQ ID NO: 5724433 - DNA, 19 bp, Homo sapiens
cttcccaataggtgatctt

SEQ ID NO: 5724434 - DNA, 19 bp, Homo sapiens
cttcccaatcttctttttc

SEQ ID NO: 5724435 - DNA, 21 bp, Homo sapiens
cttcccacaaaagacagaccc

SEQ ID NO: 5724436 - DNA, 22 bp, Homo sapiens
cttcccacacgattagctttat

SEQ ID NO: 5724437 - DNA, 18 bp, Homo sapiens
cttcccacacggcagccc

SEQ ID NO: 5724438 - DNA, 19 bp, Homo sapiens
cttcccacacggcagcccc

SEQ ID NO: 5724439 - DNA, 14 bp, Homo sapiens
cttcccacaggagg

SEQ ID NO: 5724440 - DNA, 22 bp, Homo sapiens
cttcccacaggagggccagcgc

SEQ ID NO: 5724441 - DNA, 13 bp, Homo sapiens
cttcccaccaact

SEQ ID NO: 5724442 - DNA, 21 bp, Homo sapiens
cttcccacccatcgctgtgtg

SEQ ID NO: 5724443 - DNA, 13 bp, Homo sapiens
cttcccaccccca

SEQ ID NO: 5724444 - DNA, 17 bp, Homo sapiens
cttcccacccccaggca

SEQ ID NO: 5724445 - DNA, 19 bp, Homo sapiens
cttcccacccctacacaca

SEQ ID NO: 5724446 - DNA, 21 bp, Homo sapiens
cttcccacctccctgcccagg

SEQ ID NO: 5724447 - DNA, 17 bp, Homo sapiens
cttcccacggccactgc

SEQ ID NO: 5724448 - DNA, 14 bp, Homo sapiens
cttcccactccagc

SEQ ID NO: 5724449 - DNA, 16 bp, Homo sapiens
cttcccactccagctg

SEQ ID NO: 5724450 - DNA, 14 bp, Homo sapiens
cttcccactggagg

SEQ ID NO: 5724451 - DNA, 12 bp, Homo sapiens
cttcccactggg

SEQ ID NO: 5724452 - DNA, 13 bp, Homo sapiens
cttcccactgggg

SEQ ID NO: 5724453 - DNA, 17 bp, Homo sapiens
cttcccagaatctctga

SEQ ID NO: 5724454 - DNA, 20 bp, Homo sapiens
cttcccagaatctctgagcc

SEQ ID NO: 5724455 - DNA, 18 bp, Homo sapiens
cttcccagaccaggaaag

SEQ ID NO: 5724456 - DNA, 21 bp, Homo sapiens
cttcccagaccccgcagcacg

SEQ ID NO: 5724457 - DNA, 21 bp, Homo sapiens
cttcccagagaacttcacaga

SEQ ID NO: 5724458 - DNA, 19 bp, Homo sapiens
cttcccagaggggcctgcc

SEQ ID NO: 5724459 - DNA, 22 bp, Homo sapiens
cttcccagatttagggtacttt

SEQ ID NO: 5724460 - DNA, 17 bp, Homo sapiens
cttcccagcagcagaat

SEQ ID NO: 5724461 - DNA, 17 bp, Homo sapiens
cttcccagccatgccca

SEQ ID NO: 5724462 - DNA, 21 bp, Homo sapiens
cttcccagccatgcccaggac

SEQ ID NO: 5724463 - DNA, 22 bp, Homo sapiens
cttcccagccatgcccaggacg

SEQ ID NO: 5724464 - DNA, 11 bp, Homo sapiens
cttcccagccc

SEQ ID NO: 5724465 - DNA, 22 bp, Homo sapiens
cttcccagcggttcctgtgcag

SEQ ID NO: 5724466 - DNA, 13 bp, Homo sapiens
cttcccagctcta

SEQ ID NO: 5724467 - DNA, 22 bp, Homo sapiens
cttcccagctctacattctgct

SEQ ID NO: 5724468 - DNA, 21 bp, Homo sapiens
cttcccagctctccctctggc

SEQ ID NO: 5724469 - DNA, 22 bp, Homo sapiens
cttcccagctctccctctggcc

SEQ ID NO: 5724470 - DNA, 12 bp, Homo sapiens
cttcccagctgc

SEQ ID NO: 5724471 - DNA, 21 bp, Homo sapiens
cttcccagctgcccctccctg

SEQ ID NO: 5724472 - DNA, 22 bp, Homo sapiens
cttcccagctgcccctccctgc

SEQ ID NO: 5724473 - DNA, 15 bp, Homo sapiens
cttcccagctgctcc

SEQ ID NO: 5724474 - DNA, 14 bp, Homo sapiens
cttcccagcttccc

SEQ ID NO: 5724475 - DNA, 18 bp, Homo sapiens
cttcccaggaccctgggt

SEQ ID NO: 5724476 - DNA, 14 bp, Homo sapiens
cttcccaggccagc

SEQ ID NO: 5724477 - DNA, 22 bp, Homo sapiens
cttcccaggcctttggagggga

SEQ ID NO: 5724478 - DNA, 13 bp, Homo sapiens
cttcccagggaga

SEQ ID NO: 5724479 - DNA, 21 bp, Homo sapiens
cttcccaggtaagcaggagga

SEQ ID NO: 5724480 - DNA, 19 bp, Homo sapiens
cttcccagtataagatttt

SEQ ID NO: 5724481 - DNA, 22 bp, Homo sapiens
cttcccagtataagatttttga

SEQ ID NO: 5724482 - DNA, 23 bp, Homo sapiens
cttcccagtataagatttttgaa

SEQ ID NO: 5724483 - DNA, 15 bp, Homo sapiens
cttcccagtgaatcc

SEQ ID NO: 5724484 - DNA, 21 bp, Homo sapiens
cttcccagtgaatccctggga

SEQ ID NO: 5724485 - DNA, 23 bp, Homo sapiens
cttcccagtgaatccctgggagc

SEQ ID NO: 5724486 - DNA, 14 bp, Homo sapiens
cttcccagtggctg

SEQ ID NO: 5724487 - DNA, 17 bp, Homo sapiens
cttcccagtggctgctg

SEQ ID NO: 5724488 - DNA, 14 bp, Homo sapiens
cttcccagtgggct

SEQ ID NO: 5724489 - DNA, 22 bp, Homo sapiens
cttcccataaaatgtaagaaaa

SEQ ID NO: 5724490 - DNA, 19 bp, Homo sapiens
cttcccataataaagcaat

SEQ ID NO: 5724491 - DNA, 19 bp, Homo sapiens
cttcccatacttgcataca

SEQ ID NO: 5724492 - DNA, 12 bp, Homo sapiens
cttcccatccta

SEQ ID NO: 5724493 - DNA, 19 bp, Homo sapiens
cttcccatcctaccctcgg

SEQ ID NO: 5724494 - DNA, 18 bp, Homo sapiens
cttcccatctccagggaa

SEQ ID NO: 5724495 - DNA, 20 bp, Homo sapiens
cttcccatctgaagagtgga

SEQ ID NO: 5724496 - DNA, 15 bp, Homo sapiens
cttcccatgacccag

SEQ ID NO: 5724497 - DNA, 17 bp, Homo sapiens
cttcccatgacccaggc

SEQ ID NO: 5724498 - DNA, 23 bp, Homo sapiens
cttcccatgacccaggctgggca

SEQ ID NO: 5724499 - DNA, 16 bp, Homo sapiens
cttcccatgactgcac

SEQ ID NO: 5724500 - DNA, 18 bp, Homo sapiens
cttcccatgactgcaccc

SEQ ID NO: 5724501 - DNA, 21 bp, Homo sapiens
cttcccatgactgcacccagc

SEQ ID NO: 5724502 - DNA, 17 bp, Homo sapiens
cttcccatgatgccgct

SEQ ID NO: 5724503 - DNA, 17 bp, Homo sapiens
cttcccatgtctttctc

SEQ ID NO: 5724504 - DNA, 21 bp, Homo sapiens
cttcccatgtctttctccaaa

SEQ ID NO: 5724505 - DNA, 22 bp, Homo sapiens
cttcccattaaaaatgagattt

SEQ ID NO: 5724506 - DNA, 13 bp, Homo sapiens
cttcccattctcc

SEQ ID NO: 5724507 - DNA, 23 bp, Homo sapiens
cttcccattctgccccagagtgg

SEQ ID NO: 5724508 - DNA, 24 bp, Homo sapiens
cttcccattgagtaatcatactca

SEQ ID NO: 5724509 - DNA, 12 bp, Homo sapiens
cttcccatttct

SEQ ID NO: 5724510 - DNA, 14 bp, Homo sapiens
cttcccatttcttc

SEQ ID NO: 5724511 - DNA, 17 bp, Homo sapiens
cttcccatttcttccca

SEQ ID NO: 5724512 - DNA, 14 bp, Homo sapiens
cttcccatttgtaa

SEQ ID NO: 5724513 - DNA, 21 bp, Homo sapiens
cttcccatttgtaatgtatct

SEQ ID NO: 5724514 - DNA, 16 bp, Homo sapiens
cttccccaaataatat

SEQ ID NO: 5724515 - DNA, 18 bp, Homo sapiens
cttccccaagatctgcca

SEQ ID NO: 5724516 - DNA, 19 bp, Homo sapiens
cttccccaagatctgccag

SEQ ID NO: 5724517 - DNA, 20 bp, Homo sapiens
cttccccaaggcactgagcg

SEQ ID NO: 5724518 - DNA, 22 bp, Homo sapiens
cttccccaaggcactgagcgcc

SEQ ID NO: 5724519 - DNA, 15 bp, Homo sapiens
cttccccaagggcca

SEQ ID NO: 5724520 - DNA, 13 bp, Homo sapiens
cttccccacagaa

SEQ ID NO: 5724521 - DNA, 16 bp, Homo sapiens
cttccccacagaactg

SEQ ID NO: 5724522 - DNA, 16 bp, Homo sapiens
cttccccaccaagtct

SEQ ID NO: 5724523 - DNA, 15 bp, Homo sapiens
cttccccaccccata

SEQ ID NO: 5724524 - DNA, 22 bp, Homo sapiens
cttccccactctgctcccagcc

SEQ ID NO: 5724525 - DNA, 20 bp, Homo sapiens
cttccccactgcctgcccac

SEQ ID NO: 5724526 - DNA, 20 bp, Homo sapiens
cttccccacttctgtgccac

SEQ ID NO: 5724527 - DNA, 22 bp, Homo sapiens
cttccccagacccagaggtcca

SEQ ID NO: 5724528 - DNA, 23 bp, Homo sapiens
cttccccagacccagaggtccag

SEQ ID NO: 5724529 - DNA, 18 bp, Homo sapiens
cttccccagacgcctggc

SEQ ID NO: 5724530 - DNA, 19 bp, Homo sapiens
cttccccagacttgcactg

SEQ ID NO: 5724531 - DNA, 20 bp, Homo sapiens
cttccccagacttgcactgg

SEQ ID NO: 5724532 - DNA, 13 bp, Homo sapiens
cttccccagagag

SEQ ID NO: 5724533 - DNA, 14 bp, Homo sapiens
cttccccagagagg

SEQ ID NO: 5724534 - DNA, 18 bp, Homo sapiens
cttccccagcccttagca

SEQ ID NO: 5724535 - DNA, 22 bp, Homo sapiens
cttccccagctcagagccccgc

SEQ ID NO: 5724536 - DNA, 18 bp, Homo sapiens
cttccccagctcccccag

SEQ ID NO: 5724537 - DNA, 20 bp, Homo sapiens
cttccccaggagctctctgc

SEQ ID NO: 5724538 - DNA, 22 bp, Homo sapiens
cttccccaggagctctctgctg

SEQ ID NO: 5724539 - DNA, 23 bp, Homo sapiens
cttccccaggagctctctgctga

SEQ ID NO: 5724540 - DNA, 12 bp, Homo sapiens
cttccccaggcc

SEQ ID NO: 5724541 - DNA, 17 bp, Homo sapiens
cttccccaggcccacca

SEQ ID NO: 5724542 - DNA, 19 bp, Homo sapiens
cttccccagggtgtctcta

SEQ ID NO: 5724543 - DNA, 11 bp, Homo sapiens
cttccccatac

SEQ ID NO: 5724544 - DNA, 16 bp, Homo sapiens
cttccccatacaaata

SEQ ID NO: 5724545 - DNA, 12 bp, Homo sapiens
cttccccatccc

SEQ ID NO: 5724546 - DNA, 13 bp, Homo sapiens
cttccccatcccg

SEQ ID NO: 5724547 - DNA, 19 bp, Homo sapiens
cttccccatcgccttctgg

SEQ ID NO: 5724548 - DNA, 14 bp, Homo sapiens
cttccccatctcca

SEQ ID NO: 5724549 - DNA, 19 bp, Homo sapiens
cttccccatctccatttca

SEQ ID NO: 5724550 - DNA, 15 bp, Homo sapiens
cttccccatctgtgt

SEQ ID NO: 5724551 - DNA, 19 bp, Homo sapiens
cttccccatgaaccctgcc

SEQ ID NO: 5724552 - DNA, 22 bp, Homo sapiens
cttccccatgaaccctgccctg

SEQ ID NO: 5724553 - DNA, 13 bp, Homo sapiens
cttccccatttcc

SEQ ID NO: 5724554 - DNA, 16 bp, Homo sapiens
cttcccccaccccaga

SEQ ID NO: 5724555 - DNA, 23 bp, Homo sapiens
cttcccccaccggtccagctggc

SEQ ID NO: 5724556 - DNA, 15 bp, Homo sapiens
cttcccccacttcac

SEQ ID NO: 5724557 - DNA, 22 bp, Homo sapiens
cttcccccagcacaaagcactg

SEQ ID NO: 5724558 - DNA, 23 bp, Homo sapiens
cttcccccagcacaaagcactgg

SEQ ID NO: 5724559 - DNA, 13 bp, Homo sapiens
cttcccccagccc

SEQ ID NO: 5724560 - DNA, 18 bp, Homo sapiens
cttcccccagcccaataa

SEQ ID NO: 5724561 - DNA, 17 bp, Homo sapiens
cttcccccagctttcca

SEQ ID NO: 5724562 - DNA, 23 bp, Homo sapiens
cttcccccagggtcccctgcatg

SEQ ID NO: 5724563 - DNA, 14 bp, Homo sapiens
cttcccccatagcc

SEQ ID NO: 5724564 - DNA, 16 bp, Homo sapiens
cttccccccatctctg

SEQ ID NO: 5724565 - DNA, 23 bp, Homo sapiens
cttcccccctcagcaaggggctg

SEQ ID NO: 5724566 - DNA, 13 bp, Homo sapiens
cttcccccctctc

SEQ ID NO: 5724567 - DNA, 16 bp, Homo sapiens
cttcccccctctcctc

SEQ ID NO: 5724568 - DNA, 21 bp, Homo sapiens
cttcccccctctcctcccagc

SEQ ID NO: 5724569 - DNA, 20 bp, Homo sapiens
cttcccccgattcagagact

SEQ ID NO: 5724570 - DNA, 23 bp, Homo sapiens
cttccccctccaacccacagcct

SEQ ID NO: 5724571 - DNA, 16 bp, Homo sapiens
cttccccctcccaggg

SEQ ID NO: 5724572 - DNA, 18 bp, Homo sapiens
cttccccctctcccagtt

SEQ ID NO: 5724573 - DNA, 20 bp, Homo sapiens
cttccccctcttcttctgaa

SEQ ID NO: 5724574 - DNA, 18 bp, Homo sapiens
cttccccctgtagactag

SEQ ID NO: 5724575 - DNA, 18 bp, Homo sapiens
cttccccctttctctgcc

SEQ ID NO: 5724576 - DNA, 16 bp, Homo sapiens
cttcccccttttttgt

SEQ ID NO: 5724577 - DNA, 18 bp, Homo sapiens
cttcccccttttttgtcc

SEQ ID NO: 5724578 - DNA, 18 bp, Homo sapiens
cttccccgcattccaggc

SEQ ID NO: 5724579 - DNA, 17 bp, Homo sapiens
cttccccgtcccctgca

SEQ ID NO: 5724580 - DNA, 12 bp, Homo sapiens
cttcccctaaac

SEQ ID NO: 5724581 - DNA, 11 bp, Homo sapiens
cttcccctcca

SEQ ID NO: 5724582 - DNA, 16 bp, Homo sapiens
cttcccctccaagacc

SEQ ID NO: 5724583 - DNA, 11 bp, Homo sapiens
cttcccctccc

SEQ ID NO: 5724584 - DNA, 21 bp, Homo sapiens
cttcccctcccccactcctct

SEQ ID NO: 5724585 - DNA, 13 bp, Homo sapiens
cttcccctcccct

SEQ ID NO: 5724586 - DNA, 17 bp, Homo sapiens
cttcccctcccctcctt

SEQ ID NO: 5724587 - DNA, 22 bp, Homo sapiens
cttcccctcccctccttgtcta

SEQ ID NO: 5724588 - DNA, 16 bp, Homo sapiens
cttcccctccctaccc

SEQ ID NO: 5724589 - DNA, 16 bp, Homo sapiens
cttcccctccctggct

SEQ ID NO: 5724590 - DNA, 19 bp, Homo sapiens
cttcccctcgctgtcctgc

SEQ ID NO: 5724591 - DNA, 23 bp, Homo sapiens
cttcccctcgctgtcctgctgtg

SEQ ID NO: 5724592 - DNA, 21 bp, Homo sapiens
cttcccctctaatgctcacgc

SEQ ID NO: 5724593 - DNA, 22 bp, Homo sapiens
cttcccctgagagtttcctcag

SEQ ID NO: 5724594 - DNA, 17 bp, Homo sapiens
cttcccctgcacctggc

SEQ ID NO: 5724595 - DNA, 20 bp, Homo sapiens
cttcccctgcacctggcctg

SEQ ID NO: 5724596 - DNA, 13 bp, Homo sapiens
cttcccctgcctc

SEQ ID NO: 5724597 - DNA, 20 bp, Homo sapiens
cttcccctgcgccctccctc

SEQ ID NO: 5724598 - DNA, 13 bp, Homo sapiens
cttcccctgctga

SEQ ID NO: 5724599 - DNA, 12 bp, Homo sapiens
cttcccctggga

SEQ ID NO: 5724600 - DNA, 17 bp, Homo sapiens
cttcccctgggatgctg

SEQ ID NO: 5724601 - DNA, 22 bp, Homo sapiens
cttcccctgggatgctgaccca

SEQ ID NO: 5724602 - DNA, 13 bp, Homo sapiens
cttcccctgggca

SEQ ID NO: 5724603 - DNA, 12 bp, Homo sapiens
cttcccctgtct

SEQ ID NO: 5724604 - DNA, 14 bp, Homo sapiens
cttcccctgtcttc

SEQ ID NO: 5724605 - DNA, 17 bp, Homo sapiens
cttccccttagaaacac

SEQ ID NO: 5724606 - DNA, 13 bp, Homo sapiens
cttccccttcaga

SEQ ID NO: 5724607 - DNA, 12 bp, Homo sapiens
cttccccttccc

SEQ ID NO: 5724608 - DNA, 13 bp, Homo sapiens
cttccccttcccc

SEQ ID NO: 5724609 - DNA, 12 bp, Homo sapiens
cttccccttcct

SEQ ID NO: 5724610 - DNA, 15 bp, Homo sapiens
cttccccttcctaag

SEQ ID NO: 5724611 - DNA, 14 bp, Homo sapiens
cttccccttcctct

SEQ ID NO: 5724612 - DNA, 14 bp, Homo sapiens
cttccccttcctgt

SEQ ID NO: 5724613 - DNA, 13 bp, Homo sapiens
cttccccttctgt

SEQ ID NO: 5724614 - DNA, 13 bp, Homo sapiens
cttccccttgcca

SEQ ID NO: 5724615 - DNA, 12 bp, Homo sapiens
cttccccttgtc

SEQ ID NO: 5724616 - DNA, 14 bp, Homo sapiens
cttccccttgtccc

SEQ ID NO: 5724617 - DNA, 16 bp, Homo sapiens
cttccccttgtccctg

SEQ ID NO: 5724618 - DNA, 20 bp, Homo sapiens
cttcccctttactcagccca

SEQ ID NO: 5724619 - DNA, 19 bp, Homo sapiens
cttcccctttcctggggga

SEQ ID NO: 5724620 - DNA, 18 bp, Homo sapiens
cttcccctttgtcctgcg

SEQ ID NO: 5724621 - DNA, 17 bp, Homo sapiens
cttcccgacccagccag

SEQ ID NO: 5724622 - DNA, 23 bp, Homo sapiens
cttcccgacccagccagctgcag

SEQ ID NO: 5724623 - DNA, 23 bp, Homo sapiens
cttcccgaggaactcgcctcagc

SEQ ID NO: 5724624 - DNA, 17 bp, Homo sapiens
cttcccgcagcaccagc

SEQ ID NO: 5724625 - DNA, 18 bp, Homo sapiens
cttcccgcagcaccagcc

SEQ ID NO: 5724626 - DNA, 21 bp, Homo sapiens
cttcccgcagcaccagcctga

SEQ ID NO: 5724627 - DNA, 19 bp, Homo sapiens
cttcccgccagagggcttg

SEQ ID NO: 5724628 - DNA, 23 bp, Homo sapiens
cttcccgccctccccctgccaga

SEQ ID NO: 5724629 - DNA, 16 bp, Homo sapiens
cttcccgcctcagcct

SEQ ID NO: 5724630 - DNA, 20 bp, Homo sapiens
cttcccgcctcagcctctca

SEQ ID NO: 5724631 - DNA, 13 bp, Homo sapiens
cttcccgcctcgg

SEQ ID NO: 5724632 - DNA, 15 bp, Homo sapiens
cttcccgctcagccc

SEQ ID NO: 5724633 - DNA, 17 bp, Homo sapiens
cttcccgctcagccctc

SEQ ID NO: 5724634 - DNA, 13 bp, Homo sapiens
cttcccgctcccc

SEQ ID NO: 5724635 - DNA, 20 bp, Homo sapiens
cttcccggcccccggccaag

SEQ ID NO: 5724636 - DNA, 23 bp, Homo sapiens
cttcccggcccccggccaaggac

SEQ ID NO: 5724637 - DNA, 20 bp, Homo sapiens
cttcccgggaacgcttgctc

SEQ ID NO: 5724638 - DNA, 22 bp, Homo sapiens
cttcccgggataaactgagcct

SEQ ID NO: 5724639 - DNA, 17 bp, Homo sapiens
cttcccgggccagggct

SEQ ID NO: 5724640 - DNA, 18 bp, Homo sapiens
cttcccgggccagggctg

SEQ ID NO: 5724641 - DNA, 19 bp, Homo sapiens
cttcccgggccagggctgc

SEQ ID NO: 5724642 - DNA, 18 bp, Homo sapiens
cttcccggtccgcccgct

SEQ ID NO: 5724643 - DNA, 22 bp, Homo sapiens
cttcccggtccgcccgcttccc

SEQ ID NO: 5724644 - DNA, 19 bp, Homo sapiens
cttcccggttgtgagagcc

SEQ ID NO: 5724645 - DNA, 15 bp, Homo sapiens
cttcccgtcccatat

SEQ ID NO: 5724646 - DNA, 15 bp, Homo sapiens
cttcccgtctcagaa

SEQ ID NO: 5724647 - DNA, 19 bp, Homo sapiens
cttcccgtgtgtatttcta

SEQ ID NO: 5724648 - DNA, 20 bp, Homo sapiens
cttcccgtgtgtatttctaa

SEQ ID NO: 5724649 - DNA, 16 bp, Homo sapiens
cttccctaaaatcagg

SEQ ID NO: 5724650 - DNA, 17 bp, Homo sapiens
cttccctacccagtccc

SEQ ID NO: 5724651 - DNA, 20 bp, Homo sapiens
cttccctacccttcctgcca

SEQ ID NO: 5724652 - DNA, 13 bp, Homo sapiens
cttccctacctca

SEQ ID NO: 5724653 - DNA, 20 bp, Homo sapiens
cttccctagaagtcttcatg

SEQ ID NO: 5724654 - DNA, 23 bp, Homo sapiens
cttccctagagggttcctgtaga

SEQ ID NO: 5724655 - DNA, 22 bp, Homo sapiens
cttccctagatggttccctttg

SEQ ID NO: 5724656 - DNA, 16 bp, Homo sapiens
cttccctaggctgagc

SEQ ID NO: 5724657 - DNA, 17 bp, Homo sapiens
cttccctagggctgggt

SEQ ID NO: 5724658 - DNA, 14 bp, Homo sapiens
cttccctagttctt

SEQ ID NO: 5724659 - DNA, 17 bp, Homo sapiens
cttccctatctttgcca

SEQ ID NO: 5724660 - DNA, 18 bp, Homo sapiens
cttccctatctttgccac

SEQ ID NO: 5724661 - DNA, 16 bp, Homo sapiens
cttccctcacccccag

SEQ ID NO: 5724662 - DNA, 18 bp, Homo sapiens
cttccctcactcttcctc

SEQ ID NO: 5724663 - DNA, 18 bp, Homo sapiens
cttccctccccctagtcc

SEQ ID NO: 5724664 - DNA, 19 bp, Homo sapiens
cttccctcccctctagttt

SEQ ID NO: 5724665 - DNA, 15 bp, Homo sapiens
cttccctccctatct

SEQ ID NO: 5724666 - DNA, 15 bp, Homo sapiens
cttccctccctgagg

SEQ ID NO: 5724667 - DNA, 10 bp, Homo sapiens
cttccctcct

SEQ ID NO: 5724668 - DNA, 13 bp, Homo sapiens
cttccctcctccc

SEQ ID NO: 5724669 - DNA, 19 bp, Homo sapiens
cttccctcctcccatgtca

SEQ ID NO: 5724670 - DNA, 12 bp, Homo sapiens
cttccctcctgt

SEQ ID NO: 5724671 - DNA, 16 bp, Homo sapiens
cttccctccttttaaa

SEQ ID NO: 5724672 - DNA, 17 bp, Homo sapiens
cttccctccttttaaaa

SEQ ID NO: 5724673 - DNA, 18 bp, Homo sapiens
cttccctctcgctcccct

SEQ ID NO: 5724674 - DNA, 16 bp, Homo sapiens
cttccctctctccctg

SEQ ID NO: 5724675 - DNA, 17 bp, Homo sapiens
cttccctctctccctgc

SEQ ID NO: 5724676 - DNA, 19 bp, Homo sapiens
cttccctctctccctgcct

SEQ ID NO: 5724677 - DNA, 20 bp, Homo sapiens
cttccctctctccctgcctc

SEQ ID NO: 5724678 - DNA, 15 bp, Homo sapiens
cttccctctctgatg

SEQ ID NO: 5724679 - DNA, 11 bp, Homo sapiens
cttccctctgc

SEQ ID NO: 5724680 - DNA, 22 bp, Homo sapiens
cttccctctgcattgacctgga

SEQ ID NO: 5724681 - DNA, 18 bp, Homo sapiens
cttccctctgcctgtccc

SEQ ID NO: 5724682 - DNA, 18 bp, Homo sapiens
cttccctctgctccacag

SEQ ID NO: 5724683 - DNA, 17 bp, Homo sapiens
cttccctctgtttctct

SEQ ID NO: 5724684 - DNA, 13 bp, Homo sapiens
cttccctcttccc

SEQ ID NO: 5724685 - DNA, 22 bp, Homo sapiens
cttccctcttccttccctgctg

SEQ ID NO: 5724686 - DNA, 22 bp, Homo sapiens
cttccctgaacgttttcttctt

SEQ ID NO: 5724687 - DNA, 17 bp, Homo sapiens
cttccctgacttgcttt

SEQ ID NO: 5724688 - DNA, 22 bp, Homo sapiens
cttccctgattgacctgctccg

SEQ ID NO: 5724689 - DNA, 21 bp, Homo sapiens
cttccctgcaaggtgcacctg

SEQ ID NO: 5724690 - DNA, 13 bp, Homo sapiens
cttccctgccact

SEQ ID NO: 5724691 - DNA, 22 bp, Homo sapiens
cttccctgcccaatcctccctg

SEQ ID NO: 5724692 - DNA, 22 bp, Homo sapiens
cttccctgcccctgtgcctctg

SEQ ID NO: 5724693 - DNA, 13 bp, Homo sapiens
cttccctgcctgt

SEQ ID NO: 5724694 - DNA, 14 bp, Homo sapiens
cttccctgcctgtg

SEQ ID NO: 5724695 - DNA, 16 bp, Homo sapiens
cttccctgctcccacc

SEQ ID NO: 5724696 - DNA, 11 bp, Homo sapiens
cttccctgctt

SEQ ID NO: 5724697 - DNA, 12 bp, Homo sapiens
cttccctgcttc

SEQ ID NO: 5724698 - DNA, 13 bp, Homo sapiens
cttccctgcttca

SEQ ID NO: 5724699 - DNA, 13 bp, Homo sapiens
cttccctgctttt

SEQ ID NO: 5724700 - DNA, 20 bp, Homo sapiens
cttccctgcttttctcccag

SEQ ID NO: 5724701 - DNA, 23 bp, Homo sapiens
cttccctggaagctctccgagct

SEQ ID NO: 5724702 - DNA, 13 bp, Homo sapiens
cttccctggcagg

SEQ ID NO: 5724703 - DNA, 12 bp, Homo sapiens
cttccctggcat

SEQ ID NO: 5724704 - DNA, 12 bp, Homo sapiens
cttccctggcct

SEQ ID NO: 5724705 - DNA, 21 bp, Homo sapiens
cttccctggcggccccaactc

SEQ ID NO: 5724706 - DNA, 11 bp, Homo sapiens
cttccctggct

SEQ ID NO: 5724707 - DNA, 18 bp, Homo sapiens
cttccctggctacttccc

SEQ ID NO: 5724708 - DNA, 19 bp, Homo sapiens
cttccctggctacttccct

SEQ ID NO: 5724709 - DNA, 23 bp, Homo sapiens
cttccctggctacttcccttcct

SEQ ID NO: 5724710 - DNA, 20 bp, Homo sapiens
cttccctgggaactcatcct

SEQ ID NO: 5724711 - DNA, 22 bp, Homo sapiens
cttccctgggaactcatcctgt

SEQ ID NO: 5724712 - DNA, 15 bp, Homo sapiens
cttccctgggaaggc

SEQ ID NO: 5724713 - DNA, 14 bp, Homo sapiens
cttccctgggcctc

SEQ ID NO: 5724714 - DNA, 15 bp, Homo sapiens
cttccctgggcctca

SEQ ID NO: 5724715 - DNA, 21 bp, Homo sapiens
cttccctgggcctcagcctcc

SEQ ID NO: 5724716 - DNA, 18 bp, Homo sapiens
cttccctgggctgccacc

SEQ ID NO: 5724717 - DNA, 18 bp, Homo sapiens
cttccctgggctgtgcta

SEQ ID NO: 5724718 - DNA, 11 bp, Homo sapiens
cttccctgggg

SEQ ID NO: 5724719 - DNA, 21 bp, Homo sapiens
cttccctggggagccctcagg

SEQ ID NO: 5724720 - DNA, 13 bp, Homo sapiens
cttccctggggcc

SEQ ID NO: 5724721 - DNA, 15 bp, Homo sapiens
cttccctggggcccc

SEQ ID NO: 5724722 - DNA, 17 bp, Homo sapiens
cttccctgggggtccca

SEQ ID NO: 5724723 - DNA, 19 bp, Homo sapiens
cttccctgggggtcccagg

SEQ ID NO: 5724724 - DNA, 12 bp, Homo sapiens
cttccctgggtt

SEQ ID NO: 5724725 - DNA, 19 bp, Homo sapiens
cttccctgggtttgggagc

SEQ ID NO: 5724726 - DNA, 22 bp, Homo sapiens
cttccctgggtttgggagccag

SEQ ID NO: 5724727 - DNA, 14 bp, Homo sapiens
cttccctggtcacc

SEQ ID NO: 5724728 - DNA, 15 bp, Homo sapiens
cttccctggtcacca

SEQ ID NO: 5724729 - DNA, 22 bp, Homo sapiens
cttccctggtccccccaaatct

SEQ ID NO: 5724730 - DNA, 13 bp, Homo sapiens
cttccctgtccag

SEQ ID NO: 5724731 - DNA, 12 bp, Homo sapiens
cttccctgtccc

SEQ ID NO: 5724732 - DNA, 15 bp, Homo sapiens
cttccctgtgcctcc

SEQ ID NO: 5724733 - DNA, 15 bp, Homo sapiens
cttccctgtgtcttt

SEQ ID NO: 5724734 - DNA, 12 bp, Homo sapiens
cttccctgttct

SEQ ID NO: 5724735 - DNA, 20 bp, Homo sapiens
cttcccttaaaatttatatg

SEQ ID NO: 5724736 - DNA, 15 bp, Homo sapiens
cttcccttaactcca

SEQ ID NO: 5724737 - DNA, 16 bp, Homo sapiens
cttcccttagcctctc

SEQ ID NO: 5724738 - DNA, 20 bp, Homo sapiens
cttcccttagcctctcccac

SEQ ID NO: 5724739 - DNA, 21 bp, Homo sapiens
cttcccttagcctctcccacc

SEQ ID NO: 5724740 - DNA, 19 bp, Homo sapiens
cttcccttatttttattta

SEQ ID NO: 5724741 - DNA, 20 bp, Homo sapiens
cttcccttccactgcctctg

SEQ ID NO: 5724742 - DNA, 12 bp, Homo sapiens
cttcccttccca

SEQ ID NO: 5724743 - DNA, 17 bp, Homo sapiens
cttcccttcccttccct

SEQ ID NO: 5724744 - DNA, 14 bp, Homo sapiens
cttcccttcctcag

SEQ ID NO: 5724745 - DNA, 16 bp, Homo sapiens
cttcccttcctcagca

SEQ ID NO: 5724746 - DNA, 14 bp, Homo sapiens
cttcccttcctccc

SEQ ID NO: 5724747 - DNA, 16 bp, Homo sapiens
cttcccttctccccag

SEQ ID NO: 5724748 - DNA, 12 bp, Homo sapiens
cttcccttctct

SEQ ID NO: 5724749 - DNA, 14 bp, Homo sapiens
cttcccttctctcc

SEQ ID NO: 5724750 - DNA, 12 bp, Homo sapiens
cttcccttcttt

SEQ ID NO: 5724751 - DNA, 17 bp, Homo sapiens
cttcccttgctcatgag

SEQ ID NO: 5724752 - DNA, 21 bp, Homo sapiens
cttcccttgctcatgagctcc

SEQ ID NO: 5724753 - DNA, 21 bp, Homo sapiens
cttccctttcatatgagggga

SEQ ID NO: 5724754 - DNA, 16 bp, Homo sapiens
cttccctttccccagc

SEQ ID NO: 5724755 - DNA, 20 bp, Homo sapiens
cttccctttcctgagtccca

SEQ ID NO: 5724756 - DNA, 17 bp, Homo sapiens
cttccctttccttcccc

SEQ ID NO: 5724757 - DNA, 19 bp, Homo sapiens
cttccctttccttccccct

SEQ ID NO: 5724758 - DNA, 18 bp, Homo sapiens
cttcccttttaagcaagg

SEQ ID NO: 5724759 - DNA, 16 bp, Homo sapiens
cttcccttttctgttc

SEQ ID NO: 5724760 - DNA, 19 bp, Homo sapiens
cttcccttttttttctggg

SEQ ID NO: 5724761 - DNA, 17 bp, Homo sapiens
cttccgacaccactggg

SEQ ID NO: 5724762 - DNA, 19 bp, Homo sapiens
cttccgacaccactgggaa

SEQ ID NO: 5724763 - DNA, 13 bp, Homo sapiens
cttccgacatccc

SEQ ID NO: 5724764 - DNA, 13 bp, Homo sapiens
cttccgaccctct

SEQ ID NO: 5724765 - DNA, 21 bp, Homo sapiens
cttccgaccctctgggaacct

SEQ ID NO: 5724766 - DNA, 23 bp, Homo sapiens
cttccgaccctctgggaacctcc

SEQ ID NO: 5724767 - DNA, 13 bp, Homo sapiens
cttccgatgacag

SEQ ID NO: 5724768 - DNA, 17 bp, Homo sapiens
cttccgatgacagtgct

SEQ ID NO: 5724769 - DNA, 19 bp, Homo sapiens
cttccgatgacagtgctct

SEQ ID NO: 5724770 - DNA, 18 bp, Homo sapiens
cttccgatgtttgtgtca

SEQ ID NO: 5724771 - DNA, 20 bp, Homo sapiens
cttccgatgtttgtgtcaca

SEQ ID NO: 5724772 - DNA, 19 bp, Homo sapiens
cttccgcagcccctttccc

SEQ ID NO: 5724773 - DNA, 19 bp, Homo sapiens
cttccgccaatctggccct

SEQ ID NO: 5724774 - DNA, 14 bp, Homo sapiens
cttccgccactggg

SEQ ID NO: 5724775 - DNA, 16 bp, Homo sapiens
cttccgccactggggc

SEQ ID NO: 5724776 - DNA, 17 bp, Homo sapiens
cttccgccactggggct

SEQ ID NO: 5724777 - DNA, 14 bp, Homo sapiens
cttccgctccctgg

SEQ ID NO: 5724778 - DNA, 15 bp, Homo sapiens
cttccgctccctgga

SEQ ID NO: 5724779 - DNA, 17 bp, Homo sapiens
cttccgctcctttacct

SEQ ID NO: 5724780 - DNA, 21 bp, Homo sapiens
cttccgctttgaaagaagcaa

SEQ ID NO: 5724781 - DNA, 18 bp, Homo sapiens
cttccggctcctgtgctt

SEQ ID NO: 5724782 - DNA, 22 bp, Homo sapiens
cttccggctgagctgtgccagc

SEQ ID NO: 5724783 - DNA, 15 bp, Homo sapiens
cttccgggagctggt

SEQ ID NO: 5724784 - DNA, 20 bp, Homo sapiens
cttccgggtctcgcagcctg

SEQ ID NO: 5724785 - DNA, 14 bp, Homo sapiens
cttccgtccatccc

SEQ ID NO: 5724786 - DNA, 14 bp, Homo sapiens
cttccgtctccccc

SEQ ID NO: 5724787 - DNA, 16 bp, Homo sapiens
cttccgtctcccccgt

SEQ ID NO: 5724788 - DNA, 21 bp, Homo sapiens
cttccgtggtcagagtgccac

SEQ ID NO: 5724789 - DNA, 23 bp, Homo sapiens
cttccgtggtcagagtgccactg

SEQ ID NO: 5724790 - DNA, 15 bp, Homo sapiens
cttccgtgtcctctc

SEQ ID NO: 5724791 - DNA, 16 bp, Homo sapiens
cttccgtgtcctctcc

SEQ ID NO: 5724792 - DNA, 15 bp, Homo sapiens
cttccgttcattgct

SEQ ID NO: 5724793 - DNA, 18 bp, Homo sapiens
cttccgttgctgccatcg

SEQ ID NO: 5724794 - DNA, 17 bp, Homo sapiens
cttcctaaacccaatga

SEQ ID NO: 5724795 - DNA, 19 bp, Homo sapiens
cttcctaaatattatgaga

SEQ ID NO: 5724796 - DNA, 21 bp, Homo sapiens
cttcctaaattttcctgtcct

SEQ ID NO: 5724797 - DNA, 13 bp, Homo sapiens
cttcctaacttat

SEQ ID NO: 5724798 - DNA, 18 bp, Homo sapiens
cttcctaagcctgtggct

SEQ ID NO: 5724799 - DNA, 20 bp, Homo sapiens
cttcctaagttcccttctat

SEQ ID NO: 5724800 - DNA, 17 bp, Homo sapiens
cttcctaattccacagc

SEQ ID NO: 5724801 - DNA, 21 bp, Homo sapiens
cttcctaatttcccttcttgc

SEQ ID NO: 5724802 - DNA, 22 bp, Homo sapiens
cttcctacaagagcagcctgtg

SEQ ID NO: 5724803 - DNA, 17 bp, Homo sapiens
cttcctaccaagtcaaa

SEQ ID NO: 5724804 - DNA, 19 bp, Homo sapiens
cttcctaccaagtcaaact

SEQ ID NO: 5724805 - DNA, 22 bp, Homo sapiens
cttcctaccacccggtccccac

SEQ ID NO: 5724806 - DNA, 23 bp, Homo sapiens
cttcctaccacccggtccccact

SEQ ID NO: 5724807 - DNA, 16 bp, Homo sapiens
cttcctacccacacct

SEQ ID NO: 5724808 - DNA, 19 bp, Homo sapiens
cttcctacccacacctctg

SEQ ID NO: 5724809 - DNA, 18 bp, Homo sapiens
cttcctaccctccttcca

SEQ ID NO: 5724810 - DNA, 17 bp, Homo sapiens
cttcctaccctgcctcc

SEQ ID NO: 5724811 - DNA, 15 bp, Homo sapiens
cttcctacctatccc

SEQ ID NO: 5724812 - DNA, 18 bp, Homo sapiens
cttcctactcttctctct

SEQ ID NO: 5724813 - DNA, 19 bp, Homo sapiens
cttcctactcttctctctg

SEQ ID NO: 5724814 - DNA, 18 bp, Homo sapiens
cttcctagaaagttctgt

SEQ ID NO: 5724815 - DNA, 18 bp, Homo sapiens
cttcctagaagcccctgt

SEQ ID NO: 5724816 - DNA, 20 bp, Homo sapiens
cttcctagaagcccctgtcg

SEQ ID NO: 5724817 - DNA, 21 bp, Homo sapiens
cttcctagaagttactgaatg

SEQ ID NO: 5724818 - DNA, 18 bp, Homo sapiens
cttcctagagcatctgtc

SEQ ID NO: 5724819 - DNA, 14 bp, Homo sapiens
cttcctagccttgc

SEQ ID NO: 5724820 - DNA, 17 bp, Homo sapiens
cttcctagcttatctcc

SEQ ID NO: 5724821 - DNA, 14 bp, Homo sapiens
cttcctagggatct

SEQ ID NO: 5724822 - DNA, 17 bp, Homo sapiens
cttcctagggatctgaa

SEQ ID NO: 5724823 - DNA, 19 bp, Homo sapiens
cttcctagggatctgaaat

SEQ ID NO: 5724824 - DNA, 24 bp, Homo sapiens
cttcctagttcatcccttctcttc

SEQ ID NO: 5724825 - DNA, 15 bp, Homo sapiens
cttcctagttttctc

SEQ ID NO: 5724826 - DNA, 23 bp, Homo sapiens
cttcctagttttctcctcccagg

SEQ ID NO: 5724827 - DNA, 15 bp, Homo sapiens
cttcctataacttga

SEQ ID NO: 5724828 - DNA, 19 bp, Homo sapiens
cttcctataacttgatgca

SEQ ID NO: 5724829 - DNA, 20 bp, Homo sapiens
cttcctataacttgatgcat

SEQ ID NO: 5724830 - DNA, 12 bp, Homo sapiens
cttcctataata

SEQ ID NO: 5724831 - DNA, 18 bp, Homo sapiens
cttcctataattttgata

SEQ ID NO: 5724832 - DNA, 20 bp, Homo sapiens
cttcctataattttgatagt

SEQ ID NO: 5724833 - DNA, 21 bp, Homo sapiens
cttcctataattttgatagtg

SEQ ID NO: 5724834 - DNA, 19 bp, Homo sapiens
cttcctataccggagctcc

SEQ ID NO: 5724835 - DNA, 20 bp, Homo sapiens
cttcctataccggagctcca

SEQ ID NO: 5724836 - DNA, 22 bp, Homo sapiens
cttcctataccggagctccagt

SEQ ID NO: 5724837 - DNA, 14 bp, Homo sapiens
cttcctatcccatc

SEQ ID NO: 5724838 - DNA, 17 bp, Homo sapiens
cttcctattctcctgcc

SEQ ID NO: 5724839 - DNA, 22 bp, Homo sapiens
cttcctattctcctgccatggg

SEQ ID NO: 5724840 - DNA, 16 bp, Homo sapiens
cttcctatttctaggg

SEQ ID NO: 5724841 - DNA, 23 bp, Homo sapiens
cttcctatttctagggctgggaa

SEQ ID NO: 5724842 - DNA, 18 bp, Homo sapiens
cttcctcaaatacatgca

SEQ ID NO: 5724843 - DNA, 20 bp, Homo sapiens
cttcctcaaatacatgcaca

SEQ ID NO: 5724844 - DNA, 18 bp, Homo sapiens
cttcctcaagtcttgaca

SEQ ID NO: 5724845 - DNA, 15 bp, Homo sapiens
cttcctcaatgcatt

SEQ ID NO: 5724846 - DNA, 15 bp, Homo sapiens
cttcctcacacccct

SEQ ID NO: 5724847 - DNA, 17 bp, Homo sapiens
cttcctcacacccctgt

SEQ ID NO: 5724848 - DNA, 18 bp, Homo sapiens
cttcctcacacccctgtc

SEQ ID NO: 5724849 - DNA, 17 bp, Homo sapiens
cttcctcacactgctgt

SEQ ID NO: 5724850 - DNA, 19 bp, Homo sapiens
cttcctcacactgctgtcc

SEQ ID NO: 5724851 - DNA, 21 bp, Homo sapiens
cttcctcacactgctgtcctc

SEQ ID NO: 5724852 - DNA, 23 bp, Homo sapiens
cttcctcacactgctgtcctctc

SEQ ID NO: 5724853 - DNA, 22 bp, Homo sapiens
cttcctcactatgacactgagc

SEQ ID NO: 5724854 - DNA, 16 bp, Homo sapiens
cttcctcactgcccaa

SEQ ID NO: 5724855 - DNA, 13 bp, Homo sapiens
cttcctcacttcc

SEQ ID NO: 5724856 - DNA, 15 bp, Homo sapiens
cttcctcagcaggcc

SEQ ID NO: 5724857 - DNA, 17 bp, Homo sapiens
cttcctcagcaggccaa

SEQ ID NO: 5724858 - DNA, 15 bp, Homo sapiens
cttcctcagccagcc

SEQ ID NO: 5724859 - DNA, 16 bp, Homo sapiens
cttcctcagccagcct

SEQ ID NO: 5724860 - DNA, 18 bp, Homo sapiens
cttcctcagcctccaaag

SEQ ID NO: 5724861 - DNA, 14 bp, Homo sapiens
cttcctcagcctgg

SEQ ID NO: 5724862 - DNA, 16 bp, Homo sapiens
cttcctcagcctgggg

SEQ ID NO: 5724863 - DNA, 17 bp, Homo sapiens
cttcctcagcctggggt

SEQ ID NO: 5724864 - DNA, 14 bp, Homo sapiens
cttcctcagctcag

SEQ ID NO: 5724865 - DNA, 20 bp, Homo sapiens
cttcctcagctgcctcctgc

SEQ ID NO: 5724866 - DNA, 23 bp, Homo sapiens
cttcctcagctggttactcaggg

SEQ ID NO: 5724867 - DNA, 15 bp, Homo sapiens
cttcctcagggccca

SEQ ID NO: 5724868 - DNA, 16 bp, Homo sapiens
cttcctcagggcccag

SEQ ID NO: 5724869 - DNA, 16 bp, Homo sapiens
cttcctcagggcccct

SEQ ID NO: 5724870 - DNA, 18 bp, Homo sapiens
cttcctcagtttaatcct

SEQ ID NO: 5724871 - DNA, 19 bp, Homo sapiens
cttcctcatctccatgctc

SEQ ID NO: 5724872 - DNA, 20 bp, Homo sapiens
cttcctcatctccatgctct

SEQ ID NO: 5724873 - DNA, 18 bp, Homo sapiens
cttcctcatctgtgcctg

SEQ ID NO: 5724874 - DNA, 19 bp, Homo sapiens
cttcctcatctgtgcctgt

SEQ ID NO: 5724875 - DNA, 23 bp, Homo sapiens
cttcctcattccctcgtctttcc

SEQ ID NO: 5724876 - DNA, 16 bp, Homo sapiens
cttcctccaaagcctg

SEQ ID NO: 5724877 - DNA, 18 bp, Homo sapiens
cttcctccaatccccact

SEQ ID NO: 5724878 - DNA, 12 bp, Homo sapiens
cttcctccacag

SEQ ID NO: 5724879 - DNA, 14 bp, Homo sapiens
cttcctccacagtc

SEQ ID NO: 5724880 - DNA, 21 bp, Homo sapiens
cttcctccacatcctttctaa

SEQ ID NO: 5724881 - DNA, 12 bp, Homo sapiens
cttcctccactg

SEQ ID NO: 5724882 - DNA, 16 bp, Homo sapiens
cttcctccacttcatt

SEQ ID NO: 5724883 - DNA, 13 bp, Homo sapiens
cttcctccagagg

SEQ ID NO: 5724884 - DNA, 22 bp, Homo sapiens
cttcctccagctgcaccagagc

SEQ ID NO: 5724885 - DNA, 18 bp, Homo sapiens
cttcctccagtctgttct

SEQ ID NO: 5724886 - DNA, 20 bp, Homo sapiens
cttcctccagtctgttctca

SEQ ID NO: 5724887 - DNA, 17 bp, Homo sapiens
cttcctccatcctcctc

SEQ ID NO: 5724888 - DNA, 23 bp, Homo sapiens
cttcctcccaagtggtgcctaaa

SEQ ID NO: 5724889 - DNA, 19 bp, Homo sapiens
cttcctccccacactccac

SEQ ID NO: 5724890 - DNA, 15 bp, Homo sapiens
cttcctcccctctca

SEQ ID NO: 5724891 - DNA, 16 bp, Homo sapiens
cttcctcccggggcct

SEQ ID NO: 5724892 - DNA, 21 bp, Homo sapiens
cttcctcccggggccttcctt

SEQ ID NO: 5724893 - DNA, 13 bp, Homo sapiens
cttcctccctcat

SEQ ID NO: 5724894 - DNA, 15 bp, Homo sapiens
cttcctccctcattc

SEQ ID NO: 5724895 - DNA, 17 bp, Homo sapiens
cttcctccctccctgca

SEQ ID NO: 5724896 - DNA, 20 bp, Homo sapiens
cttcctccctccctgcaggg

SEQ ID NO: 5724897 - DNA, 14 bp, Homo sapiens
cttcctccctgggg

SEQ ID NO: 5724898 - DNA, 20 bp, Homo sapiens
cttcctccgaggccagtacc

SEQ ID NO: 5724899 - DNA, 21 bp, Homo sapiens
cttcctccgaggccagtacct

SEQ ID NO: 5724900 - DNA, 21 bp, Homo sapiens
cttcctccgctcccctttccc

SEQ ID NO: 5724901 - DNA, 18 bp, Homo sapiens
cttcctccggctggacct

SEQ ID NO: 5724902 - DNA, 13 bp, Homo sapiens
cttcctccgtcca

SEQ ID NO: 5724903 - DNA, 21 bp, Homo sapiens
cttcctccgtccacccaggct

SEQ ID NO: 5724904 - DNA, 18 bp, Homo sapiens
cttcctccgtctgcaatg

SEQ ID NO: 5724905 - DNA, 12 bp, Homo sapiens
cttcctcctacc

SEQ ID NO: 5724906 - DNA, 20 bp, Homo sapiens
cttcctcctaccacccagcc

SEQ ID NO: 5724907 - DNA, 16 bp, Homo sapiens
cttcctcctacctggg

SEQ ID NO: 5724908 - DNA, 15 bp, Homo sapiens
cttcctcctcatcct

SEQ ID NO: 5724909 - DNA, 22 bp, Homo sapiens
cttcctcctcatcctccctgac

SEQ ID NO: 5724910 - DNA, 13 bp, Homo sapiens
cttcctcctccac

SEQ ID NO: 5724911 - DNA, 15 bp, Homo sapiens
cttcctcctccacag

SEQ ID NO: 5724912 - DNA, 16 bp, Homo sapiens
cttcctcctccacagt

SEQ ID NO: 5724913 - DNA, 23 bp, Homo sapiens
cttcctcctccacagtgctgctt

SEQ ID NO: 5724914 - DNA, 15 bp, Homo sapiens
cttcctcctccatca

SEQ ID NO: 5724915 - DNA, 18 bp, Homo sapiens
cttcctcctccatcacct

SEQ ID NO: 5724916 - DNA, 22 bp, Homo sapiens
cttcctcctccatcacctgaaa

SEQ ID NO: 5724917 - DNA, 16 bp, Homo sapiens
cttcctcctccccact

SEQ ID NO: 5724918 - DNA, 15 bp, Homo sapiens
cttcctcctcccctg

SEQ ID NO: 5724919 - DNA, 15 bp, Homo sapiens
cttcctcctcctcct

SEQ ID NO: 5724920 - DNA, 15 bp, Homo sapiens
cttcctcctcctttg

SEQ ID NO: 5724921 - DNA, 16 bp, Homo sapiens
cttcctcctcctttgc

SEQ ID NO: 5724922 - DNA, 14 bp, Homo sapiens
cttcctcctctcct

SEQ ID NO: 5724923 - DNA, 15 bp, Homo sapiens
cttcctcctgaagcc

SEQ ID NO: 5724924 - DNA, 15 bp, Homo sapiens
cttcctcctgacacc

SEQ ID NO: 5724925 - DNA, 13 bp, Homo sapiens
cttcctcctgatg

SEQ ID NO: 5724926 - DNA, 22 bp, Homo sapiens
cttcctcctgcagacacctgga

SEQ ID NO: 5724927 - DNA, 12 bp, Homo sapiens
cttcctcctggg

SEQ ID NO: 5724928 - DNA, 13 bp, Homo sapiens
cttcctcctggtg

SEQ ID NO: 5724929 - DNA, 20 bp, Homo sapiens
cttcctcgcacagggcatgc

SEQ ID NO: 5724930 - DNA, 16 bp, Homo sapiens
cttcctcgcagagagg

SEQ ID NO: 5724931 - DNA, 18 bp, Homo sapiens
cttcctcgcagagaggcc

SEQ ID NO: 5724932 - DNA, 19 bp, Homo sapiens
cttcctcgcagagaggcca

SEQ ID NO: 5724933 - DNA, 18 bp, Homo sapiens
cttcctcggtggctctgg

SEQ ID NO: 5724934 - DNA, 21 bp, Homo sapiens
cttcctcggtggctctggggt

SEQ ID NO: 5724935 - DNA, 15 bp, Homo sapiens
cttcctcgtgcagag

SEQ ID NO: 5724936 - DNA, 16 bp, Homo sapiens
cttcctcgtgcagagc

SEQ ID NO: 5724937 - DNA, 17 bp, Homo sapiens
cttcctcgtgcagagct

SEQ ID NO: 5724938 - DNA, 18 bp, Homo sapiens
cttcctcgtgggtcccag

SEQ ID NO: 5724939 - DNA, 19 bp, Homo sapiens
cttcctcgtgggtcccaga

SEQ ID NO: 5724940 - DNA, 20 bp, Homo sapiens
cttcctcgtgggtcccagag

SEQ ID NO: 5724941 - DNA, 15 bp, Homo sapiens
cttcctcgttgggcc

SEQ ID NO: 5724942 - DNA, 15 bp, Homo sapiens
cttcctctaacattt

SEQ ID NO: 5724943 - DNA, 17 bp, Homo sapiens
cttcctctagagtctca

SEQ ID NO: 5724944 - DNA, 20 bp, Homo sapiens
cttcctctagagtctcactg

SEQ ID NO: 5724945 - DNA, 18 bp, Homo sapiens
cttcctctatcttccaaa

SEQ ID NO: 5724946 - DNA, 18 bp, Homo sapiens
cttcctctcactcctgcc

SEQ ID NO: 5724947 - DNA, 20 bp, Homo sapiens
cttcctctcactcctgcctc

SEQ ID NO: 5724948 - DNA, 13 bp, Homo sapiens
cttcctctcaggc

SEQ ID NO: 5724949 - DNA, 22 bp, Homo sapiens
cttcctctcatccttttctcct

SEQ ID NO: 5724950 - DNA, 14 bp, Homo sapiens
cttcctctccaccc

SEQ ID NO: 5724951 - DNA, 16 bp, Homo sapiens
cttcctctccactgcc

SEQ ID NO: 5724952 - DNA, 21 bp, Homo sapiens
cttcctctccactgccttcga

SEQ ID NO: 5724953 - DNA, 16 bp, Homo sapiens
cttcctctccatacct

SEQ ID NO: 5724954 - DNA, 13 bp, Homo sapiens
cttcctctccttc

SEQ ID NO: 5724955 - DNA, 16 bp, Homo sapiens
cttcctctccttcctt

SEQ ID NO: 5724956 - DNA, 23 bp, Homo sapiens
cttcctctcggctggaagaacat

SEQ ID NO: 5724957 - DNA, 15 bp, Homo sapiens
cttcctctctacccc

SEQ ID NO: 5724958 - DNA, 16 bp, Homo sapiens
cttcctctctccccca

SEQ ID NO: 5724959 - DNA, 15 bp, Homo sapiens
cttcctctctcctta

SEQ ID NO: 5724960 - DNA, 16 bp, Homo sapiens
cttcctctctctacca

SEQ ID NO: 5724961 - DNA, 13 bp, Homo sapiens
cttcctctctgga

SEQ ID NO: 5724962 - DNA, 14 bp, Homo sapiens
cttcctctctggat

SEQ ID NO: 5724963 - DNA, 23 bp, Homo sapiens
cttcctctcttttttggggggag

SEQ ID NO: 5724964 - DNA, 13 bp, Homo sapiens
cttcctctgagga

SEQ ID NO: 5724965 - DNA, 15 bp, Homo sapiens
cttcctctgaggctg

SEQ ID NO: 5724966 - DNA, 16 bp, Homo sapiens
cttcctctgaggctga

SEQ ID NO: 5724967 - DNA, 22 bp, Homo sapiens
cttcctctgaggctgaaattca

SEQ ID NO: 5724968 - DNA, 14 bp, Homo sapiens
cttcctctgcaagt

SEQ ID NO: 5724969 - DNA, 17 bp, Homo sapiens
cttcctctgcaagtgct

SEQ ID NO: 5724970 - DNA, 20 bp, Homo sapiens
cttcctctgcaagtgctcag

SEQ ID NO: 5724971 - DNA, 23 bp, Homo sapiens
cttcctctgcaagtgctcaggga

SEQ ID NO: 5724972 - DNA, 14 bp, Homo sapiens
cttcctctgctaaa

SEQ ID NO: 5724973 - DNA, 13 bp, Homo sapiens
cttcctctgctga

SEQ ID NO: 5724974 - DNA, 14 bp, Homo sapiens
cttcctctggctcc

SEQ ID NO: 5724975 - DNA, 23 bp, Homo sapiens
cttcctctggctccccaaggctg

SEQ ID NO: 5724976 - DNA, 14 bp, Homo sapiens
cttcctctgggcag

SEQ ID NO: 5724977 - DNA, 16 bp, Homo sapiens
cttcctctgggcagcg

SEQ ID NO: 5724978 - DNA, 22 bp, Homo sapiens
cttcctctggtgtttattataa

SEQ ID NO: 5724979 - DNA, 15 bp, Homo sapiens
cttcctctggttcct

SEQ ID NO: 5724980 - DNA, 17 bp, Homo sapiens
cttcctctggtttctgt

SEQ ID NO: 5724981 - DNA, 15 bp, Homo sapiens
cttcctcttcggccc

SEQ ID NO: 5724982 - DNA, 15 bp, Homo sapiens
cttcctcttcttgtt

SEQ ID NO: 5724983 - DNA, 15 bp, Homo sapiens
cttcctcttgaccct

SEQ ID NO: 5724984 - DNA, 19 bp, Homo sapiens
cttcctcttgaccctgcac

SEQ ID NO: 5724985 - DNA, 14 bp, Homo sapiens
cttcctcttgtctg

SEQ ID NO: 5724986 - DNA, 16 bp, Homo sapiens
cttcctcttgtctgat

SEQ ID NO: 5724987 - DNA, 18 bp, Homo sapiens
cttcctgaaactatattt

SEQ ID NO: 5724988 - DNA, 15 bp, Homo sapiens
cttcctgaaataaac

SEQ ID NO: 5724989 - DNA, 18 bp, Homo sapiens
cttcctgacgaaactggc

SEQ ID NO: 5724990 - DNA, 23 bp, Homo sapiens
cttcctgactgacacaggccagc

SEQ ID NO: 5724991 - DNA, 15 bp, Homo sapiens
cttcctgactgggaa

SEQ ID NO: 5724992 - DNA, 22 bp, Homo sapiens
cttcctgagaaacgtccatctc

SEQ ID NO: 5724993 - DNA, 23 bp, Homo sapiens
cttcctgagaaagcccacctggg

SEQ ID NO: 5724994 - DNA, 16 bp, Homo sapiens
cttcctgagcagtccc

SEQ ID NO: 5724995 - DNA, 22 bp, Homo sapiens
cttcctgagcagtccctgctta

SEQ ID NO: 5724996 - DNA, 14 bp, Homo sapiens
cttcctgagcttta

SEQ ID NO: 5724997 - DNA, 12 bp, Homo sapiens
cttcctgagggc

SEQ ID NO: 5724998 - DNA, 21 bp, Homo sapiens
cttcctgaggggagacagagc

SEQ ID NO: 5724999 - DNA, 23 bp, Homo sapiens
cttcctgaggggagacagagcaa

SEQ ID NO: 5725000 - DNA, 22 bp, Homo sapiens
cttcctgattaccagtctgatt

SEQ ID NO: 5725001 - DNA, 20 bp, Homo sapiens
cttcctgattggtttctctt

SEQ ID NO: 5725002 - DNA, 21 bp, Homo sapiens
cttcctgcaaccactctgtgg

SEQ ID NO: 5725003 - DNA, 22 bp, Homo sapiens
cttcctgcaaccactctgtggc

SEQ ID NO: 5725004 - DNA, 13 bp, Homo sapiens
cttcctgcagacc

SEQ ID NO: 5725005 - DNA, 19 bp, Homo sapiens
cttcctgcagacctggctg

SEQ ID NO: 5725006 - DNA, 20 bp, Homo sapiens
cttcctgcatagtctgttcc

SEQ ID NO: 5725007 - DNA, 15 bp, Homo sapiens
cttcctgccaccagt

SEQ ID NO: 5725008 - DNA, 16 bp, Homo sapiens
cttcctgcccctcttt

SEQ ID NO: 5725009 - DNA, 20 bp, Homo sapiens
cttcctgcccctctttctct

SEQ ID NO: 5725010 - DNA, 13 bp, Homo sapiens
cttcctgcccttg

SEQ ID NO: 5725011 - DNA, 21 bp, Homo sapiens
cttcctgcctactgcccctgc

SEQ ID NO: 5725012 - DNA, 21 bp, Homo sapiens
cttcctgcgtcctcctcacct

SEQ ID NO: 5725013 - DNA, 19 bp, Homo sapiens
cttcctgctacagtagctg

SEQ ID NO: 5725014 - DNA, 18 bp, Homo sapiens
cttcctgctccttttgta

SEQ ID NO: 5725015 - DNA, 10 bp, Homo sapiens
cttcctgctg

SEQ ID NO: 5725016 - DNA, 20 bp, Homo sapiens
cttcctgctgcaccctgcgc

SEQ ID NO: 5725017 - DNA, 13 bp, Homo sapiens
cttcctgctgctg

SEQ ID NO: 5725018 - DNA, 22 bp, Homo sapiens
cttcctgctgctgctactgctg

SEQ ID NO: 5725019 - DNA, 13 bp, Homo sapiens
cttcctgctggac

SEQ ID NO: 5725020 - DNA, 18 bp, Homo sapiens
cttcctgcttaaacttga

SEQ ID NO: 5725021 - DNA, 14 bp, Homo sapiens
cttcctgcttgcca

SEQ ID NO: 5725022 - DNA, 14 bp, Homo sapiens
cttcctggaaacag

SEQ ID NO: 5725023 - DNA, 14 bp, Homo sapiens
cttcctggacacac

SEQ ID NO: 5725024 - DNA, 13 bp, Homo sapiens
cttcctggacagc

SEQ ID NO: 5725025 - DNA, 17 bp, Homo sapiens
cttcctggacagctgtg

SEQ ID NO: 5725026 - DNA, 22 bp, Homo sapiens
cttcctggacagtgagagcagg

SEQ ID NO: 5725027 - DNA, 12 bp, Homo sapiens
cttcctggacct

SEQ ID NO: 5725028 - DNA, 15 bp, Homo sapiens
cttcctggactggcc

SEQ ID NO: 5725029 - DNA, 17 bp, Homo sapiens
cttcctggactggccct

SEQ ID NO: 5725030 - DNA, 20 bp, Homo sapiens
cttcctggactggcccttgc

SEQ ID NO: 5725031 - DNA, 14 bp, Homo sapiens
cttcctggagactg

SEQ ID NO: 5725032 - DNA, 19 bp, Homo sapiens
cttcctggagcagaagcag

SEQ ID NO: 5725033 - DNA, 15 bp, Homo sapiens
cttcctggagcccca

SEQ ID NO: 5725034 - DNA, 20 bp, Homo sapiens
cttcctggaggctgcctatg

SEQ ID NO: 5725035 - DNA, 22 bp, Homo sapiens
cttcctggatggggcagagctt

SEQ ID NO: 5725036 - DNA, 22 bp, Homo sapiens
cttcctggattttctttctatg

SEQ ID NO: 5725037 - DNA, 22 bp, Homo sapiens
cttcctggcacattgcccctct

SEQ ID NO: 5725038 - DNA, 13 bp, Homo sapiens
cttcctggcccag

SEQ ID NO: 5725039 - DNA, 15 bp, Homo sapiens
cttcctggcccaggc

SEQ ID NO: 5725040 - DNA, 21 bp, Homo sapiens
cttcctggcccaggccttgct

SEQ ID NO: 5725041 - DNA, 19 bp, Homo sapiens
cttcctggcccctcatggc

SEQ ID NO: 5725042 - DNA, 13 bp, Homo sapiens
cttcctggcctca

SEQ ID NO: 5725043 - DNA, 21 bp, Homo sapiens
cttcctggcctcactggctgg

SEQ ID NO: 5725044 - DNA, 21 bp, Homo sapiens
cttcctgggaccccctcgcca

SEQ ID NO: 5725045 - DNA, 18 bp, Homo sapiens
cttcctgggaggacaggc

SEQ ID NO: 5725046 - DNA, 19 bp, Homo sapiens
cttcctgggaggacaggca

SEQ ID NO: 5725047 - DNA, 20 bp, Homo sapiens
cttcctgggatgatgtgtga

SEQ ID NO: 5725048 - DNA, 23 bp, Homo sapiens
cttcctgggcacacgctgctctg

SEQ ID NO: 5725049 - DNA, 12 bp, Homo sapiens
cttcctgggcag

SEQ ID NO: 5725050 - DNA, 17 bp, Homo sapiens
cttcctgggcagcccag

SEQ ID NO: 5725051 - DNA, 19 bp, Homo sapiens
cttcctgggcagcccagag

SEQ ID NO: 5725052 - DNA, 20 bp, Homo sapiens
cttcctgggcagcccagaga

SEQ ID NO: 5725053 - DNA, 20 bp, Homo sapiens
cttcctgggcagcctttcca

SEQ ID NO: 5725054 - DNA, 21 bp, Homo sapiens
cttcctggggacgaattccac

SEQ ID NO: 5725055 - DNA, 10 bp, Homo sapiens
cttcctgggt

SEQ ID NO: 5725056 - DNA, 17 bp, Homo sapiens
cttcctgggtcctgcct

SEQ ID NO: 5725057 - DNA, 23 bp, Homo sapiens
cttcctgggtcctgttccctacc

SEQ ID NO: 5725058 - DNA, 23 bp, Homo sapiens
cttcctggtagaccactgccata

SEQ ID NO: 5725059 - DNA, 17 bp, Homo sapiens
cttcctggtcgaaagtt

SEQ ID NO: 5725060 - DNA, 15 bp, Homo sapiens
cttcctggtgagaac

SEQ ID NO: 5725061 - DNA, 18 bp, Homo sapiens
cttcctggtgagaactga

SEQ ID NO: 5725062 - DNA, 22 bp, Homo sapiens
cttcctggtgagaactgaggag

SEQ ID NO: 5725063 - DNA, 19 bp, Homo sapiens
cttcctggtgaggcccagc

SEQ ID NO: 5725064 - DNA, 21 bp, Homo sapiens
cttcctggttttgtacactgc

SEQ ID NO: 5725065 - DNA, 22 bp, Homo sapiens
cttcctggttttgtacactgct

SEQ ID NO: 5725066 - DNA, 23 bp, Homo sapiens
cttcctggttttgtacactgctg

SEQ ID NO: 5725067 - DNA, 21 bp, Homo sapiens
cttcctgtagtgcccctccca

SEQ ID NO: 5725068 - DNA, 15 bp, Homo sapiens
cttcctgtccagaga

SEQ ID NO: 5725069 - DNA, 17 bp, Homo sapiens
cttcctgtcccacctct

SEQ ID NO: 5725070 - DNA, 14 bp, Homo sapiens
cttcctgtccgccc

SEQ ID NO: 5725071 - DNA, 13 bp, Homo sapiens
cttcctgtcctgc

SEQ ID NO: 5725072 - DNA, 17 bp, Homo sapiens
cttcctgtcctgcctcc

SEQ ID NO: 5725073 - DNA, 21 bp, Homo sapiens
cttcctgtcctgcctcctcat

SEQ ID NO: 5725074 - DNA, 14 bp, Homo sapiens
cttcctgtctattt

SEQ ID NO: 5725075 - DNA, 15 bp, Homo sapiens
cttcctgtctcactc

SEQ ID NO: 5725076 - DNA, 16 bp, Homo sapiens
cttcctgtctggccca

SEQ ID NO: 5725077 - DNA, 14 bp, Homo sapiens
cttcctgtctgttt

SEQ ID NO: 5725078 - DNA, 20 bp, Homo sapiens
cttcctgtcttcctgcattc

SEQ ID NO: 5725079 - DNA, 13 bp, Homo sapiens
cttcctgtgactt

SEQ ID NO: 5725080 - DNA, 12 bp, Homo sapiens
cttcctgtgcag

SEQ ID NO: 5725081 - DNA, 13 bp, Homo sapiens
cttcctgtgcaga

SEQ ID NO: 5725082 - DNA, 15 bp, Homo sapiens
cttcctgtgcagaag

SEQ ID NO: 5725083 - DNA, 13 bp, Homo sapiens
cttcctgtgccct

SEQ ID NO: 5725084 - DNA, 15 bp, Homo sapiens
cttcctgtgccctca

SEQ ID NO: 5725085 - DNA, 16 bp, Homo sapiens
cttcctgtgccctcac

SEQ ID NO: 5725086 - DNA, 20 bp, Homo sapiens
cttcctgtgccgtaaggatt

SEQ ID NO: 5725087 - DNA, 15 bp, Homo sapiens
cttcctgtgcctttc

SEQ ID NO: 5725088 - DNA, 15 bp, Homo sapiens
cttcctgtgctaagt

SEQ ID NO: 5725089 - DNA, 14 bp, Homo sapiens
cttcctgtggcctg

SEQ ID NO: 5725090 - DNA, 15 bp, Homo sapiens
cttcctgtggctccc

SEQ ID NO: 5725091 - DNA, 22 bp, Homo sapiens
cttcctgtggctccctctctcc

SEQ ID NO: 5725092 - DNA, 18 bp, Homo sapiens
cttcctgtggctttgttt

SEQ ID NO: 5725093 - DNA, 20 bp, Homo sapiens
cttcctgtgggccaggagct

SEQ ID NO: 5725094 - DNA, 17 bp, Homo sapiens
cttcctgttacctgtct

SEQ ID NO: 5725095 - DNA, 17 bp, Homo sapiens
cttcctgttccctcctg

SEQ ID NO: 5725096 - DNA, 15 bp, Homo sapiens
cttcctgttcttcct

SEQ ID NO: 5725097 - DNA, 17 bp, Homo sapiens
cttcctgttcttccttc

SEQ ID NO: 5725098 - DNA, 20 bp, Homo sapiens
cttcctgttcttccttccta

SEQ ID NO: 5725099 - DNA, 22 bp, Homo sapiens
cttcctgtttaaaaaaccacat

SEQ ID NO: 5725100 - DNA, 13 bp, Homo sapiens
cttcctgtttcta

SEQ ID NO: 5725101 - DNA, 20 bp, Homo sapiens
cttcctgtttcttcccatac

SEQ ID NO: 5725102 - DNA, 10 bp, Homo sapiens
cttccttaac

SEQ ID NO: 5725103 - DNA, 16 bp, Homo sapiens
cttccttaacagctgt

SEQ ID NO: 5725104 - DNA, 19 bp, Homo sapiens
cttccttaattcactccca

SEQ ID NO: 5725105 - DNA, 21 bp, Homo sapiens
cttccttaattcactcccaca

SEQ ID NO: 5725106 - DNA, 16 bp, Homo sapiens
cttccttacccaaact

SEQ ID NO: 5725107 - DNA, 16 bp, Homo sapiens
cttccttaccgtgggc

SEQ ID NO: 5725108 - DNA, 15 bp, Homo sapiens
cttccttacctggaa

SEQ ID NO: 5725109 - DNA, 23 bp, Homo sapiens
cttccttagtttcaaagtgtctc

SEQ ID NO: 5725110 - DNA, 16 bp, Homo sapiens
cttccttcacatctcc

SEQ ID NO: 5725111 - DNA, 15 bp, Homo sapiens
cttccttcacctctg

SEQ ID NO: 5725112 - DNA, 14 bp, Homo sapiens
cttccttcagagag

SEQ ID NO: 5725113 - DNA, 16 bp, Homo sapiens
cttccttcagagagca

SEQ ID NO: 5725114 - DNA, 23 bp, Homo sapiens
cttccttcagagagcagtgcttt

SEQ ID NO: 5725115 - DNA, 20 bp, Homo sapiens
cttccttcagcatctcactt

SEQ ID NO: 5725116 - DNA, 22 bp, Homo sapiens
cttccttcagggtttaatagac

SEQ ID NO: 5725117 - DNA, 11 bp, Homo sapiens
cttccttccct

SEQ ID NO: 5725118 - DNA, 17 bp, Homo sapiens
cttccttccctggctac

SEQ ID NO: 5725119 - DNA, 21 bp, Homo sapiens
cttccttccgctcctttacct

SEQ ID NO: 5725120 - DNA, 14 bp, Homo sapiens
cttccttcctgctt

SEQ ID NO: 5725121 - DNA, 11 bp, Homo sapiens
cttccttcctt

SEQ ID NO: 5725122 - DNA, 14 bp, Homo sapiens
cttccttctcagca

SEQ ID NO: 5725123 - DNA, 20 bp, Homo sapiens
cttccttctcattgctgccc

SEQ ID NO: 5725124 - DNA, 21 bp, Homo sapiens
cttccttctctactcatgcca

SEQ ID NO: 5725125 - DNA, 15 bp, Homo sapiens
cttccttctgcaccc

SEQ ID NO: 5725126 - DNA, 16 bp, Homo sapiens
cttccttctgcaccca

SEQ ID NO: 5725127 - DNA, 18 bp, Homo sapiens
cttccttctgcctgagct

SEQ ID NO: 5725128 - DNA, 18 bp, Homo sapiens
cttccttctgctcccacc

SEQ ID NO: 5725129 - DNA, 19 bp, Homo sapiens
cttccttctgctcccaccc

SEQ ID NO: 5725130 - DNA, 13 bp, Homo sapiens
cttccttctggga

SEQ ID NO: 5725131 - DNA, 19 bp, Homo sapiens
cttccttctttctcttccc

SEQ ID NO: 5725132 - DNA, 15 bp, Homo sapiens
cttccttctttgccc

SEQ ID NO: 5725133 - DNA, 16 bp, Homo sapiens
cttccttctttgccct

SEQ ID NO: 5725134 - DNA, 22 bp, Homo sapiens
cttccttgaaatttctcagcgg

SEQ ID NO: 5725135 - DNA, 14 bp, Homo sapiens
cttccttgaccagc

SEQ ID NO: 5725136 - DNA, 16 bp, Homo sapiens
cttccttgaccagcag

SEQ ID NO: 5725137 - DNA, 17 bp, Homo sapiens
cttccttgaccttcctc

SEQ ID NO: 5725138 - DNA, 18 bp, Homo sapiens
cttccttgaccttcctct

SEQ ID NO: 5725139 - DNA, 13 bp, Homo sapiens
cttccttgactgt

SEQ ID NO: 5725140 - DNA, 16 bp, Homo sapiens
cttccttgactgtcta

SEQ ID NO: 5725141 - DNA, 16 bp, Homo sapiens
cttccttgaggggcag

SEQ ID NO: 5725142 - DNA, 19 bp, Homo sapiens
cttccttgccacaatcact

SEQ ID NO: 5725143 - DNA, 13 bp, Homo sapiens
cttccttgccagt

SEQ ID NO: 5725144 - DNA, 12 bp, Homo sapiens
cttccttgcccc

SEQ ID NO: 5725145 - DNA, 19 bp, Homo sapiens
cttccttgcccctgctctg

SEQ ID NO: 5725146 - DNA, 17 bp, Homo sapiens
cttccttgcgaccacca

SEQ ID NO: 5725147 - DNA, 17 bp, Homo sapiens
cttccttgctctgcacc

SEQ ID NO: 5725148 - DNA, 19 bp, Homo sapiens
cttccttgctgtcctaggc

SEQ ID NO: 5725149 - DNA, 13 bp, Homo sapiens
cttccttgctttt

SEQ ID NO: 5725150 - DNA, 19 bp, Homo sapiens
cttccttggcatcacaggg

SEQ ID NO: 5725151 - DNA, 20 bp, Homo sapiens
cttccttggccaagagaagg

SEQ ID NO: 5725152 - DNA, 14 bp, Homo sapiens
cttccttgggcaga

SEQ ID NO: 5725153 - DNA, 19 bp, Homo sapiens
cttccttgggcgtctcccc

SEQ ID NO: 5725154 - DNA, 22 bp, Homo sapiens
cttcctttactttcccttgctt

SEQ ID NO: 5725155 - DNA, 18 bp, Homo sapiens
cttcctttaggtctggtt

SEQ ID NO: 5725156 - DNA, 17 bp, Homo sapiens
cttcctttcaggccaag

SEQ ID NO: 5725157 - DNA, 14 bp, Homo sapiens
cttcctttccctgg

SEQ ID NO: 5725158 - DNA, 16 bp, Homo sapiens
cttcctttccctggag

SEQ ID NO: 5725159 - DNA, 12 bp, Homo sapiens
cttcctttcctc

SEQ ID NO: 5725160 - DNA, 11 bp, Homo sapiens
cttcctttcta

SEQ ID NO: 5725161 - DNA, 22 bp, Homo sapiens
cttcctttctaatcctatctgg

SEQ ID NO: 5725162 - DNA, 15 bp, Homo sapiens
cttcctttctccagg

SEQ ID NO: 5725163 - DNA, 17 bp, Homo sapiens
cttcctttctccaggac

SEQ ID NO: 5725164 - DNA, 16 bp, Homo sapiens
cttcctttctcctgcc

SEQ ID NO: 5725165 - DNA, 18 bp, Homo sapiens
cttcctttctctcctggc

SEQ ID NO: 5725166 - DNA, 17 bp, Homo sapiens
cttcctttcttgtcttt

SEQ ID NO: 5725167 - DNA, 18 bp, Homo sapiens
cttcctttgctctgaggt

SEQ ID NO: 5725168 - DNA, 22 bp, Homo sapiens
cttcctttggggaagtttattt

SEQ ID NO: 5725169 - DNA, 15 bp, Homo sapiens
cttcctttggtgcct

SEQ ID NO: 5725170 - DNA, 18 bp, Homo sapiens
cttcctttggtgcctcac

SEQ ID NO: 5725171 - DNA, 15 bp, Homo sapiens
cttcctttgtgttta

SEQ ID NO: 5725172 - DNA, 18 bp, Homo sapiens
cttcctttgtgtttatat

SEQ ID NO: 5725173 - DNA, 22 bp, Homo sapiens
cttcctttgtttttttttcctg

SEQ ID NO: 5725174 - DNA, 19 bp, Homo sapiens
cttccttttactaccattt

SEQ ID NO: 5725175 - DNA, 21 bp, Homo sapiens
cttccttttagcctagttcat

SEQ ID NO: 5725176 - DNA, 17 bp, Homo sapiens
cttccttttatcagtag

SEQ ID NO: 5725177 - DNA, 14 bp, Homo sapiens
cttccttttccctg

SEQ ID NO: 5725178 - DNA, 19 bp, Homo sapiens
cttccttttgtatcctcca

SEQ ID NO: 5725179 - DNA, 18 bp, Homo sapiens
cttccttttttctttctt

SEQ ID NO: 5725180 - DNA, 14 bp, Homo sapiens
cttcgaaaatctag

SEQ ID NO: 5725181 - DNA, 14 bp, Homo sapiens
cttcgaaaggcctt

SEQ ID NO: 5725182 - DNA, 12 bp, Homo sapiens
cttcgaagtatt

SEQ ID NO: 5725183 - DNA, 18 bp, Homo sapiens
cttcgaattagtttgcac

SEQ ID NO: 5725184 - DNA, 14 bp, Homo sapiens
cttcgacagcattt

SEQ ID NO: 5725185 - DNA, 18 bp, Homo sapiens
cttcgaccctttctctga

SEQ ID NO: 5725186 - DNA, 18 bp, Homo sapiens
cttcgactactgctcctg

SEQ ID NO: 5725187 - DNA, 20 bp, Homo sapiens
cttcgactactgctcctgtg

SEQ ID NO: 5725188 - DNA, 22 bp, Homo sapiens
cttcgactgttgttatctgttt

SEQ ID NO: 5725189 - DNA, 18 bp, Homo sapiens
cttcgacttttcttaaca

SEQ ID NO: 5725190 - DNA, 17 bp, Homo sapiens
cttcgagcactgtccag

SEQ ID NO: 5725191 - DNA, 16 bp, Homo sapiens
cttcgaggacagcaat

SEQ ID NO: 5725192 - DNA, 17 bp, Homo sapiens
cttcgagggttccaggc

SEQ ID NO: 5725193 - DNA, 19 bp, Homo sapiens
cttcgagggttccaggctg

SEQ ID NO: 5725194 - DNA, 23 bp, Homo sapiens
cttcgaggtggatcacagaggct

SEQ ID NO: 5725195 - DNA, 13 bp, Homo sapiens
cttcgcagaggca

SEQ ID NO: 5725196 - DNA, 16 bp, Homo sapiens
cttcgcaggcatgtcc

SEQ ID NO: 5725197 - DNA, 16 bp, Homo sapiens
cttcgcatcaaaagac

SEQ ID NO: 5725198 - DNA, 14 bp, Homo sapiens
cttcgccacctggg

SEQ ID NO: 5725199 - DNA, 18 bp, Homo sapiens
cttcgccatgtgctgtgc

SEQ ID NO: 5725200 - DNA, 14 bp, Homo sapiens
cttcgccctctgaa

SEQ ID NO: 5725201 - DNA, 15 bp, Homo sapiens
cttcgcctttcccac

SEQ ID NO: 5725202 - DNA, 18 bp, Homo sapiens
cttcgcctttcccaccct

SEQ ID NO: 5725203 - DNA, 13 bp, Homo sapiens
cttcgcctttgct

SEQ ID NO: 5725204 - DNA, 21 bp, Homo sapiens
cttcgcgcaccttctcacctt

SEQ ID NO: 5725205 - DNA, 22 bp, Homo sapiens
cttcgcgcccgcccctgcagca

SEQ ID NO: 5725206 - DNA, 15 bp, Homo sapiens
cttcgcgctggaatc

SEQ ID NO: 5725207 - DNA, 19 bp, Homo sapiens
cttcgcgtatttcaggatt

SEQ ID NO: 5725208 - DNA, 15 bp, Homo sapiens
cttcgctattcccag

SEQ ID NO: 5725209 - DNA, 13 bp, Homo sapiens
cttcgctgaaatt

SEQ ID NO: 5725210 - DNA, 12 bp, Homo sapiens
cttcgctgccag

SEQ ID NO: 5725211 - DNA, 13 bp, Homo sapiens
cttcgctgccagg

SEQ ID NO: 5725212 - DNA, 20 bp, Homo sapiens
cttcgctgccaggacacctg

SEQ ID NO: 5725213 - DNA, 21 bp, Homo sapiens
cttcgctgccaggacacctgc

SEQ ID NO: 5725214 - DNA, 19 bp, Homo sapiens
cttcgctgctctagctggc

SEQ ID NO: 5725215 - DNA, 21 bp, Homo sapiens
cttcgctggactattgtgcca

SEQ ID NO: 5725216 - DNA, 13 bp, Homo sapiens
cttcgctggctcc

SEQ ID NO: 5725217 - DNA, 14 bp, Homo sapiens
cttcgctggctcct

SEQ ID NO: 5725218 - DNA, 13 bp, Homo sapiens
cttcgctgtcccc

SEQ ID NO: 5725219 - DNA, 16 bp, Homo sapiens
cttcgctgtcccccaa

SEQ ID NO: 5725220 - DNA, 23 bp, Homo sapiens
cttcgctgtgatgcatgagctcc

SEQ ID NO: 5725221 - DNA, 18 bp, Homo sapiens
cttcgcttcttgcctctg

SEQ ID NO: 5725222 - DNA, 17 bp, Homo sapiens
cttcgctttcctgagcc

SEQ ID NO: 5725223 - DNA, 14 bp, Homo sapiens
cttcggaccgcttg

SEQ ID NO: 5725224 - DNA, 18 bp, Homo sapiens
cttcggagggcccctgcg

SEQ ID NO: 5725225 - DNA, 22 bp, Homo sapiens
cttcggagggcccctgcgtggg

SEQ ID NO: 5725226 - DNA, 13 bp, Homo sapiens
cttcggagggccg

SEQ ID NO: 5725227 - DNA, 21 bp, Homo sapiens
cttcggagggccgcagggccc

SEQ ID NO: 5725228 - DNA, 16 bp, Homo sapiens
cttcggagtgaatgtg

SEQ ID NO: 5725229 - DNA, 16 bp, Homo sapiens
cttcggataattttca

SEQ ID NO: 5725230 - DNA, 14 bp, Homo sapiens
cttcggcagtggct

SEQ ID NO: 5725231 - DNA, 16 bp, Homo sapiens
cttcggccgagctggt

SEQ ID NO: 5725232 - DNA, 17 bp, Homo sapiens
cttcggcctctcttgga

SEQ ID NO: 5725233 - DNA, 13 bp, Homo sapiens
cttcgggaaaatt

SEQ ID NO: 5725234 - DNA, 19 bp, Homo sapiens
cttcgggaaaattcaaagg

SEQ ID NO: 5725235 - DNA, 21 bp, Homo sapiens
cttcgggaagagaggagttca

SEQ ID NO: 5725236 - DNA, 15 bp, Homo sapiens
cttcgggaccaggat

SEQ ID NO: 5725237 - DNA, 19 bp, Homo sapiens
cttcgggaggtcgaggcag

SEQ ID NO: 5725238 - DNA, 19 bp, Homo sapiens
cttcgggctggccatctgg

SEQ ID NO: 5725239 - DNA, 14 bp, Homo sapiens
cttcgggctgtgcc

SEQ ID NO: 5725240 - DNA, 16 bp, Homo sapiens
cttcgggctgtgcccg

SEQ ID NO: 5725241 - DNA, 18 bp, Homo sapiens
cttcggggaactcctgga

SEQ ID NO: 5725242 - DNA, 17 bp, Homo sapiens
cttcggggccggtgagg

SEQ ID NO: 5725243 - DNA, 19 bp, Homo sapiens
cttcggggcgatgctccct

SEQ ID NO: 5725244 - DNA, 23 bp, Homo sapiens
cttcggggtagaggctgggagga

SEQ ID NO: 5725245 - DNA, 13 bp, Homo sapiens
cttcggtggcctt

SEQ ID NO: 5725246 - DNA, 15 bp, Homo sapiens
cttcggtggccttga

SEQ ID NO: 5725247 - DNA, 15 bp, Homo sapiens
cttcggtttctgagc

SEQ ID NO: 5725248 - DNA, 14 bp, Homo sapiens
cttcgtaacttcat

SEQ ID NO: 5725249 - DNA, 17 bp, Homo sapiens
cttcgtaacttcatatt

SEQ ID NO: 5725250 - DNA, 12 bp, Homo sapiens
cttcgtacagtt

SEQ ID NO: 5725251 - DNA, 23 bp, Homo sapiens
cttcgtacagttcttcgggaaga

SEQ ID NO: 5725252 - DNA, 20 bp, Homo sapiens
cttcgtacatagtctgttcc

SEQ ID NO: 5725253 - DNA, 19 bp, Homo sapiens
cttcgtatcccgagtctgg

SEQ ID NO: 5725254 - DNA, 13 bp, Homo sapiens
cttcgtcagctcc

SEQ ID NO: 5725255 - DNA, 13 bp, Homo sapiens
cttcgtcctgatc

SEQ ID NO: 5725256 - DNA, 14 bp, Homo sapiens
cttcgtccttttgg

SEQ ID NO: 5725257 - DNA, 19 bp, Homo sapiens
cttcgtctccatctctggt

SEQ ID NO: 5725258 - DNA, 13 bp, Homo sapiens
cttcgtcttgtgt

SEQ ID NO: 5725259 - DNA, 21 bp, Homo sapiens
cttcgtcttgtgtttgctgca

SEQ ID NO: 5725260 - DNA, 23 bp, Homo sapiens
cttcgtgaacatcccctcccatc

SEQ ID NO: 5725261 - DNA, 15 bp, Homo sapiens
cttcgtgccccccct

SEQ ID NO: 5725262 - DNA, 16 bp, Homo sapiens
cttcgtggatgacctc

SEQ ID NO: 5725263 - DNA, 13 bp, Homo sapiens
cttcgtggttgtg

SEQ ID NO: 5725264 - DNA, 14 bp, Homo sapiens
cttcgtgtgctgct

SEQ ID NO: 5725265 - DNA, 15 bp, Homo sapiens
cttcgtgtgctgctg

SEQ ID NO: 5725266 - DNA, 14 bp, Homo sapiens
cttcgtgtggctcc

SEQ ID NO: 5725267 - DNA, 16 bp, Homo sapiens
cttcgtgtggctcctg

SEQ ID NO: 5725268 - DNA, 23 bp, Homo sapiens
cttcgttaatagattatttcata

SEQ ID NO: 5725269 - DNA, 18 bp, Homo sapiens
cttcgttagaatgtctgc

SEQ ID NO: 5725270 - DNA, 18 bp, Homo sapiens
cttcgtttactatgcctg

SEQ ID NO: 5725271 - DNA, 15 bp, Homo sapiens
cttcgtttatatttt

SEQ ID NO: 5725272 - DNA, 15 bp, Homo sapiens
cttcgtttgcctcca

SEQ ID NO: 5725273 - DNA, 13 bp, Homo sapiens
cttcgttttggtt

SEQ ID NO: 5725274 - DNA, 13 bp, Homo sapiens
cttctaaaaactt

SEQ ID NO: 5725275 - DNA, 13 bp, Homo sapiens
cttctaaaacaat

SEQ ID NO: 5725276 - DNA, 14 bp, Homo sapiens
cttctaaaactgta

SEQ ID NO: 5725277 - DNA, 18 bp, Homo sapiens
cttctaaaagttttctaa

SEQ ID NO: 5725278 - DNA, 16 bp, Homo sapiens
cttctaaaataaatgt

SEQ ID NO: 5725279 - DNA, 19 bp, Homo sapiens
cttctaaaatagcaataac

SEQ ID NO: 5725280 - DNA, 13 bp, Homo sapiens
cttctaaaccaaa

SEQ ID NO: 5725281 - DNA, 20 bp, Homo sapiens
cttctaaactgaagctgctg

SEQ ID NO: 5725282 - DNA, 22 bp, Homo sapiens
cttctaaactgaagctgctgta

SEQ ID NO: 5725283 - DNA, 17 bp, Homo sapiens
cttctaaagaggaagcc

SEQ ID NO: 5725284 - DNA, 23 bp, Homo sapiens
cttctaaagcactggtttcaaga

SEQ ID NO: 5725285 - DNA, 15 bp, Homo sapiens
cttctaaaggtgttg

SEQ ID NO: 5725286 - DNA, 23 bp, Homo sapiens
cttctaaaggtgttgtcccttct

SEQ ID NO: 5725287 - DNA, 20 bp, Homo sapiens
cttctaaatcataatcatcc

SEQ ID NO: 5725288 - DNA, 15 bp, Homo sapiens
cttctaaatgcatat

SEQ ID NO: 5725289 - DNA, 12 bp, Homo sapiens
cttctaaatgcc

SEQ ID NO: 5725290 - DNA, 13 bp, Homo sapiens
cttctaaattaaa

SEQ ID NO: 5725291 - DNA, 16 bp, Homo sapiens
cttctaaattcccaaa

SEQ ID NO: 5725292 - DNA, 19 bp, Homo sapiens
cttctaaatttctaggcca

SEQ ID NO: 5725293 - DNA, 17 bp, Homo sapiens
cttctaacatgaaatat

SEQ ID NO: 5725294 - DNA, 16 bp, Homo sapiens
cttctaacccaactga

SEQ ID NO: 5725295 - DNA, 23 bp, Homo sapiens
cttctaacccaactgacttgtat

SEQ ID NO: 5725296 - DNA, 14 bp, Homo sapiens
cttctaagaagaca

SEQ ID NO: 5725297 - DNA, 16 bp, Homo sapiens
cttctaagaggataca

SEQ ID NO: 5725298 - DNA, 20 bp, Homo sapiens
cttctaagggatccagagac

SEQ ID NO: 5725299 - DNA, 21 bp, Homo sapiens
cttctaagggatccagagacc

SEQ ID NO: 5725300 - DNA, 21 bp, Homo sapiens
cttctaagtaaaaccacagca

SEQ ID NO: 5725301 - DNA, 17 bp, Homo sapiens
cttctaataaagtcatt

SEQ ID NO: 5725302 - DNA, 15 bp, Homo sapiens
cttctaataaattat

SEQ ID NO: 5725303 - DNA, 16 bp, Homo sapiens
cttctaatatcattca

SEQ ID NO: 5725304 - DNA, 17 bp, Homo sapiens
cttctaatgtaaatttt

SEQ ID NO: 5725305 - DNA, 20 bp, Homo sapiens
cttctaatttatattatcca

SEQ ID NO: 5725306 - DNA, 16 bp, Homo sapiens
cttctaattttgtgct

SEQ ID NO: 5725307 - DNA, 18 bp, Homo sapiens
cttctacaaaagaagtgt

SEQ ID NO: 5725308 - DNA, 17 bp, Homo sapiens
cttctacaaccagagcc

SEQ ID NO: 5725309 - DNA, 17 bp, Homo sapiens
cttctacacatttcatc

SEQ ID NO: 5725310 - DNA, 15 bp, Homo sapiens
cttctacactagggg

SEQ ID NO: 5725311 - DNA, 13 bp, Homo sapiens
cttctacactctc

SEQ ID NO: 5725312 - DNA, 23 bp, Homo sapiens
cttctacaggcccggcccagcct

SEQ ID NO: 5725313 - DNA, 15 bp, Homo sapiens
cttctaccaactgga

SEQ ID NO: 5725314 - DNA, 22 bp, Homo sapiens
cttctacccagatggaaaaata

SEQ ID NO: 5725315 - DNA, 18 bp, Homo sapiens
cttctaccccaaggccag

SEQ ID NO: 5725316 - DNA, 19 bp, Homo sapiens
cttctaccccaaggccagt

SEQ ID NO: 5725317 - DNA, 15 bp, Homo sapiens
cttctaccccacctg

SEQ ID NO: 5725318 - DNA, 16 bp, Homo sapiens
cttctaccccacctga

SEQ ID NO: 5725319 - DNA, 19 bp, Homo sapiens
cttctacccttttcctttt

SEQ ID NO: 5725320 - DNA, 17 bp, Homo sapiens
cttctacctcttccagg

SEQ ID NO: 5725321 - DNA, 19 bp, Homo sapiens
cttctacctcttccaggaa

SEQ ID NO: 5725322 - DNA, 22 bp, Homo sapiens
cttctacctgcaggactcgggc

SEQ ID NO: 5725323 - DNA, 12 bp, Homo sapiens
cttctacctgcc

SEQ ID NO: 5725324 - DNA, 17 bp, Homo sapiens
cttctacctgccactca

SEQ ID NO: 5725325 - DNA, 23 bp, Homo sapiens
cttctacctgccactcacacagc

SEQ ID NO: 5725326 - DNA, 15 bp, Homo sapiens
cttctacctgccctc

SEQ ID NO: 5725327 - DNA, 16 bp, Homo sapiens
cttctacctgccctca

SEQ ID NO: 5725328 - DNA, 18 bp, Homo sapiens
cttctacctgccctcaag

SEQ ID NO: 5725329 - DNA, 17 bp, Homo sapiens
cttctaccttaaaatgt

SEQ ID NO: 5725330 - DNA, 16 bp, Homo sapiens
cttctactcctgcctc

SEQ ID NO: 5725331 - DNA, 23 bp, Homo sapiens
cttctactcttgagagctcaggc

SEQ ID NO: 5725332 - DNA, 18 bp, Homo sapiens
cttctactgagccttcag

SEQ ID NO: 5725333 - DNA, 22 bp, Homo sapiens
cttctactgccttgaaaaatga

SEQ ID NO: 5725334 - DNA, 21 bp, Homo sapiens
cttctacttctgcccttgcca

SEQ ID NO: 5725335 - DNA, 13 bp, Homo sapiens
cttctactttcat

SEQ ID NO: 5725336 - DNA, 16 bp, Homo sapiens
cttctactttcatctt

SEQ ID NO: 5725337 - DNA, 13 bp, Homo sapiens
cttctacttttaa

SEQ ID NO: 5725338 - DNA, 20 bp, Homo sapiens
cttctagaacacctgccttc

SEQ ID NO: 5725339 - DNA, 15 bp, Homo sapiens
cttctagaacctggg

SEQ ID NO: 5725340 - DNA, 16 bp, Homo sapiens
cttctagaacctgggc

SEQ ID NO: 5725341 - DNA, 18 bp, Homo sapiens
cttctagaacctgggctg

SEQ ID NO: 5725342 - DNA, 19 bp, Homo sapiens
cttctagaacctgggctgt

SEQ ID NO: 5725343 - DNA, 20 bp, Homo sapiens
cttctagaacctgggctgtg

SEQ ID NO: 5725344 - DNA, 23 bp, Homo sapiens
cttctagaatacatattacaaga

SEQ ID NO: 5725345 - DNA, 23 bp, Homo sapiens
cttctagaattataagtcacaaa

SEQ ID NO: 5725346 - DNA, 19 bp, Homo sapiens
cttctagacactccttgaa

SEQ ID NO: 5725347 - DNA, 21 bp, Homo sapiens
cttctagacactgaaggcaaa

SEQ ID NO: 5725348 - DNA, 22 bp, Homo sapiens
cttctagagatgtgcctgtggg

SEQ ID NO: 5725349 - DNA, 21 bp, Homo sapiens
cttctagaggctcatggccct

SEQ ID NO: 5725350 - DNA, 15 bp, Homo sapiens
cttctagatctggaa

SEQ ID NO: 5725351 - DNA, 17 bp, Homo sapiens
cttctagatctggaacc

SEQ ID NO: 5725352 - DNA, 21 bp, Homo sapiens
cttctagatcttagttctaga

SEQ ID NO: 5725353 - DNA, 18 bp, Homo sapiens
cttctagatggaccccag

SEQ ID NO: 5725354 - DNA, 20 bp, Homo sapiens
cttctagatggaccccagca

SEQ ID NO: 5725355 - DNA, 16 bp, Homo sapiens
cttctagattcactgt

SEQ ID NO: 5725356 - DNA, 17 bp, Homo sapiens
cttctagccacagttct

SEQ ID NO: 5725357 - DNA, 21 bp, Homo sapiens
cttctagccacagttctaaga

SEQ ID NO: 5725358 - DNA, 17 bp, Homo sapiens
cttctagctgacttgca

SEQ ID NO: 5725359 - DNA, 21 bp, Homo sapiens
cttctagctttgttgtcctcc

SEQ ID NO: 5725360 - DNA, 15 bp, Homo sapiens
cttctaggaatggag

SEQ ID NO: 5725361 - DNA, 17 bp, Homo sapiens
cttctaggactgggggt

SEQ ID NO: 5725362 - DNA, 16 bp, Homo sapiens
cttctaggaggatgct

SEQ ID NO: 5725363 - DNA, 17 bp, Homo sapiens
cttctaggaggatgctg

SEQ ID NO: 5725364 - DNA, 21 bp, Homo sapiens
cttctaggcccattgtcctcc

SEQ ID NO: 5725365 - DNA, 18 bp, Homo sapiens
cttctaggggcaggtgaa

SEQ ID NO: 5725366 - DNA, 18 bp, Homo sapiens
cttctaggggtagctggt

SEQ ID NO: 5725367 - DNA, 19 bp, Homo sapiens
cttctagggttattgcatt

SEQ ID NO: 5725368 - DNA, 16 bp, Homo sapiens
cttctagtgagcctgg

SEQ ID NO: 5725369 - DNA, 21 bp, Homo sapiens
cttctagtgatttctggggcc

SEQ ID NO: 5725370 - DNA, 16 bp, Homo sapiens
cttctagttctgccag

SEQ ID NO: 5725371 - DNA, 15 bp, Homo sapiens
cttctagttgctctt

SEQ ID NO: 5725372 - DNA, 23 bp, Homo sapiens
cttctagtttcacgtaaatattc

SEQ ID NO: 5725373 - DNA, 15 bp, Homo sapiens
cttctatacccaccc

SEQ ID NO: 5725374 - DNA, 18 bp, Homo sapiens
cttctatactttctcaca

SEQ ID NO: 5725375 - DNA, 18 bp, Homo sapiens
cttctatagcatcactta

SEQ ID NO: 5725376 - DNA, 13 bp, Homo sapiens
cttctatatttta

SEQ ID NO: 5725377 - DNA, 15 bp, Homo sapiens
cttctatattttaat

SEQ ID NO: 5725378 - DNA, 19 bp, Homo sapiens
cttctatattttaatagaa

SEQ ID NO: 5725379 - DNA, 20 bp, Homo sapiens
cttctatattttaatagaaa

SEQ ID NO: 5725380 - DNA, 14 bp, Homo sapiens
cttctatcctctgt

SEQ ID NO: 5725381 - DNA, 14 bp, Homo sapiens
cttctatcttcttt

SEQ ID NO: 5725382 - DNA, 20 bp, Homo sapiens
cttctatgacccagcatggg

SEQ ID NO: 5725383 - DNA, 17 bp, Homo sapiens
cttctatgatcagaact

SEQ ID NO: 5725384 - DNA, 17 bp, Homo sapiens
cttctatgctgcttcca

SEQ ID NO: 5725385 - DNA, 13 bp, Homo sapiens
cttctatgtatta

SEQ ID NO: 5725386 - DNA, 16 bp, Homo sapiens
cttctatgttggtttc

SEQ ID NO: 5725387 - DNA, 19 bp, Homo sapiens
cttctattaatcaagagaa

SEQ ID NO: 5725388 - DNA, 19 bp, Homo sapiens
cttctattatagccacatc

SEQ ID NO: 5725389 - DNA, 11 bp, Homo sapiens
cttctatttaa

SEQ ID NO: 5725390 - DNA, 16 bp, Homo sapiens
cttctatttaaaaaat

SEQ ID NO: 5725391 - DNA, 17 bp, Homo sapiens
cttctatttaaaaaata

SEQ ID NO: 5725392 - DNA, 18 bp, Homo sapiens
cttctatttaaaaaataa

SEQ ID NO: 5725393 - DNA, 22 bp, Homo sapiens
cttctatttaaaaaataaaaaa

SEQ ID NO: 5725394 - DNA, 12 bp, Homo sapiens
cttctatttatt

SEQ ID NO: 5725395 - DNA, 15 bp, Homo sapiens
cttctatttatttat

SEQ ID NO: 5725396 - DNA, 22 bp, Homo sapiens
cttctatttatttatttattca

SEQ ID NO: 5725397 - DNA, 13 bp, Homo sapiens
cttctattttcaa

SEQ ID NO: 5725398 - DNA, 16 bp, Homo sapiens
cttctattttgtaaac

SEQ ID NO: 5725399 - DNA, 18 bp, Homo sapiens
cttctcaaaaaataatta

SEQ ID NO: 5725400 - DNA, 20 bp, Homo sapiens
cttctcaaaaaataattagt

SEQ ID NO: 5725401 - DNA, 19 bp, Homo sapiens
cttctcaaacctgtttaaa

SEQ ID NO: 5725402 - DNA, 22 bp, Homo sapiens
cttctcaaacctgtttaaatat

SEQ ID NO: 5725403 - DNA, 15 bp, Homo sapiens
cttctcaaagagaat

SEQ ID NO: 5725404 - DNA, 21 bp, Homo sapiens
cttctcaaagggtacttccac

SEQ ID NO: 5725405 - DNA, 21 bp, Homo sapiens
cttctcaactccagagcccct

SEQ ID NO: 5725406 - DNA, 15 bp, Homo sapiens
cttctcaagatactg

SEQ ID NO: 5725407 - DNA, 18 bp, Homo sapiens
cttctcaaggacacattt

SEQ ID NO: 5725408 - DNA, 16 bp, Homo sapiens
cttctcaagtgcctta

SEQ ID NO: 5725409 - DNA, 17 bp, Homo sapiens
cttctcaagtgccttaa

SEQ ID NO: 5725410 - DNA, 18 bp, Homo sapiens
cttctcaagtgccttaat

SEQ ID NO: 5725411 - DNA, 16 bp, Homo sapiens
cttctcaagttctaag

SEQ ID NO: 5725412 - DNA, 17 bp, Homo sapiens
cttctcaagttctaaga

SEQ ID NO: 5725413 - DNA, 18 bp, Homo sapiens
cttctcaagttctaagat

SEQ ID NO: 5725414 - DNA, 17 bp, Homo sapiens
cttctcaatagagtgtt

SEQ ID NO: 5725415 - DNA, 12 bp, Homo sapiens
cttctcacactg

SEQ ID NO: 5725416 - DNA, 23 bp, Homo sapiens
cttctcacagcacatgctggcca

SEQ ID NO: 5725417 - DNA, 13 bp, Homo sapiens
cttctcaccagct

SEQ ID NO: 5725418 - DNA, 15 bp, Homo sapiens
cttctcaccagctgc

SEQ ID NO: 5725419 - DNA, 20 bp, Homo sapiens
cttctcaccagctgcaaagt

SEQ ID NO: 5725420 - DNA, 15 bp, Homo sapiens
cttctcaccccagga

SEQ ID NO: 5725421 - DNA, 19 bp, Homo sapiens
cttctcaccgtgcagagct

SEQ ID NO: 5725422 - DNA, 20 bp, Homo sapiens
cttctcacgctttgtttact

SEQ ID NO: 5725423 - DNA, 21 bp, Homo sapiens
cttctcacgctttgtttactc

SEQ ID NO: 5725424 - DNA, 19 bp, Homo sapiens
cttctcactagctgtctca

SEQ ID NO: 5725425 - DNA, 15 bp, Homo sapiens
cttctcactgccatg

SEQ ID NO: 5725426 - DNA, 14 bp, Homo sapiens
cttctcagaagcac

SEQ ID NO: 5725427 - DNA, 22 bp, Homo sapiens
cttctcagaaggcaaatgactt

SEQ ID NO: 5725428 - DNA, 14 bp, Homo sapiens
cttctcagatttct

SEQ ID NO: 5725429 - DNA, 12 bp, Homo sapiens
cttctcagccac

SEQ ID NO: 5725430 - DNA, 14 bp, Homo sapiens
cttctcagcccctt

SEQ ID NO: 5725431 - DNA, 21 bp, Homo sapiens
cttctcagcctacagcagtgt

SEQ ID NO: 5725432 - DNA, 20 bp, Homo sapiens
cttctcagccttggttcctg

SEQ ID NO: 5725433 - DNA, 16 bp, Homo sapiens
cttctcagctccactc

SEQ ID NO: 5725434 - DNA, 22 bp, Homo sapiens
cttctcagctccactctgaagt

SEQ ID NO: 5725435 - DNA, 14 bp, Homo sapiens
cttctcagctccca

SEQ ID NO: 5725436 - DNA, 11 bp, Homo sapiens
cttctcaggaa

SEQ ID NO: 5725437 - DNA, 18 bp, Homo sapiens
cttctcaggacacaggcc

SEQ ID NO: 5725438 - DNA, 13 bp, Homo sapiens
cttctcaggctct

SEQ ID NO: 5725439 - DNA, 22 bp, Homo sapiens
cttctcaggctctgccctgccc

SEQ ID NO: 5725440 - DNA, 17 bp, Homo sapiens
cttctcagttgcagaaa

SEQ ID NO: 5725441 - DNA, 20 bp, Homo sapiens
cttctcagttgcagaaaatg

SEQ ID NO: 5725442 - DNA, 17 bp, Homo sapiens
cttctcagtttctgcct

SEQ ID NO: 5725443 - DNA, 23 bp, Homo sapiens
cttctcagtttctgcctgggcaa

SEQ ID NO: 5725444 - DNA, 15 bp, Homo sapiens
cttctcatagcatta

SEQ ID NO: 5725445 - DNA, 16 bp, Homo sapiens
cttctcatcacacaca

SEQ ID NO: 5725446 - DNA, 21 bp, Homo sapiens
cttctcatcatattgtatgta

SEQ ID NO: 5725447 - DNA, 14 bp, Homo sapiens
cttctcatctttta

SEQ ID NO: 5725448 - DNA, 14 bp, Homo sapiens
cttctcatgatcca

SEQ ID NO: 5725449 - DNA, 18 bp, Homo sapiens
cttctcatgctatttcta

SEQ ID NO: 5725450 - DNA, 22 bp, Homo sapiens
cttctcattacttgttgcctat

SEQ ID NO: 5725451 - DNA, 20 bp, Homo sapiens
cttctcattccaacagtgag

SEQ ID NO: 5725452 - DNA, 22 bp, Homo sapiens
cttctcatttcacccctccctt

SEQ ID NO: 5725453 - DNA, 20 bp, Homo sapiens
cttctcattttttaaaaaag

SEQ ID NO: 5725454 - DNA, 15 bp, Homo sapiens
cttctcattttttcc

SEQ ID NO: 5725455 - DNA, 22 bp, Homo sapiens
cttctccaaaaatctgcctggg

SEQ ID NO: 5725456 - DNA, 19 bp, Homo sapiens
cttctccaacaagttgcct

SEQ ID NO: 5725457 - DNA, 21 bp, Homo sapiens
cttctccaacaagttgcctcc

SEQ ID NO: 5725458 - DNA, 16 bp, Homo sapiens
cttctccaatgctctg

SEQ ID NO: 5725459 - DNA, 15 bp, Homo sapiens
cttctccaccctgct

SEQ ID NO: 5725460 - DNA, 16 bp, Homo sapiens
cttctccaccctgctc

SEQ ID NO: 5725461 - DNA, 22 bp, Homo sapiens
cttctccacctcccccaaaccc

SEQ ID NO: 5725462 - DNA, 14 bp, Homo sapiens
cttctccacgtctt

SEQ ID NO: 5725463 - DNA, 11 bp, Homo sapiens
cttctccactt

SEQ ID NO: 5725464 - DNA, 20 bp, Homo sapiens
cttctccactttctagccag

SEQ ID NO: 5725465 - DNA, 17 bp, Homo sapiens
cttctccagacaaacca

SEQ ID NO: 5725466 - DNA, 18 bp, Homo sapiens
cttctccagccaccaagg

SEQ ID NO: 5725467 - DNA, 20 bp, Homo sapiens
cttctccagccaccaaggct

SEQ ID NO: 5725468 - DNA, 12 bp, Homo sapiens
cttctccagcct

SEQ ID NO: 5725469 - DNA, 15 bp, Homo sapiens
cttctccagcctaga

SEQ ID NO: 5725470 - DNA, 22 bp, Homo sapiens
cttctccagcctttttcaggga

SEQ ID NO: 5725471 - DNA, 23 bp, Homo sapiens
cttctccagggaattcttacagc

SEQ ID NO: 5725472 - DNA, 13 bp, Homo sapiens
cttctccagtggt

SEQ ID NO: 5725473 - DNA, 19 bp, Homo sapiens
cttctccagtttttgagga

SEQ ID NO: 5725474 - DNA, 10 bp, Homo sapiens
cttctccatc

SEQ ID NO: 5725475 - DNA, 20 bp, Homo sapiens
cttctccatcctttctgcct

SEQ ID NO: 5725476 - DNA, 21 bp, Homo sapiens
cttctccatctctctggccct

SEQ ID NO: 5725477 - DNA, 14 bp, Homo sapiens
cttctccatctggc

SEQ ID NO: 5725478 - DNA, 17 bp, Homo sapiens
cttctccatggccctgc

SEQ ID NO: 5725479 - DNA, 20 bp, Homo sapiens
cttctccattccctccaccc

SEQ ID NO: 5725480 - DNA, 23 bp, Homo sapiens
cttctccattctagatgcttccc

SEQ ID NO: 5725481 - DNA, 17 bp, Homo sapiens
cttctcccaactcagcc

SEQ ID NO: 5725482 - DNA, 20 bp, Homo sapiens
cttctcccaactcagcctgt

SEQ ID NO: 5725483 - DNA, 22 bp, Homo sapiens
cttctcccaactcagcctgttc

SEQ ID NO: 5725484 - DNA, 20 bp, Homo sapiens
cttctcccaccccttggccc

SEQ ID NO: 5725485 - DNA, 15 bp, Homo sapiens
cttctcccactctcc

SEQ ID NO: 5725486 - DNA, 23 bp, Homo sapiens
cttctcccagaatcccagccggc

SEQ ID NO: 5725487 - DNA, 13 bp, Homo sapiens
cttctcccagcac

SEQ ID NO: 5725488 - DNA, 15 bp, Homo sapiens
cttctcccaggcaag

SEQ ID NO: 5725489 - DNA, 18 bp, Homo sapiens
cttctcccaggcaaggct

SEQ ID NO: 5725490 - DNA, 20 bp, Homo sapiens
cttctcccaggcaaggctgt

SEQ ID NO: 5725491 - DNA, 13 bp, Homo sapiens
cttctcccaggcc

SEQ ID NO: 5725492 - DNA, 16 bp, Homo sapiens
cttctcccaggcctct

SEQ ID NO: 5725493 - DNA, 14 bp, Homo sapiens
cttctcccagtgtg

SEQ ID NO: 5725494 - DNA, 22 bp, Homo sapiens
cttctcccagtgtgagacccca

SEQ ID NO: 5725495 - DNA, 21 bp, Homo sapiens
cttctcccatttcctgatcta

SEQ ID NO: 5725496 - DNA, 22 bp, Homo sapiens
cttctccccaacaattggaggg

SEQ ID NO: 5725497 - DNA, 23 bp, Homo sapiens
cttctccccaacaattggagggt

SEQ ID NO: 5725498 - DNA, 19 bp, Homo sapiens
cttctccccacagcctctg

SEQ ID NO: 5725499 - DNA, 12 bp, Homo sapiens
cttctccccaga

SEQ ID NO: 5725500 - DNA, 18 bp, Homo sapiens
cttctccccagagctgcc

SEQ ID NO: 5725501 - DNA, 19 bp, Homo sapiens
cttctccccagagctgcct

SEQ ID NO: 5725502 - DNA, 21 bp, Homo sapiens
cttctccccagagctgcctgc

SEQ ID NO: 5725503 - DNA, 17 bp, Homo sapiens
cttctccccagccagag

SEQ ID NO: 5725504 - DNA, 17 bp, Homo sapiens
cttctccccagctccca

SEQ ID NO: 5725505 - DNA, 19 bp, Homo sapiens
cttctccccagctcccagg

SEQ ID NO: 5725506 - DNA, 20 bp, Homo sapiens
cttctccccagctcccagga

SEQ ID NO: 5725507 - DNA, 14 bp, Homo sapiens
cttctccccccatc

SEQ ID NO: 5725508 - DNA, 14 bp, Homo sapiens
cttctcccccgccc

SEQ ID NO: 5725509 - DNA, 15 bp, Homo sapiens
cttctccccctcagc

SEQ ID NO: 5725510 - DNA, 21 bp, Homo sapiens
cttctcccccttgtcttcccc

SEQ ID NO: 5725511 - DNA, 20 bp, Homo sapiens
cttctccccgaggctgcccc

SEQ ID NO: 5725512 - DNA, 23 bp, Homo sapiens
cttctccccgaggctgccccagg

SEQ ID NO: 5725513 - DNA, 14 bp, Homo sapiens
cttctccccgcagc

SEQ ID NO: 5725514 - DNA, 19 bp, Homo sapiens
cttctccccgcagcccgcc

SEQ ID NO: 5725515 - DNA, 11 bp, Homo sapiens
cttctcccctc

SEQ ID NO: 5725516 - DNA, 19 bp, Homo sapiens
cttctcccctccagacccc

SEQ ID NO: 5725517 - DNA, 22 bp, Homo sapiens
cttctcccctccagacccctac

SEQ ID NO: 5725518 - DNA, 17 bp, Homo sapiens
cttctcccctccccgcc

SEQ ID NO: 5725519 - DNA, 23 bp, Homo sapiens
cttctcccctccccgcctggcca

SEQ ID NO: 5725520 - DNA, 19 bp, Homo sapiens
cttctcccctcttctgagc

SEQ ID NO: 5725521 - DNA, 20 bp, Homo sapiens
cttctcccctcttctgagct

SEQ ID NO: 5725522 - DNA, 21 bp, Homo sapiens
cttctcccctcttctgagcta

SEQ ID NO: 5725523 - DNA, 14 bp, Homo sapiens
cttctcccctgcac

SEQ ID NO: 5725524 - DNA, 19 bp, Homo sapiens
cttctcccctgcactgtaa

SEQ ID NO: 5725525 - DNA, 20 bp, Homo sapiens
cttctcccctgcactgtaaa

SEQ ID NO: 5725526 - DNA, 21 bp, Homo sapiens
cttctcccctgcactgtaaaa

SEQ ID NO: 5725527 - DNA, 22 bp, Homo sapiens
cttctcccctgcactgtaaaat

SEQ ID NO: 5725528 - DNA, 23 bp, Homo sapiens
cttctcccctgcactgtaaaatg

SEQ ID NO: 5725529 - DNA, 15 bp, Homo sapiens
cttctcccctgcccc

SEQ ID NO: 5725530 - DNA, 15 bp, Homo sapiens
cttctcccctgccct

SEQ ID NO: 5725531 - DNA, 17 bp, Homo sapiens
cttctcccctgcccttc

SEQ ID NO: 5725532 - DNA, 20 bp, Homo sapiens
cttctccccttccatttctg

SEQ ID NO: 5725533 - DNA, 18 bp, Homo sapiens
cttctccccttcctggac

SEQ ID NO: 5725534 - DNA, 19 bp, Homo sapiens
cttctccccttcctggaca

SEQ ID NO: 5725535 - DNA, 20 bp, Homo sapiens
cttctcccgccattggcctt

SEQ ID NO: 5725536 - DNA, 15 bp, Homo sapiens
cttctcccggacctg

SEQ ID NO: 5725537 - DNA, 17 bp, Homo sapiens
cttctccctagcccttc

SEQ ID NO: 5725538 - DNA, 19 bp, Homo sapiens
cttctccctagctcctccc

SEQ ID NO: 5725539 - DNA, 18 bp, Homo sapiens
cttctccctattccctct

SEQ ID NO: 5725540 - DNA, 21 bp, Homo sapiens
cttctccctcctcctcctttc

SEQ ID NO: 5725541 - DNA, 11 bp, Homo sapiens
cttctccctgg

SEQ ID NO: 5725542 - DNA, 16 bp, Homo sapiens
cttctccctggaatga

SEQ ID NO: 5725543 - DNA, 16 bp, Homo sapiens
cttctccctggactct

SEQ ID NO: 5725544 - DNA, 21 bp, Homo sapiens
cttctccctggactctgtggg

SEQ ID NO: 5725545 - DNA, 12 bp, Homo sapiens
cttctccgccag

SEQ ID NO: 5725546 - DNA, 16 bp, Homo sapiens
cttctccgccagcctc

SEQ ID NO: 5725547 - DNA, 17 bp, Homo sapiens
cttctccgccagcctcc

SEQ ID NO: 5725548 - DNA, 18 bp, Homo sapiens
cttctccgccagcctcct

SEQ ID NO: 5725549 - DNA, 24 bp, Homo sapiens
cttctccgccagcctcctctggac

SEQ ID NO: 5725550 - DNA, 23 bp, Homo sapiens
cttctcctacatatcccttccag

SEQ ID NO: 5725551 - DNA, 15 bp, Homo sapiens
cttctcctatgtgta

SEQ ID NO: 5725552 - DNA, 14 bp, Homo sapiens
cttctcctcccaag

SEQ ID NO: 5725553 - DNA, 23 bp, Homo sapiens
cttctcctcccagcgtgtgtatc

SEQ ID NO: 5725554 - DNA, 16 bp, Homo sapiens
cttctcctctcctagc

SEQ ID NO: 5725555 - DNA, 15 bp, Homo sapiens
cttctcctctctggg

SEQ ID NO: 5725556 - DNA, 16 bp, Homo sapiens
cttctcctctctgggc

SEQ ID NO: 5725557 - DNA, 17 bp, Homo sapiens
cttctcctctctgggcc

SEQ ID NO: 5725558 - DNA, 18 bp, Homo sapiens
cttctcctctctgggcct

SEQ ID NO: 5725559 - DNA, 14 bp, Homo sapiens
cttctcctctggct

SEQ ID NO: 5725560 - DNA, 23 bp, Homo sapiens
cttctcctcttgtaaataaagcc

SEQ ID NO: 5725561 - DNA, 18 bp, Homo sapiens
cttctcctcttgtagcca

SEQ ID NO: 5725562 - DNA, 14 bp, Homo sapiens
cttctcctgaaatc

SEQ ID NO: 5725563 - DNA, 17 bp, Homo sapiens
cttctcctgaccagggc

SEQ ID NO: 5725564 - DNA, 19 bp, Homo sapiens
cttctcctgacccagtccc

SEQ ID NO: 5725565 - DNA, 13 bp, Homo sapiens
cttctcctgatcc

SEQ ID NO: 5725566 - DNA, 13 bp, Homo sapiens
cttctcctgcagt

SEQ ID NO: 5725567 - DNA, 16 bp, Homo sapiens
cttctcctgcagtctg

SEQ ID NO: 5725568 - DNA, 11 bp, Homo sapiens
cttctcctgcg

SEQ ID NO: 5725569 - DNA, 13 bp, Homo sapiens
cttctcctgctgc

SEQ ID NO: 5725570 - DNA, 23 bp, Homo sapiens
cttctcctggaccctggaagcag

SEQ ID NO: 5725571 - DNA, 11 bp, Homo sapiens
cttctcctgtg

SEQ ID NO: 5725572 - DNA, 12 bp, Homo sapiens
cttctcctgtga

SEQ ID NO: 5725573 - DNA, 13 bp, Homo sapiens
cttctcctgtgac

SEQ ID NO: 5725574 - DNA, 15 bp, Homo sapiens
cttctccttggagga

SEQ ID NO: 5725575 - DNA, 14 bp, Homo sapiens
cttctccttggctg

SEQ ID NO: 5725576 - DNA, 14 bp, Homo sapiens
cttctcctttcaca

SEQ ID NO: 5725577 - DNA, 17 bp, Homo sapiens
cttctcctttcacaacc

SEQ ID NO: 5725578 - DNA, 14 bp, Homo sapiens
cttctcctttcctt

SEQ ID NO: 5725579 - DNA, 21 bp, Homo sapiens
cttctcgaccacgggaagcat

SEQ ID NO: 5725580 - DNA, 18 bp, Homo sapiens
cttctcgcattttctcta

SEQ ID NO: 5725581 - DNA, 17 bp, Homo sapiens
cttctcgcctaggattt

SEQ ID NO: 5725582 - DNA, 15 bp, Homo sapiens
cttctcggagaccca

SEQ ID NO: 5725583 - DNA, 21 bp, Homo sapiens
cttctcggagctggcccaggg

SEQ ID NO: 5725584 - DNA, 21 bp, Homo sapiens
cttctcggaggccaggccctc

SEQ ID NO: 5725585 - DNA, 18 bp, Homo sapiens
cttctcggccagcccgtc

SEQ ID NO: 5725586 - DNA, 22 bp, Homo sapiens
cttctcggccagcccgtcctcc

SEQ ID NO: 5725587 - DNA, 14 bp, Homo sapiens
cttctcggctcagg

SEQ ID NO: 5725588 - DNA, 18 bp, Homo sapiens
cttctcggggtgggacag

SEQ ID NO: 5725589 - DNA, 19 bp, Homo sapiens
cttctcgtagatgctgcct

SEQ ID NO: 5725590 - DNA, 15 bp, Homo sapiens
cttctcgtcttcctc

SEQ ID NO: 5725591 - DNA, 16 bp, Homo sapiens
cttctcgtcttcctct

SEQ ID NO: 5725592 - DNA, 19 bp, Homo sapiens
cttctcgtgtttgcttaaa

SEQ ID NO: 5725593 - DNA, 20 bp, Homo sapiens
cttctctaaatgaggggcct

SEQ ID NO: 5725594 - DNA, 11 bp, Homo sapiens
cttctctacag

SEQ ID NO: 5725595 - DNA, 19 bp, Homo sapiens
cttctctacagaggtgaaa

SEQ ID NO: 5725596 - DNA, 20 bp, Homo sapiens
cttctctacccatcttaaaa

SEQ ID NO: 5725597 - DNA, 17 bp, Homo sapiens
cttctctactctggaag

SEQ ID NO: 5725598 - DNA, 21 bp, Homo sapiens
cttctctactgtgtgaaatga

SEQ ID NO: 5725599 - DNA, 23 bp, Homo sapiens
cttctctagtttcccctctcatc

SEQ ID NO: 5725600 - DNA, 17 bp, Homo sapiens
cttctctataaaaaata

SEQ ID NO: 5725601 - DNA, 14 bp, Homo sapiens
cttctctatatttt

SEQ ID NO: 5725602 - DNA, 16 bp, Homo sapiens
cttctctatattttta

SEQ ID NO: 5725603 - DNA, 21 bp, Homo sapiens
cttctctatatttttatttca

SEQ ID NO: 5725604 - DNA, 15 bp, Homo sapiens
cttctctatcctctc

SEQ ID NO: 5725605 - DNA, 17 bp, Homo sapiens
cttctctatcctctctc

SEQ ID NO: 5725606 - DNA, 21 bp, Homo sapiens
cttctctatgataattacaat

SEQ ID NO: 5725607 - DNA, 23 bp, Homo sapiens
cttctctattcctgaccctccct

SEQ ID NO: 5725608 - DNA, 13 bp, Homo sapiens
cttctctcaaagg

SEQ ID NO: 5725609 - DNA, 20 bp, Homo sapiens
cttctctcaaagggaagctg

SEQ ID NO: 5725610 - DNA, 19 bp, Homo sapiens
cttctctcaaccttggcct

SEQ ID NO: 5725611 - DNA, 20 bp, Homo sapiens
cttctctcaaccttggcctt

SEQ ID NO: 5725612 - DNA, 21 bp, Homo sapiens
cttctctcaaccttggccttc

SEQ ID NO: 5725613 - DNA, 20 bp, Homo sapiens
cttctctcaatccctttgca

SEQ ID NO: 5725614 - DNA, 21 bp, Homo sapiens
cttctctcaatccctttgcaa

SEQ ID NO: 5725615 - DNA, 23 bp, Homo sapiens
cttctctcactgtgttactgctt

SEQ ID NO: 5725616 - DNA, 14 bp, Homo sapiens
cttctctcacttct

SEQ ID NO: 5725617 - DNA, 16 bp, Homo sapiens
cttctctcacttctaa

SEQ ID NO: 5725618 - DNA, 15 bp, Homo sapiens
cttctctcagcctcc

SEQ ID NO: 5725619 - DNA, 21 bp, Homo sapiens
cttctctcagcctccactccc

SEQ ID NO: 5725620 - DNA, 19 bp, Homo sapiens
cttctctcagctcccaggc

SEQ ID NO: 5725621 - DNA, 16 bp, Homo sapiens
cttctctcatctctta

SEQ ID NO: 5725622 - DNA, 22 bp, Homo sapiens
cttctctccacatggaagccca

SEQ ID NO: 5725623 - DNA, 18 bp, Homo sapiens
cttctctccacttctggt

SEQ ID NO: 5725624 - DNA, 15 bp, Homo sapiens
cttctctccagctga

SEQ ID NO: 5725625 - DNA, 18 bp, Homo sapiens
cttctctccagctgacta

SEQ ID NO: 5725626 - DNA, 15 bp, Homo sapiens
cttctctccccagcc

SEQ ID NO: 5725627 - DNA, 18 bp, Homo sapiens
cttctctccccagccccc

SEQ ID NO: 5725628 - DNA, 20 bp, Homo sapiens
cttctctccccagccccctc

SEQ ID NO: 5725629 - DNA, 13 bp, Homo sapiens
cttctctcctccc

SEQ ID NO: 5725630 - DNA, 15 bp, Homo sapiens
cttctctccttgccc

SEQ ID NO: 5725631 - DNA, 21 bp, Homo sapiens
cttctctcctttctccctgca

SEQ ID NO: 5725632 - DNA, 21 bp, Homo sapiens
cttctctcggggcgacccctc

SEQ ID NO: 5725633 - DNA, 15 bp, Homo sapiens
cttctctctccaggg

SEQ ID NO: 5725634 - DNA, 17 bp, Homo sapiens
cttctctctccctgtca

SEQ ID NO: 5725635 - DNA, 23 bp, Homo sapiens
cttctctctccctgtcacacact

SEQ ID NO: 5725636 - DNA, 15 bp, Homo sapiens
cttctctctctctca

SEQ ID NO: 5725637 - DNA, 20 bp, Homo sapiens
cttctctctctctctctcgc

SEQ ID NO: 5725638 - DNA, 12 bp, Homo sapiens
cttctctctgag

SEQ ID NO: 5725639 - DNA, 14 bp, Homo sapiens
cttctctctgagct

SEQ ID NO: 5725640 - DNA, 14 bp, Homo sapiens
cttctctctgtgct

SEQ ID NO: 5725641 - DNA, 13 bp, Homo sapiens
cttctctctgtgg

SEQ ID NO: 5725642 - DNA, 13 bp, Homo sapiens
cttctctctgttc

SEQ ID NO: 5725643 - DNA, 17 bp, Homo sapiens
cttctctctgttccctt

SEQ ID NO: 5725644 - DNA, 15 bp, Homo sapiens
cttctctctttgtcc

SEQ ID NO: 5725645 - DNA, 16 bp, Homo sapiens
cttctctcttttcctc

SEQ ID NO: 5725646 - DNA, 21 bp, Homo sapiens
cttctctgaacacaggcagct

SEQ ID NO: 5725647 - DNA, 11 bp, Homo sapiens
cttctctgaag

SEQ ID NO: 5725648 - DNA, 13 bp, Homo sapiens
cttctctgaagga

SEQ ID NO: 5725649 - DNA, 13 bp, Homo sapiens
cttctctgaatca

SEQ ID NO: 5725650 - DNA, 12 bp, Homo sapiens
cttctctgactt

SEQ ID NO: 5725651 - DNA, 17 bp, Homo sapiens
cttctctgagtcagctg

SEQ ID NO: 5725652 - DNA, 13 bp, Homo sapiens
cttctctgcaatg

SEQ ID NO: 5725653 - DNA, 12 bp, Homo sapiens
cttctctgcagt

SEQ ID NO: 5725654 - DNA, 15 bp, Homo sapiens
cttctctgcagtaaa

SEQ ID NO: 5725655 - DNA, 19 bp, Homo sapiens
cttctctgcccagcttttc

SEQ ID NO: 5725656 - DNA, 16 bp, Homo sapiens
cttctctgcccattcc

SEQ ID NO: 5725657 - DNA, 19 bp, Homo sapiens
cttctctgcccattcccca

SEQ ID NO: 5725658 - DNA, 18 bp, Homo sapiens
cttctctgccctgccctg

SEQ ID NO: 5725659 - DNA, 13 bp, Homo sapiens
cttctctgcctca

SEQ ID NO: 5725660 - DNA, 20 bp, Homo sapiens
cttctctgcctccctaagtt

SEQ ID NO: 5725661 - DNA, 19 bp, Homo sapiens
cttctctgcctttgacatt

SEQ ID NO: 5725662 - DNA, 14 bp, Homo sapiens
cttctctgctccac

SEQ ID NO: 5725663 - DNA, 15 bp, Homo sapiens
cttctctgctccacc

SEQ ID NO: 5725664 - DNA, 20 bp, Homo sapiens
cttctctgctccttattccc

SEQ ID NO: 5725665 - DNA, 12 bp, Homo sapiens
cttctctgctgc

SEQ ID NO: 5725666 - DNA, 22 bp, Homo sapiens
cttctctgctgcctctgtggaa

SEQ ID NO: 5725667 - DNA, 11 bp, Homo sapiens
cttctctggag

SEQ ID NO: 5725668 - DNA, 12 bp, Homo sapiens
cttctctggaga

SEQ ID NO: 5725669 - DNA, 13 bp, Homo sapiens
cttctctggagaa

SEQ ID NO: 5725670 - DNA, 13 bp, Homo sapiens
cttctctgggacc

SEQ ID NO: 5725671 - DNA, 19 bp, Homo sapiens
cttctctgggaccaggctc

SEQ ID NO: 5725672 - DNA, 22 bp, Homo sapiens
cttctctgggaccaggctccaa

SEQ ID NO: 5725673 - DNA, 17 bp, Homo sapiens
cttctctgggtcccggg

SEQ ID NO: 5725674 - DNA, 16 bp, Homo sapiens
cttctctggtctcctt

SEQ ID NO: 5725675 - DNA, 20 bp, Homo sapiens
cttctctgtcctctgctttg

SEQ ID NO: 5725676 - DNA, 12 bp, Homo sapiens
cttctctgtctc

SEQ ID NO: 5725677 - DNA, 12 bp, Homo sapiens
cttctctgtgaa

SEQ ID NO: 5725678 - DNA, 21 bp, Homo sapiens
cttctctgtgaacgatttaga

SEQ ID NO: 5725679 - DNA, 14 bp, Homo sapiens
cttctctgtgagaa

SEQ ID NO: 5725680 - DNA, 21 bp, Homo sapiens
cttctctgtgcccctgtaaat

SEQ ID NO: 5725681 - DNA, 19 bp, Homo sapiens
cttctctgttggtctgcct

SEQ ID NO: 5725682 - DNA, 16 bp, Homo sapiens
cttctcttaaacttgt

SEQ ID NO: 5725683 - DNA, 19 bp, Homo sapiens
cttctcttaaacttgtgaa

SEQ ID NO: 5725684 - DNA, 12 bp, Homo sapiens
cttctcttaatt

SEQ ID NO: 5725685 - DNA, 21 bp, Homo sapiens
cttctcttacattttcgtcct

SEQ ID NO: 5725686 - DNA, 14 bp, Homo sapiens
cttctcttcactag

SEQ ID NO: 5725687 - DNA, 17 bp, Homo sapiens
cttctcttccaggcagc

SEQ ID NO: 5725688 - DNA, 14 bp, Homo sapiens
cttctcttcctgta

SEQ ID NO: 5725689 - DNA, 22 bp, Homo sapiens
cttctcttccttttatcagtag

SEQ ID NO: 5725690 - DNA, 14 bp, Homo sapiens
cttctcttctctgc

SEQ ID NO: 5725691 - DNA, 18 bp, Homo sapiens
cttctcttctctgcaatg

SEQ ID NO: 5725692 - DNA, 17 bp, Homo sapiens
cttctcttgaaaagttc

SEQ ID NO: 5725693 - DNA, 20 bp, Homo sapiens
cttctcttgaaaagttcagg

SEQ ID NO: 5725694 - DNA, 21 bp, Homo sapiens
cttctcttgaaaagttcaggg

SEQ ID NO: 5725695 - DNA, 20 bp, Homo sapiens
cttctcttgggaactccact

SEQ ID NO: 5725696 - DNA, 12 bp, Homo sapiens
cttctcttgggt

SEQ ID NO: 5725697 - DNA, 15 bp, Homo sapiens
cttctcttgggtggg

SEQ ID NO: 5725698 - DNA, 21 bp, Homo sapiens
cttctcttgggtgggacaggg

SEQ ID NO: 5725699 - DNA, 23 bp, Homo sapiens
cttctcttgggtgggacagggct

SEQ ID NO: 5725700 - DNA, 19 bp, Homo sapiens
cttctctttaactcaggac

SEQ ID NO: 5725701 - DNA, 20 bp, Homo sapiens
cttctctttaactcaggact

SEQ ID NO: 5725702 - DNA, 12 bp, Homo sapiens
cttctctttcaa

SEQ ID NO: 5725703 - DNA, 16 bp, Homo sapiens
cttctctttcaatgtg

SEQ ID NO: 5725704 - DNA, 21 bp, Homo sapiens
cttctctttcttattttgtaa

SEQ ID NO: 5725705 - DNA, 16 bp, Homo sapiens
cttctctttgcctcaa

SEQ ID NO: 5725706 - DNA, 12 bp, Homo sapiens
cttctctttgtg

SEQ ID NO: 5725707 - DNA, 14 bp, Homo sapiens
cttctcttttcctc

SEQ ID NO: 5725708 - DNA, 17 bp, Homo sapiens
cttctcttttcctcgca

SEQ ID NO: 5725709 - DNA, 23 bp, Homo sapiens
cttctcttttcctcgcagatgat

SEQ ID NO: 5725710 - DNA, 17 bp, Homo sapiens
cttctgaaaaatgaatg

SEQ ID NO: 5725711 - DNA, 21 bp, Homo sapiens
cttctgaaaggtgctttctcc

SEQ ID NO: 5725712 - DNA, 11 bp, Homo sapiens
cttctgaaata

SEQ ID NO: 5725713 - DNA, 12 bp, Homo sapiens
cttctgaaatac

SEQ ID NO: 5725714 - DNA, 15 bp, Homo sapiens
cttctgaaatgaaac

SEQ ID NO: 5725715 - DNA, 23 bp, Homo sapiens
cttctgaaatgaaacaaataatc

SEQ ID NO: 5725716 - DNA, 12 bp, Homo sapiens
cttctgaactca

SEQ ID NO: 5725717 - DNA, 23 bp, Homo sapiens
cttctgaactccatacagcctct

SEQ ID NO: 5725718 - DNA, 19 bp, Homo sapiens
cttctgaacttggcgctgc

SEQ ID NO: 5725719 - DNA, 15 bp, Homo sapiens
cttctgaagatctca

SEQ ID NO: 5725720 - DNA, 21 bp, Homo sapiens
cttctgaagatggaaggcctt

SEQ ID NO: 5725721 - DNA, 14 bp, Homo sapiens
cttctgaagctgct

SEQ ID NO: 5725722 - DNA, 16 bp, Homo sapiens
cttctgaagctgctgc

SEQ ID NO: 5725723 - DNA, 13 bp, Homo sapiens
cttctgaagtaat

SEQ ID NO: 5725724 - DNA, 15 bp, Homo sapiens
cttctgaagtaattt

SEQ ID NO: 5725725 - DNA, 20 bp, Homo sapiens
cttctgaagtctgagcccat

SEQ ID NO: 5725726 - DNA, 22 bp, Homo sapiens
cttctgaagtctgagcccattt

SEQ ID NO: 5725727 - DNA, 21 bp, Homo sapiens
cttctgaagtgtgtccatcct

SEQ ID NO: 5725728 - DNA, 18 bp, Homo sapiens
cttctgaatattttatct

SEQ ID NO: 5725729 - DNA, 11 bp, Homo sapiens
cttctgaatca

SEQ ID NO: 5725730 - DNA, 15 bp, Homo sapiens
cttctgaatcactgt

SEQ ID NO: 5725731 - DNA, 16 bp, Homo sapiens
cttctgaatgctgcta

SEQ ID NO: 5725732 - DNA, 21 bp, Homo sapiens
cttctgaatgtgctgatcatt

SEQ ID NO: 5725733 - DNA, 20 bp, Homo sapiens
cttctgacaaaggtggtaaa

SEQ ID NO: 5725734 - DNA, 21 bp, Homo sapiens
cttctgacaaaggtggtaaat

SEQ ID NO: 5725735 - DNA, 15 bp, Homo sapiens
cttctgacagcccaa

SEQ ID NO: 5725736 - DNA, 15 bp, Homo sapiens
cttctgacagcctca

SEQ ID NO: 5725737 - DNA, 14 bp, Homo sapiens
cttctgaccacact

SEQ ID NO: 5725738 - DNA, 17 bp, Homo sapiens
cttctgaccacacttcc

SEQ ID NO: 5725739 - DNA, 18 bp, Homo sapiens
cttctgaccacacttcct

SEQ ID NO: 5725740 - DNA, 17 bp, Homo sapiens
cttctgacccaaagcaa

SEQ ID NO: 5725741 - DNA, 18 bp, Homo sapiens
cttctgacccatgctgcc

SEQ ID NO: 5725742 - DNA, 21 bp, Homo sapiens
cttctgacccatgctgccctg

SEQ ID NO: 5725743 - DNA, 14 bp, Homo sapiens
cttctgacctcagc

SEQ ID NO: 5725744 - DNA, 14 bp, Homo sapiens
cttctgacctcccc

SEQ ID NO: 5725745 - DNA, 15 bp, Homo sapiens
cttctgaccttgctg

SEQ ID NO: 5725746 - DNA, 22 bp, Homo sapiens
cttctgaccttttggtgaaagc

SEQ ID NO: 5725747 - DNA, 20 bp, Homo sapiens
cttctgacgcagcctgagaa

SEQ ID NO: 5725748 - DNA, 18 bp, Homo sapiens
cttctgacggccctgcaa

SEQ ID NO: 5725749 - DNA, 19 bp, Homo sapiens
cttctgacggccctgcaat

SEQ ID NO: 5725750 - DNA, 20 bp, Homo sapiens
cttctgacgtgccttttgca

SEQ ID NO: 5725751 - DNA, 22 bp, Homo sapiens
cttctgacgtgccttttgcacc

SEQ ID NO: 5725752 - DNA, 16 bp, Homo sapiens
cttctgactcttcccc

SEQ ID NO: 5725753 - DNA, 23 bp, Homo sapiens
cttctgactcttccccaggaagg

SEQ ID NO: 5725754 - DNA, 22 bp, Homo sapiens
cttctgactgccccctcctgtg

SEQ ID NO: 5725755 - DNA, 14 bp, Homo sapiens
cttctgactgtcac

SEQ ID NO: 5725756 - DNA, 14 bp, Homo sapiens
cttctgactgttta

SEQ ID NO: 5725757 - DNA, 15 bp, Homo sapiens
cttctgactgtttat

SEQ ID NO: 5725758 - DNA, 18 bp, Homo sapiens
cttctgacttaagtgtgc

SEQ ID NO: 5725759 - DNA, 15 bp, Homo sapiens
cttctgagcactgtt

SEQ ID NO: 5725760 - DNA, 19 bp, Homo sapiens
cttctgagccccagcccca

SEQ ID NO: 5725761 - DNA, 16 bp, Homo sapiens
cttctgagctccacct

SEQ ID NO: 5725762 - DNA, 13 bp, Homo sapiens
cttctgagctcct

SEQ ID NO: 5725763 - DNA, 14 bp, Homo sapiens
cttctgagctcctg

SEQ ID NO: 5725764 - DNA, 15 bp, Homo sapiens
cttctgagctcctgt

SEQ ID NO: 5725765 - DNA, 16 bp, Homo sapiens
cttctgagctcctgtc

SEQ ID NO: 5725766 - DNA, 22 bp, Homo sapiens
cttctgaggaccgctgataagc

SEQ ID NO: 5725767 - DNA, 20 bp, Homo sapiens
cttctgagtaattaataaag

SEQ ID NO: 5725768 - DNA, 14 bp, Homo sapiens
cttctgagtattct

SEQ ID NO: 5725769 - DNA, 16 bp, Homo sapiens
cttctgagtattctca

SEQ ID NO: 5725770 - DNA, 13 bp, Homo sapiens
cttctgagtggtg

SEQ ID NO: 5725771 - DNA, 22 bp, Homo sapiens
cttctgataatttattgtcttt

SEQ ID NO: 5725772 - DNA, 13 bp, Homo sapiens
cttctgatcttgg

SEQ ID NO: 5725773 - DNA, 17 bp, Homo sapiens
cttctgatgaatcttgc

SEQ ID NO: 5725774 - DNA, 19 bp, Homo sapiens
cttctgatgaatcttgcgt

SEQ ID NO: 5725775 - DNA, 14 bp, Homo sapiens
cttctgatttagca

SEQ ID NO: 5725776 - DNA, 23 bp, Homo sapiens
cttctgatttagcaatgctgtga

SEQ ID NO: 5725777 - DNA, 17 bp, Homo sapiens
cttctgatttttctctt

SEQ ID NO: 5725778 - DNA, 20 bp, Homo sapiens
cttctgatttttctcttttt

SEQ ID NO: 5725779 - DNA, 16 bp, Homo sapiens
cttctgcaaagtggca

SEQ ID NO: 5725780 - DNA, 17 bp, Homo sapiens
cttctgcaactgaaatt

SEQ ID NO: 5725781 - DNA, 18 bp, Homo sapiens
cttctgcaagcctcatgc

SEQ ID NO: 5725782 - DNA, 19 bp, Homo sapiens
cttctgcaattgcttagga

SEQ ID NO: 5725783 - DNA, 16 bp, Homo sapiens
cttctgcacaaagatg

SEQ ID NO: 5725784 - DNA, 18 bp, Homo sapiens
cttctgcacaaagatgtc

SEQ ID NO: 5725785 - DNA, 12 bp, Homo sapiens
cttctgcaccct

SEQ ID NO: 5725786 - DNA, 14 bp, Homo sapiens
cttctgcaccctcc

SEQ ID NO: 5725787 - DNA, 18 bp, Homo sapiens
cttctgcaccctccaccc

SEQ ID NO: 5725788 - DNA, 20 bp, Homo sapiens
cttctgcaccctccaccctg

SEQ ID NO: 5725789 - DNA, 21 bp, Homo sapiens
cttctgcagcaactcccacga

SEQ ID NO: 5725790 - DNA, 23 bp, Homo sapiens
cttctgcagcaactcccacgact

SEQ ID NO: 5725791 - DNA, 14 bp, Homo sapiens
cttctgcagcagga

SEQ ID NO: 5725792 - DNA, 17 bp, Homo sapiens
cttctgcagcaggaact

SEQ ID NO: 5725793 - DNA, 16 bp, Homo sapiens
cttctgcagctttggc

SEQ ID NO: 5725794 - DNA, 11 bp, Homo sapiens
cttctgcatca

SEQ ID NO: 5725795 - DNA, 22 bp, Homo sapiens
cttctgcatcaaaggagattct

SEQ ID NO: 5725796 - DNA, 19 bp, Homo sapiens
cttctgcattcctgtaact

SEQ ID NO: 5725797 - DNA, 14 bp, Homo sapiens
cttctgccaagaga

SEQ ID NO: 5725798 - DNA, 20 bp, Homo sapiens
cttctgccaccagcccctcc

SEQ ID NO: 5725799 - DNA, 11 bp, Homo sapiens
cttctgccact

SEQ ID NO: 5725800 - DNA, 14 bp, Homo sapiens
cttctgccacttcc

SEQ ID NO: 5725801 - DNA, 17 bp, Homo sapiens
cttctgccacttcccag

SEQ ID NO: 5725802 - DNA, 14 bp, Homo sapiens
cttctgccagaaga

SEQ ID NO: 5725803 - DNA, 13 bp, Homo sapiens
cttctgcccaaat

SEQ ID NO: 5725804 - DNA, 20 bp, Homo sapiens
cttctgcccaaatcccctcc

SEQ ID NO: 5725805 - DNA, 21 bp, Homo sapiens
cttctgcccaccccgcctctg

SEQ ID NO: 5725806 - DNA, 22 bp, Homo sapiens
cttctgcccatcctgtctgttc

SEQ ID NO: 5725807 - DNA, 21 bp, Homo sapiens
cttctgcccccgttccagctg

SEQ ID NO: 5725808 - DNA, 22 bp, Homo sapiens
cttctgccctaacctgacagag

SEQ ID NO: 5725809 - DNA, 15 bp, Homo sapiens
cttctgccctcctgc

SEQ ID NO: 5725810 - DNA, 19 bp, Homo sapiens
cttctgcccttcctccagg

SEQ ID NO: 5725811 - DNA, 16 bp, Homo sapiens
cttctgccctttccta

SEQ ID NO: 5725812 - DNA, 19 bp, Homo sapiens
cttctgccctttcctaggc

SEQ ID NO: 5725813 - DNA, 22 bp, Homo sapiens
cttctgccctttcctaggccca

SEQ ID NO: 5725814 - DNA, 19 bp, Homo sapiens
cttctgcctaacttgtaaa

SEQ ID NO: 5725815 - DNA, 13 bp, Homo sapiens
cttctgcctcagc

SEQ ID NO: 5725816 - DNA, 19 bp, Homo sapiens
cttctgcctcccactccat

SEQ ID NO: 5725817 - DNA, 16 bp, Homo sapiens
cttctgcctggagact

SEQ ID NO: 5725818 - DNA, 12 bp, Homo sapiens
cttctgcctggg

SEQ ID NO: 5725819 - DNA, 20 bp, Homo sapiens
cttctgcctggggtgcattt

SEQ ID NO: 5725820 - DNA, 21 bp, Homo sapiens
cttctgccttagtctcagttt

SEQ ID NO: 5725821 - DNA, 14 bp, Homo sapiens
cttctgccttctca

SEQ ID NO: 5725822 - DNA, 13 bp, Homo sapiens
cttctgccttttt

SEQ ID NO: 5725823 - DNA, 17 bp, Homo sapiens
cttctgcgccgccctcc

SEQ ID NO: 5725824 - DNA, 14 bp, Homo sapiens
cttctgcggccaga

SEQ ID NO: 5725825 - DNA, 17 bp, Homo sapiens
cttctgcgggctccctc

SEQ ID NO: 5725826 - DNA, 16 bp, Homo sapiens
cttctgcgtccaccag

SEQ ID NO: 5725827 - DNA, 21 bp, Homo sapiens
cttctgcgtccaccaggcctc

SEQ ID NO: 5725828 - DNA, 22 bp, Homo sapiens
cttctgcgtccaccaggcctca

SEQ ID NO: 5725829 - DNA, 17 bp, Homo sapiens
cttctgcgtttgtccct

SEQ ID NO: 5725830 - DNA, 19 bp, Homo sapiens
cttctgctactggcaaaag

SEQ ID NO: 5725831 - DNA, 23 bp, Homo sapiens
cttctgctaggtagaggcatttg

SEQ ID NO: 5725832 - DNA, 16 bp, Homo sapiens
cttctgctcacattcc

SEQ ID NO: 5725833 - DNA, 22 bp, Homo sapiens
cttctgctcacattccctctca

SEQ ID NO: 5725834 - DNA, 14 bp, Homo sapiens
cttctgctcagctc

SEQ ID NO: 5725835 - DNA, 15 bp, Homo sapiens
cttctgctcagctct

SEQ ID NO: 5725836 - DNA, 16 bp, Homo sapiens
cttctgctcagctctg

SEQ ID NO: 5725837 - DNA, 18 bp, Homo sapiens
cttctgctcagctctggg

SEQ ID NO: 5725838 - DNA, 12 bp, Homo sapiens
cttctgctccac

SEQ ID NO: 5725839 - DNA, 21 bp, Homo sapiens
cttctgctccacccttggcct

SEQ ID NO: 5725840 - DNA, 16 bp, Homo sapiens
cttctgctccagcccc

SEQ ID NO: 5725841 - DNA, 14 bp, Homo sapiens
cttctgctcccacc

SEQ ID NO: 5725842 - DNA, 12 bp, Homo sapiens
cttctgctgaaa

SEQ ID NO: 5725843 - DNA, 22 bp, Homo sapiens
cttctgctgaaagactcgagaa

SEQ ID NO: 5725844 - DNA, 15 bp, Homo sapiens
cttctgctgcccagg

SEQ ID NO: 5725845 - DNA, 22 bp, Homo sapiens
cttctgctgcccaggccacagc

SEQ ID NO: 5725846 - DNA, 14 bp, Homo sapiens
cttctgctgcctgt

SEQ ID NO: 5725847 - DNA, 14 bp, Homo sapiens
cttctgctggagga

SEQ ID NO: 5725848 - DNA, 13 bp, Homo sapiens
cttctgctggggc

SEQ ID NO: 5725849 - DNA, 13 bp, Homo sapiens
cttctgctgtaca

SEQ ID NO: 5725850 - DNA, 14 bp, Homo sapiens
cttctgctgttctt

SEQ ID NO: 5725851 - DNA, 16 bp, Homo sapiens
cttctgcttaggagag

SEQ ID NO: 5725852 - DNA, 18 bp, Homo sapiens
cttctgcttaggagagac

SEQ ID NO: 5725853 - DNA, 18 bp, Homo sapiens
cttctgcttcagcctccc

SEQ ID NO: 5725854 - DNA, 15 bp, Homo sapiens
cttctgcttctccct

SEQ ID NO: 5725855 - DNA, 16 bp, Homo sapiens
cttctgcttgtcatcc

SEQ ID NO: 5725856 - DNA, 23 bp, Homo sapiens
cttctgctttctattacccctca

SEQ ID NO: 5725857 - DNA, 20 bp, Homo sapiens
cttctgctttgttgtgtgcc

SEQ ID NO: 5725858 - DNA, 22 bp, Homo sapiens
cttctgctttgttgtgtgcctc

SEQ ID NO: 5725859 - DNA, 14 bp, Homo sapiens
cttctgcttttctg

SEQ ID NO: 5725860 - DNA, 18 bp, Homo sapiens
cttctgcttttctgccct

SEQ ID NO: 5725861 - DNA, 19 bp, Homo sapiens
cttctgcttttctgccctg

SEQ ID NO: 5725862 - DNA, 13 bp, Homo sapiens
cttctgctttttc

SEQ ID NO: 5725863 - DNA, 22 bp, Homo sapiens
cttctggaaggctggctgagtg

SEQ ID NO: 5725864 - DNA, 18 bp, Homo sapiens
cttctggaatactgaaaa

SEQ ID NO: 5725865 - DNA, 15 bp, Homo sapiens
cttctggactggttt

SEQ ID NO: 5725866 - DNA, 18 bp, Homo sapiens
cttctggagcagaacttt

SEQ ID NO: 5725867 - DNA, 18 bp, Homo sapiens
cttctggaggtggggagg

SEQ ID NO: 5725868 - DNA, 17 bp, Homo sapiens
cttctggatccatgggg

SEQ ID NO: 5725869 - DNA, 19 bp, Homo sapiens
cttctggattcaagtgatt

SEQ ID NO: 5725870 - DNA, 15 bp, Homo sapiens
cttctggattcttgg

SEQ ID NO: 5725871 - DNA, 17 bp, Homo sapiens
cttctggattcttggcc

SEQ ID NO: 5725872 - DNA, 15 bp, Homo sapiens
cttctggccaggaag

SEQ ID NO: 5725873 - DNA, 22 bp, Homo sapiens
cttctggccaggaagctttggt

SEQ ID NO: 5725874 - DNA, 15 bp, Homo sapiens
cttctggcctcccac

SEQ ID NO: 5725875 - DNA, 15 bp, Homo sapiens
cttctggcctctgct

SEQ ID NO: 5725876 - DNA, 22 bp, Homo sapiens
cttctggcctttcctctctcct

SEQ ID NO: 5725877 - DNA, 16 bp, Homo sapiens
cttctggctcacagga

SEQ ID NO: 5725878 - DNA, 12 bp, Homo sapiens
cttctggctcca

SEQ ID NO: 5725879 - DNA, 13 bp, Homo sapiens
cttctggctccaa

SEQ ID NO: 5725880 - DNA, 22 bp, Homo sapiens
cttctggctccaaggtgctctg

SEQ ID NO: 5725881 - DNA, 22 bp, Homo sapiens
cttctggctccctcttctttca

SEQ ID NO: 5725882 - DNA, 16 bp, Homo sapiens
cttctggctgctgcag

SEQ ID NO: 5725883 - DNA, 21 bp, Homo sapiens
cttctggcttagtctgttttc

SEQ ID NO: 5725884 - DNA, 16 bp, Homo sapiens
cttctggcttcagccc

SEQ ID NO: 5725885 - DNA, 21 bp, Homo sapiens
cttctgggaagacaactagga

SEQ ID NO: 5725886 - DNA, 22 bp, Homo sapiens
cttctgggaaggggtttctaac

SEQ ID NO: 5725887 - DNA, 21 bp, Homo sapiens
cttctgggacaggcaccatgc

SEQ ID NO: 5725888 - DNA, 22 bp, Homo sapiens
cttctgggacaggcaccatgct

SEQ ID NO: 5725889 - DNA, 17 bp, Homo sapiens
cttctgggacctgtgtt

SEQ ID NO: 5725890 - DNA, 15 bp, Homo sapiens
cttctgggagggcag

SEQ ID NO: 5725891 - DNA, 15 bp, Homo sapiens
cttctgggcaagggc

SEQ ID NO: 5725892 - DNA, 18 bp, Homo sapiens
cttctgggcaagggctcc

SEQ ID NO: 5725893 - DNA, 16 bp, Homo sapiens
cttctgggcacagtgg

SEQ ID NO: 5725894 - DNA, 14 bp, Homo sapiens
cttctgggcagagc

SEQ ID NO: 5725895 - DNA, 15 bp, Homo sapiens
cttctgggcagagcc

SEQ ID NO: 5725896 - DNA, 16 bp, Homo sapiens
cttctgggcagagcct

SEQ ID NO: 5725897 - DNA, 23 bp, Homo sapiens
cttctgggcagatgaaaagctac

SEQ ID NO: 5725898 - DNA, 19 bp, Homo sapiens
cttctgggcatctgttctg

SEQ ID NO: 5725899 - DNA, 14 bp, Homo sapiens
cttctgggcctgat

SEQ ID NO: 5725900 - DNA, 19 bp, Homo sapiens
cttctgggcgtctgagctg

SEQ ID NO: 5725901 - DNA, 21 bp, Homo sapiens
cttctgggcgtctgagctggg

SEQ ID NO: 5725902 - DNA, 24 bp, Homo sapiens
cttctgggctactgccactgtgtg

SEQ ID NO: 5725903 - DNA, 23 bp, Homo sapiens
cttctgggctgcgggaggccctg

SEQ ID NO: 5725904 - DNA, 21 bp, Homo sapiens
cttctgggcttcatctggcaa

SEQ ID NO: 5725905 - DNA, 17 bp, Homo sapiens
cttctgggcttcattct

SEQ ID NO: 5725906 - DNA, 20 bp, Homo sapiens
cttctgggcttcattctgga

SEQ ID NO: 5725907 - DNA, 21 bp, Homo sapiens
cttctgggcttcattctggaa

SEQ ID NO: 5725908 - DNA, 15 bp, Homo sapiens
cttctggggacagac

SEQ ID NO: 5725909 - DNA, 18 bp, Homo sapiens
cttctggggagggacaca

SEQ ID NO: 5725910 - DNA, 22 bp, Homo sapiens
cttctggggagggacacagagg

SEQ ID NO: 5725911 - DNA, 19 bp, Homo sapiens
cttctggggcaggctgggc

SEQ ID NO: 5725912 - DNA, 21 bp, Homo sapiens
cttctggggcaggctgggcca

SEQ ID NO: 5725913 - DNA, 18 bp, Homo sapiens
cttctggggccagcccct

SEQ ID NO: 5725914 - DNA, 20 bp, Homo sapiens
cttctggggccagcccctcc

SEQ ID NO: 5725915 - DNA, 15 bp, Homo sapiens
cttctgggggtcact

SEQ ID NO: 5725916 - DNA, 22 bp, Homo sapiens
cttctggggtcaggtgccactg

SEQ ID NO: 5725917 - DNA, 19 bp, Homo sapiens
cttctggggtccccagggc

SEQ ID NO: 5725918 - DNA, 24 bp, Homo sapiens
cttctgggtagtcccctgttgatt

SEQ ID NO: 5725919 - DNA, 17 bp, Homo sapiens
cttctgggtcatgcact

SEQ ID NO: 5725920 - DNA, 20 bp, Homo sapiens
cttctgggtcatgcactgag

SEQ ID NO: 5725921 - DNA, 18 bp, Homo sapiens
cttctgggtccagggagg

SEQ ID NO: 5725922 - DNA, 14 bp, Homo sapiens
cttctgggtggctc

SEQ ID NO: 5725923 - DNA, 16 bp, Homo sapiens
cttctgggtggctcct

SEQ ID NO: 5725924 - DNA, 20 bp, Homo sapiens
cttctgggtggctcctgcca

SEQ ID NO: 5725925 - DNA, 21 bp, Homo sapiens
cttctgggtggctcctgccac

SEQ ID NO: 5725926 - DNA, 19 bp, Homo sapiens
cttctggtactctcctaga

SEQ ID NO: 5725927 - DNA, 15 bp, Homo sapiens
cttctggtatcttgt

SEQ ID NO: 5725928 - DNA, 14 bp, Homo sapiens
cttctggtcccctg

SEQ ID NO: 5725929 - DNA, 18 bp, Homo sapiens
cttctggtgctgctgggg

SEQ ID NO: 5725930 - DNA, 18 bp, Homo sapiens
cttctggtgttgactgga

SEQ ID NO: 5725931 - DNA, 19 bp, Homo sapiens
cttctggttgtatttctat

SEQ ID NO: 5725932 - DNA, 19 bp, Homo sapiens
cttctggttttcgaagact

SEQ ID NO: 5725933 - DNA, 22 bp, Homo sapiens
cttctgtacagtaagaccacct

SEQ ID NO: 5725934 - DNA, 14 bp, Homo sapiens
cttctgtacgtctg

SEQ ID NO: 5725935 - DNA, 20 bp, Homo sapiens
cttctgtacgtctgacaggc

SEQ ID NO: 5725936 - DNA, 14 bp, Homo sapiens
cttctgtagcttct

SEQ ID NO: 5725937 - DNA, 21 bp, Homo sapiens
cttctgtagtactccttaaga

SEQ ID NO: 5725938 - DNA, 14 bp, Homo sapiens
cttctgtagtttta

SEQ ID NO: 5725939 - DNA, 20 bp, Homo sapiens
cttctgtagtttttaattaa

SEQ ID NO: 5725940 - DNA, 20 bp, Homo sapiens
cttctgtataactaggctgt

SEQ ID NO: 5725941 - DNA, 18 bp, Homo sapiens
cttctgtatactgtggag

SEQ ID NO: 5725942 - DNA, 18 bp, Homo sapiens
cttctgtatataaatggg

SEQ ID NO: 5725943 - DNA, 20 bp, Homo sapiens
cttctgtatataaatgggaa

SEQ ID NO: 5725944 - DNA, 21 bp, Homo sapiens
cttctgtatataaatgggaac

SEQ ID NO: 5725945 - DNA, 19 bp, Homo sapiens
cttctgtatttcactcttt

SEQ ID NO: 5725946 - DNA, 15 bp, Homo sapiens
cttctgtatttctag

SEQ ID NO: 5725947 - DNA, 13 bp, Homo sapiens
cttctgtattttc

SEQ ID NO: 5725948 - DNA, 14 bp, Homo sapiens
cttctgtcatcccg

SEQ ID NO: 5725949 - DNA, 20 bp, Homo sapiens
cttctgtccaagtacttaac

SEQ ID NO: 5725950 - DNA, 16 bp, Homo sapiens
cttctgtccaccagac

SEQ ID NO: 5725951 - DNA, 18 bp, Homo sapiens
cttctgtccaggacatga

SEQ ID NO: 5725952 - DNA, 16 bp, Homo sapiens
cttctgtccatcagtg

SEQ ID NO: 5725953 - DNA, 20 bp, Homo sapiens
cttctgtccatcagtgcatg

SEQ ID NO: 5725954 - DNA, 14 bp, Homo sapiens
cttctgtccccagc

SEQ ID NO: 5725955 - DNA, 16 bp, Homo sapiens
cttctgtcctactctg

SEQ ID NO: 5725956 - DNA, 18 bp, Homo sapiens
cttctgtcgtccccagac

SEQ ID NO: 5725957 - DNA, 15 bp, Homo sapiens
cttctgtctcctgtc

SEQ ID NO: 5725958 - DNA, 14 bp, Homo sapiens
cttctgtctcttgc

SEQ ID NO: 5725959 - DNA, 13 bp, Homo sapiens
cttctgtctgtaa

SEQ ID NO: 5725960 - DNA, 14 bp, Homo sapiens
cttctgtgaagaag

SEQ ID NO: 5725961 - DNA, 16 bp, Homo sapiens
cttctgtgatgagctg

SEQ ID NO: 5725962 - DNA, 17 bp, Homo sapiens
cttctgtgatgagctga

SEQ ID NO: 5725963 - DNA, 15 bp, Homo sapiens
cttctgtgcacctgg

SEQ ID NO: 5725964 - DNA, 17 bp, Homo sapiens
cttctgtgcacctgggc

SEQ ID NO: 5725965 - DNA, 18 bp, Homo sapiens
cttctgtgcactagcctg

SEQ ID NO: 5725966 - DNA, 22 bp, Homo sapiens
cttctgtgcactagcctgtgat

SEQ ID NO: 5725967 - DNA, 23 bp, Homo sapiens
cttctgtgcatttgtgtctgcct

SEQ ID NO: 5725968 - DNA, 12 bp, Homo sapiens
cttctgtgccca

SEQ ID NO: 5725969 - DNA, 19 bp, Homo sapiens
cttctgtgcccagaatact

SEQ ID NO: 5725970 - DNA, 20 bp, Homo sapiens
cttctgtgcccagaatactg

SEQ ID NO: 5725971 - DNA, 23 bp, Homo sapiens
cttctgtgcccagaatactgatg

SEQ ID NO: 5725972 - DNA, 15 bp, Homo sapiens
cttctgtgcccagct

SEQ ID NO: 5725973 - DNA, 16 bp, Homo sapiens
cttctgtgcccagggt

SEQ ID NO: 5725974 - DNA, 17 bp, Homo sapiens
cttctgtgcccagggtg

SEQ ID NO: 5725975 - DNA, 19 bp, Homo sapiens
cttctgtgcccagggtggc

SEQ ID NO: 5725976 - DNA, 11 bp, Homo sapiens
cttctgtggca

SEQ ID NO: 5725977 - DNA, 15 bp, Homo sapiens
cttctgtggctcaca

SEQ ID NO: 5725978 - DNA, 22 bp, Homo sapiens
cttctgtggctcacagaaccct

SEQ ID NO: 5725979 - DNA, 13 bp, Homo sapiens
cttctgtgggcat

SEQ ID NO: 5725980 - DNA, 15 bp, Homo sapiens
cttctgtgggcccct

SEQ ID NO: 5725981 - DNA, 17 bp, Homo sapiens
cttctgtgggcccctca

SEQ ID NO: 5725982 - DNA, 20 bp, Homo sapiens
cttctgtgggcccctcaaca

SEQ ID NO: 5725983 - DNA, 21 bp, Homo sapiens
cttctgtgggcccctcaacag

SEQ ID NO: 5725984 - DNA, 11 bp, Homo sapiens
cttctgtgggg

SEQ ID NO: 5725985 - DNA, 19 bp, Homo sapiens
cttctgtggggactccggc

SEQ ID NO: 5725986 - DNA, 18 bp, Homo sapiens
cttctgtggggctgggca

SEQ ID NO: 5725987 - DNA, 21 bp, Homo sapiens
cttctgtgggtttctaaagct

SEQ ID NO: 5725988 - DNA, 17 bp, Homo sapiens
cttctgtggttgtggat

SEQ ID NO: 5725989 - DNA, 22 bp, Homo sapiens
cttctgtgtagacatggttctg

SEQ ID NO: 5725990 - DNA, 14 bp, Homo sapiens
cttctgtgtctgtc

SEQ ID NO: 5725991 - DNA, 15 bp, Homo sapiens
cttctgtgtttctgg

SEQ ID NO: 5725992 - DNA, 17 bp, Homo sapiens
cttctgtgtttgaactg

SEQ ID NO: 5725993 - DNA, 16 bp, Homo sapiens
cttctgttaagaaagg

SEQ ID NO: 5725994 - DNA, 21 bp, Homo sapiens
cttctgttctctgctgagggc

SEQ ID NO: 5725995 - DNA, 14 bp, Homo sapiens
cttctgttctctgg

SEQ ID NO: 5725996 - DNA, 16 bp, Homo sapiens
cttctgttctctggtt

SEQ ID NO: 5725997 - DNA, 14 bp, Homo sapiens
cttctgttgaaaca

SEQ ID NO: 5725998 - DNA, 17 bp, Homo sapiens
cttctgttgcgccactg

SEQ ID NO: 5725999 - DNA, 12 bp, Homo sapiens
cttctgttgctg

SEQ ID NO: 5726000 - DNA, 15 bp, Homo sapiens
cttctgttgctgcct

SEQ ID NO: 5726001 - DNA, 14 bp, Homo sapiens
cttctgttgctggt

SEQ ID NO: 5726002 - DNA, 16 bp, Homo sapiens
cttctgttggcagagc

SEQ ID NO: 5726003 - DNA, 15 bp, Homo sapiens
cttctgttgtcacct

SEQ ID NO: 5726004 - DNA, 16 bp, Homo sapiens
cttctgtttctagttg

SEQ ID NO: 5726005 - DNA, 16 bp, Homo sapiens
cttctgtttcttctct

SEQ ID NO: 5726006 - DNA, 18 bp, Homo sapiens
cttctgtttcttctcttg

SEQ ID NO: 5726007 - DNA, 16 bp, Homo sapiens
cttctgttttcaatct

SEQ ID NO: 5726008 - DNA, 19 bp, Homo sapiens
cttctgttttcaatctcgt

SEQ ID NO: 5726009 - DNA, 19 bp, Homo sapiens
cttctgttttgagttttgt

SEQ ID NO: 5726010 - DNA, 20 bp, Homo sapiens
cttctgttttgagttttgta

SEQ ID NO: 5726011 - DNA, 17 bp, Homo sapiens
cttctgtttttctcaaa

SEQ ID NO: 5726012 - DNA, 21 bp, Homo sapiens
cttctgtttttctcaaataaa

SEQ ID NO: 5726013 - DNA, 15 bp, Homo sapiens
cttcttaaaaactgt

SEQ ID NO: 5726014 - DNA, 19 bp, Homo sapiens
cttcttaaaaactgtgtat

SEQ ID NO: 5726015 - DNA, 17 bp, Homo sapiens
cttcttaaaagtttcta

SEQ ID NO: 5726016 - DNA, 16 bp, Homo sapiens
cttcttaaaattcaaa

SEQ ID NO: 5726017 - DNA, 17 bp, Homo sapiens
cttcttaaaccattttt

SEQ ID NO: 5726018 - DNA, 14 bp, Homo sapiens
cttcttaaaggcct

SEQ ID NO: 5726019 - DNA, 15 bp, Homo sapiens
cttcttaaaggcctg

SEQ ID NO: 5726020 - DNA, 19 bp, Homo sapiens
cttcttaaatatcttttat

SEQ ID NO: 5726021 - DNA, 21 bp, Homo sapiens
cttcttaaccccagtaagcca

SEQ ID NO: 5726022 - DNA, 17 bp, Homo sapiens
cttcttaaccctgaaca

SEQ ID NO: 5726023 - DNA, 18 bp, Homo sapiens
cttcttaaccctgaacaa

SEQ ID NO: 5726024 - DNA, 19 bp, Homo sapiens
cttcttaaccctgaacaag

SEQ ID NO: 5726025 - DNA, 20 bp, Homo sapiens
cttcttaatataactgcctt

SEQ ID NO: 5726026 - DNA, 21 bp, Homo sapiens
cttcttaatcttttcacaaat

SEQ ID NO: 5726027 - DNA, 17 bp, Homo sapiens
cttcttaatgctttcct

SEQ ID NO: 5726028 - DNA, 18 bp, Homo sapiens
cttcttaatgtacatagt

SEQ ID NO: 5726029 - DNA, 16 bp, Homo sapiens
cttcttaattaatttg

SEQ ID NO: 5726030 - DNA, 17 bp, Homo sapiens
cttcttaattaatttga

SEQ ID NO: 5726031 - DNA, 21 bp, Homo sapiens
cttcttaattaatttgattaa

SEQ ID NO: 5726032 - DNA, 21 bp, Homo sapiens
cttcttacaataattctatga

SEQ ID NO: 5726033 - DNA, 14 bp, Homo sapiens
cttcttacacttct

SEQ ID NO: 5726034 - DNA, 17 bp, Homo sapiens
cttcttacccgaaagca

SEQ ID NO: 5726035 - DNA, 22 bp, Homo sapiens
cttcttacccgaaagcatcact

SEQ ID NO: 5726036 - DNA, 23 bp, Homo sapiens
cttcttacccgaaagcatcactg

SEQ ID NO: 5726037 - DNA, 14 bp, Homo sapiens
cttcttagaatgtt

SEQ ID NO: 5726038 - DNA, 22 bp, Homo sapiens
cttcttagagttttattccttt

SEQ ID NO: 5726039 - DNA, 16 bp, Homo sapiens
cttcttagtaaaaagc

SEQ ID NO: 5726040 - DNA, 17 bp, Homo sapiens
cttcttatccttacact

SEQ ID NO: 5726041 - DNA, 15 bp, Homo sapiens
cttcttatgtagagt

SEQ ID NO: 5726042 - DNA, 15 bp, Homo sapiens
cttcttatgtttgct

SEQ ID NO: 5726043 - DNA, 17 bp, Homo sapiens
cttcttattacccaaac

SEQ ID NO: 5726044 - DNA, 23 bp, Homo sapiens
cttcttattcatgctttctcctt

SEQ ID NO: 5726045 - DNA, 17 bp, Homo sapiens
cttcttattctcactcc

SEQ ID NO: 5726046 - DNA, 22 bp, Homo sapiens
cttcttattctcactccaccac

SEQ ID NO: 5726047 - DNA, 14 bp, Homo sapiens
cttcttattgaagt

SEQ ID NO: 5726048 - DNA, 13 bp, Homo sapiens
cttcttattttgt

SEQ ID NO: 5726049 - DNA, 23 bp, Homo sapiens
cttcttcaaatacaaagtaaata

SEQ ID NO: 5726050 - DNA, 22 bp, Homo sapiens
cttcttcaagcacctgcagatt

SEQ ID NO: 5726051 - DNA, 16 bp, Homo sapiens
cttcttcaatggcacc

SEQ ID NO: 5726052 - DNA, 22 bp, Homo sapiens
cttcttcacccagctaatctgt

SEQ ID NO: 5726053 - DNA, 16 bp, Homo sapiens
cttcttcacctcttcc

SEQ ID NO: 5726054 - DNA, 18 bp, Homo sapiens
cttcttcagagactcctg

SEQ ID NO: 5726055 - DNA, 22 bp, Homo sapiens
cttcttcagagactcctgcagg

SEQ ID NO: 5726056 - DNA, 23 bp, Homo sapiens
cttcttcagagactcctgcaggc

SEQ ID NO: 5726057 - DNA, 14 bp, Homo sapiens
cttcttcagagtga

SEQ ID NO: 5726058 - DNA, 15 bp, Homo sapiens
cttcttcagggcctg

SEQ ID NO: 5726059 - DNA, 21 bp, Homo sapiens
cttcttcatccatagacacag

SEQ ID NO: 5726060 - DNA, 15 bp, Homo sapiens
cttcttcatcttgac

SEQ ID NO: 5726061 - DNA, 13 bp, Homo sapiens
cttcttcatgttc

SEQ ID NO: 5726062 - DNA, 19 bp, Homo sapiens
cttcttccaggtgcccagc

SEQ ID NO: 5726063 - DNA, 15 bp, Homo sapiens
cttcttccattccca

SEQ ID NO: 5726064 - DNA, 21 bp, Homo sapiens
cttcttcccacaaagaatata

SEQ ID NO: 5726065 - DNA, 17 bp, Homo sapiens
cttcttcccccagggtc

SEQ ID NO: 5726066 - DNA, 20 bp, Homo sapiens
cttcttccccttccctgact

SEQ ID NO: 5726067 - DNA, 21 bp, Homo sapiens
cttcttcccgccccacctccc

SEQ ID NO: 5726068 - DNA, 17 bp, Homo sapiens
cttcttccctaaaatgt

SEQ ID NO: 5726069 - DNA, 22 bp, Homo sapiens
cttcttccctggtctggctctg

SEQ ID NO: 5726070 - DNA, 18 bp, Homo sapiens
cttcttccctgtcagcct

SEQ ID NO: 5726071 - DNA, 20 bp, Homo sapiens
cttcttccctgttttaaatt

SEQ ID NO: 5726072 - DNA, 10 bp, Homo sapiens
cttcttcctc

SEQ ID NO: 5726073 - DNA, 16 bp, Homo sapiens
cttcttcctcacactg

SEQ ID NO: 5726074 - DNA, 18 bp, Homo sapiens
cttcttcctcacactgct

SEQ ID NO: 5726075 - DNA, 16 bp, Homo sapiens
cttcttcctcccctca

SEQ ID NO: 5726076 - DNA, 18 bp, Homo sapiens
cttcttcctcccctcaac

SEQ ID NO: 5726077 - DNA, 15 bp, Homo sapiens
cttcttcctcctcca

SEQ ID NO: 5726078 - DNA, 22 bp, Homo sapiens
cttcttcctcctccatcacctg

SEQ ID NO: 5726079 - DNA, 13 bp, Homo sapiens
cttcttccttctt

SEQ ID NO: 5726080 - DNA, 20 bp, Homo sapiens
cttcttcgcaaactgatgga

SEQ ID NO: 5726081 - DNA, 15 bp, Homo sapiens
cttcttcggaggtgg

SEQ ID NO: 5726082 - DNA, 22 bp, Homo sapiens
cttcttcgttaatagattattt

SEQ ID NO: 5726083 - DNA, 17 bp, Homo sapiens
cttcttctaagaagaca

SEQ ID NO: 5726084 - DNA, 13 bp, Homo sapiens
cttcttctcaggc

SEQ ID NO: 5726085 - DNA, 12 bp, Homo sapiens
cttcttctccat

SEQ ID NO: 5726086 - DNA, 12 bp, Homo sapiens
cttcttctcccc

SEQ ID NO: 5726087 - DNA, 12 bp, Homo sapiens
cttcttctgcca

SEQ ID NO: 5726088 - DNA, 20 bp, Homo sapiens
cttcttctgccacttctgcg

SEQ ID NO: 5726089 - DNA, 15 bp, Homo sapiens
cttcttctgcgtttg

SEQ ID NO: 5726090 - DNA, 19 bp, Homo sapiens
cttcttctgtccaagcaga

SEQ ID NO: 5726091 - DNA, 13 bp, Homo sapiens
cttcttcttcaga

SEQ ID NO: 5726092 - DNA, 14 bp, Homo sapiens
cttcttcttctttg

SEQ ID NO: 5726093 - DNA, 13 bp, Homo sapiens
cttcttcttgtgg

SEQ ID NO: 5726094 - DNA, 15 bp, Homo sapiens
cttcttctttctaca

SEQ ID NO: 5726095 - DNA, 22 bp, Homo sapiens
cttcttgaaattttaacctatg

SEQ ID NO: 5726096 - DNA, 15 bp, Homo sapiens
cttcttgagcagacc

SEQ ID NO: 5726097 - DNA, 22 bp, Homo sapiens
cttcttgcatccttcctataac

SEQ ID NO: 5726098 - DNA, 13 bp, Homo sapiens
cttcttgcccaga

SEQ ID NO: 5726099 - DNA, 15 bp, Homo sapiens
cttcttgccccttgg

SEQ ID NO: 5726100 - DNA, 15 bp, Homo sapiens
cttcttgccctccac

SEQ ID NO: 5726101 - DNA, 12 bp, Homo sapiens
cttcttgccctg

SEQ ID NO: 5726102 - DNA, 14 bp, Homo sapiens
cttcttgccctgag

SEQ ID NO: 5726103 - DNA, 16 bp, Homo sapiens
cttcttgcctctgtgc

SEQ ID NO: 5726104 - DNA, 20 bp, Homo sapiens
cttcttgcggcaccgcccac

SEQ ID NO: 5726105 - DNA, 14 bp, Homo sapiens
cttcttgctcctgt

SEQ ID NO: 5726106 - DNA, 14 bp, Homo sapiens
cttcttgctgccct

SEQ ID NO: 5726107 - DNA, 15 bp, Homo sapiens
cttcttgctgccctg

SEQ ID NO: 5726108 - DNA, 18 bp, Homo sapiens
cttcttgcttgtaaaaat

SEQ ID NO: 5726109 - DNA, 14 bp, Homo sapiens
cttcttggaaaaaa

SEQ ID NO: 5726110 - DNA, 17 bp, Homo sapiens
cttcttggagctttgga

SEQ ID NO: 5726111 - DNA, 16 bp, Homo sapiens
cttcttggccatggga

SEQ ID NO: 5726112 - DNA, 15 bp, Homo sapiens
cttcttggcttcctg

SEQ ID NO: 5726113 - DNA, 17 bp, Homo sapiens
cttcttggcttcctggc

SEQ ID NO: 5726114 - DNA, 13 bp, Homo sapiens
cttcttggcttct

SEQ ID NO: 5726115 - DNA, 16 bp, Homo sapiens
cttcttgggactgctg

SEQ ID NO: 5726116 - DNA, 18 bp, Homo sapiens
cttcttgggactgctgtg

SEQ ID NO: 5726117 - DNA, 17 bp, Homo sapiens
cttcttgggccccagac

SEQ ID NO: 5726118 - DNA, 18 bp, Homo sapiens
cttcttgggccccagacc

SEQ ID NO: 5726119 - DNA, 11 bp, Homo sapiens
cttcttgggct

SEQ ID NO: 5726120 - DNA, 12 bp, Homo sapiens
cttcttgggctg

SEQ ID NO: 5726121 - DNA, 17 bp, Homo sapiens
cttcttgggctgagtgc

SEQ ID NO: 5726122 - DNA, 22 bp, Homo sapiens
cttcttgggctgagtgcagcca

SEQ ID NO: 5726123 - DNA, 23 bp, Homo sapiens
cttcttgggtctgccctgcccat

SEQ ID NO: 5726124 - DNA, 18 bp, Homo sapiens
cttcttggtgctgttgaa

SEQ ID NO: 5726125 - DNA, 22 bp, Homo sapiens
cttcttggtgctgttgaaaata

SEQ ID NO: 5726126 - DNA, 14 bp, Homo sapiens
cttcttggttcctg

SEQ ID NO: 5726127 - DNA, 16 bp, Homo sapiens
cttcttggtttcagcc

SEQ ID NO: 5726128 - DNA, 17 bp, Homo sapiens
cttcttggtttggggag

SEQ ID NO: 5726129 - DNA, 18 bp, Homo sapiens
cttcttggtttggggaga

SEQ ID NO: 5726130 - DNA, 18 bp, Homo sapiens
cttcttgtaatatttctt

SEQ ID NO: 5726131 - DNA, 16 bp, Homo sapiens
cttcttgtcagacata

SEQ ID NO: 5726132 - DNA, 18 bp, Homo sapiens
cttcttgtctttgtccct

SEQ ID NO: 5726133 - DNA, 12 bp, Homo sapiens
cttcttgtgaag

SEQ ID NO: 5726134 - DNA, 16 bp, Homo sapiens
cttcttgtgatccttt

SEQ ID NO: 5726135 - DNA, 15 bp, Homo sapiens
cttcttgtgatcttg

SEQ ID NO: 5726136 - DNA, 19 bp, Homo sapiens
cttcttgtgatcttgctct

SEQ ID NO: 5726137 - DNA, 17 bp, Homo sapiens
cttcttgtgattgctgc

SEQ ID NO: 5726138 - DNA, 16 bp, Homo sapiens
cttcttgtgtgtatgc

SEQ ID NO: 5726139 - DNA, 18 bp, Homo sapiens
cttcttgtgtttgaaaca

SEQ ID NO: 5726140 - DNA, 21 bp, Homo sapiens
cttcttgttcatgttttgcta

SEQ ID NO: 5726141 - DNA, 23 bp, Homo sapiens
cttcttgttcatgttttgctaat

SEQ ID NO: 5726142 - DNA, 16 bp, Homo sapiens
cttcttgttctgagat

SEQ ID NO: 5726143 - DNA, 15 bp, Homo sapiens
cttcttgtttccttg

SEQ ID NO: 5726144 - DNA, 17 bp, Homo sapiens
cttcttgtttccttgtt

SEQ ID NO: 5726145 - DNA, 17 bp, Homo sapiens
cttctttaaatcaaaag

SEQ ID NO: 5726146 - DNA, 22 bp, Homo sapiens
cttctttaaatcaaaagctgct

SEQ ID NO: 5726147 - DNA, 15 bp, Homo sapiens
cttctttaagccata

SEQ ID NO: 5726148 - DNA, 18 bp, Homo sapiens
cttctttaaggaagaata

SEQ ID NO: 5726149 - DNA, 18 bp, Homo sapiens
cttctttaattttggaat

SEQ ID NO: 5726150 - DNA, 18 bp, Homo sapiens
cttctttaatttttctgt

SEQ ID NO: 5726151 - DNA, 14 bp, Homo sapiens
cttctttaccttca

SEQ ID NO: 5726152 - DNA, 23 bp, Homo sapiens
cttctttactcggcgtgctcctt

SEQ ID NO: 5726153 - DNA, 21 bp, Homo sapiens
cttctttagaccctcgggccc

SEQ ID NO: 5726154 - DNA, 21 bp, Homo sapiens
cttctttagcatttttatgca

SEQ ID NO: 5726155 - DNA, 22 bp, Homo sapiens
cttctttataattctactttga

SEQ ID NO: 5726156 - DNA, 19 bp, Homo sapiens
cttctttatactctcttcc

SEQ ID NO: 5726157 - DNA, 14 bp, Homo sapiens
cttctttatactgt

SEQ ID NO: 5726158 - DNA, 20 bp, Homo sapiens
cttctttatactgtaattta

SEQ ID NO: 5726159 - DNA, 17 bp, Homo sapiens
cttctttattctgtgtt

SEQ ID NO: 5726160 - DNA, 15 bp, Homo sapiens
cttctttattgcccc

SEQ ID NO: 5726161 - DNA, 14 bp, Homo sapiens
cttctttcatctgg

SEQ ID NO: 5726162 - DNA, 13 bp, Homo sapiens
cttctttccacag

SEQ ID NO: 5726163 - DNA, 12 bp, Homo sapiens
cttctttccaga

SEQ ID NO: 5726164 - DNA, 13 bp, Homo sapiens
cttctttccatca

SEQ ID NO: 5726165 - DNA, 18 bp, Homo sapiens
cttctttccatcccctag

SEQ ID NO: 5726166 - DNA, 14 bp, Homo sapiens
cttctttccctgga

SEQ ID NO: 5726167 - DNA, 16 bp, Homo sapiens
cttctttcccttcctc

SEQ ID NO: 5726168 - DNA, 11 bp, Homo sapiens
cttctttcctc

SEQ ID NO: 5726169 - DNA, 15 bp, Homo sapiens
cttctttctcctgtg

SEQ ID NO: 5726170 - DNA, 14 bp, Homo sapiens
cttctttctcttcc

SEQ ID NO: 5726171 - DNA, 15 bp, Homo sapiens
cttctttctcttccc

SEQ ID NO: 5726172 - DNA, 18 bp, Homo sapiens
cttctttctcttccctcc

SEQ ID NO: 5726173 - DNA, 19 bp, Homo sapiens
cttctttctcttccctcct

SEQ ID NO: 5726174 - DNA, 13 bp, Homo sapiens
cttctttctgctg

SEQ ID NO: 5726175 - DNA, 14 bp, Homo sapiens
cttctttctgctgg

SEQ ID NO: 5726176 - DNA, 13 bp, Homo sapiens
cttctttctggac

SEQ ID NO: 5726177 - DNA, 15 bp, Homo sapiens
cttctttctggactg

SEQ ID NO: 5726178 - DNA, 16 bp, Homo sapiens
cttctttctggttgtt

SEQ ID NO: 5726179 - DNA, 10 bp, Homo sapiens
cttctttctt

SEQ ID NO: 5726180 - DNA, 19 bp, Homo sapiens
cttctttctttcttttgca

SEQ ID NO: 5726181 - DNA, 16 bp, Homo sapiens
cttctttgaagttatt

SEQ ID NO: 5726182 - DNA, 22 bp, Homo sapiens
cttctttgaatttcctatctgt

SEQ ID NO: 5726183 - DNA, 22 bp, Homo sapiens
cttctttgactataacaaaatc

SEQ ID NO: 5726184 - DNA, 19 bp, Homo sapiens
cttctttgataatgttaaa

SEQ ID NO: 5726185 - DNA, 22 bp, Homo sapiens
cttctttgcaacaataataaat

SEQ ID NO: 5726186 - DNA, 20 bp, Homo sapiens
cttctttgcacttttgaaat

SEQ ID NO: 5726187 - DNA, 15 bp, Homo sapiens
cttctttgcagggct

SEQ ID NO: 5726188 - DNA, 21 bp, Homo sapiens
cttctttgctgcattcctttt

SEQ ID NO: 5726189 - DNA, 19 bp, Homo sapiens
cttctttggacttctgaag

SEQ ID NO: 5726190 - DNA, 19 bp, Homo sapiens
cttctttggtgttctggcc

SEQ ID NO: 5726191 - DNA, 16 bp, Homo sapiens
cttctttggttccatg

SEQ ID NO: 5726192 - DNA, 12 bp, Homo sapiens
cttctttgtaat

SEQ ID NO: 5726193 - DNA, 13 bp, Homo sapiens
cttctttgtgcct

SEQ ID NO: 5726194 - DNA, 15 bp, Homo sapiens
cttctttgtgcctga

SEQ ID NO: 5726195 - DNA, 20 bp, Homo sapiens
cttctttgtgcctttggcct

SEQ ID NO: 5726196 - DNA, 22 bp, Homo sapiens
cttctttgtggtctttttcctg

SEQ ID NO: 5726197 - DNA, 19 bp, Homo sapiens
cttcttttaaaccattttc

SEQ ID NO: 5726198 - DNA, 13 bp, Homo sapiens
cttcttttactca

SEQ ID NO: 5726199 - DNA, 19 bp, Homo sapiens
cttcttttagtcagaaatg

SEQ ID NO: 5726200 - DNA, 22 bp, Homo sapiens
cttcttttagtcagaaatgatt

SEQ ID NO: 5726201 - DNA, 21 bp, Homo sapiens
cttcttttcaatgcaatgcat

SEQ ID NO: 5726202 - DNA, 16 bp, Homo sapiens
cttcttttcacattct

SEQ ID NO: 5726203 - DNA, 14 bp, Homo sapiens
cttcttttcccatt

SEQ ID NO: 5726204 - DNA, 16 bp, Homo sapiens
cttcttttcctgcagg

SEQ ID NO: 5726205 - DNA, 14 bp, Homo sapiens
cttcttttctcatg

SEQ ID NO: 5726206 - DNA, 14 bp, Homo sapiens
cttcttttgtactt

SEQ ID NO: 5726207 - DNA, 21 bp, Homo sapiens
cttcttttgtggtgtcttcca

SEQ ID NO: 5726208 - DNA, 24 bp, Homo sapiens
cttcttttgtggtgtcttccatgt

SEQ ID NO: 5726209 - DNA, 15 bp, Homo sapiens
cttctttttattttc

SEQ ID NO: 5726210 - DNA, 20 bp, Homo sapiens
cttctttttattttcttttg

SEQ ID NO: 5726211 - DNA, 15 bp, Homo sapiens
cttctttttcaggct

SEQ ID NO: 5726212 - DNA, 16 bp, Homo sapiens
cttctttttccctttc

SEQ ID NO: 5726213 - DNA, 19 bp, Homo sapiens
cttctttttccctttcctt

SEQ ID NO: 5726214 - DNA, 14 bp, Homo sapiens
cttctttttctgga

SEQ ID NO: 5726215 - DNA, 15 bp, Homo sapiens
cttctttttctggac

SEQ ID NO: 5726216 - DNA, 21 bp, Homo sapiens
cttctttttctggactctgga

SEQ ID NO: 5726217 - DNA, 13 bp, Homo sapiens
cttctttttctta

SEQ ID NO: 5726218 - DNA, 17 bp, Homo sapiens
cttctttttcttaccct

SEQ ID NO: 5726219 - DNA, 13 bp, Homo sapiens
cttctttttggca

SEQ ID NO: 5726220 - DNA, 14 bp, Homo sapiens
cttcttttttaaac

SEQ ID NO: 5726221 - DNA, 21 bp, Homo sapiens
cttcttttttgtaaaaacttt

SEQ ID NO: 5726222 - DNA, 23 bp, Homo sapiens
cttgaaaaaaaaaaacacaaaaa

SEQ ID NO: 5726223 - DNA, 18 bp, Homo sapiens
cttgaaaaaaaacagtgg

SEQ ID NO: 5726224 - DNA, 13 bp, Homo sapiens
cttgaaaaacaaa

SEQ ID NO: 5726225 - DNA, 15 bp, Homo sapiens
cttgaaaaagacatt

SEQ ID NO: 5726226 - DNA, 17 bp, Homo sapiens
cttgaaaaagatggctt

SEQ ID NO: 5726227 - DNA, 20 bp, Homo sapiens
cttgaaaaagatggcttatg

SEQ ID NO: 5726228 - DNA, 21 bp, Homo sapiens
cttgaaaaatacttttcctta

SEQ ID NO: 5726229 - DNA, 14 bp, Homo sapiens
cttgaaaacactgt

SEQ ID NO: 5726230 - DNA, 23 bp, Homo sapiens
cttgaaaacagaatcagtgttaa

SEQ ID NO: 5726231 - DNA, 17 bp, Homo sapiens
cttgaaaactctcagtc

SEQ ID NO: 5726232 - DNA, 12 bp, Homo sapiens
cttgaaaacttg

SEQ ID NO: 5726233 - DNA, 18 bp, Homo sapiens
cttgaaaacttgctgaaa

SEQ ID NO: 5726234 - DNA, 20 bp, Homo sapiens
cttgaaaacttgctgaaaaa

SEQ ID NO: 5726235 - DNA, 18 bp, Homo sapiens
cttgaaaagagacaggca

SEQ ID NO: 5726236 - DNA, 21 bp, Homo sapiens
cttgaaaagagacaggcaggt

SEQ ID NO: 5726237 - DNA, 21 bp, Homo sapiens
cttgaaaagattgcaaaggga

SEQ ID NO: 5726238 - DNA, 20 bp, Homo sapiens
cttgaaaataaaaagagaaa

SEQ ID NO: 5726239 - DNA, 20 bp, Homo sapiens
cttgaaaatatatgatggct

SEQ ID NO: 5726240 - DNA, 13 bp, Homo sapiens
cttgaaaatgcca

SEQ ID NO: 5726241 - DNA, 13 bp, Homo sapiens
cttgaaaattaac

SEQ ID NO: 5726242 - DNA, 22 bp, Homo sapiens
cttgaaaccaattaagcagctt

SEQ ID NO: 5726243 - DNA, 17 bp, Homo sapiens
cttgaaaccagctcagg

SEQ ID NO: 5726244 - DNA, 13 bp, Homo sapiens
cttgaaacctgat

SEQ ID NO: 5726245 - DNA, 22 bp, Homo sapiens
cttgaaacgtttgccccatggg

SEQ ID NO: 5726246 - DNA, 19 bp, Homo sapiens
cttgaaacttggttcccag

SEQ ID NO: 5726247 - DNA, 21 bp, Homo sapiens
cttgaaacttggttcccagaa

SEQ ID NO: 5726248 - DNA, 23 bp, Homo sapiens
cttgaaactttgggaaaacatgt

SEQ ID NO: 5726249 - DNA, 19 bp, Homo sapiens
cttgaaagaagaaaaggtt

SEQ ID NO: 5726250 - DNA, 21 bp, Homo sapiens
cttgaaagaagaaaaggttct

SEQ ID NO: 5726251 - DNA, 19 bp, Homo sapiens
cttgaaagaagtattaaaa

SEQ ID NO: 5726252 - DNA, 20 bp, Homo sapiens
cttgaaagaagtattaaaaa

SEQ ID NO: 5726253 - DNA, 19 bp, Homo sapiens
cttgaaagaagttttatgc

SEQ ID NO: 5726254 - DNA, 20 bp, Homo sapiens
cttgaaagcagttaaactga

SEQ ID NO: 5726255 - DNA, 23 bp, Homo sapiens
cttgaaaggcaggaagggaagcg

SEQ ID NO: 5726256 - DNA, 17 bp, Homo sapiens
cttgaaagtcatgaaca

SEQ ID NO: 5726257 - DNA, 16 bp, Homo sapiens
cttgaaatatataata

SEQ ID NO: 5726258 - DNA, 19 bp, Homo sapiens
cttgaaatatataatattc

SEQ ID NO: 5726259 - DNA, 17 bp, Homo sapiens
cttgaaatcaagagaca

SEQ ID NO: 5726260 - DNA, 18 bp, Homo sapiens
cttgaaatgaaagggaaa

SEQ ID NO: 5726261 - DNA, 22 bp, Homo sapiens
cttgaaatgaaagtataactga

SEQ ID NO: 5726262 - DNA, 22 bp, Homo sapiens
cttgaaatgagtaaaaactaga

SEQ ID NO: 5726263 - DNA, 15 bp, Homo sapiens
cttgaaatggaaagt

SEQ ID NO: 5726264 - DNA, 21 bp, Homo sapiens
cttgaaatggaaagtcatgca

SEQ ID NO: 5726265 - DNA, 22 bp, Homo sapiens
cttgaaatggaaagtcatgcaa

SEQ ID NO: 5726266 - DNA, 20 bp, Homo sapiens
cttgaaattaagaaggcaaa

SEQ ID NO: 5726267 - DNA, 21 bp, Homo sapiens
cttgaaattaagaaggcaaaa

SEQ ID NO: 5726268 - DNA, 15 bp, Homo sapiens
cttgaaattactgtg

SEQ ID NO: 5726269 - DNA, 19 bp, Homo sapiens
cttgaaattactgtgtaaa

SEQ ID NO: 5726270 - DNA, 19 bp, Homo sapiens
cttgaaattgattaactta

SEQ ID NO: 5726271 - DNA, 20 bp, Homo sapiens
cttgaaatttgaattttgtg

SEQ ID NO: 5726272 - DNA, 17 bp, Homo sapiens
cttgaaattttaaccta

SEQ ID NO: 5726273 - DNA, 11 bp, Homo sapiens
cttgaacaaaa

SEQ ID NO: 5726274 - DNA, 14 bp, Homo sapiens
cttgaacaaaaagt

SEQ ID NO: 5726275 - DNA, 15 bp, Homo sapiens
cttgaacaaaaagtt

SEQ ID NO: 5726276 - DNA, 20 bp, Homo sapiens
cttgaacaaaagggtcagag

SEQ ID NO: 5726277 - DNA, 18 bp, Homo sapiens
cttgaacaaaatctgttg

SEQ ID NO: 5726278 - DNA, 20 bp, Homo sapiens
cttgaacaatcaaggcaact

SEQ ID NO: 5726279 - DNA, 20 bp, Homo sapiens
cttgaacactcatgctgaaa

SEQ ID NO: 5726280 - DNA, 15 bp, Homo sapiens
cttgaacactggggg

SEQ ID NO: 5726281 - DNA, 16 bp, Homo sapiens
cttgaacattaatcca

SEQ ID NO: 5726282 - DNA, 16 bp, Homo sapiens
cttgaaccccctccct

SEQ ID NO: 5726283 - DNA, 19 bp, Homo sapiens
cttgaaccccctccctgtc

SEQ ID NO: 5726284 - DNA, 14 bp, Homo sapiens
cttgaacccgggag

SEQ ID NO: 5726285 - DNA, 19 bp, Homo sapiens
cttgaacccgggaggcaga

SEQ ID NO: 5726286 - DNA, 18 bp, Homo sapiens
cttgaacctgcttcctgg

SEQ ID NO: 5726287 - DNA, 15 bp, Homo sapiens
cttgaacctgggagg

SEQ ID NO: 5726288 - DNA, 19 bp, Homo sapiens
cttgaacctgggaggtgga

SEQ ID NO: 5726289 - DNA, 21 bp, Homo sapiens
cttgaacctgtcacctggcct

SEQ ID NO: 5726290 - DNA, 15 bp, Homo sapiens
cttgaacctgtgagg

SEQ ID NO: 5726291 - DNA, 17 bp, Homo sapiens
cttgaacgagcagccca

SEQ ID NO: 5726292 - DNA, 21 bp, Homo sapiens
cttgaacgagcagcccagggc

SEQ ID NO: 5726293 - DNA, 13 bp, Homo sapiens
cttgaactcctga

SEQ ID NO: 5726294 - DNA, 14 bp, Homo sapiens
cttgaactcctgac

SEQ ID NO: 5726295 - DNA, 14 bp, Homo sapiens
cttgaactcctggc

SEQ ID NO: 5726296 - DNA, 15 bp, Homo sapiens
cttgaactcctggcc

SEQ ID NO: 5726297 - DNA, 18 bp, Homo sapiens
cttgaactctgggctcaa

SEQ ID NO: 5726298 - DNA, 15 bp, Homo sapiens
cttgaactcttggcc

SEQ ID NO: 5726299 - DNA, 17 bp, Homo sapiens
cttgaactgagcttgga

SEQ ID NO: 5726300 - DNA, 14 bp, Homo sapiens
cttgaactgaggcc

SEQ ID NO: 5726301 - DNA, 22 bp, Homo sapiens
cttgaactgaggccctgtgata

SEQ ID NO: 5726302 - DNA, 14 bp, Homo sapiens
cttgaactgattca

SEQ ID NO: 5726303 - DNA, 15 bp, Homo sapiens
cttgaactgctgcca

SEQ ID NO: 5726304 - DNA, 13 bp, Homo sapiens
cttgaactgggcg

SEQ ID NO: 5726305 - DNA, 16 bp, Homo sapiens
cttgaactgggtactt

SEQ ID NO: 5726306 - DNA, 18 bp, Homo sapiens
cttgaactgggtacttgt

SEQ ID NO: 5726307 - DNA, 18 bp, Homo sapiens
cttgaactgtggccacct

SEQ ID NO: 5726308 - DNA, 21 bp, Homo sapiens
cttgaactgttctggcctcag

SEQ ID NO: 5726309 - DNA, 23 bp, Homo sapiens
cttgaactgttctggcctcagac

SEQ ID NO: 5726310 - DNA, 15 bp, Homo sapiens
cttgaactttccaaa

SEQ ID NO: 5726311 - DNA, 17 bp, Homo sapiens
cttgaactttgacctct

SEQ ID NO: 5726312 - DNA, 18 bp, Homo sapiens
cttgaagaaaatgacttt

SEQ ID NO: 5726313 - DNA, 12 bp, Homo sapiens
cttgaagaactg

SEQ ID NO: 5726314 - DNA, 17 bp, Homo sapiens
cttgaagaactgcaggc

SEQ ID NO: 5726315 - DNA, 16 bp, Homo sapiens
cttgaagaagaaggag

SEQ ID NO: 5726316 - DNA, 17 bp, Homo sapiens
cttgaagaagtggctgc

SEQ ID NO: 5726317 - DNA, 18 bp, Homo sapiens
cttgaagaatagtcataa

SEQ ID NO: 5726318 - DNA, 12 bp, Homo sapiens
cttgaagaatat

SEQ ID NO: 5726319 - DNA, 15 bp, Homo sapiens
cttgaagaatattgt

SEQ ID NO: 5726320 - DNA, 16 bp, Homo sapiens
cttgaagacagagcaa

SEQ ID NO: 5726321 - DNA, 22 bp, Homo sapiens
cttgaagacagagcaaagcgcc

SEQ ID NO: 5726322 - DNA, 20 bp, Homo sapiens
cttgaagatcgttagtatct

SEQ ID NO: 5726323 - DNA, 12 bp, Homo sapiens
cttgaagatgta

SEQ ID NO: 5726324 - DNA, 16 bp, Homo sapiens
cttgaagcaacttggt

SEQ ID NO: 5726325 - DNA, 15 bp, Homo sapiens
cttgaagcaataact

SEQ ID NO: 5726326 - DNA, 20 bp, Homo sapiens
cttgaagcaataactccaag

SEQ ID NO: 5726327 - DNA, 23 bp, Homo sapiens
cttgaagcaataactccaagcag

SEQ ID NO: 5726328 - DNA, 21 bp, Homo sapiens
cttgaagcactacaggaggaa

SEQ ID NO: 5726329 - DNA, 16 bp, Homo sapiens
cttgaagcagccttga

SEQ ID NO: 5726330 - DNA, 20 bp, Homo sapiens
cttgaagcatttcaaagccc

SEQ ID NO: 5726331 - DNA, 19 bp, Homo sapiens
cttgaagccaaactgttgg

SEQ ID NO: 5726332 - DNA, 13 bp, Homo sapiens
cttgaagccaaag

SEQ ID NO: 5726333 - DNA, 14 bp, Homo sapiens
cttgaagccaaaga

SEQ ID NO: 5726334 - DNA, 16 bp, Homo sapiens
cttgaagccaaagaaa

SEQ ID NO: 5726335 - DNA, 19 bp, Homo sapiens
cttgaagccaaagaaaaat

SEQ ID NO: 5726336 - DNA, 13 bp, Homo sapiens
cttgaagccaagt

SEQ ID NO: 5726337 - DNA, 17 bp, Homo sapiens
cttgaagccactgaagc

SEQ ID NO: 5726338 - DNA, 21 bp, Homo sapiens
cttgaagccactgaagctggg

SEQ ID NO: 5726339 - DNA, 16 bp, Homo sapiens
cttgaagcctgctcct

SEQ ID NO: 5726340 - DNA, 20 bp, Homo sapiens
cttgaagcctgctccttccc

SEQ ID NO: 5726341 - DNA, 12 bp, Homo sapiens
cttgaagctaac

SEQ ID NO: 5726342 - DNA, 20 bp, Homo sapiens
cttgaagctgctcactgctc

SEQ ID NO: 5726343 - DNA, 16 bp, Homo sapiens
cttgaagctttgtagg

SEQ ID NO: 5726344 - DNA, 13 bp, Homo sapiens
cttgaaggaaaaa

SEQ ID NO: 5726345 - DNA, 18 bp, Homo sapiens
cttgaaggaaaaattcaa

SEQ ID NO: 5726346 - DNA, 22 bp, Homo sapiens
cttgaaggaacagtgctgttct

SEQ ID NO: 5726347 - DNA, 23 bp, Homo sapiens
cttgaaggaacagtgctgttctg

SEQ ID NO: 5726348 - DNA, 15 bp, Homo sapiens
cttgaaggaagaggg

SEQ ID NO: 5726349 - DNA, 17 bp, Homo sapiens
cttgaaggactgcagac

SEQ ID NO: 5726350 - DNA, 13 bp, Homo sapiens
cttgaaggagaat

SEQ ID NO: 5726351 - DNA, 23 bp, Homo sapiens
cttgaaggatctgtttttaaaaa

SEQ ID NO: 5726352 - DNA, 16 bp, Homo sapiens
cttgaagggtaaagaa

SEQ ID NO: 5726353 - DNA, 19 bp, Homo sapiens
cttgaaggtgctgccaccc

SEQ ID NO: 5726354 - DNA, 13 bp, Homo sapiens
cttgaagtaacta

SEQ ID NO: 5726355 - DNA, 18 bp, Homo sapiens
cttgaagtacttaacata

SEQ ID NO: 5726356 - DNA, 19 bp, Homo sapiens
cttgaagtcagccacactg

SEQ ID NO: 5726357 - DNA, 22 bp, Homo sapiens
cttgaagtcagccacactgggc

SEQ ID NO: 5726358 - DNA, 23 bp, Homo sapiens
cttgaagtcagccacactgggcc

SEQ ID NO: 5726359 - DNA, 20 bp, Homo sapiens
cttgaagtcctggcttcagg

SEQ ID NO: 5726360 - DNA, 16 bp, Homo sapiens
cttgaagtctgtacag

SEQ ID NO: 5726361 - DNA, 18 bp, Homo sapiens
cttgaagtgactgttgta

SEQ ID NO: 5726362 - DNA, 19 bp, Homo sapiens
cttgaagtgactgttgtac

SEQ ID NO: 5726363 - DNA, 19 bp, Homo sapiens
cttgaagtgatcatttcac

SEQ ID NO: 5726364 - DNA, 23 bp, Homo sapiens
cttgaagttgggtgtttccagaa

SEQ ID NO: 5726365 - DNA, 23 bp, Homo sapiens
cttgaataaacaccactggatta

SEQ ID NO: 5726366 - DNA, 19 bp, Homo sapiens
cttgaatactttgagtaaa

SEQ ID NO: 5726367 - DNA, 15 bp, Homo sapiens
cttgaatagtattgt

SEQ ID NO: 5726368 - DNA, 18 bp, Homo sapiens
cttgaatatggaacatat

SEQ ID NO: 5726369 - DNA, 21 bp, Homo sapiens
cttgaatatgtgccttctaga

SEQ ID NO: 5726370 - DNA, 19 bp, Homo sapiens
cttgaatattatacttctt

SEQ ID NO: 5726371 - DNA, 22 bp, Homo sapiens
cttgaatcaggaggagattaac

SEQ ID NO: 5726372 - DNA, 14 bp, Homo sapiens
cttgaatcctaggg

SEQ ID NO: 5726373 - DNA, 15 bp, Homo sapiens
cttgaatccttccat

SEQ ID NO: 5726374 - DNA, 23 bp, Homo sapiens
cttgaatccttccattccacaca

SEQ ID NO: 5726375 - DNA, 13 bp, Homo sapiens
cttgaatcttctc

SEQ ID NO: 5726376 - DNA, 23 bp, Homo sapiens
cttgaatgccatagtcaaagaga

SEQ ID NO: 5726377 - DNA, 23 bp, Homo sapiens
cttgaatggaaggtccgagtctt

SEQ ID NO: 5726378 - DNA, 18 bp, Homo sapiens
cttgaatggagctggtga

SEQ ID NO: 5726379 - DNA, 21 bp, Homo sapiens
cttgaatggcaatgttttgct

SEQ ID NO: 5726380 - DNA, 19 bp, Homo sapiens
cttgaatggtgcaatgaat

SEQ ID NO: 5726381 - DNA, 21 bp, Homo sapiens
cttgaatggtgcaatgaatta

SEQ ID NO: 5726382 - DNA, 16 bp, Homo sapiens
cttgaatggtttttct

SEQ ID NO: 5726383 - DNA, 14 bp, Homo sapiens
cttgaatgtacaaa

SEQ ID NO: 5726384 - DNA, 19 bp, Homo sapiens
cttgaatgtggtctcagga

SEQ ID NO: 5726385 - DNA, 21 bp, Homo sapiens
cttgaatgtggtctcaggata

SEQ ID NO: 5726386 - DNA, 13 bp, Homo sapiens
cttgaatgtttgt

SEQ ID NO: 5726387 - DNA, 18 bp, Homo sapiens
cttgaattagtatttcag

SEQ ID NO: 5726388 - DNA, 17 bp, Homo sapiens
cttgaattccttgggga

SEQ ID NO: 5726389 - DNA, 22 bp, Homo sapiens
cttgaattcttttcctctctta

SEQ ID NO: 5726390 - DNA, 17 bp, Homo sapiens
cttgaattgtaactgtt

SEQ ID NO: 5726391 - DNA, 22 bp, Homo sapiens
cttgaattgtaactgttcttga

SEQ ID NO: 5726392 - DNA, 22 bp, Homo sapiens
cttgaattgtgtattgatgcaa

SEQ ID NO: 5726393 - DNA, 12 bp, Homo sapiens
cttgaattgtta

SEQ ID NO: 5726394 - DNA, 15 bp, Homo sapiens
cttgaattgttatga

SEQ ID NO: 5726395 - DNA, 18 bp, Homo sapiens
cttgaattgttatgaaaa

SEQ ID NO: 5726396 - DNA, 13 bp, Homo sapiens
cttgaatttcaaa

SEQ ID NO: 5726397 - DNA, 16 bp, Homo sapiens
cttgaatttcatgctt

SEQ ID NO: 5726398 - DNA, 12 bp, Homo sapiens
cttgaatttctg

SEQ ID NO: 5726399 - DNA, 21 bp, Homo sapiens
cttgaatttgcatgtctaatt

SEQ ID NO: 5726400 - DNA, 18 bp, Homo sapiens
cttgaattttcccactgc

SEQ ID NO: 5726401 - DNA, 21 bp, Homo sapiens
cttgaatttttttctgcacag

SEQ ID NO: 5726402 - DNA, 21 bp, Homo sapiens
cttgacaaatattttcatgta

SEQ ID NO: 5726403 - DNA, 15 bp, Homo sapiens
cttgacaacatccca

SEQ ID NO: 5726404 - DNA, 24 bp, Homo sapiens
cttgacaacatcccacagtggcac

SEQ ID NO: 5726405 - DNA, 14 bp, Homo sapiens
cttgacaagtacat

SEQ ID NO: 5726406 - DNA, 23 bp, Homo sapiens
cttgacaatgttgtcctcctgtt

SEQ ID NO: 5726407 - DNA, 17 bp, Homo sapiens
cttgacacagtcagcat

SEQ ID NO: 5726408 - DNA, 14 bp, Homo sapiens
cttgacaccaacca

SEQ ID NO: 5726409 - DNA, 13 bp, Homo sapiens
cttgacacctgct

SEQ ID NO: 5726410 - DNA, 22 bp, Homo sapiens
cttgacacctgctgagaaaaca

SEQ ID NO: 5726411 - DNA, 15 bp, Homo sapiens
cttgacacctgtctt

SEQ ID NO: 5726412 - DNA, 21 bp, Homo sapiens
cttgacacctgtcttgaataa

SEQ ID NO: 5726413 - DNA, 16 bp, Homo sapiens
cttgacagaacactgt

SEQ ID NO: 5726414 - DNA, 14 bp, Homo sapiens
cttgacagggcaca

SEQ ID NO: 5726415 - DNA, 19 bp, Homo sapiens
cttgacagttacttacaca

SEQ ID NO: 5726416 - DNA, 22 bp, Homo sapiens
cttgacagttacttacacacct

SEQ ID NO: 5726417 - DNA, 20 bp, Homo sapiens
cttgacatacctaccagtat

SEQ ID NO: 5726418 - DNA, 14 bp, Homo sapiens
cttgacatgtagct

SEQ ID NO: 5726419 - DNA, 18 bp, Homo sapiens
cttgacatgtagcttctt

SEQ ID NO: 5726420 - DNA, 20 bp, Homo sapiens
cttgacatgtagcttcttct

SEQ ID NO: 5726421 - DNA, 13 bp, Homo sapiens
cttgacatgtgca

SEQ ID NO: 5726422 - DNA, 13 bp, Homo sapiens
cttgacattcctt

SEQ ID NO: 5726423 - DNA, 21 bp, Homo sapiens
cttgaccaacagaaacctttt

SEQ ID NO: 5726424 - DNA, 12 bp, Homo sapiens
cttgaccaagca

SEQ ID NO: 5726425 - DNA, 17 bp, Homo sapiens
cttgaccaagcaggaag

SEQ ID NO: 5726426 - DNA, 13 bp, Homo sapiens
cttgaccagacct

SEQ ID NO: 5726427 - DNA, 20 bp, Homo sapiens
cttgaccagacctagacctg

SEQ ID NO: 5726428 - DNA, 19 bp, Homo sapiens
cttgaccagcagatcccag

SEQ ID NO: 5726429 - DNA, 23 bp, Homo sapiens
cttgaccagcagatcccagctca

SEQ ID NO: 5726430 - DNA, 15 bp, Homo sapiens
cttgaccaggcctgg

SEQ ID NO: 5726431 - DNA, 13 bp, Homo sapiens
cttgaccaggctg

SEQ ID NO: 5726432 - DNA, 20 bp, Homo sapiens
cttgaccattaataaagaca

SEQ ID NO: 5726433 - DNA, 23 bp, Homo sapiens
cttgaccattctccacctgccag

SEQ ID NO: 5726434 - DNA, 23 bp, Homo sapiens
cttgaccctgaaaggaacactgg

SEQ ID NO: 5726435 - DNA, 17 bp, Homo sapiens
cttgaccctttcctccc

SEQ ID NO: 5726436 - DNA, 18 bp, Homo sapiens
cttgaccgggagacagag

SEQ ID NO: 5726437 - DNA, 17 bp, Homo sapiens
cttgaccgtactctcac

SEQ ID NO: 5726438 - DNA, 18 bp, Homo sapiens
cttgacctcactcagaag

SEQ ID NO: 5726439 - DNA, 15 bp, Homo sapiens
cttgacctctccagc

SEQ ID NO: 5726440 - DNA, 22 bp, Homo sapiens
cttgacctctccagcatcccag

SEQ ID NO: 5726441 - DNA, 12 bp, Homo sapiens
cttgacctgaga

SEQ ID NO: 5726442 - DNA, 14 bp, Homo sapiens
cttgacctgaggct

SEQ ID NO: 5726443 - DNA, 17 bp, Homo sapiens
cttgacctgaggctgtg

SEQ ID NO: 5726444 - DNA, 18 bp, Homo sapiens
cttgacctgtttctctgc

SEQ ID NO: 5726445 - DNA, 13 bp, Homo sapiens
cttgaccttcctc

SEQ ID NO: 5726446 - DNA, 23 bp, Homo sapiens
cttgaccttctgtcgtccccaga

SEQ ID NO: 5726447 - DNA, 15 bp, Homo sapiens
cttgacctttccagc

SEQ ID NO: 5726448 - DNA, 13 bp, Homo sapiens
cttgacctttgta

SEQ ID NO: 5726449 - DNA, 21 bp, Homo sapiens
cttgacctttgtacagcccag

SEQ ID NO: 5726450 - DNA, 16 bp, Homo sapiens
cttgacgcagcccccc

SEQ ID NO: 5726451 - DNA, 15 bp, Homo sapiens
cttgactacctactg

SEQ ID NO: 5726452 - DNA, 19 bp, Homo sapiens
cttgactacctactggtgt

SEQ ID NO: 5726453 - DNA, 21 bp, Homo sapiens
cttgactacctactggtgtaa

SEQ ID NO: 5726454 - DNA, 21 bp, Homo sapiens
cttgactcaggtggtgtcctt

SEQ ID NO: 5726455 - DNA, 16 bp, Homo sapiens
cttgactcatggcagc

SEQ ID NO: 5726456 - DNA, 21 bp, Homo sapiens
cttgactcctttggtatttca

SEQ ID NO: 5726457 - DNA, 22 bp, Homo sapiens
cttgactcctttggtatttcac

SEQ ID NO: 5726458 - DNA, 17 bp, Homo sapiens
cttgactctaaatgcag

SEQ ID NO: 5726459 - DNA, 19 bp, Homo sapiens
cttgactctactgatctga

SEQ ID NO: 5726460 - DNA, 13 bp, Homo sapiens
cttgactcttcta

SEQ ID NO: 5726461 - DNA, 19 bp, Homo sapiens
cttgactgcattgccgctg

SEQ ID NO: 5726462 - DNA, 22 bp, Homo sapiens
cttgactgccccttctatgctg

SEQ ID NO: 5726463 - DNA, 19 bp, Homo sapiens
cttgactgggtgagaccca

SEQ ID NO: 5726464 - DNA, 20 bp, Homo sapiens
cttgactgtcacggaacaga

SEQ ID NO: 5726465 - DNA, 11 bp, Homo sapiens
cttgactgtta

SEQ ID NO: 5726466 - DNA, 19 bp, Homo sapiens
cttgactttgaactaatga

SEQ ID NO: 5726467 - DNA, 16 bp, Homo sapiens
cttgagaaaaaaagaa

SEQ ID NO: 5726468 - DNA, 12 bp, Homo sapiens
cttgagaaacct

SEQ ID NO: 5726469 - DNA, 13 bp, Homo sapiens
cttgagaaacctt

SEQ ID NO: 5726470 - DNA, 23 bp, Homo sapiens
cttgagaaagatctaagcagctg

SEQ ID NO: 5726471 - DNA, 22 bp, Homo sapiens
cttgagaaatatggacacttaa

SEQ ID NO: 5726472 - DNA, 16 bp, Homo sapiens
cttgagaaatttgaaa

SEQ ID NO: 5726473 - DNA, 21 bp, Homo sapiens
cttgagaaccagtctcctcac

SEQ ID NO: 5726474 - DNA, 11 bp, Homo sapiens
cttgagaactt

SEQ ID NO: 5726475 - DNA, 21 bp, Homo sapiens
cttgagaagattcttcccatt

SEQ ID NO: 5726476 - DNA, 19 bp, Homo sapiens
cttgagaaggtcactactg

SEQ ID NO: 5726477 - DNA, 21 bp, Homo sapiens
cttgagaagtctaattcacag

SEQ ID NO: 5726478 - DNA, 18 bp, Homo sapiens
cttgagacaatgttttct

SEQ ID NO: 5726479 - DNA, 21 bp, Homo sapiens
cttgagacaatgttttcttca

SEQ ID NO: 5726480 - DNA, 22 bp, Homo sapiens
cttgagacacggagcccagccc

SEQ ID NO: 5726481 - DNA, 19 bp, Homo sapiens
cttgagaccaacttttcaa

SEQ ID NO: 5726482 - DNA, 18 bp, Homo sapiens
cttgagaccctcttctct

SEQ ID NO: 5726483 - DNA, 18 bp, Homo sapiens
cttgagacctcagccatg

SEQ ID NO: 5726484 - DNA, 11 bp, Homo sapiens
cttgagactgg

SEQ ID NO: 5726485 - DNA, 13 bp, Homo sapiens
cttgagactggag

SEQ ID NO: 5726486 - DNA, 13 bp, Homo sapiens
cttgagagaaaag

SEQ ID NO: 5726487 - DNA, 16 bp, Homo sapiens
cttgagagaaaagaaa

SEQ ID NO: 5726488 - DNA, 14 bp, Homo sapiens
cttgagagaccagg

SEQ ID NO: 5726489 - DNA, 16 bp, Homo sapiens
cttgagagaccaggca

SEQ ID NO: 5726490 - DNA, 16 bp, Homo sapiens
cttgagagctcaggca

SEQ ID NO: 5726491 - DNA, 15 bp, Homo sapiens
cttgagagctgctga

SEQ ID NO: 5726492 - DNA, 17 bp, Homo sapiens
cttgagagctgctgagg

SEQ ID NO: 5726493 - DNA, 15 bp, Homo sapiens
cttgagaggagactt

SEQ ID NO: 5726494 - DNA, 21 bp, Homo sapiens
cttgagaggggtgagacagtg

SEQ ID NO: 5726495 - DNA, 22 bp, Homo sapiens
cttgagagtgttcctgagacag

SEQ ID NO: 5726496 - DNA, 22 bp, Homo sapiens
cttgagataatctaaatataaa

SEQ ID NO: 5726497 - DNA, 15 bp, Homo sapiens
cttgagatctgattt

SEQ ID NO: 5726498 - DNA, 21 bp, Homo sapiens
cttgagatctgattttttccc

SEQ ID NO: 5726499 - DNA, 14 bp, Homo sapiens
cttgagatctgtat

SEQ ID NO: 5726500 - DNA, 16 bp, Homo sapiens
cttgagatctgtataa

SEQ ID NO: 5726501 - DNA, 19 bp, Homo sapiens
cttgagatctgtataaata

SEQ ID NO: 5726502 - DNA, 21 bp, Homo sapiens
cttgagatctgtataaataag

SEQ ID NO: 5726503 - DNA, 12 bp, Homo sapiens
cttgagatgaaa

SEQ ID NO: 5726504 - DNA, 19 bp, Homo sapiens
cttgagatgagtttctggg

SEQ ID NO: 5726505 - DNA, 22 bp, Homo sapiens
cttgagatgtatgaaggctttt

SEQ ID NO: 5726506 - DNA, 13 bp, Homo sapiens
cttgagatgtatt

SEQ ID NO: 5726507 - DNA, 16 bp, Homo sapiens
cttgagattcaagaca

SEQ ID NO: 5726508 - DNA, 13 bp, Homo sapiens
cttgagattctga

SEQ ID NO: 5726509 - DNA, 23 bp, Homo sapiens
cttgagattctgaagtatgaagt

SEQ ID NO: 5726510 - DNA, 15 bp, Homo sapiens
cttgagattttgtat

SEQ ID NO: 5726511 - DNA, 18 bp, Homo sapiens
cttgagattttgtatatt

SEQ ID NO: 5726512 - DNA, 22 bp, Homo sapiens
cttgagcaataaacgctgactt

SEQ ID NO: 5726513 - DNA, 13 bp, Homo sapiens
cttgagcagaccg

SEQ ID NO: 5726514 - DNA, 16 bp, Homo sapiens
cttgagcagtggctgg

SEQ ID NO: 5726515 - DNA, 21 bp, Homo sapiens
cttgagcagtggctggtccag

SEQ ID NO: 5726516 - DNA, 13 bp, Homo sapiens
cttgagcatgccc

SEQ ID NO: 5726517 - DNA, 21 bp, Homo sapiens
cttgagccacagtcactggat

SEQ ID NO: 5726518 - DNA, 18 bp, Homo sapiens
cttgagccaggaggcctg

SEQ ID NO: 5726519 - DNA, 16 bp, Homo sapiens
cttgagccagtaattg

SEQ ID NO: 5726520 - DNA, 17 bp, Homo sapiens
cttgagccatccaaaga

SEQ ID NO: 5726521 - DNA, 20 bp, Homo sapiens
cttgagcccaggagtttgag

SEQ ID NO: 5726522 - DNA, 16 bp, Homo sapiens
cttgagccccagaggc

SEQ ID NO: 5726523 - DNA, 16 bp, Homo sapiens
cttgagccctccccag

SEQ ID NO: 5726524 - DNA, 17 bp, Homo sapiens
cttgagccctccccagg

SEQ ID NO: 5726525 - DNA, 20 bp, Homo sapiens
cttgagccctccccaggaat

SEQ ID NO: 5726526 - DNA, 16 bp, Homo sapiens
cttgagccctcctgga

SEQ ID NO: 5726527 - DNA, 13 bp, Homo sapiens
cttgagccctggc

SEQ ID NO: 5726528 - DNA, 20 bp, Homo sapiens
cttgagccctggctgttctg

SEQ ID NO: 5726529 - DNA, 19 bp, Homo sapiens
cttgagccgggcccctggg

SEQ ID NO: 5726530 - DNA, 11 bp, Homo sapiens
cttgagcctcc

SEQ ID NO: 5726531 - DNA, 12 bp, Homo sapiens
cttgagcctccc

SEQ ID NO: 5726532 - DNA, 12 bp, Homo sapiens
cttgagcctggg

SEQ ID NO: 5726533 - DNA, 12 bp, Homo sapiens
cttgagcctgtc

SEQ ID NO: 5726534 - DNA, 21 bp, Homo sapiens
cttgagcctgtcacgtggtca

SEQ ID NO: 5726535 - DNA, 19 bp, Homo sapiens
cttgagccttgaactttga

SEQ ID NO: 5726536 - DNA, 20 bp, Homo sapiens
cttgagccttgaactttgac

SEQ ID NO: 5726537 - DNA, 19 bp, Homo sapiens
cttgagcggagcccgatat

SEQ ID NO: 5726538 - DNA, 20 bp, Homo sapiens
cttgagctagaccaaggtca

SEQ ID NO: 5726539 - DNA, 13 bp, Homo sapiens
cttgagctcagga

SEQ ID NO: 5726540 - DNA, 21 bp, Homo sapiens
cttgagctcccctggagccag

SEQ ID NO: 5726541 - DNA, 16 bp, Homo sapiens
cttgagctctattatg

SEQ ID NO: 5726542 - DNA, 23 bp, Homo sapiens
cttgagctctgtaacttacacct

SEQ ID NO: 5726543 - DNA, 23 bp, Homo sapiens
cttgagctgcctgctctgcagcc

SEQ ID NO: 5726544 - DNA, 12 bp, Homo sapiens
cttgagctggcc

SEQ ID NO: 5726545 - DNA, 16 bp, Homo sapiens
cttgagctggcctctc

SEQ ID NO: 5726546 - DNA, 12 bp, Homo sapiens
cttgagctgtct

SEQ ID NO: 5726547 - DNA, 21 bp, Homo sapiens
cttgagctgttgtgagctttg

SEQ ID NO: 5726548 - DNA, 17 bp, Homo sapiens
cttgagcttaaacagaa

SEQ ID NO: 5726549 - DNA, 12 bp, Homo sapiens
cttgagcttggc

SEQ ID NO: 5726550 - DNA, 21 bp, Homo sapiens
cttgagctttctgtgcatgtg

SEQ ID NO: 5726551 - DNA, 19 bp, Homo sapiens
cttgaggacctccacctgg

SEQ ID NO: 5726552 - DNA, 22 bp, Homo sapiens
cttgaggacttgggcgggacac

SEQ ID NO: 5726553 - DNA, 13 bp, Homo sapiens
cttgaggagaagt

SEQ ID NO: 5726554 - DNA, 23 bp, Homo sapiens
cttgaggaggagctggcctgcgg

SEQ ID NO: 5726555 - DNA, 18 bp, Homo sapiens
cttgaggaggggcacctg

SEQ ID NO: 5726556 - DNA, 23 bp, Homo sapiens
cttgaggaggggcacctgccacc

SEQ ID NO: 5726557 - DNA, 22 bp, Homo sapiens
cttgaggaggggcaggtaaact

SEQ ID NO: 5726558 - DNA, 17 bp, Homo sapiens
cttgaggattgtggaaa

SEQ ID NO: 5726559 - DNA, 17 bp, Homo sapiens
cttgaggccaaatgagt

SEQ ID NO: 5726560 - DNA, 13 bp, Homo sapiens
cttgaggccaaga

SEQ ID NO: 5726561 - DNA, 23 bp, Homo sapiens
cttgaggccaagatggctgctgc

SEQ ID NO: 5726562 - DNA, 21 bp, Homo sapiens
cttgaggcctgatctgcccat

SEQ ID NO: 5726563 - DNA, 18 bp, Homo sapiens
cttgaggctggcactccc

SEQ ID NO: 5726564 - DNA, 23 bp, Homo sapiens
cttgagggacgactttctttaac

SEQ ID NO: 5726565 - DNA, 20 bp, Homo sapiens
cttgagggagaatcctccct

SEQ ID NO: 5726566 - DNA, 14 bp, Homo sapiens
cttgagggccagga

SEQ ID NO: 5726567 - DNA, 19 bp, Homo sapiens
cttgagggcccagagcagg

SEQ ID NO: 5726568 - DNA, 12 bp, Homo sapiens
cttgagggctgc

SEQ ID NO: 5726569 - DNA, 15 bp, Homo sapiens
cttgagggctgcagt

SEQ ID NO: 5726570 - DNA, 12 bp, Homo sapiens
cttgaggggaag

SEQ ID NO: 5726571 - DNA, 18 bp, Homo sapiens
cttgaggggaccaggagt

SEQ ID NO: 5726572 - DNA, 16 bp, Homo sapiens
cttgaggggagccagg

SEQ ID NO: 5726573 - DNA, 12 bp, Homo sapiens
cttgaggggcag

SEQ ID NO: 5726574 - DNA, 22 bp, Homo sapiens
cttgaggggcagtttgggaagg

SEQ ID NO: 5726575 - DNA, 15 bp, Homo sapiens
cttgaggggccccag

SEQ ID NO: 5726576 - DNA, 13 bp, Homo sapiens
cttgagggggaag

SEQ ID NO: 5726577 - DNA, 20 bp, Homo sapiens
cttgagggggaaggattctg

SEQ ID NO: 5726578 - DNA, 15 bp, Homo sapiens
cttgagggtgggcca

SEQ ID NO: 5726579 - DNA, 14 bp, Homo sapiens
cttgaggtctcagc

SEQ ID NO: 5726580 - DNA, 23 bp, Homo sapiens
cttgaggtcttttgacatgtgga

SEQ ID NO: 5726581 - DNA, 22 bp, Homo sapiens
cttgaggtggcctccttgcttg

SEQ ID NO: 5726582 - DNA, 21 bp, Homo sapiens
cttgaggttttgttcatgccc

SEQ ID NO: 5726583 - DNA, 15 bp, Homo sapiens
cttgagtaaaaaggt

SEQ ID NO: 5726584 - DNA, 12 bp, Homo sapiens
cttgagtaaaat

SEQ ID NO: 5726585 - DNA, 15 bp, Homo sapiens
cttgagtaagtgaag

SEQ ID NO: 5726586 - DNA, 14 bp, Homo sapiens
cttgagtaatttaa

SEQ ID NO: 5726587 - DNA, 23 bp, Homo sapiens
cttgagtatagcaatatcaaaag

SEQ ID NO: 5726588 - DNA, 19 bp, Homo sapiens
cttgagtatcataatatat

SEQ ID NO: 5726589 - DNA, 18 bp, Homo sapiens
cttgagtcatggatttct

SEQ ID NO: 5726590 - DNA, 15 bp, Homo sapiens
cttgagtctattttt

SEQ ID NO: 5726591 - DNA, 13 bp, Homo sapiens
cttgagtctctga

SEQ ID NO: 5726592 - DNA, 19 bp, Homo sapiens
cttgagtgagaagagcttg

SEQ ID NO: 5726593 - DNA, 22 bp, Homo sapiens
cttgagtgagaagagcttgcac

SEQ ID NO: 5726594 - DNA, 16 bp, Homo sapiens
cttgagtgctcagtag

SEQ ID NO: 5726595 - DNA, 23 bp, Homo sapiens
cttgagtgcttgttagagagaaa

SEQ ID NO: 5726596 - DNA, 18 bp, Homo sapiens
cttgagtggacagcagct

SEQ ID NO: 5726597 - DNA, 23 bp, Homo sapiens
cttgagtggacagcagctggact

SEQ ID NO: 5726598 - DNA, 17 bp, Homo sapiens
cttgagtgggccccctc

SEQ ID NO: 5726599 - DNA, 20 bp, Homo sapiens
cttgagtgggccccctctct

SEQ ID NO: 5726600 - DNA, 13 bp, Homo sapiens
cttgagtggggca

SEQ ID NO: 5726601 - DNA, 23 bp, Homo sapiens
cttgagtggggttatctctgtgt

SEQ ID NO: 5726602 - DNA, 17 bp, Homo sapiens
cttgagtggtttttgct

SEQ ID NO: 5726603 - DNA, 20 bp, Homo sapiens
cttgagtgtaatgtttgtta

SEQ ID NO: 5726604 - DNA, 19 bp, Homo sapiens
cttgagtgttatgtgaatt

SEQ ID NO: 5726605 - DNA, 22 bp, Homo sapiens
cttgagtgttatgtgaatttga

SEQ ID NO: 5726606 - DNA, 23 bp, Homo sapiens
cttgagtgttcctttttaaatgt

SEQ ID NO: 5726607 - DNA, 19 bp, Homo sapiens
cttgagttcaccatctctt

SEQ ID NO: 5726608 - DNA, 21 bp, Homo sapiens
cttgagttgattcagctctgc

SEQ ID NO: 5726609 - DNA, 13 bp, Homo sapiens
cttgagttggctg

SEQ ID NO: 5726610 - DNA, 14 bp, Homo sapiens
cttgagttggctgt

SEQ ID NO: 5726611 - DNA, 17 bp, Homo sapiens
cttgagttggctgtgtt

SEQ ID NO: 5726612 - DNA, 23 bp, Homo sapiens
cttgagttgtttttgtatattgg

SEQ ID NO: 5726613 - DNA, 14 bp, Homo sapiens
cttgagtttcattt

SEQ ID NO: 5726614 - DNA, 19 bp, Homo sapiens
cttgagtttcatttttcat

SEQ ID NO: 5726615 - DNA, 21 bp, Homo sapiens
cttgagttttcatttcatata

SEQ ID NO: 5726616 - DNA, 14 bp, Homo sapiens
cttgataaaggaga

SEQ ID NO: 5726617 - DNA, 13 bp, Homo sapiens
cttgataacagct

SEQ ID NO: 5726618 - DNA, 15 bp, Homo sapiens
cttgataatacttga

SEQ ID NO: 5726619 - DNA, 16 bp, Homo sapiens
cttgataatacttgac

SEQ ID NO: 5726620 - DNA, 22 bp, Homo sapiens
cttgataatattagtgattctg

SEQ ID NO: 5726621 - DNA, 17 bp, Homo sapiens
cttgatacccccctctg

SEQ ID NO: 5726622 - DNA, 20 bp, Homo sapiens
cttgatacccccctctgtct

SEQ ID NO: 5726623 - DNA, 21 bp, Homo sapiens
cttgatacccccctctgtctt

SEQ ID NO: 5726624 - DNA, 14 bp, Homo sapiens
cttgatactgaatg

SEQ ID NO: 5726625 - DNA, 18 bp, Homo sapiens
cttgatactgaatgcata

SEQ ID NO: 5726626 - DNA, 14 bp, Homo sapiens
cttgatagaaatgc

SEQ ID NO: 5726627 - DNA, 18 bp, Homo sapiens
cttgatagacttactaat

SEQ ID NO: 5726628 - DNA, 21 bp, Homo sapiens
cttgatagacttactaataaa

SEQ ID NO: 5726629 - DNA, 15 bp, Homo sapiens
cttgatagatgtttg

SEQ ID NO: 5726630 - DNA, 14 bp, Homo sapiens
cttgatagctaaat

SEQ ID NO: 5726631 - DNA, 14 bp, Homo sapiens
cttgatataataat

SEQ ID NO: 5726632 - DNA, 18 bp, Homo sapiens
cttgatataataattact

SEQ ID NO: 5726633 - DNA, 22 bp, Homo sapiens
cttgatataataattacttaat

SEQ ID NO: 5726634 - DNA, 23 bp, Homo sapiens
cttgatataataattacttaatg

SEQ ID NO: 5726635 - DNA, 15 bp, Homo sapiens
cttgatataattact

SEQ ID NO: 5726636 - DNA, 17 bp, Homo sapiens
cttgatataattactta

SEQ ID NO: 5726637 - DNA, 17 bp, Homo sapiens
cttgatatagaaagctg

SEQ ID NO: 5726638 - DNA, 15 bp, Homo sapiens
cttgatatcattcag

SEQ ID NO: 5726639 - DNA, 22 bp, Homo sapiens
cttgatatctttcctccctctt

SEQ ID NO: 5726640 - DNA, 23 bp, Homo sapiens
cttgatcaacatcttttcttgcc

SEQ ID NO: 5726641 - DNA, 22 bp, Homo sapiens
cttgatcagttaagaaatttca

SEQ ID NO: 5726642 - DNA, 14 bp, Homo sapiens
cttgatcatgtctt

SEQ ID NO: 5726643 - DNA, 13 bp, Homo sapiens
cttgatcattccg

SEQ ID NO: 5726644 - DNA, 17 bp, Homo sapiens
cttgatccagaagagcc

SEQ ID NO: 5726645 - DNA, 17 bp, Homo sapiens
cttgatccatttctaat

SEQ ID NO: 5726646 - DNA, 20 bp, Homo sapiens
cttgatcctccaatgtctaa

SEQ ID NO: 5726647 - DNA, 17 bp, Homo sapiens
cttgatcgacttcttgg

SEQ ID NO: 5726648 - DNA, 15 bp, Homo sapiens
cttgatcggaaagct

SEQ ID NO: 5726649 - DNA, 10 bp, Homo sapiens
cttgatctat

SEQ ID NO: 5726650 - DNA, 17 bp, Homo sapiens
cttgatctatctacaaa

SEQ ID NO: 5726651 - DNA, 20 bp, Homo sapiens
cttgatctatctacaaagaa

SEQ ID NO: 5726652 - DNA, 13 bp, Homo sapiens
cttgatctcctga

SEQ ID NO: 5726653 - DNA, 16 bp, Homo sapiens
cttgatctcctgacct

SEQ ID NO: 5726654 - DNA, 13 bp, Homo sapiens
cttgatctctctt

SEQ ID NO: 5726655 - DNA, 17 bp, Homo sapiens
cttgatctctcttgtcc

SEQ ID NO: 5726656 - DNA, 22 bp, Homo sapiens
cttgatctctcttgtcctcttc

SEQ ID NO: 5726657 - DNA, 21 bp, Homo sapiens
cttgatctgctcagccctgga

SEQ ID NO: 5726658 - DNA, 15 bp, Homo sapiens
cttgatcttaaagat

SEQ ID NO: 5726659 - DNA, 13 bp, Homo sapiens
cttgatctttgga

SEQ ID NO: 5726660 - DNA, 21 bp, Homo sapiens
cttgatgaaataacacagcag

SEQ ID NO: 5726661 - DNA, 22 bp, Homo sapiens
cttgatgaagcccgtgtcctgc

SEQ ID NO: 5726662 - DNA, 23 bp, Homo sapiens
cttgatgaagcccgtgtcctgcc

SEQ ID NO: 5726663 - DNA, 14 bp, Homo sapiens
cttgatgactgctg

SEQ ID NO: 5726664 - DNA, 20 bp, Homo sapiens
cttgatgagtgtaacaagaa

SEQ ID NO: 5726665 - DNA, 21 bp, Homo sapiens
cttgatgagtgtaacaagaaa

SEQ ID NO: 5726666 - DNA, 21 bp, Homo sapiens
cttgatgatgtggaaatgctg

SEQ ID NO: 5726667 - DNA, 14 bp, Homo sapiens
cttgatgccagagg

SEQ ID NO: 5726668 - DNA, 16 bp, Homo sapiens
cttgatgccagagggc

SEQ ID NO: 5726669 - DNA, 18 bp, Homo sapiens
cttgatgccagagggcca

SEQ ID NO: 5726670 - DNA, 22 bp, Homo sapiens
cttgatgccagtaggctcaact

SEQ ID NO: 5726671 - DNA, 18 bp, Homo sapiens
cttgatgcccagctcagt

SEQ ID NO: 5726672 - DNA, 23 bp, Homo sapiens
cttgatgcctcccggctttgcag

SEQ ID NO: 5726673 - DNA, 13 bp, Homo sapiens
cttgatgcctggc

SEQ ID NO: 5726674 - DNA, 21 bp, Homo sapiens
cttgatggaagaaaatggaat

SEQ ID NO: 5726675 - DNA, 16 bp, Homo sapiens
cttgatggctaactta

SEQ ID NO: 5726676 - DNA, 22 bp, Homo sapiens
cttgatgtacagattttatttg

SEQ ID NO: 5726677 - DNA, 21 bp, Homo sapiens
cttgatgtcttgagagcgctg

SEQ ID NO: 5726678 - DNA, 12 bp, Homo sapiens
cttgatgtgaag

SEQ ID NO: 5726679 - DNA, 22 bp, Homo sapiens
cttgatgtgaagataatttgca

SEQ ID NO: 5726680 - DNA, 23 bp, Homo sapiens
cttgatgtgaagataatttgcat

SEQ ID NO: 5726681 - DNA, 15 bp, Homo sapiens
cttgatgtgccattt

SEQ ID NO: 5726682 - DNA, 22 bp, Homo sapiens
cttgatgtgccattttaaaaaa

SEQ ID NO: 5726683 - DNA, 22 bp, Homo sapiens
cttgatgtggtgaggcaggctt

SEQ ID NO: 5726684 - DNA, 16 bp, Homo sapiens
cttgatgtgtcatcta

SEQ ID NO: 5726685 - DNA, 19 bp, Homo sapiens
cttgatgttccacctgcca

SEQ ID NO: 5726686 - DNA, 15 bp, Homo sapiens
cttgatgtttcctgg

SEQ ID NO: 5726687 - DNA, 16 bp, Homo sapiens
cttgatgtttcctgga

SEQ ID NO: 5726688 - DNA, 22 bp, Homo sapiens
cttgatgttttttctgtaatgt

SEQ ID NO: 5726689 - DNA, 23 bp, Homo sapiens
cttgatgttttttctgtaatgta

SEQ ID NO: 5726690 - DNA, 13 bp, Homo sapiens
cttgattaaaagt

SEQ ID NO: 5726691 - DNA, 20 bp, Homo sapiens
cttgattaagatctcagtgg

SEQ ID NO: 5726692 - DNA, 15 bp, Homo sapiens
cttgattaagatttt

SEQ ID NO: 5726693 - DNA, 21 bp, Homo sapiens
cttgattaagattttacaaaa

SEQ ID NO: 5726694 - DNA, 21 bp, Homo sapiens
cttgattaaggactacagaat

SEQ ID NO: 5726695 - DNA, 22 bp, Homo sapiens
cttgattaaggactacagaatt

SEQ ID NO: 5726696 - DNA, 18 bp, Homo sapiens
cttgattaatgtactttt

SEQ ID NO: 5726697 - DNA, 14 bp, Homo sapiens
cttgattacataat

SEQ ID NO: 5726698 - DNA, 17 bp, Homo sapiens
cttgattacttccactg

SEQ ID NO: 5726699 - DNA, 22 bp, Homo sapiens
cttgattagaagccaagacagt

SEQ ID NO: 5726700 - DNA, 16 bp, Homo sapiens
cttgattatattgttt

SEQ ID NO: 5726701 - DNA, 20 bp, Homo sapiens
cttgattatgccttttaaaa

SEQ ID NO: 5726702 - DNA, 12 bp, Homo sapiens
cttgattcataa

SEQ ID NO: 5726703 - DNA, 20 bp, Homo sapiens
cttgattcatctctggtttt

SEQ ID NO: 5726704 - DNA, 15 bp, Homo sapiens
cttgattcattctga

SEQ ID NO: 5726705 - DNA, 17 bp, Homo sapiens
cttgattcccttgttat

SEQ ID NO: 5726706 - DNA, 14 bp, Homo sapiens
cttgattcctggct

SEQ ID NO: 5726707 - DNA, 16 bp, Homo sapiens
cttgattctaaagggg

SEQ ID NO: 5726708 - DNA, 13 bp, Homo sapiens
cttgattctgcag

SEQ ID NO: 5726709 - DNA, 17 bp, Homo sapiens
cttgattctgcagtaaa

SEQ ID NO: 5726710 - DNA, 14 bp, Homo sapiens
cttgattgattttt

SEQ ID NO: 5726711 - DNA, 19 bp, Homo sapiens
cttgattgatttttaaagt

SEQ ID NO: 5726712 - DNA, 23 bp, Homo sapiens
cttgattggggaattaaaagtca

SEQ ID NO: 5726713 - DNA, 19 bp, Homo sapiens
cttgattggtgttgccagt

SEQ ID NO: 5726714 - DNA, 14 bp, Homo sapiens
cttgattgtacttg

SEQ ID NO: 5726715 - DNA, 18 bp, Homo sapiens
cttgatttaaacacacag

SEQ ID NO: 5726716 - DNA, 19 bp, Homo sapiens
cttgatttaaacacacaga

SEQ ID NO: 5726717 - DNA, 23 bp, Homo sapiens
cttgatttcaaagttttgttgta

SEQ ID NO: 5726718 - DNA, 20 bp, Homo sapiens
cttgatttcaggtcaataac

SEQ ID NO: 5726719 - DNA, 20 bp, Homo sapiens
cttgatttcccaaaaacact

SEQ ID NO: 5726720 - DNA, 16 bp, Homo sapiens
cttgatttgagatttt

SEQ ID NO: 5726721 - DNA, 17 bp, Homo sapiens
cttgatttgatctttgt

SEQ ID NO: 5726722 - DNA, 12 bp, Homo sapiens
cttgatttgcat

SEQ ID NO: 5726723 - DNA, 17 bp, Homo sapiens
cttgatttgcatggatt

SEQ ID NO: 5726724 - DNA, 21 bp, Homo sapiens
cttgattttagccttctctgt

SEQ ID NO: 5726725 - DNA, 21 bp, Homo sapiens
cttgattttcaagctttcaaa

SEQ ID NO: 5726726 - DNA, 13 bp, Homo sapiens
cttgattttccat

SEQ ID NO: 5726727 - DNA, 14 bp, Homo sapiens
cttgattttgcaaa

SEQ ID NO: 5726728 - DNA, 14 bp, Homo sapiens
cttgatttttacat

SEQ ID NO: 5726729 - DNA, 12 bp, Homo sapiens
cttgatttttgc

SEQ ID NO: 5726730 - DNA, 16 bp, Homo sapiens
cttgcaaaaagggtca

SEQ ID NO: 5726731 - DNA, 13 bp, Homo sapiens
cttgcaaaacaaa

SEQ ID NO: 5726732 - DNA, 12 bp, Homo sapiens
cttgcaaaatgg

SEQ ID NO: 5726733 - DNA, 13 bp, Homo sapiens
cttgcaaaatgga

SEQ ID NO: 5726734 - DNA, 21 bp, Homo sapiens
cttgcaaactctataaagaaa

SEQ ID NO: 5726735 - DNA, 19 bp, Homo sapiens
cttgcaaagcctttaaatt

SEQ ID NO: 5726736 - DNA, 18 bp, Homo sapiens
cttgcaaagcgacagatt

SEQ ID NO: 5726737 - DNA, 19 bp, Homo sapiens
cttgcaaagcgacagattc

SEQ ID NO: 5726738 - DNA, 23 bp, Homo sapiens
cttgcaaatacctcctccctaat

SEQ ID NO: 5726739 - DNA, 16 bp, Homo sapiens
cttgcaaatgggagct

SEQ ID NO: 5726740 - DNA, 14 bp, Homo sapiens
cttgcaacacacag

SEQ ID NO: 5726741 - DNA, 19 bp, Homo sapiens
cttgcaacacacagacaca

SEQ ID NO: 5726742 - DNA, 16 bp, Homo sapiens
cttgcaacagtgccat

SEQ ID NO: 5726743 - DNA, 14 bp, Homo sapiens
cttgcaaccaggca

SEQ ID NO: 5726744 - DNA, 15 bp, Homo sapiens
cttgcaaccaggcag

SEQ ID NO: 5726745 - DNA, 18 bp, Homo sapiens
cttgcaaccaggcagctg

SEQ ID NO: 5726746 - DNA, 14 bp, Homo sapiens
cttgcaacccaagg

SEQ ID NO: 5726747 - DNA, 18 bp, Homo sapiens
cttgcaacccaaggtgag

SEQ ID NO: 5726748 - DNA, 23 bp, Homo sapiens
cttgcaacttctttctgttgaga

SEQ ID NO: 5726749 - DNA, 18 bp, Homo sapiens
cttgcaagaatcagtgca

SEQ ID NO: 5726750 - DNA, 16 bp, Homo sapiens
cttgcaagataatttt

SEQ ID NO: 5726751 - DNA, 21 bp, Homo sapiens
cttgcaagcaacaagctattt

SEQ ID NO: 5726752 - DNA, 17 bp, Homo sapiens
cttgcaagcatgcttgt

SEQ ID NO: 5726753 - DNA, 15 bp, Homo sapiens
cttgcaagccataac

SEQ ID NO: 5726754 - DNA, 18 bp, Homo sapiens
cttgcaagccataacgtg

SEQ ID NO: 5726755 - DNA, 20 bp, Homo sapiens
cttgcaagggaagagccttt

SEQ ID NO: 5726756 - DNA, 23 bp, Homo sapiens
cttgcaagttaaggcttccccct

SEQ ID NO: 5726757 - DNA, 20 bp, Homo sapiens
cttgcaatgaaaagaaaatg

SEQ ID NO: 5726758 - DNA, 18 bp, Homo sapiens
cttgcaatggcagccttg

SEQ ID NO: 5726759 - DNA, 16 bp, Homo sapiens
cttgcaattagcattc

SEQ ID NO: 5726760 - DNA, 19 bp, Homo sapiens
cttgcaattagcattctgt

SEQ ID NO: 5726761 - DNA, 21 bp, Homo sapiens
cttgcaattgttaatcaaaga

SEQ ID NO: 5726762 - DNA, 18 bp, Homo sapiens
cttgcacacatcatctgt

SEQ ID NO: 5726763 - DNA, 19 bp, Homo sapiens
cttgcacacatcatctgta

SEQ ID NO: 5726764 - DNA, 13 bp, Homo sapiens
cttgcacacccac

SEQ ID NO: 5726765 - DNA, 18 bp, Homo sapiens
cttgcacacccactgccc

SEQ ID NO: 5726766 - DNA, 22 bp, Homo sapiens
cttgcacactcccctgcactgg

SEQ ID NO: 5726767 - DNA, 18 bp, Homo sapiens
cttgcacagccaacgaga

SEQ ID NO: 5726768 - DNA, 23 bp, Homo sapiens
cttgcacagccaacgagacacat

SEQ ID NO: 5726769 - DNA, 18 bp, Homo sapiens
cttgcacagctggagaaa

SEQ ID NO: 5726770 - DNA, 14 bp, Homo sapiens
cttgcacaggccac

SEQ ID NO: 5726771 - DNA, 22 bp, Homo sapiens
cttgcacaggccacttgctcag

SEQ ID NO: 5726772 - DNA, 14 bp, Homo sapiens
cttgcacagggatt

SEQ ID NO: 5726773 - DNA, 15 bp, Homo sapiens
cttgcacagtcactg

SEQ ID NO: 5726774 - DNA, 19 bp, Homo sapiens
cttgcacagtcactgctct

SEQ ID NO: 5726775 - DNA, 23 bp, Homo sapiens
cttgcacagtcactgctcttcag

SEQ ID NO: 5726776 - DNA, 14 bp, Homo sapiens
cttgcacatctctg

SEQ ID NO: 5726777 - DNA, 19 bp, Homo sapiens
cttgcacatgaatgcagtc

SEQ ID NO: 5726778 - DNA, 14 bp, Homo sapiens
cttgcacccctcac

SEQ ID NO: 5726779 - DNA, 20 bp, Homo sapiens
cttgcacccctcactctggc

SEQ ID NO: 5726780 - DNA, 17 bp, Homo sapiens
cttgcacccgcctctcc

SEQ ID NO: 5726781 - DNA, 13 bp, Homo sapiens
cttgcacctgagc

SEQ ID NO: 5726782 - DNA, 16 bp, Homo sapiens
cttgcacctgagcctg

SEQ ID NO: 5726783 - DNA, 13 bp, Homo sapiens
cttgcaccttttc

SEQ ID NO: 5726784 - DNA, 20 bp, Homo sapiens
cttgcacgaccgccccagtt

SEQ ID NO: 5726785 - DNA, 19 bp, Homo sapiens
cttgcacgcccatgtgtga

SEQ ID NO: 5726786 - DNA, 20 bp, Homo sapiens
cttgcacggctgctcggctt

SEQ ID NO: 5726787 - DNA, 17 bp, Homo sapiens
cttgcacggtgacccct

SEQ ID NO: 5726788 - DNA, 16 bp, Homo sapiens
cttgcactattccaca

SEQ ID NO: 5726789 - DNA, 16 bp, Homo sapiens
cttgcactcctactga

SEQ ID NO: 5726790 - DNA, 18 bp, Homo sapiens
cttgcactctcttggctg

SEQ ID NO: 5726791 - DNA, 13 bp, Homo sapiens
cttgcactgaagc

SEQ ID NO: 5726792 - DNA, 13 bp, Homo sapiens
cttgcactgtgct

SEQ ID NO: 5726793 - DNA, 16 bp, Homo sapiens
cttgcactgtgcttgc

SEQ ID NO: 5726794 - DNA, 17 bp, Homo sapiens
cttgcactgtgcttgct

SEQ ID NO: 5726795 - DNA, 14 bp, Homo sapiens
cttgcacttctgtt

SEQ ID NO: 5726796 - DNA, 13 bp, Homo sapiens
cttgcacttgttt

SEQ ID NO: 5726797 - DNA, 14 bp, Homo sapiens
cttgcactttgtga

SEQ ID NO: 5726798 - DNA, 18 bp, Homo sapiens
cttgcagaaggcaaggcc

SEQ ID NO: 5726799 - DNA, 23 bp, Homo sapiens
cttgcagaaggcaaggccctgcc

SEQ ID NO: 5726800 - DNA, 18 bp, Homo sapiens
cttgcagactctacagag

SEQ ID NO: 5726801 - DNA, 20 bp, Homo sapiens
cttgcagactctacagaggc

SEQ ID NO: 5726802 - DNA, 20 bp, Homo sapiens
cttgcagagaagccttggta

SEQ ID NO: 5726803 - DNA, 13 bp, Homo sapiens
cttgcagagcttg

SEQ ID NO: 5726804 - DNA, 18 bp, Homo sapiens
cttgcagatatctgcatg

SEQ ID NO: 5726805 - DNA, 17 bp, Homo sapiens
cttgcagatcatctggg

SEQ ID NO: 5726806 - DNA, 21 bp, Homo sapiens
cttgcagattttcttaaggaa

SEQ ID NO: 5726807 - DNA, 23 bp, Homo sapiens
cttgcagattttcttaaggaatt

SEQ ID NO: 5726808 - DNA, 13 bp, Homo sapiens
cttgcagcagaga

SEQ ID NO: 5726809 - DNA, 19 bp, Homo sapiens
cttgcagcagggctgggcc

SEQ ID NO: 5726810 - DNA, 22 bp, Homo sapiens
cttgcagcagggctgggcctgc

SEQ ID NO: 5726811 - DNA, 15 bp, Homo sapiens
cttgcagcatttact

SEQ ID NO: 5726812 - DNA, 16 bp, Homo sapiens
cttgcagcatttacta

SEQ ID NO: 5726813 - DNA, 22 bp, Homo sapiens
cttgcagcatttactatgcaca

SEQ ID NO: 5726814 - DNA, 23 bp, Homo sapiens
cttgcagcatttactatgcacaa

SEQ ID NO: 5726815 - DNA, 13 bp, Homo sapiens
cttgcagccacat

SEQ ID NO: 5726816 - DNA, 17 bp, Homo sapiens
cttgcagccacatggcc

SEQ ID NO: 5726817 - DNA, 17 bp, Homo sapiens
cttgcagccaggagaag

SEQ ID NO: 5726818 - DNA, 16 bp, Homo sapiens
cttgcagctggcccac

SEQ ID NO: 5726819 - DNA, 14 bp, Homo sapiens
cttgcaggaggcca

SEQ ID NO: 5726820 - DNA, 19 bp, Homo sapiens
cttgcaggaggccaaactg

SEQ ID NO: 5726821 - DNA, 18 bp, Homo sapiens
cttgcaggggtccctgct

SEQ ID NO: 5726822 - DNA, 18 bp, Homo sapiens
cttgcagggtgggtgagc

SEQ ID NO: 5726823 - DNA, 15 bp, Homo sapiens
cttgcagtaattcaa

SEQ ID NO: 5726824 - DNA, 22 bp, Homo sapiens
cttgcagtacatcaaaggaatg

SEQ ID NO: 5726825 - DNA, 17 bp, Homo sapiens
cttgcagtagattttct

SEQ ID NO: 5726826 - DNA, 18 bp, Homo sapiens
cttgcagtatcggcactg

SEQ ID NO: 5726827 - DNA, 19 bp, Homo sapiens
cttgcagtatcggcactgt

SEQ ID NO: 5726828 - DNA, 22 bp, Homo sapiens
cttgcagtatgatggcaggaga

SEQ ID NO: 5726829 - DNA, 15 bp, Homo sapiens
cttgcagtcatcaga

SEQ ID NO: 5726830 - DNA, 16 bp, Homo sapiens
cttgcagtcatcagaa

SEQ ID NO: 5726831 - DNA, 21 bp, Homo sapiens
cttgcagtccgttgctgaaaa

SEQ ID NO: 5726832 - DNA, 17 bp, Homo sapiens
cttgcagtggcttttca

SEQ ID NO: 5726833 - DNA, 22 bp, Homo sapiens
cttgcagttcagcaccacccta

SEQ ID NO: 5726834 - DNA, 15 bp, Homo sapiens
cttgcagtttaagat

SEQ ID NO: 5726835 - DNA, 15 bp, Homo sapiens
cttgcagttttgtaa

SEQ ID NO: 5726836 - DNA, 16 bp, Homo sapiens
cttgcagttttgtaag

SEQ ID NO: 5726837 - DNA, 21 bp, Homo sapiens
cttgcagttttgtaagccctc

SEQ ID NO: 5726838 - DNA, 19 bp, Homo sapiens
cttgcataagcctcaggcc

SEQ ID NO: 5726839 - DNA, 21 bp, Homo sapiens
cttgcataagcctcaggcctg

SEQ ID NO: 5726840 - DNA, 22 bp, Homo sapiens
cttgcataataagctaaagagg

SEQ ID NO: 5726841 - DNA, 20 bp, Homo sapiens
cttgcatacaaacaagcata

SEQ ID NO: 5726842 - DNA, 14 bp, Homo sapiens
cttgcatcctattt

SEQ ID NO: 5726843 - DNA, 17 bp, Homo sapiens
cttgcatcctatttggt

SEQ ID NO: 5726844 - DNA, 19 bp, Homo sapiens
cttgcatcctcctcccaac

SEQ ID NO: 5726845 - DNA, 16 bp, Homo sapiens
cttgcatccttcctat

SEQ ID NO: 5726846 - DNA, 20 bp, Homo sapiens
cttgcatccttcctataact

SEQ ID NO: 5726847 - DNA, 15 bp, Homo sapiens
cttgcatctgcacat

SEQ ID NO: 5726848 - DNA, 14 bp, Homo sapiens
cttgcatgaggcta

SEQ ID NO: 5726849 - DNA, 19 bp, Homo sapiens
cttgcatggcattaattgt

SEQ ID NO: 5726850 - DNA, 20 bp, Homo sapiens
cttgcatggcattaattgtt

SEQ ID NO: 5726851 - DNA, 18 bp, Homo sapiens
cttgcatggtttggagct

SEQ ID NO: 5726852 - DNA, 22 bp, Homo sapiens
cttgcatggtttggagctgatc

SEQ ID NO: 5726853 - DNA, 19 bp, Homo sapiens
cttgcatgtacttgaagga

SEQ ID NO: 5726854 - DNA, 21 bp, Homo sapiens
cttgcatgtacttgaaggatg

SEQ ID NO: 5726855 - DNA, 13 bp, Homo sapiens
cttgcattagaaa

SEQ ID NO: 5726856 - DNA, 14 bp, Homo sapiens
cttgcattcatttt

SEQ ID NO: 5726857 - DNA, 15 bp, Homo sapiens
cttgcattcattttc

SEQ ID NO: 5726858 - DNA, 20 bp, Homo sapiens
cttgcattcattttctgaca

SEQ ID NO: 5726859 - DNA, 16 bp, Homo sapiens
cttgcattccagagtt

SEQ ID NO: 5726860 - DNA, 14 bp, Homo sapiens
cttgcattcccagt

SEQ ID NO: 5726861 - DNA, 10 bp, Homo sapiens
cttgcattga

SEQ ID NO: 5726862 - DNA, 18 bp, Homo sapiens
cttgcattgaatatatta

SEQ ID NO: 5726863 - DNA, 18 bp, Homo sapiens
cttgcatttaaaagacag

SEQ ID NO: 5726864 - DNA, 22 bp, Homo sapiens
cttgcatttctttatttctgtc

SEQ ID NO: 5726865 - DNA, 20 bp, Homo sapiens
cttgcatttttgcaggagca

SEQ ID NO: 5726866 - DNA, 19 bp, Homo sapiens
cttgcatttttttccttta

SEQ ID NO: 5726867 - DNA, 20 bp, Homo sapiens
cttgccaaaaaatagcacac

SEQ ID NO: 5726868 - DNA, 21 bp, Homo sapiens
cttgccaaagtacagaatttg

SEQ ID NO: 5726869 - DNA, 17 bp, Homo sapiens
cttgccaaattccatgt

SEQ ID NO: 5726870 - DNA, 21 bp, Homo sapiens
cttgccaaattccatgtccct

SEQ ID NO: 5726871 - DNA, 22 bp, Homo sapiens
cttgccaacctgtaataaatat

SEQ ID NO: 5726872 - DNA, 16 bp, Homo sapiens
cttgccaactccatct

SEQ ID NO: 5726873 - DNA, 17 bp, Homo sapiens
cttgccaagaaaatgaa

SEQ ID NO: 5726874 - DNA, 14 bp, Homo sapiens
cttgccaagaaatc

SEQ ID NO: 5726875 - DNA, 20 bp, Homo sapiens
cttgccaagctttcttctac

SEQ ID NO: 5726876 - DNA, 13 bp, Homo sapiens
cttgccaaggccg

SEQ ID NO: 5726877 - DNA, 20 bp, Homo sapiens
cttgccaagggtccctgtgt

SEQ ID NO: 5726878 - DNA, 13 bp, Homo sapiens
cttgccacacccc

SEQ ID NO: 5726879 - DNA, 19 bp, Homo sapiens
cttgccacaccccccaccc

SEQ ID NO: 5726880 - DNA, 21 bp, Homo sapiens
cttgccacatggtgtctccca

SEQ ID NO: 5726881 - DNA, 13 bp, Homo sapiens
cttgccacccccc

SEQ ID NO: 5726882 - DNA, 14 bp, Homo sapiens
cttgccaccctctg

SEQ ID NO: 5726883 - DNA, 19 bp, Homo sapiens
cttgccactaagccatgaa

SEQ ID NO: 5726884 - DNA, 17 bp, Homo sapiens
cttgccactagggctct

SEQ ID NO: 5726885 - DNA, 15 bp, Homo sapiens
cttgccactgcctct

SEQ ID NO: 5726886 - DNA, 17 bp, Homo sapiens
cttgccactttgcacga

SEQ ID NO: 5726887 - DNA, 22 bp, Homo sapiens
cttgccagccagaagcctctgc

SEQ ID NO: 5726888 - DNA, 23 bp, Homo sapiens
cttgccagccagaagcctctgcc

SEQ ID NO: 5726889 - DNA, 12 bp, Homo sapiens
cttgccagcctc

SEQ ID NO: 5726890 - DNA, 14 bp, Homo sapiens
cttgccagcctcct

SEQ ID NO: 5726891 - DNA, 17 bp, Homo sapiens
cttgccagcctccttgc

SEQ ID NO: 5726892 - DNA, 15 bp, Homo sapiens
cttgccagctcagca

SEQ ID NO: 5726893 - DNA, 18 bp, Homo sapiens
cttgccagctgctgagcc

SEQ ID NO: 5726894 - DNA, 20 bp, Homo sapiens
cttgccagggaggtggaagg

SEQ ID NO: 5726895 - DNA, 15 bp, Homo sapiens
cttgccagggcaggg

SEQ ID NO: 5726896 - DNA, 12 bp, Homo sapiens
cttgccagggct

SEQ ID NO: 5726897 - DNA, 20 bp, Homo sapiens
cttgccagggctctgggggc

SEQ ID NO: 5726898 - DNA, 16 bp, Homo sapiens
cttgccagtcactccg

SEQ ID NO: 5726899 - DNA, 12 bp, Homo sapiens
cttgccagtctt

SEQ ID NO: 5726900 - DNA, 11 bp, Homo sapiens
cttgccatcac

SEQ ID NO: 5726901 - DNA, 15 bp, Homo sapiens
cttgccatcagtgaa

SEQ ID NO: 5726902 - DNA, 17 bp, Homo sapiens
cttgccatcagtgaaaa

SEQ ID NO: 5726903 - DNA, 18 bp, Homo sapiens
cttgccatccattctgga

SEQ ID NO: 5726904 - DNA, 15 bp, Homo sapiens
cttgccatccctccc

SEQ ID NO: 5726905 - DNA, 13 bp, Homo sapiens
cttgccatcctga

SEQ ID NO: 5726906 - DNA, 19 bp, Homo sapiens
cttgccatgaaggcacctg

SEQ ID NO: 5726907 - DNA, 23 bp, Homo sapiens
cttgccatgcaggaagaggccca

SEQ ID NO: 5726908 - DNA, 17 bp, Homo sapiens
cttgccattccaaaata

SEQ ID NO: 5726909 - DNA, 17 bp, Homo sapiens
cttgccattgccaggag

SEQ ID NO: 5726910 - DNA, 18 bp, Homo sapiens
cttgccattgccaggaga

SEQ ID NO: 5726911 - DNA, 18 bp, Homo sapiens
cttgccatttctttatat

SEQ ID NO: 5726912 - DNA, 22 bp, Homo sapiens
cttgccatttctttatatggaa

SEQ ID NO: 5726913 - DNA, 16 bp, Homo sapiens
cttgccatttgtagct

SEQ ID NO: 5726914 - DNA, 18 bp, Homo sapiens
cttgcccaactcccagcc

SEQ ID NO: 5726915 - DNA, 20 bp, Homo sapiens
cttgcccaactcccagccac

SEQ ID NO: 5726916 - DNA, 21 bp, Homo sapiens
cttgcccaagtcacacagcta

SEQ ID NO: 5726917 - DNA, 15 bp, Homo sapiens
cttgcccacaggtgc

SEQ ID NO: 5726918 - DNA, 14 bp, Homo sapiens
cttgcccaccccac

SEQ ID NO: 5726919 - DNA, 16 bp, Homo sapiens
cttgcccactgcctgc

SEQ ID NO: 5726920 - DNA, 20 bp, Homo sapiens
cttgcccacttctccttcgc

SEQ ID NO: 5726921 - DNA, 13 bp, Homo sapiens
cttgcccagagat

SEQ ID NO: 5726922 - DNA, 19 bp, Homo sapiens
cttgcccagagatgcctcc

SEQ ID NO: 5726923 - DNA, 22 bp, Homo sapiens
cttgcccagagatgcctccacc

SEQ ID NO: 5726924 - DNA, 14 bp, Homo sapiens
cttgcccagcagct

SEQ ID NO: 5726925 - DNA, 11 bp, Homo sapiens
cttgcccagct

SEQ ID NO: 5726926 - DNA, 15 bp, Homo sapiens
cttgcccagggctca

SEQ ID NO: 5726927 - DNA, 21 bp, Homo sapiens
cttgcccagggtgcagtgtga

SEQ ID NO: 5726928 - DNA, 22 bp, Homo sapiens
cttgcccaggtgagggaaggag

SEQ ID NO: 5726929 - DNA, 14 bp, Homo sapiens
cttgcccagtttca

SEQ ID NO: 5726930 - DNA, 12 bp, Homo sapiens
cttgcccatcct

SEQ ID NO: 5726931 - DNA, 14 bp, Homo sapiens
cttgcccatcctga

SEQ ID NO: 5726932 - DNA, 22 bp, Homo sapiens
cttgcccatcgggaccagaaac

SEQ ID NO: 5726933 - DNA, 17 bp, Homo sapiens
cttgcccatgctgggct

SEQ ID NO: 5726934 - DNA, 13 bp, Homo sapiens
cttgccccaaccc

SEQ ID NO: 5726935 - DNA, 17 bp, Homo sapiens
cttgccccaacccttct

SEQ ID NO: 5726936 - DNA, 18 bp, Homo sapiens
cttgccccaacccttctt

SEQ ID NO: 5726937 - DNA, 13 bp, Homo sapiens
cttgccccacagt

SEQ ID NO: 5726938 - DNA, 13 bp, Homo sapiens
cttgccccactcc

SEQ ID NO: 5726939 - DNA, 14 bp, Homo sapiens
cttgccccactcct

SEQ ID NO: 5726940 - DNA, 22 bp, Homo sapiens
cttgccccactcctctccacca

SEQ ID NO: 5726941 - DNA, 22 bp, Homo sapiens
cttgccccagatgcctcctctg

SEQ ID NO: 5726942 - DNA, 21 bp, Homo sapiens
cttgccccaggactctggcac

SEQ ID NO: 5726943 - DNA, 13 bp, Homo sapiens
cttgccccaggcc

SEQ ID NO: 5726944 - DNA, 15 bp, Homo sapiens
cttgccccaggccag

SEQ ID NO: 5726945 - DNA, 15 bp, Homo sapiens
cttgccccagtcctg

SEQ ID NO: 5726946 - DNA, 16 bp, Homo sapiens
cttgccccatcactgc

SEQ ID NO: 5726947 - DNA, 16 bp, Homo sapiens
cttgcccccagtgcct

SEQ ID NO: 5726948 - DNA, 15 bp, Homo sapiens
cttgcccccatccct

SEQ ID NO: 5726949 - DNA, 18 bp, Homo sapiens
cttgcccccatccctcgg

SEQ ID NO: 5726950 - DNA, 22 bp, Homo sapiens
cttgcccccatccctcggaccc

SEQ ID NO: 5726951 - DNA, 23 bp, Homo sapiens
cttgcccccatttcacccatggg

SEQ ID NO: 5726952 - DNA, 13 bp, Homo sapiens
cttgccccccacc

SEQ ID NO: 5726953 - DNA, 21 bp, Homo sapiens
cttgcccccctggcctccccc

SEQ ID NO: 5726954 - DNA, 22 bp, Homo sapiens
cttgcccccctggcctccccca

SEQ ID NO: 5726955 - DNA, 23 bp, Homo sapiens
cttgccccctcatctcactgccc

SEQ ID NO: 5726956 - DNA, 20 bp, Homo sapiens
cttgcccctgctctgtagcc

SEQ ID NO: 5726957 - DNA, 22 bp, Homo sapiens
cttgcccctgctctgtagccac

SEQ ID NO: 5726958 - DNA, 17 bp, Homo sapiens
cttgcccctgtggccct

SEQ ID NO: 5726959 - DNA, 19 bp, Homo sapiens
cttgccccttgtcctgaag

SEQ ID NO: 5726960 - DNA, 22 bp, Homo sapiens
cttgccccttgtcctgaagccc

SEQ ID NO: 5726961 - DNA, 20 bp, Homo sapiens
cttgcccgccagccagtggc

SEQ ID NO: 5726962 - DNA, 18 bp, Homo sapiens
cttgcccgccagcctcag

SEQ ID NO: 5726963 - DNA, 19 bp, Homo sapiens
cttgcccgccagcctcagt

SEQ ID NO: 5726964 - DNA, 18 bp, Homo sapiens
cttgcccgcgctctttct

SEQ ID NO: 5726965 - DNA, 17 bp, Homo sapiens
cttgcccgctcaggctg

SEQ ID NO: 5726966 - DNA, 14 bp, Homo sapiens
cttgcccgctccca

SEQ ID NO: 5726967 - DNA, 17 bp, Homo sapiens
cttgcccgctcccacag

SEQ ID NO: 5726968 - DNA, 18 bp, Homo sapiens
cttgcccgtcggccctgc

SEQ ID NO: 5726969 - DNA, 18 bp, Homo sapiens
cttgccctaagcagaaag

SEQ ID NO: 5726970 - DNA, 23 bp, Homo sapiens
cttgccctcccaaagtgctggga

SEQ ID NO: 5726971 - DNA, 18 bp, Homo sapiens
cttgccctccgcctggga

SEQ ID NO: 5726972 - DNA, 13 bp, Homo sapiens
cttgccctcctgg

SEQ ID NO: 5726973 - DNA, 17 bp, Homo sapiens
cttgccctcctgggccc

SEQ ID NO: 5726974 - DNA, 13 bp, Homo sapiens
cttgccctctctt

SEQ ID NO: 5726975 - DNA, 17 bp, Homo sapiens
cttgccctgacctccca

SEQ ID NO: 5726976 - DNA, 20 bp, Homo sapiens
cttgccctgagcactcctgg

SEQ ID NO: 5726977 - DNA, 13 bp, Homo sapiens
cttgccctgagct

SEQ ID NO: 5726978 - DNA, 12 bp, Homo sapiens
cttgccctgctc

SEQ ID NO: 5726979 - DNA, 13 bp, Homo sapiens
cttgccctgctcc

SEQ ID NO: 5726980 - DNA, 16 bp, Homo sapiens
cttgccctgctccctc

SEQ ID NO: 5726981 - DNA, 18 bp, Homo sapiens
cttgccctggtgcctcac

SEQ ID NO: 5726982 - DNA, 22 bp, Homo sapiens
cttgccctgttaaaagatgaaa

SEQ ID NO: 5726983 - DNA, 16 bp, Homo sapiens
cttgcccttccctgtc

SEQ ID NO: 5726984 - DNA, 15 bp, Homo sapiens
cttgcccttcctgac

SEQ ID NO: 5726985 - DNA, 16 bp, Homo sapiens
cttgcccttcctgacc

SEQ ID NO: 5726986 - DNA, 20 bp, Homo sapiens
cttgcccttctatactttct

SEQ ID NO: 5726987 - DNA, 13 bp, Homo sapiens
cttgcccttggag

SEQ ID NO: 5726988 - DNA, 15 bp, Homo sapiens
cttgcccttggagct

SEQ ID NO: 5726989 - DNA, 14 bp, Homo sapiens
cttgccctttccat

SEQ ID NO: 5726990 - DNA, 16 bp, Homo sapiens
cttgccctttccatat

SEQ ID NO: 5726991 - DNA, 22 bp, Homo sapiens
cttgccctttccccccatgttg

SEQ ID NO: 5726992 - DNA, 23 bp, Homo sapiens
cttgccgagcctaatgaaaggga

SEQ ID NO: 5726993 - DNA, 13 bp, Homo sapiens
cttgccgaggagc

SEQ ID NO: 5726994 - DNA, 19 bp, Homo sapiens
cttgccgcacatgaaacat

SEQ ID NO: 5726995 - DNA, 15 bp, Homo sapiens
cttgccgctgggaga

SEQ ID NO: 5726996 - DNA, 18 bp, Homo sapiens
cttgccgctgggagagcc

SEQ ID NO: 5726997 - DNA, 19 bp, Homo sapiens
cttgccgctgggagagcca

SEQ ID NO: 5726998 - DNA, 13 bp, Homo sapiens
cttgccggggcct

SEQ ID NO: 5726999 - DNA, 17 bp, Homo sapiens
cttgccggggcctggac

SEQ ID NO: 5727000 - DNA, 23 bp, Homo sapiens
cttgccgtctacctgaggggcct

SEQ ID NO: 5727001 - DNA, 21 bp, Homo sapiens
cttgcctaaatttaatgctgc

SEQ ID NO: 5727002 - DNA, 22 bp, Homo sapiens
cttgcctaaatttaatgctgcc

SEQ ID NO: 5727003 - DNA, 18 bp, Homo sapiens
cttgcctagggcctggtc

SEQ ID NO: 5727004 - DNA, 19 bp, Homo sapiens
cttgcctagggcctggtcc

SEQ ID NO: 5727005 - DNA, 21 bp, Homo sapiens
cttgcctatgatactgtctct

SEQ ID NO: 5727006 - DNA, 22 bp, Homo sapiens
cttgcctcagggccaagccggc

SEQ ID NO: 5727007 - DNA, 16 bp, Homo sapiens
cttgcctccaggacct

SEQ ID NO: 5727008 - DNA, 14 bp, Homo sapiens
cttgcctccaggtg

SEQ ID NO: 5727009 - DNA, 18 bp, Homo sapiens
cttgcctccaggtgcaga

SEQ ID NO: 5727010 - DNA, 19 bp, Homo sapiens
cttgcctccaggtgcagag

SEQ ID NO: 5727011 - DNA, 15 bp, Homo sapiens
cttgcctccatcttt

SEQ ID NO: 5727012 - DNA, 22 bp, Homo sapiens
cttgcctccatctttttcttgg

SEQ ID NO: 5727013 - DNA, 19 bp, Homo sapiens
cttgcctccatggtgcctc

SEQ ID NO: 5727014 - DNA, 12 bp, Homo sapiens
cttgcctcccca

SEQ ID NO: 5727015 - DNA, 15 bp, Homo sapiens
cttgcctccgtgtca

SEQ ID NO: 5727016 - DNA, 19 bp, Homo sapiens
cttgcctccttttttctta

SEQ ID NO: 5727017 - DNA, 22 bp, Homo sapiens
cttgcctcggctcctgctgcac

SEQ ID NO: 5727018 - DNA, 14 bp, Homo sapiens
cttgcctctctgtt

SEQ ID NO: 5727019 - DNA, 17 bp, Homo sapiens
cttgcctctgtcccctt

SEQ ID NO: 5727020 - DNA, 15 bp, Homo sapiens
cttgcctctgtgctg

SEQ ID NO: 5727021 - DNA, 20 bp, Homo sapiens
cttgcctcttttacctgctg

SEQ ID NO: 5727022 - DNA, 17 bp, Homo sapiens
cttgcctgaacatcctt

SEQ ID NO: 5727023 - DNA, 20 bp, Homo sapiens
cttgcctgaacatccttcct

SEQ ID NO: 5727024 - DNA, 16 bp, Homo sapiens
cttgcctgaactccag

SEQ ID NO: 5727025 - DNA, 14 bp, Homo sapiens
cttgcctgcagggc

SEQ ID NO: 5727026 - DNA, 13 bp, Homo sapiens
cttgcctgccact

SEQ ID NO: 5727027 - DNA, 14 bp, Homo sapiens
cttgcctgccactg

SEQ ID NO: 5727028 - DNA, 16 bp, Homo sapiens
cttgcctgccactgtg

SEQ ID NO: 5727029 - DNA, 11 bp, Homo sapiens
cttgcctgcct

SEQ ID NO: 5727030 - DNA, 18 bp, Homo sapiens
cttgcctgcctcctaggc

SEQ ID NO: 5727031 - DNA, 13 bp, Homo sapiens
cttgcctgccttt

SEQ ID NO: 5727032 - DNA, 15 bp, Homo sapiens
cttgcctgctgggct

SEQ ID NO: 5727033 - DNA, 24 bp, Homo sapiens
cttgcctggaactcactcactctg

SEQ ID NO: 5727034 - DNA, 20 bp, Homo sapiens
cttgcctgggacggctgagc

SEQ ID NO: 5727035 - DNA, 13 bp, Homo sapiens
cttgcctggggtc

SEQ ID NO: 5727036 - DNA, 16 bp, Homo sapiens
cttgcctgggtcacac

SEQ ID NO: 5727037 - DNA, 19 bp, Homo sapiens
cttgcctgtctaaagcctt

SEQ ID NO: 5727038 - DNA, 17 bp, Homo sapiens
cttgcctgtctggctca

SEQ ID NO: 5727039 - DNA, 20 bp, Homo sapiens
cttgcctgtttcccaggccc

SEQ ID NO: 5727040 - DNA, 19 bp, Homo sapiens
cttgcctgtttcttctcta

SEQ ID NO: 5727041 - DNA, 19 bp, Homo sapiens
cttgccttatctgttcctt

SEQ ID NO: 5727042 - DNA, 20 bp, Homo sapiens
cttgccttattagagtgtct

SEQ ID NO: 5727043 - DNA, 21 bp, Homo sapiens
cttgccttattagagtgtctt

SEQ ID NO: 5727044 - DNA, 21 bp, Homo sapiens
cttgccttcctaagcctgtgg

SEQ ID NO: 5727045 - DNA, 15 bp, Homo sapiens
cttgccttcctgcct

SEQ ID NO: 5727046 - DNA, 20 bp, Homo sapiens
cttgccttcttcacccagct

SEQ ID NO: 5727047 - DNA, 16 bp, Homo sapiens
cttgcctttccacctg

SEQ ID NO: 5727048 - DNA, 17 bp, Homo sapiens
cttgcctttccacctgc

SEQ ID NO: 5727049 - DNA, 17 bp, Homo sapiens
cttgcctttcttatttg

SEQ ID NO: 5727050 - DNA, 13 bp, Homo sapiens
cttgccttttgtt

SEQ ID NO: 5727051 - DNA, 20 bp, Homo sapiens
cttgccttttgttaatgcat

SEQ ID NO: 5727052 - DNA, 22 bp, Homo sapiens
cttgccttttgttaatgcattg

SEQ ID NO: 5727053 - DNA, 23 bp, Homo sapiens
cttgccttttgttaatgcattgt

SEQ ID NO: 5727054 - DNA, 20 bp, Homo sapiens
cttgcctttttcattatttt

SEQ ID NO: 5727055 - DNA, 22 bp, Homo sapiens
cttgcctttttcattattttat

SEQ ID NO: 5727056 - DNA, 17 bp, Homo sapiens
cttgcgagtccaaggcc

SEQ ID NO: 5727057 - DNA, 14 bp, Homo sapiens
cttgcgcattctca

SEQ ID NO: 5727058 - DNA, 19 bp, Homo sapiens
cttgcgcctcagccctcag

SEQ ID NO: 5727059 - DNA, 14 bp, Homo sapiens
cttgcgctgtccca

SEQ ID NO: 5727060 - DNA, 17 bp, Homo sapiens
cttgcgctgtcccaggc

SEQ ID NO: 5727061 - DNA, 20 bp, Homo sapiens
cttgcgctgtcccaggcatg

SEQ ID NO: 5727062 - DNA, 18 bp, Homo sapiens
cttgcggaactcttcctg

SEQ ID NO: 5727063 - DNA, 18 bp, Homo sapiens
cttgcggaagccataggg

SEQ ID NO: 5727064 - DNA, 17 bp, Homo sapiens
cttgcggcaccgcccac

SEQ ID NO: 5727065 - DNA, 13 bp, Homo sapiens
cttgcggccacag

SEQ ID NO: 5727066 - DNA, 20 bp, Homo sapiens
cttgcggttccggcatggac

SEQ ID NO: 5727067 - DNA, 19 bp, Homo sapiens
cttgcgtcctgcagaggac

SEQ ID NO: 5727068 - DNA, 16 bp, Homo sapiens
cttgcgtggacagtca

SEQ ID NO: 5727069 - DNA, 23 bp, Homo sapiens
cttgctaaagcactttgcactta

SEQ ID NO: 5727070 - DNA, 20 bp, Homo sapiens
cttgctaaagctaggggccc

SEQ ID NO: 5727071 - DNA, 23 bp, Homo sapiens
cttgctaactttgcccttcactg

SEQ ID NO: 5727072 - DNA, 16 bp, Homo sapiens
cttgctaatcagtgtc

SEQ ID NO: 5727073 - DNA, 21 bp, Homo sapiens
cttgctaatcagtgtctcaca

SEQ ID NO: 5727074 - DNA, 22 bp, Homo sapiens
cttgctaatcagtgtctcacac

SEQ ID NO: 5727075 - DNA, 22 bp, Homo sapiens
cttgctaccaatctgtgagaag

SEQ ID NO: 5727076 - DNA, 22 bp, Homo sapiens
cttgctaccacggcctcctttc

SEQ ID NO: 5727077 - DNA, 16 bp, Homo sapiens
cttgctacctcaaggg

SEQ ID NO: 5727078 - DNA, 14 bp, Homo sapiens
cttgctagctagcc

SEQ ID NO: 5727079 - DNA, 18 bp, Homo sapiens
cttgctagctagccagcc

SEQ ID NO: 5727080 - DNA, 20 bp, Homo sapiens
cttgctagctatgtgacctt

SEQ ID NO: 5727081 - DNA, 20 bp, Homo sapiens
cttgctagtattcgctgtgt

SEQ ID NO: 5727082 - DNA, 21 bp, Homo sapiens
cttgctagtattcgctgtgtt

SEQ ID NO: 5727083 - DNA, 17 bp, Homo sapiens
cttgctataaatagatt

SEQ ID NO: 5727084 - DNA, 19 bp, Homo sapiens
cttgctatataaataaagc

SEQ ID NO: 5727085 - DNA, 17 bp, Homo sapiens
cttgctatattgcccag

SEQ ID NO: 5727086 - DNA, 14 bp, Homo sapiens
cttgctatcaagaa

SEQ ID NO: 5727087 - DNA, 13 bp, Homo sapiens
cttgctatgatga

SEQ ID NO: 5727088 - DNA, 15 bp, Homo sapiens
cttgctattctgtcc

SEQ ID NO: 5727089 - DNA, 20 bp, Homo sapiens
cttgctattctgtccctagg

SEQ ID NO: 5727090 - DNA, 15 bp, Homo sapiens
cttgctatttcaata

SEQ ID NO: 5727091 - DNA, 18 bp, Homo sapiens
cttgctcaataaaggtca

SEQ ID NO: 5727092 - DNA, 22 bp, Homo sapiens
cttgctcactcactcactccaa

SEQ ID NO: 5727093 - DNA, 16 bp, Homo sapiens
cttgctcactccctaa

SEQ ID NO: 5727094 - DNA, 22 bp, Homo sapiens
cttgctcagacgagacacccta

SEQ ID NO: 5727095 - DNA, 17 bp, Homo sapiens
cttgctcagatagatct

SEQ ID NO: 5727096 - DNA, 18 bp, Homo sapiens
cttgctcagtgcctcctg

SEQ ID NO: 5727097 - DNA, 17 bp, Homo sapiens
cttgctcatgagctcct

SEQ ID NO: 5727098 - DNA, 16 bp, Homo sapiens
cttgctcattaatttt

SEQ ID NO: 5727099 - DNA, 13 bp, Homo sapiens
cttgctccagcct

SEQ ID NO: 5727100 - DNA, 15 bp, Homo sapiens
cttgctccagcctga

SEQ ID NO: 5727101 - DNA, 17 bp, Homo sapiens
cttgctccagcctgaca

SEQ ID NO: 5727102 - DNA, 19 bp, Homo sapiens
cttgctccagcctgacaac

SEQ ID NO: 5727103 - DNA, 12 bp, Homo sapiens
cttgctccaggg

SEQ ID NO: 5727104 - DNA, 14 bp, Homo sapiens
cttgctccagggtc

SEQ ID NO: 5727105 - DNA, 17 bp, Homo sapiens
cttgctccagggtcttg

SEQ ID NO: 5727106 - DNA, 20 bp, Homo sapiens
cttgctccagggtcttgggc

SEQ ID NO: 5727107 - DNA, 22 bp, Homo sapiens
cttgctccagggtcttgggcta

SEQ ID NO: 5727108 - DNA, 18 bp, Homo sapiens
cttgctcccgccccaggg

SEQ ID NO: 5727109 - DNA, 23 bp, Homo sapiens
cttgctcccgccccagggtctga

SEQ ID NO: 5727110 - DNA, 13 bp, Homo sapiens
cttgctccctctc

SEQ ID NO: 5727111 - DNA, 14 bp, Homo sapiens
cttgctccctctcc

SEQ ID NO: 5727112 - DNA, 15 bp, Homo sapiens
cttgctcctgccaac

SEQ ID NO: 5727113 - DNA, 18 bp, Homo sapiens
cttgctcctgccaaccac

SEQ ID NO: 5727114 - DNA, 14 bp, Homo sapiens
cttgctcctggaac

SEQ ID NO: 5727115 - DNA, 23 bp, Homo sapiens
cttgctccttttgctctttttgt

SEQ ID NO: 5727116 - DNA, 18 bp, Homo sapiens
cttgctcgcttgctggaa

SEQ ID NO: 5727117 - DNA, 18 bp, Homo sapiens
cttgctctacctggccgg

SEQ ID NO: 5727118 - DNA, 19 bp, Homo sapiens
cttgctctatctcacagca

SEQ ID NO: 5727119 - DNA, 14 bp, Homo sapiens
cttgctctcagctg

SEQ ID NO: 5727120 - DNA, 16 bp, Homo sapiens
cttgctctcagctgcc

SEQ ID NO: 5727121 - DNA, 19 bp, Homo sapiens
cttgctctcccctgccctg

SEQ ID NO: 5727122 - DNA, 20 bp, Homo sapiens
cttgctctcccctgccctgc

SEQ ID NO: 5727123 - DNA, 17 bp, Homo sapiens
cttgctctccctcttct

SEQ ID NO: 5727124 - DNA, 15 bp, Homo sapiens
cttgctctcctcatc

SEQ ID NO: 5727125 - DNA, 20 bp, Homo sapiens
cttgctctctctccctgcct

SEQ ID NO: 5727126 - DNA, 15 bp, Homo sapiens
cttgctctctgttct

SEQ ID NO: 5727127 - DNA, 22 bp, Homo sapiens
cttgctctctgttctcttgctt

SEQ ID NO: 5727128 - DNA, 14 bp, Homo sapiens
cttgctctgcaccc

SEQ ID NO: 5727129 - DNA, 22 bp, Homo sapiens
cttgctctgctctaccatgttt

SEQ ID NO: 5727130 - DNA, 13 bp, Homo sapiens
cttgctctgctga

SEQ ID NO: 5727131 - DNA, 17 bp, Homo sapiens
cttgctctgtcacccag

SEQ ID NO: 5727132 - DNA, 20 bp, Homo sapiens
cttgctctgtcccccaggct

SEQ ID NO: 5727133 - DNA, 13 bp, Homo sapiens
cttgctctgtctc

SEQ ID NO: 5727134 - DNA, 17 bp, Homo sapiens
cttgctctgtctcccag

SEQ ID NO: 5727135 - DNA, 19 bp, Homo sapiens
cttgctctgtttgtggggt

SEQ ID NO: 5727136 - DNA, 20 bp, Homo sapiens
cttgctcttagattgggcca

SEQ ID NO: 5727137 - DNA, 13 bp, Homo sapiens
cttgctcttgggg

SEQ ID NO: 5727138 - DNA, 20 bp, Homo sapiens
cttgctctttctactctgaa

SEQ ID NO: 5727139 - DNA, 13 bp, Homo sapiens
cttgctgaaaaac

SEQ ID NO: 5727140 - DNA, 15 bp, Homo sapiens
cttgctgaaaaacac

SEQ ID NO: 5727141 - DNA, 20 bp, Homo sapiens
cttgctgaaagccaaggcag

SEQ ID NO: 5727142 - DNA, 15 bp, Homo sapiens
cttgctgaacatgga

SEQ ID NO: 5727143 - DNA, 20 bp, Homo sapiens
cttgctgaatcggaatctct

SEQ ID NO: 5727144 - DNA, 17 bp, Homo sapiens
cttgctgacaataaaga

SEQ ID NO: 5727145 - DNA, 19 bp, Homo sapiens
cttgctgaccccaggtcag

SEQ ID NO: 5727146 - DNA, 23 bp, Homo sapiens
cttgctgaccccaggtcagccct

SEQ ID NO: 5727147 - DNA, 19 bp, Homo sapiens
cttgctgacctcccagcct

SEQ ID NO: 5727148 - DNA, 20 bp, Homo sapiens
cttgctgacctcccagcctt

SEQ ID NO: 5727149 - DNA, 19 bp, Homo sapiens
cttgctgacttagcctcct

SEQ ID NO: 5727150 - DNA, 19 bp, Homo sapiens
cttgctgagaggggctgtc

SEQ ID NO: 5727151 - DNA, 12 bp, Homo sapiens
cttgctgagggg

SEQ ID NO: 5727152 - DNA, 22 bp, Homo sapiens
cttgctgatcagagttcctcct

SEQ ID NO: 5727153 - DNA, 15 bp, Homo sapiens
cttgctgatggctgc

SEQ ID NO: 5727154 - DNA, 22 bp, Homo sapiens
cttgctgatggctgctagattt

SEQ ID NO: 5727155 - DNA, 18 bp, Homo sapiens
cttgctgatggcttgaca

SEQ ID NO: 5727156 - DNA, 23 bp, Homo sapiens
cttgctgatggcttgacatgtgc

SEQ ID NO: 5727157 - DNA, 21 bp, Homo sapiens
cttgctgcaaacccatgaagc

SEQ ID NO: 5727158 - DNA, 21 bp, Homo sapiens
cttgctgcacctgaggcccag

SEQ ID NO: 5727159 - DNA, 16 bp, Homo sapiens
cttgctgcactcttgc

SEQ ID NO: 5727160 - DNA, 23 bp, Homo sapiens
cttgctgcactcttgcacatgga

SEQ ID NO: 5727161 - DNA, 12 bp, Homo sapiens
cttgctgcagcc

SEQ ID NO: 5727162 - DNA, 15 bp, Homo sapiens
cttgctgcaggccct

SEQ ID NO: 5727163 - DNA, 21 bp, Homo sapiens
cttgctgcaggccctccctct

SEQ ID NO: 5727164 - DNA, 21 bp, Homo sapiens
cttgctgcagtatgaaaataa

SEQ ID NO: 5727165 - DNA, 12 bp, Homo sapiens
cttgctgccaag

SEQ ID NO: 5727166 - DNA, 13 bp, Homo sapiens
cttgctgccaagt

SEQ ID NO: 5727167 - DNA, 20 bp, Homo sapiens
cttgctgccaagtcctgcct

SEQ ID NO: 5727168 - DNA, 22 bp, Homo sapiens
cttgctgccaagtcctgccttt

SEQ ID NO: 5727169 - DNA, 19 bp, Homo sapiens
cttgctgccatgatgtata

SEQ ID NO: 5727170 - DNA, 20 bp, Homo sapiens
cttgctgccatgatgtatat

SEQ ID NO: 5727171 - DNA, 23 bp, Homo sapiens
cttgctgccctaggctccgtcag

SEQ ID NO: 5727172 - DNA, 20 bp, Homo sapiens
cttgctgccctgtgctcctc

SEQ ID NO: 5727173 - DNA, 15 bp, Homo sapiens
cttgctgccttcacc

SEQ ID NO: 5727174 - DNA, 19 bp, Homo sapiens
cttgctgccttcaccctga

SEQ ID NO: 5727175 - DNA, 12 bp, Homo sapiens
cttgctgctaga

SEQ ID NO: 5727176 - DNA, 15 bp, Homo sapiens
cttgctgctagaact

SEQ ID NO: 5727177 - DNA, 16 bp, Homo sapiens
cttgctgctagaactt

SEQ ID NO: 5727178 - DNA, 19 bp, Homo sapiens
cttgctgctattttactgt

SEQ ID NO: 5727179 - DNA, 13 bp, Homo sapiens
cttgctgctgctg

SEQ ID NO: 5727180 - DNA, 15 bp, Homo sapiens
cttgctgctgctgca

SEQ ID NO: 5727181 - DNA, 16 bp, Homo sapiens
cttgctgctggctccc

SEQ ID NO: 5727182 - DNA, 13 bp, Homo sapiens
cttgctgctgtct

SEQ ID NO: 5727183 - DNA, 15 bp, Homo sapiens
cttgctgctgtgcct

SEQ ID NO: 5727184 - DNA, 19 bp, Homo sapiens
cttgctgctttagtcccga

SEQ ID NO: 5727185 - DNA, 13 bp, Homo sapiens
cttgctgcttttt

SEQ ID NO: 5727186 - DNA, 21 bp, Homo sapiens
cttgctggaaaactgccacaa

SEQ ID NO: 5727187 - DNA, 19 bp, Homo sapiens
cttgctggaagacagagaa

SEQ ID NO: 5727188 - DNA, 20 bp, Homo sapiens
cttgctggaagacagagaaa

SEQ ID NO: 5727189 - DNA, 17 bp, Homo sapiens
cttgctggacggggact

SEQ ID NO: 5727190 - DNA, 23 bp, Homo sapiens
cttgctggagtcatgtgcctctg

SEQ ID NO: 5727191 - DNA, 12 bp, Homo sapiens
cttgctggcccc

SEQ ID NO: 5727192 - DNA, 18 bp, Homo sapiens
cttgctggccccagccct

SEQ ID NO: 5727193 - DNA, 21 bp, Homo sapiens
cttgctggccccagccctgct

SEQ ID NO: 5727194 - DNA, 12 bp, Homo sapiens
cttgctggctct

SEQ ID NO: 5727195 - DNA, 17 bp, Homo sapiens
cttgctggctctgagaa

SEQ ID NO: 5727196 - DNA, 18 bp, Homo sapiens
cttgctggctctgagaat

SEQ ID NO: 5727197 - DNA, 19 bp, Homo sapiens
cttgctggctctgagaatc

SEQ ID NO: 5727198 - DNA, 14 bp, Homo sapiens
cttgctggcttctg

SEQ ID NO: 5727199 - DNA, 15 bp, Homo sapiens
cttgctgggcctggg

SEQ ID NO: 5727200 - DNA, 16 bp, Homo sapiens
cttgctgggctttggg

SEQ ID NO: 5727201 - DNA, 21 bp, Homo sapiens
cttgctggggcttgtcctaga

SEQ ID NO: 5727202 - DNA, 13 bp, Homo sapiens
cttgctggggtcc

SEQ ID NO: 5727203 - DNA, 19 bp, Homo sapiens
cttgctggggtccagggct

SEQ ID NO: 5727204 - DNA, 11 bp, Homo sapiens
cttgctgggta

SEQ ID NO: 5727205 - DNA, 15 bp, Homo sapiens
cttgctggtgcctct

SEQ ID NO: 5727206 - DNA, 18 bp, Homo sapiens
cttgctgtaactcagaca

SEQ ID NO: 5727207 - DNA, 17 bp, Homo sapiens
cttgctgtagagacttc

SEQ ID NO: 5727208 - DNA, 17 bp, Homo sapiens
cttgctgtattataaga

SEQ ID NO: 5727209 - DNA, 23 bp, Homo sapiens
cttgctgtcaatgttttgagtca

SEQ ID NO: 5727210 - DNA, 12 bp, Homo sapiens
cttgctgtcact

SEQ ID NO: 5727211 - DNA, 18 bp, Homo sapiens
cttgctgtccaggcagct

SEQ ID NO: 5727212 - DNA, 20 bp, Homo sapiens
cttgctgtccaggcagctcc

SEQ ID NO: 5727213 - DNA, 17 bp, Homo sapiens
cttgctgtcctaggcca

SEQ ID NO: 5727214 - DNA, 12 bp, Homo sapiens
cttgctgtctct

SEQ ID NO: 5727215 - DNA, 15 bp, Homo sapiens
cttgctgtctctgct

SEQ ID NO: 5727216 - DNA, 17 bp, Homo sapiens
cttgctgtctctgctcg

SEQ ID NO: 5727217 - DNA, 18 bp, Homo sapiens
cttgctgtgaaacagtgt

SEQ ID NO: 5727218 - DNA, 12 bp, Homo sapiens
cttgctgtgctt

SEQ ID NO: 5727219 - DNA, 16 bp, Homo sapiens
cttgctgtggtctctt

SEQ ID NO: 5727220 - DNA, 19 bp, Homo sapiens
cttgctgttgacatattta

SEQ ID NO: 5727221 - DNA, 21 bp, Homo sapiens
cttgctgttgacatatttaat

SEQ ID NO: 5727222 - DNA, 23 bp, Homo sapiens
cttgctgttgacatatttaatgt

SEQ ID NO: 5727223 - DNA, 16 bp, Homo sapiens
cttgctgttggtcatg

SEQ ID NO: 5727224 - DNA, 20 bp, Homo sapiens
cttgctgtttaccgcccacc

SEQ ID NO: 5727225 - DNA, 21 bp, Homo sapiens
cttgctgtttcttgatgctca

SEQ ID NO: 5727226 - DNA, 19 bp, Homo sapiens
cttgctgtttgtcctgaga

SEQ ID NO: 5727227 - DNA, 22 bp, Homo sapiens
cttgcttaccttgactgttgat

SEQ ID NO: 5727228 - DNA, 18 bp, Homo sapiens
cttgcttagagtgcccag

SEQ ID NO: 5727229 - DNA, 21 bp, Homo sapiens
cttgcttagagtgcccagcag

SEQ ID NO: 5727230 - DNA, 16 bp, Homo sapiens
cttgcttagcctgtgc

SEQ ID NO: 5727231 - DNA, 22 bp, Homo sapiens
cttgcttagtatggttctcaga

SEQ ID NO: 5727232 - DNA, 14 bp, Homo sapiens
cttgcttatgtgta

SEQ ID NO: 5727233 - DNA, 16 bp, Homo sapiens
cttgcttattacattt

SEQ ID NO: 5727234 - DNA, 18 bp, Homo sapiens
cttgcttattacatttaa

SEQ ID NO: 5727235 - DNA, 19 bp, Homo sapiens
cttgcttattacatttaaa

SEQ ID NO: 5727236 - DNA, 13 bp, Homo sapiens
cttgcttccctaa

SEQ ID NO: 5727237 - DNA, 17 bp, Homo sapiens
cttgcttccctaatcta

SEQ ID NO: 5727238 - DNA, 12 bp, Homo sapiens
cttgcttcctga

SEQ ID NO: 5727239 - DNA, 17 bp, Homo sapiens
cttgcttcctgcatggt

SEQ ID NO: 5727240 - DNA, 15 bp, Homo sapiens
cttgcttccttctca

SEQ ID NO: 5727241 - DNA, 19 bp, Homo sapiens
cttgcttctcccatttcct

SEQ ID NO: 5727242 - DNA, 23 bp, Homo sapiens
cttgcttctcccatttcctgatc

SEQ ID NO: 5727243 - DNA, 14 bp, Homo sapiens
cttgcttctcttct

SEQ ID NO: 5727244 - DNA, 14 bp, Homo sapiens
cttgcttctgcagc

SEQ ID NO: 5727245 - DNA, 20 bp, Homo sapiens
cttgcttctgcagcaactcc

SEQ ID NO: 5727246 - DNA, 19 bp, Homo sapiens
cttgcttctgtatttcctt

SEQ ID NO: 5727247 - DNA, 19 bp, Homo sapiens
cttgcttcttactgataat

SEQ ID NO: 5727248 - DNA, 15 bp, Homo sapiens
cttgcttctttctag

SEQ ID NO: 5727249 - DNA, 19 bp, Homo sapiens
cttgcttctttctagaaag

SEQ ID NO: 5727250 - DNA, 23 bp, Homo sapiens
cttgcttgaggaatgaagacctt

SEQ ID NO: 5727251 - DNA, 20 bp, Homo sapiens
cttgcttgattgtatggtgg

SEQ ID NO: 5727252 - DNA, 16 bp, Homo sapiens
cttgcttggaagccag

SEQ ID NO: 5727253 - DNA, 19 bp, Homo sapiens
cttgcttggaagccaggta

SEQ ID NO: 5727254 - DNA, 18 bp, Homo sapiens
cttgcttggctgcttggc

SEQ ID NO: 5727255 - DNA, 14 bp, Homo sapiens
cttgcttgtaaaaa

SEQ ID NO: 5727256 - DNA, 15 bp, Homo sapiens
cttgcttgtaaaaat

SEQ ID NO: 5727257 - DNA, 16 bp, Homo sapiens
cttgcttgtacctctg

SEQ ID NO: 5727258 - DNA, 12 bp, Homo sapiens
cttgcttgtcat

SEQ ID NO: 5727259 - DNA, 13 bp, Homo sapiens
cttgcttgtcatt

SEQ ID NO: 5727260 - DNA, 13 bp, Homo sapiens
cttgcttgtcttt

SEQ ID NO: 5727261 - DNA, 13 bp, Homo sapiens
cttgcttgtgaat

SEQ ID NO: 5727262 - DNA, 22 bp, Homo sapiens
cttgcttgtgaatcttaacatt

SEQ ID NO: 5727263 - DNA, 14 bp, Homo sapiens
cttgcttgttacat

SEQ ID NO: 5727264 - DNA, 22 bp, Homo sapiens
cttgcttgttgaaaatatttct

SEQ ID NO: 5727265 - DNA, 22 bp, Homo sapiens
cttgcttgttgggattcctgac

SEQ ID NO: 5727266 - DNA, 23 bp, Homo sapiens
cttgctttaaagagtcctccttc

SEQ ID NO: 5727267 - DNA, 20 bp, Homo sapiens
cttgctttaccttttcaggg

SEQ ID NO: 5727268 - DNA, 13 bp, Homo sapiens
cttgctttcaatt

SEQ ID NO: 5727269 - DNA, 13 bp, Homo sapiens
cttgctttcacat

SEQ ID NO: 5727270 - DNA, 12 bp, Homo sapiens
cttgctttcctg

SEQ ID NO: 5727271 - DNA, 15 bp, Homo sapiens
cttgctttcctgcat

SEQ ID NO: 5727272 - DNA, 17 bp, Homo sapiens
cttgctttcctgcatct

SEQ ID NO: 5727273 - DNA, 15 bp, Homo sapiens
cttgctttcctgggc

SEQ ID NO: 5727274 - DNA, 17 bp, Homo sapiens
cttgctttcctgggcct

SEQ ID NO: 5727275 - DNA, 19 bp, Homo sapiens
cttgctttctttgacctct

SEQ ID NO: 5727276 - DNA, 18 bp, Homo sapiens
cttgctttcttttttaaa

SEQ ID NO: 5727277 - DNA, 22 bp, Homo sapiens
cttgctttcttttttaaaatca

SEQ ID NO: 5727278 - DNA, 23 bp, Homo sapiens
cttgctttcttttttaaaatcaa

SEQ ID NO: 5727279 - DNA, 15 bp, Homo sapiens
cttgctttgctgtct

SEQ ID NO: 5727280 - DNA, 18 bp, Homo sapiens
cttgctttgctgtctggt

SEQ ID NO: 5727281 - DNA, 12 bp, Homo sapiens
cttgctttgggc

SEQ ID NO: 5727282 - DNA, 13 bp, Homo sapiens
cttgctttgggct

SEQ ID NO: 5727283 - DNA, 23 bp, Homo sapiens
cttgctttgggctttgcaggctc

SEQ ID NO: 5727284 - DNA, 21 bp, Homo sapiens
cttgctttggggggtgtgctg

SEQ ID NO: 5727285 - DNA, 22 bp, Homo sapiens
cttgctttggggggtgtgctga

SEQ ID NO: 5727286 - DNA, 18 bp, Homo sapiens
cttgctttgtgttctttg

SEQ ID NO: 5727287 - DNA, 17 bp, Homo sapiens
cttgcttttctgtattt

SEQ ID NO: 5727288 - DNA, 15 bp, Homo sapiens
cttgcttttctttgg

SEQ ID NO: 5727289 - DNA, 21 bp, Homo sapiens
cttgcttttctttggacaaca

SEQ ID NO: 5727290 - DNA, 23 bp, Homo sapiens
cttgctttttgcccgttgaccag

SEQ ID NO: 5727291 - DNA, 20 bp, Homo sapiens
cttggaaaaaaattacaaaa

SEQ ID NO: 5727292 - DNA, 18 bp, Homo sapiens
cttggaaaaacagcgtct

SEQ ID NO: 5727293 - DNA, 12 bp, Homo sapiens
cttggaaaataa

SEQ ID NO: 5727294 - DNA, 16 bp, Homo sapiens
cttggaaaataagaca

SEQ ID NO: 5727295 - DNA, 16 bp, Homo sapiens
cttggaaacctgccct

SEQ ID NO: 5727296 - DNA, 21 bp, Homo sapiens
cttggaaacctgccctgcctg

SEQ ID NO: 5727297 - DNA, 16 bp, Homo sapiens
cttggaaagaaatgta

SEQ ID NO: 5727298 - DNA, 19 bp, Homo sapiens
cttggaaagttcagccaga

SEQ ID NO: 5727299 - DNA, 14 bp, Homo sapiens
cttggaaatattaa

SEQ ID NO: 5727300 - DNA, 21 bp, Homo sapiens
cttggaaatcaaatgtaaagt

SEQ ID NO: 5727301 - DNA, 16 bp, Homo sapiens
cttggaaatcattgtg

SEQ ID NO: 5727302 - DNA, 16 bp, Homo sapiens
cttggaaatgggagac

SEQ ID NO: 5727303 - DNA, 17 bp, Homo sapiens
cttggaaatgtctgctg

SEQ ID NO: 5727304 - DNA, 18 bp, Homo sapiens
cttggaaatgttaagaaa

SEQ ID NO: 5727305 - DNA, 14 bp, Homo sapiens
cttggaaattcctt

SEQ ID NO: 5727306 - DNA, 18 bp, Homo sapiens
cttggaaattccttgccc

SEQ ID NO: 5727307 - DNA, 17 bp, Homo sapiens
cttggaacaccctggat

SEQ ID NO: 5727308 - DNA, 16 bp, Homo sapiens
cttggaacaccttggg

SEQ ID NO: 5727309 - DNA, 15 bp, Homo sapiens
cttggaactgaaggg

SEQ ID NO: 5727310 - DNA, 16 bp, Homo sapiens
cttggaactgcaccac

SEQ ID NO: 5727311 - DNA, 13 bp, Homo sapiens
cttggaagagctc

SEQ ID NO: 5727312 - DNA, 21 bp, Homo sapiens
cttggaagattctatttaatt

SEQ ID NO: 5727313 - DNA, 13 bp, Homo sapiens
cttggaagctccg

SEQ ID NO: 5727314 - DNA, 16 bp, Homo sapiens
cttggaagtacatgaa

SEQ ID NO: 5727315 - DNA, 18 bp, Homo sapiens
cttggaagttgcatggca

SEQ ID NO: 5727316 - DNA, 21 bp, Homo sapiens
cttggaagtttcatatattgt

SEQ ID NO: 5727317 - DNA, 21 bp, Homo sapiens
cttggaatatttgctgtgaag

SEQ ID NO: 5727318 - DNA, 18 bp, Homo sapiens
cttggaattagatgttta

SEQ ID NO: 5727319 - DNA, 18 bp, Homo sapiens
cttggaattggaattact

SEQ ID NO: 5727320 - DNA, 20 bp, Homo sapiens
cttggaatttgtaacctcag

SEQ ID NO: 5727321 - DNA, 23 bp, Homo sapiens
cttggaattttgtaaaaagaaat

SEQ ID NO: 5727322 - DNA, 16 bp, Homo sapiens
cttggacaacagctct

SEQ ID NO: 5727323 - DNA, 13 bp, Homo sapiens
cttggacacttgg

SEQ ID NO: 5727324 - DNA, 15 bp, Homo sapiens
cttggacaggagtca

SEQ ID NO: 5727325 - DNA, 17 bp, Homo sapiens
cttggacagtctgagct

SEQ ID NO: 5727326 - DNA, 19 bp, Homo sapiens
cttggacatcctcctccca

SEQ ID NO: 5727327 - DNA, 21 bp, Homo sapiens
cttggacatcctcctcccacc

SEQ ID NO: 5727328 - DNA, 19 bp, Homo sapiens
cttggacatttatgtacaa

SEQ ID NO: 5727329 - DNA, 21 bp, Homo sapiens
cttggaccactcctgtccctg

SEQ ID NO: 5727330 - DNA, 16 bp, Homo sapiens
cttggaccagatctaa

SEQ ID NO: 5727331 - DNA, 14 bp, Homo sapiens
cttggaccagggca

SEQ ID NO: 5727332 - DNA, 16 bp, Homo sapiens
cttggaccatgccaga

SEQ ID NO: 5727333 - DNA, 14 bp, Homo sapiens
cttggacccacctg

SEQ ID NO: 5727334 - DNA, 15 bp, Homo sapiens
cttggacccttggaa

SEQ ID NO: 5727335 - DNA, 21 bp, Homo sapiens
cttggacctatcaaaaactga

SEQ ID NO: 5727336 - DNA, 14 bp, Homo sapiens
cttggacctccagg

SEQ ID NO: 5727337 - DNA, 18 bp, Homo sapiens
cttggacctcgtgcttta

SEQ ID NO: 5727338 - DNA, 13 bp, Homo sapiens
cttggacctctgc

SEQ ID NO: 5727339 - DNA, 19 bp, Homo sapiens
cttggacctctgctctgag

SEQ ID NO: 5727340 - DNA, 14 bp, Homo sapiens
cttggactattata

SEQ ID NO: 5727341 - DNA, 11 bp, Homo sapiens
cttggactcat

SEQ ID NO: 5727342 - DNA, 16 bp, Homo sapiens
cttggactcattttaa

SEQ ID NO: 5727343 - DNA, 18 bp, Homo sapiens
cttggactccctccccac

SEQ ID NO: 5727344 - DNA, 15 bp, Homo sapiens
cttggactcctccca

SEQ ID NO: 5727345 - DNA, 18 bp, Homo sapiens
cttggactcctcccacaa

SEQ ID NO: 5727346 - DNA, 14 bp, Homo sapiens
cttggactcttgct

SEQ ID NO: 5727347 - DNA, 18 bp, Homo sapiens
cttggactcttgctcttt

SEQ ID NO: 5727348 - DNA, 19 bp, Homo sapiens
cttggactgagaaattata

SEQ ID NO: 5727349 - DNA, 23 bp, Homo sapiens
cttggacttcctggggccccgct

SEQ ID NO: 5727350 - DNA, 13 bp, Homo sapiens
cttggacttgagg

SEQ ID NO: 5727351 - DNA, 13 bp, Homo sapiens
cttggagaaatga

SEQ ID NO: 5727352 - DNA, 17 bp, Homo sapiens
cttggagaactccgctg

SEQ ID NO: 5727353 - DNA, 23 bp, Homo sapiens
cttggagaatgtgagaagccagc

SEQ ID NO: 5727354 - DNA, 15 bp, Homo sapiens
cttggagaccctgca

SEQ ID NO: 5727355 - DNA, 15 bp, Homo sapiens
cttggagagacacag

SEQ ID NO: 5727356 - DNA, 16 bp, Homo sapiens
cttggagagacacagc

SEQ ID NO: 5727357 - DNA, 14 bp, Homo sapiens
cttggagagagatt

SEQ ID NO: 5727358 - DNA, 14 bp, Homo sapiens
cttggagagcaaag

SEQ ID NO: 5727359 - DNA, 19 bp, Homo sapiens
cttggagagcaaaggccca

SEQ ID NO: 5727360 - DNA, 20 bp, Homo sapiens
cttggagagcaaaggcccat

SEQ ID NO: 5727361 - DNA, 22 bp, Homo sapiens
cttggagagcaaaggcccatgc

SEQ ID NO: 5727362 - DNA, 14 bp, Homo sapiens
cttggagagcagct

SEQ ID NO: 5727363 - DNA, 16 bp, Homo sapiens
cttggagagcagctgg

SEQ ID NO: 5727364 - DNA, 14 bp, Homo sapiens
cttggagagctcag

SEQ ID NO: 5727365 - DNA, 15 bp, Homo sapiens
cttggagagctcagg

SEQ ID NO: 5727366 - DNA, 12 bp, Homo sapiens
cttggagaggag

SEQ ID NO: 5727367 - DNA, 21 bp, Homo sapiens
cttggagaggaggtgtggagt

SEQ ID NO: 5727368 - DNA, 20 bp, Homo sapiens
cttggagagggacgaagaaa

SEQ ID NO: 5727369 - DNA, 21 bp, Homo sapiens
cttggagagggacgaagaaag

SEQ ID NO: 5727370 - DNA, 17 bp, Homo sapiens
cttggagataatttatg

SEQ ID NO: 5727371 - DNA, 22 bp, Homo sapiens
cttggagatctttgcttccttg

SEQ ID NO: 5727372 - DNA, 14 bp, Homo sapiens
cttggagcaatcag

SEQ ID NO: 5727373 - DNA, 17 bp, Homo sapiens
cttggagcatttatgta

SEQ ID NO: 5727374 - DNA, 16 bp, Homo sapiens
cttggagccccctggc

SEQ ID NO: 5727375 - DNA, 17 bp, Homo sapiens
cttggagccccctggcg

SEQ ID NO: 5727376 - DNA, 21 bp, Homo sapiens
cttggagccggactttcggag

SEQ ID NO: 5727377 - DNA, 18 bp, Homo sapiens
cttggagcctaaagagaa

SEQ ID NO: 5727378 - DNA, 22 bp, Homo sapiens
cttggagcctctttttccttct

SEQ ID NO: 5727379 - DNA, 23 bp, Homo sapiens
cttggagcctctttttccttctt

SEQ ID NO: 5727380 - DNA, 18 bp, Homo sapiens
cttggagcctgaacatga

SEQ ID NO: 5727381 - DNA, 17 bp, Homo sapiens
cttggagcctgcagagc

SEQ ID NO: 5727382 - DNA, 12 bp, Homo sapiens
cttggagccttc

SEQ ID NO: 5727383 - DNA, 15 bp, Homo sapiens
cttggagccttccac

SEQ ID NO: 5727384 - DNA, 19 bp, Homo sapiens
cttggagccttccaccggc

SEQ ID NO: 5727385 - DNA, 17 bp, Homo sapiens
cttggagcgtggactgg

SEQ ID NO: 5727386 - DNA, 13 bp, Homo sapiens
cttggagctgctt

SEQ ID NO: 5727387 - DNA, 14 bp, Homo sapiens
cttggagctgtgag

SEQ ID NO: 5727388 - DNA, 17 bp, Homo sapiens
cttggagctttggaata

SEQ ID NO: 5727389 - DNA, 18 bp, Homo sapiens
cttggaggaaatgtgctc

SEQ ID NO: 5727390 - DNA, 22 bp, Homo sapiens
cttggaggaagtatgagtgctg

SEQ ID NO: 5727391 - DNA, 16 bp, Homo sapiens
cttggaggaatgacaa

SEQ ID NO: 5727392 - DNA, 12 bp, Homo sapiens
cttggaggacag

SEQ ID NO: 5727393 - DNA, 16 bp, Homo sapiens
cttggaggagagagac

SEQ ID NO: 5727394 - DNA, 12 bp, Homo sapiens
cttggaggagga

SEQ ID NO: 5727395 - DNA, 23 bp, Homo sapiens
cttggaggaggatgccacgcact

SEQ ID NO: 5727396 - DNA, 13 bp, Homo sapiens
cttggaggcaacc

SEQ ID NO: 5727397 - DNA, 15 bp, Homo sapiens
cttggaggccagcca

SEQ ID NO: 5727398 - DNA, 12 bp, Homo sapiens
cttggaggcctc

SEQ ID NO: 5727399 - DNA, 15 bp, Homo sapiens
cttggaggctgtctt

SEQ ID NO: 5727400 - DNA, 12 bp, Homo sapiens
cttggagggaga

SEQ ID NO: 5727401 - DNA, 21 bp, Homo sapiens
cttggagggagaggtggcagg

SEQ ID NO: 5727402 - DNA, 15 bp, Homo sapiens
cttggagggataagc

SEQ ID NO: 5727403 - DNA, 23 bp, Homo sapiens
cttggagggatggagaggcggcc

SEQ ID NO: 5727404 - DNA, 20 bp, Homo sapiens
cttggagggcccacttgtat

SEQ ID NO: 5727405 - DNA, 19 bp, Homo sapiens
cttggagggtcccaagctg

SEQ ID NO: 5727406 - DNA, 22 bp, Homo sapiens
cttggagggtcccaagctgggc

SEQ ID NO: 5727407 - DNA, 23 bp, Homo sapiens
cttggagggtcccaagctgggcc

SEQ ID NO: 5727408 - DNA, 15 bp, Homo sapiens
cttggagggtctggg

SEQ ID NO: 5727409 - DNA, 20 bp, Homo sapiens
cttggagggtctgggggcag

SEQ ID NO: 5727410 - DNA, 22 bp, Homo sapiens
cttggagggtctgggggcagct

SEQ ID NO: 5727411 - DNA, 18 bp, Homo sapiens
cttggagggttggtcctc

SEQ ID NO: 5727412 - DNA, 23 bp, Homo sapiens
cttggaggtcacagctggatctg

SEQ ID NO: 5727413 - DNA, 18 bp, Homo sapiens
cttggagtattggggtct

SEQ ID NO: 5727414 - DNA, 15 bp, Homo sapiens
cttggagtcccaggg

SEQ ID NO: 5727415 - DNA, 19 bp, Homo sapiens
cttggagtcccaggggcag

SEQ ID NO: 5727416 - DNA, 19 bp, Homo sapiens
cttggagtgccaagtttgc

SEQ ID NO: 5727417 - DNA, 20 bp, Homo sapiens
cttggagtgccacatggccg

SEQ ID NO: 5727418 - DNA, 23 bp, Homo sapiens
cttggataatgctgttgcctcat

SEQ ID NO: 5727419 - DNA, 14 bp, Homo sapiens
cttggataccagct

SEQ ID NO: 5727420 - DNA, 21 bp, Homo sapiens
cttggataccagctcagggga

SEQ ID NO: 5727421 - DNA, 21 bp, Homo sapiens
cttggatagctaataatgagc

SEQ ID NO: 5727422 - DNA, 22 bp, Homo sapiens
cttggatatataggctattttc

SEQ ID NO: 5727423 - DNA, 18 bp, Homo sapiens
cttggatattcaagcctt

SEQ ID NO: 5727424 - DNA, 19 bp, Homo sapiens
cttggatcaagcagaaaac

SEQ ID NO: 5727425 - DNA, 16 bp, Homo sapiens
cttggatcagaggtca

SEQ ID NO: 5727426 - DNA, 16 bp, Homo sapiens
cttggatcctgggctg

SEQ ID NO: 5727427 - DNA, 22 bp, Homo sapiens
cttggatcgctaagctggctct

SEQ ID NO: 5727428 - DNA, 15 bp, Homo sapiens
cttggatcgtggaag

SEQ ID NO: 5727429 - DNA, 13 bp, Homo sapiens
cttggatctgggg

SEQ ID NO: 5727430 - DNA, 14 bp, Homo sapiens
cttggatctttttg

SEQ ID NO: 5727431 - DNA, 21 bp, Homo sapiens
cttggatgcgagcttggcctt

SEQ ID NO: 5727432 - DNA, 18 bp, Homo sapiens
cttggatggcgttctcct

SEQ ID NO: 5727433 - DNA, 17 bp, Homo sapiens
cttggatgtttttagtt

SEQ ID NO: 5727434 - DNA, 23 bp, Homo sapiens
cttggatgtttttagttctgact

SEQ ID NO: 5727435 - DNA, 16 bp, Homo sapiens
cttggattactttaca

SEQ ID NO: 5727436 - DNA, 18 bp, Homo sapiens
cttggattccctctgcct

SEQ ID NO: 5727437 - DNA, 18 bp, Homo sapiens
cttggattctttccattt

SEQ ID NO: 5727438 - DNA, 23 bp, Homo sapiens
cttggattggacaggagatcagc

SEQ ID NO: 5727439 - DNA, 13 bp, Homo sapiens
cttggattgtccc

SEQ ID NO: 5727440 - DNA, 20 bp, Homo sapiens
cttggattgtccccgaccct

SEQ ID NO: 5727441 - DNA, 13 bp, Homo sapiens
cttggatttgcat

SEQ ID NO: 5727442 - DNA, 16 bp, Homo sapiens
cttggatttgcatttt

SEQ ID NO: 5727443 - DNA, 15 bp, Homo sapiens
cttggcaacagaagc

SEQ ID NO: 5727444 - DNA, 15 bp, Homo sapiens
cttggcaactttctt

SEQ ID NO: 5727445 - DNA, 20 bp, Homo sapiens
cttggcaataaattttgaaa

SEQ ID NO: 5727446 - DNA, 20 bp, Homo sapiens
cttggcaattaaaaatgctg

SEQ ID NO: 5727447 - DNA, 22 bp, Homo sapiens
cttggcaccaaagatgcagccg

SEQ ID NO: 5727448 - DNA, 16 bp, Homo sapiens
cttggcaccaataaag

SEQ ID NO: 5727449 - DNA, 19 bp, Homo sapiens
cttggcaccagacacccag

SEQ ID NO: 5727450 - DNA, 21 bp, Homo sapiens
cttggcaccagacacccagga

SEQ ID NO: 5727451 - DNA, 21 bp, Homo sapiens
cttggcacccccatgctgcct

SEQ ID NO: 5727452 - DNA, 12 bp, Homo sapiens
cttggcacctgc

SEQ ID NO: 5727453 - DNA, 15 bp, Homo sapiens
cttggcacctgccta

SEQ ID NO: 5727454 - DNA, 16 bp, Homo sapiens
cttggcacctgcctag

SEQ ID NO: 5727455 - DNA, 18 bp, Homo sapiens
cttggcacctgcctagct

SEQ ID NO: 5727456 - DNA, 18 bp, Homo sapiens
cttggcacttattgaata

SEQ ID NO: 5727457 - DNA, 16 bp, Homo sapiens
cttggcagccttgtga

SEQ ID NO: 5727458 - DNA, 13 bp, Homo sapiens
cttggcagctttt

SEQ ID NO: 5727459 - DNA, 18 bp, Homo sapiens
cttggcagctttttctgt

SEQ ID NO: 5727460 - DNA, 14 bp, Homo sapiens
cttggcaggaacca

SEQ ID NO: 5727461 - DNA, 22 bp, Homo sapiens
cttggcaggctgaggtgagaag

SEQ ID NO: 5727462 - DNA, 19 bp, Homo sapiens
cttggcagtattccatggg

SEQ ID NO: 5727463 - DNA, 15 bp, Homo sapiens
cttggcagtgggaat

SEQ ID NO: 5727464 - DNA, 21 bp, Homo sapiens
cttggcagtgtcccagggccc

SEQ ID NO: 5727465 - DNA, 19 bp, Homo sapiens
cttggcatcacagggcaga

SEQ ID NO: 5727466 - DNA, 22 bp, Homo sapiens
cttggcatcacagggcagagcc

SEQ ID NO: 5727467 - DNA, 16 bp, Homo sapiens
cttggcatcagctggc

SEQ ID NO: 5727468 - DNA, 17 bp, Homo sapiens
cttggcatcagctggcg

SEQ ID NO: 5727469 - DNA, 16 bp, Homo sapiens
cttggcatctactctg

SEQ ID NO: 5727470 - DNA, 20 bp, Homo sapiens
cttggcatgggcgcaggccc

SEQ ID NO: 5727471 - DNA, 15 bp, Homo sapiens
cttggcattcttctt

SEQ ID NO: 5727472 - DNA, 22 bp, Homo sapiens
cttggccacaacctgaaagaca

SEQ ID NO: 5727473 - DNA, 23 bp, Homo sapiens
cttggccacaacctgaaagacaa

SEQ ID NO: 5727474 - DNA, 19 bp, Homo sapiens
cttggccacggcctgggag

SEQ ID NO: 5727475 - DNA, 14 bp, Homo sapiens
cttggccagagctg

SEQ ID NO: 5727476 - DNA, 14 bp, Homo sapiens
cttggccaggattt

SEQ ID NO: 5727477 - DNA, 23 bp, Homo sapiens
cttggccatgggaggcctttccc

SEQ ID NO: 5727478 - DNA, 20 bp, Homo sapiens
cttggcccagaaagctgcgg

SEQ ID NO: 5727479 - DNA, 21 bp, Homo sapiens
cttggcccagcactgcccatc

SEQ ID NO: 5727480 - DNA, 14 bp, Homo sapiens
cttggcccagcagc

SEQ ID NO: 5727481 - DNA, 22 bp, Homo sapiens
cttggcccagcagcggcccaga

SEQ ID NO: 5727482 - DNA, 17 bp, Homo sapiens
cttggcccaggaaaaac

SEQ ID NO: 5727483 - DNA, 15 bp, Homo sapiens
cttggcccaggagct

SEQ ID NO: 5727484 - DNA, 20 bp, Homo sapiens
cttggcccaggagctctgcg

SEQ ID NO: 5727485 - DNA, 15 bp, Homo sapiens
cttggcccaggagtt

SEQ ID NO: 5727486 - DNA, 16 bp, Homo sapiens
cttggcccaggagttt

SEQ ID NO: 5727487 - DNA, 20 bp, Homo sapiens
cttggcccaggagtttggcc

SEQ ID NO: 5727488 - DNA, 22 bp, Homo sapiens
cttggcccaggagtttggccag

SEQ ID NO: 5727489 - DNA, 23 bp, Homo sapiens
cttggcccaggagtttggccaga

SEQ ID NO: 5727490 - DNA, 21 bp, Homo sapiens
cttggcccagggggcttcctg

SEQ ID NO: 5727491 - DNA, 12 bp, Homo sapiens
cttggccccaga

SEQ ID NO: 5727492 - DNA, 20 bp, Homo sapiens
cttggccccccaaagtgctg

SEQ ID NO: 5727493 - DNA, 18 bp, Homo sapiens
cttggcccccttcaggag

SEQ ID NO: 5727494 - DNA, 20 bp, Homo sapiens
cttggcccccttcaggagcc

SEQ ID NO: 5727495 - DNA, 21 bp, Homo sapiens
cttggcccccttcaggagcct

SEQ ID NO: 5727496 - DNA, 23 bp, Homo sapiens
cttggcccctcacatcctctcca

SEQ ID NO: 5727497 - DNA, 21 bp, Homo sapiens
cttggcccctccctcccggct

SEQ ID NO: 5727498 - DNA, 14 bp, Homo sapiens
cttggcccctctct

SEQ ID NO: 5727499 - DNA, 21 bp, Homo sapiens
cttggcccggccggcctggca

SEQ ID NO: 5727500 - DNA, 16 bp, Homo sapiens
cttggccctcctcagc

SEQ ID NO: 5727501 - DNA, 20 bp, Homo sapiens
cttggccctcctcagctccc

SEQ ID NO: 5727502 - DNA, 22 bp, Homo sapiens
cttggccctcctcagctccctg

SEQ ID NO: 5727503 - DNA, 17 bp, Homo sapiens
cttggccctgcgccctg

SEQ ID NO: 5727504 - DNA, 22 bp, Homo sapiens
cttggccctgcgccctgtgcag

SEQ ID NO: 5727505 - DNA, 23 bp, Homo sapiens
cttggccctgcgccctgtgcagg

SEQ ID NO: 5727506 - DNA, 16 bp, Homo sapiens
cttggccctggcagcc

SEQ ID NO: 5727507 - DNA, 20 bp, Homo sapiens
cttggccctttccttccaga

SEQ ID NO: 5727508 - DNA, 18 bp, Homo sapiens
cttggccgactcagggac

SEQ ID NO: 5727509 - DNA, 18 bp, Homo sapiens
cttggccgcttccctacc

SEQ ID NO: 5727510 - DNA, 19 bp, Homo sapiens
cttggccggctgtgctcag

SEQ ID NO: 5727511 - DNA, 18 bp, Homo sapiens
cttggcctagcccaccct

SEQ ID NO: 5727512 - DNA, 11 bp, Homo sapiens
cttggcctcag

SEQ ID NO: 5727513 - DNA, 17 bp, Homo sapiens
cttggcctcagctggct

SEQ ID NO: 5727514 - DNA, 18 bp, Homo sapiens
cttggcctcagctggctg

SEQ ID NO: 5727515 - DNA, 16 bp, Homo sapiens
cttggcctcccaaagt

SEQ ID NO: 5727516 - DNA, 20 bp, Homo sapiens
cttggcctcccaaagtgctg

SEQ ID NO: 5727517 - DNA, 21 bp, Homo sapiens
cttggcctcccaaagtgctga

SEQ ID NO: 5727518 - DNA, 14 bp, Homo sapiens
cttggcctcccaag

SEQ ID NO: 5727519 - DNA, 17 bp, Homo sapiens
cttggcctcccagagta

SEQ ID NO: 5727520 - DNA, 13 bp, Homo sapiens
cttggcctcctgc

SEQ ID NO: 5727521 - DNA, 14 bp, Homo sapiens
cttggcctcctgct

SEQ ID NO: 5727522 - DNA, 23 bp, Homo sapiens
cttggcctcggcgggcttttctg

SEQ ID NO: 5727523 - DNA, 13 bp, Homo sapiens
cttggcctctcct

SEQ ID NO: 5727524 - DNA, 14 bp, Homo sapiens
cttggcctctctct

SEQ ID NO: 5727525 - DNA, 16 bp, Homo sapiens
cttggcctctctctag

SEQ ID NO: 5727526 - DNA, 18 bp, Homo sapiens
cttggcctctctgtacac

SEQ ID NO: 5727527 - DNA, 12 bp, Homo sapiens
cttggcctctgc

SEQ ID NO: 5727528 - DNA, 14 bp, Homo sapiens
cttggcctctgctt

SEQ ID NO: 5727529 - DNA, 16 bp, Homo sapiens
cttggcctcttcggga

SEQ ID NO: 5727530 - DNA, 13 bp, Homo sapiens
cttggcctgacct

SEQ ID NO: 5727531 - DNA, 12 bp, Homo sapiens
cttggcctgctg

SEQ ID NO: 5727532 - DNA, 16 bp, Homo sapiens
cttggcctgctgtgat

SEQ ID NO: 5727533 - DNA, 14 bp, Homo sapiens
cttggcctggagca

SEQ ID NO: 5727534 - DNA, 15 bp, Homo sapiens
cttggcctggagcac

SEQ ID NO: 5727535 - DNA, 13 bp, Homo sapiens
cttggcctgtcca

SEQ ID NO: 5727536 - DNA, 17 bp, Homo sapiens
cttggcctgtctcatcc

SEQ ID NO: 5727537 - DNA, 22 bp, Homo sapiens
cttggcctgtctcatccccagg

SEQ ID NO: 5727538 - DNA, 16 bp, Homo sapiens
cttggccttgcagctg

SEQ ID NO: 5727539 - DNA, 22 bp, Homo sapiens
cttggccttgcagctggcccac

SEQ ID NO: 5727540 - DNA, 13 bp, Homo sapiens
cttggccttggca

SEQ ID NO: 5727541 - DNA, 16 bp, Homo sapiens
cttggccttgggcttc

SEQ ID NO: 5727542 - DNA, 18 bp, Homo sapiens
cttggcgagggcagcagg

SEQ ID NO: 5727543 - DNA, 15 bp, Homo sapiens
cttggcgatgccagc

SEQ ID NO: 5727544 - DNA, 20 bp, Homo sapiens
cttggcgatgccagccaagc

SEQ ID NO: 5727545 - DNA, 17 bp, Homo sapiens
cttggcggcagcagcca

SEQ ID NO: 5727546 - DNA, 17 bp, Homo sapiens
cttggcggctctagccc

SEQ ID NO: 5727547 - DNA, 15 bp, Homo sapiens
cttggcgtggagcag

SEQ ID NO: 5727548 - DNA, 18 bp, Homo sapiens
cttggcgtggagccaggg

SEQ ID NO: 5727549 - DNA, 22 bp, Homo sapiens
cttggcgtgtgtccctgtggta

SEQ ID NO: 5727550 - DNA, 17 bp, Homo sapiens
cttggctatttctgtgt

SEQ ID NO: 5727551 - DNA, 20 bp, Homo sapiens
cttggctatttctgtgtcca

SEQ ID NO: 5727552 - DNA, 23 bp, Homo sapiens
cttggctcaagtcctcttttctg

SEQ ID NO: 5727553 - DNA, 23 bp, Homo sapiens
cttggctcacactcgacatgaaa

SEQ ID NO: 5727554 - DNA, 12 bp, Homo sapiens
cttggctcagac

SEQ ID NO: 5727555 - DNA, 16 bp, Homo sapiens
cttggctcagacacct

SEQ ID NO: 5727556 - DNA, 14 bp, Homo sapiens
cttggctcagacat

SEQ ID NO: 5727557 - DNA, 16 bp, Homo sapiens
cttggctccatgctcc

SEQ ID NO: 5727558 - DNA, 22 bp, Homo sapiens
cttggctccatgctcctcactg

SEQ ID NO: 5727559 - DNA, 16 bp, Homo sapiens
cttggctcctgagaaa

SEQ ID NO: 5727560 - DNA, 16 bp, Homo sapiens
cttggctcgcaccccc

SEQ ID NO: 5727561 - DNA, 22 bp, Homo sapiens
cttggctcgcacccccactttc

SEQ ID NO: 5727562 - DNA, 22 bp, Homo sapiens
cttggctctcaatgctgtttgg

SEQ ID NO: 5727563 - DNA, 20 bp, Homo sapiens
cttggctctcctctggctag

SEQ ID NO: 5727564 - DNA, 13 bp, Homo sapiens
cttggctctgagg

SEQ ID NO: 5727565 - DNA, 13 bp, Homo sapiens
cttggctctgcca

SEQ ID NO: 5727566 - DNA, 17 bp, Homo sapiens
cttggctcttggcttcc

SEQ ID NO: 5727567 - DNA, 16 bp, Homo sapiens
cttggctgagccccct

SEQ ID NO: 5727568 - DNA, 19 bp, Homo sapiens
cttggctgagccccctctc

SEQ ID NO: 5727569 - DNA, 17 bp, Homo sapiens
cttggctgcagccatcc

SEQ ID NO: 5727570 - DNA, 12 bp, Homo sapiens
cttggctgcagg

SEQ ID NO: 5727571 - DNA, 13 bp, Homo sapiens
cttggctgcagga

SEQ ID NO: 5727572 - DNA, 20 bp, Homo sapiens
cttggctgccgtctggccgg

SEQ ID NO: 5727573 - DNA, 13 bp, Homo sapiens
cttggctgctcag

SEQ ID NO: 5727574 - DNA, 17 bp, Homo sapiens
cttggctgcttggcctt

SEQ ID NO: 5727575 - DNA, 14 bp, Homo sapiens
cttggctggaccca

SEQ ID NO: 5727576 - DNA, 22 bp, Homo sapiens
cttggctggactgtagaaggtg

SEQ ID NO: 5727577 - DNA, 12 bp, Homo sapiens
cttggctgggcc

SEQ ID NO: 5727578 - DNA, 15 bp, Homo sapiens
cttggctgggcctct

SEQ ID NO: 5727579 - DNA, 16 bp, Homo sapiens
cttggctggggaggac

SEQ ID NO: 5727580 - DNA, 19 bp, Homo sapiens
cttggctggggaggaccag

SEQ ID NO: 5727581 - DNA, 13 bp, Homo sapiens
cttggctggtgca

SEQ ID NO: 5727582 - DNA, 15 bp, Homo sapiens
cttggctggttcttt

SEQ ID NO: 5727583 - DNA, 17 bp, Homo sapiens
cttggctgtagaaggag

SEQ ID NO: 5727584 - DNA, 23 bp, Homo sapiens
cttggctgtcccctccatctggg

SEQ ID NO: 5727585 - DNA, 13 bp, Homo sapiens
cttggctgtcctt

SEQ ID NO: 5727586 - DNA, 21 bp, Homo sapiens
cttggctgtccttccccttcc

SEQ ID NO: 5727587 - DNA, 12 bp, Homo sapiens
cttggctgtgag

SEQ ID NO: 5727588 - DNA, 20 bp, Homo sapiens
cttggctgttggcagtgagt

SEQ ID NO: 5727589 - DNA, 14 bp, Homo sapiens
cttggcttacctga

SEQ ID NO: 5727590 - DNA, 16 bp, Homo sapiens
cttggcttacctgacc

SEQ ID NO: 5727591 - DNA, 17 bp, Homo sapiens
cttggcttacctgacct

SEQ ID NO: 5727592 - DNA, 18 bp, Homo sapiens
cttggcttacctgacctc

SEQ ID NO: 5727593 - DNA, 24 bp, Homo sapiens
cttggcttacctgacctcttgctg

SEQ ID NO: 5727594 - DNA, 15 bp, Homo sapiens
cttggcttcagactc

SEQ ID NO: 5727595 - DNA, 19 bp, Homo sapiens
cttggcttccagaaggcag

SEQ ID NO: 5727596 - DNA, 20 bp, Homo sapiens
cttggcttccagaaggcagc

SEQ ID NO: 5727597 - DNA, 12 bp, Homo sapiens
cttggcttcctg

SEQ ID NO: 5727598 - DNA, 14 bp, Homo sapiens
cttggcttcctggc

SEQ ID NO: 5727599 - DNA, 18 bp, Homo sapiens
cttggcttcctttcttgg

SEQ ID NO: 5727600 - DNA, 21 bp, Homo sapiens
cttggcttctgtgatgagctg

SEQ ID NO: 5727601 - DNA, 15 bp, Homo sapiens
cttggcttcttaaaa

SEQ ID NO: 5727602 - DNA, 16 bp, Homo sapiens
cttggcttcttaaaaa

SEQ ID NO: 5727603 - DNA, 19 bp, Homo sapiens
cttggcttcttaaaaactg

SEQ ID NO: 5727604 - DNA, 22 bp, Homo sapiens
cttggcttcttaaaaactgtgt

SEQ ID NO: 5727605 - DNA, 20 bp, Homo sapiens
cttggcttggaagattctat

SEQ ID NO: 5727606 - DNA, 16 bp, Homo sapiens
cttggcttggccctgg

SEQ ID NO: 5727607 - DNA, 23 bp, Homo sapiens
cttggctttcagagccagcctgg

SEQ ID NO: 5727608 - DNA, 15 bp, Homo sapiens
cttggctttgaggcc

SEQ ID NO: 5727609 - DNA, 20 bp, Homo sapiens
cttggcttttactgaagcct

SEQ ID NO: 5727610 - DNA, 18 bp, Homo sapiens
cttggcttttgcttggca

SEQ ID NO: 5727611 - DNA, 21 bp, Homo sapiens
cttggcttttgcttggcagag

SEQ ID NO: 5727612 - DNA, 22 bp, Homo sapiens
cttggctttttactattaacat

SEQ ID NO: 5727613 - DNA, 20 bp, Homo sapiens
cttgggaaaaaaacttggca

SEQ ID NO: 5727614 - DNA, 22 bp, Homo sapiens
cttgggaaaaaaacttggcact

SEQ ID NO: 5727615 - DNA, 23 bp, Homo sapiens
cttgggaaaaaaacttggcactt

SEQ ID NO: 5727616 - DNA, 22 bp, Homo sapiens
cttgggaaaggtggtgtttctg

SEQ ID NO: 5727617 - DNA, 11 bp, Homo sapiens
cttgggaaata

SEQ ID NO: 5727618 - DNA, 19 bp, Homo sapiens
cttgggaaatatgaatgcc

SEQ ID NO: 5727619 - DNA, 18 bp, Homo sapiens
cttgggaaatttttaatg

SEQ ID NO: 5727620 - DNA, 18 bp, Homo sapiens
cttgggaagactcctagc

SEQ ID NO: 5727621 - DNA, 21 bp, Homo sapiens
cttgggaagactcctagctgt

SEQ ID NO: 5727622 - DNA, 21 bp, Homo sapiens
cttgggaagcagtttcagata

SEQ ID NO: 5727623 - DNA, 22 bp, Homo sapiens
cttgggaagcagtttcagataa

SEQ ID NO: 5727624 - DNA, 22 bp, Homo sapiens
cttgggaagctgaggcgggaga

SEQ ID NO: 5727625 - DNA, 13 bp, Homo sapiens
cttgggaaggaca

SEQ ID NO: 5727626 - DNA, 16 bp, Homo sapiens
cttgggaaggacacag

SEQ ID NO: 5727627 - DNA, 20 bp, Homo sapiens
cttgggaagtcgaggctgca

SEQ ID NO: 5727628 - DNA, 15 bp, Homo sapiens
cttgggaataaatta

SEQ ID NO: 5727629 - DNA, 17 bp, Homo sapiens
cttgggaataaattaat

SEQ ID NO: 5727630 - DNA, 20 bp, Homo sapiens
cttgggacaacgtgctgctt

SEQ ID NO: 5727631 - DNA, 15 bp, Homo sapiens
cttgggacatcctgt

SEQ ID NO: 5727632 - DNA, 21 bp, Homo sapiens
cttgggaccaaaactgcctac

SEQ ID NO: 5727633 - DNA, 19 bp, Homo sapiens
cttgggacccccactaaga

SEQ ID NO: 5727634 - DNA, 23 bp, Homo sapiens
cttgggacggaagtggcctgaga

SEQ ID NO: 5727635 - DNA, 20 bp, Homo sapiens
cttgggacgtgtacagcaca

SEQ ID NO: 5727636 - DNA, 19 bp, Homo sapiens
cttgggactaaatgccctg

SEQ ID NO: 5727637 - DNA, 17 bp, Homo sapiens
cttgggactcaggtctg

SEQ ID NO: 5727638 - DNA, 20 bp, Homo sapiens
cttgggactcaggtctgtaa

SEQ ID NO: 5727639 - DNA, 16 bp, Homo sapiens
cttgggactgctgtga

SEQ ID NO: 5727640 - DNA, 16 bp, Homo sapiens
cttgggacttgggaga

SEQ ID NO: 5727641 - DNA, 19 bp, Homo sapiens
cttgggagccactgccact

SEQ ID NO: 5727642 - DNA, 17 bp, Homo sapiens
cttgggagcctgaggca

SEQ ID NO: 5727643 - DNA, 21 bp, Homo sapiens
cttgggagcctgaggcaggag

SEQ ID NO: 5727644 - DNA, 22 bp, Homo sapiens
cttgggagcctgaggcaggaga

SEQ ID NO: 5727645 - DNA, 19 bp, Homo sapiens
cttgggagcctgtggccag

SEQ ID NO: 5727646 - DNA, 19 bp, Homo sapiens
cttgggagctgctgggcta

SEQ ID NO: 5727647 - DNA, 21 bp, Homo sapiens
cttgggaggacatgcgtgtgt

SEQ ID NO: 5727648 - DNA, 16 bp, Homo sapiens
cttgggaggctgaggc

SEQ ID NO: 5727649 - DNA, 23 bp, Homo sapiens
cttgggaggctgaggcaggagaa

SEQ ID NO: 5727650 - DNA, 15 bp, Homo sapiens
cttgggaggcttccc

SEQ ID NO: 5727651 - DNA, 14 bp, Homo sapiens
cttgggagggggca

SEQ ID NO: 5727652 - DNA, 21 bp, Homo sapiens
cttgggagtatgttgtcataa

SEQ ID NO: 5727653 - DNA, 14 bp, Homo sapiens
cttgggagtcagga

SEQ ID NO: 5727654 - DNA, 17 bp, Homo sapiens
cttgggagtcaggacct

SEQ ID NO: 5727655 - DNA, 22 bp, Homo sapiens
cttgggatagcaaactccaggt

SEQ ID NO: 5727656 - DNA, 22 bp, Homo sapiens
cttgggataggactgagtggta

SEQ ID NO: 5727657 - DNA, 19 bp, Homo sapiens
cttgggatagtgttctgct

SEQ ID NO: 5727658 - DNA, 21 bp, Homo sapiens
cttgggatagtgttctgctcc

SEQ ID NO: 5727659 - DNA, 23 bp, Homo sapiens
cttgggatagtgttctgctcctg

SEQ ID NO: 5727660 - DNA, 17 bp, Homo sapiens
cttgggatccaggcccc

SEQ ID NO: 5727661 - DNA, 23 bp, Homo sapiens
cttgggatccgcatccagccgtg

SEQ ID NO: 5727662 - DNA, 16 bp, Homo sapiens
cttgggatgggcacag

SEQ ID NO: 5727663 - DNA, 18 bp, Homo sapiens
cttgggatgggcacaggc

SEQ ID NO: 5727664 - DNA, 20 bp, Homo sapiens
cttgggatgggcacaggctg

SEQ ID NO: 5727665 - DNA, 17 bp, Homo sapiens
cttgggatttgctgtgt

SEQ ID NO: 5727666 - DNA, 15 bp, Homo sapiens
cttgggcaatattct

SEQ ID NO: 5727667 - DNA, 21 bp, Homo sapiens
cttgggcaatattctctgtac

SEQ ID NO: 5727668 - DNA, 21 bp, Homo sapiens
cttgggcaccagcttctttct

SEQ ID NO: 5727669 - DNA, 19 bp, Homo sapiens
cttgggcacccccagcctg

SEQ ID NO: 5727670 - DNA, 21 bp, Homo sapiens
cttgggcacccccagcctggg

SEQ ID NO: 5727671 - DNA, 22 bp, Homo sapiens
cttgggcacccccagcctgggc

SEQ ID NO: 5727672 - DNA, 20 bp, Homo sapiens
cttgggcacgggagagcgcc

SEQ ID NO: 5727673 - DNA, 21 bp, Homo sapiens
cttgggcacgtgtgctgggat

SEQ ID NO: 5727674 - DNA, 22 bp, Homo sapiens
cttgggcagagctggctctgag

SEQ ID NO: 5727675 - DNA, 19 bp, Homo sapiens
cttgggcagagtcctgcct

SEQ ID NO: 5727676 - DNA, 20 bp, Homo sapiens
cttgggcagagtcctgcctt

SEQ ID NO: 5727677 - DNA, 19 bp, Homo sapiens
cttgggcagatctcccaca

SEQ ID NO: 5727678 - DNA, 13 bp, Homo sapiens
cttgggcagggtc

SEQ ID NO: 5727679 - DNA, 22 bp, Homo sapiens
cttgggcagggtctctgctcca

SEQ ID NO: 5727680 - DNA, 20 bp, Homo sapiens
cttgggcagtgccccaggga

SEQ ID NO: 5727681 - DNA, 20 bp, Homo sapiens
cttgggcatccacccagtgc

SEQ ID NO: 5727682 - DNA, 23 bp, Homo sapiens
cttgggcatccacccagtgctgc

SEQ ID NO: 5727683 - DNA, 14 bp, Homo sapiens
cttgggccaagcca

SEQ ID NO: 5727684 - DNA, 13 bp, Homo sapiens
cttgggccacccc

SEQ ID NO: 5727685 - DNA, 14 bp, Homo sapiens
cttgggccactgcc

SEQ ID NO: 5727686 - DNA, 22 bp, Homo sapiens
cttgggcccagctgggctctgc

SEQ ID NO: 5727687 - DNA, 15 bp, Homo sapiens
cttgggcccaggagg

SEQ ID NO: 5727688 - DNA, 20 bp, Homo sapiens
cttgggcccaggaggtcaag

SEQ ID NO: 5727689 - DNA, 24 bp, Homo sapiens
cttgggcccaggaggtcaagcctg

SEQ ID NO: 5727690 - DNA, 23 bp, Homo sapiens
cttgggccccagaccccagggca

SEQ ID NO: 5727691 - DNA, 18 bp, Homo sapiens
cttgggcccggtccacag

SEQ ID NO: 5727692 - DNA, 16 bp, Homo sapiens
cttgggccctgcattg

SEQ ID NO: 5727693 - DNA, 16 bp, Homo sapiens
cttgggccctttgagt

SEQ ID NO: 5727694 - DNA, 21 bp, Homo sapiens
cttgggccctttttcccttcc

SEQ ID NO: 5727695 - DNA, 16 bp, Homo sapiens
cttgggccgctgcacc

SEQ ID NO: 5727696 - DNA, 15 bp, Homo sapiens
cttgggcctcccact

SEQ ID NO: 5727697 - DNA, 18 bp, Homo sapiens
cttgggcctcccactccc

SEQ ID NO: 5727698 - DNA, 14 bp, Homo sapiens
cttgggcctgcacc

SEQ ID NO: 5727699 - DNA, 15 bp, Homo sapiens
cttgggcctgcaccc

SEQ ID NO: 5727700 - DNA, 20 bp, Homo sapiens
cttgggcctgcacccttcca

SEQ ID NO: 5727701 - DNA, 12 bp, Homo sapiens
cttgggcctggc

SEQ ID NO: 5727702 - DNA, 14 bp, Homo sapiens
cttgggcctggcca

SEQ ID NO: 5727703 - DNA, 22 bp, Homo sapiens
cttgggcctggccagtcttcct

SEQ ID NO: 5727704 - DNA, 18 bp, Homo sapiens
cttgggcctgggaatcta

SEQ ID NO: 5727705 - DNA, 22 bp, Homo sapiens
cttgggccttgctgctgctgca

SEQ ID NO: 5727706 - DNA, 21 bp, Homo sapiens
cttgggcgccgtgctgggcag

SEQ ID NO: 5727707 - DNA, 22 bp, Homo sapiens
cttgggcggctgagagccccag

SEQ ID NO: 5727708 - DNA, 17 bp, Homo sapiens
cttgggcgtctccccca

SEQ ID NO: 5727709 - DNA, 20 bp, Homo sapiens
cttgggctactggcagctcc

SEQ ID NO: 5727710 - DNA, 21 bp, Homo sapiens
cttgggctatttggactcagg

SEQ ID NO: 5727711 - DNA, 23 bp, Homo sapiens
cttgggctcagggaccatggctt

SEQ ID NO: 5727712 - DNA, 21 bp, Homo sapiens
cttgggctccgtgtgggagac

SEQ ID NO: 5727713 - DNA, 13 bp, Homo sapiens
cttgggctcctgg

SEQ ID NO: 5727714 - DNA, 18 bp, Homo sapiens
cttgggctcctggctgcc

SEQ ID NO: 5727715 - DNA, 19 bp, Homo sapiens
cttgggctcctggctgcca

SEQ ID NO: 5727716 - DNA, 21 bp, Homo sapiens
cttgggctcctggctgccagg

SEQ ID NO: 5727717 - DNA, 13 bp, Homo sapiens
cttgggctctgat

SEQ ID NO: 5727718 - DNA, 14 bp, Homo sapiens
cttgggctctgctg

SEQ ID NO: 5727719 - DNA, 16 bp, Homo sapiens
cttgggctgacccagc

SEQ ID NO: 5727720 - DNA, 17 bp, Homo sapiens
cttgggctgagactgga

SEQ ID NO: 5727721 - DNA, 16 bp, Homo sapiens
cttgggctgagtgcag

SEQ ID NO: 5727722 - DNA, 14 bp, Homo sapiens
cttgggctgctcct

SEQ ID NO: 5727723 - DNA, 16 bp, Homo sapiens
cttgggctggcgggcc

SEQ ID NO: 5727724 - DNA, 18 bp, Homo sapiens
cttgggctggcgggccct

SEQ ID NO: 5727725 - DNA, 22 bp, Homo sapiens
cttgggctgggacttcttaccc

SEQ ID NO: 5727726 - DNA, 19 bp, Homo sapiens
cttgggctgggggactggg

SEQ ID NO: 5727727 - DNA, 15 bp, Homo sapiens
cttgggctggtcaga

SEQ ID NO: 5727728 - DNA, 20 bp, Homo sapiens
cttgggctggtcagagtggc

SEQ ID NO: 5727729 - DNA, 14 bp, Homo sapiens
cttgggctgtaaag

SEQ ID NO: 5727730 - DNA, 15 bp, Homo sapiens
cttgggctgtaaagc

SEQ ID NO: 5727731 - DNA, 22 bp, Homo sapiens
cttgggcttcaacagccaagct

SEQ ID NO: 5727732 - DNA, 22 bp, Homo sapiens
cttgggcttcatcctcctcaga

SEQ ID NO: 5727733 - DNA, 19 bp, Homo sapiens
cttgggcttccatttgtgt

SEQ ID NO: 5727734 - DNA, 23 bp, Homo sapiens
cttgggcttccatttgtgtgtgt

SEQ ID NO: 5727735 - DNA, 13 bp, Homo sapiens
cttgggcttctgc

SEQ ID NO: 5727736 - DNA, 17 bp, Homo sapiens
cttggggaaacttggga

SEQ ID NO: 5727737 - DNA, 20 bp, Homo sapiens
cttggggaaggatctccccg

SEQ ID NO: 5727738 - DNA, 20 bp, Homo sapiens
cttggggacaggggcaggag

SEQ ID NO: 5727739 - DNA, 16 bp, Homo sapiens
cttggggaccagagct

SEQ ID NO: 5727740 - DNA, 21 bp, Homo sapiens
cttggggaccagagctgccac

SEQ ID NO: 5727741 - DNA, 21 bp, Homo sapiens
cttggggacctgaactgtcct

SEQ ID NO: 5727742 - DNA, 23 bp, Homo sapiens
cttggggagagggatttccctgc

SEQ ID NO: 5727743 - DNA, 23 bp, Homo sapiens
cttggggaggacaaaacttcttg

SEQ ID NO: 5727744 - DNA, 11 bp, Homo sapiens
cttggggaggc

SEQ ID NO: 5727745 - DNA, 18 bp, Homo sapiens
cttggggaggggtcagct

SEQ ID NO: 5727746 - DNA, 21 bp, Homo sapiens
cttggggaggggtcagctctg

SEQ ID NO: 5727747 - DNA, 22 bp, Homo sapiens
cttggggaggggtcagctctgg

SEQ ID NO: 5727748 - DNA, 21 bp, Homo sapiens
cttggggagttaagacctggc

SEQ ID NO: 5727749 - DNA, 23 bp, Homo sapiens
cttggggagttaagacctggcag

SEQ ID NO: 5727750 - DNA, 15 bp, Homo sapiens
cttggggatgccctt

SEQ ID NO: 5727751 - DNA, 21 bp, Homo sapiens
cttggggattcttccatctga

SEQ ID NO: 5727752 - DNA, 14 bp, Homo sapiens
cttggggcaacaga

SEQ ID NO: 5727753 - DNA, 20 bp, Homo sapiens
cttggggcaacattgttcac

SEQ ID NO: 5727754 - DNA, 13 bp, Homo sapiens
cttggggcagggc

SEQ ID NO: 5727755 - DNA, 19 bp, Homo sapiens
cttggggccaccaaagctg

SEQ ID NO: 5727756 - DNA, 16 bp, Homo sapiens
cttggggccactgcct

SEQ ID NO: 5727757 - DNA, 15 bp, Homo sapiens
cttggggcctatgca

SEQ ID NO: 5727758 - DNA, 12 bp, Homo sapiens
cttggggcctgg

SEQ ID NO: 5727759 - DNA, 14 bp, Homo sapiens
cttggggcctggcg

SEQ ID NO: 5727760 - DNA, 14 bp, Homo sapiens
cttggggcctggct

SEQ ID NO: 5727761 - DNA, 18 bp, Homo sapiens
cttggggccttccccctt

SEQ ID NO: 5727762 - DNA, 22 bp, Homo sapiens
cttggggccttcccccttgtgg

SEQ ID NO: 5727763 - DNA, 13 bp, Homo sapiens
cttggggccttga

SEQ ID NO: 5727764 - DNA, 15 bp, Homo sapiens
cttggggctatttgt

SEQ ID NO: 5727765 - DNA, 15 bp, Homo sapiens
cttggggctcgcccc

SEQ ID NO: 5727766 - DNA, 16 bp, Homo sapiens
cttggggctggagagg

SEQ ID NO: 5727767 - DNA, 20 bp, Homo sapiens
cttgggggaggccaccccaa

SEQ ID NO: 5727768 - DNA, 15 bp, Homo sapiens
cttgggggctcagca

SEQ ID NO: 5727769 - DNA, 19 bp, Homo sapiens
cttgggggctcccagggca

SEQ ID NO: 5727770 - DNA, 20 bp, Homo sapiens
cttggggggagggggtgtct

SEQ ID NO: 5727771 - DNA, 16 bp, Homo sapiens
cttggggggctgaggt

SEQ ID NO: 5727772 - DNA, 14 bp, Homo sapiens
cttgggggggtggc

SEQ ID NO: 5727773 - DNA, 18 bp, Homo sapiens
cttgggggggtggccgct

SEQ ID NO: 5727774 - DNA, 20 bp, Homo sapiens
cttggggggtgatgagggca

SEQ ID NO: 5727775 - DNA, 23 bp, Homo sapiens
cttggggggtgggggctgtcctg

SEQ ID NO: 5727776 - DNA, 20 bp, Homo sapiens
cttgggggtcctcctccagg

SEQ ID NO: 5727777 - DNA, 16 bp, Homo sapiens
cttgggggtggggctg

SEQ ID NO: 5727778 - DNA, 21 bp, Homo sapiens
cttgggggtggggctgcatcc

SEQ ID NO: 5727779 - DNA, 23 bp, Homo sapiens
cttgggggttcaggcccggcagg

SEQ ID NO: 5727780 - DNA, 18 bp, Homo sapiens
cttgggggttcagggaac

SEQ ID NO: 5727781 - DNA, 23 bp, Homo sapiens
cttgggggttcagggaactgctt

SEQ ID NO: 5727782 - DNA, 21 bp, Homo sapiens
cttgggggttttcaatgtgaa

SEQ ID NO: 5727783 - DNA, 22 bp, Homo sapiens
cttgggggttttcaatgtgaaa

SEQ ID NO: 5727784 - DNA, 19 bp, Homo sapiens
cttggggtagagaggacag

SEQ ID NO: 5727785 - DNA, 23 bp, Homo sapiens
cttggggtcaggaacagtggctg

SEQ ID NO: 5727786 - DNA, 13 bp, Homo sapiens
cttggggtcccac

SEQ ID NO: 5727787 - DNA, 15 bp, Homo sapiens
cttggggtcccaggg

SEQ ID NO: 5727788 - DNA, 23 bp, Homo sapiens
cttggggtggcgcgcctgccttt

SEQ ID NO: 5727789 - DNA, 12 bp, Homo sapiens
cttggggtgggg

SEQ ID NO: 5727790 - DNA, 15 bp, Homo sapiens
cttggggtgggggcc

SEQ ID NO: 5727791 - DNA, 19 bp, Homo sapiens
cttggggtgggggccaggc

SEQ ID NO: 5727792 - DNA, 19 bp, Homo sapiens
cttggggtggtgctgggtc

SEQ ID NO: 5727793 - DNA, 20 bp, Homo sapiens
cttggggttcataggggcag

SEQ ID NO: 5727794 - DNA, 15 bp, Homo sapiens
cttggggttccccca

SEQ ID NO: 5727795 - DNA, 14 bp, Homo sapiens
cttgggtcagagaa

SEQ ID NO: 5727796 - DNA, 14 bp, Homo sapiens
cttgggtcattgac

SEQ ID NO: 5727797 - DNA, 18 bp, Homo sapiens
cttgggtcattgacctct

SEQ ID NO: 5727798 - DNA, 22 bp, Homo sapiens
cttgggtcattgacctctcagg

SEQ ID NO: 5727799 - DNA, 23 bp, Homo sapiens
cttgggtcattgacctctcaggg

SEQ ID NO: 5727800 - DNA, 14 bp, Homo sapiens
cttgggtccaccat

SEQ ID NO: 5727801 - DNA, 23 bp, Homo sapiens
cttgggtcgccctaccctcactc

SEQ ID NO: 5727802 - DNA, 18 bp, Homo sapiens
cttgggtctctctccatt

SEQ ID NO: 5727803 - DNA, 22 bp, Homo sapiens
cttgggtctctctcggcccctg

SEQ ID NO: 5727804 - DNA, 15 bp, Homo sapiens
cttgggtgaaggtgc

SEQ ID NO: 5727805 - DNA, 14 bp, Homo sapiens
cttgggtgaggaca

SEQ ID NO: 5727806 - DNA, 14 bp, Homo sapiens
cttgggtgagggga

SEQ ID NO: 5727807 - DNA, 15 bp, Homo sapiens
cttgggtgaggggag

SEQ ID NO: 5727808 - DNA, 19 bp, Homo sapiens
cttgggtggagaagccatt

SEQ ID NO: 5727809 - DNA, 20 bp, Homo sapiens
cttgggtggagaagccattg

SEQ ID NO: 5727810 - DNA, 23 bp, Homo sapiens
cttgggtggagaagccattgtct

SEQ ID NO: 5727811 - DNA, 20 bp, Homo sapiens
cttgggtggccccctctcct

SEQ ID NO: 5727812 - DNA, 16 bp, Homo sapiens
cttgggtgggacaggg

SEQ ID NO: 5727813 - DNA, 13 bp, Homo sapiens
cttgggtgggtga

SEQ ID NO: 5727814 - DNA, 14 bp, Homo sapiens
cttgggtgggtgaa

SEQ ID NO: 5727815 - DNA, 13 bp, Homo sapiens
cttgggtggttcc

SEQ ID NO: 5727816 - DNA, 18 bp, Homo sapiens
cttgggtgtattctctgt

SEQ ID NO: 5727817 - DNA, 23 bp, Homo sapiens
cttgggtgtattctctgtaagtg

SEQ ID NO: 5727818 - DNA, 15 bp, Homo sapiens
cttgggtgttccacc

SEQ ID NO: 5727819 - DNA, 16 bp, Homo sapiens
cttgggttagacctac

SEQ ID NO: 5727820 - DNA, 13 bp, Homo sapiens
cttgggttccttt

SEQ ID NO: 5727821 - DNA, 14 bp, Homo sapiens
cttgggttctgata

SEQ ID NO: 5727822 - DNA, 15 bp, Homo sapiens
cttgggttgatctct

SEQ ID NO: 5727823 - DNA, 15 bp, Homo sapiens
cttgggtttcctggt

SEQ ID NO: 5727824 - DNA, 18 bp, Homo sapiens
cttggtaacaaataacct

SEQ ID NO: 5727825 - DNA, 22 bp, Homo sapiens
cttggtaattatatctgttttg

SEQ ID NO: 5727826 - DNA, 19 bp, Homo sapiens
cttggtacttgctgctatt

SEQ ID NO: 5727827 - DNA, 20 bp, Homo sapiens
cttggtacttgctgctattt

SEQ ID NO: 5727828 - DNA, 15 bp, Homo sapiens
cttggtagagtttat

SEQ ID NO: 5727829 - DNA, 17 bp, Homo sapiens
cttggtagagtttattt

SEQ ID NO: 5727830 - DNA, 18 bp, Homo sapiens
cttggtagttcataaagg

SEQ ID NO: 5727831 - DNA, 20 bp, Homo sapiens
cttggtagttctgtgcctcc

SEQ ID NO: 5727832 - DNA, 19 bp, Homo sapiens
cttggtattattctgtttt

SEQ ID NO: 5727833 - DNA, 21 bp, Homo sapiens
cttggtatttggatatctgtt

SEQ ID NO: 5727834 - DNA, 14 bp, Homo sapiens
cttggtcaagaaag

SEQ ID NO: 5727835 - DNA, 17 bp, Homo sapiens
cttggtcaagtttttct

SEQ ID NO: 5727836 - DNA, 13 bp, Homo sapiens
cttggtcagagcc

SEQ ID NO: 5727837 - DNA, 15 bp, Homo sapiens
cttggtcatgcttca

SEQ ID NO: 5727838 - DNA, 20 bp, Homo sapiens
cttggtcattttttttatat

SEQ ID NO: 5727839 - DNA, 18 bp, Homo sapiens
cttggtccaactgcaact

SEQ ID NO: 5727840 - DNA, 19 bp, Homo sapiens
cttggtcccagacagctgg

SEQ ID NO: 5727841 - DNA, 24 bp, Homo sapiens
cttggtcccagacagctggaccca

SEQ ID NO: 5727842 - DNA, 18 bp, Homo sapiens
cttggtccctggaagctt

SEQ ID NO: 5727843 - DNA, 17 bp, Homo sapiens
cttggtccctggtccct

SEQ ID NO: 5727844 - DNA, 22 bp, Homo sapiens
cttggtcctagggtgggaaggg

SEQ ID NO: 5727845 - DNA, 16 bp, Homo sapiens
cttggtcctgcctctt

SEQ ID NO: 5727846 - DNA, 15 bp, Homo sapiens
cttggtcctgctgca

SEQ ID NO: 5727847 - DNA, 17 bp, Homo sapiens
cttggtcctgctgcagt

SEQ ID NO: 5727848 - DNA, 20 bp, Homo sapiens
cttggtcctgctgcagttgc

SEQ ID NO: 5727849 - DNA, 13 bp, Homo sapiens
cttggtcctgtca

SEQ ID NO: 5727850 - DNA, 16 bp, Homo sapiens
cttggtcctgtcaccc

SEQ ID NO: 5727851 - DNA, 15 bp, Homo sapiens
cttggtccttgattt

SEQ ID NO: 5727852 - DNA, 15 bp, Homo sapiens
cttggtctcatgccc

SEQ ID NO: 5727853 - DNA, 19 bp, Homo sapiens
cttggtctctccttcctct

SEQ ID NO: 5727854 - DNA, 20 bp, Homo sapiens
cttggtctctttctttccaa

SEQ ID NO: 5727855 - DNA, 22 bp, Homo sapiens
cttggtctgggtttggcaggca

SEQ ID NO: 5727856 - DNA, 16 bp, Homo sapiens
cttggtcttcccaggc

SEQ ID NO: 5727857 - DNA, 19 bp, Homo sapiens
cttggtcttttttctgggt

SEQ ID NO: 5727858 - DNA, 23 bp, Homo sapiens
cttggtgaaataataaaatgcaa

SEQ ID NO: 5727859 - DNA, 20 bp, Homo sapiens
cttggtgaatttttttttcc

SEQ ID NO: 5727860 - DNA, 16 bp, Homo sapiens
cttggtgactgtccca

SEQ ID NO: 5727861 - DNA, 15 bp, Homo sapiens
cttggtgaggaggag

SEQ ID NO: 5727862 - DNA, 23 bp, Homo sapiens
cttggtgcaaggccatctgctta

SEQ ID NO: 5727863 - DNA, 19 bp, Homo sapiens
cttggtgccctcgcctcct

SEQ ID NO: 5727864 - DNA, 13 bp, Homo sapiens
cttggtgccctga

SEQ ID NO: 5727865 - DNA, 19 bp, Homo sapiens
cttggtgcctaatgttcca

SEQ ID NO: 5727866 - DNA, 19 bp, Homo sapiens
cttggtgccttttgtgtga

SEQ ID NO: 5727867 - DNA, 14 bp, Homo sapiens
cttggtgctaaaga

SEQ ID NO: 5727868 - DNA, 16 bp, Homo sapiens
cttggtgctctgtgtt

SEQ ID NO: 5727869 - DNA, 15 bp, Homo sapiens
cttggtgctcttgct

SEQ ID NO: 5727870 - DNA, 13 bp, Homo sapiens
cttggtgctgctt

SEQ ID NO: 5727871 - DNA, 14 bp, Homo sapiens
cttggtgctgcttt

SEQ ID NO: 5727872 - DNA, 15 bp, Homo sapiens
cttggtgctggttta

SEQ ID NO: 5727873 - DNA, 15 bp, Homo sapiens
cttggtgctgtgtgc

SEQ ID NO: 5727874 - DNA, 16 bp, Homo sapiens
cttggtgctgtgtgcc

SEQ ID NO: 5727875 - DNA, 15 bp, Homo sapiens
cttggtggagcagcc

SEQ ID NO: 5727876 - DNA, 17 bp, Homo sapiens
cttggtggagcagccag

SEQ ID NO: 5727877 - DNA, 18 bp, Homo sapiens
cttggtggagcagccaga

SEQ ID NO: 5727878 - DNA, 21 bp, Homo sapiens
cttggtggagcagccagagct

SEQ ID NO: 5727879 - DNA, 19 bp, Homo sapiens
cttggtggatgggccctgc

SEQ ID NO: 5727880 - DNA, 14 bp, Homo sapiens
cttggtggattaga

SEQ ID NO: 5727881 - DNA, 11 bp, Homo sapiens
cttggtggcaa

SEQ ID NO: 5727882 - DNA, 17 bp, Homo sapiens
cttggtggccaagcctg

SEQ ID NO: 5727883 - DNA, 19 bp, Homo sapiens
cttggtggccaagcctggc

SEQ ID NO: 5727884 - DNA, 20 bp, Homo sapiens
cttggtggccaagcctggcc

SEQ ID NO: 5727885 - DNA, 21 bp, Homo sapiens
cttggtggccaagcctggccc

SEQ ID NO: 5727886 - DNA, 19 bp, Homo sapiens
cttggtgggggagcctctg

SEQ ID NO: 5727887 - DNA, 20 bp, Homo sapiens
cttggtgggggagcctctgg

SEQ ID NO: 5727888 - DNA, 20 bp, Homo sapiens
cttggtgtaaaccattcttg

SEQ ID NO: 5727889 - DNA, 13 bp, Homo sapiens
cttggtgtaactt

SEQ ID NO: 5727890 - DNA, 20 bp, Homo sapiens
cttggtgtaacttaaatatt

SEQ ID NO: 5727891 - DNA, 16 bp, Homo sapiens
cttggtgtccacctgg

SEQ ID NO: 5727892 - DNA, 19 bp, Homo sapiens
cttggtgtcgggcatgaca

SEQ ID NO: 5727893 - DNA, 19 bp, Homo sapiens
cttggtgtgaccctctgaa

SEQ ID NO: 5727894 - DNA, 15 bp, Homo sapiens
cttggtgtgattgca

SEQ ID NO: 5727895 - DNA, 21 bp, Homo sapiens
cttggtgttaaaacacttctg

SEQ ID NO: 5727896 - DNA, 18 bp, Homo sapiens
cttggtgtttcccttcct

SEQ ID NO: 5727897 - DNA, 20 bp, Homo sapiens
cttggtgtttcccttcctcg

SEQ ID NO: 5727898 - DNA, 23 bp, Homo sapiens
cttggtgtttcccttcctcggtg

SEQ ID NO: 5727899 - DNA, 19 bp, Homo sapiens
cttggtgtttgactgtaat

SEQ ID NO: 5727900 - DNA, 13 bp, Homo sapiens
cttggttatattt

SEQ ID NO: 5727901 - DNA, 21 bp, Homo sapiens
cttggttatttgtttaccact

SEQ ID NO: 5727902 - DNA, 23 bp, Homo sapiens
cttggttcaataaagcactgagc

SEQ ID NO: 5727903 - DNA, 14 bp, Homo sapiens
cttggttcataaat

SEQ ID NO: 5727904 - DNA, 17 bp, Homo sapiens
cttggttcataaatgaa

SEQ ID NO: 5727905 - DNA, 22 bp, Homo sapiens
cttggttcataaatgaatttta

SEQ ID NO: 5727906 - DNA, 17 bp, Homo sapiens
cttggttcatcagtgtt

SEQ ID NO: 5727907 - DNA, 20 bp, Homo sapiens
cttggttccagcctgccact

SEQ ID NO: 5727908 - DNA, 13 bp, Homo sapiens
cttggttcccaga

SEQ ID NO: 5727909 - DNA, 16 bp, Homo sapiens
cttggttcccatttgc

SEQ ID NO: 5727910 - DNA, 16 bp, Homo sapiens
cttggttcccccactg

SEQ ID NO: 5727911 - DNA, 15 bp, Homo sapiens
cttggttcctccagc

SEQ ID NO: 5727912 - DNA, 16 bp, Homo sapiens
cttggttcctccagca

SEQ ID NO: 5727913 - DNA, 17 bp, Homo sapiens
cttggttcctggggcat

SEQ ID NO: 5727914 - DNA, 15 bp, Homo sapiens
cttggttcctgtttg

SEQ ID NO: 5727915 - DNA, 16 bp, Homo sapiens
cttggttccttcccaa

SEQ ID NO: 5727916 - DNA, 13 bp, Homo sapiens
cttggttctaaag

SEQ ID NO: 5727917 - DNA, 13 bp, Homo sapiens
cttggttctcaga

SEQ ID NO: 5727918 - DNA, 15 bp, Homo sapiens
cttggttcttttttc

SEQ ID NO: 5727919 - DNA, 20 bp, Homo sapiens
cttggttcttttttcagtta

SEQ ID NO: 5727920 - DNA, 23 bp, Homo sapiens
cttggttcttttttcagttattt

SEQ ID NO: 5727921 - DNA, 17 bp, Homo sapiens
cttggttgatgtttaaa

SEQ ID NO: 5727922 - DNA, 14 bp, Homo sapiens
cttggttggctggc

SEQ ID NO: 5727923 - DNA, 16 bp, Homo sapiens
cttggttggctggcag

SEQ ID NO: 5727924 - DNA, 22 bp, Homo sapiens
cttggttggctggcagctgaga

SEQ ID NO: 5727925 - DNA, 22 bp, Homo sapiens
cttggttgggtcagatttattt

SEQ ID NO: 5727926 - DNA, 14 bp, Homo sapiens
cttggttgtctcca

SEQ ID NO: 5727927 - DNA, 20 bp, Homo sapiens
cttggttgtgaaccaactgc

SEQ ID NO: 5727928 - DNA, 15 bp, Homo sapiens
cttggttgttaattt

SEQ ID NO: 5727929 - DNA, 15 bp, Homo sapiens
cttggttgttccttt

SEQ ID NO: 5727930 - DNA, 20 bp, Homo sapiens
cttggtttatgagaactggt

SEQ ID NO: 5727931 - DNA, 14 bp, Homo sapiens
cttggtttatgtct

SEQ ID NO: 5727932 - DNA, 16 bp, Homo sapiens
cttggtttatgtcttg

SEQ ID NO: 5727933 - DNA, 17 bp, Homo sapiens
cttggtttccaaaggca

SEQ ID NO: 5727934 - DNA, 22 bp, Homo sapiens
cttggtttccatcaaagccctc

SEQ ID NO: 5727935 - DNA, 20 bp, Homo sapiens
cttggtttctctctacagtg

SEQ ID NO: 5727936 - DNA, 23 bp, Homo sapiens
cttggtttctctctacagtgcca

SEQ ID NO: 5727937 - DNA, 13 bp, Homo sapiens
cttggtttgctag

SEQ ID NO: 5727938 - DNA, 14 bp, Homo sapiens
cttggtttgctagt

SEQ ID NO: 5727939 - DNA, 14 bp, Homo sapiens
cttggtttgtaaat

SEQ ID NO: 5727940 - DNA, 15 bp, Homo sapiens
cttggtttgtaaatt

SEQ ID NO: 5727941 - DNA, 15 bp, Homo sapiens
cttggttttctctct

SEQ ID NO: 5727942 - DNA, 19 bp, Homo sapiens
cttggttttctctctggat

SEQ ID NO: 5727943 - DNA, 15 bp, Homo sapiens
cttggttttgtattg

SEQ ID NO: 5727944 - DNA, 14 bp, Homo sapiens
cttgtaaaaaaagc

SEQ ID NO: 5727945 - DNA, 17 bp, Homo sapiens
cttgtaaaaaaagcaaa

SEQ ID NO: 5727946 - DNA, 15 bp, Homo sapiens
cttgtaaaactgtga

SEQ ID NO: 5727947 - DNA, 22 bp, Homo sapiens
cttgtaaaactgtgacattcca

SEQ ID NO: 5727948 - DNA, 11 bp, Homo sapiens
cttgtaaaatg

SEQ ID NO: 5727949 - DNA, 15 bp, Homo sapiens
cttgtaaaatgcttt

SEQ ID NO: 5727950 - DNA, 20 bp, Homo sapiens
cttgtaaaatgcttttcact

SEQ ID NO: 5727951 - DNA, 14 bp, Homo sapiens
cttgtaaacttgaa

SEQ ID NO: 5727952 - DNA, 18 bp, Homo sapiens
cttgtaaacttgaaagca

SEQ ID NO: 5727953 - DNA, 12 bp, Homo sapiens
cttgtaaagact

SEQ ID NO: 5727954 - DNA, 14 bp, Homo sapiens
cttgtaaagactgg

SEQ ID NO: 5727955 - DNA, 15 bp, Homo sapiens
cttgtaaagactggt

SEQ ID NO: 5727956 - DNA, 23 bp, Homo sapiens
cttgtaaagactggttttctgcc

SEQ ID NO: 5727957 - DNA, 15 bp, Homo sapiens
cttgtaaataaagcc

SEQ ID NO: 5727958 - DNA, 17 bp, Homo sapiens
cttgtaaataaagccct

SEQ ID NO: 5727959 - DNA, 14 bp, Homo sapiens
cttgtaaataaagt

SEQ ID NO: 5727960 - DNA, 21 bp, Homo sapiens
cttgtaaataatgcttaacat

SEQ ID NO: 5727961 - DNA, 19 bp, Homo sapiens
cttgtaaataccaggattt

SEQ ID NO: 5727962 - DNA, 16 bp, Homo sapiens
cttgtaaatagctcag

SEQ ID NO: 5727963 - DNA, 13 bp, Homo sapiens
cttgtaaatataa

SEQ ID NO: 5727964 - DNA, 14 bp, Homo sapiens
cttgtaaatataaa

SEQ ID NO: 5727965 - DNA, 16 bp, Homo sapiens
cttgtaaatataaaga

SEQ ID NO: 5727966 - DNA, 19 bp, Homo sapiens
cttgtaaatatcttttttc

SEQ ID NO: 5727967 - DNA, 15 bp, Homo sapiens
cttgtaaatgtttct

SEQ ID NO: 5727968 - DNA, 20 bp, Homo sapiens
cttgtaaattccccttccca

SEQ ID NO: 5727969 - DNA, 17 bp, Homo sapiens
cttgtaacaagaaaaca

SEQ ID NO: 5727970 - DNA, 19 bp, Homo sapiens
cttgtaaccagtgcagaaa

SEQ ID NO: 5727971 - DNA, 22 bp, Homo sapiens
cttgtaaccagtgcagaaatga

SEQ ID NO: 5727972 - DNA, 22 bp, Homo sapiens
cttgtaactaaaataattttgt

SEQ ID NO: 5727973 - DNA, 13 bp, Homo sapiens
cttgtaactaaag

SEQ ID NO: 5727974 - DNA, 17 bp, Homo sapiens
cttgtaactccaccaac

SEQ ID NO: 5727975 - DNA, 21 bp, Homo sapiens
cttgtaactccaccaacccat

SEQ ID NO: 5727976 - DNA, 10 bp, Homo sapiens
cttgtaactt

SEQ ID NO: 5727977 - DNA, 18 bp, Homo sapiens
cttgtaactttcttcaaa

SEQ ID NO: 5727978 - DNA, 14 bp, Homo sapiens
cttgtaagaccctt

SEQ ID NO: 5727979 - DNA, 16 bp, Homo sapiens
cttgtaagattttgaa

SEQ ID NO: 5727980 - DNA, 18 bp, Homo sapiens
cttgtaagattttgaaaa

SEQ ID NO: 5727981 - DNA, 18 bp, Homo sapiens
cttgtaagctatctgtgc

SEQ ID NO: 5727982 - DNA, 15 bp, Homo sapiens
cttgtaaggctttga

SEQ ID NO: 5727983 - DNA, 17 bp, Homo sapiens
cttgtaataaatactgc

SEQ ID NO: 5727984 - DNA, 12 bp, Homo sapiens
cttgtaatatgt

SEQ ID NO: 5727985 - DNA, 16 bp, Homo sapiens
cttgtaatattttgta

SEQ ID NO: 5727986 - DNA, 18 bp, Homo sapiens
cttgtaatattttgtatt

SEQ ID NO: 5727987 - DNA, 13 bp, Homo sapiens
cttgtaatgtaac

SEQ ID NO: 5727988 - DNA, 10 bp, Homo sapiens
cttgtaatta

SEQ ID NO: 5727989 - DNA, 11 bp, Homo sapiens
cttgtaattat

SEQ ID NO: 5727990 - DNA, 21 bp, Homo sapiens
cttgtaattatgaaaagaaat

SEQ ID NO: 5727991 - DNA, 15 bp, Homo sapiens
cttgtaattctaaat

SEQ ID NO: 5727992 - DNA, 12 bp, Homo sapiens
cttgtaatttaa

SEQ ID NO: 5727993 - DNA, 23 bp, Homo sapiens
cttgtaatttaaacatttgttcc

SEQ ID NO: 5727994 - DNA, 18 bp, Homo sapiens
cttgtacaaactttgttt

SEQ ID NO: 5727995 - DNA, 19 bp, Homo sapiens
cttgtacaaactttgtttt

SEQ ID NO: 5727996 - DNA, 14 bp, Homo sapiens
cttgtacagaacca

SEQ ID NO: 5727997 - DNA, 15 bp, Homo sapiens
cttgtacagtctgct

SEQ ID NO: 5727998 - DNA, 22 bp, Homo sapiens
cttgtacagttgactggctttc

SEQ ID NO: 5727999 - DNA, 22 bp, Homo sapiens
cttgtacataatgcgtgcatac

SEQ ID NO: 5728000 - DNA, 19 bp, Homo sapiens
cttgtacatgtgtagcctg

SEQ ID NO: 5728001 - DNA, 19 bp, Homo sapiens
cttgtacatttttaaattc

SEQ ID NO: 5728002 - DNA, 13 bp, Homo sapiens
cttgtaccagccc

SEQ ID NO: 5728003 - DNA, 14 bp, Homo sapiens
cttgtaccagccca

SEQ ID NO: 5728004 - DNA, 18 bp, Homo sapiens
cttgtaccatagaaaaat

SEQ ID NO: 5728005 - DNA, 20 bp, Homo sapiens
cttgtaccatagaaaaatgt

SEQ ID NO: 5728006 - DNA, 22 bp, Homo sapiens
cttgtaccatagaaaaatgtat

SEQ ID NO: 5728007 - DNA, 22 bp, Homo sapiens
cttgtacccccaggtggaaggc

SEQ ID NO: 5728008 - DNA, 20 bp, Homo sapiens
cttgtacctctggctgacta

SEQ ID NO: 5728009 - DNA, 17 bp, Homo sapiens
cttgtactaagccagga

SEQ ID NO: 5728010 - DNA, 18 bp, Homo sapiens
cttgtactctacaaaata

SEQ ID NO: 5728011 - DNA, 20 bp, Homo sapiens
cttgtactcttaggatattt

SEQ ID NO: 5728012 - DNA, 13 bp, Homo sapiens
cttgtactgggac

SEQ ID NO: 5728013 - DNA, 14 bp, Homo sapiens
cttgtactgggaca

SEQ ID NO: 5728014 - DNA, 23 bp, Homo sapiens
cttgtactgtgacctaagaacaa

SEQ ID NO: 5728015 - DNA, 20 bp, Homo sapiens
cttgtacttacactgaaatc

SEQ ID NO: 5728016 - DNA, 18 bp, Homo sapiens
cttgtacttctgtgttca

SEQ ID NO: 5728017 - DNA, 22 bp, Homo sapiens
cttgtacttgtttcatctggtt

SEQ ID NO: 5728018 - DNA, 20 bp, Homo sapiens
cttgtagaactcactctggg

SEQ ID NO: 5728019 - DNA, 14 bp, Homo sapiens
cttgtagaattgtt

SEQ ID NO: 5728020 - DNA, 15 bp, Homo sapiens
cttgtagaattgtta

SEQ ID NO: 5728021 - DNA, 17 bp, Homo sapiens
cttgtagaattgttata

SEQ ID NO: 5728022 - DNA, 17 bp, Homo sapiens
cttgtagaggagcaggg

SEQ ID NO: 5728023 - DNA, 17 bp, Homo sapiens
cttgtagatttgatttt

SEQ ID NO: 5728024 - DNA, 23 bp, Homo sapiens
cttgtagcattcggccttggtga

SEQ ID NO: 5728025 - DNA, 13 bp, Homo sapiens
cttgtagccctgg

SEQ ID NO: 5728026 - DNA, 14 bp, Homo sapiens
cttgtagccctgga

SEQ ID NO: 5728027 - DNA, 15 bp, Homo sapiens
cttgtagccctggat

SEQ ID NO: 5728028 - DNA, 19 bp, Homo sapiens
cttgtagccctggatggcc

SEQ ID NO: 5728029 - DNA, 21 bp, Homo sapiens
cttgtagccctttccaagctt

SEQ ID NO: 5728030 - DNA, 14 bp, Homo sapiens
cttgtagccttttg

SEQ ID NO: 5728031 - DNA, 22 bp, Homo sapiens
cttgtagcgactaaactagatt

SEQ ID NO: 5728032 - DNA, 21 bp, Homo sapiens
cttgtagctcctcccctggag

SEQ ID NO: 5728033 - DNA, 22 bp, Homo sapiens
cttgtagctgtaaaacgctgtc

SEQ ID NO: 5728034 - DNA, 19 bp, Homo sapiens
cttgtagggtgaggcgtgg

SEQ ID NO: 5728035 - DNA, 19 bp, Homo sapiens
cttgtaggtttctctgcct

SEQ ID NO: 5728036 - DNA, 21 bp, Homo sapiens
cttgtaggtttctctgcctcc

SEQ ID NO: 5728037 - DNA, 12 bp, Homo sapiens
cttgtagtcttg

SEQ ID NO: 5728038 - DNA, 13 bp, Homo sapiens
cttgtataaatgt

SEQ ID NO: 5728039 - DNA, 17 bp, Homo sapiens
cttgtataaatgtatat

SEQ ID NO: 5728040 - DNA, 18 bp, Homo sapiens
cttgtataaatgtatata

SEQ ID NO: 5728041 - DNA, 21 bp, Homo sapiens
cttgtataaatgtatatacac

SEQ ID NO: 5728042 - DNA, 14 bp, Homo sapiens
cttgtataaattat

SEQ ID NO: 5728043 - DNA, 19 bp, Homo sapiens
cttgtataagatcctagat

SEQ ID NO: 5728044 - DNA, 20 bp, Homo sapiens
cttgtatagcttttatctgc

SEQ ID NO: 5728045 - DNA, 22 bp, Homo sapiens
cttgtataggttttaaagacct

SEQ ID NO: 5728046 - DNA, 15 bp, Homo sapiens
cttgtatatacatat

SEQ ID NO: 5728047 - DNA, 20 bp, Homo sapiens
cttgtatatacgcatctata

SEQ ID NO: 5728048 - DNA, 22 bp, Homo sapiens
cttgtatatagagattgtacat

SEQ ID NO: 5728049 - DNA, 23 bp, Homo sapiens
cttgtatatatggatcagaggag

SEQ ID NO: 5728050 - DNA, 15 bp, Homo sapiens
cttgtatattctatt

SEQ ID NO: 5728051 - DNA, 12 bp, Homo sapiens
cttgtatatttg

SEQ ID NO: 5728052 - DNA, 18 bp, Homo sapiens
cttgtatatttgtacaaa

SEQ ID NO: 5728053 - DNA, 14 bp, Homo sapiens
cttgtatcaaatgt

SEQ ID NO: 5728054 - DNA, 15 bp, Homo sapiens
cttgtatccaggcct

SEQ ID NO: 5728055 - DNA, 18 bp, Homo sapiens
cttgtatcctctggttct

SEQ ID NO: 5728056 - DNA, 14 bp, Homo sapiens
cttgtatctttcta

SEQ ID NO: 5728057 - DNA, 21 bp, Homo sapiens
cttgtatgaaagatggctgtg

SEQ ID NO: 5728058 - DNA, 21 bp, Homo sapiens
cttgtatgaataaaaggctgg

SEQ ID NO: 5728059 - DNA, 17 bp, Homo sapiens
cttgtatggctctcaag

SEQ ID NO: 5728060 - DNA, 20 bp, Homo sapiens
cttgtatggctctcaagtga

SEQ ID NO: 5728061 - DNA, 22 bp, Homo sapiens
cttgtatggctctcaagtgaaa

SEQ ID NO: 5728062 - DNA, 13 bp, Homo sapiens
cttgtattaaact

SEQ ID NO: 5728063 - DNA, 13 bp, Homo sapiens
cttgtattaagtt

SEQ ID NO: 5728064 - DNA, 22 bp, Homo sapiens
cttgtattaagttgttaataaa

SEQ ID NO: 5728065 - DNA, 17 bp, Homo sapiens
cttgtattatcagtgaa

SEQ ID NO: 5728066 - DNA, 17 bp, Homo sapiens
cttgtattatctccttt

SEQ ID NO: 5728067 - DNA, 18 bp, Homo sapiens
cttgtattatctcctttg

SEQ ID NO: 5728068 - DNA, 16 bp, Homo sapiens
cttgtattccaagcat

SEQ ID NO: 5728069 - DNA, 22 bp, Homo sapiens
cttgtattccttttagcagtag

SEQ ID NO: 5728070 - DNA, 20 bp, Homo sapiens
cttgtattgaagttaactgt

SEQ ID NO: 5728071 - DNA, 19 bp, Homo sapiens
cttgtattgactttatgtt

SEQ ID NO: 5728072 - DNA, 18 bp, Homo sapiens
cttgtattgtaaatgtgg

SEQ ID NO: 5728073 - DNA, 18 bp, Homo sapiens
cttgtatttaaaaacatt

SEQ ID NO: 5728074 - DNA, 20 bp, Homo sapiens
cttgtatttaaatattaaat

SEQ ID NO: 5728075 - DNA, 12 bp, Homo sapiens
cttgtatttaat

SEQ ID NO: 5728076 - DNA, 21 bp, Homo sapiens
cttgtatttagtaagtgcttg

SEQ ID NO: 5728077 - DNA, 15 bp, Homo sapiens
cttgtatttccaaac

SEQ ID NO: 5728078 - DNA, 14 bp, Homo sapiens
cttgtattttccat

SEQ ID NO: 5728079 - DNA, 22 bp, Homo sapiens
cttgtattttcttcccatttgt

SEQ ID NO: 5728080 - DNA, 14 bp, Homo sapiens
cttgtattttgtga

SEQ ID NO: 5728081 - DNA, 17 bp, Homo sapiens
cttgtattttgttaaag

SEQ ID NO: 5728082 - DNA, 16 bp, Homo sapiens
cttgtattttttaatg

SEQ ID NO: 5728083 - DNA, 14 bp, Homo sapiens
cttgtcaaagaagg

SEQ ID NO: 5728084 - DNA, 19 bp, Homo sapiens
cttgtcaaagaaggtgctg

SEQ ID NO: 5728085 - DNA, 19 bp, Homo sapiens
cttgtcaaatagcaaggcc

SEQ ID NO: 5728086 - DNA, 20 bp, Homo sapiens
cttgtcaaatagcaaggcca

SEQ ID NO: 5728087 - DNA, 14 bp, Homo sapiens
cttgtcaacctctt

SEQ ID NO: 5728088 - DNA, 18 bp, Homo sapiens
cttgtcaagaatgagaaa

SEQ ID NO: 5728089 - DNA, 17 bp, Homo sapiens
cttgtcaatactgagcc

SEQ ID NO: 5728090 - DNA, 19 bp, Homo sapiens
cttgtcaatatttaaacat

SEQ ID NO: 5728091 - DNA, 19 bp, Homo sapiens
cttgtcacccaggctggag

SEQ ID NO: 5728092 - DNA, 16 bp, Homo sapiens
cttgtcacgccagact

SEQ ID NO: 5728093 - DNA, 19 bp, Homo sapiens
cttgtcactacaaaaatac

SEQ ID NO: 5728094 - DNA, 16 bp, Homo sapiens
cttgtcactagcagct

SEQ ID NO: 5728095 - DNA, 15 bp, Homo sapiens
cttgtcactgaagat

SEQ ID NO: 5728096 - DNA, 16 bp, Homo sapiens
cttgtcacttgcatgt

SEQ ID NO: 5728097 - DNA, 22 bp, Homo sapiens
cttgtcagaattggcctcagtg

SEQ ID NO: 5728098 - DNA, 16 bp, Homo sapiens
cttgtcagacataaag

SEQ ID NO: 5728099 - DNA, 19 bp, Homo sapiens
cttgtcagacataaagcca

SEQ ID NO: 5728100 - DNA, 20 bp, Homo sapiens
cttgtcagacataaagccat

SEQ ID NO: 5728101 - DNA, 17 bp, Homo sapiens
cttgtcaggacccaggc

SEQ ID NO: 5728102 - DNA, 23 bp, Homo sapiens
cttgtcagggtctccttccttcc

SEQ ID NO: 5728103 - DNA, 13 bp, Homo sapiens
cttgtcagtgtag

SEQ ID NO: 5728104 - DNA, 21 bp, Homo sapiens
cttgtcagtgtagacacaggt

SEQ ID NO: 5728105 - DNA, 14 bp, Homo sapiens
cttgtcagtgtgtc

SEQ ID NO: 5728106 - DNA, 21 bp, Homo sapiens
cttgtcatccacacaacacca

SEQ ID NO: 5728107 - DNA, 20 bp, Homo sapiens
cttgtcatcttttagagtaa

SEQ ID NO: 5728108 - DNA, 23 bp, Homo sapiens
cttgtcatggaaaatgtcctgtg

SEQ ID NO: 5728109 - DNA, 13 bp, Homo sapiens
cttgtcatgtgta

SEQ ID NO: 5728110 - DNA, 14 bp, Homo sapiens
cttgtcattctcat

SEQ ID NO: 5728111 - DNA, 22 bp, Homo sapiens
cttgtcattctcatccaaaagt

SEQ ID NO: 5728112 - DNA, 13 bp, Homo sapiens
cttgtcattgact

SEQ ID NO: 5728113 - DNA, 20 bp, Homo sapiens
cttgtcattttacaagcatt

SEQ ID NO: 5728114 - DNA, 15 bp, Homo sapiens
cttgtcattttggtc

SEQ ID NO: 5728115 - DNA, 14 bp, Homo sapiens
cttgtccacagtct

SEQ ID NO: 5728116 - DNA, 24 bp, Homo sapiens
cttgtccacagtctcccattctca

SEQ ID NO: 5728117 - DNA, 14 bp, Homo sapiens
cttgtccagcgcct

SEQ ID NO: 5728118 - DNA, 18 bp, Homo sapiens
cttgtccagcgcctagtg

SEQ ID NO: 5728119 - DNA, 13 bp, Homo sapiens
cttgtccaggaac

SEQ ID NO: 5728120 - DNA, 16 bp, Homo sapiens
cttgtccaggaactgc

SEQ ID NO: 5728121 - DNA, 14 bp, Homo sapiens
cttgtccaggtctc

SEQ ID NO: 5728122 - DNA, 22 bp, Homo sapiens
cttgtccagttcaaataagaaa

SEQ ID NO: 5728123 - DNA, 23 bp, Homo sapiens
cttgtccattgcgttattttctt

SEQ ID NO: 5728124 - DNA, 22 bp, Homo sapiens
cttgtcccacgtgtcttccact

SEQ ID NO: 5728125 - DNA, 19 bp, Homo sapiens
cttgtcccactcaagccaa

SEQ ID NO: 5728126 - DNA, 19 bp, Homo sapiens
cttgtcccagaggctgccc

SEQ ID NO: 5728127 - DNA, 15 bp, Homo sapiens
cttgtcccagccagt

SEQ ID NO: 5728128 - DNA, 14 bp, Homo sapiens
cttgtccccaaatc

SEQ ID NO: 5728129 - DNA, 12 bp, Homo sapiens
cttgtccccaca

SEQ ID NO: 5728130 - DNA, 14 bp, Homo sapiens
cttgtccccacact

SEQ ID NO: 5728131 - DNA, 20 bp, Homo sapiens
cttgtccccacactcctaca

SEQ ID NO: 5728132 - DNA, 16 bp, Homo sapiens
cttgtccccacccatg

SEQ ID NO: 5728133 - DNA, 19 bp, Homo sapiens
cttgtccccacccatgcgc

SEQ ID NO: 5728134 - DNA, 21 bp, Homo sapiens
cttgtcccctcctcactccct

SEQ ID NO: 5728135 - DNA, 21 bp, Homo sapiens
cttgtcccctgcctgtgcctg

SEQ ID NO: 5728136 - DNA, 20 bp, Homo sapiens
cttgtccctctcactcccca

SEQ ID NO: 5728137 - DNA, 17 bp, Homo sapiens
cttgtccctctctcagc

SEQ ID NO: 5728138 - DNA, 14 bp, Homo sapiens
cttgtccctggggc

SEQ ID NO: 5728139 - DNA, 18 bp, Homo sapiens
cttgtccctttccctacc

SEQ ID NO: 5728140 - DNA, 16 bp, Homo sapiens
cttgtcctatgtcaat

SEQ ID NO: 5728141 - DNA, 23 bp, Homo sapiens
cttgtcctctcagagcctcagct

SEQ ID NO: 5728142 - DNA, 14 bp, Homo sapiens
cttgtcctctcccg

SEQ ID NO: 5728143 - DNA, 15 bp, Homo sapiens
cttgtcctgaagccc

SEQ ID NO: 5728144 - DNA, 18 bp, Homo sapiens
cttgtcctgaagcccagc

SEQ ID NO: 5728145 - DNA, 15 bp, Homo sapiens
cttgtcctgctcaga

SEQ ID NO: 5728146 - DNA, 14 bp, Homo sapiens
cttgtcctgctctc

SEQ ID NO: 5728147 - DNA, 14 bp, Homo sapiens
cttgtcctggccct

SEQ ID NO: 5728148 - DNA, 17 bp, Homo sapiens
cttgtcctgggcctgcc

SEQ ID NO: 5728149 - DNA, 17 bp, Homo sapiens
cttgtccttagcctgga

SEQ ID NO: 5728150 - DNA, 18 bp, Homo sapiens
cttgtccttagcctggac

SEQ ID NO: 5728151 - DNA, 21 bp, Homo sapiens
cttgtcgcgcgtctcccatcc

SEQ ID NO: 5728152 - DNA, 18 bp, Homo sapiens
cttgtcgctttctcagtg

SEQ ID NO: 5728153 - DNA, 22 bp, Homo sapiens
cttgtcgctttctcagtgtgtg

SEQ ID NO: 5728154 - DNA, 16 bp, Homo sapiens
cttgtcgggggcccaa

SEQ ID NO: 5728155 - DNA, 16 bp, Homo sapiens
cttgtctaaccccagg

SEQ ID NO: 5728156 - DNA, 19 bp, Homo sapiens
cttgtctagtttcccacat

SEQ ID NO: 5728157 - DNA, 18 bp, Homo sapiens
cttgtctcaatgctcata

SEQ ID NO: 5728158 - DNA, 23 bp, Homo sapiens
cttgtctcaatgctcataacgga

SEQ ID NO: 5728159 - DNA, 17 bp, Homo sapiens
cttgtctcacgcagcca

SEQ ID NO: 5728160 - DNA, 14 bp, Homo sapiens
cttgtctcagattt

SEQ ID NO: 5728161 - DNA, 20 bp, Homo sapiens
cttgtctcaggactctgaaa

SEQ ID NO: 5728162 - DNA, 12 bp, Homo sapiens
cttgtctccact

SEQ ID NO: 5728163 - DNA, 23 bp, Homo sapiens
cttgtctccactaaatgagctcc

SEQ ID NO: 5728164 - DNA, 18 bp, Homo sapiens
cttgtctcctttctgact

SEQ ID NO: 5728165 - DNA, 18 bp, Homo sapiens
cttgtctctgaggctctc

SEQ ID NO: 5728166 - DNA, 15 bp, Homo sapiens
cttgtctcttcctct

SEQ ID NO: 5728167 - DNA, 13 bp, Homo sapiens
cttgtctgaggcc

SEQ ID NO: 5728168 - DNA, 14 bp, Homo sapiens
cttgtctgaggcct

SEQ ID NO: 5728169 - DNA, 15 bp, Homo sapiens
cttgtctgaggcctc

SEQ ID NO: 5728170 - DNA, 21 bp, Homo sapiens
cttgtctgaggcctcatccct

SEQ ID NO: 5728171 - DNA, 12 bp, Homo sapiens
cttgtctgcctc

SEQ ID NO: 5728172 - DNA, 13 bp, Homo sapiens
cttgtctgcctcc

SEQ ID NO: 5728173 - DNA, 16 bp, Homo sapiens
cttgtctgggaattgt

SEQ ID NO: 5728174 - DNA, 13 bp, Homo sapiens
cttgtctgggtgc

SEQ ID NO: 5728175 - DNA, 15 bp, Homo sapiens
cttgtctgggtgcag

SEQ ID NO: 5728176 - DNA, 15 bp, Homo sapiens
cttgtcttagctctg

SEQ ID NO: 5728177 - DNA, 20 bp, Homo sapiens
cttgtcttattcccttcctg

SEQ ID NO: 5728178 - DNA, 18 bp, Homo sapiens
cttgtcttcccccctctc

SEQ ID NO: 5728179 - DNA, 13 bp, Homo sapiens
cttgtcttgaaaa

SEQ ID NO: 5728180 - DNA, 22 bp, Homo sapiens
cttgtcttgataaagtggaatt

SEQ ID NO: 5728181 - DNA, 14 bp, Homo sapiens
cttgtcttgctctt

SEQ ID NO: 5728182 - DNA, 23 bp, Homo sapiens
cttgtcttgtaattgtggattaa

SEQ ID NO: 5728183 - DNA, 13 bp, Homo sapiens
cttgtctttattt

SEQ ID NO: 5728184 - DNA, 18 bp, Homo sapiens
cttgtctttggaccctga

SEQ ID NO: 5728185 - DNA, 21 bp, Homo sapiens
cttgtctttggaccctgaggc

SEQ ID NO: 5728186 - DNA, 18 bp, Homo sapiens
cttgtcttttcccctcat

SEQ ID NO: 5728187 - DNA, 14 bp, Homo sapiens
cttgtgaaacacag

SEQ ID NO: 5728188 - DNA, 20 bp, Homo sapiens
cttgtgaaacgtctggactg

SEQ ID NO: 5728189 - DNA, 12 bp, Homo sapiens
cttgtgaaattg

SEQ ID NO: 5728190 - DNA, 13 bp, Homo sapiens
cttgtgaaattgt

SEQ ID NO: 5728191 - DNA, 15 bp, Homo sapiens
cttgtgaaattgtgt

SEQ ID NO: 5728192 - DNA, 14 bp, Homo sapiens
cttgtgaactccat

SEQ ID NO: 5728193 - DNA, 22 bp, Homo sapiens
cttgtgaactccatcattcatc

SEQ ID NO: 5728194 - DNA, 14 bp, Homo sapiens
cttgtgaactgctg

SEQ ID NO: 5728195 - DNA, 14 bp, Homo sapiens
cttgtgaagacaat

SEQ ID NO: 5728196 - DNA, 15 bp, Homo sapiens
cttgtgaagttgttt

SEQ ID NO: 5728197 - DNA, 18 bp, Homo sapiens
cttgtgaagttgtttttt

SEQ ID NO: 5728198 - DNA, 22 bp, Homo sapiens
cttgtgaataaagagggtgggt

SEQ ID NO: 5728199 - DNA, 17 bp, Homo sapiens
cttgtgaatatgtacat

SEQ ID NO: 5728200 - DNA, 21 bp, Homo sapiens
cttgtgaatattgtggctccc

SEQ ID NO: 5728201 - DNA, 19 bp, Homo sapiens
cttgtgaattattctgatt

SEQ ID NO: 5728202 - DNA, 15 bp, Homo sapiens
cttgtgaatttttct

SEQ ID NO: 5728203 - DNA, 19 bp, Homo sapiens
cttgtgacagattatacag

SEQ ID NO: 5728204 - DNA, 14 bp, Homo sapiens
cttgtgacagtgcc

SEQ ID NO: 5728205 - DNA, 17 bp, Homo sapiens
cttgtgacagtgcctct

SEQ ID NO: 5728206 - DNA, 20 bp, Homo sapiens
cttgtgacagtgcctcttcc

SEQ ID NO: 5728207 - DNA, 17 bp, Homo sapiens
cttgtgacccagcactg

SEQ ID NO: 5728208 - DNA, 14 bp, Homo sapiens
cttgtgactagtgc

SEQ ID NO: 5728209 - DNA, 16 bp, Homo sapiens
cttgtgactagtgctg

SEQ ID NO: 5728210 - DNA, 19 bp, Homo sapiens
cttgtgactagtgctgaag

SEQ ID NO: 5728211 - DNA, 17 bp, Homo sapiens
cttgtgactcagtgtat

SEQ ID NO: 5728212 - DNA, 18 bp, Homo sapiens
cttgtgactgaaggggca

SEQ ID NO: 5728213 - DNA, 16 bp, Homo sapiens
cttgtgacttttgctt

SEQ ID NO: 5728214 - DNA, 20 bp, Homo sapiens
cttgtgagagtggctttcta

SEQ ID NO: 5728215 - DNA, 18 bp, Homo sapiens
cttgtgagatccttcaca

SEQ ID NO: 5728216 - DNA, 21 bp, Homo sapiens
cttgtgagcatcagagggctg

SEQ ID NO: 5728217 - DNA, 13 bp, Homo sapiens
cttgtgaggaaag

SEQ ID NO: 5728218 - DNA, 22 bp, Homo sapiens
cttgtgaggattatgggtcctg

SEQ ID NO: 5728219 - DNA, 18 bp, Homo sapiens
cttgtgaggcccgaggca

SEQ ID NO: 5728220 - DNA, 19 bp, Homo sapiens
cttgtgagtggataatcag

SEQ ID NO: 5728221 - DNA, 21 bp, Homo sapiens
cttgtgagtggataatcagga

SEQ ID NO: 5728222 - DNA, 16 bp, Homo sapiens
cttgtgagtgtgtgca

SEQ ID NO: 5728223 - DNA, 19 bp, Homo sapiens
cttgtgataggtacctgag

SEQ ID NO: 5728224 - DNA, 14 bp, Homo sapiens
cttgtgatcctaaa

SEQ ID NO: 5728225 - DNA, 21 bp, Homo sapiens
cttgtgattcctacccctctt

SEQ ID NO: 5728226 - DNA, 21 bp, Homo sapiens
cttgtgattctgggatggacc

SEQ ID NO: 5728227 - DNA, 17 bp, Homo sapiens
cttgtgattgctgccat

SEQ ID NO: 5728228 - DNA, 13 bp, Homo sapiens
cttgtgattggct

SEQ ID NO: 5728229 - DNA, 19 bp, Homo sapiens
cttgtgattggctgcagga

SEQ ID NO: 5728230 - DNA, 14 bp, Homo sapiens
cttgtgatttccat

SEQ ID NO: 5728231 - DNA, 16 bp, Homo sapiens
cttgtgatttctttaa

SEQ ID NO: 5728232 - DNA, 21 bp, Homo sapiens
cttgtgatttctttaaaagaa

SEQ ID NO: 5728233 - DNA, 22 bp, Homo sapiens
cttgtgatttctttaaaagaat

SEQ ID NO: 5728234 - DNA, 15 bp, Homo sapiens
cttgtgcaattgtct

SEQ ID NO: 5728235 - DNA, 17 bp, Homo sapiens
cttgtgcaattgtcttt

SEQ ID NO: 5728236 - DNA, 21 bp, Homo sapiens
cttgtgcagaaaacattgttc

SEQ ID NO: 5728237 - DNA, 21 bp, Homo sapiens
cttgtgcataattcttccaaa

SEQ ID NO: 5728238 - DNA, 12 bp, Homo sapiens
cttgtgcatgca

SEQ ID NO: 5728239 - DNA, 21 bp, Homo sapiens
cttgtgcatgcaaaaatgaat

SEQ ID NO: 5728240 - DNA, 16 bp, Homo sapiens
cttgtgcatgtttact

SEQ ID NO: 5728241 - DNA, 14 bp, Homo sapiens
cttgtgcattgtgt

SEQ ID NO: 5728242 - DNA, 23 bp, Homo sapiens
cttgtgccaaacctactaggcca

SEQ ID NO: 5728243 - DNA, 14 bp, Homo sapiens
cttgtgccagcccg

SEQ ID NO: 5728244 - DNA, 19 bp, Homo sapiens
cttgtgccatagtcacatg

SEQ ID NO: 5728245 - DNA, 14 bp, Homo sapiens
cttgtgccctgggc

SEQ ID NO: 5728246 - DNA, 17 bp, Homo sapiens
cttgtgccctgggccaa

SEQ ID NO: 5728247 - DNA, 16 bp, Homo sapiens
cttgtgcccttaaaac

SEQ ID NO: 5728248 - DNA, 18 bp, Homo sapiens
cttgtgcccttgtatagt

SEQ ID NO: 5728249 - DNA, 14 bp, Homo sapiens
cttgtgcctcagcc

SEQ ID NO: 5728250 - DNA, 12 bp, Homo sapiens
cttgtgcctccc

SEQ ID NO: 5728251 - DNA, 21 bp, Homo sapiens
cttgtgcctcccttcccagtg

SEQ ID NO: 5728252 - DNA, 14 bp, Homo sapiens
cttgtgcctgctcc

SEQ ID NO: 5728253 - DNA, 15 bp, Homo sapiens
cttgtgcctggctca

SEQ ID NO: 5728254 - DNA, 13 bp, Homo sapiens
cttgtgctcagtc

SEQ ID NO: 5728255 - DNA, 11 bp, Homo sapiens
cttgtgctgag

SEQ ID NO: 5728256 - DNA, 23 bp, Homo sapiens
cttgtgctgagaatagtgtctga

SEQ ID NO: 5728257 - DNA, 16 bp, Homo sapiens
cttgtgctgagcctgc

SEQ ID NO: 5728258 - DNA, 21 bp, Homo sapiens
cttgtgctggatggagcccag

SEQ ID NO: 5728259 - DNA, 22 bp, Homo sapiens
cttgtgctggtttttagatttt

SEQ ID NO: 5728260 - DNA, 14 bp, Homo sapiens
cttgtgctttgctc

SEQ ID NO: 5728261 - DNA, 16 bp, Homo sapiens
cttgtgctttgctctt

SEQ ID NO: 5728262 - DNA, 17 bp, Homo sapiens
cttgtgctttgctcttg

SEQ ID NO: 5728263 - DNA, 23 bp, Homo sapiens
cttgtgctttgctcttgtcccac

SEQ ID NO: 5728264 - DNA, 20 bp, Homo sapiens
cttgtgcttttcctatttgt

SEQ ID NO: 5728265 - DNA, 19 bp, Homo sapiens
cttgtggaaaaaaagtgct

SEQ ID NO: 5728266 - DNA, 18 bp, Homo sapiens
cttgtggaattgggagct

SEQ ID NO: 5728267 - DNA, 15 bp, Homo sapiens
cttgtggacacagct

SEQ ID NO: 5728268 - DNA, 20 bp, Homo sapiens
cttgtggacctcaccagaga

SEQ ID NO: 5728269 - DNA, 19 bp, Homo sapiens
cttgtggactaaaagatat

SEQ ID NO: 5728270 - DNA, 16 bp, Homo sapiens
cttgtggactggctgt

SEQ ID NO: 5728271 - DNA, 21 bp, Homo sapiens
cttgtggagatcacagcccca

SEQ ID NO: 5728272 - DNA, 12 bp, Homo sapiens
cttgtggagccc

SEQ ID NO: 5728273 - DNA, 13 bp, Homo sapiens
cttgtggagcccc

SEQ ID NO: 5728274 - DNA, 19 bp, Homo sapiens
cttgtggagccccacactg

SEQ ID NO: 5728275 - DNA, 22 bp, Homo sapiens
cttgtggaggagggagagccct

SEQ ID NO: 5728276 - DNA, 23 bp, Homo sapiens
cttgtggaggagggagagccctg

SEQ ID NO: 5728277 - DNA, 16 bp, Homo sapiens
cttgtggataagggag

SEQ ID NO: 5728278 - DNA, 10 bp, Homo sapiens
cttgtggcag

SEQ ID NO: 5728279 - DNA, 13 bp, Homo sapiens
cttgtggcagagg

SEQ ID NO: 5728280 - DNA, 17 bp, Homo sapiens
cttgtggcagaggatgt

SEQ ID NO: 5728281 - DNA, 22 bp, Homo sapiens
cttgtggcagcctgattcgggg

SEQ ID NO: 5728282 - DNA, 15 bp, Homo sapiens
cttgtggcagcttcc

SEQ ID NO: 5728283 - DNA, 10 bp, Homo sapiens
cttgtggcct

SEQ ID NO: 5728284 - DNA, 15 bp, Homo sapiens
cttgtggcctatgaa

SEQ ID NO: 5728285 - DNA, 23 bp, Homo sapiens
cttgtggccttttttataactaa

SEQ ID NO: 5728286 - DNA, 22 bp, Homo sapiens
cttgtggcttgggacatggcac

SEQ ID NO: 5728287 - DNA, 23 bp, Homo sapiens
cttgtgggaccagtcccacaccg

SEQ ID NO: 5728288 - DNA, 18 bp, Homo sapiens
cttgtgggagacagcagc

SEQ ID NO: 5728289 - DNA, 23 bp, Homo sapiens
cttgtgggagacagcagcctgta

SEQ ID NO: 5728290 - DNA, 16 bp, Homo sapiens
cttgtgggcctgggct

SEQ ID NO: 5728291 - DNA, 19 bp, Homo sapiens
cttgtgggcctgggctcct

SEQ ID NO: 5728292 - DNA, 22 bp, Homo sapiens
cttgtgggcctgggctcctgga

SEQ ID NO: 5728293 - DNA, 23 bp, Homo sapiens
cttgtgggcctgggctcctggac

SEQ ID NO: 5728294 - DNA, 15 bp, Homo sapiens
cttgtgggctggtgc

SEQ ID NO: 5728295 - DNA, 16 bp, Homo sapiens
cttgtggggacccagg

SEQ ID NO: 5728296 - DNA, 21 bp, Homo sapiens
cttgtggggacccaggctccg

SEQ ID NO: 5728297 - DNA, 17 bp, Homo sapiens
cttgtggggcctgggag

SEQ ID NO: 5728298 - DNA, 16 bp, Homo sapiens
cttgtgggtcctgggg

SEQ ID NO: 5728299 - DNA, 21 bp, Homo sapiens
cttgtggtctcgatgctgctg

SEQ ID NO: 5728300 - DNA, 22 bp, Homo sapiens
cttgtggtctcgatgctgctgg

SEQ ID NO: 5728301 - DNA, 23 bp, Homo sapiens
cttgtggtctcgatgctgctggc

SEQ ID NO: 5728302 - DNA, 14 bp, Homo sapiens
cttgtggtggggca

SEQ ID NO: 5728303 - DNA, 14 bp, Homo sapiens
cttgtggtgtaaag

SEQ ID NO: 5728304 - DNA, 21 bp, Homo sapiens
cttgtggtgtaaagctggccc

SEQ ID NO: 5728305 - DNA, 16 bp, Homo sapiens
cttgtggtgtgaccat

SEQ ID NO: 5728306 - DNA, 21 bp, Homo sapiens
cttgtggtgtgaccatgttca

SEQ ID NO: 5728307 - DNA, 15 bp, Homo sapiens
cttgtggttaaaaac

SEQ ID NO: 5728308 - DNA, 20 bp, Homo sapiens
cttgtggttaaaaacctgcc

SEQ ID NO: 5728309 - DNA, 22 bp, Homo sapiens
cttgtggttataacttaatgaa

SEQ ID NO: 5728310 - DNA, 12 bp, Homo sapiens
cttgtggttgtg

SEQ ID NO: 5728311 - DNA, 12 bp, Homo sapiens
cttgtgtaaata

SEQ ID NO: 5728312 - DNA, 16 bp, Homo sapiens
cttgtgtaaatacaat

SEQ ID NO: 5728313 - DNA, 16 bp, Homo sapiens
cttgtgtaactaattt

SEQ ID NO: 5728314 - DNA, 20 bp, Homo sapiens
cttgtgtaactaatttgtgg

SEQ ID NO: 5728315 - DNA, 20 bp, Homo sapiens
cttgtgtaatttatgtgaaa

SEQ ID NO: 5728316 - DNA, 18 bp, Homo sapiens
cttgtgtaatttcctgct

SEQ ID NO: 5728317 - DNA, 19 bp, Homo sapiens
cttgtgtaatttcctgctc

SEQ ID NO: 5728318 - DNA, 20 bp, Homo sapiens
cttgtgtactgataaaatac

SEQ ID NO: 5728319 - DNA, 14 bp, Homo sapiens
cttgtgtagatttg

SEQ ID NO: 5728320 - DNA, 21 bp, Homo sapiens
cttgtgtagatttgaaaattg

SEQ ID NO: 5728321 - DNA, 12 bp, Homo sapiens
cttgtgtatatg

SEQ ID NO: 5728322 - DNA, 22 bp, Homo sapiens
cttgtgtatccattatcatgtg

SEQ ID NO: 5728323 - DNA, 20 bp, Homo sapiens
cttgtgtatcctgacagcgc

SEQ ID NO: 5728324 - DNA, 22 bp, Homo sapiens
cttgtgtatcttgattaatgta

SEQ ID NO: 5728325 - DNA, 20 bp, Homo sapiens
cttgtgtatttctctgtgaa

SEQ ID NO: 5728326 - DNA, 21 bp, Homo sapiens
cttgtgtatttctctgtgaat

SEQ ID NO: 5728327 - DNA, 21 bp, Homo sapiens
cttgtgtcaaccactaaagta

SEQ ID NO: 5728328 - DNA, 22 bp, Homo sapiens
cttgtgtcaaccactaaagtat

SEQ ID NO: 5728329 - DNA, 14 bp, Homo sapiens
cttgtgtcagagac

SEQ ID NO: 5728330 - DNA, 18 bp, Homo sapiens
cttgtgtcagagacagac

SEQ ID NO: 5728331 - DNA, 14 bp, Homo sapiens
cttgtgtcagagct

SEQ ID NO: 5728332 - DNA, 22 bp, Homo sapiens
cttgtgtccctcctgggatctg

SEQ ID NO: 5728333 - DNA, 19 bp, Homo sapiens
cttgtgtcctgtcctttct

SEQ ID NO: 5728334 - DNA, 21 bp, Homo sapiens
cttgtgtcctgtcctttcttg

SEQ ID NO: 5728335 - DNA, 15 bp, Homo sapiens
cttgtgtctacagag

SEQ ID NO: 5728336 - DNA, 15 bp, Homo sapiens
cttgtgtctctgtgc

SEQ ID NO: 5728337 - DNA, 18 bp, Homo sapiens
cttgtgtctctgtgcttt

SEQ ID NO: 5728338 - DNA, 14 bp, Homo sapiens
cttgtgtctgtaca

SEQ ID NO: 5728339 - DNA, 12 bp, Homo sapiens
cttgtgtctgtt

SEQ ID NO: 5728340 - DNA, 14 bp, Homo sapiens
cttgtgtctgttgc

SEQ ID NO: 5728341 - DNA, 20 bp, Homo sapiens
cttgtgtctgttttactgtt

SEQ ID NO: 5728342 - DNA, 14 bp, Homo sapiens
cttgtgtgagggca

SEQ ID NO: 5728343 - DNA, 16 bp, Homo sapiens
cttgtgtgcatggaag

SEQ ID NO: 5728344 - DNA, 20 bp, Homo sapiens
cttgtgtgcatggaagtaat

SEQ ID NO: 5728345 - DNA, 13 bp, Homo sapiens
cttgtgtgccaca

SEQ ID NO: 5728346 - DNA, 18 bp, Homo sapiens
cttgtgtggcttggagga

SEQ ID NO: 5728347 - DNA, 22 bp, Homo sapiens
cttgtgtgtaccacaccctgcc

SEQ ID NO: 5728348 - DNA, 20 bp, Homo sapiens
cttgtgtgtatgcacatgaa

SEQ ID NO: 5728349 - DNA, 22 bp, Homo sapiens
cttgtgtgtatgcacatgaact

SEQ ID NO: 5728350 - DNA, 15 bp, Homo sapiens
cttgtgtgtcaggcc

SEQ ID NO: 5728351 - DNA, 21 bp, Homo sapiens
cttgtgtgtcaggccctctgc

SEQ ID NO: 5728352 - DNA, 16 bp, Homo sapiens
cttgtgtgtgccctgg

SEQ ID NO: 5728353 - DNA, 21 bp, Homo sapiens
cttgtgtgttccaagtttcca

SEQ ID NO: 5728354 - DNA, 20 bp, Homo sapiens
cttgtgtgtttattgtcaaa

SEQ ID NO: 5728355 - DNA, 17 bp, Homo sapiens
cttgtgtgtttcacttt

SEQ ID NO: 5728356 - DNA, 17 bp, Homo sapiens
cttgtgttactaatttg

SEQ ID NO: 5728357 - DNA, 16 bp, Homo sapiens
cttgtgttcaatctgt

SEQ ID NO: 5728358 - DNA, 15 bp, Homo sapiens
cttgtgttcagaaga

SEQ ID NO: 5728359 - DNA, 22 bp, Homo sapiens
cttgtgttcagctctttccaaa

SEQ ID NO: 5728360 - DNA, 11 bp, Homo sapiens
cttgtgttcct

SEQ ID NO: 5728361 - DNA, 16 bp, Homo sapiens
cttgtgttccttctgt

SEQ ID NO: 5728362 - DNA, 17 bp, Homo sapiens
cttgtgttccttctgtg

SEQ ID NO: 5728363 - DNA, 18 bp, Homo sapiens
cttgtgttccttctgtga

SEQ ID NO: 5728364 - DNA, 23 bp, Homo sapiens
cttgtgttccttctgtgaagaag

SEQ ID NO: 5728365 - DNA, 15 bp, Homo sapiens
cttgtgttctgagta

SEQ ID NO: 5728366 - DNA, 18 bp, Homo sapiens
cttgtgttctgtagactg

SEQ ID NO: 5728367 - DNA, 20 bp, Homo sapiens
cttgtgttgcactgaacagg

SEQ ID NO: 5728368 - DNA, 19 bp, Homo sapiens
cttgtgttgctttctgact

SEQ ID NO: 5728369 - DNA, 16 bp, Homo sapiens
cttgtgtttaagcacc

SEQ ID NO: 5728370 - DNA, 21 bp, Homo sapiens
cttgtgtttgcttaaacaaag

SEQ ID NO: 5728371 - DNA, 13 bp, Homo sapiens
cttgtgtttgtat

SEQ ID NO: 5728372 - DNA, 15 bp, Homo sapiens
cttgtgtttttgtct

SEQ ID NO: 5728373 - DNA, 17 bp, Homo sapiens
cttgttaaatgagctta

SEQ ID NO: 5728374 - DNA, 16 bp, Homo sapiens
cttgttaagatagtta

SEQ ID NO: 5728375 - DNA, 14 bp, Homo sapiens
cttgttaatattct

SEQ ID NO: 5728376 - DNA, 20 bp, Homo sapiens
cttgttaatgtcattgctaa

SEQ ID NO: 5728377 - DNA, 22 bp, Homo sapiens
cttgttacaaattttttaattt

SEQ ID NO: 5728378 - DNA, 23 bp, Homo sapiens
cttgttacctttcccatgctgaa

SEQ ID NO: 5728379 - DNA, 13 bp, Homo sapiens
cttgttactgctg

SEQ ID NO: 5728380 - DNA, 14 bp, Homo sapiens
cttgttactgctga

SEQ ID NO: 5728381 - DNA, 19 bp, Homo sapiens
cttgttactgctgattctt

SEQ ID NO: 5728382 - DNA, 17 bp, Homo sapiens
cttgttacttctgaggt

SEQ ID NO: 5728383 - DNA, 13 bp, Homo sapiens
cttgttagaaaac

SEQ ID NO: 5728384 - DNA, 23 bp, Homo sapiens
cttgttagaaaacaaaattttat

SEQ ID NO: 5728385 - DNA, 22 bp, Homo sapiens
cttgttagaagaggtggcccca

SEQ ID NO: 5728386 - DNA, 14 bp, Homo sapiens
cttgttagaatctg

SEQ ID NO: 5728387 - DNA, 14 bp, Homo sapiens
cttgttagagagaa

SEQ ID NO: 5728388 - DNA, 16 bp, Homo sapiens
cttgttagagagaaag

SEQ ID NO: 5728389 - DNA, 13 bp, Homo sapiens
cttgttagatcta

SEQ ID NO: 5728390 - DNA, 22 bp, Homo sapiens
cttgttagatctagttcactct

SEQ ID NO: 5728391 - DNA, 18 bp, Homo sapiens
cttgttagccaacttcaa

SEQ ID NO: 5728392 - DNA, 20 bp, Homo sapiens
cttgttatattaagcagaaa

SEQ ID NO: 5728393 - DNA, 18 bp, Homo sapiens
cttgttatggtagaaaaa

SEQ ID NO: 5728394 - DNA, 14 bp, Homo sapiens
cttgttatgttgta

SEQ ID NO: 5728395 - DNA, 22 bp, Homo sapiens
cttgttatgttgtaatattttg

SEQ ID NO: 5728396 - DNA, 15 bp, Homo sapiens
cttgttattaatgtt

SEQ ID NO: 5728397 - DNA, 17 bp, Homo sapiens
cttgttattaatgtttc

SEQ ID NO: 5728398 - DNA, 22 bp, Homo sapiens
cttgttattaatgtttcttctc

SEQ ID NO: 5728399 - DNA, 15 bp, Homo sapiens
cttgttattatctac

SEQ ID NO: 5728400 - DNA, 14 bp, Homo sapiens
cttgttattattgt

SEQ ID NO: 5728401 - DNA, 16 bp, Homo sapiens
cttgttattcaacagc

SEQ ID NO: 5728402 - DNA, 23 bp, Homo sapiens
cttgttattcgaaccactgagag

SEQ ID NO: 5728403 - DNA, 14 bp, Homo sapiens
cttgttattgtgaa

SEQ ID NO: 5728404 - DNA, 17 bp, Homo sapiens
cttgttattgtgaatga

SEQ ID NO: 5728405 - DNA, 17 bp, Homo sapiens
cttgttcatccaaggaa

SEQ ID NO: 5728406 - DNA, 20 bp, Homo sapiens
cttgttcatgttttgctaat

SEQ ID NO: 5728407 - DNA, 18 bp, Homo sapiens
cttgttcattctgtgacc

SEQ ID NO: 5728408 - DNA, 12 bp, Homo sapiens
cttgttcattta

SEQ ID NO: 5728409 - DNA, 13 bp, Homo sapiens
cttgttcatttct

SEQ ID NO: 5728410 - DNA, 16 bp, Homo sapiens
cttgttcatttctgtc

SEQ ID NO: 5728411 - DNA, 20 bp, Homo sapiens
cttgttcatttctgtctccc

SEQ ID NO: 5728412 - DNA, 16 bp, Homo sapiens
cttgttcattttgagt

SEQ ID NO: 5728413 - DNA, 15 bp, Homo sapiens
cttgttccaaggcca

SEQ ID NO: 5728414 - DNA, 18 bp, Homo sapiens
cttgttcccgaagtaaaa

SEQ ID NO: 5728415 - DNA, 17 bp, Homo sapiens
cttgttccgtgccaggc

SEQ ID NO: 5728416 - DNA, 13 bp, Homo sapiens
cttgttcctgaaa

SEQ ID NO: 5728417 - DNA, 14 bp, Homo sapiens
cttgttcctgtgca

SEQ ID NO: 5728418 - DNA, 16 bp, Homo sapiens
cttgttccttctgctt

SEQ ID NO: 5728419 - DNA, 14 bp, Homo sapiens
cttgttctaatctt

SEQ ID NO: 5728420 - DNA, 13 bp, Homo sapiens
cttgttctactca

SEQ ID NO: 5728421 - DNA, 19 bp, Homo sapiens
cttgttctagaatcatgta

SEQ ID NO: 5728422 - DNA, 22 bp, Homo sapiens
cttgttctagaatcatgtattt

SEQ ID NO: 5728423 - DNA, 19 bp, Homo sapiens
cttgttctatttttcaatc

SEQ ID NO: 5728424 - DNA, 19 bp, Homo sapiens
cttgttctcagagcactgt

SEQ ID NO: 5728425 - DNA, 22 bp, Homo sapiens
cttgttctctctatggtaaaga

SEQ ID NO: 5728426 - DNA, 19 bp, Homo sapiens
cttgttctgagattcaata

SEQ ID NO: 5728427 - DNA, 12 bp, Homo sapiens
cttgttctgtca

SEQ ID NO: 5728428 - DNA, 17 bp, Homo sapiens
cttgttctgtcactcag

SEQ ID NO: 5728429 - DNA, 19 bp, Homo sapiens
cttgttctgtcccttccac

SEQ ID NO: 5728430 - DNA, 13 bp, Homo sapiens
cttgttctgtttt

SEQ ID NO: 5728431 - DNA, 14 bp, Homo sapiens
cttgttctgttttg

SEQ ID NO: 5728432 - DNA, 14 bp, Homo sapiens
cttgttcttgagat

SEQ ID NO: 5728433 - DNA, 15 bp, Homo sapiens
cttgttcttgagatt

SEQ ID NO: 5728434 - DNA, 20 bp, Homo sapiens
cttgttcttggttcctgttt

SEQ ID NO: 5728435 - DNA, 13 bp, Homo sapiens
cttgttctttgct

SEQ ID NO: 5728436 - DNA, 18 bp, Homo sapiens
cttgttgaaaatatttct

SEQ ID NO: 5728437 - DNA, 21 bp, Homo sapiens
cttgttgaagtgctgttttat

SEQ ID NO: 5728438 - DNA, 15 bp, Homo sapiens
cttgttgaatttatt

SEQ ID NO: 5728439 - DNA, 18 bp, Homo sapiens
cttgttgagccgtgggca

SEQ ID NO: 5728440 - DNA, 12 bp, Homo sapiens
cttgttgcactg

SEQ ID NO: 5728441 - DNA, 15 bp, Homo sapiens
cttgttgcactgccc

SEQ ID NO: 5728442 - DNA, 19 bp, Homo sapiens
cttgttgcactgccccctg

SEQ ID NO: 5728443 - DNA, 23 bp, Homo sapiens
cttgttgcagactggtgttaatg

SEQ ID NO: 5728444 - DNA, 13 bp, Homo sapiens
cttgttgcagatg

SEQ ID NO: 5728445 - DNA, 20 bp, Homo sapiens
cttgttgcagatgggtgata

SEQ ID NO: 5728446 - DNA, 15 bp, Homo sapiens
cttgttgcatttcca

SEQ ID NO: 5728447 - DNA, 14 bp, Homo sapiens
cttgttgcccaggc

SEQ ID NO: 5728448 - DNA, 20 bp, Homo sapiens
cttgttgcctataagccaaa

SEQ ID NO: 5728449 - DNA, 13 bp, Homo sapiens
cttgttgctgatt

SEQ ID NO: 5728450 - DNA, 16 bp, Homo sapiens
cttgttgctgattttg

SEQ ID NO: 5728451 - DNA, 21 bp, Homo sapiens
cttgttggatttttgtcttgt

SEQ ID NO: 5728452 - DNA, 23 bp, Homo sapiens
cttgttggatttttgtcttgtgt

SEQ ID NO: 5728453 - DNA, 21 bp, Homo sapiens
cttgttgggattcctgaccca

SEQ ID NO: 5728454 - DNA, 22 bp, Homo sapiens
cttgttgggattcctgacccag

SEQ ID NO: 5728455 - DNA, 15 bp, Homo sapiens
cttgttggtggagag

SEQ ID NO: 5728456 - DNA, 23 bp, Homo sapiens
cttgttgtacccttgttttgaaa

SEQ ID NO: 5728457 - DNA, 13 bp, Homo sapiens
cttgttgtattcc

SEQ ID NO: 5728458 - DNA, 18 bp, Homo sapiens
cttgttgtattcctgcct

SEQ ID NO: 5728459 - DNA, 14 bp, Homo sapiens
cttgttgtcaagta

SEQ ID NO: 5728460 - DNA, 19 bp, Homo sapiens
cttgttgtctccacttgta

SEQ ID NO: 5728461 - DNA, 15 bp, Homo sapiens
cttgttgtgacacat

SEQ ID NO: 5728462 - DNA, 14 bp, Homo sapiens
cttgttgtggctct

SEQ ID NO: 5728463 - DNA, 22 bp, Homo sapiens
cttgttgtttgttgacagcttg

SEQ ID NO: 5728464 - DNA, 23 bp, Homo sapiens
cttgttgtttgttgacagcttgg

SEQ ID NO: 5728465 - DNA, 19 bp, Homo sapiens
cttgttgttttactaaaga

SEQ ID NO: 5728466 - DNA, 16 bp, Homo sapiens
cttgtttaaaaaaaga

SEQ ID NO: 5728467 - DNA, 19 bp, Homo sapiens
cttgtttaaaaaaagaaaa

SEQ ID NO: 5728468 - DNA, 21 bp, Homo sapiens
cttgtttaaaaaaagaaaaaa

SEQ ID NO: 5728469 - DNA, 18 bp, Homo sapiens
cttgtttaacatatatat

SEQ ID NO: 5728470 - DNA, 16 bp, Homo sapiens
cttgtttaatggtagt

SEQ ID NO: 5728471 - DNA, 16 bp, Homo sapiens
cttgtttaatgttaat

SEQ ID NO: 5728472 - DNA, 13 bp, Homo sapiens
cttgtttaattct

SEQ ID NO: 5728473 - DNA, 16 bp, Homo sapiens
cttgtttacatgctta

SEQ ID NO: 5728474 - DNA, 16 bp, Homo sapiens
cttgtttagagagcct

SEQ ID NO: 5728475 - DNA, 21 bp, Homo sapiens
cttgtttagagagcctgtcac

SEQ ID NO: 5728476 - DNA, 23 bp, Homo sapiens
cttgtttatagcaaaaatgtttt

SEQ ID NO: 5728477 - DNA, 16 bp, Homo sapiens
cttgtttattttgtgg

SEQ ID NO: 5728478 - DNA, 22 bp, Homo sapiens
cttgtttcactccaccatcact

SEQ ID NO: 5728479 - DNA, 15 bp, Homo sapiens
cttgtttccaggagc

SEQ ID NO: 5728480 - DNA, 18 bp, Homo sapiens
cttgtttccctgctggcc

SEQ ID NO: 5728481 - DNA, 14 bp, Homo sapiens
cttgtttcctgtgc

SEQ ID NO: 5728482 - DNA, 16 bp, Homo sapiens
cttgtttctatactgt

SEQ ID NO: 5728483 - DNA, 18 bp, Homo sapiens
cttgtttctatactgttt

SEQ ID NO: 5728484 - DNA, 14 bp, Homo sapiens
cttgtttctcaact

SEQ ID NO: 5728485 - DNA, 13 bp, Homo sapiens
cttgtttctgagt

SEQ ID NO: 5728486 - DNA, 15 bp, Homo sapiens
cttgtttctgagttt

SEQ ID NO: 5728487 - DNA, 12 bp, Homo sapiens
cttgtttctgca

SEQ ID NO: 5728488 - DNA, 20 bp, Homo sapiens
cttgtttctgggtccctgct

SEQ ID NO: 5728489 - DNA, 16 bp, Homo sapiens
cttgtttctgtttagt

SEQ ID NO: 5728490 - DNA, 16 bp, Homo sapiens
cttgtttcttgttcat

SEQ ID NO: 5728491 - DNA, 13 bp, Homo sapiens
cttgtttctttct

SEQ ID NO: 5728492 - DNA, 14 bp, Homo sapiens
cttgtttctttctg

SEQ ID NO: 5728493 - DNA, 22 bp, Homo sapiens
cttgtttgattttagctgcaga

SEQ ID NO: 5728494 - DNA, 13 bp, Homo sapiens
cttgtttgctatg

SEQ ID NO: 5728495 - DNA, 22 bp, Homo sapiens
cttgtttgctatgactacattt

SEQ ID NO: 5728496 - DNA, 19 bp, Homo sapiens
cttgtttgctcacctgggg

SEQ ID NO: 5728497 - DNA, 17 bp, Homo sapiens
cttgtttgcttcaactg

SEQ ID NO: 5728498 - DNA, 21 bp, Homo sapiens
cttgtttggtttggtttgctt

SEQ ID NO: 5728499 - DNA, 13 bp, Homo sapiens
cttgtttgtcagc

SEQ ID NO: 5728500 - DNA, 14 bp, Homo sapiens
cttgtttgtcagca

SEQ ID NO: 5728501 - DNA, 15 bp, Homo sapiens
cttgtttgtcagcat

SEQ ID NO: 5728502 - DNA, 17 bp, Homo sapiens
cttgtttgtcagcatct

SEQ ID NO: 5728503 - DNA, 21 bp, Homo sapiens
cttgtttgtcagcatctgacc

SEQ ID NO: 5728504 - DNA, 20 bp, Homo sapiens
cttgtttgtgcatcctgtga

SEQ ID NO: 5728505 - DNA, 22 bp, Homo sapiens
cttgtttgttactgtcattccc

SEQ ID NO: 5728506 - DNA, 13 bp, Homo sapiens
cttgtttgttgca

SEQ ID NO: 5728507 - DNA, 14 bp, Homo sapiens
cttgtttgttttct

SEQ ID NO: 5728508 - DNA, 12 bp, Homo sapiens
cttgttttaaga

SEQ ID NO: 5728509 - DNA, 21 bp, Homo sapiens
cttgttttaagattgtaattc

SEQ ID NO: 5728510 - DNA, 13 bp, Homo sapiens
cttgttttaagca

SEQ ID NO: 5728511 - DNA, 22 bp, Homo sapiens
cttgttttataaaattttgctt

SEQ ID NO: 5728512 - DNA, 15 bp, Homo sapiens
cttgttttattttgg

SEQ ID NO: 5728513 - DNA, 17 bp, Homo sapiens
cttgttttcagcccccc

SEQ ID NO: 5728514 - DNA, 17 bp, Homo sapiens
cttgttttctctgtgtg

SEQ ID NO: 5728515 - DNA, 17 bp, Homo sapiens
cttgttttcttgccaat

SEQ ID NO: 5728516 - DNA, 20 bp, Homo sapiens
cttgttttctttctttaaat

SEQ ID NO: 5728517 - DNA, 23 bp, Homo sapiens
cttgttttctttctttaaatgtt

SEQ ID NO: 5728518 - DNA, 18 bp, Homo sapiens
cttgttttgacttgaata

SEQ ID NO: 5728519 - DNA, 23 bp, Homo sapiens
cttgttttgacttgaataaagta

SEQ ID NO: 5728520 - DNA, 13 bp, Homo sapiens
cttgttttgcttc

SEQ ID NO: 5728521 - DNA, 14 bp, Homo sapiens
cttgttttggacag

SEQ ID NO: 5728522 - DNA, 19 bp, Homo sapiens
cttgttttgttatataaaa

SEQ ID NO: 5728523 - DNA, 13 bp, Homo sapiens
cttgttttgtttg

SEQ ID NO: 5728524 - DNA, 16 bp, Homo sapiens
cttgttttgtttgtct

SEQ ID NO: 5728525 - DNA, 18 bp, Homo sapiens
cttgttttgtttgtctct

SEQ ID NO: 5728526 - DNA, 14 bp, Homo sapiens
cttgtttttcttca

SEQ ID NO: 5728527 - DNA, 12 bp, Homo sapiens
cttgtttttgca

SEQ ID NO: 5728528 - DNA, 21 bp, Homo sapiens
cttgtttttgtaaagaaaaat

SEQ ID NO: 5728529 - DNA, 23 bp, Homo sapiens
cttgttttttgtttgtttgttgc

SEQ ID NO: 5728530 - DNA, 21 bp, Homo sapiens
cttgttttttttttccactta

SEQ ID NO: 5728531 - DNA, 20 bp, Homo sapiens
ctttaaaaaaaaaagttaca

SEQ ID NO: 5728532 - DNA, 19 bp, Homo sapiens
ctttaaaaaaaaatcttgt

SEQ ID NO: 5728533 - DNA, 21 bp, Homo sapiens
ctttaaaaaaaatagaagcta

SEQ ID NO: 5728534 - DNA, 20 bp, Homo sapiens
ctttaaaaaaaatccttcta

SEQ ID NO: 5728535 - DNA, 15 bp, Homo sapiens
ctttaaaaaaacaat

SEQ ID NO: 5728536 - DNA, 18 bp, Homo sapiens
ctttaaaaaaatttaagt

SEQ ID NO: 5728537 - DNA, 19 bp, Homo sapiens
ctttaaaaaaatttaagtg

SEQ ID NO: 5728538 - DNA, 13 bp, Homo sapiens
ctttaaaaaagaa

SEQ ID NO: 5728539 - DNA, 14 bp, Homo sapiens
ctttaaaaaagaaa

SEQ ID NO: 5728540 - DNA, 23 bp, Homo sapiens
ctttaaaaaagaaattatcttta

SEQ ID NO: 5728541 - DNA, 12 bp, Homo sapiens
ctttaaaaaagc

SEQ ID NO: 5728542 - DNA, 15 bp, Homo sapiens
ctttaaaaaattctc

SEQ ID NO: 5728543 - DNA, 13 bp, Homo sapiens
ctttaaaaagaaa

SEQ ID NO: 5728544 - DNA, 21 bp, Homo sapiens
ctttaaaaagaaaaaaaaaga

SEQ ID NO: 5728545 - DNA, 16 bp, Homo sapiens
ctttaaaaagcagtcc

SEQ ID NO: 5728546 - DNA, 12 bp, Homo sapiens
ctttaaaaagga

SEQ ID NO: 5728547 - DNA, 13 bp, Homo sapiens
ctttaaaaaggaa

SEQ ID NO: 5728548 - DNA, 14 bp, Homo sapiens
ctttaaaaaggaaa

SEQ ID NO: 5728549 - DNA, 20 bp, Homo sapiens
ctttaaaaaggaaatttgtt

SEQ ID NO: 5728550 - DNA, 21 bp, Homo sapiens
ctttaaaaaggaaatttgttt

SEQ ID NO: 5728551 - DNA, 21 bp, Homo sapiens
ctttaaaaatgcaatatctga

SEQ ID NO: 5728552 - DNA, 21 bp, Homo sapiens
ctttaaaaattattatatatt

SEQ ID NO: 5728553 - DNA, 22 bp, Homo sapiens
ctttaaaaattattatatattt

SEQ ID NO: 5728554 - DNA, 23 bp, Homo sapiens
ctttaaaaattattatatattta

SEQ ID NO: 5728555 - DNA, 15 bp, Homo sapiens
ctttaaaaatttact

SEQ ID NO: 5728556 - DNA, 14 bp, Homo sapiens
ctttaaaacaaaac

SEQ ID NO: 5728557 - DNA, 17 bp, Homo sapiens
ctttaaaacaaaacaaa

SEQ ID NO: 5728558 - DNA, 12 bp, Homo sapiens
ctttaaaacaag

SEQ ID NO: 5728559 - DNA, 15 bp, Homo sapiens
ctttaaaacaagtgt

SEQ ID NO: 5728560 - DNA, 16 bp, Homo sapiens
ctttaaaaccacagct

SEQ ID NO: 5728561 - DNA, 17 bp, Homo sapiens
ctttaaaaccacagctg

SEQ ID NO: 5728562 - DNA, 16 bp, Homo sapiens
ctttaaaaccagttac

SEQ ID NO: 5728563 - DNA, 17 bp, Homo sapiens
ctttaaaacgcgtctgc

SEQ ID NO: 5728564 - DNA, 20 bp, Homo sapiens
ctttaaaacgcgtctgcctg

SEQ ID NO: 5728565 - DNA, 22 bp, Homo sapiens
ctttaaaacgcgtctgcctggg

SEQ ID NO: 5728566 - DNA, 16 bp, Homo sapiens
ctttaaaacttactat

SEQ ID NO: 5728567 - DNA, 12 bp, Homo sapiens
ctttaaaagaat

SEQ ID NO: 5728568 - DNA, 21 bp, Homo sapiens
ctttaaaagagagagagagaa

SEQ ID NO: 5728569 - DNA, 18 bp, Homo sapiens
ctttaaaagatgctttta

SEQ ID NO: 5728570 - DNA, 22 bp, Homo sapiens
ctttaaaagcattttttaacct

SEQ ID NO: 5728571 - DNA, 12 bp, Homo sapiens
ctttaaaaggat

SEQ ID NO: 5728572 - DNA, 15 bp, Homo sapiens
ctttaaaaggattaa

SEQ ID NO: 5728573 - DNA, 17 bp, Homo sapiens
ctttaaaagtatcttta

SEQ ID NO: 5728574 - DNA, 20 bp, Homo sapiens
ctttaaaagtatctttaaca

SEQ ID NO: 5728575 - DNA, 21 bp, Homo sapiens
ctttaaaataaaaaagcaaaa

SEQ ID NO: 5728576 - DNA, 17 bp, Homo sapiens
ctttaaaatatctacat

SEQ ID NO: 5728577 - DNA, 14 bp, Homo sapiens
ctttaaaatattgt

SEQ ID NO: 5728578 - DNA, 23 bp, Homo sapiens
ctttaaaatgattcacttttatt

SEQ ID NO: 5728579 - DNA, 21 bp, Homo sapiens
ctttaaaatgcgaaattattg

SEQ ID NO: 5728580 - DNA, 22 bp, Homo sapiens
ctttaaaatgcgaaattattgg

SEQ ID NO: 5728581 - DNA, 19 bp, Homo sapiens
ctttaaaattacaactaag

SEQ ID NO: 5728582 - DNA, 23 bp, Homo sapiens
ctttaaaatttttttagaaagca

SEQ ID NO: 5728583 - DNA, 15 bp, Homo sapiens
ctttaaacaccccca

SEQ ID NO: 5728584 - DNA, 18 bp, Homo sapiens
ctttaaacagtatttcat

SEQ ID NO: 5728585 - DNA, 18 bp, Homo sapiens
ctttaaacatctagcagt

SEQ ID NO: 5728586 - DNA, 23 bp, Homo sapiens
ctttaaacctgtttttttttcat

SEQ ID NO: 5728587 - DNA, 18 bp, Homo sapiens
ctttaaactactgaactg

SEQ ID NO: 5728588 - DNA, 17 bp, Homo sapiens
ctttaaactataggtaa

SEQ ID NO: 5728589 - DNA, 23 bp, Homo sapiens
ctttaaactatgttcctaacaaa

SEQ ID NO: 5728590 - DNA, 18 bp, Homo sapiens
ctttaaagacttaagatt

SEQ ID NO: 5728591 - DNA, 22 bp, Homo sapiens
ctttaaagaggctgtgtggcca

SEQ ID NO: 5728592 - DNA, 23 bp, Homo sapiens
ctttaaagaggctgtgtggccaa

SEQ ID NO: 5728593 - DNA, 21 bp, Homo sapiens
ctttaaagagtcctccttccc

SEQ ID NO: 5728594 - DNA, 21 bp, Homo sapiens
ctttaaagataagtctacatt

SEQ ID NO: 5728595 - DNA, 14 bp, Homo sapiens
ctttaaagctcagg

SEQ ID NO: 5728596 - DNA, 18 bp, Homo sapiens
ctttaaaggaaaaaatgt

SEQ ID NO: 5728597 - DNA, 19 bp, Homo sapiens
ctttaaaggcccagcccct

SEQ ID NO: 5728598 - DNA, 20 bp, Homo sapiens
ctttaaaggcccagccccta

SEQ ID NO: 5728599 - DNA, 19 bp, Homo sapiens
ctttaaagggcctgcctgg

SEQ ID NO: 5728600 - DNA, 21 bp, Homo sapiens
ctttaaaggtcgcacctcctt

SEQ ID NO: 5728601 - DNA, 17 bp, Homo sapiens
ctttaaagtaaaggcct

SEQ ID NO: 5728602 - DNA, 17 bp, Homo sapiens
ctttaaataaattaaga

SEQ ID NO: 5728603 - DNA, 12 bp, Homo sapiens
ctttaaataata

SEQ ID NO: 5728604 - DNA, 13 bp, Homo sapiens
ctttaaataataa

SEQ ID NO: 5728605 - DNA, 15 bp, Homo sapiens
ctttaaataatttaa

SEQ ID NO: 5728606 - DNA, 17 bp, Homo sapiens
ctttaaataatttaact

SEQ ID NO: 5728607 - DNA, 20 bp, Homo sapiens
ctttaaatactccctttttg

SEQ ID NO: 5728608 - DNA, 19 bp, Homo sapiens
ctttaaatagatacaaatg

SEQ ID NO: 5728609 - DNA, 21 bp, Homo sapiens
ctttaaatagtttacttcact

SEQ ID NO: 5728610 - DNA, 13 bp, Homo sapiens
ctttaaatatcat

SEQ ID NO: 5728611 - DNA, 18 bp, Homo sapiens
ctttaaatcaaaagctgc

SEQ ID NO: 5728612 - DNA, 22 bp, Homo sapiens
ctttaaatcatttttatattat

SEQ ID NO: 5728613 - DNA, 20 bp, Homo sapiens
ctttaaatccttaatggcct

SEQ ID NO: 5728614 - DNA, 17 bp, Homo sapiens
ctttaaatcttaagcaa

SEQ ID NO: 5728615 - DNA, 19 bp, Homo sapiens
ctttaaatgacagtaatat

SEQ ID NO: 5728616 - DNA, 20 bp, Homo sapiens
ctttaaatgacagtaatatt

SEQ ID NO: 5728617 - DNA, 14 bp, Homo sapiens
ctttaaatgctgct

SEQ ID NO: 5728618 - DNA, 14 bp, Homo sapiens
ctttaaatggaaac

SEQ ID NO: 5728619 - DNA, 17 bp, Homo sapiens
ctttaaatgtgtatttc

SEQ ID NO: 5728620 - DNA, 11 bp, Homo sapiens
ctttaaatgtt

SEQ ID NO: 5728621 - DNA, 14 bp, Homo sapiens
ctttaaattaaaat

SEQ ID NO: 5728622 - DNA, 22 bp, Homo sapiens
ctttaaattaaaattttatgac

SEQ ID NO: 5728623 - DNA, 12 bp, Homo sapiens
ctttaaattata

SEQ ID NO: 5728624 - DNA, 21 bp, Homo sapiens
ctttaaattatatgatatgca

SEQ ID NO: 5728625 - DNA, 23 bp, Homo sapiens
ctttaaattatatgatatgcatg

SEQ ID NO: 5728626 - DNA, 13 bp, Homo sapiens
ctttaaattctcc

SEQ ID NO: 5728627 - DNA, 16 bp, Homo sapiens
ctttaaattgtggatg

SEQ ID NO: 5728628 - DNA, 17 bp, Homo sapiens
ctttaaatttaggtaaa

SEQ ID NO: 5728629 - DNA, 13 bp, Homo sapiens
ctttaaatttcag

SEQ ID NO: 5728630 - DNA, 15 bp, Homo sapiens
ctttaaattttttaa

SEQ ID NO: 5728631 - DNA, 17 bp, Homo sapiens
ctttaaattttttaaaa

SEQ ID NO: 5728632 - DNA, 19 bp, Homo sapiens
ctttaacaaaacaagaaag

SEQ ID NO: 5728633 - DNA, 19 bp, Homo sapiens
ctttaacaattgtcttaaa

SEQ ID NO: 5728634 - DNA, 20 bp, Homo sapiens
ctttaacacagacccctagg

SEQ ID NO: 5728635 - DNA, 17 bp, Homo sapiens
ctttaacagcttacact

SEQ ID NO: 5728636 - DNA, 15 bp, Homo sapiens
ctttaacagtaatgt

SEQ ID NO: 5728637 - DNA, 19 bp, Homo sapiens
ctttaacagtaatgttctt

SEQ ID NO: 5728638 - DNA, 13 bp, Homo sapiens
ctttaacatcctt

SEQ ID NO: 5728639 - DNA, 23 bp, Homo sapiens
ctttaaccactcctcaggaacag

SEQ ID NO: 5728640 - DNA, 19 bp, Homo sapiens
ctttaaccctcactgggac

SEQ ID NO: 5728641 - DNA, 14 bp, Homo sapiens
ctttaaccctttct

SEQ ID NO: 5728642 - DNA, 18 bp, Homo sapiens
ctttaaccgtttttcaag

SEQ ID NO: 5728643 - DNA, 23 bp, Homo sapiens
ctttaaccgtttttcaagaaaac

SEQ ID NO: 5728644 - DNA, 16 bp, Homo sapiens
ctttaacctgaacctt

SEQ ID NO: 5728645 - DNA, 15 bp, Homo sapiens
ctttaaccttgtata

SEQ ID NO: 5728646 - DNA, 17 bp, Homo sapiens
ctttaaccttgtataaa

SEQ ID NO: 5728647 - DNA, 18 bp, Homo sapiens
ctttaaccttgtataaat

SEQ ID NO: 5728648 - DNA, 22 bp, Homo sapiens
ctttaactatcttctctatatt

SEQ ID NO: 5728649 - DNA, 19 bp, Homo sapiens
ctttaactcaggactccag

SEQ ID NO: 5728650 - DNA, 22 bp, Homo sapiens
ctttaactcccattaccatgta

SEQ ID NO: 5728651 - DNA, 18 bp, Homo sapiens
ctttaactcgttgcagtc

SEQ ID NO: 5728652 - DNA, 19 bp, Homo sapiens
ctttaactcgttgcagtct

SEQ ID NO: 5728653 - DNA, 17 bp, Homo sapiens
ctttaactctgcggata

SEQ ID NO: 5728654 - DNA, 13 bp, Homo sapiens
ctttaactgtcat

SEQ ID NO: 5728655 - DNA, 22 bp, Homo sapiens
ctttaactgtgtgaccagcgga

SEQ ID NO: 5728656 - DNA, 18 bp, Homo sapiens
ctttaacttctgttttac

SEQ ID NO: 5728657 - DNA, 11 bp, Homo sapiens
ctttaagaaaa

SEQ ID NO: 5728658 - DNA, 12 bp, Homo sapiens
ctttaagaaaaa

SEQ ID NO: 5728659 - DNA, 20 bp, Homo sapiens
ctttaagaaccttattttga

SEQ ID NO: 5728660 - DNA, 20 bp, Homo sapiens
ctttaagaagcgaacaaaaa

SEQ ID NO: 5728661 - DNA, 18 bp, Homo sapiens
ctttaagaatctatttcc

SEQ ID NO: 5728662 - DNA, 14 bp, Homo sapiens
ctttaagacatact

SEQ ID NO: 5728663 - DNA, 15 bp, Homo sapiens
ctttaagactgagca

SEQ ID NO: 5728664 - DNA, 15 bp, Homo sapiens
ctttaagagagaaat

SEQ ID NO: 5728665 - DNA, 15 bp, Homo sapiens
ctttaagagtttaaa

SEQ ID NO: 5728666 - DNA, 23 bp, Homo sapiens
ctttaagcaaggtgtccctgcct

SEQ ID NO: 5728667 - DNA, 19 bp, Homo sapiens
ctttaagcactacataaac

SEQ ID NO: 5728668 - DNA, 15 bp, Homo sapiens
ctttaagcagagaag

SEQ ID NO: 5728669 - DNA, 14 bp, Homo sapiens
ctttaagccaaaga

SEQ ID NO: 5728670 - DNA, 16 bp, Homo sapiens
ctttaagccaaagaaa

SEQ ID NO: 5728671 - DNA, 18 bp, Homo sapiens
ctttaagccaaagaaaca

SEQ ID NO: 5728672 - DNA, 19 bp, Homo sapiens
ctttaagcctgcattctta

SEQ ID NO: 5728673 - DNA, 17 bp, Homo sapiens
ctttaagccttcaaaac

SEQ ID NO: 5728674 - DNA, 13 bp, Homo sapiens
ctttaagctcctt

SEQ ID NO: 5728675 - DNA, 17 bp, Homo sapiens
ctttaagggcatgcctt

SEQ ID NO: 5728676 - DNA, 22 bp, Homo sapiens
ctttaagggcatgccttgtgct

SEQ ID NO: 5728677 - DNA, 13 bp, Homo sapiens
ctttaaggtcaaa

SEQ ID NO: 5728678 - DNA, 20 bp, Homo sapiens
ctttaagtgcctacattatc

SEQ ID NO: 5728679 - DNA, 21 bp, Homo sapiens
ctttaagttaaatatgtagat

SEQ ID NO: 5728680 - DNA, 14 bp, Homo sapiens
ctttaataaaacaa

SEQ ID NO: 5728681 - DNA, 20 bp, Homo sapiens
ctttaataacaaggagattt

SEQ ID NO: 5728682 - DNA, 22 bp, Homo sapiens
ctttaataacaaggagatttct

SEQ ID NO: 5728683 - DNA, 19 bp, Homo sapiens
ctttaataagtcattgaaa

SEQ ID NO: 5728684 - DNA, 17 bp, Homo sapiens
ctttaatacaaaaagca

SEQ ID NO: 5728685 - DNA, 17 bp, Homo sapiens
ctttaatagtttctgat

SEQ ID NO: 5728686 - DNA, 16 bp, Homo sapiens
ctttaatataaatgca

SEQ ID NO: 5728687 - DNA, 18 bp, Homo sapiens
ctttaatataaatgcaaa

SEQ ID NO: 5728688 - DNA, 19 bp, Homo sapiens
ctttaatatactccttaaa

SEQ ID NO: 5728689 - DNA, 17 bp, Homo sapiens
ctttaatatgaaatttt

SEQ ID NO: 5728690 - DNA, 14 bp, Homo sapiens
ctttaatatgtatt

SEQ ID NO: 5728691 - DNA, 21 bp, Homo sapiens
ctttaatatgtattttatgta

SEQ ID NO: 5728692 - DNA, 18 bp, Homo sapiens
ctttaatatttccaatgt

SEQ ID NO: 5728693 - DNA, 14 bp, Homo sapiens
ctttaatattttgt

SEQ ID NO: 5728694 - DNA, 20 bp, Homo sapiens
ctttaatattttgtaatatt

SEQ ID NO: 5728695 - DNA, 19 bp, Homo sapiens
ctttaatcaggtcctgctc

SEQ ID NO: 5728696 - DNA, 20 bp, Homo sapiens
ctttaatcccggtttcagaa

SEQ ID NO: 5728697 - DNA, 17 bp, Homo sapiens
ctttaatcttcagtttt

SEQ ID NO: 5728698 - DNA, 15 bp, Homo sapiens
ctttaatgagaaaaa

SEQ ID NO: 5728699 - DNA, 19 bp, Homo sapiens
ctttaatgagaatagaaac

SEQ ID NO: 5728700 - DNA, 22 bp, Homo sapiens
ctttaatgagaatagaaacgta

SEQ ID NO: 5728701 - DNA, 22 bp, Homo sapiens
ctttaatgagtgcacctgcctc

SEQ ID NO: 5728702 - DNA, 15 bp, Homo sapiens
ctttaatgataaaat

SEQ ID NO: 5728703 - DNA, 13 bp, Homo sapiens
ctttaatgcatct

SEQ ID NO: 5728704 - DNA, 14 bp, Homo sapiens
ctttaatgctgtct

SEQ ID NO: 5728705 - DNA, 18 bp, Homo sapiens
ctttaatgctgtctttgt

SEQ ID NO: 5728706 - DNA, 22 bp, Homo sapiens
ctttaatgttttaactcttttg

SEQ ID NO: 5728707 - DNA, 13 bp, Homo sapiens
ctttaatgttttt

SEQ ID NO: 5728708 - DNA, 17 bp, Homo sapiens
ctttaatgttttttgcc

SEQ ID NO: 5728709 - DNA, 23 bp, Homo sapiens
ctttaatgttttttgccacagct

SEQ ID NO: 5728710 - DNA, 19 bp, Homo sapiens
ctttaattaagctctcata

SEQ ID NO: 5728711 - DNA, 17 bp, Homo sapiens
ctttaattactggaatt

SEQ ID NO: 5728712 - DNA, 15 bp, Homo sapiens
ctttaattccatgaa

SEQ ID NO: 5728713 - DNA, 18 bp, Homo sapiens
ctttaattctgtatctgt

SEQ ID NO: 5728714 - DNA, 18 bp, Homo sapiens
ctttaattgaagaactgc

SEQ ID NO: 5728715 - DNA, 14 bp, Homo sapiens
ctttaattgtataa

SEQ ID NO: 5728716 - DNA, 14 bp, Homo sapiens
ctttaattgtgaat

SEQ ID NO: 5728717 - DNA, 22 bp, Homo sapiens
ctttaattgtgaattgataata

SEQ ID NO: 5728718 - DNA, 23 bp, Homo sapiens
ctttaattgttaagatatgatgt

SEQ ID NO: 5728719 - DNA, 15 bp, Homo sapiens
ctttaattgttgctt

SEQ ID NO: 5728720 - DNA, 15 bp, Homo sapiens
ctttaatttatgtaa

SEQ ID NO: 5728721 - DNA, 18 bp, Homo sapiens
ctttaatttctgtcagaa

SEQ ID NO: 5728722 - DNA, 13 bp, Homo sapiens
ctttaattttagc

SEQ ID NO: 5728723 - DNA, 14 bp, Homo sapiens
ctttaattttggaa

SEQ ID NO: 5728724 - DNA, 17 bp, Homo sapiens
ctttaatttttataaat

SEQ ID NO: 5728725 - DNA, 20 bp, Homo sapiens
ctttacaaaagaaatacctt

SEQ ID NO: 5728726 - DNA, 16 bp, Homo sapiens
ctttacaaaatgaatg

SEQ ID NO: 5728727 - DNA, 19 bp, Homo sapiens
ctttacaaaatgaatgcat

SEQ ID NO: 5728728 - DNA, 22 bp, Homo sapiens
ctttacaaaatgaatgcattgg

SEQ ID NO: 5728729 - DNA, 20 bp, Homo sapiens
ctttacaaactgaagataat

SEQ ID NO: 5728730 - DNA, 12 bp, Homo sapiens
ctttacaaataa

SEQ ID NO: 5728731 - DNA, 19 bp, Homo sapiens
ctttacaaccatactttat

SEQ ID NO: 5728732 - DNA, 21 bp, Homo sapiens
ctttacaaccatactttatat

SEQ ID NO: 5728733 - DNA, 15 bp, Homo sapiens
ctttacaatgtgaat

SEQ ID NO: 5728734 - DNA, 15 bp, Homo sapiens
ctttacacaagaatc

SEQ ID NO: 5728735 - DNA, 20 bp, Homo sapiens
ctttacagctctcctccagc

SEQ ID NO: 5728736 - DNA, 23 bp, Homo sapiens
ctttacaggaaaaaaaattctgt

SEQ ID NO: 5728737 - DNA, 16 bp, Homo sapiens
ctttacaggatcatgt

SEQ ID NO: 5728738 - DNA, 22 bp, Homo sapiens
ctttacaggatcatgtaaatgc

SEQ ID NO: 5728739 - DNA, 21 bp, Homo sapiens
ctttacaggtatttataatat

SEQ ID NO: 5728740 - DNA, 18 bp, Homo sapiens
ctttacagttctggagga

SEQ ID NO: 5728741 - DNA, 21 bp, Homo sapiens
ctttacagttctggaggagga

SEQ ID NO: 5728742 - DNA, 21 bp, Homo sapiens
ctttacagtttttttctttgt

SEQ ID NO: 5728743 - DNA, 17 bp, Homo sapiens
ctttacatatgctttaa

SEQ ID NO: 5728744 - DNA, 17 bp, Homo sapiens
ctttacatgacacagct

SEQ ID NO: 5728745 - DNA, 17 bp, Homo sapiens
ctttacatgcaatttat

SEQ ID NO: 5728746 - DNA, 19 bp, Homo sapiens
ctttacatgcaatttatta

SEQ ID NO: 5728747 - DNA, 16 bp, Homo sapiens
ctttacatgctgtgct

SEQ ID NO: 5728748 - DNA, 21 bp, Homo sapiens
ctttacatggtggtgatgtcc

SEQ ID NO: 5728749 - DNA, 21 bp, Homo sapiens
ctttacatttgataaactaaa

SEQ ID NO: 5728750 - DNA, 14 bp, Homo sapiens
ctttacattttatt

SEQ ID NO: 5728751 - DNA, 22 bp, Homo sapiens
ctttacattttatttattagct

SEQ ID NO: 5728752 - DNA, 13 bp, Homo sapiens
ctttaccaaaaac

SEQ ID NO: 5728753 - DNA, 20 bp, Homo sapiens
ctttaccaaaaaccatgttg

SEQ ID NO: 5728754 - DNA, 23 bp, Homo sapiens
ctttaccaaaaccatccatccct

SEQ ID NO: 5728755 - DNA, 18 bp, Homo sapiens
ctttaccaattgaagtaa

SEQ ID NO: 5728756 - DNA, 19 bp, Homo sapiens
ctttaccactgtggttttg

SEQ ID NO: 5728757 - DNA, 14 bp, Homo sapiens
ctttaccataaagc

SEQ ID NO: 5728758 - DNA, 18 bp, Homo sapiens
ctttaccataaagccttt

SEQ ID NO: 5728759 - DNA, 21 bp, Homo sapiens
ctttaccataaagcctttaaa

SEQ ID NO: 5728760 - DNA, 18 bp, Homo sapiens
ctttacccacctagaaca

SEQ ID NO: 5728761 - DNA, 19 bp, Homo sapiens
ctttacccacctagaacac

SEQ ID NO: 5728762 - DNA, 16 bp, Homo sapiens
ctttacccatttgggt

SEQ ID NO: 5728763 - DNA, 17 bp, Homo sapiens
ctttaccccatccctgt

SEQ ID NO: 5728764 - DNA, 20 bp, Homo sapiens
ctttacccctcatccaaagt

SEQ ID NO: 5728765 - DNA, 20 bp, Homo sapiens
ctttaccctcatctgtctgg

SEQ ID NO: 5728766 - DNA, 16 bp, Homo sapiens
ctttaccctccacaca

SEQ ID NO: 5728767 - DNA, 18 bp, Homo sapiens
ctttacctaccaccttcc

SEQ ID NO: 5728768 - DNA, 16 bp, Homo sapiens
ctttacctctctgtca

SEQ ID NO: 5728769 - DNA, 17 bp, Homo sapiens
ctttacctgcaggctcc

SEQ ID NO: 5728770 - DNA, 14 bp, Homo sapiens
ctttacctgtatac

SEQ ID NO: 5728771 - DNA, 16 bp, Homo sapiens
ctttaccttcatttca

SEQ ID NO: 5728772 - DNA, 17 bp, Homo sapiens
ctttaccttcatttcat

SEQ ID NO: 5728773 - DNA, 15 bp, Homo sapiens
ctttaccttctaaaa

SEQ ID NO: 5728774 - DNA, 14 bp, Homo sapiens
ctttacctttgccc

SEQ ID NO: 5728775 - DNA, 19 bp, Homo sapiens
ctttacctttttgtatgtg

SEQ ID NO: 5728776 - DNA, 20 bp, Homo sapiens
ctttacctttttgtatgtga

SEQ ID NO: 5728777 - DNA, 18 bp, Homo sapiens
ctttacgctcatcaccta

SEQ ID NO: 5728778 - DNA, 15 bp, Homo sapiens
ctttacgctgtctgt

SEQ ID NO: 5728779 - DNA, 13 bp, Homo sapiens
ctttacgtactgt

SEQ ID NO: 5728780 - DNA, 18 bp, Homo sapiens
ctttacgtactgtaactg

SEQ ID NO: 5728781 - DNA, 14 bp, Homo sapiens
ctttacgtagtgta

SEQ ID NO: 5728782 - DNA, 20 bp, Homo sapiens
ctttacgttcatcacctgct

SEQ ID NO: 5728783 - DNA, 16 bp, Homo sapiens
ctttactaacactggc

SEQ ID NO: 5728784 - DNA, 19 bp, Homo sapiens
ctttactaactctggttta

SEQ ID NO: 5728785 - DNA, 22 bp, Homo sapiens
ctttactaagatgacattgcta

SEQ ID NO: 5728786 - DNA, 12 bp, Homo sapiens
ctttactactgt

SEQ ID NO: 5728787 - DNA, 19 bp, Homo sapiens
ctttactactgtggaaaga

SEQ ID NO: 5728788 - DNA, 16 bp, Homo sapiens
ctttactagtgccaaa

SEQ ID NO: 5728789 - DNA, 18 bp, Homo sapiens
ctttactatgtttctcag

SEQ ID NO: 5728790 - DNA, 15 bp, Homo sapiens
ctttactattaaaat

SEQ ID NO: 5728791 - DNA, 22 bp, Homo sapiens
ctttactattaaaatattttgg

SEQ ID NO: 5728792 - DNA, 15 bp, Homo sapiens
ctttactcagcccag

SEQ ID NO: 5728793 - DNA, 22 bp, Homo sapiens
ctttactcagcccagctggcca

SEQ ID NO: 5728794 - DNA, 23 bp, Homo sapiens
ctttactcagcccagctggccac

SEQ ID NO: 5728795 - DNA, 13 bp, Homo sapiens
ctttactcccaag

SEQ ID NO: 5728796 - DNA, 22 bp, Homo sapiens
ctttactcccaagacttcattg

SEQ ID NO: 5728797 - DNA, 17 bp, Homo sapiens
ctttactcctcacactt

SEQ ID NO: 5728798 - DNA, 14 bp, Homo sapiens
ctttactcctggct

SEQ ID NO: 5728799 - DNA, 15 bp, Homo sapiens
ctttactcgtgcatt

SEQ ID NO: 5728800 - DNA, 14 bp, Homo sapiens
ctttactctgctct

SEQ ID NO: 5728801 - DNA, 14 bp, Homo sapiens
ctttactctgggca

SEQ ID NO: 5728802 - DNA, 17 bp, Homo sapiens
ctttactctgtgtttaa

SEQ ID NO: 5728803 - DNA, 19 bp, Homo sapiens
ctttactgaccctggggct

SEQ ID NO: 5728804 - DNA, 13 bp, Homo sapiens
ctttactgcctga

SEQ ID NO: 5728805 - DNA, 23 bp, Homo sapiens
ctttactgcctgaataaagagcc

SEQ ID NO: 5728806 - DNA, 18 bp, Homo sapiens
ctttactggacctgaaat

SEQ ID NO: 5728807 - DNA, 23 bp, Homo sapiens
ctttactggacctgaaatttaaa

SEQ ID NO: 5728808 - DNA, 10 bp, Homo sapiens
ctttactgta

SEQ ID NO: 5728809 - DNA, 21 bp, Homo sapiens
ctttactgtaatataaagtat

SEQ ID NO: 5728810 - DNA, 14 bp, Homo sapiens
ctttactgtgctta

SEQ ID NO: 5728811 - DNA, 14 bp, Homo sapiens
ctttacttagctta

SEQ ID NO: 5728812 - DNA, 14 bp, Homo sapiens
ctttacttatctct

SEQ ID NO: 5728813 - DNA, 17 bp, Homo sapiens
ctttacttcccagtata

SEQ ID NO: 5728814 - DNA, 15 bp, Homo sapiens
ctttacttcctttct

SEQ ID NO: 5728815 - DNA, 17 bp, Homo sapiens
ctttacttcctttctta

SEQ ID NO: 5728816 - DNA, 23 bp, Homo sapiens
ctttacttgtggtgtgaccatgt

SEQ ID NO: 5728817 - DNA, 17 bp, Homo sapiens
ctttactttagaagcac

SEQ ID NO: 5728818 - DNA, 18 bp, Homo sapiens
ctttactttagaagcaca

SEQ ID NO: 5728819 - DNA, 12 bp, Homo sapiens
ctttactttcag

SEQ ID NO: 5728820 - DNA, 13 bp, Homo sapiens
ctttactttccct

SEQ ID NO: 5728821 - DNA, 23 bp, Homo sapiens
ctttactttcccttgcttttccc

SEQ ID NO: 5728822 - DNA, 21 bp, Homo sapiens
ctttactttgtggatatattt

SEQ ID NO: 5728823 - DNA, 20 bp, Homo sapiens
ctttagaaacacataattaa

SEQ ID NO: 5728824 - DNA, 14 bp, Homo sapiens
ctttagaaacagtg

SEQ ID NO: 5728825 - DNA, 23 bp, Homo sapiens
ctttagaaacagtgcaacactgg

SEQ ID NO: 5728826 - DNA, 20 bp, Homo sapiens
ctttagaaaggttttgagca

SEQ ID NO: 5728827 - DNA, 23 bp, Homo sapiens
ctttagaaataaaccttaatatt

SEQ ID NO: 5728828 - DNA, 16 bp, Homo sapiens
ctttagaaataaatgt

SEQ ID NO: 5728829 - DNA, 14 bp, Homo sapiens
ctttagaacaacat

SEQ ID NO: 5728830 - DNA, 16 bp, Homo sapiens
ctttagaacaacataa

SEQ ID NO: 5728831 - DNA, 13 bp, Homo sapiens
ctttagaacagga

SEQ ID NO: 5728832 - DNA, 17 bp, Homo sapiens
ctttagaacaggagact

SEQ ID NO: 5728833 - DNA, 14 bp, Homo sapiens
ctttagaagcctgc

SEQ ID NO: 5728834 - DNA, 19 bp, Homo sapiens
ctttagaagtgcatttctg

SEQ ID NO: 5728835 - DNA, 12 bp, Homo sapiens
ctttagaataat

SEQ ID NO: 5728836 - DNA, 22 bp, Homo sapiens
ctttagaatagttaaattggct

SEQ ID NO: 5728837 - DNA, 14 bp, Homo sapiens
ctttagaatatctt

SEQ ID NO: 5728838 - DNA, 16 bp, Homo sapiens
ctttagaatattaaaa

SEQ ID NO: 5728839 - DNA, 15 bp, Homo sapiens
ctttagaatcccagc

SEQ ID NO: 5728840 - DNA, 18 bp, Homo sapiens
ctttagaatcccagcccc

SEQ ID NO: 5728841 - DNA, 21 bp, Homo sapiens
ctttagaatcccagccccctg

SEQ ID NO: 5728842 - DNA, 23 bp, Homo sapiens
ctttagaatcccagccccctgac

SEQ ID NO: 5728843 - DNA, 19 bp, Homo sapiens
ctttagaatcgctttcctt

SEQ ID NO: 5728844 - DNA, 22 bp, Homo sapiens
ctttagaatcgctttccttcct

SEQ ID NO: 5728845 - DNA, 20 bp, Homo sapiens
ctttagaattaatttattaa

SEQ ID NO: 5728846 - DNA, 12 bp, Homo sapiens
ctttagaattta

SEQ ID NO: 5728847 - DNA, 18 bp, Homo sapiens
ctttagacacacaaaaca

SEQ ID NO: 5728848 - DNA, 12 bp, Homo sapiens
ctttagacttga

SEQ ID NO: 5728849 - DNA, 21 bp, Homo sapiens
ctttagacttgaaaagagaca

SEQ ID NO: 5728850 - DNA, 13 bp, Homo sapiens
ctttagagaactg

SEQ ID NO: 5728851 - DNA, 15 bp, Homo sapiens
ctttagagaactgaa

SEQ ID NO: 5728852 - DNA, 16 bp, Homo sapiens
ctttagagaactgaaa

SEQ ID NO: 5728853 - DNA, 17 bp, Homo sapiens
ctttagagaactgaaaa

SEQ ID NO: 5728854 - DNA, 15 bp, Homo sapiens
ctttagagaagccat

SEQ ID NO: 5728855 - DNA, 17 bp, Homo sapiens
ctttagagaagccataa

SEQ ID NO: 5728856 - DNA, 13 bp, Homo sapiens
ctttagagacagg

SEQ ID NO: 5728857 - DNA, 14 bp, Homo sapiens
ctttagagacaggg

SEQ ID NO: 5728858 - DNA, 15 bp, Homo sapiens
ctttagagataattg

SEQ ID NO: 5728859 - DNA, 17 bp, Homo sapiens
ctttagagcaacagtaa

SEQ ID NO: 5728860 - DNA, 17 bp, Homo sapiens
ctttagagcattgccat

SEQ ID NO: 5728861 - DNA, 18 bp, Homo sapiens
ctttagagcattgccatt

SEQ ID NO: 5728862 - DNA, 13 bp, Homo sapiens
ctttagagtagca

SEQ ID NO: 5728863 - DNA, 20 bp, Homo sapiens
ctttagagttagactgttgg

SEQ ID NO: 5728864 - DNA, 15 bp, Homo sapiens
ctttagatagccctg

SEQ ID NO: 5728865 - DNA, 16 bp, Homo sapiens
ctttagatatttacat

SEQ ID NO: 5728866 - DNA, 15 bp, Homo sapiens
ctttagatatttgcc

SEQ ID NO: 5728867 - DNA, 16 bp, Homo sapiens
ctttagatatttgcct

SEQ ID NO: 5728868 - DNA, 15 bp, Homo sapiens
ctttagatctctgaa

SEQ ID NO: 5728869 - DNA, 12 bp, Homo sapiens
ctttagatgcta

SEQ ID NO: 5728870 - DNA, 14 bp, Homo sapiens
ctttagatgctgat

SEQ ID NO: 5728871 - DNA, 22 bp, Homo sapiens
ctttagatggtggcacattcct

SEQ ID NO: 5728872 - DNA, 20 bp, Homo sapiens
ctttagatgttttgggatca

SEQ ID NO: 5728873 - DNA, 13 bp, Homo sapiens
ctttagattgaaa

SEQ ID NO: 5728874 - DNA, 15 bp, Homo sapiens
ctttagattgaaatt

SEQ ID NO: 5728875 - DNA, 16 bp, Homo sapiens
ctttagattgaaattt

SEQ ID NO: 5728876 - DNA, 17 bp, Homo sapiens
ctttagattgaaattta

SEQ ID NO: 5728877 - DNA, 22 bp, Homo sapiens
ctttagattgaaatttatgact

SEQ ID NO: 5728878 - DNA, 23 bp, Homo sapiens
ctttagcaaaaaaaacccatgtg

SEQ ID NO: 5728879 - DNA, 20 bp, Homo sapiens
ctttagcacgtttaaagttc

SEQ ID NO: 5728880 - DNA, 23 bp, Homo sapiens
ctttagcacgtttaaagttctgt

SEQ ID NO: 5728881 - DNA, 17 bp, Homo sapiens
ctttagcagtttcctca

SEQ ID NO: 5728882 - DNA, 22 bp, Homo sapiens
ctttagcagtttcctcagtgat

SEQ ID NO: 5728883 - DNA, 23 bp, Homo sapiens
ctttagcatttttatgcagacag

SEQ ID NO: 5728884 - DNA, 14 bp, Homo sapiens
ctttagccagaatc

SEQ ID NO: 5728885 - DNA, 17 bp, Homo sapiens
ctttagccatcataact

SEQ ID NO: 5728886 - DNA, 18 bp, Homo sapiens
ctttagcccctcccaagc

SEQ ID NO: 5728887 - DNA, 15 bp, Homo sapiens
ctttagcctggacca

SEQ ID NO: 5728888 - DNA, 21 bp, Homo sapiens
ctttagcttacctgggcacaa

SEQ ID NO: 5728889 - DNA, 13 bp, Homo sapiens
ctttagctttgac

SEQ ID NO: 5728890 - DNA, 16 bp, Homo sapiens
ctttagcttttaccaa

SEQ ID NO: 5728891 - DNA, 22 bp, Homo sapiens
ctttaggagatttattttttgg

SEQ ID NO: 5728892 - DNA, 21 bp, Homo sapiens
ctttaggatgagcaaaacatt

SEQ ID NO: 5728893 - DNA, 20 bp, Homo sapiens
ctttaggcagcctgccgccg

SEQ ID NO: 5728894 - DNA, 22 bp, Homo sapiens
ctttaggcaggaagtcaggagc

SEQ ID NO: 5728895 - DNA, 18 bp, Homo sapiens
ctttaggctttcagctta

SEQ ID NO: 5728896 - DNA, 23 bp, Homo sapiens
ctttagggagacccaataaagaa

SEQ ID NO: 5728897 - DNA, 17 bp, Homo sapiens
ctttagggctgttgcta

SEQ ID NO: 5728898 - DNA, 23 bp, Homo sapiens
ctttagggctgttgctagggaga

SEQ ID NO: 5728899 - DNA, 22 bp, Homo sapiens
ctttaggggtacacactttttg

SEQ ID NO: 5728900 - DNA, 16 bp, Homo sapiens
ctttagggttctgcct

SEQ ID NO: 5728901 - DNA, 17 bp, Homo sapiens
ctttagggtttaaaata

SEQ ID NO: 5728902 - DNA, 14 bp, Homo sapiens
ctttaggtcaaact

SEQ ID NO: 5728903 - DNA, 17 bp, Homo sapiens
ctttaggtctttgtaag

SEQ ID NO: 5728904 - DNA, 20 bp, Homo sapiens
ctttaggtgcctcctgtctt

SEQ ID NO: 5728905 - DNA, 18 bp, Homo sapiens
ctttaggtttttttaatg

SEQ ID NO: 5728906 - DNA, 16 bp, Homo sapiens
ctttagtacaatttca

SEQ ID NO: 5728907 - DNA, 20 bp, Homo sapiens
ctttagtacatggagctcag

SEQ ID NO: 5728908 - DNA, 17 bp, Homo sapiens
ctttagtacctgaaaag

SEQ ID NO: 5728909 - DNA, 21 bp, Homo sapiens
ctttagtacgtgtggcttggt

SEQ ID NO: 5728910 - DNA, 14 bp, Homo sapiens
ctttagtagctcaa

SEQ ID NO: 5728911 - DNA, 17 bp, Homo sapiens
ctttagtatcagtgttt

SEQ ID NO: 5728912 - DNA, 16 bp, Homo sapiens
ctttagtattaaatca

SEQ ID NO: 5728913 - DNA, 21 bp, Homo sapiens
ctttagtattatattaatata

SEQ ID NO: 5728914 - DNA, 21 bp, Homo sapiens
ctttagtccacggacccccag

SEQ ID NO: 5728915 - DNA, 15 bp, Homo sapiens
ctttagtcgctgagg

SEQ ID NO: 5728916 - DNA, 18 bp, Homo sapiens
ctttagtctacataggca

SEQ ID NO: 5728917 - DNA, 18 bp, Homo sapiens
ctttagtgaaacataata

SEQ ID NO: 5728918 - DNA, 20 bp, Homo sapiens
ctttagtgaaacataataat

SEQ ID NO: 5728919 - DNA, 17 bp, Homo sapiens
ctttagtgccctgcccc

SEQ ID NO: 5728920 - DNA, 21 bp, Homo sapiens
ctttagtgccctgccccctgg

SEQ ID NO: 5728921 - DNA, 16 bp, Homo sapiens
ctttagtgctttgtga

SEQ ID NO: 5728922 - DNA, 13 bp, Homo sapiens
ctttagtgtattt

SEQ ID NO: 5728923 - DNA, 15 bp, Homo sapiens
ctttagtgtatttat

SEQ ID NO: 5728924 - DNA, 19 bp, Homo sapiens
ctttagtgttctgtttgaa

SEQ ID NO: 5728925 - DNA, 22 bp, Homo sapiens
ctttagttaccgagacatgaat

SEQ ID NO: 5728926 - DNA, 20 bp, Homo sapiens
ctttagttagcatgcgcgct

SEQ ID NO: 5728927 - DNA, 19 bp, Homo sapiens
ctttagttaggtcattttt

SEQ ID NO: 5728928 - DNA, 23 bp, Homo sapiens
ctttagttagtgattatatttca

SEQ ID NO: 5728929 - DNA, 22 bp, Homo sapiens
ctttagttcctactttagccac

SEQ ID NO: 5728930 - DNA, 19 bp, Homo sapiens
ctttagttctgctgtctcc

SEQ ID NO: 5728931 - DNA, 16 bp, Homo sapiens
ctttagttctgctttc

SEQ ID NO: 5728932 - DNA, 18 bp, Homo sapiens
ctttagttgaattccaag

SEQ ID NO: 5728933 - DNA, 22 bp, Homo sapiens
ctttagttgaattccaagtgta

SEQ ID NO: 5728934 - DNA, 15 bp, Homo sapiens
ctttataaaatgtat

SEQ ID NO: 5728935 - DNA, 12 bp, Homo sapiens
ctttataaactt

SEQ ID NO: 5728936 - DNA, 13 bp, Homo sapiens
ctttataaacttt

SEQ ID NO: 5728937 - DNA, 21 bp, Homo sapiens
ctttataaatctttctctcac

SEQ ID NO: 5728938 - DNA, 17 bp, Homo sapiens
ctttataaatgcaaatg

SEQ ID NO: 5728939 - DNA, 18 bp, Homo sapiens
ctttataactaacatgtc

SEQ ID NO: 5728940 - DNA, 19 bp, Homo sapiens
ctttataagaaagcctgag

SEQ ID NO: 5728941 - DNA, 16 bp, Homo sapiens
ctttataataaactgt

SEQ ID NO: 5728942 - DNA, 15 bp, Homo sapiens
ctttataatggctct

SEQ ID NO: 5728943 - DNA, 16 bp, Homo sapiens
ctttataatggctctg

SEQ ID NO: 5728944 - DNA, 13 bp, Homo sapiens
ctttataattcta

SEQ ID NO: 5728945 - DNA, 13 bp, Homo sapiens
ctttatacaacag

SEQ ID NO: 5728946 - DNA, 20 bp, Homo sapiens
ctttatacaacagtgctaaa

SEQ ID NO: 5728947 - DNA, 20 bp, Homo sapiens
ctttatacaacgattgtatt

SEQ ID NO: 5728948 - DNA, 24 bp, Homo sapiens
ctttatacacttctggctcacagg

SEQ ID NO: 5728949 - DNA, 19 bp, Homo sapiens
ctttatacattagtaaatg

SEQ ID NO: 5728950 - DNA, 22 bp, Homo sapiens
ctttatacattagtaaatgtct

SEQ ID NO: 5728951 - DNA, 23 bp, Homo sapiens
ctttatacattagtaaatgtctt

SEQ ID NO: 5728952 - DNA, 19 bp, Homo sapiens
ctttatacgtgtagctata

SEQ ID NO: 5728953 - DNA, 17 bp, Homo sapiens
ctttatactgtgaagtt

SEQ ID NO: 5728954 - DNA, 21 bp, Homo sapiens
ctttatagaaggaatttgtac

SEQ ID NO: 5728955 - DNA, 22 bp, Homo sapiens
ctttatagaaggaatttgtact

SEQ ID NO: 5728956 - DNA, 15 bp, Homo sapiens
ctttatagatcagcc

SEQ ID NO: 5728957 - DNA, 19 bp, Homo sapiens
ctttataggataactgatg

SEQ ID NO: 5728958 - DNA, 20 bp, Homo sapiens
ctttataggcagtagactca

SEQ ID NO: 5728959 - DNA, 19 bp, Homo sapiens
ctttatagtgaagtgttaa

SEQ ID NO: 5728960 - DNA, 21 bp, Homo sapiens
ctttatagtgcacaaaatgaa

SEQ ID NO: 5728961 - DNA, 16 bp, Homo sapiens
ctttatatatggacat

SEQ ID NO: 5728962 - DNA, 16 bp, Homo sapiens
ctttatatatgtacat

SEQ ID NO: 5728963 - DNA, 18 bp, Homo sapiens
ctttatatctgtaatgat

SEQ ID NO: 5728964 - DNA, 20 bp, Homo sapiens
ctttatatcttgtttacaat

SEQ ID NO: 5728965 - DNA, 21 bp, Homo sapiens
ctttatatggaacgcattttg

SEQ ID NO: 5728966 - DNA, 16 bp, Homo sapiens
ctttatattttcctct

SEQ ID NO: 5728967 - DNA, 18 bp, Homo sapiens
ctttatcaaggagatata

SEQ ID NO: 5728968 - DNA, 23 bp, Homo sapiens
ctttatcacaaccaccgttacaa

SEQ ID NO: 5728969 - DNA, 19 bp, Homo sapiens
ctttatcacattatttgca

SEQ ID NO: 5728970 - DNA, 19 bp, Homo sapiens
ctttatcacctcattctga

SEQ ID NO: 5728971 - DNA, 22 bp, Homo sapiens
ctttatcacctggcttgtttat

SEQ ID NO: 5728972 - DNA, 18 bp, Homo sapiens
ctttatcactttttgaac

SEQ ID NO: 5728973 - DNA, 22 bp, Homo sapiens
ctttatcactttttgaactaag

SEQ ID NO: 5728974 - DNA, 15 bp, Homo sapiens
ctttatcagaagcaa

SEQ ID NO: 5728975 - DNA, 21 bp, Homo sapiens
ctttatcatgaatgcttttag

SEQ ID NO: 5728976 - DNA, 14 bp, Homo sapiens
ctttatcatgctac

SEQ ID NO: 5728977 - DNA, 14 bp, Homo sapiens
ctttatcattaaac

SEQ ID NO: 5728978 - DNA, 18 bp, Homo sapiens
ctttatcattcctttcca

SEQ ID NO: 5728979 - DNA, 13 bp, Homo sapiens
ctttatccaatcc

SEQ ID NO: 5728980 - DNA, 13 bp, Homo sapiens
ctttatccacatt

SEQ ID NO: 5728981 - DNA, 19 bp, Homo sapiens
ctttatccccgtttcttgc

SEQ ID NO: 5728982 - DNA, 20 bp, Homo sapiens
ctttatccccgtttcttgca

SEQ ID NO: 5728983 - DNA, 21 bp, Homo sapiens
ctttatccctgaggtcacctg

SEQ ID NO: 5728984 - DNA, 17 bp, Homo sapiens
ctttatcctaaaaatct

SEQ ID NO: 5728985 - DNA, 16 bp, Homo sapiens
ctttatcgccctgaga

SEQ ID NO: 5728986 - DNA, 19 bp, Homo sapiens
ctttatctaccaactttca

SEQ ID NO: 5728987 - DNA, 16 bp, Homo sapiens
ctttatctatgggaga

SEQ ID NO: 5728988 - DNA, 15 bp, Homo sapiens
ctttatctcctgctc

SEQ ID NO: 5728989 - DNA, 16 bp, Homo sapiens
ctttatcttgaagtca

SEQ ID NO: 5728990 - DNA, 23 bp, Homo sapiens
ctttatcttgaataatgtaagac

SEQ ID NO: 5728991 - DNA, 14 bp, Homo sapiens
ctttatcttgacat

SEQ ID NO: 5728992 - DNA, 21 bp, Homo sapiens
ctttatcttgggaccaaaact

SEQ ID NO: 5728993 - DNA, 23 bp, Homo sapiens
ctttatctttccatgggagccag

SEQ ID NO: 5728994 - DNA, 21 bp, Homo sapiens
ctttatgaaaaaaaaagaaat

SEQ ID NO: 5728995 - DNA, 21 bp, Homo sapiens
ctttatgaaaaaaatatattt

SEQ ID NO: 5728996 - DNA, 15 bp, Homo sapiens
ctttatgaattattt

SEQ ID NO: 5728997 - DNA, 17 bp, Homo sapiens
ctttatgatgctaagct

SEQ ID NO: 5728998 - DNA, 15 bp, Homo sapiens
ctttatgatttcatg

SEQ ID NO: 5728999 - DNA, 18 bp, Homo sapiens
ctttatgattttcataac

SEQ ID NO: 5729000 - DNA, 16 bp, Homo sapiens
ctttatgcaaatacaa

SEQ ID NO: 5729001 - DNA, 14 bp, Homo sapiens
ctttatgcaataaa

SEQ ID NO: 5729002 - DNA, 15 bp, Homo sapiens
ctttatgcaataaat

SEQ ID NO: 5729003 - DNA, 15 bp, Homo sapiens
ctttatgcacaaaat

SEQ ID NO: 5729004 - DNA, 18 bp, Homo sapiens
ctttatgcagcttccttt

SEQ ID NO: 5729005 - DNA, 22 bp, Homo sapiens
ctttatgccggatgtgcttttc

SEQ ID NO: 5729006 - DNA, 15 bp, Homo sapiens
ctttatgctgaaaca

SEQ ID NO: 5729007 - DNA, 17 bp, Homo sapiens
ctttatggctctaacat

SEQ ID NO: 5729008 - DNA, 24 bp, Homo sapiens
ctttatggctctaacattactgcc

SEQ ID NO: 5729009 - DNA, 21 bp, Homo sapiens
ctttatgggggggagggaggg

SEQ ID NO: 5729010 - DNA, 17 bp, Homo sapiens
ctttatggtaagtagca

SEQ ID NO: 5729011 - DNA, 20 bp, Homo sapiens
ctttatggtcctaaaagcaa

SEQ ID NO: 5729012 - DNA, 14 bp, Homo sapiens
ctttatgtaagaag

SEQ ID NO: 5729013 - DNA, 23 bp, Homo sapiens
ctttatgtacaggatgctttggt

SEQ ID NO: 5729014 - DNA, 15 bp, Homo sapiens
ctttatgtagaattg

SEQ ID NO: 5729015 - DNA, 13 bp, Homo sapiens
ctttatgtattat

SEQ ID NO: 5729016 - DNA, 14 bp, Homo sapiens
ctttatgtattctc

SEQ ID NO: 5729017 - DNA, 12 bp, Homo sapiens
ctttatgtcttt

SEQ ID NO: 5729018 - DNA, 12 bp, Homo sapiens
ctttatgtgaat

SEQ ID NO: 5729019 - DNA, 18 bp, Homo sapiens
ctttatgtgatgtaacta

SEQ ID NO: 5729020 - DNA, 18 bp, Homo sapiens
ctttatgtggaaaacaga

SEQ ID NO: 5729021 - DNA, 15 bp, Homo sapiens
ctttatgttctttca

SEQ ID NO: 5729022 - DNA, 19 bp, Homo sapiens
ctttatgttgcaattaaaa

SEQ ID NO: 5729023 - DNA, 12 bp, Homo sapiens
ctttatgttgta

SEQ ID NO: 5729024 - DNA, 17 bp, Homo sapiens
ctttatgttgtatgatt

SEQ ID NO: 5729025 - DNA, 18 bp, Homo sapiens
ctttatgttgtatgattc

SEQ ID NO: 5729026 - DNA, 13 bp, Homo sapiens
ctttattaaaatc

SEQ ID NO: 5729027 - DNA, 14 bp, Homo sapiens
ctttattaaatatt

SEQ ID NO: 5729028 - DNA, 16 bp, Homo sapiens
ctttattaagtaaaat

SEQ ID NO: 5729029 - DNA, 17 bp, Homo sapiens
ctttattaagtagatga

SEQ ID NO: 5729030 - DNA, 20 bp, Homo sapiens
ctttattaatcactattgtt

SEQ ID NO: 5729031 - DNA, 23 bp, Homo sapiens
ctttattaatgaactgtgacagg

SEQ ID NO: 5729032 - DNA, 19 bp, Homo sapiens
ctttattacaatttgtatt

SEQ ID NO: 5729033 - DNA, 20 bp, Homo sapiens
ctttattacaatttgtatta

SEQ ID NO: 5729034 - DNA, 22 bp, Homo sapiens
ctttattacacctcagaaattg

SEQ ID NO: 5729035 - DNA, 21 bp, Homo sapiens
ctttattagattttcctcctt

SEQ ID NO: 5729036 - DNA, 17 bp, Homo sapiens
ctttattataatcaaag

SEQ ID NO: 5729037 - DNA, 18 bp, Homo sapiens
ctttattatggaaaacat

SEQ ID NO: 5729038 - DNA, 19 bp, Homo sapiens
ctttattatggcttgtgaa

SEQ ID NO: 5729039 - DNA, 21 bp, Homo sapiens
ctttattatggcttgtgaact

SEQ ID NO: 5729040 - DNA, 23 bp, Homo sapiens
ctttattatggcttgtgaactgc

SEQ ID NO: 5729041 - DNA, 24 bp, Homo sapiens
ctttattatggcttgtgaactgct

SEQ ID NO: 5729042 - DNA, 12 bp, Homo sapiens
ctttattattat

SEQ ID NO: 5729043 - DNA, 12 bp, Homo sapiens
ctttattattcc

SEQ ID NO: 5729044 - DNA, 14 bp, Homo sapiens
ctttattatttatt

SEQ ID NO: 5729045 - DNA, 20 bp, Homo sapiens
ctttattatttttctctctc

SEQ ID NO: 5729046 - DNA, 21 bp, Homo sapiens
ctttattatttttctctctct

SEQ ID NO: 5729047 - DNA, 16 bp, Homo sapiens
ctttattcaagtaaaa

SEQ ID NO: 5729048 - DNA, 21 bp, Homo sapiens
ctttattcaataaaaaaaaga

SEQ ID NO: 5729049 - DNA, 16 bp, Homo sapiens
ctttattcacccctgc

SEQ ID NO: 5729050 - DNA, 21 bp, Homo sapiens
ctttattcagaactttagtat

SEQ ID NO: 5729051 - DNA, 20 bp, Homo sapiens
ctttattccagaatgctgta

SEQ ID NO: 5729052 - DNA, 15 bp, Homo sapiens
ctttattctacatat

SEQ ID NO: 5729053 - DNA, 20 bp, Homo sapiens
ctttattctggcagaggagg

SEQ ID NO: 5729054 - DNA, 14 bp, Homo sapiens
ctttattcttgctg

SEQ ID NO: 5729055 - DNA, 15 bp, Homo sapiens
ctttattctttaatt

SEQ ID NO: 5729056 - DNA, 21 bp, Homo sapiens
ctttattgaaaaaataaaaaa

SEQ ID NO: 5729057 - DNA, 18 bp, Homo sapiens
ctttattgaacttgaaat

SEQ ID NO: 5729058 - DNA, 23 bp, Homo sapiens
ctttattgaagggtctgtttaaa

SEQ ID NO: 5729059 - DNA, 13 bp, Homo sapiens
ctttattgaatta

SEQ ID NO: 5729060 - DNA, 19 bp, Homo sapiens
ctttattgaattagaaaat

SEQ ID NO: 5729061 - DNA, 16 bp, Homo sapiens
ctttattgattttctt

SEQ ID NO: 5729062 - DNA, 13 bp, Homo sapiens
ctttattgcaatg

SEQ ID NO: 5729063 - DNA, 13 bp, Homo sapiens
ctttattgcacta

SEQ ID NO: 5729064 - DNA, 21 bp, Homo sapiens
ctttattgccaaaacccagct

SEQ ID NO: 5729065 - DNA, 22 bp, Homo sapiens
ctttattgccaaaacccagctg

SEQ ID NO: 5729066 - DNA, 20 bp, Homo sapiens
ctttattgccccttcttatt

SEQ ID NO: 5729067 - DNA, 15 bp, Homo sapiens
ctttattgccctaac

SEQ ID NO: 5729068 - DNA, 16 bp, Homo sapiens
ctttattgctgcattt

SEQ ID NO: 5729069 - DNA, 22 bp, Homo sapiens
ctttattgctgcattttaagca

SEQ ID NO: 5729070 - DNA, 22 bp, Homo sapiens
ctttattgcttaatttctgcct

SEQ ID NO: 5729071 - DNA, 18 bp, Homo sapiens
ctttattgcttttttgta

SEQ ID NO: 5729072 - DNA, 21 bp, Homo sapiens
ctttattggcttgataaacat

SEQ ID NO: 5729073 - DNA, 21 bp, Homo sapiens
ctttattgggtggaattatat

SEQ ID NO: 5729074 - DNA, 21 bp, Homo sapiens
ctttattggtaaattctggta

SEQ ID NO: 5729075 - DNA, 14 bp, Homo sapiens
ctttattgtctgta

SEQ ID NO: 5729076 - DNA, 23 bp, Homo sapiens
ctttattgtgtttgtcattagcc

SEQ ID NO: 5729077 - DNA, 19 bp, Homo sapiens
ctttatttaaaatgatttt

SEQ ID NO: 5729078 - DNA, 15 bp, Homo sapiens
ctttatttaaatgca

SEQ ID NO: 5729079 - DNA, 23 bp, Homo sapiens
ctttatttaaatgcatgtcttaa

SEQ ID NO: 5729080 - DNA, 12 bp, Homo sapiens
ctttatttaatt

SEQ ID NO: 5729081 - DNA, 18 bp, Homo sapiens
ctttatttaatttcataa

SEQ ID NO: 5729082 - DNA, 21 bp, Homo sapiens
ctttatttaatttcataaatt

SEQ ID NO: 5729083 - DNA, 22 bp, Homo sapiens
ctttatttacttcgttttggtt

SEQ ID NO: 5729084 - DNA, 17 bp, Homo sapiens
ctttatttaggaaacac

SEQ ID NO: 5729085 - DNA, 16 bp, Homo sapiens
ctttatttatggctta

SEQ ID NO: 5729086 - DNA, 18 bp, Homo sapiens
ctttatttattaaacttc

SEQ ID NO: 5729087 - DNA, 20 bp, Homo sapiens
ctttatttctagcagagtga

SEQ ID NO: 5729088 - DNA, 13 bp, Homo sapiens
ctttatttctgtc

SEQ ID NO: 5729089 - DNA, 17 bp, Homo sapiens
ctttatttctgtctcat

SEQ ID NO: 5729090 - DNA, 18 bp, Homo sapiens
ctttatttgcatatttat

SEQ ID NO: 5729091 - DNA, 21 bp, Homo sapiens
ctttatttgtaaaccattgta

SEQ ID NO: 5729092 - DNA, 16 bp, Homo sapiens
ctttatttgtaaattt

SEQ ID NO: 5729093 - DNA, 15 bp, Homo sapiens
ctttatttgtattac

SEQ ID NO: 5729094 - DNA, 16 bp, Homo sapiens
ctttatttgttttttt

SEQ ID NO: 5729095 - DNA, 22 bp, Homo sapiens
ctttattttaaatgtggttttt

SEQ ID NO: 5729096 - DNA, 13 bp, Homo sapiens
ctttattttacta

SEQ ID NO: 5729097 - DNA, 14 bp, Homo sapiens
ctttattttactag

SEQ ID NO: 5729098 - DNA, 17 bp, Homo sapiens
ctttattttactagaaa

SEQ ID NO: 5729099 - DNA, 20 bp, Homo sapiens
ctttattttatataataaag

SEQ ID NO: 5729100 - DNA, 23 bp, Homo sapiens
ctttattttatataataaagtat

SEQ ID NO: 5729101 - DNA, 12 bp, Homo sapiens
ctttattttatt

SEQ ID NO: 5729102 - DNA, 17 bp, Homo sapiens
ctttattttattattca

SEQ ID NO: 5729103 - DNA, 16 bp, Homo sapiens
ctttattttattgaaa

SEQ ID NO: 5729104 - DNA, 21 bp, Homo sapiens
ctttattttattttttttcaa

SEQ ID NO: 5729105 - DNA, 23 bp, Homo sapiens
ctttattttattttttttcaaaa

SEQ ID NO: 5729106 - DNA, 21 bp, Homo sapiens
ctttattttctataatttaaa

SEQ ID NO: 5729107 - DNA, 19 bp, Homo sapiens
ctttattttgtgtttagga

SEQ ID NO: 5729108 - DNA, 20 bp, Homo sapiens
ctttatttttatcccaggaa

SEQ ID NO: 5729109 - DNA, 14 bp, Homo sapiens
ctttatttttctat

SEQ ID NO: 5729110 - DNA, 23 bp, Homo sapiens
ctttatttttctctttctccctt

SEQ ID NO: 5729111 - DNA, 15 bp, Homo sapiens
ctttatttttgtata

SEQ ID NO: 5729112 - DNA, 14 bp, Homo sapiens
ctttatttttgtta

SEQ ID NO: 5729113 - DNA, 15 bp, Homo sapiens
ctttatttttgttaa

SEQ ID NO: 5729114 - DNA, 17 bp, Homo sapiens
ctttatttttgttaata

SEQ ID NO: 5729115 - DNA, 21 bp, Homo sapiens
ctttattttttaagtatttat

SEQ ID NO: 5729116 - DNA, 18 bp, Homo sapiens
ctttcaaaatatattttg

SEQ ID NO: 5729117 - DNA, 14 bp, Homo sapiens
ctttcaaaatgaat

SEQ ID NO: 5729118 - DNA, 12 bp, Homo sapiens
ctttcaaaatgg

SEQ ID NO: 5729119 - DNA, 17 bp, Homo sapiens
ctttcaaacagctattg

SEQ ID NO: 5729120 - DNA, 16 bp, Homo sapiens
ctttcaaaccagcttc

SEQ ID NO: 5729121 - DNA, 18 bp, Homo sapiens
ctttcaaaccagcttcat

SEQ ID NO: 5729122 - DNA, 18 bp, Homo sapiens
ctttcaaagtgcacacac

SEQ ID NO: 5729123 - DNA, 19 bp, Homo sapiens
ctttcaaagtgcacacaca

SEQ ID NO: 5729124 - DNA, 20 bp, Homo sapiens
ctttcaaagtgcacacacac

SEQ ID NO: 5729125 - DNA, 16 bp, Homo sapiens
ctttcaaatcctccct

SEQ ID NO: 5729126 - DNA, 21 bp, Homo sapiens
ctttcaaatttactgtcttaa

SEQ ID NO: 5729127 - DNA, 15 bp, Homo sapiens
ctttcaaatttcaca

SEQ ID NO: 5729128 - DNA, 14 bp, Homo sapiens
ctttcaactcattg

SEQ ID NO: 5729129 - DNA, 16 bp, Homo sapiens
ctttcaacttaaatca

SEQ ID NO: 5729130 - DNA, 19 bp, Homo sapiens
ctttcaacttaaatcactg

SEQ ID NO: 5729131 - DNA, 18 bp, Homo sapiens
ctttcaacttatttctga

SEQ ID NO: 5729132 - DNA, 17 bp, Homo sapiens
ctttcaagatctaaatc

SEQ ID NO: 5729133 - DNA, 17 bp, Homo sapiens
ctttcaagatcttcaac

SEQ ID NO: 5729134 - DNA, 20 bp, Homo sapiens
ctttcaagcagtcgtgcctg

SEQ ID NO: 5729135 - DNA, 22 bp, Homo sapiens
ctttcaagcagtcgtgcctgtg

SEQ ID NO: 5729136 - DNA, 19 bp, Homo sapiens
ctttcaagcggtgcctaag

SEQ ID NO: 5729137 - DNA, 15 bp, Homo sapiens
ctttcaaggctgggg

SEQ ID NO: 5729138 - DNA, 17 bp, Homo sapiens
ctttcaaggctggggca

SEQ ID NO: 5729139 - DNA, 18 bp, Homo sapiens
ctttcaaggctggggcat

SEQ ID NO: 5729140 - DNA, 19 bp, Homo sapiens
ctttcaagggctttcctgt

SEQ ID NO: 5729141 - DNA, 14 bp, Homo sapiens
ctttcaagtgcctt

SEQ ID NO: 5729142 - DNA, 14 bp, Homo sapiens
ctttcaagttgcat

SEQ ID NO: 5729143 - DNA, 22 bp, Homo sapiens
ctttcaataaagttgttgcatt

SEQ ID NO: 5729144 - DNA, 17 bp, Homo sapiens
ctttcaatacagatata

SEQ ID NO: 5729145 - DNA, 14 bp, Homo sapiens
ctttcaataggaaa

SEQ ID NO: 5729146 - DNA, 17 bp, Homo sapiens
ctttcaataggaaaaac

SEQ ID NO: 5729147 - DNA, 18 bp, Homo sapiens
ctttcaataggaaaaact

SEQ ID NO: 5729148 - DNA, 21 bp, Homo sapiens
ctttcaataggaaaaactgat

SEQ ID NO: 5729149 - DNA, 15 bp, Homo sapiens
ctttcaatattttaa

SEQ ID NO: 5729150 - DNA, 15 bp, Homo sapiens
ctttcaatccacagt

SEQ ID NO: 5729151 - DNA, 17 bp, Homo sapiens
ctttcaatccacagtat

SEQ ID NO: 5729152 - DNA, 20 bp, Homo sapiens
ctttcaatccacagtattgt

SEQ ID NO: 5729153 - DNA, 20 bp, Homo sapiens
ctttcaatgtgtttaatttt

SEQ ID NO: 5729154 - DNA, 13 bp, Homo sapiens
ctttcaattctgt

SEQ ID NO: 5729155 - DNA, 18 bp, Homo sapiens
ctttcaattgtattttat

SEQ ID NO: 5729156 - DNA, 15 bp, Homo sapiens
ctttcacaaaaaaga

SEQ ID NO: 5729157 - DNA, 20 bp, Homo sapiens
ctttcacaaaattttattcc

SEQ ID NO: 5729158 - DNA, 13 bp, Homo sapiens
ctttcacaagcaa

SEQ ID NO: 5729159 - DNA, 19 bp, Homo sapiens
ctttcacaaggtacaaaat

SEQ ID NO: 5729160 - DNA, 18 bp, Homo sapiens
ctttcacaaggtataata

SEQ ID NO: 5729161 - DNA, 18 bp, Homo sapiens
ctttcacacatctgggtg

SEQ ID NO: 5729162 - DNA, 18 bp, Homo sapiens
ctttcacagctcctccca

SEQ ID NO: 5729163 - DNA, 14 bp, Homo sapiens
ctttcacaggactc

SEQ ID NO: 5729164 - DNA, 19 bp, Homo sapiens
ctttcacagtgaagtgcct

SEQ ID NO: 5729165 - DNA, 15 bp, Homo sapiens
ctttcacatttaaat

SEQ ID NO: 5729166 - DNA, 20 bp, Homo sapiens
ctttcaccaagatgggtggc

SEQ ID NO: 5729167 - DNA, 23 bp, Homo sapiens
ctttcaccacatggccttgcctc

SEQ ID NO: 5729168 - DNA, 20 bp, Homo sapiens
ctttcacccacagaaagaga

SEQ ID NO: 5729169 - DNA, 15 bp, Homo sapiens
ctttcacccatccta

SEQ ID NO: 5729170 - DNA, 21 bp, Homo sapiens
ctttcaccccagggcctgagc

SEQ ID NO: 5729171 - DNA, 21 bp, Homo sapiens
ctttcaccccatccacatggg

SEQ ID NO: 5729172 - DNA, 18 bp, Homo sapiens
ctttcacccctcttccca

SEQ ID NO: 5729173 - DNA, 17 bp, Homo sapiens
ctttcaccctcatgaaa

SEQ ID NO: 5729174 - DNA, 14 bp, Homo sapiens
ctttcacctgggtg

SEQ ID NO: 5729175 - DNA, 16 bp, Homo sapiens
ctttcactatttcctt

SEQ ID NO: 5729176 - DNA, 15 bp, Homo sapiens
ctttcactgaagtga

SEQ ID NO: 5729177 - DNA, 19 bp, Homo sapiens
ctttcactgaagtgaatac

SEQ ID NO: 5729178 - DNA, 15 bp, Homo sapiens
ctttcacttaagtat

SEQ ID NO: 5729179 - DNA, 16 bp, Homo sapiens
ctttcacttctttccc

SEQ ID NO: 5729180 - DNA, 16 bp, Homo sapiens
ctttcacttttagttg

SEQ ID NO: 5729181 - DNA, 14 bp, Homo sapiens
ctttcagaaaacag

SEQ ID NO: 5729182 - DNA, 18 bp, Homo sapiens
ctttcagaaaacagaaaa

SEQ ID NO: 5729183 - DNA, 20 bp, Homo sapiens
ctttcagaaaacgggaagcg

SEQ ID NO: 5729184 - DNA, 22 bp, Homo sapiens
ctttcagaaatataacacattt

SEQ ID NO: 5729185 - DNA, 14 bp, Homo sapiens
ctttcagaatcttt

SEQ ID NO: 5729186 - DNA, 17 bp, Homo sapiens
ctttcagaatcttttca

SEQ ID NO: 5729187 - DNA, 19 bp, Homo sapiens
ctttcagactctctctggg

SEQ ID NO: 5729188 - DNA, 14 bp, Homo sapiens
ctttcagagacagc

SEQ ID NO: 5729189 - DNA, 20 bp, Homo sapiens
ctttcagagaggtctcaggt

SEQ ID NO: 5729190 - DNA, 11 bp, Homo sapiens
ctttcagagcc

SEQ ID NO: 5729191 - DNA, 18 bp, Homo sapiens
ctttcagagccagcctgg

SEQ ID NO: 5729192 - DNA, 18 bp, Homo sapiens
ctttcagagccagtgaag

SEQ ID NO: 5729193 - DNA, 12 bp, Homo sapiens
ctttcagagcct

SEQ ID NO: 5729194 - DNA, 21 bp, Homo sapiens
ctttcagagtttggttaatca

SEQ ID NO: 5729195 - DNA, 13 bp, Homo sapiens
ctttcagatactg

SEQ ID NO: 5729196 - DNA, 22 bp, Homo sapiens
ctttcagatactggattgtact

SEQ ID NO: 5729197 - DNA, 20 bp, Homo sapiens
ctttcagatgaccttttgga

SEQ ID NO: 5729198 - DNA, 17 bp, Homo sapiens
ctttcagatgcagtttt

SEQ ID NO: 5729199 - DNA, 12 bp, Homo sapiens
ctttcagatgtc

SEQ ID NO: 5729200 - DNA, 22 bp, Homo sapiens
ctttcagatgtcttctgcctgt

SEQ ID NO: 5729201 - DNA, 12 bp, Homo sapiens
ctttcagatgtt

SEQ ID NO: 5729202 - DNA, 20 bp, Homo sapiens
ctttcagcagaaatgaaatc

SEQ ID NO: 5729203 - DNA, 16 bp, Homo sapiens
ctttcagcaggcagcc

SEQ ID NO: 5729204 - DNA, 23 bp, Homo sapiens
ctttcagccaagaattcttaaat

SEQ ID NO: 5729205 - DNA, 19 bp, Homo sapiens
ctttcagccacatgcccca

SEQ ID NO: 5729206 - DNA, 16 bp, Homo sapiens
ctttcagcctgcttct

SEQ ID NO: 5729207 - DNA, 18 bp, Homo sapiens
ctttcagcgcccccaggc

SEQ ID NO: 5729208 - DNA, 22 bp, Homo sapiens
ctttcagcgcccccaggcctgc

SEQ ID NO: 5729209 - DNA, 23 bp, Homo sapiens
ctttcagctcatttaatcccagg

SEQ ID NO: 5729210 - DNA, 22 bp, Homo sapiens
ctttcagctgtcttttggagga

SEQ ID NO: 5729211 - DNA, 16 bp, Homo sapiens
ctttcagctgtgcttt

SEQ ID NO: 5729212 - DNA, 12 bp, Homo sapiens
ctttcaggaaat

SEQ ID NO: 5729213 - DNA, 21 bp, Homo sapiens
ctttcaggaaatttttgcatg

SEQ ID NO: 5729214 - DNA, 23 bp, Homo sapiens
ctttcaggaagttgctgagaaat

SEQ ID NO: 5729215 - DNA, 19 bp, Homo sapiens
ctttcaggagctccataca

SEQ ID NO: 5729216 - DNA, 16 bp, Homo sapiens
ctttcaggatctattt

SEQ ID NO: 5729217 - DNA, 20 bp, Homo sapiens
ctttcaggcctacagccaca

SEQ ID NO: 5729218 - DNA, 13 bp, Homo sapiens
ctttcaggctacc

SEQ ID NO: 5729219 - DNA, 21 bp, Homo sapiens
ctttcaggctacctttttctg

SEQ ID NO: 5729220 - DNA, 23 bp, Homo sapiens
ctttcaggctactgttcttgaca

SEQ ID NO: 5729221 - DNA, 20 bp, Homo sapiens
ctttcagggaatttcaggaa

SEQ ID NO: 5729222 - DNA, 17 bp, Homo sapiens
ctttcagggcagcccct

SEQ ID NO: 5729223 - DNA, 22 bp, Homo sapiens
ctttcagggcagcccctgcaga

SEQ ID NO: 5729224 - DNA, 23 bp, Homo sapiens
ctttcagggcagcccctgcagac

SEQ ID NO: 5729225 - DNA, 13 bp, Homo sapiens
ctttcagtactct

SEQ ID NO: 5729226 - DNA, 15 bp, Homo sapiens
ctttcagtattaaac

SEQ ID NO: 5729227 - DNA, 22 bp, Homo sapiens
ctttcagtattaaactctcctt

SEQ ID NO: 5729228 - DNA, 15 bp, Homo sapiens
ctttcagtgcctgct

SEQ ID NO: 5729229 - DNA, 18 bp, Homo sapiens
ctttcagtgcctgctgtt

SEQ ID NO: 5729230 - DNA, 19 bp, Homo sapiens
ctttcagtgcctgctgttc

SEQ ID NO: 5729231 - DNA, 13 bp, Homo sapiens
ctttcagtggaat

SEQ ID NO: 5729232 - DNA, 21 bp, Homo sapiens
ctttcagtttgtccacacaag

SEQ ID NO: 5729233 - DNA, 12 bp, Homo sapiens
ctttcataataa

SEQ ID NO: 5729234 - DNA, 17 bp, Homo sapiens
ctttcataatctttgct

SEQ ID NO: 5729235 - DNA, 20 bp, Homo sapiens
ctttcatacatatatatatt

SEQ ID NO: 5729236 - DNA, 13 bp, Homo sapiens
ctttcatacatta

SEQ ID NO: 5729237 - DNA, 15 bp, Homo sapiens
ctttcatagagaggc

SEQ ID NO: 5729238 - DNA, 16 bp, Homo sapiens
ctttcatagagaggcc

SEQ ID NO: 5729239 - DNA, 18 bp, Homo sapiens
ctttcatagagaggcctg

SEQ ID NO: 5729240 - DNA, 15 bp, Homo sapiens
ctttcatagtataac

SEQ ID NO: 5729241 - DNA, 19 bp, Homo sapiens
ctttcatagtataacttta

SEQ ID NO: 5729242 - DNA, 16 bp, Homo sapiens
ctttcatagttctgtt

SEQ ID NO: 5729243 - DNA, 21 bp, Homo sapiens
ctttcatagttctgttaaata

SEQ ID NO: 5729244 - DNA, 19 bp, Homo sapiens
ctttcatattttaaacaga

SEQ ID NO: 5729245 - DNA, 18 bp, Homo sapiens
ctttcatcaatcattgta

SEQ ID NO: 5729246 - DNA, 21 bp, Homo sapiens
ctttcatcaatcattgtacag

SEQ ID NO: 5729247 - DNA, 17 bp, Homo sapiens
ctttcatccccaccttg

SEQ ID NO: 5729248 - DNA, 15 bp, Homo sapiens
ctttcatcctcagca

SEQ ID NO: 5729249 - DNA, 18 bp, Homo sapiens
ctttcatcctgactctgc

SEQ ID NO: 5729250 - DNA, 21 bp, Homo sapiens
ctttcatcctgactctgcccc

SEQ ID NO: 5729251 - DNA, 21 bp, Homo sapiens
ctttcatcctgtgtcccctga

SEQ ID NO: 5729252 - DNA, 18 bp, Homo sapiens
ctttcatcggtgcctggt

SEQ ID NO: 5729253 - DNA, 18 bp, Homo sapiens
ctttcatcgtaaagtgct

SEQ ID NO: 5729254 - DNA, 21 bp, Homo sapiens
ctttcatctattctttcccta

SEQ ID NO: 5729255 - DNA, 23 bp, Homo sapiens
ctttcatctattctttccctaga

SEQ ID NO: 5729256 - DNA, 16 bp, Homo sapiens
ctttcatctgagcttt

SEQ ID NO: 5729257 - DNA, 15 bp, Homo sapiens
ctttcatctggggat

SEQ ID NO: 5729258 - DNA, 13 bp, Homo sapiens
ctttcatgaccac

SEQ ID NO: 5729259 - DNA, 23 bp, Homo sapiens
ctttcatgctacagaaagctgct

SEQ ID NO: 5729260 - DNA, 21 bp, Homo sapiens
ctttcatggggtgatgctggg

SEQ ID NO: 5729261 - DNA, 19 bp, Homo sapiens
ctttcatgtaaactgtgca

SEQ ID NO: 5729262 - DNA, 21 bp, Homo sapiens
ctttcatgtaaactgtgcacc

SEQ ID NO: 5729263 - DNA, 21 bp, Homo sapiens
ctttcatgtaattatctagta

SEQ ID NO: 5729264 - DNA, 18 bp, Homo sapiens
ctttcatgtttaagaaat

SEQ ID NO: 5729265 - DNA, 17 bp, Homo sapiens
ctttcattaccctacag

SEQ ID NO: 5729266 - DNA, 19 bp, Homo sapiens
ctttcattaccctacagac

SEQ ID NO: 5729267 - DNA, 14 bp, Homo sapiens
ctttcattaggcaa

SEQ ID NO: 5729268 - DNA, 18 bp, Homo sapiens
ctttcattaggcaaagta

SEQ ID NO: 5729269 - DNA, 17 bp, Homo sapiens
ctttcattcggtgtgaa

SEQ ID NO: 5729270 - DNA, 19 bp, Homo sapiens
ctttcattctaatccttgc

SEQ ID NO: 5729271 - DNA, 18 bp, Homo sapiens
ctttcattgccagtgtct

SEQ ID NO: 5729272 - DNA, 22 bp, Homo sapiens
ctttcattgctaagactaactc

SEQ ID NO: 5729273 - DNA, 20 bp, Homo sapiens
ctttcattggatttttgtta

SEQ ID NO: 5729274 - DNA, 18 bp, Homo sapiens
ctttcatttcttgaggta

SEQ ID NO: 5729275 - DNA, 22 bp, Homo sapiens
ctttcattttaaactcctgaaa

SEQ ID NO: 5729276 - DNA, 18 bp, Homo sapiens
ctttcattttctctcagg

SEQ ID NO: 5729277 - DNA, 13 bp, Homo sapiens
ctttcattttctg

SEQ ID NO: 5729278 - DNA, 17 bp, Homo sapiens
ctttcattttgcacctg

SEQ ID NO: 5729279 - DNA, 19 bp, Homo sapiens
ctttcattttgcacctgca

SEQ ID NO: 5729280 - DNA, 22 bp, Homo sapiens
ctttcattttgcacctgcagcc

SEQ ID NO: 5729281 - DNA, 17 bp, Homo sapiens
ctttcattttgctttaa

SEQ ID NO: 5729282 - DNA, 19 bp, Homo sapiens
ctttcattttgctttaatt

SEQ ID NO: 5729283 - DNA, 15 bp, Homo sapiens
ctttcatttttttcc

SEQ ID NO: 5729284 - DNA, 18 bp, Homo sapiens
ctttccaaaatttttcaa

SEQ ID NO: 5729285 - DNA, 22 bp, Homo sapiens
ctttccaaaccttatctccaca

SEQ ID NO: 5729286 - DNA, 15 bp, Homo sapiens
ctttccaaaggttgt

SEQ ID NO: 5729287 - DNA, 21 bp, Homo sapiens
ctttccaaatacccaaatgtc

SEQ ID NO: 5729288 - DNA, 13 bp, Homo sapiens
ctttccaaattat

SEQ ID NO: 5729289 - DNA, 12 bp, Homo sapiens
ctttccaaggaa

SEQ ID NO: 5729290 - DNA, 15 bp, Homo sapiens
ctttccaaggaagca

SEQ ID NO: 5729291 - DNA, 15 bp, Homo sapiens
ctttccaaggcttct

SEQ ID NO: 5729292 - DNA, 14 bp, Homo sapiens
ctttccaatagaaa

SEQ ID NO: 5729293 - DNA, 23 bp, Homo sapiens
ctttccaatgaaggaaacatcag

SEQ ID NO: 5729294 - DNA, 16 bp, Homo sapiens
ctttccaatgccacag

SEQ ID NO: 5729295 - DNA, 19 bp, Homo sapiens
ctttccaatgccacagaca

SEQ ID NO: 5729296 - DNA, 21 bp, Homo sapiens
ctttccaattccaaaattcca

SEQ ID NO: 5729297 - DNA, 13 bp, Homo sapiens
ctttccacagaag

SEQ ID NO: 5729298 - DNA, 21 bp, Homo sapiens
ctttccacatttgtcacagaa

SEQ ID NO: 5729299 - DNA, 15 bp, Homo sapiens
ctttccaccacagcc

SEQ ID NO: 5729300 - DNA, 22 bp, Homo sapiens
ctttccaccacagccagcacct

SEQ ID NO: 5729301 - DNA, 23 bp, Homo sapiens
ctttccaccacagccagcacctg

SEQ ID NO: 5729302 - DNA, 16 bp, Homo sapiens
ctttccaccatacctt

SEQ ID NO: 5729303 - DNA, 14 bp, Homo sapiens
ctttccacccagac

SEQ ID NO: 5729304 - DNA, 16 bp, Homo sapiens
ctttccacccagaccc

SEQ ID NO: 5729305 - DNA, 18 bp, Homo sapiens
ctttccacccagaccctc

SEQ ID NO: 5729306 - DNA, 21 bp, Homo sapiens
ctttccaccccctccctggcc

SEQ ID NO: 5729307 - DNA, 14 bp, Homo sapiens
ctttccacctgctt

SEQ ID NO: 5729308 - DNA, 17 bp, Homo sapiens
ctttccactccctgctt

SEQ ID NO: 5729309 - DNA, 13 bp, Homo sapiens
ctttccactctgg

SEQ ID NO: 5729310 - DNA, 23 bp, Homo sapiens
ctttccactctggattcagcctt

SEQ ID NO: 5729311 - DNA, 17 bp, Homo sapiens
ctttccacttcttcctt

SEQ ID NO: 5729312 - DNA, 21 bp, Homo sapiens
ctttccactttgttggccctt

SEQ ID NO: 5729313 - DNA, 23 bp, Homo sapiens
ctttccagaaggccacaggccac

SEQ ID NO: 5729314 - DNA, 15 bp, Homo sapiens
ctttccagagaactg

SEQ ID NO: 5729315 - DNA, 21 bp, Homo sapiens
ctttccagaggagtttcttaa

SEQ ID NO: 5729316 - DNA, 23 bp, Homo sapiens
ctttccagcagtcagtccctggt

SEQ ID NO: 5729317 - DNA, 18 bp, Homo sapiens
ctttccagcctcctgctg

SEQ ID NO: 5729318 - DNA, 20 bp, Homo sapiens
ctttccagcctcctgctggc

SEQ ID NO: 5729319 - DNA, 12 bp, Homo sapiens
ctttccagctca

SEQ ID NO: 5729320 - DNA, 15 bp, Homo sapiens
ctttccaggaaggct

SEQ ID NO: 5729321 - DNA, 18 bp, Homo sapiens
ctttccagggtctttact

SEQ ID NO: 5729322 - DNA, 16 bp, Homo sapiens
ctttccagggttattt

SEQ ID NO: 5729323 - DNA, 16 bp, Homo sapiens
ctttccagtgctgctc

SEQ ID NO: 5729324 - DNA, 13 bp, Homo sapiens
ctttccagttaag

SEQ ID NO: 5729325 - DNA, 22 bp, Homo sapiens
ctttccagttccctttgcttgt

SEQ ID NO: 5729326 - DNA, 23 bp, Homo sapiens
ctttccatatccatagtgacttt

SEQ ID NO: 5729327 - DNA, 15 bp, Homo sapiens
ctttccatcagcttt

SEQ ID NO: 5729328 - DNA, 16 bp, Homo sapiens
ctttccatcagcttta

SEQ ID NO: 5729329 - DNA, 20 bp, Homo sapiens
ctttccatccatggccagca

SEQ ID NO: 5729330 - DNA, 22 bp, Homo sapiens
ctttccatccattacctccatc

SEQ ID NO: 5729331 - DNA, 19 bp, Homo sapiens
ctttccatctatcactgca

SEQ ID NO: 5729332 - DNA, 21 bp, Homo sapiens
ctttccatctatcactgcatt

SEQ ID NO: 5729333 - DNA, 18 bp, Homo sapiens
ctttccatctctgcctgt

SEQ ID NO: 5729334 - DNA, 20 bp, Homo sapiens
ctttccatctgaggaccaga

SEQ ID NO: 5729335 - DNA, 13 bp, Homo sapiens
ctttccatctgct

SEQ ID NO: 5729336 - DNA, 15 bp, Homo sapiens
ctttccatctgcttg

SEQ ID NO: 5729337 - DNA, 17 bp, Homo sapiens
ctttccatctgtccaca

SEQ ID NO: 5729338 - DNA, 12 bp, Homo sapiens
ctttccatgcag

SEQ ID NO: 5729339 - DNA, 22 bp, Homo sapiens
ctttccatggcaaatgggcagc

SEQ ID NO: 5729340 - DNA, 22 bp, Homo sapiens
ctttccatgggcccgctgcctc

SEQ ID NO: 5729341 - DNA, 14 bp, Homo sapiens
ctttccatgttgct

SEQ ID NO: 5729342 - DNA, 15 bp, Homo sapiens
ctttccattcttctt

SEQ ID NO: 5729343 - DNA, 19 bp, Homo sapiens
ctttccattcttcttgcta

SEQ ID NO: 5729344 - DNA, 18 bp, Homo sapiens
ctttccattggatctcat

SEQ ID NO: 5729345 - DNA, 15 bp, Homo sapiens
ctttccatttacagt

SEQ ID NO: 5729346 - DNA, 19 bp, Homo sapiens
ctttcccaaaatgtgcctc

SEQ ID NO: 5729347 - DNA, 14 bp, Homo sapiens
ctttcccaaaatta

SEQ ID NO: 5729348 - DNA, 15 bp, Homo sapiens
ctttcccaaaggcat

SEQ ID NO: 5729349 - DNA, 15 bp, Homo sapiens
ctttcccaaatgtat

SEQ ID NO: 5729350 - DNA, 13 bp, Homo sapiens
ctttcccaacacc

SEQ ID NO: 5729351 - DNA, 11 bp, Homo sapiens
ctttcccaagc

SEQ ID NO: 5729352 - DNA, 20 bp, Homo sapiens
ctttcccaagtattgcgaat

SEQ ID NO: 5729353 - DNA, 11 bp, Homo sapiens
ctttcccacac

SEQ ID NO: 5729354 - DNA, 17 bp, Homo sapiens
ctttcccacactgaaat

SEQ ID NO: 5729355 - DNA, 16 bp, Homo sapiens
ctttcccaccattcct

SEQ ID NO: 5729356 - DNA, 21 bp, Homo sapiens
ctttcccacccactagccctc

SEQ ID NO: 5729357 - DNA, 18 bp, Homo sapiens
ctttcccacccagcctgg

SEQ ID NO: 5729358 - DNA, 22 bp, Homo sapiens
ctttcccaccccaacctgctct

SEQ ID NO: 5729359 - DNA, 14 bp, Homo sapiens
ctttcccaccctcc

SEQ ID NO: 5729360 - DNA, 17 bp, Homo sapiens
ctttcccagaagtggct

SEQ ID NO: 5729361 - DNA, 13 bp, Homo sapiens
ctttcccagcctc

SEQ ID NO: 5729362 - DNA, 17 bp, Homo sapiens
ctttcccagcctcttcc

SEQ ID NO: 5729363 - DNA, 13 bp, Homo sapiens
ctttcccaggacg

SEQ ID NO: 5729364 - DNA, 14 bp, Homo sapiens
ctttcccaggagaa

SEQ ID NO: 5729365 - DNA, 17 bp, Homo sapiens
ctttcccagtctgtcga

SEQ ID NO: 5729366 - DNA, 20 bp, Homo sapiens
ctttcccagtgagtctctgg

SEQ ID NO: 5729367 - DNA, 20 bp, Homo sapiens
ctttcccatcaccccttccc

SEQ ID NO: 5729368 - DNA, 21 bp, Homo sapiens
ctttcccatcaccccttcccc

SEQ ID NO: 5729369 - DNA, 23 bp, Homo sapiens
ctttcccatcaccccttccccat

SEQ ID NO: 5729370 - DNA, 16 bp, Homo sapiens
ctttcccatggggagg

SEQ ID NO: 5729371 - DNA, 17 bp, Homo sapiens
ctttcccatggggaggg

SEQ ID NO: 5729372 - DNA, 19 bp, Homo sapiens
ctttcccatggtcaatgca

SEQ ID NO: 5729373 - DNA, 19 bp, Homo sapiens
ctttcccattggtctgcat

SEQ ID NO: 5729374 - DNA, 23 bp, Homo sapiens
ctttccccaaggacccagccctc

SEQ ID NO: 5729375 - DNA, 23 bp, Homo sapiens
ctttccccaattacagggtgact

SEQ ID NO: 5729376 - DNA, 18 bp, Homo sapiens
ctttccccaccagatgct

SEQ ID NO: 5729377 - DNA, 22 bp, Homo sapiens
ctttccccaccagatgctgaaa

SEQ ID NO: 5729378 - DNA, 20 bp, Homo sapiens
ctttccccacctcttccttc

SEQ ID NO: 5729379 - DNA, 15 bp, Homo sapiens
ctttccccagaggct

SEQ ID NO: 5729380 - DNA, 17 bp, Homo sapiens
ctttccccagaggctcc

SEQ ID NO: 5729381 - DNA, 22 bp, Homo sapiens
ctttccccagaggctcccaatc

SEQ ID NO: 5729382 - DNA, 11 bp, Homo sapiens
ctttccccagc

SEQ ID NO: 5729383 - DNA, 16 bp, Homo sapiens
ctttccccagcccagg

SEQ ID NO: 5729384 - DNA, 17 bp, Homo sapiens
ctttccccagcccaggg

SEQ ID NO: 5729385 - DNA, 21 bp, Homo sapiens
ctttccccatgtctcgactca

SEQ ID NO: 5729386 - DNA, 16 bp, Homo sapiens
ctttccccattcagtg

SEQ ID NO: 5729387 - DNA, 19 bp, Homo sapiens
ctttccccattcctaccca

SEQ ID NO: 5729388 - DNA, 14 bp, Homo sapiens
ctttcccccttccc

SEQ ID NO: 5729389 - DNA, 18 bp, Homo sapiens
ctttcccctcctccctgg

SEQ ID NO: 5729390 - DNA, 18 bp, Homo sapiens
ctttcccctcctttgtct

SEQ ID NO: 5729391 - DNA, 11 bp, Homo sapiens
ctttcccctct

SEQ ID NO: 5729392 - DNA, 14 bp, Homo sapiens
ctttcccctctctg

SEQ ID NO: 5729393 - DNA, 17 bp, Homo sapiens
ctttcccctctctgccc

SEQ ID NO: 5729394 - DNA, 18 bp, Homo sapiens
ctttcccctctctgcccc

SEQ ID NO: 5729395 - DNA, 14 bp, Homo sapiens
ctttccccttcccc

SEQ ID NO: 5729396 - DNA, 15 bp, Homo sapiens
ctttccccttcccct

SEQ ID NO: 5729397 - DNA, 17 bp, Homo sapiens
ctttccccttcccctcc

SEQ ID NO: 5729398 - DNA, 17 bp, Homo sapiens
ctttccccttcctttta

SEQ ID NO: 5729399 - DNA, 20 bp, Homo sapiens
ctttcccctttttctttccc

SEQ ID NO: 5729400 - DNA, 18 bp, Homo sapiens
ctttcccggactgcaagc

SEQ ID NO: 5729401 - DNA, 12 bp, Homo sapiens
ctttccctaagc

SEQ ID NO: 5729402 - DNA, 20 bp, Homo sapiens
ctttccctaattctgcctta

SEQ ID NO: 5729403 - DNA, 13 bp, Homo sapiens
ctttccctaccct

SEQ ID NO: 5729404 - DNA, 14 bp, Homo sapiens
ctttccctagaaag

SEQ ID NO: 5729405 - DNA, 21 bp, Homo sapiens
ctttccctagaaagccatatt

SEQ ID NO: 5729406 - DNA, 15 bp, Homo sapiens
ctttccctcatgtat

SEQ ID NO: 5729407 - DNA, 14 bp, Homo sapiens
ctttccctccccaa

SEQ ID NO: 5729408 - DNA, 13 bp, Homo sapiens
ctttccctccctt

SEQ ID NO: 5729409 - DNA, 13 bp, Homo sapiens
ctttccctccttg

SEQ ID NO: 5729410 - DNA, 15 bp, Homo sapiens
ctttccctccttggt

SEQ ID NO: 5729411 - DNA, 18 bp, Homo sapiens
ctttccctccttggtgat

SEQ ID NO: 5729412 - DNA, 14 bp, Homo sapiens
ctttccctctccca

SEQ ID NO: 5729413 - DNA, 20 bp, Homo sapiens
ctttccctgaactgggacct

SEQ ID NO: 5729414 - DNA, 12 bp, Homo sapiens
ctttccctgagg

SEQ ID NO: 5729415 - DNA, 14 bp, Homo sapiens
ctttccctgaggaa

SEQ ID NO: 5729416 - DNA, 14 bp, Homo sapiens
ctttccctgcatcc

SEQ ID NO: 5729417 - DNA, 12 bp, Homo sapiens
ctttccctggac

SEQ ID NO: 5729418 - DNA, 13 bp, Homo sapiens
ctttccctggctc

SEQ ID NO: 5729419 - DNA, 20 bp, Homo sapiens
ctttccctgtgtaccctcca

SEQ ID NO: 5729420 - DNA, 16 bp, Homo sapiens
ctttcccttactccct

SEQ ID NO: 5729421 - DNA, 16 bp, Homo sapiens
ctttcccttattgcct

SEQ ID NO: 5729422 - DNA, 20 bp, Homo sapiens
ctttcccttattgcctccca

SEQ ID NO: 5729423 - DNA, 13 bp, Homo sapiens
ctttcccttccag

SEQ ID NO: 5729424 - DNA, 16 bp, Homo sapiens
ctttcccttcccctgt

SEQ ID NO: 5729425 - DNA, 12 bp, Homo sapiens
ctttcccttcct

SEQ ID NO: 5729426 - DNA, 16 bp, Homo sapiens
ctttcccttcctcttc

SEQ ID NO: 5729427 - DNA, 19 bp, Homo sapiens
ctttcccttgccctgggct

SEQ ID NO: 5729428 - DNA, 13 bp, Homo sapiens
ctttcccttgctt

SEQ ID NO: 5729429 - DNA, 12 bp, Homo sapiens
ctttcccttggt

SEQ ID NO: 5729430 - DNA, 18 bp, Homo sapiens
ctttcccttgtgtcaaga

SEQ ID NO: 5729431 - DNA, 20 bp, Homo sapiens
ctttcccttttccatcatct

SEQ ID NO: 5729432 - DNA, 14 bp, Homo sapiens
ctttcccttttctg

SEQ ID NO: 5729433 - DNA, 16 bp, Homo sapiens
ctttcccttttctgtt

SEQ ID NO: 5729434 - DNA, 19 bp, Homo sapiens
ctttccgacacatttacca

SEQ ID NO: 5729435 - DNA, 20 bp, Homo sapiens
ctttccgacacatttaccaa

SEQ ID NO: 5729436 - DNA, 14 bp, Homo sapiens
ctttccgactgccc

SEQ ID NO: 5729437 - DNA, 23 bp, Homo sapiens
ctttccgcgtggttctgccactt

SEQ ID NO: 5729438 - DNA, 15 bp, Homo sapiens
ctttccggcacactg

SEQ ID NO: 5729439 - DNA, 17 bp, Homo sapiens
ctttccggcacactgcc

SEQ ID NO: 5729440 - DNA, 20 bp, Homo sapiens
ctttccggggctgctggcct

SEQ ID NO: 5729441 - DNA, 21 bp, Homo sapiens
ctttccggggctgctggcctg

SEQ ID NO: 5729442 - DNA, 21 bp, Homo sapiens
ctttccgtcaacgttgtactg

SEQ ID NO: 5729443 - DNA, 20 bp, Homo sapiens
ctttccgtctccctaaaata

SEQ ID NO: 5729444 - DNA, 21 bp, Homo sapiens
ctttccgtctccctaaaataa

SEQ ID NO: 5729445 - DNA, 23 bp, Homo sapiens
ctttccgtttttttctttcctgt

SEQ ID NO: 5729446 - DNA, 20 bp, Homo sapiens
ctttcctaaagccaaagttt

SEQ ID NO: 5729447 - DNA, 18 bp, Homo sapiens
ctttcctaaagtctctgc

SEQ ID NO: 5729448 - DNA, 15 bp, Homo sapiens
ctttcctaaatgttt

SEQ ID NO: 5729449 - DNA, 22 bp, Homo sapiens
ctttcctacatgccccctccct

SEQ ID NO: 5729450 - DNA, 23 bp, Homo sapiens
ctttcctaccttggtcctgcctc

SEQ ID NO: 5729451 - DNA, 17 bp, Homo sapiens
ctttcctactgtcctgg

SEQ ID NO: 5729452 - DNA, 18 bp, Homo sapiens
ctttcctactgtcctgga

SEQ ID NO: 5729453 - DNA, 22 bp, Homo sapiens
ctttcctacttgcactcttcta

SEQ ID NO: 5729454 - DNA, 15 bp, Homo sapiens
ctttcctactttcta

SEQ ID NO: 5729455 - DNA, 23 bp, Homo sapiens
ctttcctagactaattaaaatct

SEQ ID NO: 5729456 - DNA, 20 bp, Homo sapiens
ctttcctagatggcagtcac

SEQ ID NO: 5729457 - DNA, 20 bp, Homo sapiens
ctttcctaggcccaggcctg

SEQ ID NO: 5729458 - DNA, 20 bp, Homo sapiens
ctttcctagttcttaagcat

SEQ ID NO: 5729459 - DNA, 17 bp, Homo sapiens
ctttcctatctagcatt

SEQ ID NO: 5729460 - DNA, 20 bp, Homo sapiens
ctttcctattttcttttcca

SEQ ID NO: 5729461 - DNA, 17 bp, Homo sapiens
ctttcctcaaaaagcag

SEQ ID NO: 5729462 - DNA, 18 bp, Homo sapiens
ctttcctcaaaaagcaga

SEQ ID NO: 5729463 - DNA, 19 bp, Homo sapiens
ctttcctcaaaacttcaga

SEQ ID NO: 5729464 - DNA, 15 bp, Homo sapiens
ctttcctcacatttg

SEQ ID NO: 5729465 - DNA, 13 bp, Homo sapiens
ctttcctccaccc

SEQ ID NO: 5729466 - DNA, 15 bp, Homo sapiens
ctttcctccacccat

SEQ ID NO: 5729467 - DNA, 12 bp, Homo sapiens
ctttcctcccca

SEQ ID NO: 5729468 - DNA, 17 bp, Homo sapiens
ctttcctccccaccttc

SEQ ID NO: 5729469 - DNA, 20 bp, Homo sapiens
ctttcctccccaccttcccc

SEQ ID NO: 5729470 - DNA, 18 bp, Homo sapiens
ctttcctccccatacaca

SEQ ID NO: 5729471 - DNA, 19 bp, Homo sapiens
ctttcctccccatacacac

SEQ ID NO: 5729472 - DNA, 18 bp, Homo sapiens
ctttcctcccccagcgtc

SEQ ID NO: 5729473 - DNA, 16 bp, Homo sapiens
ctttcctcccttctga

SEQ ID NO: 5729474 - DNA, 22 bp, Homo sapiens
ctttcctcctcaggcacacagc

SEQ ID NO: 5729475 - DNA, 14 bp, Homo sapiens
ctttcctcctcatg

SEQ ID NO: 5729476 - DNA, 19 bp, Homo sapiens
ctttcctcctccctgtgtt

SEQ ID NO: 5729477 - DNA, 15 bp, Homo sapiens
ctttcctcctctgac

SEQ ID NO: 5729478 - DNA, 18 bp, Homo sapiens
ctttcctccttcactgtt

SEQ ID NO: 5729479 - DNA, 13 bp, Homo sapiens
ctttcctcgcctg

SEQ ID NO: 5729480 - DNA, 18 bp, Homo sapiens
ctttcctcggtctccctt

SEQ ID NO: 5729481 - DNA, 17 bp, Homo sapiens
ctttcctctaactcatt

SEQ ID NO: 5729482 - DNA, 19 bp, Homo sapiens
ctttcctctaactcattct

SEQ ID NO: 5729483 - DNA, 17 bp, Homo sapiens
ctttcctctaatccagc

SEQ ID NO: 5729484 - DNA, 22 bp, Homo sapiens
ctttcctctccaattgtaaaaa

SEQ ID NO: 5729485 - DNA, 20 bp, Homo sapiens
ctttcctctccctcaggggc

SEQ ID NO: 5729486 - DNA, 18 bp, Homo sapiens
ctttcctctcctctctgg

SEQ ID NO: 5729487 - DNA, 12 bp, Homo sapiens
ctttcctctctc

SEQ ID NO: 5729488 - DNA, 14 bp, Homo sapiens
ctttcctctctctc

SEQ ID NO: 5729489 - DNA, 11 bp, Homo sapiens
ctttcctctga

SEQ ID NO: 5729490 - DNA, 15 bp, Homo sapiens
ctttcctctgcacgc

SEQ ID NO: 5729491 - DNA, 18 bp, Homo sapiens
ctttcctctgcagcactt

SEQ ID NO: 5729492 - DNA, 19 bp, Homo sapiens
ctttcctcttccccttgcc

SEQ ID NO: 5729493 - DNA, 20 bp, Homo sapiens
ctttcctcttctcattacca

SEQ ID NO: 5729494 - DNA, 16 bp, Homo sapiens
ctttcctctttctgct

SEQ ID NO: 5729495 - DNA, 20 bp, Homo sapiens
ctttcctctttctgctctgc

SEQ ID NO: 5729496 - DNA, 22 bp, Homo sapiens
ctttcctctttctgctctgcca

SEQ ID NO: 5729497 - DNA, 23 bp, Homo sapiens
ctttcctctttctgctctgccat

SEQ ID NO: 5729498 - DNA, 16 bp, Homo sapiens
ctttcctctttggtct

SEQ ID NO: 5729499 - DNA, 15 bp, Homo sapiens
ctttcctgaaattct

SEQ ID NO: 5729500 - DNA, 23 bp, Homo sapiens
ctttcctgaagtgtcgagtccag

SEQ ID NO: 5729501 - DNA, 22 bp, Homo sapiens
ctttcctgaatccaaactaatc

SEQ ID NO: 5729502 - DNA, 12 bp, Homo sapiens
ctttcctgaggc

SEQ ID NO: 5729503 - DNA, 21 bp, Homo sapiens
ctttcctgaggctgggctccc

SEQ ID NO: 5729504 - DNA, 22 bp, Homo sapiens
ctttcctgaggctgggctccct

SEQ ID NO: 5729505 - DNA, 21 bp, Homo sapiens
ctttcctgatcaaggtgctct

SEQ ID NO: 5729506 - DNA, 12 bp, Homo sapiens
ctttcctgatga

SEQ ID NO: 5729507 - DNA, 14 bp, Homo sapiens
ctttcctgatgatg

SEQ ID NO: 5729508 - DNA, 17 bp, Homo sapiens
ctttcctgatgcccctg

SEQ ID NO: 5729509 - DNA, 13 bp, Homo sapiens
ctttcctgcatct

SEQ ID NO: 5729510 - DNA, 15 bp, Homo sapiens
ctttcctgcatcttt

SEQ ID NO: 5729511 - DNA, 21 bp, Homo sapiens
ctttcctgcatctttcatagt

SEQ ID NO: 5729512 - DNA, 21 bp, Homo sapiens
ctttcctgccatgtttagtga

SEQ ID NO: 5729513 - DNA, 11 bp, Homo sapiens
ctttcctgccc

SEQ ID NO: 5729514 - DNA, 13 bp, Homo sapiens
ctttcctgcccca

SEQ ID NO: 5729515 - DNA, 17 bp, Homo sapiens
ctttcctgccctgtcca

SEQ ID NO: 5729516 - DNA, 18 bp, Homo sapiens
ctttcctgcccttttcct

SEQ ID NO: 5729517 - DNA, 19 bp, Homo sapiens
ctttcctgccgtccctcct

SEQ ID NO: 5729518 - DNA, 11 bp, Homo sapiens
ctttcctgcct

SEQ ID NO: 5729519 - DNA, 13 bp, Homo sapiens
ctttcctgctaca

SEQ ID NO: 5729520 - DNA, 12 bp, Homo sapiens
ctttcctgctgg

SEQ ID NO: 5729521 - DNA, 10 bp, Homo sapiens
ctttcctgga

SEQ ID NO: 5729522 - DNA, 16 bp, Homo sapiens
ctttcctggaagccag

SEQ ID NO: 5729523 - DNA, 13 bp, Homo sapiens
ctttcctggaagt

SEQ ID NO: 5729524 - DNA, 21 bp, Homo sapiens
ctttcctggaagtcaaataaa

SEQ ID NO: 5729525 - DNA, 21 bp, Homo sapiens
ctttcctggagagtctcactc

SEQ ID NO: 5729526 - DNA, 12 bp, Homo sapiens
ctttcctggagc

SEQ ID NO: 5729527 - DNA, 19 bp, Homo sapiens
ctttcctggagccaatggc

SEQ ID NO: 5729528 - DNA, 23 bp, Homo sapiens
ctttcctggagccaatggcccgg

SEQ ID NO: 5729529 - DNA, 13 bp, Homo sapiens
ctttcctgggtga

SEQ ID NO: 5729530 - DNA, 9 bp, Homo sapiens
ctttcctgt

SEQ ID NO: 5729531 - DNA, 24 bp, Homo sapiens
ctttcctgtactcactgagtaaca

SEQ ID NO: 5729532 - DNA, 13 bp, Homo sapiens
ctttcctgtccca

SEQ ID NO: 5729533 - DNA, 12 bp, Homo sapiens
ctttcctgtgcc

SEQ ID NO: 5729534 - DNA, 16 bp, Homo sapiens
ctttcctgtgccaacc

SEQ ID NO: 5729535 - DNA, 14 bp, Homo sapiens
ctttcctgtgccag

SEQ ID NO: 5729536 - DNA, 17 bp, Homo sapiens
ctttcctgttcagcatt

SEQ ID NO: 5729537 - DNA, 20 bp, Homo sapiens
ctttccttatgtctcctgac

SEQ ID NO: 5729538 - DNA, 14 bp, Homo sapiens
ctttccttcactgc

SEQ ID NO: 5729539 - DNA, 15 bp, Homo sapiens
ctttccttcactgcc

SEQ ID NO: 5729540 - DNA, 15 bp, Homo sapiens
ctttccttccatccc

SEQ ID NO: 5729541 - DNA, 11 bp, Homo sapiens
ctttccttccc

SEQ ID NO: 5729542 - DNA, 12 bp, Homo sapiens
ctttccttccca

SEQ ID NO: 5729543 - DNA, 17 bp, Homo sapiens
ctttccttcccaggccc

SEQ ID NO: 5729544 - DNA, 12 bp, Homo sapiens
ctttccttcccc

SEQ ID NO: 5729545 - DNA, 14 bp, Homo sapiens
ctttccttccccct

SEQ ID NO: 5729546 - DNA, 15 bp, Homo sapiens
ctttccttccccctc

SEQ ID NO: 5729547 - DNA, 11 bp, Homo sapiens
ctttccttcct

SEQ ID NO: 5729548 - DNA, 14 bp, Homo sapiens
ctttccttcctctc

SEQ ID NO: 5729549 - DNA, 12 bp, Homo sapiens
ctttccttcctt

SEQ ID NO: 5729550 - DNA, 19 bp, Homo sapiens
ctttccttctgatctgaga

SEQ ID NO: 5729551 - DNA, 15 bp, Homo sapiens
ctttccttctggctc

SEQ ID NO: 5729552 - DNA, 17 bp, Homo sapiens
ctttccttctggctcca

SEQ ID NO: 5729553 - DNA, 14 bp, Homo sapiens
ctttccttgccttc

SEQ ID NO: 5729554 - DNA, 17 bp, Homo sapiens
ctttccttggctcccat

SEQ ID NO: 5729555 - DNA, 14 bp, Homo sapiens
ctttccttgtctct

SEQ ID NO: 5729556 - DNA, 17 bp, Homo sapiens
ctttccttgtggcagag

SEQ ID NO: 5729557 - DNA, 22 bp, Homo sapiens
ctttccttgttagaatgcaagc

SEQ ID NO: 5729558 - DNA, 13 bp, Homo sapiens
ctttccttgttca

SEQ ID NO: 5729559 - DNA, 15 bp, Homo sapiens
ctttcctttaaaaat

SEQ ID NO: 5729560 - DNA, 10 bp, Homo sapiens
ctttcctttc

SEQ ID NO: 5729561 - DNA, 17 bp, Homo sapiens
ctttcctttcaataaag

SEQ ID NO: 5729562 - DNA, 23 bp, Homo sapiens
ctttcctttcatcctcagcaagt

SEQ ID NO: 5729563 - DNA, 17 bp, Homo sapiens
ctttcctttccccagcc

SEQ ID NO: 5729564 - DNA, 16 bp, Homo sapiens
ctttcctttcctttct

SEQ ID NO: 5729565 - DNA, 10 bp, Homo sapiens
ctttcctttt

SEQ ID NO: 5729566 - DNA, 14 bp, Homo sapiens
ctttccttttctct

SEQ ID NO: 5729567 - DNA, 15 bp, Homo sapiens
ctttccttttctctg

SEQ ID NO: 5729568 - DNA, 13 bp, Homo sapiens
ctttcctttttcc

SEQ ID NO: 5729569 - DNA, 21 bp, Homo sapiens
ctttcctttttcccaataaat

SEQ ID NO: 5729570 - DNA, 15 bp, Homo sapiens
ctttcctttttcttt

SEQ ID NO: 5729571 - DNA, 18 bp, Homo sapiens
ctttccttttttaaaaat

SEQ ID NO: 5729572 - DNA, 22 bp, Homo sapiens
ctttcgaaagcaatgcttctat

SEQ ID NO: 5729573 - DNA, 18 bp, Homo sapiens
ctttcgaaatttcatttt

SEQ ID NO: 5729574 - DNA, 13 bp, Homo sapiens
ctttcgcctcctc

SEQ ID NO: 5729575 - DNA, 17 bp, Homo sapiens
ctttcgcctcctccagc

SEQ ID NO: 5729576 - DNA, 19 bp, Homo sapiens
ctttcgcctcctccagctc

SEQ ID NO: 5729577 - DNA, 21 bp, Homo sapiens
ctttcgcctcctccagctcct

SEQ ID NO: 5729578 - DNA, 21 bp, Homo sapiens
ctttcggaatttttaaaataa

SEQ ID NO: 5729579 - DNA, 14 bp, Homo sapiens
ctttcggagctcct

SEQ ID NO: 5729580 - DNA, 20 bp, Homo sapiens
ctttcgggccatgttgcccc

SEQ ID NO: 5729581 - DNA, 16 bp, Homo sapiens
ctttcgttggttgttt

SEQ ID NO: 5729582 - DNA, 18 bp, Homo sapiens
ctttcgttggttgtttct

SEQ ID NO: 5729583 - DNA, 20 bp, Homo sapiens
ctttcgttggttgtttctct

SEQ ID NO: 5729584 - DNA, 21 bp, Homo sapiens
ctttcgttggttgtttctctg

SEQ ID NO: 5729585 - DNA, 15 bp, Homo sapiens
ctttcgttgttatta

SEQ ID NO: 5729586 - DNA, 23 bp, Homo sapiens
ctttctaaatctctatctcttta

SEQ ID NO: 5729587 - DNA, 15 bp, Homo sapiens
ctttctaaatgcctt

SEQ ID NO: 5729588 - DNA, 14 bp, Homo sapiens
ctttctaactcaca

SEQ ID NO: 5729589 - DNA, 15 bp, Homo sapiens
ctttctaagcaacca

SEQ ID NO: 5729590 - DNA, 20 bp, Homo sapiens
ctttctaagcaaccacactg

SEQ ID NO: 5729591 - DNA, 22 bp, Homo sapiens
ctttctaaggatagcctttgta

SEQ ID NO: 5729592 - DNA, 23 bp, Homo sapiens
ctttctaaggatagcctttgtag

SEQ ID NO: 5729593 - DNA, 23 bp, Homo sapiens
ctttctaaggctcagccccacgg

SEQ ID NO: 5729594 - DNA, 19 bp, Homo sapiens
ctttctaagggaaaaagtt

SEQ ID NO: 5729595 - DNA, 21 bp, Homo sapiens
ctttctaagggaaaaagttgt

SEQ ID NO: 5729596 - DNA, 13 bp, Homo sapiens
ctttctaatagag

SEQ ID NO: 5729597 - DNA, 16 bp, Homo sapiens
ctttctaatagagaga

SEQ ID NO: 5729598 - DNA, 23 bp, Homo sapiens
ctttctaatgattatagataaat

SEQ ID NO: 5729599 - DNA, 15 bp, Homo sapiens
ctttctaatgtagct

SEQ ID NO: 5729600 - DNA, 21 bp, Homo sapiens
ctttctaattaaaaaaataat

SEQ ID NO: 5729601 - DNA, 23 bp, Homo sapiens
ctttctacaaagcactagagaat

SEQ ID NO: 5729602 - DNA, 20 bp, Homo sapiens
ctttctacaatgtgaacttt

SEQ ID NO: 5729603 - DNA, 12 bp, Homo sapiens
ctttctacatgc

SEQ ID NO: 5729604 - DNA, 15 bp, Homo sapiens
ctttctacatgcaaa

SEQ ID NO: 5729605 - DNA, 23 bp, Homo sapiens
ctttctacattctcatctactca

SEQ ID NO: 5729606 - DNA, 17 bp, Homo sapiens
ctttctaccacacacag

SEQ ID NO: 5729607 - DNA, 15 bp, Homo sapiens
ctttctacttccaag

SEQ ID NO: 5729608 - DNA, 18 bp, Homo sapiens
ctttctagaaagaataaa

SEQ ID NO: 5729609 - DNA, 22 bp, Homo sapiens
ctttctagaaagagaaacagtt

SEQ ID NO: 5729610 - DNA, 23 bp, Homo sapiens
ctttctagacatcattgtcagcc

SEQ ID NO: 5729611 - DNA, 17 bp, Homo sapiens
ctttctagaccaataaa

SEQ ID NO: 5729612 - DNA, 11 bp, Homo sapiens
ctttctagagc

SEQ ID NO: 5729613 - DNA, 13 bp, Homo sapiens
ctttctagcctta

SEQ ID NO: 5729614 - DNA, 20 bp, Homo sapiens
ctttctagtcctattctatt

SEQ ID NO: 5729615 - DNA, 18 bp, Homo sapiens
ctttctagtggtctttgt

SEQ ID NO: 5729616 - DNA, 17 bp, Homo sapiens
ctttctagttcaatgcc

SEQ ID NO: 5729617 - DNA, 18 bp, Homo sapiens
ctttctagttgaaaataa

SEQ ID NO: 5729618 - DNA, 14 bp, Homo sapiens
ctttctagtttgtt

SEQ ID NO: 5729619 - DNA, 18 bp, Homo sapiens
ctttctataattttacaa

SEQ ID NO: 5729620 - DNA, 17 bp, Homo sapiens
ctttctatataaaatgt

SEQ ID NO: 5729621 - DNA, 17 bp, Homo sapiens
ctttctatgctgctttt

SEQ ID NO: 5729622 - DNA, 19 bp, Homo sapiens
ctttctatgctgcttttat

SEQ ID NO: 5729623 - DNA, 22 bp, Homo sapiens
ctttctattaatatttatgtgt

SEQ ID NO: 5729624 - DNA, 20 bp, Homo sapiens
ctttctattacccctcattt

SEQ ID NO: 5729625 - DNA, 21 bp, Homo sapiens
ctttctattgttaaacaaatg

SEQ ID NO: 5729626 - DNA, 22 bp, Homo sapiens
ctttctattgttaaacaaatga

SEQ ID NO: 5729627 - DNA, 23 bp, Homo sapiens
ctttctattttcacaattattaa

SEQ ID NO: 5729628 - DNA, 23 bp, Homo sapiens
ctttctcacatgtggctccccct

SEQ ID NO: 5729629 - DNA, 17 bp, Homo sapiens
ctttctcactaaatctt

SEQ ID NO: 5729630 - DNA, 15 bp, Homo sapiens
ctttctcactgcctt

SEQ ID NO: 5729631 - DNA, 16 bp, Homo sapiens
ctttctcactgctgtc

SEQ ID NO: 5729632 - DNA, 17 bp, Homo sapiens
ctttctcactgctgtca

SEQ ID NO: 5729633 - DNA, 12 bp, Homo sapiens
ctttctcagaat

SEQ ID NO: 5729634 - DNA, 21 bp, Homo sapiens
ctttctcagaggggccagcta

SEQ ID NO: 5729635 - DNA, 14 bp, Homo sapiens
ctttctcagcatat

SEQ ID NO: 5729636 - DNA, 24 bp, Homo sapiens
ctttctcagggggtcagcagagtt

SEQ ID NO: 5729637 - DNA, 17 bp, Homo sapiens
ctttctcagttttcata

SEQ ID NO: 5729638 - DNA, 10 bp, Homo sapiens
ctttctcatg

SEQ ID NO: 5729639 - DNA, 23 bp, Homo sapiens
ctttctccaaagttatccagagg

SEQ ID NO: 5729640 - DNA, 12 bp, Homo sapiens
ctttctccagcc

SEQ ID NO: 5729641 - DNA, 14 bp, Homo sapiens
ctttctccaggacc

SEQ ID NO: 5729642 - DNA, 12 bp, Homo sapiens
ctttctccaggc

SEQ ID NO: 5729643 - DNA, 15 bp, Homo sapiens
ctttctccaggccct

SEQ ID NO: 5729644 - DNA, 21 bp, Homo sapiens
ctttctccatggagcctacct

SEQ ID NO: 5729645 - DNA, 19 bp, Homo sapiens
ctttctcccaggccaggct

SEQ ID NO: 5729646 - DNA, 20 bp, Homo sapiens
ctttctcccaggccaggctc

SEQ ID NO: 5729647 - DNA, 21 bp, Homo sapiens
ctttctcccaggccaggctcc

SEQ ID NO: 5729648 - DNA, 16 bp, Homo sapiens
ctttctcccagtatgt

SEQ ID NO: 5729649 - DNA, 19 bp, Homo sapiens
ctttctcccagtatgtttt

SEQ ID NO: 5729650 - DNA, 21 bp, Homo sapiens
ctttctcccagtatgttttaa

SEQ ID NO: 5729651 - DNA, 17 bp, Homo sapiens
ctttctcccagtgaaat

SEQ ID NO: 5729652 - DNA, 19 bp, Homo sapiens
ctttctcccccgacactgc

SEQ ID NO: 5729653 - DNA, 20 bp, Homo sapiens
ctttctccccgctaaggaag

SEQ ID NO: 5729654 - DNA, 19 bp, Homo sapiens
ctttctcccctgcccccag

SEQ ID NO: 5729655 - DNA, 23 bp, Homo sapiens
ctttctcccctgcccccaggact

SEQ ID NO: 5729656 - DNA, 24 bp, Homo sapiens
ctttctcccctgcccccaggactg

SEQ ID NO: 5729657 - DNA, 22 bp, Homo sapiens
ctttctccctcaactgaagggg

SEQ ID NO: 5729658 - DNA, 15 bp, Homo sapiens
ctttctccctcaccc

SEQ ID NO: 5729659 - DNA, 16 bp, Homo sapiens
ctttctccctgcagcc

SEQ ID NO: 5729660 - DNA, 14 bp, Homo sapiens
ctttctccggggtc

SEQ ID NO: 5729661 - DNA, 20 bp, Homo sapiens
ctttctccggggtctgtgct

SEQ ID NO: 5729662 - DNA, 15 bp, Homo sapiens
ctttctcctcaggac

SEQ ID NO: 5729663 - DNA, 21 bp, Homo sapiens
ctttctcctcaggacaaggcc

SEQ ID NO: 5729664 - DNA, 20 bp, Homo sapiens
ctttctcctcatccatttct

SEQ ID NO: 5729665 - DNA, 23 bp, Homo sapiens
ctttctcctccccacctgtagct

SEQ ID NO: 5729666 - DNA, 14 bp, Homo sapiens
ctttctcctctttg

SEQ ID NO: 5729667 - DNA, 23 bp, Homo sapiens
ctttctcctgatagtcacctgct

SEQ ID NO: 5729668 - DNA, 14 bp, Homo sapiens
ctttctcctggtgt

SEQ ID NO: 5729669 - DNA, 15 bp, Homo sapiens
ctttctcctggtgtt

SEQ ID NO: 5729670 - DNA, 11 bp, Homo sapiens
ctttctcctgt

SEQ ID NO: 5729671 - DNA, 16 bp, Homo sapiens
ctttctcctgtgaatg

SEQ ID NO: 5729672 - DNA, 14 bp, Homo sapiens
ctttctcctgtgcc

SEQ ID NO: 5729673 - DNA, 13 bp, Homo sapiens
ctttctcctgtgg

SEQ ID NO: 5729674 - DNA, 14 bp, Homo sapiens
ctttctcctgtggt

SEQ ID NO: 5729675 - DNA, 14 bp, Homo sapiens
ctttctcctgttta

SEQ ID NO: 5729676 - DNA, 12 bp, Homo sapiens
ctttctcctttg

SEQ ID NO: 5729677 - DNA, 13 bp, Homo sapiens
ctttctccttttt

SEQ ID NO: 5729678 - DNA, 13 bp, Homo sapiens
ctttctcggggct

SEQ ID NO: 5729679 - DNA, 15 bp, Homo sapiens
ctttctctaataata

SEQ ID NO: 5729680 - DNA, 20 bp, Homo sapiens
ctttctctaataataaatag

SEQ ID NO: 5729681 - DNA, 20 bp, Homo sapiens
ctttctctcagccttacatt

SEQ ID NO: 5729682 - DNA, 21 bp, Homo sapiens
ctttctctcagccttacattt

SEQ ID NO: 5729683 - DNA, 14 bp, Homo sapiens
ctttctctccccaa

SEQ ID NO: 5729684 - DNA, 17 bp, Homo sapiens
ctttctctcccttcttt

SEQ ID NO: 5729685 - DNA, 23 bp, Homo sapiens
ctttctctccgacttcccctggg

SEQ ID NO: 5729686 - DNA, 14 bp, Homo sapiens
ctttctctcctagt

SEQ ID NO: 5729687 - DNA, 20 bp, Homo sapiens
ctttctctcctcagtttaca

SEQ ID NO: 5729688 - DNA, 21 bp, Homo sapiens
ctttctctcctcttctccctt

SEQ ID NO: 5729689 - DNA, 13 bp, Homo sapiens
ctttctctcctgg

SEQ ID NO: 5729690 - DNA, 16 bp, Homo sapiens
ctttctctcctggctc

SEQ ID NO: 5729691 - DNA, 15 bp, Homo sapiens
ctttctctccttggc

SEQ ID NO: 5729692 - DNA, 15 bp, Homo sapiens
ctttctctcctttct

SEQ ID NO: 5729693 - DNA, 15 bp, Homo sapiens
ctttctctctcactc

SEQ ID NO: 5729694 - DNA, 15 bp, Homo sapiens
ctttctctctcctct

SEQ ID NO: 5729695 - DNA, 19 bp, Homo sapiens
ctttctctctcctctctgc

SEQ ID NO: 5729696 - DNA, 17 bp, Homo sapiens
ctttctctctctctctt

SEQ ID NO: 5729697 - DNA, 15 bp, Homo sapiens
ctttctctctggctt

SEQ ID NO: 5729698 - DNA, 17 bp, Homo sapiens
ctttctctctggcttct

SEQ ID NO: 5729699 - DNA, 12 bp, Homo sapiens
ctttctctctgt

SEQ ID NO: 5729700 - DNA, 18 bp, Homo sapiens
ctttctctctgtgtggca

SEQ ID NO: 5729701 - DNA, 20 bp, Homo sapiens
ctttctctgagaaccaaaag

SEQ ID NO: 5729702 - DNA, 14 bp, Homo sapiens
ctttctctgaggac

SEQ ID NO: 5729703 - DNA, 15 bp, Homo sapiens
ctttctctgaggaca

SEQ ID NO: 5729704 - DNA, 14 bp, Homo sapiens
ctttctctgccagt

SEQ ID NO: 5729705 - DNA, 16 bp, Homo sapiens
ctttctctgccagtga

SEQ ID NO: 5729706 - DNA, 13 bp, Homo sapiens
ctttctctgcctc

SEQ ID NO: 5729707 - DNA, 15 bp, Homo sapiens
ctttctctgcctctg

SEQ ID NO: 5729708 - DNA, 16 bp, Homo sapiens
ctttctctgcctctgg

SEQ ID NO: 5729709 - DNA, 19 bp, Homo sapiens
ctttctctgcctctgggca

SEQ ID NO: 5729710 - DNA, 16 bp, Homo sapiens
ctttctctgcctggca

SEQ ID NO: 5729711 - DNA, 10 bp, Homo sapiens
ctttctctgg

SEQ ID NO: 5729712 - DNA, 17 bp, Homo sapiens
ctttctctggctccaga

SEQ ID NO: 5729713 - DNA, 19 bp, Homo sapiens
ctttctctgggcttagggt

SEQ ID NO: 5729714 - DNA, 12 bp, Homo sapiens
ctttctctgtag

SEQ ID NO: 5729715 - DNA, 13 bp, Homo sapiens
ctttctctgtagt

SEQ ID NO: 5729716 - DNA, 15 bp, Homo sapiens
ctttctctgtagttc

SEQ ID NO: 5729717 - DNA, 18 bp, Homo sapiens
ctttctctgtatattggg

SEQ ID NO: 5729718 - DNA, 15 bp, Homo sapiens
ctttctctgtgaaag

SEQ ID NO: 5729719 - DNA, 9 bp, Homo sapiens
ctttctctt

SEQ ID NO: 5729720 - DNA, 17 bp, Homo sapiens
ctttctcttctctgttc

SEQ ID NO: 5729721 - DNA, 16 bp, Homo sapiens
ctttctcttggacatt

SEQ ID NO: 5729722 - DNA, 13 bp, Homo sapiens
ctttctcttgttt

SEQ ID NO: 5729723 - DNA, 11 bp, Homo sapiens
ctttctctttc

SEQ ID NO: 5729724 - DNA, 16 bp, Homo sapiens
ctttctctttccctgg

SEQ ID NO: 5729725 - DNA, 16 bp, Homo sapiens
ctttctctttcgttac

SEQ ID NO: 5729726 - DNA, 17 bp, Homo sapiens
ctttctctttctctctt

SEQ ID NO: 5729727 - DNA, 17 bp, Homo sapiens
ctttctctttctgtttc

SEQ ID NO: 5729728 - DNA, 14 bp, Homo sapiens
ctttctctttcttc

SEQ ID NO: 5729729 - DNA, 21 bp, Homo sapiens
ctttctcttttcccctttcct

SEQ ID NO: 5729730 - DNA, 22 bp, Homo sapiens
ctttctcttttcccctttcctg

SEQ ID NO: 5729731 - DNA, 19 bp, Homo sapiens
ctttctcttttctcttttt

SEQ ID NO: 5729732 - DNA, 18 bp, Homo sapiens
ctttctgaaaatttatat

SEQ ID NO: 5729733 - DNA, 22 bp, Homo sapiens
ctttctgaaaatttatataact

SEQ ID NO: 5729734 - DNA, 21 bp, Homo sapiens
ctttctgaaactcccttgtgt

SEQ ID NO: 5729735 - DNA, 13 bp, Homo sapiens
ctttctgaaataa

SEQ ID NO: 5729736 - DNA, 16 bp, Homo sapiens
ctttctgaaatagtca

SEQ ID NO: 5729737 - DNA, 15 bp, Homo sapiens
ctttctgaaattcac

SEQ ID NO: 5729738 - DNA, 19 bp, Homo sapiens
ctttctgaacagctggtgt

SEQ ID NO: 5729739 - DNA, 20 bp, Homo sapiens
ctttctgaagcctcacttat

SEQ ID NO: 5729740 - DNA, 14 bp, Homo sapiens
ctttctgaaggaag

SEQ ID NO: 5729741 - DNA, 17 bp, Homo sapiens
ctttctgaattgcacat

SEQ ID NO: 5729742 - DNA, 20 bp, Homo sapiens
ctttctgaatttcattctct

SEQ ID NO: 5729743 - DNA, 21 bp, Homo sapiens
ctttctgacaataaataatat

SEQ ID NO: 5729744 - DNA, 17 bp, Homo sapiens
ctttctgacatcagcac

SEQ ID NO: 5729745 - DNA, 15 bp, Homo sapiens
ctttctgactctaaa

SEQ ID NO: 5729746 - DNA, 14 bp, Homo sapiens
ctttctgactgcaa

SEQ ID NO: 5729747 - DNA, 22 bp, Homo sapiens
ctttctgactgcaacttctgtc

SEQ ID NO: 5729748 - DNA, 20 bp, Homo sapiens
ctttctgagcacactttagt

SEQ ID NO: 5729749 - DNA, 22 bp, Homo sapiens
ctttctgagggcccgtgtaaat

SEQ ID NO: 5729750 - DNA, 23 bp, Homo sapiens
ctttctgataactagatggtgct

SEQ ID NO: 5729751 - DNA, 15 bp, Homo sapiens
ctttctgatcaaggc

SEQ ID NO: 5729752 - DNA, 17 bp, Homo sapiens
ctttctgatcttcacta

SEQ ID NO: 5729753 - DNA, 23 bp, Homo sapiens
ctttctgattccgcaccctgcct

SEQ ID NO: 5729754 - DNA, 18 bp, Homo sapiens
ctttctgcagaaaattct

SEQ ID NO: 5729755 - DNA, 23 bp, Homo sapiens
ctttctgcatgaccaaagtgata

SEQ ID NO: 5729756 - DNA, 14 bp, Homo sapiens
ctttctgccaggga

SEQ ID NO: 5729757 - DNA, 22 bp, Homo sapiens
ctttctgccatctagccagccc

SEQ ID NO: 5729758 - DNA, 20 bp, Homo sapiens
ctttctgccccccagggcta

SEQ ID NO: 5729759 - DNA, 21 bp, Homo sapiens
ctttctgccccccagggctag

SEQ ID NO: 5729760 - DNA, 15 bp, Homo sapiens
ctttctgcctctcct

SEQ ID NO: 5729761 - DNA, 11 bp, Homo sapiens
ctttctgcctg

SEQ ID NO: 5729762 - DNA, 14 bp, Homo sapiens
ctttctgcctggag

SEQ ID NO: 5729763 - DNA, 14 bp, Homo sapiens
ctttctgccttagc

SEQ ID NO: 5729764 - DNA, 17 bp, Homo sapiens
ctttctgccttggcctc

SEQ ID NO: 5729765 - DNA, 21 bp, Homo sapiens
ctttctgctagtggtgagcat

SEQ ID NO: 5729766 - DNA, 17 bp, Homo sapiens
ctttctgctcagcttct

SEQ ID NO: 5729767 - DNA, 19 bp, Homo sapiens
ctttctgctcctttctcca

SEQ ID NO: 5729768 - DNA, 16 bp, Homo sapiens
ctttctgcttgtgtta

SEQ ID NO: 5729769 - DNA, 23 bp, Homo sapiens
ctttctggaattgggctccgtgg

SEQ ID NO: 5729770 - DNA, 18 bp, Homo sapiens
ctttctggaccagatcct

SEQ ID NO: 5729771 - DNA, 23 bp, Homo sapiens
ctttctggactggcgttcacctc

SEQ ID NO: 5729772 - DNA, 11 bp, Homo sapiens
ctttctggccc

SEQ ID NO: 5729773 - DNA, 18 bp, Homo sapiens
ctttctggccccagccta

SEQ ID NO: 5729774 - DNA, 13 bp, Homo sapiens
ctttctggcctgc

SEQ ID NO: 5729775 - DNA, 15 bp, Homo sapiens
ctttctggcctgcct

SEQ ID NO: 5729776 - DNA, 17 bp, Homo sapiens
ctttctggcctgccttc

SEQ ID NO: 5729777 - DNA, 13 bp, Homo sapiens
ctttctggcctgt

SEQ ID NO: 5729778 - DNA, 20 bp, Homo sapiens
ctttctggctatgcatttga

SEQ ID NO: 5729779 - DNA, 12 bp, Homo sapiens
ctttctggcttt

SEQ ID NO: 5729780 - DNA, 12 bp, Homo sapiens
ctttctgggagc

SEQ ID NO: 5729781 - DNA, 14 bp, Homo sapiens
ctttctgggctctg

SEQ ID NO: 5729782 - DNA, 16 bp, Homo sapiens
ctttctgggctctgga

SEQ ID NO: 5729783 - DNA, 19 bp, Homo sapiens
ctttctgggctctggactc

SEQ ID NO: 5729784 - DNA, 14 bp, Homo sapiens
ctttctgggctttc

SEQ ID NO: 5729785 - DNA, 17 bp, Homo sapiens
ctttctggggtttttct

SEQ ID NO: 5729786 - DNA, 18 bp, Homo sapiens
ctttctggggtttttctg

SEQ ID NO: 5729787 - DNA, 18 bp, Homo sapiens
ctttctggtcccttcagt

SEQ ID NO: 5729788 - DNA, 22 bp, Homo sapiens
ctttctggtgttttatttccta

SEQ ID NO: 5729789 - DNA, 17 bp, Homo sapiens
ctttctgtaaacagaat

SEQ ID NO: 5729790 - DNA, 16 bp, Homo sapiens
ctttctgtaaccataa

SEQ ID NO: 5729791 - DNA, 13 bp, Homo sapiens
ctttctgtagcct

SEQ ID NO: 5729792 - DNA, 14 bp, Homo sapiens
ctttctgtagccta

SEQ ID NO: 5729793 - DNA, 12 bp, Homo sapiens
ctttctgtagta

SEQ ID NO: 5729794 - DNA, 16 bp, Homo sapiens
ctttctgtcccatcct

SEQ ID NO: 5729795 - DNA, 16 bp, Homo sapiens
ctttctgtctcccttc

SEQ ID NO: 5729796 - DNA, 21 bp, Homo sapiens
ctttctgtctcccttctctct

SEQ ID NO: 5729797 - DNA, 15 bp, Homo sapiens
ctttctgtctctctc

SEQ ID NO: 5729798 - DNA, 14 bp, Homo sapiens
ctttctgtctgctt

SEQ ID NO: 5729799 - DNA, 18 bp, Homo sapiens
ctttctgtgaaagcctta

SEQ ID NO: 5729800 - DNA, 14 bp, Homo sapiens
ctttctgtgaagct

SEQ ID NO: 5729801 - DNA, 15 bp, Homo sapiens
ctttctgtgaagcta

SEQ ID NO: 5729802 - DNA, 20 bp, Homo sapiens
ctttctgtgaagctaataca

SEQ ID NO: 5729803 - DNA, 14 bp, Homo sapiens
ctttctgtgcatgt

SEQ ID NO: 5729804 - DNA, 14 bp, Homo sapiens
ctttctgtgcccta

SEQ ID NO: 5729805 - DNA, 22 bp, Homo sapiens
ctttctgtgccctactcattgg

SEQ ID NO: 5729806 - DNA, 14 bp, Homo sapiens
ctttctgtgcttct

SEQ ID NO: 5729807 - DNA, 12 bp, Homo sapiens
ctttctgtgtgc

SEQ ID NO: 5729808 - DNA, 21 bp, Homo sapiens
ctttctgtgtgcaccttacca

SEQ ID NO: 5729809 - DNA, 13 bp, Homo sapiens
ctttctgtgttta

SEQ ID NO: 5729810 - DNA, 13 bp, Homo sapiens
ctttctgttcatc

SEQ ID NO: 5729811 - DNA, 20 bp, Homo sapiens
ctttctgttcatctctttgt

SEQ ID NO: 5729812 - DNA, 13 bp, Homo sapiens
ctttctgttccaa

SEQ ID NO: 5729813 - DNA, 14 bp, Homo sapiens
ctttctgttccaaa

SEQ ID NO: 5729814 - DNA, 23 bp, Homo sapiens
ctttctgttccaaattcagtttc

SEQ ID NO: 5729815 - DNA, 22 bp, Homo sapiens
ctttctgttgccagtcagcaac

SEQ ID NO: 5729816 - DNA, 15 bp, Homo sapiens
ctttctgttgtcatt

SEQ ID NO: 5729817 - DNA, 14 bp, Homo sapiens
ctttctgtttcctg

SEQ ID NO: 5729818 - DNA, 15 bp, Homo sapiens
ctttctgtttcctgg

SEQ ID NO: 5729819 - DNA, 23 bp, Homo sapiens
ctttctgttttctgtttgtaaat

SEQ ID NO: 5729820 - DNA, 23 bp, Homo sapiens
ctttctgttttttttttttgtat

SEQ ID NO: 5729821 - DNA, 12 bp, Homo sapiens
ctttcttaaaaa

SEQ ID NO: 5729822 - DNA, 23 bp, Homo sapiens
ctttcttaagccctttgctctgg

SEQ ID NO: 5729823 - DNA, 23 bp, Homo sapiens
ctttcttaatatttttacatgca

SEQ ID NO: 5729824 - DNA, 15 bp, Homo sapiens
ctttcttaattttgt

SEQ ID NO: 5729825 - DNA, 11 bp, Homo sapiens
ctttcttagaa

SEQ ID NO: 5729826 - DNA, 17 bp, Homo sapiens
ctttcttagaaatttat

SEQ ID NO: 5729827 - DNA, 17 bp, Homo sapiens
ctttcttattcagtgaa

SEQ ID NO: 5729828 - DNA, 14 bp, Homo sapiens
ctttcttatttgca

SEQ ID NO: 5729829 - DNA, 16 bp, Homo sapiens
ctttcttattttgtaa

SEQ ID NO: 5729830 - DNA, 22 bp, Homo sapiens
ctttcttattttgtaataaact

SEQ ID NO: 5729831 - DNA, 23 bp, Homo sapiens
ctttcttattttgtaataaactc

SEQ ID NO: 5729832 - DNA, 21 bp, Homo sapiens
ctttcttcaaaaagcatttta

SEQ ID NO: 5729833 - DNA, 15 bp, Homo sapiens
ctttcttcaattaat

SEQ ID NO: 5729834 - DNA, 14 bp, Homo sapiens
ctttcttcaccaag

SEQ ID NO: 5729835 - DNA, 22 bp, Homo sapiens
ctttcttcaccaagtgcaatag

SEQ ID NO: 5729836 - DNA, 22 bp, Homo sapiens
ctttcttcagttcagtagattt

SEQ ID NO: 5729837 - DNA, 19 bp, Homo sapiens
ctttcttccaaacaggctc

SEQ ID NO: 5729838 - DNA, 22 bp, Homo sapiens
ctttcttccaaacaggctcaga

SEQ ID NO: 5729839 - DNA, 21 bp, Homo sapiens
ctttcttccactaccctccct

SEQ ID NO: 5729840 - DNA, 20 bp, Homo sapiens
ctttcttccattccttcatg

SEQ ID NO: 5729841 - DNA, 14 bp, Homo sapiens
ctttcttcccgtgt

SEQ ID NO: 5729842 - DNA, 22 bp, Homo sapiens
ctttcttcctccagtctgttct

SEQ ID NO: 5729843 - DNA, 15 bp, Homo sapiens
ctttcttcctttcta

SEQ ID NO: 5729844 - DNA, 15 bp, Homo sapiens
ctttcttctatttta

SEQ ID NO: 5729845 - DNA, 16 bp, Homo sapiens
ctttcttctattttat

SEQ ID NO: 5729846 - DNA, 14 bp, Homo sapiens
ctttcttctctgct

SEQ ID NO: 5729847 - DNA, 11 bp, Homo sapiens
ctttcttctgt

SEQ ID NO: 5729848 - DNA, 14 bp, Homo sapiens
ctttcttcttccca

SEQ ID NO: 5729849 - DNA, 13 bp, Homo sapiens
ctttcttctttcc

SEQ ID NO: 5729850 - DNA, 15 bp, Homo sapiens
ctttcttctttcctt

SEQ ID NO: 5729851 - DNA, 20 bp, Homo sapiens
ctttcttgacaaaacctaac

SEQ ID NO: 5729852 - DNA, 22 bp, Homo sapiens
ctttcttgacaaaacctaactt

SEQ ID NO: 5729853 - DNA, 22 bp, Homo sapiens
ctttcttgatcaacatcttttc

SEQ ID NO: 5729854 - DNA, 19 bp, Homo sapiens
ctttcttgccacacagtgg

SEQ ID NO: 5729855 - DNA, 17 bp, Homo sapiens
ctttcttgctcccttca

SEQ ID NO: 5729856 - DNA, 20 bp, Homo sapiens
ctttcttgctcccttcagcc

SEQ ID NO: 5729857 - DNA, 20 bp, Homo sapiens
ctttcttgctggctctgaga

SEQ ID NO: 5729858 - DNA, 12 bp, Homo sapiens
ctttcttgcttc

SEQ ID NO: 5729859 - DNA, 15 bp, Homo sapiens
ctttcttggtgtctg

SEQ ID NO: 5729860 - DNA, 20 bp, Homo sapiens
ctttcttggttcataaatga

SEQ ID NO: 5729861 - DNA, 21 bp, Homo sapiens
ctttcttggttcataaatgaa

SEQ ID NO: 5729862 - DNA, 17 bp, Homo sapiens
ctttcttgtgccctggg

SEQ ID NO: 5729863 - DNA, 19 bp, Homo sapiens
ctttcttgtgccctgggcc

SEQ ID NO: 5729864 - DNA, 15 bp, Homo sapiens
ctttcttgtttgtca

SEQ ID NO: 5729865 - DNA, 20 bp, Homo sapiens
ctttcttgtttgtcagcatc

SEQ ID NO: 5729866 - DNA, 21 bp, Homo sapiens
ctttcttgtttgtcagcatct

SEQ ID NO: 5729867 - DNA, 14 bp, Homo sapiens
ctttctttaacata

SEQ ID NO: 5729868 - DNA, 17 bp, Homo sapiens
ctttctttcagatgttt

SEQ ID NO: 5729869 - DNA, 11 bp, Homo sapiens
ctttctttcca

SEQ ID NO: 5729870 - DNA, 13 bp, Homo sapiens
ctttctttccaaa

SEQ ID NO: 5729871 - DNA, 19 bp, Homo sapiens
ctttctttccaaaggttgt

SEQ ID NO: 5729872 - DNA, 14 bp, Homo sapiens
ctttctttccctta

SEQ ID NO: 5729873 - DNA, 16 bp, Homo sapiens
ctttctttcccttact

SEQ ID NO: 5729874 - DNA, 20 bp, Homo sapiens
ctttctttccgtcaccctgg

SEQ ID NO: 5729875 - DNA, 13 bp, Homo sapiens
ctttctttctctt

SEQ ID NO: 5729876 - DNA, 13 bp, Homo sapiens
ctttctttcttaa

SEQ ID NO: 5729877 - DNA, 13 bp, Homo sapiens
ctttctttcttta

SEQ ID NO: 5729878 - DNA, 15 bp, Homo sapiens
ctttctttgagtttt

SEQ ID NO: 5729879 - DNA, 18 bp, Homo sapiens
ctttctttgcaccaaaga

SEQ ID NO: 5729880 - DNA, 20 bp, Homo sapiens
ctttctttgcacttaaaaat

SEQ ID NO: 5729881 - DNA, 15 bp, Homo sapiens
ctttctttgcctctg

SEQ ID NO: 5729882 - DNA, 15 bp, Homo sapiens
ctttctttgctgctg

SEQ ID NO: 5729883 - DNA, 21 bp, Homo sapiens
ctttctttgctgctgtggaaa

SEQ ID NO: 5729884 - DNA, 22 bp, Homo sapiens
ctttctttgggaatatttgaat

SEQ ID NO: 5729885 - DNA, 17 bp, Homo sapiens
ctttctttggggaaaaa

SEQ ID NO: 5729886 - DNA, 21 bp, Homo sapiens
ctttctttggtaggtaaatct

SEQ ID NO: 5729887 - DNA, 20 bp, Homo sapiens
ctttctttggtgcctttcct

SEQ ID NO: 5729888 - DNA, 14 bp, Homo sapiens
ctttctttgtcatt

SEQ ID NO: 5729889 - DNA, 17 bp, Homo sapiens
ctttctttgtcattcag

SEQ ID NO: 5729890 - DNA, 18 bp, Homo sapiens
ctttctttgtttctttct

SEQ ID NO: 5729891 - DNA, 19 bp, Homo sapiens
ctttcttttaatgatgcca

SEQ ID NO: 5729892 - DNA, 18 bp, Homo sapiens
ctttcttttattaatata

SEQ ID NO: 5729893 - DNA, 19 bp, Homo sapiens
ctttcttttcatgcccatc

SEQ ID NO: 5729894 - DNA, 22 bp, Homo sapiens
ctttcttttgcaggagtttgtg

SEQ ID NO: 5729895 - DNA, 18 bp, Homo sapiens
ctttcttttgtgttggat

SEQ ID NO: 5729896 - DNA, 14 bp, Homo sapiens
ctttctttttctgg

SEQ ID NO: 5729897 - DNA, 22 bp, Homo sapiens
ctttctttttctggaaattttg

SEQ ID NO: 5729898 - DNA, 17 bp, Homo sapiens
ctttctttttctgtctc

SEQ ID NO: 5729899 - DNA, 18 bp, Homo sapiens
ctttctttttctgtctct

SEQ ID NO: 5729900 - DNA, 14 bp, Homo sapiens
ctttctttttcttc

SEQ ID NO: 5729901 - DNA, 20 bp, Homo sapiens
ctttctttttcttcttccct

SEQ ID NO: 5729902 - DNA, 22 bp, Homo sapiens
ctttctttttcttttttgcttt

SEQ ID NO: 5729903 - DNA, 17 bp, Homo sapiens
ctttcttttttctctga

SEQ ID NO: 5729904 - DNA, 18 bp, Homo sapiens
ctttcttttttggccatc

SEQ ID NO: 5729905 - DNA, 15 bp, Homo sapiens
ctttctttttttccc

SEQ ID NO: 5729906 - DNA, 19 bp, Homo sapiens
ctttcttttttttcttggt

SEQ ID NO: 5729907 - DNA, 17 bp, Homo sapiens
ctttgaaaaaaaataaa

SEQ ID NO: 5729908 - DNA, 23 bp, Homo sapiens
ctttgaaaaatcacttgattcat

SEQ ID NO: 5729909 - DNA, 22 bp, Homo sapiens
ctttgaaaacaccagctgtata

SEQ ID NO: 5729910 - DNA, 17 bp, Homo sapiens
ctttgaaaagttggaag

SEQ ID NO: 5729911 - DNA, 15 bp, Homo sapiens
ctttgaaaatatttc

SEQ ID NO: 5729912 - DNA, 16 bp, Homo sapiens
ctttgaaaatatttct

SEQ ID NO: 5729913 - DNA, 15 bp, Homo sapiens
ctttgaaacctcagg

SEQ ID NO: 5729914 - DNA, 17 bp, Homo sapiens
ctttgaaacctcagggc

SEQ ID NO: 5729915 - DNA, 19 bp, Homo sapiens
ctttgaaacctgctctgta

SEQ ID NO: 5729916 - DNA, 12 bp, Homo sapiens
ctttgaaagaag

SEQ ID NO: 5729917 - DNA, 13 bp, Homo sapiens
ctttgaaagaagc

SEQ ID NO: 5729918 - DNA, 11 bp, Homo sapiens
ctttgaaagac

SEQ ID NO: 5729919 - DNA, 17 bp, Homo sapiens
ctttgaaataaaataac

SEQ ID NO: 5729920 - DNA, 16 bp, Homo sapiens
ctttgaaatacctcat

SEQ ID NO: 5729921 - DNA, 19 bp, Homo sapiens
ctttgaaatagtctgtgtg

SEQ ID NO: 5729922 - DNA, 21 bp, Homo sapiens
ctttgaaatatgcatgtactt

SEQ ID NO: 5729923 - DNA, 22 bp, Homo sapiens
ctttgaaatatgcatgtacttt

SEQ ID NO: 5729924 - DNA, 19 bp, Homo sapiens
ctttgaaatatttaatttc

SEQ ID NO: 5729925 - DNA, 19 bp, Homo sapiens
ctttgaaatgctaaacttg

SEQ ID NO: 5729926 - DNA, 18 bp, Homo sapiens
ctttgaaatgtgtttctg

SEQ ID NO: 5729927 - DNA, 15 bp, Homo sapiens
ctttgaaattgttta

SEQ ID NO: 5729928 - DNA, 22 bp, Homo sapiens
ctttgaacacatctcttagtcc

SEQ ID NO: 5729929 - DNA, 13 bp, Homo sapiens
ctttgaacatgaa

SEQ ID NO: 5729930 - DNA, 18 bp, Homo sapiens
ctttgaacctgtgcaata

SEQ ID NO: 5729931 - DNA, 14 bp, Homo sapiens
ctttgaacgtgcca

SEQ ID NO: 5729932 - DNA, 19 bp, Homo sapiens
ctttgaacgtgccagcagc

SEQ ID NO: 5729933 - DNA, 16 bp, Homo sapiens
ctttgaacgtgcttct

SEQ ID NO: 5729934 - DNA, 17 bp, Homo sapiens
ctttgaacgtgcttctt

SEQ ID NO: 5729935 - DNA, 23 bp, Homo sapiens
ctttgaacgtgcttctttgtaat

SEQ ID NO: 5729936 - DNA, 23 bp, Homo sapiens
ctttgaactgaaacttttctaaa

SEQ ID NO: 5729937 - DNA, 16 bp, Homo sapiens
ctttgaacttcgatgt

SEQ ID NO: 5729938 - DNA, 17 bp, Homo sapiens
ctttgaacttcgatgtt

SEQ ID NO: 5729939 - DNA, 17 bp, Homo sapiens
ctttgaactttagtttg

SEQ ID NO: 5729940 - DNA, 14 bp, Homo sapiens
ctttgaagaaggaa

SEQ ID NO: 5729941 - DNA, 16 bp, Homo sapiens
ctttgaagaaggtgga

SEQ ID NO: 5729942 - DNA, 14 bp, Homo sapiens
ctttgaagaggaaa

SEQ ID NO: 5729943 - DNA, 16 bp, Homo sapiens
ctttgaagcctcagct

SEQ ID NO: 5729944 - DNA, 23 bp, Homo sapiens
ctttgaaggaaagctaagtcttg

SEQ ID NO: 5729945 - DNA, 14 bp, Homo sapiens
ctttgaagggcaag

SEQ ID NO: 5729946 - DNA, 18 bp, Homo sapiens
ctttgaaggggcctcacc

SEQ ID NO: 5729947 - DNA, 16 bp, Homo sapiens
ctttgaagtgcagctc

SEQ ID NO: 5729948 - DNA, 22 bp, Homo sapiens
ctttgaagtgcagctcatgttt

SEQ ID NO: 5729949 - DNA, 15 bp, Homo sapiens
ctttgaagttattta

SEQ ID NO: 5729950 - DNA, 14 bp, Homo sapiens
ctttgaataaaaga

SEQ ID NO: 5729951 - DNA, 15 bp, Homo sapiens
ctttgaataaaagaa

SEQ ID NO: 5729952 - DNA, 21 bp, Homo sapiens
ctttgaataaagaatacttga

SEQ ID NO: 5729953 - DNA, 16 bp, Homo sapiens
ctttgaataaagtctg

SEQ ID NO: 5729954 - DNA, 18 bp, Homo sapiens
ctttgaataaagtctgag

SEQ ID NO: 5729955 - DNA, 19 bp, Homo sapiens
ctttgaataaagtctgagt

SEQ ID NO: 5729956 - DNA, 18 bp, Homo sapiens
ctttgaataaatgtcact

SEQ ID NO: 5729957 - DNA, 19 bp, Homo sapiens
ctttgaataaatgtcactt

SEQ ID NO: 5729958 - DNA, 21 bp, Homo sapiens
ctttgaatacccccagagacc

SEQ ID NO: 5729959 - DNA, 16 bp, Homo sapiens
ctttgaatagaggcca

SEQ ID NO: 5729960 - DNA, 21 bp, Homo sapiens
ctttgaatattttttgaaggt

SEQ ID NO: 5729961 - DNA, 18 bp, Homo sapiens
ctttgaatctctgtatat

SEQ ID NO: 5729962 - DNA, 16 bp, Homo sapiens
ctttgaatctgggact

SEQ ID NO: 5729963 - DNA, 23 bp, Homo sapiens
ctttgaatgctttttgaatgtta

SEQ ID NO: 5729964 - DNA, 16 bp, Homo sapiens
ctttgaatgtgtttca

SEQ ID NO: 5729965 - DNA, 18 bp, Homo sapiens
ctttgaatgtgtttcaca

SEQ ID NO: 5729966 - DNA, 17 bp, Homo sapiens
ctttgaatgttaatttt

SEQ ID NO: 5729967 - DNA, 14 bp, Homo sapiens
ctttgaatttatat

SEQ ID NO: 5729968 - DNA, 22 bp, Homo sapiens
ctttgaatttcttgatttttca

SEQ ID NO: 5729969 - DNA, 11 bp, Homo sapiens
ctttgaatttt

SEQ ID NO: 5729970 - DNA, 14 bp, Homo sapiens
ctttgaattttcat

SEQ ID NO: 5729971 - DNA, 15 bp, Homo sapiens
ctttgaattttcatt

SEQ ID NO: 5729972 - DNA, 24 bp, Homo sapiens
ctttgacaaaatgactggctcctg

SEQ ID NO: 5729973 - DNA, 19 bp, Homo sapiens
ctttgacaaaggtaaatca

SEQ ID NO: 5729974 - DNA, 15 bp, Homo sapiens
ctttgacaactaaaa

SEQ ID NO: 5729975 - DNA, 22 bp, Homo sapiens
ctttgacaaggaaaatctatat

SEQ ID NO: 5729976 - DNA, 21 bp, Homo sapiens
ctttgacaattcctagataaa

SEQ ID NO: 5729977 - DNA, 16 bp, Homo sapiens
ctttgacacccaggct

SEQ ID NO: 5729978 - DNA, 22 bp, Homo sapiens
ctttgacacttttcatatcatt

SEQ ID NO: 5729979 - DNA, 19 bp, Homo sapiens
ctttgacagcgcacagctg

SEQ ID NO: 5729980 - DNA, 20 bp, Homo sapiens
ctttgacagcgcacagctgc

SEQ ID NO: 5729981 - DNA, 22 bp, Homo sapiens
ctttgacagcgcacagctgctc

SEQ ID NO: 5729982 - DNA, 21 bp, Homo sapiens
ctttgacaggttccttttaag

SEQ ID NO: 5729983 - DNA, 19 bp, Homo sapiens
ctttgacattgatgtgttc

SEQ ID NO: 5729984 - DNA, 17 bp, Homo sapiens
ctttgacatttaattta

SEQ ID NO: 5729985 - DNA, 19 bp, Homo sapiens
ctttgaccaaactgtgggt

SEQ ID NO: 5729986 - DNA, 20 bp, Homo sapiens
ctttgaccagatctttctct

SEQ ID NO: 5729987 - DNA, 17 bp, Homo sapiens
ctttgacctcaacctgt

SEQ ID NO: 5729988 - DNA, 21 bp, Homo sapiens
ctttgacctcaacctgtgatg

SEQ ID NO: 5729989 - DNA, 22 bp, Homo sapiens
ctttgacctcaatggaggtttg

SEQ ID NO: 5729990 - DNA, 17 bp, Homo sapiens
ctttgacctctgcagca

SEQ ID NO: 5729991 - DNA, 22 bp, Homo sapiens
ctttgacctgacgatcttcccc

SEQ ID NO: 5729992 - DNA, 20 bp, Homo sapiens
ctttgacctgcctcccttca

SEQ ID NO: 5729993 - DNA, 18 bp, Homo sapiens
ctttgacctgttcagaag

SEQ ID NO: 5729994 - DNA, 14 bp, Homo sapiens
ctttgacctgttgg

SEQ ID NO: 5729995 - DNA, 20 bp, Homo sapiens
ctttgacgagtcaccttcca

SEQ ID NO: 5729996 - DNA, 22 bp, Homo sapiens
ctttgacgccatcccagcccca

SEQ ID NO: 5729997 - DNA, 20 bp, Homo sapiens
ctttgacgggaggcctcagt

SEQ ID NO: 5729998 - DNA, 18 bp, Homo sapiens
ctttgacgggccaggccc

SEQ ID NO: 5729999 - DNA, 20 bp, Homo sapiens
ctttgacgtaattaaatcca

SEQ ID NO: 5730000 - DNA, 16 bp, Homo sapiens
ctttgactcacctgtt

SEQ ID NO: 5730001 - DNA, 13 bp, Homo sapiens
ctttgactcagga

SEQ ID NO: 5730002 - DNA, 20 bp, Homo sapiens
ctttgactgaagccgtgcct

SEQ ID NO: 5730003 - DNA, 18 bp, Homo sapiens
ctttgactggagggtcca

SEQ ID NO: 5730004 - DNA, 13 bp, Homo sapiens
ctttgactgtcag

SEQ ID NO: 5730005 - DNA, 20 bp, Homo sapiens
ctttgactgtgattttatgt

SEQ ID NO: 5730006 - DNA, 22 bp, Homo sapiens
ctttgacttaagggttgcttgc

SEQ ID NO: 5730007 - DNA, 20 bp, Homo sapiens
ctttgacttcagctgcctga

SEQ ID NO: 5730008 - DNA, 22 bp, Homo sapiens
ctttgacttcagctgcctgaaa

SEQ ID NO: 5730009 - DNA, 17 bp, Homo sapiens
ctttgactttatctcct

SEQ ID NO: 5730010 - DNA, 21 bp, Homo sapiens
ctttgactttatctcctgctc

SEQ ID NO: 5730011 - DNA, 13 bp, Homo sapiens
ctttgagaagaat

SEQ ID NO: 5730012 - DNA, 20 bp, Homo sapiens
ctttgagacaggtgcctggg

SEQ ID NO: 5730013 - DNA, 17 bp, Homo sapiens
ctttgagacagtttctt

SEQ ID NO: 5730014 - DNA, 18 bp, Homo sapiens
ctttgagacagtttctta

SEQ ID NO: 5730015 - DNA, 18 bp, Homo sapiens
ctttgagaccagaagaaa

SEQ ID NO: 5730016 - DNA, 19 bp, Homo sapiens
ctttgagaccagaagaaaa

SEQ ID NO: 5730017 - DNA, 20 bp, Homo sapiens
ctttgagaccagccagggca

SEQ ID NO: 5730018 - DNA, 20 bp, Homo sapiens
ctttgagaccccagtgcctg

SEQ ID NO: 5730019 - DNA, 21 bp, Homo sapiens
ctttgagactcctcagcaccc

SEQ ID NO: 5730020 - DNA, 18 bp, Homo sapiens
ctttgagagagtttatca

SEQ ID NO: 5730021 - DNA, 21 bp, Homo sapiens
ctttgagataatacattccga

SEQ ID NO: 5730022 - DNA, 16 bp, Homo sapiens
ctttgagatctaaaaa

SEQ ID NO: 5730023 - DNA, 17 bp, Homo sapiens
ctttgagatctaaaaat

SEQ ID NO: 5730024 - DNA, 23 bp, Homo sapiens
ctttgagatctaaaaataactgt

SEQ ID NO: 5730025 - DNA, 24 bp, Homo sapiens
ctttgagatgtgttcctcctgctg

SEQ ID NO: 5730026 - DNA, 21 bp, Homo sapiens
ctttgagcccacaaagcctta

SEQ ID NO: 5730027 - DNA, 13 bp, Homo sapiens
ctttgagcccatt

SEQ ID NO: 5730028 - DNA, 17 bp, Homo sapiens
ctttgagcctgcatctt

SEQ ID NO: 5730029 - DNA, 17 bp, Homo sapiens
ctttgagcctgggaaat

SEQ ID NO: 5730030 - DNA, 22 bp, Homo sapiens
ctttgagcctttattggtaaat

SEQ ID NO: 5730031 - DNA, 22 bp, Homo sapiens
ctttgagctactgccgtcagtg

SEQ ID NO: 5730032 - DNA, 14 bp, Homo sapiens
ctttgagctcccac

SEQ ID NO: 5730033 - DNA, 15 bp, Homo sapiens
ctttgagcttctcct

SEQ ID NO: 5730034 - DNA, 21 bp, Homo sapiens
ctttgagcttctcctctgctc

SEQ ID NO: 5730035 - DNA, 13 bp, Homo sapiens
ctttgaggaaacc

SEQ ID NO: 5730036 - DNA, 17 bp, Homo sapiens
ctttgaggacaaagaga

SEQ ID NO: 5730037 - DNA, 16 bp, Homo sapiens
ctttgaggctctgtca

SEQ ID NO: 5730038 - DNA, 14 bp, Homo sapiens
ctttgagggactgc

SEQ ID NO: 5730039 - DNA, 20 bp, Homo sapiens
ctttgagggactgcctctgc

SEQ ID NO: 5730040 - DNA, 21 bp, Homo sapiens
ctttgagggactgcctctgcc

SEQ ID NO: 5730041 - DNA, 17 bp, Homo sapiens
ctttgaggttgctttgt

SEQ ID NO: 5730042 - DNA, 16 bp, Homo sapiens
ctttgagtacagatac

SEQ ID NO: 5730043 - DNA, 24 bp, Homo sapiens
ctttgagtacagatactgtgagct

SEQ ID NO: 5730044 - DNA, 13 bp, Homo sapiens
ctttgagtaccaa

SEQ ID NO: 5730045 - DNA, 21 bp, Homo sapiens
ctttgagtagatccatttcca

SEQ ID NO: 5730046 - DNA, 24 bp, Homo sapiens
ctttgagtccacgcccaccagcct

SEQ ID NO: 5730047 - DNA, 13 bp, Homo sapiens
ctttgagtgtaaa

SEQ ID NO: 5730048 - DNA, 22 bp, Homo sapiens
ctttgagtgtattctatttgtg

SEQ ID NO: 5730049 - DNA, 21 bp, Homo sapiens
ctttgagtgtcttaattaaaa

SEQ ID NO: 5730050 - DNA, 22 bp, Homo sapiens
ctttgagttactgatcttcctt

SEQ ID NO: 5730051 - DNA, 19 bp, Homo sapiens
ctttgagtttcctcaggct

SEQ ID NO: 5730052 - DNA, 17 bp, Homo sapiens
ctttgataaaataaatg

SEQ ID NO: 5730053 - DNA, 14 bp, Homo sapiens
ctttgataacaaaa

SEQ ID NO: 5730054 - DNA, 19 bp, Homo sapiens
ctttgataacaaaaaataa

SEQ ID NO: 5730055 - DNA, 20 bp, Homo sapiens
ctttgataacaaaaaataaa

SEQ ID NO: 5730056 - DNA, 16 bp, Homo sapiens
ctttgataatgttaaa

SEQ ID NO: 5730057 - DNA, 16 bp, Homo sapiens
ctttgatactaccagg

SEQ ID NO: 5730058 - DNA, 15 bp, Homo sapiens
ctttgatagtgtaaa

SEQ ID NO: 5730059 - DNA, 22 bp, Homo sapiens
ctttgatatataggacattgat

SEQ ID NO: 5730060 - DNA, 19 bp, Homo sapiens
ctttgatatgttgatgaaa

SEQ ID NO: 5730061 - DNA, 15 bp, Homo sapiens
ctttgatatttcaat

SEQ ID NO: 5730062 - DNA, 22 bp, Homo sapiens
ctttgatattttcaacgcagcc

SEQ ID NO: 5730063 - DNA, 17 bp, Homo sapiens
ctttgatcacaggagca

SEQ ID NO: 5730064 - DNA, 20 bp, Homo sapiens
ctttgatcgtatatttctca

SEQ ID NO: 5730065 - DNA, 16 bp, Homo sapiens
ctttgatctctgctta

SEQ ID NO: 5730066 - DNA, 18 bp, Homo sapiens
ctttgatgagcatttgtt

SEQ ID NO: 5730067 - DNA, 16 bp, Homo sapiens
ctttgatgcacaaaat

SEQ ID NO: 5730068 - DNA, 20 bp, Homo sapiens
ctttgatgcatttccacact

SEQ ID NO: 5730069 - DNA, 14 bp, Homo sapiens
ctttgatggaggag

SEQ ID NO: 5730070 - DNA, 21 bp, Homo sapiens
ctttgatgtcaaacgccttga

SEQ ID NO: 5730071 - DNA, 13 bp, Homo sapiens
ctttgatgtgttg

SEQ ID NO: 5730072 - DNA, 15 bp, Homo sapiens
ctttgatgtgttgtt

SEQ ID NO: 5730073 - DNA, 16 bp, Homo sapiens
ctttgatgtgttgttc

SEQ ID NO: 5730074 - DNA, 17 bp, Homo sapiens
ctttgatgttaacacat

SEQ ID NO: 5730075 - DNA, 18 bp, Homo sapiens
ctttgatgttaacacatt

SEQ ID NO: 5730076 - DNA, 19 bp, Homo sapiens
ctttgatgttaacacattt

SEQ ID NO: 5730077 - DNA, 15 bp, Homo sapiens
ctttgattatttgca

SEQ ID NO: 5730078 - DNA, 16 bp, Homo sapiens
ctttgattatttgcat

SEQ ID NO: 5730079 - DNA, 17 bp, Homo sapiens
ctttgattatttgcatg

SEQ ID NO: 5730080 - DNA, 17 bp, Homo sapiens
ctttgattcacatgttt

SEQ ID NO: 5730081 - DNA, 19 bp, Homo sapiens
ctttgattcatagtaactt

SEQ ID NO: 5730082 - DNA, 13 bp, Homo sapiens
ctttgattccatt

SEQ ID NO: 5730083 - DNA, 22 bp, Homo sapiens
ctttgattctccttcagccctc

SEQ ID NO: 5730084 - DNA, 13 bp, Homo sapiens
ctttgattctgat

SEQ ID NO: 5730085 - DNA, 21 bp, Homo sapiens
ctttgattgcacattgttgtt

SEQ ID NO: 5730086 - DNA, 17 bp, Homo sapiens
ctttgattgtgaaacag

SEQ ID NO: 5730087 - DNA, 15 bp, Homo sapiens
ctttgattgttcata

SEQ ID NO: 5730088 - DNA, 14 bp, Homo sapiens
ctttgatttaactg

SEQ ID NO: 5730089 - DNA, 21 bp, Homo sapiens
ctttgatttacagtgcctgta

SEQ ID NO: 5730090 - DNA, 18 bp, Homo sapiens
ctttgatttagagatgat

SEQ ID NO: 5730091 - DNA, 15 bp, Homo sapiens
ctttgatttgtacca

SEQ ID NO: 5730092 - DNA, 17 bp, Homo sapiens
ctttgatttgtaccatt

SEQ ID NO: 5730093 - DNA, 18 bp, Homo sapiens
ctttgatttgtaccattc

SEQ ID NO: 5730094 - DNA, 16 bp, Homo sapiens
ctttgattttaaattt

SEQ ID NO: 5730095 - DNA, 23 bp, Homo sapiens
ctttgatttttatccatttcttt

SEQ ID NO: 5730096 - DNA, 18 bp, Homo sapiens
ctttgatttttgaagttg

SEQ ID NO: 5730097 - DNA, 15 bp, Homo sapiens
ctttgcaaagtattg

SEQ ID NO: 5730098 - DNA, 15 bp, Homo sapiens
ctttgcaaagttaca

SEQ ID NO: 5730099 - DNA, 19 bp, Homo sapiens
ctttgcaaattatttatta

SEQ ID NO: 5730100 - DNA, 22 bp, Homo sapiens
ctttgcaaattatttattactt

SEQ ID NO: 5730101 - DNA, 22 bp, Homo sapiens
ctttgcaaattcaagagcctcc

SEQ ID NO: 5730102 - DNA, 15 bp, Homo sapiens
ctttgcaacagcact

SEQ ID NO: 5730103 - DNA, 22 bp, Homo sapiens
ctttgcaaccttgtactttaca

SEQ ID NO: 5730104 - DNA, 17 bp, Homo sapiens
ctttgcaacgctcactg

SEQ ID NO: 5730105 - DNA, 22 bp, Homo sapiens
ctttgcaatactgcttaattgc

SEQ ID NO: 5730106 - DNA, 13 bp, Homo sapiens
ctttgcaatagca

SEQ ID NO: 5730107 - DNA, 19 bp, Homo sapiens
ctttgcaatccaaataaag

SEQ ID NO: 5730108 - DNA, 18 bp, Homo sapiens
ctttgcaattctttttgg

SEQ ID NO: 5730109 - DNA, 21 bp, Homo sapiens
ctttgcaattgctcttctcca

SEQ ID NO: 5730110 - DNA, 21 bp, Homo sapiens
ctttgcacaatcaataaaaat

SEQ ID NO: 5730111 - DNA, 13 bp, Homo sapiens
ctttgcacaatga

SEQ ID NO: 5730112 - DNA, 13 bp, Homo sapiens
ctttgcacacttc

SEQ ID NO: 5730113 - DNA, 14 bp, Homo sapiens
ctttgcacacttca

SEQ ID NO: 5730114 - DNA, 16 bp, Homo sapiens
ctttgcacacttcaaa

SEQ ID NO: 5730115 - DNA, 20 bp, Homo sapiens
ctttgcacacttcaaatcag

SEQ ID NO: 5730116 - DNA, 20 bp, Homo sapiens
ctttgcacactttggcccag

SEQ ID NO: 5730117 - DNA, 20 bp, Homo sapiens
ctttgcacaggatgctggcc

SEQ ID NO: 5730118 - DNA, 13 bp, Homo sapiens
ctttgcacatgtg

SEQ ID NO: 5730119 - DNA, 15 bp, Homo sapiens
ctttgcacatgtgac

SEQ ID NO: 5730120 - DNA, 14 bp, Homo sapiens
ctttgcacattttg

SEQ ID NO: 5730121 - DNA, 13 bp, Homo sapiens
ctttgcaccaaag

SEQ ID NO: 5730122 - DNA, 12 bp, Homo sapiens
ctttgcaccatg

SEQ ID NO: 5730123 - DNA, 17 bp, Homo sapiens
ctttgcaccatgtgaag

SEQ ID NO: 5730124 - DNA, 21 bp, Homo sapiens
ctttgcacccctttcctcccc

SEQ ID NO: 5730125 - DNA, 14 bp, Homo sapiens
ctttgcacctgaga

SEQ ID NO: 5730126 - DNA, 22 bp, Homo sapiens
ctttgcacgacgccctctcccc

SEQ ID NO: 5730127 - DNA, 13 bp, Homo sapiens
ctttgcactgagg

SEQ ID NO: 5730128 - DNA, 16 bp, Homo sapiens
ctttgcactgatatat

SEQ ID NO: 5730129 - DNA, 12 bp, Homo sapiens
ctttgcacttaa

SEQ ID NO: 5730130 - DNA, 18 bp, Homo sapiens
ctttgcacttaatggctg

SEQ ID NO: 5730131 - DNA, 22 bp, Homo sapiens
ctttgcactttttcttaatcat

SEQ ID NO: 5730132 - DNA, 22 bp, Homo sapiens
ctttgcagacctgggactttag

SEQ ID NO: 5730133 - DNA, 21 bp, Homo sapiens
ctttgcagaggtccaaatgat

SEQ ID NO: 5730134 - DNA, 12 bp, Homo sapiens
ctttgcagctgc

SEQ ID NO: 5730135 - DNA, 16 bp, Homo sapiens
ctttgcagctgcccag

SEQ ID NO: 5730136 - DNA, 19 bp, Homo sapiens
ctttgcagcttcctcttct

SEQ ID NO: 5730137 - DNA, 16 bp, Homo sapiens
ctttgcaggcggccct

SEQ ID NO: 5730138 - DNA, 13 bp, Homo sapiens
ctttgcaggctct

SEQ ID NO: 5730139 - DNA, 15 bp, Homo sapiens
ctttgcaggctctgg

SEQ ID NO: 5730140 - DNA, 19 bp, Homo sapiens
ctttgcaggctctgggctc

SEQ ID NO: 5730141 - DNA, 17 bp, Homo sapiens
ctttgcagggagaccag

SEQ ID NO: 5730142 - DNA, 22 bp, Homo sapiens
ctttgcagggagaccaggcttc

SEQ ID NO: 5730143 - DNA, 18 bp, Homo sapiens
ctttgcagggcagcccca

SEQ ID NO: 5730144 - DNA, 12 bp, Homo sapiens
ctttgcagggct

SEQ ID NO: 5730145 - DNA, 11 bp, Homo sapiens
ctttgcagtga

SEQ ID NO: 5730146 - DNA, 20 bp, Homo sapiens
ctttgcagtgtgcagggtgg

SEQ ID NO: 5730147 - DNA, 22 bp, Homo sapiens
ctttgcagttggactctcaggg

SEQ ID NO: 5730148 - DNA, 23 bp, Homo sapiens
ctttgcagttggactctcaggga

SEQ ID NO: 5730149 - DNA, 19 bp, Homo sapiens
ctttgcatagcagctgcta

SEQ ID NO: 5730150 - DNA, 22 bp, Homo sapiens
ctttgcatagcagctgctacta

SEQ ID NO: 5730151 - DNA, 19 bp, Homo sapiens
ctttgcatagctctccttc

SEQ ID NO: 5730152 - DNA, 21 bp, Homo sapiens
ctttgcatagctctccttccc

SEQ ID NO: 5730153 - DNA, 21 bp, Homo sapiens
ctttgcatatgagccgtgaac

SEQ ID NO: 5730154 - DNA, 15 bp, Homo sapiens
ctttgcatattataa

SEQ ID NO: 5730155 - DNA, 22 bp, Homo sapiens
ctttgcatggatttctttgaaa

SEQ ID NO: 5730156 - DNA, 14 bp, Homo sapiens
ctttgcatgtatta

SEQ ID NO: 5730157 - DNA, 22 bp, Homo sapiens
ctttgcatgttccactaacccc

SEQ ID NO: 5730158 - DNA, 16 bp, Homo sapiens
ctttgcatgttcttgt

SEQ ID NO: 5730159 - DNA, 18 bp, Homo sapiens
ctttgcatgttcttgttt

SEQ ID NO: 5730160 - DNA, 22 bp, Homo sapiens
ctttgcattccttacttgcact

SEQ ID NO: 5730161 - DNA, 13 bp, Homo sapiens
ctttgcatttctt

SEQ ID NO: 5730162 - DNA, 18 bp, Homo sapiens
ctttgcatttcttgtgtt

SEQ ID NO: 5730163 - DNA, 15 bp, Homo sapiens
ctttgcatttggaat

SEQ ID NO: 5730164 - DNA, 16 bp, Homo sapiens
ctttgcatttggaatt

SEQ ID NO: 5730165 - DNA, 12 bp, Homo sapiens
ctttgcatttta

SEQ ID NO: 5730166 - DNA, 22 bp, Homo sapiens
ctttgcattttaaaaatgaaat

SEQ ID NO: 5730167 - DNA, 14 bp, Homo sapiens
ctttgcattttctg

SEQ ID NO: 5730168 - DNA, 19 bp, Homo sapiens
ctttgcattttgatattgc

SEQ ID NO: 5730169 - DNA, 19 bp, Homo sapiens
ctttgccaaaaaaaaaaga

SEQ ID NO: 5730170 - DNA, 15 bp, Homo sapiens
ctttgccaacatggt

SEQ ID NO: 5730171 - DNA, 16 bp, Homo sapiens
ctttgccaccctcatg

SEQ ID NO: 5730172 - DNA, 18 bp, Homo sapiens
ctttgccaccctcatgct

SEQ ID NO: 5730173 - DNA, 14 bp, Homo sapiens
ctttgccactgctg

SEQ ID NO: 5730174 - DNA, 13 bp, Homo sapiens
ctttgccagcaga

SEQ ID NO: 5730175 - DNA, 14 bp, Homo sapiens
ctttgccagcagag

SEQ ID NO: 5730176 - DNA, 17 bp, Homo sapiens
ctttgccagcagagcca

SEQ ID NO: 5730177 - DNA, 22 bp, Homo sapiens
ctttgccagcagagccagggca

SEQ ID NO: 5730178 - DNA, 18 bp, Homo sapiens
ctttgccagccacccctc

SEQ ID NO: 5730179 - DNA, 23 bp, Homo sapiens
ctttgccagccacccctcctcta

SEQ ID NO: 5730180 - DNA, 20 bp, Homo sapiens
ctttgccagcttttcctccc

SEQ ID NO: 5730181 - DNA, 21 bp, Homo sapiens
ctttgccaggtgactgtctgg

SEQ ID NO: 5730182 - DNA, 19 bp, Homo sapiens
ctttgccagtcattcagca

SEQ ID NO: 5730183 - DNA, 16 bp, Homo sapiens
ctttgccagtctttaa

SEQ ID NO: 5730184 - DNA, 14 bp, Homo sapiens
ctttgccatctctg

SEQ ID NO: 5730185 - DNA, 13 bp, Homo sapiens
ctttgccatttct

SEQ ID NO: 5730186 - DNA, 15 bp, Homo sapiens
ctttgccatttcttc

SEQ ID NO: 5730187 - DNA, 18 bp, Homo sapiens
ctttgcccaacaccagcc

SEQ ID NO: 5730188 - DNA, 19 bp, Homo sapiens
ctttgcccaacaccagccc

SEQ ID NO: 5730189 - DNA, 18 bp, Homo sapiens
ctttgcccaacctcagca

SEQ ID NO: 5730190 - DNA, 23 bp, Homo sapiens
ctttgcccaagataggagttctc

SEQ ID NO: 5730191 - DNA, 15 bp, Homo sapiens
ctttgcccacacaca

SEQ ID NO: 5730192 - DNA, 19 bp, Homo sapiens
ctttgcccacacacactcc

SEQ ID NO: 5730193 - DNA, 21 bp, Homo sapiens
ctttgcccacacacactcctt

SEQ ID NO: 5730194 - DNA, 16 bp, Homo sapiens
ctttgcccacccctca

SEQ ID NO: 5730195 - DNA, 22 bp, Homo sapiens
ctttgcccacccctcactcccc

SEQ ID NO: 5730196 - DNA, 15 bp, Homo sapiens
ctttgcccagaaaga

SEQ ID NO: 5730197 - DNA, 16 bp, Homo sapiens
ctttgcccaggcttct

SEQ ID NO: 5730198 - DNA, 20 bp, Homo sapiens
ctttgcccagggtcctgtgc

SEQ ID NO: 5730199 - DNA, 23 bp, Homo sapiens
ctttgcccagggtcctgtgcctg

SEQ ID NO: 5730200 - DNA, 14 bp, Homo sapiens
ctttgcccatggaa

SEQ ID NO: 5730201 - DNA, 23 bp, Homo sapiens
ctttgcccatggaagtctcaaag

SEQ ID NO: 5730202 - DNA, 16 bp, Homo sapiens
ctttgccccaaggctg

SEQ ID NO: 5730203 - DNA, 23 bp, Homo sapiens
ctttgccccacctttattaaaat

SEQ ID NO: 5730204 - DNA, 23 bp, Homo sapiens
ctttgccccactgggagagtcct

SEQ ID NO: 5730205 - DNA, 19 bp, Homo sapiens
ctttgcccccgacggctgt

SEQ ID NO: 5730206 - DNA, 15 bp, Homo sapiens
ctttgccctgaggct

SEQ ID NO: 5730207 - DNA, 18 bp, Homo sapiens
ctttgcccttcctcctgc

SEQ ID NO: 5730208 - DNA, 12 bp, Homo sapiens
ctttgcctccag

SEQ ID NO: 5730209 - DNA, 22 bp, Homo sapiens
ctttgcctcctgtgtactgtgt

SEQ ID NO: 5730210 - DNA, 18 bp, Homo sapiens
ctttgcctctgcagtctc

SEQ ID NO: 5730211 - DNA, 23 bp, Homo sapiens
ctttgcctctgcagtctcatttc

SEQ ID NO: 5730212 - DNA, 19 bp, Homo sapiens
ctttgcctcttcagcagca

SEQ ID NO: 5730213 - DNA, 14 bp, Homo sapiens
ctttgcctgaagaa

SEQ ID NO: 5730214 - DNA, 22 bp, Homo sapiens
ctttgcctgcccagtctttgga

SEQ ID NO: 5730215 - DNA, 11 bp, Homo sapiens
ctttgcctgct

SEQ ID NO: 5730216 - DNA, 12 bp, Homo sapiens
ctttgcctgctt

SEQ ID NO: 5730217 - DNA, 21 bp, Homo sapiens
ctttgcctgtagagccagcct

SEQ ID NO: 5730218 - DNA, 22 bp, Homo sapiens
ctttgcctgtagagccagcctt

SEQ ID NO: 5730219 - DNA, 20 bp, Homo sapiens
ctttgcctgtgtgagcatct

SEQ ID NO: 5730220 - DNA, 14 bp, Homo sapiens
ctttgcctgttcag

SEQ ID NO: 5730221 - DNA, 15 bp, Homo sapiens
ctttgccttaaacct

SEQ ID NO: 5730222 - DNA, 22 bp, Homo sapiens
ctttgccttccacgctgtctcc

SEQ ID NO: 5730223 - DNA, 12 bp, Homo sapiens
ctttgccttccc

SEQ ID NO: 5730224 - DNA, 15 bp, Homo sapiens
ctttgccttcttttg

SEQ ID NO: 5730225 - DNA, 17 bp, Homo sapiens
ctttgccttgcagccac

SEQ ID NO: 5730226 - DNA, 22 bp, Homo sapiens
ctttgccttgcagccacatggc

SEQ ID NO: 5730227 - DNA, 20 bp, Homo sapiens
ctttgcctttcttctgccct

SEQ ID NO: 5730228 - DNA, 21 bp, Homo sapiens
ctttgcctttcttctgccctt

SEQ ID NO: 5730229 - DNA, 11 bp, Homo sapiens
ctttgcctttt

SEQ ID NO: 5730230 - DNA, 13 bp, Homo sapiens
ctttgcgctcctg

SEQ ID NO: 5730231 - DNA, 15 bp, Homo sapiens
ctttgcgctcctggc

SEQ ID NO: 5730232 - DNA, 22 bp, Homo sapiens
ctttgcgctcctggcccagcct

SEQ ID NO: 5730233 - DNA, 16 bp, Homo sapiens
ctttgcgctctgggtt

SEQ ID NO: 5730234 - DNA, 15 bp, Homo sapiens
ctttgcggacgggct

SEQ ID NO: 5730235 - DNA, 16 bp, Homo sapiens
ctttgcggaggctgct

SEQ ID NO: 5730236 - DNA, 21 bp, Homo sapiens
ctttgcggggcctgtctcagt

SEQ ID NO: 5730237 - DNA, 16 bp, Homo sapiens
ctttgcgtcaggagca

SEQ ID NO: 5730238 - DNA, 19 bp, Homo sapiens
ctttgcgtgcccggggcag

SEQ ID NO: 5730239 - DNA, 18 bp, Homo sapiens
ctttgctacaaatttatg

SEQ ID NO: 5730240 - DNA, 23 bp, Homo sapiens
ctttgctacaaatttatgcattt

SEQ ID NO: 5730241 - DNA, 13 bp, Homo sapiens
ctttgctacaata

SEQ ID NO: 5730242 - DNA, 17 bp, Homo sapiens
ctttgctacaataaatg

SEQ ID NO: 5730243 - DNA, 22 bp, Homo sapiens
ctttgctacaataaatgctgaa

SEQ ID NO: 5730244 - DNA, 14 bp, Homo sapiens
ctttgctatgtaag

SEQ ID NO: 5730245 - DNA, 20 bp, Homo sapiens
ctttgctattcccattgtga

SEQ ID NO: 5730246 - DNA, 18 bp, Homo sapiens
ctttgctcagtgtccagc

SEQ ID NO: 5730247 - DNA, 22 bp, Homo sapiens
ctttgctcagtgtccagcttcc

SEQ ID NO: 5730248 - DNA, 14 bp, Homo sapiens
ctttgctcccagtt

SEQ ID NO: 5730249 - DNA, 16 bp, Homo sapiens
ctttgctccgctccca

SEQ ID NO: 5730250 - DNA, 23 bp, Homo sapiens
ctttgctctattaagattggaaa

SEQ ID NO: 5730251 - DNA, 13 bp, Homo sapiens
ctttgctctgagg

SEQ ID NO: 5730252 - DNA, 14 bp, Homo sapiens
ctttgctctgaggt

SEQ ID NO: 5730253 - DNA, 13 bp, Homo sapiens
ctttgctctgggt

SEQ ID NO: 5730254 - DNA, 16 bp, Homo sapiens
ctttgctcttgtccca

SEQ ID NO: 5730255 - DNA, 14 bp, Homo sapiens
ctttgctgagagct

SEQ ID NO: 5730256 - DNA, 18 bp, Homo sapiens
ctttgctgagcctgtaaa

SEQ ID NO: 5730257 - DNA, 16 bp, Homo sapiens
ctttgctgcacagcag

SEQ ID NO: 5730258 - DNA, 18 bp, Homo sapiens
ctttgctgcacagcagga

SEQ ID NO: 5730259 - DNA, 22 bp, Homo sapiens
ctttgctgcacagcaggacctg

SEQ ID NO: 5730260 - DNA, 19 bp, Homo sapiens
ctttgctgcagagatcaag

SEQ ID NO: 5730261 - DNA, 15 bp, Homo sapiens
ctttgctgcatttta

SEQ ID NO: 5730262 - DNA, 10 bp, Homo sapiens
ctttgctgcc

SEQ ID NO: 5730263 - DNA, 11 bp, Homo sapiens
ctttgctgcca

SEQ ID NO: 5730264 - DNA, 15 bp, Homo sapiens
ctttgctgcccctgt

SEQ ID NO: 5730265 - DNA, 17 bp, Homo sapiens
ctttgctgcccctgtct

SEQ ID NO: 5730266 - DNA, 14 bp, Homo sapiens
ctttgctgcccttg

SEQ ID NO: 5730267 - DNA, 14 bp, Homo sapiens
ctttgctgccttaa

SEQ ID NO: 5730268 - DNA, 10 bp, Homo sapiens
ctttgctgct

SEQ ID NO: 5730269 - DNA, 11 bp, Homo sapiens
ctttgctgcta

SEQ ID NO: 5730270 - DNA, 21 bp, Homo sapiens
ctttgctgctaccgccctggg

SEQ ID NO: 5730271 - DNA, 19 bp, Homo sapiens
ctttgctgctgatgggcat

SEQ ID NO: 5730272 - DNA, 14 bp, Homo sapiens
ctttgctgctgctt

SEQ ID NO: 5730273 - DNA, 13 bp, Homo sapiens
ctttgctgctttg

SEQ ID NO: 5730274 - DNA, 15 bp, Homo sapiens
ctttgctggaaaatc

SEQ ID NO: 5730275 - DNA, 16 bp, Homo sapiens
ctttgctggaagaaac

SEQ ID NO: 5730276 - DNA, 16 bp, Homo sapiens
ctttgctggagtcctg

SEQ ID NO: 5730277 - DNA, 21 bp, Homo sapiens
ctttgctggagtcctgttctc

SEQ ID NO: 5730278 - DNA, 15 bp, Homo sapiens
ctttgctggtgtagt

SEQ ID NO: 5730279 - DNA, 14 bp, Homo sapiens
ctttgctggttgct

SEQ ID NO: 5730280 - DNA, 21 bp, Homo sapiens
ctttgctggttgctgggcctc

SEQ ID NO: 5730281 - DNA, 13 bp, Homo sapiens
ctttgctgtaaga

SEQ ID NO: 5730282 - DNA, 18 bp, Homo sapiens
ctttgctgtaagatgtct

SEQ ID NO: 5730283 - DNA, 17 bp, Homo sapiens
ctttgctgtactcttgc

SEQ ID NO: 5730284 - DNA, 21 bp, Homo sapiens
ctttgctgtactcttgctgat

SEQ ID NO: 5730285 - DNA, 14 bp, Homo sapiens
ctttgctgtagtgt

SEQ ID NO: 5730286 - DNA, 17 bp, Homo sapiens
ctttgctgtcactttct

SEQ ID NO: 5730287 - DNA, 23 bp, Homo sapiens
ctttgctgtcccatagtccctgc

SEQ ID NO: 5730288 - DNA, 13 bp, Homo sapiens
ctttgctgtgcca

SEQ ID NO: 5730289 - DNA, 13 bp, Homo sapiens
ctttgctgttact

SEQ ID NO: 5730290 - DNA, 18 bp, Homo sapiens
ctttgctgttactgcttc

SEQ ID NO: 5730291 - DNA, 23 bp, Homo sapiens
ctttgctgttgaagaaactacta

SEQ ID NO: 5730292 - DNA, 14 bp, Homo sapiens
ctttgctgtttgca

SEQ ID NO: 5730293 - DNA, 22 bp, Homo sapiens
ctttgcttaccaaaagctcagg

SEQ ID NO: 5730294 - DNA, 15 bp, Homo sapiens
ctttgcttactttta

SEQ ID NO: 5730295 - DNA, 20 bp, Homo sapiens
ctttgcttcaaatccatcca

SEQ ID NO: 5730296 - DNA, 21 bp, Homo sapiens
ctttgcttccaggtggcagga

SEQ ID NO: 5730297 - DNA, 20 bp, Homo sapiens
ctttgcttcccctccaggag

SEQ ID NO: 5730298 - DNA, 15 bp, Homo sapiens
ctttgcttgaacaca

SEQ ID NO: 5730299 - DNA, 19 bp, Homo sapiens
ctttgcttgaacacagtat

SEQ ID NO: 5730300 - DNA, 21 bp, Homo sapiens
ctttgcttgaacacagtattt

SEQ ID NO: 5730301 - DNA, 17 bp, Homo sapiens
ctttgcttgattaaaca

SEQ ID NO: 5730302 - DNA, 15 bp, Homo sapiens
ctttgcttgtcctgc

SEQ ID NO: 5730303 - DNA, 17 bp, Homo sapiens
ctttgctttaatataaa

SEQ ID NO: 5730304 - DNA, 17 bp, Homo sapiens
ctttgctttctgctcag

SEQ ID NO: 5730305 - DNA, 19 bp, Homo sapiens
ctttgctttctgctcagct

SEQ ID NO: 5730306 - DNA, 21 bp, Homo sapiens
ctttgctttctgctcagcttc

SEQ ID NO: 5730307 - DNA, 21 bp, Homo sapiens
ctttgctttgagacctttcct

SEQ ID NO: 5730308 - DNA, 16 bp, Homo sapiens
ctttgctttgcccagc

SEQ ID NO: 5730309 - DNA, 11 bp, Homo sapiens
ctttgctttgg

SEQ ID NO: 5730310 - DNA, 20 bp, Homo sapiens
ctttgctttgggtttgtggc

SEQ ID NO: 5730311 - DNA, 13 bp, Homo sapiens
ctttgctttgtag

SEQ ID NO: 5730312 - DNA, 14 bp, Homo sapiens
ctttgctttgtagg

SEQ ID NO: 5730313 - DNA, 20 bp, Homo sapiens
ctttgctttttaattgagga

SEQ ID NO: 5730314 - DNA, 22 bp, Homo sapiens
ctttggaaaatatttttttcct

SEQ ID NO: 5730315 - DNA, 19 bp, Homo sapiens
ctttggaaaatgcattgta

SEQ ID NO: 5730316 - DNA, 23 bp, Homo sapiens
ctttggaaagtacactctgctgt

SEQ ID NO: 5730317 - DNA, 24 bp, Homo sapiens
ctttggaaagtacactctgctgtt

SEQ ID NO: 5730318 - DNA, 19 bp, Homo sapiens
ctttggaaagtagaaaagc

SEQ ID NO: 5730319 - DNA, 21 bp, Homo sapiens
ctttggaaagttactgtaaat

SEQ ID NO: 5730320 - DNA, 16 bp, Homo sapiens
ctttggaaatagcatg

SEQ ID NO: 5730321 - DNA, 16 bp, Homo sapiens
ctttggaacaagacag

SEQ ID NO: 5730322 - DNA, 22 bp, Homo sapiens
ctttggaacagggttggcattc

SEQ ID NO: 5730323 - DNA, 16 bp, Homo sapiens
ctttggaagaaacagg

SEQ ID NO: 5730324 - DNA, 21 bp, Homo sapiens
ctttggaagatgcagaagcaa

SEQ ID NO: 5730325 - DNA, 14 bp, Homo sapiens
ctttggaagcactt

SEQ ID NO: 5730326 - DNA, 15 bp, Homo sapiens
ctttggaagcagcaa

SEQ ID NO: 5730327 - DNA, 14 bp, Homo sapiens
ctttggaagcagcc

SEQ ID NO: 5730328 - DNA, 15 bp, Homo sapiens
ctttggaaggagtga

SEQ ID NO: 5730329 - DNA, 20 bp, Homo sapiens
ctttggaagtttagctctga

SEQ ID NO: 5730330 - DNA, 21 bp, Homo sapiens
ctttggaatgaaattcctcct

SEQ ID NO: 5730331 - DNA, 23 bp, Homo sapiens
ctttggaatgaaattcctccttc

SEQ ID NO: 5730332 - DNA, 21 bp, Homo sapiens
ctttggaattgtgctccaaat

SEQ ID NO: 5730333 - DNA, 15 bp, Homo sapiens
ctttggaatttgaag

SEQ ID NO: 5730334 - DNA, 17 bp, Homo sapiens
ctttggacacacacagc

SEQ ID NO: 5730335 - DNA, 19 bp, Homo sapiens
ctttggacacacacagctt

SEQ ID NO: 5730336 - DNA, 18 bp, Homo sapiens
ctttggacagaagcagct

SEQ ID NO: 5730337 - DNA, 16 bp, Homo sapiens
ctttggaccctgaggc

SEQ ID NO: 5730338 - DNA, 13 bp, Homo sapiens
ctttggaccctgt

SEQ ID NO: 5730339 - DNA, 16 bp, Homo sapiens
ctttggacctaatcca

SEQ ID NO: 5730340 - DNA, 19 bp, Homo sapiens
ctttggacctgcagttggc

SEQ ID NO: 5730341 - DNA, 19 bp, Homo sapiens
ctttggacgcacacagctt

SEQ ID NO: 5730342 - DNA, 21 bp, Homo sapiens
ctttggactgttcaagcaaaa

SEQ ID NO: 5730343 - DNA, 12 bp, Homo sapiens
ctttggacttgt

SEQ ID NO: 5730344 - DNA, 19 bp, Homo sapiens
ctttggagaactcatttca

SEQ ID NO: 5730345 - DNA, 22 bp, Homo sapiens
ctttggagaagagtgtggagtc

SEQ ID NO: 5730346 - DNA, 22 bp, Homo sapiens
ctttggagagggaaaatcttca

SEQ ID NO: 5730347 - DNA, 16 bp, Homo sapiens
ctttggagcaaagaag

SEQ ID NO: 5730348 - DNA, 18 bp, Homo sapiens
ctttggaggaacagctcc

SEQ ID NO: 5730349 - DNA, 21 bp, Homo sapiens
ctttggaggggaaatggggaa

SEQ ID NO: 5730350 - DNA, 18 bp, Homo sapiens
ctttggagtcccctcacc

SEQ ID NO: 5730351 - DNA, 15 bp, Homo sapiens
ctttggagttggaat

SEQ ID NO: 5730352 - DNA, 16 bp, Homo sapiens
ctttggagttggaatt

SEQ ID NO: 5730353 - DNA, 14 bp, Homo sapiens
ctttggataataag

SEQ ID NO: 5730354 - DNA, 16 bp, Homo sapiens
ctttggataataagga

SEQ ID NO: 5730355 - DNA, 20 bp, Homo sapiens
ctttggataataggaattca

SEQ ID NO: 5730356 - DNA, 13 bp, Homo sapiens
ctttggatagcat

SEQ ID NO: 5730357 - DNA, 20 bp, Homo sapiens
ctttggatgattttttaagc

SEQ ID NO: 5730358 - DNA, 23 bp, Homo sapiens
ctttggatgattttttaagcaga

SEQ ID NO: 5730359 - DNA, 19 bp, Homo sapiens
ctttggatgcaattaaaac

SEQ ID NO: 5730360 - DNA, 16 bp, Homo sapiens
ctttggcaatttcctg

SEQ ID NO: 5730361 - DNA, 22 bp, Homo sapiens
ctttggcaatttcctggccctc

SEQ ID NO: 5730362 - DNA, 18 bp, Homo sapiens
ctttggcacaccctctct

SEQ ID NO: 5730363 - DNA, 13 bp, Homo sapiens
ctttggcaggtgc

SEQ ID NO: 5730364 - DNA, 11 bp, Homo sapiens
ctttggcagtg

SEQ ID NO: 5730365 - DNA, 14 bp, Homo sapiens
ctttggcatgttta

SEQ ID NO: 5730366 - DNA, 16 bp, Homo sapiens
ctttggcatgtttaat

SEQ ID NO: 5730367 - DNA, 18 bp, Homo sapiens
ctttggcatgtttaattg

SEQ ID NO: 5730368 - DNA, 14 bp, Homo sapiens
ctttggccaacagg

SEQ ID NO: 5730369 - DNA, 19 bp, Homo sapiens
ctttggccacaagaataag

SEQ ID NO: 5730370 - DNA, 22 bp, Homo sapiens
ctttggccagaacaccgtgggc

SEQ ID NO: 5730371 - DNA, 15 bp, Homo sapiens
ctttggccctcagtg

SEQ ID NO: 5730372 - DNA, 14 bp, Homo sapiens
ctttggcctgagtt

SEQ ID NO: 5730373 - DNA, 20 bp, Homo sapiens
ctttggcctggggtgcatct

SEQ ID NO: 5730374 - DNA, 24 bp, Homo sapiens
ctttggcctggggtgcatctcctc

SEQ ID NO: 5730375 - DNA, 15 bp, Homo sapiens
ctttggcctttcctt

SEQ ID NO: 5730376 - DNA, 14 bp, Homo sapiens
ctttggctctggag

SEQ ID NO: 5730377 - DNA, 15 bp, Homo sapiens
ctttggctctggaga

SEQ ID NO: 5730378 - DNA, 22 bp, Homo sapiens
ctttggctgaaaggaagctgtg

SEQ ID NO: 5730379 - DNA, 14 bp, Homo sapiens
ctttggctgagggg

SEQ ID NO: 5730380 - DNA, 18 bp, Homo sapiens
ctttggctgaggggcttg

SEQ ID NO: 5730381 - DNA, 19 bp, Homo sapiens
ctttggctgaggggcttgg

SEQ ID NO: 5730382 - DNA, 11 bp, Homo sapiens
ctttggctgca

SEQ ID NO: 5730383 - DNA, 18 bp, Homo sapiens
ctttggctgcaggtgttc

SEQ ID NO: 5730384 - DNA, 24 bp, Homo sapiens
ctttggcttaaagcatcctcctcc

SEQ ID NO: 5730385 - DNA, 21 bp, Homo sapiens
ctttggcttataattctttca

SEQ ID NO: 5730386 - DNA, 13 bp, Homo sapiens
ctttggcttcaaa

SEQ ID NO: 5730387 - DNA, 15 bp, Homo sapiens
ctttggcttctcctg

SEQ ID NO: 5730388 - DNA, 18 bp, Homo sapiens
ctttggcttctcctgtga

SEQ ID NO: 5730389 - DNA, 23 bp, Homo sapiens
ctttgggaaagcccagactttag

SEQ ID NO: 5730390 - DNA, 16 bp, Homo sapiens
ctttgggaactgtgtt

SEQ ID NO: 5730391 - DNA, 15 bp, Homo sapiens
ctttgggaagactga

SEQ ID NO: 5730392 - DNA, 17 bp, Homo sapiens
ctttgggaagctgaggc

SEQ ID NO: 5730393 - DNA, 19 bp, Homo sapiens
ctttgggaatatttgaatc

SEQ ID NO: 5730394 - DNA, 23 bp, Homo sapiens
ctttgggaatatttgaatcttgt

SEQ ID NO: 5730395 - DNA, 17 bp, Homo sapiens
ctttgggagacagtcta

SEQ ID NO: 5730396 - DNA, 19 bp, Homo sapiens
ctttgggagagcaggaatg

SEQ ID NO: 5730397 - DNA, 23 bp, Homo sapiens
ctttgggagagcaggaatgaaaa

SEQ ID NO: 5730398 - DNA, 23 bp, Homo sapiens
ctttgggagattatcagtagaaa

SEQ ID NO: 5730399 - DNA, 15 bp, Homo sapiens
ctttgggaggccaag

SEQ ID NO: 5730400 - DNA, 19 bp, Homo sapiens
ctttgggaggccaaggcag

SEQ ID NO: 5730401 - DNA, 23 bp, Homo sapiens
ctttgggaggccaaggcaggtag

SEQ ID NO: 5730402 - DNA, 20 bp, Homo sapiens
ctttgggaggccaaggcggg

SEQ ID NO: 5730403 - DNA, 20 bp, Homo sapiens
ctttgggaggccgaggcggg

SEQ ID NO: 5730404 - DNA, 14 bp, Homo sapiens
ctttgggaggctga

SEQ ID NO: 5730405 - DNA, 18 bp, Homo sapiens
ctttgggaggctgaggcg

SEQ ID NO: 5730406 - DNA, 23 bp, Homo sapiens
ctttgggaggtcgaggtgggcgt

SEQ ID NO: 5730407 - DNA, 21 bp, Homo sapiens
ctttgggatatgctgtatttt

SEQ ID NO: 5730408 - DNA, 16 bp, Homo sapiens
ctttgggatcagcctc

SEQ ID NO: 5730409 - DNA, 18 bp, Homo sapiens
ctttgggatcttgaagaa

SEQ ID NO: 5730410 - DNA, 13 bp, Homo sapiens
ctttgggccagac

SEQ ID NO: 5730411 - DNA, 21 bp, Homo sapiens
ctttgggccagacatgccaca

SEQ ID NO: 5730412 - DNA, 11 bp, Homo sapiens
ctttgggccca

SEQ ID NO: 5730413 - DNA, 22 bp, Homo sapiens
ctttgggcccagggacaccagc

SEQ ID NO: 5730414 - DNA, 18 bp, Homo sapiens
ctttgggcctctcctgcc

SEQ ID NO: 5730415 - DNA, 15 bp, Homo sapiens
ctttgggctgccctg

SEQ ID NO: 5730416 - DNA, 16 bp, Homo sapiens
ctttgggcttcagctg

SEQ ID NO: 5730417 - DNA, 18 bp, Homo sapiens
ctttgggcttcagctgcc

SEQ ID NO: 5730418 - DNA, 21 bp, Homo sapiens
ctttgggcttcagctgccagt

SEQ ID NO: 5730419 - DNA, 19 bp, Homo sapiens
ctttgggctttgcaggctc

SEQ ID NO: 5730420 - DNA, 21 bp, Homo sapiens
ctttgggctttgcaggctctg

SEQ ID NO: 5730421 - DNA, 13 bp, Homo sapiens
ctttggggaaaaa

SEQ ID NO: 5730422 - DNA, 14 bp, Homo sapiens
ctttggggaaaaat

SEQ ID NO: 5730423 - DNA, 16 bp, Homo sapiens
ctttggggaaaaattc

SEQ ID NO: 5730424 - DNA, 19 bp, Homo sapiens
ctttggggaaaaattcttg

SEQ ID NO: 5730425 - DNA, 24 bp, Homo sapiens
ctttggggaagtttatttgagaaa

SEQ ID NO: 5730426 - DNA, 12 bp, Homo sapiens
ctttggggacag

SEQ ID NO: 5730427 - DNA, 21 bp, Homo sapiens
ctttggggacagggggtggga

SEQ ID NO: 5730428 - DNA, 21 bp, Homo sapiens
ctttggggacagttggcagag

SEQ ID NO: 5730429 - DNA, 16 bp, Homo sapiens
ctttggggagagctgg

SEQ ID NO: 5730430 - DNA, 17 bp, Homo sapiens
ctttggggagagctggc

SEQ ID NO: 5730431 - DNA, 23 bp, Homo sapiens
ctttggggagagctggcagtgtg

SEQ ID NO: 5730432 - DNA, 13 bp, Homo sapiens
ctttggggagcag

SEQ ID NO: 5730433 - DNA, 20 bp, Homo sapiens
ctttggggatagtctggaaa

SEQ ID NO: 5730434 - DNA, 16 bp, Homo sapiens
ctttggggctcctttc

SEQ ID NO: 5730435 - DNA, 17 bp, Homo sapiens
ctttggggcttatcaga

SEQ ID NO: 5730436 - DNA, 16 bp, Homo sapiens
ctttggggcttctgtg

SEQ ID NO: 5730437 - DNA, 17 bp, Homo sapiens
ctttggggcttctgtga

SEQ ID NO: 5730438 - DNA, 20 bp, Homo sapiens
ctttggggcttttacaccag

SEQ ID NO: 5730439 - DNA, 18 bp, Homo sapiens
ctttgggggagtgggcgc

SEQ ID NO: 5730440 - DNA, 16 bp, Homo sapiens
ctttgggggattcaaa

SEQ ID NO: 5730441 - DNA, 17 bp, Homo sapiens
ctttggggggccacccg

SEQ ID NO: 5730442 - DNA, 19 bp, Homo sapiens
ctttgggggtggaaaagga

SEQ ID NO: 5730443 - DNA, 17 bp, Homo sapiens
ctttggggtctacactg

SEQ ID NO: 5730444 - DNA, 20 bp, Homo sapiens
ctttggggttcggcctgtgt

SEQ ID NO: 5730445 - DNA, 22 bp, Homo sapiens
ctttggggttcggcctgtgtcc

SEQ ID NO: 5730446 - DNA, 18 bp, Homo sapiens
ctttggggttgcccagcc

SEQ ID NO: 5730447 - DNA, 17 bp, Homo sapiens
ctttggggttttttaat

SEQ ID NO: 5730448 - DNA, 21 bp, Homo sapiens
ctttgggtacctattttcatt

SEQ ID NO: 5730449 - DNA, 23 bp, Homo sapiens
ctttgggtactactgctgcaaag

SEQ ID NO: 5730450 - DNA, 13 bp, Homo sapiens
ctttgggtcattt

SEQ ID NO: 5730451 - DNA, 19 bp, Homo sapiens
ctttgggtctacaagtata

SEQ ID NO: 5730452 - DNA, 14 bp, Homo sapiens
ctttgggtgctgtt

SEQ ID NO: 5730453 - DNA, 20 bp, Homo sapiens
ctttgggtggctcactactg

SEQ ID NO: 5730454 - DNA, 21 bp, Homo sapiens
ctttgggtggctcactactga

SEQ ID NO: 5730455 - DNA, 17 bp, Homo sapiens
ctttgggttaagcatta

SEQ ID NO: 5730456 - DNA, 18 bp, Homo sapiens
ctttgggttccatcttgc

SEQ ID NO: 5730457 - DNA, 19 bp, Homo sapiens
ctttggtaaaacagtttca

SEQ ID NO: 5730458 - DNA, 19 bp, Homo sapiens
ctttggtaatgtgtcaaag

SEQ ID NO: 5730459 - DNA, 15 bp, Homo sapiens
ctttggtaccagata

SEQ ID NO: 5730460 - DNA, 16 bp, Homo sapiens
ctttggtactaataat

SEQ ID NO: 5730461 - DNA, 18 bp, Homo sapiens
ctttggtcacttttagat

SEQ ID NO: 5730462 - DNA, 14 bp, Homo sapiens
ctttggtcctggtg

SEQ ID NO: 5730463 - DNA, 16 bp, Homo sapiens
ctttggtcttcttcca

SEQ ID NO: 5730464 - DNA, 18 bp, Homo sapiens
ctttggtgaacagttttg

SEQ ID NO: 5730465 - DNA, 14 bp, Homo sapiens
ctttggtgaataac

SEQ ID NO: 5730466 - DNA, 16 bp, Homo sapiens
ctttggtgcacaagta

SEQ ID NO: 5730467 - DNA, 16 bp, Homo sapiens
ctttggtgcctcactg

SEQ ID NO: 5730468 - DNA, 15 bp, Homo sapiens
ctttggtgcctttcc

SEQ ID NO: 5730469 - DNA, 19 bp, Homo sapiens
ctttggtgcctttcctgtt

SEQ ID NO: 5730470 - DNA, 14 bp, Homo sapiens
ctttggtggcccct

SEQ ID NO: 5730471 - DNA, 14 bp, Homo sapiens
ctttggtggctttg

SEQ ID NO: 5730472 - DNA, 18 bp, Homo sapiens
ctttggtggctttgcatt

SEQ ID NO: 5730473 - DNA, 19 bp, Homo sapiens
ctttggtgttacacagccc

SEQ ID NO: 5730474 - DNA, 19 bp, Homo sapiens
ctttggtgttctggcctct

SEQ ID NO: 5730475 - DNA, 21 bp, Homo sapiens
ctttggtgttctggcctctgg

SEQ ID NO: 5730476 - DNA, 16 bp, Homo sapiens
ctttggttaaaaatgg

SEQ ID NO: 5730477 - DNA, 22 bp, Homo sapiens
ctttggttatcctgtttgaaga

SEQ ID NO: 5730478 - DNA, 15 bp, Homo sapiens
ctttggttatgaaac

SEQ ID NO: 5730479 - DNA, 21 bp, Homo sapiens
ctttggttattggaaggcaag

SEQ ID NO: 5730480 - DNA, 13 bp, Homo sapiens
ctttggttatttt

SEQ ID NO: 5730481 - DNA, 17 bp, Homo sapiens
ctttggttattttactt

SEQ ID NO: 5730482 - DNA, 19 bp, Homo sapiens
ctttggttattttactttt

SEQ ID NO: 5730483 - DNA, 15 bp, Homo sapiens
ctttggttcctgtga

SEQ ID NO: 5730484 - DNA, 19 bp, Homo sapiens
ctttggttccttctctggg

SEQ ID NO: 5730485 - DNA, 20 bp, Homo sapiens
ctttggttccttctctgggt

SEQ ID NO: 5730486 - DNA, 14 bp, Homo sapiens
ctttggttctaagg

SEQ ID NO: 5730487 - DNA, 16 bp, Homo sapiens
ctttggttctaaggac

SEQ ID NO: 5730488 - DNA, 17 bp, Homo sapiens
ctttggttctctccagg

SEQ ID NO: 5730489 - DNA, 21 bp, Homo sapiens
ctttggttctctccaggaagg

SEQ ID NO: 5730490 - DNA, 21 bp, Homo sapiens
ctttggttgcttaactggctg

SEQ ID NO: 5730491 - DNA, 14 bp, Homo sapiens
ctttggttggaact

SEQ ID NO: 5730492 - DNA, 14 bp, Homo sapiens
ctttggtttggcct

SEQ ID NO: 5730493 - DNA, 22 bp, Homo sapiens
ctttggtttggcctccatcctc

SEQ ID NO: 5730494 - DNA, 17 bp, Homo sapiens
ctttggtttttttcttc

SEQ ID NO: 5730495 - DNA, 23 bp, Homo sapiens
ctttggtttttttcttctgtatt

SEQ ID NO: 5730496 - DNA, 13 bp, Homo sapiens
ctttgtaaaaatc

SEQ ID NO: 5730497 - DNA, 21 bp, Homo sapiens
ctttgtaaaccggctggacca

SEQ ID NO: 5730498 - DNA, 16 bp, Homo sapiens
ctttgtaaaggtcaga

SEQ ID NO: 5730499 - DNA, 16 bp, Homo sapiens
ctttgtaaattatttt

SEQ ID NO: 5730500 - DNA, 17 bp, Homo sapiens
ctttgtaaattctgatt

SEQ ID NO: 5730501 - DNA, 18 bp, Homo sapiens
ctttgtaaccacaacttt

SEQ ID NO: 5730502 - DNA, 20 bp, Homo sapiens
ctttgtaaccagaattatac

SEQ ID NO: 5730503 - DNA, 17 bp, Homo sapiens
ctttgtaagaaaaccaa

SEQ ID NO: 5730504 - DNA, 11 bp, Homo sapiens
ctttgtaagac

SEQ ID NO: 5730505 - DNA, 20 bp, Homo sapiens
ctttgtaagacacacagcct

SEQ ID NO: 5730506 - DNA, 21 bp, Homo sapiens
ctttgtaagacacacagcctt

SEQ ID NO: 5730507 - DNA, 16 bp, Homo sapiens
ctttgtaagacatttg

SEQ ID NO: 5730508 - DNA, 19 bp, Homo sapiens
ctttgtaagacatttgtat

SEQ ID NO: 5730509 - DNA, 21 bp, Homo sapiens
ctttgtaagacatttgtatat

SEQ ID NO: 5730510 - DNA, 15 bp, Homo sapiens
ctttgtaagagcaaa

SEQ ID NO: 5730511 - DNA, 17 bp, Homo sapiens
ctttgtaagatccaccc

SEQ ID NO: 5730512 - DNA, 16 bp, Homo sapiens
ctttgtaaggacttgt

SEQ ID NO: 5730513 - DNA, 22 bp, Homo sapiens
ctttgtaagtaaactgccctgt

SEQ ID NO: 5730514 - DNA, 22 bp, Homo sapiens
ctttgtaagtcagtgttgagat

SEQ ID NO: 5730515 - DNA, 23 bp, Homo sapiens
ctttgtaatatgagaatgtatta

SEQ ID NO: 5730516 - DNA, 20 bp, Homo sapiens
ctttgtaatattttccataa

SEQ ID NO: 5730517 - DNA, 13 bp, Homo sapiens
ctttgtaatcact

SEQ ID NO: 5730518 - DNA, 21 bp, Homo sapiens
ctttgtaatcactcccatttt

SEQ ID NO: 5730519 - DNA, 14 bp, Homo sapiens
ctttgtaatgaaaa

SEQ ID NO: 5730520 - DNA, 15 bp, Homo sapiens
ctttgtaatgaaaac

SEQ ID NO: 5730521 - DNA, 19 bp, Homo sapiens
ctttgtaatgcttgtacag

SEQ ID NO: 5730522 - DNA, 17 bp, Homo sapiens
ctttgtaatgtcaccac

SEQ ID NO: 5730523 - DNA, 20 bp, Homo sapiens
ctttgtacacccatgaaaga

SEQ ID NO: 5730524 - DNA, 19 bp, Homo sapiens
ctttgtacatgttacaggc

SEQ ID NO: 5730525 - DNA, 16 bp, Homo sapiens
ctttgtaccatctgtc

SEQ ID NO: 5730526 - DNA, 14 bp, Homo sapiens
ctttgtacccccca

SEQ ID NO: 5730527 - DNA, 19 bp, Homo sapiens
ctttgtaccccccaacccc

SEQ ID NO: 5730528 - DNA, 21 bp, Homo sapiens
ctttgtaccccccaacccctg

SEQ ID NO: 5730529 - DNA, 17 bp, Homo sapiens
ctttgtacgttccttct

SEQ ID NO: 5730530 - DNA, 12 bp, Homo sapiens
ctttgtacttgt

SEQ ID NO: 5730531 - DNA, 14 bp, Homo sapiens
ctttgtactttgtg

SEQ ID NO: 5730532 - DNA, 14 bp, Homo sapiens
ctttgtagaataaa

SEQ ID NO: 5730533 - DNA, 20 bp, Homo sapiens
ctttgtagacattttgaaat

SEQ ID NO: 5730534 - DNA, 22 bp, Homo sapiens
ctttgtagatgtattttcaata

SEQ ID NO: 5730535 - DNA, 15 bp, Homo sapiens
ctttgtagcactcag

SEQ ID NO: 5730536 - DNA, 21 bp, Homo sapiens
ctttgtagcactcaggctctc

SEQ ID NO: 5730537 - DNA, 20 bp, Homo sapiens
ctttgtagcatttggtgctt

SEQ ID NO: 5730538 - DNA, 20 bp, Homo sapiens
ctttgtagctaacagtgaag

SEQ ID NO: 5730539 - DNA, 14 bp, Homo sapiens
ctttgtagctactt

SEQ ID NO: 5730540 - DNA, 14 bp, Homo sapiens
ctttgtagcttaaa

SEQ ID NO: 5730541 - DNA, 21 bp, Homo sapiens
ctttgtagcttaaaaaaagga

SEQ ID NO: 5730542 - DNA, 19 bp, Homo sapiens
ctttgtagttactcaagca

SEQ ID NO: 5730543 - DNA, 17 bp, Homo sapiens
ctttgtagtttgcccag

SEQ ID NO: 5730544 - DNA, 18 bp, Homo sapiens
ctttgtagtttgcccaga

SEQ ID NO: 5730545 - DNA, 12 bp, Homo sapiens
ctttgtataaat

SEQ ID NO: 5730546 - DNA, 14 bp, Homo sapiens
ctttgtataaattt

SEQ ID NO: 5730547 - DNA, 16 bp, Homo sapiens
ctttgtataaattttt

SEQ ID NO: 5730548 - DNA, 20 bp, Homo sapiens
ctttgtataaatttttaagt

SEQ ID NO: 5730549 - DNA, 17 bp, Homo sapiens
ctttgtatactttaaat

SEQ ID NO: 5730550 - DNA, 20 bp, Homo sapiens
ctttgtatactttaaataat

SEQ ID NO: 5730551 - DNA, 18 bp, Homo sapiens
ctttgtatataggcttct

SEQ ID NO: 5730552 - DNA, 19 bp, Homo sapiens
ctttgtatataggcttctc

SEQ ID NO: 5730553 - DNA, 14 bp, Homo sapiens
ctttgtatattaca

SEQ ID NO: 5730554 - DNA, 18 bp, Homo sapiens
ctttgtatattatttcta

SEQ ID NO: 5730555 - DNA, 13 bp, Homo sapiens
ctttgtatctttc

SEQ ID NO: 5730556 - DNA, 16 bp, Homo sapiens
ctttgtatgacagtga

SEQ ID NO: 5730557 - DNA, 14 bp, Homo sapiens
ctttgtatgatatt

SEQ ID NO: 5730558 - DNA, 15 bp, Homo sapiens
ctttgtatgatattc

SEQ ID NO: 5730559 - DNA, 12 bp, Homo sapiens
ctttgtatgcac

SEQ ID NO: 5730560 - DNA, 20 bp, Homo sapiens
ctttgtatgtcatttccttc

SEQ ID NO: 5730561 - DNA, 17 bp, Homo sapiens
ctttgtatgtggaagta

SEQ ID NO: 5730562 - DNA, 12 bp, Homo sapiens
ctttgtattata

SEQ ID NO: 5730563 - DNA, 17 bp, Homo sapiens
ctttgtattataaaagc

SEQ ID NO: 5730564 - DNA, 18 bp, Homo sapiens
ctttgtattataattgtt

SEQ ID NO: 5730565 - DNA, 13 bp, Homo sapiens
ctttgtattctct

SEQ ID NO: 5730566 - DNA, 22 bp, Homo sapiens
ctttgtattctctcctgtacct

SEQ ID NO: 5730567 - DNA, 19 bp, Homo sapiens
ctttgtattcttcatgaaa

SEQ ID NO: 5730568 - DNA, 12 bp, Homo sapiens
ctttgtattgtc

SEQ ID NO: 5730569 - DNA, 16 bp, Homo sapiens
ctttgtattgtcctat

SEQ ID NO: 5730570 - DNA, 17 bp, Homo sapiens
ctttgtattttgattat

SEQ ID NO: 5730571 - DNA, 18 bp, Homo sapiens
ctttgtattttgattatt

SEQ ID NO: 5730572 - DNA, 19 bp, Homo sapiens
ctttgtatttttgtcattg

SEQ ID NO: 5730573 - DNA, 15 bp, Homo sapiens
ctttgtcaatgctct

SEQ ID NO: 5730574 - DNA, 23 bp, Homo sapiens
ctttgtcacagggtgttggaaga

SEQ ID NO: 5730575 - DNA, 20 bp, Homo sapiens
ctttgtcaccacgtggggct

SEQ ID NO: 5730576 - DNA, 15 bp, Homo sapiens
ctttgtcacttgcca

SEQ ID NO: 5730577 - DNA, 17 bp, Homo sapiens
ctttgtcacttttcctt

SEQ ID NO: 5730578 - DNA, 20 bp, Homo sapiens
ctttgtcatagttatgtgat

SEQ ID NO: 5730579 - DNA, 15 bp, Homo sapiens
ctttgtcattatgat

SEQ ID NO: 5730580 - DNA, 17 bp, Homo sapiens
ctttgtcattcagttct

SEQ ID NO: 5730581 - DNA, 22 bp, Homo sapiens
ctttgtccaccattcctttaaa

SEQ ID NO: 5730582 - DNA, 16 bp, Homo sapiens
ctttgtccattattca

SEQ ID NO: 5730583 - DNA, 15 bp, Homo sapiens
ctttgtccatttacc

SEQ ID NO: 5730584 - DNA, 14 bp, Homo sapiens
ctttgtcccacagc

SEQ ID NO: 5730585 - DNA, 16 bp, Homo sapiens
ctttgtcccacagctt

SEQ ID NO: 5730586 - DNA, 14 bp, Homo sapiens
ctttgtcccatttc

SEQ ID NO: 5730587 - DNA, 22 bp, Homo sapiens
ctttgtccccaccgcagacagg

SEQ ID NO: 5730588 - DNA, 15 bp, Homo sapiens
ctttgtcccctgctt

SEQ ID NO: 5730589 - DNA, 16 bp, Homo sapiens
ctttgtcccctgcttc

SEQ ID NO: 5730590 - DNA, 13 bp, Homo sapiens
ctttgtcctcctg

SEQ ID NO: 5730591 - DNA, 21 bp, Homo sapiens
ctttgtcctcctgctgccagt

SEQ ID NO: 5730592 - DNA, 14 bp, Homo sapiens
ctttgtcctgaatg

SEQ ID NO: 5730593 - DNA, 11 bp, Homo sapiens
ctttgtcctgc

SEQ ID NO: 5730594 - DNA, 17 bp, Homo sapiens
ctttgtcctttttgtta

SEQ ID NO: 5730595 - DNA, 18 bp, Homo sapiens
ctttgtcgtggttcttaa

SEQ ID NO: 5730596 - DNA, 15 bp, Homo sapiens
ctttgtctaaaacaa

SEQ ID NO: 5730597 - DNA, 17 bp, Homo sapiens
ctttgtctaagaaacat

SEQ ID NO: 5730598 - DNA, 23 bp, Homo sapiens
ctttgtctaagaaacattggaag

SEQ ID NO: 5730599 - DNA, 23 bp, Homo sapiens
ctttgtctacttcaaaagtttgt

SEQ ID NO: 5730600 - DNA, 20 bp, Homo sapiens
ctttgtctcacgattccagt

SEQ ID NO: 5730601 - DNA, 22 bp, Homo sapiens
ctttgtctcacgattccagtgc

SEQ ID NO: 5730602 - DNA, 12 bp, Homo sapiens
ctttgtctccaa

SEQ ID NO: 5730603 - DNA, 13 bp, Homo sapiens
ctttgtctccaaa

SEQ ID NO: 5730604 - DNA, 18 bp, Homo sapiens
ctttgtctccaaagaaga

SEQ ID NO: 5730605 - DNA, 21 bp, Homo sapiens
ctttgtctctcctggctgggc

SEQ ID NO: 5730606 - DNA, 15 bp, Homo sapiens
ctttgtctgaaaaat

SEQ ID NO: 5730607 - DNA, 14 bp, Homo sapiens
ctttgtctgccttc

SEQ ID NO: 5730608 - DNA, 15 bp, Homo sapiens
ctttgtctgtacata

SEQ ID NO: 5730609 - DNA, 16 bp, Homo sapiens
ctttgtcttgaaaaaa

SEQ ID NO: 5730610 - DNA, 19 bp, Homo sapiens
ctttgtcttgaaaaaaaat

SEQ ID NO: 5730611 - DNA, 23 bp, Homo sapiens
ctttgtcttggaaccaccagtct

SEQ ID NO: 5730612 - DNA, 13 bp, Homo sapiens
ctttgtcttggac

SEQ ID NO: 5730613 - DNA, 16 bp, Homo sapiens
ctttgtcttgtacttc

SEQ ID NO: 5730614 - DNA, 13 bp, Homo sapiens
ctttgtctttctt

SEQ ID NO: 5730615 - DNA, 18 bp, Homo sapiens
ctttgtctttctttgtca

SEQ ID NO: 5730616 - DNA, 17 bp, Homo sapiens
ctttgtcttttcaatct

SEQ ID NO: 5730617 - DNA, 22 bp, Homo sapiens
ctttgtgaatagaactctgaaa

SEQ ID NO: 5730618 - DNA, 14 bp, Homo sapiens
ctttgtgaatattt

SEQ ID NO: 5730619 - DNA, 23 bp, Homo sapiens
ctttgtgaatctgaactgctcta

SEQ ID NO: 5730620 - DNA, 14 bp, Homo sapiens
ctttgtgacaggaa

SEQ ID NO: 5730621 - DNA, 18 bp, Homo sapiens
ctttgtgactattaaatg

SEQ ID NO: 5730622 - DNA, 15 bp, Homo sapiens
ctttgtgactgtcac

SEQ ID NO: 5730623 - DNA, 16 bp, Homo sapiens
ctttgtgacttcttct

SEQ ID NO: 5730624 - DNA, 19 bp, Homo sapiens
ctttgtgagagaggacctc

SEQ ID NO: 5730625 - DNA, 21 bp, Homo sapiens
ctttgtgagagaggacctcca

SEQ ID NO: 5730626 - DNA, 23 bp, Homo sapiens
ctttgtgagagaggacctccatg

SEQ ID NO: 5730627 - DNA, 19 bp, Homo sapiens
ctttgtgagtattctatgt

SEQ ID NO: 5730628 - DNA, 19 bp, Homo sapiens
ctttgtgagtcaatacata

SEQ ID NO: 5730629 - DNA, 17 bp, Homo sapiens
ctttgtgataacaaaga

SEQ ID NO: 5730630 - DNA, 14 bp, Homo sapiens
ctttgtgataattc

SEQ ID NO: 5730631 - DNA, 17 bp, Homo sapiens
ctttgtgataatttaag

SEQ ID NO: 5730632 - DNA, 17 bp, Homo sapiens
ctttgtgattatttcac

SEQ ID NO: 5730633 - DNA, 16 bp, Homo sapiens
ctttgtgattccatgg

SEQ ID NO: 5730634 - DNA, 20 bp, Homo sapiens
ctttgtgattccatggattg

SEQ ID NO: 5730635 - DNA, 17 bp, Homo sapiens
ctttgtgatttttgtaa

SEQ ID NO: 5730636 - DNA, 13 bp, Homo sapiens
ctttgtgcaatat

SEQ ID NO: 5730637 - DNA, 18 bp, Homo sapiens
ctttgtgccctatcaccc

SEQ ID NO: 5730638 - DNA, 17 bp, Homo sapiens
ctttgtgcctttggcct

SEQ ID NO: 5730639 - DNA, 19 bp, Homo sapiens
ctttgtgctctgttcctgt

SEQ ID NO: 5730640 - DNA, 16 bp, Homo sapiens
ctttgtgctgctgagt

SEQ ID NO: 5730641 - DNA, 20 bp, Homo sapiens
ctttgtgctggggttatctg

SEQ ID NO: 5730642 - DNA, 14 bp, Homo sapiens
ctttgtgcttgggg

SEQ ID NO: 5730643 - DNA, 22 bp, Homo sapiens
ctttgtgcttggggctatttgt

SEQ ID NO: 5730644 - DNA, 14 bp, Homo sapiens
ctttgtgctttcct

SEQ ID NO: 5730645 - DNA, 17 bp, Homo sapiens
ctttgtgctttttgtca

SEQ ID NO: 5730646 - DNA, 19 bp, Homo sapiens
ctttgtgctttttgtcatg

SEQ ID NO: 5730647 - DNA, 15 bp, Homo sapiens
ctttgtggaaacagc

SEQ ID NO: 5730648 - DNA, 16 bp, Homo sapiens
ctttgtggaaacagct

SEQ ID NO: 5730649 - DNA, 12 bp, Homo sapiens
ctttgtggactt

SEQ ID NO: 5730650 - DNA, 23 bp, Homo sapiens
ctttgtggatactattaaagtaa

SEQ ID NO: 5730651 - DNA, 20 bp, Homo sapiens
ctttgtggattctgaggccc

SEQ ID NO: 5730652 - DNA, 14 bp, Homo sapiens
ctttgtggcagtgg

SEQ ID NO: 5730653 - DNA, 17 bp, Homo sapiens
ctttgtggcatgtgcct

SEQ ID NO: 5730654 - DNA, 13 bp, Homo sapiens
ctttgtggccaag

SEQ ID NO: 5730655 - DNA, 18 bp, Homo sapiens
ctttgtggccaaggagct

SEQ ID NO: 5730656 - DNA, 16 bp, Homo sapiens
ctttgtggcttctctt

SEQ ID NO: 5730657 - DNA, 20 bp, Homo sapiens
ctttgtgggagggtaagaca

SEQ ID NO: 5730658 - DNA, 21 bp, Homo sapiens
ctttgtgggagggtaagacaa

SEQ ID NO: 5730659 - DNA, 18 bp, Homo sapiens
ctttgtggtttcttgttt

SEQ ID NO: 5730660 - DNA, 18 bp, Homo sapiens
ctttgtgtaatctaagta

SEQ ID NO: 5730661 - DNA, 16 bp, Homo sapiens
ctttgtgtatctcatt

SEQ ID NO: 5730662 - DNA, 21 bp, Homo sapiens
ctttgtgtatctcatttaatt

SEQ ID NO: 5730663 - DNA, 19 bp, Homo sapiens
ctttgtgtatgggggaagg

SEQ ID NO: 5730664 - DNA, 20 bp, Homo sapiens
ctttgtgtcagaaaaaggaa

SEQ ID NO: 5730665 - DNA, 11 bp, Homo sapiens
ctttgtgtcta

SEQ ID NO: 5730666 - DNA, 12 bp, Homo sapiens
ctttgtgtctgg

SEQ ID NO: 5730667 - DNA, 13 bp, Homo sapiens
ctttgtgtctttt

SEQ ID NO: 5730668 - DNA, 22 bp, Homo sapiens
ctttgtgtcttttgttctctct

SEQ ID NO: 5730669 - DNA, 17 bp, Homo sapiens
ctttgtgtgctctccat

SEQ ID NO: 5730670 - DNA, 12 bp, Homo sapiens
ctttgtgtgctg

SEQ ID NO: 5730671 - DNA, 21 bp, Homo sapiens
ctttgtgtgctgttagtattg

SEQ ID NO: 5730672 - DNA, 14 bp, Homo sapiens
ctttgtgtgtctcc

SEQ ID NO: 5730673 - DNA, 20 bp, Homo sapiens
ctttgtgtgtgtgtcagctg

SEQ ID NO: 5730674 - DNA, 15 bp, Homo sapiens
ctttgtgtgttatat

SEQ ID NO: 5730675 - DNA, 17 bp, Homo sapiens
ctttgtgtgttatattc

SEQ ID NO: 5730676 - DNA, 17 bp, Homo sapiens
ctttgtgttgtaattct

SEQ ID NO: 5730677 - DNA, 15 bp, Homo sapiens
ctttgtgtttacttt

SEQ ID NO: 5730678 - DNA, 17 bp, Homo sapiens
ctttgtgtttggtttac

SEQ ID NO: 5730679 - DNA, 22 bp, Homo sapiens
ctttgttaaaatatagtgttgt

SEQ ID NO: 5730680 - DNA, 14 bp, Homo sapiens
ctttgttaacctta

SEQ ID NO: 5730681 - DNA, 18 bp, Homo sapiens
ctttgttaagactgctga

SEQ ID NO: 5730682 - DNA, 16 bp, Homo sapiens
ctttgttaaggtcctg

SEQ ID NO: 5730683 - DNA, 17 bp, Homo sapiens
ctttgttaagttctatt

SEQ ID NO: 5730684 - DNA, 21 bp, Homo sapiens
ctttgttacactgttattttc

SEQ ID NO: 5730685 - DNA, 21 bp, Homo sapiens
ctttgttaccatactgtctct

SEQ ID NO: 5730686 - DNA, 23 bp, Homo sapiens
ctttgttaccatactgtctctgg

SEQ ID NO: 5730687 - DNA, 16 bp, Homo sapiens
ctttgttaccttaaaa

SEQ ID NO: 5730688 - DNA, 18 bp, Homo sapiens
ctttgttagtttctccaa

SEQ ID NO: 5730689 - DNA, 17 bp, Homo sapiens
ctttgttatacatttaa

SEQ ID NO: 5730690 - DNA, 14 bp, Homo sapiens
ctttgttataccat

SEQ ID NO: 5730691 - DNA, 22 bp, Homo sapiens
ctttgttattgcaaattgagga

SEQ ID NO: 5730692 - DNA, 20 bp, Homo sapiens
ctttgttatttttgtttctt

SEQ ID NO: 5730693 - DNA, 15 bp, Homo sapiens
ctttgttcaataaag

SEQ ID NO: 5730694 - DNA, 15 bp, Homo sapiens
ctttgttcactgtga

SEQ ID NO: 5730695 - DNA, 17 bp, Homo sapiens
ctttgttcactgtgagt

SEQ ID NO: 5730696 - DNA, 21 bp, Homo sapiens
ctttgttcccaaggacttcca

SEQ ID NO: 5730697 - DNA, 19 bp, Homo sapiens
ctttgttccccactggagc

SEQ ID NO: 5730698 - DNA, 14 bp, Homo sapiens
ctttgttctggctc

SEQ ID NO: 5730699 - DNA, 13 bp, Homo sapiens
ctttgttctgttg

SEQ ID NO: 5730700 - DNA, 18 bp, Homo sapiens
ctttgttcttcaatgtga

SEQ ID NO: 5730701 - DNA, 22 bp, Homo sapiens
ctttgttcttcaatgtgaaact

SEQ ID NO: 5730702 - DNA, 18 bp, Homo sapiens
ctttgttcttgtcatcag

SEQ ID NO: 5730703 - DNA, 13 bp, Homo sapiens
ctttgttgaaaga

SEQ ID NO: 5730704 - DNA, 20 bp, Homo sapiens
ctttgttgaagtttgaacca

SEQ ID NO: 5730705 - DNA, 18 bp, Homo sapiens
ctttgttgcaagatgtga

SEQ ID NO: 5730706 - DNA, 11 bp, Homo sapiens
ctttgttgcac

SEQ ID NO: 5730707 - DNA, 15 bp, Homo sapiens
ctttgttgcactgaa

SEQ ID NO: 5730708 - DNA, 16 bp, Homo sapiens
ctttgttgctgttgct

SEQ ID NO: 5730709 - DNA, 15 bp, Homo sapiens
ctttgttggagtcaa

SEQ ID NO: 5730710 - DNA, 19 bp, Homo sapiens
ctttgttggctcagaaaat

SEQ ID NO: 5730711 - DNA, 14 bp, Homo sapiens
ctttgttggcttct

SEQ ID NO: 5730712 - DNA, 15 bp, Homo sapiens
ctttgttgtcctccc

SEQ ID NO: 5730713 - DNA, 18 bp, Homo sapiens
ctttgttgtcctcccagg

SEQ ID NO: 5730714 - DNA, 20 bp, Homo sapiens
ctttgttgtcctcccaggaa

SEQ ID NO: 5730715 - DNA, 16 bp, Homo sapiens
ctttgttgtctacatt

SEQ ID NO: 5730716 - DNA, 22 bp, Homo sapiens
ctttgttgtgagaatggcctgg

SEQ ID NO: 5730717 - DNA, 17 bp, Homo sapiens
ctttgttgttctgcctg

SEQ ID NO: 5730718 - DNA, 23 bp, Homo sapiens
ctttgttgttctgcctgtcctag

SEQ ID NO: 5730719 - DNA, 14 bp, Homo sapiens
ctttgtttagcctg

SEQ ID NO: 5730720 - DNA, 15 bp, Homo sapiens
ctttgtttatgcata

SEQ ID NO: 5730721 - DNA, 13 bp, Homo sapiens
ctttgtttccaga

SEQ ID NO: 5730722 - DNA, 22 bp, Homo sapiens
ctttgtttcctccttgtcactg

SEQ ID NO: 5730723 - DNA, 15 bp, Homo sapiens
ctttgtttccttgtt

SEQ ID NO: 5730724 - DNA, 17 bp, Homo sapiens
ctttgtttctgtttctt

SEQ ID NO: 5730725 - DNA, 21 bp, Homo sapiens
ctttgtttctttgttttattt

SEQ ID NO: 5730726 - DNA, 19 bp, Homo sapiens
ctttgtttgctaatgcact

SEQ ID NO: 5730727 - DNA, 14 bp, Homo sapiens
ctttgttttaataa

SEQ ID NO: 5730728 - DNA, 16 bp, Homo sapiens
ctttgttttaataaac

SEQ ID NO: 5730729 - DNA, 17 bp, Homo sapiens
ctttgttttaataaaca

SEQ ID NO: 5730730 - DNA, 11 bp, Homo sapiens
ctttgttttat

SEQ ID NO: 5730731 - DNA, 20 bp, Homo sapiens
ctttgttttcccacacatat

SEQ ID NO: 5730732 - DNA, 19 bp, Homo sapiens
ctttgttttcttagttact

SEQ ID NO: 5730733 - DNA, 19 bp, Homo sapiens
ctttgttttgcacactttg

SEQ ID NO: 5730734 - DNA, 14 bp, Homo sapiens
ctttgttttgcact

SEQ ID NO: 5730735 - DNA, 16 bp, Homo sapiens
ctttgttttgcactga

SEQ ID NO: 5730736 - DNA, 20 bp, Homo sapiens
ctttgttttgggttttcttc

SEQ ID NO: 5730737 - DNA, 13 bp, Homo sapiens
ctttgtttttaaa

SEQ ID NO: 5730738 - DNA, 17 bp, Homo sapiens
ctttgtttttattctgt

SEQ ID NO: 5730739 - DNA, 18 bp, Homo sapiens
ctttgtttttccatgtgt

SEQ ID NO: 5730740 - DNA, 23 bp, Homo sapiens
ctttgtttttccatgtgttttgc

SEQ ID NO: 5730741 - DNA, 12 bp, Homo sapiens
ctttgttttttt

SEQ ID NO: 5730742 - DNA, 15 bp, Homo sapiens
ctttgtttttttaaa

SEQ ID NO: 5730743 - DNA, 16 bp, Homo sapiens
ctttgtttttttttcc

SEQ ID NO: 5730744 - DNA, 18 bp, Homo sapiens
cttttaaaaaaataatat

SEQ ID NO: 5730745 - DNA, 19 bp, Homo sapiens
cttttaaaaaacaaaaaaa

SEQ ID NO: 5730746 - DNA, 15 bp, Homo sapiens
cttttaaaaaatatt

SEQ ID NO: 5730747 - DNA, 22 bp, Homo sapiens
cttttaaaaaatattttaagaa

SEQ ID NO: 5730748 - DNA, 18 bp, Homo sapiens
cttttaaaaactcctgtt

SEQ ID NO: 5730749 - DNA, 15 bp, Homo sapiens
cttttaaaaagtatt

SEQ ID NO: 5730750 - DNA, 13 bp, Homo sapiens
cttttaaaaatac

SEQ ID NO: 5730751 - DNA, 19 bp, Homo sapiens
cttttaaaaatacaattat

SEQ ID NO: 5730752 - DNA, 17 bp, Homo sapiens
cttttaaaaatgtttgg

SEQ ID NO: 5730753 - DNA, 13 bp, Homo sapiens
cttttaaaaggaa

SEQ ID NO: 5730754 - DNA, 16 bp, Homo sapiens
cttttaaaaggaaaac

SEQ ID NO: 5730755 - DNA, 21 bp, Homo sapiens
cttttaaaataaattctctcc

SEQ ID NO: 5730756 - DNA, 13 bp, Homo sapiens
cttttaaaatagt

SEQ ID NO: 5730757 - DNA, 18 bp, Homo sapiens
cttttaaaatagtaattt

SEQ ID NO: 5730758 - DNA, 13 bp, Homo sapiens
cttttaaaatatc

SEQ ID NO: 5730759 - DNA, 17 bp, Homo sapiens
cttttaaaattcaaaag

SEQ ID NO: 5730760 - DNA, 20 bp, Homo sapiens
cttttaaaattgaatagttt

SEQ ID NO: 5730761 - DNA, 22 bp, Homo sapiens
cttttaaaatttgtagaattga

SEQ ID NO: 5730762 - DNA, 12 bp, Homo sapiens
cttttaaacaaa

SEQ ID NO: 5730763 - DNA, 15 bp, Homo sapiens
cttttaaacaaaagt

SEQ ID NO: 5730764 - DNA, 18 bp, Homo sapiens
cttttaaacaaaagtgta

SEQ ID NO: 5730765 - DNA, 23 bp, Homo sapiens
cttttaaacaaaagtgtacctgt

SEQ ID NO: 5730766 - DNA, 16 bp, Homo sapiens
cttttaaacaagtcat

SEQ ID NO: 5730767 - DNA, 12 bp, Homo sapiens
cttttaaacaca

SEQ ID NO: 5730768 - DNA, 19 bp, Homo sapiens
cttttaaacataaagaatt

SEQ ID NO: 5730769 - DNA, 16 bp, Homo sapiens
cttttaaacattattt

SEQ ID NO: 5730770 - DNA, 17 bp, Homo sapiens
cttttaaacattatttt

SEQ ID NO: 5730771 - DNA, 20 bp, Homo sapiens
cttttaaacctcacctttgt

SEQ ID NO: 5730772 - DNA, 21 bp, Homo sapiens
cttttaaacctgttcctgact

SEQ ID NO: 5730773 - DNA, 22 bp, Homo sapiens
cttttaaactactatttttctt

SEQ ID NO: 5730774 - DNA, 11 bp, Homo sapiens
cttttaaactc

SEQ ID NO: 5730775 - DNA, 20 bp, Homo sapiens
cttttaaagaaaaatatgat

SEQ ID NO: 5730776 - DNA, 16 bp, Homo sapiens
cttttaaagaagcttt

SEQ ID NO: 5730777 - DNA, 19 bp, Homo sapiens
cttttaaagaagctttatc

SEQ ID NO: 5730778 - DNA, 18 bp, Homo sapiens
cttttaaagaatttcttt

SEQ ID NO: 5730779 - DNA, 17 bp, Homo sapiens
cttttaaagatttgttt

SEQ ID NO: 5730780 - DNA, 22 bp, Homo sapiens
cttttaaaggaatgtgaaattt

SEQ ID NO: 5730781 - DNA, 22 bp, Homo sapiens
cttttaaaggggcagaaaaact

SEQ ID NO: 5730782 - DNA, 23 bp, Homo sapiens
cttttaaaggggcagaaaaactc

SEQ ID NO: 5730783 - DNA, 13 bp, Homo sapiens
cttttaaagtgtt

SEQ ID NO: 5730784 - DNA, 19 bp, Homo sapiens
cttttaaagtgtttcagct

SEQ ID NO: 5730785 - DNA, 23 bp, Homo sapiens
cttttaaagttttgtcagaaaag

SEQ ID NO: 5730786 - DNA, 10 bp, Homo sapiens
cttttaaata

SEQ ID NO: 5730787 - DNA, 17 bp, Homo sapiens
cttttaaataaattatg

SEQ ID NO: 5730788 - DNA, 17 bp, Homo sapiens
cttttaaatcctgttga

SEQ ID NO: 5730789 - DNA, 19 bp, Homo sapiens
cttttaaatgggtgaaaaa

SEQ ID NO: 5730790 - DNA, 16 bp, Homo sapiens
cttttaaattagaaaa

SEQ ID NO: 5730791 - DNA, 13 bp, Homo sapiens
cttttaaattatg

SEQ ID NO: 5730792 - DNA, 14 bp, Homo sapiens
cttttaaattcttt

SEQ ID NO: 5730793 - DNA, 19 bp, Homo sapiens
cttttaacacctgatgtgt

SEQ ID NO: 5730794 - DNA, 23 bp, Homo sapiens
cttttaacacctgatgtgtacat

SEQ ID NO: 5730795 - DNA, 22 bp, Homo sapiens
cttttaacagagtctgaaccta

SEQ ID NO: 5730796 - DNA, 22 bp, Homo sapiens
cttttaacatttatctaaaaga

SEQ ID NO: 5730797 - DNA, 15 bp, Homo sapiens
cttttaacattttgt

SEQ ID NO: 5730798 - DNA, 21 bp, Homo sapiens
cttttaacattttgttcttac

SEQ ID NO: 5730799 - DNA, 15 bp, Homo sapiens
cttttaaccatctga

SEQ ID NO: 5730800 - DNA, 18 bp, Homo sapiens
cttttaaccatctgatat

SEQ ID NO: 5730801 - DNA, 21 bp, Homo sapiens
cttttaactcctcaattccaa

SEQ ID NO: 5730802 - DNA, 14 bp, Homo sapiens
cttttaactgtgca

SEQ ID NO: 5730803 - DNA, 17 bp, Homo sapiens
cttttaacttcacctta

SEQ ID NO: 5730804 - DNA, 17 bp, Homo sapiens
cttttaacttctttcta

SEQ ID NO: 5730805 - DNA, 13 bp, Homo sapiens
cttttaagaaaaa

SEQ ID NO: 5730806 - DNA, 19 bp, Homo sapiens
cttttaagaaaaacaaagt

SEQ ID NO: 5730807 - DNA, 13 bp, Homo sapiens
cttttaagaaaca

SEQ ID NO: 5730808 - DNA, 12 bp, Homo sapiens
cttttaagaaag

SEQ ID NO: 5730809 - DNA, 16 bp, Homo sapiens
cttttaagacattttc

SEQ ID NO: 5730810 - DNA, 14 bp, Homo sapiens
cttttaagatttct

SEQ ID NO: 5730811 - DNA, 18 bp, Homo sapiens
cttttaaggataaatcat

SEQ ID NO: 5730812 - DNA, 23 bp, Homo sapiens
cttttaaggataaatcataaagt

SEQ ID NO: 5730813 - DNA, 13 bp, Homo sapiens
cttttaaggtttc

SEQ ID NO: 5730814 - DNA, 20 bp, Homo sapiens
cttttaaggtttcaacaaat

SEQ ID NO: 5730815 - DNA, 22 bp, Homo sapiens
cttttaagtggactctctgaca

SEQ ID NO: 5730816 - DNA, 13 bp, Homo sapiens
cttttaagttaat

SEQ ID NO: 5730817 - DNA, 19 bp, Homo sapiens
cttttaagttaatgaaata

SEQ ID NO: 5730818 - DNA, 21 bp, Homo sapiens
cttttaagttaatgaaataaa

SEQ ID NO: 5730819 - DNA, 12 bp, Homo sapiens
cttttaataaaa

SEQ ID NO: 5730820 - DNA, 14 bp, Homo sapiens
cttttaataaactg

SEQ ID NO: 5730821 - DNA, 16 bp, Homo sapiens
cttttaatacagggta

SEQ ID NO: 5730822 - DNA, 15 bp, Homo sapiens
cttttaatcagtgaa

SEQ ID NO: 5730823 - DNA, 23 bp, Homo sapiens
cttttaatcatgagcctgtttat

SEQ ID NO: 5730824 - DNA, 16 bp, Homo sapiens
cttttaatccatttca

SEQ ID NO: 5730825 - DNA, 21 bp, Homo sapiens
cttttaatgaatttaaggcaa

SEQ ID NO: 5730826 - DNA, 22 bp, Homo sapiens
cttttaatgaatttaaggcaaa

SEQ ID NO: 5730827 - DNA, 16 bp, Homo sapiens
cttttaatgatactgt

SEQ ID NO: 5730828 - DNA, 19 bp, Homo sapiens
cttttaatgatactgtcta

SEQ ID NO: 5730829 - DNA, 15 bp, Homo sapiens
cttttaatgccttcc

SEQ ID NO: 5730830 - DNA, 19 bp, Homo sapiens
cttttaatggatgtataat

SEQ ID NO: 5730831 - DNA, 20 bp, Homo sapiens
cttttaattaaatgctcatc

SEQ ID NO: 5730832 - DNA, 23 bp, Homo sapiens
cttttaattaatatgttcattaa

SEQ ID NO: 5730833 - DNA, 22 bp, Homo sapiens
cttttaattaatgaaatatctg

SEQ ID NO: 5730834 - DNA, 23 bp, Homo sapiens
cttttaattaatgaaatatctgt

SEQ ID NO: 5730835 - DNA, 12 bp, Homo sapiens
cttttaattcat

SEQ ID NO: 5730836 - DNA, 16 bp, Homo sapiens
cttttaattctcattt

SEQ ID NO: 5730837 - DNA, 23 bp, Homo sapiens
cttttaattgaaattaactttta

SEQ ID NO: 5730838 - DNA, 15 bp, Homo sapiens
cttttacatacagtg

SEQ ID NO: 5730839 - DNA, 13 bp, Homo sapiens
cttttacattctg

SEQ ID NO: 5730840 - DNA, 17 bp, Homo sapiens
cttttacatttttctga

SEQ ID NO: 5730841 - DNA, 18 bp, Homo sapiens
cttttacatttttctgat

SEQ ID NO: 5730842 - DNA, 16 bp, Homo sapiens
cttttaccactcccag

SEQ ID NO: 5730843 - DNA, 12 bp, Homo sapiens
cttttaccatta

SEQ ID NO: 5730844 - DNA, 15 bp, Homo sapiens
cttttaccattttat

SEQ ID NO: 5730845 - DNA, 21 bp, Homo sapiens
cttttaccctggcccctctcc

SEQ ID NO: 5730846 - DNA, 21 bp, Homo sapiens
cttttacctgagactttcagt

SEQ ID NO: 5730847 - DNA, 17 bp, Homo sapiens
cttttacgtagtaaaag

SEQ ID NO: 5730848 - DNA, 15 bp, Homo sapiens
cttttactaagcact

SEQ ID NO: 5730849 - DNA, 15 bp, Homo sapiens
cttttactacagtga

SEQ ID NO: 5730850 - DNA, 12 bp, Homo sapiens
cttttactcctt

SEQ ID NO: 5730851 - DNA, 15 bp, Homo sapiens
cttttactctgtgta

SEQ ID NO: 5730852 - DNA, 21 bp, Homo sapiens
cttttactctgtgtaaagact

SEQ ID NO: 5730853 - DNA, 20 bp, Homo sapiens
cttttactgaagcctttctt

SEQ ID NO: 5730854 - DNA, 17 bp, Homo sapiens
cttttactggttgcatg

SEQ ID NO: 5730855 - DNA, 21 bp, Homo sapiens
cttttactggttgcatggaaa

SEQ ID NO: 5730856 - DNA, 11 bp, Homo sapiens
cttttactgtg

SEQ ID NO: 5730857 - DNA, 12 bp, Homo sapiens
cttttactgtga

SEQ ID NO: 5730858 - DNA, 20 bp, Homo sapiens
cttttactgtggaggtggct

SEQ ID NO: 5730859 - DNA, 13 bp, Homo sapiens
cttttacttgttc

SEQ ID NO: 5730860 - DNA, 14 bp, Homo sapiens
cttttactttttta

SEQ ID NO: 5730861 - DNA, 18 bp, Homo sapiens
cttttacttttttatagc

SEQ ID NO: 5730862 - DNA, 13 bp, Homo sapiens
cttttagaaaagg

SEQ ID NO: 5730863 - DNA, 15 bp, Homo sapiens
cttttagaaatactg

SEQ ID NO: 5730864 - DNA, 15 bp, Homo sapiens
cttttagaaatgcat

SEQ ID NO: 5730865 - DNA, 17 bp, Homo sapiens
cttttagaaatgcatat

SEQ ID NO: 5730866 - DNA, 13 bp, Homo sapiens
cttttagacaact

SEQ ID NO: 5730867 - DNA, 15 bp, Homo sapiens
cttttagacagtggt

SEQ ID NO: 5730868 - DNA, 15 bp, Homo sapiens
cttttagagagggga

SEQ ID NO: 5730869 - DNA, 20 bp, Homo sapiens
cttttagcacatcactgaga

SEQ ID NO: 5730870 - DNA, 16 bp, Homo sapiens
cttttagcagtaaaat

SEQ ID NO: 5730871 - DNA, 18 bp, Homo sapiens
cttttagccagagatgca

SEQ ID NO: 5730872 - DNA, 20 bp, Homo sapiens
cttttagccagagatgcaat

SEQ ID NO: 5730873 - DNA, 19 bp, Homo sapiens
cttttagcctggctgtcac

SEQ ID NO: 5730874 - DNA, 19 bp, Homo sapiens
cttttagcggtttgcaaac

SEQ ID NO: 5730875 - DNA, 17 bp, Homo sapiens
cttttagctagaatcca

SEQ ID NO: 5730876 - DNA, 18 bp, Homo sapiens
cttttagctagaatccac

SEQ ID NO: 5730877 - DNA, 22 bp, Homo sapiens
cttttagctcaaacgtggcttt

SEQ ID NO: 5730878 - DNA, 20 bp, Homo sapiens
cttttaggaaaatcactttg

SEQ ID NO: 5730879 - DNA, 22 bp, Homo sapiens
cttttaggaatatgttcaatgc

SEQ ID NO: 5730880 - DNA, 22 bp, Homo sapiens
cttttagggtaagaagtttgtg

SEQ ID NO: 5730881 - DNA, 17 bp, Homo sapiens
cttttagtaaaaacatt

SEQ ID NO: 5730882 - DNA, 18 bp, Homo sapiens
cttttagtacccacctga

SEQ ID NO: 5730883 - DNA, 22 bp, Homo sapiens
cttttagtacccacctgagctt

SEQ ID NO: 5730884 - DNA, 19 bp, Homo sapiens
cttttagtcacgtgtattt

SEQ ID NO: 5730885 - DNA, 15 bp, Homo sapiens
cttttagtcagaaat

SEQ ID NO: 5730886 - DNA, 16 bp, Homo sapiens
cttttagtcagaaatg

SEQ ID NO: 5730887 - DNA, 23 bp, Homo sapiens
cttttagtggttctgtgcctctt

SEQ ID NO: 5730888 - DNA, 15 bp, Homo sapiens
cttttagttcctgtg

SEQ ID NO: 5730889 - DNA, 20 bp, Homo sapiens
cttttagttgtatctctttt

SEQ ID NO: 5730890 - DNA, 15 bp, Homo sapiens
cttttagtttttccc

SEQ ID NO: 5730891 - DNA, 20 bp, Homo sapiens
cttttataaaaaaaatgaaa

SEQ ID NO: 5730892 - DNA, 21 bp, Homo sapiens
cttttataaaaaaaatgaaat

SEQ ID NO: 5730893 - DNA, 16 bp, Homo sapiens
cttttataaacctcta

SEQ ID NO: 5730894 - DNA, 13 bp, Homo sapiens
cttttataaactt

SEQ ID NO: 5730895 - DNA, 14 bp, Homo sapiens
cttttataaacttt

SEQ ID NO: 5730896 - DNA, 12 bp, Homo sapiens
cttttataaata

SEQ ID NO: 5730897 - DNA, 14 bp, Homo sapiens
cttttataaatatt

SEQ ID NO: 5730898 - DNA, 13 bp, Homo sapiens
cttttataaatta

SEQ ID NO: 5730899 - DNA, 20 bp, Homo sapiens
cttttataaattaaatatat

SEQ ID NO: 5730900 - DNA, 18 bp, Homo sapiens
cttttataagacaaaatt

SEQ ID NO: 5730901 - DNA, 17 bp, Homo sapiens
cttttataagcactcca

SEQ ID NO: 5730902 - DNA, 14 bp, Homo sapiens
cttttataatgatt

SEQ ID NO: 5730903 - DNA, 21 bp, Homo sapiens
cttttataattctcattaaaa

SEQ ID NO: 5730904 - DNA, 22 bp, Homo sapiens
cttttatacctttcctttttgg

SEQ ID NO: 5730905 - DNA, 17 bp, Homo sapiens
cttttatactctttctg

SEQ ID NO: 5730906 - DNA, 16 bp, Homo sapiens
cttttatagatggtca

SEQ ID NO: 5730907 - DNA, 19 bp, Homo sapiens
cttttatagctattactgt

SEQ ID NO: 5730908 - DNA, 19 bp, Homo sapiens
cttttataggtgagaaaaa

SEQ ID NO: 5730909 - DNA, 22 bp, Homo sapiens
cttttataggtgagaaaaaaac

SEQ ID NO: 5730910 - DNA, 14 bp, Homo sapiens
cttttatagttgta

SEQ ID NO: 5730911 - DNA, 18 bp, Homo sapiens
cttttatataactacatt

SEQ ID NO: 5730912 - DNA, 15 bp, Homo sapiens
cttttatatataaaa

SEQ ID NO: 5730913 - DNA, 16 bp, Homo sapiens
cttttatatataaaat

SEQ ID NO: 5730914 - DNA, 19 bp, Homo sapiens
cttttatatataaaataaa

SEQ ID NO: 5730915 - DNA, 20 bp, Homo sapiens
cttttatattctaatagttt

SEQ ID NO: 5730916 - DNA, 23 bp, Homo sapiens
cttttatatttgaaaaaattaaa

SEQ ID NO: 5730917 - DNA, 13 bp, Homo sapiens
cttttatatttgt

SEQ ID NO: 5730918 - DNA, 16 bp, Homo sapiens
cttttatcaaaatccc

SEQ ID NO: 5730919 - DNA, 14 bp, Homo sapiens
cttttatcaataaa

SEQ ID NO: 5730920 - DNA, 19 bp, Homo sapiens
cttttatcaataaagcact

SEQ ID NO: 5730921 - DNA, 22 bp, Homo sapiens
cttttatcacttaatttgaaat

SEQ ID NO: 5730922 - DNA, 18 bp, Homo sapiens
cttttatccactggcatt

SEQ ID NO: 5730923 - DNA, 23 bp, Homo sapiens
cttttatctattctgagaaaaca

SEQ ID NO: 5730924 - DNA, 15 bp, Homo sapiens
cttttatctcacaaa

SEQ ID NO: 5730925 - DNA, 19 bp, Homo sapiens
cttttatctggtgcctcct

SEQ ID NO: 5730926 - DNA, 19 bp, Homo sapiens
cttttatctgtagcagaaa

SEQ ID NO: 5730927 - DNA, 20 bp, Homo sapiens
cttttatcttctagccacag

SEQ ID NO: 5730928 - DNA, 15 bp, Homo sapiens
cttttatgaaattaa

SEQ ID NO: 5730929 - DNA, 10 bp, Homo sapiens
cttttatgac

SEQ ID NO: 5730930 - DNA, 21 bp, Homo sapiens
cttttatgagctcatgtagca

SEQ ID NO: 5730931 - DNA, 22 bp, Homo sapiens
cttttatgagctcatgtagcaa

SEQ ID NO: 5730932 - DNA, 17 bp, Homo sapiens
cttttatgatgtatatt

SEQ ID NO: 5730933 - DNA, 18 bp, Homo sapiens
cttttatgcaaaaggttt

SEQ ID NO: 5730934 - DNA, 16 bp, Homo sapiens
cttttatgctcacctg

SEQ ID NO: 5730935 - DNA, 20 bp, Homo sapiens
cttttatggatgattaaatt

SEQ ID NO: 5730936 - DNA, 23 bp, Homo sapiens
cttttatgtagtaattgacatgt

SEQ ID NO: 5730937 - DNA, 14 bp, Homo sapiens
cttttatgtgaaac

SEQ ID NO: 5730938 - DNA, 14 bp, Homo sapiens
cttttatgtgagat

SEQ ID NO: 5730939 - DNA, 15 bp, Homo sapiens
cttttatgtgagatt

SEQ ID NO: 5730940 - DNA, 18 bp, Homo sapiens
cttttatgtgagatttcc

SEQ ID NO: 5730941 - DNA, 18 bp, Homo sapiens
cttttatgtgatatgttt

SEQ ID NO: 5730942 - DNA, 20 bp, Homo sapiens
cttttatgtgatatgtttta

SEQ ID NO: 5730943 - DNA, 21 bp, Homo sapiens
cttttatgtgatatgttttaa

SEQ ID NO: 5730944 - DNA, 15 bp, Homo sapiens
cttttattaatactt

SEQ ID NO: 5730945 - DNA, 22 bp, Homo sapiens
cttttattaatactttctttta

SEQ ID NO: 5730946 - DNA, 15 bp, Homo sapiens
cttttattaatatat

SEQ ID NO: 5730947 - DNA, 14 bp, Homo sapiens
cttttattagccag

SEQ ID NO: 5730948 - DNA, 21 bp, Homo sapiens
cttttattattattattgctg

SEQ ID NO: 5730949 - DNA, 18 bp, Homo sapiens
cttttattcattagctgt

SEQ ID NO: 5730950 - DNA, 17 bp, Homo sapiens
cttttattcatttgagt

SEQ ID NO: 5730951 - DNA, 22 bp, Homo sapiens
cttttattcctgccctgctgtt

SEQ ID NO: 5730952 - DNA, 18 bp, Homo sapiens
cttttattcctttgaata

SEQ ID NO: 5730953 - DNA, 23 bp, Homo sapiens
cttttattgagtaatattacatt

SEQ ID NO: 5730954 - DNA, 22 bp, Homo sapiens
cttttattgcaccattttcaat

SEQ ID NO: 5730955 - DNA, 17 bp, Homo sapiens
cttttattgtaaatgag

SEQ ID NO: 5730956 - DNA, 13 bp, Homo sapiens
cttttattgtata

SEQ ID NO: 5730957 - DNA, 17 bp, Homo sapiens
cttttattgtataatta

SEQ ID NO: 5730958 - DNA, 20 bp, Homo sapiens
cttttatttagggccttttc

SEQ ID NO: 5730959 - DNA, 15 bp, Homo sapiens
cttttatttcagtgc

SEQ ID NO: 5730960 - DNA, 14 bp, Homo sapiens
cttttatttcattc

SEQ ID NO: 5730961 - DNA, 15 bp, Homo sapiens
cttttatttcattca

SEQ ID NO: 5730962 - DNA, 20 bp, Homo sapiens
cttttattttacacagaaac

SEQ ID NO: 5730963 - DNA, 17 bp, Homo sapiens
cttttattttcctgctg

SEQ ID NO: 5730964 - DNA, 14 bp, Homo sapiens
cttttattttgaaa

SEQ ID NO: 5730965 - DNA, 14 bp, Homo sapiens
cttttattttggaa

SEQ ID NO: 5730966 - DNA, 22 bp, Homo sapiens
cttttattttggaactatgaag

SEQ ID NO: 5730967 - DNA, 21 bp, Homo sapiens
cttttattttttcttttgtaa

SEQ ID NO: 5730968 - DNA, 18 bp, Homo sapiens
cttttcaaaataaagctt

SEQ ID NO: 5730969 - DNA, 18 bp, Homo sapiens
cttttcaaacaagaatgt

SEQ ID NO: 5730970 - DNA, 16 bp, Homo sapiens
cttttcaaacacacac

SEQ ID NO: 5730971 - DNA, 17 bp, Homo sapiens
cttttcaaacacacaca

SEQ ID NO: 5730972 - DNA, 18 bp, Homo sapiens
cttttcaaaccagagaaa

SEQ ID NO: 5730973 - DNA, 14 bp, Homo sapiens
cttttcaaaggtac

SEQ ID NO: 5730974 - DNA, 16 bp, Homo sapiens
cttttcaaatgcagca

SEQ ID NO: 5730975 - DNA, 22 bp, Homo sapiens
cttttcaaggcacattgaaata

SEQ ID NO: 5730976 - DNA, 18 bp, Homo sapiens
cttttcaatatatttgta

SEQ ID NO: 5730977 - DNA, 18 bp, Homo sapiens
cttttcaatcttctactt

SEQ ID NO: 5730978 - DNA, 20 bp, Homo sapiens
cttttcacaaaggctgatgt

SEQ ID NO: 5730979 - DNA, 12 bp, Homo sapiens
cttttcacaaat

SEQ ID NO: 5730980 - DNA, 13 bp, Homo sapiens
cttttcacaaata

SEQ ID NO: 5730981 - DNA, 14 bp, Homo sapiens
cttttcacaaataa

SEQ ID NO: 5730982 - DNA, 14 bp, Homo sapiens
cttttcacactgtc

SEQ ID NO: 5730983 - DNA, 18 bp, Homo sapiens
cttttcacactgtcttcc

SEQ ID NO: 5730984 - DNA, 20 bp, Homo sapiens
cttttcacactgtcttcccg

SEQ ID NO: 5730985 - DNA, 21 bp, Homo sapiens
cttttcacatgctaatgtgca

SEQ ID NO: 5730986 - DNA, 21 bp, Homo sapiens
cttttcacattagataaatta

SEQ ID NO: 5730987 - DNA, 19 bp, Homo sapiens
cttttcacattaggctgtt

SEQ ID NO: 5730988 - DNA, 20 bp, Homo sapiens
cttttcacattaggctgttg

SEQ ID NO: 5730989 - DNA, 13 bp, Homo sapiens
cttttcacattct

SEQ ID NO: 5730990 - DNA, 20 bp, Homo sapiens
cttttcacattcttataaat

SEQ ID NO: 5730991 - DNA, 15 bp, Homo sapiens
cttttcacattttta

SEQ ID NO: 5730992 - DNA, 14 bp, Homo sapiens
cttttcaccaatga

SEQ ID NO: 5730993 - DNA, 15 bp, Homo sapiens
cttttcaccattcgt

SEQ ID NO: 5730994 - DNA, 16 bp, Homo sapiens
cttttcacccttctac

SEQ ID NO: 5730995 - DNA, 18 bp, Homo sapiens
cttttcacccttctactc

SEQ ID NO: 5730996 - DNA, 21 bp, Homo sapiens
cttttcacctccaactggatg

SEQ ID NO: 5730997 - DNA, 18 bp, Homo sapiens
cttttcacctccttcaat

SEQ ID NO: 5730998 - DNA, 15 bp, Homo sapiens
cttttcacctcttta

SEQ ID NO: 5730999 - DNA, 12 bp, Homo sapiens
cttttcaccttt

SEQ ID NO: 5731000 - DNA, 12 bp, Homo sapiens
cttttcacggga

SEQ ID NO: 5731001 - DNA, 19 bp, Homo sapiens
cttttcacgggaactctcc

SEQ ID NO: 5731002 - DNA, 15 bp, Homo sapiens
cttttcacgttttct

SEQ ID NO: 5731003 - DNA, 20 bp, Homo sapiens
cttttcactgctgcaaggcc

SEQ ID NO: 5731004 - DNA, 16 bp, Homo sapiens
cttttcactgctggct

SEQ ID NO: 5731005 - DNA, 20 bp, Homo sapiens
cttttcactgctggctgcct

SEQ ID NO: 5731006 - DNA, 21 bp, Homo sapiens
cttttcacttcctctccacag

SEQ ID NO: 5731007 - DNA, 22 bp, Homo sapiens
cttttcacttcctctccacagg

SEQ ID NO: 5731008 - DNA, 22 bp, Homo sapiens
cttttcacttcgggctgtgtaa

SEQ ID NO: 5731009 - DNA, 16 bp, Homo sapiens
cttttcagattgtgga

SEQ ID NO: 5731010 - DNA, 22 bp, Homo sapiens
cttttcagcatggtttgcatga

SEQ ID NO: 5731011 - DNA, 23 bp, Homo sapiens
cttttcagcgatgtatgcagcta

SEQ ID NO: 5731012 - DNA, 15 bp, Homo sapiens
cttttcagctgagcc

SEQ ID NO: 5731013 - DNA, 17 bp, Homo sapiens
cttttcagcttctgctg

SEQ ID NO: 5731014 - DNA, 23 bp, Homo sapiens
cttttcagcttctgctgggctgg

SEQ ID NO: 5731015 - DNA, 17 bp, Homo sapiens
cttttcagcttgtttct

SEQ ID NO: 5731016 - DNA, 18 bp, Homo sapiens
cttttcaggagatgggga

SEQ ID NO: 5731017 - DNA, 22 bp, Homo sapiens
cttttcaggaggtactgtgagg

SEQ ID NO: 5731018 - DNA, 16 bp, Homo sapiens
cttttcagggctggct

SEQ ID NO: 5731019 - DNA, 22 bp, Homo sapiens
cttttcagtgttttttcacttt

SEQ ID NO: 5731020 - DNA, 18 bp, Homo sapiens
cttttcatacattttcta

SEQ ID NO: 5731021 - DNA, 23 bp, Homo sapiens
cttttcatatctcttgcccttcc

SEQ ID NO: 5731022 - DNA, 13 bp, Homo sapiens
cttttcatctggg

SEQ ID NO: 5731023 - DNA, 17 bp, Homo sapiens
cttttcatctgggaaag

SEQ ID NO: 5731024 - DNA, 20 bp, Homo sapiens
cttttcatctgttgttctgt

SEQ ID NO: 5731025 - DNA, 15 bp, Homo sapiens
cttttcatgcaaact

SEQ ID NO: 5731026 - DNA, 20 bp, Homo sapiens
cttttcatgcaaactctttg

SEQ ID NO: 5731027 - DNA, 18 bp, Homo sapiens
cttttcatgcgtgtgtgt

SEQ ID NO: 5731028 - DNA, 13 bp, Homo sapiens
cttttcatgtaga

SEQ ID NO: 5731029 - DNA, 17 bp, Homo sapiens
cttttcattacactaaa

SEQ ID NO: 5731030 - DNA, 21 bp, Homo sapiens
cttttcattacactaaagtgc

SEQ ID NO: 5731031 - DNA, 15 bp, Homo sapiens
cttttcattccctgt

SEQ ID NO: 5731032 - DNA, 17 bp, Homo sapiens
cttttcattctctttta

SEQ ID NO: 5731033 - DNA, 12 bp, Homo sapiens
cttttcattgca

SEQ ID NO: 5731034 - DNA, 23 bp, Homo sapiens
cttttcatttatcaagcagagac

SEQ ID NO: 5731035 - DNA, 14 bp, Homo sapiens
cttttcatttcaga

SEQ ID NO: 5731036 - DNA, 13 bp, Homo sapiens
cttttccaaaaat

SEQ ID NO: 5731037 - DNA, 14 bp, Homo sapiens
cttttccaaataaa

SEQ ID NO: 5731038 - DNA, 17 bp, Homo sapiens
cttttccaaataaaggt

SEQ ID NO: 5731039 - DNA, 16 bp, Homo sapiens
cttttccaacatacaa

SEQ ID NO: 5731040 - DNA, 22 bp, Homo sapiens
cttttccaacatacaatttact

SEQ ID NO: 5731041 - DNA, 18 bp, Homo sapiens
cttttccaagcaaaatct

SEQ ID NO: 5731042 - DNA, 23 bp, Homo sapiens
cttttccaatgacattttgttgg

SEQ ID NO: 5731043 - DNA, 17 bp, Homo sapiens
cttttccacaaggaatc

SEQ ID NO: 5731044 - DNA, 23 bp, Homo sapiens
cttttccacagatttttttgtaa

SEQ ID NO: 5731045 - DNA, 11 bp, Homo sapiens
cttttccagaa

SEQ ID NO: 5731046 - DNA, 14 bp, Homo sapiens
cttttccagagcat

SEQ ID NO: 5731047 - DNA, 22 bp, Homo sapiens
cttttccaggagttctgaagct

SEQ ID NO: 5731048 - DNA, 20 bp, Homo sapiens
cttttccaggatcctgcagg

SEQ ID NO: 5731049 - DNA, 21 bp, Homo sapiens
cttttccaggatcctgcagga

SEQ ID NO: 5731050 - DNA, 19 bp, Homo sapiens
cttttccagttgctgtgga

SEQ ID NO: 5731051 - DNA, 20 bp, Homo sapiens
cttttccataaagtgtaatt

SEQ ID NO: 5731052 - DNA, 14 bp, Homo sapiens
cttttccatcatct

SEQ ID NO: 5731053 - DNA, 21 bp, Homo sapiens
cttttccatcatctcttttcc

SEQ ID NO: 5731054 - DNA, 15 bp, Homo sapiens
cttttccatcccact

SEQ ID NO: 5731055 - DNA, 18 bp, Homo sapiens
cttttccatcccactcca

SEQ ID NO: 5731056 - DNA, 15 bp, Homo sapiens
cttttccatcctgag

SEQ ID NO: 5731057 - DNA, 16 bp, Homo sapiens
cttttccatctaaaat

SEQ ID NO: 5731058 - DNA, 17 bp, Homo sapiens
cttttccattctgggtg

SEQ ID NO: 5731059 - DNA, 21 bp, Homo sapiens
cttttccattgaccagctctc

SEQ ID NO: 5731060 - DNA, 14 bp, Homo sapiens
cttttccattgtca

SEQ ID NO: 5731061 - DNA, 20 bp, Homo sapiens
cttttcccaccttcaccttt

SEQ ID NO: 5731062 - DNA, 13 bp, Homo sapiens
cttttcccactcc

SEQ ID NO: 5731063 - DNA, 22 bp, Homo sapiens
cttttcccactccaagcccagc

SEQ ID NO: 5731064 - DNA, 14 bp, Homo sapiens
cttttcccaggaat

SEQ ID NO: 5731065 - DNA, 17 bp, Homo sapiens
cttttcccataaataaa

SEQ ID NO: 5731066 - DNA, 21 bp, Homo sapiens
cttttcccatttatctaaata

SEQ ID NO: 5731067 - DNA, 15 bp, Homo sapiens
cttttccccaggagc

SEQ ID NO: 5731068 - DNA, 22 bp, Homo sapiens
cttttcccccaccctcccatga

SEQ ID NO: 5731069 - DNA, 18 bp, Homo sapiens
cttttcccccagcaccta

SEQ ID NO: 5731070 - DNA, 23 bp, Homo sapiens
cttttcccccattaatcagttca

SEQ ID NO: 5731071 - DNA, 17 bp, Homo sapiens
cttttcccctcattgca

SEQ ID NO: 5731072 - DNA, 19 bp, Homo sapiens
cttttcccctcattgcatt

SEQ ID NO: 5731073 - DNA, 15 bp, Homo sapiens
cttttcccctgttaa

SEQ ID NO: 5731074 - DNA, 19 bp, Homo sapiens
cttttcccctgttaaacag

SEQ ID NO: 5731075 - DNA, 16 bp, Homo sapiens
cttttcccctttcctg

SEQ ID NO: 5731076 - DNA, 18 bp, Homo sapiens
cttttcccctttcctgtc

SEQ ID NO: 5731077 - DNA, 18 bp, Homo sapiens
cttttccctcctttcctt

SEQ ID NO: 5731078 - DNA, 20 bp, Homo sapiens
cttttccctctttggctccc

SEQ ID NO: 5731079 - DNA, 16 bp, Homo sapiens
cttttccctcttttct

SEQ ID NO: 5731080 - DNA, 13 bp, Homo sapiens
cttttccctgctt

SEQ ID NO: 5731081 - DNA, 14 bp, Homo sapiens
cttttccctgcttc

SEQ ID NO: 5731082 - DNA, 13 bp, Homo sapiens
cttttcccttgct

SEQ ID NO: 5731083 - DNA, 17 bp, Homo sapiens
cttttccgttctgttct

SEQ ID NO: 5731084 - DNA, 23 bp, Homo sapiens
cttttccgttctgttctgctggg

SEQ ID NO: 5731085 - DNA, 19 bp, Homo sapiens
cttttcctaacatgcacct

SEQ ID NO: 5731086 - DNA, 23 bp, Homo sapiens
cttttcctaacatgcaccttgct

SEQ ID NO: 5731087 - DNA, 16 bp, Homo sapiens
cttttcctatttgttt

SEQ ID NO: 5731088 - DNA, 13 bp, Homo sapiens
cttttcctccctt

SEQ ID NO: 5731089 - DNA, 17 bp, Homo sapiens
cttttcctcgcttcttt

SEQ ID NO: 5731090 - DNA, 19 bp, Homo sapiens
cttttcctcgcttctttca

SEQ ID NO: 5731091 - DNA, 16 bp, Homo sapiens
cttttcctctctcccg

SEQ ID NO: 5731092 - DNA, 13 bp, Homo sapiens
cttttcctctctg

SEQ ID NO: 5731093 - DNA, 15 bp, Homo sapiens
cttttcctctctgtc

SEQ ID NO: 5731094 - DNA, 17 bp, Homo sapiens
cttttcctctctgtctg

SEQ ID NO: 5731095 - DNA, 15 bp, Homo sapiens
cttttcctcttagaa

SEQ ID NO: 5731096 - DNA, 15 bp, Homo sapiens
cttttcctgaggtca

SEQ ID NO: 5731097 - DNA, 22 bp, Homo sapiens
cttttcctgaggtcatctgtaa

SEQ ID NO: 5731098 - DNA, 22 bp, Homo sapiens
cttttcctgataaagcacagct

SEQ ID NO: 5731099 - DNA, 21 bp, Homo sapiens
cttttcctgatggctggcagg

SEQ ID NO: 5731100 - DNA, 15 bp, Homo sapiens
cttttcctgccctgt

SEQ ID NO: 5731101 - DNA, 13 bp, Homo sapiens
cttttcctgctgc

SEQ ID NO: 5731102 - DNA, 14 bp, Homo sapiens
cttttcctgctgcc

SEQ ID NO: 5731103 - DNA, 19 bp, Homo sapiens
cttttcctggcagctgctg

SEQ ID NO: 5731104 - DNA, 21 bp, Homo sapiens
cttttcctgggaatggaataa

SEQ ID NO: 5731105 - DNA, 15 bp, Homo sapiens
cttttcctggtgctc

SEQ ID NO: 5731106 - DNA, 16 bp, Homo sapiens
cttttcctggtgctct

SEQ ID NO: 5731107 - DNA, 13 bp, Homo sapiens
cttttcctgtcag

SEQ ID NO: 5731108 - DNA, 14 bp, Homo sapiens
cttttcctgtcagt

SEQ ID NO: 5731109 - DNA, 21 bp, Homo sapiens
cttttcctgtcagtgtttttg

SEQ ID NO: 5731110 - DNA, 16 bp, Homo sapiens
cttttccttatactgt

SEQ ID NO: 5731111 - DNA, 20 bp, Homo sapiens
cttttccttatttgccttct

SEQ ID NO: 5731112 - DNA, 11 bp, Homo sapiens
cttttccttca

SEQ ID NO: 5731113 - DNA, 13 bp, Homo sapiens
cttttccttcaga

SEQ ID NO: 5731114 - DNA, 20 bp, Homo sapiens
cttttccttccctcaaagct

SEQ ID NO: 5731115 - DNA, 20 bp, Homo sapiens
cttttccttcccttttctgt

SEQ ID NO: 5731116 - DNA, 17 bp, Homo sapiens
cttttccttggggcagg

SEQ ID NO: 5731117 - DNA, 16 bp, Homo sapiens
cttttcctttcttcta

SEQ ID NO: 5731118 - DNA, 14 bp, Homo sapiens
cttttcctttcttt

SEQ ID NO: 5731119 - DNA, 16 bp, Homo sapiens
cttttcctttgtggtt

SEQ ID NO: 5731120 - DNA, 11 bp, Homo sapiens
cttttcctttt

SEQ ID NO: 5731121 - DNA, 14 bp, Homo sapiens
cttttccttttgca

SEQ ID NO: 5731122 - DNA, 21 bp, Homo sapiens
cttttcgccaaggctcacatg

SEQ ID NO: 5731123 - DNA, 22 bp, Homo sapiens
cttttcgccccctgcctgccat

SEQ ID NO: 5731124 - DNA, 24 bp, Homo sapiens
cttttcgcttgcttctgcagcaac

SEQ ID NO: 5731125 - DNA, 14 bp, Homo sapiens
cttttctaactttt

SEQ ID NO: 5731126 - DNA, 13 bp, Homo sapiens
cttttctaagaaa

SEQ ID NO: 5731127 - DNA, 21 bp, Homo sapiens
cttttctaagtggcgtgtgca

SEQ ID NO: 5731128 - DNA, 17 bp, Homo sapiens
cttttctaatctctttt

SEQ ID NO: 5731129 - DNA, 13 bp, Homo sapiens
cttttctaatctt

SEQ ID NO: 5731130 - DNA, 16 bp, Homo sapiens
cttttctaattaatag

SEQ ID NO: 5731131 - DNA, 22 bp, Homo sapiens
cttttctaattcctgttgctct

SEQ ID NO: 5731132 - DNA, 19 bp, Homo sapiens
cttttctacacactcagcc

SEQ ID NO: 5731133 - DNA, 22 bp, Homo sapiens
cttttctacacactcagccaca

SEQ ID NO: 5731134 - DNA, 23 bp, Homo sapiens
cttttctacacactcagccacaa

SEQ ID NO: 5731135 - DNA, 14 bp, Homo sapiens
cttttctacagcaa

SEQ ID NO: 5731136 - DNA, 15 bp, Homo sapiens
cttttctacagcaaa

SEQ ID NO: 5731137 - DNA, 17 bp, Homo sapiens
cttttctacagcaaatt

SEQ ID NO: 5731138 - DNA, 18 bp, Homo sapiens
cttttctacagcaaattt

SEQ ID NO: 5731139 - DNA, 16 bp, Homo sapiens
cttttctaccctagcc

SEQ ID NO: 5731140 - DNA, 15 bp, Homo sapiens
cttttctagagacac

SEQ ID NO: 5731141 - DNA, 16 bp, Homo sapiens
cttttctagcaactgt

SEQ ID NO: 5731142 - DNA, 16 bp, Homo sapiens
cttttctaggaagcac

SEQ ID NO: 5731143 - DNA, 13 bp, Homo sapiens
cttttctatttat

SEQ ID NO: 5731144 - DNA, 13 bp, Homo sapiens
cttttctattttc

SEQ ID NO: 5731145 - DNA, 17 bp, Homo sapiens
cttttctattttttata

SEQ ID NO: 5731146 - DNA, 20 bp, Homo sapiens
cttttctcaactgggtccag

SEQ ID NO: 5731147 - DNA, 15 bp, Homo sapiens
cttttctcaggagct

SEQ ID NO: 5731148 - DNA, 14 bp, Homo sapiens
cttttctcatctgt

SEQ ID NO: 5731149 - DNA, 13 bp, Homo sapiens
cttttctcatggt

SEQ ID NO: 5731150 - DNA, 18 bp, Homo sapiens
cttttctcatgtgtttgc

SEQ ID NO: 5731151 - DNA, 23 bp, Homo sapiens
cttttctcccacctccttcctcc

SEQ ID NO: 5731152 - DNA, 14 bp, Homo sapiens
cttttctccccacg

SEQ ID NO: 5731153 - DNA, 19 bp, Homo sapiens
cttttctccctagaaacaa

SEQ ID NO: 5731154 - DNA, 17 bp, Homo sapiens
cttttctcctcactgta

SEQ ID NO: 5731155 - DNA, 16 bp, Homo sapiens
cttttctcctccgcct

SEQ ID NO: 5731156 - DNA, 10 bp, Homo sapiens
cttttctctc

SEQ ID NO: 5731157 - DNA, 15 bp, Homo sapiens
cttttctctcccata

SEQ ID NO: 5731158 - DNA, 12 bp, Homo sapiens
cttttctctgcc

SEQ ID NO: 5731159 - DNA, 14 bp, Homo sapiens
cttttctctgctct

SEQ ID NO: 5731160 - DNA, 17 bp, Homo sapiens
cttttctctggtaatat

SEQ ID NO: 5731161 - DNA, 22 bp, Homo sapiens
cttttctgagttcttgaagcat

SEQ ID NO: 5731162 - DNA, 14 bp, Homo sapiens
cttttctgatccag

SEQ ID NO: 5731163 - DNA, 19 bp, Homo sapiens
cttttctgatcgtctcggc

SEQ ID NO: 5731164 - DNA, 20 bp, Homo sapiens
cttttctgattaatatattt

SEQ ID NO: 5731165 - DNA, 15 bp, Homo sapiens
cttttctgcatttgg

SEQ ID NO: 5731166 - DNA, 16 bp, Homo sapiens
cttttctgccaaaata

SEQ ID NO: 5731167 - DNA, 21 bp, Homo sapiens
cttttctgccctgccctcagc

SEQ ID NO: 5731168 - DNA, 14 bp, Homo sapiens
cttttctgccctgg

SEQ ID NO: 5731169 - DNA, 17 bp, Homo sapiens
cttttctgccctggctg

SEQ ID NO: 5731170 - DNA, 16 bp, Homo sapiens
cttttctgcctgctcc

SEQ ID NO: 5731171 - DNA, 18 bp, Homo sapiens
cttttctggaatgtaatc

SEQ ID NO: 5731172 - DNA, 19 bp, Homo sapiens
cttttctggaatgtaatca

SEQ ID NO: 5731173 - DNA, 13 bp, Homo sapiens
cttttctggagtt

SEQ ID NO: 5731174 - DNA, 14 bp, Homo sapiens
cttttctggctcct

SEQ ID NO: 5731175 - DNA, 21 bp, Homo sapiens
cttttctggggaaagacactg

SEQ ID NO: 5731176 - DNA, 23 bp, Homo sapiens
cttttctggggaaagacactgcc

SEQ ID NO: 5731177 - DNA, 18 bp, Homo sapiens
cttttctggggcccagga

SEQ ID NO: 5731178 - DNA, 21 bp, Homo sapiens
cttttctggggcccaggaagc

SEQ ID NO: 5731179 - DNA, 20 bp, Homo sapiens
cttttctgggtttgaagctg

SEQ ID NO: 5731180 - DNA, 22 bp, Homo sapiens
cttttctggtaggttctgtctg

SEQ ID NO: 5731181 - DNA, 15 bp, Homo sapiens
cttttctgtaattca

SEQ ID NO: 5731182 - DNA, 13 bp, Homo sapiens
cttttctgtactt

SEQ ID NO: 5731183 - DNA, 13 bp, Homo sapiens
cttttctgtattt

SEQ ID NO: 5731184 - DNA, 18 bp, Homo sapiens
cttttctgtccgagcttt

SEQ ID NO: 5731185 - DNA, 16 bp, Homo sapiens
cttttctgtcctgggc

SEQ ID NO: 5731186 - DNA, 18 bp, Homo sapiens
cttttctgtctctctctt

SEQ ID NO: 5731187 - DNA, 17 bp, Homo sapiens
cttttctgtctctgcct

SEQ ID NO: 5731188 - DNA, 14 bp, Homo sapiens
cttttctgtgccag

SEQ ID NO: 5731189 - DNA, 18 bp, Homo sapiens
cttttctgtggctggctc

SEQ ID NO: 5731190 - DNA, 15 bp, Homo sapiens
cttttctgttattgt

SEQ ID NO: 5731191 - DNA, 18 bp, Homo sapiens
cttttctgttattgtatt

SEQ ID NO: 5731192 - DNA, 16 bp, Homo sapiens
cttttctgttctagtt

SEQ ID NO: 5731193 - DNA, 15 bp, Homo sapiens
cttttctgtttagga

SEQ ID NO: 5731194 - DNA, 15 bp, Homo sapiens
cttttctgtttgcta

SEQ ID NO: 5731195 - DNA, 15 bp, Homo sapiens
cttttcttaaacctt

SEQ ID NO: 5731196 - DNA, 16 bp, Homo sapiens
cttttcttaaaccttc

SEQ ID NO: 5731197 - DNA, 20 bp, Homo sapiens
cttttcttaaagactgaaat

SEQ ID NO: 5731198 - DNA, 23 bp, Homo sapiens
cttttcttacagtaactgagtgt

SEQ ID NO: 5731199 - DNA, 14 bp, Homo sapiens
cttttcttactcct

SEQ ID NO: 5731200 - DNA, 19 bp, Homo sapiens
cttttcttactcctcctct

SEQ ID NO: 5731201 - DNA, 17 bp, Homo sapiens
cttttcttactctgaaa

SEQ ID NO: 5731202 - DNA, 17 bp, Homo sapiens
cttttcttattcctttt

SEQ ID NO: 5731203 - DNA, 19 bp, Homo sapiens
cttttcttattccttttta

SEQ ID NO: 5731204 - DNA, 12 bp, Homo sapiens
cttttcttcaaa

SEQ ID NO: 5731205 - DNA, 14 bp, Homo sapiens
cttttcttcctggc

SEQ ID NO: 5731206 - DNA, 14 bp, Homo sapiens
cttttcttccttct

SEQ ID NO: 5731207 - DNA, 14 bp, Homo sapiens
cttttcttctatgt

SEQ ID NO: 5731208 - DNA, 17 bp, Homo sapiens
cttttcttcttcctggt

SEQ ID NO: 5731209 - DNA, 17 bp, Homo sapiens
cttttcttgataggcct

SEQ ID NO: 5731210 - DNA, 18 bp, Homo sapiens
cttttcttgcatgaggct

SEQ ID NO: 5731211 - DNA, 13 bp, Homo sapiens
cttttcttgccag

SEQ ID NO: 5731212 - DNA, 14 bp, Homo sapiens
cttttcttgccagc

SEQ ID NO: 5731213 - DNA, 21 bp, Homo sapiens
cttttcttggaactgtcccag

SEQ ID NO: 5731214 - DNA, 23 bp, Homo sapiens
cttttcttggcaaaagccttgtg

SEQ ID NO: 5731215 - DNA, 15 bp, Homo sapiens
cttttcttggccaac

SEQ ID NO: 5731216 - DNA, 19 bp, Homo sapiens
cttttcttggcgttcctgc

SEQ ID NO: 5731217 - DNA, 17 bp, Homo sapiens
cttttcttggcttgttt

SEQ ID NO: 5731218 - DNA, 11 bp, Homo sapiens
cttttcttgta

SEQ ID NO: 5731219 - DNA, 14 bp, Homo sapiens
cttttcttgtctct

SEQ ID NO: 5731220 - DNA, 18 bp, Homo sapiens
cttttcttgtctctgagg

SEQ ID NO: 5731221 - DNA, 20 bp, Homo sapiens
cttttcttgtctctgaggct

SEQ ID NO: 5731222 - DNA, 18 bp, Homo sapiens
cttttctttaaagaagtt

SEQ ID NO: 5731223 - DNA, 12 bp, Homo sapiens
cttttctttatt

SEQ ID NO: 5731224 - DNA, 20 bp, Homo sapiens
cttttctttattagctttct

SEQ ID NO: 5731225 - DNA, 19 bp, Homo sapiens
cttttctttattgctgtga

SEQ ID NO: 5731226 - DNA, 16 bp, Homo sapiens
cttttctttcagccaa

SEQ ID NO: 5731227 - DNA, 17 bp, Homo sapiens
cttttctttccttttca

SEQ ID NO: 5731228 - DNA, 23 bp, Homo sapiens
cttttctttgaaggatgactaca

SEQ ID NO: 5731229 - DNA, 22 bp, Homo sapiens
cttttctttgccatctctgctc

SEQ ID NO: 5731230 - DNA, 19 bp, Homo sapiens
cttttctttgggcttgaca

SEQ ID NO: 5731231 - DNA, 13 bp, Homo sapiens
cttttctttgtat

SEQ ID NO: 5731232 - DNA, 15 bp, Homo sapiens
cttttcttttctaac

SEQ ID NO: 5731233 - DNA, 17 bp, Homo sapiens
cttttcttttctaccct

SEQ ID NO: 5731234 - DNA, 18 bp, Homo sapiens
cttttcttttgctttcct

SEQ ID NO: 5731235 - DNA, 20 bp, Homo sapiens
cttttcttttgctttccttt

SEQ ID NO: 5731236 - DNA, 13 bp, Homo sapiens
cttttcttttgtt

SEQ ID NO: 5731237 - DNA, 14 bp, Homo sapiens
cttttcttttgtta

SEQ ID NO: 5731238 - DNA, 21 bp, Homo sapiens
cttttcttttgttactgttct

SEQ ID NO: 5731239 - DNA, 22 bp, Homo sapiens
cttttctttttaaatgtgcttc

SEQ ID NO: 5731240 - DNA, 13 bp, Homo sapiens
cttttctttttat

SEQ ID NO: 5731241 - DNA, 13 bp, Homo sapiens
cttttctttttcc

SEQ ID NO: 5731242 - DNA, 19 bp, Homo sapiens
cttttctttttcccttgaa

SEQ ID NO: 5731243 - DNA, 18 bp, Homo sapiens
cttttctttttttcttta

SEQ ID NO: 5731244 - DNA, 17 bp, Homo sapiens
cttttgaaaaaggatca

SEQ ID NO: 5731245 - DNA, 19 bp, Homo sapiens
cttttgaaaaagtgtacat

SEQ ID NO: 5731246 - DNA, 17 bp, Homo sapiens
cttttgaaaagaccaag

SEQ ID NO: 5731247 - DNA, 18 bp, Homo sapiens
cttttgaaaagttgaaat

SEQ ID NO: 5731248 - DNA, 22 bp, Homo sapiens
cttttgaaaagttgaaatgtgt

SEQ ID NO: 5731249 - DNA, 14 bp, Homo sapiens
cttttgaaaatcaa

SEQ ID NO: 5731250 - DNA, 15 bp, Homo sapiens
cttttgaaaatgtac

SEQ ID NO: 5731251 - DNA, 16 bp, Homo sapiens
cttttgaaaatgtaca

SEQ ID NO: 5731252 - DNA, 21 bp, Homo sapiens
cttttgaaagtagagctagct

SEQ ID NO: 5731253 - DNA, 20 bp, Homo sapiens
cttttgaaagtttgttctgc

SEQ ID NO: 5731254 - DNA, 19 bp, Homo sapiens
cttttgaacgtatgtgctc

SEQ ID NO: 5731255 - DNA, 16 bp, Homo sapiens
cttttgaacttgtcac

SEQ ID NO: 5731256 - DNA, 20 bp, Homo sapiens
cttttgaagctcaactgttg

SEQ ID NO: 5731257 - DNA, 21 bp, Homo sapiens
cttttgaataaaaactttgct

SEQ ID NO: 5731258 - DNA, 19 bp, Homo sapiens
cttttgaatacatttgtat

SEQ ID NO: 5731259 - DNA, 16 bp, Homo sapiens
cttttgaatatcttcc

SEQ ID NO: 5731260 - DNA, 19 bp, Homo sapiens
cttttgaatgtccaaaatt

SEQ ID NO: 5731261 - DNA, 23 bp, Homo sapiens
cttttgaattacagagatataaa

SEQ ID NO: 5731262 - DNA, 14 bp, Homo sapiens
cttttgaattgtta

SEQ ID NO: 5731263 - DNA, 20 bp, Homo sapiens
cttttgacaatcaaagaaaa

SEQ ID NO: 5731264 - DNA, 17 bp, Homo sapiens
cttttgacacagttgtt

SEQ ID NO: 5731265 - DNA, 23 bp, Homo sapiens
cttttgacagctggtccctgcct

SEQ ID NO: 5731266 - DNA, 15 bp, Homo sapiens
cttttgacattttat

SEQ ID NO: 5731267 - DNA, 16 bp, Homo sapiens
cttttgacattttatt

SEQ ID NO: 5731268 - DNA, 21 bp, Homo sapiens
cttttgaccccttcctgtctg

SEQ ID NO: 5731269 - DNA, 22 bp, Homo sapiens
cttttgaccccttcctgtctgg

SEQ ID NO: 5731270 - DNA, 22 bp, Homo sapiens
cttttgacgtcttaggtggcag

SEQ ID NO: 5731271 - DNA, 18 bp, Homo sapiens
cttttgagaacttttggt

SEQ ID NO: 5731272 - DNA, 18 bp, Homo sapiens
cttttgagctcctaagct

SEQ ID NO: 5731273 - DNA, 17 bp, Homo sapiens
cttttgaggtccctgta

SEQ ID NO: 5731274 - DNA, 21 bp, Homo sapiens
cttttgagtatggctatctat

SEQ ID NO: 5731275 - DNA, 21 bp, Homo sapiens
cttttgagtgccttacacaat

SEQ ID NO: 5731276 - DNA, 15 bp, Homo sapiens
cttttgagtgggccc

SEQ ID NO: 5731277 - DNA, 18 bp, Homo sapiens
cttttgagtgggccctgc

SEQ ID NO: 5731278 - DNA, 23 bp, Homo sapiens
cttttgagtgtgtgtgtgcatgt

SEQ ID NO: 5731279 - DNA, 23 bp, Homo sapiens
cttttgataaaatgttccttttg

SEQ ID NO: 5731280 - DNA, 13 bp, Homo sapiens
cttttgatacatt

SEQ ID NO: 5731281 - DNA, 15 bp, Homo sapiens
cttttgatacattta

SEQ ID NO: 5731282 - DNA, 16 bp, Homo sapiens
cttttgatacatttat

SEQ ID NO: 5731283 - DNA, 23 bp, Homo sapiens
cttttgatacatttatcttctgt

SEQ ID NO: 5731284 - DNA, 21 bp, Homo sapiens
cttttgatatgattgtaacat

SEQ ID NO: 5731285 - DNA, 15 bp, Homo sapiens
cttttgatatgcata

SEQ ID NO: 5731286 - DNA, 18 bp, Homo sapiens
cttttgatcacattgttt

SEQ ID NO: 5731287 - DNA, 17 bp, Homo sapiens
cttttgatggctatgtt

SEQ ID NO: 5731288 - DNA, 14 bp, Homo sapiens
cttttgatggggag

SEQ ID NO: 5731289 - DNA, 23 bp, Homo sapiens
cttttgatggtggccctgaacct

SEQ ID NO: 5731290 - DNA, 14 bp, Homo sapiens
cttttgatgtgaaa

SEQ ID NO: 5731291 - DNA, 15 bp, Homo sapiens
cttttgatgtggtgt

SEQ ID NO: 5731292 - DNA, 22 bp, Homo sapiens
cttttgatgttcagagtggctc

SEQ ID NO: 5731293 - DNA, 12 bp, Homo sapiens
cttttgcaaaat

SEQ ID NO: 5731294 - DNA, 22 bp, Homo sapiens
cttttgcaaacagaacactgta

SEQ ID NO: 5731295 - DNA, 20 bp, Homo sapiens
cttttgcaaagaaagaaaaa

SEQ ID NO: 5731296 - DNA, 13 bp, Homo sapiens
cttttgcaaataa

SEQ ID NO: 5731297 - DNA, 18 bp, Homo sapiens
cttttgcaacttaatact

SEQ ID NO: 5731298 - DNA, 18 bp, Homo sapiens
cttttgcaaggttccaca

SEQ ID NO: 5731299 - DNA, 20 bp, Homo sapiens
cttttgcaaggttccacaga

SEQ ID NO: 5731300 - DNA, 21 bp, Homo sapiens
cttttgcaataataataaatt

SEQ ID NO: 5731301 - DNA, 15 bp, Homo sapiens
cttttgcacatatat

SEQ ID NO: 5731302 - DNA, 12 bp, Homo sapiens
cttttgcacccc

SEQ ID NO: 5731303 - DNA, 18 bp, Homo sapiens
cttttgcacccctcccat

SEQ ID NO: 5731304 - DNA, 19 bp, Homo sapiens
cttttgcacccctcccatt

SEQ ID NO: 5731305 - DNA, 14 bp, Homo sapiens
cttttgcagaaaaa

SEQ ID NO: 5731306 - DNA, 15 bp, Homo sapiens
cttttgcagcagagg

SEQ ID NO: 5731307 - DNA, 12 bp, Homo sapiens
cttttgcagctt

SEQ ID NO: 5731308 - DNA, 18 bp, Homo sapiens
cttttgcagcttccttcc

SEQ ID NO: 5731309 - DNA, 22 bp, Homo sapiens
cttttgcataagattaaaggaa

SEQ ID NO: 5731310 - DNA, 21 bp, Homo sapiens
cttttgcataatgcaatcaaa

SEQ ID NO: 5731311 - DNA, 22 bp, Homo sapiens
cttttgcataatgcaatcaaaa

SEQ ID NO: 5731312 - DNA, 15 bp, Homo sapiens
cttttgcatattgca

SEQ ID NO: 5731313 - DNA, 14 bp, Homo sapiens
cttttgcattctcc

SEQ ID NO: 5731314 - DNA, 15 bp, Homo sapiens
cttttgcattctccc

SEQ ID NO: 5731315 - DNA, 19 bp, Homo sapiens
cttttgccagtattatgca

SEQ ID NO: 5731316 - DNA, 16 bp, Homo sapiens
cttttgcccacacact

SEQ ID NO: 5731317 - DNA, 17 bp, Homo sapiens
cttttgcccacctcttc

SEQ ID NO: 5731318 - DNA, 18 bp, Homo sapiens
cttttgcccgttgaggta

SEQ ID NO: 5731319 - DNA, 22 bp, Homo sapiens
cttttgcccgttgaggtagagg

SEQ ID NO: 5731320 - DNA, 15 bp, Homo sapiens
cttttgcctgcaaga

SEQ ID NO: 5731321 - DNA, 16 bp, Homo sapiens
cttttgcctgcaagag

SEQ ID NO: 5731322 - DNA, 21 bp, Homo sapiens
cttttgcgcttatttggaaat

SEQ ID NO: 5731323 - DNA, 11 bp, Homo sapiens
cttttgctaaa

SEQ ID NO: 5731324 - DNA, 19 bp, Homo sapiens
cttttgctacgtgcctccc

SEQ ID NO: 5731325 - DNA, 22 bp, Homo sapiens
cttttgctcgatgcagacaggg

SEQ ID NO: 5731326 - DNA, 15 bp, Homo sapiens
cttttgctctttttg

SEQ ID NO: 5731327 - DNA, 13 bp, Homo sapiens
cttttgctgctgc

SEQ ID NO: 5731328 - DNA, 14 bp, Homo sapiens
cttttgctgctgct

SEQ ID NO: 5731329 - DNA, 19 bp, Homo sapiens
cttttgctgtctttctcta

SEQ ID NO: 5731330 - DNA, 13 bp, Homo sapiens
cttttgctgtgca

SEQ ID NO: 5731331 - DNA, 14 bp, Homo sapiens
cttttgctgtgctg

SEQ ID NO: 5731332 - DNA, 13 bp, Homo sapiens
cttttgctgtgtg

SEQ ID NO: 5731333 - DNA, 14 bp, Homo sapiens
cttttgctgtgtga

SEQ ID NO: 5731334 - DNA, 13 bp, Homo sapiens
cttttgctgttta

SEQ ID NO: 5731335 - DNA, 19 bp, Homo sapiens
cttttgctgtttatacttg

SEQ ID NO: 5731336 - DNA, 23 bp, Homo sapiens
cttttgctgtttggatgtttcca

SEQ ID NO: 5731337 - DNA, 20 bp, Homo sapiens
cttttgcttaccttttccta

SEQ ID NO: 5731338 - DNA, 20 bp, Homo sapiens
cttttgctttctgtttctta

SEQ ID NO: 5731339 - DNA, 9 bp, Homo sapiens
cttttggaa

SEQ ID NO: 5731340 - DNA, 13 bp, Homo sapiens
cttttggaaataa

SEQ ID NO: 5731341 - DNA, 14 bp, Homo sapiens
cttttggaatgact

SEQ ID NO: 5731342 - DNA, 16 bp, Homo sapiens
cttttggacaaggaag

SEQ ID NO: 5731343 - DNA, 23 bp, Homo sapiens
cttttggacctggctaatggagt

SEQ ID NO: 5731344 - DNA, 23 bp, Homo sapiens
cttttggagaaccagggctcttc

SEQ ID NO: 5731345 - DNA, 19 bp, Homo sapiens
cttttggagcaaagtggtt

SEQ ID NO: 5731346 - DNA, 12 bp, Homo sapiens
cttttggaggac

SEQ ID NO: 5731347 - DNA, 17 bp, Homo sapiens
cttttggataatatcca

SEQ ID NO: 5731348 - DNA, 17 bp, Homo sapiens
cttttggcagagaccat

SEQ ID NO: 5731349 - DNA, 16 bp, Homo sapiens
cttttggcatgaaagt

SEQ ID NO: 5731350 - DNA, 20 bp, Homo sapiens
cttttggcccccgagctggg

SEQ ID NO: 5731351 - DNA, 23 bp, Homo sapiens
cttttggcctcatctctgcctga

SEQ ID NO: 5731352 - DNA, 14 bp, Homo sapiens
cttttggcctgggg

SEQ ID NO: 5731353 - DNA, 15 bp, Homo sapiens
cttttggcctggggg

SEQ ID NO: 5731354 - DNA, 18 bp, Homo sapiens
cttttggcctgggggagg

SEQ ID NO: 5731355 - DNA, 16 bp, Homo sapiens
cttttggcctttgtaa

SEQ ID NO: 5731356 - DNA, 15 bp, Homo sapiens
cttttggcttccatg

SEQ ID NO: 5731357 - DNA, 15 bp, Homo sapiens
cttttgggaaatgct

SEQ ID NO: 5731358 - DNA, 21 bp, Homo sapiens
cttttgggaagaatccagtat

SEQ ID NO: 5731359 - DNA, 23 bp, Homo sapiens
cttttgggaggatttgatgtaag

SEQ ID NO: 5731360 - DNA, 22 bp, Homo sapiens
cttttgggaggtccaggcagga

SEQ ID NO: 5731361 - DNA, 23 bp, Homo sapiens
cttttgggaggtccaggcaggag

SEQ ID NO: 5731362 - DNA, 15 bp, Homo sapiens
cttttggggaatgag

SEQ ID NO: 5731363 - DNA, 17 bp, Homo sapiens
cttttggggagggaggg

SEQ ID NO: 5731364 - DNA, 22 bp, Homo sapiens
cttttgggggtaaagtttgctc

SEQ ID NO: 5731365 - DNA, 18 bp, Homo sapiens
cttttgggggtcaacagt

SEQ ID NO: 5731366 - DNA, 21 bp, Homo sapiens
cttttgggggtcagcatccag

SEQ ID NO: 5731367 - DNA, 12 bp, Homo sapiens
cttttgggggtt

SEQ ID NO: 5731368 - DNA, 19 bp, Homo sapiens
cttttgggtagttgttttt

SEQ ID NO: 5731369 - DNA, 22 bp, Homo sapiens
cttttgggtctgtcctctctgt

SEQ ID NO: 5731370 - DNA, 23 bp, Homo sapiens
cttttgggtgtggtgtcaccagc

SEQ ID NO: 5731371 - DNA, 20 bp, Homo sapiens
cttttggtaaagactggctt

SEQ ID NO: 5731372 - DNA, 20 bp, Homo sapiens
cttttggtcttcagcctccc

SEQ ID NO: 5731373 - DNA, 23 bp, Homo sapiens
cttttggtcttcagcctccctca

SEQ ID NO: 5731374 - DNA, 15 bp, Homo sapiens
cttttggtgcctggc

SEQ ID NO: 5731375 - DNA, 18 bp, Homo sapiens
cttttggtgctctcacct

SEQ ID NO: 5731376 - DNA, 18 bp, Homo sapiens
cttttggtgtgttggaca

SEQ ID NO: 5731377 - DNA, 20 bp, Homo sapiens
cttttggtgtgttggacaga

SEQ ID NO: 5731378 - DNA, 13 bp, Homo sapiens
cttttggttaagt

SEQ ID NO: 5731379 - DNA, 16 bp, Homo sapiens
cttttggttaagtctg

SEQ ID NO: 5731380 - DNA, 21 bp, Homo sapiens
cttttggttatgaatactttg

SEQ ID NO: 5731381 - DNA, 23 bp, Homo sapiens
cttttggtttcaccttccctcga

SEQ ID NO: 5731382 - DNA, 21 bp, Homo sapiens
cttttggtttgggggcgccct

SEQ ID NO: 5731383 - DNA, 22 bp, Homo sapiens
cttttggtttgtgggtccagga

SEQ ID NO: 5731384 - DNA, 22 bp, Homo sapiens
cttttggttttaaacctttaat

SEQ ID NO: 5731385 - DNA, 12 bp, Homo sapiens
cttttgtaaaga

SEQ ID NO: 5731386 - DNA, 22 bp, Homo sapiens
cttttgtaaagaaatttactat

SEQ ID NO: 5731387 - DNA, 23 bp, Homo sapiens
cttttgtaaagaaatttactata

SEQ ID NO: 5731388 - DNA, 18 bp, Homo sapiens
cttttgtaaagtaaaata

SEQ ID NO: 5731389 - DNA, 19 bp, Homo sapiens
cttttgtaaagtgaagaat

SEQ ID NO: 5731390 - DNA, 13 bp, Homo sapiens
cttttgtaaatat

SEQ ID NO: 5731391 - DNA, 21 bp, Homo sapiens
cttttgtaaatgagacacata

SEQ ID NO: 5731392 - DNA, 15 bp, Homo sapiens
cttttgtaaattaaa

SEQ ID NO: 5731393 - DNA, 10 bp, Homo sapiens
cttttgtaag

SEQ ID NO: 5731394 - DNA, 22 bp, Homo sapiens
cttttgtaattgtgtaaaaaat

SEQ ID NO: 5731395 - DNA, 12 bp, Homo sapiens
cttttgtaattt

SEQ ID NO: 5731396 - DNA, 14 bp, Homo sapiens
cttttgtaatttga

SEQ ID NO: 5731397 - DNA, 16 bp, Homo sapiens
cttttgtaatttgaat

SEQ ID NO: 5731398 - DNA, 13 bp, Homo sapiens
cttttgtacatct

SEQ ID NO: 5731399 - DNA, 16 bp, Homo sapiens
cttttgtaccagtgtg

SEQ ID NO: 5731400 - DNA, 23 bp, Homo sapiens
cttttgtactgaatttttttgta

SEQ ID NO: 5731401 - DNA, 15 bp, Homo sapiens
cttttgtacttttca

SEQ ID NO: 5731402 - DNA, 16 bp, Homo sapiens
cttttgtacttttcat

SEQ ID NO: 5731403 - DNA, 22 bp, Homo sapiens
cttttgtaggctgttccctttg

SEQ ID NO: 5731404 - DNA, 19 bp, Homo sapiens
cttttgtagtatactttca

SEQ ID NO: 5731405 - DNA, 21 bp, Homo sapiens
cttttgtagtcttatgaatag

SEQ ID NO: 5731406 - DNA, 23 bp, Homo sapiens
cttttgtagtttgtattaaactt

SEQ ID NO: 5731407 - DNA, 22 bp, Homo sapiens
cttttgtagttttatttgtatt

SEQ ID NO: 5731408 - DNA, 19 bp, Homo sapiens
cttttgtatacatcctggg

SEQ ID NO: 5731409 - DNA, 13 bp, Homo sapiens
cttttgtatgtaa

SEQ ID NO: 5731410 - DNA, 16 bp, Homo sapiens
cttttgtatgtaaatg

SEQ ID NO: 5731411 - DNA, 11 bp, Homo sapiens
cttttgtatta

SEQ ID NO: 5731412 - DNA, 12 bp, Homo sapiens
cttttgtattaa

SEQ ID NO: 5731413 - DNA, 19 bp, Homo sapiens
cttttgtattgtttctaca

SEQ ID NO: 5731414 - DNA, 17 bp, Homo sapiens
cttttgtccaatgtggt

SEQ ID NO: 5731415 - DNA, 19 bp, Homo sapiens
cttttgtccacttgtaaga

SEQ ID NO: 5731416 - DNA, 21 bp, Homo sapiens
cttttgtcctgcatcatcttg

SEQ ID NO: 5731417 - DNA, 16 bp, Homo sapiens
cttttgtctaattaaa

SEQ ID NO: 5731418 - DNA, 17 bp, Homo sapiens
cttttgtctatgggact

SEQ ID NO: 5731419 - DNA, 18 bp, Homo sapiens
cttttgtctatgggactc

SEQ ID NO: 5731420 - DNA, 14 bp, Homo sapiens
cttttgtgaaagct

SEQ ID NO: 5731421 - DNA, 13 bp, Homo sapiens
cttttgtgaatta

SEQ ID NO: 5731422 - DNA, 15 bp, Homo sapiens
cttttgtgatgaaca

SEQ ID NO: 5731423 - DNA, 18 bp, Homo sapiens
cttttgtgatgaacatat

SEQ ID NO: 5731424 - DNA, 21 bp, Homo sapiens
cttttgtgatgaacatattca

SEQ ID NO: 5731425 - DNA, 23 bp, Homo sapiens
cttttgtgatgaacatattcatg

SEQ ID NO: 5731426 - DNA, 13 bp, Homo sapiens
cttttgtgcatta

SEQ ID NO: 5731427 - DNA, 18 bp, Homo sapiens
cttttgtgcattatctag

SEQ ID NO: 5731428 - DNA, 15 bp, Homo sapiens
cttttgtgccaggag

SEQ ID NO: 5731429 - DNA, 23 bp, Homo sapiens
cttttgtgccatgttcaaaagaa

SEQ ID NO: 5731430 - DNA, 20 bp, Homo sapiens
cttttgtgctatcaatgagt

SEQ ID NO: 5731431 - DNA, 20 bp, Homo sapiens
cttttgtggacttgtctgac

SEQ ID NO: 5731432 - DNA, 15 bp, Homo sapiens
cttttgtggagggga

SEQ ID NO: 5731433 - DNA, 19 bp, Homo sapiens
cttttgtgggggactgtaa

SEQ ID NO: 5731434 - DNA, 20 bp, Homo sapiens
cttttgtgggtttctctgtg

SEQ ID NO: 5731435 - DNA, 22 bp, Homo sapiens
cttttgtgggtttctctgtgct

SEQ ID NO: 5731436 - DNA, 16 bp, Homo sapiens
cttttgtgtaatgaaa

SEQ ID NO: 5731437 - DNA, 14 bp, Homo sapiens
cttttgtgtattct

SEQ ID NO: 5731438 - DNA, 13 bp, Homo sapiens
cttttgtgtccca

SEQ ID NO: 5731439 - DNA, 19 bp, Homo sapiens
cttttgtgtcctgctctgt

SEQ ID NO: 5731440 - DNA, 17 bp, Homo sapiens
cttttgtgtctatgatg

SEQ ID NO: 5731441 - DNA, 19 bp, Homo sapiens
cttttgtgtgaattgacta

SEQ ID NO: 5731442 - DNA, 23 bp, Homo sapiens
cttttgtgtgatgcgccttgctg

SEQ ID NO: 5731443 - DNA, 23 bp, Homo sapiens
cttttgtgtgcctggtagaaact

SEQ ID NO: 5731444 - DNA, 13 bp, Homo sapiens
cttttgtgttact

SEQ ID NO: 5731445 - DNA, 14 bp, Homo sapiens
cttttgtgttccaa

SEQ ID NO: 5731446 - DNA, 20 bp, Homo sapiens
cttttgttaaacccttctgt

SEQ ID NO: 5731447 - DNA, 18 bp, Homo sapiens
cttttgttaatgcattgt

SEQ ID NO: 5731448 - DNA, 19 bp, Homo sapiens
cttttgttaatgcattgtt

SEQ ID NO: 5731449 - DNA, 20 bp, Homo sapiens
cttttgttactcttgggaca

SEQ ID NO: 5731450 - DNA, 12 bp, Homo sapiens
cttttgttactg

SEQ ID NO: 5731451 - DNA, 18 bp, Homo sapiens
cttttgttactgttcttg

SEQ ID NO: 5731452 - DNA, 19 bp, Homo sapiens
cttttgttactgttcttgc

SEQ ID NO: 5731453 - DNA, 21 bp, Homo sapiens
cttttgttactgttcttgctg

SEQ ID NO: 5731454 - DNA, 17 bp, Homo sapiens
cttttgttattaaaaaa

SEQ ID NO: 5731455 - DNA, 20 bp, Homo sapiens
cttttgttattaaaaaaaca

SEQ ID NO: 5731456 - DNA, 21 bp, Homo sapiens
cttttgttattaaaaaaacac

SEQ ID NO: 5731457 - DNA, 22 bp, Homo sapiens
cttttgttcagggctgtgatcg

SEQ ID NO: 5731458 - DNA, 16 bp, Homo sapiens
cttttgttcatttcat

SEQ ID NO: 5731459 - DNA, 17 bp, Homo sapiens
cttttgttcccatcctc

SEQ ID NO: 5731460 - DNA, 14 bp, Homo sapiens
cttttgttctagac

SEQ ID NO: 5731461 - DNA, 15 bp, Homo sapiens
cttttgttctagact

SEQ ID NO: 5731462 - DNA, 12 bp, Homo sapiens
cttttgttctga

SEQ ID NO: 5731463 - DNA, 13 bp, Homo sapiens
cttttgttctgag

SEQ ID NO: 5731464 - DNA, 12 bp, Homo sapiens
cttttgttcttg

SEQ ID NO: 5731465 - DNA, 19 bp, Homo sapiens
cttttgttgtactttatat

SEQ ID NO: 5731466 - DNA, 19 bp, Homo sapiens
cttttgttgtatgggattg

SEQ ID NO: 5731467 - DNA, 17 bp, Homo sapiens
cttttgttgtgactttt

SEQ ID NO: 5731468 - DNA, 15 bp, Homo sapiens
cttttgttgtttctt

SEQ ID NO: 5731469 - DNA, 21 bp, Homo sapiens
cttttgtttaaatataaatgt

SEQ ID NO: 5731470 - DNA, 17 bp, Homo sapiens
cttttgtttagagccct

SEQ ID NO: 5731471 - DNA, 11 bp, Homo sapiens
cttttgtttca

SEQ ID NO: 5731472 - DNA, 16 bp, Homo sapiens
cttttgtttccttttt

SEQ ID NO: 5731473 - DNA, 20 bp, Homo sapiens
cttttgtttccttttttccc

SEQ ID NO: 5731474 - DNA, 15 bp, Homo sapiens
cttttgtttcttaag

SEQ ID NO: 5731475 - DNA, 16 bp, Homo sapiens
cttttgtttcttccct

SEQ ID NO: 5731476 - DNA, 12 bp, Homo sapiens
cttttgtttggt

SEQ ID NO: 5731477 - DNA, 14 bp, Homo sapiens
cttttgtttggtaa

SEQ ID NO: 5731478 - DNA, 16 bp, Homo sapiens
cttttgttttcttcat

SEQ ID NO: 5731479 - DNA, 20 bp, Homo sapiens
cttttgttttcttcatttct

SEQ ID NO: 5731480 - DNA, 14 bp, Homo sapiens
cttttgttttgctt

SEQ ID NO: 5731481 - DNA, 22 bp, Homo sapiens
cttttgttttggtttggttttg

SEQ ID NO: 5731482 - DNA, 13 bp, Homo sapiens
cttttgtttttcc

SEQ ID NO: 5731483 - DNA, 18 bp, Homo sapiens
cttttgttttttgaagtg

SEQ ID NO: 5731484 - DNA, 21 bp, Homo sapiens
cttttgttttttgaagtgttg

SEQ ID NO: 5731485 - DNA, 16 bp, Homo sapiens
cttttgttttttgggg

SEQ ID NO: 5731486 - DNA, 15 bp, Homo sapiens
cttttgtttttttcc

SEQ ID NO: 5731487 - DNA, 20 bp, Homo sapiens
ctttttaaaaaaataaaaca

SEQ ID NO: 5731488 - DNA, 19 bp, Homo sapiens
ctttttaaaaaatgctggg

SEQ ID NO: 5731489 - DNA, 20 bp, Homo sapiens
ctttttaaaaactcttcagt

SEQ ID NO: 5731490 - DNA, 22 bp, Homo sapiens
ctttttaaaaactcttcagtgc

SEQ ID NO: 5731491 - DNA, 14 bp, Homo sapiens
ctttttaaaaatga

SEQ ID NO: 5731492 - DNA, 18 bp, Homo sapiens
ctttttaaaaattgttat

SEQ ID NO: 5731493 - DNA, 13 bp, Homo sapiens
ctttttaaaacta

SEQ ID NO: 5731494 - DNA, 22 bp, Homo sapiens
ctttttaaaaggtattttgaat

SEQ ID NO: 5731495 - DNA, 16 bp, Homo sapiens
ctttttaaaatatatg

SEQ ID NO: 5731496 - DNA, 20 bp, Homo sapiens
ctttttaaaatgttggtgca

SEQ ID NO: 5731497 - DNA, 15 bp, Homo sapiens
ctttttaaacagtgt

SEQ ID NO: 5731498 - DNA, 21 bp, Homo sapiens
ctttttaaagaagtgcatgaa

SEQ ID NO: 5731499 - DNA, 19 bp, Homo sapiens
ctttttaaagtgtttctgt

SEQ ID NO: 5731500 - DNA, 17 bp, Homo sapiens
ctttttaaagtttgttc

SEQ ID NO: 5731501 - DNA, 22 bp, Homo sapiens
ctttttaaatagggaatatgat

SEQ ID NO: 5731502 - DNA, 20 bp, Homo sapiens
ctttttaaatgtaaagatat

SEQ ID NO: 5731503 - DNA, 21 bp, Homo sapiens
ctttttaaatgtgaattttta

SEQ ID NO: 5731504 - DNA, 16 bp, Homo sapiens
ctttttaaattacctt

SEQ ID NO: 5731505 - DNA, 23 bp, Homo sapiens
ctttttaaattcagtcctaagaa

SEQ ID NO: 5731506 - DNA, 19 bp, Homo sapiens
ctttttaaattttccatta

SEQ ID NO: 5731507 - DNA, 20 bp, Homo sapiens
ctttttaacaaatgttttca

SEQ ID NO: 5731508 - DNA, 14 bp, Homo sapiens
ctttttaacattct

SEQ ID NO: 5731509 - DNA, 16 bp, Homo sapiens
ctttttaacctctgtt

SEQ ID NO: 5731510 - DNA, 16 bp, Homo sapiens
ctttttaacctgcaaa

SEQ ID NO: 5731511 - DNA, 12 bp, Homo sapiens
ctttttaacttt

SEQ ID NO: 5731512 - DNA, 17 bp, Homo sapiens
ctttttaagaatatttt

SEQ ID NO: 5731513 - DNA, 17 bp, Homo sapiens
ctttttaagcttattta

SEQ ID NO: 5731514 - DNA, 14 bp, Homo sapiens
ctttttaataaagt

SEQ ID NO: 5731515 - DNA, 14 bp, Homo sapiens
ctttttaatatgct

SEQ ID NO: 5731516 - DNA, 21 bp, Homo sapiens
ctttttaatcatgaatatgat

SEQ ID NO: 5731517 - DNA, 14 bp, Homo sapiens
ctttttaatccagg

SEQ ID NO: 5731518 - DNA, 14 bp, Homo sapiens
ctttttaattattt

SEQ ID NO: 5731519 - DNA, 17 bp, Homo sapiens
ctttttaattcaccaaa

SEQ ID NO: 5731520 - DNA, 15 bp, Homo sapiens
ctttttacactttat

SEQ ID NO: 5731521 - DNA, 22 bp, Homo sapiens
ctttttacataactgccttgaa

SEQ ID NO: 5731522 - DNA, 20 bp, Homo sapiens
ctttttaccaagtttcaggt

SEQ ID NO: 5731523 - DNA, 17 bp, Homo sapiens
ctttttaccagtgaaaa

SEQ ID NO: 5731524 - DNA, 16 bp, Homo sapiens
ctttttacctggccta

SEQ ID NO: 5731525 - DNA, 20 bp, Homo sapiens
ctttttactattaacatgat

SEQ ID NO: 5731526 - DNA, 19 bp, Homo sapiens
ctttttactccccttgagc

SEQ ID NO: 5731527 - DNA, 22 bp, Homo sapiens
ctttttacttggaaataataaa

SEQ ID NO: 5731528 - DNA, 21 bp, Homo sapiens
ctttttagatgtgctgctttg

SEQ ID NO: 5731529 - DNA, 20 bp, Homo sapiens
ctttttagggcagattttgg

SEQ ID NO: 5731530 - DNA, 19 bp, Homo sapiens
ctttttagggccaggcagg

SEQ ID NO: 5731531 - DNA, 17 bp, Homo sapiens
ctttttagtcttttact

SEQ ID NO: 5731532 - DNA, 21 bp, Homo sapiens
ctttttagtgttttgcaaggg

SEQ ID NO: 5731533 - DNA, 12 bp, Homo sapiens
ctttttagttta

SEQ ID NO: 5731534 - DNA, 13 bp, Homo sapiens
ctttttagttttt

SEQ ID NO: 5731535 - DNA, 11 bp, Homo sapiens
ctttttataaa

SEQ ID NO: 5731536 - DNA, 14 bp, Homo sapiens
ctttttataaaaag

SEQ ID NO: 5731537 - DNA, 12 bp, Homo sapiens
ctttttataact

SEQ ID NO: 5731538 - DNA, 16 bp, Homo sapiens
ctttttataacttttt

SEQ ID NO: 5731539 - DNA, 18 bp, Homo sapiens
ctttttataatgtggatt

SEQ ID NO: 5731540 - DNA, 18 bp, Homo sapiens
ctttttatactccataca

SEQ ID NO: 5731541 - DNA, 18 bp, Homo sapiens
ctttttataggttttata

SEQ ID NO: 5731542 - DNA, 18 bp, Homo sapiens
ctttttatattctcagca

SEQ ID NO: 5731543 - DNA, 22 bp, Homo sapiens
ctttttatattctcagcagagt

SEQ ID NO: 5731544 - DNA, 22 bp, Homo sapiens
ctttttatattttatactgcac

SEQ ID NO: 5731545 - DNA, 20 bp, Homo sapiens
ctttttatcgccattccagg

SEQ ID NO: 5731546 - DNA, 18 bp, Homo sapiens
ctttttatgcaaaagtca

SEQ ID NO: 5731547 - DNA, 15 bp, Homo sapiens
ctttttatgctattt

SEQ ID NO: 5731548 - DNA, 20 bp, Homo sapiens
ctttttattaggttaagtct

SEQ ID NO: 5731549 - DNA, 15 bp, Homo sapiens
ctttttattccctgc

SEQ ID NO: 5731550 - DNA, 15 bp, Homo sapiens
ctttttattgcatgg

SEQ ID NO: 5731551 - DNA, 14 bp, Homo sapiens
ctttttattgcctt

SEQ ID NO: 5731552 - DNA, 18 bp, Homo sapiens
ctttttatttaattaaat

SEQ ID NO: 5731553 - DNA, 21 bp, Homo sapiens
ctttttatttaattaaatgta

SEQ ID NO: 5731554 - DNA, 12 bp, Homo sapiens
ctttttatttat

SEQ ID NO: 5731555 - DNA, 14 bp, Homo sapiens
ctttttatttatat

SEQ ID NO: 5731556 - DNA, 19 bp, Homo sapiens
ctttttatttatatgtact

SEQ ID NO: 5731557 - DNA, 18 bp, Homo sapiens
ctttttatttatatgtat

SEQ ID NO: 5731558 - DNA, 12 bp, Homo sapiens
ctttttatttct

SEQ ID NO: 5731559 - DNA, 21 bp, Homo sapiens
ctttttatttctaaatgagac

SEQ ID NO: 5731560 - DNA, 13 bp, Homo sapiens
ctttttatttctg

SEQ ID NO: 5731561 - DNA, 15 bp, Homo sapiens
ctttttatttgagga

SEQ ID NO: 5731562 - DNA, 13 bp, Homo sapiens
ctttttatttgca

SEQ ID NO: 5731563 - DNA, 14 bp, Homo sapiens
ctttttatttgcat

SEQ ID NO: 5731564 - DNA, 17 bp, Homo sapiens
ctttttatttgtttgca

SEQ ID NO: 5731565 - DNA, 18 bp, Homo sapiens
ctttttattttttaatta

SEQ ID NO: 5731566 - DNA, 23 bp, Homo sapiens
ctttttcaacttggaaaaagaaa

SEQ ID NO: 5731567 - DNA, 23 bp, Homo sapiens
ctttttcaatggttgggacaatg

SEQ ID NO: 5731568 - DNA, 15 bp, Homo sapiens
ctttttcactttgaa

SEQ ID NO: 5731569 - DNA, 19 bp, Homo sapiens
ctttttcagaaacagggca

SEQ ID NO: 5731570 - DNA, 23 bp, Homo sapiens
ctttttcagaggtgaattaatgg

SEQ ID NO: 5731571 - DNA, 17 bp, Homo sapiens
ctttttcaggagaatta

SEQ ID NO: 5731572 - DNA, 18 bp, Homo sapiens
ctttttcaggctcgccaa

SEQ ID NO: 5731573 - DNA, 19 bp, Homo sapiens
ctttttcaggttgttttgt

SEQ ID NO: 5731574 - DNA, 13 bp, Homo sapiens
ctttttcataatt

SEQ ID NO: 5731575 - DNA, 16 bp, Homo sapiens
ctttttcatcccctta

SEQ ID NO: 5731576 - DNA, 13 bp, Homo sapiens
ctttttcatcctt

SEQ ID NO: 5731577 - DNA, 13 bp, Homo sapiens
ctttttcattccc

SEQ ID NO: 5731578 - DNA, 13 bp, Homo sapiens
ctttttcatttgc

SEQ ID NO: 5731579 - DNA, 15 bp, Homo sapiens
ctttttcatttgcct

SEQ ID NO: 5731580 - DNA, 17 bp, Homo sapiens
ctttttcattttccaat

SEQ ID NO: 5731581 - DNA, 17 bp, Homo sapiens
ctttttcattttgcaga

SEQ ID NO: 5731582 - DNA, 17 bp, Homo sapiens
ctttttccaacaagaag

SEQ ID NO: 5731583 - DNA, 13 bp, Homo sapiens
ctttttccaatgt

SEQ ID NO: 5731584 - DNA, 18 bp, Homo sapiens
ctttttccaatgttttat

SEQ ID NO: 5731585 - DNA, 13 bp, Homo sapiens
ctttttccagagg

SEQ ID NO: 5731586 - DNA, 13 bp, Homo sapiens
ctttttccagcaa

SEQ ID NO: 5731587 - DNA, 11 bp, Homo sapiens
ctttttccagt

SEQ ID NO: 5731588 - DNA, 12 bp, Homo sapiens
ctttttccagtg

SEQ ID NO: 5731589 - DNA, 17 bp, Homo sapiens
ctttttccagtgttcta

SEQ ID NO: 5731590 - DNA, 22 bp, Homo sapiens
ctttttccatatagtttgtttt

SEQ ID NO: 5731591 - DNA, 22 bp, Homo sapiens
ctttttccatttcttcagaggg

SEQ ID NO: 5731592 - DNA, 20 bp, Homo sapiens
ctttttccattttttaaatg

SEQ ID NO: 5731593 - DNA, 16 bp, Homo sapiens
ctttttcccaataaat

SEQ ID NO: 5731594 - DNA, 17 bp, Homo sapiens
ctttttccccaaagtct

SEQ ID NO: 5731595 - DNA, 14 bp, Homo sapiens
ctttttcccctgca

SEQ ID NO: 5731596 - DNA, 15 bp, Homo sapiens
ctttttcccctgcaa

SEQ ID NO: 5731597 - DNA, 23 bp, Homo sapiens
ctttttcccctgcaatgcgtctt

SEQ ID NO: 5731598 - DNA, 15 bp, Homo sapiens
ctttttccctttcct

SEQ ID NO: 5731599 - DNA, 13 bp, Homo sapiens
ctttttcctctga

SEQ ID NO: 5731600 - DNA, 20 bp, Homo sapiens
ctttttcctctgagcccagc

SEQ ID NO: 5731601 - DNA, 21 bp, Homo sapiens
ctttttcctctgagcccagct

SEQ ID NO: 5731602 - DNA, 16 bp, Homo sapiens
ctttttccttatttca

SEQ ID NO: 5731603 - DNA, 13 bp, Homo sapiens
ctttttccttcct

SEQ ID NO: 5731604 - DNA, 17 bp, Homo sapiens
ctttttccttcctgccc

SEQ ID NO: 5731605 - DNA, 19 bp, Homo sapiens
ctttttccttcttcagcag

SEQ ID NO: 5731606 - DNA, 14 bp, Homo sapiens
ctttttcctttata

SEQ ID NO: 5731607 - DNA, 21 bp, Homo sapiens
ctttttcgccaaactgtctct

SEQ ID NO: 5731608 - DNA, 16 bp, Homo sapiens
ctttttcgtctatata

SEQ ID NO: 5731609 - DNA, 17 bp, Homo sapiens
ctttttctacatgtgag

SEQ ID NO: 5731610 - DNA, 13 bp, Homo sapiens
ctttttctccacc

SEQ ID NO: 5731611 - DNA, 14 bp, Homo sapiens
ctttttctctgtat

SEQ ID NO: 5731612 - DNA, 16 bp, Homo sapiens
ctttttctctgtatat

SEQ ID NO: 5731613 - DNA, 14 bp, Homo sapiens
ctttttctcttctg

SEQ ID NO: 5731614 - DNA, 20 bp, Homo sapiens
ctttttctgaagcctctaac

SEQ ID NO: 5731615 - DNA, 13 bp, Homo sapiens
ctttttctgatta

SEQ ID NO: 5731616 - DNA, 16 bp, Homo sapiens
ctttttctgcactata

SEQ ID NO: 5731617 - DNA, 17 bp, Homo sapiens
ctttttctgccactgag

SEQ ID NO: 5731618 - DNA, 16 bp, Homo sapiens
ctttttctgtctctct

SEQ ID NO: 5731619 - DNA, 17 bp, Homo sapiens
ctttttctgtctctctt

SEQ ID NO: 5731620 - DNA, 20 bp, Homo sapiens
ctttttctgtgcgccttaaa

SEQ ID NO: 5731621 - DNA, 16 bp, Homo sapiens
ctttttctgtgtgagg

SEQ ID NO: 5731622 - DNA, 15 bp, Homo sapiens
ctttttcttaatcat

SEQ ID NO: 5731623 - DNA, 22 bp, Homo sapiens
ctttttcttaccctctctttca

SEQ ID NO: 5731624 - DNA, 22 bp, Homo sapiens
ctttttcttcacttacaagaaa

SEQ ID NO: 5731625 - DNA, 13 bp, Homo sapiens
ctttttcttcctc

SEQ ID NO: 5731626 - DNA, 18 bp, Homo sapiens
ctttttcttcctctcggc

SEQ ID NO: 5731627 - DNA, 14 bp, Homo sapiens
ctttttcttgatct

SEQ ID NO: 5731628 - DNA, 22 bp, Homo sapiens
ctttttcttgatcttaaagatc

SEQ ID NO: 5731629 - DNA, 12 bp, Homo sapiens
ctttttcttgta

SEQ ID NO: 5731630 - DNA, 22 bp, Homo sapiens
ctttttcttgtaaacctggagg

SEQ ID NO: 5731631 - DNA, 23 bp, Homo sapiens
ctttttcttgtcattaacacatt

SEQ ID NO: 5731632 - DNA, 17 bp, Homo sapiens
ctttttctttaaggtcc

SEQ ID NO: 5731633 - DNA, 16 bp, Homo sapiens
ctttttctttataaac

SEQ ID NO: 5731634 - DNA, 18 bp, Homo sapiens
ctttttcttttgtaagtg

SEQ ID NO: 5731635 - DNA, 19 bp, Homo sapiens
ctttttctttttctttctt

SEQ ID NO: 5731636 - DNA, 21 bp, Homo sapiens
ctttttctttttttctttggt

SEQ ID NO: 5731637 - DNA, 10 bp, Homo sapiens
ctttttgaaa

SEQ ID NO: 5731638 - DNA, 15 bp, Homo sapiens
ctttttgaaatcagc

SEQ ID NO: 5731639 - DNA, 23 bp, Homo sapiens
ctttttgaaatgaaatttaaaca

SEQ ID NO: 5731640 - DNA, 21 bp, Homo sapiens
ctttttgaagtgtaggcagac

SEQ ID NO: 5731641 - DNA, 22 bp, Homo sapiens
ctttttgaagtgtaggcagaca

SEQ ID NO: 5731642 - DNA, 17 bp, Homo sapiens
ctttttgaatctttaat

SEQ ID NO: 5731643 - DNA, 18 bp, Homo sapiens
ctttttgaatctttaatt

SEQ ID NO: 5731644 - DNA, 11 bp, Homo sapiens
ctttttgaatg

SEQ ID NO: 5731645 - DNA, 19 bp, Homo sapiens
ctttttgaccagtttcttt

SEQ ID NO: 5731646 - DNA, 14 bp, Homo sapiens
ctttttgaggcaaa

SEQ ID NO: 5731647 - DNA, 20 bp, Homo sapiens
ctttttgaggcaaaagaagg

SEQ ID NO: 5731648 - DNA, 20 bp, Homo sapiens
ctttttgaggtggcactttt

SEQ ID NO: 5731649 - DNA, 19 bp, Homo sapiens
ctttttgatgtataaaact

SEQ ID NO: 5731650 - DNA, 14 bp, Homo sapiens
ctttttgcagcttt

SEQ ID NO: 5731651 - DNA, 20 bp, Homo sapiens
ctttttgcatgatatcttca

SEQ ID NO: 5731652 - DNA, 16 bp, Homo sapiens
ctttttgctctaaaat

SEQ ID NO: 5731653 - DNA, 18 bp, Homo sapiens
ctttttgctctaaaatat

SEQ ID NO: 5731654 - DNA, 17 bp, Homo sapiens
ctttttgcttctacttt

SEQ ID NO: 5731655 - DNA, 11 bp, Homo sapiens
ctttttggaat

SEQ ID NO: 5731656 - DNA, 12 bp, Homo sapiens
ctttttggaatc

SEQ ID NO: 5731657 - DNA, 15 bp, Homo sapiens
ctttttggaggtgct

SEQ ID NO: 5731658 - DNA, 16 bp, Homo sapiens
ctttttggcataacat

SEQ ID NO: 5731659 - DNA, 13 bp, Homo sapiens
ctttttggcctgt

SEQ ID NO: 5731660 - DNA, 21 bp, Homo sapiens
ctttttggctgacttcatctg

SEQ ID NO: 5731661 - DNA, 17 bp, Homo sapiens
ctttttgggagagactt

SEQ ID NO: 5731662 - DNA, 15 bp, Homo sapiens
ctttttggtaaatat

SEQ ID NO: 5731663 - DNA, 16 bp, Homo sapiens
ctttttggtaataaca

SEQ ID NO: 5731664 - DNA, 15 bp, Homo sapiens
ctttttggtggatgt

SEQ ID NO: 5731665 - DNA, 17 bp, Homo sapiens
ctttttggtttgcagat

SEQ ID NO: 5731666 - DNA, 12 bp, Homo sapiens
ctttttgtaaat

SEQ ID NO: 5731667 - DNA, 13 bp, Homo sapiens
ctttttgtaaata

SEQ ID NO: 5731668 - DNA, 21 bp, Homo sapiens
ctttttgtaaatgctgtaaat

SEQ ID NO: 5731669 - DNA, 14 bp, Homo sapiens
ctttttgtacctgg

SEQ ID NO: 5731670 - DNA, 12 bp, Homo sapiens
ctttttgtactg

SEQ ID NO: 5731671 - DNA, 23 bp, Homo sapiens
ctttttgtactgtagttcagata

SEQ ID NO: 5731672 - DNA, 11 bp, Homo sapiens
ctttttgtagg

SEQ ID NO: 5731673 - DNA, 17 bp, Homo sapiens
ctttttgtatctaaagt

SEQ ID NO: 5731674 - DNA, 15 bp, Homo sapiens
ctttttgtatgtgaa

SEQ ID NO: 5731675 - DNA, 17 bp, Homo sapiens
ctttttgtattaacaaa

SEQ ID NO: 5731676 - DNA, 18 bp, Homo sapiens
ctttttgtattttttcct

SEQ ID NO: 5731677 - DNA, 19 bp, Homo sapiens
ctttttgtattttttcctt

SEQ ID NO: 5731678 - DNA, 21 bp, Homo sapiens
ctttttgtattttttccttaa

SEQ ID NO: 5731679 - DNA, 11 bp, Homo sapiens
ctttttgtcat

SEQ ID NO: 5731680 - DNA, 12 bp, Homo sapiens
ctttttgtcatg

SEQ ID NO: 5731681 - DNA, 18 bp, Homo sapiens
ctttttgtgaagttaggt

SEQ ID NO: 5731682 - DNA, 14 bp, Homo sapiens
ctttttgtgagaaa

SEQ ID NO: 5731683 - DNA, 17 bp, Homo sapiens
ctttttgtgagaaagag

SEQ ID NO: 5731684 - DNA, 22 bp, Homo sapiens
ctttttgtgatatgcacaatgt

SEQ ID NO: 5731685 - DNA, 16 bp, Homo sapiens
ctttttgttaacagca

SEQ ID NO: 5731686 - DNA, 15 bp, Homo sapiens
ctttttgttcagaat

SEQ ID NO: 5731687 - DNA, 19 bp, Homo sapiens
ctttttgttccctcattct

SEQ ID NO: 5731688 - DNA, 15 bp, Homo sapiens
ctttttgtttcactg

SEQ ID NO: 5731689 - DNA, 14 bp, Homo sapiens
ctttttgtttgcat

SEQ ID NO: 5731690 - DNA, 23 bp, Homo sapiens
ctttttgtttgggatcagcttct

SEQ ID NO: 5731691 - DNA, 19 bp, Homo sapiens
ctttttgtttttatttctt

SEQ ID NO: 5731692 - DNA, 20 bp, Homo sapiens
ctttttgttttttgcttatt

SEQ ID NO: 5731693 - DNA, 14 bp, Homo sapiens
cttttttaaaaaaa

SEQ ID NO: 5731694 - DNA, 17 bp, Homo sapiens
cttttttaaaaaagcaa

SEQ ID NO: 5731695 - DNA, 14 bp, Homo sapiens
cttttttaaaaaca

SEQ ID NO: 5731696 - DNA, 15 bp, Homo sapiens
cttttttaaaataaa

SEQ ID NO: 5731697 - DNA, 18 bp, Homo sapiens
cttttttaaaatcaactt

SEQ ID NO: 5731698 - DNA, 12 bp, Homo sapiens
cttttttaaagt

SEQ ID NO: 5731699 - DNA, 13 bp, Homo sapiens
cttttttaaatga

SEQ ID NO: 5731700 - DNA, 16 bp, Homo sapiens
cttttttaaatgtttc

SEQ ID NO: 5731701 - DNA, 18 bp, Homo sapiens
cttttttaaattttcttc

SEQ ID NO: 5731702 - DNA, 20 bp, Homo sapiens
cttttttaaattttcttcag

SEQ ID NO: 5731703 - DNA, 17 bp, Homo sapiens
cttttttaacatgtgtt

SEQ ID NO: 5731704 - DNA, 22 bp, Homo sapiens
cttttttaaccaaggaggggcc

SEQ ID NO: 5731705 - DNA, 12 bp, Homo sapiens
cttttttaagtt

SEQ ID NO: 5731706 - DNA, 21 bp, Homo sapiens
cttttttactcattgaaatgt

SEQ ID NO: 5731707 - DNA, 21 bp, Homo sapiens
cttttttacttagtagattaa

SEQ ID NO: 5731708 - DNA, 15 bp, Homo sapiens
cttttttagcttcat

SEQ ID NO: 5731709 - DNA, 14 bp, Homo sapiens
cttttttaggcttc

SEQ ID NO: 5731710 - DNA, 19 bp, Homo sapiens
cttttttagtaacaattca

SEQ ID NO: 5731711 - DNA, 15 bp, Homo sapiens
cttttttataactaa

SEQ ID NO: 5731712 - DNA, 14 bp, Homo sapiens
cttttttatacaca

SEQ ID NO: 5731713 - DNA, 18 bp, Homo sapiens
cttttttatacataaaca

SEQ ID NO: 5731714 - DNA, 15 bp, Homo sapiens
cttttttatataata

SEQ ID NO: 5731715 - DNA, 19 bp, Homo sapiens
cttttttatataataaaag

SEQ ID NO: 5731716 - DNA, 14 bp, Homo sapiens
cttttttatatctt

SEQ ID NO: 5731717 - DNA, 15 bp, Homo sapiens
cttttttatatcttg

SEQ ID NO: 5731718 - DNA, 21 bp, Homo sapiens
cttttttatggcgattcccat

SEQ ID NO: 5731719 - DNA, 13 bp, Homo sapiens
cttttttatgtga

SEQ ID NO: 5731720 - DNA, 14 bp, Homo sapiens
cttttttattaatc

SEQ ID NO: 5731721 - DNA, 15 bp, Homo sapiens
cttttttattaatca

SEQ ID NO: 5731722 - DNA, 19 bp, Homo sapiens
cttttttattaatcactgt

SEQ ID NO: 5731723 - DNA, 21 bp, Homo sapiens
cttttttattctgttttcttg

SEQ ID NO: 5731724 - DNA, 22 bp, Homo sapiens
cttttttcaaaatccaaaaaga

SEQ ID NO: 5731725 - DNA, 17 bp, Homo sapiens
cttttttcaaatattga

SEQ ID NO: 5731726 - DNA, 21 bp, Homo sapiens
cttttttcaactggctgggac

SEQ ID NO: 5731727 - DNA, 15 bp, Homo sapiens
cttttttcactacat

SEQ ID NO: 5731728 - DNA, 17 bp, Homo sapiens
cttttttcagttatttt

SEQ ID NO: 5731729 - DNA, 22 bp, Homo sapiens
cttttttcatttcttcctcagc

SEQ ID NO: 5731730 - DNA, 14 bp, Homo sapiens
cttttttcattttg

SEQ ID NO: 5731731 - DNA, 12 bp, Homo sapiens
cttttttcccca

SEQ ID NO: 5731732 - DNA, 13 bp, Homo sapiens
cttttttcctaat

SEQ ID NO: 5731733 - DNA, 20 bp, Homo sapiens
cttttttcctcctttctctg

SEQ ID NO: 5731734 - DNA, 22 bp, Homo sapiens
cttttttcctgtcaatatatag

SEQ ID NO: 5731735 - DNA, 22 bp, Homo sapiens
cttttttcctgttggtttcatt

SEQ ID NO: 5731736 - DNA, 18 bp, Homo sapiens
cttttttccttaatccag

SEQ ID NO: 5731737 - DNA, 22 bp, Homo sapiens
cttttttctaaacctgtgcctc

SEQ ID NO: 5731738 - DNA, 17 bp, Homo sapiens
cttttttctctatgtac

SEQ ID NO: 5731739 - DNA, 15 bp, Homo sapiens
cttttttctcttccc

SEQ ID NO: 5731740 - DNA, 15 bp, Homo sapiens
cttttttctcttctg

SEQ ID NO: 5731741 - DNA, 19 bp, Homo sapiens
cttttttctgcctccttta

SEQ ID NO: 5731742 - DNA, 16 bp, Homo sapiens
cttttttcttatttaa

SEQ ID NO: 5731743 - DNA, 13 bp, Homo sapiens
cttttttcttccc

SEQ ID NO: 5731744 - DNA, 17 bp, Homo sapiens
cttttttctttaaattt

SEQ ID NO: 5731745 - DNA, 15 bp, Homo sapiens
cttttttctttcttt

SEQ ID NO: 5731746 - DNA, 15 bp, Homo sapiens
cttttttctttgaaa

SEQ ID NO: 5731747 - DNA, 22 bp, Homo sapiens
cttttttctttgaaatgctaaa

SEQ ID NO: 5731748 - DNA, 13 bp, Homo sapiens
cttttttgaacca

SEQ ID NO: 5731749 - DNA, 19 bp, Homo sapiens
cttttttgagtcattgact

SEQ ID NO: 5731750 - DNA, 23 bp, Homo sapiens
cttttttgagtcattgacttcat

SEQ ID NO: 5731751 - DNA, 18 bp, Homo sapiens
cttttttgataaagtttc

SEQ ID NO: 5731752 - DNA, 19 bp, Homo sapiens
cttttttgataaagtttct

SEQ ID NO: 5731753 - DNA, 21 bp, Homo sapiens
cttttttgataaagtttctca

SEQ ID NO: 5731754 - DNA, 19 bp, Homo sapiens
cttttttgcaataaggatt

SEQ ID NO: 5731755 - DNA, 15 bp, Homo sapiens
cttttttgctttctt

SEQ ID NO: 5731756 - DNA, 24 bp, Homo sapiens
cttttttggggagtacctgtccaa

SEQ ID NO: 5731757 - DNA, 20 bp, Homo sapiens
cttttttggggatatgctta

SEQ ID NO: 5731758 - DNA, 13 bp, Homo sapiens
cttttttgggggg

SEQ ID NO: 5731759 - DNA, 13 bp, Homo sapiens
cttttttgtaaaa

SEQ ID NO: 5731760 - DNA, 13 bp, Homo sapiens
cttttttgtacat

SEQ ID NO: 5731761 - DNA, 10 bp, Homo sapiens
cttttttgtc

SEQ ID NO: 5731762 - DNA, 19 bp, Homo sapiens
cttttttgtcccccaactt

SEQ ID NO: 5731763 - DNA, 22 bp, Homo sapiens
cttttttgtcccccaacttgag

SEQ ID NO: 5731764 - DNA, 16 bp, Homo sapiens
cttttttgtctatgaa

SEQ ID NO: 5731765 - DNA, 19 bp, Homo sapiens
cttttttgtggcaattagt

SEQ ID NO: 5731766 - DNA, 14 bp, Homo sapiens
cttttttgtgtatg

SEQ ID NO: 5731767 - DNA, 18 bp, Homo sapiens
cttttttgtgtatgtact

SEQ ID NO: 5731768 - DNA, 13 bp, Homo sapiens
cttttttgttttg

SEQ ID NO: 5731769 - DNA, 16 bp, Homo sapiens
cttttttgttttttca

SEQ ID NO: 5731770 - DNA, 21 bp, Homo sapiens
cttttttgttttttcaaaata

SEQ ID NO: 5731771 - DNA, 20 bp, Homo sapiens
ctttttttaaaaataaatct

SEQ ID NO: 5731772 - DNA, 14 bp, Homo sapiens
ctttttttaaattt

SEQ ID NO: 5731773 - DNA, 20 bp, Homo sapiens
ctttttttaaattttctcca

SEQ ID NO: 5731774 - DNA, 15 bp, Homo sapiens
ctttttttaactggt

SEQ ID NO: 5731775 - DNA, 14 bp, Homo sapiens
ctttttttattact

SEQ ID NO: 5731776 - DNA, 19 bp, Homo sapiens
ctttttttattactagtgt

SEQ ID NO: 5731777 - DNA, 12 bp, Homo sapiens
ctttttttcaat

SEQ ID NO: 5731778 - DNA, 22 bp, Homo sapiens
ctttttttcaatttttttgtgt

SEQ ID NO: 5731779 - DNA, 11 bp, Homo sapiens
ctttttttccc

SEQ ID NO: 5731780 - DNA, 11 bp, Homo sapiens
ctttttttcct

SEQ ID NO: 5731781 - DNA, 17 bp, Homo sapiens
ctttttttctctagagt

SEQ ID NO: 5731782 - DNA, 22 bp, Homo sapiens
ctttttttctctgcatttaaaa

SEQ ID NO: 5731783 - DNA, 14 bp, Homo sapiens
ctttttttctgtac

SEQ ID NO: 5731784 - DNA, 19 bp, Homo sapiens
ctttttttctgtaccagtt

SEQ ID NO: 5731785 - DNA, 20 bp, Homo sapiens
ctttttttctgtgacattta

SEQ ID NO: 5731786 - DNA, 18 bp, Homo sapiens
ctttttttctttaataac

SEQ ID NO: 5731787 - DNA, 15 bp, Homo sapiens
ctttttttctttggt

SEQ ID NO: 5731788 - DNA, 15 bp, Homo sapiens
ctttttttcttttct

SEQ ID NO: 5731789 - DNA, 20 bp, Homo sapiens
ctttttttgagtgacagctt

SEQ ID NO: 5731790 - DNA, 20 bp, Homo sapiens
ctttttttgctttaaaacaa

SEQ ID NO: 5731791 - DNA, 17 bp, Homo sapiens
ctttttttgctttgttt

SEQ ID NO: 5731792 - DNA, 19 bp, Homo sapiens
ctttttttggaagttattt

SEQ ID NO: 5731793 - DNA, 23 bp, Homo sapiens
ctttttttggtaaatttttgaaa

SEQ ID NO: 5731794 - DNA, 16 bp, Homo sapiens
ctttttttgtatagtt

SEQ ID NO: 5731795 - DNA, 16 bp, Homo sapiens
ctttttttgtatgtgt

SEQ ID NO: 5731796 - DNA, 13 bp, Homo sapiens
ctttttttgtgtg

SEQ ID NO: 5731797 - DNA, 14 bp, Homo sapiens
cttttttttaataa

SEQ ID NO: 5731798 - DNA, 16 bp, Homo sapiens
cttttttttaataagg

SEQ ID NO: 5731799 - DNA, 17 bp, Homo sapiens
cttttttttaataagga

SEQ ID NO: 5731800 - DNA, 23 bp, Homo sapiens
cttttttttatacacaacattta

SEQ ID NO: 5731801 - DNA, 15 bp, Homo sapiens
cttttttttatgaaa

SEQ ID NO: 5731802 - DNA, 21 bp, Homo sapiens
cttttttttcccccctagaaa

SEQ ID NO: 5731803 - DNA, 15 bp, Homo sapiens
cttttttttccttct

SEQ ID NO: 5731804 - DNA, 18 bp, Homo sapiens
cttttttttctatttcac

SEQ ID NO: 5731805 - DNA, 15 bp, Homo sapiens
cttttttttctgatt

SEQ ID NO: 5731806 - DNA, 16 bp, Homo sapiens
cttttttttctgattc

SEQ ID NO: 5731807 - DNA, 21 bp, Homo sapiens
cttttttttctgggtagaagc

SEQ ID NO: 5731808 - DNA, 14 bp, Homo sapiens
cttttttttcttta

SEQ ID NO: 5731809 - DNA, 15 bp, Homo sapiens
cttttttttgtatgt

SEQ ID NO: 5731810 - DNA, 13 bp, Homo sapiens
ctttttttttaag

SEQ ID NO: 5731811 - DNA, 20 bp, Homo sapiens
ctttttttttcttcattgta

SEQ ID NO: 5731812 - DNA, 15 bp, Homo sapiens
ctttttttttgaaac

SEQ ID NO: 5731813 - DNA, 17 bp, Homo sapiens
ctttttttttgaaacag

SEQ ID NO: 5731814 - DNA, 20 bp, Homo sapiens
ctttttttttgaaacagcag

SEQ ID NO: 5731815 - DNA, 21 bp, Homo sapiens
ctttttttttgaaacagcagt

SEQ ID NO: 5731816 - DNA, 22 bp, Homo sapiens
cttttttttttaagtgaaattt

SEQ ID NO: 5731817 - DNA, 17 bp, Homo sapiens
cttttttttttccaaat

SEQ ID NO: 5731818 - DNA, 23 bp, Homo sapiens
cttttttttttccaaattattaa

SEQ ID NO: 5731819 - DNA, 23 bp, Homo sapiens
cttttttttttcgtcttccctgc

SEQ ID NO: 5731820 - DNA, 18 bp, Homo sapiens
cttttttttttctttata

SEQ ID NO: 5731821 - DNA, 14 bp, Homo sapiens
cttttttttttgag

SEQ ID NO: 5731822 - DNA, 20 bp, Homo sapiens
ctttttttttttaagaaaaa

SEQ ID NO: 5731823 - DNA, 22 bp, Homo sapiens
ctttttttttttctgcctgaga

SEQ ID NO: 5731824 - DNA, 18 bp, Homo sapiens
cttttttttttttaacat

SEQ ID NO: 5731825 - DNA, 15 bp, Homo sapiens
cttttttttttttcc

SEQ ID NO: 5731826 - DNA, 16 bp, Homo sapiens
cttttttttttttcca

SEQ ID NO: 5731827 - DNA, 17 bp, Homo sapiens
ctttttttttttttccc

SEQ ID NO: 5731828 - DNA, 18 bp, Homo sapiens
cttttttttttttttggt

SEQ ID NO: 5731829 - DNA, 21 bp, Homo sapiens
ctttttttttttttttaaaga

SEQ ID NO: 5731830 - DNA, 18 bp, Homo sapiens
ctttttttttttttttga

SEQ ID NO: 5731831 - DNA, 20 bp, Homo sapiens
ctttttttttttttttgaaa

SEQ ID NO: 5731832 - DNA, 22 bp, Homo sapiens
ctttttttttttttttttggtc

SEQ ID NO: 5731833 - DNA, 23 bp, Homo sapiens
ctttttttttttttttttttccg

SEQ ID NO: 5731834 - DNA, 22 bp, Homo sapiens
gaaaaaaaaaaaaagaaattcg

SEQ ID NO: 5731835 - DNA, 19 bp, Homo sapiens
gaaaaaaaaaaaagaaaag

SEQ ID NO: 5731836 - DNA, 17 bp, Homo sapiens
gaaaaaaaaaaaagagg

SEQ ID NO: 5731837 - DNA, 18 bp, Homo sapiens
gaaaaaaaaaaaagagga

SEQ ID NO: 5731838 - DNA, 22 bp, Homo sapiens
gaaaaaaaaaaaagaggaaaac

SEQ ID NO: 5731839 - DNA, 16 bp, Homo sapiens
gaaaaaaaaaaagaaa

SEQ ID NO: 5731840 - DNA, 17 bp, Homo sapiens
gaaaaaaaaaaagaaag

SEQ ID NO: 5731841 - DNA, 17 bp, Homo sapiens
gaaaaaaaaaacacttg

SEQ ID NO: 5731842 - DNA, 15 bp, Homo sapiens
gaaaaaaaaaacttt

SEQ ID NO: 5731843 - DNA, 14 bp, Homo sapiens
gaaaaaaaaaagaa

SEQ ID NO: 5731844 - DNA, 20 bp, Homo sapiens
gaaaaaaaaaagaaaaagga

SEQ ID NO: 5731845 - DNA, 23 bp, Homo sapiens
gaaaaaaaaaagaaaaaggaaaa

SEQ ID NO: 5731846 - DNA, 17 bp, Homo sapiens
gaaaaaaaaaagtaatt

SEQ ID NO: 5731847 - DNA, 14 bp, Homo sapiens
gaaaaaaaaaatga

SEQ ID NO: 5731848 - DNA, 18 bp, Homo sapiens
gaaaaaaaaaatgctgaa

SEQ ID NO: 5731849 - DNA, 19 bp, Homo sapiens
gaaaaaaaaaatgctgaac

SEQ ID NO: 5731850 - DNA, 20 bp, Homo sapiens
gaaaaaaaaaatgctgaaca

SEQ ID NO: 5731851 - DNA, 17 bp, Homo sapiens
gaaaaaaaaacagccac

SEQ ID NO: 5731852 - DNA, 12 bp, Homo sapiens
gaaaaaaaaaga

SEQ ID NO: 5731853 - DNA, 13 bp, Homo sapiens
gaaaaaaaaagaa

SEQ ID NO: 5731854 - DNA, 14 bp, Homo sapiens
gaaaaaaaaagaaa

SEQ ID NO: 5731855 - DNA, 15 bp, Homo sapiens
gaaaaaaaaagaaaa

SEQ ID NO: 5731856 - DNA, 16 bp, Homo sapiens
gaaaaaaaaagaatta

SEQ ID NO: 5731857 - DNA, 21 bp, Homo sapiens
gaaaaaaaaatgccataatac

SEQ ID NO: 5731858 - DNA, 16 bp, Homo sapiens
gaaaaaaaaattccat

SEQ ID NO: 5731859 - DNA, 11 bp, Homo sapiens
gaaaaaaaaca

SEQ ID NO: 5731860 - DNA, 14 bp, Homo sapiens
gaaaaaaaaccttg

SEQ ID NO: 5731861 - DNA, 13 bp, Homo sapiens
gaaaaaaaagaaa

SEQ ID NO: 5731862 - DNA, 22 bp, Homo sapiens
gaaaaaaaagaaaaaagtcctt

SEQ ID NO: 5731863 - DNA, 20 bp, Homo sapiens
gaaaaaaaagtgtctcaaag

SEQ ID NO: 5731864 - DNA, 13 bp, Homo sapiens
gaaaaaaaatgta

SEQ ID NO: 5731865 - DNA, 14 bp, Homo sapiens
gaaaaaaaatgtag

SEQ ID NO: 5731866 - DNA, 20 bp, Homo sapiens
gaaaaaaaatgttctttggg

SEQ ID NO: 5731867 - DNA, 22 bp, Homo sapiens
gaaaaaaaattcctttcagatt

SEQ ID NO: 5731868 - DNA, 21 bp, Homo sapiens
gaaaaaaactaaagttgaaaa

SEQ ID NO: 5731869 - DNA, 11 bp, Homo sapiens
gaaaaaaagaa

SEQ ID NO: 5731870 - DNA, 12 bp, Homo sapiens
gaaaaaaagaaa

SEQ ID NO: 5731871 - DNA, 22 bp, Homo sapiens
gaaaaaaagaggtttaagtttg

SEQ ID NO: 5731872 - DNA, 20 bp, Homo sapiens
gaaaaaaagcacaaagttct

SEQ ID NO: 5731873 - DNA, 23 bp, Homo sapiens
gaaaaaaaggttaacagtaaaaa

SEQ ID NO: 5731874 - DNA, 19 bp, Homo sapiens
gaaaaaaagtgctgaaaat

SEQ ID NO: 5731875 - DNA, 18 bp, Homo sapiens
gaaaaaaagttgctttgt

SEQ ID NO: 5731876 - DNA, 16 bp, Homo sapiens
gaaaaaaagtttctat

SEQ ID NO: 5731877 - DNA, 19 bp, Homo sapiens
gaaaaaaataactattttg

SEQ ID NO: 5731878 - DNA, 15 bp, Homo sapiens
gaaaaaaatactatt

SEQ ID NO: 5731879 - DNA, 14 bp, Homo sapiens
gaaaaaaatagttt

SEQ ID NO: 5731880 - DNA, 12 bp, Homo sapiens
gaaaaaaatata

SEQ ID NO: 5731881 - DNA, 16 bp, Homo sapiens
gaaaaaaatgactaaa

SEQ ID NO: 5731882 - DNA, 16 bp, Homo sapiens
gaaaaaaatgatctat

SEQ ID NO: 5731883 - DNA, 12 bp, Homo sapiens
gaaaaaaatgga

SEQ ID NO: 5731884 - DNA, 22 bp, Homo sapiens
gaaaaaaatgtacatttattca

SEQ ID NO: 5731885 - DNA, 19 bp, Homo sapiens
gaaaaaaatgtattttatg

SEQ ID NO: 5731886 - DNA, 13 bp, Homo sapiens
gaaaaaaatgttg

SEQ ID NO: 5731887 - DNA, 21 bp, Homo sapiens
gaaaaaaatgttgtttcctaa

SEQ ID NO: 5731888 - DNA, 14 bp, Homo sapiens
gaaaaaaattacaa

SEQ ID NO: 5731889 - DNA, 19 bp, Homo sapiens
gaaaaaaattacaaaatga

SEQ ID NO: 5731890 - DNA, 14 bp, Homo sapiens
gaaaaaaattgaaa

SEQ ID NO: 5731891 - DNA, 18 bp, Homo sapiens
gaaaaaaattgaaatgta

SEQ ID NO: 5731892 - DNA, 19 bp, Homo sapiens
gaaaaaaattgaaatgtaa

SEQ ID NO: 5731893 - DNA, 15 bp, Homo sapiens
gaaaaaacaaaatca

SEQ ID NO: 5731894 - DNA, 11 bp, Homo sapiens
gaaaaaacaag

SEQ ID NO: 5731895 - DNA, 22 bp, Homo sapiens
gaaaaaaccgtgtttgtctctt

SEQ ID NO: 5731896 - DNA, 17 bp, Homo sapiens
gaaaaaactatatttga

SEQ ID NO: 5731897 - DNA, 16 bp, Homo sapiens
gaaaaaactggaaaca

SEQ ID NO: 5731898 - DNA, 13 bp, Homo sapiens
gaaaaaactttct

SEQ ID NO: 5731899 - DNA, 20 bp, Homo sapiens
gaaaaaactttctctttgcc

SEQ ID NO: 5731900 - DNA, 22 bp, Homo sapiens
gaaaaaactttctctttgccat

SEQ ID NO: 5731901 - DNA, 12 bp, Homo sapiens
gaaaaaagaaag

SEQ ID NO: 5731902 - DNA, 15 bp, Homo sapiens
gaaaaaagagaaaaa

SEQ ID NO: 5731903 - DNA, 16 bp, Homo sapiens
gaaaaaagagaaaaga

SEQ ID NO: 5731904 - DNA, 20 bp, Homo sapiens
gaaaaaagagtttaaacaaa

SEQ ID NO: 5731905 - DNA, 14 bp, Homo sapiens
gaaaaaagattttt

SEQ ID NO: 5731906 - DNA, 13 bp, Homo sapiens
gaaaaaagcaatt

SEQ ID NO: 5731907 - DNA, 14 bp, Homo sapiens
gaaaaaagcacata

SEQ ID NO: 5731908 - DNA, 19 bp, Homo sapiens
gaaaaaagcacatacatta

SEQ ID NO: 5731909 - DNA, 15 bp, Homo sapiens
gaaaaaaggaagtgg

SEQ ID NO: 5731910 - DNA, 18 bp, Homo sapiens
gaaaaaagggtttatgct

SEQ ID NO: 5731911 - DNA, 14 bp, Homo sapiens
gaaaaaagtacaga

SEQ ID NO: 5731912 - DNA, 17 bp, Homo sapiens
gaaaaaagtccagattg

SEQ ID NO: 5731913 - DNA, 12 bp, Homo sapiens
gaaaaaagtcct

SEQ ID NO: 5731914 - DNA, 18 bp, Homo sapiens
gaaaaaagtggaaaacat

SEQ ID NO: 5731915 - DNA, 15 bp, Homo sapiens
gaaaaaataaaaaga

SEQ ID NO: 5731916 - DNA, 14 bp, Homo sapiens
gaaaaaataaatgt

SEQ ID NO: 5731917 - DNA, 21 bp, Homo sapiens
gaaaaaataattgatttcaag

SEQ ID NO: 5731918 - DNA, 14 bp, Homo sapiens
gaaaaaatacattt

SEQ ID NO: 5731919 - DNA, 17 bp, Homo sapiens
gaaaaaatacattttat

SEQ ID NO: 5731920 - DNA, 16 bp, Homo sapiens
gaaaaaatactaccta

SEQ ID NO: 5731921 - DNA, 11 bp, Homo sapiens
gaaaaaatata

SEQ ID NO: 5731922 - DNA, 14 bp, Homo sapiens
gaaaaaatatatat

SEQ ID NO: 5731923 - DNA, 23 bp, Homo sapiens
gaaaaaatattgtttaatgcaaa

SEQ ID NO: 5731924 - DNA, 19 bp, Homo sapiens
gaaaaaatgatgttcattt

SEQ ID NO: 5731925 - DNA, 13 bp, Homo sapiens
gaaaaaatggcaa

SEQ ID NO: 5731926 - DNA, 19 bp, Homo sapiens
gaaaaaatggcaagagatc

SEQ ID NO: 5731927 - DNA, 14 bp, Homo sapiens
gaaaaaatgtagaa

SEQ ID NO: 5731928 - DNA, 15 bp, Homo sapiens
gaaaaaatgtatgtg

SEQ ID NO: 5731929 - DNA, 13 bp, Homo sapiens
gaaaaaatgttca

SEQ ID NO: 5731930 - DNA, 21 bp, Homo sapiens
gaaaaaatgttggatttataa

SEQ ID NO: 5731931 - DNA, 19 bp, Homo sapiens
gaaaaaattgaaagaactt

SEQ ID NO: 5731932 - DNA, 14 bp, Homo sapiens
gaaaaacaaaacaa

SEQ ID NO: 5731933 - DNA, 23 bp, Homo sapiens
gaaaaacaaactcgttttttaca

SEQ ID NO: 5731934 - DNA, 15 bp, Homo sapiens
gaaaaacaataagag

SEQ ID NO: 5731935 - DNA, 15 bp, Homo sapiens
gaaaaacaatcttat

SEQ ID NO: 5731936 - DNA, 15 bp, Homo sapiens
gaaaaacacaagcaa

SEQ ID NO: 5731937 - DNA, 14 bp, Homo sapiens
gaaaaacactattt

SEQ ID NO: 5731938 - DNA, 13 bp, Homo sapiens
gaaaaacagaaaa

SEQ ID NO: 5731939 - DNA, 16 bp, Homo sapiens
gaaaaacagaacattt

SEQ ID NO: 5731940 - DNA, 17 bp, Homo sapiens
gaaaaacaggaaaggag

SEQ ID NO: 5731941 - DNA, 11 bp, Homo sapiens
gaaaaacaggt

SEQ ID NO: 5731942 - DNA, 20 bp, Homo sapiens
gaaaaacatcccaaacttta

SEQ ID NO: 5731943 - DNA, 22 bp, Homo sapiens
gaaaaacatcccaaactttaaa

SEQ ID NO: 5731944 - DNA, 13 bp, Homo sapiens
gaaaaacatgtca

SEQ ID NO: 5731945 - DNA, 16 bp, Homo sapiens
gaaaaacatgtcatgt

SEQ ID NO: 5731946 - DNA, 20 bp, Homo sapiens
gaaaaacatttaaacttttt

SEQ ID NO: 5731947 - DNA, 21 bp, Homo sapiens
gaaaaacatttaaacttttta

SEQ ID NO: 5731948 - DNA, 17 bp, Homo sapiens
gaaaaacctgctccctt

SEQ ID NO: 5731949 - DNA, 20 bp, Homo sapiens
gaaaaacggcagtatcacag

SEQ ID NO: 5731950 - DNA, 20 bp, Homo sapiens
gaaaaactcaaccaaatggt

SEQ ID NO: 5731951 - DNA, 23 bp, Homo sapiens
gaaaaactcttctactttcatct

SEQ ID NO: 5731952 - DNA, 16 bp, Homo sapiens
gaaaaactgagacagg

SEQ ID NO: 5731953 - DNA, 19 bp, Homo sapiens
gaaaaactgatcaaaaata

SEQ ID NO: 5731954 - DNA, 22 bp, Homo sapiens
gaaaaactgatcaaaaataaac

SEQ ID NO: 5731955 - DNA, 21 bp, Homo sapiens
gaaaaactgcagtcatcaaca

SEQ ID NO: 5731956 - DNA, 12 bp, Homo sapiens
gaaaaacttgtg

SEQ ID NO: 5731957 - DNA, 21 bp, Homo sapiens
gaaaaactttggaaccagact

SEQ ID NO: 5731958 - DNA, 22 bp, Homo sapiens
gaaaaacttttaggttgttacc

SEQ ID NO: 5731959 - DNA, 19 bp, Homo sapiens
gaaaaagaaaaaaaaagca

SEQ ID NO: 5731960 - DNA, 14 bp, Homo sapiens
gaaaaagaaacaca

SEQ ID NO: 5731961 - DNA, 12 bp, Homo sapiens
gaaaaagaaatg

SEQ ID NO: 5731962 - DNA, 22 bp, Homo sapiens
gaaaaagaaatgcaaaaatctc

SEQ ID NO: 5731963 - DNA, 23 bp, Homo sapiens
gaaaaagaacttccccatacaaa

SEQ ID NO: 5731964 - DNA, 13 bp, Homo sapiens
gaaaaagaagaag

SEQ ID NO: 5731965 - DNA, 19 bp, Homo sapiens
gaaaaagaagaaggagctc

SEQ ID NO: 5731966 - DNA, 19 bp, Homo sapiens
gaaaaagaatcggcagtat

SEQ ID NO: 5731967 - DNA, 18 bp, Homo sapiens
gaaaaagacataaaacag

SEQ ID NO: 5731968 - DNA, 20 bp, Homo sapiens
gaaaaagactttaaaagtga

SEQ ID NO: 5731969 - DNA, 14 bp, Homo sapiens
gaaaaagagactct

SEQ ID NO: 5731970 - DNA, 11 bp, Homo sapiens
gaaaaagagag

SEQ ID NO: 5731971 - DNA, 14 bp, Homo sapiens
gaaaaagagagagc

SEQ ID NO: 5731972 - DNA, 18 bp, Homo sapiens
gaaaaagagagagcaggg

SEQ ID NO: 5731973 - DNA, 16 bp, Homo sapiens
gaaaaagatattgtat

SEQ ID NO: 5731974 - DNA, 17 bp, Homo sapiens
gaaaaagatattgtatt

SEQ ID NO: 5731975 - DNA, 19 bp, Homo sapiens
gaaaaagatattgtattat

SEQ ID NO: 5731976 - DNA, 16 bp, Homo sapiens
gaaaaagcacaagaag

SEQ ID NO: 5731977 - DNA, 12 bp, Homo sapiens
gaaaaagcatga

SEQ ID NO: 5731978 - DNA, 14 bp, Homo sapiens
gaaaaagcatgatg

SEQ ID NO: 5731979 - DNA, 21 bp, Homo sapiens
gaaaaagcatgatgggaaaat

SEQ ID NO: 5731980 - DNA, 13 bp, Homo sapiens
gaaaaagcatgta

SEQ ID NO: 5731981 - DNA, 15 bp, Homo sapiens
gaaaaagcatgtaca

SEQ ID NO: 5731982 - DNA, 17 bp, Homo sapiens
gaaaaagcatgtacagt

SEQ ID NO: 5731983 - DNA, 22 bp, Homo sapiens
gaaaaagcatgtacagtgttct

SEQ ID NO: 5731984 - DNA, 15 bp, Homo sapiens
gaaaaagccatatca

SEQ ID NO: 5731985 - DNA, 21 bp, Homo sapiens
gaaaaagctcctgtcctccca

SEQ ID NO: 5731986 - DNA, 13 bp, Homo sapiens
gaaaaaggaaaac

SEQ ID NO: 5731987 - DNA, 18 bp, Homo sapiens
gaaaaaggagcttacctc

SEQ ID NO: 5731988 - DNA, 17 bp, Homo sapiens
gaaaaaggatgcacaga

SEQ ID NO: 5731989 - DNA, 23 bp, Homo sapiens
gaaaaaggatgcacagagttgtt

SEQ ID NO: 5731990 - DNA, 20 bp, Homo sapiens
gaaaaaggatggaagaaaga

SEQ ID NO: 5731991 - DNA, 21 bp, Homo sapiens
gaaaaaggatggaagaaagaa

SEQ ID NO: 5731992 - DNA, 15 bp, Homo sapiens
gaaaaaggctggtgg

SEQ ID NO: 5731993 - DNA, 16 bp, Homo sapiens
gaaaaaggctgtgctg

SEQ ID NO: 5731994 - DNA, 15 bp, Homo sapiens
gaaaaagtacaatga

SEQ ID NO: 5731995 - DNA, 16 bp, Homo sapiens
gaaaaagtaggctgcc

SEQ ID NO: 5731996 - DNA, 18 bp, Homo sapiens
gaaaaagtcatccaatct

SEQ ID NO: 5731997 - DNA, 21 bp, Homo sapiens
gaaaaagtcatccaatctaac

SEQ ID NO: 5731998 - DNA, 21 bp, Homo sapiens
gaaaaagtcctgtcagttcag

SEQ ID NO: 5731999 - DNA, 12 bp, Homo sapiens
gaaaaagtgatg

SEQ ID NO: 5732000 - DNA, 23 bp, Homo sapiens
gaaaaagtgatggagcagagcaa

SEQ ID NO: 5732001 - DNA, 20 bp, Homo sapiens
gaaaaagttaatgcttaaga

SEQ ID NO: 5732002 - DNA, 16 bp, Homo sapiens
gaaaaagttgcagtct

SEQ ID NO: 5732003 - DNA, 9 bp, Homo sapiens
gaaaaataa

SEQ ID NO: 5732004 - DNA, 13 bp, Homo sapiens
gaaaaataaaaga

SEQ ID NO: 5732005 - DNA, 15 bp, Homo sapiens
gaaaaataaaatgtt

SEQ ID NO: 5732006 - DNA, 17 bp, Homo sapiens
gaaaaataaacactaca

SEQ ID NO: 5732007 - DNA, 12 bp, Homo sapiens
gaaaaataaaga

SEQ ID NO: 5732008 - DNA, 14 bp, Homo sapiens
gaaaaataaagtta

SEQ ID NO: 5732009 - DNA, 12 bp, Homo sapiens
gaaaaataaata

SEQ ID NO: 5732010 - DNA, 17 bp, Homo sapiens
gaaaaataaatgtcact

SEQ ID NO: 5732011 - DNA, 22 bp, Homo sapiens
gaaaaataacaactaacttgtt

SEQ ID NO: 5732012 - DNA, 11 bp, Homo sapiens
gaaaaataaga

SEQ ID NO: 5732013 - DNA, 13 bp, Homo sapiens
gaaaaataatcaa

SEQ ID NO: 5732014 - DNA, 20 bp, Homo sapiens
gaaaaatagtgtctttgtga

SEQ ID NO: 5732015 - DNA, 20 bp, Homo sapiens
gaaaaatatatgcttacatt

SEQ ID NO: 5732016 - DNA, 22 bp, Homo sapiens
gaaaaatatctggttatatcat

SEQ ID NO: 5732017 - DNA, 20 bp, Homo sapiens
gaaaaatatctgtaagagtg

SEQ ID NO: 5732018 - DNA, 13 bp, Homo sapiens
gaaaaatatgtga

SEQ ID NO: 5732019 - DNA, 19 bp, Homo sapiens
gaaaaatattcaagtaaca

SEQ ID NO: 5732020 - DNA, 11 bp, Homo sapiens
gaaaaatattg

SEQ ID NO: 5732021 - DNA, 16 bp, Homo sapiens
gaaaaatattgctaaa

SEQ ID NO: 5732022 - DNA, 20 bp, Homo sapiens
gaaaaatattgctaaaagtg

SEQ ID NO: 5732023 - DNA, 14 bp, Homo sapiens
gaaaaatatttaag

SEQ ID NO: 5732024 - DNA, 16 bp, Homo sapiens
gaaaaatatttattca

SEQ ID NO: 5732025 - DNA, 15 bp, Homo sapiens
gaaaaatatttctga

SEQ ID NO: 5732026 - DNA, 19 bp, Homo sapiens
gaaaaatcacatcctggcc

SEQ ID NO: 5732027 - DNA, 18 bp, Homo sapiens
gaaaaatcagaagcacaa

SEQ ID NO: 5732028 - DNA, 14 bp, Homo sapiens
gaaaaatcagtttt

SEQ ID NO: 5732029 - DNA, 15 bp, Homo sapiens
gaaaaatcagttttt

SEQ ID NO: 5732030 - DNA, 21 bp, Homo sapiens
gaaaaatcagtttttgactga

SEQ ID NO: 5732031 - DNA, 21 bp, Homo sapiens
gaaaaatcataaccaccctag

SEQ ID NO: 5732032 - DNA, 13 bp, Homo sapiens
gaaaaatctcatt

SEQ ID NO: 5732033 - DNA, 17 bp, Homo sapiens
gaaaaatctcattattt

SEQ ID NO: 5732034 - DNA, 20 bp, Homo sapiens
gaaaaatctcattatttcaa

SEQ ID NO: 5732035 - DNA, 18 bp, Homo sapiens
gaaaaatcttaagtacca

SEQ ID NO: 5732036 - DNA, 15 bp, Homo sapiens
gaaaaatgaaaagca

SEQ ID NO: 5732037 - DNA, 16 bp, Homo sapiens
gaaaaatgaaagatga

SEQ ID NO: 5732038 - DNA, 17 bp, Homo sapiens
gaaaaatgaaagatgat

SEQ ID NO: 5732039 - DNA, 18 bp, Homo sapiens
gaaaaatgaaagatgatt

SEQ ID NO: 5732040 - DNA, 23 bp, Homo sapiens
gaaaaatgaactgtattattgca

SEQ ID NO: 5732041 - DNA, 19 bp, Homo sapiens
gaaaaatgacaattgtgaa

SEQ ID NO: 5732042 - DNA, 17 bp, Homo sapiens
gaaaaatgatgtcttta

SEQ ID NO: 5732043 - DNA, 16 bp, Homo sapiens
gaaaaatgccactccc

SEQ ID NO: 5732044 - DNA, 22 bp, Homo sapiens
gaaaaatgccactccctaccca

SEQ ID NO: 5732045 - DNA, 20 bp, Homo sapiens
gaaaaatgcccttaaatcat

SEQ ID NO: 5732046 - DNA, 14 bp, Homo sapiens
gaaaaatgcctgct

SEQ ID NO: 5732047 - DNA, 17 bp, Homo sapiens
gaaaaatgctccccaca

SEQ ID NO: 5732048 - DNA, 16 bp, Homo sapiens
gaaaaatgctttgctt

SEQ ID NO: 5732049 - DNA, 17 bp, Homo sapiens
gaaaaatgcttttgtgt

SEQ ID NO: 5732050 - DNA, 16 bp, Homo sapiens
gaaaaatggagcaaag

SEQ ID NO: 5732051 - DNA, 15 bp, Homo sapiens
gaaaaatgggaaata

SEQ ID NO: 5732052 - DNA, 17 bp, Homo sapiens
gaaaaatgggagccagg

SEQ ID NO: 5732053 - DNA, 20 bp, Homo sapiens
gaaaaatgggagccaggagt

SEQ ID NO: 5732054 - DNA, 19 bp, Homo sapiens
gaaaaatgggtcttttata

SEQ ID NO: 5732055 - DNA, 19 bp, Homo sapiens
gaaaaatgtaatttagaaa

SEQ ID NO: 5732056 - DNA, 15 bp, Homo sapiens
gaaaaatgtataaaa

SEQ ID NO: 5732057 - DNA, 15 bp, Homo sapiens
gaaaaatgtcagtct

SEQ ID NO: 5732058 - DNA, 17 bp, Homo sapiens
gaaaaatgtgtggttct

SEQ ID NO: 5732059 - DNA, 17 bp, Homo sapiens
gaaaaatgttataactt

SEQ ID NO: 5732060 - DNA, 15 bp, Homo sapiens
gaaaaatgttcttta

SEQ ID NO: 5732061 - DNA, 18 bp, Homo sapiens
gaaaaattaagttgttga

SEQ ID NO: 5732062 - DNA, 16 bp, Homo sapiens
gaaaaattccactcaa

SEQ ID NO: 5732063 - DNA, 15 bp, Homo sapiens
gaaaaattcctattg

SEQ ID NO: 5732064 - DNA, 20 bp, Homo sapiens
gaaaaattcctattgtgatt

SEQ ID NO: 5732065 - DNA, 18 bp, Homo sapiens
gaaaaattcttggttatt

SEQ ID NO: 5732066 - DNA, 18 bp, Homo sapiens
gaaaaattgaactacagc

SEQ ID NO: 5732067 - DNA, 16 bp, Homo sapiens
gaaaaattgacaaaaa

SEQ ID NO: 5732068 - DNA, 15 bp, Homo sapiens
gaaaaattgtctttc

SEQ ID NO: 5732069 - DNA, 23 bp, Homo sapiens
gaaaaattgtttccaaagtgcat

SEQ ID NO: 5732070 - DNA, 22 bp, Homo sapiens
gaaaaatttaagcattgtttgc

SEQ ID NO: 5732071 - DNA, 14 bp, Homo sapiens
gaaaaatttcacga

SEQ ID NO: 5732072 - DNA, 15 bp, Homo sapiens
gaaaaatttcacgat

SEQ ID NO: 5732073 - DNA, 18 bp, Homo sapiens
gaaaaatttgaaaatgat

SEQ ID NO: 5732074 - DNA, 20 bp, Homo sapiens
gaaaaatttttatgtaaaac

SEQ ID NO: 5732075 - DNA, 11 bp, Homo sapiens
gaaaacaaaaa

SEQ ID NO: 5732076 - DNA, 15 bp, Homo sapiens
gaaaacaaaaaactt

SEQ ID NO: 5732077 - DNA, 22 bp, Homo sapiens
gaaaacaaaaacgccttttctt

SEQ ID NO: 5732078 - DNA, 14 bp, Homo sapiens
gaaaacaaaatcta

SEQ ID NO: 5732079 - DNA, 19 bp, Homo sapiens
gaaaacaaaatctaaaaca

SEQ ID NO: 5732080 - DNA, 15 bp, Homo sapiens
gaaaacaaaggagca

SEQ ID NO: 5732081 - DNA, 14 bp, Homo sapiens
gaaaacaaagttct

SEQ ID NO: 5732082 - DNA, 17 bp, Homo sapiens
gaaaacaaagttctatt

SEQ ID NO: 5732083 - DNA, 13 bp, Homo sapiens
gaaaacaacaaaa

SEQ ID NO: 5732084 - DNA, 14 bp, Homo sapiens
gaaaacaacaaaag

SEQ ID NO: 5732085 - DNA, 16 bp, Homo sapiens
gaaaacaacaaaagaa

SEQ ID NO: 5732086 - DNA, 21 bp, Homo sapiens
gaaaacaacaaaagaattttt

SEQ ID NO: 5732087 - DNA, 16 bp, Homo sapiens
gaaaacaaccaaagaa

SEQ ID NO: 5732088 - DNA, 20 bp, Homo sapiens
gaaaacaaccaaagaaaatt

SEQ ID NO: 5732089 - DNA, 23 bp, Homo sapiens
gaaaacaaccgtcctgctgtccc

SEQ ID NO: 5732090 - DNA, 24 bp, Homo sapiens
gaaaacaaccgtcctgctgtccct

SEQ ID NO: 5732091 - DNA, 20 bp, Homo sapiens
gaaaacaacttggcatttct

SEQ ID NO: 5732092 - DNA, 14 bp, Homo sapiens
gaaaacaaggaagt

SEQ ID NO: 5732093 - DNA, 14 bp, Homo sapiens
gaaaacaaggatga

SEQ ID NO: 5732094 - DNA, 17 bp, Homo sapiens
gaaaacaagttccaaat

SEQ ID NO: 5732095 - DNA, 19 bp, Homo sapiens
gaaaacaatgcaaaacctt

SEQ ID NO: 5732096 - DNA, 20 bp, Homo sapiens
gaaaacaatggagtattctc

SEQ ID NO: 5732097 - DNA, 19 bp, Homo sapiens
gaaaacaattcagtggtct

SEQ ID NO: 5732098 - DNA, 18 bp, Homo sapiens
gaaaacacaataaaaaat

SEQ ID NO: 5732099 - DNA, 17 bp, Homo sapiens
gaaaacacactcaaaag

SEQ ID NO: 5732100 - DNA, 17 bp, Homo sapiens
gaaaacacagcctccct

SEQ ID NO: 5732101 - DNA, 14 bp, Homo sapiens
gaaaacacattttt

SEQ ID NO: 5732102 - DNA, 18 bp, Homo sapiens
gaaaacacatttttctta

SEQ ID NO: 5732103 - DNA, 16 bp, Homo sapiens
gaaaacaccaagagta

SEQ ID NO: 5732104 - DNA, 23 bp, Homo sapiens
gaaaacaccatggagatgaaatg

SEQ ID NO: 5732105 - DNA, 17 bp, Homo sapiens
gaaaacacggccctcct

SEQ ID NO: 5732106 - DNA, 19 bp, Homo sapiens
gaaaacacggccctcctgg

SEQ ID NO: 5732107 - DNA, 20 bp, Homo sapiens
gaaaacacggccctcctggg

SEQ ID NO: 5732108 - DNA, 21 bp, Homo sapiens
gaaaacacggccctcctggga

SEQ ID NO: 5732109 - DNA, 10 bp, Homo sapiens
gaaaacacta

SEQ ID NO: 5732110 - DNA, 19 bp, Homo sapiens
gaaaacactaacaaaattt

SEQ ID NO: 5732111 - DNA, 18 bp, Homo sapiens
gaaaacactatttccaaa

SEQ ID NO: 5732112 - DNA, 17 bp, Homo sapiens
gaaaacactcaaaatga

SEQ ID NO: 5732113 - DNA, 15 bp, Homo sapiens
gaaaacactgttatc

SEQ ID NO: 5732114 - DNA, 14 bp, Homo sapiens
gaaaacactttcct

SEQ ID NO: 5732115 - DNA, 13 bp, Homo sapiens
gaaaacagaaaac

SEQ ID NO: 5732116 - DNA, 13 bp, Homo sapiens
gaaaacagaaatt

SEQ ID NO: 5732117 - DNA, 13 bp, Homo sapiens
gaaaacagaccta

SEQ ID NO: 5732118 - DNA, 16 bp, Homo sapiens
gaaaacagagcctgcc

SEQ ID NO: 5732119 - DNA, 23 bp, Homo sapiens
gaaaacagaggccacactttctg

SEQ ID NO: 5732120 - DNA, 23 bp, Homo sapiens
gaaaacaggaaaaaaacttttat

SEQ ID NO: 5732121 - DNA, 22 bp, Homo sapiens
gaaaacaggacttaaaatgaca

SEQ ID NO: 5732122 - DNA, 13 bp, Homo sapiens
gaaaacaggagag

SEQ ID NO: 5732123 - DNA, 12 bp, Homo sapiens
gaaaacaggcac

SEQ ID NO: 5732124 - DNA, 21 bp, Homo sapiens
gaaaacagggtccaggaatgg

SEQ ID NO: 5732125 - DNA, 18 bp, Homo sapiens
gaaaacagggtctgggac

SEQ ID NO: 5732126 - DNA, 21 bp, Homo sapiens
gaaaacagtcaaccaacccca

SEQ ID NO: 5732127 - DNA, 15 bp, Homo sapiens
gaaaacagtgaatct

SEQ ID NO: 5732128 - DNA, 22 bp, Homo sapiens
gaaaacataaaaagttaaaaaa

SEQ ID NO: 5732129 - DNA, 19 bp, Homo sapiens
gaaaacataaagaaaagat

SEQ ID NO: 5732130 - DNA, 19 bp, Homo sapiens
gaaaacataatataagaat

SEQ ID NO: 5732131 - DNA, 14 bp, Homo sapiens
gaaaacatatattt

SEQ ID NO: 5732132 - DNA, 15 bp, Homo sapiens
gaaaacatatatttt

SEQ ID NO: 5732133 - DNA, 16 bp, Homo sapiens
gaaaacatatatttta

SEQ ID NO: 5732134 - DNA, 22 bp, Homo sapiens
gaaaacatatgaaatataaatt

SEQ ID NO: 5732135 - DNA, 16 bp, Homo sapiens
gaaaacatcctgactt

SEQ ID NO: 5732136 - DNA, 19 bp, Homo sapiens
gaaaacatctccttagaaa

SEQ ID NO: 5732137 - DNA, 16 bp, Homo sapiens
gaaaacatgctacaca

SEQ ID NO: 5732138 - DNA, 18 bp, Homo sapiens
gaaaacatgctacacact

SEQ ID NO: 5732139 - DNA, 14 bp, Homo sapiens
gaaaacatgttaat

SEQ ID NO: 5732140 - DNA, 16 bp, Homo sapiens
gaaaacatgttaatga

SEQ ID NO: 5732141 - DNA, 13 bp, Homo sapiens
gaaaacattccat

SEQ ID NO: 5732142 - DNA, 15 bp, Homo sapiens
gaaaacatttaacat

SEQ ID NO: 5732143 - DNA, 17 bp, Homo sapiens
gaaaacatttaacataa

SEQ ID NO: 5732144 - DNA, 18 bp, Homo sapiens
gaaaacatttcaaagctg

SEQ ID NO: 5732145 - DNA, 18 bp, Homo sapiens
gaaaaccaaattttaaaa

SEQ ID NO: 5732146 - DNA, 19 bp, Homo sapiens
gaaaaccaaattttaaaag

SEQ ID NO: 5732147 - DNA, 18 bp, Homo sapiens
gaaaaccaaccctgtggg

SEQ ID NO: 5732148 - DNA, 21 bp, Homo sapiens
gaaaaccaagccgtggcttcc

SEQ ID NO: 5732149 - DNA, 10 bp, Homo sapiens
gaaaaccaca

SEQ ID NO: 5732150 - DNA, 19 bp, Homo sapiens
gaaaaccacaaacggagcc

SEQ ID NO: 5732151 - DNA, 16 bp, Homo sapiens
gaaaaccacagtcagt

SEQ ID NO: 5732152 - DNA, 12 bp, Homo sapiens
gaaaaccaggga

SEQ ID NO: 5732153 - DNA, 16 bp, Homo sapiens
gaaaaccatcacatga

SEQ ID NO: 5732154 - DNA, 16 bp, Homo sapiens
gaaaacccaaggccag

SEQ ID NO: 5732155 - DNA, 17 bp, Homo sapiens
gaaaacccaagttttta

SEQ ID NO: 5732156 - DNA, 15 bp, Homo sapiens
gaaaacccagagagg

SEQ ID NO: 5732157 - DNA, 12 bp, Homo sapiens
gaaaacctacca

SEQ ID NO: 5732158 - DNA, 13 bp, Homo sapiens
gaaaacctcagtt

SEQ ID NO: 5732159 - DNA, 22 bp, Homo sapiens
gaaaacctcagttggcctctgc

SEQ ID NO: 5732160 - DNA, 15 bp, Homo sapiens
gaaaacctcatggag

SEQ ID NO: 5732161 - DNA, 13 bp, Homo sapiens
gaaaacctctcct

SEQ ID NO: 5732162 - DNA, 17 bp, Homo sapiens
gaaaacctgaggccaaa

SEQ ID NO: 5732163 - DNA, 17 bp, Homo sapiens
gaaaacctgggggatgg

SEQ ID NO: 5732164 - DNA, 14 bp, Homo sapiens
gaaaacctgtcact

SEQ ID NO: 5732165 - DNA, 15 bp, Homo sapiens
gaaaacctgttttta

SEQ ID NO: 5732166 - DNA, 19 bp, Homo sapiens
gaaaaccttaaaagtaata

SEQ ID NO: 5732167 - DNA, 22 bp, Homo sapiens
gaaaaccttaaaagtaataaag

SEQ ID NO: 5732168 - DNA, 15 bp, Homo sapiens
gaaaacctttcttca

SEQ ID NO: 5732169 - DNA, 22 bp, Homo sapiens
gaaaacgctctctactctgctt

SEQ ID NO: 5732170 - DNA, 13 bp, Homo sapiens
gaaaacggagctg

SEQ ID NO: 5732171 - DNA, 20 bp, Homo sapiens
gaaaacgggaaagaatataa

SEQ ID NO: 5732172 - DNA, 17 bp, Homo sapiens
gaaaacggttaaaactg

SEQ ID NO: 5732173 - DNA, 18 bp, Homo sapiens
gaaaacgtcttccttctt

SEQ ID NO: 5732174 - DNA, 14 bp, Homo sapiens
gaaaacgtggctgc

SEQ ID NO: 5732175 - DNA, 15 bp, Homo sapiens
gaaaacgtggctgct

SEQ ID NO: 5732176 - DNA, 22 bp, Homo sapiens
gaaaacgtggctgcttcaagga

SEQ ID NO: 5732177 - DNA, 20 bp, Homo sapiens
gaaaacgttttattgtgttt

SEQ ID NO: 5732178 - DNA, 17 bp, Homo sapiens
gaaaacgttttgtttga

SEQ ID NO: 5732179 - DNA, 13 bp, Homo sapiens
gaaaactaactca

SEQ ID NO: 5732180 - DNA, 14 bp, Homo sapiens
gaaaactaactcag

SEQ ID NO: 5732181 - DNA, 16 bp, Homo sapiens
gaaaactaaggatttt

SEQ ID NO: 5732182 - DNA, 17 bp, Homo sapiens
gaaaactacatgtaaaa

SEQ ID NO: 5732183 - DNA, 18 bp, Homo sapiens
gaaaactacattttaaca

SEQ ID NO: 5732184 - DNA, 20 bp, Homo sapiens
gaaaactacattttaacatg

SEQ ID NO: 5732185 - DNA, 21 bp, Homo sapiens
gaaaactacattttaacatgg

SEQ ID NO: 5732186 - DNA, 17 bp, Homo sapiens
gaaaactattccatgtt

SEQ ID NO: 5732187 - DNA, 21 bp, Homo sapiens
gaaaactattgagccttgcat

SEQ ID NO: 5732188 - DNA, 24 bp, Homo sapiens
gaaaactattgagccttgcatgta

SEQ ID NO: 5732189 - DNA, 20 bp, Homo sapiens
gaaaactcaaagaatgtgta

SEQ ID NO: 5732190 - DNA, 19 bp, Homo sapiens
gaaaactcaaccagagtca

SEQ ID NO: 5732191 - DNA, 16 bp, Homo sapiens
gaaaactcaccatttc

SEQ ID NO: 5732192 - DNA, 21 bp, Homo sapiens
gaaaactcatcgggagtgaat

SEQ ID NO: 5732193 - DNA, 18 bp, Homo sapiens
gaaaactccaccttccca

SEQ ID NO: 5732194 - DNA, 21 bp, Homo sapiens
gaaaactccagggtcccctgc

SEQ ID NO: 5732195 - DNA, 18 bp, Homo sapiens
gaaaactcccaatacaaa

SEQ ID NO: 5732196 - DNA, 23 bp, Homo sapiens
gaaaactctatgtccggctttaa

SEQ ID NO: 5732197 - DNA, 17 bp, Homo sapiens
gaaaactcttggcctct

SEQ ID NO: 5732198 - DNA, 20 bp, Homo sapiens
gaaaactcttggcctctgct

SEQ ID NO: 5732199 - DNA, 16 bp, Homo sapiens
gaaaactctttgctgc

SEQ ID NO: 5732200 - DNA, 18 bp, Homo sapiens
gaaaactgaaaatctaat

SEQ ID NO: 5732201 - DNA, 20 bp, Homo sapiens
gaaaactgaaaatctaatat

SEQ ID NO: 5732202 - DNA, 22 bp, Homo sapiens
gaaaactgaccatcagtatatt

SEQ ID NO: 5732203 - DNA, 16 bp, Homo sapiens
gaaaactgatttccca

SEQ ID NO: 5732204 - DNA, 12 bp, Homo sapiens
gaaaactgccac

SEQ ID NO: 5732205 - DNA, 13 bp, Homo sapiens
gaaaactgccaca

SEQ ID NO: 5732206 - DNA, 22 bp, Homo sapiens
gaaaactgcctgacctttggga

SEQ ID NO: 5732207 - DNA, 17 bp, Homo sapiens
gaaaactggaataagaa

SEQ ID NO: 5732208 - DNA, 21 bp, Homo sapiens
gaaaactgggtatgcgtttca

SEQ ID NO: 5732209 - DNA, 15 bp, Homo sapiens
gaaaactgtgatttc

SEQ ID NO: 5732210 - DNA, 23 bp, Homo sapiens
gaaaactgtgcaactttttaaag

SEQ ID NO: 5732211 - DNA, 13 bp, Homo sapiens
gaaaactgtgttg

SEQ ID NO: 5732212 - DNA, 19 bp, Homo sapiens
gaaaactgtgttgccacag

SEQ ID NO: 5732213 - DNA, 10 bp, Homo sapiens
gaaaactgtt

SEQ ID NO: 5732214 - DNA, 23 bp, Homo sapiens
gaaaactgttacctaaagtattt

SEQ ID NO: 5732215 - DNA, 18 bp, Homo sapiens
gaaaacttaaagaggaat

SEQ ID NO: 5732216 - DNA, 20 bp, Homo sapiens
gaaaacttaaagaggaatgg

SEQ ID NO: 5732217 - DNA, 19 bp, Homo sapiens
gaaaacttagaaataagaa

SEQ ID NO: 5732218 - DNA, 14 bp, Homo sapiens
gaaaacttatttga

SEQ ID NO: 5732219 - DNA, 15 bp, Homo sapiens
gaaaacttatttgag

SEQ ID NO: 5732220 - DNA, 16 bp, Homo sapiens
gaaaacttatttgagt

SEQ ID NO: 5732221 - DNA, 13 bp, Homo sapiens
gaaaacttatttt

SEQ ID NO: 5732222 - DNA, 12 bp, Homo sapiens
gaaaacttcaaa

SEQ ID NO: 5732223 - DNA, 17 bp, Homo sapiens
gaaaacttcactccaaa

SEQ ID NO: 5732224 - DNA, 23 bp, Homo sapiens
gaaaacttcactccaaagagaaa

SEQ ID NO: 5732225 - DNA, 23 bp, Homo sapiens
gaaaacttcgtaagaacatgtta

SEQ ID NO: 5732226 - DNA, 14 bp, Homo sapiens
gaaaacttctcatt

SEQ ID NO: 5732227 - DNA, 23 bp, Homo sapiens
gaaaacttctcatttatgttatt

SEQ ID NO: 5732228 - DNA, 19 bp, Homo sapiens
gaaaacttgtattatgtgt

SEQ ID NO: 5732229 - DNA, 21 bp, Homo sapiens
gaaaactttatgctaagtgaa

SEQ ID NO: 5732230 - DNA, 16 bp, Homo sapiens
gaaaactttgttaggc

SEQ ID NO: 5732231 - DNA, 18 bp, Homo sapiens
gaaaactttgttaggcca

SEQ ID NO: 5732232 - DNA, 16 bp, Homo sapiens
gaaaactttttcacag

SEQ ID NO: 5732233 - DNA, 19 bp, Homo sapiens
gaaaagaaaacatttaaca

SEQ ID NO: 5732234 - DNA, 21 bp, Homo sapiens
gaaaagaaaatttttgtagta

SEQ ID NO: 5732235 - DNA, 22 bp, Homo sapiens
gaaaagaaacaatatgctttac

SEQ ID NO: 5732236 - DNA, 12 bp, Homo sapiens
gaaaagaaagaa

SEQ ID NO: 5732237 - DNA, 21 bp, Homo sapiens
gaaaagaaagaagttattttc

SEQ ID NO: 5732238 - DNA, 17 bp, Homo sapiens
gaaaagaaagctgcttt

SEQ ID NO: 5732239 - DNA, 14 bp, Homo sapiens
gaaaagaaataata

SEQ ID NO: 5732240 - DNA, 18 bp, Homo sapiens
gaaaagaaatcaattttt

SEQ ID NO: 5732241 - DNA, 21 bp, Homo sapiens
gaaaagaaatctatagaaagt

SEQ ID NO: 5732242 - DNA, 22 bp, Homo sapiens
gaaaagaaatctatgattccag

SEQ ID NO: 5732243 - DNA, 18 bp, Homo sapiens
gaaaagaaattgtccttg

SEQ ID NO: 5732244 - DNA, 15 bp, Homo sapiens
gaaaagaacagaagg

SEQ ID NO: 5732245 - DNA, 19 bp, Homo sapiens
gaaaagaagaaagtctatg

SEQ ID NO: 5732246 - DNA, 13 bp, Homo sapiens
gaaaagaagctgt

SEQ ID NO: 5732247 - DNA, 15 bp, Homo sapiens
gaaaagaaggaaaga

SEQ ID NO: 5732248 - DNA, 22 bp, Homo sapiens
gaaaagaagtgaagtcttgggt

SEQ ID NO: 5732249 - DNA, 21 bp, Homo sapiens
gaaaagaatccctgcagcctg

SEQ ID NO: 5732250 - DNA, 14 bp, Homo sapiens
gaaaagaattacag

SEQ ID NO: 5732251 - DNA, 16 bp, Homo sapiens
gaaaagacaaatgtgc

SEQ ID NO: 5732252 - DNA, 19 bp, Homo sapiens
gaaaagacagggtgggagg

SEQ ID NO: 5732253 - DNA, 16 bp, Homo sapiens
gaaaagaccctgagac

SEQ ID NO: 5732254 - DNA, 18 bp, Homo sapiens
gaaaagacggatggcagg

SEQ ID NO: 5732255 - DNA, 17 bp, Homo sapiens
gaaaagactccaaagaa

SEQ ID NO: 5732256 - DNA, 17 bp, Homo sapiens
gaaaagactgtgggtgg

SEQ ID NO: 5732257 - DNA, 22 bp, Homo sapiens
gaaaagactgtgggtggggagg

SEQ ID NO: 5732258 - DNA, 22 bp, Homo sapiens
gaaaagacttttgttgaaatag

SEQ ID NO: 5732259 - DNA, 10 bp, Homo sapiens
gaaaagagaa

SEQ ID NO: 5732260 - DNA, 12 bp, Homo sapiens
gaaaagagaaaa

SEQ ID NO: 5732261 - DNA, 15 bp, Homo sapiens
gaaaagagaaaaaaa

SEQ ID NO: 5732262 - DNA, 12 bp, Homo sapiens
gaaaagagaaac

SEQ ID NO: 5732263 - DNA, 13 bp, Homo sapiens
gaaaagagaaact

SEQ ID NO: 5732264 - DNA, 16 bp, Homo sapiens
gaaaagagaagaagaa

SEQ ID NO: 5732265 - DNA, 19 bp, Homo sapiens
gaaaagagaagaagaaaaa

SEQ ID NO: 5732266 - DNA, 18 bp, Homo sapiens
gaaaagagacaggcaggt

SEQ ID NO: 5732267 - DNA, 11 bp, Homo sapiens
gaaaagagaga

SEQ ID NO: 5732268 - DNA, 15 bp, Homo sapiens
gaaaagagatatttt

SEQ ID NO: 5732269 - DNA, 19 bp, Homo sapiens
gaaaagagatattttaaaa

SEQ ID NO: 5732270 - DNA, 18 bp, Homo sapiens
gaaaagaggaaaaaaagc

SEQ ID NO: 5732271 - DNA, 14 bp, Homo sapiens
gaaaagaggagcca

SEQ ID NO: 5732272 - DNA, 22 bp, Homo sapiens
gaaaagagggagaagaaagaaa

SEQ ID NO: 5732273 - DNA, 13 bp, Homo sapiens
gaaaagagtgaat

SEQ ID NO: 5732274 - DNA, 19 bp, Homo sapiens
gaaaagataaagaccagaa

SEQ ID NO: 5732275 - DNA, 20 bp, Homo sapiens
gaaaagataaagaccagaaa

SEQ ID NO: 5732276 - DNA, 19 bp, Homo sapiens
gaaaagatacgactttatt

SEQ ID NO: 5732277 - DNA, 21 bp, Homo sapiens
gaaaagatatgtattctaatt

SEQ ID NO: 5732278 - DNA, 15 bp, Homo sapiens
gaaaagatccccaag

SEQ ID NO: 5732279 - DNA, 19 bp, Homo sapiens
gaaaagatgaatttgtcca

SEQ ID NO: 5732280 - DNA, 18 bp, Homo sapiens
gaaaagatgagaggcaga

SEQ ID NO: 5732281 - DNA, 11 bp, Homo sapiens
gaaaagatgca

SEQ ID NO: 5732282 - DNA, 21 bp, Homo sapiens
gaaaagatggtatcatatatt

SEQ ID NO: 5732283 - DNA, 14 bp, Homo sapiens
gaaaagatgtagat

SEQ ID NO: 5732284 - DNA, 18 bp, Homo sapiens
gaaaagatgtagatttat

SEQ ID NO: 5732285 - DNA, 15 bp, Homo sapiens
gaaaagatgtatgtt

SEQ ID NO: 5732286 - DNA, 18 bp, Homo sapiens
gaaaagatgttgtgtctt

SEQ ID NO: 5732287 - DNA, 23 bp, Homo sapiens
gaaaagattcttctgtgtttata

SEQ ID NO: 5732288 - DNA, 23 bp, Homo sapiens
gaaaagcaaaccttaatttgaaa

SEQ ID NO: 5732289 - DNA, 22 bp, Homo sapiens
gaaaagcaaatctgtataaatg

SEQ ID NO: 5732290 - DNA, 16 bp, Homo sapiens
gaaaagcaacattcat

SEQ ID NO: 5732291 - DNA, 16 bp, Homo sapiens
gaaaagcaatacaact

SEQ ID NO: 5732292 - DNA, 22 bp, Homo sapiens
gaaaagcacttttgttattcca

SEQ ID NO: 5732293 - DNA, 19 bp, Homo sapiens
gaaaagcagcccttggcca

SEQ ID NO: 5732294 - DNA, 14 bp, Homo sapiens
gaaaagcagctctc

SEQ ID NO: 5732295 - DNA, 16 bp, Homo sapiens
gaaaagcagttcatgt

SEQ ID NO: 5732296 - DNA, 20 bp, Homo sapiens
gaaaagcagttcatgtctga

SEQ ID NO: 5732297 - DNA, 14 bp, Homo sapiens
gaaaagcataacac

SEQ ID NO: 5732298 - DNA, 17 bp, Homo sapiens
gaaaagcatctgccaca

SEQ ID NO: 5732299 - DNA, 14 bp, Homo sapiens
gaaaagcattttca

SEQ ID NO: 5732300 - DNA, 15 bp, Homo sapiens
gaaaagccaaaggtc

SEQ ID NO: 5732301 - DNA, 17 bp, Homo sapiens
gaaaagccatatctagt

SEQ ID NO: 5732302 - DNA, 22 bp, Homo sapiens
gaaaagccatatctagtcaata

SEQ ID NO: 5732303 - DNA, 15 bp, Homo sapiens
gaaaagccatgttta

SEQ ID NO: 5732304 - DNA, 16 bp, Homo sapiens
gaaaagccatgtttaa

SEQ ID NO: 5732305 - DNA, 20 bp, Homo sapiens
gaaaagccatgtttaagatt

SEQ ID NO: 5732306 - DNA, 21 bp, Homo sapiens
gaaaagccatgtttaagattt

SEQ ID NO: 5732307 - DNA, 15 bp, Homo sapiens
gaaaagcccacataa

SEQ ID NO: 5732308 - DNA, 20 bp, Homo sapiens
gaaaagcccacataagtttt

SEQ ID NO: 5732309 - DNA, 21 bp, Homo sapiens
gaaaagcccagtgacctgacc

SEQ ID NO: 5732310 - DNA, 22 bp, Homo sapiens
gaaaagccctcatcttctcttt

SEQ ID NO: 5732311 - DNA, 23 bp, Homo sapiens
gaaaagccgaaagggttaatcat

SEQ ID NO: 5732312 - DNA, 15 bp, Homo sapiens
gaaaagcctcagctc

SEQ ID NO: 5732313 - DNA, 21 bp, Homo sapiens
gaaaagcctctgtgtcactgg

SEQ ID NO: 5732314 - DNA, 15 bp, Homo sapiens
gaaaagcctctgttt

SEQ ID NO: 5732315 - DNA, 18 bp, Homo sapiens
gaaaagcctgaactattt

SEQ ID NO: 5732316 - DNA, 22 bp, Homo sapiens
gaaaagcctgggtttggtgtat

SEQ ID NO: 5732317 - DNA, 16 bp, Homo sapiens
gaaaagccttcttata

SEQ ID NO: 5732318 - DNA, 15 bp, Homo sapiens
gaaaagcgcgttgtg

SEQ ID NO: 5732319 - DNA, 18 bp, Homo sapiens
gaaaagcggacatcagct

SEQ ID NO: 5732320 - DNA, 12 bp, Homo sapiens
gaaaagcgtctt

SEQ ID NO: 5732321 - DNA, 20 bp, Homo sapiens
gaaaagcgtctttaagagac

SEQ ID NO: 5732322 - DNA, 21 bp, Homo sapiens
gaaaagcgtctttaagagact

SEQ ID NO: 5732323 - DNA, 13 bp, Homo sapiens
gaaaagctatctt

SEQ ID NO: 5732324 - DNA, 24 bp, Homo sapiens
gaaaagctatcttaaaatatagaa

SEQ ID NO: 5732325 - DNA, 19 bp, Homo sapiens
gaaaagctattagccagga

SEQ ID NO: 5732326 - DNA, 20 bp, Homo sapiens
gaaaagctattagccaggat

SEQ ID NO: 5732327 - DNA, 13 bp, Homo sapiens
gaaaagctgctga

SEQ ID NO: 5732328 - DNA, 18 bp, Homo sapiens
gaaaagctgtgtacttta

SEQ ID NO: 5732329 - DNA, 15 bp, Homo sapiens
gaaaagctgttccca

SEQ ID NO: 5732330 - DNA, 23 bp, Homo sapiens
gaaaagcttagctttagaaacag

SEQ ID NO: 5732331 - DNA, 16 bp, Homo sapiens
gaaaagcttcttaatt

SEQ ID NO: 5732332 - DNA, 15 bp, Homo sapiens
gaaaagctttcctga

SEQ ID NO: 5732333 - DNA, 12 bp, Homo sapiens
gaaaaggaaaaa

SEQ ID NO: 5732334 - DNA, 19 bp, Homo sapiens
gaaaaggaacggcttcctc

SEQ ID NO: 5732335 - DNA, 13 bp, Homo sapiens
gaaaaggaagact

SEQ ID NO: 5732336 - DNA, 20 bp, Homo sapiens
gaaaaggaagactagaggct

SEQ ID NO: 5732337 - DNA, 19 bp, Homo sapiens
gaaaaggaaggtagttcaa

SEQ ID NO: 5732338 - DNA, 18 bp, Homo sapiens
gaaaaggaatgcaagaga

SEQ ID NO: 5732339 - DNA, 21 bp, Homo sapiens
gaaaaggaatgcaagagaagg

SEQ ID NO: 5732340 - DNA, 19 bp, Homo sapiens
gaaaaggacaaataaagca

SEQ ID NO: 5732341 - DNA, 19 bp, Homo sapiens
gaaaaggagaaaggagctc

SEQ ID NO: 5732342 - DNA, 17 bp, Homo sapiens
gaaaaggagaggaaact

SEQ ID NO: 5732343 - DNA, 19 bp, Homo sapiens
gaaaaggaggccattctga

SEQ ID NO: 5732344 - DNA, 16 bp, Homo sapiens
gaaaaggaggggacgg

SEQ ID NO: 5732345 - DNA, 17 bp, Homo sapiens
gaaaaggagtcaagaac

SEQ ID NO: 5732346 - DNA, 21 bp, Homo sapiens
gaaaaggatattatctacctg

SEQ ID NO: 5732347 - DNA, 14 bp, Homo sapiens
gaaaaggatctaag

SEQ ID NO: 5732348 - DNA, 19 bp, Homo sapiens
gaaaaggatctaagggaag

SEQ ID NO: 5732349 - DNA, 22 bp, Homo sapiens
gaaaaggatgatggaaaaatca

SEQ ID NO: 5732350 - DNA, 13 bp, Homo sapiens
gaaaaggcagcca

SEQ ID NO: 5732351 - DNA, 17 bp, Homo sapiens
gaaaaggcagccagatc

SEQ ID NO: 5732352 - DNA, 23 bp, Homo sapiens
gaaaaggcagccagatccccagg

SEQ ID NO: 5732353 - DNA, 20 bp, Homo sapiens
gaaaaggctgcagctaattt

SEQ ID NO: 5732354 - DNA, 18 bp, Homo sapiens
gaaaaggctggcaaggtg

SEQ ID NO: 5732355 - DNA, 13 bp, Homo sapiens
gaaaagggaaaaa

SEQ ID NO: 5732356 - DNA, 14 bp, Homo sapiens
gaaaagggaaaaaa

SEQ ID NO: 5732357 - DNA, 15 bp, Homo sapiens
gaaaagggaaaaaag

SEQ ID NO: 5732358 - DNA, 18 bp, Homo sapiens
gaaaagggaaaaaagaaa

SEQ ID NO: 5732359 - DNA, 14 bp, Homo sapiens
gaaaagggagaaaa

SEQ ID NO: 5732360 - DNA, 17 bp, Homo sapiens
gaaaagggagaaaaaga

SEQ ID NO: 5732361 - DNA, 22 bp, Homo sapiens
gaaaagggatgctgtaggttga

SEQ ID NO: 5732362 - DNA, 18 bp, Homo sapiens
gaaaagggcactcccaac

SEQ ID NO: 5732363 - DNA, 15 bp, Homo sapiens
gaaaagggcagaggc

SEQ ID NO: 5732364 - DNA, 19 bp, Homo sapiens
gaaaagggcaggagcctag

SEQ ID NO: 5732365 - DNA, 19 bp, Homo sapiens
gaaaagggcggaagagtta

SEQ ID NO: 5732366 - DNA, 13 bp, Homo sapiens
gaaaaggggagca

SEQ ID NO: 5732367 - DNA, 21 bp, Homo sapiens
gaaaaggggagcacaaggcct

SEQ ID NO: 5732368 - DNA, 14 bp, Homo sapiens
gaaaagggtcttct

SEQ ID NO: 5732369 - DNA, 21 bp, Homo sapiens
gaaaagggtcttgggaaatat

SEQ ID NO: 5732370 - DNA, 23 bp, Homo sapiens
gaaaaggtagaggagtcacgtta

SEQ ID NO: 5732371 - DNA, 13 bp, Homo sapiens
gaaaaggtccttg

SEQ ID NO: 5732372 - DNA, 18 bp, Homo sapiens
gaaaaggtgataaaatca

SEQ ID NO: 5732373 - DNA, 13 bp, Homo sapiens
gaaaaggtgtaaa

SEQ ID NO: 5732374 - DNA, 20 bp, Homo sapiens
gaaaaggtgtccttttcctt

SEQ ID NO: 5732375 - DNA, 18 bp, Homo sapiens
gaaaaggttaaatacctg

SEQ ID NO: 5732376 - DNA, 16 bp, Homo sapiens
gaaaaggttgaataat

SEQ ID NO: 5732377 - DNA, 13 bp, Homo sapiens
gaaaagtaaaaaa

SEQ ID NO: 5732378 - DNA, 17 bp, Homo sapiens
gaaaagtaaaacactct

SEQ ID NO: 5732379 - DNA, 15 bp, Homo sapiens
gaaaagtaagggaat

SEQ ID NO: 5732380 - DNA, 14 bp, Homo sapiens
gaaaagtaatattt

SEQ ID NO: 5732381 - DNA, 17 bp, Homo sapiens
gaaaagtaattttgtca

SEQ ID NO: 5732382 - DNA, 14 bp, Homo sapiens
gaaaagtacattta

SEQ ID NO: 5732383 - DNA, 13 bp, Homo sapiens
gaaaagtagaatt

SEQ ID NO: 5732384 - DNA, 17 bp, Homo sapiens
gaaaagtagaattatat

SEQ ID NO: 5732385 - DNA, 21 bp, Homo sapiens
gaaaagtagaattatatctaa

SEQ ID NO: 5732386 - DNA, 20 bp, Homo sapiens
gaaaagtatattgataacct

SEQ ID NO: 5732387 - DNA, 19 bp, Homo sapiens
gaaaagtatgttctaacct

SEQ ID NO: 5732388 - DNA, 16 bp, Homo sapiens
gaaaagtattctcaaa

SEQ ID NO: 5732389 - DNA, 22 bp, Homo sapiens
gaaaagtcaagggtagggtggg

SEQ ID NO: 5732390 - DNA, 19 bp, Homo sapiens
gaaaagtcacacagacaca

SEQ ID NO: 5732391 - DNA, 23 bp, Homo sapiens
gaaaagtcattcagttatcacta

SEQ ID NO: 5732392 - DNA, 19 bp, Homo sapiens
gaaaagtgaatcttgctgt

SEQ ID NO: 5732393 - DNA, 16 bp, Homo sapiens
gaaaagtgaatgctca

SEQ ID NO: 5732394 - DNA, 16 bp, Homo sapiens
gaaaagtgatgtattt

SEQ ID NO: 5732395 - DNA, 19 bp, Homo sapiens
gaaaagtgcctgagctggg

SEQ ID NO: 5732396 - DNA, 21 bp, Homo sapiens
gaaaagtgcctgagctgggga

SEQ ID NO: 5732397 - DNA, 18 bp, Homo sapiens
gaaaagtgcttagaaagt

SEQ ID NO: 5732398 - DNA, 21 bp, Homo sapiens
gaaaagtgttagggattcctt

SEQ ID NO: 5732399 - DNA, 15 bp, Homo sapiens
gaaaagtgttattat

SEQ ID NO: 5732400 - DNA, 20 bp, Homo sapiens
gaaaagttaaactaaaaaaa

SEQ ID NO: 5732401 - DNA, 18 bp, Homo sapiens
gaaaagttattggcatgg

SEQ ID NO: 5732402 - DNA, 22 bp, Homo sapiens
gaaaagttcaatactcttgaaa

SEQ ID NO: 5732403 - DNA, 16 bp, Homo sapiens
gaaaagttctttcaac

SEQ ID NO: 5732404 - DNA, 20 bp, Homo sapiens
gaaaagttgcagatgtattg

SEQ ID NO: 5732405 - DNA, 18 bp, Homo sapiens
gaaaagttgctcttaaaa

SEQ ID NO: 5732406 - DNA, 20 bp, Homo sapiens
gaaaagttgctgaaagggaa

SEQ ID NO: 5732407 - DNA, 20 bp, Homo sapiens
gaaaagttggaaggatctgc

SEQ ID NO: 5732408 - DNA, 14 bp, Homo sapiens
gaaaagttgtctta

SEQ ID NO: 5732409 - DNA, 22 bp, Homo sapiens
gaaaagtttaacctaaataatt

SEQ ID NO: 5732410 - DNA, 15 bp, Homo sapiens
gaaaagtttaatatt

SEQ ID NO: 5732411 - DNA, 20 bp, Homo sapiens
gaaaagtttaatattaaagc

SEQ ID NO: 5732412 - DNA, 22 bp, Homo sapiens
gaaaagtttaatattaaagcca

SEQ ID NO: 5732413 - DNA, 13 bp, Homo sapiens
gaaaagtttccta

SEQ ID NO: 5732414 - DNA, 12 bp, Homo sapiens
gaaaataaaaag

SEQ ID NO: 5732415 - DNA, 15 bp, Homo sapiens
gaaaataaaaagaga

SEQ ID NO: 5732416 - DNA, 18 bp, Homo sapiens
gaaaataaaaagagaaac

SEQ ID NO: 5732417 - DNA, 15 bp, Homo sapiens
gaaaataaaaagtta

SEQ ID NO: 5732418 - DNA, 16 bp, Homo sapiens
gaaaataaaacacacc

SEQ ID NO: 5732419 - DNA, 18 bp, Homo sapiens
gaaaataaaacacacctc

SEQ ID NO: 5732420 - DNA, 15 bp, Homo sapiens
gaaaataaaataaac

SEQ ID NO: 5732421 - DNA, 19 bp, Homo sapiens
gaaaataaaataaacgaaa

SEQ ID NO: 5732422 - DNA, 16 bp, Homo sapiens
gaaaataaaataaatt

SEQ ID NO: 5732423 - DNA, 20 bp, Homo sapiens
gaaaataaaatattcactct

SEQ ID NO: 5732424 - DNA, 22 bp, Homo sapiens
gaaaataaacagacaaaaacaa

SEQ ID NO: 5732425 - DNA, 21 bp, Homo sapiens
gaaaataaactcataaaactc

SEQ ID NO: 5732426 - DNA, 13 bp, Homo sapiens
gaaaataaagaat

SEQ ID NO: 5732427 - DNA, 16 bp, Homo sapiens
gaaaataaagaatgga

SEQ ID NO: 5732428 - DNA, 23 bp, Homo sapiens
gaaaataaagacaaccatattta

SEQ ID NO: 5732429 - DNA, 17 bp, Homo sapiens
gaaaataaagcagaagc

SEQ ID NO: 5732430 - DNA, 18 bp, Homo sapiens
gaaaataaagcagaagca

SEQ ID NO: 5732431 - DNA, 11 bp, Homo sapiens
gaaaataaagt

SEQ ID NO: 5732432 - DNA, 23 bp, Homo sapiens
gaaaataaatcaatgctataact

SEQ ID NO: 5732433 - DNA, 23 bp, Homo sapiens
gaaaataacagagctggatgctg

SEQ ID NO: 5732434 - DNA, 16 bp, Homo sapiens
gaaaataacagatgct

SEQ ID NO: 5732435 - DNA, 13 bp, Homo sapiens
gaaaataactgaa

SEQ ID NO: 5732436 - DNA, 14 bp, Homo sapiens
gaaaataactgaac

SEQ ID NO: 5732437 - DNA, 20 bp, Homo sapiens
gaaaataagaaagaattgca

SEQ ID NO: 5732438 - DNA, 23 bp, Homo sapiens
gaaaataagacaatagtatttct

SEQ ID NO: 5732439 - DNA, 23 bp, Homo sapiens
gaaaataagacttctggtgctgc

SEQ ID NO: 5732440 - DNA, 19 bp, Homo sapiens
gaaaataagtgaataataa

SEQ ID NO: 5732441 - DNA, 17 bp, Homo sapiens
gaaaataataaaagaat

SEQ ID NO: 5732442 - DNA, 13 bp, Homo sapiens
gaaaataatccat

SEQ ID NO: 5732443 - DNA, 22 bp, Homo sapiens
gaaaataatctggtgttcttgc

SEQ ID NO: 5732444 - DNA, 17 bp, Homo sapiens
gaaaataatgcaaatgt

SEQ ID NO: 5732445 - DNA, 22 bp, Homo sapiens
gaaaataatggagaatcacttt

SEQ ID NO: 5732446 - DNA, 14 bp, Homo sapiens
gaaaataattctct

SEQ ID NO: 5732447 - DNA, 18 bp, Homo sapiens
gaaaataattctctatta

SEQ ID NO: 5732448 - DNA, 11 bp, Homo sapiens
gaaaataattg

SEQ ID NO: 5732449 - DNA, 17 bp, Homo sapiens
gaaaataatttgttgta

SEQ ID NO: 5732450 - DNA, 20 bp, Homo sapiens
gaaaataatttgttgtactt

SEQ ID NO: 5732451 - DNA, 18 bp, Homo sapiens
gaaaataattttccaagt

SEQ ID NO: 5732452 - DNA, 15 bp, Homo sapiens
gaaaatacaataaac

SEQ ID NO: 5732453 - DNA, 20 bp, Homo sapiens
gaaaatacattattagaata

SEQ ID NO: 5732454 - DNA, 20 bp, Homo sapiens
gaaaataccataggaagaca

SEQ ID NO: 5732455 - DNA, 19 bp, Homo sapiens
gaaaatacctattttatat

SEQ ID NO: 5732456 - DNA, 21 bp, Homo sapiens
gaaaatacctattttatatga

SEQ ID NO: 5732457 - DNA, 22 bp, Homo sapiens
gaaaatacgagaaaatctgcat

SEQ ID NO: 5732458 - DNA, 15 bp, Homo sapiens
gaaaatactggaatt

SEQ ID NO: 5732459 - DNA, 21 bp, Homo sapiens
gaaaataggatttgcactgct

SEQ ID NO: 5732460 - DNA, 19 bp, Homo sapiens
gaaaataggcaggaagccc

SEQ ID NO: 5732461 - DNA, 18 bp, Homo sapiens
gaaaatagggtccttgaa

SEQ ID NO: 5732462 - DNA, 15 bp, Homo sapiens
gaaaatagtcctcca

SEQ ID NO: 5732463 - DNA, 22 bp, Homo sapiens
gaaaatagtcctccaaaacaca

SEQ ID NO: 5732464 - DNA, 20 bp, Homo sapiens
gaaaatagtgtaagaactgt

SEQ ID NO: 5732465 - DNA, 21 bp, Homo sapiens
gaaaatagtgtaagaactgta

SEQ ID NO: 5732466 - DNA, 16 bp, Homo sapiens
gaaaatagttcccttt

SEQ ID NO: 5732467 - DNA, 14 bp, Homo sapiens
gaaaatagtttatt

SEQ ID NO: 5732468 - DNA, 13 bp, Homo sapiens
gaaaatagtttgt

SEQ ID NO: 5732469 - DNA, 14 bp, Homo sapiens
gaaaatagtttgtt

SEQ ID NO: 5732470 - DNA, 15 bp, Homo sapiens
gaaaatataaatgca

SEQ ID NO: 5732471 - DNA, 17 bp, Homo sapiens
gaaaatatactgtaaag

SEQ ID NO: 5732472 - DNA, 18 bp, Homo sapiens
gaaaatatactgtaaaga

SEQ ID NO: 5732473 - DNA, 12 bp, Homo sapiens
gaaaatatatat

SEQ ID NO: 5732474 - DNA, 14 bp, Homo sapiens
gaaaatatatgcct

SEQ ID NO: 5732475 - DNA, 22 bp, Homo sapiens
gaaaatatatgtatttttatat

SEQ ID NO: 5732476 - DNA, 12 bp, Homo sapiens
gaaaatatcact

SEQ ID NO: 5732477 - DNA, 12 bp, Homo sapiens
gaaaatatgata

SEQ ID NO: 5732478 - DNA, 16 bp, Homo sapiens
gaaaatatgtactgta

SEQ ID NO: 5732479 - DNA, 11 bp, Homo sapiens
gaaaatatgtt

SEQ ID NO: 5732480 - DNA, 21 bp, Homo sapiens
gaaaatattatgtgtttccat

SEQ ID NO: 5732481 - DNA, 13 bp, Homo sapiens
gaaaatattctct

SEQ ID NO: 5732482 - DNA, 15 bp, Homo sapiens
gaaaatattgtttta

SEQ ID NO: 5732483 - DNA, 16 bp, Homo sapiens
gaaaatatttctatgt

SEQ ID NO: 5732484 - DNA, 21 bp, Homo sapiens
gaaaatatttttttcctttgc

SEQ ID NO: 5732485 - DNA, 17 bp, Homo sapiens
gaaaatatttttttcta

SEQ ID NO: 5732486 - DNA, 24 bp, Homo sapiens
gaaaatcaaaccgagcagggctgt

SEQ ID NO: 5732487 - DNA, 13 bp, Homo sapiens
gaaaatcaaagca

SEQ ID NO: 5732488 - DNA, 16 bp, Homo sapiens
gaaaatcaaagcagtc

SEQ ID NO: 5732489 - DNA, 14 bp, Homo sapiens
gaaaatcaaagtaa

SEQ ID NO: 5732490 - DNA, 17 bp, Homo sapiens
gaaaatcaagatgagat

SEQ ID NO: 5732491 - DNA, 16 bp, Homo sapiens
gaaaatcaccattccg

SEQ ID NO: 5732492 - DNA, 18 bp, Homo sapiens
gaaaatcagcaacttcta

SEQ ID NO: 5732493 - DNA, 20 bp, Homo sapiens
gaaaatcagttatattcttt

SEQ ID NO: 5732494 - DNA, 13 bp, Homo sapiens
gaaaatcatattg

SEQ ID NO: 5732495 - DNA, 16 bp, Homo sapiens
gaaaatcatattgaga

SEQ ID NO: 5732496 - DNA, 17 bp, Homo sapiens
gaaaatcatattgagaa

SEQ ID NO: 5732497 - DNA, 14 bp, Homo sapiens
gaaaatcatattgc

SEQ ID NO: 5732498 - DNA, 13 bp, Homo sapiens
gaaaatcctacca

SEQ ID NO: 5732499 - DNA, 22 bp, Homo sapiens
gaaaatccttttaaccatttta

SEQ ID NO: 5732500 - DNA, 20 bp, Homo sapiens
gaaaatctaatattaaaaat

SEQ ID NO: 5732501 - DNA, 21 bp, Homo sapiens
gaaaatctaatattaaaaata

SEQ ID NO: 5732502 - DNA, 21 bp, Homo sapiens
gaaaatctatatttgtcttcc

SEQ ID NO: 5732503 - DNA, 20 bp, Homo sapiens
gaaaatctgtaaaaaagaaa

SEQ ID NO: 5732504 - DNA, 18 bp, Homo sapiens
gaaaatcttataatttaa

SEQ ID NO: 5732505 - DNA, 20 bp, Homo sapiens
gaaaatcttataatttaaaa

SEQ ID NO: 5732506 - DNA, 16 bp, Homo sapiens
gaaaatcttcactttc

SEQ ID NO: 5732507 - DNA, 16 bp, Homo sapiens
gaaaatctttcctctt

SEQ ID NO: 5732508 - DNA, 16 bp, Homo sapiens
gaaaatctttgttgaa

SEQ ID NO: 5732509 - DNA, 13 bp, Homo sapiens
gaaaatgaaaaga

SEQ ID NO: 5732510 - DNA, 13 bp, Homo sapiens
gaaaatgaaagct

SEQ ID NO: 5732511 - DNA, 12 bp, Homo sapiens
gaaaatgaaatc

SEQ ID NO: 5732512 - DNA, 16 bp, Homo sapiens
gaaaatgaactgcttt

SEQ ID NO: 5732513 - DNA, 22 bp, Homo sapiens
gaaaatgaatatctattaatat

SEQ ID NO: 5732514 - DNA, 16 bp, Homo sapiens
gaaaatgaatccctct

SEQ ID NO: 5732515 - DNA, 23 bp, Homo sapiens
gaaaatgaatttgggatactaaa

SEQ ID NO: 5732516 - DNA, 14 bp, Homo sapiens
gaaaatgacttatt

SEQ ID NO: 5732517 - DNA, 18 bp, Homo sapiens
gaaaatgacttatttctg

SEQ ID NO: 5732518 - DNA, 19 bp, Homo sapiens
gaaaatgagaaaggacaga

SEQ ID NO: 5732519 - DNA, 16 bp, Homo sapiens
gaaaatgagcatcaga

SEQ ID NO: 5732520 - DNA, 12 bp, Homo sapiens
gaaaatgagccc

SEQ ID NO: 5732521 - DNA, 17 bp, Homo sapiens
gaaaatgagccctggct

SEQ ID NO: 5732522 - DNA, 14 bp, Homo sapiens
gaaaatgaggagga

SEQ ID NO: 5732523 - DNA, 19 bp, Homo sapiens
gaaaatgagtatttggtcc

SEQ ID NO: 5732524 - DNA, 15 bp, Homo sapiens
gaaaatgatacagca

SEQ ID NO: 5732525 - DNA, 16 bp, Homo sapiens
gaaaatgatctgagtc

SEQ ID NO: 5732526 - DNA, 16 bp, Homo sapiens
gaaaatgcaaaatgaa

SEQ ID NO: 5732527 - DNA, 15 bp, Homo sapiens
gaaaatgcaccaaat

SEQ ID NO: 5732528 - DNA, 14 bp, Homo sapiens
gaaaatgcagcagg

SEQ ID NO: 5732529 - DNA, 22 bp, Homo sapiens
gaaaatgcagcagggatgccct

SEQ ID NO: 5732530 - DNA, 16 bp, Homo sapiens
gaaaatgcaggagagc

SEQ ID NO: 5732531 - DNA, 18 bp, Homo sapiens
gaaaatgcaggagagctt

SEQ ID NO: 5732532 - DNA, 15 bp, Homo sapiens
gaaaatgcattatgt

SEQ ID NO: 5732533 - DNA, 13 bp, Homo sapiens
gaaaatgcatttt

SEQ ID NO: 5732534 - DNA, 18 bp, Homo sapiens
gaaaatgcattttcttca

SEQ ID NO: 5732535 - DNA, 23 bp, Homo sapiens
gaaaatgccacattttgctttat

SEQ ID NO: 5732536 - DNA, 19 bp, Homo sapiens
gaaaatgctagaagaaaac

SEQ ID NO: 5732537 - DNA, 16 bp, Homo sapiens
gaaaatgctcttaaaa

SEQ ID NO: 5732538 - DNA, 18 bp, Homo sapiens
gaaaatgctcttaaaata

SEQ ID NO: 5732539 - DNA, 20 bp, Homo sapiens
gaaaatgctcttaaaatatc

SEQ ID NO: 5732540 - DNA, 22 bp, Homo sapiens
gaaaatgctcttaaaatatctt

SEQ ID NO: 5732541 - DNA, 15 bp, Homo sapiens
gaaaatgctggctga

SEQ ID NO: 5732542 - DNA, 19 bp, Homo sapiens
gaaaatgcttaaaaaataa

SEQ ID NO: 5732543 - DNA, 23 bp, Homo sapiens
gaaaatgcttattgatgaggttt

SEQ ID NO: 5732544 - DNA, 15 bp, Homo sapiens
gaaaatggaaaatat

SEQ ID NO: 5732545 - DNA, 20 bp, Homo sapiens
gaaaatggaaaatatacaag

SEQ ID NO: 5732546 - DNA, 13 bp, Homo sapiens
gaaaatggaaaga

SEQ ID NO: 5732547 - DNA, 14 bp, Homo sapiens
gaaaatggaacatt

SEQ ID NO: 5732548 - DNA, 15 bp, Homo sapiens
gaaaatggaaccagg

SEQ ID NO: 5732549 - DNA, 17 bp, Homo sapiens
gaaaatggaagacctaa

SEQ ID NO: 5732550 - DNA, 21 bp, Homo sapiens
gaaaatggaagacctaaggca

SEQ ID NO: 5732551 - DNA, 20 bp, Homo sapiens
gaaaatggaattactccaaa

SEQ ID NO: 5732552 - DNA, 19 bp, Homo sapiens
gaaaatggacattgagata

SEQ ID NO: 5732553 - DNA, 19 bp, Homo sapiens
gaaaatggacgtgttatga

SEQ ID NO: 5732554 - DNA, 22 bp, Homo sapiens
gaaaatggatatagaaaatctt

SEQ ID NO: 5732555 - DNA, 16 bp, Homo sapiens
gaaaatggcagaaaga

SEQ ID NO: 5732556 - DNA, 18 bp, Homo sapiens
gaaaatggccatgcagga

SEQ ID NO: 5732557 - DNA, 21 bp, Homo sapiens
gaaaatggctaataaactgta

SEQ ID NO: 5732558 - DNA, 22 bp, Homo sapiens
gaaaatggctaataaactgtat

SEQ ID NO: 5732559 - DNA, 20 bp, Homo sapiens
gaaaatggctgaagaaacac

SEQ ID NO: 5732560 - DNA, 22 bp, Homo sapiens
gaaaatggctgaagaaacacag

SEQ ID NO: 5732561 - DNA, 22 bp, Homo sapiens
gaaaatggtcgagaaagaggca

SEQ ID NO: 5732562 - DNA, 23 bp, Homo sapiens
gaaaatggtttattttgtattgt

SEQ ID NO: 5732563 - DNA, 21 bp, Homo sapiens
gaaaatgtaaaaaacaaaaac

SEQ ID NO: 5732564 - DNA, 17 bp, Homo sapiens
gaaaatgtaaaggaggg

SEQ ID NO: 5732565 - DNA, 23 bp, Homo sapiens
gaaaatgtaacttttcttacagc

SEQ ID NO: 5732566 - DNA, 16 bp, Homo sapiens
gaaaatgtaagtaaat

SEQ ID NO: 5732567 - DNA, 20 bp, Homo sapiens
gaaaatgtaagtaaatgtct

SEQ ID NO: 5732568 - DNA, 12 bp, Homo sapiens
gaaaatgtacat

SEQ ID NO: 5732569 - DNA, 19 bp, Homo sapiens
gaaaatgtacatactatgt

SEQ ID NO: 5732570 - DNA, 22 bp, Homo sapiens
gaaaatgtacatactatgttca

SEQ ID NO: 5732571 - DNA, 18 bp, Homo sapiens
gaaaatgtatattttgat

SEQ ID NO: 5732572 - DNA, 21 bp, Homo sapiens
gaaaatgtattattgtaaagt

SEQ ID NO: 5732573 - DNA, 19 bp, Homo sapiens
gaaaatgtattcctttaaa

SEQ ID NO: 5732574 - DNA, 13 bp, Homo sapiens
gaaaatgtatttg

SEQ ID NO: 5732575 - DNA, 17 bp, Homo sapiens
gaaaatgtcaacctttg

SEQ ID NO: 5732576 - DNA, 21 bp, Homo sapiens
gaaaatgtcagaaaccagtta

SEQ ID NO: 5732577 - DNA, 15 bp, Homo sapiens
gaaaatgtcctgtgg

SEQ ID NO: 5732578 - DNA, 23 bp, Homo sapiens
gaaaatgtctattcaaaatatca

SEQ ID NO: 5732579 - DNA, 22 bp, Homo sapiens
gaaaatgtctgtaataatagac

SEQ ID NO: 5732580 - DNA, 11 bp, Homo sapiens
gaaaatgtctt

SEQ ID NO: 5732581 - DNA, 14 bp, Homo sapiens
gaaaatgtcttgtg

SEQ ID NO: 5732582 - DNA, 16 bp, Homo sapiens
gaaaatgtgaagctga

SEQ ID NO: 5732583 - DNA, 17 bp, Homo sapiens
gaaaatgtgtaattcaa

SEQ ID NO: 5732584 - DNA, 12 bp, Homo sapiens
gaaaatgtgtat

SEQ ID NO: 5732585 - DNA, 19 bp, Homo sapiens
gaaaatgtgtcctatctat

SEQ ID NO: 5732586 - DNA, 22 bp, Homo sapiens
gaaaatgtgtctctgctttcct

SEQ ID NO: 5732587 - DNA, 22 bp, Homo sapiens
gaaaatgtgtctgcaacatgga

SEQ ID NO: 5732588 - DNA, 15 bp, Homo sapiens
gaaaatgtgtgtgtg

SEQ ID NO: 5732589 - DNA, 19 bp, Homo sapiens
gaaaatgtgtttgctgcct

SEQ ID NO: 5732590 - DNA, 22 bp, Homo sapiens
gaaaatgttacggcatcacact

SEQ ID NO: 5732591 - DNA, 21 bp, Homo sapiens
gaaaatgtttatgccacagaa

SEQ ID NO: 5732592 - DNA, 14 bp, Homo sapiens
gaaaattaaaataa

SEQ ID NO: 5732593 - DNA, 23 bp, Homo sapiens
gaaaattaagggccgatttaatt

SEQ ID NO: 5732594 - DNA, 13 bp, Homo sapiens
gaaaattaatatc

SEQ ID NO: 5732595 - DNA, 15 bp, Homo sapiens
gaaaattaatatcac

SEQ ID NO: 5732596 - DNA, 18 bp, Homo sapiens
gaaaattaattatatttc

SEQ ID NO: 5732597 - DNA, 19 bp, Homo sapiens
gaaaattaattatatttct

SEQ ID NO: 5732598 - DNA, 17 bp, Homo sapiens
gaaaattaattctaaac

SEQ ID NO: 5732599 - DNA, 20 bp, Homo sapiens
gaaaattaattctaaactta

SEQ ID NO: 5732600 - DNA, 22 bp, Homo sapiens
gaaaattacagtccaaaatact

SEQ ID NO: 5732601 - DNA, 17 bp, Homo sapiens
gaaaattacatgttttt

SEQ ID NO: 5732602 - DNA, 14 bp, Homo sapiens
gaaaattagactgt

SEQ ID NO: 5732603 - DNA, 18 bp, Homo sapiens
gaaaattagactgtgatt

SEQ ID NO: 5732604 - DNA, 23 bp, Homo sapiens
gaaaattagcttttagttttaaa

SEQ ID NO: 5732605 - DNA, 15 bp, Homo sapiens
gaaaattatattctg

SEQ ID NO: 5732606 - DNA, 16 bp, Homo sapiens
gaaaattatattctgt

SEQ ID NO: 5732607 - DNA, 14 bp, Homo sapiens
gaaaattatgcaaa

SEQ ID NO: 5732608 - DNA, 22 bp, Homo sapiens
gaaaattattccttgctttcat

SEQ ID NO: 5732609 - DNA, 16 bp, Homo sapiens
gaaaattattctataa

SEQ ID NO: 5732610 - DNA, 15 bp, Homo sapiens
gaaaattatttgcat

SEQ ID NO: 5732611 - DNA, 12 bp, Homo sapiens
gaaaattatttt

SEQ ID NO: 5732612 - DNA, 22 bp, Homo sapiens
gaaaattattttgttcatacat

SEQ ID NO: 5732613 - DNA, 21 bp, Homo sapiens
gaaaattcaaaaagtgtttat

SEQ ID NO: 5732614 - DNA, 17 bp, Homo sapiens
gaaaattcaaaggtgga

SEQ ID NO: 5732615 - DNA, 18 bp, Homo sapiens
gaaaattcagataatggt

SEQ ID NO: 5732616 - DNA, 16 bp, Homo sapiens
gaaaattcaggtctgt

SEQ ID NO: 5732617 - DNA, 16 bp, Homo sapiens
gaaaattcatttcaca

SEQ ID NO: 5732618 - DNA, 13 bp, Homo sapiens
gaaaattcatttt

SEQ ID NO: 5732619 - DNA, 11 bp, Homo sapiens
gaaaattccaa

SEQ ID NO: 5732620 - DNA, 12 bp, Homo sapiens
gaaaattccaat

SEQ ID NO: 5732621 - DNA, 14 bp, Homo sapiens
gaaaattccagaaa

SEQ ID NO: 5732622 - DNA, 13 bp, Homo sapiens
gaaaattcctaga

SEQ ID NO: 5732623 - DNA, 18 bp, Homo sapiens
gaaaattcctataaggaa

SEQ ID NO: 5732624 - DNA, 21 bp, Homo sapiens
gaaaattctaacccaagacat

SEQ ID NO: 5732625 - DNA, 19 bp, Homo sapiens
gaaaattctcaagtgatag

SEQ ID NO: 5732626 - DNA, 19 bp, Homo sapiens
gaaaattctctcaagactt

SEQ ID NO: 5732627 - DNA, 22 bp, Homo sapiens
gaaaattctcttaatcactact

SEQ ID NO: 5732628 - DNA, 22 bp, Homo sapiens
gaaaattctgtgccttgttttt

SEQ ID NO: 5732629 - DNA, 16 bp, Homo sapiens
gaaaattcttaaaagg

SEQ ID NO: 5732630 - DNA, 23 bp, Homo sapiens
gaaaattcttgagaagtaactgt

SEQ ID NO: 5732631 - DNA, 18 bp, Homo sapiens
gaaaattgaaacacagag

SEQ ID NO: 5732632 - DNA, 16 bp, Homo sapiens
gaaaattgaatttaac

SEQ ID NO: 5732633 - DNA, 19 bp, Homo sapiens
gaaaattgaatttaacaat

SEQ ID NO: 5732634 - DNA, 19 bp, Homo sapiens
gaaaattgcattgaagccc

SEQ ID NO: 5732635 - DNA, 13 bp, Homo sapiens
gaaaattgccaaa

SEQ ID NO: 5732636 - DNA, 18 bp, Homo sapiens
gaaaattgcctttctgtg

SEQ ID NO: 5732637 - DNA, 18 bp, Homo sapiens
gaaaattgcgaaatctgt

SEQ ID NO: 5732638 - DNA, 21 bp, Homo sapiens
gaaaattggcagtggcagaga

SEQ ID NO: 5732639 - DNA, 14 bp, Homo sapiens
gaaaattgtataaa

SEQ ID NO: 5732640 - DNA, 23 bp, Homo sapiens
gaaaattgtataccaatgtgttt

SEQ ID NO: 5732641 - DNA, 12 bp, Homo sapiens
gaaaattgtatt

SEQ ID NO: 5732642 - DNA, 14 bp, Homo sapiens
gaaaattgtttagt

SEQ ID NO: 5732643 - DNA, 21 bp, Homo sapiens
gaaaattgtttagtgatatta

SEQ ID NO: 5732644 - DNA, 20 bp, Homo sapiens
gaaaatttaaaaattaaagc

SEQ ID NO: 5732645 - DNA, 13 bp, Homo sapiens
gaaaatttaacag

SEQ ID NO: 5732646 - DNA, 14 bp, Homo sapiens
gaaaatttaacagt

SEQ ID NO: 5732647 - DNA, 11 bp, Homo sapiens
gaaaatttaat

SEQ ID NO: 5732648 - DNA, 18 bp, Homo sapiens
gaaaatttacaaaattta

SEQ ID NO: 5732649 - DNA, 21 bp, Homo sapiens
gaaaatttacaaaatttattc

SEQ ID NO: 5732650 - DNA, 22 bp, Homo sapiens
gaaaatttacaaaatttattct

SEQ ID NO: 5732651 - DNA, 15 bp, Homo sapiens
gaaaatttatataac

SEQ ID NO: 5732652 - DNA, 19 bp, Homo sapiens
gaaaatttatataactgtt

SEQ ID NO: 5732653 - DNA, 21 bp, Homo sapiens
gaaaatttcccccacctgcag

SEQ ID NO: 5732654 - DNA, 17 bp, Homo sapiens
gaaaatttgaaaatgtc

SEQ ID NO: 5732655 - DNA, 22 bp, Homo sapiens
gaaaatttgcaacatataaagt

SEQ ID NO: 5732656 - DNA, 14 bp, Homo sapiens
gaaaattttaaaaa

SEQ ID NO: 5732657 - DNA, 21 bp, Homo sapiens
gaaaattttaaaaatacatat

SEQ ID NO: 5732658 - DNA, 19 bp, Homo sapiens
gaaaattttgtattaattt

SEQ ID NO: 5732659 - DNA, 16 bp, Homo sapiens
gaaaattttttttcaa

SEQ ID NO: 5732660 - DNA, 18 bp, Homo sapiens
gaaacaaaaaaaaaatga

SEQ ID NO: 5732661 - DNA, 18 bp, Homo sapiens
gaaacaaaaaatattcat

SEQ ID NO: 5732662 - DNA, 15 bp, Homo sapiens
gaaacaaaaagagct

SEQ ID NO: 5732663 - DNA, 17 bp, Homo sapiens
gaaacaaaaagagcttt

SEQ ID NO: 5732664 - DNA, 21 bp, Homo sapiens
gaaacaaaaagagctttcctt

SEQ ID NO: 5732665 - DNA, 22 bp, Homo sapiens
gaaacaaaaatgatcctcagtg

SEQ ID NO: 5732666 - DNA, 21 bp, Homo sapiens
gaaacaaaaattgtctttatg

SEQ ID NO: 5732667 - DNA, 23 bp, Homo sapiens
gaaacaaaaattgtctttatgag

SEQ ID NO: 5732668 - DNA, 16 bp, Homo sapiens
gaaacaaaatataaat

SEQ ID NO: 5732669 - DNA, 22 bp, Homo sapiens
gaaacaaaccgaaaatggacat

SEQ ID NO: 5732670 - DNA, 14 bp, Homo sapiens
gaaacaaagaaaga

SEQ ID NO: 5732671 - DNA, 14 bp, Homo sapiens
gaaacaaagaaggt

SEQ ID NO: 5732672 - DNA, 15 bp, Homo sapiens
gaaacaaagaagtgt

SEQ ID NO: 5732673 - DNA, 20 bp, Homo sapiens
gaaacaaagacaatttataa

SEQ ID NO: 5732674 - DNA, 19 bp, Homo sapiens
gaaacaaagcttagcagga

SEQ ID NO: 5732675 - DNA, 13 bp, Homo sapiens
gaaacaaagggga

SEQ ID NO: 5732676 - DNA, 17 bp, Homo sapiens
gaaacaaagtactcttt

SEQ ID NO: 5732677 - DNA, 17 bp, Homo sapiens
gaaacaaataaactagt

SEQ ID NO: 5732678 - DNA, 18 bp, Homo sapiens
gaaacaaataatttgaac

SEQ ID NO: 5732679 - DNA, 17 bp, Homo sapiens
gaaacaaatatactcat

SEQ ID NO: 5732680 - DNA, 22 bp, Homo sapiens
gaaacaaatatactcatttgga

SEQ ID NO: 5732681 - DNA, 23 bp, Homo sapiens
gaaacaaatatactcatttggat

SEQ ID NO: 5732682 - DNA, 17 bp, Homo sapiens
gaaacaacaaaggaagt

SEQ ID NO: 5732683 - DNA, 18 bp, Homo sapiens
gaaacaacactcagtcct

SEQ ID NO: 5732684 - DNA, 15 bp, Homo sapiens
gaaacaacactgtag

SEQ ID NO: 5732685 - DNA, 17 bp, Homo sapiens
gaaacaacactgtagta

SEQ ID NO: 5732686 - DNA, 14 bp, Homo sapiens
gaaacaacagaaac

SEQ ID NO: 5732687 - DNA, 13 bp, Homo sapiens
gaaacaacagaga

SEQ ID NO: 5732688 - DNA, 16 bp, Homo sapiens
gaaacaacattatttt

SEQ ID NO: 5732689 - DNA, 20 bp, Homo sapiens
gaaacaactctttgagaaac

SEQ ID NO: 5732690 - DNA, 13 bp, Homo sapiens
gaaacaactgcca

SEQ ID NO: 5732691 - DNA, 19 bp, Homo sapiens
gaaacaactgccaaataaa

SEQ ID NO: 5732692 - DNA, 18 bp, Homo sapiens
gaaacaacttgtgttcta

SEQ ID NO: 5732693 - DNA, 18 bp, Homo sapiens
gaaacaagacaagctcct

SEQ ID NO: 5732694 - DNA, 21 bp, Homo sapiens
gaaacaagacaagctcctccc

SEQ ID NO: 5732695 - DNA, 23 bp, Homo sapiens
gaaacaagacaagctcctccctt

SEQ ID NO: 5732696 - DNA, 13 bp, Homo sapiens
gaaacaagggaag

SEQ ID NO: 5732697 - DNA, 21 bp, Homo sapiens
gaaacaagtcagtcattcaga

SEQ ID NO: 5732698 - DNA, 20 bp, Homo sapiens
gaaacaagtctagtcttctg

SEQ ID NO: 5732699 - DNA, 15 bp, Homo sapiens
gaaacaataaagaaa

SEQ ID NO: 5732700 - DNA, 15 bp, Homo sapiens
gaaacaataaagaga

SEQ ID NO: 5732701 - DNA, 21 bp, Homo sapiens
gaaacaatactcataatgtga

SEQ ID NO: 5732702 - DNA, 17 bp, Homo sapiens
gaaacaatgaaaacaaa

SEQ ID NO: 5732703 - DNA, 10 bp, Homo sapiens
gaaacaatgt

SEQ ID NO: 5732704 - DNA, 9 bp, Homo sapiens
gaaacacaa

SEQ ID NO: 5732705 - DNA, 15 bp, Homo sapiens
gaaacacaaatgggg

SEQ ID NO: 5732706 - DNA, 15 bp, Homo sapiens
gaaacacaaccactc

SEQ ID NO: 5732707 - DNA, 20 bp, Homo sapiens
gaaacacaaccactcaccag

SEQ ID NO: 5732708 - DNA, 16 bp, Homo sapiens
gaaacacaactatatt

SEQ ID NO: 5732709 - DNA, 22 bp, Homo sapiens
gaaacacaatacctacaataaa

SEQ ID NO: 5732710 - DNA, 15 bp, Homo sapiens
gaaacacaatatttt

SEQ ID NO: 5732711 - DNA, 18 bp, Homo sapiens
gaaacacacagtgaccaa

SEQ ID NO: 5732712 - DNA, 16 bp, Homo sapiens
gaaacacaccaggctg

SEQ ID NO: 5732713 - DNA, 13 bp, Homo sapiens
gaaacacagaaac

SEQ ID NO: 5732714 - DNA, 18 bp, Homo sapiens
gaaacacagaactcagcc

SEQ ID NO: 5732715 - DNA, 12 bp, Homo sapiens
gaaacacagctg

SEQ ID NO: 5732716 - DNA, 15 bp, Homo sapiens
gaaacacataattaa

SEQ ID NO: 5732717 - DNA, 16 bp, Homo sapiens
gaaacaccaaaaaaat

SEQ ID NO: 5732718 - DNA, 23 bp, Homo sapiens
gaaacaccaaaaaaatccagaaa

SEQ ID NO: 5732719 - DNA, 16 bp, Homo sapiens
gaaacacccctctgtc

SEQ ID NO: 5732720 - DNA, 18 bp, Homo sapiens
gaaacacctagatcagaa

SEQ ID NO: 5732721 - DNA, 16 bp, Homo sapiens
gaaacacctcccaggg

SEQ ID NO: 5732722 - DNA, 22 bp, Homo sapiens
gaaacacgaaacttgttattgt

SEQ ID NO: 5732723 - DNA, 19 bp, Homo sapiens
gaaacacgcggatctgaac

SEQ ID NO: 5732724 - DNA, 15 bp, Homo sapiens
gaaacacggagtttc

SEQ ID NO: 5732725 - DNA, 20 bp, Homo sapiens
gaaacactaagctctctggg

SEQ ID NO: 5732726 - DNA, 23 bp, Homo sapiens
gaaacactaagctctctgggcct

SEQ ID NO: 5732727 - DNA, 20 bp, Homo sapiens
gaaacactatttgtgacttt

SEQ ID NO: 5732728 - DNA, 21 bp, Homo sapiens
gaaacactcaacaataaagac

SEQ ID NO: 5732729 - DNA, 15 bp, Homo sapiens
gaaacactccttgca

SEQ ID NO: 5732730 - DNA, 24 bp, Homo sapiens
gaaacactcgtgtgcatgagaatg

SEQ ID NO: 5732731 - DNA, 13 bp, Homo sapiens
gaaacactcttat

SEQ ID NO: 5732732 - DNA, 19 bp, Homo sapiens
gaaacactgcaaattttaa

SEQ ID NO: 5732733 - DNA, 23 bp, Homo sapiens
gaaacactgcaaattttaactgt

SEQ ID NO: 5732734 - DNA, 14 bp, Homo sapiens
gaaacactgccttt

SEQ ID NO: 5732735 - DNA, 17 bp, Homo sapiens
gaaacactgccttttta

SEQ ID NO: 5732736 - DNA, 11 bp, Homo sapiens
gaaacactgga

SEQ ID NO: 5732737 - DNA, 16 bp, Homo sapiens
gaaacactggacctgg

SEQ ID NO: 5732738 - DNA, 19 bp, Homo sapiens
gaaacactggacctggggg

SEQ ID NO: 5732739 - DNA, 22 bp, Homo sapiens
gaaacactggttttaaatattt

SEQ ID NO: 5732740 - DNA, 14 bp, Homo sapiens
gaaacacttgcttg

SEQ ID NO: 5732741 - DNA, 20 bp, Homo sapiens
gaaacactttgcctcctgtg

SEQ ID NO: 5732742 - DNA, 12 bp, Homo sapiens
gaaacagaaaaa

SEQ ID NO: 5732743 - DNA, 22 bp, Homo sapiens
gaaacagaaaaatatgtaccaa

SEQ ID NO: 5732744 - DNA, 13 bp, Homo sapiens
gaaacagaaaaga

SEQ ID NO: 5732745 - DNA, 17 bp, Homo sapiens
gaaacagaaaagagaag

SEQ ID NO: 5732746 - DNA, 18 bp, Homo sapiens
gaaacagaaaagagaaga

SEQ ID NO: 5732747 - DNA, 14 bp, Homo sapiens
gaaacagaaacaaa

SEQ ID NO: 5732748 - DNA, 22 bp, Homo sapiens
gaaacagaaacaaaaacactaa

SEQ ID NO: 5732749 - DNA, 17 bp, Homo sapiens
gaaacagaactcgatgc

SEQ ID NO: 5732750 - DNA, 15 bp, Homo sapiens
gaaacagaagaaaaa

SEQ ID NO: 5732751 - DNA, 12 bp, Homo sapiens
gaaacagaagac

SEQ ID NO: 5732752 - DNA, 14 bp, Homo sapiens
gaaacagaagacaa

SEQ ID NO: 5732753 - DNA, 16 bp, Homo sapiens
gaaacagacagggaga

SEQ ID NO: 5732754 - DNA, 17 bp, Homo sapiens
gaaacagagaaagaaaa

SEQ ID NO: 5732755 - DNA, 18 bp, Homo sapiens
gaaacagagaaagaaaag

SEQ ID NO: 5732756 - DNA, 15 bp, Homo sapiens
gaaacagagaaccct

SEQ ID NO: 5732757 - DNA, 14 bp, Homo sapiens
gaaacagagacagg

SEQ ID NO: 5732758 - DNA, 14 bp, Homo sapiens
gaaacagagagaga

SEQ ID NO: 5732759 - DNA, 21 bp, Homo sapiens
gaaacagaggaccagcacact

SEQ ID NO: 5732760 - DNA, 16 bp, Homo sapiens
gaaacagagtccaatt

SEQ ID NO: 5732761 - DNA, 17 bp, Homo sapiens
gaaacagagtggcctcc

SEQ ID NO: 5732762 - DNA, 14 bp, Homo sapiens
gaaacagataccat

SEQ ID NO: 5732763 - DNA, 15 bp, Homo sapiens
gaaacagataccata

SEQ ID NO: 5732764 - DNA, 21 bp, Homo sapiens
gaaacagataccatactcatt

SEQ ID NO: 5732765 - DNA, 21 bp, Homo sapiens
gaaacagatgataaatattta

SEQ ID NO: 5732766 - DNA, 20 bp, Homo sapiens
gaaacagattcaggccagcc

SEQ ID NO: 5732767 - DNA, 11 bp, Homo sapiens
gaaacagcagc

SEQ ID NO: 5732768 - DNA, 16 bp, Homo sapiens
gaaacagcagtcccag

SEQ ID NO: 5732769 - DNA, 18 bp, Homo sapiens
gaaacagcatctccaagc

SEQ ID NO: 5732770 - DNA, 13 bp, Homo sapiens
gaaacagcatgaa

SEQ ID NO: 5732771 - DNA, 16 bp, Homo sapiens
gaaacagcatgaataa

SEQ ID NO: 5732772 - DNA, 17 bp, Homo sapiens
gaaacagcctgtgtctt

SEQ ID NO: 5732773 - DNA, 20 bp, Homo sapiens
gaaacagcctgtgtctttaa

SEQ ID NO: 5732774 - DNA, 18 bp, Homo sapiens
gaaacagctaatgggaca

SEQ ID NO: 5732775 - DNA, 12 bp, Homo sapiens
gaaacagctcag

SEQ ID NO: 5732776 - DNA, 17 bp, Homo sapiens
gaaacagctcagccagt

SEQ ID NO: 5732777 - DNA, 15 bp, Homo sapiens
gaaacagctcgactt

SEQ ID NO: 5732778 - DNA, 20 bp, Homo sapiens
gaaacagctcgactttaaaa

SEQ ID NO: 5732779 - DNA, 16 bp, Homo sapiens
gaaacagctgccttag

SEQ ID NO: 5732780 - DNA, 14 bp, Homo sapiens
gaaacagctgcttc

SEQ ID NO: 5732781 - DNA, 22 bp, Homo sapiens
gaaacagctgcttctcccccca

SEQ ID NO: 5732782 - DNA, 19 bp, Homo sapiens
gaaacagctttaggggtgg

SEQ ID NO: 5732783 - DNA, 16 bp, Homo sapiens
gaaacagctttcaagt

SEQ ID NO: 5732784 - DNA, 13 bp, Homo sapiens
gaaacaggagaga

SEQ ID NO: 5732785 - DNA, 17 bp, Homo sapiens
gaaacaggccctctgtg

SEQ ID NO: 5732786 - DNA, 16 bp, Homo sapiens
gaaacaggctctgaga

SEQ ID NO: 5732787 - DNA, 23 bp, Homo sapiens
gaaacagggcagcagtggggtga

SEQ ID NO: 5732788 - DNA, 15 bp, Homo sapiens
gaaacagggcagtga

SEQ ID NO: 5732789 - DNA, 17 bp, Homo sapiens
gaaacagggcagtgaca

SEQ ID NO: 5732790 - DNA, 17 bp, Homo sapiens
gaaacaggggatcaaag

SEQ ID NO: 5732791 - DNA, 18 bp, Homo sapiens
gaaacaggggatcaaagt

SEQ ID NO: 5732792 - DNA, 16 bp, Homo sapiens
gaaacaggtctgtttt

SEQ ID NO: 5732793 - DNA, 19 bp, Homo sapiens
gaaacagtgcgttgagtgt

SEQ ID NO: 5732794 - DNA, 15 bp, Homo sapiens
gaaacagtgtggatg

SEQ ID NO: 5732795 - DNA, 12 bp, Homo sapiens
gaaacagttcca

SEQ ID NO: 5732796 - DNA, 15 bp, Homo sapiens
gaaacagttctcact

SEQ ID NO: 5732797 - DNA, 16 bp, Homo sapiens
gaaacagttggcactg

SEQ ID NO: 5732798 - DNA, 21 bp, Homo sapiens
gaaacagttggcactgtaagg

SEQ ID NO: 5732799 - DNA, 15 bp, Homo sapiens
gaaacagtttaacag

SEQ ID NO: 5732800 - DNA, 17 bp, Homo sapiens
gaaacataaataaaatg

SEQ ID NO: 5732801 - DNA, 22 bp, Homo sapiens
gaaacataataataatgggttt

SEQ ID NO: 5732802 - DNA, 21 bp, Homo sapiens
gaaacataattttttttttct

SEQ ID NO: 5732803 - DNA, 16 bp, Homo sapiens
gaaacatagaaagaca

SEQ ID NO: 5732804 - DNA, 11 bp, Homo sapiens
gaaacatatca

SEQ ID NO: 5732805 - DNA, 16 bp, Homo sapiens
gaaacatcactggggt

SEQ ID NO: 5732806 - DNA, 20 bp, Homo sapiens
gaaacatcagttactctgaa

SEQ ID NO: 5732807 - DNA, 15 bp, Homo sapiens
gaaacatcatagaaa

SEQ ID NO: 5732808 - DNA, 21 bp, Homo sapiens
gaaacatcctatgaaatactt

SEQ ID NO: 5732809 - DNA, 16 bp, Homo sapiens
gaaacatctcaataaa

SEQ ID NO: 5732810 - DNA, 17 bp, Homo sapiens
gaaacatctcaataaag

SEQ ID NO: 5732811 - DNA, 13 bp, Homo sapiens
gaaacatctctgg

SEQ ID NO: 5732812 - DNA, 16 bp, Homo sapiens
gaaacatgaacccaaa

SEQ ID NO: 5732813 - DNA, 18 bp, Homo sapiens
gaaacatgaagcataatt

SEQ ID NO: 5732814 - DNA, 16 bp, Homo sapiens
gaaacatgacactgac

SEQ ID NO: 5732815 - DNA, 20 bp, Homo sapiens
gaaacatgactcgtatatgt

SEQ ID NO: 5732816 - DNA, 19 bp, Homo sapiens
gaaacatgcagctcttcaa

SEQ ID NO: 5732817 - DNA, 13 bp, Homo sapiens
gaaacatgtcttg

SEQ ID NO: 5732818 - DNA, 19 bp, Homo sapiens
gaaacatgtgcccctgcca

SEQ ID NO: 5732819 - DNA, 23 bp, Homo sapiens
gaaacatgttgccaaaatggtgg

SEQ ID NO: 5732820 - DNA, 16 bp, Homo sapiens
gaaacattacagttca

SEQ ID NO: 5732821 - DNA, 17 bp, Homo sapiens
gaaacattacagttcat

SEQ ID NO: 5732822 - DNA, 19 bp, Homo sapiens
gaaacattagtgaaaattc

SEQ ID NO: 5732823 - DNA, 21 bp, Homo sapiens
gaaacattattttaattggtt

SEQ ID NO: 5732824 - DNA, 19 bp, Homo sapiens
gaaacattcatttttacct

SEQ ID NO: 5732825 - DNA, 23 bp, Homo sapiens
gaaacattgttaatataatttaa

SEQ ID NO: 5732826 - DNA, 22 bp, Homo sapiens
gaaacatttacaataaatattc

SEQ ID NO: 5732827 - DNA, 23 bp, Homo sapiens
gaaacatttagatttagagtttt

SEQ ID NO: 5732828 - DNA, 14 bp, Homo sapiens
gaaacatttatatt

SEQ ID NO: 5732829 - DNA, 13 bp, Homo sapiens
gaaacatttatct

SEQ ID NO: 5732830 - DNA, 23 bp, Homo sapiens
gaaacatttcagaaggtatcagt

SEQ ID NO: 5732831 - DNA, 15 bp, Homo sapiens
gaaacatttgacaca

SEQ ID NO: 5732832 - DNA, 21 bp, Homo sapiens
gaaacattttatactgtacat

SEQ ID NO: 5732833 - DNA, 22 bp, Homo sapiens
gaaacattttatactgtacatg

SEQ ID NO: 5732834 - DNA, 13 bp, Homo sapiens
gaaacattttgat

SEQ ID NO: 5732835 - DNA, 17 bp, Homo sapiens
gaaaccaaaacataaaa

SEQ ID NO: 5732836 - DNA, 18 bp, Homo sapiens
gaaaccaaaattatatgg

SEQ ID NO: 5732837 - DNA, 14 bp, Homo sapiens
gaaaccaaagccag

SEQ ID NO: 5732838 - DNA, 15 bp, Homo sapiens
gaaaccaaagtctgc

SEQ ID NO: 5732839 - DNA, 14 bp, Homo sapiens
gaaaccaactgttg

SEQ ID NO: 5732840 - DNA, 17 bp, Homo sapiens
gaaaccaagagacacaa

SEQ ID NO: 5732841 - DNA, 19 bp, Homo sapiens
gaaaccaagtcaggccagg

SEQ ID NO: 5732842 - DNA, 15 bp, Homo sapiens
gaaaccaagtgggct

SEQ ID NO: 5732843 - DNA, 17 bp, Homo sapiens
gaaaccaagtgggctgg

SEQ ID NO: 5732844 - DNA, 17 bp, Homo sapiens
gaaaccaagttgaaaaa

SEQ ID NO: 5732845 - DNA, 21 bp, Homo sapiens
gaaaccaatcaagataaagga

SEQ ID NO: 5732846 - DNA, 21 bp, Homo sapiens
gaaaccacacttcttgaaaca

SEQ ID NO: 5732847 - DNA, 17 bp, Homo sapiens
gaaaccacagctgctgg

SEQ ID NO: 5732848 - DNA, 18 bp, Homo sapiens
gaaaccacaggcccttgg

SEQ ID NO: 5732849 - DNA, 19 bp, Homo sapiens
gaaaccacaggcccttggg

SEQ ID NO: 5732850 - DNA, 21 bp, Homo sapiens
gaaaccacaggcccttggggt

SEQ ID NO: 5732851 - DNA, 15 bp, Homo sapiens
gaaaccacagtcagt

SEQ ID NO: 5732852 - DNA, 20 bp, Homo sapiens
gaaaccacagtcttcccagc

SEQ ID NO: 5732853 - DNA, 21 bp, Homo sapiens
gaaaccacagtcttcccagca

SEQ ID NO: 5732854 - DNA, 20 bp, Homo sapiens
gaaaccaccgtgaaccagag

SEQ ID NO: 5732855 - DNA, 15 bp, Homo sapiens
gaaaccacctgggtt

SEQ ID NO: 5732856 - DNA, 16 bp, Homo sapiens
gaaaccactaaagtag

SEQ ID NO: 5732857 - DNA, 17 bp, Homo sapiens
gaaaccaggacattaaa

SEQ ID NO: 5732858 - DNA, 14 bp, Homo sapiens
gaaaccagggcctg

SEQ ID NO: 5732859 - DNA, 14 bp, Homo sapiens
gaaaccagtattta

SEQ ID NO: 5732860 - DNA, 18 bp, Homo sapiens
gaaaccagtgcaacagca

SEQ ID NO: 5732861 - DNA, 18 bp, Homo sapiens
gaaaccatgactgtgacc

SEQ ID NO: 5732862 - DNA, 22 bp, Homo sapiens
gaaaccatgactgtgaccacct

SEQ ID NO: 5732863 - DNA, 23 bp, Homo sapiens
gaaaccattttcccatcatcctt

SEQ ID NO: 5732864 - DNA, 18 bp, Homo sapiens
gaaaccatttttaatgag

SEQ ID NO: 5732865 - DNA, 15 bp, Homo sapiens
gaaacccaagttatg

SEQ ID NO: 5732866 - DNA, 14 bp, Homo sapiens
gaaacccacagttt

SEQ ID NO: 5732867 - DNA, 15 bp, Homo sapiens
gaaacccaccagcct

SEQ ID NO: 5732868 - DNA, 21 bp, Homo sapiens
gaaacccagactgaacttacc

SEQ ID NO: 5732869 - DNA, 20 bp, Homo sapiens
gaaacccagatcgctgtgtt

SEQ ID NO: 5732870 - DNA, 21 bp, Homo sapiens
gaaacccagatcgctgtgtta

SEQ ID NO: 5732871 - DNA, 23 bp, Homo sapiens
gaaacccagatcgctgtgttact

SEQ ID NO: 5732872 - DNA, 13 bp, Homo sapiens
gaaacccagctct

SEQ ID NO: 5732873 - DNA, 14 bp, Homo sapiens
gaaacccagctctg

SEQ ID NO: 5732874 - DNA, 16 bp, Homo sapiens
gaaacccagctctggt

SEQ ID NO: 5732875 - DNA, 19 bp, Homo sapiens
gaaacccagctctggtcca

SEQ ID NO: 5732876 - DNA, 18 bp, Homo sapiens
gaaacccataggcccaca

SEQ ID NO: 5732877 - DNA, 19 bp, Homo sapiens
gaaacccataggcccacac

SEQ ID NO: 5732878 - DNA, 21 bp, Homo sapiens
gaaacccataggcccacacac

SEQ ID NO: 5732879 - DNA, 23 bp, Homo sapiens
gaaacccataggcccacacacag

SEQ ID NO: 5732880 - DNA, 21 bp, Homo sapiens
gaaacccatttacttaggact

SEQ ID NO: 5732881 - DNA, 15 bp, Homo sapiens
gaaaccccacttcca

SEQ ID NO: 5732882 - DNA, 15 bp, Homo sapiens
gaaaccccagggcag

SEQ ID NO: 5732883 - DNA, 23 bp, Homo sapiens
gaaacccccacacacacacacat

SEQ ID NO: 5732884 - DNA, 16 bp, Homo sapiens
gaaacccccaggagga

SEQ ID NO: 5732885 - DNA, 19 bp, Homo sapiens
gaaacccccttttcccttc

SEQ ID NO: 5732886 - DNA, 17 bp, Homo sapiens
gaaaccccgtctctact

SEQ ID NO: 5732887 - DNA, 19 bp, Homo sapiens
gaaacccctgtaggcctca

SEQ ID NO: 5732888 - DNA, 19 bp, Homo sapiens
gaaaccccttctctgtgac

SEQ ID NO: 5732889 - DNA, 20 bp, Homo sapiens
gaaaccccttctctgtgacc

SEQ ID NO: 5732890 - DNA, 18 bp, Homo sapiens
gaaacccgagggttgatt

SEQ ID NO: 5732891 - DNA, 18 bp, Homo sapiens
gaaacccggcttcctgtg

SEQ ID NO: 5732892 - DNA, 17 bp, Homo sapiens
gaaacccggtgcatctg

SEQ ID NO: 5732893 - DNA, 14 bp, Homo sapiens
gaaaccctctccat

SEQ ID NO: 5732894 - DNA, 14 bp, Homo sapiens
gaaaccctctgtca

SEQ ID NO: 5732895 - DNA, 21 bp, Homo sapiens
gaaaccctggaccagtggtct

SEQ ID NO: 5732896 - DNA, 16 bp, Homo sapiens
gaaaccctggagccat

SEQ ID NO: 5732897 - DNA, 14 bp, Homo sapiens
gaaaccctggtctc

SEQ ID NO: 5732898 - DNA, 16 bp, Homo sapiens
gaaaccctggtctccg

SEQ ID NO: 5732899 - DNA, 16 bp, Homo sapiens
gaaacccttgctgctt

SEQ ID NO: 5732900 - DNA, 18 bp, Homo sapiens
gaaacccttgctgcttta

SEQ ID NO: 5732901 - DNA, 17 bp, Homo sapiens
gaaaccgaagggactgg

SEQ ID NO: 5732902 - DNA, 15 bp, Homo sapiens
gaaaccgacgaaaaa

SEQ ID NO: 5732903 - DNA, 13 bp, Homo sapiens
gaaaccgggagaa

SEQ ID NO: 5732904 - DNA, 14 bp, Homo sapiens
gaaaccgggagaag

SEQ ID NO: 5732905 - DNA, 21 bp, Homo sapiens
gaaaccgggagaaggcatgag

SEQ ID NO: 5732906 - DNA, 17 bp, Homo sapiens
gaaaccgtaattttatt

SEQ ID NO: 5732907 - DNA, 15 bp, Homo sapiens
gaaacctaactgcaa

SEQ ID NO: 5732908 - DNA, 21 bp, Homo sapiens
gaaacctacagacaaggagga

SEQ ID NO: 5732909 - DNA, 19 bp, Homo sapiens
gaaacctatctcagggagg

SEQ ID NO: 5732910 - DNA, 20 bp, Homo sapiens
gaaacctatctcagggaggg

SEQ ID NO: 5732911 - DNA, 19 bp, Homo sapiens
gaaacctcacccttgcacc

SEQ ID NO: 5732912 - DNA, 15 bp, Homo sapiens
gaaacctcagggctg

SEQ ID NO: 5732913 - DNA, 19 bp, Homo sapiens
gaaacctcagggctgtccc

SEQ ID NO: 5732914 - DNA, 21 bp, Homo sapiens
gaaacctcagggctgtcccag

SEQ ID NO: 5732915 - DNA, 17 bp, Homo sapiens
gaaacctcattggccag

SEQ ID NO: 5732916 - DNA, 18 bp, Homo sapiens
gaaacctcattggccagc

SEQ ID NO: 5732917 - DNA, 13 bp, Homo sapiens
gaaacctccatcc

SEQ ID NO: 5732918 - DNA, 20 bp, Homo sapiens
gaaacctccatcctgccagg

SEQ ID NO: 5732919 - DNA, 20 bp, Homo sapiens
gaaacctctactaaaaagaa

SEQ ID NO: 5732920 - DNA, 15 bp, Homo sapiens
gaaacctctgttctc

SEQ ID NO: 5732921 - DNA, 14 bp, Homo sapiens
gaaacctcttccta

SEQ ID NO: 5732922 - DNA, 16 bp, Homo sapiens
gaaacctcttcctagg

SEQ ID NO: 5732923 - DNA, 13 bp, Homo sapiens
gaaacctgaaaaa

SEQ ID NO: 5732924 - DNA, 18 bp, Homo sapiens
gaaacctgccaaggagca

SEQ ID NO: 5732925 - DNA, 14 bp, Homo sapiens
gaaacctgccctgc

SEQ ID NO: 5732926 - DNA, 18 bp, Homo sapiens
gaaacctgccctgcctga

SEQ ID NO: 5732927 - DNA, 17 bp, Homo sapiens
gaaacctgcctttgtat

SEQ ID NO: 5732928 - DNA, 19 bp, Homo sapiens
gaaacctgctctgtaggag

SEQ ID NO: 5732929 - DNA, 14 bp, Homo sapiens
gaaacctgggagag

SEQ ID NO: 5732930 - DNA, 12 bp, Homo sapiens
gaaacctgggct

SEQ ID NO: 5732931 - DNA, 18 bp, Homo sapiens
gaaacctgtataaccctg

SEQ ID NO: 5732932 - DNA, 18 bp, Homo sapiens
gaaacctgtccataaagt

SEQ ID NO: 5732933 - DNA, 19 bp, Homo sapiens
gaaacctgtccataaagta

SEQ ID NO: 5732934 - DNA, 13 bp, Homo sapiens
gaaacctgtctga

SEQ ID NO: 5732935 - DNA, 13 bp, Homo sapiens
gaaaccttaatat

SEQ ID NO: 5732936 - DNA, 19 bp, Homo sapiens
gaaaccttattgtacctct

SEQ ID NO: 5732937 - DNA, 22 bp, Homo sapiens
gaaaccttattttttcccaaag

SEQ ID NO: 5732938 - DNA, 16 bp, Homo sapiens
gaaaccttcactccag

SEQ ID NO: 5732939 - DNA, 20 bp, Homo sapiens
gaaaccttccaatgcttctg

SEQ ID NO: 5732940 - DNA, 14 bp, Homo sapiens
gaaaccttccaccc

SEQ ID NO: 5732941 - DNA, 13 bp, Homo sapiens
gaaaccttgcagc

SEQ ID NO: 5732942 - DNA, 17 bp, Homo sapiens
gaaaccttgctctcctc

SEQ ID NO: 5732943 - DNA, 15 bp, Homo sapiens
gaaaccttgtctcta

SEQ ID NO: 5732944 - DNA, 15 bp, Homo sapiens
gaaaccttgtttgtt

SEQ ID NO: 5732945 - DNA, 18 bp, Homo sapiens
gaaacctttagggcagct

SEQ ID NO: 5732946 - DNA, 19 bp, Homo sapiens
gaaacctttagggcagctt

SEQ ID NO: 5732947 - DNA, 20 bp, Homo sapiens
gaaacctttagggcagcttg

SEQ ID NO: 5732948 - DNA, 21 bp, Homo sapiens
gaaacctttatccctgcttat

SEQ ID NO: 5732949 - DNA, 17 bp, Homo sapiens
gaaaccttttaaaaaaa

SEQ ID NO: 5732950 - DNA, 20 bp, Homo sapiens
gaaaccttttcttgtatctg

SEQ ID NO: 5732951 - DNA, 17 bp, Homo sapiens
gaaaccttttttaagat

SEQ ID NO: 5732952 - DNA, 18 bp, Homo sapiens
gaaaccttttttaagatt

SEQ ID NO: 5732953 - DNA, 23 bp, Homo sapiens
gaaaccttttttaagatttttct

SEQ ID NO: 5732954 - DNA, 16 bp, Homo sapiens
gaaacctttttttgat

SEQ ID NO: 5732955 - DNA, 17 bp, Homo sapiens
gaaacgactcaaaatga

SEQ ID NO: 5732956 - DNA, 23 bp, Homo sapiens
gaaacgagactttccattacaag

SEQ ID NO: 5732957 - DNA, 17 bp, Homo sapiens
gaaacgagatttgccaa

SEQ ID NO: 5732958 - DNA, 17 bp, Homo sapiens
gaaacgcacttacaagt

SEQ ID NO: 5732959 - DNA, 21 bp, Homo sapiens
gaaacgccccgggcaaagggt

SEQ ID NO: 5732960 - DNA, 22 bp, Homo sapiens
gaaacgccccgggcaaagggtc

SEQ ID NO: 5732961 - DNA, 23 bp, Homo sapiens
gaaacgccccgggcaaagggtct

SEQ ID NO: 5732962 - DNA, 20 bp, Homo sapiens
gaaacgctacctctctgtcc

SEQ ID NO: 5732963 - DNA, 17 bp, Homo sapiens
gaaacggaatgaccttg

SEQ ID NO: 5732964 - DNA, 16 bp, Homo sapiens
gaaacggatgatttct

SEQ ID NO: 5732965 - DNA, 20 bp, Homo sapiens
gaaacgggctccttcccctg

SEQ ID NO: 5732966 - DNA, 23 bp, Homo sapiens
gaaacggtatcctccctgcccat

SEQ ID NO: 5732967 - DNA, 16 bp, Homo sapiens
gaaacgtcttctaaac

SEQ ID NO: 5732968 - DNA, 22 bp, Homo sapiens
gaaacgtggatacagagccacg

SEQ ID NO: 5732969 - DNA, 13 bp, Homo sapiens
gaaacgtggcagg

SEQ ID NO: 5732970 - DNA, 18 bp, Homo sapiens
gaaacgtgtcacacttgt

SEQ ID NO: 5732971 - DNA, 19 bp, Homo sapiens
gaaacgtgttaaaggtttt

SEQ ID NO: 5732972 - DNA, 17 bp, Homo sapiens
gaaactaaacagaaaac

SEQ ID NO: 5732973 - DNA, 19 bp, Homo sapiens
gaaactaaacagaaaactc

SEQ ID NO: 5732974 - DNA, 15 bp, Homo sapiens
gaaactaacagataa

SEQ ID NO: 5732975 - DNA, 23 bp, Homo sapiens
gaaactaagagacagttctctgt

SEQ ID NO: 5732976 - DNA, 15 bp, Homo sapiens
gaaactaagccaggc

SEQ ID NO: 5732977 - DNA, 12 bp, Homo sapiens
gaaactaataaa

SEQ ID NO: 5732978 - DNA, 19 bp, Homo sapiens
gaaactaataaaatatttt

SEQ ID NO: 5732979 - DNA, 20 bp, Homo sapiens
gaaactaatcataagctgcc

SEQ ID NO: 5732980 - DNA, 22 bp, Homo sapiens
gaaactaccagtgggcatgtat

SEQ ID NO: 5732981 - DNA, 24 bp, Homo sapiens
gaaactagcttacatgagaacaga

SEQ ID NO: 5732982 - DNA, 19 bp, Homo sapiens
gaaactaggtgcatattta

SEQ ID NO: 5732983 - DNA, 19 bp, Homo sapiens
gaaactatattttgtcata

SEQ ID NO: 5732984 - DNA, 18 bp, Homo sapiens
gaaactatgatgtggaga

SEQ ID NO: 5732985 - DNA, 15 bp, Homo sapiens
gaaactatgcaccta

SEQ ID NO: 5732986 - DNA, 17 bp, Homo sapiens
gaaactatgtgtttttc

SEQ ID NO: 5732987 - DNA, 19 bp, Homo sapiens
gaaactatgtgtttttctc

SEQ ID NO: 5732988 - DNA, 19 bp, Homo sapiens
gaaactattataaggccat

SEQ ID NO: 5732989 - DNA, 23 bp, Homo sapiens
gaaactatttaaaggcactatta

SEQ ID NO: 5732990 - DNA, 21 bp, Homo sapiens
gaaactcaaggaaaagttctt

SEQ ID NO: 5732991 - DNA, 17 bp, Homo sapiens
gaaactcaccatgtaaa

SEQ ID NO: 5732992 - DNA, 21 bp, Homo sapiens
gaaactcacccccaaggggca

SEQ ID NO: 5732993 - DNA, 21 bp, Homo sapiens
gaaactcacctgctggcccct

SEQ ID NO: 5732994 - DNA, 23 bp, Homo sapiens
gaaactcacctgctggcccctca

SEQ ID NO: 5732995 - DNA, 17 bp, Homo sapiens
gaaactcagatgtccaa

SEQ ID NO: 5732996 - DNA, 12 bp, Homo sapiens
gaaactcagccg

SEQ ID NO: 5732997 - DNA, 15 bp, Homo sapiens
gaaactcaggaaaga

SEQ ID NO: 5732998 - DNA, 17 bp, Homo sapiens
gaaactcatacagtctc

SEQ ID NO: 5732999 - DNA, 18 bp, Homo sapiens
gaaactcatagacactga

SEQ ID NO: 5733000 - DNA, 14 bp, Homo sapiens
gaaactcatctcat

SEQ ID NO: 5733001 - DNA, 14 bp, Homo sapiens
gaaactccaaagtc

SEQ ID NO: 5733002 - DNA, 19 bp, Homo sapiens
gaaactccacatctgcctt

SEQ ID NO: 5733003 - DNA, 15 bp, Homo sapiens
gaaactccagatgcc

SEQ ID NO: 5733004 - DNA, 13 bp, Homo sapiens
gaaactccatctc

SEQ ID NO: 5733005 - DNA, 20 bp, Homo sapiens
gaaactccatctcaaaacaa

SEQ ID NO: 5733006 - DNA, 21 bp, Homo sapiens
gaaactccatctcaaaacaaa

SEQ ID NO: 5733007 - DNA, 23 bp, Homo sapiens
gaaactccatctcaaaacaaaac

SEQ ID NO: 5733008 - DNA, 14 bp, Homo sapiens
gaaactcccaccct

SEQ ID NO: 5733009 - DNA, 18 bp, Homo sapiens
gaaactcccatgtatgga

SEQ ID NO: 5733010 - DNA, 15 bp, Homo sapiens
gaaactcccctgggg

SEQ ID NO: 5733011 - DNA, 18 bp, Homo sapiens
gaaactcccttgtgttcc

SEQ ID NO: 5733012 - DNA, 19 bp, Homo sapiens
gaaactcccttgtgttcct

SEQ ID NO: 5733013 - DNA, 22 bp, Homo sapiens
gaaactcctgattttgtagtta

SEQ ID NO: 5733014 - DNA, 20 bp, Homo sapiens
gaaactccttttgctgtctt

SEQ ID NO: 5733015 - DNA, 16 bp, Homo sapiens
gaaactcgggcttgag

SEQ ID NO: 5733016 - DNA, 23 bp, Homo sapiens
gaaactcgttaatttgtagtgtt

SEQ ID NO: 5733017 - DNA, 21 bp, Homo sapiens
gaaactctcatttatattgca

SEQ ID NO: 5733018 - DNA, 12 bp, Homo sapiens
gaaactctccat

SEQ ID NO: 5733019 - DNA, 20 bp, Homo sapiens
gaaactctggagagcctgca

SEQ ID NO: 5733020 - DNA, 18 bp, Homo sapiens
gaaactctggctcagcct

SEQ ID NO: 5733021 - DNA, 12 bp, Homo sapiens
gaaactctggtg

SEQ ID NO: 5733022 - DNA, 20 bp, Homo sapiens
gaaactcttgctattgaatt

SEQ ID NO: 5733023 - DNA, 18 bp, Homo sapiens
gaaactctttcattcttc

SEQ ID NO: 5733024 - DNA, 12 bp, Homo sapiens
gaaactgaaaaa

SEQ ID NO: 5733025 - DNA, 15 bp, Homo sapiens
gaaactgaaagtgtt

SEQ ID NO: 5733026 - DNA, 21 bp, Homo sapiens
gaaactgaaagtgttttactc

SEQ ID NO: 5733027 - DNA, 21 bp, Homo sapiens
gaaactgaaggtcaataaatt

SEQ ID NO: 5733028 - DNA, 19 bp, Homo sapiens
gaaactgacatgccctccc

SEQ ID NO: 5733029 - DNA, 16 bp, Homo sapiens
gaaactgacttgctca

SEQ ID NO: 5733030 - DNA, 16 bp, Homo sapiens
gaaactgacttgctgt

SEQ ID NO: 5733031 - DNA, 22 bp, Homo sapiens
gaaactgaggaattttctttgt

SEQ ID NO: 5733032 - DNA, 15 bp, Homo sapiens
gaaactgaggcccag

SEQ ID NO: 5733033 - DNA, 17 bp, Homo sapiens
gaaactgaggcccagag

SEQ ID NO: 5733034 - DNA, 19 bp, Homo sapiens
gaaactgagggcagagagg

SEQ ID NO: 5733035 - DNA, 23 bp, Homo sapiens
gaaactgaggtgttattttcaat

SEQ ID NO: 5733036 - DNA, 22 bp, Homo sapiens
gaaactgagtcactcacattga

SEQ ID NO: 5733037 - DNA, 17 bp, Homo sapiens
gaaactgagtctgtgga

SEQ ID NO: 5733038 - DNA, 14 bp, Homo sapiens
gaaactgatttctt

SEQ ID NO: 5733039 - DNA, 11 bp, Homo sapiens
gaaactgccaa

SEQ ID NO: 5733040 - DNA, 18 bp, Homo sapiens
gaaactgccacatacacc

SEQ ID NO: 5733041 - DNA, 14 bp, Homo sapiens
gaaactgctaaatt

SEQ ID NO: 5733042 - DNA, 17 bp, Homo sapiens
gaaactgctaaattcta

SEQ ID NO: 5733043 - DNA, 17 bp, Homo sapiens
gaaactgctaattacac

SEQ ID NO: 5733044 - DNA, 18 bp, Homo sapiens
gaaactgctaattacaca

SEQ ID NO: 5733045 - DNA, 14 bp, Homo sapiens
gaaactgctgcaga

SEQ ID NO: 5733046 - DNA, 17 bp, Homo sapiens
gaaactgctgcagatta

SEQ ID NO: 5733047 - DNA, 15 bp, Homo sapiens
gaaactgctttattt

SEQ ID NO: 5733048 - DNA, 16 bp, Homo sapiens
gaaactggcaaagcag

SEQ ID NO: 5733049 - DNA, 11 bp, Homo sapiens
gaaactggctg

SEQ ID NO: 5733050 - DNA, 13 bp, Homo sapiens
gaaactgggaaac

SEQ ID NO: 5733051 - DNA, 23 bp, Homo sapiens
gaaactggtccatgtaaatactt

SEQ ID NO: 5733052 - DNA, 22 bp, Homo sapiens
gaaactggttgtaaaagagaaa

SEQ ID NO: 5733053 - DNA, 18 bp, Homo sapiens
gaaactgtagtctcagga

SEQ ID NO: 5733054 - DNA, 15 bp, Homo sapiens
gaaactgtgtatagc

SEQ ID NO: 5733055 - DNA, 22 bp, Homo sapiens
gaaactgttcccacctgctgga

SEQ ID NO: 5733056 - DNA, 15 bp, Homo sapiens
gaaactgttgccaga

SEQ ID NO: 5733057 - DNA, 15 bp, Homo sapiens
gaaacttacacacaa

SEQ ID NO: 5733058 - DNA, 22 bp, Homo sapiens
gaaacttacactgtttcatctc

SEQ ID NO: 5733059 - DNA, 18 bp, Homo sapiens
gaaacttacctgagaacc

SEQ ID NO: 5733060 - DNA, 23 bp, Homo sapiens
gaaacttcagcggtttatataag

SEQ ID NO: 5733061 - DNA, 17 bp, Homo sapiens
gaaacttcattcagagg

SEQ ID NO: 5733062 - DNA, 12 bp, Homo sapiens
gaaacttctgta

SEQ ID NO: 5733063 - DNA, 21 bp, Homo sapiens
gaaacttgagtttgtttcttg

SEQ ID NO: 5733064 - DNA, 14 bp, Homo sapiens
gaaacttgtaaata

SEQ ID NO: 5733065 - DNA, 21 bp, Homo sapiens
gaaacttgtaatggtctctga

SEQ ID NO: 5733066 - DNA, 19 bp, Homo sapiens
gaaacttgtcacttgcatg

SEQ ID NO: 5733067 - DNA, 16 bp, Homo sapiens
gaaacttgtgtaaata

SEQ ID NO: 5733068 - DNA, 16 bp, Homo sapiens
gaaacttgttcttcca

SEQ ID NO: 5733069 - DNA, 22 bp, Homo sapiens
gaaacttgttcttccaaagcag

SEQ ID NO: 5733070 - DNA, 15 bp, Homo sapiens
gaaactttatacatt

SEQ ID NO: 5733071 - DNA, 18 bp, Homo sapiens
gaaactttatacattagt

SEQ ID NO: 5733072 - DNA, 20 bp, Homo sapiens
gaaactttatacattagtaa

SEQ ID NO: 5733073 - DNA, 21 bp, Homo sapiens
gaaactttatttaaatgcatg

SEQ ID NO: 5733074 - DNA, 13 bp, Homo sapiens
gaaactttccttt

SEQ ID NO: 5733075 - DNA, 19 bp, Homo sapiens
gaaactttgagatctaaaa

SEQ ID NO: 5733076 - DNA, 14 bp, Homo sapiens
gaaactttggaagc

SEQ ID NO: 5733077 - DNA, 20 bp, Homo sapiens
gaaactttggaagttttact

SEQ ID NO: 5733078 - DNA, 19 bp, Homo sapiens
gaaacttttaactgagaaa

SEQ ID NO: 5733079 - DNA, 16 bp, Homo sapiens
gaaacttttgtaaaga

SEQ ID NO: 5733080 - DNA, 23 bp, Homo sapiens
gaaacttttgtaaagaaatttac

SEQ ID NO: 5733081 - DNA, 23 bp, Homo sapiens
gaaacttttttattttttaaatc

SEQ ID NO: 5733082 - DNA, 21 bp, Homo sapiens
gaaacttttttcattttgaaa

SEQ ID NO: 5733083 - DNA, 11 bp, Homo sapiens
gaaagaaaaaa

SEQ ID NO: 5733084 - DNA, 16 bp, Homo sapiens
gaaagaaaaaaaaata

SEQ ID NO: 5733085 - DNA, 13 bp, Homo sapiens
gaaagaaaaaatt

SEQ ID NO: 5733086 - DNA, 13 bp, Homo sapiens
gaaagaaaagaat

SEQ ID NO: 5733087 - DNA, 18 bp, Homo sapiens
gaaagaaaagaatgtaca

SEQ ID NO: 5733088 - DNA, 12 bp, Homo sapiens
gaaagaaaagac

SEQ ID NO: 5733089 - DNA, 19 bp, Homo sapiens
gaaagaaaagaccctgaga

SEQ ID NO: 5733090 - DNA, 21 bp, Homo sapiens
gaaagaaaagaccctgagact

SEQ ID NO: 5733091 - DNA, 19 bp, Homo sapiens
gaaagaaaaggaatgcaag

SEQ ID NO: 5733092 - DNA, 23 bp, Homo sapiens
gaaagaaaaggaatgcaagagaa

SEQ ID NO: 5733093 - DNA, 16 bp, Homo sapiens
gaaagaaaaggcaaaa

SEQ ID NO: 5733094 - DNA, 20 bp, Homo sapiens
gaaagaaaaggcaaaagact

SEQ ID NO: 5733095 - DNA, 22 bp, Homo sapiens
gaaagaaaaggcaaaagactgg

SEQ ID NO: 5733096 - DNA, 14 bp, Homo sapiens
gaaagaaaatattt

SEQ ID NO: 5733097 - DNA, 13 bp, Homo sapiens
gaaagaaaatgaa

SEQ ID NO: 5733098 - DNA, 14 bp, Homo sapiens
gaaagaaaatggaa

SEQ ID NO: 5733099 - DNA, 19 bp, Homo sapiens
gaaagaaaatggaaagaag

SEQ ID NO: 5733100 - DNA, 22 bp, Homo sapiens
gaaagaaacccacagaagggga

SEQ ID NO: 5733101 - DNA, 21 bp, Homo sapiens
gaaagaaacccgacagaggga

SEQ ID NO: 5733102 - DNA, 22 bp, Homo sapiens
gaaagaaacccgacagagggaa

SEQ ID NO: 5733103 - DNA, 23 bp, Homo sapiens
gaaagaaacgtacttaactgtgt

SEQ ID NO: 5733104 - DNA, 11 bp, Homo sapiens
gaaagaaacta

SEQ ID NO: 5733105 - DNA, 20 bp, Homo sapiens
gaaagaaacttcattcagag

SEQ ID NO: 5733106 - DNA, 16 bp, Homo sapiens
gaaagaaaggaaagaa

SEQ ID NO: 5733107 - DNA, 16 bp, Homo sapiens
gaaagaaatcatgtta

SEQ ID NO: 5733108 - DNA, 17 bp, Homo sapiens
gaaagaaatcatgttat

SEQ ID NO: 5733109 - DNA, 22 bp, Homo sapiens
gaaagaaatggcttttcttacc

SEQ ID NO: 5733110 - DNA, 23 bp, Homo sapiens
gaaagaacatttaaaattaaata

SEQ ID NO: 5733111 - DNA, 17 bp, Homo sapiens
gaaagaactatcttcat

SEQ ID NO: 5733112 - DNA, 16 bp, Homo sapiens
gaaagaagaaaaggtt

SEQ ID NO: 5733113 - DNA, 17 bp, Homo sapiens
gaaagaagaacagctgt

SEQ ID NO: 5733114 - DNA, 14 bp, Homo sapiens
gaaagaagactgtg

SEQ ID NO: 5733115 - DNA, 18 bp, Homo sapiens
gaaagaagcactctgctg

SEQ ID NO: 5733116 - DNA, 20 bp, Homo sapiens
gaaagaagcactctgctggc

SEQ ID NO: 5733117 - DNA, 23 bp, Homo sapiens
gaaagaagctcgccccacctcca

SEQ ID NO: 5733118 - DNA, 12 bp, Homo sapiens
gaaagaaggaaa

SEQ ID NO: 5733119 - DNA, 13 bp, Homo sapiens
gaaagaaggaaga

SEQ ID NO: 5733120 - DNA, 14 bp, Homo sapiens
gaaagaagggggcc

SEQ ID NO: 5733121 - DNA, 16 bp, Homo sapiens
gaaagaagggggccct

SEQ ID NO: 5733122 - DNA, 20 bp, Homo sapiens
gaaagaagggggccctgcta

SEQ ID NO: 5733123 - DNA, 15 bp, Homo sapiens
gaaagaagtattaaa

SEQ ID NO: 5733124 - DNA, 14 bp, Homo sapiens
gaaagaagtattta

SEQ ID NO: 5733125 - DNA, 18 bp, Homo sapiens
gaaagaagtggggacaga

SEQ ID NO: 5733126 - DNA, 15 bp, Homo sapiens
gaaagaataaaatgt

SEQ ID NO: 5733127 - DNA, 16 bp, Homo sapiens
gaaagaataaaatgtt

SEQ ID NO: 5733128 - DNA, 18 bp, Homo sapiens
gaaagaataaaatgtttc

SEQ ID NO: 5733129 - DNA, 15 bp, Homo sapiens
gaaagaatagaaaga

SEQ ID NO: 5733130 - DNA, 13 bp, Homo sapiens
gaaagaatatatt

SEQ ID NO: 5733131 - DNA, 20 bp, Homo sapiens
gaaagaatcagtaggaccag

SEQ ID NO: 5733132 - DNA, 21 bp, Homo sapiens
gaaagaatcagtaggaccagg

SEQ ID NO: 5733133 - DNA, 22 bp, Homo sapiens
gaaagaatgttactgccttaat

SEQ ID NO: 5733134 - DNA, 17 bp, Homo sapiens
gaaagaattaaaaactt

SEQ ID NO: 5733135 - DNA, 22 bp, Homo sapiens
gaaagaattgcagtaaagtctt

SEQ ID NO: 5733136 - DNA, 17 bp, Homo sapiens
gaaagaatttcatatgc

SEQ ID NO: 5733137 - DNA, 14 bp, Homo sapiens
gaaagacactgcct

SEQ ID NO: 5733138 - DNA, 15 bp, Homo sapiens
gaaagacactgcctg

SEQ ID NO: 5733139 - DNA, 18 bp, Homo sapiens
gaaagacactgcctgggc

SEQ ID NO: 5733140 - DNA, 16 bp, Homo sapiens
gaaagacagcttctca

SEQ ID NO: 5733141 - DNA, 21 bp, Homo sapiens
gaaagacatcacatccctctc

SEQ ID NO: 5733142 - DNA, 22 bp, Homo sapiens
gaaagacatccataaagaagca

SEQ ID NO: 5733143 - DNA, 15 bp, Homo sapiens
gaaagacatctgagg

SEQ ID NO: 5733144 - DNA, 21 bp, Homo sapiens
gaaagaccctgatgcaggtca

SEQ ID NO: 5733145 - DNA, 15 bp, Homo sapiens
gaaagactattcaaa

SEQ ID NO: 5733146 - DNA, 19 bp, Homo sapiens
gaaagactattcaaacagt

SEQ ID NO: 5733147 - DNA, 23 bp, Homo sapiens
gaaagactattcaaacagtctca

SEQ ID NO: 5733148 - DNA, 17 bp, Homo sapiens
gaaagactgaagaaagt

SEQ ID NO: 5733149 - DNA, 16 bp, Homo sapiens
gaaagacttccaaaga

SEQ ID NO: 5733150 - DNA, 19 bp, Homo sapiens
gaaagacttctcaaagaga

SEQ ID NO: 5733151 - DNA, 19 bp, Homo sapiens
gaaagacttttccaaccct

SEQ ID NO: 5733152 - DNA, 12 bp, Homo sapiens
gaaagagaaaat

SEQ ID NO: 5733153 - DNA, 16 bp, Homo sapiens
gaaagagaaaatatat

SEQ ID NO: 5733154 - DNA, 13 bp, Homo sapiens
gaaagagaaacac

SEQ ID NO: 5733155 - DNA, 19 bp, Homo sapiens
gaaagagaaagtactcaga

SEQ ID NO: 5733156 - DNA, 14 bp, Homo sapiens
gaaagagaaggtgg

SEQ ID NO: 5733157 - DNA, 19 bp, Homo sapiens
gaaagagaagtcacaacaa

SEQ ID NO: 5733158 - DNA, 17 bp, Homo sapiens
gaaagagaatgaactgt

SEQ ID NO: 5733159 - DNA, 20 bp, Homo sapiens
gaaagagaatttggagccag

SEQ ID NO: 5733160 - DNA, 11 bp, Homo sapiens
gaaagagacca

SEQ ID NO: 5733161 - DNA, 11 bp, Homo sapiens
gaaagagagaa

SEQ ID NO: 5733162 - DNA, 12 bp, Homo sapiens
gaaagagagaaa

SEQ ID NO: 5733163 - DNA, 13 bp, Homo sapiens
gaaagagagaaaa

SEQ ID NO: 5733164 - DNA, 15 bp, Homo sapiens
gaaagagagaaaata

SEQ ID NO: 5733165 - DNA, 21 bp, Homo sapiens
gaaagagagaaaataaaaagt

SEQ ID NO: 5733166 - DNA, 15 bp, Homo sapiens
gaaagagagaagcca

SEQ ID NO: 5733167 - DNA, 16 bp, Homo sapiens
gaaagagagaagccag

SEQ ID NO: 5733168 - DNA, 17 bp, Homo sapiens
gaaagagagaagccagc

SEQ ID NO: 5733169 - DNA, 21 bp, Homo sapiens
gaaagagagagaaacaaactt

SEQ ID NO: 5733170 - DNA, 16 bp, Homo sapiens
gaaagagagcactgac

SEQ ID NO: 5733171 - DNA, 14 bp, Homo sapiens
gaaagagagctgga

SEQ ID NO: 5733172 - DNA, 21 bp, Homo sapiens
gaaagagatcacccactccta

SEQ ID NO: 5733173 - DNA, 20 bp, Homo sapiens
gaaagagattagaacattta

SEQ ID NO: 5733174 - DNA, 16 bp, Homo sapiens
gaaagagatttaaact

SEQ ID NO: 5733175 - DNA, 22 bp, Homo sapiens
gaaagagcaaagtcatgtcaga

SEQ ID NO: 5733176 - DNA, 19 bp, Homo sapiens
gaaagagcaccctcgagaa

SEQ ID NO: 5733177 - DNA, 16 bp, Homo sapiens
gaaagagcacttaaga

SEQ ID NO: 5733178 - DNA, 23 bp, Homo sapiens
gaaagagcacttaagagaatatt

SEQ ID NO: 5733179 - DNA, 18 bp, Homo sapiens
gaaagagccagactctgt

SEQ ID NO: 5733180 - DNA, 14 bp, Homo sapiens
gaaagagctgcctg

SEQ ID NO: 5733181 - DNA, 15 bp, Homo sapiens
gaaagagctgcctgg

SEQ ID NO: 5733182 - DNA, 16 bp, Homo sapiens
gaaagaggaaaagaaa

SEQ ID NO: 5733183 - DNA, 21 bp, Homo sapiens
gaaagaggaatgaagtactca

SEQ ID NO: 5733184 - DNA, 17 bp, Homo sapiens
gaaagaggagaaggaga

SEQ ID NO: 5733185 - DNA, 20 bp, Homo sapiens
gaaagaggaggcagaaagat

SEQ ID NO: 5733186 - DNA, 17 bp, Homo sapiens
gaaagaggcaccaggaa

SEQ ID NO: 5733187 - DNA, 20 bp, Homo sapiens
gaaagaggcaccaggaagcc

SEQ ID NO: 5733188 - DNA, 21 bp, Homo sapiens
gaaagaggcaccaggaagccg

SEQ ID NO: 5733189 - DNA, 20 bp, Homo sapiens
gaaagaggctgaggcctgga

SEQ ID NO: 5733190 - DNA, 21 bp, Homo sapiens
gaaagaggctgaggcctggac

SEQ ID NO: 5733191 - DNA, 22 bp, Homo sapiens
gaaagaggctgaggcctggact

SEQ ID NO: 5733192 - DNA, 17 bp, Homo sapiens
gaaagagggaaaaagag

SEQ ID NO: 5733193 - DNA, 14 bp, Homo sapiens
gaaagagggagcag

SEQ ID NO: 5733194 - DNA, 15 bp, Homo sapiens
gaaagagggagcagg

SEQ ID NO: 5733195 - DNA, 18 bp, Homo sapiens
gaaagagggagcaggtgc

SEQ ID NO: 5733196 - DNA, 19 bp, Homo sapiens
gaaagagggagcaggtgcc

SEQ ID NO: 5733197 - DNA, 16 bp, Homo sapiens
gaaagaggtctcccca

SEQ ID NO: 5733198 - DNA, 17 bp, Homo sapiens
gaaagaggtctttcaga

SEQ ID NO: 5733199 - DNA, 16 bp, Homo sapiens
gaaagaggtgaaaatg

SEQ ID NO: 5733200 - DNA, 19 bp, Homo sapiens
gaaagaggtgaccccaggg

SEQ ID NO: 5733201 - DNA, 18 bp, Homo sapiens
gaaagagttaagaatgtc

SEQ ID NO: 5733202 - DNA, 16 bp, Homo sapiens
gaaagataaaatagtg

SEQ ID NO: 5733203 - DNA, 18 bp, Homo sapiens
gaaagatacaggggatca

SEQ ID NO: 5733204 - DNA, 12 bp, Homo sapiens
gaaagatactaa

SEQ ID NO: 5733205 - DNA, 15 bp, Homo sapiens
gaaagatacttacat

SEQ ID NO: 5733206 - DNA, 13 bp, Homo sapiens
gaaagatatgtat

SEQ ID NO: 5733207 - DNA, 13 bp, Homo sapiens
gaaagatctctgt

SEQ ID NO: 5733208 - DNA, 17 bp, Homo sapiens
gaaagatgatttgtatg

SEQ ID NO: 5733209 - DNA, 23 bp, Homo sapiens
gaaagatgcatcatctcttcctc

SEQ ID NO: 5733210 - DNA, 21 bp, Homo sapiens
gaaagatgctcaggtacagag

SEQ ID NO: 5733211 - DNA, 19 bp, Homo sapiens
gaaagatggaaattctgaa

SEQ ID NO: 5733212 - DNA, 22 bp, Homo sapiens
gaaagatggctgtgcctctgcc

SEQ ID NO: 5733213 - DNA, 23 bp, Homo sapiens
gaaagatggctgtgcctctgcct

SEQ ID NO: 5733214 - DNA, 18 bp, Homo sapiens
gaaagatggtaatctttt

SEQ ID NO: 5733215 - DNA, 20 bp, Homo sapiens
gaaagatggtaatcttttct

SEQ ID NO: 5733216 - DNA, 18 bp, Homo sapiens
gaaagatgtcccacaggg

SEQ ID NO: 5733217 - DNA, 19 bp, Homo sapiens
gaaagatgtcccacaggga

SEQ ID NO: 5733218 - DNA, 15 bp, Homo sapiens
gaaagattaaatata

SEQ ID NO: 5733219 - DNA, 16 bp, Homo sapiens
gaaagattatcctgtt

SEQ ID NO: 5733220 - DNA, 13 bp, Homo sapiens
gaaagattattta

SEQ ID NO: 5733221 - DNA, 17 bp, Homo sapiens
gaaagattatttaaatg

SEQ ID NO: 5733222 - DNA, 20 bp, Homo sapiens
gaaagatttaaagtatttta

SEQ ID NO: 5733223 - DNA, 16 bp, Homo sapiens
gaaagatttggaaaat

SEQ ID NO: 5733224 - DNA, 17 bp, Homo sapiens
gaaagatttgttactgt

SEQ ID NO: 5733225 - DNA, 14 bp, Homo sapiens
gaaagattttatgt

SEQ ID NO: 5733226 - DNA, 17 bp, Homo sapiens
gaaagattttattgtat

SEQ ID NO: 5733227 - DNA, 19 bp, Homo sapiens
gaaagattttattgtataa

SEQ ID NO: 5733228 - DNA, 15 bp, Homo sapiens
gaaagcaaaaaataa

SEQ ID NO: 5733229 - DNA, 19 bp, Homo sapiens
gaaagcaaaaaataaaata

SEQ ID NO: 5733230 - DNA, 20 bp, Homo sapiens
gaaagcaaaaaataaaataa

SEQ ID NO: 5733231 - DNA, 22 bp, Homo sapiens
gaaagcaaaaaataaaataagt

SEQ ID NO: 5733232 - DNA, 15 bp, Homo sapiens
gaaagcaaaaatgct

SEQ ID NO: 5733233 - DNA, 18 bp, Homo sapiens
gaaagcaaaaatgctaat

SEQ ID NO: 5733234 - DNA, 15 bp, Homo sapiens
gaaagcaaaatacat

SEQ ID NO: 5733235 - DNA, 16 bp, Homo sapiens
gaaagcaaaatacatc

SEQ ID NO: 5733236 - DNA, 15 bp, Homo sapiens
gaaagcaaagcacag

SEQ ID NO: 5733237 - DNA, 14 bp, Homo sapiens
gaaagcaaagggct

SEQ ID NO: 5733238 - DNA, 22 bp, Homo sapiens
gaaagcaaaggtgcactccaga

SEQ ID NO: 5733239 - DNA, 23 bp, Homo sapiens
gaaagcaaaggtgcactccagac

SEQ ID NO: 5733240 - DNA, 15 bp, Homo sapiens
gaaagcaaattattt

SEQ ID NO: 5733241 - DNA, 18 bp, Homo sapiens
gaaagcaaattattttta

SEQ ID NO: 5733242 - DNA, 17 bp, Homo sapiens
gaaagcaacaaagaaat

SEQ ID NO: 5733243 - DNA, 13 bp, Homo sapiens
gaaagcaacagct

SEQ ID NO: 5733244 - DNA, 12 bp, Homo sapiens
gaaagcaacttt

SEQ ID NO: 5733245 - DNA, 23 bp, Homo sapiens
gaaagcaagaccttgattgcacc

SEQ ID NO: 5733246 - DNA, 20 bp, Homo sapiens
gaaagcacagaggcctcctg

SEQ ID NO: 5733247 - DNA, 23 bp, Homo sapiens
gaaagcacaggtgggcttcccag

SEQ ID NO: 5733248 - DNA, 16 bp, Homo sapiens
gaaagcacatgaataa

SEQ ID NO: 5733249 - DNA, 17 bp, Homo sapiens
gaaagcactatgaattt

SEQ ID NO: 5733250 - DNA, 19 bp, Homo sapiens
gaaagcacttaaacagaag

SEQ ID NO: 5733251 - DNA, 17 bp, Homo sapiens
gaaagcagaacagtgat

SEQ ID NO: 5733252 - DNA, 22 bp, Homo sapiens
gaaagcagaacagtgattacca

SEQ ID NO: 5733253 - DNA, 23 bp, Homo sapiens
gaaagcagaactgaagccacttg

SEQ ID NO: 5733254 - DNA, 19 bp, Homo sapiens
gaaagcagagcctcctggg

SEQ ID NO: 5733255 - DNA, 14 bp, Homo sapiens
gaaagcagaggctg

SEQ ID NO: 5733256 - DNA, 19 bp, Homo sapiens
gaaagcagaggctggcctc

SEQ ID NO: 5733257 - DNA, 22 bp, Homo sapiens
gaaagcagatacctcaccctgc

SEQ ID NO: 5733258 - DNA, 16 bp, Homo sapiens
gaaagcagatcatctc

SEQ ID NO: 5733259 - DNA, 16 bp, Homo sapiens
gaaagcagcagcttgt

SEQ ID NO: 5733260 - DNA, 14 bp, Homo sapiens
gaaagcagctgaac

SEQ ID NO: 5733261 - DNA, 17 bp, Homo sapiens
gaaagcaggagcagctg

SEQ ID NO: 5733262 - DNA, 20 bp, Homo sapiens
gaaagcaggatgaattttct

SEQ ID NO: 5733263 - DNA, 14 bp, Homo sapiens
gaaagcagggactt

SEQ ID NO: 5733264 - DNA, 14 bp, Homo sapiens
gaaagcaggggcta

SEQ ID NO: 5733265 - DNA, 21 bp, Homo sapiens
gaaagcagtcagcggagagga

SEQ ID NO: 5733266 - DNA, 23 bp, Homo sapiens
gaaagcatatgggttagatgttg

SEQ ID NO: 5733267 - DNA, 18 bp, Homo sapiens
gaaagcatcacctcaggc

SEQ ID NO: 5733268 - DNA, 19 bp, Homo sapiens
gaaagcatcacctcaggcc

SEQ ID NO: 5733269 - DNA, 15 bp, Homo sapiens
gaaagcatccatgtg

SEQ ID NO: 5733270 - DNA, 20 bp, Homo sapiens
gaaagcatgtctctgcttcc

SEQ ID NO: 5733271 - DNA, 16 bp, Homo sapiens
gaaagcatttaggaga

SEQ ID NO: 5733272 - DNA, 17 bp, Homo sapiens
gaaagcatttaggagaa

SEQ ID NO: 5733273 - DNA, 21 bp, Homo sapiens
gaaagcatttaggagaatagc

SEQ ID NO: 5733274 - DNA, 12 bp, Homo sapiens
gaaagcatttga

SEQ ID NO: 5733275 - DNA, 15 bp, Homo sapiens
gaaagcatttgaatg

SEQ ID NO: 5733276 - DNA, 18 bp, Homo sapiens
gaaagcatttgaatgcat

SEQ ID NO: 5733277 - DNA, 14 bp, Homo sapiens
gaaagccacatctt

SEQ ID NO: 5733278 - DNA, 18 bp, Homo sapiens
gaaagccacctctccctc

SEQ ID NO: 5733279 - DNA, 17 bp, Homo sapiens
gaaagccacgccctccc

SEQ ID NO: 5733280 - DNA, 14 bp, Homo sapiens
gaaagccagaacct

SEQ ID NO: 5733281 - DNA, 13 bp, Homo sapiens
gaaagccagacaa

SEQ ID NO: 5733282 - DNA, 15 bp, Homo sapiens
gaaagccagacaact

SEQ ID NO: 5733283 - DNA, 16 bp, Homo sapiens
gaaagccagacaactt

SEQ ID NO: 5733284 - DNA, 20 bp, Homo sapiens
gaaagccagcaaagcctcca

SEQ ID NO: 5733285 - DNA, 12 bp, Homo sapiens
gaaagccagcct

SEQ ID NO: 5733286 - DNA, 11 bp, Homo sapiens
gaaagccaggc

SEQ ID NO: 5733287 - DNA, 11 bp, Homo sapiens
gaaagccaggt

SEQ ID NO: 5733288 - DNA, 14 bp, Homo sapiens
gaaagccagtctta

SEQ ID NO: 5733289 - DNA, 15 bp, Homo sapiens
gaaagccagtcttaa

SEQ ID NO: 5733290 - DNA, 19 bp, Homo sapiens
gaaagccagtgactccagg

SEQ ID NO: 5733291 - DNA, 20 bp, Homo sapiens
gaaagccagtgactccagga

SEQ ID NO: 5733292 - DNA, 22 bp, Homo sapiens
gaaagccatatttttttctgta

SEQ ID NO: 5733293 - DNA, 19 bp, Homo sapiens
gaaagcccaaggtgctgat

SEQ ID NO: 5733294 - DNA, 14 bp, Homo sapiens
gaaagcccacctgg

SEQ ID NO: 5733295 - DNA, 19 bp, Homo sapiens
gaaagcccacctgggctgg

SEQ ID NO: 5733296 - DNA, 14 bp, Homo sapiens
gaaagcccagactt

SEQ ID NO: 5733297 - DNA, 13 bp, Homo sapiens
gaaagccccaccc

SEQ ID NO: 5733298 - DNA, 21 bp, Homo sapiens
gaaagccccacccaggccagg

SEQ ID NO: 5733299 - DNA, 19 bp, Homo sapiens
gaaagcccctcacctcagg

SEQ ID NO: 5733300 - DNA, 15 bp, Homo sapiens
gaaagccctaaaata

SEQ ID NO: 5733301 - DNA, 21 bp, Homo sapiens
gaaagccctgagctttctgct

SEQ ID NO: 5733302 - DNA, 13 bp, Homo sapiens
gaaagccctgtgc

SEQ ID NO: 5733303 - DNA, 14 bp, Homo sapiens
gaaagcctagtcca

SEQ ID NO: 5733304 - DNA, 18 bp, Homo sapiens
gaaagcctcactgatata

SEQ ID NO: 5733305 - DNA, 19 bp, Homo sapiens
gaaagcctccgctgggctt

SEQ ID NO: 5733306 - DNA, 14 bp, Homo sapiens
gaaagcctctctct

SEQ ID NO: 5733307 - DNA, 14 bp, Homo sapiens
gaaagcctctgtcc

SEQ ID NO: 5733308 - DNA, 14 bp, Homo sapiens
gaaagcctgaaggg

SEQ ID NO: 5733309 - DNA, 20 bp, Homo sapiens
gaaagcctgttcccctcact

SEQ ID NO: 5733310 - DNA, 16 bp, Homo sapiens
gaaagccttagggaag

SEQ ID NO: 5733311 - DNA, 14 bp, Homo sapiens
gaaagcctttcatt

SEQ ID NO: 5733312 - DNA, 17 bp, Homo sapiens
gaaagcctttcattttg

SEQ ID NO: 5733313 - DNA, 16 bp, Homo sapiens
gaaagcgacttcaggt

SEQ ID NO: 5733314 - DNA, 16 bp, Homo sapiens
gaaagcgattcactgt

SEQ ID NO: 5733315 - DNA, 20 bp, Homo sapiens
gaaagcgcccctcactcctg

SEQ ID NO: 5733316 - DNA, 17 bp, Homo sapiens
gaaagcgcctccaaccc

SEQ ID NO: 5733317 - DNA, 22 bp, Homo sapiens
gaaagcgcctccaaccctagca

SEQ ID NO: 5733318 - DNA, 14 bp, Homo sapiens
gaaagcggctgcct

SEQ ID NO: 5733319 - DNA, 15 bp, Homo sapiens
gaaagcggctgcctc

SEQ ID NO: 5733320 - DNA, 17 bp, Homo sapiens
gaaagcggctgcctcca

SEQ ID NO: 5733321 - DNA, 16 bp, Homo sapiens
gaaagcgggcagcccc

SEQ ID NO: 5733322 - DNA, 17 bp, Homo sapiens
gaaagcgggcagccccg

SEQ ID NO: 5733323 - DNA, 21 bp, Homo sapiens
gaaagcgtgtgagtgagggag

SEQ ID NO: 5733324 - DNA, 14 bp, Homo sapiens
gaaagctaaagttt

SEQ ID NO: 5733325 - DNA, 21 bp, Homo sapiens
gaaagctaatacaaaactatc

SEQ ID NO: 5733326 - DNA, 16 bp, Homo sapiens
gaaagctaatactaat

SEQ ID NO: 5733327 - DNA, 19 bp, Homo sapiens
gaaagctagatatgcctta

SEQ ID NO: 5733328 - DNA, 17 bp, Homo sapiens
gaaagctcactgtagct

SEQ ID NO: 5733329 - DNA, 16 bp, Homo sapiens
gaaagctgaaaagcat

SEQ ID NO: 5733330 - DNA, 23 bp, Homo sapiens
gaaagctgaaagggaaggacagc

SEQ ID NO: 5733331 - DNA, 15 bp, Homo sapiens
gaaagctgacttggc

SEQ ID NO: 5733332 - DNA, 16 bp, Homo sapiens
gaaagctgacttggct

SEQ ID NO: 5733333 - DNA, 19 bp, Homo sapiens
gaaagctgacttggctggt

SEQ ID NO: 5733334 - DNA, 22 bp, Homo sapiens
gaaagctgatgatgtctcttgt

SEQ ID NO: 5733335 - DNA, 22 bp, Homo sapiens
gaaagctgattactgtcaataa

SEQ ID NO: 5733336 - DNA, 14 bp, Homo sapiens
gaaagctgcactca

SEQ ID NO: 5733337 - DNA, 19 bp, Homo sapiens
gaaagctgctctgctcaga

SEQ ID NO: 5733338 - DNA, 15 bp, Homo sapiens
gaaagctgcttctgg

SEQ ID NO: 5733339 - DNA, 12 bp, Homo sapiens
gaaagctgcttt

SEQ ID NO: 5733340 - DNA, 15 bp, Homo sapiens
gaaagctggactgac

SEQ ID NO: 5733341 - DNA, 20 bp, Homo sapiens
gaaagctggactgaccaaag

SEQ ID NO: 5733342 - DNA, 19 bp, Homo sapiens
gaaagctggtggcagagtc

SEQ ID NO: 5733343 - DNA, 14 bp, Homo sapiens
gaaagctgtgaaat

SEQ ID NO: 5733344 - DNA, 17 bp, Homo sapiens
gaaagctgtgaacaggc

SEQ ID NO: 5733345 - DNA, 20 bp, Homo sapiens
gaaagctgtgtttatatgga

SEQ ID NO: 5733346 - DNA, 19 bp, Homo sapiens
gaaagcttcaaattataga

SEQ ID NO: 5733347 - DNA, 21 bp, Homo sapiens
gaaagcttcaaattatagaaa

SEQ ID NO: 5733348 - DNA, 18 bp, Homo sapiens
gaaagcttcagtgctgcc

SEQ ID NO: 5733349 - DNA, 22 bp, Homo sapiens
gaaagctttggaaaaatctttt

SEQ ID NO: 5733350 - DNA, 15 bp, Homo sapiens
gaaagcttttaaaat

SEQ ID NO: 5733351 - DNA, 20 bp, Homo sapiens
gaaagcttttattcctttga

SEQ ID NO: 5733352 - DNA, 22 bp, Homo sapiens
gaaaggaaaaacagaacatttc

SEQ ID NO: 5733353 - DNA, 11 bp, Homo sapiens
gaaaggaaaac

SEQ ID NO: 5733354 - DNA, 15 bp, Homo sapiens
gaaaggaaaaccagg

SEQ ID NO: 5733355 - DNA, 14 bp, Homo sapiens
gaaaggaaaagagg

SEQ ID NO: 5733356 - DNA, 14 bp, Homo sapiens
gaaaggaaacattg

SEQ ID NO: 5733357 - DNA, 11 bp, Homo sapiens
gaaaggaaaga

SEQ ID NO: 5733358 - DNA, 16 bp, Homo sapiens
gaaaggaaagaaggag

SEQ ID NO: 5733359 - DNA, 21 bp, Homo sapiens
gaaaggaagatgtaagaagct

SEQ ID NO: 5733360 - DNA, 12 bp, Homo sapiens
gaaaggaagcaa

SEQ ID NO: 5733361 - DNA, 18 bp, Homo sapiens
gaaaggaagctccactgt

SEQ ID NO: 5733362 - DNA, 13 bp, Homo sapiens
gaaaggaataaaa

SEQ ID NO: 5733363 - DNA, 15 bp, Homo sapiens
gaaaggacagagcca

SEQ ID NO: 5733364 - DNA, 20 bp, Homo sapiens
gaaaggaccaaattgcttta

SEQ ID NO: 5733365 - DNA, 13 bp, Homo sapiens
gaaaggacccacc

SEQ ID NO: 5733366 - DNA, 16 bp, Homo sapiens
gaaaggacctgcaaac

SEQ ID NO: 5733367 - DNA, 21 bp, Homo sapiens
gaaaggactctggggttttta

SEQ ID NO: 5733368 - DNA, 23 bp, Homo sapiens
gaaaggactctggggtttttact

SEQ ID NO: 5733369 - DNA, 15 bp, Homo sapiens
gaaaggagaatttga

SEQ ID NO: 5733370 - DNA, 14 bp, Homo sapiens
gaaaggagacattg

SEQ ID NO: 5733371 - DNA, 15 bp, Homo sapiens
gaaaggagagtactt

SEQ ID NO: 5733372 - DNA, 14 bp, Homo sapiens
gaaaggaggaccag

SEQ ID NO: 5733373 - DNA, 19 bp, Homo sapiens
gaaaggaggaccagtcagg

SEQ ID NO: 5733374 - DNA, 18 bp, Homo sapiens
gaaaggaggcatgcctct

SEQ ID NO: 5733375 - DNA, 19 bp, Homo sapiens
gaaaggaggcatgcctctg

SEQ ID NO: 5733376 - DNA, 20 bp, Homo sapiens
gaaaggaggcatgcctctga

SEQ ID NO: 5733377 - DNA, 21 bp, Homo sapiens
gaaaggaggcatgcctctgat

SEQ ID NO: 5733378 - DNA, 15 bp, Homo sapiens
gaaaggaggggagaa

SEQ ID NO: 5733379 - DNA, 15 bp, Homo sapiens
gaaaggagtagtttt

SEQ ID NO: 5733380 - DNA, 22 bp, Homo sapiens
gaaaggagtttctttagctgac

SEQ ID NO: 5733381 - DNA, 16 bp, Homo sapiens
gaaaggatatttaaga

SEQ ID NO: 5733382 - DNA, 14 bp, Homo sapiens
gaaaggatctgtga

SEQ ID NO: 5733383 - DNA, 21 bp, Homo sapiens
gaaaggatctgtgattggctg

SEQ ID NO: 5733384 - DNA, 21 bp, Homo sapiens
gaaaggatggagtgttttagt

SEQ ID NO: 5733385 - DNA, 23 bp, Homo sapiens
gaaaggatggcagcctcagggct

SEQ ID NO: 5733386 - DNA, 22 bp, Homo sapiens
gaaaggatgtaaacagtgcctg

SEQ ID NO: 5733387 - DNA, 14 bp, Homo sapiens
gaaaggattaagat

SEQ ID NO: 5733388 - DNA, 19 bp, Homo sapiens
gaaaggattaagatacact

SEQ ID NO: 5733389 - DNA, 14 bp, Homo sapiens
gaaaggattcatgt

SEQ ID NO: 5733390 - DNA, 18 bp, Homo sapiens
gaaaggattctaaacaga

SEQ ID NO: 5733391 - DNA, 13 bp, Homo sapiens
gaaaggattttac

SEQ ID NO: 5733392 - DNA, 17 bp, Homo sapiens
gaaaggcaaccaataaa

SEQ ID NO: 5733393 - DNA, 13 bp, Homo sapiens
gaaaggcaaggga

SEQ ID NO: 5733394 - DNA, 12 bp, Homo sapiens
gaaaggcagaaa

SEQ ID NO: 5733395 - DNA, 14 bp, Homo sapiens
gaaaggcagatgta

SEQ ID NO: 5733396 - DNA, 18 bp, Homo sapiens
gaaaggcagccctcacct

SEQ ID NO: 5733397 - DNA, 12 bp, Homo sapiens
gaaaggcagggc

SEQ ID NO: 5733398 - DNA, 15 bp, Homo sapiens
gaaaggcaggtttca

SEQ ID NO: 5733399 - DNA, 16 bp, Homo sapiens
gaaaggcattctctga

SEQ ID NO: 5733400 - DNA, 17 bp, Homo sapiens
gaaaggcattctctgaa

SEQ ID NO: 5733401 - DNA, 16 bp, Homo sapiens
gaaaggcattgcacag

SEQ ID NO: 5733402 - DNA, 13 bp, Homo sapiens
gaaaggccagcag

SEQ ID NO: 5733403 - DNA, 14 bp, Homo sapiens
gaaaggccagcagc

SEQ ID NO: 5733404 - DNA, 17 bp, Homo sapiens
gaaaggccagcagcctt

SEQ ID NO: 5733405 - DNA, 21 bp, Homo sapiens
gaaaggccagcagctgatgct

SEQ ID NO: 5733406 - DNA, 16 bp, Homo sapiens
gaaaggccagctggca

SEQ ID NO: 5733407 - DNA, 22 bp, Homo sapiens
gaaaggccagctggcagcagag

SEQ ID NO: 5733408 - DNA, 22 bp, Homo sapiens
gaaaggcctgtggggagccgag

SEQ ID NO: 5733409 - DNA, 14 bp, Homo sapiens
gaaaggcctttaaa

SEQ ID NO: 5733410 - DNA, 21 bp, Homo sapiens
gaaaggcgcccccgccccagg

SEQ ID NO: 5733411 - DNA, 16 bp, Homo sapiens
gaaaggctcatttaaa

SEQ ID NO: 5733412 - DNA, 19 bp, Homo sapiens
gaaaggctcatttaaaaca

SEQ ID NO: 5733413 - DNA, 22 bp, Homo sapiens
gaaaggctcatttaaaacaggc

SEQ ID NO: 5733414 - DNA, 15 bp, Homo sapiens
gaaaggctccaggag

SEQ ID NO: 5733415 - DNA, 22 bp, Homo sapiens
gaaaggctccaggagcagccac

SEQ ID NO: 5733416 - DNA, 15 bp, Homo sapiens
gaaaggctctgaaag

SEQ ID NO: 5733417 - DNA, 22 bp, Homo sapiens
gaaaggctgcaacgctgattcc

SEQ ID NO: 5733418 - DNA, 21 bp, Homo sapiens
gaaaggctgccgaggaccctc

SEQ ID NO: 5733419 - DNA, 19 bp, Homo sapiens
gaaaggctgctgtactgaa

SEQ ID NO: 5733420 - DNA, 20 bp, Homo sapiens
gaaaggctgctgtactgaag

SEQ ID NO: 5733421 - DNA, 15 bp, Homo sapiens
gaaaggctgtggcat

SEQ ID NO: 5733422 - DNA, 23 bp, Homo sapiens
gaaaggcttccagatgtctaaaa

SEQ ID NO: 5733423 - DNA, 16 bp, Homo sapiens
gaaagggaaactggct

SEQ ID NO: 5733424 - DNA, 15 bp, Homo sapiens
gaaagggaactagat

SEQ ID NO: 5733425 - DNA, 15 bp, Homo sapiens
gaaagggaagcctga

SEQ ID NO: 5733426 - DNA, 20 bp, Homo sapiens
gaaagggaagcctgactgct

SEQ ID NO: 5733427 - DNA, 18 bp, Homo sapiens
gaaagggaagtgatatca

SEQ ID NO: 5733428 - DNA, 14 bp, Homo sapiens
gaaagggacaagta

SEQ ID NO: 5733429 - DNA, 16 bp, Homo sapiens
gaaagggacccacctg

SEQ ID NO: 5733430 - DNA, 15 bp, Homo sapiens
gaaagggagagaaaa

SEQ ID NO: 5733431 - DNA, 20 bp, Homo sapiens
gaaagggagagaaaactctt

SEQ ID NO: 5733432 - DNA, 19 bp, Homo sapiens
gaaagggagatgtcaggat

SEQ ID NO: 5733433 - DNA, 15 bp, Homo sapiens
gaaagggagggctct

SEQ ID NO: 5733434 - DNA, 20 bp, Homo sapiens
gaaagggagggctctgaggc

SEQ ID NO: 5733435 - DNA, 14 bp, Homo sapiens
gaaagggatcatca

SEQ ID NO: 5733436 - DNA, 19 bp, Homo sapiens
gaaagggattgctgaggca

SEQ ID NO: 5733437 - DNA, 23 bp, Homo sapiens
gaaagggcacttaatttgtaaac

SEQ ID NO: 5733438 - DNA, 15 bp, Homo sapiens
gaaagggcagcccct

SEQ ID NO: 5733439 - DNA, 17 bp, Homo sapiens
gaaagggcagcccctcc

SEQ ID NO: 5733440 - DNA, 13 bp, Homo sapiens
gaaagggcccaga

SEQ ID NO: 5733441 - DNA, 14 bp, Homo sapiens
gaaagggcctggcc

SEQ ID NO: 5733442 - DNA, 22 bp, Homo sapiens
gaaagggcctggccagtcctgg

SEQ ID NO: 5733443 - DNA, 18 bp, Homo sapiens
gaaagggctatggcaagg

SEQ ID NO: 5733444 - DNA, 14 bp, Homo sapiens
gaaagggctggctg

SEQ ID NO: 5733445 - DNA, 16 bp, Homo sapiens
gaaaggggacaaggaa

SEQ ID NO: 5733446 - DNA, 18 bp, Homo sapiens
gaaaggggacaaggaagg

SEQ ID NO: 5733447 - DNA, 17 bp, Homo sapiens
gaaaggggacacctgta

SEQ ID NO: 5733448 - DNA, 19 bp, Homo sapiens
gaaaggggagtaggtgggg

SEQ ID NO: 5733449 - DNA, 22 bp, Homo sapiens
gaaaggggatggagtgagccca

SEQ ID NO: 5733450 - DNA, 19 bp, Homo sapiens
gaaaggggcgagggagggg

SEQ ID NO: 5733451 - DNA, 22 bp, Homo sapiens
gaaaggggctagcactggatgg

SEQ ID NO: 5733452 - DNA, 17 bp, Homo sapiens
gaaagggggtcccagtg

SEQ ID NO: 5733453 - DNA, 15 bp, Homo sapiens
gaaagggggtgacct

SEQ ID NO: 5733454 - DNA, 23 bp, Homo sapiens
gaaagggggtgacctcttgcctc

SEQ ID NO: 5733455 - DNA, 17 bp, Homo sapiens
gaaaggggtcggctgac

SEQ ID NO: 5733456 - DNA, 21 bp, Homo sapiens
gaaaggggtgattgaaagaaa

SEQ ID NO: 5733457 - DNA, 15 bp, Homo sapiens
gaaaggggtgctttt

SEQ ID NO: 5733458 - DNA, 11 bp, Homo sapiens
gaaaggggtgt

SEQ ID NO: 5733459 - DNA, 12 bp, Homo sapiens
gaaagggtctcc

SEQ ID NO: 5733460 - DNA, 14 bp, Homo sapiens
gaaagggttaatca

SEQ ID NO: 5733461 - DNA, 21 bp, Homo sapiens
gaaagggtttgtaatacttta

SEQ ID NO: 5733462 - DNA, 18 bp, Homo sapiens
gaaaggtctcagcttgta

SEQ ID NO: 5733463 - DNA, 18 bp, Homo sapiens
gaaaggtctctggaggga

SEQ ID NO: 5733464 - DNA, 19 bp, Homo sapiens
gaaaggtgaaacacacaca

SEQ ID NO: 5733465 - DNA, 23 bp, Homo sapiens
gaaaggtgagtttgagctgcctt

SEQ ID NO: 5733466 - DNA, 17 bp, Homo sapiens
gaaaggtgcagctgcgt

SEQ ID NO: 5733467 - DNA, 22 bp, Homo sapiens
gaaaggtgccatggaagaggct

SEQ ID NO: 5733468 - DNA, 14 bp, Homo sapiens
gaaaggtgccatgt

SEQ ID NO: 5733469 - DNA, 19 bp, Homo sapiens
gaaaggtgctatataattg

SEQ ID NO: 5733470 - DNA, 19 bp, Homo sapiens
gaaaggtgctcaaagatgt

SEQ ID NO: 5733471 - DNA, 12 bp, Homo sapiens
gaaaggtgctga

SEQ ID NO: 5733472 - DNA, 20 bp, Homo sapiens
gaaaggtgctgatggccctc

SEQ ID NO: 5733473 - DNA, 14 bp, Homo sapiens
gaaaggtggtgttt

SEQ ID NO: 5733474 - DNA, 22 bp, Homo sapiens
gaaaggtggtgtttctgtaaga

SEQ ID NO: 5733475 - DNA, 16 bp, Homo sapiens
gaaaggtgtgaggaga

SEQ ID NO: 5733476 - DNA, 14 bp, Homo sapiens
gaaaggttctgccc

SEQ ID NO: 5733477 - DNA, 21 bp, Homo sapiens
gaaaggttgattctcatgcac

SEQ ID NO: 5733478 - DNA, 14 bp, Homo sapiens
gaaaggtttacatt

SEQ ID NO: 5733479 - DNA, 14 bp, Homo sapiens
gaaaggtttcaaga

SEQ ID NO: 5733480 - DNA, 16 bp, Homo sapiens
gaaaggtttcaagact

SEQ ID NO: 5733481 - DNA, 21 bp, Homo sapiens
gaaaggtttcaagacttgata

SEQ ID NO: 5733482 - DNA, 13 bp, Homo sapiens
gaaaggttttgag

SEQ ID NO: 5733483 - DNA, 14 bp, Homo sapiens
gaaaggttttgtat

SEQ ID NO: 5733484 - DNA, 18 bp, Homo sapiens
gaaagtaaaaaaataatt

SEQ ID NO: 5733485 - DNA, 14 bp, Homo sapiens
gaaagtaaaaagaa

SEQ ID NO: 5733486 - DNA, 15 bp, Homo sapiens
gaaagtaaaagttat

SEQ ID NO: 5733487 - DNA, 19 bp, Homo sapiens
gaaagtaaataaaaggact

SEQ ID NO: 5733488 - DNA, 16 bp, Homo sapiens
gaaagtaagaaaacaa

SEQ ID NO: 5733489 - DNA, 19 bp, Homo sapiens
gaaagtaagaaaacaatat

SEQ ID NO: 5733490 - DNA, 20 bp, Homo sapiens
gaaagtaagcatttccagcc

SEQ ID NO: 5733491 - DNA, 15 bp, Homo sapiens
gaaagtaagtctttt

SEQ ID NO: 5733492 - DNA, 13 bp, Homo sapiens
gaaagtaatttaa

SEQ ID NO: 5733493 - DNA, 13 bp, Homo sapiens
gaaagtaatttca

SEQ ID NO: 5733494 - DNA, 14 bp, Homo sapiens
gaaagtaatttctt

SEQ ID NO: 5733495 - DNA, 16 bp, Homo sapiens
gaaagtaatttcttct

SEQ ID NO: 5733496 - DNA, 19 bp, Homo sapiens
gaaagtaatttcttctcaa

SEQ ID NO: 5733497 - DNA, 20 bp, Homo sapiens
gaaagtacactctgctgttt

SEQ ID NO: 5733498 - DNA, 16 bp, Homo sapiens
gaaagtacagcagtag

SEQ ID NO: 5733499 - DNA, 16 bp, Homo sapiens
gaaagtagaacttact

SEQ ID NO: 5733500 - DNA, 18 bp, Homo sapiens
gaaagtagtccaggctgt

SEQ ID NO: 5733501 - DNA, 19 bp, Homo sapiens
gaaagtatagatggccaaa

SEQ ID NO: 5733502 - DNA, 15 bp, Homo sapiens
gaaagtatatactga

SEQ ID NO: 5733503 - DNA, 19 bp, Homo sapiens
gaaagtatgtgatatctga

SEQ ID NO: 5733504 - DNA, 15 bp, Homo sapiens
gaaagtatgttgtat

SEQ ID NO: 5733505 - DNA, 14 bp, Homo sapiens
gaaagtattcagaa

SEQ ID NO: 5733506 - DNA, 16 bp, Homo sapiens
gaaagtattcagaaat

SEQ ID NO: 5733507 - DNA, 18 bp, Homo sapiens
gaaagtattcagaaatta

SEQ ID NO: 5733508 - DNA, 23 bp, Homo sapiens
gaaagtattcagaaattaaaata

SEQ ID NO: 5733509 - DNA, 15 bp, Homo sapiens
gaaagtatttttgaa

SEQ ID NO: 5733510 - DNA, 18 bp, Homo sapiens
gaaagtatttttgaaaga

SEQ ID NO: 5733511 - DNA, 18 bp, Homo sapiens
gaaagtcaaaaaattatt

SEQ ID NO: 5733512 - DNA, 17 bp, Homo sapiens
gaaagtcaaatttactt

SEQ ID NO: 5733513 - DNA, 15 bp, Homo sapiens
gaaagtcaccaggac

SEQ ID NO: 5733514 - DNA, 18 bp, Homo sapiens
gaaagtcacccaaacact

SEQ ID NO: 5733515 - DNA, 23 bp, Homo sapiens
gaaagtcacccaaacacttctgc

SEQ ID NO: 5733516 - DNA, 19 bp, Homo sapiens
gaaagtcacctacaggact

SEQ ID NO: 5733517 - DNA, 17 bp, Homo sapiens
gaaagtcatgaacacat

SEQ ID NO: 5733518 - DNA, 19 bp, Homo sapiens
gaaagtcatgaacacatca

SEQ ID NO: 5733519 - DNA, 21 bp, Homo sapiens
gaaagtcattggctttatcct

SEQ ID NO: 5733520 - DNA, 17 bp, Homo sapiens
gaaagtccattgatgtc

SEQ ID NO: 5733521 - DNA, 13 bp, Homo sapiens
gaaagtcccccct

SEQ ID NO: 5733522 - DNA, 16 bp, Homo sapiens
gaaagtcctgctttcc

SEQ ID NO: 5733523 - DNA, 22 bp, Homo sapiens
gaaagtcgaattaatagctttt

SEQ ID NO: 5733524 - DNA, 14 bp, Homo sapiens
gaaagtctctgata

SEQ ID NO: 5733525 - DNA, 23 bp, Homo sapiens
gaaagtctgtccttgaaggacta

SEQ ID NO: 5733526 - DNA, 21 bp, Homo sapiens
gaaagtcttgtgactagtgct

SEQ ID NO: 5733527 - DNA, 17 bp, Homo sapiens
gaaagtgaataaaaatt

SEQ ID NO: 5733528 - DNA, 18 bp, Homo sapiens
gaaagtgaataaacttca

SEQ ID NO: 5733529 - DNA, 22 bp, Homo sapiens
gaaagtgaataaacttcagcac

SEQ ID NO: 5733530 - DNA, 13 bp, Homo sapiens
gaaagtgaatttg

SEQ ID NO: 5733531 - DNA, 17 bp, Homo sapiens
gaaagtgaatttgaatg

SEQ ID NO: 5733532 - DNA, 16 bp, Homo sapiens
gaaagtgacagagacc

SEQ ID NO: 5733533 - DNA, 17 bp, Homo sapiens
gaaagtgactttaaaag

SEQ ID NO: 5733534 - DNA, 21 bp, Homo sapiens
gaaagtgatatcccccagcct

SEQ ID NO: 5733535 - DNA, 16 bp, Homo sapiens
gaaagtgatttgtaat

SEQ ID NO: 5733536 - DNA, 12 bp, Homo sapiens
gaaagtgcagaa

SEQ ID NO: 5733537 - DNA, 22 bp, Homo sapiens
gaaagtgcagaatcaacttgaa

SEQ ID NO: 5733538 - DNA, 18 bp, Homo sapiens
gaaagtgcagcatggagg

SEQ ID NO: 5733539 - DNA, 21 bp, Homo sapiens
gaaagtgcctttcaggatcta

SEQ ID NO: 5733540 - DNA, 18 bp, Homo sapiens
gaaagtgcctttgcagct

SEQ ID NO: 5733541 - DNA, 20 bp, Homo sapiens
gaaagtgcctttgcagctca

SEQ ID NO: 5733542 - DNA, 17 bp, Homo sapiens
gaaagtgcgttctccca

SEQ ID NO: 5733543 - DNA, 17 bp, Homo sapiens
gaaagtggcagagccag

SEQ ID NO: 5733544 - DNA, 21 bp, Homo sapiens
gaaagtgggaggtcaggaaac

SEQ ID NO: 5733545 - DNA, 22 bp, Homo sapiens
gaaagtgggcttaatggagttc

SEQ ID NO: 5733546 - DNA, 15 bp, Homo sapiens
gaaagtgggggtgga

SEQ ID NO: 5733547 - DNA, 18 bp, Homo sapiens
gaaagtgggggtggagga

SEQ ID NO: 5733548 - DNA, 21 bp, Homo sapiens
gaaagtgggtgagatgctgga

SEQ ID NO: 5733549 - DNA, 23 bp, Homo sapiens
gaaagtgggtgagatgctggaga

SEQ ID NO: 5733550 - DNA, 23 bp, Homo sapiens
gaaagtgggttcactagagctgg

SEQ ID NO: 5733551 - DNA, 24 bp, Homo sapiens
gaaagtgggttcactagagctggg

SEQ ID NO: 5733552 - DNA, 10 bp, Homo sapiens
gaaagtggtg

SEQ ID NO: 5733553 - DNA, 16 bp, Homo sapiens
gaaagtggtgctcagt

SEQ ID NO: 5733554 - DNA, 15 bp, Homo sapiens
gaaagtgtatttgga

SEQ ID NO: 5733555 - DNA, 23 bp, Homo sapiens
gaaagtgtatttggaaataaagt

SEQ ID NO: 5733556 - DNA, 18 bp, Homo sapiens
gaaagtgtgagctcttcc

SEQ ID NO: 5733557 - DNA, 19 bp, Homo sapiens
gaaagtgtgagctcttccc

SEQ ID NO: 5733558 - DNA, 23 bp, Homo sapiens
gaaagtgttatttttcaaggaag

SEQ ID NO: 5733559 - DNA, 13 bp, Homo sapiens
gaaagtgttctgt

SEQ ID NO: 5733560 - DNA, 14 bp, Homo sapiens
gaaagtgttctgtt

SEQ ID NO: 5733561 - DNA, 19 bp, Homo sapiens
gaaagtgttctgttacaaa

SEQ ID NO: 5733562 - DNA, 18 bp, Homo sapiens
gaaagttagggggttctt

SEQ ID NO: 5733563 - DNA, 15 bp, Homo sapiens
gaaagttattgtgtt

SEQ ID NO: 5733564 - DNA, 20 bp, Homo sapiens
gaaagttattgtgttgcctt

SEQ ID NO: 5733565 - DNA, 22 bp, Homo sapiens
gaaagttattgtgttgccttag

SEQ ID NO: 5733566 - DNA, 13 bp, Homo sapiens
gaaagttcatgct

SEQ ID NO: 5733567 - DNA, 15 bp, Homo sapiens
gaaagttctcagaac

SEQ ID NO: 5733568 - DNA, 21 bp, Homo sapiens
gaaagttgcaaggcaaatgtt

SEQ ID NO: 5733569 - DNA, 20 bp, Homo sapiens
gaaagttgcacggctgctga

SEQ ID NO: 5733570 - DNA, 12 bp, Homo sapiens
gaaagttgccat

SEQ ID NO: 5733571 - DNA, 18 bp, Homo sapiens
gaaagttgccattattct

SEQ ID NO: 5733572 - DNA, 19 bp, Homo sapiens
gaaagttgcttttattgca

SEQ ID NO: 5733573 - DNA, 13 bp, Homo sapiens
gaaagttggaaag

SEQ ID NO: 5733574 - DNA, 14 bp, Homo sapiens
gaaagttggaaagg

SEQ ID NO: 5733575 - DNA, 14 bp, Homo sapiens
gaaagttggttttg

SEQ ID NO: 5733576 - DNA, 13 bp, Homo sapiens
gaaagttgtacat

SEQ ID NO: 5733577 - DNA, 14 bp, Homo sapiens
gaaagttgtacatg

SEQ ID NO: 5733578 - DNA, 17 bp, Homo sapiens
gaaagttgtacatgaaa

SEQ ID NO: 5733579 - DNA, 19 bp, Homo sapiens
gaaagttgtacatgataag

SEQ ID NO: 5733580 - DNA, 18 bp, Homo sapiens
gaaagttgtatccattaa

SEQ ID NO: 5733581 - DNA, 11 bp, Homo sapiens
gaaagtttctt

SEQ ID NO: 5733582 - DNA, 22 bp, Homo sapiens
gaaagtttcttggtctcagctt

SEQ ID NO: 5733583 - DNA, 22 bp, Homo sapiens
gaaagtttggggacatgtgatt

SEQ ID NO: 5733584 - DNA, 20 bp, Homo sapiens
gaaagtttgtagcatttttc

SEQ ID NO: 5733585 - DNA, 22 bp, Homo sapiens
gaaagtttgttctgcagagact

SEQ ID NO: 5733586 - DNA, 21 bp, Homo sapiens
gaaagttttccagtattgaaa

SEQ ID NO: 5733587 - DNA, 23 bp, Homo sapiens
gaaagttttgatacttgtaactt

SEQ ID NO: 5733588 - DNA, 13 bp, Homo sapiens
gaaagttttgtaa

SEQ ID NO: 5733589 - DNA, 14 bp, Homo sapiens
gaaagttttgttct

SEQ ID NO: 5733590 - DNA, 15 bp, Homo sapiens
gaaagttttgttctg

SEQ ID NO: 5733591 - DNA, 16 bp, Homo sapiens
gaaagttttgttctgt

SEQ ID NO: 5733592 - DNA, 14 bp, Homo sapiens
gaaagtttttaatt

SEQ ID NO: 5733593 - DNA, 14 bp, Homo sapiens
gaaataaaaaagtc

SEQ ID NO: 5733594 - DNA, 15 bp, Homo sapiens
gaaataaaaaagtct

SEQ ID NO: 5733595 - DNA, 20 bp, Homo sapiens
gaaataaaaagtatgttgta

SEQ ID NO: 5733596 - DNA, 19 bp, Homo sapiens
gaaataaaacaactctgat

SEQ ID NO: 5733597 - DNA, 14 bp, Homo sapiens
gaaataaaacagga

SEQ ID NO: 5733598 - DNA, 15 bp, Homo sapiens
gaaataaaacaggac

SEQ ID NO: 5733599 - DNA, 18 bp, Homo sapiens
gaaataaaacctttcaaa

SEQ ID NO: 5733600 - DNA, 14 bp, Homo sapiens
gaaataaaagtatg

SEQ ID NO: 5733601 - DNA, 17 bp, Homo sapiens
gaaataaaagtatgaat

SEQ ID NO: 5733602 - DNA, 19 bp, Homo sapiens
gaaataaaagtgaatgaaa

SEQ ID NO: 5733603 - DNA, 21 bp, Homo sapiens
gaaataaaatacacaacacaa

SEQ ID NO: 5733604 - DNA, 12 bp, Homo sapiens
gaaataaaatcc

SEQ ID NO: 5733605 - DNA, 20 bp, Homo sapiens
gaaataaaatgaaatgtctt

SEQ ID NO: 5733606 - DNA, 23 bp, Homo sapiens
gaaataaaatgccatagtttgtg

SEQ ID NO: 5733607 - DNA, 12 bp, Homo sapiens
gaaataaaatta

SEQ ID NO: 5733608 - DNA, 13 bp, Homo sapiens
gaaataaaatttg

SEQ ID NO: 5733609 - DNA, 13 bp, Homo sapiens
gaaataaacactg

SEQ ID NO: 5733610 - DNA, 15 bp, Homo sapiens
gaaataaacactggt

SEQ ID NO: 5733611 - DNA, 19 bp, Homo sapiens
gaaataaacactggtgcca

SEQ ID NO: 5733612 - DNA, 13 bp, Homo sapiens
gaaataaacatta

SEQ ID NO: 5733613 - DNA, 19 bp, Homo sapiens
gaaataaaccaaaggaaaa

SEQ ID NO: 5733614 - DNA, 22 bp, Homo sapiens
gaaataaaccttaatatttctt

SEQ ID NO: 5733615 - DNA, 18 bp, Homo sapiens
gaaataaacgtcttaaat

SEQ ID NO: 5733616 - DNA, 14 bp, Homo sapiens
gaaataaagaaaat

SEQ ID NO: 5733617 - DNA, 15 bp, Homo sapiens
gaaataaagaaaatt

SEQ ID NO: 5733618 - DNA, 19 bp, Homo sapiens
gaaataaagaaaattctct

SEQ ID NO: 5733619 - DNA, 17 bp, Homo sapiens
gaaataaagaatttaaa

SEQ ID NO: 5733620 - DNA, 21 bp, Homo sapiens
gaaataaaggtaaaatcactt

SEQ ID NO: 5733621 - DNA, 19 bp, Homo sapiens
gaaataaagtaggaaagaa

SEQ ID NO: 5733622 - DNA, 19 bp, Homo sapiens
gaaataaagttaagtttgt

SEQ ID NO: 5733623 - DNA, 22 bp, Homo sapiens
gaaataaataaattgcctccct

SEQ ID NO: 5733624 - DNA, 13 bp, Homo sapiens
gaaataaatcaca

SEQ ID NO: 5733625 - DNA, 16 bp, Homo sapiens
gaaataaatcagagag

SEQ ID NO: 5733626 - DNA, 15 bp, Homo sapiens
gaaataaatctaaat

SEQ ID NO: 5733627 - DNA, 15 bp, Homo sapiens
gaaataaatctatat

SEQ ID NO: 5733628 - DNA, 21 bp, Homo sapiens
gaaataaatgtatcatagaaa

SEQ ID NO: 5733629 - DNA, 12 bp, Homo sapiens
gaaataaatgtt

SEQ ID NO: 5733630 - DNA, 22 bp, Homo sapiens
gaaataaattctgacttatgaa

SEQ ID NO: 5733631 - DNA, 19 bp, Homo sapiens
gaaataaattctgattctt

SEQ ID NO: 5733632 - DNA, 14 bp, Homo sapiens
gaaataaattggtg

SEQ ID NO: 5733633 - DNA, 18 bp, Homo sapiens
gaaataacaatgttaagg

SEQ ID NO: 5733634 - DNA, 20 bp, Homo sapiens
gaaataacaatgttaaggaa

SEQ ID NO: 5733635 - DNA, 17 bp, Homo sapiens
gaaataacacagcagtt

SEQ ID NO: 5733636 - DNA, 19 bp, Homo sapiens
gaaataacagaagaaaata

SEQ ID NO: 5733637 - DNA, 22 bp, Homo sapiens
gaaataacagaagaaaatagaa

SEQ ID NO: 5733638 - DNA, 14 bp, Homo sapiens
gaaataacagagag

SEQ ID NO: 5733639 - DNA, 18 bp, Homo sapiens
gaaataacagagagaatg

SEQ ID NO: 5733640 - DNA, 15 bp, Homo sapiens
gaaataacagctggg

SEQ ID NO: 5733641 - DNA, 20 bp, Homo sapiens
gaaataacagtatttccaca

SEQ ID NO: 5733642 - DNA, 23 bp, Homo sapiens
gaaataacattgcactttataaa

SEQ ID NO: 5733643 - DNA, 21 bp, Homo sapiens
gaaataacgggtggcattggg

SEQ ID NO: 5733644 - DNA, 14 bp, Homo sapiens
gaaataactgcctt

SEQ ID NO: 5733645 - DNA, 16 bp, Homo sapiens
gaaataagaaaaatca

SEQ ID NO: 5733646 - DNA, 24 bp, Homo sapiens
gaaataagaaacacaaatgtaaaa

SEQ ID NO: 5733647 - DNA, 18 bp, Homo sapiens
gaaataagaataaagtac

SEQ ID NO: 5733648 - DNA, 16 bp, Homo sapiens
gaaataagagcagtca

SEQ ID NO: 5733649 - DNA, 15 bp, Homo sapiens
gaaataagctatttg

SEQ ID NO: 5733650 - DNA, 19 bp, Homo sapiens
gaaataagctatttgatgt

SEQ ID NO: 5733651 - DNA, 20 bp, Homo sapiens
gaaataagctatttgatgta

SEQ ID NO: 5733652 - DNA, 23 bp, Homo sapiens
gaaataagctatttgatgtaata

SEQ ID NO: 5733653 - DNA, 20 bp, Homo sapiens
gaaataataaaatgcaaatg

SEQ ID NO: 5733654 - DNA, 13 bp, Homo sapiens
gaaataataaatc

SEQ ID NO: 5733655 - DNA, 15 bp, Homo sapiens
gaaataataatattt

SEQ ID NO: 5733656 - DNA, 18 bp, Homo sapiens
gaaataatagaatgagca

SEQ ID NO: 5733657 - DNA, 18 bp, Homo sapiens
gaaataatatatttcttc

SEQ ID NO: 5733658 - DNA, 14 bp, Homo sapiens
gaaataatatgcat

SEQ ID NO: 5733659 - DNA, 19 bp, Homo sapiens
gaaataatgctacaatttt

SEQ ID NO: 5733660 - DNA, 21 bp, Homo sapiens
gaaataatgctacaattttaa

SEQ ID NO: 5733661 - DNA, 19 bp, Homo sapiens
gaaataatgtacatctggc

SEQ ID NO: 5733662 - DNA, 14 bp, Homo sapiens
gaaataattacaga

SEQ ID NO: 5733663 - DNA, 21 bp, Homo sapiens
gaaataattgttgttctgtta

SEQ ID NO: 5733664 - DNA, 16 bp, Homo sapiens
gaaataatttgaatgt

SEQ ID NO: 5733665 - DNA, 18 bp, Homo sapiens
gaaataattttattccag

SEQ ID NO: 5733666 - DNA, 13 bp, Homo sapiens
gaaataattttca

SEQ ID NO: 5733667 - DNA, 17 bp, Homo sapiens
gaaataatttttaactt

SEQ ID NO: 5733668 - DNA, 23 bp, Homo sapiens
gaaataattttttagttaaaatc

SEQ ID NO: 5733669 - DNA, 13 bp, Homo sapiens
gaaatacaaaaaa

SEQ ID NO: 5733670 - DNA, 13 bp, Homo sapiens
gaaatacaaaaat

SEQ ID NO: 5733671 - DNA, 23 bp, Homo sapiens
gaaatacaaggagggcctctggt

SEQ ID NO: 5733672 - DNA, 16 bp, Homo sapiens
gaaatacacagggagg

SEQ ID NO: 5733673 - DNA, 18 bp, Homo sapiens
gaaatacactacaaatgt

SEQ ID NO: 5733674 - DNA, 21 bp, Homo sapiens
gaaatacacttttttccaaag

SEQ ID NO: 5733675 - DNA, 15 bp, Homo sapiens
gaaatacagaagaaa

SEQ ID NO: 5733676 - DNA, 17 bp, Homo sapiens
gaaatacagaagaaaat

SEQ ID NO: 5733677 - DNA, 17 bp, Homo sapiens
gaaatacagactggatg

SEQ ID NO: 5733678 - DNA, 19 bp, Homo sapiens
gaaatacagataaatgatt

SEQ ID NO: 5733679 - DNA, 13 bp, Homo sapiens
gaaatacagctgg

SEQ ID NO: 5733680 - DNA, 16 bp, Homo sapiens
gaaatacagctggcta

SEQ ID NO: 5733681 - DNA, 17 bp, Homo sapiens
gaaatacagtgctttat

SEQ ID NO: 5733682 - DNA, 14 bp, Homo sapiens
gaaatacagttatt

SEQ ID NO: 5733683 - DNA, 17 bp, Homo sapiens
gaaatacagttctgctc

SEQ ID NO: 5733684 - DNA, 18 bp, Homo sapiens
gaaatacatatgcagata

SEQ ID NO: 5733685 - DNA, 17 bp, Homo sapiens
gaaatacatatttccaa

SEQ ID NO: 5733686 - DNA, 21 bp, Homo sapiens
gaaatacccttcttttatgag

SEQ ID NO: 5733687 - DNA, 15 bp, Homo sapiens
gaaatacctttgtag

SEQ ID NO: 5733688 - DNA, 19 bp, Homo sapiens
gaaatacgccagaactgct

SEQ ID NO: 5733689 - DNA, 20 bp, Homo sapiens
gaaatacgtgattaatatgc

SEQ ID NO: 5733690 - DNA, 22 bp, Homo sapiens
gaaatacgtgattaatatgcaa

SEQ ID NO: 5733691 - DNA, 22 bp, Homo sapiens
gaaatacgttaggaggacaaaa

SEQ ID NO: 5733692 - DNA, 16 bp, Homo sapiens
gaaatactactcctgt

SEQ ID NO: 5733693 - DNA, 19 bp, Homo sapiens
gaaatactactcctgtaat

SEQ ID NO: 5733694 - DNA, 17 bp, Homo sapiens
gaaatactactgtgtaa

SEQ ID NO: 5733695 - DNA, 20 bp, Homo sapiens
gaaatactagatttgggaga

SEQ ID NO: 5733696 - DNA, 14 bp, Homo sapiens
gaaatactatttaa

SEQ ID NO: 5733697 - DNA, 15 bp, Homo sapiens
gaaatactatttaaa

SEQ ID NO: 5733698 - DNA, 13 bp, Homo sapiens
gaaatactgctct

SEQ ID NO: 5733699 - DNA, 15 bp, Homo sapiens
gaaatactgctctga

SEQ ID NO: 5733700 - DNA, 22 bp, Homo sapiens
gaaatactgctctgaatatttt

SEQ ID NO: 5733701 - DNA, 13 bp, Homo sapiens
gaaatactgtatt

SEQ ID NO: 5733702 - DNA, 19 bp, Homo sapiens
gaaatactgtttgaggttt

SEQ ID NO: 5733703 - DNA, 15 bp, Homo sapiens
gaaatacttgtgatt

SEQ ID NO: 5733704 - DNA, 18 bp, Homo sapiens
gaaatactttatctgtga

SEQ ID NO: 5733705 - DNA, 21 bp, Homo sapiens
gaaatactttgcataaattaa

SEQ ID NO: 5733706 - DNA, 23 bp, Homo sapiens
gaaatagaaaaaccctgccccca

SEQ ID NO: 5733707 - DNA, 18 bp, Homo sapiens
gaaatagaaagaagccat

SEQ ID NO: 5733708 - DNA, 12 bp, Homo sapiens
gaaatagaacac

SEQ ID NO: 5733709 - DNA, 18 bp, Homo sapiens
gaaatagacagcatgaga

SEQ ID NO: 5733710 - DNA, 22 bp, Homo sapiens
gaaatagaggtgatgctgctaa

SEQ ID NO: 5733711 - DNA, 14 bp, Homo sapiens
gaaatagcagagcc

SEQ ID NO: 5733712 - DNA, 19 bp, Homo sapiens
gaaatagccgaactccagg

SEQ ID NO: 5733713 - DNA, 10 bp, Homo sapiens
gaaatagcta

SEQ ID NO: 5733714 - DNA, 21 bp, Homo sapiens
gaaatagctgaaaagggcact

SEQ ID NO: 5733715 - DNA, 16 bp, Homo sapiens
gaaatagctgtataga

SEQ ID NO: 5733716 - DNA, 18 bp, Homo sapiens
gaaatagcttatgaaaag

SEQ ID NO: 5733717 - DNA, 19 bp, Homo sapiens
gaaatagcttatgaaaaga

SEQ ID NO: 5733718 - DNA, 21 bp, Homo sapiens
gaaatagctttactgtttctc

SEQ ID NO: 5733719 - DNA, 18 bp, Homo sapiens
gaaataggtatcaaaata

SEQ ID NO: 5733720 - DNA, 17 bp, Homo sapiens
gaaatagtcaaatacga

SEQ ID NO: 5733721 - DNA, 17 bp, Homo sapiens
gaaatagtcctgaagtt

SEQ ID NO: 5733722 - DNA, 15 bp, Homo sapiens
gaaatagtgcactcc

SEQ ID NO: 5733723 - DNA, 22 bp, Homo sapiens
gaaatagtgtggaaattaagaa

SEQ ID NO: 5733724 - DNA, 18 bp, Homo sapiens
gaaatagttcaaactgca

SEQ ID NO: 5733725 - DNA, 17 bp, Homo sapiens
gaaatagttctgtgact

SEQ ID NO: 5733726 - DNA, 15 bp, Homo sapiens
gaaatagttgtctgt

SEQ ID NO: 5733727 - DNA, 17 bp, Homo sapiens
gaaatagttgtctgtgc

SEQ ID NO: 5733728 - DNA, 21 bp, Homo sapiens
gaaatataaacacattaaaag

SEQ ID NO: 5733729 - DNA, 14 bp, Homo sapiens
gaaatataaactgt

SEQ ID NO: 5733730 - DNA, 18 bp, Homo sapiens
gaaatataaactgtgaga

SEQ ID NO: 5733731 - DNA, 18 bp, Homo sapiens
gaaatataacacattttt

SEQ ID NO: 5733732 - DNA, 20 bp, Homo sapiens
gaaatatacagtttgacttt

SEQ ID NO: 5733733 - DNA, 17 bp, Homo sapiens
gaaatataggaacttaa

SEQ ID NO: 5733734 - DNA, 23 bp, Homo sapiens
gaaatataggatagacactggac

SEQ ID NO: 5733735 - DNA, 15 bp, Homo sapiens
gaaatatagtgcaat

SEQ ID NO: 5733736 - DNA, 16 bp, Homo sapiens
gaaatatagtgcaata

SEQ ID NO: 5733737 - DNA, 17 bp, Homo sapiens
gaaatatagttgaaagt

SEQ ID NO: 5733738 - DNA, 18 bp, Homo sapiens
gaaatatagttgaaagta

SEQ ID NO: 5733739 - DNA, 19 bp, Homo sapiens
gaaatatatacgaacaaaa

SEQ ID NO: 5733740 - DNA, 14 bp, Homo sapiens
gaaatatatataca

SEQ ID NO: 5733741 - DNA, 21 bp, Homo sapiens
gaaatatatatacatatgtag

SEQ ID NO: 5733742 - DNA, 12 bp, Homo sapiens
gaaatatatatt

SEQ ID NO: 5733743 - DNA, 15 bp, Homo sapiens
gaaatatatattata

SEQ ID NO: 5733744 - DNA, 22 bp, Homo sapiens
gaaatatatattatacttgtaa

SEQ ID NO: 5733745 - DNA, 22 bp, Homo sapiens
gaaatatatctgtgattttaaa

SEQ ID NO: 5733746 - DNA, 14 bp, Homo sapiens
gaaatatatgtgaa

SEQ ID NO: 5733747 - DNA, 16 bp, Homo sapiens
gaaatatcaaagtcat

SEQ ID NO: 5733748 - DNA, 21 bp, Homo sapiens
gaaatatcagttactcagccc

SEQ ID NO: 5733749 - DNA, 22 bp, Homo sapiens
gaaatatcatcacgtatgttat

SEQ ID NO: 5733750 - DNA, 16 bp, Homo sapiens
gaaatatcatcgtatt

SEQ ID NO: 5733751 - DNA, 14 bp, Homo sapiens
gaaatatcatgtta

SEQ ID NO: 5733752 - DNA, 12 bp, Homo sapiens
gaaatatcattt

SEQ ID NO: 5733753 - DNA, 22 bp, Homo sapiens
gaaatatcgctgatgcagacac

SEQ ID NO: 5733754 - DNA, 23 bp, Homo sapiens
gaaatatcgctgatgcagacaca

SEQ ID NO: 5733755 - DNA, 14 bp, Homo sapiens
gaaatatctgtatt

SEQ ID NO: 5733756 - DNA, 16 bp, Homo sapiens
gaaatatctttctctt

SEQ ID NO: 5733757 - DNA, 14 bp, Homo sapiens
gaaatatgaaattc

SEQ ID NO: 5733758 - DNA, 14 bp, Homo sapiens
gaaatatgaatgcc

SEQ ID NO: 5733759 - DNA, 16 bp, Homo sapiens
gaaatatgcaacctgt

SEQ ID NO: 5733760 - DNA, 14 bp, Homo sapiens
gaaatatgcatact

SEQ ID NO: 5733761 - DNA, 13 bp, Homo sapiens
gaaatatgcatgt

SEQ ID NO: 5733762 - DNA, 15 bp, Homo sapiens
gaaatatgcatgtac

SEQ ID NO: 5733763 - DNA, 20 bp, Homo sapiens
gaaatatgtattctgtaaaa

SEQ ID NO: 5733764 - DNA, 13 bp, Homo sapiens
gaaatatgtgaga

SEQ ID NO: 5733765 - DNA, 14 bp, Homo sapiens
gaaatatgtgagat

SEQ ID NO: 5733766 - DNA, 15 bp, Homo sapiens
gaaatatgtgagatt

SEQ ID NO: 5733767 - DNA, 11 bp, Homo sapiens
gaaatattaaa

SEQ ID NO: 5733768 - DNA, 19 bp, Homo sapiens
gaaatattaaaccctggat

SEQ ID NO: 5733769 - DNA, 23 bp, Homo sapiens
gaaatattagttacttgctataa

SEQ ID NO: 5733770 - DNA, 19 bp, Homo sapiens
gaaatattatgcaaattcc

SEQ ID NO: 5733771 - DNA, 22 bp, Homo sapiens
gaaatattatgcaaattcccag

SEQ ID NO: 5733772 - DNA, 16 bp, Homo sapiens
gaaatattatgttaaa

SEQ ID NO: 5733773 - DNA, 18 bp, Homo sapiens
gaaatattgctgtatagc

SEQ ID NO: 5733774 - DNA, 14 bp, Homo sapiens
gaaatattgtaaat

SEQ ID NO: 5733775 - DNA, 13 bp, Homo sapiens
gaaatatttacct

SEQ ID NO: 5733776 - DNA, 15 bp, Homo sapiens
gaaatatttacctaa

SEQ ID NO: 5733777 - DNA, 15 bp, Homo sapiens
gaaatatttagcaaa

SEQ ID NO: 5733778 - DNA, 19 bp, Homo sapiens
gaaatatttagcaaataat

SEQ ID NO: 5733779 - DNA, 21 bp, Homo sapiens
gaaatatttagtatctagtca

SEQ ID NO: 5733780 - DNA, 18 bp, Homo sapiens
gaaatatttattttaata

SEQ ID NO: 5733781 - DNA, 19 bp, Homo sapiens
gaaatatttatttttttaa

SEQ ID NO: 5733782 - DNA, 23 bp, Homo sapiens
gaaatattttaatttttaaatgc

SEQ ID NO: 5733783 - DNA, 23 bp, Homo sapiens
gaaatattttcttccttctcagc

SEQ ID NO: 5733784 - DNA, 13 bp, Homo sapiens
gaaatattttgat

SEQ ID NO: 5733785 - DNA, 14 bp, Homo sapiens
gaaatatttttcaa

SEQ ID NO: 5733786 - DNA, 15 bp, Homo sapiens
gaaatatttttcaac

SEQ ID NO: 5733787 - DNA, 21 bp, Homo sapiens
gaaatattttttaatttaaag

SEQ ID NO: 5733788 - DNA, 12 bp, Homo sapiens
gaaatcaaagtg

SEQ ID NO: 5733789 - DNA, 14 bp, Homo sapiens
gaaatcaaagtgct

SEQ ID NO: 5733790 - DNA, 16 bp, Homo sapiens
gaaatcaaatatgcaa

SEQ ID NO: 5733791 - DNA, 23 bp, Homo sapiens
gaaatcaaatatgcaaagcactg

SEQ ID NO: 5733792 - DNA, 15 bp, Homo sapiens
gaaatcaaatgtatg

SEQ ID NO: 5733793 - DNA, 15 bp, Homo sapiens
gaaatcaaccctctc

SEQ ID NO: 5733794 - DNA, 21 bp, Homo sapiens
gaaatcaaccctctcctgtct

SEQ ID NO: 5733795 - DNA, 16 bp, Homo sapiens
gaaatcaatgcaagag

SEQ ID NO: 5733796 - DNA, 20 bp, Homo sapiens
gaaatcacaatgagaaaaat

SEQ ID NO: 5733797 - DNA, 15 bp, Homo sapiens
gaaatcacaggggcg

SEQ ID NO: 5733798 - DNA, 22 bp, Homo sapiens
gaaatcacaggggcggggcagg

SEQ ID NO: 5733799 - DNA, 16 bp, Homo sapiens
gaaatcacagtcaatg

SEQ ID NO: 5733800 - DNA, 23 bp, Homo sapiens
gaaatcacgttgctggtggtttt

SEQ ID NO: 5733801 - DNA, 16 bp, Homo sapiens
gaaatcactgtgaaat

SEQ ID NO: 5733802 - DNA, 15 bp, Homo sapiens
gaaatcagagctggc

SEQ ID NO: 5733803 - DNA, 16 bp, Homo sapiens
gaaatcagagctggca

SEQ ID NO: 5733804 - DNA, 20 bp, Homo sapiens
gaaatcagcatgacaaaaat

SEQ ID NO: 5733805 - DNA, 23 bp, Homo sapiens
gaaatcagcatgacaaaaataac

SEQ ID NO: 5733806 - DNA, 15 bp, Homo sapiens
gaaatcaggcctgat

SEQ ID NO: 5733807 - DNA, 23 bp, Homo sapiens
gaaatcaggtgttttaagactga

SEQ ID NO: 5733808 - DNA, 21 bp, Homo sapiens
gaaatcagttgtgaatacatt

SEQ ID NO: 5733809 - DNA, 17 bp, Homo sapiens
gaaatcagtttctcaaa

SEQ ID NO: 5733810 - DNA, 18 bp, Homo sapiens
gaaatcataccagttgtt

SEQ ID NO: 5733811 - DNA, 22 bp, Homo sapiens
gaaatcatagtatatgattgta

SEQ ID NO: 5733812 - DNA, 17 bp, Homo sapiens
gaaatcatgtccataca

SEQ ID NO: 5733813 - DNA, 21 bp, Homo sapiens
gaaatcatgttatgataaaaa

SEQ ID NO: 5733814 - DNA, 16 bp, Homo sapiens
gaaatcattgtagaaa

SEQ ID NO: 5733815 - DNA, 12 bp, Homo sapiens
gaaatcattgtg

SEQ ID NO: 5733816 - DNA, 17 bp, Homo sapiens
gaaatcattgtgtgtct

SEQ ID NO: 5733817 - DNA, 21 bp, Homo sapiens
gaaatccaaatttctcatgtt

SEQ ID NO: 5733818 - DNA, 16 bp, Homo sapiens
gaaatccaactccagg

SEQ ID NO: 5733819 - DNA, 11 bp, Homo sapiens
gaaatccagat

SEQ ID NO: 5733820 - DNA, 14 bp, Homo sapiens
gaaatccagcccca

SEQ ID NO: 5733821 - DNA, 18 bp, Homo sapiens
gaaatccagggtggtggt

SEQ ID NO: 5733822 - DNA, 22 bp, Homo sapiens
gaaatccataaactaagagaaa

SEQ ID NO: 5733823 - DNA, 22 bp, Homo sapiens
gaaatccatactgtagacactc

SEQ ID NO: 5733824 - DNA, 19 bp, Homo sapiens
gaaatccattgtttaaaga

SEQ ID NO: 5733825 - DNA, 16 bp, Homo sapiens
gaaatcccaacaaaaa

SEQ ID NO: 5733826 - DNA, 14 bp, Homo sapiens
gaaatcccagttca

SEQ ID NO: 5733827 - DNA, 17 bp, Homo sapiens
gaaatcccagttcatgt

SEQ ID NO: 5733828 - DNA, 18 bp, Homo sapiens
gaaatccccccttcagaa

SEQ ID NO: 5733829 - DNA, 12 bp, Homo sapiens
gaaatcctcagc

SEQ ID NO: 5733830 - DNA, 14 bp, Homo sapiens
gaaatcctctgtta

SEQ ID NO: 5733831 - DNA, 18 bp, Homo sapiens
gaaatcctgccctggagg

SEQ ID NO: 5733832 - DNA, 18 bp, Homo sapiens
gaaatcctggtttgtaat

SEQ ID NO: 5733833 - DNA, 13 bp, Homo sapiens
gaaatcctgttac

SEQ ID NO: 5733834 - DNA, 19 bp, Homo sapiens
gaaatcctttcataaagca

SEQ ID NO: 5733835 - DNA, 18 bp, Homo sapiens
gaaatcgagagtgtgctc

SEQ ID NO: 5733836 - DNA, 17 bp, Homo sapiens
gaaatcgccttatgaga

SEQ ID NO: 5733837 - DNA, 20 bp, Homo sapiens
gaaatcgccttatgagaaca

SEQ ID NO: 5733838 - DNA, 16 bp, Homo sapiens
gaaatcgttggaaaat

SEQ ID NO: 5733839 - DNA, 15 bp, Homo sapiens
gaaatctacaggcct

SEQ ID NO: 5733840 - DNA, 15 bp, Homo sapiens
gaaatctacttccta

SEQ ID NO: 5733841 - DNA, 15 bp, Homo sapiens
gaaatctagtatttc

SEQ ID NO: 5733842 - DNA, 14 bp, Homo sapiens
gaaatctatagaaa

SEQ ID NO: 5733843 - DNA, 23 bp, Homo sapiens
gaaatctatagaaagtgttctgt

SEQ ID NO: 5733844 - DNA, 19 bp, Homo sapiens
gaaatctcacttttctcca

SEQ ID NO: 5733845 - DNA, 19 bp, Homo sapiens
gaaatctcagattcttcac

SEQ ID NO: 5733846 - DNA, 20 bp, Homo sapiens
gaaatctcctaacaaaagaa

SEQ ID NO: 5733847 - DNA, 21 bp, Homo sapiens
gaaatctgaaaaatggccatg

SEQ ID NO: 5733848 - DNA, 14 bp, Homo sapiens
gaaatctgaacatt

SEQ ID NO: 5733849 - DNA, 14 bp, Homo sapiens
gaaatctgaagcct

SEQ ID NO: 5733850 - DNA, 19 bp, Homo sapiens
gaaatctgaagccttttcc

SEQ ID NO: 5733851 - DNA, 23 bp, Homo sapiens
gaaatctgaggaatggacatttc

SEQ ID NO: 5733852 - DNA, 18 bp, Homo sapiens
gaaatctggcccagggtg

SEQ ID NO: 5733853 - DNA, 13 bp, Homo sapiens
gaaatctggccct

SEQ ID NO: 5733854 - DNA, 20 bp, Homo sapiens
gaaatctggcttctggccag

SEQ ID NO: 5733855 - DNA, 18 bp, Homo sapiens
gaaatctgtaaagccagt

SEQ ID NO: 5733856 - DNA, 20 bp, Homo sapiens
gaaatctgtaattctattgt

SEQ ID NO: 5733857 - DNA, 22 bp, Homo sapiens
gaaatctgtatctgtagtgaga

SEQ ID NO: 5733858 - DNA, 18 bp, Homo sapiens
gaaatctgtgcaataaaa

SEQ ID NO: 5733859 - DNA, 12 bp, Homo sapiens
gaaatcttaaaa

SEQ ID NO: 5733860 - DNA, 15 bp, Homo sapiens
gaaatcttaaaaacc

SEQ ID NO: 5733861 - DNA, 14 bp, Homo sapiens
gaaatcttaagtca

SEQ ID NO: 5733862 - DNA, 21 bp, Homo sapiens
gaaatcttaagtcataatgaa

SEQ ID NO: 5733863 - DNA, 17 bp, Homo sapiens
gaaatcttgcttcagac

SEQ ID NO: 5733864 - DNA, 21 bp, Homo sapiens
gaaatcttgcttcagaccatc

SEQ ID NO: 5733865 - DNA, 13 bp, Homo sapiens
gaaatctttccag

SEQ ID NO: 5733866 - DNA, 15 bp, Homo sapiens
gaaatctttctttct

SEQ ID NO: 5733867 - DNA, 14 bp, Homo sapiens
gaaatcttttaaaa

SEQ ID NO: 5733868 - DNA, 16 bp, Homo sapiens
gaaatgaaaacatgta

SEQ ID NO: 5733869 - DNA, 15 bp, Homo sapiens
gaaatgaaagggaaa

SEQ ID NO: 5733870 - DNA, 18 bp, Homo sapiens
gaaatgaaagggaaactg

SEQ ID NO: 5733871 - DNA, 23 bp, Homo sapiens
gaaatgaaagggaaactgggaaa

SEQ ID NO: 5733872 - DNA, 19 bp, Homo sapiens
gaaatgaaatttaaacatt

SEQ ID NO: 5733873 - DNA, 22 bp, Homo sapiens
gaaatgaacaaaagattggagc

SEQ ID NO: 5733874 - DNA, 14 bp, Homo sapiens
gaaatgaacacaaa

SEQ ID NO: 5733875 - DNA, 15 bp, Homo sapiens
gaaatgaacattcca

SEQ ID NO: 5733876 - DNA, 21 bp, Homo sapiens
gaaatgaactttgtcagtgtt

SEQ ID NO: 5733877 - DNA, 18 bp, Homo sapiens
gaaatgaagcagaggaag

SEQ ID NO: 5733878 - DNA, 22 bp, Homo sapiens
gaaatgaagcagaggaaggaaa

SEQ ID NO: 5733879 - DNA, 15 bp, Homo sapiens
gaaatgaatgtgtgt

SEQ ID NO: 5733880 - DNA, 16 bp, Homo sapiens
gaaatgaatttatctg

SEQ ID NO: 5733881 - DNA, 17 bp, Homo sapiens
gaaatgaatttatctga

SEQ ID NO: 5733882 - DNA, 18 bp, Homo sapiens
gaaatgacatttcactaa

SEQ ID NO: 5733883 - DNA, 14 bp, Homo sapiens
gaaatgacattttg

SEQ ID NO: 5733884 - DNA, 14 bp, Homo sapiens
gaaatgacccaaac

SEQ ID NO: 5733885 - DNA, 19 bp, Homo sapiens
gaaatgacggtgttaattt

SEQ ID NO: 5733886 - DNA, 22 bp, Homo sapiens
gaaatgacggtgttaattttgc

SEQ ID NO: 5733887 - DNA, 16 bp, Homo sapiens
gaaatgagatcccaga

SEQ ID NO: 5733888 - DNA, 22 bp, Homo sapiens
gaaatgagcacctccattaaag

SEQ ID NO: 5733889 - DNA, 20 bp, Homo sapiens
gaaatgagcagcccttacag

SEQ ID NO: 5733890 - DNA, 22 bp, Homo sapiens
gaaatgaggtagctgacacaga

SEQ ID NO: 5733891 - DNA, 18 bp, Homo sapiens
gaaatgaggtcagagcct

SEQ ID NO: 5733892 - DNA, 17 bp, Homo sapiens
gaaatgaggtctgttta

SEQ ID NO: 5733893 - DNA, 22 bp, Homo sapiens
gaaatgaggtctgtttaaagtg

SEQ ID NO: 5733894 - DNA, 15 bp, Homo sapiens
gaaatgagtggccag

SEQ ID NO: 5733895 - DNA, 17 bp, Homo sapiens
gaaatgagtggccagcg

SEQ ID NO: 5733896 - DNA, 14 bp, Homo sapiens
gaaatgataaagac

SEQ ID NO: 5733897 - DNA, 18 bp, Homo sapiens
gaaatgataaagactttt

SEQ ID NO: 5733898 - DNA, 19 bp, Homo sapiens
gaaatgataaagactttta

SEQ ID NO: 5733899 - DNA, 22 bp, Homo sapiens
gaaatgatagagaactgaagga

SEQ ID NO: 5733900 - DNA, 21 bp, Homo sapiens
gaaatgatagatttgacctcc

SEQ ID NO: 5733901 - DNA, 15 bp, Homo sapiens
gaaatgatgtgaaag

SEQ ID NO: 5733902 - DNA, 11 bp, Homo sapiens
gaaatgatgtt

SEQ ID NO: 5733903 - DNA, 15 bp, Homo sapiens
gaaatgatgttggtc

SEQ ID NO: 5733904 - DNA, 22 bp, Homo sapiens
gaaatgatgttggtccaaagtg

SEQ ID NO: 5733905 - DNA, 21 bp, Homo sapiens
gaaatgattcagggttatttg

SEQ ID NO: 5733906 - DNA, 14 bp, Homo sapiens
gaaatgattcatct

SEQ ID NO: 5733907 - DNA, 18 bp, Homo sapiens
gaaatgcaagctctggaa

SEQ ID NO: 5733908 - DNA, 12 bp, Homo sapiens
gaaatgcacaat

SEQ ID NO: 5733909 - DNA, 12 bp, Homo sapiens
gaaatgcagaaa

SEQ ID NO: 5733910 - DNA, 13 bp, Homo sapiens
gaaatgcagaaat

SEQ ID NO: 5733911 - DNA, 15 bp, Homo sapiens
gaaatgcagaaatca

SEQ ID NO: 5733912 - DNA, 16 bp, Homo sapiens
gaaatgcataccagta

SEQ ID NO: 5733913 - DNA, 20 bp, Homo sapiens
gaaatgcattattttgaatg

SEQ ID NO: 5733914 - DNA, 20 bp, Homo sapiens
gaaatgcatttatagatcat

SEQ ID NO: 5733915 - DNA, 16 bp, Homo sapiens
gaaatgccaagactct

SEQ ID NO: 5733916 - DNA, 18 bp, Homo sapiens
gaaatgccaagactctat

SEQ ID NO: 5733917 - DNA, 23 bp, Homo sapiens
gaaatgccagacttctaaaataa

SEQ ID NO: 5733918 - DNA, 12 bp, Homo sapiens
gaaatgccccag

SEQ ID NO: 5733919 - DNA, 19 bp, Homo sapiens
gaaatgccctcctaaatgt

SEQ ID NO: 5733920 - DNA, 20 bp, Homo sapiens
gaaatgcccttcactttctc

SEQ ID NO: 5733921 - DNA, 21 bp, Homo sapiens
gaaatgcccttcactttctcc

SEQ ID NO: 5733922 - DNA, 18 bp, Homo sapiens
gaaatgcctaagaagatg

SEQ ID NO: 5733923 - DNA, 23 bp, Homo sapiens
gaaatgcctaagaagatgacttc

SEQ ID NO: 5733924 - DNA, 22 bp, Homo sapiens
gaaatgccttactttgtatgat

SEQ ID NO: 5733925 - DNA, 23 bp, Homo sapiens
gaaatgccttactttgtatgata

SEQ ID NO: 5733926 - DNA, 21 bp, Homo sapiens
gaaatgctaacctgtggaaag

SEQ ID NO: 5733927 - DNA, 21 bp, Homo sapiens
gaaatgctaaccttgtagcat

SEQ ID NO: 5733928 - DNA, 17 bp, Homo sapiens
gaaatgctatgtcattt

SEQ ID NO: 5733929 - DNA, 19 bp, Homo sapiens
gaaatgctatgtcatttca

SEQ ID NO: 5733930 - DNA, 21 bp, Homo sapiens
gaaatgctatgtcatttcatg

SEQ ID NO: 5733931 - DNA, 20 bp, Homo sapiens
gaaatgctattgttgtgggc

SEQ ID NO: 5733932 - DNA, 21 bp, Homo sapiens
gaaatgctattgttgtgggct

SEQ ID NO: 5733933 - DNA, 14 bp, Homo sapiens
gaaatgctgaccca

SEQ ID NO: 5733934 - DNA, 22 bp, Homo sapiens
gaaatgctgatttaaacttctt

SEQ ID NO: 5733935 - DNA, 16 bp, Homo sapiens
gaaatgctgcctgcct

SEQ ID NO: 5733936 - DNA, 17 bp, Homo sapiens
gaaatgctgcctgcctg

SEQ ID NO: 5733937 - DNA, 16 bp, Homo sapiens
gaaatgctgctggcca

SEQ ID NO: 5733938 - DNA, 15 bp, Homo sapiens
gaaatgctgggctga

SEQ ID NO: 5733939 - DNA, 22 bp, Homo sapiens
gaaatgctgttagtaaatttct

SEQ ID NO: 5733940 - DNA, 22 bp, Homo sapiens
gaaatgctgttggtaaagcaca

SEQ ID NO: 5733941 - DNA, 24 bp, Homo sapiens
gaaatgctgttggtaaagcacatg

SEQ ID NO: 5733942 - DNA, 20 bp, Homo sapiens
gaaatgcttatgcttgtgta

SEQ ID NO: 5733943 - DNA, 22 bp, Homo sapiens
gaaatgcttgtggattgagggt

SEQ ID NO: 5733944 - DNA, 22 bp, Homo sapiens
gaaatgctttagcatactagaa

SEQ ID NO: 5733945 - DNA, 16 bp, Homo sapiens
gaaatggaaagcagag

SEQ ID NO: 5733946 - DNA, 19 bp, Homo sapiens
gaaatggaaagtcatgcaa

SEQ ID NO: 5733947 - DNA, 20 bp, Homo sapiens
gaaatggactggtttgagat

SEQ ID NO: 5733948 - DNA, 15 bp, Homo sapiens
gaaatggagaagctc

SEQ ID NO: 5733949 - DNA, 16 bp, Homo sapiens
gaaatggatactacat

SEQ ID NO: 5733950 - DNA, 23 bp, Homo sapiens
gaaatggcctgtccctagggctc

SEQ ID NO: 5733951 - DNA, 12 bp, Homo sapiens
gaaatggccttc

SEQ ID NO: 5733952 - DNA, 14 bp, Homo sapiens
gaaatggccttccc

SEQ ID NO: 5733953 - DNA, 17 bp, Homo sapiens
gaaatggcgtctgctct

SEQ ID NO: 5733954 - DNA, 18 bp, Homo sapiens
gaaatggcgtctgctctg

SEQ ID NO: 5733955 - DNA, 18 bp, Homo sapiens
gaaatggctatgaacaga

SEQ ID NO: 5733956 - DNA, 17 bp, Homo sapiens
gaaatggctgaagtgca

SEQ ID NO: 5733957 - DNA, 16 bp, Homo sapiens
gaaatggctttgtgat

SEQ ID NO: 5733958 - DNA, 20 bp, Homo sapiens
gaaatggcttttcccaaccc

SEQ ID NO: 5733959 - DNA, 15 bp, Homo sapiens
gaaatggcttttctt

SEQ ID NO: 5733960 - DNA, 23 bp, Homo sapiens
gaaatggcttttcttacccagat

SEQ ID NO: 5733961 - DNA, 15 bp, Homo sapiens
gaaatgggaacaata

SEQ ID NO: 5733962 - DNA, 22 bp, Homo sapiens
gaaatgggaacaatatcaatat

SEQ ID NO: 5733963 - DNA, 23 bp, Homo sapiens
gaaatgggaattgcgctcagggg

SEQ ID NO: 5733964 - DNA, 16 bp, Homo sapiens
gaaatgggacggaggt

SEQ ID NO: 5733965 - DNA, 12 bp, Homo sapiens
gaaatgggcagt

SEQ ID NO: 5733966 - DNA, 16 bp, Homo sapiens
gaaatgggcatttatt

SEQ ID NO: 5733967 - DNA, 21 bp, Homo sapiens
gaaatgggcatttattttata

SEQ ID NO: 5733968 - DNA, 15 bp, Homo sapiens
gaaatgggcctcagc

SEQ ID NO: 5733969 - DNA, 12 bp, Homo sapiens
gaaatgggcctg

SEQ ID NO: 5733970 - DNA, 13 bp, Homo sapiens
gaaatgggcctgc

SEQ ID NO: 5733971 - DNA, 15 bp, Homo sapiens
gaaatgggcctgcct

SEQ ID NO: 5733972 - DNA, 17 bp, Homo sapiens
gaaatgggctttaacaa

SEQ ID NO: 5733973 - DNA, 20 bp, Homo sapiens
gaaatggggaaagcagaact

SEQ ID NO: 5733974 - DNA, 20 bp, Homo sapiens
gaaatggggaactcccccag

SEQ ID NO: 5733975 - DNA, 15 bp, Homo sapiens
gaaatggggagctgg

SEQ ID NO: 5733976 - DNA, 16 bp, Homo sapiens
gaaatggggagctggc

SEQ ID NO: 5733977 - DNA, 14 bp, Homo sapiens
gaaatggggcgctg

SEQ ID NO: 5733978 - DNA, 18 bp, Homo sapiens
gaaatggtactgtacagc

SEQ ID NO: 5733979 - DNA, 13 bp, Homo sapiens
gaaatggttgtat

SEQ ID NO: 5733980 - DNA, 14 bp, Homo sapiens
gaaatggttgtatt

SEQ ID NO: 5733981 - DNA, 15 bp, Homo sapiens
gaaatggttgtatta

SEQ ID NO: 5733982 - DNA, 20 bp, Homo sapiens
gaaatggttgtattagatgt

SEQ ID NO: 5733983 - DNA, 21 bp, Homo sapiens
gaaatggtttcacttgctctt

SEQ ID NO: 5733984 - DNA, 23 bp, Homo sapiens
gaaatggtttcacttgctctttg

SEQ ID NO: 5733985 - DNA, 16 bp, Homo sapiens
gaaatgtaaactgcca

SEQ ID NO: 5733986 - DNA, 13 bp, Homo sapiens
gaaatgtaacatg

SEQ ID NO: 5733987 - DNA, 14 bp, Homo sapiens
gaaatgtaacatga

SEQ ID NO: 5733988 - DNA, 14 bp, Homo sapiens
gaaatgtaaggctg

SEQ ID NO: 5733989 - DNA, 20 bp, Homo sapiens
gaaatgtacactaccaaaca

SEQ ID NO: 5733990 - DNA, 22 bp, Homo sapiens
gaaatgtacactaccaaacact

SEQ ID NO: 5733991 - DNA, 22 bp, Homo sapiens
gaaatgtaccatcaaatgttaa

SEQ ID NO: 5733992 - DNA, 16 bp, Homo sapiens
gaaatgtacgtcattt

SEQ ID NO: 5733993 - DNA, 17 bp, Homo sapiens
gaaatgtacttttggat

SEQ ID NO: 5733994 - DNA, 19 bp, Homo sapiens
gaaatgtagatgatatgtt

SEQ ID NO: 5733995 - DNA, 22 bp, Homo sapiens
gaaatgtaggcatcatgcatgt

SEQ ID NO: 5733996 - DNA, 18 bp, Homo sapiens
gaaatgtaggtcctcaga

SEQ ID NO: 5733997 - DNA, 16 bp, Homo sapiens
gaaatgtattcctgaa

SEQ ID NO: 5733998 - DNA, 13 bp, Homo sapiens
gaaatgtcataaa

SEQ ID NO: 5733999 - DNA, 20 bp, Homo sapiens
gaaatgtcataaattactgt

SEQ ID NO: 5734000 - DNA, 15 bp, Homo sapiens
gaaatgtcatctaac

SEQ ID NO: 5734001 - DNA, 23 bp, Homo sapiens
gaaatgtcccctcaaactcattg

SEQ ID NO: 5734002 - DNA, 16 bp, Homo sapiens
gaaatgtccctttctt

SEQ ID NO: 5734003 - DNA, 18 bp, Homo sapiens
gaaatgtccctttcttct

SEQ ID NO: 5734004 - DNA, 12 bp, Homo sapiens
gaaatgtcctgc

SEQ ID NO: 5734005 - DNA, 15 bp, Homo sapiens
gaaatgtcctgcatg

SEQ ID NO: 5734006 - DNA, 14 bp, Homo sapiens
gaaatgtctctgct

SEQ ID NO: 5734007 - DNA, 15 bp, Homo sapiens
gaaatgtctctgctc

SEQ ID NO: 5734008 - DNA, 16 bp, Homo sapiens
gaaatgtctctgctcc

SEQ ID NO: 5734009 - DNA, 14 bp, Homo sapiens
gaaatgtctgctgg

SEQ ID NO: 5734010 - DNA, 17 bp, Homo sapiens
gaaatgtctggagaata

SEQ ID NO: 5734011 - DNA, 12 bp, Homo sapiens
gaaatgtgaagg

SEQ ID NO: 5734012 - DNA, 17 bp, Homo sapiens
gaaatgtgaagggtggg

SEQ ID NO: 5734013 - DNA, 19 bp, Homo sapiens
gaaatgtgaatttttattg

SEQ ID NO: 5734014 - DNA, 20 bp, Homo sapiens
gaaatgtgaatttttattgt

SEQ ID NO: 5734015 - DNA, 14 bp, Homo sapiens
gaaatgtgagaaat

SEQ ID NO: 5734016 - DNA, 16 bp, Homo sapiens
gaaatgtgagaaatgt

SEQ ID NO: 5734017 - DNA, 16 bp, Homo sapiens
gaaatgtgatttgtct

SEQ ID NO: 5734018 - DNA, 23 bp, Homo sapiens
gaaatgtgatttgtcttcccttc

SEQ ID NO: 5734019 - DNA, 16 bp, Homo sapiens
gaaatgtgctgcaaag

SEQ ID NO: 5734020 - DNA, 14 bp, Homo sapiens
gaaatgtggagaag

SEQ ID NO: 5734021 - DNA, 16 bp, Homo sapiens
gaaatgtggatgctct

SEQ ID NO: 5734022 - DNA, 17 bp, Homo sapiens
gaaatgtggatgctctt

SEQ ID NO: 5734023 - DNA, 23 bp, Homo sapiens
gaaatgtggtagcctcactttta

SEQ ID NO: 5734024 - DNA, 15 bp, Homo sapiens
gaaatgtgtatctat

SEQ ID NO: 5734025 - DNA, 13 bp, Homo sapiens
gaaatgtgtgtga

SEQ ID NO: 5734026 - DNA, 21 bp, Homo sapiens
gaaatgtgtgtgatgtgacat

SEQ ID NO: 5734027 - DNA, 16 bp, Homo sapiens
gaaatgtgtttctgta

SEQ ID NO: 5734028 - DNA, 18 bp, Homo sapiens
gaaatgtgttttgtcttt

SEQ ID NO: 5734029 - DNA, 20 bp, Homo sapiens
gaaatgttagtgccccgcac

SEQ ID NO: 5734030 - DNA, 21 bp, Homo sapiens
gaaatgttattttttaattat

SEQ ID NO: 5734031 - DNA, 16 bp, Homo sapiens
gaaatgtttgctgaac

SEQ ID NO: 5734032 - DNA, 13 bp, Homo sapiens
gaaatgttttaat

SEQ ID NO: 5734033 - DNA, 18 bp, Homo sapiens
gaaatgttttgtaaacat

SEQ ID NO: 5734034 - DNA, 19 bp, Homo sapiens
gaaatgttttgtaaacatt

SEQ ID NO: 5734035 - DNA, 14 bp, Homo sapiens
gaaatgtttttaac

SEQ ID NO: 5734036 - DNA, 21 bp, Homo sapiens
gaaattaaaaaaaaaaaacta

SEQ ID NO: 5734037 - DNA, 14 bp, Homo sapiens
gaaattaaaatatt

SEQ ID NO: 5734038 - DNA, 23 bp, Homo sapiens
gaaattaaaatattatttgatat

SEQ ID NO: 5734039 - DNA, 15 bp, Homo sapiens
gaaattaaacatatt

SEQ ID NO: 5734040 - DNA, 15 bp, Homo sapiens
gaaattaaagtatgc

SEQ ID NO: 5734041 - DNA, 16 bp, Homo sapiens
gaaattaaagtatgca

SEQ ID NO: 5734042 - DNA, 22 bp, Homo sapiens
gaaattaaagtatgcaaaataa

SEQ ID NO: 5734043 - DNA, 17 bp, Homo sapiens
gaaattaacaagaactc

SEQ ID NO: 5734044 - DNA, 12 bp, Homo sapiens
gaaattaacaca

SEQ ID NO: 5734045 - DNA, 16 bp, Homo sapiens
gaaattaagaactgaa

SEQ ID NO: 5734046 - DNA, 13 bp, Homo sapiens
gaaattaagaaga

SEQ ID NO: 5734047 - DNA, 17 bp, Homo sapiens
gaaattaagaaggcaaa

SEQ ID NO: 5734048 - DNA, 19 bp, Homo sapiens
gaaattaagatgttgtctt

SEQ ID NO: 5734049 - DNA, 18 bp, Homo sapiens
gaaattaagcattttgaa

SEQ ID NO: 5734050 - DNA, 22 bp, Homo sapiens
gaaattaatatggcttcaccaa

SEQ ID NO: 5734051 - DNA, 16 bp, Homo sapiens
gaaattaatttgtgaa

SEQ ID NO: 5734052 - DNA, 21 bp, Homo sapiens
gaaattacaagtttcagtaat

SEQ ID NO: 5734053 - DNA, 20 bp, Homo sapiens
gaaattaccagagttgttct

SEQ ID NO: 5734054 - DNA, 19 bp, Homo sapiens
gaaattactaattttactt

SEQ ID NO: 5734055 - DNA, 20 bp, Homo sapiens
gaaattactaattttacttc

SEQ ID NO: 5734056 - DNA, 22 bp, Homo sapiens
gaaattactgcccacttgtcaa

SEQ ID NO: 5734057 - DNA, 13 bp, Homo sapiens
gaaattactttaa

SEQ ID NO: 5734058 - DNA, 20 bp, Homo sapiens
gaaattactttaacattttg

SEQ ID NO: 5734059 - DNA, 14 bp, Homo sapiens
gaaattaggatgta

SEQ ID NO: 5734060 - DNA, 19 bp, Homo sapiens
gaaattaggccttatgtaa

SEQ ID NO: 5734061 - DNA, 19 bp, Homo sapiens
gaaattaggggttaaagca

SEQ ID NO: 5734062 - DNA, 20 bp, Homo sapiens
gaaattaggggttaaagcag

SEQ ID NO: 5734063 - DNA, 18 bp, Homo sapiens
gaaattaggttgaaacat

SEQ ID NO: 5734064 - DNA, 20 bp, Homo sapiens
gaaattaggttgaaacatat

SEQ ID NO: 5734065 - DNA, 17 bp, Homo sapiens
gaaattagtgttttcat

SEQ ID NO: 5734066 - DNA, 18 bp, Homo sapiens
gaaattatataaggcatt

SEQ ID NO: 5734067 - DNA, 17 bp, Homo sapiens
gaaattatataagtatt

SEQ ID NO: 5734068 - DNA, 19 bp, Homo sapiens
gaaattatatctgtggtct

SEQ ID NO: 5734069 - DNA, 15 bp, Homo sapiens
gaaattatctgcctt

SEQ ID NO: 5734070 - DNA, 21 bp, Homo sapiens
gaaattatctgccttatacat

SEQ ID NO: 5734071 - DNA, 19 bp, Homo sapiens
gaaattatctttagttgaa

SEQ ID NO: 5734072 - DNA, 23 bp, Homo sapiens
gaaattatgtgacattttacatt

SEQ ID NO: 5734073 - DNA, 21 bp, Homo sapiens
gaaattattggttggtgtgaa

SEQ ID NO: 5734074 - DNA, 15 bp, Homo sapiens
gaaattatttaataa

SEQ ID NO: 5734075 - DNA, 15 bp, Homo sapiens
gaaattcaaagcata

SEQ ID NO: 5734076 - DNA, 21 bp, Homo sapiens
gaaattcaaagcataaaactt

SEQ ID NO: 5734077 - DNA, 15 bp, Homo sapiens
gaaattcacactgtg

SEQ ID NO: 5734078 - DNA, 15 bp, Homo sapiens
gaaattcagattgtt

SEQ ID NO: 5734079 - DNA, 23 bp, Homo sapiens
gaaattcagcccaccagccacct

SEQ ID NO: 5734080 - DNA, 20 bp, Homo sapiens
gaaattcagttataaagtca

SEQ ID NO: 5734081 - DNA, 17 bp, Homo sapiens
gaaattcatttgtggca

SEQ ID NO: 5734082 - DNA, 15 bp, Homo sapiens
gaaattccagcaata

SEQ ID NO: 5734083 - DNA, 12 bp, Homo sapiens
gaaattccagta

SEQ ID NO: 5734084 - DNA, 17 bp, Homo sapiens
gaaattccagttgcaat

SEQ ID NO: 5734085 - DNA, 14 bp, Homo sapiens
gaaattccagttta

SEQ ID NO: 5734086 - DNA, 21 bp, Homo sapiens
gaaattccatacttctctcag

SEQ ID NO: 5734087 - DNA, 13 bp, Homo sapiens
gaaattcccccac

SEQ ID NO: 5734088 - DNA, 23 bp, Homo sapiens
gaaattccctggaccagatgctg

SEQ ID NO: 5734089 - DNA, 21 bp, Homo sapiens
gaaattcccttcatctggaac

SEQ ID NO: 5734090 - DNA, 12 bp, Homo sapiens
gaaattcctgta

SEQ ID NO: 5734091 - DNA, 19 bp, Homo sapiens
gaaattcctgtagcatctt

SEQ ID NO: 5734092 - DNA, 19 bp, Homo sapiens
gaaattcgccccattttct

SEQ ID NO: 5734093 - DNA, 17 bp, Homo sapiens
gaaattctataagagac

SEQ ID NO: 5734094 - DNA, 21 bp, Homo sapiens
gaaattctatatgatcctgaa

SEQ ID NO: 5734095 - DNA, 16 bp, Homo sapiens
gaaattctcctggagg

SEQ ID NO: 5734096 - DNA, 15 bp, Homo sapiens
gaaattctgaaaact

SEQ ID NO: 5734097 - DNA, 17 bp, Homo sapiens
gaaattctgaatttgca

SEQ ID NO: 5734098 - DNA, 15 bp, Homo sapiens
gaaattcttccctgg

SEQ ID NO: 5734099 - DNA, 19 bp, Homo sapiens
gaaattcttccctgggggt

SEQ ID NO: 5734100 - DNA, 22 bp, Homo sapiens
gaaattctttcccagtctgtcg

SEQ ID NO: 5734101 - DNA, 15 bp, Homo sapiens
gaaattgaaaagtta

SEQ ID NO: 5734102 - DNA, 15 bp, Homo sapiens
gaaattgaacctggt

SEQ ID NO: 5734103 - DNA, 15 bp, Homo sapiens
gaaattgaagtgtct

SEQ ID NO: 5734104 - DNA, 16 bp, Homo sapiens
gaaattgaagtgtctt

SEQ ID NO: 5734105 - DNA, 23 bp, Homo sapiens
gaaattgaagtgtcttctgttcc

SEQ ID NO: 5734106 - DNA, 19 bp, Homo sapiens
gaaattgaatactttgaat

SEQ ID NO: 5734107 - DNA, 21 bp, Homo sapiens
gaaattgaatactttgaatgt

SEQ ID NO: 5734108 - DNA, 13 bp, Homo sapiens
gaaattgacagat

SEQ ID NO: 5734109 - DNA, 23 bp, Homo sapiens
gaaattgagctgctttttttgaa

SEQ ID NO: 5734110 - DNA, 23 bp, Homo sapiens
gaaattgatttgtcaagaggata

SEQ ID NO: 5734111 - DNA, 16 bp, Homo sapiens
gaaattgcatactttg

SEQ ID NO: 5734112 - DNA, 20 bp, Homo sapiens
gaaattgcctatcctgctgt

SEQ ID NO: 5734113 - DNA, 22 bp, Homo sapiens
gaaattgcctccttatttatca

SEQ ID NO: 5734114 - DNA, 17 bp, Homo sapiens
gaaattgcctgacgaac

SEQ ID NO: 5734115 - DNA, 18 bp, Homo sapiens
gaaattgctttgtattgt

SEQ ID NO: 5734116 - DNA, 17 bp, Homo sapiens
gaaattggaacagaatg

SEQ ID NO: 5734117 - DNA, 17 bp, Homo sapiens
gaaattgggtgaagagc

SEQ ID NO: 5734118 - DNA, 20 bp, Homo sapiens
gaaattgggtgtgccctggc

SEQ ID NO: 5734119 - DNA, 23 bp, Homo sapiens
gaaattgggtgtgccctggctcc

SEQ ID NO: 5734120 - DNA, 20 bp, Homo sapiens
gaaattggtaccttgcacac

SEQ ID NO: 5734121 - DNA, 17 bp, Homo sapiens
gaaattggtgggaagca

SEQ ID NO: 5734122 - DNA, 18 bp, Homo sapiens
gaaattgtacatatttgt

SEQ ID NO: 5734123 - DNA, 18 bp, Homo sapiens
gaaattgtattacaaatc

SEQ ID NO: 5734124 - DNA, 20 bp, Homo sapiens
gaaattgtccttgaagcttg

SEQ ID NO: 5734125 - DNA, 21 bp, Homo sapiens
gaaattgtctagcagagcagg

SEQ ID NO: 5734126 - DNA, 18 bp, Homo sapiens
gaaattgtgaactcattg

SEQ ID NO: 5734127 - DNA, 20 bp, Homo sapiens
gaaattgtgccaaagatagc

SEQ ID NO: 5734128 - DNA, 22 bp, Homo sapiens
gaaattgttgtatatcactaaa

SEQ ID NO: 5734129 - DNA, 22 bp, Homo sapiens
gaaattgtttaagtgttgtaaa

SEQ ID NO: 5734130 - DNA, 20 bp, Homo sapiens
gaaattgttttaccagctcc

SEQ ID NO: 5734131 - DNA, 17 bp, Homo sapiens
gaaatttaaaaatcttt

SEQ ID NO: 5734132 - DNA, 19 bp, Homo sapiens
gaaatttaaaaatctttca

SEQ ID NO: 5734133 - DNA, 19 bp, Homo sapiens
gaaatttaaaagacactgt

SEQ ID NO: 5734134 - DNA, 16 bp, Homo sapiens
gaaatttaaaagcaga

SEQ ID NO: 5734135 - DNA, 23 bp, Homo sapiens
gaaatttaaactataagcaagaa

SEQ ID NO: 5734136 - DNA, 16 bp, Homo sapiens
gaaatttaaataatag

SEQ ID NO: 5734137 - DNA, 22 bp, Homo sapiens
gaaatttaagcacaaaaaattt

SEQ ID NO: 5734138 - DNA, 14 bp, Homo sapiens
gaaatttaatacat

SEQ ID NO: 5734139 - DNA, 22 bp, Homo sapiens
gaaatttaatatagctattttt

SEQ ID NO: 5734140 - DNA, 18 bp, Homo sapiens
gaaatttaattacaaaca

SEQ ID NO: 5734141 - DNA, 21 bp, Homo sapiens
gaaatttaattcatgtttctt

SEQ ID NO: 5734142 - DNA, 13 bp, Homo sapiens
gaaatttactata

SEQ ID NO: 5734143 - DNA, 20 bp, Homo sapiens
gaaatttactatgtaaatgc

SEQ ID NO: 5734144 - DNA, 12 bp, Homo sapiens
gaaatttagcat

SEQ ID NO: 5734145 - DNA, 17 bp, Homo sapiens
gaaatttataaactttt

SEQ ID NO: 5734146 - DNA, 21 bp, Homo sapiens
gaaatttatgaagcagattta

SEQ ID NO: 5734147 - DNA, 12 bp, Homo sapiens
gaaatttcacgt

SEQ ID NO: 5734148 - DNA, 20 bp, Homo sapiens
gaaatttcacgtcataggaa

SEQ ID NO: 5734149 - DNA, 11 bp, Homo sapiens
gaaatttcatg

SEQ ID NO: 5734150 - DNA, 14 bp, Homo sapiens
gaaatttcatgaaa

SEQ ID NO: 5734151 - DNA, 19 bp, Homo sapiens
gaaatttccactcaggtct

SEQ ID NO: 5734152 - DNA, 14 bp, Homo sapiens
gaaatttctgtgaa

SEQ ID NO: 5734153 - DNA, 15 bp, Homo sapiens
gaaatttgaaaaaac

SEQ ID NO: 5734154 - DNA, 23 bp, Homo sapiens
gaaatttgaaaaaactttctctt

SEQ ID NO: 5734155 - DNA, 17 bp, Homo sapiens
gaaatttgataatgaca

SEQ ID NO: 5734156 - DNA, 13 bp, Homo sapiens
gaaatttgcaaaa

SEQ ID NO: 5734157 - DNA, 18 bp, Homo sapiens
gaaatttgcaaaatcact

SEQ ID NO: 5734158 - DNA, 16 bp, Homo sapiens
gaaatttgggttttta

SEQ ID NO: 5734159 - DNA, 14 bp, Homo sapiens
gaaatttggtaccc

SEQ ID NO: 5734160 - DNA, 14 bp, Homo sapiens
gaaatttgttaata

SEQ ID NO: 5734161 - DNA, 21 bp, Homo sapiens
gaaatttgttatacttcaaaa

SEQ ID NO: 5734162 - DNA, 15 bp, Homo sapiens
gaaatttgtttgtat

SEQ ID NO: 5734163 - DNA, 15 bp, Homo sapiens
gaaattttacaatag

SEQ ID NO: 5734164 - DNA, 12 bp, Homo sapiens
gaaattttacca

SEQ ID NO: 5734165 - DNA, 14 bp, Homo sapiens
gaaattttaccaag

SEQ ID NO: 5734166 - DNA, 21 bp, Homo sapiens
gaaattttaccaagttatata

SEQ ID NO: 5734167 - DNA, 21 bp, Homo sapiens
gaaattttatatgtaaatgtg

SEQ ID NO: 5734168 - DNA, 16 bp, Homo sapiens
gaaattttatgaagtt

SEQ ID NO: 5734169 - DNA, 14 bp, Homo sapiens
gaaattttccatta

SEQ ID NO: 5734170 - DNA, 23 bp, Homo sapiens
gaaattttccattacatgatctt

SEQ ID NO: 5734171 - DNA, 16 bp, Homo sapiens
gaaattttctacagta

SEQ ID NO: 5734172 - DNA, 21 bp, Homo sapiens
gaaattttctagactttctgt

SEQ ID NO: 5734173 - DNA, 15 bp, Homo sapiens
gaaattttgcaaata

SEQ ID NO: 5734174 - DNA, 21 bp, Homo sapiens
gaaattttgcaaatataaaca

SEQ ID NO: 5734175 - DNA, 24 bp, Homo sapiens
gaaattttgcaaatataaacatct

SEQ ID NO: 5734176 - DNA, 13 bp, Homo sapiens
gaaattttggttt

SEQ ID NO: 5734177 - DNA, 19 bp, Homo sapiens
gaaattttgtaagaaggca

SEQ ID NO: 5734178 - DNA, 18 bp, Homo sapiens
gaaattttgtccatttta

SEQ ID NO: 5734179 - DNA, 18 bp, Homo sapiens
gaaatttttaatgtttat

SEQ ID NO: 5734180 - DNA, 18 bp, Homo sapiens
gaaatttttattaaatta

SEQ ID NO: 5734181 - DNA, 17 bp, Homo sapiens
gaaatttttatttttct

SEQ ID NO: 5734182 - DNA, 17 bp, Homo sapiens
gaaatttttcagatgct

SEQ ID NO: 5734183 - DNA, 12 bp, Homo sapiens
gaaatttttcat

SEQ ID NO: 5734184 - DNA, 13 bp, Homo sapiens
gaaatttttcata

SEQ ID NO: 5734185 - DNA, 17 bp, Homo sapiens
gaaatttttcatatttt

SEQ ID NO: 5734186 - DNA, 15 bp, Homo sapiens
gaaatttttcttctt

SEQ ID NO: 5734187 - DNA, 22 bp, Homo sapiens
gaaatttttgatgcccagacag

SEQ ID NO: 5734188 - DNA, 17 bp, Homo sapiens
gaaatttttgcatgttt

SEQ ID NO: 5734189 - DNA, 16 bp, Homo sapiens
gaaatttttgtaaatc

SEQ ID NO: 5734190 - DNA, 21 bp, Homo sapiens
gaaatttttgtaaatcacatc

SEQ ID NO: 5734191 - DNA, 16 bp, Homo sapiens
gaacaaaaaaatctgc

SEQ ID NO: 5734192 - DNA, 21 bp, Homo sapiens
gaacaaaaaaatctgcagaag

SEQ ID NO: 5734193 - DNA, 22 bp, Homo sapiens
gaacaaaacctcttctgtattt

SEQ ID NO: 5734194 - DNA, 10 bp, Homo sapiens
gaacaaaact

SEQ ID NO: 5734195 - DNA, 13 bp, Homo sapiens
gaacaaaactgtt

SEQ ID NO: 5734196 - DNA, 19 bp, Homo sapiens
gaacaaaactgttcttttg

SEQ ID NO: 5734197 - DNA, 19 bp, Homo sapiens
gaacaaaagcaggttttta

SEQ ID NO: 5734198 - DNA, 21 bp, Homo sapiens
gaacaaaagttcgaaagaaaa

SEQ ID NO: 5734199 - DNA, 16 bp, Homo sapiens
gaacaaaataaattgg

SEQ ID NO: 5734200 - DNA, 17 bp, Homo sapiens
gaacaaacactgaatca

SEQ ID NO: 5734201 - DNA, 23 bp, Homo sapiens
gaacaaacactgcagtttcctgg

SEQ ID NO: 5734202 - DNA, 15 bp, Homo sapiens
gaacaaactcagatc

SEQ ID NO: 5734203 - DNA, 18 bp, Homo sapiens
gaacaaactgatgcgaaa

SEQ ID NO: 5734204 - DNA, 19 bp, Homo sapiens
gaacaaagaaaaaaatata

SEQ ID NO: 5734205 - DNA, 14 bp, Homo sapiens
gaacaaagaaaaga

SEQ ID NO: 5734206 - DNA, 13 bp, Homo sapiens
gaacaaagacatt

SEQ ID NO: 5734207 - DNA, 18 bp, Homo sapiens
gaacaaagaccaatgtga

SEQ ID NO: 5734208 - DNA, 21 bp, Homo sapiens
gaacaaagaccaatgtgaaga

SEQ ID NO: 5734209 - DNA, 15 bp, Homo sapiens
gaacaaagcagccac

SEQ ID NO: 5734210 - DNA, 19 bp, Homo sapiens
gaacaaagcagccacgagg

SEQ ID NO: 5734211 - DNA, 16 bp, Homo sapiens
gaacaaagctgttaaa

SEQ ID NO: 5734212 - DNA, 22 bp, Homo sapiens
gaacaaagctgttaaactgtta

SEQ ID NO: 5734213 - DNA, 17 bp, Homo sapiens
gaacaaagtgaaggaca

SEQ ID NO: 5734214 - DNA, 15 bp, Homo sapiens
gaacaaatatgcttt

SEQ ID NO: 5734215 - DNA, 18 bp, Homo sapiens
gaacaaatcaaattgctt

SEQ ID NO: 5734216 - DNA, 19 bp, Homo sapiens
gaacaaatcgtttctcaga

SEQ ID NO: 5734217 - DNA, 15 bp, Homo sapiens
gaacaaatctgggca

SEQ ID NO: 5734218 - DNA, 13 bp, Homo sapiens
gaacaaatgaaga

SEQ ID NO: 5734219 - DNA, 20 bp, Homo sapiens
gaacaaatgtgtttttctat

SEQ ID NO: 5734220 - DNA, 17 bp, Homo sapiens
gaacaaattagaggaga

SEQ ID NO: 5734221 - DNA, 18 bp, Homo sapiens
gaacaaattagaggagac

SEQ ID NO: 5734222 - DNA, 22 bp, Homo sapiens
gaacaaattctttagtactcaa

SEQ ID NO: 5734223 - DNA, 23 bp, Homo sapiens
gaacaaatttacagagacagaaa

SEQ ID NO: 5734224 - DNA, 13 bp, Homo sapiens
gaacaaattttca

SEQ ID NO: 5734225 - DNA, 17 bp, Homo sapiens
gaacaaattttctggtg

SEQ ID NO: 5734226 - DNA, 15 bp, Homo sapiens
gaacaacaaagacat

SEQ ID NO: 5734227 - DNA, 23 bp, Homo sapiens
gaacaacaacaaagcatgctcag

SEQ ID NO: 5734228 - DNA, 14 bp, Homo sapiens
gaacaacaaggaca

SEQ ID NO: 5734229 - DNA, 19 bp, Homo sapiens
gaacaacataaaattaaaa

SEQ ID NO: 5734230 - DNA, 22 bp, Homo sapiens
gaacaacgtactatggaagcca

SEQ ID NO: 5734231 - DNA, 21 bp, Homo sapiens
gaacaactaggcttcagcata

SEQ ID NO: 5734232 - DNA, 15 bp, Homo sapiens
gaacaactggaaata

SEQ ID NO: 5734233 - DNA, 16 bp, Homo sapiens
gaacaactggaaataa

SEQ ID NO: 5734234 - DNA, 20 bp, Homo sapiens
gaacaagaccctgtctcaaa

SEQ ID NO: 5734235 - DNA, 13 bp, Homo sapiens
gaacaagagaaaa

SEQ ID NO: 5734236 - DNA, 17 bp, Homo sapiens
gaacaagagaagcattc

SEQ ID NO: 5734237 - DNA, 16 bp, Homo sapiens
gaacaagcaaacccag

SEQ ID NO: 5734238 - DNA, 23 bp, Homo sapiens
gaacaagcaaatataaacagcaa

SEQ ID NO: 5734239 - DNA, 23 bp, Homo sapiens
gaacaagcaatgatgacccacta

SEQ ID NO: 5734240 - DNA, 16 bp, Homo sapiens
gaacaagcatgtctct

SEQ ID NO: 5734241 - DNA, 23 bp, Homo sapiens
gaacaagcatgtctctctgccaa

SEQ ID NO: 5734242 - DNA, 16 bp, Homo sapiens
gaacaagccagagccg

SEQ ID NO: 5734243 - DNA, 13 bp, Homo sapiens
gaacaagcctaaa

SEQ ID NO: 5734244 - DNA, 14 bp, Homo sapiens
gaacaagctggctt

SEQ ID NO: 5734245 - DNA, 15 bp, Homo sapiens
gaacaaggaaggaaa

SEQ ID NO: 5734246 - DNA, 20 bp, Homo sapiens
gaacaaggaaggaaagatgt

SEQ ID NO: 5734247 - DNA, 15 bp, Homo sapiens
gaacaaggcaaggct

SEQ ID NO: 5734248 - DNA, 14 bp, Homo sapiens
gaacaagtcacagc

SEQ ID NO: 5734249 - DNA, 13 bp, Homo sapiens
gaacaagtgaaca

SEQ ID NO: 5734250 - DNA, 17 bp, Homo sapiens
gaacaagtgaacacatt

SEQ ID NO: 5734251 - DNA, 23 bp, Homo sapiens
gaacaagtgcctcctggactgtt

SEQ ID NO: 5734252 - DNA, 15 bp, Homo sapiens
gaacaagtgtacaga

SEQ ID NO: 5734253 - DNA, 19 bp, Homo sapiens
gaacaagtgtacagaagaa

SEQ ID NO: 5734254 - DNA, 21 bp, Homo sapiens
gaacaagttttggcagccatg

SEQ ID NO: 5734255 - DNA, 22 bp, Homo sapiens
gaacaagttttggcagccatga

SEQ ID NO: 5734256 - DNA, 19 bp, Homo sapiens
gaacaataaagtttgcttt

SEQ ID NO: 5734257 - DNA, 19 bp, Homo sapiens
gaacaatagctattgcatg

SEQ ID NO: 5734258 - DNA, 20 bp, Homo sapiens
gaacaatagctattgcatgt

SEQ ID NO: 5734259 - DNA, 22 bp, Homo sapiens
gaacaatagctattgcatgtaa

SEQ ID NO: 5734260 - DNA, 19 bp, Homo sapiens
gaacaatcacaaaagctgt

SEQ ID NO: 5734261 - DNA, 15 bp, Homo sapiens
gaacaatcactattc

SEQ ID NO: 5734262 - DNA, 14 bp, Homo sapiens
gaacaatcagatta

SEQ ID NO: 5734263 - DNA, 12 bp, Homo sapiens
gaacaatgaagt

SEQ ID NO: 5734264 - DNA, 19 bp, Homo sapiens
gaacaatgccgcctgtcaa

SEQ ID NO: 5734265 - DNA, 19 bp, Homo sapiens
gaacaatgtatacaatgca

SEQ ID NO: 5734266 - DNA, 15 bp, Homo sapiens
gaacaatgtcagaaa

SEQ ID NO: 5734267 - DNA, 22 bp, Homo sapiens
gaacaattattttattgtctaa

SEQ ID NO: 5734268 - DNA, 21 bp, Homo sapiens
gaacaattcggtggtaaaagt

SEQ ID NO: 5734269 - DNA, 11 bp, Homo sapiens
gaacaatttct

SEQ ID NO: 5734270 - DNA, 15 bp, Homo sapiens
gaacaatttctctgg

SEQ ID NO: 5734271 - DNA, 19 bp, Homo sapiens
gaacaatttggcaattttg

SEQ ID NO: 5734272 - DNA, 16 bp, Homo sapiens
gaacacaaaacattta

SEQ ID NO: 5734273 - DNA, 21 bp, Homo sapiens
gaacacaagcaaaccttctca

SEQ ID NO: 5734274 - DNA, 21 bp, Homo sapiens
gaacacaagccacgcctgcga

SEQ ID NO: 5734275 - DNA, 15 bp, Homo sapiens
gaacacaatgtgtat

SEQ ID NO: 5734276 - DNA, 24 bp, Homo sapiens
gaacacaattgatacttcaggtgc

SEQ ID NO: 5734277 - DNA, 14 bp, Homo sapiens
gaacacacacacac

SEQ ID NO: 5734278 - DNA, 16 bp, Homo sapiens
gaacacacacatatac

SEQ ID NO: 5734279 - DNA, 17 bp, Homo sapiens
gaacacacacatataca

SEQ ID NO: 5734280 - DNA, 15 bp, Homo sapiens
gaacacacacgccag

SEQ ID NO: 5734281 - DNA, 17 bp, Homo sapiens
gaacacacacgccagct

SEQ ID NO: 5734282 - DNA, 18 bp, Homo sapiens
gaacacacacgccagctc

SEQ ID NO: 5734283 - DNA, 20 bp, Homo sapiens
gaacacacacgccagctcct

SEQ ID NO: 5734284 - DNA, 22 bp, Homo sapiens
gaacacacacgctccctggaag

SEQ ID NO: 5734285 - DNA, 23 bp, Homo sapiens
gaacacacacgctccctggaagc

SEQ ID NO: 5734286 - DNA, 18 bp, Homo sapiens
gaacacacatcccaggag

SEQ ID NO: 5734287 - DNA, 12 bp, Homo sapiens
gaacacacattg

SEQ ID NO: 5734288 - DNA, 15 bp, Homo sapiens
gaacacactcagcag

SEQ ID NO: 5734289 - DNA, 16 bp, Homo sapiens
gaacacactgagtgag

SEQ ID NO: 5734290 - DNA, 21 bp, Homo sapiens
gaacacacttgggagcagtcc

SEQ ID NO: 5734291 - DNA, 13 bp, Homo sapiens
gaacacagaactg

SEQ ID NO: 5734292 - DNA, 12 bp, Homo sapiens
gaacacagagaa

SEQ ID NO: 5734293 - DNA, 14 bp, Homo sapiens
gaacacagcagacc

SEQ ID NO: 5734294 - DNA, 11 bp, Homo sapiens
gaacacagcta

SEQ ID NO: 5734295 - DNA, 23 bp, Homo sapiens
gaacacagctctttaacatggtt

SEQ ID NO: 5734296 - DNA, 12 bp, Homo sapiens
gaacacaggcaa

SEQ ID NO: 5734297 - DNA, 20 bp, Homo sapiens
gaacacaggtgttggaagcc

SEQ ID NO: 5734298 - DNA, 15 bp, Homo sapiens
gaacacagtattttc

SEQ ID NO: 5734299 - DNA, 13 bp, Homo sapiens
gaacacagtgaca

SEQ ID NO: 5734300 - DNA, 12 bp, Homo sapiens
gaacacagtgtc

SEQ ID NO: 5734301 - DNA, 17 bp, Homo sapiens
gaacacagttctgggca

SEQ ID NO: 5734302 - DNA, 20 bp, Homo sapiens
gaacacagtttagtgcttta

SEQ ID NO: 5734303 - DNA, 18 bp, Homo sapiens
gaacacatactagaaagc

SEQ ID NO: 5734304 - DNA, 14 bp, Homo sapiens
gaacacatgcacac

SEQ ID NO: 5734305 - DNA, 16 bp, Homo sapiens
gaacacatgtgtatga

SEQ ID NO: 5734306 - DNA, 16 bp, Homo sapiens
gaacacatttctaatt

SEQ ID NO: 5734307 - DNA, 22 bp, Homo sapiens
gaacacatttctttttaaaaaa

SEQ ID NO: 5734308 - DNA, 15 bp, Homo sapiens
gaacacattttaaat

SEQ ID NO: 5734309 - DNA, 17 bp, Homo sapiens
gaacaccaacttttatt

SEQ ID NO: 5734310 - DNA, 15 bp, Homo sapiens
gaacaccaagtaaat

SEQ ID NO: 5734311 - DNA, 18 bp, Homo sapiens
gaacaccaagtaaatcta

SEQ ID NO: 5734312 - DNA, 19 bp, Homo sapiens
gaacaccagcagcactgga

SEQ ID NO: 5734313 - DNA, 20 bp, Homo sapiens
gaacaccataggtagaatgt

SEQ ID NO: 5734314 - DNA, 20 bp, Homo sapiens
gaacaccattgaaggcttaa

SEQ ID NO: 5734315 - DNA, 18 bp, Homo sapiens
gaacacccactggccagt

SEQ ID NO: 5734316 - DNA, 14 bp, Homo sapiens
gaacacccctgtgc

SEQ ID NO: 5734317 - DNA, 16 bp, Homo sapiens
gaacacccggaaagac

SEQ ID NO: 5734318 - DNA, 21 bp, Homo sapiens
gaacacctatgcaaagatgaa

SEQ ID NO: 5734319 - DNA, 23 bp, Homo sapiens
gaacacctggccgggtcaccctg

SEQ ID NO: 5734320 - DNA, 14 bp, Homo sapiens
gaacacgattttca

SEQ ID NO: 5734321 - DNA, 16 bp, Homo sapiens
gaacacgcgtatttac

SEQ ID NO: 5734322 - DNA, 17 bp, Homo sapiens
gaacacgcgtatttaca

SEQ ID NO: 5734323 - DNA, 22 bp, Homo sapiens
gaacacggccacatcaaagagg

SEQ ID NO: 5734324 - DNA, 16 bp, Homo sapiens
gaacacggcctactga

SEQ ID NO: 5734325 - DNA, 18 bp, Homo sapiens
gaacacgtgtgcacatgc

SEQ ID NO: 5734326 - DNA, 17 bp, Homo sapiens
gaacacgtttttacata

SEQ ID NO: 5734327 - DNA, 17 bp, Homo sapiens
gaacactagacaagcca

SEQ ID NO: 5734328 - DNA, 19 bp, Homo sapiens
gaacactagacaagccaga

SEQ ID NO: 5734329 - DNA, 17 bp, Homo sapiens
gaacactcatcccccat

SEQ ID NO: 5734330 - DNA, 22 bp, Homo sapiens
gaacactcatgcggcccagcca

SEQ ID NO: 5734331 - DNA, 16 bp, Homo sapiens
gaacactcatgctgaa

SEQ ID NO: 5734332 - DNA, 18 bp, Homo sapiens
gaacactcatgtctggag

SEQ ID NO: 5734333 - DNA, 18 bp, Homo sapiens
gaacactcttttgcttta

SEQ ID NO: 5734334 - DNA, 15 bp, Homo sapiens
gaacactgagaaaga

SEQ ID NO: 5734335 - DNA, 18 bp, Homo sapiens
gaacactgcagtgttatt

SEQ ID NO: 5734336 - DNA, 14 bp, Homo sapiens
gaacactggacaac

SEQ ID NO: 5734337 - DNA, 22 bp, Homo sapiens
gaacactggcacactgctctta

SEQ ID NO: 5734338 - DNA, 22 bp, Homo sapiens
gaacactggcagactgtgtaaa

SEQ ID NO: 5734339 - DNA, 22 bp, Homo sapiens
gaacactggcttgaaggactgc

SEQ ID NO: 5734340 - DNA, 17 bp, Homo sapiens
gaacactgggggagggg

SEQ ID NO: 5734341 - DNA, 18 bp, Homo sapiens
gaacactgtcatcaatgt

SEQ ID NO: 5734342 - DNA, 12 bp, Homo sapiens
gaacactgtgac

SEQ ID NO: 5734343 - DNA, 19 bp, Homo sapiens
gaacactgtgaccaggctt

SEQ ID NO: 5734344 - DNA, 20 bp, Homo sapiens
gaacactgtgaccaggcttt

SEQ ID NO: 5734345 - DNA, 16 bp, Homo sapiens
gaacactttgctagga

SEQ ID NO: 5734346 - DNA, 22 bp, Homo sapiens
gaacacttttgaaaatgtacat

SEQ ID NO: 5734347 - DNA, 11 bp, Homo sapiens
gaacagaaaac

SEQ ID NO: 5734348 - DNA, 13 bp, Homo sapiens
gaacagaaatacc

SEQ ID NO: 5734349 - DNA, 23 bp, Homo sapiens
gaacagaacatagacagaagaaa

SEQ ID NO: 5734350 - DNA, 22 bp, Homo sapiens
gaacagaactcggtgtccccac

SEQ ID NO: 5734351 - DNA, 15 bp, Homo sapiens
gaacagaaggactga

SEQ ID NO: 5734352 - DNA, 19 bp, Homo sapiens
gaacagacaacagaagtca

SEQ ID NO: 5734353 - DNA, 16 bp, Homo sapiens
gaacagacaggagaaa

SEQ ID NO: 5734354 - DNA, 11 bp, Homo sapiens
gaacagaccat

SEQ ID NO: 5734355 - DNA, 20 bp, Homo sapiens
gaacagactggaagcacagc

SEQ ID NO: 5734356 - DNA, 19 bp, Homo sapiens
gaacagagactctggaagc

SEQ ID NO: 5734357 - DNA, 14 bp, Homo sapiens
gaacagagagaacc

SEQ ID NO: 5734358 - DNA, 19 bp, Homo sapiens
gaacagagagaaccaggag

SEQ ID NO: 5734359 - DNA, 20 bp, Homo sapiens
gaacagagagaaccaggagg

SEQ ID NO: 5734360 - DNA, 20 bp, Homo sapiens
gaacagagagacccttgtgg

SEQ ID NO: 5734361 - DNA, 16 bp, Homo sapiens
gaacagagcgggcctc

SEQ ID NO: 5734362 - DNA, 18 bp, Homo sapiens
gaacagataatcagtgtg

SEQ ID NO: 5734363 - DNA, 19 bp, Homo sapiens
gaacagatctccaaagctt

SEQ ID NO: 5734364 - DNA, 20 bp, Homo sapiens
gaacagatgacccctgccca

SEQ ID NO: 5734365 - DNA, 22 bp, Homo sapiens
gaacagatgacccctgcccaga

SEQ ID NO: 5734366 - DNA, 14 bp, Homo sapiens
gaacagatggctgt

SEQ ID NO: 5734367 - DNA, 15 bp, Homo sapiens
gaacagatggctgtg

SEQ ID NO: 5734368 - DNA, 21 bp, Homo sapiens
gaacagatggctgtgaaaatt

SEQ ID NO: 5734369 - DNA, 17 bp, Homo sapiens
gaacagattcacactgt

SEQ ID NO: 5734370 - DNA, 21 bp, Homo sapiens
gaacagattcacactgtctgg

SEQ ID NO: 5734371 - DNA, 20 bp, Homo sapiens
gaacagattgctacacacac

SEQ ID NO: 5734372 - DNA, 22 bp, Homo sapiens
gaacagcagaaacccatgtgca

SEQ ID NO: 5734373 - DNA, 20 bp, Homo sapiens
gaacagcagactcagctctg

SEQ ID NO: 5734374 - DNA, 15 bp, Homo sapiens
gaacagcaggcccac

SEQ ID NO: 5734375 - DNA, 18 bp, Homo sapiens
gaacagcatatgatttct

SEQ ID NO: 5734376 - DNA, 14 bp, Homo sapiens
gaacagccaaagaa

SEQ ID NO: 5734377 - DNA, 15 bp, Homo sapiens
gaacagccaaagaaa

SEQ ID NO: 5734378 - DNA, 13 bp, Homo sapiens
gaacagccatttt

SEQ ID NO: 5734379 - DNA, 12 bp, Homo sapiens
gaacagcccagc

SEQ ID NO: 5734380 - DNA, 13 bp, Homo sapiens
gaacagcccagca

SEQ ID NO: 5734381 - DNA, 12 bp, Homo sapiens
gaacagccccgg

SEQ ID NO: 5734382 - DNA, 17 bp, Homo sapiens
gaacagccccggggccc

SEQ ID NO: 5734383 - DNA, 15 bp, Homo sapiens
gaacagccctctctc

SEQ ID NO: 5734384 - DNA, 13 bp, Homo sapiens
gaacagccctgca

SEQ ID NO: 5734385 - DNA, 15 bp, Homo sapiens
gaacagccctgcacg

SEQ ID NO: 5734386 - DNA, 18 bp, Homo sapiens
gaacagccgctcctgtct

SEQ ID NO: 5734387 - DNA, 14 bp, Homo sapiens
gaacagcctgagcc

SEQ ID NO: 5734388 - DNA, 21 bp, Homo sapiens
gaacagcgaagtagcttgctc

SEQ ID NO: 5734389 - DNA, 21 bp, Homo sapiens
gaacagcggctggacttggag

SEQ ID NO: 5734390 - DNA, 14 bp, Homo sapiens
gaacagcgggagac

SEQ ID NO: 5734391 - DNA, 21 bp, Homo sapiens
gaacagcgggagacctgtgct

SEQ ID NO: 5734392 - DNA, 21 bp, Homo sapiens
gaacagcgggtacttatttct

SEQ ID NO: 5734393 - DNA, 22 bp, Homo sapiens
gaacagctatgggagccccagg

SEQ ID NO: 5734394 - DNA, 15 bp, Homo sapiens
gaacagctcatcttc

SEQ ID NO: 5734395 - DNA, 17 bp, Homo sapiens
gaacagctctgagatcc

SEQ ID NO: 5734396 - DNA, 19 bp, Homo sapiens
gaacagctctgagatcctg

SEQ ID NO: 5734397 - DNA, 21 bp, Homo sapiens
gaacagctcttcactcagcca

SEQ ID NO: 5734398 - DNA, 13 bp, Homo sapiens
gaacagctggtgt

SEQ ID NO: 5734399 - DNA, 14 bp, Homo sapiens
gaacagctggtgta

SEQ ID NO: 5734400 - DNA, 15 bp, Homo sapiens
gaacagctggtgtag

SEQ ID NO: 5734401 - DNA, 23 bp, Homo sapiens
gaacagctggtgtagctacagag

SEQ ID NO: 5734402 - DNA, 24 bp, Homo sapiens
gaacagctggtgtagctacagaga

SEQ ID NO: 5734403 - DNA, 11 bp, Homo sapiens
gaacagctgtg

SEQ ID NO: 5734404 - DNA, 19 bp, Homo sapiens
gaacagctgtgagccatgc

SEQ ID NO: 5734405 - DNA, 19 bp, Homo sapiens
gaacagctgtgtctgccaa

SEQ ID NO: 5734406 - DNA, 18 bp, Homo sapiens
gaacagctgttcctgtgt

SEQ ID NO: 5734407 - DNA, 17 bp, Homo sapiens
gaacagctgttgactct

SEQ ID NO: 5734408 - DNA, 14 bp, Homo sapiens
gaacagcttcaggt

SEQ ID NO: 5734409 - DNA, 16 bp, Homo sapiens
gaacagctttgtatgt

SEQ ID NO: 5734410 - DNA, 15 bp, Homo sapiens
gaacaggaaaagaaa

SEQ ID NO: 5734411 - DNA, 23 bp, Homo sapiens
gaacaggaaaataaaatatttaa

SEQ ID NO: 5734412 - DNA, 18 bp, Homo sapiens
gaacaggaaagagctagg

SEQ ID NO: 5734413 - DNA, 22 bp, Homo sapiens
gaacaggaatccttactgatat

SEQ ID NO: 5734414 - DNA, 18 bp, Homo sapiens
gaacaggaggaactggtc

SEQ ID NO: 5734415 - DNA, 20 bp, Homo sapiens
gaacaggaggaactggtcca

SEQ ID NO: 5734416 - DNA, 22 bp, Homo sapiens
gaacaggagtgactctggctgc

SEQ ID NO: 5734417 - DNA, 16 bp, Homo sapiens
gaacaggcagaaatat

SEQ ID NO: 5734418 - DNA, 12 bp, Homo sapiens
gaacaggctggt

SEQ ID NO: 5734419 - DNA, 14 bp, Homo sapiens
gaacaggcttggag

SEQ ID NO: 5734420 - DNA, 19 bp, Homo sapiens
gaacaggcttggagggaag

SEQ ID NO: 5734421 - DNA, 21 bp, Homo sapiens
gaacagggaaaataggcagga

SEQ ID NO: 5734422 - DNA, 22 bp, Homo sapiens
gaacagggacttgtttagagag

SEQ ID NO: 5734423 - DNA, 13 bp, Homo sapiens
gaacagggcccag

SEQ ID NO: 5734424 - DNA, 19 bp, Homo sapiens
gaacagggcccaggcctgg

SEQ ID NO: 5734425 - DNA, 20 bp, Homo sapiens
gaacagggtccctggatcag

SEQ ID NO: 5734426 - DNA, 19 bp, Homo sapiens
gaacagggttactgtatac

SEQ ID NO: 5734427 - DNA, 18 bp, Homo sapiens
gaacaggtcaaagatgtg

SEQ ID NO: 5734428 - DNA, 19 bp, Homo sapiens
gaacaggtcaaagatgtgt

SEQ ID NO: 5734429 - DNA, 18 bp, Homo sapiens
gaacaggtgttcctcctc

SEQ ID NO: 5734430 - DNA, 18 bp, Homo sapiens
gaacaggttctccaggtg

SEQ ID NO: 5734431 - DNA, 19 bp, Homo sapiens
gaacaggttcttaaaaagg

SEQ ID NO: 5734432 - DNA, 21 bp, Homo sapiens
gaacaggtttttttgtttgtt

SEQ ID NO: 5734433 - DNA, 20 bp, Homo sapiens
gaacagtaaagaaagcagaa

SEQ ID NO: 5734434 - DNA, 14 bp, Homo sapiens
gaacagtaagaaca

SEQ ID NO: 5734435 - DNA, 20 bp, Homo sapiens
gaacagtaggattgctgtgg

SEQ ID NO: 5734436 - DNA, 20 bp, Homo sapiens
gaacagtattgggcaggagg

SEQ ID NO: 5734437 - DNA, 22 bp, Homo sapiens
gaacagtccctcacacctgggc

SEQ ID NO: 5734438 - DNA, 17 bp, Homo sapiens
gaacagtctctggaaga

SEQ ID NO: 5734439 - DNA, 19 bp, Homo sapiens
gaacagtctctggaagaag

SEQ ID NO: 5734440 - DNA, 12 bp, Homo sapiens
gaacagtgaaag

SEQ ID NO: 5734441 - DNA, 20 bp, Homo sapiens
gaacagtgattaccagggac

SEQ ID NO: 5734442 - DNA, 21 bp, Homo sapiens
gaacagtgatttttttttaga

SEQ ID NO: 5734443 - DNA, 17 bp, Homo sapiens
gaacagtgcatgtgcat

SEQ ID NO: 5734444 - DNA, 14 bp, Homo sapiens
gaacagtgctctgc

SEQ ID NO: 5734445 - DNA, 15 bp, Homo sapiens
gaacagtgctctgcc

SEQ ID NO: 5734446 - DNA, 18 bp, Homo sapiens
gaacagtgcttgccacag

SEQ ID NO: 5734447 - DNA, 13 bp, Homo sapiens
gaacagtggctgg

SEQ ID NO: 5734448 - DNA, 14 bp, Homo sapiens
gaacagtggctggg

SEQ ID NO: 5734449 - DNA, 16 bp, Homo sapiens
gaacagtggctgggtg

SEQ ID NO: 5734450 - DNA, 21 bp, Homo sapiens
gaacagtggtggcaacattca

SEQ ID NO: 5734451 - DNA, 22 bp, Homo sapiens
gaacagtgtgcaaggcagccgt

SEQ ID NO: 5734452 - DNA, 23 bp, Homo sapiens
gaacagtgtggtttgggaaagat

SEQ ID NO: 5734453 - DNA, 18 bp, Homo sapiens
gaacagtgtttactttaa

SEQ ID NO: 5734454 - DNA, 14 bp, Homo sapiens
gaacagtgtttccc

SEQ ID NO: 5734455 - DNA, 21 bp, Homo sapiens
gaacagtgtttcccataattt

SEQ ID NO: 5734456 - DNA, 21 bp, Homo sapiens
gaacagttctcccttcaactg

SEQ ID NO: 5734457 - DNA, 14 bp, Homo sapiens
gaacagtttgtaca

SEQ ID NO: 5734458 - DNA, 14 bp, Homo sapiens
gaacataaaaagga

SEQ ID NO: 5734459 - DNA, 16 bp, Homo sapiens
gaacataaaaaggaca

SEQ ID NO: 5734460 - DNA, 15 bp, Homo sapiens
gaacataaagcaaat

SEQ ID NO: 5734461 - DNA, 23 bp, Homo sapiens
gaacataatgaacagaatttatg

SEQ ID NO: 5734462 - DNA, 15 bp, Homo sapiens
gaacatacaaatgca

SEQ ID NO: 5734463 - DNA, 21 bp, Homo sapiens
gaacatacatgatacattttt

SEQ ID NO: 5734464 - DNA, 17 bp, Homo sapiens
gaacatactgattggga

SEQ ID NO: 5734465 - DNA, 16 bp, Homo sapiens
gaacatactgttcact

SEQ ID NO: 5734466 - DNA, 16 bp, Homo sapiens
gaacatagacagaaga

SEQ ID NO: 5734467 - DNA, 19 bp, Homo sapiens
gaacatagactagagaaac

SEQ ID NO: 5734468 - DNA, 22 bp, Homo sapiens
gaacatatcatttgtgaagaat

SEQ ID NO: 5734469 - DNA, 15 bp, Homo sapiens
gaacatcaagatacc

SEQ ID NO: 5734470 - DNA, 17 bp, Homo sapiens
gaacatcacattcctct

SEQ ID NO: 5734471 - DNA, 23 bp, Homo sapiens
gaacatcaccgacgcgtctcctg

SEQ ID NO: 5734472 - DNA, 21 bp, Homo sapiens
gaacatcatcaaggcactgcc

SEQ ID NO: 5734473 - DNA, 22 bp, Homo sapiens
gaacatcatcaaggcactgcct

SEQ ID NO: 5734474 - DNA, 15 bp, Homo sapiens
gaacatcattagaac

SEQ ID NO: 5734475 - DNA, 17 bp, Homo sapiens
gaacatccaaccttccc

SEQ ID NO: 5734476 - DNA, 18 bp, Homo sapiens
gaacatccaaccttccca

SEQ ID NO: 5734477 - DNA, 23 bp, Homo sapiens
gaacatccaaggagaaacagaga

SEQ ID NO: 5734478 - DNA, 14 bp, Homo sapiens
gaacatccctcctg

SEQ ID NO: 5734479 - DNA, 14 bp, Homo sapiens
gaacatccctgcca

SEQ ID NO: 5734480 - DNA, 15 bp, Homo sapiens
gaacatccctgggca

SEQ ID NO: 5734481 - DNA, 18 bp, Homo sapiens
gaacatccttaaatgtct

SEQ ID NO: 5734482 - DNA, 21 bp, Homo sapiens
gaacatcctttgcagggcagc

SEQ ID NO: 5734483 - DNA, 22 bp, Homo sapiens
gaacatcgcgatgggaaccgat

SEQ ID NO: 5734484 - DNA, 17 bp, Homo sapiens
gaacatctatagagata

SEQ ID NO: 5734485 - DNA, 13 bp, Homo sapiens
gaacatgaagcca

SEQ ID NO: 5734486 - DNA, 15 bp, Homo sapiens
gaacatgaatcaaaa

SEQ ID NO: 5734487 - DNA, 15 bp, Homo sapiens
gaacatgaccaaaaa

SEQ ID NO: 5734488 - DNA, 22 bp, Homo sapiens
gaacatgaccaaaaaccaaaag

SEQ ID NO: 5734489 - DNA, 14 bp, Homo sapiens
gaacatgacccagc

SEQ ID NO: 5734490 - DNA, 18 bp, Homo sapiens
gaacatgacccgtacaca

SEQ ID NO: 5734491 - DNA, 22 bp, Homo sapiens
gaacatgacccgtacacaccac

SEQ ID NO: 5734492 - DNA, 21 bp, Homo sapiens
gaacatgagtttatgggaatg

SEQ ID NO: 5734493 - DNA, 20 bp, Homo sapiens
gaacatgatagttaaactac

SEQ ID NO: 5734494 - DNA, 20 bp, Homo sapiens
gaacatgcaagaatttctgg

SEQ ID NO: 5734495 - DNA, 18 bp, Homo sapiens
gaacatgcacatttatat

SEQ ID NO: 5734496 - DNA, 19 bp, Homo sapiens
gaacatgcacatttatata

SEQ ID NO: 5734497 - DNA, 19 bp, Homo sapiens
gaacatgcagctctgcagc

SEQ ID NO: 5734498 - DNA, 12 bp, Homo sapiens
gaacatgcagtt

SEQ ID NO: 5734499 - DNA, 16 bp, Homo sapiens
gaacatgcagttcatt

SEQ ID NO: 5734500 - DNA, 13 bp, Homo sapiens
gaacatgcagttt

SEQ ID NO: 5734501 - DNA, 20 bp, Homo sapiens
gaacatgcagtttgaaattc

SEQ ID NO: 5734502 - DNA, 14 bp, Homo sapiens
gaacatgcctcctc

SEQ ID NO: 5734503 - DNA, 17 bp, Homo sapiens
gaacatgcctcctcctg

SEQ ID NO: 5734504 - DNA, 18 bp, Homo sapiens
gaacatgcctcctcctgc

SEQ ID NO: 5734505 - DNA, 22 bp, Homo sapiens
gaacatgcctcctcctgccctc

SEQ ID NO: 5734506 - DNA, 15 bp, Homo sapiens
gaacatgcctgattt

SEQ ID NO: 5734507 - DNA, 20 bp, Homo sapiens
gaacatgcctgattttaaaa

SEQ ID NO: 5734508 - DNA, 23 bp, Homo sapiens
gaacatgctggaaataaaacagc

SEQ ID NO: 5734509 - DNA, 17 bp, Homo sapiens
gaacatgcttttacttt

SEQ ID NO: 5734510 - DNA, 17 bp, Homo sapiens
gaacatggattccactg

SEQ ID NO: 5734511 - DNA, 14 bp, Homo sapiens
gaacatggccaata

SEQ ID NO: 5734512 - DNA, 23 bp, Homo sapiens
gaacatggccaatagtcatatgt

SEQ ID NO: 5734513 - DNA, 22 bp, Homo sapiens
gaacatggctagcctttcttgt

SEQ ID NO: 5734514 - DNA, 17 bp, Homo sapiens
gaacatggctggcctgg

SEQ ID NO: 5734515 - DNA, 19 bp, Homo sapiens
gaacatggctggcctggta

SEQ ID NO: 5734516 - DNA, 18 bp, Homo sapiens
gaacatggtgtgtgtctc

SEQ ID NO: 5734517 - DNA, 16 bp, Homo sapiens
gaacatgtacactggt

SEQ ID NO: 5734518 - DNA, 22 bp, Homo sapiens
gaacatgtcctaattcttctgt

SEQ ID NO: 5734519 - DNA, 19 bp, Homo sapiens
gaacatgtcggagtagaaa

SEQ ID NO: 5734520 - DNA, 22 bp, Homo sapiens
gaacatgtgaatgaatacacag

SEQ ID NO: 5734521 - DNA, 19 bp, Homo sapiens
gaacatgtgccttttctga

SEQ ID NO: 5734522 - DNA, 17 bp, Homo sapiens
gaacatgtggcttgaat

SEQ ID NO: 5734523 - DNA, 18 bp, Homo sapiens
gaacatgtgggaggaaga

SEQ ID NO: 5734524 - DNA, 22 bp, Homo sapiens
gaacatgtgtgtggtggtgact

SEQ ID NO: 5734525 - DNA, 23 bp, Homo sapiens
gaacatgtgtgtgtgttgtgtta

SEQ ID NO: 5734526 - DNA, 20 bp, Homo sapiens
gaacatgttacgtgtgcaac

SEQ ID NO: 5734527 - DNA, 14 bp, Homo sapiens
gaacatgttctcca

SEQ ID NO: 5734528 - DNA, 23 bp, Homo sapiens
gaacattaatgttgaaaaagaaa

SEQ ID NO: 5734529 - DNA, 17 bp, Homo sapiens
gaacattaattatatgt

SEQ ID NO: 5734530 - DNA, 21 bp, Homo sapiens
gaacattaggccccagcaaca

SEQ ID NO: 5734531 - DNA, 13 bp, Homo sapiens
gaacattataatt

SEQ ID NO: 5734532 - DNA, 18 bp, Homo sapiens
gaacattcagctctggag

SEQ ID NO: 5734533 - DNA, 19 bp, Homo sapiens
gaacattcagctctggaga

SEQ ID NO: 5734534 - DNA, 20 bp, Homo sapiens
gaacattcagctctggagaa

SEQ ID NO: 5734535 - DNA, 13 bp, Homo sapiens
gaacattcatgtg

SEQ ID NO: 5734536 - DNA, 20 bp, Homo sapiens
gaacattccaaggagttgga

SEQ ID NO: 5734537 - DNA, 13 bp, Homo sapiens
gaacattcccagc

SEQ ID NO: 5734538 - DNA, 19 bp, Homo sapiens
gaacattcgaggtgtcacc

SEQ ID NO: 5734539 - DNA, 21 bp, Homo sapiens
gaacattctggatctgaccct

SEQ ID NO: 5734540 - DNA, 18 bp, Homo sapiens
gaacattctgtcatcacc

SEQ ID NO: 5734541 - DNA, 13 bp, Homo sapiens
gaacattgatctg

SEQ ID NO: 5734542 - DNA, 18 bp, Homo sapiens
gaacattgatctgtttta

SEQ ID NO: 5734543 - DNA, 20 bp, Homo sapiens
gaacattgatctgttttaca

SEQ ID NO: 5734544 - DNA, 16 bp, Homo sapiens
gaacattgattgctgt

SEQ ID NO: 5734545 - DNA, 16 bp, Homo sapiens
gaacattggagctgac

SEQ ID NO: 5734546 - DNA, 15 bp, Homo sapiens
gaacatttaaaatta

SEQ ID NO: 5734547 - DNA, 20 bp, Homo sapiens
gaacatttaataatgtatgt

SEQ ID NO: 5734548 - DNA, 23 bp, Homo sapiens
gaacatttagtaccctgcaggcc

SEQ ID NO: 5734549 - DNA, 17 bp, Homo sapiens
gaacatttattttatga

SEQ ID NO: 5734550 - DNA, 19 bp, Homo sapiens
gaacatttattttatgaga

SEQ ID NO: 5734551 - DNA, 22 bp, Homo sapiens
gaacatttattttatgagaaat

SEQ ID NO: 5734552 - DNA, 20 bp, Homo sapiens
gaacatttcaaattgaattt

SEQ ID NO: 5734553 - DNA, 16 bp, Homo sapiens
gaacatttcatggtgt

SEQ ID NO: 5734554 - DNA, 13 bp, Homo sapiens
gaacatttctcat

SEQ ID NO: 5734555 - DNA, 20 bp, Homo sapiens
gaacatttcttatgattttt

SEQ ID NO: 5734556 - DNA, 22 bp, Homo sapiens
gaacatttcttatgatttttaa

SEQ ID NO: 5734557 - DNA, 22 bp, Homo sapiens
gaacatttgatatttttccatt

SEQ ID NO: 5734558 - DNA, 13 bp, Homo sapiens
gaacatttgtgat

SEQ ID NO: 5734559 - DNA, 13 bp, Homo sapiens
gaacattttactg

SEQ ID NO: 5734560 - DNA, 21 bp, Homo sapiens
gaacattttctgtgtgtacat

SEQ ID NO: 5734561 - DNA, 18 bp, Homo sapiens
gaacattttttaaggact

SEQ ID NO: 5734562 - DNA, 14 bp, Homo sapiens
gaacattttttatt

SEQ ID NO: 5734563 - DNA, 19 bp, Homo sapiens
gaaccaaaaaaccccagct

SEQ ID NO: 5734564 - DNA, 13 bp, Homo sapiens
gaaccaaaaagag

SEQ ID NO: 5734565 - DNA, 16 bp, Homo sapiens
gaaccaaaaatagaaa

SEQ ID NO: 5734566 - DNA, 15 bp, Homo sapiens
gaaccaaaacattcc

SEQ ID NO: 5734567 - DNA, 23 bp, Homo sapiens
gaaccaaaacttccaaggccctg

SEQ ID NO: 5734568 - DNA, 17 bp, Homo sapiens
gaaccaaaagatgcctt

SEQ ID NO: 5734569 - DNA, 21 bp, Homo sapiens
gaaccaaacccaccctttcta

SEQ ID NO: 5734570 - DNA, 17 bp, Homo sapiens
gaaccaaagagactgga

SEQ ID NO: 5734571 - DNA, 20 bp, Homo sapiens
gaaccaaagagactggagca

SEQ ID NO: 5734572 - DNA, 20 bp, Homo sapiens
gaaccaaagcgaattttaaa

SEQ ID NO: 5734573 - DNA, 16 bp, Homo sapiens
gaaccaaatctggaag

SEQ ID NO: 5734574 - DNA, 19 bp, Homo sapiens
gaaccaaattgcactgaag

SEQ ID NO: 5734575 - DNA, 14 bp, Homo sapiens
gaaccaacatcttt

SEQ ID NO: 5734576 - DNA, 19 bp, Homo sapiens
gaaccaacccccatctccc

SEQ ID NO: 5734577 - DNA, 16 bp, Homo sapiens
gaaccaagcactacca

SEQ ID NO: 5734578 - DNA, 21 bp, Homo sapiens
gaaccaagctataaaagccca

SEQ ID NO: 5734579 - DNA, 22 bp, Homo sapiens
gaaccaagcttcagagcctagc

SEQ ID NO: 5734580 - DNA, 17 bp, Homo sapiens
gaaccaagcttgtcttt

SEQ ID NO: 5734581 - DNA, 13 bp, Homo sapiens
gaaccaaggcagc

SEQ ID NO: 5734582 - DNA, 17 bp, Homo sapiens
gaaccaaggcagcctcc

SEQ ID NO: 5734583 - DNA, 20 bp, Homo sapiens
gaaccaaggcagcctccaga

SEQ ID NO: 5734584 - DNA, 19 bp, Homo sapiens
gaaccaataaaataatttt

SEQ ID NO: 5734585 - DNA, 23 bp, Homo sapiens
gaaccaatcaaggtagaacaaag

SEQ ID NO: 5734586 - DNA, 14 bp, Homo sapiens
gaaccacaagactg

SEQ ID NO: 5734587 - DNA, 12 bp, Homo sapiens
gaaccacagaaa

SEQ ID NO: 5734588 - DNA, 23 bp, Homo sapiens
gaaccacagatgtgtctgggaga

SEQ ID NO: 5734589 - DNA, 14 bp, Homo sapiens
gaaccacagcagac

SEQ ID NO: 5734590 - DNA, 15 bp, Homo sapiens
gaaccacagcagaca

SEQ ID NO: 5734591 - DNA, 17 bp, Homo sapiens
gaaccacagcagacacc

SEQ ID NO: 5734592 - DNA, 19 bp, Homo sapiens
gaaccacagcagacaccat

SEQ ID NO: 5734593 - DNA, 14 bp, Homo sapiens
gaaccacagggcca

SEQ ID NO: 5734594 - DNA, 16 bp, Homo sapiens
gaaccacagggccaga

SEQ ID NO: 5734595 - DNA, 21 bp, Homo sapiens
gaaccacatggaacttaaaac

SEQ ID NO: 5734596 - DNA, 15 bp, Homo sapiens
gaaccacattcaggg

SEQ ID NO: 5734597 - DNA, 17 bp, Homo sapiens
gaaccaccacacccagc

SEQ ID NO: 5734598 - DNA, 23 bp, Homo sapiens
gaaccaccagcgttcccttctcc

SEQ ID NO: 5734599 - DNA, 14 bp, Homo sapiens
gaaccacgaggctg

SEQ ID NO: 5734600 - DNA, 21 bp, Homo sapiens
gaaccacgcgggggccttgag

SEQ ID NO: 5734601 - DNA, 23 bp, Homo sapiens
gaaccacggtgaaagtgctgctc

SEQ ID NO: 5734602 - DNA, 15 bp, Homo sapiens
gaaccactcccacca

SEQ ID NO: 5734603 - DNA, 13 bp, Homo sapiens
gaaccactgagag

SEQ ID NO: 5734604 - DNA, 16 bp, Homo sapiens
gaaccactgcttctct

SEQ ID NO: 5734605 - DNA, 18 bp, Homo sapiens
gaaccactgcttctcttt

SEQ ID NO: 5734606 - DNA, 21 bp, Homo sapiens
gaaccactgcttctcttttga

SEQ ID NO: 5734607 - DNA, 23 bp, Homo sapiens
gaaccactgtctagagcaacttt

SEQ ID NO: 5734608 - DNA, 12 bp, Homo sapiens
gaaccactgtgg

SEQ ID NO: 5734609 - DNA, 14 bp, Homo sapiens
gaaccactgtggcc

SEQ ID NO: 5734610 - DNA, 17 bp, Homo sapiens
gaaccactgtggccttc

SEQ ID NO: 5734611 - DNA, 14 bp, Homo sapiens
gaaccacttccctc

SEQ ID NO: 5734612 - DNA, 22 bp, Homo sapiens
gaaccacttcctgctacaggag

SEQ ID NO: 5734613 - DNA, 15 bp, Homo sapiens
gaaccacttgtagat

SEQ ID NO: 5734614 - DNA, 20 bp, Homo sapiens
gaaccacttgtagatttgat

SEQ ID NO: 5734615 - DNA, 13 bp, Homo sapiens
gaaccactttctt

SEQ ID NO: 5734616 - DNA, 16 bp, Homo sapiens
gaaccagactcttgcc

SEQ ID NO: 5734617 - DNA, 22 bp, Homo sapiens
gaaccagagcgatgtgttcttt

SEQ ID NO: 5734618 - DNA, 17 bp, Homo sapiens
gaaccagagctggaaca

SEQ ID NO: 5734619 - DNA, 12 bp, Homo sapiens
gaaccagagggt

SEQ ID NO: 5734620 - DNA, 23 bp, Homo sapiens
gaaccagatgagtaaaggagtaa

SEQ ID NO: 5734621 - DNA, 17 bp, Homo sapiens
gaaccagcaagtcccag

SEQ ID NO: 5734622 - DNA, 15 bp, Homo sapiens
gaaccagcactccca

SEQ ID NO: 5734623 - DNA, 17 bp, Homo sapiens
gaaccagcactcccagg

SEQ ID NO: 5734624 - DNA, 21 bp, Homo sapiens
gaaccagcagaaatgccccca

SEQ ID NO: 5734625 - DNA, 22 bp, Homo sapiens
gaaccagcagaaatgcccccat

SEQ ID NO: 5734626 - DNA, 16 bp, Homo sapiens
gaaccagcagaacagc

SEQ ID NO: 5734627 - DNA, 20 bp, Homo sapiens
gaaccagcatctcagcgcca

SEQ ID NO: 5734628 - DNA, 15 bp, Homo sapiens
gaaccagcccagcct

SEQ ID NO: 5734629 - DNA, 22 bp, Homo sapiens
gaaccagcccagcctgccccct

SEQ ID NO: 5734630 - DNA, 12 bp, Homo sapiens
gaaccagccctc

SEQ ID NO: 5734631 - DNA, 19 bp, Homo sapiens
gaaccagccctccagagca

SEQ ID NO: 5734632 - DNA, 17 bp, Homo sapiens
gaaccagccggggcctt

SEQ ID NO: 5734633 - DNA, 16 bp, Homo sapiens
gaaccagccgtatttt

SEQ ID NO: 5734634 - DNA, 12 bp, Homo sapiens
gaaccagctcta

SEQ ID NO: 5734635 - DNA, 23 bp, Homo sapiens
gaaccagctctttggtgccagct

SEQ ID NO: 5734636 - DNA, 15 bp, Homo sapiens
gaaccaggctgctgc

SEQ ID NO: 5734637 - DNA, 17 bp, Homo sapiens
gaaccaggctgctgcat

SEQ ID NO: 5734638 - DNA, 15 bp, Homo sapiens
gaaccaggcttggaa

SEQ ID NO: 5734639 - DNA, 17 bp, Homo sapiens
gaaccagggaggagagg

SEQ ID NO: 5734640 - DNA, 13 bp, Homo sapiens
gaaccagggcctc

SEQ ID NO: 5734641 - DNA, 14 bp, Homo sapiens
gaaccagtgcagac

SEQ ID NO: 5734642 - DNA, 16 bp, Homo sapiens
gaaccagttaagagac

SEQ ID NO: 5734643 - DNA, 13 bp, Homo sapiens
gaaccataaattc

SEQ ID NO: 5734644 - DNA, 15 bp, Homo sapiens
gaaccataaattcaa

SEQ ID NO: 5734645 - DNA, 20 bp, Homo sapiens
gaaccatagttactgtaaaa

SEQ ID NO: 5734646 - DNA, 21 bp, Homo sapiens
gaaccatagttactgtaaaat

SEQ ID NO: 5734647 - DNA, 20 bp, Homo sapiens
gaaccatccacttacatata

SEQ ID NO: 5734648 - DNA, 16 bp, Homo sapiens
gaaccatccttcccat

SEQ ID NO: 5734649 - DNA, 23 bp, Homo sapiens
gaaccatgtcagcaaaaagcaaa

SEQ ID NO: 5734650 - DNA, 21 bp, Homo sapiens
gaaccatgttggttgcacttt

SEQ ID NO: 5734651 - DNA, 16 bp, Homo sapiens
gaaccatgtttgtggc

SEQ ID NO: 5734652 - DNA, 19 bp, Homo sapiens
gaaccattatactttatat

SEQ ID NO: 5734653 - DNA, 20 bp, Homo sapiens
gaaccattcccaagccatgg

SEQ ID NO: 5734654 - DNA, 15 bp, Homo sapiens
gaacccaagagcaag

SEQ ID NO: 5734655 - DNA, 15 bp, Homo sapiens
gaacccaatctgcac

SEQ ID NO: 5734656 - DNA, 19 bp, Homo sapiens
gaacccacataaaagcccc

SEQ ID NO: 5734657 - DNA, 16 bp, Homo sapiens
gaacccaccctctcca

SEQ ID NO: 5734658 - DNA, 22 bp, Homo sapiens
gaacccaccctctccacaccca

SEQ ID NO: 5734659 - DNA, 14 bp, Homo sapiens
gaacccacctgctg

SEQ ID NO: 5734660 - DNA, 20 bp, Homo sapiens
gaacccagctgtgcccctcc

SEQ ID NO: 5734661 - DNA, 11 bp, Homo sapiens
gaacccaggac

SEQ ID NO: 5734662 - DNA, 19 bp, Homo sapiens
gaacccaggacaagcatgg

SEQ ID NO: 5734663 - DNA, 19 bp, Homo sapiens
gaacccaggacgcttctga

SEQ ID NO: 5734664 - DNA, 12 bp, Homo sapiens
gaacccaggaga

SEQ ID NO: 5734665 - DNA, 13 bp, Homo sapiens
gaacccaggaggt

SEQ ID NO: 5734666 - DNA, 11 bp, Homo sapiens
gaacccaggca

SEQ ID NO: 5734667 - DNA, 12 bp, Homo sapiens
gaacccaggcag

SEQ ID NO: 5734668 - DNA, 16 bp, Homo sapiens
gaacccaggcagctgg

SEQ ID NO: 5734669 - DNA, 19 bp, Homo sapiens
gaacccaggcagctggcag

SEQ ID NO: 5734670 - DNA, 20 bp, Homo sapiens
gaacccaggcagctggcagg

SEQ ID NO: 5734671 - DNA, 18 bp, Homo sapiens
gaacccagggctctgccc

SEQ ID NO: 5734672 - DNA, 15 bp, Homo sapiens
gaacccatcactgtg

SEQ ID NO: 5734673 - DNA, 21 bp, Homo sapiens
gaacccatctaaaccagaagg

SEQ ID NO: 5734674 - DNA, 20 bp, Homo sapiens
gaacccatggaaaaatgcca

SEQ ID NO: 5734675 - DNA, 21 bp, Homo sapiens
gaacccccaccagacatcacc

SEQ ID NO: 5734676 - DNA, 15 bp, Homo sapiens
gaacccccactcaca

SEQ ID NO: 5734677 - DNA, 16 bp, Homo sapiens
gaaccccccaggccct

SEQ ID NO: 5734678 - DNA, 13 bp, Homo sapiens
gaacccccctccc

SEQ ID NO: 5734679 - DNA, 24 bp, Homo sapiens
gaacccccctccgcccccatgctc

SEQ ID NO: 5734680 - DNA, 22 bp, Homo sapiens
gaaccccctcaccacctgcccg

SEQ ID NO: 5734681 - DNA, 14 bp, Homo sapiens
gaaccccctccctg

SEQ ID NO: 5734682 - DNA, 18 bp, Homo sapiens
gaaccccctccctgtccc

SEQ ID NO: 5734683 - DNA, 21 bp, Homo sapiens
gaaccccctccctgtcccagg

SEQ ID NO: 5734684 - DNA, 18 bp, Homo sapiens
gaaccccgagctgggggg

SEQ ID NO: 5734685 - DNA, 13 bp, Homo sapiens
gaacccctcccct

SEQ ID NO: 5734686 - DNA, 13 bp, Homo sapiens
gaacccctggcca

SEQ ID NO: 5734687 - DNA, 14 bp, Homo sapiens
gaacccctggccag

SEQ ID NO: 5734688 - DNA, 15 bp, Homo sapiens
gaacccctggctcct

SEQ ID NO: 5734689 - DNA, 12 bp, Homo sapiens
gaacccctgtgt

SEQ ID NO: 5734690 - DNA, 16 bp, Homo sapiens
gaacccgactgtgaaa

SEQ ID NO: 5734691 - DNA, 16 bp, Homo sapiens
gaacccgggaggcaga

SEQ ID NO: 5734692 - DNA, 17 bp, Homo sapiens
gaacccgggaggcagag

SEQ ID NO: 5734693 - DNA, 19 bp, Homo sapiens
gaacccgggaggcagaggt

SEQ ID NO: 5734694 - DNA, 22 bp, Homo sapiens
gaaccctagaaatatatcctgt

SEQ ID NO: 5734695 - DNA, 20 bp, Homo sapiens
gaaccctatacttggtttgc

SEQ ID NO: 5734696 - DNA, 18 bp, Homo sapiens
gaaccctcaggccaccct

SEQ ID NO: 5734697 - DNA, 13 bp, Homo sapiens
gaaccctccaaag

SEQ ID NO: 5734698 - DNA, 14 bp, Homo sapiens
gaaccctcctcctt

SEQ ID NO: 5734699 - DNA, 18 bp, Homo sapiens
gaaccctccttttctctg

SEQ ID NO: 5734700 - DNA, 17 bp, Homo sapiens
gaaccctctggggccct

SEQ ID NO: 5734701 - DNA, 19 bp, Homo sapiens
gaaccctctggggcccttt

SEQ ID NO: 5734702 - DNA, 13 bp, Homo sapiens
gaaccctcttgcc

SEQ ID NO: 5734703 - DNA, 15 bp, Homo sapiens
gaaccctgcagggcc

SEQ ID NO: 5734704 - DNA, 16 bp, Homo sapiens
gaaccctgccatggaa

SEQ ID NO: 5734705 - DNA, 16 bp, Homo sapiens
gaaccctgccccactc

SEQ ID NO: 5734706 - DNA, 16 bp, Homo sapiens
gaaccctgccctgctc

SEQ ID NO: 5734707 - DNA, 21 bp, Homo sapiens
gaaccctgccctgctctgccc

SEQ ID NO: 5734708 - DNA, 19 bp, Homo sapiens
gaaccctgcgtggggacag

SEQ ID NO: 5734709 - DNA, 13 bp, Homo sapiens
gaaccctggagac

SEQ ID NO: 5734710 - DNA, 21 bp, Homo sapiens
gaaccctggagacagaagtca

SEQ ID NO: 5734711 - DNA, 17 bp, Homo sapiens
gaaccctggggcctgac

SEQ ID NO: 5734712 - DNA, 20 bp, Homo sapiens
gaaccctggggcctgactgc

SEQ ID NO: 5734713 - DNA, 14 bp, Homo sapiens
gaaccctgtgctgg

SEQ ID NO: 5734714 - DNA, 23 bp, Homo sapiens
gaacccttctgctttctattacc

SEQ ID NO: 5734715 - DNA, 22 bp, Homo sapiens
gaacccttgcatccattgttgt

SEQ ID NO: 5734716 - DNA, 17 bp, Homo sapiens
gaacccttggcttgccc

SEQ ID NO: 5734717 - DNA, 18 bp, Homo sapiens
gaacccttggcttgccca

SEQ ID NO: 5734718 - DNA, 18 bp, Homo sapiens
gaacccttgtgcttggtg

SEQ ID NO: 5734719 - DNA, 12 bp, Homo sapiens
gaaccctttgtt

SEQ ID NO: 5734720 - DNA, 20 bp, Homo sapiens
gaaccctttgtttcttgttt

SEQ ID NO: 5734721 - DNA, 19 bp, Homo sapiens
gaaccgaggactccagggg

SEQ ID NO: 5734722 - DNA, 22 bp, Homo sapiens
gaaccgagggggctgctcccac

SEQ ID NO: 5734723 - DNA, 21 bp, Homo sapiens
gaaccgcagaagcctccccag

SEQ ID NO: 5734724 - DNA, 16 bp, Homo sapiens
gaaccgcaggaagctg

SEQ ID NO: 5734725 - DNA, 13 bp, Homo sapiens
gaaccgcccagtg

SEQ ID NO: 5734726 - DNA, 16 bp, Homo sapiens
gaaccgctcacctaga

SEQ ID NO: 5734727 - DNA, 22 bp, Homo sapiens
gaaccgctcacctagagccaga

SEQ ID NO: 5734728 - DNA, 17 bp, Homo sapiens
gaaccggagagccagct

SEQ ID NO: 5734729 - DNA, 16 bp, Homo sapiens
gaaccgggaagggtgg

SEQ ID NO: 5734730 - DNA, 14 bp, Homo sapiens
gaaccggtcccagc

SEQ ID NO: 5734731 - DNA, 16 bp, Homo sapiens
gaaccggtcccagcct

SEQ ID NO: 5734732 - DNA, 17 bp, Homo sapiens
gaaccggtcccagcctg

SEQ ID NO: 5734733 - DNA, 19 bp, Homo sapiens
gaaccggtcccagcctggg

SEQ ID NO: 5734734 - DNA, 20 bp, Homo sapiens
gaaccggtcccagcctgggc

SEQ ID NO: 5734735 - DNA, 23 bp, Homo sapiens
gaaccggtcccagcctgggctcc

SEQ ID NO: 5734736 - DNA, 17 bp, Homo sapiens
gaaccgtgacatcagcg

SEQ ID NO: 5734737 - DNA, 19 bp, Homo sapiens
gaaccgtggtatgtctgcc

SEQ ID NO: 5734738 - DNA, 15 bp, Homo sapiens
gaaccgtgtccagca

SEQ ID NO: 5734739 - DNA, 19 bp, Homo sapiens
gaaccgttttgaagctact

SEQ ID NO: 5734740 - DNA, 17 bp, Homo sapiens
gaacctaactgtatctt

SEQ ID NO: 5734741 - DNA, 14 bp, Homo sapiens
gaacctaataccct

SEQ ID NO: 5734742 - DNA, 15 bp, Homo sapiens
gaacctaatgcactc

SEQ ID NO: 5734743 - DNA, 20 bp, Homo sapiens
gaacctaatgcactctgggt

SEQ ID NO: 5734744 - DNA, 23 bp, Homo sapiens
gaacctaatgggaatcattccac

SEQ ID NO: 5734745 - DNA, 19 bp, Homo sapiens
gaacctaattcaattcaaa

SEQ ID NO: 5734746 - DNA, 16 bp, Homo sapiens
gaacctaattgaaatt

SEQ ID NO: 5734747 - DNA, 19 bp, Homo sapiens
gaacctaattgaaatttaa

SEQ ID NO: 5734748 - DNA, 22 bp, Homo sapiens
gaacctacaaaagcttgtgtat

SEQ ID NO: 5734749 - DNA, 22 bp, Homo sapiens
gaacctacctgccttggagagg

SEQ ID NO: 5734750 - DNA, 17 bp, Homo sapiens
gaacctactgttccttt

SEQ ID NO: 5734751 - DNA, 19 bp, Homo sapiens
gaacctactgttcctttca

SEQ ID NO: 5734752 - DNA, 21 bp, Homo sapiens
gaacctactgttcctttcaga

SEQ ID NO: 5734753 - DNA, 14 bp, Homo sapiens
gaacctagaagggc

SEQ ID NO: 5734754 - DNA, 21 bp, Homo sapiens
gaacctatttctctttcttta

SEQ ID NO: 5734755 - DNA, 16 bp, Homo sapiens
gaacctattttcattt

SEQ ID NO: 5734756 - DNA, 11 bp, Homo sapiens
gaacctcactc

SEQ ID NO: 5734757 - DNA, 20 bp, Homo sapiens
gaacctcactcttgccaacc

SEQ ID NO: 5734758 - DNA, 13 bp, Homo sapiens
gaacctcagcctg

SEQ ID NO: 5734759 - DNA, 14 bp, Homo sapiens
gaacctcagcctgg

SEQ ID NO: 5734760 - DNA, 19 bp, Homo sapiens
gaacctcagcctggccaga

SEQ ID NO: 5734761 - DNA, 18 bp, Homo sapiens
gaacctcagtttcctcat

SEQ ID NO: 5734762 - DNA, 22 bp, Homo sapiens
gaacctcagtttcctcatctgc

SEQ ID NO: 5734763 - DNA, 15 bp, Homo sapiens
gaacctcatccagct

SEQ ID NO: 5734764 - DNA, 12 bp, Homo sapiens
gaacctcccaga

SEQ ID NO: 5734765 - DNA, 13 bp, Homo sapiens
gaacctcccagag

SEQ ID NO: 5734766 - DNA, 20 bp, Homo sapiens
gaacctccctgggcctgtct

SEQ ID NO: 5734767 - DNA, 21 bp, Homo sapiens
gaacctccctgggcctgtctc

SEQ ID NO: 5734768 - DNA, 17 bp, Homo sapiens
gaacctcctatatcatt

SEQ ID NO: 5734769 - DNA, 14 bp, Homo sapiens
gaacctcctctgtg

SEQ ID NO: 5734770 - DNA, 16 bp, Homo sapiens
gaacctccttacctgg

SEQ ID NO: 5734771 - DNA, 16 bp, Homo sapiens
gaacctcgagtactgt

SEQ ID NO: 5734772 - DNA, 19 bp, Homo sapiens
gaacctcggggtgggggtg

SEQ ID NO: 5734773 - DNA, 16 bp, Homo sapiens
gaacctctaagtgctg

SEQ ID NO: 5734774 - DNA, 19 bp, Homo sapiens
gaacctctaagtgctgctg

SEQ ID NO: 5734775 - DNA, 22 bp, Homo sapiens
gaacctctaagtgctgctgtgg

SEQ ID NO: 5734776 - DNA, 23 bp, Homo sapiens
gaacctctaagtgctgctgtgga

SEQ ID NO: 5734777 - DNA, 23 bp, Homo sapiens
gaacctctcaggatcaatgaccc

SEQ ID NO: 5734778 - DNA, 15 bp, Homo sapiens
gaacctctgtctcat

SEQ ID NO: 5734779 - DNA, 22 bp, Homo sapiens
gaacctctgtctcatcctcctg

SEQ ID NO: 5734780 - DNA, 14 bp, Homo sapiens
gaacctcttcccca

SEQ ID NO: 5734781 - DNA, 20 bp, Homo sapiens
gaacctgagttcccgggagc

SEQ ID NO: 5734782 - DNA, 19 bp, Homo sapiens
gaacctgatacctgcctgg

SEQ ID NO: 5734783 - DNA, 16 bp, Homo sapiens
gaacctgcaaaaaata

SEQ ID NO: 5734784 - DNA, 21 bp, Homo sapiens
gaacctgcacacaggacagcg

SEQ ID NO: 5734785 - DNA, 19 bp, Homo sapiens
gaacctgcatttaagaaca

SEQ ID NO: 5734786 - DNA, 17 bp, Homo sapiens
gaacctgctacttaaaa

SEQ ID NO: 5734787 - DNA, 12 bp, Homo sapiens
gaacctggaact

SEQ ID NO: 5734788 - DNA, 23 bp, Homo sapiens
gaacctggaagatcatggacctg

SEQ ID NO: 5734789 - DNA, 16 bp, Homo sapiens
gaacctggaccaaagc

SEQ ID NO: 5734790 - DNA, 17 bp, Homo sapiens
gaacctggaccaaagct

SEQ ID NO: 5734791 - DNA, 22 bp, Homo sapiens
gaacctggaccccagccttggt

SEQ ID NO: 5734792 - DNA, 17 bp, Homo sapiens
gaacctggaggggctag

SEQ ID NO: 5734793 - DNA, 19 bp, Homo sapiens
gaacctggatgtacttaag

SEQ ID NO: 5734794 - DNA, 15 bp, Homo sapiens
gaacctggcaggccc

SEQ ID NO: 5734795 - DNA, 17 bp, Homo sapiens
gaacctggcaggccctg

SEQ ID NO: 5734796 - DNA, 13 bp, Homo sapiens
gaacctggctgcg

SEQ ID NO: 5734797 - DNA, 23 bp, Homo sapiens
gaacctgggaaagagatttaaac

SEQ ID NO: 5734798 - DNA, 17 bp, Homo sapiens
gaacctgggcactccgc

SEQ ID NO: 5734799 - DNA, 13 bp, Homo sapiens
gaacctgggctgt

SEQ ID NO: 5734800 - DNA, 17 bp, Homo sapiens
gaacctgggctgtgctg

SEQ ID NO: 5734801 - DNA, 18 bp, Homo sapiens
gaacctggggttttgact

SEQ ID NO: 5734802 - DNA, 21 bp, Homo sapiens
gaacctgggttgcagacagga

SEQ ID NO: 5734803 - DNA, 16 bp, Homo sapiens
gaacctggtggctgga

SEQ ID NO: 5734804 - DNA, 14 bp, Homo sapiens
gaacctgtactggg

SEQ ID NO: 5734805 - DNA, 17 bp, Homo sapiens
gaacctgtagaagatga

SEQ ID NO: 5734806 - DNA, 19 bp, Homo sapiens
gaacctgtaggatcttatt

SEQ ID NO: 5734807 - DNA, 21 bp, Homo sapiens
gaacctgtaggatcttatttg

SEQ ID NO: 5734808 - DNA, 20 bp, Homo sapiens
gaacctgtccttgcacactc

SEQ ID NO: 5734809 - DNA, 12 bp, Homo sapiens
gaacctgtgggc

SEQ ID NO: 5734810 - DNA, 12 bp, Homo sapiens
gaacctgtgtcc

SEQ ID NO: 5734811 - DNA, 20 bp, Homo sapiens
gaacctgtttaatgttatga

SEQ ID NO: 5734812 - DNA, 20 bp, Homo sapiens
gaaccttaacctctctaagc

SEQ ID NO: 5734813 - DNA, 21 bp, Homo sapiens
gaaccttaacctctctaagcc

SEQ ID NO: 5734814 - DNA, 17 bp, Homo sapiens
gaaccttactggcactg

SEQ ID NO: 5734815 - DNA, 15 bp, Homo sapiens
gaaccttccctccaa

SEQ ID NO: 5734816 - DNA, 21 bp, Homo sapiens
gaaccttctagaacctgggct

SEQ ID NO: 5734817 - DNA, 13 bp, Homo sapiens
gaaccttctccct

SEQ ID NO: 5734818 - DNA, 21 bp, Homo sapiens
gaaccttctggcctcccacag

SEQ ID NO: 5734819 - DNA, 12 bp, Homo sapiens
gaaccttctttg

SEQ ID NO: 5734820 - DNA, 14 bp, Homo sapiens
gaaccttctttggt

SEQ ID NO: 5734821 - DNA, 14 bp, Homo sapiens
gaaccttgctgtcc

SEQ ID NO: 5734822 - DNA, 17 bp, Homo sapiens
gaaccttgctgtcctga

SEQ ID NO: 5734823 - DNA, 18 bp, Homo sapiens
gaaccttggaccactcct

SEQ ID NO: 5734824 - DNA, 20 bp, Homo sapiens
gaaccttggaccactcctgt

SEQ ID NO: 5734825 - DNA, 13 bp, Homo sapiens
gaaccttggcctg

SEQ ID NO: 5734826 - DNA, 17 bp, Homo sapiens
gaaccttggcctgggcc

SEQ ID NO: 5734827 - DNA, 24 bp, Homo sapiens
gaaccttgtcccagccagtgagga

SEQ ID NO: 5734828 - DNA, 18 bp, Homo sapiens
gaaccttgtgcctggctc

SEQ ID NO: 5734829 - DNA, 14 bp, Homo sapiens
gaacctttcaaaat

SEQ ID NO: 5734830 - DNA, 19 bp, Homo sapiens
gaacctttcaaaatggaaa

SEQ ID NO: 5734831 - DNA, 23 bp, Homo sapiens
gaacctttccactcccactgcca

SEQ ID NO: 5734832 - DNA, 21 bp, Homo sapiens
gaacctttggacaagaggaaa

SEQ ID NO: 5734833 - DNA, 19 bp, Homo sapiens
gaacctttgtgccctatca

SEQ ID NO: 5734834 - DNA, 18 bp, Homo sapiens
gaaccttttgagtgcctt

SEQ ID NO: 5734835 - DNA, 21 bp, Homo sapiens
gaacgaaccttggcctgggcc

SEQ ID NO: 5734836 - DNA, 21 bp, Homo sapiens
gaacgacaatagctttaccct

SEQ ID NO: 5734837 - DNA, 15 bp, Homo sapiens
gaacgactgtatatt

SEQ ID NO: 5734838 - DNA, 17 bp, Homo sapiens
gaacgagcactggccag

SEQ ID NO: 5734839 - DNA, 22 bp, Homo sapiens
gaacgagcactggccagagagg

SEQ ID NO: 5734840 - DNA, 12 bp, Homo sapiens
gaacgagcagcc

SEQ ID NO: 5734841 - DNA, 16 bp, Homo sapiens
gaacgatccttcaaag

SEQ ID NO: 5734842 - DNA, 18 bp, Homo sapiens
gaacgatccttcaaagtc

SEQ ID NO: 5734843 - DNA, 20 bp, Homo sapiens
gaacgcaacttaggatggct

SEQ ID NO: 5734844 - DNA, 24 bp, Homo sapiens
gaacgcaacttaggatggctagga

SEQ ID NO: 5734845 - DNA, 15 bp, Homo sapiens
gaacgcacatagctc

SEQ ID NO: 5734846 - DNA, 21 bp, Homo sapiens
gaacgcagaggcggaaacctt

SEQ ID NO: 5734847 - DNA, 22 bp, Homo sapiens
gaacgcagaggcggaaaccttg

SEQ ID NO: 5734848 - DNA, 12 bp, Homo sapiens
gaacgcagccct

SEQ ID NO: 5734849 - DNA, 16 bp, Homo sapiens
gaacgcagccctagag

SEQ ID NO: 5734850 - DNA, 20 bp, Homo sapiens
gaacgcagccctagagcctg

SEQ ID NO: 5734851 - DNA, 12 bp, Homo sapiens
gaacgcagcctc

SEQ ID NO: 5734852 - DNA, 14 bp, Homo sapiens
gaacgcagttgatt

SEQ ID NO: 5734853 - DNA, 22 bp, Homo sapiens
gaacgcattttgggttgtttaa

SEQ ID NO: 5734854 - DNA, 16 bp, Homo sapiens
gaacgccagtctccca

SEQ ID NO: 5734855 - DNA, 21 bp, Homo sapiens
gaacgccagtctcccaggccc

SEQ ID NO: 5734856 - DNA, 22 bp, Homo sapiens
gaacgccagtctcccaggcccc

SEQ ID NO: 5734857 - DNA, 12 bp, Homo sapiens
gaacgcccactt

SEQ ID NO: 5734858 - DNA, 15 bp, Homo sapiens
gaacgcccccgcccc

SEQ ID NO: 5734859 - DNA, 13 bp, Homo sapiens
gaacgctctcctc

SEQ ID NO: 5734860 - DNA, 13 bp, Homo sapiens
gaacgctcttagc

SEQ ID NO: 5734861 - DNA, 21 bp, Homo sapiens
gaacgctcttagctttctcag

SEQ ID NO: 5734862 - DNA, 22 bp, Homo sapiens
gaacgctgtgatgctgtgtgcc

SEQ ID NO: 5734863 - DNA, 15 bp, Homo sapiens
gaacggaagggttgg

SEQ ID NO: 5734864 - DNA, 13 bp, Homo sapiens
gaacggcttcctc

SEQ ID NO: 5734865 - DNA, 14 bp, Homo sapiens
gaacgggcagccac

SEQ ID NO: 5734866 - DNA, 15 bp, Homo sapiens
gaacgggcagccaca

SEQ ID NO: 5734867 - DNA, 18 bp, Homo sapiens
gaacgggcagccacagga

SEQ ID NO: 5734868 - DNA, 23 bp, Homo sapiens
gaacgggcagccacaggactgag

SEQ ID NO: 5734869 - DNA, 17 bp, Homo sapiens
gaacgggcagcctgggc

SEQ ID NO: 5734870 - DNA, 14 bp, Homo sapiens
gaacgggcctcccc

SEQ ID NO: 5734871 - DNA, 22 bp, Homo sapiens
gaacggggctcttctcatttca

SEQ ID NO: 5734872 - DNA, 16 bp, Homo sapiens
gaacggggtccttcaa

SEQ ID NO: 5734873 - DNA, 14 bp, Homo sapiens
gaacgtatgtgctc

SEQ ID NO: 5734874 - DNA, 14 bp, Homo sapiens
gaacgtctctcacc

SEQ ID NO: 5734875 - DNA, 15 bp, Homo sapiens
gaacgtcttatctaa

SEQ ID NO: 5734876 - DNA, 22 bp, Homo sapiens
gaacgtgattagtgaaaggaag

SEQ ID NO: 5734877 - DNA, 17 bp, Homo sapiens
gaacgtggattgtattt

SEQ ID NO: 5734878 - DNA, 23 bp, Homo sapiens
gaacgtggattgtatttaagaca

SEQ ID NO: 5734879 - DNA, 21 bp, Homo sapiens
gaacgtggttcagagactggc

SEQ ID NO: 5734880 - DNA, 19 bp, Homo sapiens
gaacgttttaataattttt

SEQ ID NO: 5734881 - DNA, 18 bp, Homo sapiens
gaacgttttctaattgct

SEQ ID NO: 5734882 - DNA, 20 bp, Homo sapiens
gaacgttttctaattgctta

SEQ ID NO: 5734883 - DNA, 14 bp, Homo sapiens
gaacgttttcttct

SEQ ID NO: 5734884 - DNA, 19 bp, Homo sapiens
gaacgttttcttctttccc

SEQ ID NO: 5734885 - DNA, 20 bp, Homo sapiens
gaacgttttcttctttccct

SEQ ID NO: 5734886 - DNA, 23 bp, Homo sapiens
gaactaaaaagagactgtgccat

SEQ ID NO: 5734887 - DNA, 19 bp, Homo sapiens
gaactaaactagtttttcc

SEQ ID NO: 5734888 - DNA, 23 bp, Homo sapiens
gaactaaactagtttttcctatc

SEQ ID NO: 5734889 - DNA, 17 bp, Homo sapiens
gaactaaactcatttat

SEQ ID NO: 5734890 - DNA, 13 bp, Homo sapiens
gaactaaagcaaa

SEQ ID NO: 5734891 - DNA, 19 bp, Homo sapiens
gaactaaaggtggccacaa

SEQ ID NO: 5734892 - DNA, 22 bp, Homo sapiens
gaactaaatagatttttagatt

SEQ ID NO: 5734893 - DNA, 14 bp, Homo sapiens
gaactaaatgttct

SEQ ID NO: 5734894 - DNA, 15 bp, Homo sapiens
gaactaaatgttcta

SEQ ID NO: 5734895 - DNA, 18 bp, Homo sapiens
gaactaaatttttcatag

SEQ ID NO: 5734896 - DNA, 19 bp, Homo sapiens
gaactaaatttttcataga

SEQ ID NO: 5734897 - DNA, 17 bp, Homo sapiens
gaactaacactatttta

SEQ ID NO: 5734898 - DNA, 19 bp, Homo sapiens
gaactaacataatcttaaa

SEQ ID NO: 5734899 - DNA, 18 bp, Homo sapiens
gaactaagaaacttttgt

SEQ ID NO: 5734900 - DNA, 23 bp, Homo sapiens
gaactaagaaacttttgtaaaga

SEQ ID NO: 5734901 - DNA, 12 bp, Homo sapiens
gaactaagcact

SEQ ID NO: 5734902 - DNA, 15 bp, Homo sapiens
gaactaagttattgc

SEQ ID NO: 5734903 - DNA, 16 bp, Homo sapiens
gaactaagttattgct

SEQ ID NO: 5734904 - DNA, 18 bp, Homo sapiens
gaactaagttattgctgc

SEQ ID NO: 5734905 - DNA, 15 bp, Homo sapiens
gaactaagttattgt

SEQ ID NO: 5734906 - DNA, 19 bp, Homo sapiens
gaactaagttttgtgtgta

SEQ ID NO: 5734907 - DNA, 21 bp, Homo sapiens
gaactaagttttgtgtgtata

SEQ ID NO: 5734908 - DNA, 22 bp, Homo sapiens
gaactaagttttgtgtgtatat

SEQ ID NO: 5734909 - DNA, 16 bp, Homo sapiens
gaactaataaatacat

SEQ ID NO: 5734910 - DNA, 13 bp, Homo sapiens
gaactaataaatg

SEQ ID NO: 5734911 - DNA, 14 bp, Homo sapiens
gaactaatatatga

SEQ ID NO: 5734912 - DNA, 22 bp, Homo sapiens
gaactaattcatttattaagta

SEQ ID NO: 5734913 - DNA, 15 bp, Homo sapiens
gaactaatttatact

SEQ ID NO: 5734914 - DNA, 15 bp, Homo sapiens
gaactacatatttgt

SEQ ID NO: 5734915 - DNA, 13 bp, Homo sapiens
gaactactgtact

SEQ ID NO: 5734916 - DNA, 15 bp, Homo sapiens
gaactactgtacttt

SEQ ID NO: 5734917 - DNA, 22 bp, Homo sapiens
gaactagactttcctttgcacc

SEQ ID NO: 5734918 - DNA, 16 bp, Homo sapiens
gaactagagatgtgca

SEQ ID NO: 5734919 - DNA, 21 bp, Homo sapiens
gaactagagtttagctggaaa

SEQ ID NO: 5734920 - DNA, 22 bp, Homo sapiens
gaactagagtttagctggaaaa

SEQ ID NO: 5734921 - DNA, 21 bp, Homo sapiens
gaactagcatatagccattga

SEQ ID NO: 5734922 - DNA, 16 bp, Homo sapiens
gaactagctatgaaat

SEQ ID NO: 5734923 - DNA, 18 bp, Homo sapiens
gaactaggtagattgttt

SEQ ID NO: 5734924 - DNA, 18 bp, Homo sapiens
gaactaggtttaaaacag

SEQ ID NO: 5734925 - DNA, 21 bp, Homo sapiens
gaactagtctacttcttaaaa

SEQ ID NO: 5734926 - DNA, 14 bp, Homo sapiens
gaactatacctgct

SEQ ID NO: 5734927 - DNA, 19 bp, Homo sapiens
gaactatatcagtagtgta

SEQ ID NO: 5734928 - DNA, 23 bp, Homo sapiens
gaactatcatttttacactattg

SEQ ID NO: 5734929 - DNA, 12 bp, Homo sapiens
gaactatcttca

SEQ ID NO: 5734930 - DNA, 16 bp, Homo sapiens
gaactatcttcatctg

SEQ ID NO: 5734931 - DNA, 16 bp, Homo sapiens
gaactatgaaaagtgg

SEQ ID NO: 5734932 - DNA, 19 bp, Homo sapiens
gaactatgaggagcctctg

SEQ ID NO: 5734933 - DNA, 15 bp, Homo sapiens
gaactatgctaattt

SEQ ID NO: 5734934 - DNA, 19 bp, Homo sapiens
gaactattctgggggcccg

SEQ ID NO: 5734935 - DNA, 21 bp, Homo sapiens
gaactatttattaaaaacatg

SEQ ID NO: 5734936 - DNA, 19 bp, Homo sapiens
gaactattttcaaagactt

SEQ ID NO: 5734937 - DNA, 20 bp, Homo sapiens
gaactattttcaaagactta

SEQ ID NO: 5734938 - DNA, 15 bp, Homo sapiens
gaactattttgaaga

SEQ ID NO: 5734939 - DNA, 21 bp, Homo sapiens
gaactattttgaagaaaacac

SEQ ID NO: 5734940 - DNA, 19 bp, Homo sapiens
gaactcaaacttctggctc

SEQ ID NO: 5734941 - DNA, 23 bp, Homo sapiens
gaactcaaatggggccagatcca

SEQ ID NO: 5734942 - DNA, 13 bp, Homo sapiens
gaactcaatataa

SEQ ID NO: 5734943 - DNA, 15 bp, Homo sapiens
gaactcaatgcatga

SEQ ID NO: 5734944 - DNA, 18 bp, Homo sapiens
gaactcaatgcatgatga

SEQ ID NO: 5734945 - DNA, 16 bp, Homo sapiens
gaactcaccctgggag

SEQ ID NO: 5734946 - DNA, 21 bp, Homo sapiens
gaactcaccctgggagccagt

SEQ ID NO: 5734947 - DNA, 22 bp, Homo sapiens
gaactcaccctgggagccagtc

SEQ ID NO: 5734948 - DNA, 19 bp, Homo sapiens
gaactcaccgctcaccctc

SEQ ID NO: 5734949 - DNA, 17 bp, Homo sapiens
gaactcacgagccttgc

SEQ ID NO: 5734950 - DNA, 15 bp, Homo sapiens
gaactcactctgggc

SEQ ID NO: 5734951 - DNA, 20 bp, Homo sapiens
gaactcagcacattcgggac

SEQ ID NO: 5734952 - DNA, 14 bp, Homo sapiens
gaactcagccaagc

SEQ ID NO: 5734953 - DNA, 15 bp, Homo sapiens
gaactcagccaagca

SEQ ID NO: 5734954 - DNA, 17 bp, Homo sapiens
gaactcagccaagcaca

SEQ ID NO: 5734955 - DNA, 24 bp, Homo sapiens
gaactcagccaagcacagtggtgg

SEQ ID NO: 5734956 - DNA, 17 bp, Homo sapiens
gaactcagccttaagaa

SEQ ID NO: 5734957 - DNA, 21 bp, Homo sapiens
gaactcagccttaagaaagct

SEQ ID NO: 5734958 - DNA, 20 bp, Homo sapiens
gaactcagctgtctgtggct

SEQ ID NO: 5734959 - DNA, 21 bp, Homo sapiens
gaactcaggatgggaagaaaa

SEQ ID NO: 5734960 - DNA, 14 bp, Homo sapiens
gaactcatcactgt

SEQ ID NO: 5734961 - DNA, 19 bp, Homo sapiens
gaactcatcactgtggctg

SEQ ID NO: 5734962 - DNA, 19 bp, Homo sapiens
gaactcatcccttgtttat

SEQ ID NO: 5734963 - DNA, 15 bp, Homo sapiens
gaactcattaacaac

SEQ ID NO: 5734964 - DNA, 16 bp, Homo sapiens
gaactcattattttga

SEQ ID NO: 5734965 - DNA, 13 bp, Homo sapiens
gaactcattcctg

SEQ ID NO: 5734966 - DNA, 15 bp, Homo sapiens
gaactcattctcttc

SEQ ID NO: 5734967 - DNA, 23 bp, Homo sapiens
gaactcattctcttcttgctata

SEQ ID NO: 5734968 - DNA, 13 bp, Homo sapiens
gaactcatttcaa

SEQ ID NO: 5734969 - DNA, 14 bp, Homo sapiens
gaactcatttcaag

SEQ ID NO: 5734970 - DNA, 23 bp, Homo sapiens
gaactccaccgaccaactgccct

SEQ ID NO: 5734971 - DNA, 18 bp, Homo sapiens
gaactccactctccttcg

SEQ ID NO: 5734972 - DNA, 19 bp, Homo sapiens
gaactccagctggtgcccc

SEQ ID NO: 5734973 - DNA, 16 bp, Homo sapiens
gaactccaggatggaa

SEQ ID NO: 5734974 - DNA, 14 bp, Homo sapiens
gaactccaggcatg

SEQ ID NO: 5734975 - DNA, 16 bp, Homo sapiens
gaactccaggcatgtg

SEQ ID NO: 5734976 - DNA, 14 bp, Homo sapiens
gaactccaggccct

SEQ ID NO: 5734977 - DNA, 17 bp, Homo sapiens
gaactccaggccctcct

SEQ ID NO: 5734978 - DNA, 18 bp, Homo sapiens
gaactccaggctgggctg

SEQ ID NO: 5734979 - DNA, 16 bp, Homo sapiens
gaactccatacagcct

SEQ ID NO: 5734980 - DNA, 14 bp, Homo sapiens
gaactcccccagag

SEQ ID NO: 5734981 - DNA, 22 bp, Homo sapiens
gaactcccccgaagaaggacca

SEQ ID NO: 5734982 - DNA, 13 bp, Homo sapiens
gaactcctacctg

SEQ ID NO: 5734983 - DNA, 14 bp, Homo sapiens
gaactcctacctga

SEQ ID NO: 5734984 - DNA, 17 bp, Homo sapiens
gaactcctacctgaagg

SEQ ID NO: 5734985 - DNA, 16 bp, Homo sapiens
gaactcctagactcaa

SEQ ID NO: 5734986 - DNA, 16 bp, Homo sapiens
gaactcctcaagggca

SEQ ID NO: 5734987 - DNA, 15 bp, Homo sapiens
gaactcctcccaccc

SEQ ID NO: 5734988 - DNA, 14 bp, Homo sapiens
gaactcctgaaatc

SEQ ID NO: 5734989 - DNA, 13 bp, Homo sapiens
gaactcctgacct

SEQ ID NO: 5734990 - DNA, 14 bp, Homo sapiens
gaactcctgacctc

SEQ ID NO: 5734991 - DNA, 23 bp, Homo sapiens
gaactcctgacctcgtgatctac

SEQ ID NO: 5734992 - DNA, 12 bp, Homo sapiens
gaactcctgcca

SEQ ID NO: 5734993 - DNA, 23 bp, Homo sapiens
gaactcctgccacaacagaataa

SEQ ID NO: 5734994 - DNA, 12 bp, Homo sapiens
gaactcctggcc

SEQ ID NO: 5734995 - DNA, 14 bp, Homo sapiens
gaactcctggcctc

SEQ ID NO: 5734996 - DNA, 15 bp, Homo sapiens
gaactcctggcctca

SEQ ID NO: 5734997 - DNA, 14 bp, Homo sapiens
gaactcctggcttt

SEQ ID NO: 5734998 - DNA, 24 bp, Homo sapiens
gaactcctgtcttctttctccatg

SEQ ID NO: 5734999 - DNA, 16 bp, Homo sapiens
gaactccttccccact

SEQ ID NO: 5735000 - DNA, 15 bp, Homo sapiens
gaactccttgcacac

SEQ ID NO: 5735001 - DNA, 12 bp, Homo sapiens
gaactccttggc

SEQ ID NO: 5735002 - DNA, 13 bp, Homo sapiens
gaactccttggcc

SEQ ID NO: 5735003 - DNA, 15 bp, Homo sapiens
gaactccttggccta

SEQ ID NO: 5735004 - DNA, 16 bp, Homo sapiens
gaactcgatgcactga

SEQ ID NO: 5735005 - DNA, 15 bp, Homo sapiens
gaactcgccacctgc

SEQ ID NO: 5735006 - DNA, 14 bp, Homo sapiens
gaactcgcctcagc

SEQ ID NO: 5735007 - DNA, 18 bp, Homo sapiens
gaactcgcctcagcctga

SEQ ID NO: 5735008 - DNA, 18 bp, Homo sapiens
gaactcgcgctcagtaaa

SEQ ID NO: 5735009 - DNA, 19 bp, Homo sapiens
gaactcgggattacagaaa

SEQ ID NO: 5735010 - DNA, 20 bp, Homo sapiens
gaactcggtgtccccaccat

SEQ ID NO: 5735011 - DNA, 18 bp, Homo sapiens
gaactctaaccagtgtac

SEQ ID NO: 5735012 - DNA, 21 bp, Homo sapiens
gaactctaaccagtgtacagg

SEQ ID NO: 5735013 - DNA, 17 bp, Homo sapiens
gaactctaagcagaaga

SEQ ID NO: 5735014 - DNA, 18 bp, Homo sapiens
gaactctaagcagaagac

SEQ ID NO: 5735015 - DNA, 18 bp, Homo sapiens
gaactctaccctggtagg

SEQ ID NO: 5735016 - DNA, 22 bp, Homo sapiens
gaactctagagggcgagggatg

SEQ ID NO: 5735017 - DNA, 22 bp, Homo sapiens
gaactctatctgggcctgggct

SEQ ID NO: 5735018 - DNA, 15 bp, Homo sapiens
gaactctattttgat

SEQ ID NO: 5735019 - DNA, 15 bp, Homo sapiens
gaactctcccctccc

SEQ ID NO: 5735020 - DNA, 17 bp, Homo sapiens
gaactctcccctcccca

SEQ ID NO: 5735021 - DNA, 16 bp, Homo sapiens
gaactctcctgctcct

SEQ ID NO: 5735022 - DNA, 14 bp, Homo sapiens
gaactctcctggcc

SEQ ID NO: 5735023 - DNA, 13 bp, Homo sapiens
gaactctctgtct

SEQ ID NO: 5735024 - DNA, 20 bp, Homo sapiens
gaactctctgtcttctctcc

SEQ ID NO: 5735025 - DNA, 21 bp, Homo sapiens
gaactctctgtcttctctcca

SEQ ID NO: 5735026 - DNA, 22 bp, Homo sapiens
gaactctgaaccacctttgtct

SEQ ID NO: 5735027 - DNA, 20 bp, Homo sapiens
gaactctgaactttggagag

SEQ ID NO: 5735028 - DNA, 20 bp, Homo sapiens
gaactctgacaacagacttc

SEQ ID NO: 5735029 - DNA, 17 bp, Homo sapiens
gaactctgacaagggct

SEQ ID NO: 5735030 - DNA, 15 bp, Homo sapiens
gaactctgcacagca

SEQ ID NO: 5735031 - DNA, 22 bp, Homo sapiens
gaactctggacccctgggcctc

SEQ ID NO: 5735032 - DNA, 19 bp, Homo sapiens
gaactctggcttccaggta

SEQ ID NO: 5735033 - DNA, 18 bp, Homo sapiens
gaactctgggctgccatg

SEQ ID NO: 5735034 - DNA, 14 bp, Homo sapiens
gaactctgtgcagg

SEQ ID NO: 5735035 - DNA, 18 bp, Homo sapiens
gaactctgtgcaggtgct

SEQ ID NO: 5735036 - DNA, 22 bp, Homo sapiens
gaactctgtgtgagagagaggg

SEQ ID NO: 5735037 - DNA, 13 bp, Homo sapiens
gaactcttaatca

SEQ ID NO: 5735038 - DNA, 19 bp, Homo sapiens
gaactcttaggcacatcaa

SEQ ID NO: 5735039 - DNA, 22 bp, Homo sapiens
gaactcttaggcacatcaatta

SEQ ID NO: 5735040 - DNA, 13 bp, Homo sapiens
gaactcttcagaa

SEQ ID NO: 5735041 - DNA, 21 bp, Homo sapiens
gaactcttcagaacacacaga

SEQ ID NO: 5735042 - DNA, 15 bp, Homo sapiens
gaactcttcctggaa

SEQ ID NO: 5735043 - DNA, 22 bp, Homo sapiens
gaactcttcctggaatgcattc

SEQ ID NO: 5735044 - DNA, 15 bp, Homo sapiens
gaactcttctttgct

SEQ ID NO: 5735045 - DNA, 15 bp, Homo sapiens
gaactcttggcctca

SEQ ID NO: 5735046 - DNA, 19 bp, Homo sapiens
gaactctttcaaattatat

SEQ ID NO: 5735047 - DNA, 15 bp, Homo sapiens
gaactgaaaacataa

SEQ ID NO: 5735048 - DNA, 18 bp, Homo sapiens
gaactgaaaacataaaaa

SEQ ID NO: 5735049 - DNA, 18 bp, Homo sapiens
gaactgaaaagagagcag

SEQ ID NO: 5735050 - DNA, 16 bp, Homo sapiens
gaactgaaacttttct

SEQ ID NO: 5735051 - DNA, 18 bp, Homo sapiens
gaactgaaacttttctaa

SEQ ID NO: 5735052 - DNA, 18 bp, Homo sapiens
gaactgaaatccttgaga

SEQ ID NO: 5735053 - DNA, 19 bp, Homo sapiens
gaactgaaatccttgagag

SEQ ID NO: 5735054 - DNA, 21 bp, Homo sapiens
gaactgaacaccattgaaggc

SEQ ID NO: 5735055 - DNA, 22 bp, Homo sapiens
gaactgaacaccattgaaggct

SEQ ID NO: 5735056 - DNA, 16 bp, Homo sapiens
gaactgaagcagagtc

SEQ ID NO: 5735057 - DNA, 15 bp, Homo sapiens
gaactgaagccactt

SEQ ID NO: 5735058 - DNA, 17 bp, Homo sapiens
gaactgaagccacttgg

SEQ ID NO: 5735059 - DNA, 20 bp, Homo sapiens
gaactgaagccacttggccc

SEQ ID NO: 5735060 - DNA, 19 bp, Homo sapiens
gaactgaagggggcggcct

SEQ ID NO: 5735061 - DNA, 17 bp, Homo sapiens
gaactgaagtccaaatt

SEQ ID NO: 5735062 - DNA, 17 bp, Homo sapiens
gaactgaagtttcacat

SEQ ID NO: 5735063 - DNA, 23 bp, Homo sapiens
gaactgaagtttccgcccccgcc

SEQ ID NO: 5735064 - DNA, 18 bp, Homo sapiens
gaactgaattttgggact

SEQ ID NO: 5735065 - DNA, 19 bp, Homo sapiens
gaactgacaaaggagcctt

SEQ ID NO: 5735066 - DNA, 20 bp, Homo sapiens
gaactgacaaaggagccttg

SEQ ID NO: 5735067 - DNA, 22 bp, Homo sapiens
gaactgacaaaggagccttgat

SEQ ID NO: 5735068 - DNA, 23 bp, Homo sapiens
gaactgaccctcaggcacacctt

SEQ ID NO: 5735069 - DNA, 16 bp, Homo sapiens
gaactgactgaaggaa

SEQ ID NO: 5735070 - DNA, 14 bp, Homo sapiens
gaactgactttctc

SEQ ID NO: 5735071 - DNA, 15 bp, Homo sapiens
gaactgactttctcc

SEQ ID NO: 5735072 - DNA, 15 bp, Homo sapiens
gaactgagaaggcag

SEQ ID NO: 5735073 - DNA, 14 bp, Homo sapiens
gaactgagaccttg

SEQ ID NO: 5735074 - DNA, 13 bp, Homo sapiens
gaactgagccaga

SEQ ID NO: 5735075 - DNA, 14 bp, Homo sapiens
gaactgagccagaa

SEQ ID NO: 5735076 - DNA, 16 bp, Homo sapiens
gaactgagccccagcg

SEQ ID NO: 5735077 - DNA, 11 bp, Homo sapiens
gaactgagccg

SEQ ID NO: 5735078 - DNA, 17 bp, Homo sapiens
gaactgagctcctctgg

SEQ ID NO: 5735079 - DNA, 21 bp, Homo sapiens
gaactgagcttggaagcttct

SEQ ID NO: 5735080 - DNA, 11 bp, Homo sapiens
gaactgaggag

SEQ ID NO: 5735081 - DNA, 21 bp, Homo sapiens
gaactgaggagatgaccaggg

SEQ ID NO: 5735082 - DNA, 22 bp, Homo sapiens
gaactgaggagcggactcactt

SEQ ID NO: 5735083 - DNA, 12 bp, Homo sapiens
gaactgaggccc

SEQ ID NO: 5735084 - DNA, 14 bp, Homo sapiens
gaactgaggccctg

SEQ ID NO: 5735085 - DNA, 15 bp, Homo sapiens
gaactgaggccctgt

SEQ ID NO: 5735086 - DNA, 16 bp, Homo sapiens
gaactgaggccctgtg

SEQ ID NO: 5735087 - DNA, 20 bp, Homo sapiens
gaactgatcatgtttatgag

SEQ ID NO: 5735088 - DNA, 16 bp, Homo sapiens
gaactgatgacactga

SEQ ID NO: 5735089 - DNA, 23 bp, Homo sapiens
gaactgattcacatctcattttt

SEQ ID NO: 5735090 - DNA, 19 bp, Homo sapiens
gaactgcaaagctttggct

SEQ ID NO: 5735091 - DNA, 14 bp, Homo sapiens
gaactgcaacactg

SEQ ID NO: 5735092 - DNA, 17 bp, Homo sapiens
gaactgcacactcagtg

SEQ ID NO: 5735093 - DNA, 20 bp, Homo sapiens
gaactgcagacctcactgtc

SEQ ID NO: 5735094 - DNA, 18 bp, Homo sapiens
gaactgcagatagcccag

SEQ ID NO: 5735095 - DNA, 19 bp, Homo sapiens
gaactgcagcaatctttga

SEQ ID NO: 5735096 - DNA, 16 bp, Homo sapiens
gaactgcaggaagaga

SEQ ID NO: 5735097 - DNA, 12 bp, Homo sapiens
gaactgcaggcc

SEQ ID NO: 5735098 - DNA, 16 bp, Homo sapiens
gaactgcaggccctgg

SEQ ID NO: 5735099 - DNA, 19 bp, Homo sapiens
gaactgcaggccctggcct

SEQ ID NO: 5735100 - DNA, 23 bp, Homo sapiens
gaactgcaggccctggcctcccc

SEQ ID NO: 5735101 - DNA, 15 bp, Homo sapiens
gaactgcatatgttt

SEQ ID NO: 5735102 - DNA, 17 bp, Homo sapiens
gaactgcatcaagactt

SEQ ID NO: 5735103 - DNA, 17 bp, Homo sapiens
gaactgcatgtataaat

SEQ ID NO: 5735104 - DNA, 19 bp, Homo sapiens
gaactgccattattttctg

SEQ ID NO: 5735105 - DNA, 21 bp, Homo sapiens
gaactgcccatttccatggtg

SEQ ID NO: 5735106 - DNA, 19 bp, Homo sapiens
gaactgcccttgctgcccg

SEQ ID NO: 5735107 - DNA, 18 bp, Homo sapiens
gaactgcctggattccat

SEQ ID NO: 5735108 - DNA, 13 bp, Homo sapiens
gaactgcctgggc

SEQ ID NO: 5735109 - DNA, 22 bp, Homo sapiens
gaactgctaaatactgtacata

SEQ ID NO: 5735110 - DNA, 18 bp, Homo sapiens
gaactgctaccatgaagt

SEQ ID NO: 5735111 - DNA, 19 bp, Homo sapiens
gaactgctaccatgaagtg

SEQ ID NO: 5735112 - DNA, 22 bp, Homo sapiens
gaactgctagtcaagtgcgtcc

SEQ ID NO: 5735113 - DNA, 11 bp, Homo sapiens
gaactgctgcc

SEQ ID NO: 5735114 - DNA, 15 bp, Homo sapiens
gaactgctgccactg

SEQ ID NO: 5735115 - DNA, 17 bp, Homo sapiens
gaactgctgccactgag

SEQ ID NO: 5735116 - DNA, 11 bp, Homo sapiens
gaactgctgct

SEQ ID NO: 5735117 - DNA, 15 bp, Homo sapiens
gaactgctgctgacc

SEQ ID NO: 5735118 - DNA, 16 bp, Homo sapiens
gaactgctgctgaccc

SEQ ID NO: 5735119 - DNA, 20 bp, Homo sapiens
gaactgctgctgacccctgt

SEQ ID NO: 5735120 - DNA, 15 bp, Homo sapiens
gaactgctgctggtc

SEQ ID NO: 5735121 - DNA, 20 bp, Homo sapiens
gaactgctgctggtcacccc

SEQ ID NO: 5735122 - DNA, 22 bp, Homo sapiens
gaactgctgctggtcaccccca

SEQ ID NO: 5735123 - DNA, 14 bp, Homo sapiens
gaactgctggggct

SEQ ID NO: 5735124 - DNA, 15 bp, Homo sapiens
gaactgctggggctg

SEQ ID NO: 5735125 - DNA, 18 bp, Homo sapiens
gaactgcttcatgtgaac

SEQ ID NO: 5735126 - DNA, 17 bp, Homo sapiens
gaactgcttttcctcaa

SEQ ID NO: 5735127 - DNA, 23 bp, Homo sapiens
gaactgcttttcctcaagcaata

SEQ ID NO: 5735128 - DNA, 13 bp, Homo sapiens
gaactggaagaaa

SEQ ID NO: 5735129 - DNA, 14 bp, Homo sapiens
gaactggaagaaag

SEQ ID NO: 5735130 - DNA, 16 bp, Homo sapiens
gaactggacgcccagc

SEQ ID NO: 5735131 - DNA, 19 bp, Homo sapiens
gaactggacgcccagctga

SEQ ID NO: 5735132 - DNA, 11 bp, Homo sapiens
gaactggaggc

SEQ ID NO: 5735133 - DNA, 16 bp, Homo sapiens
gaactggccaagctga

SEQ ID NO: 5735134 - DNA, 18 bp, Homo sapiens
gaactggccaagctgagg

SEQ ID NO: 5735135 - DNA, 13 bp, Homo sapiens
gaactggccccag

SEQ ID NO: 5735136 - DNA, 15 bp, Homo sapiens
gaactggcctgctgc

SEQ ID NO: 5735137 - DNA, 16 bp, Homo sapiens
gaactggcctgctgcg

SEQ ID NO: 5735138 - DNA, 18 bp, Homo sapiens
gaactggctcctttgcct

SEQ ID NO: 5735139 - DNA, 18 bp, Homo sapiens
gaactggctgggcccctg

SEQ ID NO: 5735140 - DNA, 23 bp, Homo sapiens
gaactggctgggcccctggggac

SEQ ID NO: 5735141 - DNA, 17 bp, Homo sapiens
gaactggcttgtacatt

SEQ ID NO: 5735142 - DNA, 18 bp, Homo sapiens
gaactgggatttgaaccc

SEQ ID NO: 5735143 - DNA, 16 bp, Homo sapiens
gaactgggcatatttc

SEQ ID NO: 5735144 - DNA, 15 bp, Homo sapiens
gaactgggccagcag

SEQ ID NO: 5735145 - DNA, 17 bp, Homo sapiens
gaactgggccagcagag

SEQ ID NO: 5735146 - DNA, 18 bp, Homo sapiens
gaactgggccagcagagc

SEQ ID NO: 5735147 - DNA, 14 bp, Homo sapiens
gaactgggctgggc

SEQ ID NO: 5735148 - DNA, 17 bp, Homo sapiens
gaactgggctgggcctc

SEQ ID NO: 5735149 - DNA, 22 bp, Homo sapiens
gaactggggttcaagcccaggc

SEQ ID NO: 5735150 - DNA, 12 bp, Homo sapiens
gaactgggtaaa

SEQ ID NO: 5735151 - DNA, 22 bp, Homo sapiens
gaactgggtacttgtggacaca

SEQ ID NO: 5735152 - DNA, 21 bp, Homo sapiens
gaactgggtggtttggttttt

SEQ ID NO: 5735153 - DNA, 18 bp, Homo sapiens
gaactgggttctttggaa

SEQ ID NO: 5735154 - DNA, 18 bp, Homo sapiens
gaactggttcaagagaca

SEQ ID NO: 5735155 - DNA, 17 bp, Homo sapiens
gaactggttgtagtggg

SEQ ID NO: 5735156 - DNA, 16 bp, Homo sapiens
gaactgtacattgtga

SEQ ID NO: 5735157 - DNA, 19 bp, Homo sapiens
gaactgtacattgtgagct

SEQ ID NO: 5735158 - DNA, 23 bp, Homo sapiens
gaactgtacattgtgagctctgg

SEQ ID NO: 5735159 - DNA, 14 bp, Homo sapiens
gaactgtactgttt

SEQ ID NO: 5735160 - DNA, 20 bp, Homo sapiens
gaactgtagctgccatggct

SEQ ID NO: 5735161 - DNA, 20 bp, Homo sapiens
gaactgtattctagtggctg

SEQ ID NO: 5735162 - DNA, 21 bp, Homo sapiens
gaactgtattctagtggctgt

SEQ ID NO: 5735163 - DNA, 17 bp, Homo sapiens
gaactgtcaccctgagg

SEQ ID NO: 5735164 - DNA, 19 bp, Homo sapiens
gaactgtccacatctgcct

SEQ ID NO: 5735165 - DNA, 20 bp, Homo sapiens
gaactgtccacatctgcctc

SEQ ID NO: 5735166 - DNA, 15 bp, Homo sapiens
gaactgtccagagag

SEQ ID NO: 5735167 - DNA, 18 bp, Homo sapiens
gaactgtccagagagcaa

SEQ ID NO: 5735168 - DNA, 12 bp, Homo sapiens
gaactgtcccag

SEQ ID NO: 5735169 - DNA, 21 bp, Homo sapiens
gaactgtctagatggatgaat

SEQ ID NO: 5735170 - DNA, 11 bp, Homo sapiens
gaactgtgaat

SEQ ID NO: 5735171 - DNA, 14 bp, Homo sapiens
gaactgtgaatatg

SEQ ID NO: 5735172 - DNA, 15 bp, Homo sapiens
gaactgtgaatatgt

SEQ ID NO: 5735173 - DNA, 18 bp, Homo sapiens
gaactgtgaatatgtgta

SEQ ID NO: 5735174 - DNA, 17 bp, Homo sapiens
gaactgtgacaggaagc

SEQ ID NO: 5735175 - DNA, 18 bp, Homo sapiens
gaactgtgacaggaagcc

SEQ ID NO: 5735176 - DNA, 22 bp, Homo sapiens
gaactgtgatggggtgggcagg

SEQ ID NO: 5735177 - DNA, 16 bp, Homo sapiens
gaactgtgccacaatg

SEQ ID NO: 5735178 - DNA, 13 bp, Homo sapiens
gaactgtgccttc

SEQ ID NO: 5735179 - DNA, 13 bp, Homo sapiens
gaactgtgctccc

SEQ ID NO: 5735180 - DNA, 12 bp, Homo sapiens
gaactgtgctct

SEQ ID NO: 5735181 - DNA, 15 bp, Homo sapiens
gaactgtggaattta

SEQ ID NO: 5735182 - DNA, 18 bp, Homo sapiens
gaactgtggtgccacatg

SEQ ID NO: 5735183 - DNA, 14 bp, Homo sapiens
gaactgtgtattta

SEQ ID NO: 5735184 - DNA, 17 bp, Homo sapiens
gaactgtgtatttattt

SEQ ID NO: 5735185 - DNA, 19 bp, Homo sapiens
gaactgtgtatttatttaa

SEQ ID NO: 5735186 - DNA, 12 bp, Homo sapiens
gaactgtgtgtg

SEQ ID NO: 5735187 - DNA, 23 bp, Homo sapiens
gaactgtgtttcaaatggactgt

SEQ ID NO: 5735188 - DNA, 18 bp, Homo sapiens
gaactgttcaagtgtccc

SEQ ID NO: 5735189 - DNA, 21 bp, Homo sapiens
gaactgttcaagtgtccccag

SEQ ID NO: 5735190 - DNA, 14 bp, Homo sapiens
gaactgttcacact

SEQ ID NO: 5735191 - DNA, 20 bp, Homo sapiens
gaactgttcacactgcagag

SEQ ID NO: 5735192 - DNA, 16 bp, Homo sapiens
gaactgttctggcctc

SEQ ID NO: 5735193 - DNA, 15 bp, Homo sapiens
gaactgttgtataaa

SEQ ID NO: 5735194 - DNA, 12 bp, Homo sapiens
gaactgttgtct

SEQ ID NO: 5735195 - DNA, 14 bp, Homo sapiens
gaacttaaataatg

SEQ ID NO: 5735196 - DNA, 18 bp, Homo sapiens
gaacttaaggcatttgtt

SEQ ID NO: 5735197 - DNA, 17 bp, Homo sapiens
gaacttaagtctcgaat

SEQ ID NO: 5735198 - DNA, 17 bp, Homo sapiens
gaacttacacttggagc

SEQ ID NO: 5735199 - DNA, 18 bp, Homo sapiens
gaacttacacttggagcc

SEQ ID NO: 5735200 - DNA, 19 bp, Homo sapiens
gaacttacacttggagccc

SEQ ID NO: 5735201 - DNA, 21 bp, Homo sapiens
gaacttacacttggagcccgt

SEQ ID NO: 5735202 - DNA, 17 bp, Homo sapiens
gaacttacattgttcaa

SEQ ID NO: 5735203 - DNA, 21 bp, Homo sapiens
gaacttactattcattaaatg

SEQ ID NO: 5735204 - DNA, 18 bp, Homo sapiens
gaacttacttgcatacca

SEQ ID NO: 5735205 - DNA, 21 bp, Homo sapiens
gaacttagatgttaaatgtta

SEQ ID NO: 5735206 - DNA, 17 bp, Homo sapiens
gaacttagattttacat

SEQ ID NO: 5735207 - DNA, 19 bp, Homo sapiens
gaacttagattttacatga

SEQ ID NO: 5735208 - DNA, 16 bp, Homo sapiens
gaacttatgtacagaa

SEQ ID NO: 5735209 - DNA, 14 bp, Homo sapiens
gaacttcaatcact

SEQ ID NO: 5735210 - DNA, 17 bp, Homo sapiens
gaacttcacataggaag

SEQ ID NO: 5735211 - DNA, 15 bp, Homo sapiens
gaacttcacctgcaa

SEQ ID NO: 5735212 - DNA, 13 bp, Homo sapiens
gaacttcagaaag

SEQ ID NO: 5735213 - DNA, 22 bp, Homo sapiens
gaacttcaggtgtgactctagc

SEQ ID NO: 5735214 - DNA, 13 bp, Homo sapiens
gaacttcatctgc

SEQ ID NO: 5735215 - DNA, 14 bp, Homo sapiens
gaacttcatctgcc

SEQ ID NO: 5735216 - DNA, 12 bp, Homo sapiens
gaacttcatgct

SEQ ID NO: 5735217 - DNA, 16 bp, Homo sapiens
gaacttcatgcttgat

SEQ ID NO: 5735218 - DNA, 18 bp, Homo sapiens
gaacttcgcatcaaaaga

SEQ ID NO: 5735219 - DNA, 16 bp, Homo sapiens
gaacttctaaacactt

SEQ ID NO: 5735220 - DNA, 16 bp, Homo sapiens
gaacttctccgtcctc

SEQ ID NO: 5735221 - DNA, 17 bp, Homo sapiens
gaacttctctcagactt

SEQ ID NO: 5735222 - DNA, 20 bp, Homo sapiens
gaacttgaaaaaaaaaaaca

SEQ ID NO: 5735223 - DNA, 15 bp, Homo sapiens
gaacttgaaagtttt

SEQ ID NO: 5735224 - DNA, 12 bp, Homo sapiens
gaacttgaaatt

SEQ ID NO: 5735225 - DNA, 22 bp, Homo sapiens
gaacttgaagcctgctccttcc

SEQ ID NO: 5735226 - DNA, 15 bp, Homo sapiens
gaacttgaagctaac

SEQ ID NO: 5735227 - DNA, 21 bp, Homo sapiens
gaacttgaagggttactgacg

SEQ ID NO: 5735228 - DNA, 14 bp, Homo sapiens
gaacttgaatgtgt

SEQ ID NO: 5735229 - DNA, 15 bp, Homo sapiens
gaacttgactgggtg

SEQ ID NO: 5735230 - DNA, 19 bp, Homo sapiens
gaacttgagcctgtcaaga

SEQ ID NO: 5735231 - DNA, 14 bp, Homo sapiens
gaacttgagctctg

SEQ ID NO: 5735232 - DNA, 15 bp, Homo sapiens
gaacttgagctctgt

SEQ ID NO: 5735233 - DNA, 20 bp, Homo sapiens
gaacttgagctctgtaactt

SEQ ID NO: 5735234 - DNA, 13 bp, Homo sapiens
gaacttgaggaca

SEQ ID NO: 5735235 - DNA, 14 bp, Homo sapiens
gaacttgaggacac

SEQ ID NO: 5735236 - DNA, 17 bp, Homo sapiens
gaacttgaggacacatg

SEQ ID NO: 5735237 - DNA, 19 bp, Homo sapiens
gaacttgaggacacatgtc

SEQ ID NO: 5735238 - DNA, 13 bp, Homo sapiens
gaacttgattgcc

SEQ ID NO: 5735239 - DNA, 21 bp, Homo sapiens
gaacttgcagctgatgttgga

SEQ ID NO: 5735240 - DNA, 16 bp, Homo sapiens
gaacttgcctgccttt

SEQ ID NO: 5735241 - DNA, 13 bp, Homo sapiens
gaacttggaagca

SEQ ID NO: 5735242 - DNA, 21 bp, Homo sapiens
gaacttggagagggggccgga

SEQ ID NO: 5735243 - DNA, 15 bp, Homo sapiens
gaacttggaggcacc

SEQ ID NO: 5735244 - DNA, 17 bp, Homo sapiens
gaacttggcgctgcccc

SEQ ID NO: 5735245 - DNA, 17 bp, Homo sapiens
gaacttgggccactgtg

SEQ ID NO: 5735246 - DNA, 19 bp, Homo sapiens
gaacttggtgcctaatgtt

SEQ ID NO: 5735247 - DNA, 23 bp, Homo sapiens
gaacttggttcccatttgctcct

SEQ ID NO: 5735248 - DNA, 21 bp, Homo sapiens
gaacttgtaaaggaatttaaa

SEQ ID NO: 5735249 - DNA, 18 bp, Homo sapiens
gaacttgtagctgtaaaa

SEQ ID NO: 5735250 - DNA, 20 bp, Homo sapiens
gaacttgttgctgattttga

SEQ ID NO: 5735251 - DNA, 14 bp, Homo sapiens
gaacttgtttaata

SEQ ID NO: 5735252 - DNA, 19 bp, Homo sapiens
gaactttaaagctcaggag

SEQ ID NO: 5735253 - DNA, 17 bp, Homo sapiens
gaactttagggggtggg

SEQ ID NO: 5735254 - DNA, 14 bp, Homo sapiens
gaactttatttcca

SEQ ID NO: 5735255 - DNA, 23 bp, Homo sapiens
gaactttcatttttttccaggct

SEQ ID NO: 5735256 - DNA, 23 bp, Homo sapiens
gaactttctcagcatatatataa

SEQ ID NO: 5735257 - DNA, 14 bp, Homo sapiens
gaactttctccctc

SEQ ID NO: 5735258 - DNA, 18 bp, Homo sapiens
gaactttctccctcatcg

SEQ ID NO: 5735259 - DNA, 23 bp, Homo sapiens
gaactttgacctctgcagcaata

SEQ ID NO: 5735260 - DNA, 16 bp, Homo sapiens
gaactttgaggaggaa

SEQ ID NO: 5735261 - DNA, 17 bp, Homo sapiens
gaactttgatacaaatg

SEQ ID NO: 5735262 - DNA, 18 bp, Homo sapiens
gaactttgcagcatacca

SEQ ID NO: 5735263 - DNA, 22 bp, Homo sapiens
gaactttgccaaaaaaaaaaga

SEQ ID NO: 5735264 - DNA, 13 bp, Homo sapiens
gaactttgtcagt

SEQ ID NO: 5735265 - DNA, 15 bp, Homo sapiens
gaactttgtcagtgt

SEQ ID NO: 5735266 - DNA, 13 bp, Homo sapiens
gaactttgtgctt

SEQ ID NO: 5735267 - DNA, 19 bp, Homo sapiens
gaacttttaaactgcagtt

SEQ ID NO: 5735268 - DNA, 14 bp, Homo sapiens
gaacttttacagaa

SEQ ID NO: 5735269 - DNA, 13 bp, Homo sapiens
gaacttttctctt

SEQ ID NO: 5735270 - DNA, 15 bp, Homo sapiens
gaacttttctgtaat

SEQ ID NO: 5735271 - DNA, 21 bp, Homo sapiens
gaacttttggctaacagaaat

SEQ ID NO: 5735272 - DNA, 17 bp, Homo sapiens
gaacttttgtaatttga

SEQ ID NO: 5735273 - DNA, 18 bp, Homo sapiens
gaacttttgtaatttgaa

SEQ ID NO: 5735274 - DNA, 15 bp, Homo sapiens
gaacttttttaaata

SEQ ID NO: 5735275 - DNA, 17 bp, Homo sapiens
gaacttttttaaataaa

SEQ ID NO: 5735276 - DNA, 19 bp, Homo sapiens
gaacttttttaaataaact

SEQ ID NO: 5735277 - DNA, 15 bp, Homo sapiens
gaactttttttaagg

SEQ ID NO: 5735278 - DNA, 19 bp, Homo sapiens
gaagaaaaaaaaaaattca

SEQ ID NO: 5735279 - DNA, 16 bp, Homo sapiens
gaagaaaaaaaataac

SEQ ID NO: 5735280 - DNA, 17 bp, Homo sapiens
gaagaaaaaaaataaca

SEQ ID NO: 5735281 - DNA, 16 bp, Homo sapiens
gaagaaaaaaatcttc

SEQ ID NO: 5735282 - DNA, 19 bp, Homo sapiens
gaagaaaaaaggccttgaa

SEQ ID NO: 5735283 - DNA, 15 bp, Homo sapiens
gaagaaaaaatggca

SEQ ID NO: 5735284 - DNA, 21 bp, Homo sapiens
gaagaaaaaatggcaagagat

SEQ ID NO: 5735285 - DNA, 15 bp, Homo sapiens
gaagaaaaagaagct

SEQ ID NO: 5735286 - DNA, 12 bp, Homo sapiens
gaagaaaaagga

SEQ ID NO: 5735287 - DNA, 13 bp, Homo sapiens
gaagaaaaaggaa

SEQ ID NO: 5735288 - DNA, 23 bp, Homo sapiens
gaagaaaaataataaagtcagaa

SEQ ID NO: 5735289 - DNA, 14 bp, Homo sapiens
gaagaaaacatcta

SEQ ID NO: 5735290 - DNA, 22 bp, Homo sapiens
gaagaaaactcctttagcaggt

SEQ ID NO: 5735291 - DNA, 13 bp, Homo sapiens
gaagaaaacttga

SEQ ID NO: 5735292 - DNA, 12 bp, Homo sapiens
gaagaaaagact

SEQ ID NO: 5735293 - DNA, 19 bp, Homo sapiens
gaagaaaagagaagaagaa

SEQ ID NO: 5735294 - DNA, 13 bp, Homo sapiens
gaagaaaagcact

SEQ ID NO: 5735295 - DNA, 15 bp, Homo sapiens
gaagaaaaggaaatg

SEQ ID NO: 5735296 - DNA, 12 bp, Homo sapiens
gaagaaaatact

SEQ ID NO: 5735297 - DNA, 17 bp, Homo sapiens
gaagaaaatacttaaat

SEQ ID NO: 5735298 - DNA, 20 bp, Homo sapiens
gaagaaaatacttaaatgtt

SEQ ID NO: 5735299 - DNA, 14 bp, Homo sapiens
gaagaaaatatttt

SEQ ID NO: 5735300 - DNA, 23 bp, Homo sapiens
gaagaaaatggaaccaggcttgg

SEQ ID NO: 5735301 - DNA, 18 bp, Homo sapiens
gaagaaaattgctgtgcc

SEQ ID NO: 5735302 - DNA, 14 bp, Homo sapiens
gaagaaaatttaat

SEQ ID NO: 5735303 - DNA, 19 bp, Homo sapiens
gaagaaaatttgccaatct

SEQ ID NO: 5735304 - DNA, 21 bp, Homo sapiens
gaagaaaatttgccaatcttt

SEQ ID NO: 5735305 - DNA, 20 bp, Homo sapiens
gaagaaacacagcatgcatt

SEQ ID NO: 5735306 - DNA, 19 bp, Homo sapiens
gaagaaacacgtggtcatg

SEQ ID NO: 5735307 - DNA, 21 bp, Homo sapiens
gaagaaacacgtggtcatgaa

SEQ ID NO: 5735308 - DNA, 17 bp, Homo sapiens
gaagaaacactttctct

SEQ ID NO: 5735309 - DNA, 20 bp, Homo sapiens
gaagaaaccatttttaatga

SEQ ID NO: 5735310 - DNA, 16 bp, Homo sapiens
gaagaaaccccaagca

SEQ ID NO: 5735311 - DNA, 22 bp, Homo sapiens
gaagaaacctggaaccagaggg

SEQ ID NO: 5735312 - DNA, 20 bp, Homo sapiens
gaagaaactattttttaaaa

SEQ ID NO: 5735313 - DNA, 12 bp, Homo sapiens
gaagaaagaaaa

SEQ ID NO: 5735314 - DNA, 14 bp, Homo sapiens
gaagaaagaagcac

SEQ ID NO: 5735315 - DNA, 15 bp, Homo sapiens
gaagaaagaagcact

SEQ ID NO: 5735316 - DNA, 14 bp, Homo sapiens
gaagaaagaagcat

SEQ ID NO: 5735317 - DNA, 17 bp, Homo sapiens
gaagaaagagaaggagc

SEQ ID NO: 5735318 - DNA, 17 bp, Homo sapiens
gaagaaagagcttgagg

SEQ ID NO: 5735319 - DNA, 23 bp, Homo sapiens
gaagaaagaggtgaccccagggc

SEQ ID NO: 5735320 - DNA, 21 bp, Homo sapiens
gaagaaagatttgttactgta

SEQ ID NO: 5735321 - DNA, 22 bp, Homo sapiens
gaagaaagatttgttactgtat

SEQ ID NO: 5735322 - DNA, 10 bp, Homo sapiens
gaagaaagcc

SEQ ID NO: 5735323 - DNA, 13 bp, Homo sapiens
gaagaaagcccct

SEQ ID NO: 5735324 - DNA, 12 bp, Homo sapiens
gaagaaaggcat

SEQ ID NO: 5735325 - DNA, 12 bp, Homo sapiens
gaagaaaggcca

SEQ ID NO: 5735326 - DNA, 21 bp, Homo sapiens
gaagaaaggccatcagagcaa

SEQ ID NO: 5735327 - DNA, 23 bp, Homo sapiens
gaagaaagggtctgataaacaca

SEQ ID NO: 5735328 - DNA, 17 bp, Homo sapiens
gaagaaagggtgttttt

SEQ ID NO: 5735329 - DNA, 16 bp, Homo sapiens
gaagaaagtaaaaaga

SEQ ID NO: 5735330 - DNA, 17 bp, Homo sapiens
gaagaaagtaaaaccat

SEQ ID NO: 5735331 - DNA, 17 bp, Homo sapiens
gaagaaagtcaaaaaat

SEQ ID NO: 5735332 - DNA, 23 bp, Homo sapiens
gaagaaatctttctccctcaact

SEQ ID NO: 5735333 - DNA, 23 bp, Homo sapiens
gaagaaatgaaattttaccaagt

SEQ ID NO: 5735334 - DNA, 16 bp, Homo sapiens
gaagaaatgtcagatg

SEQ ID NO: 5735335 - DNA, 18 bp, Homo sapiens
gaagaaattataaagata

SEQ ID NO: 5735336 - DNA, 23 bp, Homo sapiens
gaagaaattatttaatatgcatc

SEQ ID NO: 5735337 - DNA, 22 bp, Homo sapiens
gaagaaattcctgtagcatctt

SEQ ID NO: 5735338 - DNA, 18 bp, Homo sapiens
gaagaacacagcatgtgc

SEQ ID NO: 5735339 - DNA, 18 bp, Homo sapiens
gaagaacagccccggggc

SEQ ID NO: 5735340 - DNA, 13 bp, Homo sapiens
gaagaacatagaa

SEQ ID NO: 5735341 - DNA, 17 bp, Homo sapiens
gaagaaccaaatacctc

SEQ ID NO: 5735342 - DNA, 18 bp, Homo sapiens
gaagaaccaaatacctca

SEQ ID NO: 5735343 - DNA, 21 bp, Homo sapiens
gaagaaccagcccagcctgcc

SEQ ID NO: 5735344 - DNA, 13 bp, Homo sapiens
gaagaaccagtcc

SEQ ID NO: 5735345 - DNA, 19 bp, Homo sapiens
gaagaaccagtccccccac

SEQ ID NO: 5735346 - DNA, 22 bp, Homo sapiens
gaagaaccgccgttcccttgaa

SEQ ID NO: 5735347 - DNA, 22 bp, Homo sapiens
gaagaacgcggtgtgtaacact

SEQ ID NO: 5735348 - DNA, 22 bp, Homo sapiens
gaagaactagcatatagccatt

SEQ ID NO: 5735349 - DNA, 16 bp, Homo sapiens
gaagaactgaaaggct

SEQ ID NO: 5735350 - DNA, 13 bp, Homo sapiens
gaagaactgcact

SEQ ID NO: 5735351 - DNA, 13 bp, Homo sapiens
gaagaactgcagg

SEQ ID NO: 5735352 - DNA, 14 bp, Homo sapiens
gaagaactgcatgt

SEQ ID NO: 5735353 - DNA, 16 bp, Homo sapiens
gaagaacttgaagtga

SEQ ID NO: 5735354 - DNA, 14 bp, Homo sapiens
gaagaagaaaaaaa

SEQ ID NO: 5735355 - DNA, 16 bp, Homo sapiens
gaagaagaaaaaaacg

SEQ ID NO: 5735356 - DNA, 13 bp, Homo sapiens
gaagaagaaaaca

SEQ ID NO: 5735357 - DNA, 22 bp, Homo sapiens
gaagaagaaaacatgtctgtga

SEQ ID NO: 5735358 - DNA, 15 bp, Homo sapiens
gaagaagaaaggact

SEQ ID NO: 5735359 - DNA, 16 bp, Homo sapiens
gaagaagaaaggactg

SEQ ID NO: 5735360 - DNA, 13 bp, Homo sapiens
gaagaagaaatct

SEQ ID NO: 5735361 - DNA, 13 bp, Homo sapiens
gaagaagaaccag

SEQ ID NO: 5735362 - DNA, 20 bp, Homo sapiens
gaagaagaaccagcccagcc

SEQ ID NO: 5735363 - DNA, 14 bp, Homo sapiens
gaagaagaagaaaa

SEQ ID NO: 5735364 - DNA, 15 bp, Homo sapiens
gaagaagaagaaaag

SEQ ID NO: 5735365 - DNA, 15 bp, Homo sapiens
gaagaagaagaagaa

SEQ ID NO: 5735366 - DNA, 23 bp, Homo sapiens
gaagaagaattggccatcttaaa

SEQ ID NO: 5735367 - DNA, 12 bp, Homo sapiens
gaagaagacaaa

SEQ ID NO: 5735368 - DNA, 22 bp, Homo sapiens
gaagaagaccagtcacagccat

SEQ ID NO: 5735369 - DNA, 17 bp, Homo sapiens
gaagaagagaagctgct

SEQ ID NO: 5735370 - DNA, 14 bp, Homo sapiens
gaagaagagaggca

SEQ ID NO: 5735371 - DNA, 17 bp, Homo sapiens
gaagaagagatgacaaa

SEQ ID NO: 5735372 - DNA, 14 bp, Homo sapiens
gaagaagagccaca

SEQ ID NO: 5735373 - DNA, 15 bp, Homo sapiens
gaagaagagccacag

SEQ ID NO: 5735374 - DNA, 13 bp, Homo sapiens
gaagaagaggaag

SEQ ID NO: 5735375 - DNA, 14 bp, Homo sapiens
gaagaagaggaagt

SEQ ID NO: 5735376 - DNA, 23 bp, Homo sapiens
gaagaagaggaggaagactctgg

SEQ ID NO: 5735377 - DNA, 12 bp, Homo sapiens
gaagaagcagcg

SEQ ID NO: 5735378 - DNA, 13 bp, Homo sapiens
gaagaagccccgt

SEQ ID NO: 5735379 - DNA, 14 bp, Homo sapiens
gaagaagccctgtt

SEQ ID NO: 5735380 - DNA, 14 bp, Homo sapiens
gaagaagctctctc

SEQ ID NO: 5735381 - DNA, 13 bp, Homo sapiens
gaagaagctgagg

SEQ ID NO: 5735382 - DNA, 15 bp, Homo sapiens
gaagaagctgggagg

SEQ ID NO: 5735383 - DNA, 17 bp, Homo sapiens
gaagaagcttaggcagg

SEQ ID NO: 5735384 - DNA, 21 bp, Homo sapiens
gaagaaggaagctgtgttgaa

SEQ ID NO: 5735385 - DNA, 22 bp, Homo sapiens
gaagaaggaaggcctgagcccc

SEQ ID NO: 5735386 - DNA, 18 bp, Homo sapiens
gaagaaggaccagtgaag

SEQ ID NO: 5735387 - DNA, 18 bp, Homo sapiens
gaagaaggagcagaataa

SEQ ID NO: 5735388 - DNA, 20 bp, Homo sapiens
gaagaaggagtcagccatcg

SEQ ID NO: 5735389 - DNA, 10 bp, Homo sapiens
gaagaaggca

SEQ ID NO: 5735390 - DNA, 14 bp, Homo sapiens
gaagaaggcaaggc

SEQ ID NO: 5735391 - DNA, 12 bp, Homo sapiens
gaagaaggcagt

SEQ ID NO: 5735392 - DNA, 13 bp, Homo sapiens
gaagaaggcagtg

SEQ ID NO: 5735393 - DNA, 16 bp, Homo sapiens
gaagaaggccagagag

SEQ ID NO: 5735394 - DNA, 17 bp, Homo sapiens
gaagaaggccagagagg

SEQ ID NO: 5735395 - DNA, 17 bp, Homo sapiens
gaagaaggcccgggagg

SEQ ID NO: 5735396 - DNA, 22 bp, Homo sapiens
gaagaagggaaattcacactgt

SEQ ID NO: 5735397 - DNA, 13 bp, Homo sapiens
gaagaagggaagc

SEQ ID NO: 5735398 - DNA, 15 bp, Homo sapiens
gaagaagggagaaga

SEQ ID NO: 5735399 - DNA, 16 bp, Homo sapiens
gaagaagggagaagaa

SEQ ID NO: 5735400 - DNA, 13 bp, Homo sapiens
gaagaagggccac

SEQ ID NO: 5735401 - DNA, 24 bp, Homo sapiens
gaagaagggggtggggggagtttg

SEQ ID NO: 5735402 - DNA, 14 bp, Homo sapiens
gaagaaggtgaata

SEQ ID NO: 5735403 - DNA, 21 bp, Homo sapiens
gaagaaggtggaccttttaaa

SEQ ID NO: 5735404 - DNA, 23 bp, Homo sapiens
gaagaaggtggaccttttaaagt

SEQ ID NO: 5735405 - DNA, 19 bp, Homo sapiens
gaagaagtgagcagtgttg

SEQ ID NO: 5735406 - DNA, 17 bp, Homo sapiens
gaagaagtgattctgtc

SEQ ID NO: 5735407 - DNA, 13 bp, Homo sapiens
gaagaagtggctg

SEQ ID NO: 5735408 - DNA, 16 bp, Homo sapiens
gaagaagttaattctt

SEQ ID NO: 5735409 - DNA, 20 bp, Homo sapiens
gaagaagttcagaaatttaa

SEQ ID NO: 5735410 - DNA, 13 bp, Homo sapiens
gaagaagttttaa

SEQ ID NO: 5735411 - DNA, 14 bp, Homo sapiens
gaagaataaaaaag

SEQ ID NO: 5735412 - DNA, 16 bp, Homo sapiens
gaagaataaattctac

SEQ ID NO: 5735413 - DNA, 17 bp, Homo sapiens
gaagaatacccaggaag

SEQ ID NO: 5735414 - DNA, 20 bp, Homo sapiens
gaagaatacccaggaagact

SEQ ID NO: 5735415 - DNA, 23 bp, Homo sapiens
gaagaatacttctcattttttaa

SEQ ID NO: 5735416 - DNA, 13 bp, Homo sapiens
gaagaatagaggt

SEQ ID NO: 5735417 - DNA, 17 bp, Homo sapiens
gaagaatataatgggaa

SEQ ID NO: 5735418 - DNA, 14 bp, Homo sapiens
gaagaatattgtta

SEQ ID NO: 5735419 - DNA, 14 bp, Homo sapiens
gaagaatatttaag

SEQ ID NO: 5735420 - DNA, 21 bp, Homo sapiens
gaagaatatttaagaaaagca

SEQ ID NO: 5735421 - DNA, 22 bp, Homo sapiens
gaagaatatttaagaaaagcac

SEQ ID NO: 5735422 - DNA, 23 bp, Homo sapiens
gaagaatatttaagaaaagcact

SEQ ID NO: 5735423 - DNA, 16 bp, Homo sapiens
gaagaatccagtatta

SEQ ID NO: 5735424 - DNA, 21 bp, Homo sapiens
gaagaatctcatctcagtgaa

SEQ ID NO: 5735425 - DNA, 14 bp, Homo sapiens
gaagaatctgcccc

SEQ ID NO: 5735426 - DNA, 12 bp, Homo sapiens
gaagaatgaaag

SEQ ID NO: 5735427 - DNA, 23 bp, Homo sapiens
gaagaatgaagaccactggactc

SEQ ID NO: 5735428 - DNA, 14 bp, Homo sapiens
gaagaatgcatgct

SEQ ID NO: 5735429 - DNA, 17 bp, Homo sapiens
gaagaatgcattcaaaa

SEQ ID NO: 5735430 - DNA, 19 bp, Homo sapiens
gaagaatgctgttctgatt

SEQ ID NO: 5735431 - DNA, 23 bp, Homo sapiens
gaagaatgctgttctgatttact

SEQ ID NO: 5735432 - DNA, 18 bp, Homo sapiens
gaagaatggagaggaaca

SEQ ID NO: 5735433 - DNA, 18 bp, Homo sapiens
gaagaatggctttcaata

SEQ ID NO: 5735434 - DNA, 20 bp, Homo sapiens
gaagaatgggaaagagaaag

SEQ ID NO: 5735435 - DNA, 14 bp, Homo sapiens
gaagaatgtctcct

SEQ ID NO: 5735436 - DNA, 14 bp, Homo sapiens
gaagaattatgtaa

SEQ ID NO: 5735437 - DNA, 21 bp, Homo sapiens
gaagaattattcagtgaattt

SEQ ID NO: 5735438 - DNA, 12 bp, Homo sapiens
gaagaattccag

SEQ ID NO: 5735439 - DNA, 21 bp, Homo sapiens
gaagaattgaaaagtttttgt

SEQ ID NO: 5735440 - DNA, 18 bp, Homo sapiens
gaagaattgaacccagga

SEQ ID NO: 5735441 - DNA, 14 bp, Homo sapiens
gaagaattggcaga

SEQ ID NO: 5735442 - DNA, 22 bp, Homo sapiens
gaagaattgtcttgcaagttaa

SEQ ID NO: 5735443 - DNA, 15 bp, Homo sapiens
gaagaattttaaaaa

SEQ ID NO: 5735444 - DNA, 21 bp, Homo sapiens
gaagaattttcagaccccagc

SEQ ID NO: 5735445 - DNA, 18 bp, Homo sapiens
gaagaattttgagtgaat

SEQ ID NO: 5735446 - DNA, 15 bp, Homo sapiens
gaagacaaaaagaca

SEQ ID NO: 5735447 - DNA, 16 bp, Homo sapiens
gaagacaaaaatactc

SEQ ID NO: 5735448 - DNA, 12 bp, Homo sapiens
gaagacaaaatt

SEQ ID NO: 5735449 - DNA, 23 bp, Homo sapiens
gaagacaaaattgtaagccagag

SEQ ID NO: 5735450 - DNA, 16 bp, Homo sapiens
gaagacaaaccactgt

SEQ ID NO: 5735451 - DNA, 19 bp, Homo sapiens
gaagacaaagtcccagaat

SEQ ID NO: 5735452 - DNA, 13 bp, Homo sapiens
gaagacaacagaa

SEQ ID NO: 5735453 - DNA, 16 bp, Homo sapiens
gaagacaacagaaaga

SEQ ID NO: 5735454 - DNA, 18 bp, Homo sapiens
gaagacaagcatttttaa

SEQ ID NO: 5735455 - DNA, 15 bp, Homo sapiens
gaagacaaggcatgt

SEQ ID NO: 5735456 - DNA, 21 bp, Homo sapiens
gaagacacagactgcgatttg

SEQ ID NO: 5735457 - DNA, 17 bp, Homo sapiens
gaagacacagcctcccc

SEQ ID NO: 5735458 - DNA, 16 bp, Homo sapiens
gaagacaccagagcag

SEQ ID NO: 5735459 - DNA, 18 bp, Homo sapiens
gaagacaccagagcagat

SEQ ID NO: 5735460 - DNA, 21 bp, Homo sapiens
gaagacactaattccttaaat

SEQ ID NO: 5735461 - DNA, 16 bp, Homo sapiens
gaagacactgatgggc

SEQ ID NO: 5735462 - DNA, 17 bp, Homo sapiens
gaagacagaaacccagt

SEQ ID NO: 5735463 - DNA, 17 bp, Homo sapiens
gaagacagagatggcag

SEQ ID NO: 5735464 - DNA, 22 bp, Homo sapiens
gaagacagagatggcagagcca

SEQ ID NO: 5735465 - DNA, 13 bp, Homo sapiens
gaagacagcagga

SEQ ID NO: 5735466 - DNA, 13 bp, Homo sapiens
gaagacagtggcc

SEQ ID NO: 5735467 - DNA, 15 bp, Homo sapiens
gaagacagtggcccc

SEQ ID NO: 5735468 - DNA, 23 bp, Homo sapiens
gaagacatagccgattctctgcc

SEQ ID NO: 5735469 - DNA, 14 bp, Homo sapiens
gaagacatatatta

SEQ ID NO: 5735470 - DNA, 23 bp, Homo sapiens
gaagacatatattatatatagaa

SEQ ID NO: 5735471 - DNA, 20 bp, Homo sapiens
gaagacatggagactcctgc

SEQ ID NO: 5735472 - DNA, 21 bp, Homo sapiens
gaagacatggagactcctgcc

SEQ ID NO: 5735473 - DNA, 14 bp, Homo sapiens
gaagacattgcacc

SEQ ID NO: 5735474 - DNA, 17 bp, Homo sapiens
gaagacatttctgctct

SEQ ID NO: 5735475 - DNA, 19 bp, Homo sapiens
gaagacatttctgctctca

SEQ ID NO: 5735476 - DNA, 15 bp, Homo sapiens
gaagacatttctttt

SEQ ID NO: 5735477 - DNA, 19 bp, Homo sapiens
gaagacattttctcttaga

SEQ ID NO: 5735478 - DNA, 20 bp, Homo sapiens
gaagacattttttgctataa

SEQ ID NO: 5735479 - DNA, 18 bp, Homo sapiens
gaagaccaaaggaaggaa

SEQ ID NO: 5735480 - DNA, 19 bp, Homo sapiens
gaagaccagaattcccttg

SEQ ID NO: 5735481 - DNA, 18 bp, Homo sapiens
gaagaccagactgtggag

SEQ ID NO: 5735482 - DNA, 12 bp, Homo sapiens
gaagaccagagc

SEQ ID NO: 5735483 - DNA, 19 bp, Homo sapiens
gaagaccagtcacagccat

SEQ ID NO: 5735484 - DNA, 21 bp, Homo sapiens
gaagaccagtcacagccattt

SEQ ID NO: 5735485 - DNA, 13 bp, Homo sapiens
gaagaccatgcct

SEQ ID NO: 5735486 - DNA, 17 bp, Homo sapiens
gaagaccattctgtgac

SEQ ID NO: 5735487 - DNA, 22 bp, Homo sapiens
gaagaccattctgtgaccaaaa

SEQ ID NO: 5735488 - DNA, 17 bp, Homo sapiens
gaagacccaaaacagct

SEQ ID NO: 5735489 - DNA, 18 bp, Homo sapiens
gaagacccaaaacagctt

SEQ ID NO: 5735490 - DNA, 19 bp, Homo sapiens
gaagacccaacacatggga

SEQ ID NO: 5735491 - DNA, 18 bp, Homo sapiens
gaagacccagcagatgtt

SEQ ID NO: 5735492 - DNA, 14 bp, Homo sapiens
gaagacccagcagg

SEQ ID NO: 5735493 - DNA, 23 bp, Homo sapiens
gaagacccagtgtaaagaataaa

SEQ ID NO: 5735494 - DNA, 18 bp, Homo sapiens
gaagaccccacccaagct

SEQ ID NO: 5735495 - DNA, 21 bp, Homo sapiens
gaagaccccagatgtgagggc

SEQ ID NO: 5735496 - DNA, 18 bp, Homo sapiens
gaagaccccgcaggatcc

SEQ ID NO: 5735497 - DNA, 14 bp, Homo sapiens
gaagaccctccccg

SEQ ID NO: 5735498 - DNA, 23 bp, Homo sapiens
gaagaccctcttgcccatcctga

SEQ ID NO: 5735499 - DNA, 16 bp, Homo sapiens
gaagacctaaagtgct

SEQ ID NO: 5735500 - DNA, 16 bp, Homo sapiens
gaagacctaaggcaga

SEQ ID NO: 5735501 - DNA, 18 bp, Homo sapiens
gaagacctaaggcagaca

SEQ ID NO: 5735502 - DNA, 13 bp, Homo sapiens
gaagacctgaaag

SEQ ID NO: 5735503 - DNA, 22 bp, Homo sapiens
gaagacctggcaaggacacaga

SEQ ID NO: 5735504 - DNA, 22 bp, Homo sapiens
gaagacctttattcacccctgc

SEQ ID NO: 5735505 - DNA, 17 bp, Homo sapiens
gaagacgaagtgtaaac

SEQ ID NO: 5735506 - DNA, 23 bp, Homo sapiens
gaagacgcccattcggactgctg

SEQ ID NO: 5735507 - DNA, 16 bp, Homo sapiens
gaagacgcctgagctc

SEQ ID NO: 5735508 - DNA, 16 bp, Homo sapiens
gaagacggaaaacaat

SEQ ID NO: 5735509 - DNA, 15 bp, Homo sapiens
gaagacgggagggga

SEQ ID NO: 5735510 - DNA, 18 bp, Homo sapiens
gaagacgtggactcctct

SEQ ID NO: 5735511 - DNA, 13 bp, Homo sapiens
gaagacgttttct

SEQ ID NO: 5735512 - DNA, 15 bp, Homo sapiens
gaagacgttttcttt

SEQ ID NO: 5735513 - DNA, 21 bp, Homo sapiens
gaagactcacttctcagctga

SEQ ID NO: 5735514 - DNA, 16 bp, Homo sapiens
gaagactcattcttct

SEQ ID NO: 5735515 - DNA, 17 bp, Homo sapiens
gaagactcattcttctg

SEQ ID NO: 5735516 - DNA, 18 bp, Homo sapiens
gaagactcctaggccctt

SEQ ID NO: 5735517 - DNA, 20 bp, Homo sapiens
gaagactcgtcttggcacaa

SEQ ID NO: 5735518 - DNA, 21 bp, Homo sapiens
gaagactctccactgacctgg

SEQ ID NO: 5735519 - DNA, 13 bp, Homo sapiens
gaagactgagaac

SEQ ID NO: 5735520 - DNA, 12 bp, Homo sapiens
gaagactgctcc

SEQ ID NO: 5735521 - DNA, 16 bp, Homo sapiens
gaagactgctcccggc

SEQ ID NO: 5735522 - DNA, 16 bp, Homo sapiens
gaagactggaagctaa

SEQ ID NO: 5735523 - DNA, 14 bp, Homo sapiens
gaagactggagaaa

SEQ ID NO: 5735524 - DNA, 13 bp, Homo sapiens
gaagactggagac

SEQ ID NO: 5735525 - DNA, 20 bp, Homo sapiens
gaagactgtcagcttccaaa

SEQ ID NO: 5735526 - DNA, 13 bp, Homo sapiens
gaagactgtgcag

SEQ ID NO: 5735527 - DNA, 20 bp, Homo sapiens
gaagactgtgcggcacagga

SEQ ID NO: 5735528 - DNA, 18 bp, Homo sapiens
gaagacttaaaagagctc

SEQ ID NO: 5735529 - DNA, 19 bp, Homo sapiens
gaagacttaaaagagctca

SEQ ID NO: 5735530 - DNA, 21 bp, Homo sapiens
gaagacttacagcaaatcctt

SEQ ID NO: 5735531 - DNA, 13 bp, Homo sapiens
gaagacttcaaaa

SEQ ID NO: 5735532 - DNA, 21 bp, Homo sapiens
gaagacttccccaagcctggc

SEQ ID NO: 5735533 - DNA, 23 bp, Homo sapiens
gaagacttccccaagcctggcag

SEQ ID NO: 5735534 - DNA, 22 bp, Homo sapiens
gaagacttctttgcaacaataa

SEQ ID NO: 5735535 - DNA, 21 bp, Homo sapiens
gaagacttgggttgatctctt

SEQ ID NO: 5735536 - DNA, 11 bp, Homo sapiens
gaagactttgg

SEQ ID NO: 5735537 - DNA, 14 bp, Homo sapiens
gaagactttggaaa

SEQ ID NO: 5735538 - DNA, 21 bp, Homo sapiens
gaagagaaaccatcctctccc

SEQ ID NO: 5735539 - DNA, 22 bp, Homo sapiens
gaagagaaaccatcctctccct

SEQ ID NO: 5735540 - DNA, 15 bp, Homo sapiens
gaagagaaaggactc

SEQ ID NO: 5735541 - DNA, 18 bp, Homo sapiens
gaagagaaatacagctgg

SEQ ID NO: 5735542 - DNA, 15 bp, Homo sapiens
gaagagaagacaaaa

SEQ ID NO: 5735543 - DNA, 15 bp, Homo sapiens
gaagagaagagaaag

SEQ ID NO: 5735544 - DNA, 15 bp, Homo sapiens
gaagagaagctgaga

SEQ ID NO: 5735545 - DNA, 18 bp, Homo sapiens
gaagagaagctgagaaga

SEQ ID NO: 5735546 - DNA, 17 bp, Homo sapiens
gaagagaagctgctgac

SEQ ID NO: 5735547 - DNA, 15 bp, Homo sapiens
gaagagaaggagcag

SEQ ID NO: 5735548 - DNA, 15 bp, Homo sapiens
gaagagaaggcacac

SEQ ID NO: 5735549 - DNA, 15 bp, Homo sapiens
gaagagaaggggaga

SEQ ID NO: 5735550 - DNA, 18 bp, Homo sapiens
gaagagacaggagggcaa

SEQ ID NO: 5735551 - DNA, 14 bp, Homo sapiens
gaagagaccactca

SEQ ID NO: 5735552 - DNA, 13 bp, Homo sapiens
gaagagagaactt

SEQ ID NO: 5735553 - DNA, 15 bp, Homo sapiens
gaagagagagctgag

SEQ ID NO: 5735554 - DNA, 19 bp, Homo sapiens
gaagagagaggcctgggtg

SEQ ID NO: 5735555 - DNA, 23 bp, Homo sapiens
gaagagagatatatctgaaaact

SEQ ID NO: 5735556 - DNA, 13 bp, Homo sapiens
gaagagagcctgc

SEQ ID NO: 5735557 - DNA, 22 bp, Homo sapiens
gaagagaggaaataacagagag

SEQ ID NO: 5735558 - DNA, 23 bp, Homo sapiens
gaagagaggaaataacagagaga

SEQ ID NO: 5735559 - DNA, 19 bp, Homo sapiens
gaagagaggagaggagaga

SEQ ID NO: 5735560 - DNA, 21 bp, Homo sapiens
gaagagaggagaggagagagg

SEQ ID NO: 5735561 - DNA, 12 bp, Homo sapiens
gaagagaggagt

SEQ ID NO: 5735562 - DNA, 16 bp, Homo sapiens
gaagagaggagttcaa

SEQ ID NO: 5735563 - DNA, 19 bp, Homo sapiens
gaagagaggagttcaatga

SEQ ID NO: 5735564 - DNA, 19 bp, Homo sapiens
gaagagaggcacctgctgg

SEQ ID NO: 5735565 - DNA, 20 bp, Homo sapiens
gaagagaggcacctgctgga

SEQ ID NO: 5735566 - DNA, 15 bp, Homo sapiens
gaagagagggacagg

SEQ ID NO: 5735567 - DNA, 21 bp, Homo sapiens
gaagagagggctgagccatgg

SEQ ID NO: 5735568 - DNA, 21 bp, Homo sapiens
gaagagagtagctcgtcctca

SEQ ID NO: 5735569 - DNA, 23 bp, Homo sapiens
gaagagagtagctcgtcctcact

SEQ ID NO: 5735570 - DNA, 17 bp, Homo sapiens
gaagagatcaggaagag

SEQ ID NO: 5735571 - DNA, 17 bp, Homo sapiens
gaagagatcccaggagg

SEQ ID NO: 5735572 - DNA, 16 bp, Homo sapiens
gaagagatgcactata

SEQ ID NO: 5735573 - DNA, 12 bp, Homo sapiens
gaagagcacaga

SEQ ID NO: 5735574 - DNA, 15 bp, Homo sapiens
gaagagcacagccct

SEQ ID NO: 5735575 - DNA, 23 bp, Homo sapiens
gaagagcactgggctaatttgta

SEQ ID NO: 5735576 - DNA, 22 bp, Homo sapiens
gaagagcagcctgatggccaag

SEQ ID NO: 5735577 - DNA, 16 bp, Homo sapiens
gaagagcagctccttc

SEQ ID NO: 5735578 - DNA, 16 bp, Homo sapiens
gaagagcagctggtca

SEQ ID NO: 5735579 - DNA, 11 bp, Homo sapiens
gaagagccacc

SEQ ID NO: 5735580 - DNA, 16 bp, Homo sapiens
gaagagccacctgcaa

SEQ ID NO: 5735581 - DNA, 20 bp, Homo sapiens
gaagagccatcttggcaggg

SEQ ID NO: 5735582 - DNA, 14 bp, Homo sapiens
gaagagcccagtct

SEQ ID NO: 5735583 - DNA, 12 bp, Homo sapiens
gaagagccccac

SEQ ID NO: 5735584 - DNA, 13 bp, Homo sapiens
gaagagccccact

SEQ ID NO: 5735585 - DNA, 20 bp, Homo sapiens
gaagagcccgccgtctgcag

SEQ ID NO: 5735586 - DNA, 22 bp, Homo sapiens
gaagagcccgccgtctgcaggg

SEQ ID NO: 5735587 - DNA, 24 bp, Homo sapiens
gaagagcccgtcgcgctggacagc

SEQ ID NO: 5735588 - DNA, 11 bp, Homo sapiens
gaagagccctg

SEQ ID NO: 5735589 - DNA, 12 bp, Homo sapiens
gaagagccctga

SEQ ID NO: 5735590 - DNA, 15 bp, Homo sapiens
gaagagccctgagct

SEQ ID NO: 5735591 - DNA, 16 bp, Homo sapiens
gaagagccgagcacct

SEQ ID NO: 5735592 - DNA, 20 bp, Homo sapiens
gaagagcctgaagctggcct

SEQ ID NO: 5735593 - DNA, 18 bp, Homo sapiens
gaagagcctgcaggtgct

SEQ ID NO: 5735594 - DNA, 17 bp, Homo sapiens
gaagagccttccaccca

SEQ ID NO: 5735595 - DNA, 22 bp, Homo sapiens
gaagagccttccacccaggggc

SEQ ID NO: 5735596 - DNA, 12 bp, Homo sapiens
gaagagccttgc

SEQ ID NO: 5735597 - DNA, 22 bp, Homo sapiens
gaagagcgagagatcaaagatg

SEQ ID NO: 5735598 - DNA, 15 bp, Homo sapiens
gaagagctcaaggga

SEQ ID NO: 5735599 - DNA, 19 bp, Homo sapiens
gaagagctgctgtatttga

SEQ ID NO: 5735600 - DNA, 12 bp, Homo sapiens
gaagagctgggt

SEQ ID NO: 5735601 - DNA, 22 bp, Homo sapiens
gaagagctgggtaccaggccac

SEQ ID NO: 5735602 - DNA, 19 bp, Homo sapiens
gaagagctgtcttcccctg

SEQ ID NO: 5735603 - DNA, 15 bp, Homo sapiens
gaagagctgttcaca

SEQ ID NO: 5735604 - DNA, 17 bp, Homo sapiens
gaagagcttagaaactg

SEQ ID NO: 5735605 - DNA, 17 bp, Homo sapiens
gaagagcttgcacagcc

SEQ ID NO: 5735606 - DNA, 18 bp, Homo sapiens
gaagaggaaaatgaataa

SEQ ID NO: 5735607 - DNA, 16 bp, Homo sapiens
gaagaggaacagtgtg

SEQ ID NO: 5735608 - DNA, 18 bp, Homo sapiens
gaagaggaagaaattcag

SEQ ID NO: 5735609 - DNA, 14 bp, Homo sapiens
gaagaggaccagag

SEQ ID NO: 5735610 - DNA, 13 bp, Homo sapiens
gaagaggactttt

SEQ ID NO: 5735611 - DNA, 17 bp, Homo sapiens
gaagaggagaaaaagaa

SEQ ID NO: 5735612 - DNA, 21 bp, Homo sapiens
gaagaggagaaaaagaagaaa

SEQ ID NO: 5735613 - DNA, 22 bp, Homo sapiens
gaagaggagaaaaagaagaaaa

SEQ ID NO: 5735614 - DNA, 21 bp, Homo sapiens
gaagaggagattggccagtga

SEQ ID NO: 5735615 - DNA, 14 bp, Homo sapiens
gaagaggaggaggt

SEQ ID NO: 5735616 - DNA, 17 bp, Homo sapiens
gaagaggatgagcagag

SEQ ID NO: 5735617 - DNA, 17 bp, Homo sapiens
gaagaggcatcctgcct

SEQ ID NO: 5735618 - DNA, 22 bp, Homo sapiens
gaagaggcatcctgcctgggtg

SEQ ID NO: 5735619 - DNA, 17 bp, Homo sapiens
gaagaggccaaaggaat

SEQ ID NO: 5735620 - DNA, 20 bp, Homo sapiens
gaagaggcccactagagggc

SEQ ID NO: 5735621 - DNA, 22 bp, Homo sapiens
gaagaggcccactagagggccc

SEQ ID NO: 5735622 - DNA, 18 bp, Homo sapiens
gaagaggccgctgcaggg

SEQ ID NO: 5735623 - DNA, 21 bp, Homo sapiens
gaagaggccgctgcagggtgg

SEQ ID NO: 5735624 - DNA, 15 bp, Homo sapiens
gaagaggctgcactg

SEQ ID NO: 5735625 - DNA, 15 bp, Homo sapiens
gaagaggctggttct

SEQ ID NO: 5735626 - DNA, 18 bp, Homo sapiens
gaagagggaaaacagaaa

SEQ ID NO: 5735627 - DNA, 19 bp, Homo sapiens
gaagagggaaatgtacact

SEQ ID NO: 5735628 - DNA, 17 bp, Homo sapiens
gaagagggaactaagca

SEQ ID NO: 5735629 - DNA, 18 bp, Homo sapiens
gaagagggaactaagcat

SEQ ID NO: 5735630 - DNA, 21 bp, Homo sapiens
gaagagggaatggatggggag

SEQ ID NO: 5735631 - DNA, 22 bp, Homo sapiens
gaagagggaatggatggggaga

SEQ ID NO: 5735632 - DNA, 12 bp, Homo sapiens
gaagagggagaa

SEQ ID NO: 5735633 - DNA, 15 bp, Homo sapiens
gaagagggagaagga

SEQ ID NO: 5735634 - DNA, 19 bp, Homo sapiens
gaagagggagaaggagagg

SEQ ID NO: 5735635 - DNA, 23 bp, Homo sapiens
gaagagggaggcttcctgactga

SEQ ID NO: 5735636 - DNA, 17 bp, Homo sapiens
gaagagggaggggccct

SEQ ID NO: 5735637 - DNA, 19 bp, Homo sapiens
gaagagggcagtacctggg

SEQ ID NO: 5735638 - DNA, 15 bp, Homo sapiens
gaagagggcccagcc

SEQ ID NO: 5735639 - DNA, 19 bp, Homo sapiens
gaagagggcccagcccaga

SEQ ID NO: 5735640 - DNA, 20 bp, Homo sapiens
gaagagggcctgtgggagcc

SEQ ID NO: 5735641 - DNA, 19 bp, Homo sapiens
gaagaggggacaggtccct

SEQ ID NO: 5735642 - DNA, 18 bp, Homo sapiens
gaagaggggcagcccttg

SEQ ID NO: 5735643 - DNA, 16 bp, Homo sapiens
gaagaggggcagcttt

SEQ ID NO: 5735644 - DNA, 23 bp, Homo sapiens
gaagaggggcgctgcccccacag

SEQ ID NO: 5735645 - DNA, 17 bp, Homo sapiens
gaagaggggctggggca

SEQ ID NO: 5735646 - DNA, 16 bp, Homo sapiens
gaagaggggtggtggg

SEQ ID NO: 5735647 - DNA, 21 bp, Homo sapiens
gaagaggtagtgtgaatatta

SEQ ID NO: 5735648 - DNA, 19 bp, Homo sapiens
gaagaggtccttggttggg

SEQ ID NO: 5735649 - DNA, 17 bp, Homo sapiens
gaagaggtctgattggc

SEQ ID NO: 5735650 - DNA, 20 bp, Homo sapiens
gaagaggtctgattggctgc

SEQ ID NO: 5735651 - DNA, 21 bp, Homo sapiens
gaagaggtctgattggctgct

SEQ ID NO: 5735652 - DNA, 22 bp, Homo sapiens
gaagaggttctcagcaagtgta

SEQ ID NO: 5735653 - DNA, 14 bp, Homo sapiens
gaagagtattaatg

SEQ ID NO: 5735654 - DNA, 23 bp, Homo sapiens
gaagagtcattttcacttttaaa

SEQ ID NO: 5735655 - DNA, 22 bp, Homo sapiens
gaagagtcccagtgaactcggc

SEQ ID NO: 5735656 - DNA, 16 bp, Homo sapiens
gaagagtcctctgaat

SEQ ID NO: 5735657 - DNA, 21 bp, Homo sapiens
gaagagtccttttagcacatc

SEQ ID NO: 5735658 - DNA, 13 bp, Homo sapiens
gaagagtgaaata

SEQ ID NO: 5735659 - DNA, 17 bp, Homo sapiens
gaagagtgggtttcaca

SEQ ID NO: 5735660 - DNA, 18 bp, Homo sapiens
gaagagtgggtttcacaa

SEQ ID NO: 5735661 - DNA, 15 bp, Homo sapiens
gaagagtgtactggg

SEQ ID NO: 5735662 - DNA, 18 bp, Homo sapiens
gaagagttacaataaagt

SEQ ID NO: 5735663 - DNA, 14 bp, Homo sapiens
gaagagttgaggaa

SEQ ID NO: 5735664 - DNA, 18 bp, Homo sapiens
gaagagttgcatcaacaa

SEQ ID NO: 5735665 - DNA, 23 bp, Homo sapiens
gaagagtttttgtgatgggggag

SEQ ID NO: 5735666 - DNA, 14 bp, Homo sapiens
gaagataaaaaaac

SEQ ID NO: 5735667 - DNA, 15 bp, Homo sapiens
gaagataaacgtgga

SEQ ID NO: 5735668 - DNA, 21 bp, Homo sapiens
gaagataaacgtggatgttac

SEQ ID NO: 5735669 - DNA, 14 bp, Homo sapiens
gaagataaatgctt

SEQ ID NO: 5735670 - DNA, 21 bp, Homo sapiens
gaagataacgccttccctaag

SEQ ID NO: 5735671 - DNA, 20 bp, Homo sapiens
gaagataatattaaggaaga

SEQ ID NO: 5735672 - DNA, 15 bp, Homo sapiens
gaagataatcattgc

SEQ ID NO: 5735673 - DNA, 15 bp, Homo sapiens
gaagataattttatg

SEQ ID NO: 5735674 - DNA, 16 bp, Homo sapiens
gaagatacacaagagg

SEQ ID NO: 5735675 - DNA, 12 bp, Homo sapiens
gaagatacacat

SEQ ID NO: 5735676 - DNA, 13 bp, Homo sapiens
gaagatactttgt

SEQ ID NO: 5735677 - DNA, 14 bp, Homo sapiens
gaagatactttgta

SEQ ID NO: 5735678 - DNA, 14 bp, Homo sapiens
gaagatagaagaaa

SEQ ID NO: 5735679 - DNA, 14 bp, Homo sapiens
gaagatagaagaac

SEQ ID NO: 5735680 - DNA, 14 bp, Homo sapiens
gaagatagctctct

SEQ ID NO: 5735681 - DNA, 20 bp, Homo sapiens
gaagataggctctcagtaag

SEQ ID NO: 5735682 - DNA, 15 bp, Homo sapiens
gaagatatacatgaa

SEQ ID NO: 5735683 - DNA, 18 bp, Homo sapiens
gaagatcacagcagggcc

SEQ ID NO: 5735684 - DNA, 19 bp, Homo sapiens
gaagatcacagcagggcct

SEQ ID NO: 5735685 - DNA, 17 bp, Homo sapiens
gaagatcacgctccccg

SEQ ID NO: 5735686 - DNA, 18 bp, Homo sapiens
gaagatcacgctccccgc

SEQ ID NO: 5735687 - DNA, 14 bp, Homo sapiens
gaagatcagaacat

SEQ ID NO: 5735688 - DNA, 21 bp, Homo sapiens
gaagatcatggacctggtgcc

SEQ ID NO: 5735689 - DNA, 21 bp, Homo sapiens
gaagatccagctgcctattga

SEQ ID NO: 5735690 - DNA, 13 bp, Homo sapiens
gaagatccccaac

SEQ ID NO: 5735691 - DNA, 19 bp, Homo sapiens
gaagatccccaactgctcc

SEQ ID NO: 5735692 - DNA, 14 bp, Homo sapiens
gaagatcccccaga

SEQ ID NO: 5735693 - DNA, 21 bp, Homo sapiens
gaagatctaaataaaatgcta

SEQ ID NO: 5735694 - DNA, 15 bp, Homo sapiens
gaagatctaccccag

SEQ ID NO: 5735695 - DNA, 21 bp, Homo sapiens
gaagatctacctgcaacacaa

SEQ ID NO: 5735696 - DNA, 21 bp, Homo sapiens
gaagatctcactctgcccccc

SEQ ID NO: 5735697 - DNA, 19 bp, Homo sapiens
gaagatctgcttccctggg

SEQ ID NO: 5735698 - DNA, 20 bp, Homo sapiens
gaagatctgcttccctgggg

SEQ ID NO: 5735699 - DNA, 15 bp, Homo sapiens
gaagatcttaaattt

SEQ ID NO: 5735700 - DNA, 17 bp, Homo sapiens
gaagatcttctgcagaa

SEQ ID NO: 5735701 - DNA, 19 bp, Homo sapiens
gaagatcttgagagctgct

SEQ ID NO: 5735702 - DNA, 20 bp, Homo sapiens
gaagatcttgagagctgctg

SEQ ID NO: 5735703 - DNA, 21 bp, Homo sapiens
gaagatcttgatggtgtttct

SEQ ID NO: 5735704 - DNA, 17 bp, Homo sapiens
gaagatctttgggcata

SEQ ID NO: 5735705 - DNA, 20 bp, Homo sapiens
gaagatgaaaccgtccctga

SEQ ID NO: 5735706 - DNA, 22 bp, Homo sapiens
gaagatgaatggtctggcaata

SEQ ID NO: 5735707 - DNA, 15 bp, Homo sapiens
gaagatgacttccca

SEQ ID NO: 5735708 - DNA, 22 bp, Homo sapiens
gaagatgaggttctgagaccag

SEQ ID NO: 5735709 - DNA, 16 bp, Homo sapiens
gaagatgatcagacct

SEQ ID NO: 5735710 - DNA, 21 bp, Homo sapiens
gaagatgcagcaaaatgtgaa

SEQ ID NO: 5735711 - DNA, 12 bp, Homo sapiens
gaagatgccaag

SEQ ID NO: 5735712 - DNA, 16 bp, Homo sapiens
gaagatgccagcttct

SEQ ID NO: 5735713 - DNA, 19 bp, Homo sapiens
gaagatgccagcttctctc

SEQ ID NO: 5735714 - DNA, 15 bp, Homo sapiens
gaagatgcccctgct

SEQ ID NO: 5735715 - DNA, 14 bp, Homo sapiens
gaagatgctggccc

SEQ ID NO: 5735716 - DNA, 15 bp, Homo sapiens
gaagatgctgtagta

SEQ ID NO: 5735717 - DNA, 16 bp, Homo sapiens
gaagatgctgtagtaa

SEQ ID NO: 5735718 - DNA, 18 bp, Homo sapiens
gaagatggactctgaaaa

SEQ ID NO: 5735719 - DNA, 22 bp, Homo sapiens
gaagatggagacaccctctggg

SEQ ID NO: 5735720 - DNA, 13 bp, Homo sapiens
gaagatggagggg

SEQ ID NO: 5735721 - DNA, 22 bp, Homo sapiens
gaagatggagggggctggggtc

SEQ ID NO: 5735722 - DNA, 13 bp, Homo sapiens
gaagatggcactg

SEQ ID NO: 5735723 - DNA, 17 bp, Homo sapiens
gaagatggcactgtcca

SEQ ID NO: 5735724 - DNA, 18 bp, Homo sapiens
gaagatggcactgtccag

SEQ ID NO: 5735725 - DNA, 21 bp, Homo sapiens
gaagatggcactgtccagggc

SEQ ID NO: 5735726 - DNA, 13 bp, Homo sapiens
gaagatgggaggt

SEQ ID NO: 5735727 - DNA, 13 bp, Homo sapiens
gaagatgggggct

SEQ ID NO: 5735728 - DNA, 15 bp, Homo sapiens
gaagatggtagcaga

SEQ ID NO: 5735729 - DNA, 22 bp, Homo sapiens
gaagatggtccgtgcccaggcc

SEQ ID NO: 5735730 - DNA, 16 bp, Homo sapiens
gaagatggtgaagaca

SEQ ID NO: 5735731 - DNA, 23 bp, Homo sapiens
gaagatggttttattctttgaga

SEQ ID NO: 5735732 - DNA, 19 bp, Homo sapiens
gaagatgtattcagagcca

SEQ ID NO: 5735733 - DNA, 10 bp, Homo sapiens
gaagatgtcc

SEQ ID NO: 5735734 - DNA, 14 bp, Homo sapiens
gaagatgtgattta

SEQ ID NO: 5735735 - DNA, 14 bp, Homo sapiens
gaagatgtgtaaat

SEQ ID NO: 5735736 - DNA, 17 bp, Homo sapiens
gaagatgtgtaaataag

SEQ ID NO: 5735737 - DNA, 20 bp, Homo sapiens
gaagatgttaattacttttg

SEQ ID NO: 5735738 - DNA, 23 bp, Homo sapiens
gaagatgttcaatagaacatgca

SEQ ID NO: 5735739 - DNA, 21 bp, Homo sapiens
gaagatgttgtcattatgtac

SEQ ID NO: 5735740 - DNA, 15 bp, Homo sapiens
gaagatgtttcaaaa

SEQ ID NO: 5735741 - DNA, 15 bp, Homo sapiens
gaagatgtttttaga

SEQ ID NO: 5735742 - DNA, 15 bp, Homo sapiens
gaagattcatgttta

SEQ ID NO: 5735743 - DNA, 15 bp, Homo sapiens
gaagattctaaaaca

SEQ ID NO: 5735744 - DNA, 21 bp, Homo sapiens
gaagattctaaaacattcttt

SEQ ID NO: 5735745 - DNA, 17 bp, Homo sapiens
gaagattctcgcccctt

SEQ ID NO: 5735746 - DNA, 20 bp, Homo sapiens
gaagattctcgccccttccc

SEQ ID NO: 5735747 - DNA, 20 bp, Homo sapiens
gaagattcttaccaagagtg

SEQ ID NO: 5735748 - DNA, 14 bp, Homo sapiens
gaagattctttccc

SEQ ID NO: 5735749 - DNA, 17 bp, Homo sapiens
gaagattgagatgtgtt

SEQ ID NO: 5735750 - DNA, 21 bp, Homo sapiens
gaagattggggacactcatat

SEQ ID NO: 5735751 - DNA, 13 bp, Homo sapiens
gaagattgtttat

SEQ ID NO: 5735752 - DNA, 16 bp, Homo sapiens
gaagattgtttatcta

SEQ ID NO: 5735753 - DNA, 17 bp, Homo sapiens
gaagatttagatgtttt

SEQ ID NO: 5735754 - DNA, 20 bp, Homo sapiens
gaagatttatgaacagaaat

SEQ ID NO: 5735755 - DNA, 22 bp, Homo sapiens
gaagatttatgaacagaaatat

SEQ ID NO: 5735756 - DNA, 18 bp, Homo sapiens
gaagatttcagagctgag

SEQ ID NO: 5735757 - DNA, 18 bp, Homo sapiens
gaagatttgaaaacaaac

SEQ ID NO: 5735758 - DNA, 23 bp, Homo sapiens
gaagatttgaaaacaaacttctc

SEQ ID NO: 5735759 - DNA, 21 bp, Homo sapiens
gaagatttgcccatttacact

SEQ ID NO: 5735760 - DNA, 15 bp, Homo sapiens
gaagatttgtctact

SEQ ID NO: 5735761 - DNA, 20 bp, Homo sapiens
gaagattttatgcacagcct

SEQ ID NO: 5735762 - DNA, 15 bp, Homo sapiens
gaagattttcagtct

SEQ ID NO: 5735763 - DNA, 21 bp, Homo sapiens
gaagcaaaaacgaaagctggg

SEQ ID NO: 5735764 - DNA, 21 bp, Homo sapiens
gaagcaaaattataagaagag

SEQ ID NO: 5735765 - DNA, 18 bp, Homo sapiens
gaagcaaacacacagact

SEQ ID NO: 5735766 - DNA, 12 bp, Homo sapiens
gaagcaaagaca

SEQ ID NO: 5735767 - DNA, 13 bp, Homo sapiens
gaagcaaagacaa

SEQ ID NO: 5735768 - DNA, 16 bp, Homo sapiens
gaagcaaagacaaaag

SEQ ID NO: 5735769 - DNA, 17 bp, Homo sapiens
gaagcaaagacaaaaga

SEQ ID NO: 5735770 - DNA, 16 bp, Homo sapiens
gaagcaaaggcaggag

SEQ ID NO: 5735771 - DNA, 16 bp, Homo sapiens
gaagcaaagttcaact

SEQ ID NO: 5735772 - DNA, 19 bp, Homo sapiens
gaagcaaagttcaacttat

SEQ ID NO: 5735773 - DNA, 19 bp, Homo sapiens
gaagcaaatggcaaaacca

SEQ ID NO: 5735774 - DNA, 22 bp, Homo sapiens
gaagcaaatgtcatgctgcctt

SEQ ID NO: 5735775 - DNA, 14 bp, Homo sapiens
gaagcaacatttta

SEQ ID NO: 5735776 - DNA, 16 bp, Homo sapiens
gaagcaacgaagggaa

SEQ ID NO: 5735777 - DNA, 15 bp, Homo sapiens
gaagcaacgtgttaa

SEQ ID NO: 5735778 - DNA, 14 bp, Homo sapiens
gaagcaagaagaat

SEQ ID NO: 5735779 - DNA, 18 bp, Homo sapiens
gaagcaagatcgctgtgc

SEQ ID NO: 5735780 - DNA, 20 bp, Homo sapiens
gaagcaagatcgctgtgcta

SEQ ID NO: 5735781 - DNA, 16 bp, Homo sapiens
gaagcaagccagacct

SEQ ID NO: 5735782 - DNA, 13 bp, Homo sapiens
gaagcaagctgtg

SEQ ID NO: 5735783 - DNA, 12 bp, Homo sapiens
gaagcaaggaag

SEQ ID NO: 5735784 - DNA, 20 bp, Homo sapiens
gaagcaaggaagatatacat

SEQ ID NO: 5735785 - DNA, 23 bp, Homo sapiens
gaagcaaggaagatatacatgaa

SEQ ID NO: 5735786 - DNA, 15 bp, Homo sapiens
gaagcaaggaagtaa

SEQ ID NO: 5735787 - DNA, 20 bp, Homo sapiens
gaagcaaggaagtaagggag

SEQ ID NO: 5735788 - DNA, 19 bp, Homo sapiens
gaagcaaggagaaaatata

SEQ ID NO: 5735789 - DNA, 14 bp, Homo sapiens
gaagcaaggccagc

SEQ ID NO: 5735790 - DNA, 13 bp, Homo sapiens
gaagcaaggctgg

SEQ ID NO: 5735791 - DNA, 23 bp, Homo sapiens
gaagcaaggctggggtcttgggt

SEQ ID NO: 5735792 - DNA, 14 bp, Homo sapiens
gaagcaagggcaag

SEQ ID NO: 5735793 - DNA, 15 bp, Homo sapiens
gaagcaataaagctc

SEQ ID NO: 5735794 - DNA, 13 bp, Homo sapiens
gaagcaataactc

SEQ ID NO: 5735795 - DNA, 19 bp, Homo sapiens
gaagcaataataaagtact

SEQ ID NO: 5735796 - DNA, 15 bp, Homo sapiens
gaagcaatcagcaaa

SEQ ID NO: 5735797 - DNA, 12 bp, Homo sapiens
gaagcaatctcc

SEQ ID NO: 5735798 - DNA, 15 bp, Homo sapiens
gaagcaattatttaa

SEQ ID NO: 5735799 - DNA, 13 bp, Homo sapiens
gaagcacaactcc

SEQ ID NO: 5735800 - DNA, 15 bp, Homo sapiens
gaagcacaactccct

SEQ ID NO: 5735801 - DNA, 21 bp, Homo sapiens
gaagcacaagaagtgggagtg

SEQ ID NO: 5735802 - DNA, 23 bp, Homo sapiens
gaagcacaccaatcttactttgt

SEQ ID NO: 5735803 - DNA, 15 bp, Homo sapiens
gaagcacagaatatt

SEQ ID NO: 5735804 - DNA, 23 bp, Homo sapiens
gaagcacagcaccgggggagagg

SEQ ID NO: 5735805 - DNA, 13 bp, Homo sapiens
gaagcacagcttc

SEQ ID NO: 5735806 - DNA, 14 bp, Homo sapiens
gaagcacagcttca

SEQ ID NO: 5735807 - DNA, 14 bp, Homo sapiens
gaagcacaggccag

SEQ ID NO: 5735808 - DNA, 22 bp, Homo sapiens
gaagcacaggccaggggatctg

SEQ ID NO: 5735809 - DNA, 17 bp, Homo sapiens
gaagcacagtgatcaag

SEQ ID NO: 5735810 - DNA, 20 bp, Homo sapiens
gaagcacatgcacctaccca

SEQ ID NO: 5735811 - DNA, 20 bp, Homo sapiens
gaagcacatgcctctctcag

SEQ ID NO: 5735812 - DNA, 13 bp, Homo sapiens
gaagcacatgtgt

SEQ ID NO: 5735813 - DNA, 14 bp, Homo sapiens
gaagcacatgttta

SEQ ID NO: 5735814 - DNA, 22 bp, Homo sapiens
gaagcaccagcctcagtgcagc

SEQ ID NO: 5735815 - DNA, 21 bp, Homo sapiens
gaagcaccccatgccaaagct

SEQ ID NO: 5735816 - DNA, 20 bp, Homo sapiens
gaagcacctactatgtgctg

SEQ ID NO: 5735817 - DNA, 15 bp, Homo sapiens
gaagcacctctcagc

SEQ ID NO: 5735818 - DNA, 21 bp, Homo sapiens
gaagcactacaccttgccttg

SEQ ID NO: 5735819 - DNA, 15 bp, Homo sapiens
gaagcactctgctgg

SEQ ID NO: 5735820 - DNA, 14 bp, Homo sapiens
gaagcactgctgtg

SEQ ID NO: 5735821 - DNA, 16 bp, Homo sapiens
gaagcacttaagtctt

SEQ ID NO: 5735822 - DNA, 22 bp, Homo sapiens
gaagcacttaagtcttccttaa

SEQ ID NO: 5735823 - DNA, 13 bp, Homo sapiens
gaagcagaacctt

SEQ ID NO: 5735824 - DNA, 21 bp, Homo sapiens
gaagcagaagacgggagggga

SEQ ID NO: 5735825 - DNA, 20 bp, Homo sapiens
gaagcagaataaagcaattt

SEQ ID NO: 5735826 - DNA, 21 bp, Homo sapiens
gaagcagaataaagcaatttt

SEQ ID NO: 5735827 - DNA, 22 bp, Homo sapiens
gaagcagaataaagcaattttc

SEQ ID NO: 5735828 - DNA, 22 bp, Homo sapiens
gaagcagaatgagatgatttaa

SEQ ID NO: 5735829 - DNA, 15 bp, Homo sapiens
gaagcagagcactgt

SEQ ID NO: 5735830 - DNA, 14 bp, Homo sapiens
gaagcagagcctgg

SEQ ID NO: 5735831 - DNA, 15 bp, Homo sapiens
gaagcagaggaagga

SEQ ID NO: 5735832 - DNA, 16 bp, Homo sapiens
gaagcagaggaaggaa

SEQ ID NO: 5735833 - DNA, 17 bp, Homo sapiens
gaagcagaggaaggaaa

SEQ ID NO: 5735834 - DNA, 18 bp, Homo sapiens
gaagcagaggaaggaaac

SEQ ID NO: 5735835 - DNA, 12 bp, Homo sapiens
gaagcagaggcc

SEQ ID NO: 5735836 - DNA, 13 bp, Homo sapiens
gaagcagaggccc

SEQ ID NO: 5735837 - DNA, 16 bp, Homo sapiens
gaagcagaggccctgc

SEQ ID NO: 5735838 - DNA, 23 bp, Homo sapiens
gaagcagaggccctgcccccacc

SEQ ID NO: 5735839 - DNA, 22 bp, Homo sapiens
gaagcagaggtcttcagggctc

SEQ ID NO: 5735840 - DNA, 12 bp, Homo sapiens
gaagcagagtgg

SEQ ID NO: 5735841 - DNA, 19 bp, Homo sapiens
gaagcagatgcaaagaggc

SEQ ID NO: 5735842 - DNA, 19 bp, Homo sapiens
gaagcagcaaatgaaagaa

SEQ ID NO: 5735843 - DNA, 16 bp, Homo sapiens
gaagcagcaaggtggg

SEQ ID NO: 5735844 - DNA, 13 bp, Homo sapiens
gaagcagcagcct

SEQ ID NO: 5735845 - DNA, 12 bp, Homo sapiens
gaagcagccagc

SEQ ID NO: 5735846 - DNA, 18 bp, Homo sapiens
gaagcagcctcagagtgg

SEQ ID NO: 5735847 - DNA, 12 bp, Homo sapiens
gaagcagcctct

SEQ ID NO: 5735848 - DNA, 13 bp, Homo sapiens
gaagcagctcaag

SEQ ID NO: 5735849 - DNA, 18 bp, Homo sapiens
gaagcagctctgccttct

SEQ ID NO: 5735850 - DNA, 15 bp, Homo sapiens
gaagcaggacccagt

SEQ ID NO: 5735851 - DNA, 23 bp, Homo sapiens
gaagcaggagggagggtggcttt

SEQ ID NO: 5735852 - DNA, 12 bp, Homo sapiens
gaagcaggcaga

SEQ ID NO: 5735853 - DNA, 13 bp, Homo sapiens
gaagcaggcagag

SEQ ID NO: 5735854 - DNA, 17 bp, Homo sapiens
gaagcaggcagagcggg

SEQ ID NO: 5735855 - DNA, 23 bp, Homo sapiens
gaagcaggcagagcggggaggtg

SEQ ID NO: 5735856 - DNA, 15 bp, Homo sapiens
gaagcaggcagggca

SEQ ID NO: 5735857 - DNA, 16 bp, Homo sapiens
gaagcaggcagggcaa

SEQ ID NO: 5735858 - DNA, 18 bp, Homo sapiens
gaagcaggctacactgac

SEQ ID NO: 5735859 - DNA, 12 bp, Homo sapiens
gaagcagggact

SEQ ID NO: 5735860 - DNA, 17 bp, Homo sapiens
gaagcagggagagttgg

SEQ ID NO: 5735861 - DNA, 22 bp, Homo sapiens
gaagcaggggtggggggtgcag

SEQ ID NO: 5735862 - DNA, 19 bp, Homo sapiens
gaagcaggtgtgagggcag

SEQ ID NO: 5735863 - DNA, 16 bp, Homo sapiens
gaagcaggttaaatgt

SEQ ID NO: 5735864 - DNA, 19 bp, Homo sapiens
gaagcaggttaaatgtttt

SEQ ID NO: 5735865 - DNA, 12 bp, Homo sapiens
gaagcaggttcc

SEQ ID NO: 5735866 - DNA, 17 bp, Homo sapiens
gaagcaggttcttgatg

SEQ ID NO: 5735867 - DNA, 19 bp, Homo sapiens
gaagcaggttgaggggctc

SEQ ID NO: 5735868 - DNA, 22 bp, Homo sapiens
gaagcagtgcctcgaggcaccg

SEQ ID NO: 5735869 - DNA, 18 bp, Homo sapiens
gaagcagtgccttccata

SEQ ID NO: 5735870 - DNA, 14 bp, Homo sapiens
gaagcagtggcctt

SEQ ID NO: 5735871 - DNA, 12 bp, Homo sapiens
gaagcagtgtcg

SEQ ID NO: 5735872 - DNA, 22 bp, Homo sapiens
gaagcagtgtcgccgtccctct

SEQ ID NO: 5735873 - DNA, 18 bp, Homo sapiens
gaagcagttggggccctc

SEQ ID NO: 5735874 - DNA, 19 bp, Homo sapiens
gaagcagttggggccctct

SEQ ID NO: 5735875 - DNA, 13 bp, Homo sapiens
gaagcagttgtgt

SEQ ID NO: 5735876 - DNA, 11 bp, Homo sapiens
gaagcagtttc

SEQ ID NO: 5735877 - DNA, 15 bp, Homo sapiens
gaagcagtttcagat

SEQ ID NO: 5735878 - DNA, 16 bp, Homo sapiens
gaagcagtttcagata

SEQ ID NO: 5735879 - DNA, 18 bp, Homo sapiens
gaagcataatttgtttaa

SEQ ID NO: 5735880 - DNA, 23 bp, Homo sapiens
gaagcataatttgtttaaaattc

SEQ ID NO: 5735881 - DNA, 17 bp, Homo sapiens
gaagcatagctacaatt

SEQ ID NO: 5735882 - DNA, 21 bp, Homo sapiens
gaagcatagctacaatttgtt

SEQ ID NO: 5735883 - DNA, 16 bp, Homo sapiens
gaagcatccaaagatt

SEQ ID NO: 5735884 - DNA, 14 bp, Homo sapiens
gaagcatccaagga

SEQ ID NO: 5735885 - DNA, 14 bp, Homo sapiens
gaagcatcctcccc

SEQ ID NO: 5735886 - DNA, 22 bp, Homo sapiens
gaagcatcctccccaccagagc

SEQ ID NO: 5735887 - DNA, 22 bp, Homo sapiens
gaagcatcttccagaagtgtga

SEQ ID NO: 5735888 - DNA, 13 bp, Homo sapiens
gaagcatgaaaaa

SEQ ID NO: 5735889 - DNA, 18 bp, Homo sapiens
gaagcatgaacagtgcac

SEQ ID NO: 5735890 - DNA, 22 bp, Homo sapiens
gaagcatgaataacatttaaat

SEQ ID NO: 5735891 - DNA, 22 bp, Homo sapiens
gaagcatgctttgctgctatga

SEQ ID NO: 5735892 - DNA, 20 bp, Homo sapiens
gaagcatggctgtctgcaca

SEQ ID NO: 5735893 - DNA, 10 bp, Homo sapiens
gaagcatgta

SEQ ID NO: 5735894 - DNA, 12 bp, Homo sapiens
gaagcatgtttc

SEQ ID NO: 5735895 - DNA, 13 bp, Homo sapiens
gaagcatgtttca

SEQ ID NO: 5735896 - DNA, 21 bp, Homo sapiens
gaagcattaacttctctggaa

SEQ ID NO: 5735897 - DNA, 23 bp, Homo sapiens
gaagcattagttggagctagaaa

SEQ ID NO: 5735898 - DNA, 15 bp, Homo sapiens
gaagcattcagagag

SEQ ID NO: 5735899 - DNA, 17 bp, Homo sapiens
gaagcattcagagagca

SEQ ID NO: 5735900 - DNA, 18 bp, Homo sapiens
gaagcattctcattggaa

SEQ ID NO: 5735901 - DNA, 21 bp, Homo sapiens
gaagcattctcattggaaatt

SEQ ID NO: 5735902 - DNA, 15 bp, Homo sapiens
gaagcattctcccca

SEQ ID NO: 5735903 - DNA, 19 bp, Homo sapiens
gaagcattctccccagtgt

SEQ ID NO: 5735904 - DNA, 18 bp, Homo sapiens
gaagcattgcctggactg

SEQ ID NO: 5735905 - DNA, 17 bp, Homo sapiens
gaagcattgtaaaataa

SEQ ID NO: 5735906 - DNA, 18 bp, Homo sapiens
gaagcatttactttgtgt

SEQ ID NO: 5735907 - DNA, 20 bp, Homo sapiens
gaagcatttcaaagccctgc

SEQ ID NO: 5735908 - DNA, 23 bp, Homo sapiens
gaagcatttcaaagccctgcctc

SEQ ID NO: 5735909 - DNA, 14 bp, Homo sapiens
gaagcatttcaggt

SEQ ID NO: 5735910 - DNA, 17 bp, Homo sapiens
gaagcatttggtggcct

SEQ ID NO: 5735911 - DNA, 12 bp, Homo sapiens
gaagcatttgta

SEQ ID NO: 5735912 - DNA, 14 bp, Homo sapiens
gaagcatttgtatt

SEQ ID NO: 5735913 - DNA, 16 bp, Homo sapiens
gaagcatttgtatttt

SEQ ID NO: 5735914 - DNA, 18 bp, Homo sapiens
gaagcatttgtattttgt

SEQ ID NO: 5735915 - DNA, 12 bp, Homo sapiens
gaagccaaagaa

SEQ ID NO: 5735916 - DNA, 21 bp, Homo sapiens
gaagccaaagagactgggcct

SEQ ID NO: 5735917 - DNA, 15 bp, Homo sapiens
gaagccaagacagtg

SEQ ID NO: 5735918 - DNA, 19 bp, Homo sapiens
gaagccaagctccctggag

SEQ ID NO: 5735919 - DNA, 15 bp, Homo sapiens
gaagccaagggaaag

SEQ ID NO: 5735920 - DNA, 17 bp, Homo sapiens
gaagccaagggaaaggg

SEQ ID NO: 5735921 - DNA, 21 bp, Homo sapiens
gaagccaagggaaaggggtgc

SEQ ID NO: 5735922 - DNA, 19 bp, Homo sapiens
gaagccaagggacacagga

SEQ ID NO: 5735923 - DNA, 18 bp, Homo sapiens
gaagccaagggggacctc

SEQ ID NO: 5735924 - DNA, 21 bp, Homo sapiens
gaagccaagggggacctcggg

SEQ ID NO: 5735925 - DNA, 22 bp, Homo sapiens
gaagccaagtggggtgctggga

SEQ ID NO: 5735926 - DNA, 14 bp, Homo sapiens
gaagccacacagcc

SEQ ID NO: 5735927 - DNA, 15 bp, Homo sapiens
gaagccacacagccc

SEQ ID NO: 5735928 - DNA, 18 bp, Homo sapiens
gaagccacacagcccaga

SEQ ID NO: 5735929 - DNA, 21 bp, Homo sapiens
gaagccacacagcccagaagg

SEQ ID NO: 5735930 - DNA, 15 bp, Homo sapiens
gaagccacagcccag

SEQ ID NO: 5735931 - DNA, 13 bp, Homo sapiens
gaagccacaggcc

SEQ ID NO: 5735932 - DNA, 18 bp, Homo sapiens
gaagccacaggcctgaga

SEQ ID NO: 5735933 - DNA, 13 bp, Homo sapiens
gaagccacagggt

SEQ ID NO: 5735934 - DNA, 15 bp, Homo sapiens
gaagccacagggtga

SEQ ID NO: 5735935 - DNA, 19 bp, Homo sapiens
gaagccacagggtgagcac

SEQ ID NO: 5735936 - DNA, 17 bp, Homo sapiens
gaagccacccaaagcag

SEQ ID NO: 5735937 - DNA, 17 bp, Homo sapiens
gaagccaccctcccagc

SEQ ID NO: 5735938 - DNA, 18 bp, Homo sapiens
gaagccaccctcccagct

SEQ ID NO: 5735939 - DNA, 18 bp, Homo sapiens
gaagccacccttccctgc

SEQ ID NO: 5735940 - DNA, 15 bp, Homo sapiens
gaagccacctctctg

SEQ ID NO: 5735941 - DNA, 14 bp, Homo sapiens
gaagccaccttccc

SEQ ID NO: 5735942 - DNA, 15 bp, Homo sapiens
gaagccaccttccca

SEQ ID NO: 5735943 - DNA, 18 bp, Homo sapiens
gaagccacgctgtcctct

SEQ ID NO: 5735944 - DNA, 19 bp, Homo sapiens
gaagccacgtgctggagag

SEQ ID NO: 5735945 - DNA, 18 bp, Homo sapiens
gaagccactgaagctggg

SEQ ID NO: 5735946 - DNA, 18 bp, Homo sapiens
gaagccacttggcccaga

SEQ ID NO: 5735947 - DNA, 18 bp, Homo sapiens
gaagccagagccccaagc

SEQ ID NO: 5735948 - DNA, 22 bp, Homo sapiens
gaagccagagccccaagcagga

SEQ ID NO: 5735949 - DNA, 19 bp, Homo sapiens
gaagccagagggtgggagg

SEQ ID NO: 5735950 - DNA, 19 bp, Homo sapiens
gaagccagcaggctctcag

SEQ ID NO: 5735951 - DNA, 22 bp, Homo sapiens
gaagccagcaggctctcaggcc

SEQ ID NO: 5735952 - DNA, 13 bp, Homo sapiens
gaagccagccaca

SEQ ID NO: 5735953 - DNA, 17 bp, Homo sapiens
gaagccagccacagacc

SEQ ID NO: 5735954 - DNA, 21 bp, Homo sapiens
gaagccagccacagacccctg

SEQ ID NO: 5735955 - DNA, 12 bp, Homo sapiens
gaagccagctgc

SEQ ID NO: 5735956 - DNA, 15 bp, Homo sapiens
gaagccagctgccct

SEQ ID NO: 5735957 - DNA, 18 bp, Homo sapiens
gaagccagctgcctagga

SEQ ID NO: 5735958 - DNA, 23 bp, Homo sapiens
gaagccagctgcctaggattcac

SEQ ID NO: 5735959 - DNA, 22 bp, Homo sapiens
gaagccagcttgtttacatgct

SEQ ID NO: 5735960 - DNA, 22 bp, Homo sapiens
gaagccagctttccctgcctct

SEQ ID NO: 5735961 - DNA, 21 bp, Homo sapiens
gaagccaggaatttcccagga

SEQ ID NO: 5735962 - DNA, 14 bp, Homo sapiens
gaagccaggagcaa

SEQ ID NO: 5735963 - DNA, 15 bp, Homo sapiens
gaagccaggagcaaa

SEQ ID NO: 5735964 - DNA, 18 bp, Homo sapiens
gaagccaggagcaaatgt

SEQ ID NO: 5735965 - DNA, 17 bp, Homo sapiens
gaagccaggaggcctgc

SEQ ID NO: 5735966 - DNA, 14 bp, Homo sapiens
gaagccagggcccg

SEQ ID NO: 5735967 - DNA, 13 bp, Homo sapiens
gaagccaggtaca

SEQ ID NO: 5735968 - DNA, 12 bp, Homo sapiens
gaagccaggtga

SEQ ID NO: 5735969 - DNA, 15 bp, Homo sapiens
gaagccagtcagggc

SEQ ID NO: 5735970 - DNA, 15 bp, Homo sapiens
gaagccagtgacact

SEQ ID NO: 5735971 - DNA, 16 bp, Homo sapiens
gaagccagtggagctg

SEQ ID NO: 5735972 - DNA, 21 bp, Homo sapiens
gaagccagtgtctaggcactg

SEQ ID NO: 5735973 - DNA, 23 bp, Homo sapiens
gaagccatatatgaccagaagcc

SEQ ID NO: 5735974 - DNA, 17 bp, Homo sapiens
gaagccatcacctcaga

SEQ ID NO: 5735975 - DNA, 22 bp, Homo sapiens
gaagccatccctttttttacat

SEQ ID NO: 5735976 - DNA, 12 bp, Homo sapiens
gaagccatgtct

SEQ ID NO: 5735977 - DNA, 21 bp, Homo sapiens
gaagccatgtggggttgctga

SEQ ID NO: 5735978 - DNA, 14 bp, Homo sapiens
gaagccattgtctt

SEQ ID NO: 5735979 - DNA, 16 bp, Homo sapiens
gaagccattgtcttcg

SEQ ID NO: 5735980 - DNA, 17 bp, Homo sapiens
gaagcccaaagcctgag

SEQ ID NO: 5735981 - DNA, 19 bp, Homo sapiens
gaagcccaaagcctgagga

SEQ ID NO: 5735982 - DNA, 14 bp, Homo sapiens
gaagcccaataaac

SEQ ID NO: 5735983 - DNA, 18 bp, Homo sapiens
gaagcccaataaacctct

SEQ ID NO: 5735984 - DNA, 23 bp, Homo sapiens
gaagcccacactatgcacagagc

SEQ ID NO: 5735985 - DNA, 16 bp, Homo sapiens
gaagcccaccaatctg

SEQ ID NO: 5735986 - DNA, 16 bp, Homo sapiens
gaagcccacccgcccc

SEQ ID NO: 5735987 - DNA, 19 bp, Homo sapiens
gaagcccacccgccccaga

SEQ ID NO: 5735988 - DNA, 20 bp, Homo sapiens
gaagcccacccgccccagag

SEQ ID NO: 5735989 - DNA, 21 bp, Homo sapiens
gaagcccacccgccccagaga

SEQ ID NO: 5735990 - DNA, 22 bp, Homo sapiens
gaagcccacccgccccagagac

SEQ ID NO: 5735991 - DNA, 12 bp, Homo sapiens
gaagcccagctc

SEQ ID NO: 5735992 - DNA, 14 bp, Homo sapiens
gaagcccagctcca

SEQ ID NO: 5735993 - DNA, 15 bp, Homo sapiens
gaagcccagctctgg

SEQ ID NO: 5735994 - DNA, 16 bp, Homo sapiens
gaagcccaggaaaggc

SEQ ID NO: 5735995 - DNA, 20 bp, Homo sapiens
gaagcccaggaaaggctcca

SEQ ID NO: 5735996 - DNA, 13 bp, Homo sapiens
gaagcccaggctc

SEQ ID NO: 5735997 - DNA, 17 bp, Homo sapiens
gaagcccatcctgacca

SEQ ID NO: 5735998 - DNA, 23 bp, Homo sapiens
gaagcccatgaactgtgtttcca

SEQ ID NO: 5735999 - DNA, 16 bp, Homo sapiens
gaagcccatggagcag

SEQ ID NO: 5736000 - DNA, 19 bp, Homo sapiens
gaagcccatggctggtggc

SEQ ID NO: 5736001 - DNA, 20 bp, Homo sapiens
gaagcccatgtcttctgctg

SEQ ID NO: 5736002 - DNA, 17 bp, Homo sapiens
gaagccccacatgtcca

SEQ ID NO: 5736003 - DNA, 18 bp, Homo sapiens
gaagccccctcttcctcc

SEQ ID NO: 5736004 - DNA, 23 bp, Homo sapiens
gaagccccgcacgggctgtctgg

SEQ ID NO: 5736005 - DNA, 21 bp, Homo sapiens
gaagccccgctcaggtagcca

SEQ ID NO: 5736006 - DNA, 14 bp, Homo sapiens
gaagcccctgggcc

SEQ ID NO: 5736007 - DNA, 18 bp, Homo sapiens
gaagcccctgggcccagt

SEQ ID NO: 5736008 - DNA, 21 bp, Homo sapiens
gaagcccctgggggctccctg

SEQ ID NO: 5736009 - DNA, 15 bp, Homo sapiens
gaagccccttatttt

SEQ ID NO: 5736010 - DNA, 14 bp, Homo sapiens
gaagccccttcccc

SEQ ID NO: 5736011 - DNA, 16 bp, Homo sapiens
gaagcccggctcctgg

SEQ ID NO: 5736012 - DNA, 19 bp, Homo sapiens
gaagcccggctcctggtca

SEQ ID NO: 5736013 - DNA, 21 bp, Homo sapiens
gaagcccggctcctggtcacc

SEQ ID NO: 5736014 - DNA, 21 bp, Homo sapiens
gaagccctagtagctggcgcc

SEQ ID NO: 5736015 - DNA, 15 bp, Homo sapiens
gaagccctccttcca

SEQ ID NO: 5736016 - DNA, 19 bp, Homo sapiens
gaagccctccttccacgga

SEQ ID NO: 5736017 - DNA, 16 bp, Homo sapiens
gaagccctccttgcca

SEQ ID NO: 5736018 - DNA, 23 bp, Homo sapiens
gaagccctgttgtgccacagagt

SEQ ID NO: 5736019 - DNA, 14 bp, Homo sapiens
gaagccgactctgg

SEQ ID NO: 5736020 - DNA, 17 bp, Homo sapiens
gaagccgactctggccc

SEQ ID NO: 5736021 - DNA, 19 bp, Homo sapiens
gaagccgactctggccctg

SEQ ID NO: 5736022 - DNA, 22 bp, Homo sapiens
gaagccgactctggccctggcc

SEQ ID NO: 5736023 - DNA, 19 bp, Homo sapiens
gaagccgcaccaccagcca

SEQ ID NO: 5736024 - DNA, 20 bp, Homo sapiens
gaagccgccagtacttgtca

SEQ ID NO: 5736025 - DNA, 23 bp, Homo sapiens
gaagccgcctagtgcagagaggt

SEQ ID NO: 5736026 - DNA, 14 bp, Homo sapiens
gaagccgctgctgg

SEQ ID NO: 5736027 - DNA, 14 bp, Homo sapiens
gaagccgctggggc

SEQ ID NO: 5736028 - DNA, 18 bp, Homo sapiens
gaagccgctggggccagt

SEQ ID NO: 5736029 - DNA, 20 bp, Homo sapiens
gaagccgctggggccagttg

SEQ ID NO: 5736030 - DNA, 18 bp, Homo sapiens
gaagccggacagctgccc

SEQ ID NO: 5736031 - DNA, 19 bp, Homo sapiens
gaagccggacagctgccca

SEQ ID NO: 5736032 - DNA, 20 bp, Homo sapiens
gaagccggacagctgcccag

SEQ ID NO: 5736033 - DNA, 21 bp, Homo sapiens
gaagccggacagctgcccaga

SEQ ID NO: 5736034 - DNA, 23 bp, Homo sapiens
gaagccggacagctgcccagaca

SEQ ID NO: 5736035 - DNA, 22 bp, Homo sapiens
gaagccggcggagctctggctt

SEQ ID NO: 5736036 - DNA, 20 bp, Homo sapiens
gaagccggcggcccaagccc

SEQ ID NO: 5736037 - DNA, 21 bp, Homo sapiens
gaagccggggtgtaacttcct

SEQ ID NO: 5736038 - DNA, 22 bp, Homo sapiens
gaagccggggtgtaacttcctg

SEQ ID NO: 5736039 - DNA, 23 bp, Homo sapiens
gaagccggggtgtaacttcctgc

SEQ ID NO: 5736040 - DNA, 19 bp, Homo sapiens
gaagccggtgtccctggat

SEQ ID NO: 5736041 - DNA, 21 bp, Homo sapiens
gaagccggtgtccctggatgt

SEQ ID NO: 5736042 - DNA, 21 bp, Homo sapiens
gaagccgttgaatctgggagg

SEQ ID NO: 5736043 - DNA, 18 bp, Homo sapiens
gaagcctaattgtcacat

SEQ ID NO: 5736044 - DNA, 17 bp, Homo sapiens
gaagcctactggtagaa

SEQ ID NO: 5736045 - DNA, 21 bp, Homo sapiens
gaagcctactggtagaaaaac

SEQ ID NO: 5736046 - DNA, 12 bp, Homo sapiens
gaagcctcagag

SEQ ID NO: 5736047 - DNA, 16 bp, Homo sapiens
gaagcctcagattcct

SEQ ID NO: 5736048 - DNA, 21 bp, Homo sapiens
gaagcctcagattccttccca

SEQ ID NO: 5736049 - DNA, 22 bp, Homo sapiens
gaagcctcagattccttcccat

SEQ ID NO: 5736050 - DNA, 22 bp, Homo sapiens
gaagcctcatgggagtcaggga

SEQ ID NO: 5736051 - DNA, 19 bp, Homo sapiens
gaagcctccaagcacagag

SEQ ID NO: 5736052 - DNA, 23 bp, Homo sapiens
gaagcctccaagcacagagcctg

SEQ ID NO: 5736053 - DNA, 16 bp, Homo sapiens
gaagcctccacctgca

SEQ ID NO: 5736054 - DNA, 14 bp, Homo sapiens
gaagcctccgtgga

SEQ ID NO: 5736055 - DNA, 14 bp, Homo sapiens
gaagcctcctgctg

SEQ ID NO: 5736056 - DNA, 20 bp, Homo sapiens
gaagcctcctgctgagtggt

SEQ ID NO: 5736057 - DNA, 18 bp, Homo sapiens
gaagcctctaacaaatga

SEQ ID NO: 5736058 - DNA, 23 bp, Homo sapiens
gaagcctctaacaaatgatctag

SEQ ID NO: 5736059 - DNA, 23 bp, Homo sapiens
gaagcctctcgtcccgtccctcc

SEQ ID NO: 5736060 - DNA, 22 bp, Homo sapiens
gaagcctctctccttggccaca

SEQ ID NO: 5736061 - DNA, 15 bp, Homo sapiens
gaagcctctgccctg

SEQ ID NO: 5736062 - DNA, 14 bp, Homo sapiens
gaagcctctggcta

SEQ ID NO: 5736063 - DNA, 15 bp, Homo sapiens
gaagcctgaactgag

SEQ ID NO: 5736064 - DNA, 18 bp, Homo sapiens
gaagcctgaactgaggcc

SEQ ID NO: 5736065 - DNA, 11 bp, Homo sapiens
gaagcctgagc

SEQ ID NO: 5736066 - DNA, 13 bp, Homo sapiens
gaagcctgagcag

SEQ ID NO: 5736067 - DNA, 16 bp, Homo sapiens
gaagcctgagcaggca

SEQ ID NO: 5736068 - DNA, 18 bp, Homo sapiens
gaagcctgagcaggcagg

SEQ ID NO: 5736069 - DNA, 19 bp, Homo sapiens
gaagcctgaggcaaaaact

SEQ ID NO: 5736070 - DNA, 15 bp, Homo sapiens
gaagcctgcaggagt

SEQ ID NO: 5736071 - DNA, 16 bp, Homo sapiens
gaagcctgcccttgtc

SEQ ID NO: 5736072 - DNA, 11 bp, Homo sapiens
gaagcctggac

SEQ ID NO: 5736073 - DNA, 18 bp, Homo sapiens
gaagcctggacgcagcca

SEQ ID NO: 5736074 - DNA, 19 bp, Homo sapiens
gaagcctggacgcagccac

SEQ ID NO: 5736075 - DNA, 18 bp, Homo sapiens
gaagcctggactctgccc

SEQ ID NO: 5736076 - DNA, 21 bp, Homo sapiens
gaagcctgggggcctggctgg

SEQ ID NO: 5736077 - DNA, 22 bp, Homo sapiens
gaagcctgtaacactcctctgc

SEQ ID NO: 5736078 - DNA, 12 bp, Homo sapiens
gaagcctgtcct

SEQ ID NO: 5736079 - DNA, 17 bp, Homo sapiens
gaagcctgtgccacctg

SEQ ID NO: 5736080 - DNA, 19 bp, Homo sapiens
gaagcctgtgccacctgca

SEQ ID NO: 5736081 - DNA, 18 bp, Homo sapiens
gaagcctgtgccagcacc

SEQ ID NO: 5736082 - DNA, 22 bp, Homo sapiens
gaagccttacaaggttatgtag

SEQ ID NO: 5736083 - DNA, 17 bp, Homo sapiens
gaagccttcaagctctg

SEQ ID NO: 5736084 - DNA, 15 bp, Homo sapiens
gaagccttcagctcc

SEQ ID NO: 5736085 - DNA, 16 bp, Homo sapiens
gaagccttcagctcca

SEQ ID NO: 5736086 - DNA, 15 bp, Homo sapiens
gaagccttctgacct

SEQ ID NO: 5736087 - DNA, 17 bp, Homo sapiens
gaagccttctgacctgg

SEQ ID NO: 5736088 - DNA, 13 bp, Homo sapiens
gaagccttctgca

SEQ ID NO: 5736089 - DNA, 22 bp, Homo sapiens
gaagccttctgcagcaggaact

SEQ ID NO: 5736090 - DNA, 18 bp, Homo sapiens
gaagccttcttgctgccc

SEQ ID NO: 5736091 - DNA, 20 bp, Homo sapiens
gaagccttcttgctgcccac

SEQ ID NO: 5736092 - DNA, 16 bp, Homo sapiens
gaagccttgctgaact

SEQ ID NO: 5736093 - DNA, 19 bp, Homo sapiens
gaagccttggaaccagccc

SEQ ID NO: 5736094 - DNA, 20 bp, Homo sapiens
gaagccttttgcaaatagta

SEQ ID NO: 5736095 - DNA, 23 bp, Homo sapiens
gaagcgaaaggggatggagtgag

SEQ ID NO: 5736096 - DNA, 16 bp, Homo sapiens
gaagcgaacatcttca

SEQ ID NO: 5736097 - DNA, 15 bp, Homo sapiens
gaagcgactctcctg

SEQ ID NO: 5736098 - DNA, 17 bp, Homo sapiens
gaagcgccaggctggag

SEQ ID NO: 5736099 - DNA, 18 bp, Homo sapiens
gaagcgctgccctgtgag

SEQ ID NO: 5736100 - DNA, 17 bp, Homo sapiens
gaagcggagcttgcagt

SEQ ID NO: 5736101 - DNA, 14 bp, Homo sapiens
gaagcggctggcag

SEQ ID NO: 5736102 - DNA, 15 bp, Homo sapiens
gaagcgggtggtggc

SEQ ID NO: 5736103 - DNA, 22 bp, Homo sapiens
gaagcggtggataactagccag

SEQ ID NO: 5736104 - DNA, 14 bp, Homo sapiens
gaagcgtatgtttt

SEQ ID NO: 5736105 - DNA, 19 bp, Homo sapiens
gaagcgtgtttctttccca

SEQ ID NO: 5736106 - DNA, 19 bp, Homo sapiens
gaagcgttgtcctcagccc

SEQ ID NO: 5736107 - DNA, 17 bp, Homo sapiens
gaagctaaaaggaaaag

SEQ ID NO: 5736108 - DNA, 18 bp, Homo sapiens
gaagctaacagggaaggc

SEQ ID NO: 5736109 - DNA, 19 bp, Homo sapiens
gaagctaacagggaaggca

SEQ ID NO: 5736110 - DNA, 14 bp, Homo sapiens
gaagctaagctgca

SEQ ID NO: 5736111 - DNA, 20 bp, Homo sapiens
gaagctaataaaattcgctt

SEQ ID NO: 5736112 - DNA, 23 bp, Homo sapiens
gaagctaataaaattcgctttct

SEQ ID NO: 5736113 - DNA, 16 bp, Homo sapiens
gaagctaatgaccaac

SEQ ID NO: 5736114 - DNA, 16 bp, Homo sapiens
gaagctaatgtcacaa

SEQ ID NO: 5736115 - DNA, 14 bp, Homo sapiens
gaagctaatttgca

SEQ ID NO: 5736116 - DNA, 15 bp, Homo sapiens
gaagctacaggttac

SEQ ID NO: 5736117 - DNA, 21 bp, Homo sapiens
gaagctacaggttacaacaga

SEQ ID NO: 5736118 - DNA, 19 bp, Homo sapiens
gaagctactattttggaaa

SEQ ID NO: 5736119 - DNA, 15 bp, Homo sapiens
gaagctactgtgtgt

SEQ ID NO: 5736120 - DNA, 23 bp, Homo sapiens
gaagctactgtgtgtgtgaatga

SEQ ID NO: 5736121 - DNA, 15 bp, Homo sapiens
gaagctacttctcca

SEQ ID NO: 5736122 - DNA, 19 bp, Homo sapiens
gaagctactttgtttttaa

SEQ ID NO: 5736123 - DNA, 21 bp, Homo sapiens
gaagctagacacatgaaggta

SEQ ID NO: 5736124 - DNA, 23 bp, Homo sapiens
gaagctagacacatgaaggtaaa

SEQ ID NO: 5736125 - DNA, 12 bp, Homo sapiens
gaagctagctcc

SEQ ID NO: 5736126 - DNA, 16 bp, Homo sapiens
gaagctagctcccctc

SEQ ID NO: 5736127 - DNA, 21 bp, Homo sapiens
gaagctatattagctgaaaca

SEQ ID NO: 5736128 - DNA, 15 bp, Homo sapiens
gaagctatgttttta

SEQ ID NO: 5736129 - DNA, 16 bp, Homo sapiens
gaagctatgtttttaa

SEQ ID NO: 5736130 - DNA, 20 bp, Homo sapiens
gaagctattgatgtttccag

SEQ ID NO: 5736131 - DNA, 20 bp, Homo sapiens
gaagctatttcctttgcgca

SEQ ID NO: 5736132 - DNA, 21 bp, Homo sapiens
gaagctatttttttaagctat

SEQ ID NO: 5736133 - DNA, 23 bp, Homo sapiens
gaagctatttttttaagctatca

SEQ ID NO: 5736134 - DNA, 16 bp, Homo sapiens
gaagctcacacatcct

SEQ ID NO: 5736135 - DNA, 20 bp, Homo sapiens
gaagctcacacatcctgtca

SEQ ID NO: 5736136 - DNA, 21 bp, Homo sapiens
gaagctcacactgatgggctg

SEQ ID NO: 5736137 - DNA, 23 bp, Homo sapiens
gaagctcacactgatgggctggg

SEQ ID NO: 5736138 - DNA, 13 bp, Homo sapiens
gaagctcacgcct

SEQ ID NO: 5736139 - DNA, 16 bp, Homo sapiens
gaagctcagggcctgg

SEQ ID NO: 5736140 - DNA, 19 bp, Homo sapiens
gaagctcagggcctggctc

SEQ ID NO: 5736141 - DNA, 20 bp, Homo sapiens
gaagctcagggcctggctca

SEQ ID NO: 5736142 - DNA, 21 bp, Homo sapiens
gaagctcaggttccctgccac

SEQ ID NO: 5736143 - DNA, 20 bp, Homo sapiens
gaagctcatatccttttgaa

SEQ ID NO: 5736144 - DNA, 14 bp, Homo sapiens
gaagctccactgtc

SEQ ID NO: 5736145 - DNA, 16 bp, Homo sapiens
gaagctccactgtcac

SEQ ID NO: 5736146 - DNA, 19 bp, Homo sapiens
gaagctccactgtcaccct

SEQ ID NO: 5736147 - DNA, 19 bp, Homo sapiens
gaagctccagtcctgctct

SEQ ID NO: 5736148 - DNA, 22 bp, Homo sapiens
gaagctcccacacccacctctg

SEQ ID NO: 5736149 - DNA, 12 bp, Homo sapiens
gaagctccccca

SEQ ID NO: 5736150 - DNA, 21 bp, Homo sapiens
gaagctcccccagcaaagccc

SEQ ID NO: 5736151 - DNA, 19 bp, Homo sapiens
gaagctccctccctcactg

SEQ ID NO: 5736152 - DNA, 19 bp, Homo sapiens
gaagctccgctttctaccc

SEQ ID NO: 5736153 - DNA, 22 bp, Homo sapiens
gaagctccgctttctacccagc

SEQ ID NO: 5736154 - DNA, 15 bp, Homo sapiens
gaagctcctccagtg

SEQ ID NO: 5736155 - DNA, 15 bp, Homo sapiens
gaagctccttcctgt

SEQ ID NO: 5736156 - DNA, 19 bp, Homo sapiens
gaagctcgcatccagacag

SEQ ID NO: 5736157 - DNA, 18 bp, Homo sapiens
gaagctctccgagctctg

SEQ ID NO: 5736158 - DNA, 19 bp, Homo sapiens
gaagctcttcaatagctaa

SEQ ID NO: 5736159 - DNA, 22 bp, Homo sapiens
gaagctcttggacaacagctct

SEQ ID NO: 5736160 - DNA, 21 bp, Homo sapiens
gaagctcttttctcctgcaga

SEQ ID NO: 5736161 - DNA, 22 bp, Homo sapiens
gaagctcttttctcctgcagaa

SEQ ID NO: 5736162 - DNA, 21 bp, Homo sapiens
gaagctgaaaggatgatcctg

SEQ ID NO: 5736163 - DNA, 19 bp, Homo sapiens
gaagctgaagagcacggtc

SEQ ID NO: 5736164 - DNA, 19 bp, Homo sapiens
gaagctgaagatccccaac

SEQ ID NO: 5736165 - DNA, 22 bp, Homo sapiens
gaagctgaagatccccaactgc

SEQ ID NO: 5736166 - DNA, 19 bp, Homo sapiens
gaagctgaagccccccttt

SEQ ID NO: 5736167 - DNA, 20 bp, Homo sapiens
gaagctgacctttaactgag

SEQ ID NO: 5736168 - DNA, 17 bp, Homo sapiens
gaagctgagaagaagct

SEQ ID NO: 5736169 - DNA, 17 bp, Homo sapiens
gaagctgagcaccaggg

SEQ ID NO: 5736170 - DNA, 13 bp, Homo sapiens
gaagctgagcagg

SEQ ID NO: 5736171 - DNA, 14 bp, Homo sapiens
gaagctgagcaggc

SEQ ID NO: 5736172 - DNA, 15 bp, Homo sapiens
gaagctgagcaggcc

SEQ ID NO: 5736173 - DNA, 18 bp, Homo sapiens
gaagctgagcaggcccga

SEQ ID NO: 5736174 - DNA, 18 bp, Homo sapiens
gaagctgaggcgggagaa

SEQ ID NO: 5736175 - DNA, 15 bp, Homo sapiens
gaagctgaggctgct

SEQ ID NO: 5736176 - DNA, 17 bp, Homo sapiens
gaagctgaggctgctgc

SEQ ID NO: 5736177 - DNA, 18 bp, Homo sapiens
gaagctgatacagagaga

SEQ ID NO: 5736178 - DNA, 15 bp, Homo sapiens
gaagctgatccagtt

SEQ ID NO: 5736179 - DNA, 20 bp, Homo sapiens
gaagctgattcccagagcag

SEQ ID NO: 5736180 - DNA, 14 bp, Homo sapiens
gaagctgcaataaa

SEQ ID NO: 5736181 - DNA, 18 bp, Homo sapiens
gaagctgcatccagaggc

SEQ ID NO: 5736182 - DNA, 19 bp, Homo sapiens
gaagctgccgtagcttcag

SEQ ID NO: 5736183 - DNA, 20 bp, Homo sapiens
gaagctgccgtagcttcagc

SEQ ID NO: 5736184 - DNA, 13 bp, Homo sapiens
gaagctgcctgct

SEQ ID NO: 5736185 - DNA, 22 bp, Homo sapiens
gaagctgcctggtgtggagtga

SEQ ID NO: 5736186 - DNA, 19 bp, Homo sapiens
gaagctgcgggggcaggcc

SEQ ID NO: 5736187 - DNA, 14 bp, Homo sapiens
gaagctgctccagg

SEQ ID NO: 5736188 - DNA, 17 bp, Homo sapiens
gaagctgctctggaatt

SEQ ID NO: 5736189 - DNA, 14 bp, Homo sapiens
gaagctgctggagc

SEQ ID NO: 5736190 - DNA, 12 bp, Homo sapiens
gaagctgctgtc

SEQ ID NO: 5736191 - DNA, 15 bp, Homo sapiens
gaagctgctgtctct

SEQ ID NO: 5736192 - DNA, 13 bp, Homo sapiens
gaagctggagcag

SEQ ID NO: 5736193 - DNA, 14 bp, Homo sapiens
gaagctggagcagc

SEQ ID NO: 5736194 - DNA, 19 bp, Homo sapiens
gaagctggaggctccagga

SEQ ID NO: 5736195 - DNA, 21 bp, Homo sapiens
gaagctggaggctccaggact

SEQ ID NO: 5736196 - DNA, 13 bp, Homo sapiens
gaagctggagtgc

SEQ ID NO: 5736197 - DNA, 14 bp, Homo sapiens
gaagctggagtgct

SEQ ID NO: 5736198 - DNA, 17 bp, Homo sapiens
gaagctggcagcactca

SEQ ID NO: 5736199 - DNA, 22 bp, Homo sapiens
gaagctggcaggagacactggt

SEQ ID NO: 5736200 - DNA, 16 bp, Homo sapiens
gaagctggccctcagc

SEQ ID NO: 5736201 - DNA, 17 bp, Homo sapiens
gaagctggccctcagct

SEQ ID NO: 5736202 - DNA, 21 bp, Homo sapiens
gaagctggccctcagctccct

SEQ ID NO: 5736203 - DNA, 23 bp, Homo sapiens
gaagctggccgagggtcctggct

SEQ ID NO: 5736204 - DNA, 15 bp, Homo sapiens
gaagctggcctgaga

SEQ ID NO: 5736205 - DNA, 22 bp, Homo sapiens
gaagctggcctgagaggggaag

SEQ ID NO: 5736206 - DNA, 14 bp, Homo sapiens
gaagctggcctgga

SEQ ID NO: 5736207 - DNA, 22 bp, Homo sapiens
gaagctggctgggctggctgaa

SEQ ID NO: 5736208 - DNA, 15 bp, Homo sapiens
gaagctggctttgaa

SEQ ID NO: 5736209 - DNA, 17 bp, Homo sapiens
gaagctgggagggaggg

SEQ ID NO: 5736210 - DNA, 16 bp, Homo sapiens
gaagctgggcccaaag

SEQ ID NO: 5736211 - DNA, 21 bp, Homo sapiens
gaagctgggcccaaaggccca

SEQ ID NO: 5736212 - DNA, 17 bp, Homo sapiens
gaagctgggctgtctct

SEQ ID NO: 5736213 - DNA, 11 bp, Homo sapiens
gaagctgggga

SEQ ID NO: 5736214 - DNA, 23 bp, Homo sapiens
gaagctggggacagctttcctgg

SEQ ID NO: 5736215 - DNA, 13 bp, Homo sapiens
gaagctgggggaa

SEQ ID NO: 5736216 - DNA, 14 bp, Homo sapiens
gaagctggggtaca

SEQ ID NO: 5736217 - DNA, 14 bp, Homo sapiens
gaagctggtgccct

SEQ ID NO: 5736218 - DNA, 21 bp, Homo sapiens
gaagctgtactcagagcagag

SEQ ID NO: 5736219 - DNA, 21 bp, Homo sapiens
gaagctgtcataaaaagacaa

SEQ ID NO: 5736220 - DNA, 21 bp, Homo sapiens
gaagctgtggggtcggagagg

SEQ ID NO: 5736221 - DNA, 15 bp, Homo sapiens
gaagctgtgttgaaa

SEQ ID NO: 5736222 - DNA, 18 bp, Homo sapiens
gaagctgtgttgaaacag

SEQ ID NO: 5736223 - DNA, 23 bp, Homo sapiens
gaagctgttcagggcatcggcag

SEQ ID NO: 5736224 - DNA, 24 bp, Homo sapiens
gaagctgttcagggcatcggcagc

SEQ ID NO: 5736225 - DNA, 17 bp, Homo sapiens
gaagctgttctctgctt

SEQ ID NO: 5736226 - DNA, 21 bp, Homo sapiens
gaagctgttgggagaaagcaa

SEQ ID NO: 5736227 - DNA, 16 bp, Homo sapiens
gaagctgttgtacatt

SEQ ID NO: 5736228 - DNA, 16 bp, Homo sapiens
gaagctgttgtgtgag

SEQ ID NO: 5736229 - DNA, 18 bp, Homo sapiens
gaagctgttttgagccag

SEQ ID NO: 5736230 - DNA, 14 bp, Homo sapiens
gaagcttaaaataa

SEQ ID NO: 5736231 - DNA, 16 bp, Homo sapiens
gaagcttactctctgc

SEQ ID NO: 5736232 - DNA, 16 bp, Homo sapiens
gaagcttattaatgct

SEQ ID NO: 5736233 - DNA, 19 bp, Homo sapiens
gaagcttattaatgctaag

SEQ ID NO: 5736234 - DNA, 20 bp, Homo sapiens
gaagcttattaatgctaagg

SEQ ID NO: 5736235 - DNA, 21 bp, Homo sapiens
gaagcttattaatgctaaggg

SEQ ID NO: 5736236 - DNA, 22 bp, Homo sapiens
gaagcttcagcaggaggcaagc

SEQ ID NO: 5736237 - DNA, 17 bp, Homo sapiens
gaagcttccacaaaatt

SEQ ID NO: 5736238 - DNA, 11 bp, Homo sapiens
gaagcttctaa

SEQ ID NO: 5736239 - DNA, 18 bp, Homo sapiens
gaagcttcttgctcctgt

SEQ ID NO: 5736240 - DNA, 15 bp, Homo sapiens
gaagcttgactccca

SEQ ID NO: 5736241 - DNA, 17 bp, Homo sapiens
gaagcttgagcctcccc

SEQ ID NO: 5736242 - DNA, 19 bp, Homo sapiens
gaagcttgagcctccccca

SEQ ID NO: 5736243 - DNA, 14 bp, Homo sapiens
gaagcttggaggag

SEQ ID NO: 5736244 - DNA, 18 bp, Homo sapiens
gaagcttggggaagaccc

SEQ ID NO: 5736245 - DNA, 19 bp, Homo sapiens
gaagcttggggaagaccca

SEQ ID NO: 5736246 - DNA, 13 bp, Homo sapiens
gaagcttgtatct

SEQ ID NO: 5736247 - DNA, 14 bp, Homo sapiens
gaagcttgtatctg

SEQ ID NO: 5736248 - DNA, 17 bp, Homo sapiens
gaagcttgtatctgata

SEQ ID NO: 5736249 - DNA, 21 bp, Homo sapiens
gaagcttgttgaaaacccaga

SEQ ID NO: 5736250 - DNA, 14 bp, Homo sapiens
gaagctttctgtct

SEQ ID NO: 5736251 - DNA, 21 bp, Homo sapiens
gaagctttgagttgacttctg

SEQ ID NO: 5736252 - DNA, 19 bp, Homo sapiens
gaagctttggaagcagcaa

SEQ ID NO: 5736253 - DNA, 18 bp, Homo sapiens
gaagcttttatgtgaaac

SEQ ID NO: 5736254 - DNA, 21 bp, Homo sapiens
gaaggaaaaaattatgttttt

SEQ ID NO: 5736255 - DNA, 17 bp, Homo sapiens
gaaggaaaaacatgctt

SEQ ID NO: 5736256 - DNA, 12 bp, Homo sapiens
gaaggaaaagaa

SEQ ID NO: 5736257 - DNA, 13 bp, Homo sapiens
gaaggaaaagagt

SEQ ID NO: 5736258 - DNA, 16 bp, Homo sapiens
gaaggaaaaggctggc

SEQ ID NO: 5736259 - DNA, 21 bp, Homo sapiens
gaaggaaaatactacctgtcc

SEQ ID NO: 5736260 - DNA, 14 bp, Homo sapiens
gaaggaaaatattt

SEQ ID NO: 5736261 - DNA, 14 bp, Homo sapiens
gaaggaaacaaatg

SEQ ID NO: 5736262 - DNA, 18 bp, Homo sapiens
gaaggaaacaacaaagga

SEQ ID NO: 5736263 - DNA, 22 bp, Homo sapiens
gaaggaaacaacaaaggaagtg

SEQ ID NO: 5736264 - DNA, 15 bp, Homo sapiens
gaaggaaacatagaa

SEQ ID NO: 5736265 - DNA, 18 bp, Homo sapiens
gaaggaaacatagaaaga

SEQ ID NO: 5736266 - DNA, 18 bp, Homo sapiens
gaaggaaacccagctctg

SEQ ID NO: 5736267 - DNA, 19 bp, Homo sapiens
gaaggaaacccagctctgg

SEQ ID NO: 5736268 - DNA, 20 bp, Homo sapiens
gaaggaaacccagctctggt

SEQ ID NO: 5736269 - DNA, 15 bp, Homo sapiens
gaaggaaactggaat

SEQ ID NO: 5736270 - DNA, 23 bp, Homo sapiens
gaaggaaagatttgtgaactgga

SEQ ID NO: 5736271 - DNA, 19 bp, Homo sapiens
gaaggaaagcatgtctctg

SEQ ID NO: 5736272 - DNA, 20 bp, Homo sapiens
gaaggaaagcatgtctctgc

SEQ ID NO: 5736273 - DNA, 14 bp, Homo sapiens
gaaggaaaggcaga

SEQ ID NO: 5736274 - DNA, 12 bp, Homo sapiens
gaaggaaataac

SEQ ID NO: 5736275 - DNA, 14 bp, Homo sapiens
gaaggaaatatatt

SEQ ID NO: 5736276 - DNA, 20 bp, Homo sapiens
gaaggaaatgaatttctcta

SEQ ID NO: 5736277 - DNA, 20 bp, Homo sapiens
gaaggaaatgagtggccagc

SEQ ID NO: 5736278 - DNA, 15 bp, Homo sapiens
gaaggaacaaagaca

SEQ ID NO: 5736279 - DNA, 21 bp, Homo sapiens
gaaggaacccggtcccaggcc

SEQ ID NO: 5736280 - DNA, 22 bp, Homo sapiens
gaaggaacccggtcccaggccg

SEQ ID NO: 5736281 - DNA, 21 bp, Homo sapiens
gaaggaacttgtctcttcatc

SEQ ID NO: 5736282 - DNA, 19 bp, Homo sapiens
gaaggaagacttcatccct

SEQ ID NO: 5736283 - DNA, 23 bp, Homo sapiens
gaaggaagataggacgtatttat

SEQ ID NO: 5736284 - DNA, 18 bp, Homo sapiens
gaaggaagatcttgagag

SEQ ID NO: 5736285 - DNA, 22 bp, Homo sapiens
gaaggaagccaaatttatcaaa

SEQ ID NO: 5736286 - DNA, 15 bp, Homo sapiens
gaaggaagctgtgtt

SEQ ID NO: 5736287 - DNA, 21 bp, Homo sapiens
gaaggaagctgtgttgaaaca

SEQ ID NO: 5736288 - DNA, 18 bp, Homo sapiens
gaaggaaggaggcagact

SEQ ID NO: 5736289 - DNA, 15 bp, Homo sapiens
gaaggaaggagggca

SEQ ID NO: 5736290 - DNA, 18 bp, Homo sapiens
gaaggaaggcagggagga

SEQ ID NO: 5736291 - DNA, 19 bp, Homo sapiens
gaaggaaggggctatcctg

SEQ ID NO: 5736292 - DNA, 18 bp, Homo sapiens
gaaggaagtgtgtttgcc

SEQ ID NO: 5736293 - DNA, 15 bp, Homo sapiens
gaaggaatagccaga

SEQ ID NO: 5736294 - DNA, 19 bp, Homo sapiens
gaaggaatatatggcagag

SEQ ID NO: 5736295 - DNA, 18 bp, Homo sapiens
gaaggaatcctggatttt

SEQ ID NO: 5736296 - DNA, 13 bp, Homo sapiens
gaaggaatgcaat

SEQ ID NO: 5736297 - DNA, 20 bp, Homo sapiens
gaaggaatgcaataaagagt

SEQ ID NO: 5736298 - DNA, 22 bp, Homo sapiens
gaaggaatggtgcttggcagga

SEQ ID NO: 5736299 - DNA, 19 bp, Homo sapiens
gaaggaatgtcagggccag

SEQ ID NO: 5736300 - DNA, 20 bp, Homo sapiens
gaaggaatttgattgctttg

SEQ ID NO: 5736301 - DNA, 17 bp, Homo sapiens
gaaggaatttgtacttc

SEQ ID NO: 5736302 - DNA, 15 bp, Homo sapiens
gaaggacacagcagt

SEQ ID NO: 5736303 - DNA, 19 bp, Homo sapiens
gaaggacacagtcaggggc

SEQ ID NO: 5736304 - DNA, 14 bp, Homo sapiens
gaaggacacagtga

SEQ ID NO: 5736305 - DNA, 24 bp, Homo sapiens
gaaggacacattgttttccagaag

SEQ ID NO: 5736306 - DNA, 15 bp, Homo sapiens
gaaggacagtccctg

SEQ ID NO: 5736307 - DNA, 13 bp, Homo sapiens
gaaggacatagag

SEQ ID NO: 5736308 - DNA, 22 bp, Homo sapiens
gaaggacatgagatcagggcct

SEQ ID NO: 5736309 - DNA, 15 bp, Homo sapiens
gaaggaccagccctt

SEQ ID NO: 5736310 - DNA, 12 bp, Homo sapiens
gaaggacccctc

SEQ ID NO: 5736311 - DNA, 14 bp, Homo sapiens
gaaggacccctcac

SEQ ID NO: 5736312 - DNA, 20 bp, Homo sapiens
gaaggacccctcaccacccc

SEQ ID NO: 5736313 - DNA, 21 bp, Homo sapiens
gaaggacccttcagaggtggc

SEQ ID NO: 5736314 - DNA, 17 bp, Homo sapiens
gaaggacctatgtttgc

SEQ ID NO: 5736315 - DNA, 13 bp, Homo sapiens
gaaggactacagg

SEQ ID NO: 5736316 - DNA, 19 bp, Homo sapiens
gaaggactcaacattacat

SEQ ID NO: 5736317 - DNA, 15 bp, Homo sapiens
gaaggactgaagaaa

SEQ ID NO: 5736318 - DNA, 19 bp, Homo sapiens
gaaggactgacgagagatg

SEQ ID NO: 5736319 - DNA, 15 bp, Homo sapiens
gaaggactgcagcca

SEQ ID NO: 5736320 - DNA, 17 bp, Homo sapiens
gaaggactggccgtggc

SEQ ID NO: 5736321 - DNA, 15 bp, Homo sapiens
gaaggactggtgcga

SEQ ID NO: 5736322 - DNA, 22 bp, Homo sapiens
gaaggactggtgcgacccccca

SEQ ID NO: 5736323 - DNA, 23 bp, Homo sapiens
gaaggactggtgcgaccccccac

SEQ ID NO: 5736324 - DNA, 18 bp, Homo sapiens
gaaggactgtgacaggca

SEQ ID NO: 5736325 - DNA, 22 bp, Homo sapiens
gaaggactgtgacaggcagcag

SEQ ID NO: 5736326 - DNA, 23 bp, Homo sapiens
gaaggactgtgacaggcagcaga

SEQ ID NO: 5736327 - DNA, 18 bp, Homo sapiens
gaaggactgtggctgcag

SEQ ID NO: 5736328 - DNA, 17 bp, Homo sapiens
gaaggacttagccgact

SEQ ID NO: 5736329 - DNA, 12 bp, Homo sapiens
gaaggagaaagg

SEQ ID NO: 5736330 - DNA, 18 bp, Homo sapiens
gaaggagaaatacccatg

SEQ ID NO: 5736331 - DNA, 17 bp, Homo sapiens
gaaggagaaggaaggag

SEQ ID NO: 5736332 - DNA, 18 bp, Homo sapiens
gaaggagaatcatcagga

SEQ ID NO: 5736333 - DNA, 12 bp, Homo sapiens
gaaggagaatgg

SEQ ID NO: 5736334 - DNA, 24 bp, Homo sapiens
gaaggagaatggcatggcaggagt

SEQ ID NO: 5736335 - DNA, 16 bp, Homo sapiens
gaaggagacaggcaga

SEQ ID NO: 5736336 - DNA, 15 bp, Homo sapiens
gaaggagactcacct

SEQ ID NO: 5736337 - DNA, 20 bp, Homo sapiens
gaaggagactcacctctgcc

SEQ ID NO: 5736338 - DNA, 22 bp, Homo sapiens
gaaggagactcacctctgcctc

SEQ ID NO: 5736339 - DNA, 16 bp, Homo sapiens
gaaggagagaaagtgg

SEQ ID NO: 5736340 - DNA, 16 bp, Homo sapiens
gaaggagagaagggga

SEQ ID NO: 5736341 - DNA, 19 bp, Homo sapiens
gaaggagagcaagaaggaa

SEQ ID NO: 5736342 - DNA, 13 bp, Homo sapiens
gaaggagagcctg

SEQ ID NO: 5736343 - DNA, 18 bp, Homo sapiens
gaaggagaggaaaatgtt

SEQ ID NO: 5736344 - DNA, 17 bp, Homo sapiens
gaaggagaggagtgcgc

SEQ ID NO: 5736345 - DNA, 23 bp, Homo sapiens
gaaggagataattactgccttga

SEQ ID NO: 5736346 - DNA, 13 bp, Homo sapiens
gaaggagatcagg

SEQ ID NO: 5736347 - DNA, 20 bp, Homo sapiens
gaaggagatgaatagaagaa

SEQ ID NO: 5736348 - DNA, 21 bp, Homo sapiens
gaaggagatgaatagaagaaa

SEQ ID NO: 5736349 - DNA, 21 bp, Homo sapiens
gaaggagatggagttatgagg

SEQ ID NO: 5736350 - DNA, 22 bp, Homo sapiens
gaaggagatgtaatgacagaga

SEQ ID NO: 5736351 - DNA, 14 bp, Homo sapiens
gaaggagcagaaag

SEQ ID NO: 5736352 - DNA, 22 bp, Homo sapiens
gaaggagcccagccagaaagca

SEQ ID NO: 5736353 - DNA, 17 bp, Homo sapiens
gaaggagcccctgagtc

SEQ ID NO: 5736354 - DNA, 13 bp, Homo sapiens
gaaggagcctgcg

SEQ ID NO: 5736355 - DNA, 19 bp, Homo sapiens
gaaggagcctgcggctgct

SEQ ID NO: 5736356 - DNA, 21 bp, Homo sapiens
gaaggagcctgcggctgctgg

SEQ ID NO: 5736357 - DNA, 19 bp, Homo sapiens
gaaggagcggcgccctgga

SEQ ID NO: 5736358 - DNA, 22 bp, Homo sapiens
gaaggagctcccaggaggggct

SEQ ID NO: 5736359 - DNA, 16 bp, Homo sapiens
gaaggagctgcctgga

SEQ ID NO: 5736360 - DNA, 17 bp, Homo sapiens
gaaggaggaagggactg

SEQ ID NO: 5736361 - DNA, 20 bp, Homo sapiens
gaaggaggaatgctggactg

SEQ ID NO: 5736362 - DNA, 19 bp, Homo sapiens
gaaggaggacccaggacag

SEQ ID NO: 5736363 - DNA, 10 bp, Homo sapiens
gaaggaggag

SEQ ID NO: 5736364 - DNA, 15 bp, Homo sapiens
gaaggaggagcctgt

SEQ ID NO: 5736365 - DNA, 22 bp, Homo sapiens
gaaggaggagcctgtcctgcct

SEQ ID NO: 5736366 - DNA, 19 bp, Homo sapiens
gaaggaggagggcgcccat

SEQ ID NO: 5736367 - DNA, 13 bp, Homo sapiens
gaaggaggcagac

SEQ ID NO: 5736368 - DNA, 15 bp, Homo sapiens
gaaggaggcagactg

SEQ ID NO: 5736369 - DNA, 21 bp, Homo sapiens
gaaggaggccaaccagcccga

SEQ ID NO: 5736370 - DNA, 19 bp, Homo sapiens
gaaggaggccactttgaga

SEQ ID NO: 5736371 - DNA, 18 bp, Homo sapiens
gaaggaggctccaggcag

SEQ ID NO: 5736372 - DNA, 19 bp, Homo sapiens
gaaggagggacttggctgt

SEQ ID NO: 5736373 - DNA, 21 bp, Homo sapiens
gaaggagggatgcgtgttcca

SEQ ID NO: 5736374 - DNA, 15 bp, Homo sapiens
gaaggagggcagagc

SEQ ID NO: 5736375 - DNA, 17 bp, Homo sapiens
gaaggaggggaagctgc

SEQ ID NO: 5736376 - DNA, 19 bp, Homo sapiens
gaaggaggggaagctgcag

SEQ ID NO: 5736377 - DNA, 19 bp, Homo sapiens
gaaggaggggagagacagg

SEQ ID NO: 5736378 - DNA, 20 bp, Homo sapiens
gaaggaggggagagacaggc

SEQ ID NO: 5736379 - DNA, 21 bp, Homo sapiens
gaaggaggggagagacaggca

SEQ ID NO: 5736380 - DNA, 22 bp, Homo sapiens
gaaggaggggagagacaggcag

SEQ ID NO: 5736381 - DNA, 23 bp, Homo sapiens
gaaggaggggagagacaggcagc

SEQ ID NO: 5736382 - DNA, 22 bp, Homo sapiens
gaaggagggggacaacccccca

SEQ ID NO: 5736383 - DNA, 19 bp, Homo sapiens
gaaggaggtaaaggatgag

SEQ ID NO: 5736384 - DNA, 20 bp, Homo sapiens
gaaggaggtaaaggatgagg

SEQ ID NO: 5736385 - DNA, 21 bp, Homo sapiens
gaaggaggtaaaggatgaggg

SEQ ID NO: 5736386 - DNA, 13 bp, Homo sapiens
gaaggaggtgagg

SEQ ID NO: 5736387 - DNA, 21 bp, Homo sapiens
gaaggagtgtatgagtgtgag

SEQ ID NO: 5736388 - DNA, 21 bp, Homo sapiens
gaaggataagagaaacaggcc

SEQ ID NO: 5736389 - DNA, 14 bp, Homo sapiens
gaaggatagcctca

SEQ ID NO: 5736390 - DNA, 10 bp, Homo sapiens
gaaggatccg

SEQ ID NO: 5736391 - DNA, 14 bp, Homo sapiens
gaaggatctgctga

SEQ ID NO: 5736392 - DNA, 22 bp, Homo sapiens
gaaggatctgctgaggcccagt

SEQ ID NO: 5736393 - DNA, 19 bp, Homo sapiens
gaaggatggatgagtcaga

SEQ ID NO: 5736394 - DNA, 13 bp, Homo sapiens
gaaggatgggaaa

SEQ ID NO: 5736395 - DNA, 23 bp, Homo sapiens
gaaggatgggggctcctggcagt

SEQ ID NO: 5736396 - DNA, 17 bp, Homo sapiens
gaaggatgtacatttcc

SEQ ID NO: 5736397 - DNA, 14 bp, Homo sapiens
gaaggattgcatcc

SEQ ID NO: 5736398 - DNA, 16 bp, Homo sapiens
gaaggattgcatcctg

SEQ ID NO: 5736399 - DNA, 17 bp, Homo sapiens
gaaggattgcatcctgc

SEQ ID NO: 5736400 - DNA, 18 bp, Homo sapiens
gaaggattgcatcctgct

SEQ ID NO: 5736401 - DNA, 19 bp, Homo sapiens
gaaggattgcatcctgctg

SEQ ID NO: 5736402 - DNA, 12 bp, Homo sapiens
gaaggatttctt

SEQ ID NO: 5736403 - DNA, 13 bp, Homo sapiens
gaaggatttgtgt

SEQ ID NO: 5736404 - DNA, 20 bp, Homo sapiens
gaaggattttaaatgctgta

SEQ ID NO: 5736405 - DNA, 19 bp, Homo sapiens
gaaggattttttaaagttt

SEQ ID NO: 5736406 - DNA, 12 bp, Homo sapiens
gaaggcaaaaaa

SEQ ID NO: 5736407 - DNA, 19 bp, Homo sapiens
gaaggcaaaaactgtactg

SEQ ID NO: 5736408 - DNA, 22 bp, Homo sapiens
gaaggcaaaaactgtactgtgt

SEQ ID NO: 5736409 - DNA, 23 bp, Homo sapiens
gaaggcaaatataagctgggaaa

SEQ ID NO: 5736410 - DNA, 13 bp, Homo sapiens
gaaggcaaatctc

SEQ ID NO: 5736411 - DNA, 19 bp, Homo sapiens
gaaggcaacttgaagaaac

SEQ ID NO: 5736412 - DNA, 16 bp, Homo sapiens
gaaggcaagccaggct

SEQ ID NO: 5736413 - DNA, 15 bp, Homo sapiens
gaaggcaagctggca

SEQ ID NO: 5736414 - DNA, 21 bp, Homo sapiens
gaaggcaataccaacctgaaa

SEQ ID NO: 5736415 - DNA, 15 bp, Homo sapiens
gaaggcacagctaac

SEQ ID NO: 5736416 - DNA, 21 bp, Homo sapiens
gaaggcacaggtgtaaatata

SEQ ID NO: 5736417 - DNA, 15 bp, Homo sapiens
gaaggcacccgccct

SEQ ID NO: 5736418 - DNA, 22 bp, Homo sapiens
gaaggcacctgcccccacagct

SEQ ID NO: 5736419 - DNA, 21 bp, Homo sapiens
gaaggcacctgctcccacaga

SEQ ID NO: 5736420 - DNA, 13 bp, Homo sapiens
gaaggcagacagc

SEQ ID NO: 5736421 - DNA, 15 bp, Homo sapiens
gaaggcagacagcag

SEQ ID NO: 5736422 - DNA, 13 bp, Homo sapiens
gaaggcagagaaa

SEQ ID NO: 5736423 - DNA, 12 bp, Homo sapiens
gaaggcagaggc

SEQ ID NO: 5736424 - DNA, 14 bp, Homo sapiens
gaaggcagaggctg

SEQ ID NO: 5736425 - DNA, 14 bp, Homo sapiens
gaaggcagctgctc

SEQ ID NO: 5736426 - DNA, 15 bp, Homo sapiens
gaaggcagctgctct

SEQ ID NO: 5736427 - DNA, 13 bp, Homo sapiens
gaaggcaggagtg

SEQ ID NO: 5736428 - DNA, 16 bp, Homo sapiens
gaaggcaggcagggct

SEQ ID NO: 5736429 - DNA, 17 bp, Homo sapiens
gaaggcaggcagggctc

SEQ ID NO: 5736430 - DNA, 18 bp, Homo sapiens
gaaggcaggcagggctct

SEQ ID NO: 5736431 - DNA, 15 bp, Homo sapiens
gaaggcaggcctccg

SEQ ID NO: 5736432 - DNA, 13 bp, Homo sapiens
gaaggcagggaaa

SEQ ID NO: 5736433 - DNA, 21 bp, Homo sapiens
gaaggcagggacagagatgga

SEQ ID NO: 5736434 - DNA, 18 bp, Homo sapiens
gaaggcagggaggaggca

SEQ ID NO: 5736435 - DNA, 20 bp, Homo sapiens
gaaggcagggaggaggcaga

SEQ ID NO: 5736436 - DNA, 14 bp, Homo sapiens
gaaggcagggaggg

SEQ ID NO: 5736437 - DNA, 13 bp, Homo sapiens
gaaggcagggcag

SEQ ID NO: 5736438 - DNA, 17 bp, Homo sapiens
gaaggcagggcagaggg

SEQ ID NO: 5736439 - DNA, 16 bp, Homo sapiens
gaaggcagggctcctc

SEQ ID NO: 5736440 - DNA, 19 bp, Homo sapiens
gaaggcagtggcaggggag

SEQ ID NO: 5736441 - DNA, 21 bp, Homo sapiens
gaaggcagtggcaggggagca

SEQ ID NO: 5736442 - DNA, 21 bp, Homo sapiens
gaaggcatatcagtctctgag

SEQ ID NO: 5736443 - DNA, 16 bp, Homo sapiens
gaaggcatgagaaaga

SEQ ID NO: 5736444 - DNA, 18 bp, Homo sapiens
gaaggcatgcctggacaa

SEQ ID NO: 5736445 - DNA, 20 bp, Homo sapiens
gaaggcatggacttctggat

SEQ ID NO: 5736446 - DNA, 20 bp, Homo sapiens
gaaggcattggcatctgctt

SEQ ID NO: 5736447 - DNA, 21 bp, Homo sapiens
gaaggcattggcatctgcttt

SEQ ID NO: 5736448 - DNA, 22 bp, Homo sapiens
gaaggcattggcatctgctttt

SEQ ID NO: 5736449 - DNA, 19 bp, Homo sapiens
gaaggcatttgcagggtcc

SEQ ID NO: 5736450 - DNA, 19 bp, Homo sapiens
gaaggccaaaatcaagagt

SEQ ID NO: 5736451 - DNA, 18 bp, Homo sapiens
gaaggccacaggccactg

SEQ ID NO: 5736452 - DNA, 14 bp, Homo sapiens
gaaggccacctgca

SEQ ID NO: 5736453 - DNA, 13 bp, Homo sapiens
gaaggccagagag

SEQ ID NO: 5736454 - DNA, 16 bp, Homo sapiens
gaaggccagcaacatt

SEQ ID NO: 5736455 - DNA, 14 bp, Homo sapiens
gaaggccagcccac

SEQ ID NO: 5736456 - DNA, 18 bp, Homo sapiens
gaaggccagcccactggg

SEQ ID NO: 5736457 - DNA, 20 bp, Homo sapiens
gaaggccagccctccctggc

SEQ ID NO: 5736458 - DNA, 22 bp, Homo sapiens
gaaggcccaactggttcaggct

SEQ ID NO: 5736459 - DNA, 12 bp, Homo sapiens
gaaggcccaggg

SEQ ID NO: 5736460 - DNA, 14 bp, Homo sapiens
gaaggcccaggggt

SEQ ID NO: 5736461 - DNA, 11 bp, Homo sapiens
gaaggccccag

SEQ ID NO: 5736462 - DNA, 18 bp, Homo sapiens
gaaggccccagagagacc

SEQ ID NO: 5736463 - DNA, 15 bp, Homo sapiens
gaaggccccttccct

SEQ ID NO: 5736464 - DNA, 18 bp, Homo sapiens
gaaggccctgctgagtca

SEQ ID NO: 5736465 - DNA, 22 bp, Homo sapiens
gaaggcccttaactatcaccag

SEQ ID NO: 5736466 - DNA, 17 bp, Homo sapiens
gaaggccgagaagcaag

SEQ ID NO: 5736467 - DNA, 22 bp, Homo sapiens
gaaggccgagaagcaagaaaga

SEQ ID NO: 5736468 - DNA, 20 bp, Homo sapiens
gaaggcctcactcaagcctg

SEQ ID NO: 5736469 - DNA, 23 bp, Homo sapiens
gaaggcctcactcaagcctgaga

SEQ ID NO: 5736470 - DNA, 13 bp, Homo sapiens
gaaggcctcccct

SEQ ID NO: 5736471 - DNA, 14 bp, Homo sapiens
gaaggcctcgcagg

SEQ ID NO: 5736472 - DNA, 12 bp, Homo sapiens
gaaggcctcttg

SEQ ID NO: 5736473 - DNA, 21 bp, Homo sapiens
gaaggcctcttgtgctcacgc

SEQ ID NO: 5736474 - DNA, 12 bp, Homo sapiens
gaaggcctgagg

SEQ ID NO: 5736475 - DNA, 22 bp, Homo sapiens
gaaggcctgagggaagcccacc

SEQ ID NO: 5736476 - DNA, 20 bp, Homo sapiens
gaaggccttacagaaaattg

SEQ ID NO: 5736477 - DNA, 13 bp, Homo sapiens
gaaggccttgctg

SEQ ID NO: 5736478 - DNA, 15 bp, Homo sapiens
gaaggccttgctgtc

SEQ ID NO: 5736479 - DNA, 16 bp, Homo sapiens
gaaggccttgctgtca

SEQ ID NO: 5736480 - DNA, 17 bp, Homo sapiens
gaaggccttgctgtcat

SEQ ID NO: 5736481 - DNA, 15 bp, Homo sapiens
gaaggcctttcttct

SEQ ID NO: 5736482 - DNA, 14 bp, Homo sapiens
gaaggcgaggagag

SEQ ID NO: 5736483 - DNA, 16 bp, Homo sapiens
gaaggcgatgtggtga

SEQ ID NO: 5736484 - DNA, 22 bp, Homo sapiens
gaaggcgctgggtgcctgcagc

SEQ ID NO: 5736485 - DNA, 16 bp, Homo sapiens
gaaggcggcaggcaga

SEQ ID NO: 5736486 - DNA, 21 bp, Homo sapiens
gaaggctaagcatggcctgga

SEQ ID NO: 5736487 - DNA, 17 bp, Homo sapiens
gaaggctccggggtgac

SEQ ID NO: 5736488 - DNA, 17 bp, Homo sapiens
gaaggctcgagcatgcc

SEQ ID NO: 5736489 - DNA, 19 bp, Homo sapiens
gaaggctcgagcatgcctg

SEQ ID NO: 5736490 - DNA, 21 bp, Homo sapiens
gaaggctcgagcatgcctgga

SEQ ID NO: 5736491 - DNA, 20 bp, Homo sapiens
gaaggctctatctgctgggc

SEQ ID NO: 5736492 - DNA, 14 bp, Homo sapiens
gaaggctctctggt

SEQ ID NO: 5736493 - DNA, 21 bp, Homo sapiens
gaaggctcttctccccagagt

SEQ ID NO: 5736494 - DNA, 19 bp, Homo sapiens
gaaggctggaaggcagcag

SEQ ID NO: 5736495 - DNA, 13 bp, Homo sapiens
gaaggctggctga

SEQ ID NO: 5736496 - DNA, 14 bp, Homo sapiens
gaaggctggctgag

SEQ ID NO: 5736497 - DNA, 16 bp, Homo sapiens
gaaggctggctgggca

SEQ ID NO: 5736498 - DNA, 18 bp, Homo sapiens
gaaggctgggtccagggg

SEQ ID NO: 5736499 - DNA, 19 bp, Homo sapiens
gaaggctgggttctgatcc

SEQ ID NO: 5736500 - DNA, 12 bp, Homo sapiens
gaaggctgtcct

SEQ ID NO: 5736501 - DNA, 17 bp, Homo sapiens
gaaggctgtccttaccc

SEQ ID NO: 5736502 - DNA, 23 bp, Homo sapiens
gaaggctgtgtgtcttctgcccc

SEQ ID NO: 5736503 - DNA, 14 bp, Homo sapiens
gaaggcttctctcc

SEQ ID NO: 5736504 - DNA, 15 bp, Homo sapiens
gaaggcttctgcagc

SEQ ID NO: 5736505 - DNA, 20 bp, Homo sapiens
gaaggcttgggatttgctgt

SEQ ID NO: 5736506 - DNA, 20 bp, Homo sapiens
gaaggcttgttgtgctttta

SEQ ID NO: 5736507 - DNA, 17 bp, Homo sapiens
gaaggctttcagggcct

SEQ ID NO: 5736508 - DNA, 23 bp, Homo sapiens
gaaggctttcagggcctccagcc

SEQ ID NO: 5736509 - DNA, 12 bp, Homo sapiens
gaaggctttgtg

SEQ ID NO: 5736510 - DNA, 17 bp, Homo sapiens
gaaggcttttggtctcc

SEQ ID NO: 5736511 - DNA, 14 bp, Homo sapiens
gaaggcttttttaa

SEQ ID NO: 5736512 - DNA, 16 bp, Homo sapiens
gaagggaaacaaagaa

SEQ ID NO: 5736513 - DNA, 14 bp, Homo sapiens
gaagggaaagtttt

SEQ ID NO: 5736514 - DNA, 22 bp, Homo sapiens
gaagggaacccccaaatttaat

SEQ ID NO: 5736515 - DNA, 17 bp, Homo sapiens
gaagggaagaaggggcc

SEQ ID NO: 5736516 - DNA, 17 bp, Homo sapiens
gaagggaataaggtaca

SEQ ID NO: 5736517 - DNA, 20 bp, Homo sapiens
gaagggaccaaggcaaggca

SEQ ID NO: 5736518 - DNA, 18 bp, Homo sapiens
gaagggaccttgaagggt

SEQ ID NO: 5736519 - DNA, 14 bp, Homo sapiens
gaagggactctggg

SEQ ID NO: 5736520 - DNA, 20 bp, Homo sapiens
gaagggactctgggctgtgc

SEQ ID NO: 5736521 - DNA, 14 bp, Homo sapiens
gaagggactgagag

SEQ ID NO: 5736522 - DNA, 22 bp, Homo sapiens
gaagggagaagacactgcagtg

SEQ ID NO: 5736523 - DNA, 15 bp, Homo sapiens
gaagggagcagcaca

SEQ ID NO: 5736524 - DNA, 23 bp, Homo sapiens
gaagggagccaagggatggacat

SEQ ID NO: 5736525 - DNA, 13 bp, Homo sapiens
gaagggagctgag

SEQ ID NO: 5736526 - DNA, 18 bp, Homo sapiens
gaagggaggaaggccttt

SEQ ID NO: 5736527 - DNA, 13 bp, Homo sapiens
gaagggaggcctg

SEQ ID NO: 5736528 - DNA, 14 bp, Homo sapiens
gaagggaggcctga

SEQ ID NO: 5736529 - DNA, 20 bp, Homo sapiens
gaagggagggagctgaggcc

SEQ ID NO: 5736530 - DNA, 16 bp, Homo sapiens
gaagggagggcagagc

SEQ ID NO: 5736531 - DNA, 21 bp, Homo sapiens
gaagggagggcagagctggtg

SEQ ID NO: 5736532 - DNA, 21 bp, Homo sapiens
gaagggaggggaagagagagg

SEQ ID NO: 5736533 - DNA, 16 bp, Homo sapiens
gaagggaggtctcctc

SEQ ID NO: 5736534 - DNA, 23 bp, Homo sapiens
gaagggaggttcacctgcagcga

SEQ ID NO: 5736535 - DNA, 23 bp, Homo sapiens
gaagggagttgctcactcaggac

SEQ ID NO: 5736536 - DNA, 17 bp, Homo sapiens
gaagggatggattccaa

SEQ ID NO: 5736537 - DNA, 20 bp, Homo sapiens
gaagggattttagtcacacg

SEQ ID NO: 5736538 - DNA, 14 bp, Homo sapiens
gaagggcaccgaga

SEQ ID NO: 5736539 - DNA, 23 bp, Homo sapiens
gaagggcaggaaggagagcctgc

SEQ ID NO: 5736540 - DNA, 22 bp, Homo sapiens
gaagggcatgggctagaagagg

SEQ ID NO: 5736541 - DNA, 18 bp, Homo sapiens
gaagggccaccctgagca

SEQ ID NO: 5736542 - DNA, 14 bp, Homo sapiens
gaagggccagagcc

SEQ ID NO: 5736543 - DNA, 16 bp, Homo sapiens
gaagggccagagccag

SEQ ID NO: 5736544 - DNA, 13 bp, Homo sapiens
gaagggccagccc

SEQ ID NO: 5736545 - DNA, 15 bp, Homo sapiens
gaagggccaggagag

SEQ ID NO: 5736546 - DNA, 21 bp, Homo sapiens
gaagggccaggagagagatct

SEQ ID NO: 5736547 - DNA, 18 bp, Homo sapiens
gaagggccagtcctgcct

SEQ ID NO: 5736548 - DNA, 22 bp, Homo sapiens
gaagggccagtcctgcctggcc

SEQ ID NO: 5736549 - DNA, 18 bp, Homo sapiens
gaagggccagtctgggct

SEQ ID NO: 5736550 - DNA, 21 bp, Homo sapiens
gaagggcccttcactgccttt

SEQ ID NO: 5736551 - DNA, 22 bp, Homo sapiens
gaagggcctgcccagttgcact

SEQ ID NO: 5736552 - DNA, 15 bp, Homo sapiens
gaagggcctgctctg

SEQ ID NO: 5736553 - DNA, 16 bp, Homo sapiens
gaagggcctgctctgc

SEQ ID NO: 5736554 - DNA, 19 bp, Homo sapiens
gaagggccttgagcatctg

SEQ ID NO: 5736555 - DNA, 22 bp, Homo sapiens
gaagggccttgagcatctggat

SEQ ID NO: 5736556 - DNA, 19 bp, Homo sapiens
gaagggctcagagaggaca

SEQ ID NO: 5736557 - DNA, 13 bp, Homo sapiens
gaagggctgcatg

SEQ ID NO: 5736558 - DNA, 23 bp, Homo sapiens
gaagggctggggccggggctgag

SEQ ID NO: 5736559 - DNA, 20 bp, Homo sapiens
gaaggggaaaaatgggaaat

SEQ ID NO: 5736560 - DNA, 19 bp, Homo sapiens
gaaggggaagcactcgtgt

SEQ ID NO: 5736561 - DNA, 16 bp, Homo sapiens
gaaggggaatgtgtcc

SEQ ID NO: 5736562 - DNA, 23 bp, Homo sapiens
gaaggggaatgtgtcctcctgct

SEQ ID NO: 5736563 - DNA, 19 bp, Homo sapiens
gaaggggacagcgccacct

SEQ ID NO: 5736564 - DNA, 21 bp, Homo sapiens
gaaggggacccccgccccctg

SEQ ID NO: 5736565 - DNA, 22 bp, Homo sapiens
gaaggggagataagggtatctg

SEQ ID NO: 5736566 - DNA, 12 bp, Homo sapiens
gaaggggagctt

SEQ ID NO: 5736567 - DNA, 22 bp, Homo sapiens
gaaggggaggacctctgggctt

SEQ ID NO: 5736568 - DNA, 16 bp, Homo sapiens
gaaggggaggcacact

SEQ ID NO: 5736569 - DNA, 14 bp, Homo sapiens
gaaggggagtgagc

SEQ ID NO: 5736570 - DNA, 16 bp, Homo sapiens
gaaggggatggaggcc

SEQ ID NO: 5736571 - DNA, 17 bp, Homo sapiens
gaaggggatggaggcca

SEQ ID NO: 5736572 - DNA, 19 bp, Homo sapiens
gaaggggatggaggccaga

SEQ ID NO: 5736573 - DNA, 20 bp, Homo sapiens
gaaggggatggaggccagag

SEQ ID NO: 5736574 - DNA, 23 bp, Homo sapiens
gaaggggcaaattcttttgaatt

SEQ ID NO: 5736575 - DNA, 13 bp, Homo sapiens
gaaggggcacacc

SEQ ID NO: 5736576 - DNA, 22 bp, Homo sapiens
gaaggggcacaccactgccctg

SEQ ID NO: 5736577 - DNA, 19 bp, Homo sapiens
gaaggggcacgcctgccca

SEQ ID NO: 5736578 - DNA, 15 bp, Homo sapiens
gaaggggcagcagga

SEQ ID NO: 5736579 - DNA, 15 bp, Homo sapiens
gaaggggcccaaggt

SEQ ID NO: 5736580 - DNA, 18 bp, Homo sapiens
gaaggggccccatggcag

SEQ ID NO: 5736581 - DNA, 20 bp, Homo sapiens
gaaggggccccggggctggc

SEQ ID NO: 5736582 - DNA, 22 bp, Homo sapiens
gaaggggcctcaccgagtgggg

SEQ ID NO: 5736583 - DNA, 14 bp, Homo sapiens
gaaggggcctccct

SEQ ID NO: 5736584 - DNA, 13 bp, Homo sapiens
gaaggggcctggg

SEQ ID NO: 5736585 - DNA, 21 bp, Homo sapiens
gaaggggcctgggctgtgagg

SEQ ID NO: 5736586 - DNA, 23 bp, Homo sapiens
gaaggggctcttcatctgcctgc

SEQ ID NO: 5736587 - DNA, 17 bp, Homo sapiens
gaaggggctgaggacga

SEQ ID NO: 5736588 - DNA, 11 bp, Homo sapiens
gaaggggctgg

SEQ ID NO: 5736589 - DNA, 12 bp, Homo sapiens
gaaggggctggt

SEQ ID NO: 5736590 - DNA, 13 bp, Homo sapiens
gaaggggctggtg

SEQ ID NO: 5736591 - DNA, 19 bp, Homo sapiens
gaaggggcttctaatgacc

SEQ ID NO: 5736592 - DNA, 21 bp, Homo sapiens
gaagggggaacgcaagaggca

SEQ ID NO: 5736593 - DNA, 19 bp, Homo sapiens
gaagggggacgtttctgga

SEQ ID NO: 5736594 - DNA, 15 bp, Homo sapiens
gaagggggaggagtc

SEQ ID NO: 5736595 - DNA, 18 bp, Homo sapiens
gaagggggagtgaaacag

SEQ ID NO: 5736596 - DNA, 20 bp, Homo sapiens
gaagggggccatgaggcctc

SEQ ID NO: 5736597 - DNA, 20 bp, Homo sapiens
gaagggggccctgctacctg

SEQ ID NO: 5736598 - DNA, 19 bp, Homo sapiens
gaagggggctcttttactg

SEQ ID NO: 5736599 - DNA, 19 bp, Homo sapiens
gaagggggggctacattat

SEQ ID NO: 5736600 - DNA, 20 bp, Homo sapiens
gaagggggggctacattata

SEQ ID NO: 5736601 - DNA, 18 bp, Homo sapiens
gaaggggggttgcagtgg

SEQ ID NO: 5736602 - DNA, 17 bp, Homo sapiens
gaagggggtccacccag

SEQ ID NO: 5736603 - DNA, 22 bp, Homo sapiens
gaagggggtgcaaagactctga

SEQ ID NO: 5736604 - DNA, 16 bp, Homo sapiens
gaagggggtgggggga

SEQ ID NO: 5736605 - DNA, 15 bp, Homo sapiens
gaagggggttgtggc

SEQ ID NO: 5736606 - DNA, 16 bp, Homo sapiens
gaagggggttgtggca

SEQ ID NO: 5736607 - DNA, 17 bp, Homo sapiens
gaaggggtcctgcaggg

SEQ ID NO: 5736608 - DNA, 19 bp, Homo sapiens
gaaggggtcctgcaggggg

SEQ ID NO: 5736609 - DNA, 21 bp, Homo sapiens
gaaggggtcctgcagggggag

SEQ ID NO: 5736610 - DNA, 15 bp, Homo sapiens
gaaggggtgccctct

SEQ ID NO: 5736611 - DNA, 15 bp, Homo sapiens
gaaggggtgctgtga

SEQ ID NO: 5736612 - DNA, 17 bp, Homo sapiens
gaaggggtgggagccaa

SEQ ID NO: 5736613 - DNA, 13 bp, Homo sapiens
gaagggtaaacaa

SEQ ID NO: 5736614 - DNA, 15 bp, Homo sapiens
gaagggtagctgggc

SEQ ID NO: 5736615 - DNA, 14 bp, Homo sapiens
gaagggtccaccct

SEQ ID NO: 5736616 - DNA, 14 bp, Homo sapiens
gaagggtccttccc

SEQ ID NO: 5736617 - DNA, 23 bp, Homo sapiens
gaagggtctctctccaggtcagc

SEQ ID NO: 5736618 - DNA, 15 bp, Homo sapiens
gaagggtgacatccc

SEQ ID NO: 5736619 - DNA, 15 bp, Homo sapiens
gaagggtgcatagct

SEQ ID NO: 5736620 - DNA, 13 bp, Homo sapiens
gaagggtgcctgg

SEQ ID NO: 5736621 - DNA, 18 bp, Homo sapiens
gaagggtgcctggctggg

SEQ ID NO: 5736622 - DNA, 22 bp, Homo sapiens
gaagggtgggaagcttgctggc

SEQ ID NO: 5736623 - DNA, 21 bp, Homo sapiens
gaagggtgggaagggataatt

SEQ ID NO: 5736624 - DNA, 22 bp, Homo sapiens
gaagggtgggaagggataattt

SEQ ID NO: 5736625 - DNA, 15 bp, Homo sapiens
gaagggtgggagtgg

SEQ ID NO: 5736626 - DNA, 15 bp, Homo sapiens
gaagggtgggccctg

SEQ ID NO: 5736627 - DNA, 18 bp, Homo sapiens
gaagggtgggccctggag

SEQ ID NO: 5736628 - DNA, 20 bp, Homo sapiens
gaagggtgggccctggaggg

SEQ ID NO: 5736629 - DNA, 15 bp, Homo sapiens
gaagggtggggagaa

SEQ ID NO: 5736630 - DNA, 22 bp, Homo sapiens
gaagggtggtctgagcaccccc

SEQ ID NO: 5736631 - DNA, 23 bp, Homo sapiens
gaagggttagacaagcctggagg

SEQ ID NO: 5736632 - DNA, 15 bp, Homo sapiens
gaagggttctgccct

SEQ ID NO: 5736633 - DNA, 17 bp, Homo sapiens
gaagggttctgccctgc

SEQ ID NO: 5736634 - DNA, 22 bp, Homo sapiens
gaagggttctgccctgcctgag

SEQ ID NO: 5736635 - DNA, 18 bp, Homo sapiens
gaagggttggtgggctgg

SEQ ID NO: 5736636 - DNA, 16 bp, Homo sapiens
gaagggtttctctatt

SEQ ID NO: 5736637 - DNA, 20 bp, Homo sapiens
gaagggttttccaccctgga

SEQ ID NO: 5736638 - DNA, 18 bp, Homo sapiens
gaaggtaaaaacccagcg

SEQ ID NO: 5736639 - DNA, 13 bp, Homo sapiens
gaaggtaaaattg

SEQ ID NO: 5736640 - DNA, 18 bp, Homo sapiens
gaaggtaaagggacactg

SEQ ID NO: 5736641 - DNA, 13 bp, Homo sapiens
gaaggtaaataaa

SEQ ID NO: 5736642 - DNA, 22 bp, Homo sapiens
gaaggtaaataaaaagaaaggc

SEQ ID NO: 5736643 - DNA, 14 bp, Homo sapiens
gaaggtaataaata

SEQ ID NO: 5736644 - DNA, 14 bp, Homo sapiens
gaaggtaattaaag

SEQ ID NO: 5736645 - DNA, 17 bp, Homo sapiens
gaaggtagaatgttttc

SEQ ID NO: 5736646 - DNA, 22 bp, Homo sapiens
gaaggtagattttaagaatggt

SEQ ID NO: 5736647 - DNA, 16 bp, Homo sapiens
gaaggtagcccagcac

SEQ ID NO: 5736648 - DNA, 18 bp, Homo sapiens
gaaggtagcccagcactg

SEQ ID NO: 5736649 - DNA, 20 bp, Homo sapiens
gaaggtatatctaggtttat

SEQ ID NO: 5736650 - DNA, 20 bp, Homo sapiens
gaaggtatcagttatatgat

SEQ ID NO: 5736651 - DNA, 17 bp, Homo sapiens
gaaggtattagcaaagc

SEQ ID NO: 5736652 - DNA, 19 bp, Homo sapiens
gaaggtattggctgaactg

SEQ ID NO: 5736653 - DNA, 16 bp, Homo sapiens
gaaggtatttttgaag

SEQ ID NO: 5736654 - DNA, 15 bp, Homo sapiens
gaaggtcaataaatt

SEQ ID NO: 5736655 - DNA, 14 bp, Homo sapiens
gaaggtcacagaag

SEQ ID NO: 5736656 - DNA, 17 bp, Homo sapiens
gaaggtcacctgagccc

SEQ ID NO: 5736657 - DNA, 18 bp, Homo sapiens
gaaggtcacgctgaatga

SEQ ID NO: 5736658 - DNA, 16 bp, Homo sapiens
gaaggtcataagtttc

SEQ ID NO: 5736659 - DNA, 15 bp, Homo sapiens
gaaggtcatttccat

SEQ ID NO: 5736660 - DNA, 15 bp, Homo sapiens
gaaggtcccacagcc

SEQ ID NO: 5736661 - DNA, 18 bp, Homo sapiens
gaaggtcccatggcctgc

SEQ ID NO: 5736662 - DNA, 15 bp, Homo sapiens
gaaggtcccctggca

SEQ ID NO: 5736663 - DNA, 17 bp, Homo sapiens
gaaggtcccctggcagt

SEQ ID NO: 5736664 - DNA, 16 bp, Homo sapiens
gaaggtcctgctatta

SEQ ID NO: 5736665 - DNA, 18 bp, Homo sapiens
gaaggtcggaggcttggg

SEQ ID NO: 5736666 - DNA, 16 bp, Homo sapiens
gaaggtctcatgcctg

SEQ ID NO: 5736667 - DNA, 18 bp, Homo sapiens
gaaggtctcatgcctgag

SEQ ID NO: 5736668 - DNA, 18 bp, Homo sapiens
gaaggtctctctggctct

SEQ ID NO: 5736669 - DNA, 17 bp, Homo sapiens
gaaggtctgatttgcag

SEQ ID NO: 5736670 - DNA, 13 bp, Homo sapiens
gaaggtctgggtc

SEQ ID NO: 5736671 - DNA, 19 bp, Homo sapiens
gaaggtctgttttgtgtac

SEQ ID NO: 5736672 - DNA, 15 bp, Homo sapiens
gaaggtcttgatttg

SEQ ID NO: 5736673 - DNA, 24 bp, Homo sapiens
gaaggtgaccgcccagctctccca

SEQ ID NO: 5736674 - DNA, 17 bp, Homo sapiens
gaaggtgagatggccag

SEQ ID NO: 5736675 - DNA, 21 bp, Homo sapiens
gaaggtgcatctttccctgcc

SEQ ID NO: 5736676 - DNA, 18 bp, Homo sapiens
gaaggtgccagaaggaag

SEQ ID NO: 5736677 - DNA, 19 bp, Homo sapiens
gaaggtgccagaaggaagg

SEQ ID NO: 5736678 - DNA, 14 bp, Homo sapiens
gaaggtgcctcaga

SEQ ID NO: 5736679 - DNA, 22 bp, Homo sapiens
gaaggtgcctcagactccgccc

SEQ ID NO: 5736680 - DNA, 20 bp, Homo sapiens
gaaggtgcctgccatagcca

SEQ ID NO: 5736681 - DNA, 13 bp, Homo sapiens
gaaggtgctgcca

SEQ ID NO: 5736682 - DNA, 16 bp, Homo sapiens
gaaggtgctggaggtg

SEQ ID NO: 5736683 - DNA, 20 bp, Homo sapiens
gaaggtggaccagaatgaaa

SEQ ID NO: 5736684 - DNA, 15 bp, Homo sapiens
gaaggtggacctggc

SEQ ID NO: 5736685 - DNA, 16 bp, Homo sapiens
gaaggtggacctggca

SEQ ID NO: 5736686 - DNA, 23 bp, Homo sapiens
gaaggtggaccttttaaagtgtt

SEQ ID NO: 5736687 - DNA, 18 bp, Homo sapiens
gaaggtggccacagcaag

SEQ ID NO: 5736688 - DNA, 13 bp, Homo sapiens
gaaggtggggccc

SEQ ID NO: 5736689 - DNA, 18 bp, Homo sapiens
gaaggtggggccctgccc

SEQ ID NO: 5736690 - DNA, 21 bp, Homo sapiens
gaaggtggggccctgccccta

SEQ ID NO: 5736691 - DNA, 21 bp, Homo sapiens
gaaggtgggtgaggctgggca

SEQ ID NO: 5736692 - DNA, 13 bp, Homo sapiens
gaaggtggtctgc

SEQ ID NO: 5736693 - DNA, 15 bp, Homo sapiens
gaaggtggtctgcac

SEQ ID NO: 5736694 - DNA, 17 bp, Homo sapiens
gaaggtggtggggctgc

SEQ ID NO: 5736695 - DNA, 23 bp, Homo sapiens
gaaggtgtccaaatttaatgtag

SEQ ID NO: 5736696 - DNA, 12 bp, Homo sapiens
gaaggtgtgcta

SEQ ID NO: 5736697 - DNA, 16 bp, Homo sapiens
gaaggtgtttaaagag

SEQ ID NO: 5736698 - DNA, 17 bp, Homo sapiens
gaaggtgtttaaagagt

SEQ ID NO: 5736699 - DNA, 15 bp, Homo sapiens
gaaggttaaaggaaa

SEQ ID NO: 5736700 - DNA, 23 bp, Homo sapiens
gaaggttagaggtttgtcaacaa

SEQ ID NO: 5736701 - DNA, 20 bp, Homo sapiens
gaaggttatcagtgcttccc

SEQ ID NO: 5736702 - DNA, 19 bp, Homo sapiens
gaaggttcatgtagagaaa

SEQ ID NO: 5736703 - DNA, 14 bp, Homo sapiens
gaaggttccatgaa

SEQ ID NO: 5736704 - DNA, 12 bp, Homo sapiens
gaaggttcctga

SEQ ID NO: 5736705 - DNA, 16 bp, Homo sapiens
gaaggttctggtgtga

SEQ ID NO: 5736706 - DNA, 13 bp, Homo sapiens
gaaggttcttctt

SEQ ID NO: 5736707 - DNA, 13 bp, Homo sapiens
gaaggttgaagag

SEQ ID NO: 5736708 - DNA, 15 bp, Homo sapiens
gaaggttgctgtggg

SEQ ID NO: 5736709 - DNA, 12 bp, Homo sapiens
gaaggttgtaag

SEQ ID NO: 5736710 - DNA, 21 bp, Homo sapiens
gaaggtttgatgccaaagcag

SEQ ID NO: 5736711 - DNA, 23 bp, Homo sapiens
gaaggtttgcggatgagggcatg

SEQ ID NO: 5736712 - DNA, 19 bp, Homo sapiens
gaaggtttttgtaaagatt

SEQ ID NO: 5736713 - DNA, 16 bp, Homo sapiens
gaagtaaaacagtcat

SEQ ID NO: 5736714 - DNA, 23 bp, Homo sapiens
gaagtaaaaccttttttcttgct

SEQ ID NO: 5736715 - DNA, 20 bp, Homo sapiens
gaagtaaactggatactgta

SEQ ID NO: 5736716 - DNA, 19 bp, Homo sapiens
gaagtaaagccattaaatg

SEQ ID NO: 5736717 - DNA, 12 bp, Homo sapiens
gaagtaaagcct

SEQ ID NO: 5736718 - DNA, 18 bp, Homo sapiens
gaagtaaagtttatttca

SEQ ID NO: 5736719 - DNA, 20 bp, Homo sapiens
gaagtaaattaaacattttt

SEQ ID NO: 5736720 - DNA, 22 bp, Homo sapiens
gaagtaaattaaacatttttca

SEQ ID NO: 5736721 - DNA, 15 bp, Homo sapiens
gaagtaacagacaca

SEQ ID NO: 5736722 - DNA, 18 bp, Homo sapiens
gaagtaactcccactcct

SEQ ID NO: 5736723 - DNA, 12 bp, Homo sapiens
gaagtaacttat

SEQ ID NO: 5736724 - DNA, 16 bp, Homo sapiens
gaagtaacttttacaa

SEQ ID NO: 5736725 - DNA, 13 bp, Homo sapiens
gaagtaagaagag

SEQ ID NO: 5736726 - DNA, 20 bp, Homo sapiens
gaagtaagaagaggagcctc

SEQ ID NO: 5736727 - DNA, 22 bp, Homo sapiens
gaagtaagatgtaaattgaaga

SEQ ID NO: 5736728 - DNA, 17 bp, Homo sapiens
gaagtaagttcatcaaa

SEQ ID NO: 5736729 - DNA, 22 bp, Homo sapiens
gaagtaatatgcacacattttt

SEQ ID NO: 5736730 - DNA, 13 bp, Homo sapiens
gaagtaatgaatt

SEQ ID NO: 5736731 - DNA, 15 bp, Homo sapiens
gaagtaatgacagat

SEQ ID NO: 5736732 - DNA, 23 bp, Homo sapiens
gaagtaattaaggtacatcatta

SEQ ID NO: 5736733 - DNA, 19 bp, Homo sapiens
gaagtaattttcttctcat

SEQ ID NO: 5736734 - DNA, 16 bp, Homo sapiens
gaagtacaaacatgaa

SEQ ID NO: 5736735 - DNA, 17 bp, Homo sapiens
gaagtacaaacatgaaa

SEQ ID NO: 5736736 - DNA, 17 bp, Homo sapiens
gaagtacaataagcaga

SEQ ID NO: 5736737 - DNA, 16 bp, Homo sapiens
gaagtacacctgtgtg

SEQ ID NO: 5736738 - DNA, 14 bp, Homo sapiens
gaagtacagggcag

SEQ ID NO: 5736739 - DNA, 19 bp, Homo sapiens
gaagtacagtagtttccct

SEQ ID NO: 5736740 - DNA, 16 bp, Homo sapiens
gaagtacatgaataca

SEQ ID NO: 5736741 - DNA, 16 bp, Homo sapiens
gaagtaccttatcaaa

SEQ ID NO: 5736742 - DNA, 23 bp, Homo sapiens
gaagtacgaatcttatttttcct

SEQ ID NO: 5736743 - DNA, 22 bp, Homo sapiens
gaagtacgtttttgcattattc

SEQ ID NO: 5736744 - DNA, 22 bp, Homo sapiens
gaagtacttggcccccttcagg

SEQ ID NO: 5736745 - DNA, 19 bp, Homo sapiens
gaagtacttttctgttcat

SEQ ID NO: 5736746 - DNA, 13 bp, Homo sapiens
gaagtagcctctt

SEQ ID NO: 5736747 - DNA, 18 bp, Homo sapiens
gaagtaggaaggaaaaaa

SEQ ID NO: 5736748 - DNA, 17 bp, Homo sapiens
gaagtaggaggaaacag

SEQ ID NO: 5736749 - DNA, 17 bp, Homo sapiens
gaagtaggttctgtttt

SEQ ID NO: 5736750 - DNA, 23 bp, Homo sapiens
gaagtagtggagcccctgctctg

SEQ ID NO: 5736751 - DNA, 22 bp, Homo sapiens
gaagtagtgtgagtgttagaaa

SEQ ID NO: 5736752 - DNA, 14 bp, Homo sapiens
gaagtagttatcat

SEQ ID NO: 5736753 - DNA, 18 bp, Homo sapiens
gaagtagttatcatgtta

SEQ ID NO: 5736754 - DNA, 15 bp, Homo sapiens
gaagtagttctgttt

SEQ ID NO: 5736755 - DNA, 19 bp, Homo sapiens
gaagtagtttgtataactt

SEQ ID NO: 5736756 - DNA, 20 bp, Homo sapiens
gaagtagttttgttcatgaa

SEQ ID NO: 5736757 - DNA, 17 bp, Homo sapiens
gaagtatacatttagtt

SEQ ID NO: 5736758 - DNA, 14 bp, Homo sapiens
gaagtatacctgat

SEQ ID NO: 5736759 - DNA, 17 bp, Homo sapiens
gaagtatcagcactaga

SEQ ID NO: 5736760 - DNA, 13 bp, Homo sapiens
gaagtatccaatt

SEQ ID NO: 5736761 - DNA, 20 bp, Homo sapiens
gaagtatccaattatgtgac

SEQ ID NO: 5736762 - DNA, 19 bp, Homo sapiens
gaagtatccctgatttatt

SEQ ID NO: 5736763 - DNA, 17 bp, Homo sapiens
gaagtatctaaaagtgt

SEQ ID NO: 5736764 - DNA, 17 bp, Homo sapiens
gaagtatgagtgctgat

SEQ ID NO: 5736765 - DNA, 12 bp, Homo sapiens
gaagtatgggaa

SEQ ID NO: 5736766 - DNA, 11 bp, Homo sapiens
gaagtatgtgt

SEQ ID NO: 5736767 - DNA, 22 bp, Homo sapiens
gaagtattagacttctaaataa

SEQ ID NO: 5736768 - DNA, 19 bp, Homo sapiens
gaagtattataaattatgt

SEQ ID NO: 5736769 - DNA, 23 bp, Homo sapiens
gaagtattataaattatgtttat

SEQ ID NO: 5736770 - DNA, 22 bp, Homo sapiens
gaagtattcttttcaattatat

SEQ ID NO: 5736771 - DNA, 14 bp, Homo sapiens
gaagtattgtttac

SEQ ID NO: 5736772 - DNA, 14 bp, Homo sapiens
gaagtatttatcag

SEQ ID NO: 5736773 - DNA, 14 bp, Homo sapiens
gaagtattttcctc

SEQ ID NO: 5736774 - DNA, 17 bp, Homo sapiens
gaagtcaaaatatgtaa

SEQ ID NO: 5736775 - DNA, 19 bp, Homo sapiens
gaagtcacaacaaaaggaa

SEQ ID NO: 5736776 - DNA, 13 bp, Homo sapiens
gaagtcacagggc

SEQ ID NO: 5736777 - DNA, 15 bp, Homo sapiens
gaagtcacagggcag

SEQ ID NO: 5736778 - DNA, 17 bp, Homo sapiens
gaagtcacctttctggg

SEQ ID NO: 5736779 - DNA, 19 bp, Homo sapiens
gaagtcacctttctgggct

SEQ ID NO: 5736780 - DNA, 20 bp, Homo sapiens
gaagtcacctttctgggctt

SEQ ID NO: 5736781 - DNA, 14 bp, Homo sapiens
gaagtcagaatttt

SEQ ID NO: 5736782 - DNA, 17 bp, Homo sapiens
gaagtcagccacactgg

SEQ ID NO: 5736783 - DNA, 13 bp, Homo sapiens
gaagtcaggagcc

SEQ ID NO: 5736784 - DNA, 15 bp, Homo sapiens
gaagtcaggagccag

SEQ ID NO: 5736785 - DNA, 18 bp, Homo sapiens
gaagtcaggggagaagct

SEQ ID NO: 5736786 - DNA, 22 bp, Homo sapiens
gaagtcaggggagaagctgaag

SEQ ID NO: 5736787 - DNA, 12 bp, Homo sapiens
gaagtcaggtgt

SEQ ID NO: 5736788 - DNA, 15 bp, Homo sapiens
gaagtcataaacagc

SEQ ID NO: 5736789 - DNA, 17 bp, Homo sapiens
gaagtcataaacagcat

SEQ ID NO: 5736790 - DNA, 19 bp, Homo sapiens
gaagtcatagataatagta

SEQ ID NO: 5736791 - DNA, 21 bp, Homo sapiens
gaagtcatgctcccctgtgcc

SEQ ID NO: 5736792 - DNA, 20 bp, Homo sapiens
gaagtccaggactgggtctg

SEQ ID NO: 5736793 - DNA, 23 bp, Homo sapiens
gaagtcccaatttaagagtcctg

SEQ ID NO: 5736794 - DNA, 17 bp, Homo sapiens
gaagtccctaggaggga

SEQ ID NO: 5736795 - DNA, 18 bp, Homo sapiens
gaagtccctgttctcagc

SEQ ID NO: 5736796 - DNA, 15 bp, Homo sapiens
gaagtcccttcctgt

SEQ ID NO: 5736797 - DNA, 23 bp, Homo sapiens
gaagtcctaagaagtggggcaga

SEQ ID NO: 5736798 - DNA, 20 bp, Homo sapiens
gaagtcctccctcctgcagg

SEQ ID NO: 5736799 - DNA, 22 bp, Homo sapiens
gaagtcctccctcctgcaggct

SEQ ID NO: 5736800 - DNA, 12 bp, Homo sapiens
gaagtcctctgt

SEQ ID NO: 5736801 - DNA, 14 bp, Homo sapiens
gaagtcctgtcact

SEQ ID NO: 5736802 - DNA, 18 bp, Homo sapiens
gaagtccttaagcagagg

SEQ ID NO: 5736803 - DNA, 22 bp, Homo sapiens
gaagtccttcagtgagcccctc

SEQ ID NO: 5736804 - DNA, 16 bp, Homo sapiens
gaagtcgaaggatgct

SEQ ID NO: 5736805 - DNA, 20 bp, Homo sapiens
gaagtcgaaggatgctcttt

SEQ ID NO: 5736806 - DNA, 15 bp, Homo sapiens
gaagtcgcttttggt

SEQ ID NO: 5736807 - DNA, 17 bp, Homo sapiens
gaagtctacctgctgga

SEQ ID NO: 5736808 - DNA, 22 bp, Homo sapiens
gaagtctacctgctggacagcc

SEQ ID NO: 5736809 - DNA, 15 bp, Homo sapiens
gaagtctaggagctg

SEQ ID NO: 5736810 - DNA, 22 bp, Homo sapiens
gaagtctaggagctgggaggaa

SEQ ID NO: 5736811 - DNA, 24 bp, Homo sapiens
gaagtctcatctggggagcaggca

SEQ ID NO: 5736812 - DNA, 14 bp, Homo sapiens
gaagtctccccgca

SEQ ID NO: 5736813 - DNA, 19 bp, Homo sapiens
gaagtctccccgcagccct

SEQ ID NO: 5736814 - DNA, 13 bp, Homo sapiens
gaagtctccctgc

SEQ ID NO: 5736815 - DNA, 18 bp, Homo sapiens
gaagtctccctgcacagc

SEQ ID NO: 5736816 - DNA, 18 bp, Homo sapiens
gaagtctctaggttctga

SEQ ID NO: 5736817 - DNA, 21 bp, Homo sapiens
gaagtctgcttaccaaaacat

SEQ ID NO: 5736818 - DNA, 15 bp, Homo sapiens
gaagtctggctttgc

SEQ ID NO: 5736819 - DNA, 16 bp, Homo sapiens
gaagtctggctttgct

SEQ ID NO: 5736820 - DNA, 14 bp, Homo sapiens
gaagtctggtcaga

SEQ ID NO: 5736821 - DNA, 18 bp, Homo sapiens
gaagtctggtcagagcca

SEQ ID NO: 5736822 - DNA, 23 bp, Homo sapiens
gaagtctggtcagagccacaggg

SEQ ID NO: 5736823 - DNA, 12 bp, Homo sapiens
gaagtctgtgtc

SEQ ID NO: 5736824 - DNA, 17 bp, Homo sapiens
gaagtcttaattgtgtt

SEQ ID NO: 5736825 - DNA, 21 bp, Homo sapiens
gaagtcttaattgtgtttatt

SEQ ID NO: 5736826 - DNA, 15 bp, Homo sapiens
gaagtcttagatgta

SEQ ID NO: 5736827 - DNA, 18 bp, Homo sapiens
gaagtcttagatgtatat

SEQ ID NO: 5736828 - DNA, 22 bp, Homo sapiens
gaagtcttatcttctgcagtga

SEQ ID NO: 5736829 - DNA, 14 bp, Homo sapiens
gaagtcttcaaatt

SEQ ID NO: 5736830 - DNA, 15 bp, Homo sapiens
gaagtcttcatgaaa

SEQ ID NO: 5736831 - DNA, 19 bp, Homo sapiens
gaagtcttccatcagcagt

SEQ ID NO: 5736832 - DNA, 22 bp, Homo sapiens
gaagtcttccatcagcagtgat

SEQ ID NO: 5736833 - DNA, 23 bp, Homo sapiens
gaagtcttccatcagcagtgatt

SEQ ID NO: 5736834 - DNA, 15 bp, Homo sapiens
gaagtcttccctcag

SEQ ID NO: 5736835 - DNA, 16 bp, Homo sapiens
gaagtcttccctcaga

SEQ ID NO: 5736836 - DNA, 13 bp, Homo sapiens
gaagtcttctatt

SEQ ID NO: 5736837 - DNA, 15 bp, Homo sapiens
gaagtcttctattta

SEQ ID NO: 5736838 - DNA, 20 bp, Homo sapiens
gaagtcttcttatctaaacc

SEQ ID NO: 5736839 - DNA, 17 bp, Homo sapiens
gaagtctttaatatttt

SEQ ID NO: 5736840 - DNA, 18 bp, Homo sapiens
gaagtctttcagtggaat

SEQ ID NO: 5736841 - DNA, 14 bp, Homo sapiens
gaagtctttgtaca

SEQ ID NO: 5736842 - DNA, 19 bp, Homo sapiens
gaagtctttgtacagacaa

SEQ ID NO: 5736843 - DNA, 20 bp, Homo sapiens
gaagtctttgtacagacaac

SEQ ID NO: 5736844 - DNA, 23 bp, Homo sapiens
gaagtcttttccacatggcagat

SEQ ID NO: 5736845 - DNA, 14 bp, Homo sapiens
gaagtgaaactgct

SEQ ID NO: 5736846 - DNA, 21 bp, Homo sapiens
gaagtgaaatctgtgcaataa

SEQ ID NO: 5736847 - DNA, 17 bp, Homo sapiens
gaagtgaacaaatttca

SEQ ID NO: 5736848 - DNA, 13 bp, Homo sapiens
gaagtgaacactt

SEQ ID NO: 5736849 - DNA, 12 bp, Homo sapiens
gaagtgaagccc

SEQ ID NO: 5736850 - DNA, 21 bp, Homo sapiens
gaagtgaaggagaaaggagcc

SEQ ID NO: 5736851 - DNA, 17 bp, Homo sapiens
gaagtgaataactgcaa

SEQ ID NO: 5736852 - DNA, 15 bp, Homo sapiens
gaagtgaatgctggg

SEQ ID NO: 5736853 - DNA, 16 bp, Homo sapiens
gaagtgacaagatgct

SEQ ID NO: 5736854 - DNA, 23 bp, Homo sapiens
gaagtgacaaggccccagagact

SEQ ID NO: 5736855 - DNA, 24 bp, Homo sapiens
gaagtgacaaggccccagagactc

SEQ ID NO: 5736856 - DNA, 13 bp, Homo sapiens
gaagtgacaggga

SEQ ID NO: 5736857 - DNA, 18 bp, Homo sapiens
gaagtgacagggaagcta

SEQ ID NO: 5736858 - DNA, 21 bp, Homo sapiens
gaagtgaccaaattgggagat

SEQ ID NO: 5736859 - DNA, 23 bp, Homo sapiens
gaagtgaccaaattgggagataa

SEQ ID NO: 5736860 - DNA, 15 bp, Homo sapiens
gaagtgaccaaggtg

SEQ ID NO: 5736861 - DNA, 18 bp, Homo sapiens
gaagtgaccccagctcca

SEQ ID NO: 5736862 - DNA, 20 bp, Homo sapiens
gaagtgacctcactggcctg

SEQ ID NO: 5736863 - DNA, 21 bp, Homo sapiens
gaagtgacctcactggcctgc

SEQ ID NO: 5736864 - DNA, 16 bp, Homo sapiens
gaagtgacggttccta

SEQ ID NO: 5736865 - DNA, 18 bp, Homo sapiens
gaagtgactgtaccactt

SEQ ID NO: 5736866 - DNA, 13 bp, Homo sapiens
gaagtgactttgg

SEQ ID NO: 5736867 - DNA, 21 bp, Homo sapiens
gaagtgagaagggctcagaga

SEQ ID NO: 5736868 - DNA, 13 bp, Homo sapiens
gaagtgagcaagg

SEQ ID NO: 5736869 - DNA, 14 bp, Homo sapiens
gaagtgaggatgag

SEQ ID NO: 5736870 - DNA, 13 bp, Homo sapiens
gaagtgaggccca

SEQ ID NO: 5736871 - DNA, 14 bp, Homo sapiens
gaagtgaggcccaa

SEQ ID NO: 5736872 - DNA, 20 bp, Homo sapiens
gaagtgaggcccaaggagct

SEQ ID NO: 5736873 - DNA, 16 bp, Homo sapiens
gaagtgagggaggaag

SEQ ID NO: 5736874 - DNA, 15 bp, Homo sapiens
gaagtgaggtagtgc

SEQ ID NO: 5736875 - DNA, 19 bp, Homo sapiens
gaagtgagtttgtaaatat

SEQ ID NO: 5736876 - DNA, 21 bp, Homo sapiens
gaagtgataacactggagtgg

SEQ ID NO: 5736877 - DNA, 17 bp, Homo sapiens
gaagtgatgattgtaag

SEQ ID NO: 5736878 - DNA, 20 bp, Homo sapiens
gaagtgatttagttgtggaa

SEQ ID NO: 5736879 - DNA, 23 bp, Homo sapiens
gaagtgatttagttgtggaaaga

SEQ ID NO: 5736880 - DNA, 17 bp, Homo sapiens
gaagtgcagaactgcag

SEQ ID NO: 5736881 - DNA, 20 bp, Homo sapiens
gaagtgcagaactgcagtca

SEQ ID NO: 5736882 - DNA, 22 bp, Homo sapiens
gaagtgcagcgggccaggcagg

SEQ ID NO: 5736883 - DNA, 14 bp, Homo sapiens
gaagtgcagctcag

SEQ ID NO: 5736884 - DNA, 23 bp, Homo sapiens
gaagtgcatctggagagaacagg

SEQ ID NO: 5736885 - DNA, 16 bp, Homo sapiens
gaagtgcatgggtcag

SEQ ID NO: 5736886 - DNA, 21 bp, Homo sapiens
gaagtgcatgggtcagggtgt

SEQ ID NO: 5736887 - DNA, 14 bp, Homo sapiens
gaagtgcatttctg

SEQ ID NO: 5736888 - DNA, 14 bp, Homo sapiens
gaagtgcccctgct

SEQ ID NO: 5736889 - DNA, 15 bp, Homo sapiens
gaagtgcccctgctg

SEQ ID NO: 5736890 - DNA, 18 bp, Homo sapiens
gaagtgcccctgctgcct

SEQ ID NO: 5736891 - DNA, 19 bp, Homo sapiens
gaagtgcccttaaggatca

SEQ ID NO: 5736892 - DNA, 21 bp, Homo sapiens
gaagtgccttctccttcccca

SEQ ID NO: 5736893 - DNA, 22 bp, Homo sapiens
gaagtgccttctccttccccag

SEQ ID NO: 5736894 - DNA, 13 bp, Homo sapiens
gaagtgctcccca

SEQ ID NO: 5736895 - DNA, 13 bp, Homo sapiens
gaagtgctccctg

SEQ ID NO: 5736896 - DNA, 17 bp, Homo sapiens
gaagtgctccctggagg

SEQ ID NO: 5736897 - DNA, 18 bp, Homo sapiens
gaagtgctcttggctgac

SEQ ID NO: 5736898 - DNA, 20 bp, Homo sapiens
gaagtgctggcaaccactaa

SEQ ID NO: 5736899 - DNA, 19 bp, Homo sapiens
gaagtgcttggaacatact

SEQ ID NO: 5736900 - DNA, 17 bp, Homo sapiens
gaagtggaaaaagaaat

SEQ ID NO: 5736901 - DNA, 10 bp, Homo sapiens
gaagtggaag

SEQ ID NO: 5736902 - DNA, 22 bp, Homo sapiens
gaagtggaccaggacaggacca

SEQ ID NO: 5736903 - DNA, 18 bp, Homo sapiens
gaagtggactggcccctg

SEQ ID NO: 5736904 - DNA, 23 bp, Homo sapiens
gaagtggagacagtcctttccca

SEQ ID NO: 5736905 - DNA, 15 bp, Homo sapiens
gaagtggagtgacta

SEQ ID NO: 5736906 - DNA, 21 bp, Homo sapiens
gaagtggatctgcttctccag

SEQ ID NO: 5736907 - DNA, 13 bp, Homo sapiens
gaagtggcaggag

SEQ ID NO: 5736908 - DNA, 21 bp, Homo sapiens
gaagtggcataggagtgtgtt

SEQ ID NO: 5736909 - DNA, 15 bp, Homo sapiens
gaagtggccagggct

SEQ ID NO: 5736910 - DNA, 15 bp, Homo sapiens
gaagtggccctccct

SEQ ID NO: 5736911 - DNA, 17 bp, Homo sapiens
gaagtggcctcttggat

SEQ ID NO: 5736912 - DNA, 14 bp, Homo sapiens
gaagtggcctgaga

SEQ ID NO: 5736913 - DNA, 16 bp, Homo sapiens
gaagtggccttgcccg

SEQ ID NO: 5736914 - DNA, 16 bp, Homo sapiens
gaagtggctgccacac

SEQ ID NO: 5736915 - DNA, 19 bp, Homo sapiens
gaagtggctggtagaaaaa

SEQ ID NO: 5736916 - DNA, 16 bp, Homo sapiens
gaagtggctggtctgg

SEQ ID NO: 5736917 - DNA, 17 bp, Homo sapiens
gaagtggctggtctgga

SEQ ID NO: 5736918 - DNA, 13 bp, Homo sapiens
gaagtgggagcag

SEQ ID NO: 5736919 - DNA, 15 bp, Homo sapiens
gaagtgggagcagct

SEQ ID NO: 5736920 - DNA, 16 bp, Homo sapiens
gaagtgggagcagctt

SEQ ID NO: 5736921 - DNA, 18 bp, Homo sapiens
gaagtgggagcagcttct

SEQ ID NO: 5736922 - DNA, 13 bp, Homo sapiens
gaagtgggagtgg

SEQ ID NO: 5736923 - DNA, 17 bp, Homo sapiens
gaagtgggagtgggaga

SEQ ID NO: 5736924 - DNA, 11 bp, Homo sapiens
gaagtgggcca

SEQ ID NO: 5736925 - DNA, 16 bp, Homo sapiens
gaagtgggccagtcct

SEQ ID NO: 5736926 - DNA, 17 bp, Homo sapiens
gaagtgggccagtcctg

SEQ ID NO: 5736927 - DNA, 21 bp, Homo sapiens
gaagtgggccagtcctggttg

SEQ ID NO: 5736928 - DNA, 16 bp, Homo sapiens
gaagtgggcgtgagtg

SEQ ID NO: 5736929 - DNA, 15 bp, Homo sapiens
gaagtggggacagag

SEQ ID NO: 5736930 - DNA, 15 bp, Homo sapiens
gaagtggggacagat

SEQ ID NO: 5736931 - DNA, 17 bp, Homo sapiens
gaagtggggacagattc

SEQ ID NO: 5736932 - DNA, 16 bp, Homo sapiens
gaagtggggcagatgg

SEQ ID NO: 5736933 - DNA, 19 bp, Homo sapiens
gaagtgggggccgctggcc

SEQ ID NO: 5736934 - DNA, 21 bp, Homo sapiens
gaagtgggggccgctggccca

SEQ ID NO: 5736935 - DNA, 23 bp, Homo sapiens
gaagtgggggccgctggcccagg

SEQ ID NO: 5736936 - DNA, 14 bp, Homo sapiens
gaagtgggtgccct

SEQ ID NO: 5736937 - DNA, 23 bp, Homo sapiens
gaagtggtacaatctggctcact

SEQ ID NO: 5736938 - DNA, 17 bp, Homo sapiens
gaagtggtactagtgtg

SEQ ID NO: 5736939 - DNA, 14 bp, Homo sapiens
gaagtggtccatct

SEQ ID NO: 5736940 - DNA, 20 bp, Homo sapiens
gaagtggtgttccatgactt

SEQ ID NO: 5736941 - DNA, 20 bp, Homo sapiens
gaagtggtttcctgataaca

SEQ ID NO: 5736942 - DNA, 15 bp, Homo sapiens
gaagtggtttgtaga

SEQ ID NO: 5736943 - DNA, 14 bp, Homo sapiens
gaagtgtaacagct

SEQ ID NO: 5736944 - DNA, 16 bp, Homo sapiens
gaagtgtagggcaagg

SEQ ID NO: 5736945 - DNA, 17 bp, Homo sapiens
gaagtgtattcatatta

SEQ ID NO: 5736946 - DNA, 14 bp, Homo sapiens
gaagtgtcatgttt

SEQ ID NO: 5736947 - DNA, 16 bp, Homo sapiens
gaagtgtcgagtccag

SEQ ID NO: 5736948 - DNA, 17 bp, Homo sapiens
gaagtgtcgagtccagt

SEQ ID NO: 5736949 - DNA, 12 bp, Homo sapiens
gaagtgtcttct

SEQ ID NO: 5736950 - DNA, 13 bp, Homo sapiens
gaagtgtcttctg

SEQ ID NO: 5736951 - DNA, 11 bp, Homo sapiens
gaagtgtgatt

SEQ ID NO: 5736952 - DNA, 13 bp, Homo sapiens
gaagtgtgctgag

SEQ ID NO: 5736953 - DNA, 17 bp, Homo sapiens
gaagtgtgctgaggtgg

SEQ ID NO: 5736954 - DNA, 14 bp, Homo sapiens
gaagtgtgctgtga

SEQ ID NO: 5736955 - DNA, 20 bp, Homo sapiens
gaagtgtggctggtgtcccc

SEQ ID NO: 5736956 - DNA, 16 bp, Homo sapiens
gaagtgtggggcgggg

SEQ ID NO: 5736957 - DNA, 19 bp, Homo sapiens
gaagtgtggggcgggggtc

SEQ ID NO: 5736958 - DNA, 19 bp, Homo sapiens
gaagtgtgggtctgtgtgt

SEQ ID NO: 5736959 - DNA, 21 bp, Homo sapiens
gaagtgtgggtctgtgtgtgt

SEQ ID NO: 5736960 - DNA, 17 bp, Homo sapiens
gaagtgtgtgccaagag

SEQ ID NO: 5736961 - DNA, 13 bp, Homo sapiens
gaagtgtgtttgc

SEQ ID NO: 5736962 - DNA, 17 bp, Homo sapiens
gaagtgttaatactagt

SEQ ID NO: 5736963 - DNA, 17 bp, Homo sapiens
gaagtgttcaagaaata

SEQ ID NO: 5736964 - DNA, 18 bp, Homo sapiens
gaagtgttcaagaaataa

SEQ ID NO: 5736965 - DNA, 14 bp, Homo sapiens
gaagtgttgattgc

SEQ ID NO: 5736966 - DNA, 19 bp, Homo sapiens
gaagtgtttaaaagagcca

SEQ ID NO: 5736967 - DNA, 21 bp, Homo sapiens
gaagtgtttcacgagagcccg

SEQ ID NO: 5736968 - DNA, 17 bp, Homo sapiens
gaagtgtttcagatttt

SEQ ID NO: 5736969 - DNA, 21 bp, Homo sapiens
gaagttaaaaaacagctgcat

SEQ ID NO: 5736970 - DNA, 20 bp, Homo sapiens
gaagttaaaagcacaaagga

SEQ ID NO: 5736971 - DNA, 21 bp, Homo sapiens
gaagttaaagggaagaaaaca

SEQ ID NO: 5736972 - DNA, 15 bp, Homo sapiens
gaagttaacagagac

SEQ ID NO: 5736973 - DNA, 22 bp, Homo sapiens
gaagttacacagaaatgctgct

SEQ ID NO: 5736974 - DNA, 23 bp, Homo sapiens
gaagttacacagaaatgctgctg

SEQ ID NO: 5736975 - DNA, 14 bp, Homo sapiens
gaagttacctttta

SEQ ID NO: 5736976 - DNA, 15 bp, Homo sapiens
gaagttactgaatgc

SEQ ID NO: 5736977 - DNA, 21 bp, Homo sapiens
gaagttactgttacttgataa

SEQ ID NO: 5736978 - DNA, 16 bp, Homo sapiens
gaagttactttatgtt

SEQ ID NO: 5736979 - DNA, 12 bp, Homo sapiens
gaagttactttg

SEQ ID NO: 5736980 - DNA, 20 bp, Homo sapiens
gaagttactttgtaattttt

SEQ ID NO: 5736981 - DNA, 15 bp, Homo sapiens
gaagttactttttgt

SEQ ID NO: 5736982 - DNA, 21 bp, Homo sapiens
gaagttagaattccttcaggg

SEQ ID NO: 5736983 - DNA, 17 bp, Homo sapiens
gaagttagtttgtatat

SEQ ID NO: 5736984 - DNA, 13 bp, Homo sapiens
gaagttatgggaa

SEQ ID NO: 5736985 - DNA, 20 bp, Homo sapiens
gaagttatgtgtatgtgagt

SEQ ID NO: 5736986 - DNA, 23 bp, Homo sapiens
gaagttattaacgggcatgtatt

SEQ ID NO: 5736987 - DNA, 18 bp, Homo sapiens
gaagttatttagaaatat

SEQ ID NO: 5736988 - DNA, 22 bp, Homo sapiens
gaagttatttagaaatatcctt

SEQ ID NO: 5736989 - DNA, 15 bp, Homo sapiens
gaagttattttccag

SEQ ID NO: 5736990 - DNA, 18 bp, Homo sapiens
gaagttcaccagccctga

SEQ ID NO: 5736991 - DNA, 21 bp, Homo sapiens
gaagttcaccagccctgagcc

SEQ ID NO: 5736992 - DNA, 20 bp, Homo sapiens
gaagttcaccattaaaaggg

SEQ ID NO: 5736993 - DNA, 22 bp, Homo sapiens
gaagttcatacctaagtactgt

SEQ ID NO: 5736994 - DNA, 12 bp, Homo sapiens
gaagttcatttt

SEQ ID NO: 5736995 - DNA, 18 bp, Homo sapiens
gaagttccacttaacaca

SEQ ID NO: 5736996 - DNA, 16 bp, Homo sapiens
gaagttctagtgtttt

SEQ ID NO: 5736997 - DNA, 13 bp, Homo sapiens
gaagttctgggtg

SEQ ID NO: 5736998 - DNA, 15 bp, Homo sapiens
gaagttcttcaagag

SEQ ID NO: 5736999 - DNA, 16 bp, Homo sapiens
gaagttcttcaagagg

SEQ ID NO: 5737000 - DNA, 15 bp, Homo sapiens
gaagttctttgatcc

SEQ ID NO: 5737001 - DNA, 15 bp, Homo sapiens
gaagttgaatgggca

SEQ ID NO: 5737002 - DNA, 19 bp, Homo sapiens
gaagttgattcatattgca

SEQ ID NO: 5737003 - DNA, 20 bp, Homo sapiens
gaagttgcattcctttgtct

SEQ ID NO: 5737004 - DNA, 22 bp, Homo sapiens
gaagttgccatgggaaacaaat

SEQ ID NO: 5737005 - DNA, 12 bp, Homo sapiens
gaagttgctgct

SEQ ID NO: 5737006 - DNA, 22 bp, Homo sapiens
gaagttgctggttttgaatatt

SEQ ID NO: 5737007 - DNA, 14 bp, Homo sapiens
gaagttggccacct

SEQ ID NO: 5737008 - DNA, 21 bp, Homo sapiens
gaagttggccccccagcgcag

SEQ ID NO: 5737009 - DNA, 18 bp, Homo sapiens
gaagttgggcaatataac

SEQ ID NO: 5737010 - DNA, 22 bp, Homo sapiens
gaagttgggcaatataaccaat

SEQ ID NO: 5737011 - DNA, 20 bp, Homo sapiens
gaagttggggcactgggcgt

SEQ ID NO: 5737012 - DNA, 21 bp, Homo sapiens
gaagttggtcttactttgtgc

SEQ ID NO: 5737013 - DNA, 20 bp, Homo sapiens
gaagttggtttagctttgga

SEQ ID NO: 5737014 - DNA, 17 bp, Homo sapiens
gaagttgtaaacacagt

SEQ ID NO: 5737015 - DNA, 16 bp, Homo sapiens
gaagttgtaagaaaag

SEQ ID NO: 5737016 - DNA, 17 bp, Homo sapiens
gaagttgtaagaaaagc

SEQ ID NO: 5737017 - DNA, 16 bp, Homo sapiens
gaagttgtctccttcc

SEQ ID NO: 5737018 - DNA, 13 bp, Homo sapiens
gaagttgtgaaac

SEQ ID NO: 5737019 - DNA, 20 bp, Homo sapiens
gaagttgtgccttttatagc

SEQ ID NO: 5737020 - DNA, 21 bp, Homo sapiens
gaagttgtggatatcagggta

SEQ ID NO: 5737021 - DNA, 17 bp, Homo sapiens
gaagttgtgtgacccta

SEQ ID NO: 5737022 - DNA, 22 bp, Homo sapiens
gaagttgttactaactaaactc

SEQ ID NO: 5737023 - DNA, 21 bp, Homo sapiens
gaagttgttgctatacatgtt

SEQ ID NO: 5737024 - DNA, 14 bp, Homo sapiens
gaagtttaaaacag

SEQ ID NO: 5737025 - DNA, 21 bp, Homo sapiens
gaagtttaaaacagtatttat

SEQ ID NO: 5737026 - DNA, 15 bp, Homo sapiens
gaagtttaaaaccca

SEQ ID NO: 5737027 - DNA, 21 bp, Homo sapiens
gaagtttaaatctttgttaaa

SEQ ID NO: 5737028 - DNA, 13 bp, Homo sapiens
gaagtttacattt

SEQ ID NO: 5737029 - DNA, 14 bp, Homo sapiens
gaagtttagatgag

SEQ ID NO: 5737030 - DNA, 14 bp, Homo sapiens
gaagtttatttgag

SEQ ID NO: 5737031 - DNA, 20 bp, Homo sapiens
gaagtttatttgagaaaata

SEQ ID NO: 5737032 - DNA, 15 bp, Homo sapiens
gaagtttcaagtttt

SEQ ID NO: 5737033 - DNA, 14 bp, Homo sapiens
gaagtttcagtttc

SEQ ID NO: 5737034 - DNA, 13 bp, Homo sapiens
gaagtttcattta

SEQ ID NO: 5737035 - DNA, 23 bp, Homo sapiens
gaagtttcctatgactaattcac

SEQ ID NO: 5737036 - DNA, 12 bp, Homo sapiens
gaagtttctgcc

SEQ ID NO: 5737037 - DNA, 13 bp, Homo sapiens
gaagtttgaatgt

SEQ ID NO: 5737038 - DNA, 16 bp, Homo sapiens
gaagtttgaatgttaa

SEQ ID NO: 5737039 - DNA, 16 bp, Homo sapiens
gaagtttgataaatag

SEQ ID NO: 5737040 - DNA, 20 bp, Homo sapiens
gaagtttgataaatagtgtt

SEQ ID NO: 5737041 - DNA, 17 bp, Homo sapiens
gaagtttgtagccaggt

SEQ ID NO: 5737042 - DNA, 20 bp, Homo sapiens
gaagtttgtccatttgtaaa

SEQ ID NO: 5737043 - DNA, 21 bp, Homo sapiens
gaagtttgtccatttgtaaaa

SEQ ID NO: 5737044 - DNA, 16 bp, Homo sapiens
gaagtttgtggtataa

SEQ ID NO: 5737045 - DNA, 14 bp, Homo sapiens
gaagtttgtgtctt

SEQ ID NO: 5737046 - DNA, 15 bp, Homo sapiens
gaagttttacttgat

SEQ ID NO: 5737047 - DNA, 21 bp, Homo sapiens
gaagttttatgccatgttaat

SEQ ID NO: 5737048 - DNA, 13 bp, Homo sapiens
gaagttttcagtg

SEQ ID NO: 5737049 - DNA, 14 bp, Homo sapiens
gaagttttcctgat

SEQ ID NO: 5737050 - DNA, 12 bp, Homo sapiens
gaagttttgcat

SEQ ID NO: 5737051 - DNA, 12 bp, Homo sapiens
gaagttttgcta

SEQ ID NO: 5737052 - DNA, 23 bp, Homo sapiens
gaagtttttattttaaacatttt

SEQ ID NO: 5737053 - DNA, 15 bp, Homo sapiens
gaagtttttgaaata

SEQ ID NO: 5737054 - DNA, 15 bp, Homo sapiens
gaagtttttgtaaac

SEQ ID NO: 5737055 - DNA, 18 bp, Homo sapiens
gaagtttttgtactgtaa

SEQ ID NO: 5737056 - DNA, 16 bp, Homo sapiens
gaataaaaaacatttg

SEQ ID NO: 5737057 - DNA, 17 bp, Homo sapiens
gaataaaaaacatttgt

SEQ ID NO: 5737058 - DNA, 16 bp, Homo sapiens
gaataaaaaagattct

SEQ ID NO: 5737059 - DNA, 20 bp, Homo sapiens
gaataaaaaagattctacta

SEQ ID NO: 5737060 - DNA, 22 bp, Homo sapiens
gaataaaaaatagacatgtagt

SEQ ID NO: 5737061 - DNA, 16 bp, Homo sapiens
gaataaaaactttgct

SEQ ID NO: 5737062 - DNA, 18 bp, Homo sapiens
gaataaaaagtgaacttt

SEQ ID NO: 5737063 - DNA, 17 bp, Homo sapiens
gaataaaaataaagttt

SEQ ID NO: 5737064 - DNA, 18 bp, Homo sapiens
gaataaaaataaagtttt

SEQ ID NO: 5737065 - DNA, 14 bp, Homo sapiens
gaataaaaattgac

SEQ ID NO: 5737066 - DNA, 19 bp, Homo sapiens
gaataaaacaataaatgaa

SEQ ID NO: 5737067 - DNA, 18 bp, Homo sapiens
gaataaaacatttctctc

SEQ ID NO: 5737068 - DNA, 13 bp, Homo sapiens
gaataaaaggctg

SEQ ID NO: 5737069 - DNA, 21 bp, Homo sapiens
gaataaaaggcttgaagctgt

SEQ ID NO: 5737070 - DNA, 23 bp, Homo sapiens
gaataaaatactatttttactgc

SEQ ID NO: 5737071 - DNA, 21 bp, Homo sapiens
gaataaaatataaaactgaaa

SEQ ID NO: 5737072 - DNA, 21 bp, Homo sapiens
gaataaaatgttgaaaagtca

SEQ ID NO: 5737073 - DNA, 23 bp, Homo sapiens
gaataaaatgttgaaaagtcaaa

SEQ ID NO: 5737074 - DNA, 11 bp, Homo sapiens
gaataaaatta

SEQ ID NO: 5737075 - DNA, 12 bp, Homo sapiens
gaataaaattag

SEQ ID NO: 5737076 - DNA, 15 bp, Homo sapiens
gaataaaatttctac

SEQ ID NO: 5737077 - DNA, 13 bp, Homo sapiens
gaataaacaaaat

SEQ ID NO: 5737078 - DNA, 18 bp, Homo sapiens
gaataaacatctgtgtct

SEQ ID NO: 5737079 - DNA, 19 bp, Homo sapiens
gaataaacatctgtgtctg

SEQ ID NO: 5737080 - DNA, 20 bp, Homo sapiens
gaataaacatctgtgtctgt

SEQ ID NO: 5737081 - DNA, 15 bp, Homo sapiens
gaataaacatttgtt

SEQ ID NO: 5737082 - DNA, 18 bp, Homo sapiens
gaataaactagagaaggg

SEQ ID NO: 5737083 - DNA, 16 bp, Homo sapiens
gaataaactagattac

SEQ ID NO: 5737084 - DNA, 18 bp, Homo sapiens
gaataaactcaaaactct

SEQ ID NO: 5737085 - DNA, 21 bp, Homo sapiens
gaataaactctcccctttctt

SEQ ID NO: 5737086 - DNA, 16 bp, Homo sapiens
gaataaacttcagcac

SEQ ID NO: 5737087 - DNA, 18 bp, Homo sapiens
gaataaacttcagcacca

SEQ ID NO: 5737088 - DNA, 11 bp, Homo sapiens
gaataaagaat

SEQ ID NO: 5737089 - DNA, 17 bp, Homo sapiens
gaataaagaatgaatgg

SEQ ID NO: 5737090 - DNA, 20 bp, Homo sapiens
gaataaagaatgccatttct

SEQ ID NO: 5737091 - DNA, 13 bp, Homo sapiens
gaataaagcaatt

SEQ ID NO: 5737092 - DNA, 15 bp, Homo sapiens
gaataaagcaatttt

SEQ ID NO: 5737093 - DNA, 18 bp, Homo sapiens
gaataaagcaattttcct

SEQ ID NO: 5737094 - DNA, 19 bp, Homo sapiens
gaataaagcaattttcctt

SEQ ID NO: 5737095 - DNA, 14 bp, Homo sapiens
gaataaagcagcct

SEQ ID NO: 5737096 - DNA, 15 bp, Homo sapiens
gaataaagcagcctg

SEQ ID NO: 5737097 - DNA, 16 bp, Homo sapiens
gaataaagcagcctga

SEQ ID NO: 5737098 - DNA, 12 bp, Homo sapiens
gaataaagccac

SEQ ID NO: 5737099 - DNA, 23 bp, Homo sapiens
gaataaagctgtgagcaaacaga

SEQ ID NO: 5737100 - DNA, 14 bp, Homo sapiens
gaataaagcttctc

SEQ ID NO: 5737101 - DNA, 21 bp, Homo sapiens
gaataaagcttctctctgagc

SEQ ID NO: 5737102 - DNA, 18 bp, Homo sapiens
gaataaaggcagctgttg

SEQ ID NO: 5737103 - DNA, 20 bp, Homo sapiens
gaataaagtaccttgacttt

SEQ ID NO: 5737104 - DNA, 17 bp, Homo sapiens
gaataaagtctgagtgg

SEQ ID NO: 5737105 - DNA, 20 bp, Homo sapiens
gaataaagtgcaaacagaag

SEQ ID NO: 5737106 - DNA, 13 bp, Homo sapiens
gaataaagttctg

SEQ ID NO: 5737107 - DNA, 20 bp, Homo sapiens
gaataaagttctgagtgttt

SEQ ID NO: 5737108 - DNA, 14 bp, Homo sapiens
gaataaagttgtat

SEQ ID NO: 5737109 - DNA, 22 bp, Homo sapiens
gaataaataaagaagaaaataa

SEQ ID NO: 5737110 - DNA, 11 bp, Homo sapiens
gaataaatatg

SEQ ID NO: 5737111 - DNA, 12 bp, Homo sapiens
gaataaatatgc

SEQ ID NO: 5737112 - DNA, 19 bp, Homo sapiens
gaataaatatgcctctcct

SEQ ID NO: 5737113 - DNA, 17 bp, Homo sapiens
gaataaatgcctttata

SEQ ID NO: 5737114 - DNA, 15 bp, Homo sapiens
gaataaatggtttct

SEQ ID NO: 5737115 - DNA, 16 bp, Homo sapiens
gaataaatgtcacttt

SEQ ID NO: 5737116 - DNA, 18 bp, Homo sapiens
gaataaatgtcacttttt

SEQ ID NO: 5737117 - DNA, 13 bp, Homo sapiens
gaataaatgttca

SEQ ID NO: 5737118 - DNA, 16 bp, Homo sapiens
gaataaatgttttaca

SEQ ID NO: 5737119 - DNA, 18 bp, Homo sapiens
gaataaattaatattgta

SEQ ID NO: 5737120 - DNA, 12 bp, Homo sapiens
gaataaattatg

SEQ ID NO: 5737121 - DNA, 21 bp, Homo sapiens
gaataaattatggcatttcta

SEQ ID NO: 5737122 - DNA, 22 bp, Homo sapiens
gaataaattatggcatttctat

SEQ ID NO: 5737123 - DNA, 15 bp, Homo sapiens
gaataaattgctcct

SEQ ID NO: 5737124 - DNA, 19 bp, Homo sapiens
gaataaattggattatttt

SEQ ID NO: 5737125 - DNA, 20 bp, Homo sapiens
gaataaattggattattttc

SEQ ID NO: 5737126 - DNA, 21 bp, Homo sapiens
gaataaattggattattttct

SEQ ID NO: 5737127 - DNA, 17 bp, Homo sapiens
gaataaattgtacagcc

SEQ ID NO: 5737128 - DNA, 19 bp, Homo sapiens
gaataaattgtacagccgg

SEQ ID NO: 5737129 - DNA, 14 bp, Homo sapiens
gaataaatttggga

SEQ ID NO: 5737130 - DNA, 21 bp, Homo sapiens
gaataacaactgctgggaata

SEQ ID NO: 5737131 - DNA, 22 bp, Homo sapiens
gaataacaactttcagtggctt

SEQ ID NO: 5737132 - DNA, 19 bp, Homo sapiens
gaataacaagaagcccagt

SEQ ID NO: 5737133 - DNA, 16 bp, Homo sapiens
gaataacataggtgct

SEQ ID NO: 5737134 - DNA, 15 bp, Homo sapiens
gaataacctttcaga

SEQ ID NO: 5737135 - DNA, 21 bp, Homo sapiens
gaataactatctcacttccag

SEQ ID NO: 5737136 - DNA, 20 bp, Homo sapiens
gaataactcagaatattgtc

SEQ ID NO: 5737137 - DNA, 13 bp, Homo sapiens
gaataacttgaag

SEQ ID NO: 5737138 - DNA, 12 bp, Homo sapiens
gaataagagacc

SEQ ID NO: 5737139 - DNA, 22 bp, Homo sapiens
gaataagagacctgttttaaaa

SEQ ID NO: 5737140 - DNA, 16 bp, Homo sapiens
gaataagcagaacata

SEQ ID NO: 5737141 - DNA, 22 bp, Homo sapiens
gaataagcagaacatactgttc

SEQ ID NO: 5737142 - DNA, 13 bp, Homo sapiens
gaataagccatga

SEQ ID NO: 5737143 - DNA, 21 bp, Homo sapiens
gaataagccattctgactcat

SEQ ID NO: 5737144 - DNA, 18 bp, Homo sapiens
gaataagctcccagggcc

SEQ ID NO: 5737145 - DNA, 13 bp, Homo sapiens
gaataaggaggag

SEQ ID NO: 5737146 - DNA, 15 bp, Homo sapiens
gaataaggaggagga

SEQ ID NO: 5737147 - DNA, 12 bp, Homo sapiens
gaataaggccca

SEQ ID NO: 5737148 - DNA, 12 bp, Homo sapiens
gaataaggcctt

SEQ ID NO: 5737149 - DNA, 17 bp, Homo sapiens
gaataaggtacaagaag

SEQ ID NO: 5737150 - DNA, 19 bp, Homo sapiens
gaataaggtacaagaagca

SEQ ID NO: 5737151 - DNA, 14 bp, Homo sapiens
gaataagtgctgtt

SEQ ID NO: 5737152 - DNA, 14 bp, Homo sapiens
gaataagtgtacat

SEQ ID NO: 5737153 - DNA, 16 bp, Homo sapiens
gaataagtgtctttct

SEQ ID NO: 5737154 - DNA, 21 bp, Homo sapiens
gaataagttatgggtttttat

SEQ ID NO: 5737155 - DNA, 23 bp, Homo sapiens
gaataagttatgggtttttatgt

SEQ ID NO: 5737156 - DNA, 14 bp, Homo sapiens
gaataataaaatca

SEQ ID NO: 5737157 - DNA, 16 bp, Homo sapiens
gaataataaatattta

SEQ ID NO: 5737158 - DNA, 14 bp, Homo sapiens
gaataataagcagg

SEQ ID NO: 5737159 - DNA, 22 bp, Homo sapiens
gaataataattatccagagttt

SEQ ID NO: 5737160 - DNA, 20 bp, Homo sapiens
gaataatacatactaatgaa

SEQ ID NO: 5737161 - DNA, 12 bp, Homo sapiens
gaataatagaag

SEQ ID NO: 5737162 - DNA, 19 bp, Homo sapiens
gaataatcaaatacatttt

SEQ ID NO: 5737163 - DNA, 20 bp, Homo sapiens
gaataatcctaaacatatga

SEQ ID NO: 5737164 - DNA, 13 bp, Homo sapiens
gaataatctatta

SEQ ID NO: 5737165 - DNA, 22 bp, Homo sapiens
gaataatgacgtattgtgaaat

SEQ ID NO: 5737166 - DNA, 16 bp, Homo sapiens
gaataatgcctttgta

SEQ ID NO: 5737167 - DNA, 17 bp, Homo sapiens
gaataatgcctttgtaa

SEQ ID NO: 5737168 - DNA, 14 bp, Homo sapiens
gaataatggactct

SEQ ID NO: 5737169 - DNA, 13 bp, Homo sapiens
gaataatgggctt

SEQ ID NO: 5737170 - DNA, 14 bp, Homo sapiens
gaataatgtaaaat

SEQ ID NO: 5737171 - DNA, 22 bp, Homo sapiens
gaataatgtaaaatgttgaata

SEQ ID NO: 5737172 - DNA, 14 bp, Homo sapiens
gaataatgtctaga

SEQ ID NO: 5737173 - DNA, 19 bp, Homo sapiens
gaataatgtctagattttg

SEQ ID NO: 5737174 - DNA, 17 bp, Homo sapiens
gaataatgtgggaagaa

SEQ ID NO: 5737175 - DNA, 20 bp, Homo sapiens
gaataatgtgggaagaaaca

SEQ ID NO: 5737176 - DNA, 22 bp, Homo sapiens
gaataatgttttgggaaacact

SEQ ID NO: 5737177 - DNA, 18 bp, Homo sapiens
gaataattatttatttaa

SEQ ID NO: 5737178 - DNA, 13 bp, Homo sapiens
gaataattgtgta

SEQ ID NO: 5737179 - DNA, 16 bp, Homo sapiens
gaataattgtgtacaa

SEQ ID NO: 5737180 - DNA, 21 bp, Homo sapiens
gaataattgtgtacaaagtag

SEQ ID NO: 5737181 - DNA, 17 bp, Homo sapiens
gaataatttattattaa

SEQ ID NO: 5737182 - DNA, 14 bp, Homo sapiens
gaataatttcactt

SEQ ID NO: 5737183 - DNA, 16 bp, Homo sapiens
gaataatttcacttaa

SEQ ID NO: 5737184 - DNA, 13 bp, Homo sapiens
gaataatttctat

SEQ ID NO: 5737185 - DNA, 16 bp, Homo sapiens
gaataatttgtaaatg

SEQ ID NO: 5737186 - DNA, 17 bp, Homo sapiens
gaataatttgtaaatga

SEQ ID NO: 5737187 - DNA, 20 bp, Homo sapiens
gaataatttgtaaatgattt

SEQ ID NO: 5737188 - DNA, 16 bp, Homo sapiens
gaataattttaacaga

SEQ ID NO: 5737189 - DNA, 16 bp, Homo sapiens
gaatacaaacatattt

SEQ ID NO: 5737190 - DNA, 21 bp, Homo sapiens
gaatacaaatagaaaaagtga

SEQ ID NO: 5737191 - DNA, 20 bp, Homo sapiens
gaatacaagatattatgtat

SEQ ID NO: 5737192 - DNA, 16 bp, Homo sapiens
gaatacaatgggaaaa

SEQ ID NO: 5737193 - DNA, 17 bp, Homo sapiens
gaatacaatgggaaaag

SEQ ID NO: 5737194 - DNA, 19 bp, Homo sapiens
gaatacaattcagttttag

SEQ ID NO: 5737195 - DNA, 19 bp, Homo sapiens
gaatacacagtattcagag

SEQ ID NO: 5737196 - DNA, 16 bp, Homo sapiens
gaatacacatgcagga

SEQ ID NO: 5737197 - DNA, 16 bp, Homo sapiens
gaatacacttacagtt

SEQ ID NO: 5737198 - DNA, 12 bp, Homo sapiens
gaatacagcagc

SEQ ID NO: 5737199 - DNA, 20 bp, Homo sapiens
gaatacagcagcaagaaaaa

SEQ ID NO: 5737200 - DNA, 21 bp, Homo sapiens
gaatacagcagcaagaaaaaa

SEQ ID NO: 5737201 - DNA, 23 bp, Homo sapiens
gaatacagggcatgcattttgca

SEQ ID NO: 5737202 - DNA, 16 bp, Homo sapiens
gaatacatattacaag

SEQ ID NO: 5737203 - DNA, 13 bp, Homo sapiens
gaatacatttgta

SEQ ID NO: 5737204 - DNA, 17 bp, Homo sapiens
gaatacatttgtattta

SEQ ID NO: 5737205 - DNA, 19 bp, Homo sapiens
gaataccacatcaaataag

SEQ ID NO: 5737206 - DNA, 17 bp, Homo sapiens
gaataccactctgtaat

SEQ ID NO: 5737207 - DNA, 21 bp, Homo sapiens
gaataccattaaaactgcttt

SEQ ID NO: 5737208 - DNA, 20 bp, Homo sapiens
gaatacccaggaagactttg

SEQ ID NO: 5737209 - DNA, 15 bp, Homo sapiens
gaatacccccagaga

SEQ ID NO: 5737210 - DNA, 12 bp, Homo sapiens
gaataccctttt

SEQ ID NO: 5737211 - DNA, 15 bp, Homo sapiens
gaatacctgtccccc

SEQ ID NO: 5737212 - DNA, 23 bp, Homo sapiens
gaatacgctaagcctggaagcca

SEQ ID NO: 5737213 - DNA, 20 bp, Homo sapiens
gaatactacagcataaatct

SEQ ID NO: 5737214 - DNA, 20 bp, Homo sapiens
gaatactacttatgaaatgt

SEQ ID NO: 5737215 - DNA, 18 bp, Homo sapiens
gaatactatccatgtaat

SEQ ID NO: 5737216 - DNA, 23 bp, Homo sapiens
gaatactatccatgtaataagca

SEQ ID NO: 5737217 - DNA, 14 bp, Homo sapiens
gaatactcacattt

SEQ ID NO: 5737218 - DNA, 16 bp, Homo sapiens
gaatactcacattttg

SEQ ID NO: 5737219 - DNA, 14 bp, Homo sapiens
gaatactcttgaaa

SEQ ID NO: 5737220 - DNA, 19 bp, Homo sapiens
gaatactcttggtcacctc

SEQ ID NO: 5737221 - DNA, 21 bp, Homo sapiens
gaatactcttggtcacctcaa

SEQ ID NO: 5737222 - DNA, 16 bp, Homo sapiens
gaatactgatggaatt

SEQ ID NO: 5737223 - DNA, 21 bp, Homo sapiens
gaatactgcatttacagtgta

SEQ ID NO: 5737224 - DNA, 14 bp, Homo sapiens
gaatactgcttgaa

SEQ ID NO: 5737225 - DNA, 18 bp, Homo sapiens
gaatactgggttcttagt

SEQ ID NO: 5737226 - DNA, 13 bp, Homo sapiens
gaatactgtattg

SEQ ID NO: 5737227 - DNA, 16 bp, Homo sapiens
gaatactgtctgtatc

SEQ ID NO: 5737228 - DNA, 17 bp, Homo sapiens
gaatactgtctgtatct

SEQ ID NO: 5737229 - DNA, 18 bp, Homo sapiens
gaatactgtctgtatctt

SEQ ID NO: 5737230 - DNA, 18 bp, Homo sapiens
gaatactgttaaaggaaa

SEQ ID NO: 5737231 - DNA, 13 bp, Homo sapiens
gaatactgtttta

SEQ ID NO: 5737232 - DNA, 18 bp, Homo sapiens
gaatactgttttatctcc

SEQ ID NO: 5737233 - DNA, 14 bp, Homo sapiens
gaatacttgaactt

SEQ ID NO: 5737234 - DNA, 13 bp, Homo sapiens
gaatacttgaagt

SEQ ID NO: 5737235 - DNA, 17 bp, Homo sapiens
gaatactttcttagatt

SEQ ID NO: 5737236 - DNA, 16 bp, Homo sapiens
gaatactttgaatgtg

SEQ ID NO: 5737237 - DNA, 17 bp, Homo sapiens
gaatactttgaatgtgt

SEQ ID NO: 5737238 - DNA, 18 bp, Homo sapiens
gaatactttgaatgtgtt

SEQ ID NO: 5737239 - DNA, 17 bp, Homo sapiens
gaatactttgagtaaac

SEQ ID NO: 5737240 - DNA, 19 bp, Homo sapiens
gaatactttgagtaaactt

SEQ ID NO: 5737241 - DNA, 20 bp, Homo sapiens
gaatactttttacaattaaa

SEQ ID NO: 5737242 - DNA, 19 bp, Homo sapiens
gaatagaaacgtaaactat

SEQ ID NO: 5737243 - DNA, 12 bp, Homo sapiens
gaatagaaagaa

SEQ ID NO: 5737244 - DNA, 21 bp, Homo sapiens
gaatagaaatttgcccctggc

SEQ ID NO: 5737245 - DNA, 14 bp, Homo sapiens
gaatagaagaaaga

SEQ ID NO: 5737246 - DNA, 18 bp, Homo sapiens
gaatagacataaattgta

SEQ ID NO: 5737247 - DNA, 14 bp, Homo sapiens
gaatagacatcaaa

SEQ ID NO: 5737248 - DNA, 19 bp, Homo sapiens
gaatagacatcaaactcaa

SEQ ID NO: 5737249 - DNA, 14 bp, Homo sapiens
gaatagagctgcca

SEQ ID NO: 5737250 - DNA, 17 bp, Homo sapiens
gaatagagctgccactg

SEQ ID NO: 5737251 - DNA, 19 bp, Homo sapiens
gaatagagctgccactggg

SEQ ID NO: 5737252 - DNA, 13 bp, Homo sapiens
gaatagagggagt

SEQ ID NO: 5737253 - DNA, 19 bp, Homo sapiens
gaatagatatgaaagctga

SEQ ID NO: 5737254 - DNA, 18 bp, Homo sapiens
gaatagattttctctgga

SEQ ID NO: 5737255 - DNA, 19 bp, Homo sapiens
gaatagcaaggtgctcaca

SEQ ID NO: 5737256 - DNA, 22 bp, Homo sapiens
gaatagcacccatatctgtgtg

SEQ ID NO: 5737257 - DNA, 23 bp, Homo sapiens
gaatagcagagagccaaatctga

SEQ ID NO: 5737258 - DNA, 21 bp, Homo sapiens
gaatagcagtggcaaaatatt

SEQ ID NO: 5737259 - DNA, 16 bp, Homo sapiens
gaatagcctattgtct

SEQ ID NO: 5737260 - DNA, 13 bp, Homo sapiens
gaatagcctggcc

SEQ ID NO: 5737261 - DNA, 19 bp, Homo sapiens
gaatagcgaatcatctcaa

SEQ ID NO: 5737262 - DNA, 20 bp, Homo sapiens
gaatagcttgtacacatata

SEQ ID NO: 5737263 - DNA, 14 bp, Homo sapiens
gaataggaaataaa

SEQ ID NO: 5737264 - DNA, 19 bp, Homo sapiens
gaataggacttgtttttgt

SEQ ID NO: 5737265 - DNA, 19 bp, Homo sapiens
gaataggagaaagcttaat

SEQ ID NO: 5737266 - DNA, 17 bp, Homo sapiens
gaataggcaaactttta

SEQ ID NO: 5737267 - DNA, 16 bp, Homo sapiens
gaataggcactttaaa

SEQ ID NO: 5737268 - DNA, 21 bp, Homo sapiens
gaataggcattaaatgcaaaa

SEQ ID NO: 5737269 - DNA, 20 bp, Homo sapiens
gaataggcattaacacaaag

SEQ ID NO: 5737270 - DNA, 18 bp, Homo sapiens
gaatagggagacagggta

SEQ ID NO: 5737271 - DNA, 21 bp, Homo sapiens
gaatagggcccatgggaggga

SEQ ID NO: 5737272 - DNA, 17 bp, Homo sapiens
gaataggggaaagaaat

SEQ ID NO: 5737273 - DNA, 14 bp, Homo sapiens
gaataggggagcca

SEQ ID NO: 5737274 - DNA, 16 bp, Homo sapiens
gaataggtaggagacc

SEQ ID NO: 5737275 - DNA, 17 bp, Homo sapiens
gaataggttactttgga

SEQ ID NO: 5737276 - DNA, 18 bp, Homo sapiens
gaatagtatcctccaggt

SEQ ID NO: 5737277 - DNA, 13 bp, Homo sapiens
gaatagtctctgg

SEQ ID NO: 5737278 - DNA, 17 bp, Homo sapiens
gaatagtctctgggttt

SEQ ID NO: 5737279 - DNA, 15 bp, Homo sapiens
gaatagtgcctcagc

SEQ ID NO: 5737280 - DNA, 19 bp, Homo sapiens
gaatagtgcctcagcgctg

SEQ ID NO: 5737281 - DNA, 22 bp, Homo sapiens
gaatagtgctgcaataaacata

SEQ ID NO: 5737282 - DNA, 18 bp, Homo sapiens
gaatagtgcttgctggcc

SEQ ID NO: 5737283 - DNA, 19 bp, Homo sapiens
gaatagtgcttgctggcca

SEQ ID NO: 5737284 - DNA, 15 bp, Homo sapiens
gaatagtggacatgg

SEQ ID NO: 5737285 - DNA, 13 bp, Homo sapiens
gaatagtgtctga

SEQ ID NO: 5737286 - DNA, 23 bp, Homo sapiens
gaatagttaaaaattaaatattt

SEQ ID NO: 5737287 - DNA, 18 bp, Homo sapiens
gaatagttactttacaac

SEQ ID NO: 5737288 - DNA, 21 bp, Homo sapiens
gaatagttgtcagaatatgta

SEQ ID NO: 5737289 - DNA, 16 bp, Homo sapiens
gaatagtttatttctg

SEQ ID NO: 5737290 - DNA, 23 bp, Homo sapiens
gaatagtttatttctgtgaaaga

SEQ ID NO: 5737291 - DNA, 13 bp, Homo sapiens
gaatataaaaaat

SEQ ID NO: 5737292 - DNA, 22 bp, Homo sapiens
gaatataaaaactcctgggctt

SEQ ID NO: 5737293 - DNA, 15 bp, Homo sapiens
gaatataaaacagtc

SEQ ID NO: 5737294 - DNA, 14 bp, Homo sapiens
gaatataaacacta

SEQ ID NO: 5737295 - DNA, 17 bp, Homo sapiens
gaatataaacatataca

SEQ ID NO: 5737296 - DNA, 22 bp, Homo sapiens
gaatataaacatatacagaaaa

SEQ ID NO: 5737297 - DNA, 14 bp, Homo sapiens
gaatataaatatca

SEQ ID NO: 5737298 - DNA, 17 bp, Homo sapiens
gaatataaatatcacaa

SEQ ID NO: 5737299 - DNA, 12 bp, Homo sapiens
gaatataagaaa

SEQ ID NO: 5737300 - DNA, 15 bp, Homo sapiens
gaatataagaaaagt

SEQ ID NO: 5737301 - DNA, 14 bp, Homo sapiens
gaatataagaaaat

SEQ ID NO: 5737302 - DNA, 21 bp, Homo sapiens
gaatataagcttaaaataagt

SEQ ID NO: 5737303 - DNA, 22 bp, Homo sapiens
gaatataatatttgaagcagct

SEQ ID NO: 5737304 - DNA, 19 bp, Homo sapiens
gaatataatggcctcttaa

SEQ ID NO: 5737305 - DNA, 16 bp, Homo sapiens
gaatatacagagcctt

SEQ ID NO: 5737306 - DNA, 14 bp, Homo sapiens
gaatatacatagtc

SEQ ID NO: 5737307 - DNA, 21 bp, Homo sapiens
gaatatacatagtctttgttt

SEQ ID NO: 5737308 - DNA, 21 bp, Homo sapiens
gaatataccccttagtgtttg

SEQ ID NO: 5737309 - DNA, 17 bp, Homo sapiens
gaatatagcatctttca

SEQ ID NO: 5737310 - DNA, 14 bp, Homo sapiens
gaatatagcctgcc

SEQ ID NO: 5737311 - DNA, 15 bp, Homo sapiens
gaatataggaagcat

SEQ ID NO: 5737312 - DNA, 13 bp, Homo sapiens
gaatatagttatt

SEQ ID NO: 5737313 - DNA, 15 bp, Homo sapiens
gaatatagttctgtg

SEQ ID NO: 5737314 - DNA, 22 bp, Homo sapiens
gaatatagttctgtgtagagaa

SEQ ID NO: 5737315 - DNA, 14 bp, Homo sapiens
gaatatatatggaa

SEQ ID NO: 5737316 - DNA, 15 bp, Homo sapiens
gaatatatggcagag

SEQ ID NO: 5737317 - DNA, 23 bp, Homo sapiens
gaatatatggcatttgcagattt

SEQ ID NO: 5737318 - DNA, 15 bp, Homo sapiens
gaatatatgtgtgcc

SEQ ID NO: 5737319 - DNA, 14 bp, Homo sapiens
gaatatattactga

SEQ ID NO: 5737320 - DNA, 16 bp, Homo sapiens
gaatatatttaagcaa

SEQ ID NO: 5737321 - DNA, 21 bp, Homo sapiens
gaatatatttatttaaagcat

SEQ ID NO: 5737322 - DNA, 16 bp, Homo sapiens
gaatatcatctgtcat

SEQ ID NO: 5737323 - DNA, 22 bp, Homo sapiens
gaatatcatctgtcattatatt

SEQ ID NO: 5737324 - DNA, 15 bp, Homo sapiens
gaatatcatctttta

SEQ ID NO: 5737325 - DNA, 22 bp, Homo sapiens
gaatatcccctcccagtcacct

SEQ ID NO: 5737326 - DNA, 20 bp, Homo sapiens
gaatatccgtgccaggaaaa

SEQ ID NO: 5737327 - DNA, 16 bp, Homo sapiens
gaatatctgagaattg

SEQ ID NO: 5737328 - DNA, 14 bp, Homo sapiens
gaatatctgggatt

SEQ ID NO: 5737329 - DNA, 12 bp, Homo sapiens
gaatatgaagtt

SEQ ID NO: 5737330 - DNA, 11 bp, Homo sapiens
gaatatgaatg

SEQ ID NO: 5737331 - DNA, 12 bp, Homo sapiens
gaatatgaatgt

SEQ ID NO: 5737332 - DNA, 16 bp, Homo sapiens
gaatatgactcaggag

SEQ ID NO: 5737333 - DNA, 15 bp, Homo sapiens
gaatatgactgtttt

SEQ ID NO: 5737334 - DNA, 21 bp, Homo sapiens
gaatatgattaaaaatatcaa

SEQ ID NO: 5737335 - DNA, 18 bp, Homo sapiens
gaatatgattagtaaaga

SEQ ID NO: 5737336 - DNA, 22 bp, Homo sapiens
gaatatgcaaggcggtacacta

SEQ ID NO: 5737337 - DNA, 19 bp, Homo sapiens
gaatatgcatcccacagcc

SEQ ID NO: 5737338 - DNA, 20 bp, Homo sapiens
gaatatgcatcccacagcca

SEQ ID NO: 5737339 - DNA, 18 bp, Homo sapiens
gaatatgcctgtaattca

SEQ ID NO: 5737340 - DNA, 13 bp, Homo sapiens
gaatatggaacat

SEQ ID NO: 5737341 - DNA, 18 bp, Homo sapiens
gaatatgggagaaatagt

SEQ ID NO: 5737342 - DNA, 21 bp, Homo sapiens
gaatatgggagaaatagtgtg

SEQ ID NO: 5737343 - DNA, 20 bp, Homo sapiens
gaatatggttggagagccct

SEQ ID NO: 5737344 - DNA, 21 bp, Homo sapiens
gaatatggttggagagccctg

SEQ ID NO: 5737345 - DNA, 16 bp, Homo sapiens
gaatatgtatgtacct

SEQ ID NO: 5737346 - DNA, 21 bp, Homo sapiens
gaatatgtcagtgctgatgta

SEQ ID NO: 5737347 - DNA, 16 bp, Homo sapiens
gaatatgtgccttcta

SEQ ID NO: 5737348 - DNA, 23 bp, Homo sapiens
gaatatgtgccttctagaataca

SEQ ID NO: 5737349 - DNA, 12 bp, Homo sapiens
gaatatgtgtaa

SEQ ID NO: 5737350 - DNA, 13 bp, Homo sapiens
gaatatgttgatt

SEQ ID NO: 5737351 - DNA, 15 bp, Homo sapiens
gaatatgtttcaaac

SEQ ID NO: 5737352 - DNA, 15 bp, Homo sapiens
gaatatgtttccttg

SEQ ID NO: 5737353 - DNA, 19 bp, Homo sapiens
gaatatgtttccttgttta

SEQ ID NO: 5737354 - DNA, 23 bp, Homo sapiens
gaatattaaagctcttcatttct

SEQ ID NO: 5737355 - DNA, 23 bp, Homo sapiens
gaatattaagcacattattgtag

SEQ ID NO: 5737356 - DNA, 13 bp, Homo sapiens
gaatattaatccc

SEQ ID NO: 5737357 - DNA, 18 bp, Homo sapiens
gaatattaattagtttat

SEQ ID NO: 5737358 - DNA, 18 bp, Homo sapiens
gaatattacatgtaaagc

SEQ ID NO: 5737359 - DNA, 16 bp, Homo sapiens
gaatattacattgcat

SEQ ID NO: 5737360 - DNA, 18 bp, Homo sapiens
gaatattagatgctctga

SEQ ID NO: 5737361 - DNA, 20 bp, Homo sapiens
gaatattagtgacctcagct

SEQ ID NO: 5737362 - DNA, 15 bp, Homo sapiens
gaatattataaaaat

SEQ ID NO: 5737363 - DNA, 18 bp, Homo sapiens
gaatattataaaaatatc

SEQ ID NO: 5737364 - DNA, 13 bp, Homo sapiens
gaatattatatat

SEQ ID NO: 5737365 - DNA, 13 bp, Homo sapiens
gaatattatattt

SEQ ID NO: 5737366 - DNA, 16 bp, Homo sapiens
gaatattatatttgga

SEQ ID NO: 5737367 - DNA, 20 bp, Homo sapiens
gaatattcagagaatatcaa

SEQ ID NO: 5737368 - DNA, 16 bp, Homo sapiens
gaatattcatattgga

SEQ ID NO: 5737369 - DNA, 19 bp, Homo sapiens
gaatattcatggatggctc

SEQ ID NO: 5737370 - DNA, 14 bp, Homo sapiens
gaatattcatttta

SEQ ID NO: 5737371 - DNA, 18 bp, Homo sapiens
gaatattcccaagcccat

SEQ ID NO: 5737372 - DNA, 22 bp, Homo sapiens
gaatattcctggacttacaaaa

SEQ ID NO: 5737373 - DNA, 14 bp, Homo sapiens
gaatattctagaac

SEQ ID NO: 5737374 - DNA, 20 bp, Homo sapiens
gaatattgcaaaatacatga

SEQ ID NO: 5737375 - DNA, 21 bp, Homo sapiens
gaatattgcaaaatacatgaa

SEQ ID NO: 5737376 - DNA, 13 bp, Homo sapiens
gaatattgccaat

SEQ ID NO: 5737377 - DNA, 15 bp, Homo sapiens
gaatattgctgatgg

SEQ ID NO: 5737378 - DNA, 22 bp, Homo sapiens
gaatattgctgatggtgcaatg

SEQ ID NO: 5737379 - DNA, 13 bp, Homo sapiens
gaatattggacat

SEQ ID NO: 5737380 - DNA, 18 bp, Homo sapiens
gaatattgtaactcacat

SEQ ID NO: 5737381 - DNA, 23 bp, Homo sapiens
gaatattgtattgttagatgttt

SEQ ID NO: 5737382 - DNA, 14 bp, Homo sapiens
gaatattgttaaaa

SEQ ID NO: 5737383 - DNA, 14 bp, Homo sapiens
gaatattgtttctt

SEQ ID NO: 5737384 - DNA, 20 bp, Homo sapiens
gaatatttaagcaataaaac

SEQ ID NO: 5737385 - DNA, 18 bp, Homo sapiens
gaatatttacaataaaga

SEQ ID NO: 5737386 - DNA, 20 bp, Homo sapiens
gaatatttacaataaagagt

SEQ ID NO: 5737387 - DNA, 12 bp, Homo sapiens
gaatatttagca

SEQ ID NO: 5737388 - DNA, 19 bp, Homo sapiens
gaatatttatatttcacta

SEQ ID NO: 5737389 - DNA, 17 bp, Homo sapiens
gaatatttattacctct

SEQ ID NO: 5737390 - DNA, 19 bp, Homo sapiens
gaatatttattacctctga

SEQ ID NO: 5737391 - DNA, 14 bp, Homo sapiens
gaatatttatttaa

SEQ ID NO: 5737392 - DNA, 17 bp, Homo sapiens
gaatatttcaaaataaa

SEQ ID NO: 5737393 - DNA, 18 bp, Homo sapiens
gaatatttcaaatgaaca

SEQ ID NO: 5737394 - DNA, 16 bp, Homo sapiens
gaatatttcaagctct

SEQ ID NO: 5737395 - DNA, 10 bp, Homo sapiens
gaatatttga

SEQ ID NO: 5737396 - DNA, 15 bp, Homo sapiens
gaatatttgaataat

SEQ ID NO: 5737397 - DNA, 13 bp, Homo sapiens
gaatatttgaatc

SEQ ID NO: 5737398 - DNA, 14 bp, Homo sapiens
gaatatttgaatct

SEQ ID NO: 5737399 - DNA, 20 bp, Homo sapiens
gaatatttgtcgatatttcc

SEQ ID NO: 5737400 - DNA, 18 bp, Homo sapiens
gaatattttaaaaataaa

SEQ ID NO: 5737401 - DNA, 16 bp, Homo sapiens
gaatattttatcctgt

SEQ ID NO: 5737402 - DNA, 14 bp, Homo sapiens
gaatattttattca

SEQ ID NO: 5737403 - DNA, 18 bp, Homo sapiens
gaatattttattcaaggt

SEQ ID NO: 5737404 - DNA, 14 bp, Homo sapiens
gaatattttcaaaa

SEQ ID NO: 5737405 - DNA, 15 bp, Homo sapiens
gaatattttcaaaat

SEQ ID NO: 5737406 - DNA, 21 bp, Homo sapiens
gaatattttcagtaatgttat

SEQ ID NO: 5737407 - DNA, 15 bp, Homo sapiens
gaatattttgatgca

SEQ ID NO: 5737408 - DNA, 19 bp, Homo sapiens
gaatattttgatgcagata

SEQ ID NO: 5737409 - DNA, 18 bp, Homo sapiens
gaatattttggaaactgc

SEQ ID NO: 5737410 - DNA, 20 bp, Homo sapiens
gaatattttggaaactgcta

SEQ ID NO: 5737411 - DNA, 22 bp, Homo sapiens
gaatattttggaaactgctaaa

SEQ ID NO: 5737412 - DNA, 21 bp, Homo sapiens
gaatatttttatatttccttt

SEQ ID NO: 5737413 - DNA, 16 bp, Homo sapiens
gaatatttttgtattt

SEQ ID NO: 5737414 - DNA, 20 bp, Homo sapiens
gaatattttttatttctaag

SEQ ID NO: 5737415 - DNA, 21 bp, Homo sapiens
gaatattttttatttctaagt

SEQ ID NO: 5737416 - DNA, 18 bp, Homo sapiens
gaatattttttgaaggtt

SEQ ID NO: 5737417 - DNA, 13 bp, Homo sapiens
gaatcaaaactct

SEQ ID NO: 5737418 - DNA, 15 bp, Homo sapiens
gaatcaaaactctcc

SEQ ID NO: 5737419 - DNA, 17 bp, Homo sapiens
gaatcaaagacatttca

SEQ ID NO: 5737420 - DNA, 17 bp, Homo sapiens
gaatcaaagcaatgcat

SEQ ID NO: 5737421 - DNA, 18 bp, Homo sapiens
gaatcaaagcaatgcatt

SEQ ID NO: 5737422 - DNA, 17 bp, Homo sapiens
gaatcaaataaaaattc

SEQ ID NO: 5737423 - DNA, 17 bp, Homo sapiens
gaatcaaatactcattt

SEQ ID NO: 5737424 - DNA, 16 bp, Homo sapiens
gaatcaaatcttacaa

SEQ ID NO: 5737425 - DNA, 17 bp, Homo sapiens
gaatcaaatcttacaaa

SEQ ID NO: 5737426 - DNA, 22 bp, Homo sapiens
gaatcaaatcttacaaaatcct

SEQ ID NO: 5737427 - DNA, 17 bp, Homo sapiens
gaatcaacagggcagca

SEQ ID NO: 5737428 - DNA, 19 bp, Homo sapiens
gaatcaacagtgaacagct

SEQ ID NO: 5737429 - DNA, 21 bp, Homo sapiens
gaatcaactaggtatttaaga

SEQ ID NO: 5737430 - DNA, 21 bp, Homo sapiens
gaatcaagatgtcagactggc

SEQ ID NO: 5737431 - DNA, 17 bp, Homo sapiens
gaatcaagggtcaggcc

SEQ ID NO: 5737432 - DNA, 16 bp, Homo sapiens
gaatcaagtctgtgaa

SEQ ID NO: 5737433 - DNA, 21 bp, Homo sapiens
gaatcaataatatattttctg

SEQ ID NO: 5737434 - DNA, 14 bp, Homo sapiens
gaatcaatcctggg

SEQ ID NO: 5737435 - DNA, 19 bp, Homo sapiens
gaatcaatgtgctccttca

SEQ ID NO: 5737436 - DNA, 15 bp, Homo sapiens
gaatcacaggctggg

SEQ ID NO: 5737437 - DNA, 18 bp, Homo sapiens
gaatcacagtatcagtat

SEQ ID NO: 5737438 - DNA, 17 bp, Homo sapiens
gaatcaccaattaaaaa

SEQ ID NO: 5737439 - DNA, 21 bp, Homo sapiens
gaatcaccaattaaaaacctt

SEQ ID NO: 5737440 - DNA, 17 bp, Homo sapiens
gaatcacctgaacccca

SEQ ID NO: 5737441 - DNA, 22 bp, Homo sapiens
gaatcacctgaaccccagaggc

SEQ ID NO: 5737442 - DNA, 14 bp, Homo sapiens
gaatcacctggagg

SEQ ID NO: 5737443 - DNA, 15 bp, Homo sapiens
gaatcacctggaggg

SEQ ID NO: 5737444 - DNA, 14 bp, Homo sapiens
gaatcacctggctg

SEQ ID NO: 5737445 - DNA, 18 bp, Homo sapiens
gaatcacctggctgagca

SEQ ID NO: 5737446 - DNA, 20 bp, Homo sapiens
gaatcactaggtaacttatt

SEQ ID NO: 5737447 - DNA, 18 bp, Homo sapiens
gaatcactcttgtggatg

SEQ ID NO: 5737448 - DNA, 19 bp, Homo sapiens
gaatcactgtgctcagcca

SEQ ID NO: 5737449 - DNA, 16 bp, Homo sapiens
gaatcactgtttttag

SEQ ID NO: 5737450 - DNA, 18 bp, Homo sapiens
gaatcacttaagcctgga

SEQ ID NO: 5737451 - DNA, 20 bp, Homo sapiens
gaatcacttgaacccgggag

SEQ ID NO: 5737452 - DNA, 21 bp, Homo sapiens
gaatcacttttaactgtttta

SEQ ID NO: 5737453 - DNA, 15 bp, Homo sapiens
gaatcacttttctag

SEQ ID NO: 5737454 - DNA, 19 bp, Homo sapiens
gaatcagaacagatgctga

SEQ ID NO: 5737455 - DNA, 12 bp, Homo sapiens
gaatcagaagaa

SEQ ID NO: 5737456 - DNA, 15 bp, Homo sapiens
gaatcagaagaaagg

SEQ ID NO: 5737457 - DNA, 18 bp, Homo sapiens
gaatcagaatcatggaga

SEQ ID NO: 5737458 - DNA, 17 bp, Homo sapiens
gaatcagacagcaggaa

SEQ ID NO: 5737459 - DNA, 23 bp, Homo sapiens
gaatcagaccctaccccaccacg

SEQ ID NO: 5737460 - DNA, 19 bp, Homo sapiens
gaatcagacttcacactgc

SEQ ID NO: 5737461 - DNA, 20 bp, Homo sapiens
gaatcagatggtgtcattta

SEQ ID NO: 5737462 - DNA, 15 bp, Homo sapiens
gaatcagattattaa

SEQ ID NO: 5737463 - DNA, 18 bp, Homo sapiens
gaatcagattcaggagct

SEQ ID NO: 5737464 - DNA, 12 bp, Homo sapiens
gaatcagctgga

SEQ ID NO: 5737465 - DNA, 16 bp, Homo sapiens
gaatcagctggtggct

SEQ ID NO: 5737466 - DNA, 12 bp, Homo sapiens
gaatcagcttct

SEQ ID NO: 5737467 - DNA, 13 bp, Homo sapiens
gaatcaggaaact

SEQ ID NO: 5737468 - DNA, 15 bp, Homo sapiens
gaatcagggaccagc

SEQ ID NO: 5737469 - DNA, 18 bp, Homo sapiens
gaatcagggaccagcttt

SEQ ID NO: 5737470 - DNA, 19 bp, Homo sapiens
gaatcagggaccagcttta

SEQ ID NO: 5737471 - DNA, 15 bp, Homo sapiens
gaatcaggtttccaa

SEQ ID NO: 5737472 - DNA, 19 bp, Homo sapiens
gaatcagtaggaccaggcc

SEQ ID NO: 5737473 - DNA, 19 bp, Homo sapiens
gaatcagtataaacaaagt

SEQ ID NO: 5737474 - DNA, 16 bp, Homo sapiens
gaatcagtatttcctt

SEQ ID NO: 5737475 - DNA, 22 bp, Homo sapiens
gaatcagtatttccttccactg

SEQ ID NO: 5737476 - DNA, 23 bp, Homo sapiens
gaatcagtatttccttccactgt

SEQ ID NO: 5737477 - DNA, 15 bp, Homo sapiens
gaatcagtgcaaaga

SEQ ID NO: 5737478 - DNA, 14 bp, Homo sapiens
gaatcagtgttaaa

SEQ ID NO: 5737479 - DNA, 22 bp, Homo sapiens
gaatcagtttccaattatttga

SEQ ID NO: 5737480 - DNA, 13 bp, Homo sapiens
gaatcataatttt

SEQ ID NO: 5737481 - DNA, 17 bp, Homo sapiens
gaatcataattttcaag

SEQ ID NO: 5737482 - DNA, 19 bp, Homo sapiens
gaatcatatgattctgctt

SEQ ID NO: 5737483 - DNA, 17 bp, Homo sapiens
gaatcatctcctttgca

SEQ ID NO: 5737484 - DNA, 21 bp, Homo sapiens
gaatcatctcctttgcagaat

SEQ ID NO: 5737485 - DNA, 18 bp, Homo sapiens
gaatcatgagcctgctgg

SEQ ID NO: 5737486 - DNA, 16 bp, Homo sapiens
gaatcatggagaaaat

SEQ ID NO: 5737487 - DNA, 17 bp, Homo sapiens
gaatcatggatttattt

SEQ ID NO: 5737488 - DNA, 22 bp, Homo sapiens
gaatcatggcctcttgaagaga

SEQ ID NO: 5737489 - DNA, 14 bp, Homo sapiens
gaatcatgtatttt

SEQ ID NO: 5737490 - DNA, 19 bp, Homo sapiens
gaatcatgtattttgtaaa

SEQ ID NO: 5737491 - DNA, 20 bp, Homo sapiens
gaatcatgtcaggcctgtgt

SEQ ID NO: 5737492 - DNA, 12 bp, Homo sapiens
gaatcatgtcca

SEQ ID NO: 5737493 - DNA, 17 bp, Homo sapiens
gaatcatgtccatccct

SEQ ID NO: 5737494 - DNA, 13 bp, Homo sapiens
gaatcatgtctgt

SEQ ID NO: 5737495 - DNA, 14 bp, Homo sapiens
gaatcatgtttctt

SEQ ID NO: 5737496 - DNA, 16 bp, Homo sapiens
gaatcattatttatta

SEQ ID NO: 5737497 - DNA, 13 bp, Homo sapiens
gaatcattctggc

SEQ ID NO: 5737498 - DNA, 14 bp, Homo sapiens
gaatcattctgtaa

SEQ ID NO: 5737499 - DNA, 12 bp, Homo sapiens
gaatcattgctt

SEQ ID NO: 5737500 - DNA, 20 bp, Homo sapiens
gaatcattgtaaacattagt

SEQ ID NO: 5737501 - DNA, 14 bp, Homo sapiens
gaatcattgtgctt

SEQ ID NO: 5737502 - DNA, 21 bp, Homo sapiens
gaatcattgtgcttaataata

SEQ ID NO: 5737503 - DNA, 23 bp, Homo sapiens
gaatcatttgttcaaagctgttg

SEQ ID NO: 5737504 - DNA, 17 bp, Homo sapiens
gaatccaaaagaaaaac

SEQ ID NO: 5737505 - DNA, 22 bp, Homo sapiens
gaatccaaaagacaaaaatcaa

SEQ ID NO: 5737506 - DNA, 12 bp, Homo sapiens
gaatccaagatt

SEQ ID NO: 5737507 - DNA, 20 bp, Homo sapiens
gaatccaagcctaaaattaa

SEQ ID NO: 5737508 - DNA, 15 bp, Homo sapiens
gaatccaagcctcca

SEQ ID NO: 5737509 - DNA, 17 bp, Homo sapiens
gaatccaagtgaacact

SEQ ID NO: 5737510 - DNA, 17 bp, Homo sapiens
gaatccacatttctaaa

SEQ ID NO: 5737511 - DNA, 15 bp, Homo sapiens
gaatccacctcggag

SEQ ID NO: 5737512 - DNA, 13 bp, Homo sapiens
gaatccacctgca

SEQ ID NO: 5737513 - DNA, 15 bp, Homo sapiens
gaatccagcaggtca

SEQ ID NO: 5737514 - DNA, 19 bp, Homo sapiens
gaatccagctccctagact

SEQ ID NO: 5737515 - DNA, 17 bp, Homo sapiens
gaatccaggaggcagtg

SEQ ID NO: 5737516 - DNA, 18 bp, Homo sapiens
gaatccataaatgtgttc

SEQ ID NO: 5737517 - DNA, 19 bp, Homo sapiens
gaatccatcaggacttggg

SEQ ID NO: 5737518 - DNA, 15 bp, Homo sapiens
gaatccatcctgcaa

SEQ ID NO: 5737519 - DNA, 17 bp, Homo sapiens
gaatccatgggtctggc

SEQ ID NO: 5737520 - DNA, 15 bp, Homo sapiens
gaatccattggagaa

SEQ ID NO: 5737521 - DNA, 19 bp, Homo sapiens
gaatcccaaatttgattga

SEQ ID NO: 5737522 - DNA, 18 bp, Homo sapiens
gaatcccacccacatgtg

SEQ ID NO: 5737523 - DNA, 22 bp, Homo sapiens
gaatcccacttatcaaatcatt

SEQ ID NO: 5737524 - DNA, 17 bp, Homo sapiens
gaatcccagaggtggga

SEQ ID NO: 5737525 - DNA, 14 bp, Homo sapiens
gaatcccagcagca

SEQ ID NO: 5737526 - DNA, 12 bp, Homo sapiens
gaatcccagctc

SEQ ID NO: 5737527 - DNA, 13 bp, Homo sapiens
gaatcccagctcc

SEQ ID NO: 5737528 - DNA, 19 bp, Homo sapiens
gaatccccaacatgcactg

SEQ ID NO: 5737529 - DNA, 23 bp, Homo sapiens
gaatcccccttgccaccccaccc

SEQ ID NO: 5737530 - DNA, 17 bp, Homo sapiens
gaatccccgtgctcaca

SEQ ID NO: 5737531 - DNA, 20 bp, Homo sapiens
gaatcccctaaacaaaaaga

SEQ ID NO: 5737532 - DNA, 21 bp, Homo sapiens
gaatcccctatcccattctgc

SEQ ID NO: 5737533 - DNA, 13 bp, Homo sapiens
gaatcccctcgct

SEQ ID NO: 5737534 - DNA, 18 bp, Homo sapiens
gaatcccctcgcttcata

SEQ ID NO: 5737535 - DNA, 22 bp, Homo sapiens
gaatcccctcgcttcataggca

SEQ ID NO: 5737536 - DNA, 14 bp, Homo sapiens
gaatcccctgggga

SEQ ID NO: 5737537 - DNA, 21 bp, Homo sapiens
gaatcccggctccagagcagg

SEQ ID NO: 5737538 - DNA, 22 bp, Homo sapiens
gaatcccggctccagagcagga

SEQ ID NO: 5737539 - DNA, 18 bp, Homo sapiens
gaatccctgcagcctggt

SEQ ID NO: 5737540 - DNA, 13 bp, Homo sapiens
gaatccctgggag

SEQ ID NO: 5737541 - DNA, 17 bp, Homo sapiens
gaatccctgttcattgt

SEQ ID NO: 5737542 - DNA, 19 bp, Homo sapiens
gaatcccttaacagttgta

SEQ ID NO: 5737543 - DNA, 22 bp, Homo sapiens
gaatccctttgcacctgagacc

SEQ ID NO: 5737544 - DNA, 14 bp, Homo sapiens
gaatccgtattgaa

SEQ ID NO: 5737545 - DNA, 18 bp, Homo sapiens
gaatccgtattgaatttg

SEQ ID NO: 5737546 - DNA, 21 bp, Homo sapiens
gaatccgtattgaatttgtgt

SEQ ID NO: 5737547 - DNA, 23 bp, Homo sapiens
gaatcctacacacctaagggaca

SEQ ID NO: 5737548 - DNA, 19 bp, Homo sapiens
gaatcctgcggcaggactg

SEQ ID NO: 5737549 - DNA, 16 bp, Homo sapiens
gaatcctgctgccaga

SEQ ID NO: 5737550 - DNA, 18 bp, Homo sapiens
gaatcctgctgccagaga

SEQ ID NO: 5737551 - DNA, 12 bp, Homo sapiens
gaatcctgcttt

SEQ ID NO: 5737552 - DNA, 16 bp, Homo sapiens
gaatcctggacagctc

SEQ ID NO: 5737553 - DNA, 22 bp, Homo sapiens
gaatcctgtcctcagcttctta

SEQ ID NO: 5737554 - DNA, 15 bp, Homo sapiens
gaatccttactgata

SEQ ID NO: 5737555 - DNA, 23 bp, Homo sapiens
gaatccttactgatatttataga

SEQ ID NO: 5737556 - DNA, 14 bp, Homo sapiens
gaatcgaggaacca

SEQ ID NO: 5737557 - DNA, 18 bp, Homo sapiens
gaatcgaggaaccagagc

SEQ ID NO: 5737558 - DNA, 19 bp, Homo sapiens
gaatcgatctgtactgtaa

SEQ ID NO: 5737559 - DNA, 21 bp, Homo sapiens
gaatcgatgggggatgcttca

SEQ ID NO: 5737560 - DNA, 22 bp, Homo sapiens
gaatcgatgggggatgcttcat

SEQ ID NO: 5737561 - DNA, 21 bp, Homo sapiens
gaatcgattcccaagctccct

SEQ ID NO: 5737562 - DNA, 15 bp, Homo sapiens
gaatcgcagctgtgg

SEQ ID NO: 5737563 - DNA, 16 bp, Homo sapiens
gaatcgctcctgcagc

SEQ ID NO: 5737564 - DNA, 19 bp, Homo sapiens
gaatcgcttgaacctggga

SEQ ID NO: 5737565 - DNA, 14 bp, Homo sapiens
gaatcgctttcctt

SEQ ID NO: 5737566 - DNA, 22 bp, Homo sapiens
gaatcggcgacggagcactgca

SEQ ID NO: 5737567 - DNA, 14 bp, Homo sapiens
gaatcggctgggga

SEQ ID NO: 5737568 - DNA, 20 bp, Homo sapiens
gaatcgtttcaaatggactc

SEQ ID NO: 5737569 - DNA, 16 bp, Homo sapiens
gaatcgtttcatgtaa

SEQ ID NO: 5737570 - DNA, 11 bp, Homo sapiens
gaatctaaacc

SEQ ID NO: 5737571 - DNA, 18 bp, Homo sapiens
gaatctaacagtgacttc

SEQ ID NO: 5737572 - DNA, 20 bp, Homo sapiens
gaatctaacttgatcttgtt

SEQ ID NO: 5737573 - DNA, 23 bp, Homo sapiens
gaatctaaggataatgaaataat

SEQ ID NO: 5737574 - DNA, 15 bp, Homo sapiens
gaatctacatttgtt

SEQ ID NO: 5737575 - DNA, 20 bp, Homo sapiens
gaatctacatttgtttgtat

SEQ ID NO: 5737576 - DNA, 21 bp, Homo sapiens
gaatctacatttgtttgtatt

SEQ ID NO: 5737577 - DNA, 12 bp, Homo sapiens
gaatctaccaac

SEQ ID NO: 5737578 - DNA, 18 bp, Homo sapiens
gaatctacccccagatcc

SEQ ID NO: 5737579 - DNA, 13 bp, Homo sapiens
gaatctactttaa

SEQ ID NO: 5737580 - DNA, 21 bp, Homo sapiens
gaatctagaaatgttcacaag

SEQ ID NO: 5737581 - DNA, 16 bp, Homo sapiens
gaatctagaagaaatg

SEQ ID NO: 5737582 - DNA, 16 bp, Homo sapiens
gaatctagaggagggg

SEQ ID NO: 5737583 - DNA, 19 bp, Homo sapiens
gaatctagataggtgcttt

SEQ ID NO: 5737584 - DNA, 16 bp, Homo sapiens
gaatctagcccaacct

SEQ ID NO: 5737585 - DNA, 16 bp, Homo sapiens
gaatctataaaagaat

SEQ ID NO: 5737586 - DNA, 19 bp, Homo sapiens
gaatctataagtagtaaat

SEQ ID NO: 5737587 - DNA, 12 bp, Homo sapiens
gaatctatgcca

SEQ ID NO: 5737588 - DNA, 15 bp, Homo sapiens
gaatctatgccaaag

SEQ ID NO: 5737589 - DNA, 20 bp, Homo sapiens
gaatctatggctttaaataa

SEQ ID NO: 5737590 - DNA, 16 bp, Homo sapiens
gaatctattagatttt

SEQ ID NO: 5737591 - DNA, 21 bp, Homo sapiens
gaatctattatactgtattaa

SEQ ID NO: 5737592 - DNA, 13 bp, Homo sapiens
gaatctatttaag

SEQ ID NO: 5737593 - DNA, 20 bp, Homo sapiens
gaatctatttatcttcattt

SEQ ID NO: 5737594 - DNA, 23 bp, Homo sapiens
gaatctattttctatgtactagt

SEQ ID NO: 5737595 - DNA, 20 bp, Homo sapiens
gaatctccatttctgctcag

SEQ ID NO: 5737596 - DNA, 17 bp, Homo sapiens
gaatctcccactccagc

SEQ ID NO: 5737597 - DNA, 14 bp, Homo sapiens
gaatctcccctcct

SEQ ID NO: 5737598 - DNA, 20 bp, Homo sapiens
gaatctccgtagaattttgc

SEQ ID NO: 5737599 - DNA, 19 bp, Homo sapiens
gaatctcgcagtgtttctg

SEQ ID NO: 5737600 - DNA, 19 bp, Homo sapiens
gaatctctcaaaatgtgcc

SEQ ID NO: 5737601 - DNA, 20 bp, Homo sapiens
gaatctctcaaacggcaaca

SEQ ID NO: 5737602 - DNA, 15 bp, Homo sapiens
gaatctctgtgcctt

SEQ ID NO: 5737603 - DNA, 22 bp, Homo sapiens
gaatctcttttctggtaatttt

SEQ ID NO: 5737604 - DNA, 20 bp, Homo sapiens
gaatctgaaaccctccttct

SEQ ID NO: 5737605 - DNA, 20 bp, Homo sapiens
gaatctgaaagtatattttc

SEQ ID NO: 5737606 - DNA, 14 bp, Homo sapiens
gaatctgaccacag

SEQ ID NO: 5737607 - DNA, 17 bp, Homo sapiens
gaatctgaccacagaca

SEQ ID NO: 5737608 - DNA, 18 bp, Homo sapiens
gaatctgaccacagacac

SEQ ID NO: 5737609 - DNA, 15 bp, Homo sapiens
gaatctgagacatct

SEQ ID NO: 5737610 - DNA, 23 bp, Homo sapiens
gaatctgagagatgctgtagaca

SEQ ID NO: 5737611 - DNA, 17 bp, Homo sapiens
gaatctgagctgcaggt

SEQ ID NO: 5737612 - DNA, 20 bp, Homo sapiens
gaatctgataggaaaagaag

SEQ ID NO: 5737613 - DNA, 12 bp, Homo sapiens
gaatctgcaggg

SEQ ID NO: 5737614 - DNA, 18 bp, Homo sapiens
gaatctgccattactctg

SEQ ID NO: 5737615 - DNA, 21 bp, Homo sapiens
gaatctgcctgtggccttgcc

SEQ ID NO: 5737616 - DNA, 20 bp, Homo sapiens
gaatctgccttccagcccag

SEQ ID NO: 5737617 - DNA, 18 bp, Homo sapiens
gaatctgctgagaggcac

SEQ ID NO: 5737618 - DNA, 15 bp, Homo sapiens
gaatctgctgttgcc

SEQ ID NO: 5737619 - DNA, 21 bp, Homo sapiens
gaatctgctgttgccatagcc

SEQ ID NO: 5737620 - DNA, 16 bp, Homo sapiens
gaatctgctttaatta

SEQ ID NO: 5737621 - DNA, 18 bp, Homo sapiens
gaatctgcttttcctctg

SEQ ID NO: 5737622 - DNA, 23 bp, Homo sapiens
gaatctgcttttcctctgccttc

SEQ ID NO: 5737623 - DNA, 15 bp, Homo sapiens
gaatctggacatttg

SEQ ID NO: 5737624 - DNA, 16 bp, Homo sapiens
gaatctggacatttgt

SEQ ID NO: 5737625 - DNA, 13 bp, Homo sapiens
gaatctggattat

SEQ ID NO: 5737626 - DNA, 23 bp, Homo sapiens
gaatctggcattctacacctgga

SEQ ID NO: 5737627 - DNA, 14 bp, Homo sapiens
gaatctgggaggga

SEQ ID NO: 5737628 - DNA, 12 bp, Homo sapiens
gaatctgggggt

SEQ ID NO: 5737629 - DNA, 12 bp, Homo sapiens
gaatctgtacat

SEQ ID NO: 5737630 - DNA, 21 bp, Homo sapiens
gaatctgtacatgttcttgtc

SEQ ID NO: 5737631 - DNA, 20 bp, Homo sapiens
gaatctgtagaggagcctgg

SEQ ID NO: 5737632 - DNA, 23 bp, Homo sapiens
gaatctgtagaggagcctggagt

SEQ ID NO: 5737633 - DNA, 16 bp, Homo sapiens
gaatctgtatatattt

SEQ ID NO: 5737634 - DNA, 16 bp, Homo sapiens
gaatctgtatgattct

SEQ ID NO: 5737635 - DNA, 19 bp, Homo sapiens
gaatctgtgcagtcatcaa

SEQ ID NO: 5737636 - DNA, 17 bp, Homo sapiens
gaatctgtgctggccat

SEQ ID NO: 5737637 - DNA, 22 bp, Homo sapiens
gaatctgtgtgcatatttgtta

SEQ ID NO: 5737638 - DNA, 21 bp, Homo sapiens
gaatcttaaggtgtagccaca

SEQ ID NO: 5737639 - DNA, 20 bp, Homo sapiens
gaatcttaatgcttgtaatt

SEQ ID NO: 5737640 - DNA, 15 bp, Homo sapiens
gaatcttatttttcc

SEQ ID NO: 5737641 - DNA, 22 bp, Homo sapiens
gaatcttatttttcctgtcctg

SEQ ID NO: 5737642 - DNA, 15 bp, Homo sapiens
gaatcttcacctcag

SEQ ID NO: 5737643 - DNA, 18 bp, Homo sapiens
gaatcttcctggcacaat

SEQ ID NO: 5737644 - DNA, 20 bp, Homo sapiens
gaatcttctcatcttttatc

SEQ ID NO: 5737645 - DNA, 17 bp, Homo sapiens
gaatcttgactttctga

SEQ ID NO: 5737646 - DNA, 20 bp, Homo sapiens
gaatcttgctgcaggccctc

SEQ ID NO: 5737647 - DNA, 13 bp, Homo sapiens
gaatcttgtccaa

SEQ ID NO: 5737648 - DNA, 14 bp, Homo sapiens
gaatcttgtctaac

SEQ ID NO: 5737649 - DNA, 14 bp, Homo sapiens
gaatcttgtctcaa

SEQ ID NO: 5737650 - DNA, 16 bp, Homo sapiens
gaatcttgtctcaatg

SEQ ID NO: 5737651 - DNA, 18 bp, Homo sapiens
gaatcttgtctcaatgct

SEQ ID NO: 5737652 - DNA, 13 bp, Homo sapiens
gaatctttaaggg

SEQ ID NO: 5737653 - DNA, 18 bp, Homo sapiens
gaatctttaattaaaacc

SEQ ID NO: 5737654 - DNA, 17 bp, Homo sapiens
gaatctttattgagaaa

SEQ ID NO: 5737655 - DNA, 19 bp, Homo sapiens
gaatctttattgagaaaga

SEQ ID NO: 5737656 - DNA, 16 bp, Homo sapiens
gaatctttctcctggt

SEQ ID NO: 5737657 - DNA, 14 bp, Homo sapiens
gaatctttgttaag

SEQ ID NO: 5737658 - DNA, 12 bp, Homo sapiens
gaatcttttaaa

SEQ ID NO: 5737659 - DNA, 22 bp, Homo sapiens
gaatcttttactgtggaggtgg

SEQ ID NO: 5737660 - DNA, 16 bp, Homo sapiens
gaatcttttataatga

SEQ ID NO: 5737661 - DNA, 17 bp, Homo sapiens
gaatcttttataatgat

SEQ ID NO: 5737662 - DNA, 22 bp, Homo sapiens
gaatcttttataatgattcata

SEQ ID NO: 5737663 - DNA, 23 bp, Homo sapiens
gaatctttttcagaaacagtgag

SEQ ID NO: 5737664 - DNA, 19 bp, Homo sapiens
gaatgaaaaatgaaagatg

SEQ ID NO: 5737665 - DNA, 20 bp, Homo sapiens
gaatgaaaaatgaaagatga

SEQ ID NO: 5737666 - DNA, 15 bp, Homo sapiens
gaatgaaaaatttaa

SEQ ID NO: 5737667 - DNA, 22 bp, Homo sapiens
gaatgaaaaatttaagcattgt

SEQ ID NO: 5737668 - DNA, 14 bp, Homo sapiens
gaatgaaaacattt

SEQ ID NO: 5737669 - DNA, 16 bp, Homo sapiens
gaatgaaaacatttta

SEQ ID NO: 5737670 - DNA, 14 bp, Homo sapiens
gaatgaaaataact

SEQ ID NO: 5737671 - DNA, 18 bp, Homo sapiens
gaatgaaaataactgaac

SEQ ID NO: 5737672 - DNA, 23 bp, Homo sapiens
gaatgaaaataactgaaccaaat

SEQ ID NO: 5737673 - DNA, 16 bp, Homo sapiens
gaatgaaaattgtatg

SEQ ID NO: 5737674 - DNA, 20 bp, Homo sapiens
gaatgaaacccccacacaca

SEQ ID NO: 5737675 - DNA, 15 bp, Homo sapiens
gaatgaaagctgttc

SEQ ID NO: 5737676 - DNA, 23 bp, Homo sapiens
gaatgaaagtcttgtgactagtg

SEQ ID NO: 5737677 - DNA, 23 bp, Homo sapiens
gaatgaaatataaactgtgagat

SEQ ID NO: 5737678 - DNA, 16 bp, Homo sapiens
gaatgaaattaacaca

SEQ ID NO: 5737679 - DNA, 20 bp, Homo sapiens
gaatgaaattaacacaaagg

SEQ ID NO: 5737680 - DNA, 17 bp, Homo sapiens
gaatgaacccaagagca

SEQ ID NO: 5737681 - DNA, 22 bp, Homo sapiens
gaatgaacccctggctccttca

SEQ ID NO: 5737682 - DNA, 17 bp, Homo sapiens
gaatgaaccctcctttt

SEQ ID NO: 5737683 - DNA, 18 bp, Homo sapiens
gaatgaaccctccttttc

SEQ ID NO: 5737684 - DNA, 15 bp, Homo sapiens
gaatgaaccttctgg

SEQ ID NO: 5737685 - DNA, 15 bp, Homo sapiens
gaatgaactgtggaa

SEQ ID NO: 5737686 - DNA, 21 bp, Homo sapiens
gaatgaacttgttacttgcag

SEQ ID NO: 5737687 - DNA, 14 bp, Homo sapiens
gaatgaagcatgta

SEQ ID NO: 5737688 - DNA, 16 bp, Homo sapiens
gaatgaagcatgtagc

SEQ ID NO: 5737689 - DNA, 17 bp, Homo sapiens
gaatgaagctaatgtga

SEQ ID NO: 5737690 - DNA, 18 bp, Homo sapiens
gaatgaagcttgtgtatc

SEQ ID NO: 5737691 - DNA, 20 bp, Homo sapiens
gaatgaagcttgtgtatcca

SEQ ID NO: 5737692 - DNA, 14 bp, Homo sapiens
gaatgaaggttttt

SEQ ID NO: 5737693 - DNA, 15 bp, Homo sapiens
gaatgaatacagcat

SEQ ID NO: 5737694 - DNA, 14 bp, Homo sapiens
gaatgaatggctaa

SEQ ID NO: 5737695 - DNA, 15 bp, Homo sapiens
gaatgaatggctaag

SEQ ID NO: 5737696 - DNA, 20 bp, Homo sapiens
gaatgaatggctaagcaaaa

SEQ ID NO: 5737697 - DNA, 14 bp, Homo sapiens
gaatgaatgtcagt

SEQ ID NO: 5737698 - DNA, 22 bp, Homo sapiens
gaatgaatgtcagtgtgactga

SEQ ID NO: 5737699 - DNA, 16 bp, Homo sapiens
gaatgaatttatcttt

SEQ ID NO: 5737700 - DNA, 20 bp, Homo sapiens
gaatgaatttatctttacca

SEQ ID NO: 5737701 - DNA, 13 bp, Homo sapiens
gaatgacaaagag

SEQ ID NO: 5737702 - DNA, 16 bp, Homo sapiens
gaatgacaacagaagc

SEQ ID NO: 5737703 - DNA, 15 bp, Homo sapiens
gaatgacaagcatca

SEQ ID NO: 5737704 - DNA, 12 bp, Homo sapiens
gaatgacactgt

SEQ ID NO: 5737705 - DNA, 23 bp, Homo sapiens
gaatgacaggaacccatcactgt

SEQ ID NO: 5737706 - DNA, 23 bp, Homo sapiens
gaatgaccagaaaatttttgtct

SEQ ID NO: 5737707 - DNA, 19 bp, Homo sapiens
gaatgacccttttgtgtct

SEQ ID NO: 5737708 - DNA, 20 bp, Homo sapiens
gaatgacccttttgtgtcta

SEQ ID NO: 5737709 - DNA, 22 bp, Homo sapiens
gaatgacctggccgcagtgagg

SEQ ID NO: 5737710 - DNA, 18 bp, Homo sapiens
gaatgaccttgtaatgta

SEQ ID NO: 5737711 - DNA, 17 bp, Homo sapiens
gaatgactatgtccaga

SEQ ID NO: 5737712 - DNA, 17 bp, Homo sapiens
gaatgactcatgcctct

SEQ ID NO: 5737713 - DNA, 19 bp, Homo sapiens
gaatgactcatgcctctga

SEQ ID NO: 5737714 - DNA, 15 bp, Homo sapiens
gaatgactgaagaca

SEQ ID NO: 5737715 - DNA, 21 bp, Homo sapiens
gaatgactgaagacaggcaca

SEQ ID NO: 5737716 - DNA, 15 bp, Homo sapiens
gaatgactgacccaa

SEQ ID NO: 5737717 - DNA, 22 bp, Homo sapiens
gaatgactgacccaaaatgtga

SEQ ID NO: 5737718 - DNA, 23 bp, Homo sapiens
gaatgactgacccaaaatgtgaa

SEQ ID NO: 5737719 - DNA, 13 bp, Homo sapiens
gaatgagaaagaa

SEQ ID NO: 5737720 - DNA, 17 bp, Homo sapiens
gaatgagaaagaaaagg

SEQ ID NO: 5737721 - DNA, 14 bp, Homo sapiens
gaatgagaaatgga

SEQ ID NO: 5737722 - DNA, 12 bp, Homo sapiens
gaatgagaagta

SEQ ID NO: 5737723 - DNA, 19 bp, Homo sapiens
gaatgagaagtagccacag

SEQ ID NO: 5737724 - DNA, 16 bp, Homo sapiens
gaatgagaatgtgcca

SEQ ID NO: 5737725 - DNA, 19 bp, Homo sapiens
gaatgagaatgtgccatgt

SEQ ID NO: 5737726 - DNA, 13 bp, Homo sapiens
gaatgagacatcc

SEQ ID NO: 5737727 - DNA, 23 bp, Homo sapiens
gaatgagagacacactgaagaag

SEQ ID NO: 5737728 - DNA, 14 bp, Homo sapiens
gaatgagagagaaa

SEQ ID NO: 5737729 - DNA, 18 bp, Homo sapiens
gaatgagagagtgtggaa

SEQ ID NO: 5737730 - DNA, 19 bp, Homo sapiens
gaatgagagttccttctca

SEQ ID NO: 5737731 - DNA, 19 bp, Homo sapiens
gaatgagcagttagaaata

SEQ ID NO: 5737732 - DNA, 13 bp, Homo sapiens
gaatgagcctcgg

SEQ ID NO: 5737733 - DNA, 14 bp, Homo sapiens
gaatgagctctcta

SEQ ID NO: 5737734 - DNA, 14 bp, Homo sapiens
gaatgaggaaaatt

SEQ ID NO: 5737735 - DNA, 23 bp, Homo sapiens
gaatgaggaaaattcttaaaagg

SEQ ID NO: 5737736 - DNA, 16 bp, Homo sapiens
gaatgaggaacaatca

SEQ ID NO: 5737737 - DNA, 13 bp, Homo sapiens
gaatgaggaggaa

SEQ ID NO: 5737738 - DNA, 18 bp, Homo sapiens
gaatgaggcttgctgaga

SEQ ID NO: 5737739 - DNA, 14 bp, Homo sapiens
gaatgagggaggcg

SEQ ID NO: 5737740 - DNA, 21 bp, Homo sapiens
gaatgagggctgagttatgaa

SEQ ID NO: 5737741 - DNA, 17 bp, Homo sapiens
gaatgagggggctcagt

SEQ ID NO: 5737742 - DNA, 19 bp, Homo sapiens
gaatgagggtttgagagag

SEQ ID NO: 5737743 - DNA, 22 bp, Homo sapiens
gaatgaggtcccaggcagagaa

SEQ ID NO: 5737744 - DNA, 18 bp, Homo sapiens
gaatgaggtctgggctag

SEQ ID NO: 5737745 - DNA, 21 bp, Homo sapiens
gaatgagtctgttgtgtgtca

SEQ ID NO: 5737746 - DNA, 13 bp, Homo sapiens
gaatgagtgggaa

SEQ ID NO: 5737747 - DNA, 15 bp, Homo sapiens
gaatgagtttttaat

SEQ ID NO: 5737748 - DNA, 14 bp, Homo sapiens
gaatgatacgatta

SEQ ID NO: 5737749 - DNA, 21 bp, Homo sapiens
gaatgatcaagtcctttgtga

SEQ ID NO: 5737750 - DNA, 20 bp, Homo sapiens
gaatgatccatactgaaaaa

SEQ ID NO: 5737751 - DNA, 20 bp, Homo sapiens
gaatgatccctcagtctgag

SEQ ID NO: 5737752 - DNA, 18 bp, Homo sapiens
gaatgatctttctttcct

SEQ ID NO: 5737753 - DNA, 14 bp, Homo sapiens
gaatgatgccatga

SEQ ID NO: 5737754 - DNA, 21 bp, Homo sapiens
gaatgatggtttccaatttca

SEQ ID NO: 5737755 - DNA, 21 bp, Homo sapiens
gaatgatggtttccagcttca

SEQ ID NO: 5737756 - DNA, 14 bp, Homo sapiens
gaatgatgtatata

SEQ ID NO: 5737757 - DNA, 13 bp, Homo sapiens
gaatgattaatca

SEQ ID NO: 5737758 - DNA, 14 bp, Homo sapiens
gaatgattatgaat

SEQ ID NO: 5737759 - DNA, 15 bp, Homo sapiens
gaatgattcatgtta

SEQ ID NO: 5737760 - DNA, 22 bp, Homo sapiens
gaatgatttccaaagagaaaaa

SEQ ID NO: 5737761 - DNA, 14 bp, Homo sapiens
gaatgatttctatg

SEQ ID NO: 5737762 - DNA, 16 bp, Homo sapiens
gaatgatttctatgaa

SEQ ID NO: 5737763 - DNA, 14 bp, Homo sapiens
gaatgatttgcata

SEQ ID NO: 5737764 - DNA, 16 bp, Homo sapiens
gaatgatttttagatg

SEQ ID NO: 5737765 - DNA, 16 bp, Homo sapiens
gaatgatttttgctat

SEQ ID NO: 5737766 - DNA, 22 bp, Homo sapiens
gaatgcaaaattgttttcactt

SEQ ID NO: 5737767 - DNA, 12 bp, Homo sapiens
gaatgcaagagt

SEQ ID NO: 5737768 - DNA, 21 bp, Homo sapiens
gaatgcaaggccttgaagaca

SEQ ID NO: 5737769 - DNA, 12 bp, Homo sapiens
gaatgcaataaa

SEQ ID NO: 5737770 - DNA, 16 bp, Homo sapiens
gaatgcaataaagagt

SEQ ID NO: 5737771 - DNA, 21 bp, Homo sapiens
gaatgcaatataaaaatgtga

SEQ ID NO: 5737772 - DNA, 14 bp, Homo sapiens
gaatgcaatccttc

SEQ ID NO: 5737773 - DNA, 21 bp, Homo sapiens
gaatgcaatttttttttgttc

SEQ ID NO: 5737774 - DNA, 18 bp, Homo sapiens
gaatgcacaagaatggat

SEQ ID NO: 5737775 - DNA, 19 bp, Homo sapiens
gaatgcacaagaatggatc

SEQ ID NO: 5737776 - DNA, 22 bp, Homo sapiens
gaatgcacacagcggctgcctc

SEQ ID NO: 5737777 - DNA, 22 bp, Homo sapiens
gaatgcacactagcctctccag

SEQ ID NO: 5737778 - DNA, 16 bp, Homo sapiens
gaatgcacagatatac

SEQ ID NO: 5737779 - DNA, 22 bp, Homo sapiens
gaatgcacagatatactttgtg

SEQ ID NO: 5737780 - DNA, 16 bp, Homo sapiens
gaatgcacagtgggtg

SEQ ID NO: 5737781 - DNA, 21 bp, Homo sapiens
gaatgcaccatactcatgcat

SEQ ID NO: 5737782 - DNA, 16 bp, Homo sapiens
gaatgcacctccccaa

SEQ ID NO: 5737783 - DNA, 17 bp, Homo sapiens
gaatgcacctccccaaa

SEQ ID NO: 5737784 - DNA, 14 bp, Homo sapiens
gaatgcacgtttca

SEQ ID NO: 5737785 - DNA, 16 bp, Homo sapiens
gaatgcagaagcaaac

SEQ ID NO: 5737786 - DNA, 12 bp, Homo sapiens
gaatgcagagat

SEQ ID NO: 5737787 - DNA, 19 bp, Homo sapiens
gaatgcagaggtctccaaa

SEQ ID NO: 5737788 - DNA, 14 bp, Homo sapiens
gaatgcagcactgc

SEQ ID NO: 5737789 - DNA, 16 bp, Homo sapiens
gaatgcagcactgctg

SEQ ID NO: 5737790 - DNA, 19 bp, Homo sapiens
gaatgcagcactgctgcct

SEQ ID NO: 5737791 - DNA, 18 bp, Homo sapiens
gaatgcagtataaaatgt

SEQ ID NO: 5737792 - DNA, 22 bp, Homo sapiens
gaatgcagtctgtccaggctcg

SEQ ID NO: 5737793 - DNA, 15 bp, Homo sapiens
gaatgcataatgttt

SEQ ID NO: 5737794 - DNA, 17 bp, Homo sapiens
gaatgcatattcaacac

SEQ ID NO: 5737795 - DNA, 23 bp, Homo sapiens
gaatgcatattcaacacactgcc

SEQ ID NO: 5737796 - DNA, 18 bp, Homo sapiens
gaatgcatccttaacctt

SEQ ID NO: 5737797 - DNA, 18 bp, Homo sapiens
gaatgcatgctttccata

SEQ ID NO: 5737798 - DNA, 20 bp, Homo sapiens
gaatgcatggggcgggtcct

SEQ ID NO: 5737799 - DNA, 12 bp, Homo sapiens
gaatgcatgtgt

SEQ ID NO: 5737800 - DNA, 14 bp, Homo sapiens
gaatgcattcaggg

SEQ ID NO: 5737801 - DNA, 19 bp, Homo sapiens
gaatgcattccctgaatct

SEQ ID NO: 5737802 - DNA, 19 bp, Homo sapiens
gaatgccatctatctagtt

SEQ ID NO: 5737803 - DNA, 15 bp, Homo sapiens
gaatgccgaatttgg

SEQ ID NO: 5737804 - DNA, 22 bp, Homo sapiens
gaatgccgaatttggtacacat

SEQ ID NO: 5737805 - DNA, 17 bp, Homo sapiens
gaatgccgctgtctctg

SEQ ID NO: 5737806 - DNA, 15 bp, Homo sapiens
gaatgcctaggccag

SEQ ID NO: 5737807 - DNA, 19 bp, Homo sapiens
gaatgcctaggccagctcc

SEQ ID NO: 5737808 - DNA, 20 bp, Homo sapiens
gaatgcctcaatgtgaccag

SEQ ID NO: 5737809 - DNA, 19 bp, Homo sapiens
gaatgcctcataaattaat

SEQ ID NO: 5737810 - DNA, 16 bp, Homo sapiens
gaatgcctcctgtggg

SEQ ID NO: 5737811 - DNA, 17 bp, Homo sapiens
gaatgcctcgctccctt

SEQ ID NO: 5737812 - DNA, 16 bp, Homo sapiens
gaatgccttatttttg

SEQ ID NO: 5737813 - DNA, 14 bp, Homo sapiens
gaatgcctttcaaa

SEQ ID NO: 5737814 - DNA, 20 bp, Homo sapiens
gaatgcgctcttcaccagga

SEQ ID NO: 5737815 - DNA, 19 bp, Homo sapiens
gaatgcggttgggaggcag

SEQ ID NO: 5737816 - DNA, 18 bp, Homo sapiens
gaatgctaagccagttct

SEQ ID NO: 5737817 - DNA, 23 bp, Homo sapiens
gaatgctaagccagttcttaaga

SEQ ID NO: 5737818 - DNA, 21 bp, Homo sapiens
gaatgctcccccatcctcccc

SEQ ID NO: 5737819 - DNA, 15 bp, Homo sapiens
gaatgctctgtgcca

SEQ ID NO: 5737820 - DNA, 10 bp, Homo sapiens
gaatgctgcc

SEQ ID NO: 5737821 - DNA, 13 bp, Homo sapiens
gaatgctgccagt

SEQ ID NO: 5737822 - DNA, 15 bp, Homo sapiens
gaatgctgccagtgt

SEQ ID NO: 5737823 - DNA, 23 bp, Homo sapiens
gaatgctgcccagggtcagtgta

SEQ ID NO: 5737824 - DNA, 16 bp, Homo sapiens
gaatgctgggactcag

SEQ ID NO: 5737825 - DNA, 21 bp, Homo sapiens
gaatgctgggcccccagcctg

SEQ ID NO: 5737826 - DNA, 22 bp, Homo sapiens
gaatgctgggtatgctctgtga

SEQ ID NO: 5737827 - DNA, 23 bp, Homo sapiens
gaatgctgggtatgctctgtgac

SEQ ID NO: 5737828 - DNA, 17 bp, Homo sapiens
gaatgctggttttccta

SEQ ID NO: 5737829 - DNA, 13 bp, Homo sapiens
gaatgctgtacat

SEQ ID NO: 5737830 - DNA, 17 bp, Homo sapiens
gaatgctgtacatctat

SEQ ID NO: 5737831 - DNA, 15 bp, Homo sapiens
gaatgctgtatatgt

SEQ ID NO: 5737832 - DNA, 22 bp, Homo sapiens
gaatgctgtgggaaggcaattt

SEQ ID NO: 5737833 - DNA, 15 bp, Homo sapiens
gaatgcttaaatgat

SEQ ID NO: 5737834 - DNA, 22 bp, Homo sapiens
gaatgcttcaagtttagtgcat

SEQ ID NO: 5737835 - DNA, 22 bp, Homo sapiens
gaatgcttctaagtaaatacaa

SEQ ID NO: 5737836 - DNA, 15 bp, Homo sapiens
gaatgcttctcttta

SEQ ID NO: 5737837 - DNA, 11 bp, Homo sapiens
gaatgcttctg

SEQ ID NO: 5737838 - DNA, 21 bp, Homo sapiens
gaatgcttctgcatcaaagga

SEQ ID NO: 5737839 - DNA, 17 bp, Homo sapiens
gaatgcttgaaaaatgt

SEQ ID NO: 5737840 - DNA, 13 bp, Homo sapiens
gaatgctttagga

SEQ ID NO: 5737841 - DNA, 21 bp, Homo sapiens
gaatgcttttagtgtgtgcat

SEQ ID NO: 5737842 - DNA, 15 bp, Homo sapiens
gaatggaaagcttca

SEQ ID NO: 5737843 - DNA, 20 bp, Homo sapiens
gaatggaactactgtacttt

SEQ ID NO: 5737844 - DNA, 23 bp, Homo sapiens
gaatggaagcctccacctgcagc

SEQ ID NO: 5737845 - DNA, 21 bp, Homo sapiens
gaatggaagggttctggctgc

SEQ ID NO: 5737846 - DNA, 17 bp, Homo sapiens
gaatggaatccatctgt

SEQ ID NO: 5737847 - DNA, 19 bp, Homo sapiens
gaatggacatcctgtataa

SEQ ID NO: 5737848 - DNA, 15 bp, Homo sapiens
gaatggacatttcta

SEQ ID NO: 5737849 - DNA, 16 bp, Homo sapiens
gaatggactaagatga

SEQ ID NO: 5737850 - DNA, 22 bp, Homo sapiens
gaatggactgggtgccacggtg

SEQ ID NO: 5737851 - DNA, 17 bp, Homo sapiens
gaatggagaaagtaagt

SEQ ID NO: 5737852 - DNA, 21 bp, Homo sapiens
gaatggagaatacatcttgtt

SEQ ID NO: 5737853 - DNA, 11 bp, Homo sapiens
gaatggagcag

SEQ ID NO: 5737854 - DNA, 16 bp, Homo sapiens
gaatggaggagccagg

SEQ ID NO: 5737855 - DNA, 17 bp, Homo sapiens
gaatggaggagccaggc

SEQ ID NO: 5737856 - DNA, 17 bp, Homo sapiens
gaatggaggatattcta

SEQ ID NO: 5737857 - DNA, 21 bp, Homo sapiens
gaatggagggcaacattccac

SEQ ID NO: 5737858 - DNA, 16 bp, Homo sapiens
gaatggaggggcagag

SEQ ID NO: 5737859 - DNA, 21 bp, Homo sapiens
gaatggaggggcagagccagg

SEQ ID NO: 5737860 - DNA, 21 bp, Homo sapiens
gaatggatcaatacacacaca

SEQ ID NO: 5737861 - DNA, 19 bp, Homo sapiens
gaatggatcacaagatgga

SEQ ID NO: 5737862 - DNA, 14 bp, Homo sapiens
gaatggatgctgct

SEQ ID NO: 5737863 - DNA, 15 bp, Homo sapiens
gaatggatggggaga

SEQ ID NO: 5737864 - DNA, 16 bp, Homo sapiens
gaatggattaaatggc

SEQ ID NO: 5737865 - DNA, 17 bp, Homo sapiens
gaatggattaaatggca

SEQ ID NO: 5737866 - DNA, 21 bp, Homo sapiens
gaatggatttttctttaactg

SEQ ID NO: 5737867 - DNA, 20 bp, Homo sapiens
gaatggattttttttttcag

SEQ ID NO: 5737868 - DNA, 22 bp, Homo sapiens
gaatggcaaagcggttgcttct

SEQ ID NO: 5737869 - DNA, 23 bp, Homo sapiens
gaatggcaaataaacagtttgac

SEQ ID NO: 5737870 - DNA, 18 bp, Homo sapiens
gaatggcaatgttttgct

SEQ ID NO: 5737871 - DNA, 17 bp, Homo sapiens
gaatggcacagcccaaa

SEQ ID NO: 5737872 - DNA, 23 bp, Homo sapiens
gaatggcagcatgcaaacttgga

SEQ ID NO: 5737873 - DNA, 15 bp, Homo sapiens
gaatggcagctggaa

SEQ ID NO: 5737874 - DNA, 19 bp, Homo sapiens
gaatggcaggggaagcctt

SEQ ID NO: 5737875 - DNA, 14 bp, Homo sapiens
gaatggcagtcctg

SEQ ID NO: 5737876 - DNA, 15 bp, Homo sapiens
gaatggcatggcagg

SEQ ID NO: 5737877 - DNA, 18 bp, Homo sapiens
gaatggcatggcaggagt

SEQ ID NO: 5737878 - DNA, 18 bp, Homo sapiens
gaatggcatttgcaataa

SEQ ID NO: 5737879 - DNA, 17 bp, Homo sapiens
gaatggccacaaacctg

SEQ ID NO: 5737880 - DNA, 18 bp, Homo sapiens
gaatggccctagaactgt

SEQ ID NO: 5737881 - DNA, 13 bp, Homo sapiens
gaatggcctggag

SEQ ID NO: 5737882 - DNA, 14 bp, Homo sapiens
gaatggctctggct

SEQ ID NO: 5737883 - DNA, 17 bp, Homo sapiens
gaatggctgtgccccac

SEQ ID NO: 5737884 - DNA, 14 bp, Homo sapiens
gaatggctttgtat

SEQ ID NO: 5737885 - DNA, 16 bp, Homo sapiens
gaatggctttgtatag

SEQ ID NO: 5737886 - DNA, 11 bp, Homo sapiens
gaatgggaatt

SEQ ID NO: 5737887 - DNA, 16 bp, Homo sapiens
gaatgggacgaggaca

SEQ ID NO: 5737888 - DNA, 11 bp, Homo sapiens
gaatgggactg

SEQ ID NO: 5737889 - DNA, 17 bp, Homo sapiens
gaatgggagacctgttg

SEQ ID NO: 5737890 - DNA, 22 bp, Homo sapiens
gaatgggagccagaattcacta

SEQ ID NO: 5737891 - DNA, 21 bp, Homo sapiens
gaatgggatcatgaaagtaga

SEQ ID NO: 5737892 - DNA, 14 bp, Homo sapiens
gaatgggatgtgtg

SEQ ID NO: 5737893 - DNA, 19 bp, Homo sapiens
gaatgggccaagccagggt

SEQ ID NO: 5737894 - DNA, 19 bp, Homo sapiens
gaatgggctttcataaatt

SEQ ID NO: 5737895 - DNA, 13 bp, Homo sapiens
gaatggggacctg

SEQ ID NO: 5737896 - DNA, 17 bp, Homo sapiens
gaatggggacctggggt

SEQ ID NO: 5737897 - DNA, 13 bp, Homo sapiens
gaatgggggagag

SEQ ID NO: 5737898 - DNA, 21 bp, Homo sapiens
gaatggggggcgggccagggt

SEQ ID NO: 5737899 - DNA, 16 bp, Homo sapiens
gaatgggggtatcctg

SEQ ID NO: 5737900 - DNA, 17 bp, Homo sapiens
gaatggggtccccctcc

SEQ ID NO: 5737901 - DNA, 19 bp, Homo sapiens
gaatggggtgggagccaca

SEQ ID NO: 5737902 - DNA, 22 bp, Homo sapiens
gaatggggtgggagccacaggg

SEQ ID NO: 5737903 - DNA, 18 bp, Homo sapiens
gaatgggtaattcaagag

SEQ ID NO: 5737904 - DNA, 16 bp, Homo sapiens
gaatgggttctcagtg

SEQ ID NO: 5737905 - DNA, 15 bp, Homo sapiens
gaatgggtttactct

SEQ ID NO: 5737906 - DNA, 13 bp, Homo sapiens
gaatggtagtcta

SEQ ID NO: 5737907 - DNA, 23 bp, Homo sapiens
gaatggtagtctaaccaaatgca

SEQ ID NO: 5737908 - DNA, 13 bp, Homo sapiens
gaatggtccaggg

SEQ ID NO: 5737909 - DNA, 14 bp, Homo sapiens
gaatggtccagggt

SEQ ID NO: 5737910 - DNA, 15 bp, Homo sapiens
gaatggtctcagtgt

SEQ ID NO: 5737911 - DNA, 22 bp, Homo sapiens
gaatggtctggcaatattctgt

SEQ ID NO: 5737912 - DNA, 14 bp, Homo sapiens
gaatggtctttgct

SEQ ID NO: 5737913 - DNA, 19 bp, Homo sapiens
gaatggtctttgctccaga

SEQ ID NO: 5737914 - DNA, 22 bp, Homo sapiens
gaatggtctttgctccagataa

SEQ ID NO: 5737915 - DNA, 16 bp, Homo sapiens
gaatggtgcccttgga

SEQ ID NO: 5737916 - DNA, 20 bp, Homo sapiens
gaatggtgcccttggaggca

SEQ ID NO: 5737917 - DNA, 16 bp, Homo sapiens
gaatggtgcgtggctt

SEQ ID NO: 5737918 - DNA, 11 bp, Homo sapiens
gaatggtgctt

SEQ ID NO: 5737919 - DNA, 18 bp, Homo sapiens
gaatggtgcttggcagga

SEQ ID NO: 5737920 - DNA, 17 bp, Homo sapiens
gaatggtgggctccaga

SEQ ID NO: 5737921 - DNA, 22 bp, Homo sapiens
gaatggtgtgaacccgggaagc

SEQ ID NO: 5737922 - DNA, 17 bp, Homo sapiens
gaatggttaataaaact

SEQ ID NO: 5737923 - DNA, 20 bp, Homo sapiens
gaatggttaataaaactgca

SEQ ID NO: 5737924 - DNA, 16 bp, Homo sapiens
gaatggttccatgcct

SEQ ID NO: 5737925 - DNA, 22 bp, Homo sapiens
gaatggttccatgcctgagggt

SEQ ID NO: 5737926 - DNA, 14 bp, Homo sapiens
gaatggttgagtga

SEQ ID NO: 5737927 - DNA, 13 bp, Homo sapiens
gaatggttgcaaa

SEQ ID NO: 5737928 - DNA, 16 bp, Homo sapiens
gaatggtttttgttga

SEQ ID NO: 5737929 - DNA, 22 bp, Homo sapiens
gaatgtaaaagaacttactgat

SEQ ID NO: 5737930 - DNA, 15 bp, Homo sapiens
gaatgtaaagcttgt

SEQ ID NO: 5737931 - DNA, 13 bp, Homo sapiens
gaatgtaaatgtc

SEQ ID NO: 5737932 - DNA, 17 bp, Homo sapiens
gaatgtaaatttgtact

SEQ ID NO: 5737933 - DNA, 23 bp, Homo sapiens
gaatgtaagaaaacaaaatctaa

SEQ ID NO: 5737934 - DNA, 20 bp, Homo sapiens
gaatgtaaggatgagggaag

SEQ ID NO: 5737935 - DNA, 13 bp, Homo sapiens
gaatgtaattgga

SEQ ID NO: 5737936 - DNA, 21 bp, Homo sapiens
gaatgtaattttgaactgttt

SEQ ID NO: 5737937 - DNA, 23 bp, Homo sapiens
gaatgtacatactgaaaaataca

SEQ ID NO: 5737938 - DNA, 21 bp, Homo sapiens
gaatgtaccttatttaaaaga

SEQ ID NO: 5737939 - DNA, 13 bp, Homo sapiens
gaatgtactatgt

SEQ ID NO: 5737940 - DNA, 23 bp, Homo sapiens
gaatgtagaagtggcatctgaaa

SEQ ID NO: 5737941 - DNA, 16 bp, Homo sapiens
gaatgtagcatctgag

SEQ ID NO: 5737942 - DNA, 16 bp, Homo sapiens
gaatgtagcttccacc

SEQ ID NO: 5737943 - DNA, 13 bp, Homo sapiens
gaatgtaggctgg

SEQ ID NO: 5737944 - DNA, 11 bp, Homo sapiens
gaatgtagtta

SEQ ID NO: 5737945 - DNA, 14 bp, Homo sapiens
gaatgtagtttgag

SEQ ID NO: 5737946 - DNA, 17 bp, Homo sapiens
gaatgtagtttgaggaa

SEQ ID NO: 5737947 - DNA, 15 bp, Homo sapiens
gaatgtatagtattt

SEQ ID NO: 5737948 - DNA, 15 bp, Homo sapiens
gaatgtatcaggaaa

SEQ ID NO: 5737949 - DNA, 21 bp, Homo sapiens
gaatgtattattctgcagcat

SEQ ID NO: 5737950 - DNA, 18 bp, Homo sapiens
gaatgtatttatgtgtat

SEQ ID NO: 5737951 - DNA, 13 bp, Homo sapiens
gaatgtatttatt

SEQ ID NO: 5737952 - DNA, 13 bp, Homo sapiens
gaatgtatttgat

SEQ ID NO: 5737953 - DNA, 23 bp, Homo sapiens
gaatgtattttaactatttttgt

SEQ ID NO: 5737954 - DNA, 16 bp, Homo sapiens
gaatgtcaagaaaagg

SEQ ID NO: 5737955 - DNA, 13 bp, Homo sapiens
gaatgtcaataaa

SEQ ID NO: 5737956 - DNA, 16 bp, Homo sapiens
gaatgtcaatatttga

SEQ ID NO: 5737957 - DNA, 13 bp, Homo sapiens
gaatgtcaatcat

SEQ ID NO: 5737958 - DNA, 15 bp, Homo sapiens
gaatgtcacaaattg

SEQ ID NO: 5737959 - DNA, 16 bp, Homo sapiens
gaatgtcacaaattga

SEQ ID NO: 5737960 - DNA, 15 bp, Homo sapiens
gaatgtcagaattaa

SEQ ID NO: 5737961 - DNA, 17 bp, Homo sapiens
gaatgtcagaattaaaa

SEQ ID NO: 5737962 - DNA, 13 bp, Homo sapiens
gaatgtcagtatg

SEQ ID NO: 5737963 - DNA, 16 bp, Homo sapiens
gaatgtcagtatgtgg

SEQ ID NO: 5737964 - DNA, 19 bp, Homo sapiens
gaatgtcagtatgtggaag

SEQ ID NO: 5737965 - DNA, 14 bp, Homo sapiens
gaatgtcagtgtga

SEQ ID NO: 5737966 - DNA, 14 bp, Homo sapiens
gaatgtcagtgttc

SEQ ID NO: 5737967 - DNA, 22 bp, Homo sapiens
gaatgtcagttgttatttattg

SEQ ID NO: 5737968 - DNA, 15 bp, Homo sapiens
gaatgtcataaagaa

SEQ ID NO: 5737969 - DNA, 14 bp, Homo sapiens
gaatgtcatttgct

SEQ ID NO: 5737970 - DNA, 16 bp, Homo sapiens
gaatgtcatttgctaa

SEQ ID NO: 5737971 - DNA, 18 bp, Homo sapiens
gaatgtccaaaatttata

SEQ ID NO: 5737972 - DNA, 18 bp, Homo sapiens
gaatgtccccattctata

SEQ ID NO: 5737973 - DNA, 21 bp, Homo sapiens
gaatgtccccattctataaat

SEQ ID NO: 5737974 - DNA, 15 bp, Homo sapiens
gaatgtccccttagg

SEQ ID NO: 5737975 - DNA, 18 bp, Homo sapiens
gaatgtcgcagactcctc

SEQ ID NO: 5737976 - DNA, 11 bp, Homo sapiens
gaatgtgaaaa

SEQ ID NO: 5737977 - DNA, 23 bp, Homo sapiens
gaatgtgaaaaaaaaaagtaatt

SEQ ID NO: 5737978 - DNA, 13 bp, Homo sapiens
gaatgtgaaacat

SEQ ID NO: 5737979 - DNA, 13 bp, Homo sapiens
gaatgtgaagcca

SEQ ID NO: 5737980 - DNA, 17 bp, Homo sapiens
gaatgtgaagccagatc

SEQ ID NO: 5737981 - DNA, 15 bp, Homo sapiens
gaatgtgaagccttc

SEQ ID NO: 5737982 - DNA, 20 bp, Homo sapiens
gaatgtgaagccttcccctt

SEQ ID NO: 5737983 - DNA, 17 bp, Homo sapiens
gaatgtgattttaaaga

SEQ ID NO: 5737984 - DNA, 19 bp, Homo sapiens
gaatgtgcaaagcagtatg

SEQ ID NO: 5737985 - DNA, 17 bp, Homo sapiens
gaatgtgccacagaggc

SEQ ID NO: 5737986 - DNA, 19 bp, Homo sapiens
gaatgtgccacagaggccc

SEQ ID NO: 5737987 - DNA, 20 bp, Homo sapiens
gaatgtgccacagaggcccc

SEQ ID NO: 5737988 - DNA, 23 bp, Homo sapiens
gaatgtgccacagaggccccacc

SEQ ID NO: 5737989 - DNA, 21 bp, Homo sapiens
gaatgtgccacctgtccggcc

SEQ ID NO: 5737990 - DNA, 13 bp, Homo sapiens
gaatgtgccatgt

SEQ ID NO: 5737991 - DNA, 19 bp, Homo sapiens
gaatgtgcccctggcccat

SEQ ID NO: 5737992 - DNA, 21 bp, Homo sapiens
gaatgtgctttgtaagatcca

SEQ ID NO: 5737993 - DNA, 17 bp, Homo sapiens
gaatgtgcttttccatc

SEQ ID NO: 5737994 - DNA, 22 bp, Homo sapiens
gaatgtgcttttccatctaaaa

SEQ ID NO: 5737995 - DNA, 15 bp, Homo sapiens
gaatgtggcagttta

SEQ ID NO: 5737996 - DNA, 15 bp, Homo sapiens
gaatgtggtctcagg

SEQ ID NO: 5737997 - DNA, 16 bp, Homo sapiens
gaatgtggtctcagga

SEQ ID NO: 5737998 - DNA, 18 bp, Homo sapiens
gaatgtgtacaaagtgta

SEQ ID NO: 5737999 - DNA, 22 bp, Homo sapiens
gaatgtgtcctcctgctctgct

SEQ ID NO: 5738000 - DNA, 15 bp, Homo sapiens
gaatgtgtctcagga

SEQ ID NO: 5738001 - DNA, 14 bp, Homo sapiens
gaatgtgtctttag

SEQ ID NO: 5738002 - DNA, 15 bp, Homo sapiens
gaatgtgtgccttgt

SEQ ID NO: 5738003 - DNA, 13 bp, Homo sapiens
gaatgtgtgtatg

SEQ ID NO: 5738004 - DNA, 21 bp, Homo sapiens
gaatgtgtttcacagtttgaa

SEQ ID NO: 5738005 - DNA, 14 bp, Homo sapiens
gaatgttaaataaa

SEQ ID NO: 5738006 - DNA, 19 bp, Homo sapiens
gaatgttaagaattgacca

SEQ ID NO: 5738007 - DNA, 14 bp, Homo sapiens
gaatgttaagcaga

SEQ ID NO: 5738008 - DNA, 13 bp, Homo sapiens
gaatgttaatttt

SEQ ID NO: 5738009 - DNA, 17 bp, Homo sapiens
gaatgttacattgtttg

SEQ ID NO: 5738010 - DNA, 20 bp, Homo sapiens
gaatgttacattgtttgtct

SEQ ID NO: 5738011 - DNA, 15 bp, Homo sapiens
gaatgttaccagact

SEQ ID NO: 5738012 - DNA, 22 bp, Homo sapiens
gaatgttactttggaatgacta

SEQ ID NO: 5738013 - DNA, 17 bp, Homo sapiens
gaatgttagccatgact

SEQ ID NO: 5738014 - DNA, 15 bp, Homo sapiens
gaatgttatcagtat

SEQ ID NO: 5738015 - DNA, 23 bp, Homo sapiens
gaatgttatcggattactgaatt

SEQ ID NO: 5738016 - DNA, 22 bp, Homo sapiens
gaatgttatgggatgtaaacaa

SEQ ID NO: 5738017 - DNA, 14 bp, Homo sapiens
gaatgttccctgca

SEQ ID NO: 5738018 - DNA, 17 bp, Homo sapiens
gaatgttccctgcaccc

SEQ ID NO: 5738019 - DNA, 22 bp, Homo sapiens
gaatgttccctgcaccctggaa

SEQ ID NO: 5738020 - DNA, 21 bp, Homo sapiens
gaatgttcctgcctccttgat

SEQ ID NO: 5738021 - DNA, 17 bp, Homo sapiens
gaatgttctgacattaa

SEQ ID NO: 5738022 - DNA, 19 bp, Homo sapiens
gaatgttctgacattaaca

SEQ ID NO: 5738023 - DNA, 20 bp, Homo sapiens
gaatgttgattacagtgcag

SEQ ID NO: 5738024 - DNA, 14 bp, Homo sapiens
gaatgttggataag

SEQ ID NO: 5738025 - DNA, 20 bp, Homo sapiens
gaatgttggataaggaatta

SEQ ID NO: 5738026 - DNA, 20 bp, Homo sapiens
gaatgttggtgtgaaacaaa

SEQ ID NO: 5738027 - DNA, 18 bp, Homo sapiens
gaatgttggtttactttc

SEQ ID NO: 5738028 - DNA, 19 bp, Homo sapiens
gaatgttgtcctgtgtcat

SEQ ID NO: 5738029 - DNA, 18 bp, Homo sapiens
gaatgttgttaaatgcta

SEQ ID NO: 5738030 - DNA, 23 bp, Homo sapiens
gaatgtttagtgtgctgctgttc

SEQ ID NO: 5738031 - DNA, 15 bp, Homo sapiens
gaatgtttgaattac

SEQ ID NO: 5738032 - DNA, 16 bp, Homo sapiens
gaatgtttgaattaca

SEQ ID NO: 5738033 - DNA, 16 bp, Homo sapiens
gaatgtttgcctctgc

SEQ ID NO: 5738034 - DNA, 18 bp, Homo sapiens
gaatgtttgcctctgcct

SEQ ID NO: 5738035 - DNA, 16 bp, Homo sapiens
gaatgtttgtgtctgt

SEQ ID NO: 5738036 - DNA, 16 bp, Homo sapiens
gaatgttttaaattct

SEQ ID NO: 5738037 - DNA, 20 bp, Homo sapiens
gaatgttttagcacagcgtt

SEQ ID NO: 5738038 - DNA, 17 bp, Homo sapiens
gaatgttttcaaatgtt

SEQ ID NO: 5738039 - DNA, 19 bp, Homo sapiens
gaatgttttcgcaaatgtt

SEQ ID NO: 5738040 - DNA, 14 bp, Homo sapiens
gaatgttttggaat

SEQ ID NO: 5738041 - DNA, 16 bp, Homo sapiens
gaatgttttgtgtgta

SEQ ID NO: 5738042 - DNA, 20 bp, Homo sapiens
gaatgttttgtgtgtaagga

SEQ ID NO: 5738043 - DNA, 16 bp, Homo sapiens
gaatgtttttccctcc

SEQ ID NO: 5738044 - DNA, 18 bp, Homo sapiens
gaatgtttttccctcccc

SEQ ID NO: 5738045 - DNA, 14 bp, Homo sapiens
gaattaaaaaagca

SEQ ID NO: 5738046 - DNA, 14 bp, Homo sapiens
gaattaaaactgag

SEQ ID NO: 5738047 - DNA, 22 bp, Homo sapiens
gaattaaaactgagtccatgaa

SEQ ID NO: 5738048 - DNA, 12 bp, Homo sapiens
gaattaaaactt

SEQ ID NO: 5738049 - DNA, 16 bp, Homo sapiens
gaattaaaacttctta

SEQ ID NO: 5738050 - DNA, 17 bp, Homo sapiens
gaattaaaacttcttaa

SEQ ID NO: 5738051 - DNA, 19 bp, Homo sapiens
gaattaaaacttcttaaat

SEQ ID NO: 5738052 - DNA, 11 bp, Homo sapiens
gaattaaaagt

SEQ ID NO: 5738053 - DNA, 11 bp, Homo sapiens
gaattaaaata

SEQ ID NO: 5738054 - DNA, 15 bp, Homo sapiens
gaattaaaataaaac

SEQ ID NO: 5738055 - DNA, 12 bp, Homo sapiens
gaattaaaattt

SEQ ID NO: 5738056 - DNA, 20 bp, Homo sapiens
gaattaaacccacaagctgc

SEQ ID NO: 5738057 - DNA, 13 bp, Homo sapiens
gaattaaactttt

SEQ ID NO: 5738058 - DNA, 13 bp, Homo sapiens
gaattaaagtcta

SEQ ID NO: 5738059 - DNA, 14 bp, Homo sapiens
gaattaaagtctac

SEQ ID NO: 5738060 - DNA, 12 bp, Homo sapiens
gaattaaataaa

SEQ ID NO: 5738061 - DNA, 21 bp, Homo sapiens
gaattaaatcctccagctttt

SEQ ID NO: 5738062 - DNA, 13 bp, Homo sapiens
gaattaaatttaa

SEQ ID NO: 5738063 - DNA, 19 bp, Homo sapiens
gaattaacacagtgtttca

SEQ ID NO: 5738064 - DNA, 20 bp, Homo sapiens
gaattaacacagtgtttcaa

SEQ ID NO: 5738065 - DNA, 19 bp, Homo sapiens
gaattaaccatttaataaa

SEQ ID NO: 5738066 - DNA, 16 bp, Homo sapiens
gaattaacctggtgct

SEQ ID NO: 5738067 - DNA, 19 bp, Homo sapiens
gaattaacctggtgctgga

SEQ ID NO: 5738068 - DNA, 22 bp, Homo sapiens
gaattaacctggtgctggatat

SEQ ID NO: 5738069 - DNA, 17 bp, Homo sapiens
gaattaactccattcca

SEQ ID NO: 5738070 - DNA, 16 bp, Homo sapiens
gaattaagaaagatta

SEQ ID NO: 5738071 - DNA, 16 bp, Homo sapiens
gaattaagaggataca

SEQ ID NO: 5738072 - DNA, 13 bp, Homo sapiens
gaattaagcagaa

SEQ ID NO: 5738073 - DNA, 23 bp, Homo sapiens
gaattaagggccagaaaaaagtg

SEQ ID NO: 5738074 - DNA, 13 bp, Homo sapiens
gaattaagttatt

SEQ ID NO: 5738075 - DNA, 21 bp, Homo sapiens
gaattaatatccctacatgta

SEQ ID NO: 5738076 - DNA, 16 bp, Homo sapiens
gaattaatatttatgt

SEQ ID NO: 5738077 - DNA, 18 bp, Homo sapiens
gaattaatctagaaaatg

SEQ ID NO: 5738078 - DNA, 17 bp, Homo sapiens
gaattaattcagatgtt

SEQ ID NO: 5738079 - DNA, 20 bp, Homo sapiens
gaattaattggctatatgga

SEQ ID NO: 5738080 - DNA, 20 bp, Homo sapiens
gaattacactcaaggaaaag

SEQ ID NO: 5738081 - DNA, 17 bp, Homo sapiens
gaattacagaaaatttg

SEQ ID NO: 5738082 - DNA, 20 bp, Homo sapiens
gaattacagaaaatttgcaa

SEQ ID NO: 5738083 - DNA, 17 bp, Homo sapiens
gaattacagagatataa

SEQ ID NO: 5738084 - DNA, 21 bp, Homo sapiens
gaattacagagatataaatga

SEQ ID NO: 5738085 - DNA, 22 bp, Homo sapiens
gaattacagagatataaatgaa

SEQ ID NO: 5738086 - DNA, 11 bp, Homo sapiens
gaattacagta

SEQ ID NO: 5738087 - DNA, 13 bp, Homo sapiens
gaattacagtgaa

SEQ ID NO: 5738088 - DNA, 16 bp, Homo sapiens
gaattaccaagagaag

SEQ ID NO: 5738089 - DNA, 22 bp, Homo sapiens
gaattaccatagagtaatgatg

SEQ ID NO: 5738090 - DNA, 15 bp, Homo sapiens
gaattacccttcctc

SEQ ID NO: 5738091 - DNA, 19 bp, Homo sapiens
gaattacccttcctcatct

SEQ ID NO: 5738092 - DNA, 14 bp, Homo sapiens
gaattactaacttc

SEQ ID NO: 5738093 - DNA, 22 bp, Homo sapiens
gaattactatttactttattaa

SEQ ID NO: 5738094 - DNA, 12 bp, Homo sapiens
gaattactgttt

SEQ ID NO: 5738095 - DNA, 18 bp, Homo sapiens
gaattactgtttgaaact

SEQ ID NO: 5738096 - DNA, 10 bp, Homo sapiens
gaattagaaa

SEQ ID NO: 5738097 - DNA, 15 bp, Homo sapiens
gaattagaaaattag

SEQ ID NO: 5738098 - DNA, 20 bp, Homo sapiens
gaattagaagccatctgaca

SEQ ID NO: 5738099 - DNA, 23 bp, Homo sapiens
gaattagagggccttgcttctct

SEQ ID NO: 5738100 - DNA, 20 bp, Homo sapiens
gaattagccaaaacacttag

SEQ ID NO: 5738101 - DNA, 16 bp, Homo sapiens
gaattaggctgtaact

SEQ ID NO: 5738102 - DNA, 17 bp, Homo sapiens
gaattaggctgtaacta

SEQ ID NO: 5738103 - DNA, 18 bp, Homo sapiens
gaattaggctgtaactac

SEQ ID NO: 5738104 - DNA, 23 bp, Homo sapiens
gaattaggctgtaactactttat

SEQ ID NO: 5738105 - DNA, 15 bp, Homo sapiens
gaattaggtaatgga

SEQ ID NO: 5738106 - DNA, 20 bp, Homo sapiens
gaattaggtccacttcaatg

SEQ ID NO: 5738107 - DNA, 21 bp, Homo sapiens
gaattaggtttctttgaagaa

SEQ ID NO: 5738108 - DNA, 18 bp, Homo sapiens
gaattagtatgtctgttt

SEQ ID NO: 5738109 - DNA, 16 bp, Homo sapiens
gaattagtcctcacag

SEQ ID NO: 5738110 - DNA, 15 bp, Homo sapiens
gaattataacagtta

SEQ ID NO: 5738111 - DNA, 20 bp, Homo sapiens
gaattataacagttatattt

SEQ ID NO: 5738112 - DNA, 21 bp, Homo sapiens
gaattataacagttatatttt

SEQ ID NO: 5738113 - DNA, 13 bp, Homo sapiens
gaattataactgt

SEQ ID NO: 5738114 - DNA, 21 bp, Homo sapiens
gaattataactgtaaagatgt

SEQ ID NO: 5738115 - DNA, 22 bp, Homo sapiens
gaattatacagacctaatatca

SEQ ID NO: 5738116 - DNA, 22 bp, Homo sapiens
gaattatactttgttgttttta

SEQ ID NO: 5738117 - DNA, 19 bp, Homo sapiens
gaattatatctaatttata

SEQ ID NO: 5738118 - DNA, 12 bp, Homo sapiens
gaattatatttt

SEQ ID NO: 5738119 - DNA, 14 bp, Homo sapiens
gaattatccattac

SEQ ID NO: 5738120 - DNA, 23 bp, Homo sapiens
gaattatccattacgtgcattta

SEQ ID NO: 5738121 - DNA, 18 bp, Homo sapiens
gaattatcccttttcttg

SEQ ID NO: 5738122 - DNA, 15 bp, Homo sapiens
gaattatctcaagta

SEQ ID NO: 5738123 - DNA, 16 bp, Homo sapiens
gaattatcttggatga

SEQ ID NO: 5738124 - DNA, 20 bp, Homo sapiens
gaattatgtaatatattgta

SEQ ID NO: 5738125 - DNA, 21 bp, Homo sapiens
gaattatgtaatatattgtac

SEQ ID NO: 5738126 - DNA, 16 bp, Homo sapiens
gaattatgtataacaa

SEQ ID NO: 5738127 - DNA, 13 bp, Homo sapiens
gaattattacact

SEQ ID NO: 5738128 - DNA, 12 bp, Homo sapiens
gaattattgaca

SEQ ID NO: 5738129 - DNA, 14 bp, Homo sapiens
gaattattgacact

SEQ ID NO: 5738130 - DNA, 16 bp, Homo sapiens
gaattattgacactga

SEQ ID NO: 5738131 - DNA, 20 bp, Homo sapiens
gaattattgtaccattttct

SEQ ID NO: 5738132 - DNA, 14 bp, Homo sapiens
gaattatttctgtc

SEQ ID NO: 5738133 - DNA, 21 bp, Homo sapiens
gaattatttctgtcacagtaa

SEQ ID NO: 5738134 - DNA, 20 bp, Homo sapiens
gaattatttgccttctgaaa

SEQ ID NO: 5738135 - DNA, 13 bp, Homo sapiens
gaattattttaaa

SEQ ID NO: 5738136 - DNA, 16 bp, Homo sapiens
gaattattttgttact

SEQ ID NO: 5738137 - DNA, 19 bp, Homo sapiens
gaattattttgttgtgatt

SEQ ID NO: 5738138 - DNA, 19 bp, Homo sapiens
gaattatttttttaaactt

SEQ ID NO: 5738139 - DNA, 19 bp, Homo sapiens
gaattcaaaagtgattatc

SEQ ID NO: 5738140 - DNA, 22 bp, Homo sapiens
gaattcaaaagtgattatctct

SEQ ID NO: 5738141 - DNA, 23 bp, Homo sapiens
gaattcaaactggggcctccaga

SEQ ID NO: 5738142 - DNA, 18 bp, Homo sapiens
gaattcaaagcttgtgaa

SEQ ID NO: 5738143 - DNA, 16 bp, Homo sapiens
gaattcaaatttgtaa

SEQ ID NO: 5738144 - DNA, 23 bp, Homo sapiens
gaattcaaatttgtaataaaact

SEQ ID NO: 5738145 - DNA, 21 bp, Homo sapiens
gaattcaatgggtaaataaat

SEQ ID NO: 5738146 - DNA, 22 bp, Homo sapiens
gaattcaatgggtaaataaatg

SEQ ID NO: 5738147 - DNA, 17 bp, Homo sapiens
gaattcacaaacaaatg

SEQ ID NO: 5738148 - DNA, 19 bp, Homo sapiens
gaattcacaaacaaatggc

SEQ ID NO: 5738149 - DNA, 22 bp, Homo sapiens
gaattcacaaagtaatttggaa

SEQ ID NO: 5738150 - DNA, 19 bp, Homo sapiens
gaattcacagatatttaaa

SEQ ID NO: 5738151 - DNA, 20 bp, Homo sapiens
gaattcacagatatttaaag

SEQ ID NO: 5738152 - DNA, 18 bp, Homo sapiens
gaattcaccacagacttt

SEQ ID NO: 5738153 - DNA, 19 bp, Homo sapiens
gaattcaccacagacttta

SEQ ID NO: 5738154 - DNA, 17 bp, Homo sapiens
gaattcaccagtgttcc

SEQ ID NO: 5738155 - DNA, 17 bp, Homo sapiens
gaattcactaggaggtc

SEQ ID NO: 5738156 - DNA, 20 bp, Homo sapiens
gaattcactccagtcaacag

SEQ ID NO: 5738157 - DNA, 22 bp, Homo sapiens
gaattcactccagtcaacagat

SEQ ID NO: 5738158 - DNA, 23 bp, Homo sapiens
gaattcacttaagtttttccaaa

SEQ ID NO: 5738159 - DNA, 18 bp, Homo sapiens
gaattcagaagtggagat

SEQ ID NO: 5738160 - DNA, 13 bp, Homo sapiens
gaattcagcagtt

SEQ ID NO: 5738161 - DNA, 23 bp, Homo sapiens
gaattcagctcagcttcttccta

SEQ ID NO: 5738162 - DNA, 14 bp, Homo sapiens
gaattcagtgcctt

SEQ ID NO: 5738163 - DNA, 17 bp, Homo sapiens
gaattcagtgccttcaa

SEQ ID NO: 5738164 - DNA, 24 bp, Homo sapiens
gaattcagtgccttcaacaacgtg

SEQ ID NO: 5738165 - DNA, 11 bp, Homo sapiens
gaattcagtgg

SEQ ID NO: 5738166 - DNA, 12 bp, Homo sapiens
gaattcataaaa

SEQ ID NO: 5738167 - DNA, 15 bp, Homo sapiens
gaattcataaaaata

SEQ ID NO: 5738168 - DNA, 22 bp, Homo sapiens
gaattcatactctgttgcctcc

SEQ ID NO: 5738169 - DNA, 21 bp, Homo sapiens
gaattcatgatgctagttctt

SEQ ID NO: 5738170 - DNA, 22 bp, Homo sapiens
gaattcatgatgctagttctta

SEQ ID NO: 5738171 - DNA, 15 bp, Homo sapiens
gaattcattccccag

SEQ ID NO: 5738172 - DNA, 20 bp, Homo sapiens
gaattcattccccagctcca

SEQ ID NO: 5738173 - DNA, 14 bp, Homo sapiens
gaattcattgtctc

SEQ ID NO: 5738174 - DNA, 14 bp, Homo sapiens
gaattcatttcact

SEQ ID NO: 5738175 - DNA, 12 bp, Homo sapiens
gaattccaaagc

SEQ ID NO: 5738176 - DNA, 19 bp, Homo sapiens
gaattccaacttgaaggat

SEQ ID NO: 5738177 - DNA, 12 bp, Homo sapiens
gaattccaagga

SEQ ID NO: 5738178 - DNA, 18 bp, Homo sapiens
gaattccaagtgtatttt

SEQ ID NO: 5738179 - DNA, 21 bp, Homo sapiens
gaattccagttgtatttgaag

SEQ ID NO: 5738180 - DNA, 17 bp, Homo sapiens
gaattccataatacata

SEQ ID NO: 5738181 - DNA, 22 bp, Homo sapiens
gaattccatagtggaccacttg

SEQ ID NO: 5738182 - DNA, 17 bp, Homo sapiens
gaattccatttgaggat

SEQ ID NO: 5738183 - DNA, 12 bp, Homo sapiens
gaattcccaggt

SEQ ID NO: 5738184 - DNA, 13 bp, Homo sapiens
gaattccctcact

SEQ ID NO: 5738185 - DNA, 21 bp, Homo sapiens
gaattccctcactcgtctccc

SEQ ID NO: 5738186 - DNA, 16 bp, Homo sapiens
gaattccctccccctc

SEQ ID NO: 5738187 - DNA, 18 bp, Homo sapiens
gaattcctaacttttcaa

SEQ ID NO: 5738188 - DNA, 17 bp, Homo sapiens
gaattcctacacatggt

SEQ ID NO: 5738189 - DNA, 19 bp, Homo sapiens
gaattcctgcagcagttat

SEQ ID NO: 5738190 - DNA, 17 bp, Homo sapiens
gaattcctgtagcacac

SEQ ID NO: 5738191 - DNA, 15 bp, Homo sapiens
gaattccttaaagtt

SEQ ID NO: 5738192 - DNA, 20 bp, Homo sapiens
gaattccttcgaaaggcctt

SEQ ID NO: 5738193 - DNA, 21 bp, Homo sapiens
gaattccttcgaaaggccttc

SEQ ID NO: 5738194 - DNA, 22 bp, Homo sapiens
gaattccttcgaaaggccttca

SEQ ID NO: 5738195 - DNA, 15 bp, Homo sapiens
gaattccttctaaga

SEQ ID NO: 5738196 - DNA, 14 bp, Homo sapiens
gaattcctttacaa

SEQ ID NO: 5738197 - DNA, 20 bp, Homo sapiens
gaattcctttacaactaaat

SEQ ID NO: 5738198 - DNA, 22 bp, Homo sapiens
gaattcctttacaactaaataa

SEQ ID NO: 5738199 - DNA, 22 bp, Homo sapiens
gaattcgagacaggcagaatca

SEQ ID NO: 5738200 - DNA, 17 bp, Homo sapiens
gaattcggtgtgcacca

SEQ ID NO: 5738201 - DNA, 18 bp, Homo sapiens
gaattcggtgtgctgcca

SEQ ID NO: 5738202 - DNA, 15 bp, Homo sapiens
gaattcgtgttatga

SEQ ID NO: 5738203 - DNA, 17 bp, Homo sapiens
gaattcgtgttatgaat

SEQ ID NO: 5738204 - DNA, 18 bp, Homo sapiens
gaattcgtgttatgaatc

SEQ ID NO: 5738205 - DNA, 22 bp, Homo sapiens
gaattctaacattaaatcacag

SEQ ID NO: 5738206 - DNA, 20 bp, Homo sapiens
gaattctaagattgtacata

SEQ ID NO: 5738207 - DNA, 15 bp, Homo sapiens
gaattctactggaaa

SEQ ID NO: 5738208 - DNA, 16 bp, Homo sapiens
gaattctactggaaaa

SEQ ID NO: 5738209 - DNA, 16 bp, Homo sapiens
gaattctagaaaattt

SEQ ID NO: 5738210 - DNA, 16 bp, Homo sapiens
gaattctagaaataaa

SEQ ID NO: 5738211 - DNA, 16 bp, Homo sapiens
gaattctagtgctgct

SEQ ID NO: 5738212 - DNA, 18 bp, Homo sapiens
gaattctcggaatggcag

SEQ ID NO: 5738213 - DNA, 17 bp, Homo sapiens
gaattctctagtttgat

SEQ ID NO: 5738214 - DNA, 20 bp, Homo sapiens
gaattctctctaaaaataaa

SEQ ID NO: 5738215 - DNA, 16 bp, Homo sapiens
gaattctgcccttttc

SEQ ID NO: 5738216 - DNA, 18 bp, Homo sapiens
gaattctgctacctcact

SEQ ID NO: 5738217 - DNA, 16 bp, Homo sapiens
gaattctggtcctgtt

SEQ ID NO: 5738218 - DNA, 14 bp, Homo sapiens
gaattctgtacttc

SEQ ID NO: 5738219 - DNA, 19 bp, Homo sapiens
gaattctgttcatttgtta

SEQ ID NO: 5738220 - DNA, 18 bp, Homo sapiens
gaattcttacatgttttc

SEQ ID NO: 5738221 - DNA, 22 bp, Homo sapiens
gaattcttacatgttttctttg

SEQ ID NO: 5738222 - DNA, 21 bp, Homo sapiens
gaattcttatgcttataatat

SEQ ID NO: 5738223 - DNA, 23 bp, Homo sapiens
gaattcttcaacagggaaaacag

SEQ ID NO: 5738224 - DNA, 11 bp, Homo sapiens
gaattcttcct

SEQ ID NO: 5738225 - DNA, 17 bp, Homo sapiens
gaattcttcctcctctg

SEQ ID NO: 5738226 - DNA, 20 bp, Homo sapiens
gaattcttcctctccttccc

SEQ ID NO: 5738227 - DNA, 18 bp, Homo sapiens
gaattcttctgcaacatt

SEQ ID NO: 5738228 - DNA, 12 bp, Homo sapiens
gaattcttctgt

SEQ ID NO: 5738229 - DNA, 14 bp, Homo sapiens
gaattcttctgtta

SEQ ID NO: 5738230 - DNA, 23 bp, Homo sapiens
gaattcttgaaggaaaatgatac

SEQ ID NO: 5738231 - DNA, 18 bp, Homo sapiens
gaattcttgagtttacat

SEQ ID NO: 5738232 - DNA, 14 bp, Homo sapiens
gaattcttttgcca

SEQ ID NO: 5738233 - DNA, 11 bp, Homo sapiens
gaattgaaaaa

SEQ ID NO: 5738234 - DNA, 14 bp, Homo sapiens
gaattgaaaaacaa

SEQ ID NO: 5738235 - DNA, 13 bp, Homo sapiens
gaattgaaacact

SEQ ID NO: 5738236 - DNA, 14 bp, Homo sapiens
gaattgaaacactt

SEQ ID NO: 5738237 - DNA, 15 bp, Homo sapiens
gaattgaaatgaggt

SEQ ID NO: 5738238 - DNA, 21 bp, Homo sapiens
gaattgaaatggggcgctgga

SEQ ID NO: 5738239 - DNA, 18 bp, Homo sapiens
gaattgaacccaggaggt

SEQ ID NO: 5738240 - DNA, 23 bp, Homo sapiens
gaattgaaccgtcaatgtgaaat

SEQ ID NO: 5738241 - DNA, 21 bp, Homo sapiens
gaattgaagctttactttaga

SEQ ID NO: 5738242 - DNA, 17 bp, Homo sapiens
gaattgaagtcatcata

SEQ ID NO: 5738243 - DNA, 17 bp, Homo sapiens
gaattgaccatctgctt

SEQ ID NO: 5738244 - DNA, 18 bp, Homo sapiens
gaattgaccatctgcttt

SEQ ID NO: 5738245 - DNA, 19 bp, Homo sapiens
gaattgactgaagcacagc

SEQ ID NO: 5738246 - DNA, 16 bp, Homo sapiens
gaattgactgcagttg

SEQ ID NO: 5738247 - DNA, 18 bp, Homo sapiens
gaattgacttcgactgtg

SEQ ID NO: 5738248 - DNA, 14 bp, Homo sapiens
gaattgagaaaaga

SEQ ID NO: 5738249 - DNA, 13 bp, Homo sapiens
gaattgagaggtg

SEQ ID NO: 5738250 - DNA, 16 bp, Homo sapiens
gaattgagctgcagaa

SEQ ID NO: 5738251 - DNA, 18 bp, Homo sapiens
gaattgaggggattaata

SEQ ID NO: 5738252 - DNA, 18 bp, Homo sapiens
gaattgataaaagagttc

SEQ ID NO: 5738253 - DNA, 20 bp, Homo sapiens
gaattgataaaagagttccc

SEQ ID NO: 5738254 - DNA, 16 bp, Homo sapiens
gaattgatcagaatcc

SEQ ID NO: 5738255 - DNA, 18 bp, Homo sapiens
gaattgatgatgcagttt

SEQ ID NO: 5738256 - DNA, 20 bp, Homo sapiens
gaattgatttcccttcttct

SEQ ID NO: 5738257 - DNA, 17 bp, Homo sapiens
gaattgatttgcattga

SEQ ID NO: 5738258 - DNA, 16 bp, Homo sapiens
gaattgcaattttaac

SEQ ID NO: 5738259 - DNA, 21 bp, Homo sapiens
gaattgcagcatatcgtttaa

SEQ ID NO: 5738260 - DNA, 17 bp, Homo sapiens
gaattgcagtaaagtct

SEQ ID NO: 5738261 - DNA, 12 bp, Homo sapiens
gaattgcattga

SEQ ID NO: 5738262 - DNA, 20 bp, Homo sapiens
gaattgcccattgtttttct

SEQ ID NO: 5738263 - DNA, 20 bp, Homo sapiens
gaattgcctgcagagagaag

SEQ ID NO: 5738264 - DNA, 20 bp, Homo sapiens
gaattgcctttgataattct

SEQ ID NO: 5738265 - DNA, 16 bp, Homo sapiens
gaattgctatcatttg

SEQ ID NO: 5738266 - DNA, 17 bp, Homo sapiens
gaattgcttgaacctgg

SEQ ID NO: 5738267 - DNA, 18 bp, Homo sapiens
gaattggaaagacttctc

SEQ ID NO: 5738268 - DNA, 16 bp, Homo sapiens
gaattggaactgcaat

SEQ ID NO: 5738269 - DNA, 21 bp, Homo sapiens
gaattggaagttacatgctgt

SEQ ID NO: 5738270 - DNA, 22 bp, Homo sapiens
gaattggaccatcctatttaac

SEQ ID NO: 5738271 - DNA, 19 bp, Homo sapiens
gaattggaggctgcagtga

SEQ ID NO: 5738272 - DNA, 18 bp, Homo sapiens
gaattggcaaactagaat

SEQ ID NO: 5738273 - DNA, 21 bp, Homo sapiens
gaattggcataatttgtctta

SEQ ID NO: 5738274 - DNA, 17 bp, Homo sapiens
gaattggcctcagtgta

SEQ ID NO: 5738275 - DNA, 13 bp, Homo sapiens
gaattgggaagct

SEQ ID NO: 5738276 - DNA, 16 bp, Homo sapiens
gaattgggactctgtt

SEQ ID NO: 5738277 - DNA, 22 bp, Homo sapiens
gaattgggtggggggcttcata

SEQ ID NO: 5738278 - DNA, 23 bp, Homo sapiens
gaattgggtggggggcttcatac

SEQ ID NO: 5738279 - DNA, 14 bp, Homo sapiens
gaattgggtttctg

SEQ ID NO: 5738280 - DNA, 19 bp, Homo sapiens
gaattggtgaataaaacct

SEQ ID NO: 5738281 - DNA, 14 bp, Homo sapiens
gaattggtgtatat

SEQ ID NO: 5738282 - DNA, 15 bp, Homo sapiens
gaattgtaaggaatg

SEQ ID NO: 5738283 - DNA, 18 bp, Homo sapiens
gaattgtacctatttctg

SEQ ID NO: 5738284 - DNA, 15 bp, Homo sapiens
gaattgtagactgat

SEQ ID NO: 5738285 - DNA, 20 bp, Homo sapiens
gaattgtagactgatgtttt

SEQ ID NO: 5738286 - DNA, 19 bp, Homo sapiens
gaattgtagataatactgt

SEQ ID NO: 5738287 - DNA, 17 bp, Homo sapiens
gaattgtagttcttagt

SEQ ID NO: 5738288 - DNA, 18 bp, Homo sapiens
gaattgtccatgtgcttc

SEQ ID NO: 5738289 - DNA, 14 bp, Homo sapiens
gaattgtccccagt

SEQ ID NO: 5738290 - DNA, 15 bp, Homo sapiens
gaattgtctctgggc

SEQ ID NO: 5738291 - DNA, 13 bp, Homo sapiens
gaattgtcttgat

SEQ ID NO: 5738292 - DNA, 20 bp, Homo sapiens
gaattgtgctccaaatgtct

SEQ ID NO: 5738293 - DNA, 22 bp, Homo sapiens
gaattgtgctccaaatgtctac

SEQ ID NO: 5738294 - DNA, 19 bp, Homo sapiens
gaattgtgctttcaccaga

SEQ ID NO: 5738295 - DNA, 16 bp, Homo sapiens
gaattgtggtttatat

SEQ ID NO: 5738296 - DNA, 20 bp, Homo sapiens
gaattgtgtggagaagtgtg

SEQ ID NO: 5738297 - DNA, 22 bp, Homo sapiens
gaattgtgttttcaggttttgt

SEQ ID NO: 5738298 - DNA, 20 bp, Homo sapiens
gaattgttagcaaatgacag

SEQ ID NO: 5738299 - DNA, 18 bp, Homo sapiens
gaattgttgaaactaaag

SEQ ID NO: 5738300 - DNA, 20 bp, Homo sapiens
gaattgttgaatgtattctt

SEQ ID NO: 5738301 - DNA, 22 bp, Homo sapiens
gaattgttgagatactttacta

SEQ ID NO: 5738302 - DNA, 19 bp, Homo sapiens
gaattgtttttataaaaac

SEQ ID NO: 5738303 - DNA, 13 bp, Homo sapiens
gaatttaaaatgt

SEQ ID NO: 5738304 - DNA, 14 bp, Homo sapiens
gaatttaaaatgta

SEQ ID NO: 5738305 - DNA, 15 bp, Homo sapiens
gaatttaaaatgtag

SEQ ID NO: 5738306 - DNA, 16 bp, Homo sapiens
gaatttaaaatgtagt

SEQ ID NO: 5738307 - DNA, 21 bp, Homo sapiens
gaatttaaaatgtagttttaa

SEQ ID NO: 5738308 - DNA, 20 bp, Homo sapiens
gaatttaaagaaaaaaatgt

SEQ ID NO: 5738309 - DNA, 16 bp, Homo sapiens
gaatttaacaatgcga

SEQ ID NO: 5738310 - DNA, 14 bp, Homo sapiens
gaatttaagaattt

SEQ ID NO: 5738311 - DNA, 17 bp, Homo sapiens
gaatttaagaatttgtt

SEQ ID NO: 5738312 - DNA, 18 bp, Homo sapiens
gaatttaagaatttgttt

SEQ ID NO: 5738313 - DNA, 13 bp, Homo sapiens
gaatttaagcatg

SEQ ID NO: 5738314 - DNA, 14 bp, Homo sapiens
gaatttaaggcaaa

SEQ ID NO: 5738315 - DNA, 20 bp, Homo sapiens
gaatttaatggactgtgaat

SEQ ID NO: 5738316 - DNA, 23 bp, Homo sapiens
gaatttaatgtctaggataattt

SEQ ID NO: 5738317 - DNA, 20 bp, Homo sapiens
gaatttaatttttaaaagac

SEQ ID NO: 5738318 - DNA, 15 bp, Homo sapiens
gaatttaccagaaat

SEQ ID NO: 5738319 - DNA, 15 bp, Homo sapiens
gaatttaccatcaaa

SEQ ID NO: 5738320 - DNA, 21 bp, Homo sapiens
gaatttacctcttatgagctc

SEQ ID NO: 5738321 - DNA, 19 bp, Homo sapiens
gaatttactttcttcacca

SEQ ID NO: 5738322 - DNA, 18 bp, Homo sapiens
gaatttagaaatattcaa

SEQ ID NO: 5738323 - DNA, 21 bp, Homo sapiens
gaatttagccctggtttgaaa

SEQ ID NO: 5738324 - DNA, 21 bp, Homo sapiens
gaatttagggagaaatgttgt

SEQ ID NO: 5738325 - DNA, 18 bp, Homo sapiens
gaatttagtattatcaaa

SEQ ID NO: 5738326 - DNA, 23 bp, Homo sapiens
gaatttatacctacctgtgtggt

SEQ ID NO: 5738327 - DNA, 15 bp, Homo sapiens
gaatttatagaataa

SEQ ID NO: 5738328 - DNA, 12 bp, Homo sapiens
gaatttatatag

SEQ ID NO: 5738329 - DNA, 20 bp, Homo sapiens
gaatttatcacacttctgtg

SEQ ID NO: 5738330 - DNA, 15 bp, Homo sapiens
gaatttatcccttta

SEQ ID NO: 5738331 - DNA, 23 bp, Homo sapiens
gaatttatctcccttagaagaga

SEQ ID NO: 5738332 - DNA, 14 bp, Homo sapiens
gaatttatctcttt

SEQ ID NO: 5738333 - DNA, 14 bp, Homo sapiens
gaatttatctttac

SEQ ID NO: 5738334 - DNA, 15 bp, Homo sapiens
gaatttatctttacc

SEQ ID NO: 5738335 - DNA, 15 bp, Homo sapiens
gaatttatctttgat

SEQ ID NO: 5738336 - DNA, 21 bp, Homo sapiens
gaatttatgagatttactgct

SEQ ID NO: 5738337 - DNA, 20 bp, Homo sapiens
gaatttatgtgaaatgcttt

SEQ ID NO: 5738338 - DNA, 17 bp, Homo sapiens
gaatttattattgttct

SEQ ID NO: 5738339 - DNA, 23 bp, Homo sapiens
gaatttattcaattcctctggga

SEQ ID NO: 5738340 - DNA, 17 bp, Homo sapiens
gaatttattgaatattt

SEQ ID NO: 5738341 - DNA, 13 bp, Homo sapiens
gaatttattgata

SEQ ID NO: 5738342 - DNA, 16 bp, Homo sapiens
gaatttattggctttt

SEQ ID NO: 5738343 - DNA, 20 bp, Homo sapiens
gaatttattggcttttctga

SEQ ID NO: 5738344 - DNA, 13 bp, Homo sapiens
gaatttatttatg

SEQ ID NO: 5738345 - DNA, 17 bp, Homo sapiens
gaatttatttatgttct

SEQ ID NO: 5738346 - DNA, 20 bp, Homo sapiens
gaatttatttatgttctcaa

SEQ ID NO: 5738347 - DNA, 21 bp, Homo sapiens
gaatttatttttaagaaagaa

SEQ ID NO: 5738348 - DNA, 16 bp, Homo sapiens
gaatttcaacttttga

SEQ ID NO: 5738349 - DNA, 12 bp, Homo sapiens
gaatttcacctg

SEQ ID NO: 5738350 - DNA, 21 bp, Homo sapiens
gaatttcacctgtaaacctga

SEQ ID NO: 5738351 - DNA, 16 bp, Homo sapiens
gaatttcactgtcttt

SEQ ID NO: 5738352 - DNA, 17 bp, Homo sapiens
gaatttcactgtctttt

SEQ ID NO: 5738353 - DNA, 18 bp, Homo sapiens
gaatttcactgtctttta

SEQ ID NO: 5738354 - DNA, 19 bp, Homo sapiens
gaatttcactgtcttttaa

SEQ ID NO: 5738355 - DNA, 10 bp, Homo sapiens
gaatttcagg

SEQ ID NO: 5738356 - DNA, 18 bp, Homo sapiens
gaatttcaggcattttgt

SEQ ID NO: 5738357 - DNA, 20 bp, Homo sapiens
gaatttcagtgggtctctgt

SEQ ID NO: 5738358 - DNA, 18 bp, Homo sapiens
gaatttcatatctacaga

SEQ ID NO: 5738359 - DNA, 19 bp, Homo sapiens
gaatttccattgacatttg

SEQ ID NO: 5738360 - DNA, 15 bp, Homo sapiens
gaatttcccaaagca

SEQ ID NO: 5738361 - DNA, 18 bp, Homo sapiens
gaatttcccaaagcagtg

SEQ ID NO: 5738362 - DNA, 17 bp, Homo sapiens
gaatttcccacataccc

SEQ ID NO: 5738363 - DNA, 22 bp, Homo sapiens
gaatttcccaggaccctgaagg

SEQ ID NO: 5738364 - DNA, 16 bp, Homo sapiens
gaatttctaaagtaaa

SEQ ID NO: 5738365 - DNA, 20 bp, Homo sapiens
gaatttctaggactgaatta

SEQ ID NO: 5738366 - DNA, 19 bp, Homo sapiens
gaatttctatctaaatgat

SEQ ID NO: 5738367 - DNA, 11 bp, Homo sapiens
gaatttctgat

SEQ ID NO: 5738368 - DNA, 19 bp, Homo sapiens
gaatttctggaagaaaggc

SEQ ID NO: 5738369 - DNA, 14 bp, Homo sapiens
gaatttcttaactt

SEQ ID NO: 5738370 - DNA, 19 bp, Homo sapiens
gaatttcttaacttcttgc

SEQ ID NO: 5738371 - DNA, 20 bp, Homo sapiens
gaatttcttcttttcctgca

SEQ ID NO: 5738372 - DNA, 16 bp, Homo sapiens
gaatttcttgattttt

SEQ ID NO: 5738373 - DNA, 12 bp, Homo sapiens
gaatttcttggt

SEQ ID NO: 5738374 - DNA, 11 bp, Homo sapiens
gaatttcttgt

SEQ ID NO: 5738375 - DNA, 19 bp, Homo sapiens
gaatttctttgatttaact

SEQ ID NO: 5738376 - DNA, 22 bp, Homo sapiens
gaatttcttttgccgttattaa

SEQ ID NO: 5738377 - DNA, 16 bp, Homo sapiens
gaatttgaaaggaaaa

SEQ ID NO: 5738378 - DNA, 19 bp, Homo sapiens
gaatttgaagaattaatga

SEQ ID NO: 5738379 - DNA, 11 bp, Homo sapiens
gaatttgaagc

SEQ ID NO: 5738380 - DNA, 19 bp, Homo sapiens
gaatttgaagctcagaaag

SEQ ID NO: 5738381 - DNA, 19 bp, Homo sapiens
gaatttgaatgaaaaattt

SEQ ID NO: 5738382 - DNA, 19 bp, Homo sapiens
gaatttgaggtctagagag

SEQ ID NO: 5738383 - DNA, 20 bp, Homo sapiens
gaatttgaggtctagagaga

SEQ ID NO: 5738384 - DNA, 23 bp, Homo sapiens
gaatttgatcgttccagttccca

SEQ ID NO: 5738385 - DNA, 14 bp, Homo sapiens
gaatttgattgctt

SEQ ID NO: 5738386 - DNA, 17 bp, Homo sapiens
gaatttgcaaagtactg

SEQ ID NO: 5738387 - DNA, 18 bp, Homo sapiens
gaatttgcaaagtactgt

SEQ ID NO: 5738388 - DNA, 19 bp, Homo sapiens
gaatttgcaagtcatggct

SEQ ID NO: 5738389 - DNA, 11 bp, Homo sapiens
gaatttgcacc

SEQ ID NO: 5738390 - DNA, 17 bp, Homo sapiens
gaatttgcatacttacc

SEQ ID NO: 5738391 - DNA, 14 bp, Homo sapiens
gaatttgcatgtct

SEQ ID NO: 5738392 - DNA, 15 bp, Homo sapiens
gaatttgccagagga

SEQ ID NO: 5738393 - DNA, 14 bp, Homo sapiens
gaatttgcctgctg

SEQ ID NO: 5738394 - DNA, 20 bp, Homo sapiens
gaatttgcctgctgggattc

SEQ ID NO: 5738395 - DNA, 13 bp, Homo sapiens
gaatttggaaatc

SEQ ID NO: 5738396 - DNA, 23 bp, Homo sapiens
gaatttggagccaggatgggtct

SEQ ID NO: 5738397 - DNA, 13 bp, Homo sapiens
gaatttggcccag

SEQ ID NO: 5738398 - DNA, 21 bp, Homo sapiens
gaatttgggaccctgctttag

SEQ ID NO: 5738399 - DNA, 14 bp, Homo sapiens
gaatttgggcagat

SEQ ID NO: 5738400 - DNA, 22 bp, Homo sapiens
gaatttggggcaggaaatactt

SEQ ID NO: 5738401 - DNA, 21 bp, Homo sapiens
gaatttggtacacatgtgtta

SEQ ID NO: 5738402 - DNA, 21 bp, Homo sapiens
gaatttggtgtggctgtattc

SEQ ID NO: 5738403 - DNA, 14 bp, Homo sapiens
gaatttgtaagttt

SEQ ID NO: 5738404 - DNA, 18 bp, Homo sapiens
gaatttgtacgtttatac

SEQ ID NO: 5738405 - DNA, 18 bp, Homo sapiens
gaatttgtccattgtaaa

SEQ ID NO: 5738406 - DNA, 17 bp, Homo sapiens
gaatttgtcgggttctc

SEQ ID NO: 5738407 - DNA, 17 bp, Homo sapiens
gaatttgtgaacagcag

SEQ ID NO: 5738408 - DNA, 18 bp, Homo sapiens
gaatttgtgtggatattt

SEQ ID NO: 5738409 - DNA, 13 bp, Homo sapiens
gaatttgttctta

SEQ ID NO: 5738410 - DNA, 14 bp, Homo sapiens
gaatttgtttcatc

SEQ ID NO: 5738411 - DNA, 15 bp, Homo sapiens
gaatttgtttcatct

SEQ ID NO: 5738412 - DNA, 20 bp, Homo sapiens
gaatttgtttcatctatttt

SEQ ID NO: 5738413 - DNA, 18 bp, Homo sapiens
gaattttaaaacatggca

SEQ ID NO: 5738414 - DNA, 23 bp, Homo sapiens
gaattttaaaagatgcaatgtag

SEQ ID NO: 5738415 - DNA, 14 bp, Homo sapiens
gaattttaaaatgt

SEQ ID NO: 5738416 - DNA, 12 bp, Homo sapiens
gaattttaaagt

SEQ ID NO: 5738417 - DNA, 23 bp, Homo sapiens
gaattttaaataatgtatttact

SEQ ID NO: 5738418 - DNA, 13 bp, Homo sapiens
gaattttaagcct

SEQ ID NO: 5738419 - DNA, 20 bp, Homo sapiens
gaattttaagcctttgttga

SEQ ID NO: 5738420 - DNA, 15 bp, Homo sapiens
gaattttaagtgctt

SEQ ID NO: 5738421 - DNA, 17 bp, Homo sapiens
gaattttaagttctatc

SEQ ID NO: 5738422 - DNA, 18 bp, Homo sapiens
gaattttaagttctatca

SEQ ID NO: 5738423 - DNA, 17 bp, Homo sapiens
gaattttacaaaaattt

SEQ ID NO: 5738424 - DNA, 15 bp, Homo sapiens
gaattttacttccat

SEQ ID NO: 5738425 - DNA, 12 bp, Homo sapiens
gaattttatatt

SEQ ID NO: 5738426 - DNA, 16 bp, Homo sapiens
gaattttattgaaagc

SEQ ID NO: 5738427 - DNA, 17 bp, Homo sapiens
gaattttattttgctga

SEQ ID NO: 5738428 - DNA, 17 bp, Homo sapiens
gaattttcaaggccttc

SEQ ID NO: 5738429 - DNA, 12 bp, Homo sapiens
gaattttcattt

SEQ ID NO: 5738430 - DNA, 14 bp, Homo sapiens
gaattttcatttta

SEQ ID NO: 5738431 - DNA, 16 bp, Homo sapiens
gaattttcattttaca

SEQ ID NO: 5738432 - DNA, 22 bp, Homo sapiens
gaattttcctgagacaaatttt

SEQ ID NO: 5738433 - DNA, 23 bp, Homo sapiens
gaattttctccctttatgtatct

SEQ ID NO: 5738434 - DNA, 13 bp, Homo sapiens
gaattttctttca

SEQ ID NO: 5738435 - DNA, 19 bp, Homo sapiens
gaattttctttcatacatt

SEQ ID NO: 5738436 - DNA, 21 bp, Homo sapiens
gaattttctttcatacattat

SEQ ID NO: 5738437 - DNA, 23 bp, Homo sapiens
gaattttctttgtgtagctttgc

SEQ ID NO: 5738438 - DNA, 20 bp, Homo sapiens
gaattttgagtattccatga

SEQ ID NO: 5738439 - DNA, 14 bp, Homo sapiens
gaattttgcaatgt

SEQ ID NO: 5738440 - DNA, 21 bp, Homo sapiens
gaattttgctttatcagaagc

SEQ ID NO: 5738441 - DNA, 20 bp, Homo sapiens
gaattttggggattttcaaa

SEQ ID NO: 5738442 - DNA, 17 bp, Homo sapiens
gaattttgtaaaaagaa

SEQ ID NO: 5738443 - DNA, 18 bp, Homo sapiens
gaattttgtaaaaagaaa

SEQ ID NO: 5738444 - DNA, 14 bp, Homo sapiens
gaattttgtaagta

SEQ ID NO: 5738445 - DNA, 16 bp, Homo sapiens
gaattttgtgtgattg

SEQ ID NO: 5738446 - DNA, 13 bp, Homo sapiens
gaattttgtgtta

SEQ ID NO: 5738447 - DNA, 16 bp, Homo sapiens
gaattttgtgttagag

SEQ ID NO: 5738448 - DNA, 18 bp, Homo sapiens
gaattttgttctctggga

SEQ ID NO: 5738449 - DNA, 23 bp, Homo sapiens
gaattttgttctctgggagaaaa

SEQ ID NO: 5738450 - DNA, 23 bp, Homo sapiens
gaattttgtttttattttcaaga

SEQ ID NO: 5738451 - DNA, 22 bp, Homo sapiens
gaatttttaaaaaagtgatctt

SEQ ID NO: 5738452 - DNA, 14 bp, Homo sapiens
gaatttttaaaata

SEQ ID NO: 5738453 - DNA, 15 bp, Homo sapiens
gaatttttaaaataa

SEQ ID NO: 5738454 - DNA, 15 bp, Homo sapiens
gaatttttaaaatgc

SEQ ID NO: 5738455 - DNA, 18 bp, Homo sapiens
gaatttttaacaaaactt

SEQ ID NO: 5738456 - DNA, 16 bp, Homo sapiens
gaatttttaagcaaat

SEQ ID NO: 5738457 - DNA, 20 bp, Homo sapiens
gaatttttaatgacttttta

SEQ ID NO: 5738458 - DNA, 17 bp, Homo sapiens
gaatttttactggggat

SEQ ID NO: 5738459 - DNA, 18 bp, Homo sapiens
gaatttttatgtgtgatt

SEQ ID NO: 5738460 - DNA, 17 bp, Homo sapiens
gaatttttattatgcat

SEQ ID NO: 5738461 - DNA, 14 bp, Homo sapiens
gaatttttattatt

SEQ ID NO: 5738462 - DNA, 13 bp, Homo sapiens
gaatttttattgt

SEQ ID NO: 5738463 - DNA, 16 bp, Homo sapiens
gaatttttcattgata

SEQ ID NO: 5738464 - DNA, 16 bp, Homo sapiens
gaatttttcttgcgaa

SEQ ID NO: 5738465 - DNA, 13 bp, Homo sapiens
gaatttttgcaat

SEQ ID NO: 5738466 - DNA, 17 bp, Homo sapiens
gaatttttgcaataatg

SEQ ID NO: 5738467 - DNA, 20 bp, Homo sapiens
gaatttttgcaataatgcag

SEQ ID NO: 5738468 - DNA, 19 bp, Homo sapiens
gaatttttgcccatatctg

SEQ ID NO: 5738469 - DNA, 17 bp, Homo sapiens
gaatttttgcctatctt

SEQ ID NO: 5738470 - DNA, 15 bp, Homo sapiens
gaatttttgttttgt

SEQ ID NO: 5738471 - DNA, 19 bp, Homo sapiens
gaattttttattcttgtga

SEQ ID NO: 5738472 - DNA, 16 bp, Homo sapiens
gaattttttctttgta

SEQ ID NO: 5738473 - DNA, 20 bp, Homo sapiens
gaattttttgaaatgggcat

SEQ ID NO: 5738474 - DNA, 19 bp, Homo sapiens
gaattttttgaatatgcct

SEQ ID NO: 5738475 - DNA, 21 bp, Homo sapiens
gaattttttgaatatgcctta

SEQ ID NO: 5738476 - DNA, 16 bp, Homo sapiens
gaattttttgagtaat

SEQ ID NO: 5738477 - DNA, 13 bp, Homo sapiens
gaattttttgatc

SEQ ID NO: 5738478 - DNA, 15 bp, Homo sapiens
gaatttttttctgca

SEQ ID NO: 5738479 - DNA, 19 bp, Homo sapiens
gaattttttttaacattcc

SEQ ID NO: 5738480 - DNA, 22 bp, Homo sapiens
gaattttttttttaaatgattc

SEQ ID NO: 5738481 - DNA, 15 bp, Homo sapiens
gacaaaaacaagact

SEQ ID NO: 5738482 - DNA, 18 bp, Homo sapiens
gacaaaaacaagactgcc

SEQ ID NO: 5738483 - DNA, 20 bp, Homo sapiens
gacaaaaacaagactgcctc

SEQ ID NO: 5738484 - DNA, 21 bp, Homo sapiens
gacaaaaacaagactgcctcc

SEQ ID NO: 5738485 - DNA, 14 bp, Homo sapiens
gacaaaaagctact

SEQ ID NO: 5738486 - DNA, 17 bp, Homo sapiens
gacaaaaataacactgt

SEQ ID NO: 5738487 - DNA, 17 bp, Homo sapiens
gacaaaaatactctaat

SEQ ID NO: 5738488 - DNA, 21 bp, Homo sapiens
gacaaaaatgaactgaagttt

SEQ ID NO: 5738489 - DNA, 11 bp, Homo sapiens
gacaaaaatgt

SEQ ID NO: 5738490 - DNA, 17 bp, Homo sapiens
gacaaaaattatctatt

SEQ ID NO: 5738491 - DNA, 20 bp, Homo sapiens
gacaaaaccccccagatatc

SEQ ID NO: 5738492 - DNA, 21 bp, Homo sapiens
gacaaaacttataatttccaa

SEQ ID NO: 5738493 - DNA, 12 bp, Homo sapiens
gacaaaacttct

SEQ ID NO: 5738494 - DNA, 13 bp, Homo sapiens
gacaaaagaaaaa

SEQ ID NO: 5738495 - DNA, 12 bp, Homo sapiens
gacaaaaggaat

SEQ ID NO: 5738496 - DNA, 14 bp, Homo sapiens
gacaaaagggccag

SEQ ID NO: 5738497 - DNA, 18 bp, Homo sapiens
gacaaaagtgacagatgt

SEQ ID NO: 5738498 - DNA, 19 bp, Homo sapiens
gacaaaagtgacagatgtt

SEQ ID NO: 5738499 - DNA, 13 bp, Homo sapiens
gacaaaagtttca

SEQ ID NO: 5738500 - DNA, 14 bp, Homo sapiens
gacaaaataaagtg

SEQ ID NO: 5738501 - DNA, 21 bp, Homo sapiens
gacaaaatccatcagggaatg

SEQ ID NO: 5738502 - DNA, 14 bp, Homo sapiens
gacaaaatgaaaca

SEQ ID NO: 5738503 - DNA, 11 bp, Homo sapiens
gacaaaatgga

SEQ ID NO: 5738504 - DNA, 21 bp, Homo sapiens
gacaaaatggggcagaagaga

SEQ ID NO: 5738505 - DNA, 16 bp, Homo sapiens
gacaaaattaatacat

SEQ ID NO: 5738506 - DNA, 14 bp, Homo sapiens
gacaaaattgctta

SEQ ID NO: 5738507 - DNA, 19 bp, Homo sapiens
gacaaaattgtaagccaga

SEQ ID NO: 5738508 - DNA, 24 bp, Homo sapiens
gacaaaatttgagaatacataaac

SEQ ID NO: 5738509 - DNA, 17 bp, Homo sapiens
gacaaacacctcccagg

SEQ ID NO: 5738510 - DNA, 19 bp, Homo sapiens
gacaaacacctcccaggag

SEQ ID NO: 5738511 - DNA, 22 bp, Homo sapiens
gacaaacacctcccaggagaca

SEQ ID NO: 5738512 - DNA, 14 bp, Homo sapiens
gacaaacactgcca

SEQ ID NO: 5738513 - DNA, 16 bp, Homo sapiens
gacaaacagcccttcc

SEQ ID NO: 5738514 - DNA, 14 bp, Homo sapiens
gacaaacagctcag

SEQ ID NO: 5738515 - DNA, 18 bp, Homo sapiens
gacaaaccactgtacata

SEQ ID NO: 5738516 - DNA, 15 bp, Homo sapiens
gacaaaccagaagca

SEQ ID NO: 5738517 - DNA, 16 bp, Homo sapiens
gacaaaccagagcaga

SEQ ID NO: 5738518 - DNA, 22 bp, Homo sapiens
gacaaacctagcttttaaaaaa

SEQ ID NO: 5738519 - DNA, 18 bp, Homo sapiens
gacaaaccttatggaaaa

SEQ ID NO: 5738520 - DNA, 19 bp, Homo sapiens
gacaaactgcatatgtact

SEQ ID NO: 5738521 - DNA, 17 bp, Homo sapiens
gacaaactgccagtttt

SEQ ID NO: 5738522 - DNA, 20 bp, Homo sapiens
gacaaactgccagttttgtt

SEQ ID NO: 5738523 - DNA, 17 bp, Homo sapiens
gacaaactggagtctgg

SEQ ID NO: 5738524 - DNA, 19 bp, Homo sapiens
gacaaactgtaaaaaatgt

SEQ ID NO: 5738525 - DNA, 12 bp, Homo sapiens
gacaaagaaaat

SEQ ID NO: 5738526 - DNA, 18 bp, Homo sapiens
gacaaagaaaatgagaat

SEQ ID NO: 5738527 - DNA, 13 bp, Homo sapiens
gacaaagaacctt

SEQ ID NO: 5738528 - DNA, 14 bp, Homo sapiens
gacaaagacaaatt

SEQ ID NO: 5738529 - DNA, 21 bp, Homo sapiens
gacaaagacaaattctgtttc

SEQ ID NO: 5738530 - DNA, 16 bp, Homo sapiens
gacaaagcaggagtgg

SEQ ID NO: 5738531 - DNA, 18 bp, Homo sapiens
gacaaagcatcattgtaa

SEQ ID NO: 5738532 - DNA, 11 bp, Homo sapiens
gacaaagccat

SEQ ID NO: 5738533 - DNA, 19 bp, Homo sapiens
gacaaagccattcttttaa

SEQ ID NO: 5738534 - DNA, 14 bp, Homo sapiens
gacaaagccctgtc

SEQ ID NO: 5738535 - DNA, 16 bp, Homo sapiens
gacaaagccttaagca

SEQ ID NO: 5738536 - DNA, 22 bp, Homo sapiens
gacaaagccttaagcaaatttt

SEQ ID NO: 5738537 - DNA, 16 bp, Homo sapiens
gacaaagctgctaaat

SEQ ID NO: 5738538 - DNA, 16 bp, Homo sapiens
gacaaaggagcctgtg

SEQ ID NO: 5738539 - DNA, 16 bp, Homo sapiens
gacaaaggaggaattt

SEQ ID NO: 5738540 - DNA, 13 bp, Homo sapiens
gacaaaggcaagc

SEQ ID NO: 5738541 - DNA, 20 bp, Homo sapiens
gacaaaggccacaggcagtc

SEQ ID NO: 5738542 - DNA, 13 bp, Homo sapiens
gacaaaggcccag

SEQ ID NO: 5738543 - DNA, 19 bp, Homo sapiens
gacaaagggagggagcaag

SEQ ID NO: 5738544 - DNA, 18 bp, Homo sapiens
gacaaaggtggtaaattc

SEQ ID NO: 5738545 - DNA, 23 bp, Homo sapiens
gacaaaggtggtaaattcagaca

SEQ ID NO: 5738546 - DNA, 23 bp, Homo sapiens
gacaaagtcaataaaagagctgt

SEQ ID NO: 5738547 - DNA, 16 bp, Homo sapiens
gacaaagtcatcccct

SEQ ID NO: 5738548 - DNA, 16 bp, Homo sapiens
gacaaagtcccagaat

SEQ ID NO: 5738549 - DNA, 18 bp, Homo sapiens
gacaaagtctaaggaaga

SEQ ID NO: 5738550 - DNA, 19 bp, Homo sapiens
gacaaagtctccagcccac

SEQ ID NO: 5738551 - DNA, 12 bp, Homo sapiens
gacaaagtgcca

SEQ ID NO: 5738552 - DNA, 17 bp, Homo sapiens
gacaaagtgccaaagaa

SEQ ID NO: 5738553 - DNA, 19 bp, Homo sapiens
gacaaagtgccaaagaaag

SEQ ID NO: 5738554 - DNA, 22 bp, Homo sapiens
gacaaagtgggtactttctgaa

SEQ ID NO: 5738555 - DNA, 14 bp, Homo sapiens
gacaaagtgggtgt

SEQ ID NO: 5738556 - DNA, 12 bp, Homo sapiens
gacaaagtgttg

SEQ ID NO: 5738557 - DNA, 14 bp, Homo sapiens
gacaaataaaacat

SEQ ID NO: 5738558 - DNA, 13 bp, Homo sapiens
gacaaataaagca

SEQ ID NO: 5738559 - DNA, 12 bp, Homo sapiens
gacaaataagaa

SEQ ID NO: 5738560 - DNA, 17 bp, Homo sapiens
gacaaatacacatacat

SEQ ID NO: 5738561 - DNA, 18 bp, Homo sapiens
gacaaatacacatacata

SEQ ID NO: 5738562 - DNA, 22 bp, Homo sapiens
gacaaatacacatacatatata

SEQ ID NO: 5738563 - DNA, 23 bp, Homo sapiens
gacaaataggagtgagtgtatgt

SEQ ID NO: 5738564 - DNA, 21 bp, Homo sapiens
gacaaatagtaggcaagatgg

SEQ ID NO: 5738565 - DNA, 23 bp, Homo sapiens
gacaaatattgttaccatgaaga

SEQ ID NO: 5738566 - DNA, 18 bp, Homo sapiens
gacaaatcaacagaagca

SEQ ID NO: 5738567 - DNA, 19 bp, Homo sapiens
gacaaatcaacagaagcat

SEQ ID NO: 5738568 - DNA, 13 bp, Homo sapiens
gacaaatcaagtt

SEQ ID NO: 5738569 - DNA, 15 bp, Homo sapiens
gacaaatcaagtttc

SEQ ID NO: 5738570 - DNA, 18 bp, Homo sapiens
gacaaatcaagtttccaa

SEQ ID NO: 5738571 - DNA, 23 bp, Homo sapiens
gacaaatcaagtttccaagcaaa

SEQ ID NO: 5738572 - DNA, 18 bp, Homo sapiens
gacaaatcctttctgccc

SEQ ID NO: 5738573 - DNA, 21 bp, Homo sapiens
gacaaatctaaaatgcaaaga

SEQ ID NO: 5738574 - DNA, 15 bp, Homo sapiens
gacaaatctgtctgc

SEQ ID NO: 5738575 - DNA, 20 bp, Homo sapiens
gacaaatctgtgtatattat

SEQ ID NO: 5738576 - DNA, 17 bp, Homo sapiens
gacaaatctttaagaat

SEQ ID NO: 5738577 - DNA, 18 bp, Homo sapiens
gacaaatgaaataataaa

SEQ ID NO: 5738578 - DNA, 20 bp, Homo sapiens
gacaaatgacagattctgac

SEQ ID NO: 5738579 - DNA, 21 bp, Homo sapiens
gacaaatgctgcgcccttccc

SEQ ID NO: 5738580 - DNA, 14 bp, Homo sapiens
gacaaatgggactg

SEQ ID NO: 5738581 - DNA, 15 bp, Homo sapiens
gacaaatgggactga

SEQ ID NO: 5738582 - DNA, 16 bp, Homo sapiens
gacaaatgggactgat

SEQ ID NO: 5738583 - DNA, 21 bp, Homo sapiens
gacaaatgggactgatgtcat

SEQ ID NO: 5738584 - DNA, 23 bp, Homo sapiens
gacaaatgggactgatgtcatct

SEQ ID NO: 5738585 - DNA, 12 bp, Homo sapiens
gacaaatgtgta

SEQ ID NO: 5738586 - DNA, 16 bp, Homo sapiens
gacaaattagcatgca

SEQ ID NO: 5738587 - DNA, 19 bp, Homo sapiens
gacaaattagcatgcaagc

SEQ ID NO: 5738588 - DNA, 13 bp, Homo sapiens
gacaaattatatt

SEQ ID NO: 5738589 - DNA, 16 bp, Homo sapiens
gacaaattcattccct

SEQ ID NO: 5738590 - DNA, 17 bp, Homo sapiens
gacaaattcggatgtat

SEQ ID NO: 5738591 - DNA, 12 bp, Homo sapiens
gacaaattctgt

SEQ ID NO: 5738592 - DNA, 15 bp, Homo sapiens
gacaaattctgtttc

SEQ ID NO: 5738593 - DNA, 15 bp, Homo sapiens
gacaaattgcacaga

SEQ ID NO: 5738594 - DNA, 15 bp, Homo sapiens
gacaaattgtaacta

SEQ ID NO: 5738595 - DNA, 20 bp, Homo sapiens
gacaaatttaaaacaaacaa

SEQ ID NO: 5738596 - DNA, 23 bp, Homo sapiens
gacaaatttgcaaaactgtgctt

SEQ ID NO: 5738597 - DNA, 14 bp, Homo sapiens
gacaaattttaatt

SEQ ID NO: 5738598 - DNA, 14 bp, Homo sapiens
gacaacaaaagaaa

SEQ ID NO: 5738599 - DNA, 23 bp, Homo sapiens
gacaacaaaagggaaaaaagcaa

SEQ ID NO: 5738600 - DNA, 21 bp, Homo sapiens
gacaacaaattaggttttgta

SEQ ID NO: 5738601 - DNA, 22 bp, Homo sapiens
gacaacaaattttggttttcta

SEQ ID NO: 5738602 - DNA, 20 bp, Homo sapiens
gacaacacacacacacacaa

SEQ ID NO: 5738603 - DNA, 15 bp, Homo sapiens
gacaacaccttcctc

SEQ ID NO: 5738604 - DNA, 20 bp, Homo sapiens
gacaacaccttcctcctgca

SEQ ID NO: 5738605 - DNA, 23 bp, Homo sapiens
gacaacactcattgacctgaggc

SEQ ID NO: 5738606 - DNA, 23 bp, Homo sapiens
gacaacagaaaaacaatcttatt

SEQ ID NO: 5738607 - DNA, 23 bp, Homo sapiens
gacaacagagatgccatgatatc

SEQ ID NO: 5738608 - DNA, 23 bp, Homo sapiens
gacaacagctctcgttctccttc

SEQ ID NO: 5738609 - DNA, 23 bp, Homo sapiens
gacaacaggttttcaccatagcc

SEQ ID NO: 5738610 - DNA, 12 bp, Homo sapiens
gacaacagttct

SEQ ID NO: 5738611 - DNA, 23 bp, Homo sapiens
gacaacatcgcaatagtttttta

SEQ ID NO: 5738612 - DNA, 19 bp, Homo sapiens
gacaacatgaaacctattg

SEQ ID NO: 5738613 - DNA, 13 bp, Homo sapiens
gacaacatggctt

SEQ ID NO: 5738614 - DNA, 20 bp, Homo sapiens
gacaacatgtttaataaata

SEQ ID NO: 5738615 - DNA, 23 bp, Homo sapiens
gacaacattatgatctaataaac

SEQ ID NO: 5738616 - DNA, 22 bp, Homo sapiens
gacaacatttctatagccaaaa

SEQ ID NO: 5738617 - DNA, 16 bp, Homo sapiens
gacaacattttattac

SEQ ID NO: 5738618 - DNA, 16 bp, Homo sapiens
gacaaccaaaacatat

SEQ ID NO: 5738619 - DNA, 17 bp, Homo sapiens
gacaaccaccgctcccc

SEQ ID NO: 5738620 - DNA, 18 bp, Homo sapiens
gacaaccaccgctcccca

SEQ ID NO: 5738621 - DNA, 19 bp, Homo sapiens
gacaaccattaaagtcaga

SEQ ID NO: 5738622 - DNA, 12 bp, Homo sapiens
gacaacccagaa

SEQ ID NO: 5738623 - DNA, 23 bp, Homo sapiens
gacaaccccccaagaccatccct

SEQ ID NO: 5738624 - DNA, 20 bp, Homo sapiens
gacaaccctgcaaaggactg

SEQ ID NO: 5738625 - DNA, 19 bp, Homo sapiens
gacaaccctggcctcactt

SEQ ID NO: 5738626 - DNA, 16 bp, Homo sapiens
gacaacctagaatgtc

SEQ ID NO: 5738627 - DNA, 14 bp, Homo sapiens
gacaacctttgtgt

SEQ ID NO: 5738628 - DNA, 16 bp, Homo sapiens
gacaacctttgtgtaa

SEQ ID NO: 5738629 - DNA, 20 bp, Homo sapiens
gacaacctttgtgtaataaa

SEQ ID NO: 5738630 - DNA, 15 bp, Homo sapiens
gacaacgaaagtaaa

SEQ ID NO: 5738631 - DNA, 15 bp, Homo sapiens
gacaacgaggaagcc

SEQ ID NO: 5738632 - DNA, 15 bp, Homo sapiens
gacaacgtctcttca

SEQ ID NO: 5738633 - DNA, 22 bp, Homo sapiens
gacaactaaaattaggactgta

SEQ ID NO: 5738634 - DNA, 23 bp, Homo sapiens
gacaactcattttcatattgtaa

SEQ ID NO: 5738635 - DNA, 17 bp, Homo sapiens
gacaactgctcccacct

SEQ ID NO: 5738636 - DNA, 21 bp, Homo sapiens
gacaactgctcccacctcctg

SEQ ID NO: 5738637 - DNA, 17 bp, Homo sapiens
gacaactgtgaagccac

SEQ ID NO: 5738638 - DNA, 20 bp, Homo sapiens
gacaactgtgaagccaccct

SEQ ID NO: 5738639 - DNA, 13 bp, Homo sapiens
gacaactgtgact

SEQ ID NO: 5738640 - DNA, 20 bp, Homo sapiens
gacaactgttttaataaaag

SEQ ID NO: 5738641 - DNA, 16 bp, Homo sapiens
gacaacttatttaaaa

SEQ ID NO: 5738642 - DNA, 17 bp, Homo sapiens
gacaacttatttaaaaa

SEQ ID NO: 5738643 - DNA, 21 bp, Homo sapiens
gacaacttatttaaaaatatt

SEQ ID NO: 5738644 - DNA, 21 bp, Homo sapiens
gacaactttatgtagagaaaa

SEQ ID NO: 5738645 - DNA, 22 bp, Homo sapiens
gacaactttatgtagagaaaag

SEQ ID NO: 5738646 - DNA, 20 bp, Homo sapiens
gacaacttttaaagaaaaat

SEQ ID NO: 5738647 - DNA, 15 bp, Homo sapiens
gacaagaaaggcaga

SEQ ID NO: 5738648 - DNA, 15 bp, Homo sapiens
gacaagaaatccctg

SEQ ID NO: 5738649 - DNA, 16 bp, Homo sapiens
gacaagaacagccgcc

SEQ ID NO: 5738650 - DNA, 15 bp, Homo sapiens
gacaagaacattctc

SEQ ID NO: 5738651 - DNA, 15 bp, Homo sapiens
gacaagaagagtcct

SEQ ID NO: 5738652 - DNA, 17 bp, Homo sapiens
gacaagaagctcccaga

SEQ ID NO: 5738653 - DNA, 18 bp, Homo sapiens
gacaagaagctcccagat

SEQ ID NO: 5738654 - DNA, 17 bp, Homo sapiens
gacaagaaggccactgg

SEQ ID NO: 5738655 - DNA, 12 bp, Homo sapiens
gacaagacagag

SEQ ID NO: 5738656 - DNA, 15 bp, Homo sapiens
gacaagacccccagc

SEQ ID NO: 5738657 - DNA, 20 bp, Homo sapiens
gacaagacttcagtatgttg

SEQ ID NO: 5738658 - DNA, 24 bp, Homo sapiens
gacaagacttcgggaaggtgtctg

SEQ ID NO: 5738659 - DNA, 16 bp, Homo sapiens
gacaagagatctacac

SEQ ID NO: 5738660 - DNA, 13 bp, Homo sapiens
gacaagagctgct

SEQ ID NO: 5738661 - DNA, 14 bp, Homo sapiens
gacaagagctgctg

SEQ ID NO: 5738662 - DNA, 19 bp, Homo sapiens
gacaagaggtacagggttt

SEQ ID NO: 5738663 - DNA, 15 bp, Homo sapiens
gacaagatgggacag

SEQ ID NO: 5738664 - DNA, 17 bp, Homo sapiens
gacaagatgggacagca

SEQ ID NO: 5738665 - DNA, 20 bp, Homo sapiens
gacaagatttcctactttct

SEQ ID NO: 5738666 - DNA, 16 bp, Homo sapiens
gacaagcaacccaaac

SEQ ID NO: 5738667 - DNA, 13 bp, Homo sapiens
gacaagcaattag

SEQ ID NO: 5738668 - DNA, 17 bp, Homo sapiens
gacaagcaattagaagc

SEQ ID NO: 5738669 - DNA, 16 bp, Homo sapiens
gacaagcactgctagg

SEQ ID NO: 5738670 - DNA, 22 bp, Homo sapiens
gacaagcagagtaacaggatca

SEQ ID NO: 5738671 - DNA, 11 bp, Homo sapiens
gacaagcaggc

SEQ ID NO: 5738672 - DNA, 21 bp, Homo sapiens
gacaagcatggtcccacatcc

SEQ ID NO: 5738673 - DNA, 18 bp, Homo sapiens
gacaagcattgggtcaga

SEQ ID NO: 5738674 - DNA, 13 bp, Homo sapiens
gacaagcccagga

SEQ ID NO: 5738675 - DNA, 12 bp, Homo sapiens
gacaagccccag

SEQ ID NO: 5738676 - DNA, 17 bp, Homo sapiens
gacaagccccaggcagg

SEQ ID NO: 5738677 - DNA, 14 bp, Homo sapiens
gacaagccctggca

SEQ ID NO: 5738678 - DNA, 17 bp, Homo sapiens
gacaagccctggcaaca

SEQ ID NO: 5738679 - DNA, 13 bp, Homo sapiens
gacaagcctggag

SEQ ID NO: 5738680 - DNA, 14 bp, Homo sapiens
gacaagcctggagg

SEQ ID NO: 5738681 - DNA, 16 bp, Homo sapiens
gacaagcgtcacttct

SEQ ID NO: 5738682 - DNA, 13 bp, Homo sapiens
gacaagctcctcc

SEQ ID NO: 5738683 - DNA, 15 bp, Homo sapiens
gacaagctcctccct

SEQ ID NO: 5738684 - DNA, 19 bp, Homo sapiens
gacaagctgacttggcact

SEQ ID NO: 5738685 - DNA, 20 bp, Homo sapiens
gacaagctgttgaccaggca

SEQ ID NO: 5738686 - DNA, 21 bp, Homo sapiens
gacaagctgttgaccaggcac

SEQ ID NO: 5738687 - DNA, 12 bp, Homo sapiens
gacaagcttctg

SEQ ID NO: 5738688 - DNA, 13 bp, Homo sapiens
gacaagcttctga

SEQ ID NO: 5738689 - DNA, 16 bp, Homo sapiens
gacaaggaaaaaataa

SEQ ID NO: 5738690 - DNA, 17 bp, Homo sapiens
gacaaggaagtgggggc

SEQ ID NO: 5738691 - DNA, 22 bp, Homo sapiens
gacaaggaagtgggggccgctg

SEQ ID NO: 5738692 - DNA, 21 bp, Homo sapiens
gacaaggagagcggaggagga

SEQ ID NO: 5738693 - DNA, 21 bp, Homo sapiens
gacaaggatgatctaggaaga

SEQ ID NO: 5738694 - DNA, 14 bp, Homo sapiens
gacaaggccccaga

SEQ ID NO: 5738695 - DNA, 16 bp, Homo sapiens
gacaaggccccagaga

SEQ ID NO: 5738696 - DNA, 23 bp, Homo sapiens
gacaaggccccagagactcagag

SEQ ID NO: 5738697 - DNA, 15 bp, Homo sapiens
gacaaggctgtgcca

SEQ ID NO: 5738698 - DNA, 19 bp, Homo sapiens
gacaagggaggcagtggct

SEQ ID NO: 5738699 - DNA, 15 bp, Homo sapiens
gacaagggattctgg

SEQ ID NO: 5738700 - DNA, 20 bp, Homo sapiens
gacaagggattctgggaagc

SEQ ID NO: 5738701 - DNA, 12 bp, Homo sapiens
gacaagggctga

SEQ ID NO: 5738702 - DNA, 22 bp, Homo sapiens
gacaagggctgacctgcctctc

SEQ ID NO: 5738703 - DNA, 22 bp, Homo sapiens
gacaaggggcgtgcctggcgcc

SEQ ID NO: 5738704 - DNA, 18 bp, Homo sapiens
gacaagggggatgttgtg

SEQ ID NO: 5738705 - DNA, 21 bp, Homo sapiens
gacaaggggtggaagggcagg

SEQ ID NO: 5738706 - DNA, 24 bp, Homo sapiens
gacaaggggtggaagggcaggagc

SEQ ID NO: 5738707 - DNA, 16 bp, Homo sapiens
gacaaggtcacctggg

SEQ ID NO: 5738708 - DNA, 14 bp, Homo sapiens
gacaaggtgctaac

SEQ ID NO: 5738709 - DNA, 19 bp, Homo sapiens
gacaaggtgtttctctgta

SEQ ID NO: 5738710 - DNA, 22 bp, Homo sapiens
gacaaggttcttcccttttaca

SEQ ID NO: 5738711 - DNA, 18 bp, Homo sapiens
gacaagtagttcatgagt

SEQ ID NO: 5738712 - DNA, 18 bp, Homo sapiens
gacaagtcttgctgtgct

SEQ ID NO: 5738713 - DNA, 19 bp, Homo sapiens
gacaagtcttgctgtgctt

SEQ ID NO: 5738714 - DNA, 16 bp, Homo sapiens
gacaagtctttctcct

SEQ ID NO: 5738715 - DNA, 22 bp, Homo sapiens
gacaagtgatgctaaaacctga

SEQ ID NO: 5738716 - DNA, 16 bp, Homo sapiens
gacaagtgattttcat

SEQ ID NO: 5738717 - DNA, 15 bp, Homo sapiens
gacaagtggactcag

SEQ ID NO: 5738718 - DNA, 14 bp, Homo sapiens
gacaataaacagct

SEQ ID NO: 5738719 - DNA, 14 bp, Homo sapiens
gacaataaagcttg

SEQ ID NO: 5738720 - DNA, 19 bp, Homo sapiens
gacaataaagcttgttgac

SEQ ID NO: 5738721 - DNA, 16 bp, Homo sapiens
gacaataactttgaac

SEQ ID NO: 5738722 - DNA, 17 bp, Homo sapiens
gacaataagaaacagtt

SEQ ID NO: 5738723 - DNA, 18 bp, Homo sapiens
gacaataagaaacagttt

SEQ ID NO: 5738724 - DNA, 17 bp, Homo sapiens
gacaataattacattgg

SEQ ID NO: 5738725 - DNA, 21 bp, Homo sapiens
gacaataattacattggcaca

SEQ ID NO: 5738726 - DNA, 16 bp, Homo sapiens
gacaataattctacat

SEQ ID NO: 5738727 - DNA, 23 bp, Homo sapiens
gacaataattctacatgttgtct

SEQ ID NO: 5738728 - DNA, 19 bp, Homo sapiens
gacaataattctggagata

SEQ ID NO: 5738729 - DNA, 13 bp, Homo sapiens
gacaatacagtaa

SEQ ID NO: 5738730 - DNA, 21 bp, Homo sapiens
gacaatactccctttaaagag

SEQ ID NO: 5738731 - DNA, 15 bp, Homo sapiens
gacaatactgctgcc

SEQ ID NO: 5738732 - DNA, 15 bp, Homo sapiens
gacaatactggggtt

SEQ ID NO: 5738733 - DNA, 22 bp, Homo sapiens
gacaatactgtatcagatgtga

SEQ ID NO: 5738734 - DNA, 12 bp, Homo sapiens
gacaatagtatt

SEQ ID NO: 5738735 - DNA, 17 bp, Homo sapiens
gacaatagtatttctcc

SEQ ID NO: 5738736 - DNA, 14 bp, Homo sapiens
gacaatataaactg

SEQ ID NO: 5738737 - DNA, 14 bp, Homo sapiens
gacaatatacttca

SEQ ID NO: 5738738 - DNA, 20 bp, Homo sapiens
gacaatcacgggcggtcctg

SEQ ID NO: 5738739 - DNA, 17 bp, Homo sapiens
gacaatcactgaaacaa

SEQ ID NO: 5738740 - DNA, 14 bp, Homo sapiens
gacaatcagtcccc

SEQ ID NO: 5738741 - DNA, 17 bp, Homo sapiens
gacaatcagtcccctcc

SEQ ID NO: 5738742 - DNA, 20 bp, Homo sapiens
gacaatcagtcccctcccat

SEQ ID NO: 5738743 - DNA, 14 bp, Homo sapiens
gacaatcatctcca

SEQ ID NO: 5738744 - DNA, 18 bp, Homo sapiens
gacaatcatctccaatgg

SEQ ID NO: 5738745 - DNA, 20 bp, Homo sapiens
gacaatcatgaaatatgcat

SEQ ID NO: 5738746 - DNA, 20 bp, Homo sapiens
gacaatcattgttttgaata

SEQ ID NO: 5738747 - DNA, 21 bp, Homo sapiens
gacaatccactctcaggaggc

SEQ ID NO: 5738748 - DNA, 21 bp, Homo sapiens
gacaatccccacataccatct

SEQ ID NO: 5738749 - DNA, 19 bp, Homo sapiens
gacaatcctgaagaaacca

SEQ ID NO: 5738750 - DNA, 21 bp, Homo sapiens
gacaatcctgaagaaaccaca

SEQ ID NO: 5738751 - DNA, 13 bp, Homo sapiens
gacaatcttctgt

SEQ ID NO: 5738752 - DNA, 23 bp, Homo sapiens
gacaatgactaagccaagctgtg

SEQ ID NO: 5738753 - DNA, 20 bp, Homo sapiens
gacaatgacttactgtacat

SEQ ID NO: 5738754 - DNA, 20 bp, Homo sapiens
gacaatgatattgacactgt

SEQ ID NO: 5738755 - DNA, 18 bp, Homo sapiens
gacaatgcaaaccatcat

SEQ ID NO: 5738756 - DNA, 22 bp, Homo sapiens
gacaatgcacctagctgtgcaa

SEQ ID NO: 5738757 - DNA, 13 bp, Homo sapiens
gacaatgctgcca

SEQ ID NO: 5738758 - DNA, 19 bp, Homo sapiens
gacaatggaaactgtacca

SEQ ID NO: 5738759 - DNA, 14 bp, Homo sapiens
gacaatggaccgga

SEQ ID NO: 5738760 - DNA, 16 bp, Homo sapiens
gacaatggaccggaga

SEQ ID NO: 5738761 - DNA, 16 bp, Homo sapiens
gacaatggacctctca

SEQ ID NO: 5738762 - DNA, 20 bp, Homo sapiens
gacaatggacctctcagcag

SEQ ID NO: 5738763 - DNA, 16 bp, Homo sapiens
gacaatggcaatagga

SEQ ID NO: 5738764 - DNA, 15 bp, Homo sapiens
gacaatggcagctag

SEQ ID NO: 5738765 - DNA, 21 bp, Homo sapiens
gacaatggcagctagactgga

SEQ ID NO: 5738766 - DNA, 17 bp, Homo sapiens
gacaatgtctgcagccc

SEQ ID NO: 5738767 - DNA, 18 bp, Homo sapiens
gacaatgtggaattacat

SEQ ID NO: 5738768 - DNA, 14 bp, Homo sapiens
gacaatgttgagaa

SEQ ID NO: 5738769 - DNA, 17 bp, Homo sapiens
gacaatgttgtagtgtc

SEQ ID NO: 5738770 - DNA, 17 bp, Homo sapiens
gacaatgttttcttcaa

SEQ ID NO: 5738771 - DNA, 18 bp, Homo sapiens
gacaatgttttcttcaac

SEQ ID NO: 5738772 - DNA, 23 bp, Homo sapiens
gacaattaatgattaaagactgt

SEQ ID NO: 5738773 - DNA, 22 bp, Homo sapiens
gacaattagataaatgtccatt

SEQ ID NO: 5738774 - DNA, 14 bp, Homo sapiens
gacaattatgaaaa

SEQ ID NO: 5738775 - DNA, 12 bp, Homo sapiens
gacaattcactt

SEQ ID NO: 5738776 - DNA, 21 bp, Homo sapiens
gacaattcctagataaaaaga

SEQ ID NO: 5738777 - DNA, 16 bp, Homo sapiens
gacaattctaatggta

SEQ ID NO: 5738778 - DNA, 19 bp, Homo sapiens
gacaattctaatggtaact

SEQ ID NO: 5738779 - DNA, 16 bp, Homo sapiens
gacaattctgcatgta

SEQ ID NO: 5738780 - DNA, 17 bp, Homo sapiens
gacaatttcaaaatgca

SEQ ID NO: 5738781 - DNA, 18 bp, Homo sapiens
gacaatttccaagaatga

SEQ ID NO: 5738782 - DNA, 20 bp, Homo sapiens
gacaatttctggcagatgta

SEQ ID NO: 5738783 - DNA, 12 bp, Homo sapiens
gacaatttgcca

SEQ ID NO: 5738784 - DNA, 15 bp, Homo sapiens
gacaatttgtgatat

SEQ ID NO: 5738785 - DNA, 23 bp, Homo sapiens
gacaattttacctattctgaaaa

SEQ ID NO: 5738786 - DNA, 18 bp, Homo sapiens
gacaattttgtcttaagt

SEQ ID NO: 5738787 - DNA, 24 bp, Homo sapiens
gacaattttgtcttaagtgtttct

SEQ ID NO: 5738788 - DNA, 22 bp, Homo sapiens
gacaattttttttcaaatgtgc

SEQ ID NO: 5738789 - DNA, 14 bp, Homo sapiens
gacacaaaaaaatg

SEQ ID NO: 5738790 - DNA, 16 bp, Homo sapiens
gacacaaaaagtagat

SEQ ID NO: 5738791 - DNA, 18 bp, Homo sapiens
gacacaaaactccgcccc

SEQ ID NO: 5738792 - DNA, 22 bp, Homo sapiens
gacacaaaactccgcccccagc

SEQ ID NO: 5738793 - DNA, 23 bp, Homo sapiens
gacacaaaactccgcccccagcc

SEQ ID NO: 5738794 - DNA, 19 bp, Homo sapiens
gacacaaacacacacaaaa

SEQ ID NO: 5738795 - DNA, 20 bp, Homo sapiens
gacacaaacctgcctgggtt

SEQ ID NO: 5738796 - DNA, 21 bp, Homo sapiens
gacacaaaggacaaaaatata

SEQ ID NO: 5738797 - DNA, 13 bp, Homo sapiens
gacacaaatgcat

SEQ ID NO: 5738798 - DNA, 22 bp, Homo sapiens
gacacaaattacaacagtaaat

SEQ ID NO: 5738799 - DNA, 17 bp, Homo sapiens
gacacaacccaatagga

SEQ ID NO: 5738800 - DNA, 13 bp, Homo sapiens
gacacaactattt

SEQ ID NO: 5738801 - DNA, 16 bp, Homo sapiens
gacacaagccttcggc

SEQ ID NO: 5738802 - DNA, 15 bp, Homo sapiens
gacacaagcggccct

SEQ ID NO: 5738803 - DNA, 18 bp, Homo sapiens
gacacaagcggccctgac

SEQ ID NO: 5738804 - DNA, 16 bp, Homo sapiens
gacacaaggcacggcc

SEQ ID NO: 5738805 - DNA, 17 bp, Homo sapiens
gacacaagggtgcaagc

SEQ ID NO: 5738806 - DNA, 20 bp, Homo sapiens
gacacaagggtgcaagcccc

SEQ ID NO: 5738807 - DNA, 22 bp, Homo sapiens
gacacaataggtctttctctca

SEQ ID NO: 5738808 - DNA, 21 bp, Homo sapiens
gacacaatatgtatgcttttt

SEQ ID NO: 5738809 - DNA, 20 bp, Homo sapiens
gacacaatctcagctcactg

SEQ ID NO: 5738810 - DNA, 20 bp, Homo sapiens
gacacaatgacacatttgtt

SEQ ID NO: 5738811 - DNA, 19 bp, Homo sapiens
gacacaatggtagctctga

SEQ ID NO: 5738812 - DNA, 19 bp, Homo sapiens
gacacaattacgcaggtat

SEQ ID NO: 5738813 - DNA, 15 bp, Homo sapiens
gacacaattagagaa

SEQ ID NO: 5738814 - DNA, 19 bp, Homo sapiens
gacacaatttcatttccag

SEQ ID NO: 5738815 - DNA, 23 bp, Homo sapiens
gacacacaaaatgtcacaatcct

SEQ ID NO: 5738816 - DNA, 13 bp, Homo sapiens
gacacacaaagca

SEQ ID NO: 5738817 - DNA, 21 bp, Homo sapiens
gacacacaattcattggctcc

SEQ ID NO: 5738818 - DNA, 23 bp, Homo sapiens
gacacacacacacacacaaatgc

SEQ ID NO: 5738819 - DNA, 12 bp, Homo sapiens
gacacacacacg

SEQ ID NO: 5738820 - DNA, 20 bp, Homo sapiens
gacacacacacgcacgcaca

SEQ ID NO: 5738821 - DNA, 21 bp, Homo sapiens
gacacacacacgcacgcacac

SEQ ID NO: 5738822 - DNA, 20 bp, Homo sapiens
gacacacactggctcctgga

SEQ ID NO: 5738823 - DNA, 17 bp, Homo sapiens
gacacacagaaatgtgt

SEQ ID NO: 5738824 - DNA, 13 bp, Homo sapiens
gacacacagcact

SEQ ID NO: 5738825 - DNA, 14 bp, Homo sapiens
gacacacagcactc

SEQ ID NO: 5738826 - DNA, 15 bp, Homo sapiens
gacacacagcactct

SEQ ID NO: 5738827 - DNA, 11 bp, Homo sapiens
gacacacagcc

SEQ ID NO: 5738828 - DNA, 14 bp, Homo sapiens
gacacacagcctag

SEQ ID NO: 5738829 - DNA, 13 bp, Homo sapiens
gacacacagctct

SEQ ID NO: 5738830 - DNA, 9 bp, Homo sapiens
gacacacat

SEQ ID NO: 5738831 - DNA, 14 bp, Homo sapiens
gacacacatacata

SEQ ID NO: 5738832 - DNA, 12 bp, Homo sapiens
gacacacatgaa

SEQ ID NO: 5738833 - DNA, 18 bp, Homo sapiens
gacacacattctgccttg

SEQ ID NO: 5738834 - DNA, 10 bp, Homo sapiens
gacacaccca

SEQ ID NO: 5738835 - DNA, 22 bp, Homo sapiens
gacacaccccaacatgcctgca

SEQ ID NO: 5738836 - DNA, 21 bp, Homo sapiens
gacacaccccacaccccagcc

SEQ ID NO: 5738837 - DNA, 22 bp, Homo sapiens
gacacaccccacaccccagccc

SEQ ID NO: 5738838 - DNA, 22 bp, Homo sapiens
gacacaccccccagtcgagccc

SEQ ID NO: 5738839 - DNA, 13 bp, Homo sapiens
gacacacctctgc

SEQ ID NO: 5738840 - DNA, 22 bp, Homo sapiens
gacacacgtatttatatttgga

SEQ ID NO: 5738841 - DNA, 19 bp, Homo sapiens
gacacactaaactctgggg

SEQ ID NO: 5738842 - DNA, 20 bp, Homo sapiens
gacacactaaactctggggc

SEQ ID NO: 5738843 - DNA, 20 bp, Homo sapiens
gacacactacaccacacaca

SEQ ID NO: 5738844 - DNA, 22 bp, Homo sapiens
gacacactcaccatttaatcat

SEQ ID NO: 5738845 - DNA, 13 bp, Homo sapiens
gacacactgaaga

SEQ ID NO: 5738846 - DNA, 14 bp, Homo sapiens
gacacactgaagaa

SEQ ID NO: 5738847 - DNA, 23 bp, Homo sapiens
gacacactgcggtgtctgcagct

SEQ ID NO: 5738848 - DNA, 11 bp, Homo sapiens
gacacagaaaa

SEQ ID NO: 5738849 - DNA, 21 bp, Homo sapiens
gacacagaaaatgttgagaat

SEQ ID NO: 5738850 - DNA, 14 bp, Homo sapiens
gacacagaagcccc

SEQ ID NO: 5738851 - DNA, 22 bp, Homo sapiens
gacacagacattttgtgtgaga

SEQ ID NO: 5738852 - DNA, 16 bp, Homo sapiens
gacacagacccaggac

SEQ ID NO: 5738853 - DNA, 18 bp, Homo sapiens
gacacagacccaggaccc

SEQ ID NO: 5738854 - DNA, 12 bp, Homo sapiens
gacacagactca

SEQ ID NO: 5738855 - DNA, 18 bp, Homo sapiens
gacacagactggcaataa

SEQ ID NO: 5738856 - DNA, 14 bp, Homo sapiens
gacacagagatgga

SEQ ID NO: 5738857 - DNA, 17 bp, Homo sapiens
gacacagaggctggcac

SEQ ID NO: 5738858 - DNA, 21 bp, Homo sapiens
gacacagagtggagccctcag

SEQ ID NO: 5738859 - DNA, 22 bp, Homo sapiens
gacacagagtggagccctcagt

SEQ ID NO: 5738860 - DNA, 18 bp, Homo sapiens
gacacagatacatgggga

SEQ ID NO: 5738861 - DNA, 18 bp, Homo sapiens
gacacagatggcacctgt

SEQ ID NO: 5738862 - DNA, 22 bp, Homo sapiens
gacacagatggcacctgtggcc

SEQ ID NO: 5738863 - DNA, 21 bp, Homo sapiens
gacacagattatgttcctgct

SEQ ID NO: 5738864 - DNA, 23 bp, Homo sapiens
gacacagattatgttcctgctgt

SEQ ID NO: 5738865 - DNA, 16 bp, Homo sapiens
gacacagatttttaca

SEQ ID NO: 5738866 - DNA, 13 bp, Homo sapiens
gacacagcacaag

SEQ ID NO: 5738867 - DNA, 18 bp, Homo sapiens
gacacagcagcttcacca

SEQ ID NO: 5738868 - DNA, 16 bp, Homo sapiens
gacacagcatcagctc

SEQ ID NO: 5738869 - DNA, 18 bp, Homo sapiens
gacacagcatcagctcaa

SEQ ID NO: 5738870 - DNA, 21 bp, Homo sapiens
gacacagcgtccctagcagtg

SEQ ID NO: 5738871 - DNA, 11 bp, Homo sapiens
gacacagctct

SEQ ID NO: 5738872 - DNA, 13 bp, Homo sapiens
gacacagctcttc

SEQ ID NO: 5738873 - DNA, 14 bp, Homo sapiens
gacacagctcttca

SEQ ID NO: 5738874 - DNA, 15 bp, Homo sapiens
gacacagctcttcat

SEQ ID NO: 5738875 - DNA, 20 bp, Homo sapiens
gacacagctcttctccaggc

SEQ ID NO: 5738876 - DNA, 21 bp, Homo sapiens
gacacagctcttctccaggct

SEQ ID NO: 5738877 - DNA, 22 bp, Homo sapiens
gacacagctttatcaccagaga

SEQ ID NO: 5738878 - DNA, 16 bp, Homo sapiens
gacacaggaaaaataa

SEQ ID NO: 5738879 - DNA, 19 bp, Homo sapiens
gacacaggaaaaataaacg

SEQ ID NO: 5738880 - DNA, 12 bp, Homo sapiens
gacacaggaaga

SEQ ID NO: 5738881 - DNA, 20 bp, Homo sapiens
gacacaggagaccacccccg

SEQ ID NO: 5738882 - DNA, 21 bp, Homo sapiens
gacacaggatagataactctt

SEQ ID NO: 5738883 - DNA, 19 bp, Homo sapiens
gacacaggatcctggcctg

SEQ ID NO: 5738884 - DNA, 20 bp, Homo sapiens
gacacaggatgaaggcaatg

SEQ ID NO: 5738885 - DNA, 18 bp, Homo sapiens
gacacaggccagccccat

SEQ ID NO: 5738886 - DNA, 20 bp, Homo sapiens
gacacaggccagccttggca

SEQ ID NO: 5738887 - DNA, 17 bp, Homo sapiens
gacacaggcccggctcc

SEQ ID NO: 5738888 - DNA, 19 bp, Homo sapiens
gacacaggcccggctccag

SEQ ID NO: 5738889 - DNA, 21 bp, Homo sapiens
gacacaggcccggctccaggc

SEQ ID NO: 5738890 - DNA, 17 bp, Homo sapiens
gacacaggccctccctg

SEQ ID NO: 5738891 - DNA, 23 bp, Homo sapiens
gacacaggccgtgggacccaggc

SEQ ID NO: 5738892 - DNA, 14 bp, Homo sapiens
gacacaggcctgtg

SEQ ID NO: 5738893 - DNA, 13 bp, Homo sapiens
gacacaggctcag

SEQ ID NO: 5738894 - DNA, 15 bp, Homo sapiens
gacacaggctcagca

SEQ ID NO: 5738895 - DNA, 16 bp, Homo sapiens
gacacaggctcagcat

SEQ ID NO: 5738896 - DNA, 12 bp, Homo sapiens
gacacaggctgc

SEQ ID NO: 5738897 - DNA, 22 bp, Homo sapiens
gacacaggggacacccagaaac

SEQ ID NO: 5738898 - DNA, 21 bp, Homo sapiens
gacacaggggacactgaacct

SEQ ID NO: 5738899 - DNA, 13 bp, Homo sapiens
gacacaggtcagg

SEQ ID NO: 5738900 - DNA, 15 bp, Homo sapiens
gacacaggtcagggc

SEQ ID NO: 5738901 - DNA, 16 bp, Homo sapiens
gacacaggtcagggct

SEQ ID NO: 5738902 - DNA, 17 bp, Homo sapiens
gacacaggtcagggctc

SEQ ID NO: 5738903 - DNA, 18 bp, Homo sapiens
gacacaggtcagggctca

SEQ ID NO: 5738904 - DNA, 22 bp, Homo sapiens
gacacaggtcagggctcagagt

SEQ ID NO: 5738905 - DNA, 17 bp, Homo sapiens
gacacaggtctttccta

SEQ ID NO: 5738906 - DNA, 22 bp, Homo sapiens
gacacaggtgcctcacgcctgt

SEQ ID NO: 5738907 - DNA, 16 bp, Homo sapiens
gacacagtattgactt

SEQ ID NO: 5738908 - DNA, 17 bp, Homo sapiens
gacacagtcagcatgct

SEQ ID NO: 5738909 - DNA, 13 bp, Homo sapiens
gacacagtcaggg

SEQ ID NO: 5738910 - DNA, 19 bp, Homo sapiens
gacacagtcagggcggggc

SEQ ID NO: 5738911 - DNA, 22 bp, Homo sapiens
gacacagtcagggcggggctgg

SEQ ID NO: 5738912 - DNA, 22 bp, Homo sapiens
gacacagtgatgaatgtactat

SEQ ID NO: 5738913 - DNA, 22 bp, Homo sapiens
gacacatatgcaccttgtgtct

SEQ ID NO: 5738914 - DNA, 14 bp, Homo sapiens
gacacatcaaatgc

SEQ ID NO: 5738915 - DNA, 16 bp, Homo sapiens
gacacatcaaatgccc

SEQ ID NO: 5738916 - DNA, 18 bp, Homo sapiens
gacacatcaagcttttct

SEQ ID NO: 5738917 - DNA, 21 bp, Homo sapiens
gacacatcagcatgttttctg

SEQ ID NO: 5738918 - DNA, 23 bp, Homo sapiens
gacacatcagcatgttttctgct

SEQ ID NO: 5738919 - DNA, 13 bp, Homo sapiens
gacacatcccggc

SEQ ID NO: 5738920 - DNA, 16 bp, Homo sapiens
gacacatcccggcctc

SEQ ID NO: 5738921 - DNA, 13 bp, Homo sapiens
gacacatcgtttt

SEQ ID NO: 5738922 - DNA, 17 bp, Homo sapiens
gacacatcgttttgggg

SEQ ID NO: 5738923 - DNA, 20 bp, Homo sapiens
gacacatgaaggtaaataaa

SEQ ID NO: 5738924 - DNA, 17 bp, Homo sapiens
gacacatgctatgttct

SEQ ID NO: 5738925 - DNA, 19 bp, Homo sapiens
gacacatgctatgttctgt

SEQ ID NO: 5738926 - DNA, 23 bp, Homo sapiens
gacacatgctgaggttttgaata

SEQ ID NO: 5738927 - DNA, 21 bp, Homo sapiens
gacacatggctatcctagaga

SEQ ID NO: 5738928 - DNA, 16 bp, Homo sapiens
gacacatgggtgctat

SEQ ID NO: 5738929 - DNA, 16 bp, Homo sapiens
gacacatgtggagaag

SEQ ID NO: 5738930 - DNA, 12 bp, Homo sapiens
gacacattcaca

SEQ ID NO: 5738931 - DNA, 20 bp, Homo sapiens
gacacattggaatgccttgg

SEQ ID NO: 5738932 - DNA, 14 bp, Homo sapiens
gacacatttaagga

SEQ ID NO: 5738933 - DNA, 19 bp, Homo sapiens
gacacatttaatgaacaca

SEQ ID NO: 5738934 - DNA, 16 bp, Homo sapiens
gacacatttaccaaat

SEQ ID NO: 5738935 - DNA, 14 bp, Homo sapiens
gacacatttggacc

SEQ ID NO: 5738936 - DNA, 23 bp, Homo sapiens
gacacattttttaggaaatgttt

SEQ ID NO: 5738937 - DNA, 18 bp, Homo sapiens
gacaccaaactgccaaaa

SEQ ID NO: 5738938 - DNA, 15 bp, Homo sapiens
gacaccaaagttcta

SEQ ID NO: 5738939 - DNA, 15 bp, Homo sapiens
gacaccaaccagaca

SEQ ID NO: 5738940 - DNA, 23 bp, Homo sapiens
gacaccaaccgacaggccctggc

SEQ ID NO: 5738941 - DNA, 22 bp, Homo sapiens
gacaccaagctcacccttcgtc

SEQ ID NO: 5738942 - DNA, 17 bp, Homo sapiens
gacaccaataaatgttt

SEQ ID NO: 5738943 - DNA, 18 bp, Homo sapiens
gacaccaataaatgtttg

SEQ ID NO: 5738944 - DNA, 15 bp, Homo sapiens
gacaccacacccagc

SEQ ID NO: 5738945 - DNA, 20 bp, Homo sapiens
gacaccacacccagcctcag

SEQ ID NO: 5738946 - DNA, 17 bp, Homo sapiens
gacaccacagcctcccc

SEQ ID NO: 5738947 - DNA, 21 bp, Homo sapiens
gacaccacagcctccccttcc

SEQ ID NO: 5738948 - DNA, 12 bp, Homo sapiens
gacaccaccacc

SEQ ID NO: 5738949 - DNA, 14 bp, Homo sapiens
gacaccaccactgt

SEQ ID NO: 5738950 - DNA, 15 bp, Homo sapiens
gacaccactcctgcc

SEQ ID NO: 5738951 - DNA, 19 bp, Homo sapiens
gacaccactgagctctgcc

SEQ ID NO: 5738952 - DNA, 23 bp, Homo sapiens
gacaccactgagctctgcctcaa

SEQ ID NO: 5738953 - DNA, 15 bp, Homo sapiens
gacaccactgggaac

SEQ ID NO: 5738954 - DNA, 22 bp, Homo sapiens
gacaccagaagctgttgggaga

SEQ ID NO: 5738955 - DNA, 18 bp, Homo sapiens
gacaccagagcagatgca

SEQ ID NO: 5738956 - DNA, 19 bp, Homo sapiens
gacaccagagcagatgcag

SEQ ID NO: 5738957 - DNA, 15 bp, Homo sapiens
gacaccagagctgcc

SEQ ID NO: 5738958 - DNA, 20 bp, Homo sapiens
gacaccagagtgtatgcata

SEQ ID NO: 5738959 - DNA, 19 bp, Homo sapiens
gacaccagccaggctctgt

SEQ ID NO: 5738960 - DNA, 20 bp, Homo sapiens
gacaccagcctttctcccag

SEQ ID NO: 5738961 - DNA, 18 bp, Homo sapiens
gacaccaggcaagaaaag

SEQ ID NO: 5738962 - DNA, 18 bp, Homo sapiens
gacaccatcaccacgcag

SEQ ID NO: 5738963 - DNA, 16 bp, Homo sapiens
gacaccatcctgagcc

SEQ ID NO: 5738964 - DNA, 22 bp, Homo sapiens
gacaccatcttttgtgagatgt

SEQ ID NO: 5738965 - DNA, 14 bp, Homo sapiens
gacaccatgtgcaa

SEQ ID NO: 5738966 - DNA, 21 bp, Homo sapiens
gacaccatgttcccagctcag

SEQ ID NO: 5738967 - DNA, 14 bp, Homo sapiens
gacaccattcattc

SEQ ID NO: 5738968 - DNA, 13 bp, Homo sapiens
gacaccattctga

SEQ ID NO: 5738969 - DNA, 17 bp, Homo sapiens
gacacccaccctgtgcc

SEQ ID NO: 5738970 - DNA, 23 bp, Homo sapiens
gacacccaccctgtgccatcacc

SEQ ID NO: 5738971 - DNA, 12 bp, Homo sapiens
gacacccagagg

SEQ ID NO: 5738972 - DNA, 23 bp, Homo sapiens
gacacccaggcccgagcgcctgc

SEQ ID NO: 5738973 - DNA, 20 bp, Homo sapiens
gacacccaggctggagtgca

SEQ ID NO: 5738974 - DNA, 23 bp, Homo sapiens
gacaccccacgggaggagtggca

SEQ ID NO: 5738975 - DNA, 21 bp, Homo sapiens
gacaccccagaatcccctggg

SEQ ID NO: 5738976 - DNA, 14 bp, Homo sapiens
gacaccccagacct

SEQ ID NO: 5738977 - DNA, 21 bp, Homo sapiens
gacaccccctccccgcccctg

SEQ ID NO: 5738978 - DNA, 15 bp, Homo sapiens
gacacccccttggtg

SEQ ID NO: 5738979 - DNA, 16 bp, Homo sapiens
gacacccctacacaca

SEQ ID NO: 5738980 - DNA, 18 bp, Homo sapiens
gacacccctacacacacc

SEQ ID NO: 5738981 - DNA, 20 bp, Homo sapiens
gacaccctaactcttgctca

SEQ ID NO: 5738982 - DNA, 22 bp, Homo sapiens
gacaccctccctccagggtcct

SEQ ID NO: 5738983 - DNA, 13 bp, Homo sapiens
gacaccctctgcc

SEQ ID NO: 5738984 - DNA, 16 bp, Homo sapiens
gacaccctctgggggt

SEQ ID NO: 5738985 - DNA, 13 bp, Homo sapiens
gacaccctggcag

SEQ ID NO: 5738986 - DNA, 12 bp, Homo sapiens
gacaccctggcc

SEQ ID NO: 5738987 - DNA, 16 bp, Homo sapiens
gacaccgctcagtatt

SEQ ID NO: 5738988 - DNA, 14 bp, Homo sapiens
gacaccgtggcctg

SEQ ID NO: 5738989 - DNA, 16 bp, Homo sapiens
gacaccgtggcctggg

SEQ ID NO: 5738990 - DNA, 19 bp, Homo sapiens
gacaccgtggggaaggggt

SEQ ID NO: 5738991 - DNA, 15 bp, Homo sapiens
gacacctaactcttc

SEQ ID NO: 5738992 - DNA, 14 bp, Homo sapiens
gacacctacagcag

SEQ ID NO: 5738993 - DNA, 15 bp, Homo sapiens
gacacctacagcagc

SEQ ID NO: 5738994 - DNA, 15 bp, Homo sapiens
gacacctaccatgct

SEQ ID NO: 5738995 - DNA, 22 bp, Homo sapiens
gacacctagactctaaaactat

SEQ ID NO: 5738996 - DNA, 16 bp, Homo sapiens
gacacctaggctaggg

SEQ ID NO: 5738997 - DNA, 17 bp, Homo sapiens
gacacctatcagagaag

SEQ ID NO: 5738998 - DNA, 11 bp, Homo sapiens
gacacctcaga

SEQ ID NO: 5738999 - DNA, 17 bp, Homo sapiens
gacacctcccttcgtgt

SEQ ID NO: 5739000 - DNA, 21 bp, Homo sapiens
gacacctccgagaggcagcca

SEQ ID NO: 5739001 - DNA, 18 bp, Homo sapiens
gacacctcgcccttcagc

SEQ ID NO: 5739002 - DNA, 13 bp, Homo sapiens
gacacctcttttt

SEQ ID NO: 5739003 - DNA, 9 bp, Homo sapiens
gacacctgc

SEQ ID NO: 5739004 - DNA, 19 bp, Homo sapiens
gacacctgcacctcccccc

SEQ ID NO: 5739005 - DNA, 16 bp, Homo sapiens
gacacctgccccagcg

SEQ ID NO: 5739006 - DNA, 15 bp, Homo sapiens
gacacctgccctgcc

SEQ ID NO: 5739007 - DNA, 19 bp, Homo sapiens
gacacctgccgctgcttga

SEQ ID NO: 5739008 - DNA, 16 bp, Homo sapiens
gacacctgccttatgc

SEQ ID NO: 5739009 - DNA, 21 bp, Homo sapiens
gacacctggccgcctccagga

SEQ ID NO: 5739010 - DNA, 17 bp, Homo sapiens
gacacctgggccgggct

SEQ ID NO: 5739011 - DNA, 20 bp, Homo sapiens
gacacctgtactggagagca

SEQ ID NO: 5739012 - DNA, 20 bp, Homo sapiens
gacacctgtcttgaataaga

SEQ ID NO: 5739013 - DNA, 13 bp, Homo sapiens
gacacctgtgcac

SEQ ID NO: 5739014 - DNA, 18 bp, Homo sapiens
gacaccttagagaagcta

SEQ ID NO: 5739015 - DNA, 22 bp, Homo sapiens
gacaccttctgagtattctcat

SEQ ID NO: 5739016 - DNA, 14 bp, Homo sapiens
gacaccttctgtgc

SEQ ID NO: 5739017 - DNA, 17 bp, Homo sapiens
gacaccttctgtgctca

SEQ ID NO: 5739018 - DNA, 18 bp, Homo sapiens
gacaccttgacagggcac

SEQ ID NO: 5739019 - DNA, 20 bp, Homo sapiens
gacaccttgacagggcacac

SEQ ID NO: 5739020 - DNA, 12 bp, Homo sapiens
gacacctttcat

SEQ ID NO: 5739021 - DNA, 11 bp, Homo sapiens
gacacctttga

SEQ ID NO: 5739022 - DNA, 12 bp, Homo sapiens
gacacctttgaa

SEQ ID NO: 5739023 - DNA, 19 bp, Homo sapiens
gacaccttttttcaacagt

SEQ ID NO: 5739024 - DNA, 18 bp, Homo sapiens
gacacgaaggctgcccct

SEQ ID NO: 5739025 - DNA, 18 bp, Homo sapiens
gacacgaatattgctgat

SEQ ID NO: 5739026 - DNA, 22 bp, Homo sapiens
gacacgatgccgagacctcaag

SEQ ID NO: 5739027 - DNA, 14 bp, Homo sapiens
gacacgcacggcag

SEQ ID NO: 5739028 - DNA, 19 bp, Homo sapiens
gacacgcacggcagccaca

SEQ ID NO: 5739029 - DNA, 21 bp, Homo sapiens
gacacgcacggcagccacagc

SEQ ID NO: 5739030 - DNA, 22 bp, Homo sapiens
gacacgcacggcagccacagct

SEQ ID NO: 5739031 - DNA, 17 bp, Homo sapiens
gacacgcacttctgggg

SEQ ID NO: 5739032 - DNA, 21 bp, Homo sapiens
gacacgcccgactctctccat

SEQ ID NO: 5739033 - DNA, 17 bp, Homo sapiens
gacacgccttcccctca

SEQ ID NO: 5739034 - DNA, 23 bp, Homo sapiens
gacacgcgcccccctcccagagg

SEQ ID NO: 5739035 - DNA, 17 bp, Homo sapiens
gacacgcgctctccacc

SEQ ID NO: 5739036 - DNA, 22 bp, Homo sapiens
gacacgcgctctccaccaccca

SEQ ID NO: 5739037 - DNA, 23 bp, Homo sapiens
gacacgctccctccccctgcccc

SEQ ID NO: 5739038 - DNA, 23 bp, Homo sapiens
gacacgctcgcgggcagcgggcc

SEQ ID NO: 5739039 - DNA, 13 bp, Homo sapiens
gacacgcttctga

SEQ ID NO: 5739040 - DNA, 19 bp, Homo sapiens
gacacgcttctgagcaggg

SEQ ID NO: 5739041 - DNA, 17 bp, Homo sapiens
gacacggaccctgtgtg

SEQ ID NO: 5739042 - DNA, 15 bp, Homo sapiens
gacacggagcccagc

SEQ ID NO: 5739043 - DNA, 19 bp, Homo sapiens
gacacggatctgagaatct

SEQ ID NO: 5739044 - DNA, 20 bp, Homo sapiens
gacacgggcagcctggctcc

SEQ ID NO: 5739045 - DNA, 15 bp, Homo sapiens
gacacgggcctgtcc

SEQ ID NO: 5739046 - DNA, 18 bp, Homo sapiens
gacacgggcctgtccaca

SEQ ID NO: 5739047 - DNA, 20 bp, Homo sapiens
gacacgggcctgtccacagg

SEQ ID NO: 5739048 - DNA, 18 bp, Homo sapiens
gacacggggatcatctct

SEQ ID NO: 5739049 - DNA, 18 bp, Homo sapiens
gacacgggtggggaaagg

SEQ ID NO: 5739050 - DNA, 16 bp, Homo sapiens
gacacggtaggccaag

SEQ ID NO: 5739051 - DNA, 23 bp, Homo sapiens
gacacggtaggccaagctgaagt

SEQ ID NO: 5739052 - DNA, 22 bp, Homo sapiens
gacacggtcggggcatctggcc

SEQ ID NO: 5739053 - DNA, 22 bp, Homo sapiens
gacacggtgaaatccaggtctc

SEQ ID NO: 5739054 - DNA, 23 bp, Homo sapiens
gacacggtttaactgtcccagcg

SEQ ID NO: 5739055 - DNA, 14 bp, Homo sapiens
gacacgtccacccc

SEQ ID NO: 5739056 - DNA, 19 bp, Homo sapiens
gacacgtgatggaccaaag

SEQ ID NO: 5739057 - DNA, 20 bp, Homo sapiens
gacacgtgatggaccaaagc

SEQ ID NO: 5739058 - DNA, 21 bp, Homo sapiens
gacacgtgatggaccaaagcc

SEQ ID NO: 5739059 - DNA, 21 bp, Homo sapiens
gacacgtgcaacagactgcct

SEQ ID NO: 5739060 - DNA, 13 bp, Homo sapiens
gacacgtggcctc

SEQ ID NO: 5739061 - DNA, 17 bp, Homo sapiens
gacacgtggcctcgtga

SEQ ID NO: 5739062 - DNA, 22 bp, Homo sapiens
gacacgtttggccagtgacatt

SEQ ID NO: 5739063 - DNA, 23 bp, Homo sapiens
gacactaaaacaagaggacacaa

SEQ ID NO: 5739064 - DNA, 21 bp, Homo sapiens
gacactaaactccatgatatt

SEQ ID NO: 5739065 - DNA, 17 bp, Homo sapiens
gacactaaatgcagaca

SEQ ID NO: 5739066 - DNA, 15 bp, Homo sapiens
gacactaaccacgct

SEQ ID NO: 5739067 - DNA, 21 bp, Homo sapiens
gacactaaccacgctggacct

SEQ ID NO: 5739068 - DNA, 14 bp, Homo sapiens
gacactaagaatga

SEQ ID NO: 5739069 - DNA, 20 bp, Homo sapiens
gacactaagaatgaggaata

SEQ ID NO: 5739070 - DNA, 13 bp, Homo sapiens
gacactaagagga

SEQ ID NO: 5739071 - DNA, 17 bp, Homo sapiens
gacactaagaggaggca

SEQ ID NO: 5739072 - DNA, 20 bp, Homo sapiens
gacactaagttatagtatat

SEQ ID NO: 5739073 - DNA, 16 bp, Homo sapiens
gacactaattccttaa

SEQ ID NO: 5739074 - DNA, 18 bp, Homo sapiens
gacactacacccagcaat

SEQ ID NO: 5739075 - DNA, 20 bp, Homo sapiens
gacactacacccagcaatag

SEQ ID NO: 5739076 - DNA, 14 bp, Homo sapiens
gacactacagagga

SEQ ID NO: 5739077 - DNA, 18 bp, Homo sapiens
gacactacagaggattct

SEQ ID NO: 5739078 - DNA, 22 bp, Homo sapiens
gacactaccccatatacacctg

SEQ ID NO: 5739079 - DNA, 20 bp, Homo sapiens
gacactatagtttaaaacac

SEQ ID NO: 5739080 - DNA, 20 bp, Homo sapiens
gacactatatatttcttaat

SEQ ID NO: 5739081 - DNA, 16 bp, Homo sapiens
gacactattcactaaa

SEQ ID NO: 5739082 - DNA, 19 bp, Homo sapiens
gacactcagaccagagaag

SEQ ID NO: 5739083 - DNA, 15 bp, Homo sapiens
gacactcagacctga

SEQ ID NO: 5739084 - DNA, 12 bp, Homo sapiens
gacactcagggc

SEQ ID NO: 5739085 - DNA, 18 bp, Homo sapiens
gacactcagggcagctgc

SEQ ID NO: 5739086 - DNA, 21 bp, Homo sapiens
gacactcagggcagctgcctg

SEQ ID NO: 5739087 - DNA, 14 bp, Homo sapiens
gacactcatattgc

SEQ ID NO: 5739088 - DNA, 21 bp, Homo sapiens
gacactccagggacacacagc

SEQ ID NO: 5739089 - DNA, 16 bp, Homo sapiens
gacactccagtgccag

SEQ ID NO: 5739090 - DNA, 19 bp, Homo sapiens
gacactccagtgccagcaa

SEQ ID NO: 5739091 - DNA, 16 bp, Homo sapiens
gacactcccacccagt

SEQ ID NO: 5739092 - DNA, 23 bp, Homo sapiens
gacactcccacccagtctctgct

SEQ ID NO: 5739093 - DNA, 21 bp, Homo sapiens
gacactccccgaagtcttttg

SEQ ID NO: 5739094 - DNA, 21 bp, Homo sapiens
gacactcccttgggctccctg

SEQ ID NO: 5739095 - DNA, 21 bp, Homo sapiens
gacactcctagagaacgcagc

SEQ ID NO: 5739096 - DNA, 12 bp, Homo sapiens
gacactcctggg

SEQ ID NO: 5739097 - DNA, 21 bp, Homo sapiens
gacactcgcttgccgggcctg

SEQ ID NO: 5739098 - DNA, 16 bp, Homo sapiens
gacactcgtcacccca

SEQ ID NO: 5739099 - DNA, 22 bp, Homo sapiens
gacactctagtgacttcctggt

SEQ ID NO: 5739100 - DNA, 22 bp, Homo sapiens
gacactctcaccccccgacctg

SEQ ID NO: 5739101 - DNA, 15 bp, Homo sapiens
gacactctgacaagc

SEQ ID NO: 5739102 - DNA, 17 bp, Homo sapiens
gacactctgacaagctg

SEQ ID NO: 5739103 - DNA, 22 bp, Homo sapiens
gacactctgacaagctggccaa

SEQ ID NO: 5739104 - DNA, 16 bp, Homo sapiens
gacactctgctctgcc

SEQ ID NO: 5739105 - DNA, 13 bp, Homo sapiens
gacactgaaggca

SEQ ID NO: 5739106 - DNA, 19 bp, Homo sapiens
gacactgacagcctttgat

SEQ ID NO: 5739107 - DNA, 15 bp, Homo sapiens
gacactgactagagt

SEQ ID NO: 5739108 - DNA, 13 bp, Homo sapiens
gacactgagccag

SEQ ID NO: 5739109 - DNA, 15 bp, Homo sapiens
gacactgagccagtc

SEQ ID NO: 5739110 - DNA, 17 bp, Homo sapiens
gacactgagccagtctt

SEQ ID NO: 5739111 - DNA, 12 bp, Homo sapiens
gacactgagccc

SEQ ID NO: 5739112 - DNA, 18 bp, Homo sapiens
gacactgagcttctgaga

SEQ ID NO: 5739113 - DNA, 22 bp, Homo sapiens
gacactgcacagaagacagcag

SEQ ID NO: 5739114 - DNA, 23 bp, Homo sapiens
gacactgcagaaaccctgagcag

SEQ ID NO: 5739115 - DNA, 11 bp, Homo sapiens
gacactgcagt

SEQ ID NO: 5739116 - DNA, 14 bp, Homo sapiens
gacactgccaagag

SEQ ID NO: 5739117 - DNA, 16 bp, Homo sapiens
gacactgccacacagg

SEQ ID NO: 5739118 - DNA, 12 bp, Homo sapiens
gacactgcctgg

SEQ ID NO: 5739119 - DNA, 23 bp, Homo sapiens
gacactgccttagcctcttggaa

SEQ ID NO: 5739120 - DNA, 18 bp, Homo sapiens
gacactgcctttgctgcc

SEQ ID NO: 5739121 - DNA, 16 bp, Homo sapiens
gacactgcggggcttg

SEQ ID NO: 5739122 - DNA, 19 bp, Homo sapiens
gacactgcggggcttggct

SEQ ID NO: 5739123 - DNA, 12 bp, Homo sapiens
gacactgctgca

SEQ ID NO: 5739124 - DNA, 16 bp, Homo sapiens
gacactgctgcaccag

SEQ ID NO: 5739125 - DNA, 21 bp, Homo sapiens
gacactgctgcaccagagtga

SEQ ID NO: 5739126 - DNA, 13 bp, Homo sapiens
gacactggaccag

SEQ ID NO: 5739127 - DNA, 18 bp, Homo sapiens
gacactggaccaggtcct

SEQ ID NO: 5739128 - DNA, 12 bp, Homo sapiens
gacactggcatg

SEQ ID NO: 5739129 - DNA, 14 bp, Homo sapiens
gacactggccccac

SEQ ID NO: 5739130 - DNA, 17 bp, Homo sapiens
gacactggccccacagg

SEQ ID NO: 5739131 - DNA, 13 bp, Homo sapiens
gacactggcccct

SEQ ID NO: 5739132 - DNA, 14 bp, Homo sapiens
gacactggcccctc

SEQ ID NO: 5739133 - DNA, 17 bp, Homo sapiens
gacactggctgccagct

SEQ ID NO: 5739134 - DNA, 13 bp, Homo sapiens
gacactgggagaa

SEQ ID NO: 5739135 - DNA, 20 bp, Homo sapiens
gacactgggagaagagaacc

SEQ ID NO: 5739136 - DNA, 16 bp, Homo sapiens
gacactgggaggccag

SEQ ID NO: 5739137 - DNA, 16 bp, Homo sapiens
gacactgggcagcaag

SEQ ID NO: 5739138 - DNA, 19 bp, Homo sapiens
gacactggtattcctgcct

SEQ ID NO: 5739139 - DNA, 23 bp, Homo sapiens
gacactggtttacactttatgcc

SEQ ID NO: 5739140 - DNA, 13 bp, Homo sapiens
gacactgtacaag

SEQ ID NO: 5739141 - DNA, 17 bp, Homo sapiens
gacactgtccctctttg

SEQ ID NO: 5739142 - DNA, 14 bp, Homo sapiens
gacactgtctgctg

SEQ ID NO: 5739143 - DNA, 18 bp, Homo sapiens
gacactgtctgctgcccc

SEQ ID NO: 5739144 - DNA, 17 bp, Homo sapiens
gacactgtgcaggccca

SEQ ID NO: 5739145 - DNA, 16 bp, Homo sapiens
gacactgtgcccagcc

SEQ ID NO: 5739146 - DNA, 16 bp, Homo sapiens
gacactgtggcagcag

SEQ ID NO: 5739147 - DNA, 17 bp, Homo sapiens
gacactgtggcagcagg

SEQ ID NO: 5739148 - DNA, 18 bp, Homo sapiens
gacactgtggcagcagga

SEQ ID NO: 5739149 - DNA, 19 bp, Homo sapiens
gacactgtggcagcaggag

SEQ ID NO: 5739150 - DNA, 20 bp, Homo sapiens
gacactgtggcagcaggagg

SEQ ID NO: 5739151 - DNA, 21 bp, Homo sapiens
gacactgtggcagcaggaggg

SEQ ID NO: 5739152 - DNA, 20 bp, Homo sapiens
gacactgtgtggccctggac

SEQ ID NO: 5739153 - DNA, 22 bp, Homo sapiens
gacactgttcttagctcaatga

SEQ ID NO: 5739154 - DNA, 18 bp, Homo sapiens
gacactgttgataaaaac

SEQ ID NO: 5739155 - DNA, 14 bp, Homo sapiens
gacactgttgcaaa

SEQ ID NO: 5739156 - DNA, 14 bp, Homo sapiens
gacactgtttcctg

SEQ ID NO: 5739157 - DNA, 17 bp, Homo sapiens
gacacttaattctgttc

SEQ ID NO: 5739158 - DNA, 18 bp, Homo sapiens
gacacttccattgtttaa

SEQ ID NO: 5739159 - DNA, 17 bp, Homo sapiens
gacacttccccttgtct

SEQ ID NO: 5739160 - DNA, 21 bp, Homo sapiens
gacacttccccttgtctccct

SEQ ID NO: 5739161 - DNA, 21 bp, Homo sapiens
gacacttccctctgtttctct

SEQ ID NO: 5739162 - DNA, 13 bp, Homo sapiens
gacacttcctgcc

SEQ ID NO: 5739163 - DNA, 14 bp, Homo sapiens
gacacttcctgcct

SEQ ID NO: 5739164 - DNA, 15 bp, Homo sapiens
gacacttcctgccta

SEQ ID NO: 5739165 - DNA, 21 bp, Homo sapiens
gacacttctttatactctctt

SEQ ID NO: 5739166 - DNA, 19 bp, Homo sapiens
gacacttgagttaactttt

SEQ ID NO: 5739167 - DNA, 22 bp, Homo sapiens
gacacttgccttcttcacccag

SEQ ID NO: 5739168 - DNA, 13 bp, Homo sapiens
gacacttgtacaa

SEQ ID NO: 5739169 - DNA, 14 bp, Homo sapiens
gacactttacctct

SEQ ID NO: 5739170 - DNA, 20 bp, Homo sapiens
gacactttgaaatgtgtttc

SEQ ID NO: 5739171 - DNA, 22 bp, Homo sapiens
gacactttgaaatgtgtttctg

SEQ ID NO: 5739172 - DNA, 16 bp, Homo sapiens
gacacttttaaaaaac

SEQ ID NO: 5739173 - DNA, 19 bp, Homo sapiens
gacacttttaaaaaacaaa

SEQ ID NO: 5739174 - DNA, 23 bp, Homo sapiens
gacacttttaaaataaattctct

SEQ ID NO: 5739175 - DNA, 13 bp, Homo sapiens
gacacttttatat

SEQ ID NO: 5739176 - DNA, 21 bp, Homo sapiens
gacacttttatatttgaaaaa

SEQ ID NO: 5739177 - DNA, 21 bp, Homo sapiens
gacacttttcatatcatttct

SEQ ID NO: 5739178 - DNA, 23 bp, Homo sapiens
gacacttttgccaatgaactctt

SEQ ID NO: 5739179 - DNA, 16 bp, Homo sapiens
gacagaaaacatgttt

SEQ ID NO: 5739180 - DNA, 19 bp, Homo sapiens
gacagaaaagtgcctgagc

SEQ ID NO: 5739181 - DNA, 21 bp, Homo sapiens
gacagaaaagtgcctgagctg

SEQ ID NO: 5739182 - DNA, 22 bp, Homo sapiens
gacagaaacatgtcttgactgt

SEQ ID NO: 5739183 - DNA, 15 bp, Homo sapiens
gacagaaagagacac

SEQ ID NO: 5739184 - DNA, 12 bp, Homo sapiens
gacagaaagcaa

SEQ ID NO: 5739185 - DNA, 20 bp, Homo sapiens
gacagaaagcagaacagtga

SEQ ID NO: 5739186 - DNA, 13 bp, Homo sapiens
gacagaaagcagt

SEQ ID NO: 5739187 - DNA, 23 bp, Homo sapiens
gacagaaagcctccgctgggctt

SEQ ID NO: 5739188 - DNA, 22 bp, Homo sapiens
gacagaaaggagagtggccatt

SEQ ID NO: 5739189 - DNA, 18 bp, Homo sapiens
gacagaaatgcaatctcc

SEQ ID NO: 5739190 - DNA, 22 bp, Homo sapiens
gacagaaccaacgggtctgtgg

SEQ ID NO: 5739191 - DNA, 17 bp, Homo sapiens
gacagaaccacagggct

SEQ ID NO: 5739192 - DNA, 21 bp, Homo sapiens
gacagaaccgagaagggggtg

SEQ ID NO: 5739193 - DNA, 20 bp, Homo sapiens
gacagaactgaacgtcctgc

SEQ ID NO: 5739194 - DNA, 14 bp, Homo sapiens
gacagaactgtcca

SEQ ID NO: 5739195 - DNA, 23 bp, Homo sapiens
gacagaacttcagcattgtaatt

SEQ ID NO: 5739196 - DNA, 13 bp, Homo sapiens
gacagaagaaggc

SEQ ID NO: 5739197 - DNA, 16 bp, Homo sapiens
gacagaagcaggctgg

SEQ ID NO: 5739198 - DNA, 23 bp, Homo sapiens
gacagaagcctggactctgcccc

SEQ ID NO: 5739199 - DNA, 15 bp, Homo sapiens
gacagaaggaccagc

SEQ ID NO: 5739200 - DNA, 18 bp, Homo sapiens
gacagaaggactggtgcg

SEQ ID NO: 5739201 - DNA, 17 bp, Homo sapiens
gacagaaggcaaagttt

SEQ ID NO: 5739202 - DNA, 14 bp, Homo sapiens
gacagaaggcccga

SEQ ID NO: 5739203 - DNA, 19 bp, Homo sapiens
gacagaaggctcctgcccc

SEQ ID NO: 5739204 - DNA, 16 bp, Homo sapiens
gacagaagtcaggtgt

SEQ ID NO: 5739205 - DNA, 16 bp, Homo sapiens
gacagaagtctcctca

SEQ ID NO: 5739206 - DNA, 20 bp, Homo sapiens
gacagaagtttgcactatct

SEQ ID NO: 5739207 - DNA, 23 bp, Homo sapiens
gacagaatataaaaactcctggg

SEQ ID NO: 5739208 - DNA, 22 bp, Homo sapiens
gacagaatatacacattttgta

SEQ ID NO: 5739209 - DNA, 14 bp, Homo sapiens
gacagaatgatgga

SEQ ID NO: 5739210 - DNA, 18 bp, Homo sapiens
gacagaatgtatctgtga

SEQ ID NO: 5739211 - DNA, 16 bp, Homo sapiens
gacagaattcactgtc

SEQ ID NO: 5739212 - DNA, 23 bp, Homo sapiens
gacagacaacactgggaaacaga

SEQ ID NO: 5739213 - DNA, 17 bp, Homo sapiens
gacagacacacactggc

SEQ ID NO: 5739214 - DNA, 18 bp, Homo sapiens
gacagacacacactggct

SEQ ID NO: 5739215 - DNA, 12 bp, Homo sapiens
gacagacacagg

SEQ ID NO: 5739216 - DNA, 17 bp, Homo sapiens
gacagacacaggcccgg

SEQ ID NO: 5739217 - DNA, 20 bp, Homo sapiens
gacagacacaggcccggctc

SEQ ID NO: 5739218 - DNA, 22 bp, Homo sapiens
gacagacacaggcccggctcca

SEQ ID NO: 5739219 - DNA, 15 bp, Homo sapiens
gacagacaccacagc

SEQ ID NO: 5739220 - DNA, 21 bp, Homo sapiens
gacagacacctccccctaccc

SEQ ID NO: 5739221 - DNA, 18 bp, Homo sapiens
gacagacactgttgcaaa

SEQ ID NO: 5739222 - DNA, 12 bp, Homo sapiens
gacagacagacg

SEQ ID NO: 5739223 - DNA, 10 bp, Homo sapiens
gacagacagc

SEQ ID NO: 5739224 - DNA, 12 bp, Homo sapiens
gacagacagcca

SEQ ID NO: 5739225 - DNA, 14 bp, Homo sapiens
gacagacatacata

SEQ ID NO: 5739226 - DNA, 21 bp, Homo sapiens
gacagacattccttctacatg

SEQ ID NO: 5739227 - DNA, 18 bp, Homo sapiens
gacagaccacatctttat

SEQ ID NO: 5739228 - DNA, 14 bp, Homo sapiens
gacagaccagcagc

SEQ ID NO: 5739229 - DNA, 23 bp, Homo sapiens
gacagacccacccccagccttgc

SEQ ID NO: 5739230 - DNA, 12 bp, Homo sapiens
gacagacccagg

SEQ ID NO: 5739231 - DNA, 14 bp, Homo sapiens
gacagacccaggtc

SEQ ID NO: 5739232 - DNA, 18 bp, Homo sapiens
gacagacccaggtcttcc

SEQ ID NO: 5739233 - DNA, 22 bp, Homo sapiens
gacagacccaggtcttccagac

SEQ ID NO: 5739234 - DNA, 12 bp, Homo sapiens
gacagacccagt

SEQ ID NO: 5739235 - DNA, 23 bp, Homo sapiens
gacagacccagtgagtgaatcag

SEQ ID NO: 5739236 - DNA, 16 bp, Homo sapiens
gacagaccccttggct

SEQ ID NO: 5739237 - DNA, 20 bp, Homo sapiens
gacagaccggggttcaagcc

SEQ ID NO: 5739238 - DNA, 15 bp, Homo sapiens
gacagacctggacac

SEQ ID NO: 5739239 - DNA, 13 bp, Homo sapiens
gacagaccttcac

SEQ ID NO: 5739240 - DNA, 18 bp, Homo sapiens
gacagaccttcacagatg

SEQ ID NO: 5739241 - DNA, 13 bp, Homo sapiens
gacagacgagaca

SEQ ID NO: 5739242 - DNA, 17 bp, Homo sapiens
gacagacgcatgtggca

SEQ ID NO: 5739243 - DNA, 19 bp, Homo sapiens
gacagactcctgaggacag

SEQ ID NO: 5739244 - DNA, 23 bp, Homo sapiens
gacagactcctgaggacagctgt

SEQ ID NO: 5739245 - DNA, 11 bp, Homo sapiens
gacagactggc

SEQ ID NO: 5739246 - DNA, 16 bp, Homo sapiens
gacagactggccgggc

SEQ ID NO: 5739247 - DNA, 19 bp, Homo sapiens
gacagactggccgggcagg

SEQ ID NO: 5739248 - DNA, 23 bp, Homo sapiens
gacagactttggacagtggcctc

SEQ ID NO: 5739249 - DNA, 15 bp, Homo sapiens
gacagagacacctgc

SEQ ID NO: 5739250 - DNA, 15 bp, Homo sapiens
gacagagacccagat

SEQ ID NO: 5739251 - DNA, 15 bp, Homo sapiens
gacagagacctcctg

SEQ ID NO: 5739252 - DNA, 16 bp, Homo sapiens
gacagagacctcctgc

SEQ ID NO: 5739253 - DNA, 13 bp, Homo sapiens
gacagagactcag

SEQ ID NO: 5739254 - DNA, 22 bp, Homo sapiens
gacagagactttaatcactgct

SEQ ID NO: 5739255 - DNA, 15 bp, Homo sapiens
gacagagagagactg

SEQ ID NO: 5739256 - DNA, 18 bp, Homo sapiens
gacagagaggacgtgggc

SEQ ID NO: 5739257 - DNA, 21 bp, Homo sapiens
gacagagagttctggtgagat

SEQ ID NO: 5739258 - DNA, 15 bp, Homo sapiens
gacagagatcagaat

SEQ ID NO: 5739259 - DNA, 15 bp, Homo sapiens
gacagagatggcaga

SEQ ID NO: 5739260 - DNA, 18 bp, Homo sapiens
gacagagatggcagagcc

SEQ ID NO: 5739261 - DNA, 16 bp, Homo sapiens
gacagagatgtgcaga

SEQ ID NO: 5739262 - DNA, 19 bp, Homo sapiens
gacagagcaaagcgcccac

SEQ ID NO: 5739263 - DNA, 20 bp, Homo sapiens
gacagagcaacccctggacc

SEQ ID NO: 5739264 - DNA, 21 bp, Homo sapiens
gacagagcaagaccctgcctc

SEQ ID NO: 5739265 - DNA, 14 bp, Homo sapiens
gacagagcaggtct

SEQ ID NO: 5739266 - DNA, 19 bp, Homo sapiens
gacagagcaggtctgcagg

SEQ ID NO: 5739267 - DNA, 21 bp, Homo sapiens
gacagagccaagcactgctca

SEQ ID NO: 5739268 - DNA, 13 bp, Homo sapiens
gacagagccaccc

SEQ ID NO: 5739269 - DNA, 21 bp, Homo sapiens
gacagagccaccccatgagct

SEQ ID NO: 5739270 - DNA, 14 bp, Homo sapiens
gacagagccagagg

SEQ ID NO: 5739271 - DNA, 15 bp, Homo sapiens
gacagagccagaggc

SEQ ID NO: 5739272 - DNA, 16 bp, Homo sapiens
gacagagccagcggct

SEQ ID NO: 5739273 - DNA, 13 bp, Homo sapiens
gacagagccagga

SEQ ID NO: 5739274 - DNA, 15 bp, Homo sapiens
gacagagccaggaga

SEQ ID NO: 5739275 - DNA, 13 bp, Homo sapiens
gacagagccatgg

SEQ ID NO: 5739276 - DNA, 18 bp, Homo sapiens
gacagagcccagcatccc

SEQ ID NO: 5739277 - DNA, 17 bp, Homo sapiens
gacagagcccccaagcc

SEQ ID NO: 5739278 - DNA, 19 bp, Homo sapiens
gacagagcccccaagcctc

SEQ ID NO: 5739279 - DNA, 12 bp, Homo sapiens
gacagagcccgg

SEQ ID NO: 5739280 - DNA, 17 bp, Homo sapiens
gacagagcgacagagca

SEQ ID NO: 5739281 - DNA, 18 bp, Homo sapiens
gacagagcgacagagcag

SEQ ID NO: 5739282 - DNA, 17 bp, Homo sapiens
gacagagcgagactgtc

SEQ ID NO: 5739283 - DNA, 20 bp, Homo sapiens
gacagagctggctgtcttcc

SEQ ID NO: 5739284 - DNA, 17 bp, Homo sapiens
gacagaggaaagggctg

SEQ ID NO: 5739285 - DNA, 22 bp, Homo sapiens
gacagaggaaagggctggctcc

SEQ ID NO: 5739286 - DNA, 22 bp, Homo sapiens
gacagaggaggatgtaaggcct

SEQ ID NO: 5739287 - DNA, 23 bp, Homo sapiens
gacagaggcagccccattctgcc

SEQ ID NO: 5739288 - DNA, 17 bp, Homo sapiens
gacagaggccaaggact

SEQ ID NO: 5739289 - DNA, 19 bp, Homo sapiens
gacagaggccccagcctcc

SEQ ID NO: 5739290 - DNA, 15 bp, Homo sapiens
gacagaggccctgcc

SEQ ID NO: 5739291 - DNA, 17 bp, Homo sapiens
gacagaggccctgccac

SEQ ID NO: 5739292 - DNA, 20 bp, Homo sapiens
gacagaggccctgccacgtc

SEQ ID NO: 5739293 - DNA, 19 bp, Homo sapiens
gacagaggccggggtccag

SEQ ID NO: 5739294 - DNA, 13 bp, Homo sapiens
gacagaggcctgc

SEQ ID NO: 5739295 - DNA, 15 bp, Homo sapiens
gacagaggcggggct

SEQ ID NO: 5739296 - DNA, 22 bp, Homo sapiens
gacagaggctgcacccctgggc

SEQ ID NO: 5739297 - DNA, 19 bp, Homo sapiens
gacagagggacagtgggct

SEQ ID NO: 5739298 - DNA, 12 bp, Homo sapiens
gacagagggaga

SEQ ID NO: 5739299 - DNA, 15 bp, Homo sapiens
gacagagggagaagg

SEQ ID NO: 5739300 - DNA, 13 bp, Homo sapiens
gacagagggagga

SEQ ID NO: 5739301 - DNA, 21 bp, Homo sapiens
gacagagggcacatgaacagc

SEQ ID NO: 5739302 - DNA, 15 bp, Homo sapiens
gacagaggggactct

SEQ ID NO: 5739303 - DNA, 17 bp, Homo sapiens
gacagaggggactctgg

SEQ ID NO: 5739304 - DNA, 21 bp, Homo sapiens
gacagaggggactctgggcta

SEQ ID NO: 5739305 - DNA, 13 bp, Homo sapiens
gacagaggggagc

SEQ ID NO: 5739306 - DNA, 22 bp, Homo sapiens
gacagaggggatggggatagag

SEQ ID NO: 5739307 - DNA, 18 bp, Homo sapiens
gacagagggggtggcctc

SEQ ID NO: 5739308 - DNA, 21 bp, Homo sapiens
gacagagggggtggcctccca

SEQ ID NO: 5739309 - DNA, 22 bp, Homo sapiens
gacagagggggtggcctcccaa

SEQ ID NO: 5739310 - DNA, 15 bp, Homo sapiens
gacagaggtttcatt

SEQ ID NO: 5739311 - DNA, 21 bp, Homo sapiens
gacagagtcttgctctgtctc

SEQ ID NO: 5739312 - DNA, 12 bp, Homo sapiens
gacagagtgaga

SEQ ID NO: 5739313 - DNA, 12 bp, Homo sapiens
gacagagtggat

SEQ ID NO: 5739314 - DNA, 17 bp, Homo sapiens
gacagagtggatctgga

SEQ ID NO: 5739315 - DNA, 16 bp, Homo sapiens
gacagagttcacagga

SEQ ID NO: 5739316 - DNA, 15 bp, Homo sapiens
gacagagttcaggga

SEQ ID NO: 5739317 - DNA, 19 bp, Homo sapiens
gacagataaatccttaaca

SEQ ID NO: 5739318 - DNA, 18 bp, Homo sapiens
gacagatacatagatgga

SEQ ID NO: 5739319 - DNA, 15 bp, Homo sapiens
gacagatacctccaa

SEQ ID NO: 5739320 - DNA, 23 bp, Homo sapiens
gacagatacgtagttgtgctttt

SEQ ID NO: 5739321 - DNA, 18 bp, Homo sapiens
gacagatagacagtgctg

SEQ ID NO: 5739322 - DNA, 23 bp, Homo sapiens
gacagatagtgaaacagctttct

SEQ ID NO: 5739323 - DNA, 14 bp, Homo sapiens
gacagatatattta

SEQ ID NO: 5739324 - DNA, 15 bp, Homo sapiens
gacagatatatttaa

SEQ ID NO: 5739325 - DNA, 18 bp, Homo sapiens
gacagatatatttaagcc

SEQ ID NO: 5739326 - DNA, 14 bp, Homo sapiens
gacagatattttat

SEQ ID NO: 5739327 - DNA, 17 bp, Homo sapiens
gacagatcaagctgtga

SEQ ID NO: 5739328 - DNA, 19 bp, Homo sapiens
gacagatcaagctgtgaga

SEQ ID NO: 5739329 - DNA, 18 bp, Homo sapiens
gacagatcaatggcgcag

SEQ ID NO: 5739330 - DNA, 14 bp, Homo sapiens
gacagatcacaggg

SEQ ID NO: 5739331 - DNA, 18 bp, Homo sapiens
gacagatcactcctggag

SEQ ID NO: 5739332 - DNA, 20 bp, Homo sapiens
gacagatcactcctggaggc

SEQ ID NO: 5739333 - DNA, 21 bp, Homo sapiens
gacagatcatagatttctgat

SEQ ID NO: 5739334 - DNA, 23 bp, Homo sapiens
gacagatccccgttcctgacatc

SEQ ID NO: 5739335 - DNA, 18 bp, Homo sapiens
gacagatcggatccagtt

SEQ ID NO: 5739336 - DNA, 23 bp, Homo sapiens
gacagatctctgctttggaaatc

SEQ ID NO: 5739337 - DNA, 15 bp, Homo sapiens
gacagatcttgagca

SEQ ID NO: 5739338 - DNA, 15 bp, Homo sapiens
gacagatgaatacct

SEQ ID NO: 5739339 - DNA, 14 bp, Homo sapiens
gacagatgagcagg

SEQ ID NO: 5739340 - DNA, 20 bp, Homo sapiens
gacagatgaggctttccatg

SEQ ID NO: 5739341 - DNA, 14 bp, Homo sapiens
gacagatgccaact

SEQ ID NO: 5739342 - DNA, 17 bp, Homo sapiens
gacagatgccaacttcc

SEQ ID NO: 5739343 - DNA, 22 bp, Homo sapiens
gacagatgccaacttcccacac

SEQ ID NO: 5739344 - DNA, 18 bp, Homo sapiens
gacagatgccccagagct

SEQ ID NO: 5739345 - DNA, 14 bp, Homo sapiens
gacagatgctggtg

SEQ ID NO: 5739346 - DNA, 19 bp, Homo sapiens
gacagatgctggtggagga

SEQ ID NO: 5739347 - DNA, 15 bp, Homo sapiens
gacagatggaccaaa

SEQ ID NO: 5739348 - DNA, 16 bp, Homo sapiens
gacagatggaccaaaa

SEQ ID NO: 5739349 - DNA, 14 bp, Homo sapiens
gacagatggacgca

SEQ ID NO: 5739350 - DNA, 18 bp, Homo sapiens
gacagatggacgcaggcc

SEQ ID NO: 5739351 - DNA, 12 bp, Homo sapiens
gacagatggccc

SEQ ID NO: 5739352 - DNA, 18 bp, Homo sapiens
gacagatgttatttttgt

SEQ ID NO: 5739353 - DNA, 14 bp, Homo sapiens
gacagattaatatt

SEQ ID NO: 5739354 - DNA, 18 bp, Homo sapiens
gacagattcataaagtaa

SEQ ID NO: 5739355 - DNA, 18 bp, Homo sapiens
gacagattctgacattta

SEQ ID NO: 5739356 - DNA, 16 bp, Homo sapiens
gacagcaaacacagtc

SEQ ID NO: 5739357 - DNA, 16 bp, Homo sapiens
gacagcaaagcagcag

SEQ ID NO: 5739358 - DNA, 23 bp, Homo sapiens
gacagcaacaaagcataagacaa

SEQ ID NO: 5739359 - DNA, 19 bp, Homo sapiens
gacagcaacggggaggcca

SEQ ID NO: 5739360 - DNA, 18 bp, Homo sapiens
gacagcaaggtgtggagg

SEQ ID NO: 5739361 - DNA, 23 bp, Homo sapiens
gacagcaattcatggttcaagta

SEQ ID NO: 5739362 - DNA, 22 bp, Homo sapiens
gacagcacacggtgagggtgcg

SEQ ID NO: 5739363 - DNA, 15 bp, Homo sapiens
gacagcacagggcag

SEQ ID NO: 5739364 - DNA, 16 bp, Homo sapiens
gacagcacagggcagg

SEQ ID NO: 5739365 - DNA, 12 bp, Homo sapiens
gacagcaccact

SEQ ID NO: 5739366 - DNA, 16 bp, Homo sapiens
gacagcaccactgctg

SEQ ID NO: 5739367 - DNA, 21 bp, Homo sapiens
gacagcaccactgctgaggag

SEQ ID NO: 5739368 - DNA, 16 bp, Homo sapiens
gacagcagaagcctcc

SEQ ID NO: 5739369 - DNA, 17 bp, Homo sapiens
gacagcagaagcctcca

SEQ ID NO: 5739370 - DNA, 20 bp, Homo sapiens
gacagcagaagcctccaagc

SEQ ID NO: 5739371 - DNA, 17 bp, Homo sapiens
gacagcagagccatctg

SEQ ID NO: 5739372 - DNA, 13 bp, Homo sapiens
gacagcagcagcc

SEQ ID NO: 5739373 - DNA, 17 bp, Homo sapiens
gacagcagcagcctgca

SEQ ID NO: 5739374 - DNA, 21 bp, Homo sapiens
gacagcagcagcctgcacctg

SEQ ID NO: 5739375 - DNA, 15 bp, Homo sapiens
gacagcagcctccct

SEQ ID NO: 5739376 - DNA, 13 bp, Homo sapiens
gacagcagcctgt

SEQ ID NO: 5739377 - DNA, 15 bp, Homo sapiens
gacagcagcctgtat

SEQ ID NO: 5739378 - DNA, 18 bp, Homo sapiens
gacagcagcctgtatgtg

SEQ ID NO: 5739379 - DNA, 15 bp, Homo sapiens
gacagcagcctgtga

SEQ ID NO: 5739380 - DNA, 15 bp, Homo sapiens
gacagcagctcaggc

SEQ ID NO: 5739381 - DNA, 14 bp, Homo sapiens
gacagcagctggac

SEQ ID NO: 5739382 - DNA, 21 bp, Homo sapiens
gacagcagctggactgggtgg

SEQ ID NO: 5739383 - DNA, 20 bp, Homo sapiens
gacagcagctggtgccccac

SEQ ID NO: 5739384 - DNA, 12 bp, Homo sapiens
gacagcaggtgt

SEQ ID NO: 5739385 - DNA, 20 bp, Homo sapiens
gacagcagtatcacaggcca

SEQ ID NO: 5739386 - DNA, 22 bp, Homo sapiens
gacagcagtcttatgcttccag

SEQ ID NO: 5739387 - DNA, 23 bp, Homo sapiens
gacagcagtcttcttcacccgct

SEQ ID NO: 5739388 - DNA, 16 bp, Homo sapiens
gacagcagtgtgaggg

SEQ ID NO: 5739389 - DNA, 21 bp, Homo sapiens
gacagcagtttgagcttgctg

SEQ ID NO: 5739390 - DNA, 23 bp, Homo sapiens
gacagcatcccttcccacatgcc

SEQ ID NO: 5739391 - DNA, 20 bp, Homo sapiens
gacagcatgccccttggctg

SEQ ID NO: 5739392 - DNA, 22 bp, Homo sapiens
gacagcatgccccttggctgga

SEQ ID NO: 5739393 - DNA, 18 bp, Homo sapiens
gacagcatggtgcatgcc

SEQ ID NO: 5739394 - DNA, 21 bp, Homo sapiens
gacagcatggtgcatgccgct

SEQ ID NO: 5739395 - DNA, 22 bp, Homo sapiens
gacagcatggtgcatgccgctg

SEQ ID NO: 5739396 - DNA, 21 bp, Homo sapiens
gacagcatgtgccctcctgag

SEQ ID NO: 5739397 - DNA, 13 bp, Homo sapiens
gacagcatttaaa

SEQ ID NO: 5739398 - DNA, 22 bp, Homo sapiens
gacagcattttaaggttctcag

SEQ ID NO: 5739399 - DNA, 19 bp, Homo sapiens
gacagccaactatggcctg

SEQ ID NO: 5739400 - DNA, 22 bp, Homo sapiens
gacagccaactatggcctgtgg

SEQ ID NO: 5739401 - DNA, 17 bp, Homo sapiens
gacagccacggccaggc

SEQ ID NO: 5739402 - DNA, 13 bp, Homo sapiens
gacagccagagcc

SEQ ID NO: 5739403 - DNA, 13 bp, Homo sapiens
gacagccagagct

SEQ ID NO: 5739404 - DNA, 15 bp, Homo sapiens
gacagccagagctgg

SEQ ID NO: 5739405 - DNA, 13 bp, Homo sapiens
gacagccagcagc

SEQ ID NO: 5739406 - DNA, 19 bp, Homo sapiens
gacagccagggcagggctt

SEQ ID NO: 5739407 - DNA, 20 bp, Homo sapiens
gacagccaggtggcacctgc

SEQ ID NO: 5739408 - DNA, 21 bp, Homo sapiens
gacagccaggtggcacctgca

SEQ ID NO: 5739409 - DNA, 15 bp, Homo sapiens
gacagccatgcgtgg

SEQ ID NO: 5739410 - DNA, 17 bp, Homo sapiens
gacagccatttgtaatg

SEQ ID NO: 5739411 - DNA, 18 bp, Homo sapiens
gacagcccaacttccaga

SEQ ID NO: 5739412 - DNA, 22 bp, Homo sapiens
gacagcccaacttccagaggac

SEQ ID NO: 5739413 - DNA, 13 bp, Homo sapiens
gacagcccagagc

SEQ ID NO: 5739414 - DNA, 22 bp, Homo sapiens
gacagcccaggatactggcaca

SEQ ID NO: 5739415 - DNA, 18 bp, Homo sapiens
gacagcccatcacctcta

SEQ ID NO: 5739416 - DNA, 14 bp, Homo sapiens
gacagccccaccct

SEQ ID NO: 5739417 - DNA, 20 bp, Homo sapiens
gacagccccagagcagggtg

SEQ ID NO: 5739418 - DNA, 14 bp, Homo sapiens
gacagccccctgcc

SEQ ID NO: 5739419 - DNA, 15 bp, Homo sapiens
gacagcccctccctc

SEQ ID NO: 5739420 - DNA, 17 bp, Homo sapiens
gacagcccgggctctgc

SEQ ID NO: 5739421 - DNA, 23 bp, Homo sapiens
gacagcccgggctctgcctccca

SEQ ID NO: 5739422 - DNA, 12 bp, Homo sapiens
gacagccctgcc

SEQ ID NO: 5739423 - DNA, 22 bp, Homo sapiens
gacagccctgcctatcctctgt

SEQ ID NO: 5739424 - DNA, 19 bp, Homo sapiens
gacagcctcagtgaccctg

SEQ ID NO: 5739425 - DNA, 21 bp, Homo sapiens
gacagcctccaccttgagcac

SEQ ID NO: 5739426 - DNA, 16 bp, Homo sapiens
gacagcctcccacccc

SEQ ID NO: 5739427 - DNA, 18 bp, Homo sapiens
gacagcctcttcagcccc

SEQ ID NO: 5739428 - DNA, 21 bp, Homo sapiens
gacagcctcttcagccccttc

SEQ ID NO: 5739429 - DNA, 22 bp, Homo sapiens
gacagcctcttctgtcccaagt

SEQ ID NO: 5739430 - DNA, 13 bp, Homo sapiens
gacagcctggcac

SEQ ID NO: 5739431 - DNA, 13 bp, Homo sapiens
gacagcctggggg

SEQ ID NO: 5739432 - DNA, 14 bp, Homo sapiens
gacagcctgtttct

SEQ ID NO: 5739433 - DNA, 16 bp, Homo sapiens
gacagccttgcaaccc

SEQ ID NO: 5739434 - DNA, 19 bp, Homo sapiens
gacagcgataagctttcaa

SEQ ID NO: 5739435 - DNA, 20 bp, Homo sapiens
gacagcgatggcaggcctga

SEQ ID NO: 5739436 - DNA, 14 bp, Homo sapiens
gacagcgccacctc

SEQ ID NO: 5739437 - DNA, 17 bp, Homo sapiens
gacagcgcccctgctgt

SEQ ID NO: 5739438 - DNA, 18 bp, Homo sapiens
gacagcgcccctgctgtc

SEQ ID NO: 5739439 - DNA, 21 bp, Homo sapiens
gacagcggccccgcggagccc

SEQ ID NO: 5739440 - DNA, 14 bp, Homo sapiens
gacagcggcccggc

SEQ ID NO: 5739441 - DNA, 17 bp, Homo sapiens
gacagcggcccggccca

SEQ ID NO: 5739442 - DNA, 22 bp, Homo sapiens
gacagcggcccggcccacgcag

SEQ ID NO: 5739443 - DNA, 13 bp, Homo sapiens
gacagcgggaaaa

SEQ ID NO: 5739444 - DNA, 15 bp, Homo sapiens
gacagcgggaaaaat

SEQ ID NO: 5739445 - DNA, 21 bp, Homo sapiens
gacagcggggaaggtttttat

SEQ ID NO: 5739446 - DNA, 19 bp, Homo sapiens
gacagcgggtaaaaagaga

SEQ ID NO: 5739447 - DNA, 21 bp, Homo sapiens
gacagcgggtaaaaagagaag

SEQ ID NO: 5739448 - DNA, 17 bp, Homo sapiens
gacagcggtcccagggg

SEQ ID NO: 5739449 - DNA, 22 bp, Homo sapiens
gacagcggtcccaggggcctga

SEQ ID NO: 5739450 - DNA, 15 bp, Homo sapiens
gacagcggttgtaaa

SEQ ID NO: 5739451 - DNA, 19 bp, Homo sapiens
gacagcggttgtaaataca

SEQ ID NO: 5739452 - DNA, 22 bp, Homo sapiens
gacagctactaacctggagaca

SEQ ID NO: 5739453 - DNA, 18 bp, Homo sapiens
gacagctaggctgagatg

SEQ ID NO: 5739454 - DNA, 16 bp, Homo sapiens
gacagctccctctgcc

SEQ ID NO: 5739455 - DNA, 20 bp, Homo sapiens
gacagctccgcgctcggggc

SEQ ID NO: 5739456 - DNA, 22 bp, Homo sapiens
gacagctccgcgctcggggctg

SEQ ID NO: 5739457 - DNA, 18 bp, Homo sapiens
gacagctccttctgtcct

SEQ ID NO: 5739458 - DNA, 17 bp, Homo sapiens
gacagctctctgggcac

SEQ ID NO: 5739459 - DNA, 15 bp, Homo sapiens
gacagctctgcctgt

SEQ ID NO: 5739460 - DNA, 12 bp, Homo sapiens
gacagctcttga

SEQ ID NO: 5739461 - DNA, 16 bp, Homo sapiens
gacagctctttttgtg

SEQ ID NO: 5739462 - DNA, 14 bp, Homo sapiens
gacagctgacagat

SEQ ID NO: 5739463 - DNA, 20 bp, Homo sapiens
gacagctgactgaatgcaga

SEQ ID NO: 5739464 - DNA, 17 bp, Homo sapiens
gacagctgatacttcat

SEQ ID NO: 5739465 - DNA, 14 bp, Homo sapiens
gacagctgcaagcc

SEQ ID NO: 5739466 - DNA, 19 bp, Homo sapiens
gacagctgcaagccaggga

SEQ ID NO: 5739467 - DNA, 20 bp, Homo sapiens
gacagctgcaagccagggat

SEQ ID NO: 5739468 - DNA, 11 bp, Homo sapiens
gacagctgcag

SEQ ID NO: 5739469 - DNA, 17 bp, Homo sapiens
gacagctgcaggtgccc

SEQ ID NO: 5739470 - DNA, 19 bp, Homo sapiens
gacagctgcattccagagc

SEQ ID NO: 5739471 - DNA, 12 bp, Homo sapiens
gacagctgccca

SEQ ID NO: 5739472 - DNA, 14 bp, Homo sapiens
gacagctgcctggg

SEQ ID NO: 5739473 - DNA, 16 bp, Homo sapiens
gacagctgcctgggat

SEQ ID NO: 5739474 - DNA, 18 bp, Homo sapiens
gacagctgcctgggatcc

SEQ ID NO: 5739475 - DNA, 14 bp, Homo sapiens
gacagctgctcaga

SEQ ID NO: 5739476 - DNA, 14 bp, Homo sapiens
gacagctgctccta

SEQ ID NO: 5739477 - DNA, 12 bp, Homo sapiens
gacagctgctgg

SEQ ID NO: 5739478 - DNA, 16 bp, Homo sapiens
gacagctgctgggacc

SEQ ID NO: 5739479 - DNA, 21 bp, Homo sapiens
gacagctgctgggacccacct

SEQ ID NO: 5739480 - DNA, 15 bp, Homo sapiens
gacagctgcttgtgg

SEQ ID NO: 5739481 - DNA, 13 bp, Homo sapiens
gacagctggaccc

SEQ ID NO: 5739482 - DNA, 14 bp, Homo sapiens
gacagctggctagc

SEQ ID NO: 5739483 - DNA, 12 bp, Homo sapiens
gacagctggctg

SEQ ID NO: 5739484 - DNA, 22 bp, Homo sapiens
gacagctggctgctgacaggat

SEQ ID NO: 5739485 - DNA, 14 bp, Homo sapiens
gacagctgtccctg

SEQ ID NO: 5739486 - DNA, 15 bp, Homo sapiens
gacagctgtccctgt

SEQ ID NO: 5739487 - DNA, 18 bp, Homo sapiens
gacagctgtccctgtcac

SEQ ID NO: 5739488 - DNA, 19 bp, Homo sapiens
gacagctgtccctgtcacc

SEQ ID NO: 5739489 - DNA, 16 bp, Homo sapiens
gacagctgtgccggga

SEQ ID NO: 5739490 - DNA, 13 bp, Homo sapiens
gacagctgtgcct

SEQ ID NO: 5739491 - DNA, 14 bp, Homo sapiens
gacagctgtgcctc

SEQ ID NO: 5739492 - DNA, 15 bp, Homo sapiens
gacagctgtgctgta

SEQ ID NO: 5739493 - DNA, 14 bp, Homo sapiens
gacagctgttccac

SEQ ID NO: 5739494 - DNA, 18 bp, Homo sapiens
gacagcttacaggagcca

SEQ ID NO: 5739495 - DNA, 19 bp, Homo sapiens
gacagcttacaggagccag

SEQ ID NO: 5739496 - DNA, 20 bp, Homo sapiens
gacagcttacaggagccagc

SEQ ID NO: 5739497 - DNA, 12 bp, Homo sapiens
gacagcttcctc

SEQ ID NO: 5739498 - DNA, 17 bp, Homo sapiens
gacagcttcctcacacc

SEQ ID NO: 5739499 - DNA, 22 bp, Homo sapiens
gacagcttcctcacacccctgt

SEQ ID NO: 5739500 - DNA, 13 bp, Homo sapiens
gacagcttggaaa

SEQ ID NO: 5739501 - DNA, 20 bp, Homo sapiens
gacagcttgtaggggagggg

SEQ ID NO: 5739502 - DNA, 21 bp, Homo sapiens
gacagctttattttaaatgtg

SEQ ID NO: 5739503 - DNA, 20 bp, Homo sapiens
gacagctttcccctcatttt

SEQ ID NO: 5739504 - DNA, 15 bp, Homo sapiens
gacagctttcctggg

SEQ ID NO: 5739505 - DNA, 16 bp, Homo sapiens
gacagctttctaactc

SEQ ID NO: 5739506 - DNA, 13 bp, Homo sapiens
gacagctttctgg

SEQ ID NO: 5739507 - DNA, 16 bp, Homo sapiens
gacagctttgctccgc

SEQ ID NO: 5739508 - DNA, 17 bp, Homo sapiens
gacagctttgctccgct

SEQ ID NO: 5739509 - DNA, 19 bp, Homo sapiens
gacagctttgctccgctcc

SEQ ID NO: 5739510 - DNA, 16 bp, Homo sapiens
gacagctttgctgctg

SEQ ID NO: 5739511 - DNA, 15 bp, Homo sapiens
gacagcttttctcaa

SEQ ID NO: 5739512 - DNA, 19 bp, Homo sapiens
gacaggaaaaaccaacagg

SEQ ID NO: 5739513 - DNA, 16 bp, Homo sapiens
gacaggaaagagagga

SEQ ID NO: 5739514 - DNA, 16 bp, Homo sapiens
gacaggaaagccctcc

SEQ ID NO: 5739515 - DNA, 17 bp, Homo sapiens
gacaggaaagccctccc

SEQ ID NO: 5739516 - DNA, 17 bp, Homo sapiens
gacaggaaagggaaggc

SEQ ID NO: 5739517 - DNA, 21 bp, Homo sapiens
gacaggaacacccagccccag

SEQ ID NO: 5739518 - DNA, 21 bp, Homo sapiens
gacaggaacccatcactgtgt

SEQ ID NO: 5739519 - DNA, 22 bp, Homo sapiens
gacaggaacccatcactgtgtc

SEQ ID NO: 5739520 - DNA, 14 bp, Homo sapiens
gacaggaagactgg

SEQ ID NO: 5739521 - DNA, 19 bp, Homo sapiens
gacaggaagactggagact

SEQ ID NO: 5739522 - DNA, 18 bp, Homo sapiens
gacaggaagcacagcagg

SEQ ID NO: 5739523 - DNA, 17 bp, Homo sapiens
gacaggaagctggcaga

SEQ ID NO: 5739524 - DNA, 14 bp, Homo sapiens
gacaggaaggaagc

SEQ ID NO: 5739525 - DNA, 17 bp, Homo sapiens
gacaggaaggtctgatt

SEQ ID NO: 5739526 - DNA, 16 bp, Homo sapiens
gacaggacagcatggt

SEQ ID NO: 5739527 - DNA, 15 bp, Homo sapiens
gacaggaccagggat

SEQ ID NO: 5739528 - DNA, 14 bp, Homo sapiens
gacaggaccccagc

SEQ ID NO: 5739529 - DNA, 16 bp, Homo sapiens
gacaggaccccagctc

SEQ ID NO: 5739530 - DNA, 17 bp, Homo sapiens
gacaggaccccagctct

SEQ ID NO: 5739531 - DNA, 19 bp, Homo sapiens
gacaggaccccagctctgc

SEQ ID NO: 5739532 - DNA, 14 bp, Homo sapiens
gacaggacccctgc

SEQ ID NO: 5739533 - DNA, 21 bp, Homo sapiens
gacaggacccctgcagttccc

SEQ ID NO: 5739534 - DNA, 11 bp, Homo sapiens
gacaggaccct

SEQ ID NO: 5739535 - DNA, 17 bp, Homo sapiens
gacaggaccctcaggaa

SEQ ID NO: 5739536 - DNA, 14 bp, Homo sapiens
gacaggacctagga

SEQ ID NO: 5739537 - DNA, 13 bp, Homo sapiens
gacaggacctgac

SEQ ID NO: 5739538 - DNA, 18 bp, Homo sapiens
gacaggacttgtgcgccg

SEQ ID NO: 5739539 - DNA, 23 bp, Homo sapiens
gacaggacttgtgcgccggcgcc

SEQ ID NO: 5739540 - DNA, 18 bp, Homo sapiens
gacaggagacctggcact

SEQ ID NO: 5739541 - DNA, 17 bp, Homo sapiens
gacaggagatcagcagc

SEQ ID NO: 5739542 - DNA, 17 bp, Homo sapiens
gacaggagatgctgtgc

SEQ ID NO: 5739543 - DNA, 13 bp, Homo sapiens
gacaggagcactg

SEQ ID NO: 5739544 - DNA, 14 bp, Homo sapiens
gacaggagcctagc

SEQ ID NO: 5739545 - DNA, 13 bp, Homo sapiens
gacaggagcctgg

SEQ ID NO: 5739546 - DNA, 17 bp, Homo sapiens
gacaggagcctggtcct

SEQ ID NO: 5739547 - DNA, 22 bp, Homo sapiens
gacaggaggagtgggacagaca

SEQ ID NO: 5739548 - DNA, 17 bp, Homo sapiens
gacaggaggcggcccgg

SEQ ID NO: 5739549 - DNA, 21 bp, Homo sapiens
gacaggaggcggcccggccag

SEQ ID NO: 5739550 - DNA, 22 bp, Homo sapiens
gacaggaggcggcccggccagc

SEQ ID NO: 5739551 - DNA, 20 bp, Homo sapiens
gacaggagggcaagggccat

SEQ ID NO: 5739552 - DNA, 18 bp, Homo sapiens
gacaggatccaggccggc

SEQ ID NO: 5739553 - DNA, 16 bp, Homo sapiens
gacaggatgaggacag

SEQ ID NO: 5739554 - DNA, 19 bp, Homo sapiens
gacaggatgaggacagagg

SEQ ID NO: 5739555 - DNA, 22 bp, Homo sapiens
gacaggatgaggacagagggca

SEQ ID NO: 5739556 - DNA, 14 bp, Homo sapiens
gacaggatgaggtc

SEQ ID NO: 5739557 - DNA, 18 bp, Homo sapiens
gacaggatgtggcactgc

SEQ ID NO: 5739558 - DNA, 14 bp, Homo sapiens
gacaggatgtgttt

SEQ ID NO: 5739559 - DNA, 19 bp, Homo sapiens
gacaggatgtgtttgcttt

SEQ ID NO: 5739560 - DNA, 18 bp, Homo sapiens
gacaggatgtttgctcag

SEQ ID NO: 5739561 - DNA, 23 bp, Homo sapiens
gacaggattgtctgctgcctcca

SEQ ID NO: 5739562 - DNA, 24 bp, Homo sapiens
gacaggattgtctgctgcctccaa

SEQ ID NO: 5739563 - DNA, 22 bp, Homo sapiens
gacaggatttggccacactggg

SEQ ID NO: 5739564 - DNA, 18 bp, Homo sapiens
gacaggcaatgctggctg

SEQ ID NO: 5739565 - DNA, 19 bp, Homo sapiens
gacaggcaatgctggctgt

SEQ ID NO: 5739566 - DNA, 12 bp, Homo sapiens
gacaggcacaaa

SEQ ID NO: 5739567 - DNA, 14 bp, Homo sapiens
gacaggcacaaaat

SEQ ID NO: 5739568 - DNA, 14 bp, Homo sapiens
gacaggcagaaaga

SEQ ID NO: 5739569 - DNA, 15 bp, Homo sapiens
gacaggcagaaagag

SEQ ID NO: 5739570 - DNA, 14 bp, Homo sapiens
gacaggcagagctg

SEQ ID NO: 5739571 - DNA, 14 bp, Homo sapiens
gacaggcagcagag

SEQ ID NO: 5739572 - DNA, 17 bp, Homo sapiens
gacaggcagcccagcag

SEQ ID NO: 5739573 - DNA, 12 bp, Homo sapiens
gacaggcaggcc

SEQ ID NO: 5739574 - DNA, 21 bp, Homo sapiens
gacaggcaggccagatggccc

SEQ ID NO: 5739575 - DNA, 22 bp, Homo sapiens
gacaggcaggccagatggcccc

SEQ ID NO: 5739576 - DNA, 11 bp, Homo sapiens
gacaggcagtt

SEQ ID NO: 5739577 - DNA, 19 bp, Homo sapiens
gacaggcatgttctctgag

SEQ ID NO: 5739578 - DNA, 20 bp, Homo sapiens
gacaggcatgttctctgagg

SEQ ID NO: 5739579 - DNA, 21 bp, Homo sapiens
gacaggcatgttctctgagga

SEQ ID NO: 5739580 - DNA, 15 bp, Homo sapiens
gacaggccaggtggt

SEQ ID NO: 5739581 - DNA, 11 bp, Homo sapiens
gacaggcccaa

SEQ ID NO: 5739582 - DNA, 18 bp, Homo sapiens
gacaggcccaagagatga

SEQ ID NO: 5739583 - DNA, 22 bp, Homo sapiens
gacaggcccaagagatgaagag

SEQ ID NO: 5739584 - DNA, 21 bp, Homo sapiens
gacaggcccagcgcggccagc

SEQ ID NO: 5739585 - DNA, 15 bp, Homo sapiens
gacaggccctccctg

SEQ ID NO: 5739586 - DNA, 15 bp, Homo sapiens
gacaggcctcacctc

SEQ ID NO: 5739587 - DNA, 21 bp, Homo sapiens
gacaggccttcctcctctcaa

SEQ ID NO: 5739588 - DNA, 17 bp, Homo sapiens
gacaggcgaaagaaaac

SEQ ID NO: 5739589 - DNA, 23 bp, Homo sapiens
gacaggcgagagaggagccagac

SEQ ID NO: 5739590 - DNA, 15 bp, Homo sapiens
gacaggcgccgcctc

SEQ ID NO: 5739591 - DNA, 16 bp, Homo sapiens
gacaggcgccgcctcg

SEQ ID NO: 5739592 - DNA, 22 bp, Homo sapiens
gacaggctacaaagcagagatc

SEQ ID NO: 5739593 - DNA, 14 bp, Homo sapiens
gacaggctcgtcag

SEQ ID NO: 5739594 - DNA, 22 bp, Homo sapiens
gacaggctcgtcagccacctgg

SEQ ID NO: 5739595 - DNA, 14 bp, Homo sapiens
gacaggctctcctg

SEQ ID NO: 5739596 - DNA, 17 bp, Homo sapiens
gacaggctcttagcagc

SEQ ID NO: 5739597 - DNA, 19 bp, Homo sapiens
gacaggctcttagcagctt

SEQ ID NO: 5739598 - DNA, 20 bp, Homo sapiens
gacaggctcttctttcccaa

SEQ ID NO: 5739599 - DNA, 18 bp, Homo sapiens
gacaggctgcggcccctc

SEQ ID NO: 5739600 - DNA, 22 bp, Homo sapiens
gacaggctgcggcccctccccc

SEQ ID NO: 5739601 - DNA, 23 bp, Homo sapiens
gacaggctgcggcccctcccccg

SEQ ID NO: 5739602 - DNA, 17 bp, Homo sapiens
gacaggctggaatgagg

SEQ ID NO: 5739603 - DNA, 22 bp, Homo sapiens
gacaggctggaatgagggaggc

SEQ ID NO: 5739604 - DNA, 12 bp, Homo sapiens
gacaggctgggt

SEQ ID NO: 5739605 - DNA, 14 bp, Homo sapiens
gacaggctggtgct

SEQ ID NO: 5739606 - DNA, 14 bp, Homo sapiens
gacagggaagctac

SEQ ID NO: 5739607 - DNA, 17 bp, Homo sapiens
gacagggaatagtggga

SEQ ID NO: 5739608 - DNA, 18 bp, Homo sapiens
gacagggaatgctgaggc

SEQ ID NO: 5739609 - DNA, 22 bp, Homo sapiens
gacagggaggccacacgcactg

SEQ ID NO: 5739610 - DNA, 15 bp, Homo sapiens
gacagggagggggac

SEQ ID NO: 5739611 - DNA, 22 bp, Homo sapiens
gacagggagggggacctgtccc

SEQ ID NO: 5739612 - DNA, 23 bp, Homo sapiens
gacagggagggggacctgtcccc

SEQ ID NO: 5739613 - DNA, 16 bp, Homo sapiens
gacagggaggtgaccc

SEQ ID NO: 5739614 - DNA, 21 bp, Homo sapiens
gacagggatgagcatggagct

SEQ ID NO: 5739615 - DNA, 15 bp, Homo sapiens
gacagggatgccaac

SEQ ID NO: 5739616 - DNA, 12 bp, Homo sapiens
gacagggcagag

SEQ ID NO: 5739617 - DNA, 15 bp, Homo sapiens
gacagggcatggcca

SEQ ID NO: 5739618 - DNA, 11 bp, Homo sapiens
gacagggccag

SEQ ID NO: 5739619 - DNA, 20 bp, Homo sapiens
gacagggccagtggggcctg

SEQ ID NO: 5739620 - DNA, 23 bp, Homo sapiens
gacagggcccccacaggggatgg

SEQ ID NO: 5739621 - DNA, 16 bp, Homo sapiens
gacagggcgggggtgg

SEQ ID NO: 5739622 - DNA, 16 bp, Homo sapiens
gacagggctccagcct

SEQ ID NO: 5739623 - DNA, 17 bp, Homo sapiens
gacagggctccagcctg

SEQ ID NO: 5739624 - DNA, 17 bp, Homo sapiens
gacagggctgagcgtgg

SEQ ID NO: 5739625 - DNA, 15 bp, Homo sapiens
gacagggctggccca

SEQ ID NO: 5739626 - DNA, 17 bp, Homo sapiens
gacagggctggcccagc

SEQ ID NO: 5739627 - DNA, 19 bp, Homo sapiens
gacagggctggcccagccc

SEQ ID NO: 5739628 - DNA, 22 bp, Homo sapiens
gacagggctggcccagccctgc

SEQ ID NO: 5739629 - DNA, 16 bp, Homo sapiens
gacagggctggctcct

SEQ ID NO: 5739630 - DNA, 18 bp, Homo sapiens
gacagggctggctcctct

SEQ ID NO: 5739631 - DNA, 19 bp, Homo sapiens
gacagggctggctcctctg

SEQ ID NO: 5739632 - DNA, 10 bp, Homo sapiens
gacagggctt

SEQ ID NO: 5739633 - DNA, 13 bp, Homo sapiens
gacagggcttctc

SEQ ID NO: 5739634 - DNA, 15 bp, Homo sapiens
gacagggcttctcct

SEQ ID NO: 5739635 - DNA, 17 bp, Homo sapiens
gacagggcttctcctgc

SEQ ID NO: 5739636 - DNA, 18 bp, Homo sapiens
gacagggcttctcctgcg

SEQ ID NO: 5739637 - DNA, 19 bp, Homo sapiens
gacaggggcgcttgggagg

SEQ ID NO: 5739638 - DNA, 15 bp, Homo sapiens
gacaggggctcagga

SEQ ID NO: 5739639 - DNA, 23 bp, Homo sapiens
gacagggggaagttcagaaggtg

SEQ ID NO: 5739640 - DNA, 14 bp, Homo sapiens
gacagggggtggga

SEQ ID NO: 5739641 - DNA, 21 bp, Homo sapiens
gacaggggttccttctgggca

SEQ ID NO: 5739642 - DNA, 14 bp, Homo sapiens
gacagggtctcact

SEQ ID NO: 5739643 - DNA, 22 bp, Homo sapiens
gacagggtctcactctgtcgct

SEQ ID NO: 5739644 - DNA, 18 bp, Homo sapiens
gacagggtctcactgtgt

SEQ ID NO: 5739645 - DNA, 20 bp, Homo sapiens
gacagggtcttgctctgtcc

SEQ ID NO: 5739646 - DNA, 22 bp, Homo sapiens
gacagggtgaataaagcaggga

SEQ ID NO: 5739647 - DNA, 19 bp, Homo sapiens
gacagggtgggagggagga

SEQ ID NO: 5739648 - DNA, 22 bp, Homo sapiens
gacagggtgggagggaggaggg

SEQ ID NO: 5739649 - DNA, 14 bp, Homo sapiens
gacagggtgggctt

SEQ ID NO: 5739650 - DNA, 16 bp, Homo sapiens
gacagggtgggcttcc

SEQ ID NO: 5739651 - DNA, 20 bp, Homo sapiens
gacagggttttgccatgttg

SEQ ID NO: 5739652 - DNA, 14 bp, Homo sapiens
gacaggtaaattaa

SEQ ID NO: 5739653 - DNA, 16 bp, Homo sapiens
gacaggtaagtggcag

SEQ ID NO: 5739654 - DNA, 18 bp, Homo sapiens
gacaggtaagtggcagga

SEQ ID NO: 5739655 - DNA, 13 bp, Homo sapiens
gacaggtctctga

SEQ ID NO: 5739656 - DNA, 16 bp, Homo sapiens
gacaggtctctgagac

SEQ ID NO: 5739657 - DNA, 15 bp, Homo sapiens
gacaggtcttttcaa

SEQ ID NO: 5739658 - DNA, 16 bp, Homo sapiens
gacaggtgacagtggc

SEQ ID NO: 5739659 - DNA, 17 bp, Homo sapiens
gacaggtgacagtggct

SEQ ID NO: 5739660 - DNA, 18 bp, Homo sapiens
gacaggtgacagtggctg

SEQ ID NO: 5739661 - DNA, 18 bp, Homo sapiens
gacaggtgatgctctggc

SEQ ID NO: 5739662 - DNA, 20 bp, Homo sapiens
gacaggtgatgctctggctt

SEQ ID NO: 5739663 - DNA, 21 bp, Homo sapiens
gacaggtgcctaacctgggac

SEQ ID NO: 5739664 - DNA, 13 bp, Homo sapiens
gacaggtgcctgg

SEQ ID NO: 5739665 - DNA, 23 bp, Homo sapiens
gacaggtgcctggggctggctgc

SEQ ID NO: 5739666 - DNA, 20 bp, Homo sapiens
gacaggtggaggcgagccag

SEQ ID NO: 5739667 - DNA, 16 bp, Homo sapiens
gacaggtgggcctggc

SEQ ID NO: 5739668 - DNA, 18 bp, Homo sapiens
gacaggtgggcctggcgg

SEQ ID NO: 5739669 - DNA, 20 bp, Homo sapiens
gacaggtgggcctggcggcc

SEQ ID NO: 5739670 - DNA, 21 bp, Homo sapiens
gacaggtgggcctggcggcct

SEQ ID NO: 5739671 - DNA, 17 bp, Homo sapiens
gacaggtgggcctggga

SEQ ID NO: 5739672 - DNA, 19 bp, Homo sapiens
gacaggtggggcctcagcc

SEQ ID NO: 5739673 - DNA, 15 bp, Homo sapiens
gacaggtgtgagcca

SEQ ID NO: 5739674 - DNA, 15 bp, Homo sapiens
gacaggttcccagca

SEQ ID NO: 5739675 - DNA, 17 bp, Homo sapiens
gacaggttcccagcagc

SEQ ID NO: 5739676 - DNA, 18 bp, Homo sapiens
gacaggttcccagcagct

SEQ ID NO: 5739677 - DNA, 19 bp, Homo sapiens
gacaggttcccagcagctg

SEQ ID NO: 5739678 - DNA, 16 bp, Homo sapiens
gacagtaacacaatta

SEQ ID NO: 5739679 - DNA, 17 bp, Homo sapiens
gacagtaagagtttaca

SEQ ID NO: 5739680 - DNA, 18 bp, Homo sapiens
gacagtaattgtgtttac

SEQ ID NO: 5739681 - DNA, 22 bp, Homo sapiens
gacagtaattgtgtttacattt

SEQ ID NO: 5739682 - DNA, 16 bp, Homo sapiens
gacagtagctcttaga

SEQ ID NO: 5739683 - DNA, 22 bp, Homo sapiens
gacagtatcactctaatataat

SEQ ID NO: 5739684 - DNA, 16 bp, Homo sapiens
gacagtatcccacatc

SEQ ID NO: 5739685 - DNA, 19 bp, Homo sapiens
gacagtatcgtttgtttat

SEQ ID NO: 5739686 - DNA, 22 bp, Homo sapiens
gacagtattaagggtaggatgt

SEQ ID NO: 5739687 - DNA, 16 bp, Homo sapiens
gacagtattgccacct

SEQ ID NO: 5739688 - DNA, 21 bp, Homo sapiens
gacagtatttattggtgggtt

SEQ ID NO: 5739689 - DNA, 17 bp, Homo sapiens
gacagtcaaggagtggc

SEQ ID NO: 5739690 - DNA, 16 bp, Homo sapiens
gacagtcaccccagga

SEQ ID NO: 5739691 - DNA, 23 bp, Homo sapiens
gacagtcactgcatttgcctgct

SEQ ID NO: 5739692 - DNA, 18 bp, Homo sapiens
gacagtcagctgtgggga

SEQ ID NO: 5739693 - DNA, 20 bp, Homo sapiens
gacagtcatcatcagggcct

SEQ ID NO: 5739694 - DNA, 19 bp, Homo sapiens
gacagtccacaggggccac

SEQ ID NO: 5739695 - DNA, 15 bp, Homo sapiens
gacagtccagtgtca

SEQ ID NO: 5739696 - DNA, 16 bp, Homo sapiens
gacagtcccagttccc

SEQ ID NO: 5739697 - DNA, 12 bp, Homo sapiens
gacagtccctgc

SEQ ID NO: 5739698 - DNA, 15 bp, Homo sapiens
gacagtccctgctgg

SEQ ID NO: 5739699 - DNA, 17 bp, Homo sapiens
gacagtccgcagttgta

SEQ ID NO: 5739700 - DNA, 15 bp, Homo sapiens
gacagtcctccatcc

SEQ ID NO: 5739701 - DNA, 17 bp, Homo sapiens
gacagtcctccatccac

SEQ ID NO: 5739702 - DNA, 15 bp, Homo sapiens
gacagtcctctccac

SEQ ID NO: 5739703 - DNA, 24 bp, Homo sapiens
gacagtcctctccacctagtggct

SEQ ID NO: 5739704 - DNA, 22 bp, Homo sapiens
gacagtccttggggttaagtct

SEQ ID NO: 5739705 - DNA, 23 bp, Homo sapiens
gacagtcctttcccaccattcct

SEQ ID NO: 5739706 - DNA, 21 bp, Homo sapiens
gacagtcggtgaccccatcac

SEQ ID NO: 5739707 - DNA, 16 bp, Homo sapiens
gacagtctccctgatg

SEQ ID NO: 5739708 - DNA, 10 bp, Homo sapiens
gacagtctga

SEQ ID NO: 5739709 - DNA, 23 bp, Homo sapiens
gacagtctgctctagatgagctg

SEQ ID NO: 5739710 - DNA, 13 bp, Homo sapiens
gacagtctggaaa

SEQ ID NO: 5739711 - DNA, 16 bp, Homo sapiens
gacagtctgttatgca

SEQ ID NO: 5739712 - DNA, 20 bp, Homo sapiens
gacagtctgttatgcactgt

SEQ ID NO: 5739713 - DNA, 13 bp, Homo sapiens
gacagtcttgtgc

SEQ ID NO: 5739714 - DNA, 19 bp, Homo sapiens
gacagtgaagcagcactgt

SEQ ID NO: 5739715 - DNA, 21 bp, Homo sapiens
gacagtgaagcagcactgtga

SEQ ID NO: 5739716 - DNA, 22 bp, Homo sapiens
gacagtgacctctctaggtgtg

SEQ ID NO: 5739717 - DNA, 18 bp, Homo sapiens
gacagtgacgtgactcag

SEQ ID NO: 5739718 - DNA, 21 bp, Homo sapiens
gacagtgacgtgactcagagc

SEQ ID NO: 5739719 - DNA, 19 bp, Homo sapiens
gacagtgagacagtctgga

SEQ ID NO: 5739720 - DNA, 15 bp, Homo sapiens
gacagtgagaggata

SEQ ID NO: 5739721 - DNA, 21 bp, Homo sapiens
gacagtgataggcccaaggtc

SEQ ID NO: 5739722 - DNA, 15 bp, Homo sapiens
gacagtgcacatgaa

SEQ ID NO: 5739723 - DNA, 11 bp, Homo sapiens
gacagtgcccc

SEQ ID NO: 5739724 - DNA, 18 bp, Homo sapiens
gacagtgccccgggaacc

SEQ ID NO: 5739725 - DNA, 16 bp, Homo sapiens
gacagtgcccttggtg

SEQ ID NO: 5739726 - DNA, 22 bp, Homo sapiens
gacagtgcctcttccagtgaac

SEQ ID NO: 5739727 - DNA, 17 bp, Homo sapiens
gacagtgcgttgcaact

SEQ ID NO: 5739728 - DNA, 19 bp, Homo sapiens
gacagtgctgaccccagga

SEQ ID NO: 5739729 - DNA, 15 bp, Homo sapiens
gacagtgctgccctg

SEQ ID NO: 5739730 - DNA, 17 bp, Homo sapiens
gacagtgctgccctgcg

SEQ ID NO: 5739731 - DNA, 17 bp, Homo sapiens
gacagtgctgttgaaga

SEQ ID NO: 5739732 - DNA, 16 bp, Homo sapiens
gacagtgcttcagcct

SEQ ID NO: 5739733 - DNA, 14 bp, Homo sapiens
gacagtgcttgcat

SEQ ID NO: 5739734 - DNA, 23 bp, Homo sapiens
gacagtggatatgacccacactg

SEQ ID NO: 5739735 - DNA, 13 bp, Homo sapiens
gacagtggcacta

SEQ ID NO: 5739736 - DNA, 15 bp, Homo sapiens
gacagtggcactaaa

SEQ ID NO: 5739737 - DNA, 14 bp, Homo sapiens
gacagtggcagcaa

SEQ ID NO: 5739738 - DNA, 22 bp, Homo sapiens
gacagtggcagcaaaggaagac

SEQ ID NO: 5739739 - DNA, 15 bp, Homo sapiens
gacagtggcaggaca

SEQ ID NO: 5739740 - DNA, 14 bp, Homo sapiens
gacagtggctctcc

SEQ ID NO: 5739741 - DNA, 13 bp, Homo sapiens
gacagtggctgct

SEQ ID NO: 5739742 - DNA, 15 bp, Homo sapiens
gacagtgggaaatat

SEQ ID NO: 5739743 - DNA, 12 bp, Homo sapiens
gacagtgggcag

SEQ ID NO: 5739744 - DNA, 23 bp, Homo sapiens
gacagtgggggtgcctggtgcgc

SEQ ID NO: 5739745 - DNA, 22 bp, Homo sapiens
gacagtgtatggggctgcagtt

SEQ ID NO: 5739746 - DNA, 15 bp, Homo sapiens
gacagtgtcagagtc

SEQ ID NO: 5739747 - DNA, 17 bp, Homo sapiens
gacagtgtgggacaggc

SEQ ID NO: 5739748 - DNA, 15 bp, Homo sapiens
gacagtgtgggcgct

SEQ ID NO: 5739749 - DNA, 21 bp, Homo sapiens
gacagtgttccccgataccat

SEQ ID NO: 5739750 - DNA, 21 bp, Homo sapiens
gacagttatactgtcggtttt

SEQ ID NO: 5739751 - DNA, 17 bp, Homo sapiens
gacagttcacaccctgc

SEQ ID NO: 5739752 - DNA, 18 bp, Homo sapiens
gacagttcacaccctgca

SEQ ID NO: 5739753 - DNA, 18 bp, Homo sapiens
gacagttcagagatcagg

SEQ ID NO: 5739754 - DNA, 15 bp, Homo sapiens
gacagttcatatgta

SEQ ID NO: 5739755 - DNA, 16 bp, Homo sapiens
gacagttcccagagtg

SEQ ID NO: 5739756 - DNA, 20 bp, Homo sapiens
gacagttcccagagtgggct

SEQ ID NO: 5739757 - DNA, 17 bp, Homo sapiens
gacagttcctgagacca

SEQ ID NO: 5739758 - DNA, 14 bp, Homo sapiens
gacagttctgaaga

SEQ ID NO: 5739759 - DNA, 19 bp, Homo sapiens
gacagttgaacagagctag

SEQ ID NO: 5739760 - DNA, 15 bp, Homo sapiens
gacagttgatggagc

SEQ ID NO: 5739761 - DNA, 17 bp, Homo sapiens
gacagttgatggagccc

SEQ ID NO: 5739762 - DNA, 19 bp, Homo sapiens
gacagttgatggagcccca

SEQ ID NO: 5739763 - DNA, 22 bp, Homo sapiens
gacagttgatggagccccaggg

SEQ ID NO: 5739764 - DNA, 20 bp, Homo sapiens
gacagttggagggaaagcca

SEQ ID NO: 5739765 - DNA, 15 bp, Homo sapiens
gacagttggcagaga

SEQ ID NO: 5739766 - DNA, 23 bp, Homo sapiens
gacagttggcagagaaggcctct

SEQ ID NO: 5739767 - DNA, 18 bp, Homo sapiens
gacagttgggtgagaaca

SEQ ID NO: 5739768 - DNA, 16 bp, Homo sapiens
gacagttgtttggaga

SEQ ID NO: 5739769 - DNA, 18 bp, Homo sapiens
gacagtttactttgccaa

SEQ ID NO: 5739770 - DNA, 18 bp, Homo sapiens
gacagtttatcatgaagc

SEQ ID NO: 5739771 - DNA, 20 bp, Homo sapiens
gacagtttatcatgaagcct

SEQ ID NO: 5739772 - DNA, 16 bp, Homo sapiens
gacagtttatttgttg

SEQ ID NO: 5739773 - DNA, 20 bp, Homo sapiens
gacagtttcttagcttttta

SEQ ID NO: 5739774 - DNA, 23 bp, Homo sapiens
gacagtttcttagctttttaatt

SEQ ID NO: 5739775 - DNA, 23 bp, Homo sapiens
gacagtttcttgcaagctccagt

SEQ ID NO: 5739776 - DNA, 20 bp, Homo sapiens
gacagtttgtaaatgttatt

SEQ ID NO: 5739777 - DNA, 14 bp, Homo sapiens
gacagtttgtttcc

SEQ ID NO: 5739778 - DNA, 15 bp, Homo sapiens
gacagtttgtttcct

SEQ ID NO: 5739779 - DNA, 16 bp, Homo sapiens
gacagtttgtttcctg

SEQ ID NO: 5739780 - DNA, 16 bp, Homo sapiens
gacagttttcaccatc

SEQ ID NO: 5739781 - DNA, 17 bp, Homo sapiens
gacagttttccaaactg

SEQ ID NO: 5739782 - DNA, 22 bp, Homo sapiens
gacagttttccttctcatctgt

SEQ ID NO: 5739783 - DNA, 15 bp, Homo sapiens
gacagtttttgacat

SEQ ID NO: 5739784 - DNA, 17 bp, Homo sapiens
gacataaaaacaacttt

SEQ ID NO: 5739785 - DNA, 14 bp, Homo sapiens
gacataaaacagaa

SEQ ID NO: 5739786 - DNA, 14 bp, Homo sapiens
gacataaaacttta

SEQ ID NO: 5739787 - DNA, 17 bp, Homo sapiens
gacataaaactttaaaa

SEQ ID NO: 5739788 - DNA, 22 bp, Homo sapiens
gacataaaactttaaaaggcaa

SEQ ID NO: 5739789 - DNA, 14 bp, Homo sapiens
gacataaaatttaa

SEQ ID NO: 5739790 - DNA, 11 bp, Homo sapiens
gacataaagcc

SEQ ID NO: 5739791 - DNA, 12 bp, Homo sapiens
gacataaagcca

SEQ ID NO: 5739792 - DNA, 18 bp, Homo sapiens
gacataaagccatgtttc

SEQ ID NO: 5739793 - DNA, 15 bp, Homo sapiens
gacataaaggaaaag

SEQ ID NO: 5739794 - DNA, 17 bp, Homo sapiens
gacataaagttgataaa

SEQ ID NO: 5739795 - DNA, 23 bp, Homo sapiens
gacataaccaacattaaaactca

SEQ ID NO: 5739796 - DNA, 16 bp, Homo sapiens
gacataacgtttttcc

SEQ ID NO: 5739797 - DNA, 21 bp, Homo sapiens
gacataacgtttttcctttaa

SEQ ID NO: 5739798 - DNA, 19 bp, Homo sapiens
gacataactatctttttga

SEQ ID NO: 5739799 - DNA, 14 bp, Homo sapiens
gacataagataaaa

SEQ ID NO: 5739800 - DNA, 16 bp, Homo sapiens
gacataataaagtatt

SEQ ID NO: 5739801 - DNA, 20 bp, Homo sapiens
gacataataaagtattttct

SEQ ID NO: 5739802 - DNA, 22 bp, Homo sapiens
gacataataaagtattttcttt

SEQ ID NO: 5739803 - DNA, 15 bp, Homo sapiens
gacataattgtccag

SEQ ID NO: 5739804 - DNA, 16 bp, Homo sapiens
gacataatttcactga

SEQ ID NO: 5739805 - DNA, 22 bp, Homo sapiens
gacatacagctgcctacctaat

SEQ ID NO: 5739806 - DNA, 12 bp, Homo sapiens
gacatacgaaac

SEQ ID NO: 5739807 - DNA, 23 bp, Homo sapiens
gacatactaaccagcagaaatgc

SEQ ID NO: 5739808 - DNA, 22 bp, Homo sapiens
gacatactctctgcctggtggt

SEQ ID NO: 5739809 - DNA, 16 bp, Homo sapiens
gacatactgctggagt

SEQ ID NO: 5739810 - DNA, 18 bp, Homo sapiens
gacatacttgaagggcca

SEQ ID NO: 5739811 - DNA, 23 bp, Homo sapiens
gacatacttgaagggccagagcc

SEQ ID NO: 5739812 - DNA, 22 bp, Homo sapiens
gacatagaatctgtgacctctg

SEQ ID NO: 5739813 - DNA, 20 bp, Homo sapiens
gacatagaattaacacatga

SEQ ID NO: 5739814 - DNA, 21 bp, Homo sapiens
gacatagagagggagaagaag

SEQ ID NO: 5739815 - DNA, 22 bp, Homo sapiens
gacatagagagggagaagaagt

SEQ ID NO: 5739816 - DNA, 23 bp, Homo sapiens
gacatagcacgaatctgttacca

SEQ ID NO: 5739817 - DNA, 21 bp, Homo sapiens
gacatagcatcttgtggcttt

SEQ ID NO: 5739818 - DNA, 22 bp, Homo sapiens
gacatagcccatccctgcctgg

SEQ ID NO: 5739819 - DNA, 20 bp, Homo sapiens
gacataggtcataaagcatt

SEQ ID NO: 5739820 - DNA, 16 bp, Homo sapiens
gacatagtctggctgt

SEQ ID NO: 5739821 - DNA, 19 bp, Homo sapiens
gacatagtggatggacaga

SEQ ID NO: 5739822 - DNA, 20 bp, Homo sapiens
gacatagtggatggacagat

SEQ ID NO: 5739823 - DNA, 23 bp, Homo sapiens
gacatagtggatggacagatgga

SEQ ID NO: 5739824 - DNA, 11 bp, Homo sapiens
gacatatatag

SEQ ID NO: 5739825 - DNA, 18 bp, Homo sapiens
gacatatattatatatag

SEQ ID NO: 5739826 - DNA, 17 bp, Homo sapiens
gacatatattttttaaa

SEQ ID NO: 5739827 - DNA, 18 bp, Homo sapiens
gacatatcacatgtcagc

SEQ ID NO: 5739828 - DNA, 20 bp, Homo sapiens
gacatatcactgctgctggg

SEQ ID NO: 5739829 - DNA, 21 bp, Homo sapiens
gacatatgggatattcccaag

SEQ ID NO: 5739830 - DNA, 13 bp, Homo sapiens
gacatattatgcc

SEQ ID NO: 5739831 - DNA, 20 bp, Homo sapiens
gacatattatgcctgaatga

SEQ ID NO: 5739832 - DNA, 12 bp, Homo sapiens
gacatattcaag

SEQ ID NO: 5739833 - DNA, 15 bp, Homo sapiens
gacatattcttggag

SEQ ID NO: 5739834 - DNA, 12 bp, Homo sapiens
gacatatttaat

SEQ ID NO: 5739835 - DNA, 20 bp, Homo sapiens
gacatatttaatgttttaaa

SEQ ID NO: 5739836 - DNA, 13 bp, Homo sapiens
gacatatttcagt

SEQ ID NO: 5739837 - DNA, 18 bp, Homo sapiens
gacatcaaaaaaggcagt

SEQ ID NO: 5739838 - DNA, 19 bp, Homo sapiens
gacatcaaaaaaggcagtt

SEQ ID NO: 5739839 - DNA, 14 bp, Homo sapiens
gacatcaaaacttg

SEQ ID NO: 5739840 - DNA, 12 bp, Homo sapiens
gacatcaaaatc

SEQ ID NO: 5739841 - DNA, 16 bp, Homo sapiens
gacatcaaagcctggc

SEQ ID NO: 5739842 - DNA, 18 bp, Homo sapiens
gacatcaaagcctggcct

SEQ ID NO: 5739843 - DNA, 23 bp, Homo sapiens
gacatcaaagtggtaaatactgt

SEQ ID NO: 5739844 - DNA, 14 bp, Homo sapiens
gacatcaagtgtaa

SEQ ID NO: 5739845 - DNA, 16 bp, Homo sapiens
gacatcaagtgtaatt

SEQ ID NO: 5739846 - DNA, 13 bp, Homo sapiens
gacatcaatgaaa

SEQ ID NO: 5739847 - DNA, 13 bp, Homo sapiens
gacatcacagcag

SEQ ID NO: 5739848 - DNA, 15 bp, Homo sapiens
gacatcacagggtgg

SEQ ID NO: 5739849 - DNA, 19 bp, Homo sapiens
gacatcacagggtgggcct

SEQ ID NO: 5739850 - DNA, 15 bp, Homo sapiens
gacatcacttgtaca

SEQ ID NO: 5739851 - DNA, 20 bp, Homo sapiens
gacatcagaggttctttgag

SEQ ID NO: 5739852 - DNA, 12 bp, Homo sapiens
gacatcagattt

SEQ ID NO: 5739853 - DNA, 14 bp, Homo sapiens
gacatcagatttct

SEQ ID NO: 5739854 - DNA, 19 bp, Homo sapiens
gacatcagatttcttaatg

SEQ ID NO: 5739855 - DNA, 14 bp, Homo sapiens
gacatcagcaaaca

SEQ ID NO: 5739856 - DNA, 17 bp, Homo sapiens
gacatcagccagctgcc

SEQ ID NO: 5739857 - DNA, 22 bp, Homo sapiens
gacatcagcccggtgtgaggag

SEQ ID NO: 5739858 - DNA, 13 bp, Homo sapiens
gacatcagctggt

SEQ ID NO: 5739859 - DNA, 16 bp, Homo sapiens
gacatcaggagactgg

SEQ ID NO: 5739860 - DNA, 13 bp, Homo sapiens
gacatcagggagt

SEQ ID NO: 5739861 - DNA, 23 bp, Homo sapiens
gacatcaggtgatccacctgcct

SEQ ID NO: 5739862 - DNA, 16 bp, Homo sapiens
gacatcaggtttttcc

SEQ ID NO: 5739863 - DNA, 13 bp, Homo sapiens
gacatcagtggca

SEQ ID NO: 5739864 - DNA, 18 bp, Homo sapiens
gacatcagtgtttgttgg

SEQ ID NO: 5739865 - DNA, 20 bp, Homo sapiens
gacatcatcattcttgtggg

SEQ ID NO: 5739866 - DNA, 19 bp, Homo sapiens
gacatcattgtcagccttg

SEQ ID NO: 5739867 - DNA, 14 bp, Homo sapiens
gacatccaaatcta

SEQ ID NO: 5739868 - DNA, 16 bp, Homo sapiens
gacatccataaagaag

SEQ ID NO: 5739869 - DNA, 17 bp, Homo sapiens
gacatccataaagaagc

SEQ ID NO: 5739870 - DNA, 19 bp, Homo sapiens
gacatccataaagaagcaa

SEQ ID NO: 5739871 - DNA, 23 bp, Homo sapiens
gacatccatgtttgtaaaactac

SEQ ID NO: 5739872 - DNA, 18 bp, Homo sapiens
gacatccccctccttgcc

SEQ ID NO: 5739873 - DNA, 18 bp, Homo sapiens
gacatccctcccccagca

SEQ ID NO: 5739874 - DNA, 16 bp, Homo sapiens
gacatcccttcctgga

SEQ ID NO: 5739875 - DNA, 21 bp, Homo sapiens
gacatccgtcattgctgctgc

SEQ ID NO: 5739876 - DNA, 23 bp, Homo sapiens
gacatccgtcccacatcagggcg

SEQ ID NO: 5739877 - DNA, 23 bp, Homo sapiens
gacatcctagccccacccagagg

SEQ ID NO: 5739878 - DNA, 18 bp, Homo sapiens
gacatcctcctcccaccc

SEQ ID NO: 5739879 - DNA, 17 bp, Homo sapiens
gacatccttgcagttta

SEQ ID NO: 5739880 - DNA, 16 bp, Homo sapiens
gacatcgtaggcagcc

SEQ ID NO: 5739881 - DNA, 19 bp, Homo sapiens
gacatctacctcccgacct

SEQ ID NO: 5739882 - DNA, 22 bp, Homo sapiens
gacatctacgaagccacaggcc

SEQ ID NO: 5739883 - DNA, 18 bp, Homo sapiens
gacatctcaggggccaga

SEQ ID NO: 5739884 - DNA, 20 bp, Homo sapiens
gacatctcaggggccagagg

SEQ ID NO: 5739885 - DNA, 17 bp, Homo sapiens
gacatctccagtgtgcc

SEQ ID NO: 5739886 - DNA, 21 bp, Homo sapiens
gacatctcctcaccccagtgc

SEQ ID NO: 5739887 - DNA, 23 bp, Homo sapiens
gacatctcctggctaagcctctg

SEQ ID NO: 5739888 - DNA, 15 bp, Homo sapiens
gacatctctctggct

SEQ ID NO: 5739889 - DNA, 17 bp, Homo sapiens
gacatctctctggcttc

SEQ ID NO: 5739890 - DNA, 18 bp, Homo sapiens
gacatctctctggcttct

SEQ ID NO: 5739891 - DNA, 19 bp, Homo sapiens
gacatctctctggcttctg

SEQ ID NO: 5739892 - DNA, 23 bp, Homo sapiens
gacatctctctggcttctgaaga

SEQ ID NO: 5739893 - DNA, 14 bp, Homo sapiens
gacatctctggagc

SEQ ID NO: 5739894 - DNA, 14 bp, Homo sapiens
gacatctgacccca

SEQ ID NO: 5739895 - DNA, 22 bp, Homo sapiens
gacatctgaggaaaatggaaga

SEQ ID NO: 5739896 - DNA, 20 bp, Homo sapiens
gacatctgattggcagatga

SEQ ID NO: 5739897 - DNA, 16 bp, Homo sapiens
gacatctgcctgtaat

SEQ ID NO: 5739898 - DNA, 20 bp, Homo sapiens
gacatctgcctgtaattaaa

SEQ ID NO: 5739899 - DNA, 14 bp, Homo sapiens
gacatctggaatct

SEQ ID NO: 5739900 - DNA, 21 bp, Homo sapiens
gacatctgtttctaaatgttt

SEQ ID NO: 5739901 - DNA, 16 bp, Homo sapiens
gacatcttagtatttg

SEQ ID NO: 5739902 - DNA, 20 bp, Homo sapiens
gacatcttcaaagcttgaag

SEQ ID NO: 5739903 - DNA, 13 bp, Homo sapiens
gacatcttctcaa

SEQ ID NO: 5739904 - DNA, 14 bp, Homo sapiens
gacatcttctcaac

SEQ ID NO: 5739905 - DNA, 17 bp, Homo sapiens
gacatgaaataaagaat

SEQ ID NO: 5739906 - DNA, 21 bp, Homo sapiens
gacatgaaataaagaatttaa

SEQ ID NO: 5739907 - DNA, 16 bp, Homo sapiens
gacatgaaatgaaaat

SEQ ID NO: 5739908 - DNA, 19 bp, Homo sapiens
gacatgaacgttttctctt

SEQ ID NO: 5739909 - DNA, 20 bp, Homo sapiens
gacatgaagattctttccca

SEQ ID NO: 5739910 - DNA, 13 bp, Homo sapiens
gacatgaagccac

SEQ ID NO: 5739911 - DNA, 13 bp, Homo sapiens
gacatgaaggaaa

SEQ ID NO: 5739912 - DNA, 22 bp, Homo sapiens
gacatgaaggtaggtaaatagg

SEQ ID NO: 5739913 - DNA, 14 bp, Homo sapiens
gacatgaatatgat

SEQ ID NO: 5739914 - DNA, 14 bp, Homo sapiens
gacatgacaatgca

SEQ ID NO: 5739915 - DNA, 16 bp, Homo sapiens
gacatgaccctctgtc

SEQ ID NO: 5739916 - DNA, 22 bp, Homo sapiens
gacatgaccctctgtccccagg

SEQ ID NO: 5739917 - DNA, 22 bp, Homo sapiens
gacatgacgtggtaaaatgtga

SEQ ID NO: 5739918 - DNA, 16 bp, Homo sapiens
gacatgagagtagggc

SEQ ID NO: 5739919 - DNA, 20 bp, Homo sapiens
gacatgagagtagggccctg

SEQ ID NO: 5739920 - DNA, 16 bp, Homo sapiens
gacatgagccaccgcg

SEQ ID NO: 5739921 - DNA, 21 bp, Homo sapiens
gacatgagtccaccctttgga

SEQ ID NO: 5739922 - DNA, 19 bp, Homo sapiens
gacatgagtctccagatag

SEQ ID NO: 5739923 - DNA, 13 bp, Homo sapiens
gacatgagtctgt

SEQ ID NO: 5739924 - DNA, 18 bp, Homo sapiens
gacatgatactgatgcca

SEQ ID NO: 5739925 - DNA, 13 bp, Homo sapiens
gacatgatgcttt

SEQ ID NO: 5739926 - DNA, 19 bp, Homo sapiens
gacatgatgcttttactga

SEQ ID NO: 5739927 - DNA, 14 bp, Homo sapiens
gacatgattccttc

SEQ ID NO: 5739928 - DNA, 22 bp, Homo sapiens
gacatgatttccttgaatgtgg

SEQ ID NO: 5739929 - DNA, 12 bp, Homo sapiens
gacatgcagtta

SEQ ID NO: 5739930 - DNA, 18 bp, Homo sapiens
gacatgcatgacacttcc

SEQ ID NO: 5739931 - DNA, 16 bp, Homo sapiens
gacatgcattgttggc

SEQ ID NO: 5739932 - DNA, 17 bp, Homo sapiens
gacatgcatttttaaaa

SEQ ID NO: 5739933 - DNA, 17 bp, Homo sapiens
gacatgcccaaaactta

SEQ ID NO: 5739934 - DNA, 19 bp, Homo sapiens
gacatgccctcccttctcc

SEQ ID NO: 5739935 - DNA, 17 bp, Homo sapiens
gacatgccctgtgtggc

SEQ ID NO: 5739936 - DNA, 22 bp, Homo sapiens
gacatgcctatatgagaagaat

SEQ ID NO: 5739937 - DNA, 19 bp, Homo sapiens
gacatgcctgtcctgaaag

SEQ ID NO: 5739938 - DNA, 20 bp, Homo sapiens
gacatgcgggctgggcagct

SEQ ID NO: 5739939 - DNA, 21 bp, Homo sapiens
gacatgcgggctgggcagctg

SEQ ID NO: 5739940 - DNA, 16 bp, Homo sapiens
gacatgcggtagccag

SEQ ID NO: 5739941 - DNA, 18 bp, Homo sapiens
gacatgcggtagccagca

SEQ ID NO: 5739942 - DNA, 22 bp, Homo sapiens
gacctgtcgtctctcccacccc

SEQ ID NO: 5739943 - DNA, 16 bp, Homo sapiens
gacctgtctcctggcg

SEQ ID NO: 5739944 - DNA, 15 bp, Homo sapiens
gacctgtgaccagca

SEQ ID NO: 5739945 - DNA, 17 bp, Homo sapiens
gacctgtgaccagcact

SEQ ID NO: 5739946 - DNA, 15 bp, Homo sapiens
gacctgtgagcccag

SEQ ID NO: 5739947 - DNA, 12 bp, Homo sapiens
gacctgtgaggg

SEQ ID NO: 5739948 - DNA, 13 bp, Homo sapiens
gacctgtgctagt

SEQ ID NO: 5739949 - DNA, 20 bp, Homo sapiens
gacctgtggggatttctccc

SEQ ID NO: 5739950 - DNA, 22 bp, Homo sapiens
gacctgtggggatttctcccag

SEQ ID NO: 5739951 - DNA, 23 bp, Homo sapiens
gacctgtggggatttctcccagc

SEQ ID NO: 5739952 - DNA, 19 bp, Homo sapiens
gacctgtgtcactacgtga

SEQ ID NO: 5739953 - DNA, 18 bp, Homo sapiens
gacctgtgttcttgctga

SEQ ID NO: 5739954 - DNA, 23 bp, Homo sapiens
gacctgtgttcttgctgagcacc

SEQ ID NO: 5739955 - DNA, 19 bp, Homo sapiens
gacctgttagcagacaggc

SEQ ID NO: 5739956 - DNA, 22 bp, Homo sapiens
gacctgttaggtctcatgccca

SEQ ID NO: 5739957 - DNA, 13 bp, Homo sapiens
gacctgttggcct

SEQ ID NO: 5739958 - DNA, 23 bp, Homo sapiens
gacctgttggcctgtgggcctca

SEQ ID NO: 5739959 - DNA, 15 bp, Homo sapiens
gacctgtttagagaa

SEQ ID NO: 5739960 - DNA, 19 bp, Homo sapiens
gaccttaaatgctactgaa

SEQ ID NO: 5739961 - DNA, 20 bp, Homo sapiens
gaccttaagacactgtgaga

SEQ ID NO: 5739962 - DNA, 22 bp, Homo sapiens
gaccttaatttaactttccagt

SEQ ID NO: 5739963 - DNA, 21 bp, Homo sapiens
gaccttacacaccattttgta

SEQ ID NO: 5739964 - DNA, 21 bp, Homo sapiens
gaccttagaaatcattgtaga

SEQ ID NO: 5739965 - DNA, 22 bp, Homo sapiens
gaccttagatttggtgaacaac

SEQ ID NO: 5739966 - DNA, 15 bp, Homo sapiens
gaccttagcgttctg

SEQ ID NO: 5739967 - DNA, 20 bp, Homo sapiens
gaccttagcgttctggactc

SEQ ID NO: 5739968 - DNA, 18 bp, Homo sapiens
gaccttaggccttcctct

SEQ ID NO: 5739969 - DNA, 16 bp, Homo sapiens
gaccttagtgtttctg

SEQ ID NO: 5739970 - DNA, 22 bp, Homo sapiens
gaccttagtgtttctgtgcatg

SEQ ID NO: 5739971 - DNA, 21 bp, Homo sapiens
gaccttatctgtgcgtgaaac

SEQ ID NO: 5739972 - DNA, 22 bp, Homo sapiens
gaccttatctgtgcgtgaaaca

SEQ ID NO: 5739973 - DNA, 20 bp, Homo sapiens
gaccttcaccaagcttagaa

SEQ ID NO: 5739974 - DNA, 19 bp, Homo sapiens
gaccttcactctaagatgt

SEQ ID NO: 5739975 - DNA, 21 bp, Homo sapiens
gaccttcatgcccttctgatt

SEQ ID NO: 5739976 - DNA, 16 bp, Homo sapiens
gaccttccaagagcct

SEQ ID NO: 5739977 - DNA, 12 bp, Homo sapiens
gaccttcccagg

SEQ ID NO: 5739978 - DNA, 13 bp, Homo sapiens
gaccttcccaggg

SEQ ID NO: 5739979 - DNA, 18 bp, Homo sapiens
gaccttcctcgcagagag

SEQ ID NO: 5739980 - DNA, 19 bp, Homo sapiens
gaccttcctcgcagagagg

SEQ ID NO: 5739981 - DNA, 20 bp, Homo sapiens
gaccttcctcgcagagaggc

SEQ ID NO: 5739982 - DNA, 23 bp, Homo sapiens
gaccttcctcgcagagaggccag

SEQ ID NO: 5739983 - DNA, 21 bp, Homo sapiens
gaccttcctctggggctctag

SEQ ID NO: 5739984 - DNA, 14 bp, Homo sapiens
gaccttcggcagtg

SEQ ID NO: 5739985 - DNA, 16 bp, Homo sapiens
gaccttcgggctgtgc

SEQ ID NO: 5739986 - DNA, 18 bp, Homo sapiens
gaccttcgggctgtgccc

SEQ ID NO: 5739987 - DNA, 21 bp, Homo sapiens
gaccttcggggcctgtctgaa

SEQ ID NO: 5739988 - DNA, 20 bp, Homo sapiens
gaccttctagtgagcctggg

SEQ ID NO: 5739989 - DNA, 16 bp, Homo sapiens
gaccttctccagggac

SEQ ID NO: 5739990 - DNA, 12 bp, Homo sapiens
gaccttctccct

SEQ ID NO: 5739991 - DNA, 13 bp, Homo sapiens
gaccttctctcca

SEQ ID NO: 5739992 - DNA, 19 bp, Homo sapiens
gaccttctgatcttggaaa

SEQ ID NO: 5739993 - DNA, 22 bp, Homo sapiens
gaccttctgcggctccgggctg

SEQ ID NO: 5739994 - DNA, 12 bp, Homo sapiens
gaccttctggga

SEQ ID NO: 5739995 - DNA, 18 bp, Homo sapiens
gaccttctgtcgtcccca

SEQ ID NO: 5739996 - DNA, 19 bp, Homo sapiens
gaccttctttattctgtgt

SEQ ID NO: 5739997 - DNA, 14 bp, Homo sapiens
gaccttgaactggg

SEQ ID NO: 5739998 - DNA, 15 bp, Homo sapiens
gaccttgaatctttt

SEQ ID NO: 5739999 - DNA, 15 bp, Homo sapiens
gaccttgacagagca

SEQ ID NO: 5740000 - DNA, 23 bp, Homo sapiens
gaccttgaccattaataaagaca

SEQ ID NO: 5740001 - DNA, 18 bp, Homo sapiens
gaccttgacttgccatga

SEQ ID NO: 5740002 - DNA, 16 bp, Homo sapiens
gaccttgagggtgggc

SEQ ID NO: 5740003 - DNA, 22 bp, Homo sapiens
gaccttgagggtgggccagcat

SEQ ID NO: 5740004 - DNA, 20 bp, Homo sapiens
gaccttgatgtcttgagagc

SEQ ID NO: 5740005 - DNA, 21 bp, Homo sapiens
gaccttgatgtcttgagagcg

SEQ ID NO: 5740006 - DNA, 20 bp, Homo sapiens
gaccttgcctcccctcctct

SEQ ID NO: 5740007 - DNA, 13 bp, Homo sapiens
gaccttgctgcca

SEQ ID NO: 5740008 - DNA, 16 bp, Homo sapiens
gaccttgctgccacaa

SEQ ID NO: 5740009 - DNA, 13 bp, Homo sapiens
gaccttgcttcct

SEQ ID NO: 5740010 - DNA, 15 bp, Homo sapiens
gaccttgcttccttc

SEQ ID NO: 5740011 - DNA, 20 bp, Homo sapiens
gaccttgctttgagactcct

SEQ ID NO: 5740012 - DNA, 23 bp, Homo sapiens
gaccttggaaacagttggcactg

SEQ ID NO: 5740013 - DNA, 20 bp, Homo sapiens
gaccttggaatcgtccctat

SEQ ID NO: 5740014 - DNA, 16 bp, Homo sapiens
gaccttggagagacac

SEQ ID NO: 5740015 - DNA, 21 bp, Homo sapiens
gaccttgggaccaaaggggga

SEQ ID NO: 5740016 - DNA, 22 bp, Homo sapiens
gaccttgggaccaaagggggag

SEQ ID NO: 5740017 - DNA, 21 bp, Homo sapiens
gaccttgggccaaatccgctc

SEQ ID NO: 5740018 - DNA, 16 bp, Homo sapiens
gaccttgtaaaagaca

SEQ ID NO: 5740019 - DNA, 17 bp, Homo sapiens
gaccttgtaatgtaact

SEQ ID NO: 5740020 - DNA, 20 bp, Homo sapiens
gaccttgtaatgtaactgct

SEQ ID NO: 5740021 - DNA, 13 bp, Homo sapiens
gaccttgtctcta

SEQ ID NO: 5740022 - DNA, 17 bp, Homo sapiens
gaccttgttacttctga

SEQ ID NO: 5740023 - DNA, 14 bp, Homo sapiens
gaccttgttgcatg

SEQ ID NO: 5740024 - DNA, 20 bp, Homo sapiens
gaccttgttgcatgatgtat

SEQ ID NO: 5740025 - DNA, 17 bp, Homo sapiens
gacctttaactgagggc

SEQ ID NO: 5740026 - DNA, 23 bp, Homo sapiens
gacctttaagaaaaatgaaaact

SEQ ID NO: 5740027 - DNA, 22 bp, Homo sapiens
gacctttaagagaaatgagctg

SEQ ID NO: 5740028 - DNA, 22 bp, Homo sapiens
gacctttaattcaggtatgtaa

SEQ ID NO: 5740029 - DNA, 12 bp, Homo sapiens
gacctttatcca

SEQ ID NO: 5740030 - DNA, 23 bp, Homo sapiens
gacctttattgggtatcaagaca

SEQ ID NO: 5740031 - DNA, 21 bp, Homo sapiens
gacctttatttattaaacttc

SEQ ID NO: 5740032 - DNA, 23 bp, Homo sapiens
gacctttatttattaaacttcag

SEQ ID NO: 5740033 - DNA, 15 bp, Homo sapiens
gacctttatttttct

SEQ ID NO: 5740034 - DNA, 18 bp, Homo sapiens
gacctttccaccacagcc

SEQ ID NO: 5740035 - DNA, 23 bp, Homo sapiens
gacctttccaccacagccagcac

SEQ ID NO: 5740036 - DNA, 20 bp, Homo sapiens
gacctttcctctcctgggta

SEQ ID NO: 5740037 - DNA, 14 bp, Homo sapiens
gacctttctgagtg

SEQ ID NO: 5740038 - DNA, 18 bp, Homo sapiens
gacctttcttttcttaga

SEQ ID NO: 5740039 - DNA, 22 bp, Homo sapiens
gacctttgatgaattcttcctc

SEQ ID NO: 5740040 - DNA, 14 bp, Homo sapiens
gacctttgccaaac

SEQ ID NO: 5740041 - DNA, 13 bp, Homo sapiens
gacctttgcccac

SEQ ID NO: 5740042 - DNA, 18 bp, Homo sapiens
gacctttgggttctttct

SEQ ID NO: 5740043 - DNA, 18 bp, Homo sapiens
gacctttgtacagcccag

SEQ ID NO: 5740044 - DNA, 22 bp, Homo sapiens
gaccttttcaacttggcttcct

SEQ ID NO: 5740045 - DNA, 18 bp, Homo sapiens
gaccttttctctcccata

SEQ ID NO: 5740046 - DNA, 19 bp, Homo sapiens
gaccttttggcctttgtaa

SEQ ID NO: 5740047 - DNA, 18 bp, Homo sapiens
gaccttttgggggagggc

SEQ ID NO: 5740048 - DNA, 15 bp, Homo sapiens
gaccttttggtcttc

SEQ ID NO: 5740049 - DNA, 22 bp, Homo sapiens
gaccttttgtctcacacagcag

SEQ ID NO: 5740050 - DNA, 17 bp, Homo sapiens
gacctttttctgcacta

SEQ ID NO: 5740051 - DNA, 21 bp, Homo sapiens
gacgaaatggaaacacacaca

SEQ ID NO: 5740052 - DNA, 15 bp, Homo sapiens
gacgaacggaagggt

SEQ ID NO: 5740053 - DNA, 17 bp, Homo sapiens
gacgaatatgaatgtca

SEQ ID NO: 5740054 - DNA, 20 bp, Homo sapiens
gacgaatttggccgatggca

SEQ ID NO: 5740055 - DNA, 21 bp, Homo sapiens
gacgacaagtgctgaacagtg

SEQ ID NO: 5740056 - DNA, 15 bp, Homo sapiens
gacgacaggcgagag

SEQ ID NO: 5740057 - DNA, 20 bp, Homo sapiens
gacgacctacatctgaaatc

SEQ ID NO: 5740058 - DNA, 24 bp, Homo sapiens
gacgagacccccatccagcctcca

SEQ ID NO: 5740059 - DNA, 18 bp, Homo sapiens
gacgagagggctgtgagc

SEQ ID NO: 5740060 - DNA, 24 bp, Homo sapiens
gacgagcatccccctcctctccct

SEQ ID NO: 5740061 - DNA, 21 bp, Homo sapiens
gacgaggccactcagaggccc

SEQ ID NO: 5740062 - DNA, 21 bp, Homo sapiens
gacgaggccctcgggcccagc

SEQ ID NO: 5740063 - DNA, 22 bp, Homo sapiens
gacgaggccctcgggcccagcc

SEQ ID NO: 5740064 - DNA, 18 bp, Homo sapiens
gacgagggatgggatttc

SEQ ID NO: 5740065 - DNA, 15 bp, Homo sapiens
gacgagggccaggca

SEQ ID NO: 5740066 - DNA, 18 bp, Homo sapiens
gacgaggggtgtcttggg

SEQ ID NO: 5740067 - DNA, 17 bp, Homo sapiens
gacgagttgatttcctc

SEQ ID NO: 5740068 - DNA, 23 bp, Homo sapiens
gacgatactccaaccatatggat

SEQ ID NO: 5740069 - DNA, 19 bp, Homo sapiens
gacgatcttcccccttccc

SEQ ID NO: 5740070 - DNA, 16 bp, Homo sapiens
gacgatgggtgttgct

SEQ ID NO: 5740071 - DNA, 19 bp, Homo sapiens
gacgatgtcaaccttgtgt

SEQ ID NO: 5740072 - DNA, 16 bp, Homo sapiens
gacgattatttatttc

SEQ ID NO: 5740073 - DNA, 17 bp, Homo sapiens
gacgattccttctctga

SEQ ID NO: 5740074 - DNA, 13 bp, Homo sapiens
gacgcacagtgca

SEQ ID NO: 5740075 - DNA, 16 bp, Homo sapiens
gacgcaccgccgccac

SEQ ID NO: 5740076 - DNA, 19 bp, Homo sapiens
gacgcaccgccgccaccag

SEQ ID NO: 5740077 - DNA, 14 bp, Homo sapiens
gacgcacgctcgct

SEQ ID NO: 5740078 - DNA, 16 bp, Homo sapiens
gacgcacgctcgctgc

SEQ ID NO: 5740079 - DNA, 19 bp, Homo sapiens
gacgcacgctcgctgccat

SEQ ID NO: 5740080 - DNA, 21 bp, Homo sapiens
gacgcacgctcgctgccatca

SEQ ID NO: 5740081 - DNA, 22 bp, Homo sapiens
gacgcagataactggttactca

SEQ ID NO: 5740082 - DNA, 12 bp, Homo sapiens
gacgcagcagct

SEQ ID NO: 5740083 - DNA, 18 bp, Homo sapiens
gacgcagccacacagtgg

SEQ ID NO: 5740084 - DNA, 21 bp, Homo sapiens
gacgcagccacacagtggccg

SEQ ID NO: 5740085 - DNA, 20 bp, Homo sapiens
gacgcagccggagggaggca

SEQ ID NO: 5740086 - DNA, 13 bp, Homo sapiens
gacgcaggaatgg

SEQ ID NO: 5740087 - DNA, 13 bp, Homo sapiens
gacgcaggcccct

SEQ ID NO: 5740088 - DNA, 14 bp, Homo sapiens
gacgcaggcccctc

SEQ ID NO: 5740089 - DNA, 15 bp, Homo sapiens
gacgcaggcccctct

SEQ ID NO: 5740090 - DNA, 20 bp, Homo sapiens
gacgcaggccctgtccagcc

SEQ ID NO: 5740091 - DNA, 17 bp, Homo sapiens
gacgcagggagaccctg

SEQ ID NO: 5740092 - DNA, 22 bp, Homo sapiens
gacgcagggagaccctgggaga

SEQ ID NO: 5740093 - DNA, 15 bp, Homo sapiens
gacgcatatgagtaa

SEQ ID NO: 5740094 - DNA, 14 bp, Homo sapiens
gacgcatcctgcag

SEQ ID NO: 5740095 - DNA, 18 bp, Homo sapiens
gacgcatctcaaaacaga

SEQ ID NO: 5740096 - DNA, 17 bp, Homo sapiens
gacgccaacttctccca

SEQ ID NO: 5740097 - DNA, 19 bp, Homo sapiens
gacgccaacttctcccacc

SEQ ID NO: 5740098 - DNA, 22 bp, Homo sapiens
gacgccaacttctcccacccct

SEQ ID NO: 5740099 - DNA, 17 bp, Homo sapiens
gacgccaaggaggtggg

SEQ ID NO: 5740100 - DNA, 18 bp, Homo sapiens
gacgccacagtctcccca

SEQ ID NO: 5740101 - DNA, 14 bp, Homo sapiens
gacgccactcattt

SEQ ID NO: 5740102 - DNA, 17 bp, Homo sapiens
gacgccactcatttcat

SEQ ID NO: 5740103 - DNA, 18 bp, Homo sapiens
gacgccactcatttcatc

SEQ ID NO: 5740104 - DNA, 21 bp, Homo sapiens
gacgccactcatttcatctca

SEQ ID NO: 5740105 - DNA, 23 bp, Homo sapiens
gacgccactcatttcatctcatt

SEQ ID NO: 5740106 - DNA, 15 bp, Homo sapiens
gacgccactccctgg

SEQ ID NO: 5740107 - DNA, 17 bp, Homo sapiens
gacgccaggcaccacag

SEQ ID NO: 5740108 - DNA, 16 bp, Homo sapiens
gacgccatcccagccc

SEQ ID NO: 5740109 - DNA, 16 bp, Homo sapiens
gacgccatgtgatgga

SEQ ID NO: 5740110 - DNA, 22 bp, Homo sapiens
gacgccatgtgatggacactcc

SEQ ID NO: 5740111 - DNA, 21 bp, Homo sapiens
gacgccccggggcgcctagag

SEQ ID NO: 5740112 - DNA, 20 bp, Homo sapiens
gacgcccgagagcctcgctt

SEQ ID NO: 5740113 - DNA, 15 bp, Homo sapiens
gacgccctctcccca

SEQ ID NO: 5740114 - DNA, 23 bp, Homo sapiens
gacgccctctccccacccctacc

SEQ ID NO: 5740115 - DNA, 18 bp, Homo sapiens
gacgccgcgcactcagcc

SEQ ID NO: 5740116 - DNA, 21 bp, Homo sapiens
gacgccggggacagaggcctg

SEQ ID NO: 5740117 - DNA, 11 bp, Homo sapiens
gacgcctctgg

SEQ ID NO: 5740118 - DNA, 15 bp, Homo sapiens
gacgcctctggacct

SEQ ID NO: 5740119 - DNA, 15 bp, Homo sapiens
gacgcctgagacagc

SEQ ID NO: 5740120 - DNA, 13 bp, Homo sapiens
gacgcctgagctc

SEQ ID NO: 5740121 - DNA, 17 bp, Homo sapiens
gacgcctgcaggagaga

SEQ ID NO: 5740122 - DNA, 18 bp, Homo sapiens
gacgcctgccctccccag

SEQ ID NO: 5740123 - DNA, 20 bp, Homo sapiens
gacgcctgccctccccagag

SEQ ID NO: 5740124 - DNA, 14 bp, Homo sapiens
gacgcctggctcca

SEQ ID NO: 5740125 - DNA, 16 bp, Homo sapiens
gacgcctggctccagg

SEQ ID NO: 5740126 - DNA, 19 bp, Homo sapiens
gacgcctggctccaggctc

SEQ ID NO: 5740127 - DNA, 20 bp, Homo sapiens
gacgcctggctccaggctcc

SEQ ID NO: 5740128 - DNA, 14 bp, Homo sapiens
gacgcctggctgct

SEQ ID NO: 5740129 - DNA, 15 bp, Homo sapiens
gacgcctggctgctg

SEQ ID NO: 5740130 - DNA, 12 bp, Homo sapiens
gacgcctggggg

SEQ ID NO: 5740131 - DNA, 20 bp, Homo sapiens
gacgccttcaggcaccacag

SEQ ID NO: 5740132 - DNA, 21 bp, Homo sapiens
gacgccttcaggcaccacaga

SEQ ID NO: 5740133 - DNA, 18 bp, Homo sapiens
gacgccttccaggtcagg

SEQ ID NO: 5740134 - DNA, 19 bp, Homo sapiens
gacgccttccaggtcagga

SEQ ID NO: 5740135 - DNA, 15 bp, Homo sapiens
gacgcgagaggctct

SEQ ID NO: 5740136 - DNA, 22 bp, Homo sapiens
gacgcgcacacacaccggtcac

SEQ ID NO: 5740137 - DNA, 14 bp, Homo sapiens
gacgcggaggagga

SEQ ID NO: 5740138 - DNA, 18 bp, Homo sapiens
gacgctaataaaaattta

SEQ ID NO: 5740139 - DNA, 16 bp, Homo sapiens
gacgctacccgggaag

SEQ ID NO: 5740140 - DNA, 19 bp, Homo sapiens
gacgctacccgggaagggg

SEQ ID NO: 5740141 - DNA, 22 bp, Homo sapiens
gacgctacccgggaagggggct

SEQ ID NO: 5740142 - DNA, 17 bp, Homo sapiens
gacgctcaagaatcctc

SEQ ID NO: 5740143 - DNA, 20 bp, Homo sapiens
gacgctcagccccaggccag

SEQ ID NO: 5740144 - DNA, 21 bp, Homo sapiens
gacgctcagccccaggccagc

SEQ ID NO: 5740145 - DNA, 22 bp, Homo sapiens
gacgctcagccccaggccagct

SEQ ID NO: 5740146 - DNA, 23 bp, Homo sapiens
gacgctcagccccaggccagctg

SEQ ID NO: 5740147 - DNA, 17 bp, Homo sapiens
gacgctccctgctccac

SEQ ID NO: 5740148 - DNA, 17 bp, Homo sapiens
gacgctgaataaatgtc

SEQ ID NO: 5740149 - DNA, 15 bp, Homo sapiens
gacgctgatacataa

SEQ ID NO: 5740150 - DNA, 19 bp, Homo sapiens
gacgctgatacataactaa

SEQ ID NO: 5740151 - DNA, 21 bp, Homo sapiens
gacgctgatccataaagacaa

SEQ ID NO: 5740152 - DNA, 14 bp, Homo sapiens
gacgctgcatgaga

SEQ ID NO: 5740153 - DNA, 18 bp, Homo sapiens
gacgctgccctgcatgct

SEQ ID NO: 5740154 - DNA, 16 bp, Homo sapiens
gacgctggagaccctg

SEQ ID NO: 5740155 - DNA, 21 bp, Homo sapiens
gacgctggagaccctgcgccc

SEQ ID NO: 5740156 - DNA, 17 bp, Homo sapiens
gacgctggtaactgtta

SEQ ID NO: 5740157 - DNA, 20 bp, Homo sapiens
gacgctggtagagatggagg

SEQ ID NO: 5740158 - DNA, 21 bp, Homo sapiens
gacgctggtagagatggagga

SEQ ID NO: 5740159 - DNA, 19 bp, Homo sapiens
gacgctgtccattgccacg

SEQ ID NO: 5740160 - DNA, 16 bp, Homo sapiens
gacgctgtcctgagat

SEQ ID NO: 5740161 - DNA, 12 bp, Homo sapiens
gacgctgtgctg

SEQ ID NO: 5740162 - DNA, 22 bp, Homo sapiens
gacgctgtgctgccctgcccac

SEQ ID NO: 5740163 - DNA, 13 bp, Homo sapiens
gacgcttccagac

SEQ ID NO: 5740164 - DNA, 16 bp, Homo sapiens
gacgcttccagaccac

SEQ ID NO: 5740165 - DNA, 22 bp, Homo sapiens
gacgcttcccttgccgttggct

SEQ ID NO: 5740166 - DNA, 16 bp, Homo sapiens
gacgcttgtgacagtg

SEQ ID NO: 5740167 - DNA, 21 bp, Homo sapiens
gacgcttgtgacagtgcctct

SEQ ID NO: 5740168 - DNA, 19 bp, Homo sapiens
gacgcttttgagtgggccc

SEQ ID NO: 5740169 - DNA, 22 bp, Homo sapiens
gacgcttttgagtgggccctgc

SEQ ID NO: 5740170 - DNA, 13 bp, Homo sapiens
gacggaaaacaat

SEQ ID NO: 5740171 - DNA, 19 bp, Homo sapiens
gacggaaaatgcttaaaaa

SEQ ID NO: 5740172 - DNA, 14 bp, Homo sapiens
gacggaaatgaaat

SEQ ID NO: 5740173 - DNA, 21 bp, Homo sapiens
gacggaagcctttttccccaa

SEQ ID NO: 5740174 - DNA, 18 bp, Homo sapiens
gacggaagggtaaacaat

SEQ ID NO: 5740175 - DNA, 19 bp, Homo sapiens
gacggacatccaggcgtgg

SEQ ID NO: 5740176 - DNA, 15 bp, Homo sapiens
gacggacgggacagc

SEQ ID NO: 5740177 - DNA, 22 bp, Homo sapiens
gacggactcagactcctggctt

SEQ ID NO: 5740178 - DNA, 23 bp, Homo sapiens
gacggactcagactcctggcttc

SEQ ID NO: 5740179 - DNA, 15 bp, Homo sapiens
gacggagagaaaaaa

SEQ ID NO: 5740180 - DNA, 19 bp, Homo sapiens
gacggaggaggggaagggg

SEQ ID NO: 5740181 - DNA, 21 bp, Homo sapiens
gacggaggaggggaaggggct

SEQ ID NO: 5740182 - DNA, 21 bp, Homo sapiens
gacggaggggagtagagaagt

SEQ ID NO: 5740183 - DNA, 13 bp, Homo sapiens
gacggaggtgcct

SEQ ID NO: 5740184 - DNA, 16 bp, Homo sapiens
gacggaggttgcagtg

SEQ ID NO: 5740185 - DNA, 18 bp, Homo sapiens
gacggaggttgcagtgag

SEQ ID NO: 5740186 - DNA, 23 bp, Homo sapiens
gacggagtcccaccttggctgca

SEQ ID NO: 5740187 - DNA, 14 bp, Homo sapiens
gacggagtctctca

SEQ ID NO: 5740188 - DNA, 14 bp, Homo sapiens
gacggagttcagag

SEQ ID NO: 5740189 - DNA, 14 bp, Homo sapiens
gacggatccacagt

SEQ ID NO: 5740190 - DNA, 22 bp, Homo sapiens
gacggatgcccattcctgcctg

SEQ ID NO: 5740191 - DNA, 15 bp, Homo sapiens
gacggatggaaggag

SEQ ID NO: 5740192 - DNA, 20 bp, Homo sapiens
gacggcagaaaacagagcct

SEQ ID NO: 5740193 - DNA, 16 bp, Homo sapiens
gacggcagagacccca

SEQ ID NO: 5740194 - DNA, 21 bp, Homo sapiens
gacggcagagaccccaggatc

SEQ ID NO: 5740195 - DNA, 20 bp, Homo sapiens
gacggcaggctcactgccag

SEQ ID NO: 5740196 - DNA, 16 bp, Homo sapiens
gacggccaagaatgta

SEQ ID NO: 5740197 - DNA, 11 bp, Homo sapiens
gacggccaggc

SEQ ID NO: 5740198 - DNA, 12 bp, Homo sapiens
gacggccaggct

SEQ ID NO: 5740199 - DNA, 13 bp, Homo sapiens
gacggccaggctc

SEQ ID NO: 5740200 - DNA, 18 bp, Homo sapiens
gacggccctgcctgcctc

SEQ ID NO: 5740201 - DNA, 19 bp, Homo sapiens
gacggccctgcctgcctct

SEQ ID NO: 5740202 - DNA, 18 bp, Homo sapiens
gacggcctaggggtggcg

SEQ ID NO: 5740203 - DNA, 14 bp, Homo sapiens
gacggcctccagga

SEQ ID NO: 5740204 - DNA, 15 bp, Homo sapiens
gacggcctccaggag

SEQ ID NO: 5740205 - DNA, 18 bp, Homo sapiens
gacggcctccaggagggg

SEQ ID NO: 5740206 - DNA, 19 bp, Homo sapiens
gacggcctccaggaggggc

SEQ ID NO: 5740207 - DNA, 15 bp, Homo sapiens
gacggcctgatgctc

SEQ ID NO: 5740208 - DNA, 20 bp, Homo sapiens
gacggcctgatgctccctcc

SEQ ID NO: 5740209 - DNA, 22 bp, Homo sapiens
gacggcctgatgctccctcccc

SEQ ID NO: 5740210 - DNA, 21 bp, Homo sapiens
gacggcgagaaatgcctctgg

SEQ ID NO: 5740211 - DNA, 13 bp, Homo sapiens
gacggcgctgcct

SEQ ID NO: 5740212 - DNA, 15 bp, Homo sapiens
gacggcggccaggca

SEQ ID NO: 5740213 - DNA, 12 bp, Homo sapiens
gacggctccact

SEQ ID NO: 5740214 - DNA, 13 bp, Homo sapiens
gacggctcctcag

SEQ ID NO: 5740215 - DNA, 23 bp, Homo sapiens
gacggctcctcagagcgccagga

SEQ ID NO: 5740216 - DNA, 16 bp, Homo sapiens
gacggctgagctgggc

SEQ ID NO: 5740217 - DNA, 15 bp, Homo sapiens
gacggctgccattgg

SEQ ID NO: 5740218 - DNA, 13 bp, Homo sapiens
gacggctggacct

SEQ ID NO: 5740219 - DNA, 14 bp, Homo sapiens
gacggctggacctg

SEQ ID NO: 5740220 - DNA, 17 bp, Homo sapiens
gacggctggacctgcac

SEQ ID NO: 5740221 - DNA, 12 bp, Homo sapiens
gacggctgggca

SEQ ID NO: 5740222 - DNA, 17 bp, Homo sapiens
gacggctgtgggaccag

SEQ ID NO: 5740223 - DNA, 18 bp, Homo sapiens
gacggctgtgtatttctg

SEQ ID NO: 5740224 - DNA, 20 bp, Homo sapiens
gacggctgtgtatttctgta

SEQ ID NO: 5740225 - DNA, 21 bp, Homo sapiens
gacggctgtgtatttctgtag

SEQ ID NO: 5740226 - DNA, 23 bp, Homo sapiens
gacggctgtgtatttctgtagaa

SEQ ID NO: 5740227 - DNA, 19 bp, Homo sapiens
gacgggacagcggcccggc

SEQ ID NO: 5740228 - DNA, 23 bp, Homo sapiens
gacgggactcaggcgggacagtg

SEQ ID NO: 5740229 - DNA, 13 bp, Homo sapiens
gacgggaggcccc

SEQ ID NO: 5740230 - DNA, 14 bp, Homo sapiens
gacgggaggcccca

SEQ ID NO: 5740231 - DNA, 16 bp, Homo sapiens
gacgggaggccccagc

SEQ ID NO: 5740232 - DNA, 21 bp, Homo sapiens
gacgggaggccccagctctga

SEQ ID NO: 5740233 - DNA, 15 bp, Homo sapiens
gacgggaggcctcag

SEQ ID NO: 5740234 - DNA, 19 bp, Homo sapiens
gacgggatgacctccagaa

SEQ ID NO: 5740235 - DNA, 17 bp, Homo sapiens
gacgggatgctctttaa

SEQ ID NO: 5740236 - DNA, 10 bp, Homo sapiens
gacgggcaca

SEQ ID NO: 5740237 - DNA, 18 bp, Homo sapiens
gacgggccaggccctgga

SEQ ID NO: 5740238 - DNA, 22 bp, Homo sapiens
gacgggccctccttccctcctg

SEQ ID NO: 5740239 - DNA, 23 bp, Homo sapiens
gacgggccctccttccctcctgt

SEQ ID NO: 5740240 - DNA, 18 bp, Homo sapiens
gacggggcccgccccagg

SEQ ID NO: 5740241 - DNA, 17 bp, Homo sapiens
gacggggcctcactatg

SEQ ID NO: 5740242 - DNA, 15 bp, Homo sapiens
gacggggctcccctg

SEQ ID NO: 5740243 - DNA, 17 bp, Homo sapiens
gacggggcttcaccatc

SEQ ID NO: 5740244 - DNA, 19 bp, Homo sapiens
gacgggggttggggtgggg

SEQ ID NO: 5740245 - DNA, 20 bp, Homo sapiens
gacggggtcggacggggcag

SEQ ID NO: 5740246 - DNA, 17 bp, Homo sapiens
gacggggtttcaccgtg

SEQ ID NO: 5740247 - DNA, 17 bp, Homo sapiens
gacggggtttccccatg

SEQ ID NO: 5740248 - DNA, 17 bp, Homo sapiens
gacggggtttctccatg

SEQ ID NO: 5740249 - DNA, 23 bp, Homo sapiens
gacgggtgggcggctggagacca

SEQ ID NO: 5740250 - DNA, 21 bp, Homo sapiens
gacggtaagtgttctcatgaa

SEQ ID NO: 5740251 - DNA, 21 bp, Homo sapiens
gacggtcagtttggtgtcaac

SEQ ID NO: 5740252 - DNA, 17 bp, Homo sapiens
gacggtccccacccctc

SEQ ID NO: 5740253 - DNA, 19 bp, Homo sapiens
gacggtcctttaggcagcc

SEQ ID NO: 5740254 - DNA, 14 bp, Homo sapiens
gacggtgacaaaga

SEQ ID NO: 5740255 - DNA, 21 bp, Homo sapiens
gacggtgacaaagatggctca

SEQ ID NO: 5740256 - DNA, 23 bp, Homo sapiens
gacggtgcccaagccagaggctg

SEQ ID NO: 5740257 - DNA, 20 bp, Homo sapiens
gacggtgttaattttgctaa

SEQ ID NO: 5740258 - DNA, 22 bp, Homo sapiens
gacggtgttaattttgctaact

SEQ ID NO: 5740259 - DNA, 18 bp, Homo sapiens
gacggtttccagggaggg

SEQ ID NO: 5740260 - DNA, 18 bp, Homo sapiens
gacggtttctagcctctg

SEQ ID NO: 5740261 - DNA, 14 bp, Homo sapiens
gacggttttgcttt

SEQ ID NO: 5740262 - DNA, 16 bp, Homo sapiens
gacgtaattaaatcca

SEQ ID NO: 5740263 - DNA, 21 bp, Homo sapiens
gacgtagctgcaaaggacaga

SEQ ID NO: 5740264 - DNA, 22 bp, Homo sapiens
gacgtcaacccaagctctgggg

SEQ ID NO: 5740265 - DNA, 19 bp, Homo sapiens
gacgtcaccctccattctg

SEQ ID NO: 5740266 - DNA, 20 bp, Homo sapiens
gacgtcactttttggccatg

SEQ ID NO: 5740267 - DNA, 21 bp, Homo sapiens
gacgtcagatgtttaaaacac

SEQ ID NO: 5740268 - DNA, 14 bp, Homo sapiens
gacgtcagcctctt

SEQ ID NO: 5740269 - DNA, 14 bp, Homo sapiens
gacgtcaggccctg

SEQ ID NO: 5740270 - DNA, 20 bp, Homo sapiens
gacgtcaggccctgactcct

SEQ ID NO: 5740271 - DNA, 20 bp, Homo sapiens
gacgtccacccgtttccaag

SEQ ID NO: 5740272 - DNA, 12 bp, Homo sapiens
gacgtccctcca

SEQ ID NO: 5740273 - DNA, 13 bp, Homo sapiens
gacgtcctgccac

SEQ ID NO: 5740274 - DNA, 21 bp, Homo sapiens
gacgtcctgccacctggggca

SEQ ID NO: 5740275 - DNA, 21 bp, Homo sapiens
gacgtcctgctggcacctcag

SEQ ID NO: 5740276 - DNA, 23 bp, Homo sapiens
gacgtcctggaatgaagcatgta

SEQ ID NO: 5740277 - DNA, 20 bp, Homo sapiens
gacgtcgtacccagccatgt

SEQ ID NO: 5740278 - DNA, 16 bp, Homo sapiens
gacgtctgccaccagc

SEQ ID NO: 5740279 - DNA, 20 bp, Homo sapiens
gacgtctgccaccagcgccc

SEQ ID NO: 5740280 - DNA, 22 bp, Homo sapiens
gacgtcttaggtggcagggctg

SEQ ID NO: 5740281 - DNA, 22 bp, Homo sapiens
gacgtctttctttttttccccc

SEQ ID NO: 5740282 - DNA, 22 bp, Homo sapiens
gacgtgaacgttttaataattt

SEQ ID NO: 5740283 - DNA, 14 bp, Homo sapiens
gacgtgactcagag

SEQ ID NO: 5740284 - DNA, 15 bp, Homo sapiens
gacgtgactcagagc

SEQ ID NO: 5740285 - DNA, 17 bp, Homo sapiens
gacgtgactcagagctt

SEQ ID NO: 5740286 - DNA, 19 bp, Homo sapiens
gacgtgagtggggaggaga

SEQ ID NO: 5740287 - DNA, 19 bp, Homo sapiens
gacgtgagtgtgacttttt

SEQ ID NO: 5740288 - DNA, 20 bp, Homo sapiens
gacgtgataatgcagataaa

SEQ ID NO: 5740289 - DNA, 22 bp, Homo sapiens
gacgtgattcaattcaacactc

SEQ ID NO: 5740290 - DNA, 18 bp, Homo sapiens
gacgtgcacctgtactca

SEQ ID NO: 5740291 - DNA, 16 bp, Homo sapiens
gacgtgcactgacagc

SEQ ID NO: 5740292 - DNA, 17 bp, Homo sapiens
gacgtgcactgacagcc

SEQ ID NO: 5740293 - DNA, 23 bp, Homo sapiens
gacgtgcactgagagtgaagtga

SEQ ID NO: 5740294 - DNA, 23 bp, Homo sapiens
gacgtgccttttgcacccctccc

SEQ ID NO: 5740295 - DNA, 15 bp, Homo sapiens
gacgtgctcccctgc

SEQ ID NO: 5740296 - DNA, 16 bp, Homo sapiens
gacgtggacatgcctc

SEQ ID NO: 5740297 - DNA, 18 bp, Homo sapiens
gacgtggacatgcctcaa

SEQ ID NO: 5740298 - DNA, 18 bp, Homo sapiens
gacgtggactggggtagg

SEQ ID NO: 5740299 - DNA, 12 bp, Homo sapiens
gacgtggctcag

SEQ ID NO: 5740300 - DNA, 14 bp, Homo sapiens
gacgtggctcagcc

SEQ ID NO: 5740301 - DNA, 13 bp, Homo sapiens
gacgtgggccctg

SEQ ID NO: 5740302 - DNA, 14 bp, Homo sapiens
gacgtgggccctgc

SEQ ID NO: 5740303 - DNA, 13 bp, Homo sapiens
gacgtgggctggg

SEQ ID NO: 5740304 - DNA, 20 bp, Homo sapiens
gacgtgggctgggcccacaa

SEQ ID NO: 5740305 - DNA, 21 bp, Homo sapiens
gacgtggtcagggcagggctc

SEQ ID NO: 5740306 - DNA, 19 bp, Homo sapiens
gacgtggtctagaccaggg

SEQ ID NO: 5740307 - DNA, 15 bp, Homo sapiens
gacgtggtgggactc

SEQ ID NO: 5740308 - DNA, 15 bp, Homo sapiens
gacgtgtacagcaca

SEQ ID NO: 5740309 - DNA, 17 bp, Homo sapiens
gacgtgtacagcacaga

SEQ ID NO: 5740310 - DNA, 19 bp, Homo sapiens
gacgtgtacagcacagaat

SEQ ID NO: 5740311 - DNA, 14 bp, Homo sapiens
gacgtgtgtgaatg

SEQ ID NO: 5740312 - DNA, 22 bp, Homo sapiens
gacgtgtgttcttttgagtcct

SEQ ID NO: 5740313 - DNA, 19 bp, Homo sapiens
gacgtgtgtttctagagcc

SEQ ID NO: 5740314 - DNA, 11 bp, Homo sapiens
gacgtgttatg

SEQ ID NO: 5740315 - DNA, 15 bp, Homo sapiens
gacgtgttatgactc

SEQ ID NO: 5740316 - DNA, 20 bp, Homo sapiens
gacgtgttatgactccagaa

SEQ ID NO: 5740317 - DNA, 14 bp, Homo sapiens
gacgtgtttgtgtt

SEQ ID NO: 5740318 - DNA, 17 bp, Homo sapiens
gacgttaggccaggcct

SEQ ID NO: 5740319 - DNA, 15 bp, Homo sapiens
gacgttccagccggc

SEQ ID NO: 5740320 - DNA, 21 bp, Homo sapiens
gacgttcggggcatgctgggg

SEQ ID NO: 5740321 - DNA, 14 bp, Homo sapiens
gacgttgcctgaga

SEQ ID NO: 5740322 - DNA, 16 bp, Homo sapiens
gacgttgctttttcac

SEQ ID NO: 5740323 - DNA, 23 bp, Homo sapiens
gacgttggcctcagggccaggaa

SEQ ID NO: 5740324 - DNA, 18 bp, Homo sapiens
gacgttgttgtcattgtc

SEQ ID NO: 5740325 - DNA, 22 bp, Homo sapiens
gacgtttaactgcagttgactt

SEQ ID NO: 5740326 - DNA, 23 bp, Homo sapiens
gacgtttataaacagaaatggaa

SEQ ID NO: 5740327 - DNA, 13 bp, Homo sapiens
gacgtttccatca

SEQ ID NO: 5740328 - DNA, 17 bp, Homo sapiens
gacgtttctgggcggcc

SEQ ID NO: 5740329 - DNA, 16 bp, Homo sapiens
gacgtttcttctttct

SEQ ID NO: 5740330 - DNA, 21 bp, Homo sapiens
gacgtttgcatagagagaaat

SEQ ID NO: 5740331 - DNA, 15 bp, Homo sapiens
gacgttttctccgca

SEQ ID NO: 5740332 - DNA, 21 bp, Homo sapiens
gacgtttttgtgctgtgggca

SEQ ID NO: 5740333 - DNA, 23 bp, Homo sapiens
gacgtttttgtgctgtgggcagc

SEQ ID NO: 5740334 - DNA, 18 bp, Homo sapiens
gacgttttttctgcacaa

SEQ ID NO: 5740335 - DNA, 23 bp, Homo sapiens
gactaaaacattttgactaagtt

SEQ ID NO: 5740336 - DNA, 17 bp, Homo sapiens
gactaaaagatataagt

SEQ ID NO: 5740337 - DNA, 19 bp, Homo sapiens
gactaaaagatataagtgc

SEQ ID NO: 5740338 - DNA, 23 bp, Homo sapiens
gactaaaagggcttcggccacag

SEQ ID NO: 5740339 - DNA, 20 bp, Homo sapiens
gactaaaatgctgcttttaa

SEQ ID NO: 5740340 - DNA, 13 bp, Homo sapiens
gactaaaatgttt

SEQ ID NO: 5740341 - DNA, 19 bp, Homo sapiens
gactaaaccattgtgcatt

SEQ ID NO: 5740342 - DNA, 21 bp, Homo sapiens
gactaaacgggcgccaagact

SEQ ID NO: 5740343 - DNA, 18 bp, Homo sapiens
gactaaactaccacctca

SEQ ID NO: 5740344 - DNA, 19 bp, Homo sapiens
gactaaactaccacctcag

SEQ ID NO: 5740345 - DNA, 20 bp, Homo sapiens
gactaaactatctgtattta

SEQ ID NO: 5740346 - DNA, 18 bp, Homo sapiens
gactaaactttttttctg

SEQ ID NO: 5740347 - DNA, 22 bp, Homo sapiens
gactaaactttttttctgtacc

SEQ ID NO: 5740348 - DNA, 17 bp, Homo sapiens
gactaaagagagaatgt

SEQ ID NO: 5740349 - DNA, 13 bp, Homo sapiens
gactaaagcatca

SEQ ID NO: 5740350 - DNA, 17 bp, Homo sapiens
gactaaagccaggaaca

SEQ ID NO: 5740351 - DNA, 14 bp, Homo sapiens
gactaaattcgtga

SEQ ID NO: 5740352 - DNA, 16 bp, Homo sapiens
gactaaattttctttt

SEQ ID NO: 5740353 - DNA, 16 bp, Homo sapiens
gactaacaaaggcagc

SEQ ID NO: 5740354 - DNA, 21 bp, Homo sapiens
gactaacaaaggcagctgtgt

SEQ ID NO: 5740355 - DNA, 16 bp, Homo sapiens
gactaacaactgggaa

SEQ ID NO: 5740356 - DNA, 18 bp, Homo sapiens
gactaacataaaatctgt

SEQ ID NO: 5740357 - DNA, 19 bp, Homo sapiens
gactaaccccaacgcacag

SEQ ID NO: 5740358 - DNA, 22 bp, Homo sapiens
gactaaccccaacgcacaggaa

SEQ ID NO: 5740359 - DNA, 23 bp, Homo sapiens
gactaaccccaacgcacaggaaa

SEQ ID NO: 5740360 - DNA, 12 bp, Homo sapiens
gactaactaaaa

SEQ ID NO: 5740361 - DNA, 23 bp, Homo sapiens
gactaactagacaccaaagttct

SEQ ID NO: 5740362 - DNA, 16 bp, Homo sapiens
gactaactcaaataca

SEQ ID NO: 5740363 - DNA, 18 bp, Homo sapiens
gactaagaaatgccagtg

SEQ ID NO: 5740364 - DNA, 16 bp, Homo sapiens
gactaagaattttgtt

SEQ ID NO: 5740365 - DNA, 22 bp, Homo sapiens
gactaagatgaaatgcactgta

SEQ ID NO: 5740366 - DNA, 19 bp, Homo sapiens
gactaagccaagctgtgtt

SEQ ID NO: 5740367 - DNA, 12 bp, Homo sapiens
gactaagccagc

SEQ ID NO: 5740368 - DNA, 18 bp, Homo sapiens
gactaagccagcaccgga

SEQ ID NO: 5740369 - DNA, 14 bp, Homo sapiens
gactaagccctgtc

SEQ ID NO: 5740370 - DNA, 18 bp, Homo sapiens
gactaagcctacctgctc

SEQ ID NO: 5740371 - DNA, 16 bp, Homo sapiens
gactaaggaactaaaa

SEQ ID NO: 5740372 - DNA, 12 bp, Homo sapiens
gactaaggcctc

SEQ ID NO: 5740373 - DNA, 19 bp, Homo sapiens
gactaagggcaggaagact

SEQ ID NO: 5740374 - DNA, 20 bp, Homo sapiens
gactaaggggcagctcctga

SEQ ID NO: 5740375 - DNA, 16 bp, Homo sapiens
gactaatagagacaca

SEQ ID NO: 5740376 - DNA, 18 bp, Homo sapiens
gactaatagagacacaga

SEQ ID NO: 5740377 - DNA, 20 bp, Homo sapiens
gactaatagagacacagaga

SEQ ID NO: 5740378 - DNA, 20 bp, Homo sapiens
gactaatcagatgatggcca

SEQ ID NO: 5740379 - DNA, 23 bp, Homo sapiens
gactaatcagatgatggccattt

SEQ ID NO: 5740380 - DNA, 15 bp, Homo sapiens
gactaatcttattca

SEQ ID NO: 5740381 - DNA, 23 bp, Homo sapiens
gactaatgctttttagaaagcat

SEQ ID NO: 5740382 - DNA, 20 bp, Homo sapiens
gactaatgttggacagacac

SEQ ID NO: 5740383 - DNA, 15 bp, Homo sapiens
gactaattaggcaag

SEQ ID NO: 5740384 - DNA, 21 bp, Homo sapiens
gactaattcctgccctgccca

SEQ ID NO: 5740385 - DNA, 12 bp, Homo sapiens
gactaattgact

SEQ ID NO: 5740386 - DNA, 15 bp, Homo sapiens
gactaattgtataac

SEQ ID NO: 5740387 - DNA, 18 bp, Homo sapiens
gactaatttaaaaaataa

SEQ ID NO: 5740388 - DNA, 12 bp, Homo sapiens
gactaatttcaa

SEQ ID NO: 5740389 - DNA, 13 bp, Homo sapiens
gactaatttcaaa

SEQ ID NO: 5740390 - DNA, 23 bp, Homo sapiens
gactaattttacatgtttataaa

SEQ ID NO: 5740391 - DNA, 15 bp, Homo sapiens
gactacaaaatacaa

SEQ ID NO: 5740392 - DNA, 12 bp, Homo sapiens
gactacaataaa

SEQ ID NO: 5740393 - DNA, 16 bp, Homo sapiens
gactacacaatacagt

SEQ ID NO: 5740394 - DNA, 15 bp, Homo sapiens
gactacacctacgga

SEQ ID NO: 5740395 - DNA, 13 bp, Homo sapiens
gactacagaagtg

SEQ ID NO: 5740396 - DNA, 14 bp, Homo sapiens
gactacagaagtgg

SEQ ID NO: 5740397 - DNA, 12 bp, Homo sapiens
gactacaggcac

SEQ ID NO: 5740398 - DNA, 13 bp, Homo sapiens
gactacaggcacc

SEQ ID NO: 5740399 - DNA, 13 bp, Homo sapiens
gactacagggccg

SEQ ID NO: 5740400 - DNA, 17 bp, Homo sapiens
gactacaggtattttca

SEQ ID NO: 5740401 - DNA, 12 bp, Homo sapiens
gactacattttg

SEQ ID NO: 5740402 - DNA, 22 bp, Homo sapiens
gactacattttgctctgtgaac

SEQ ID NO: 5740403 - DNA, 14 bp, Homo sapiens
gactaccccagtcc

SEQ ID NO: 5740404 - DNA, 19 bp, Homo sapiens
gactaccccagtcccaggg

SEQ ID NO: 5740405 - DNA, 15 bp, Homo sapiens
gactaccgcaggccc

SEQ ID NO: 5740406 - DNA, 20 bp, Homo sapiens
gactacctataaatggactt

SEQ ID NO: 5740407 - DNA, 19 bp, Homo sapiens
gactacctctgtgccttgc

SEQ ID NO: 5740408 - DNA, 18 bp, Homo sapiens
gactactaacaaatgtaa

SEQ ID NO: 5740409 - DNA, 23 bp, Homo sapiens
gactactaaggccttttatgtaa

SEQ ID NO: 5740410 - DNA, 16 bp, Homo sapiens
gactactactctgcca

SEQ ID NO: 5740411 - DNA, 18 bp, Homo sapiens
gactactactctgccaat

SEQ ID NO: 5740412 - DNA, 17 bp, Homo sapiens
gactactcccccaggtg

SEQ ID NO: 5740413 - DNA, 13 bp, Homo sapiens
gactactctgcct

SEQ ID NO: 5740414 - DNA, 18 bp, Homo sapiens
gactactgctcctgtggc

SEQ ID NO: 5740415 - DNA, 14 bp, Homo sapiens
gactacttagcatc

SEQ ID NO: 5740416 - DNA, 18 bp, Homo sapiens
gactacttgggagcaccg

SEQ ID NO: 5740417 - DNA, 20 bp, Homo sapiens
gactacttgggagcaccgcc

SEQ ID NO: 5740418 - DNA, 22 bp, Homo sapiens
gactacttgttgtatctgctgg

SEQ ID NO: 5740419 - DNA, 18 bp, Homo sapiens
gactagaaagtgaataaa

SEQ ID NO: 5740420 - DNA, 14 bp, Homo sapiens
gactagaaattctt

SEQ ID NO: 5740421 - DNA, 16 bp, Homo sapiens
gactagaacctggagg

SEQ ID NO: 5740422 - DNA, 20 bp, Homo sapiens
gactagaacctggagggctg

SEQ ID NO: 5740423 - DNA, 21 bp, Homo sapiens
gactagaactcctgtcttctt

SEQ ID NO: 5740424 - DNA, 23 bp, Homo sapiens
gactagaagggccagtcctgcct

SEQ ID NO: 5740425 - DNA, 18 bp, Homo sapiens
gactagaattctagtgct

SEQ ID NO: 5740426 - DNA, 16 bp, Homo sapiens
gactagacaaataact

SEQ ID NO: 5740427 - DNA, 12 bp, Homo sapiens
gactagagaaac

SEQ ID NO: 5740428 - DNA, 15 bp, Homo sapiens
gactagagctttctt

SEQ ID NO: 5740429 - DNA, 22 bp, Homo sapiens
gactagaggcagggaggggact

SEQ ID NO: 5740430 - DNA, 20 bp, Homo sapiens
gactagaggccagggcagca

SEQ ID NO: 5740431 - DNA, 21 bp, Homo sapiens
gactagatactactttctctt

SEQ ID NO: 5740432 - DNA, 19 bp, Homo sapiens
gactagatttcaagctaat

SEQ ID NO: 5740433 - DNA, 20 bp, Homo sapiens
gactagcaaacaaaaataga

SEQ ID NO: 5740434 - DNA, 16 bp, Homo sapiens
gactagccagaattct

SEQ ID NO: 5740435 - DNA, 21 bp, Homo sapiens
gactagcccctgtggagactg

SEQ ID NO: 5740436 - DNA, 19 bp, Homo sapiens
gactagcctggccaacatg

SEQ ID NO: 5740437 - DNA, 15 bp, Homo sapiens
gactagctatctctg

SEQ ID NO: 5740438 - DNA, 12 bp, Homo sapiens
gactagctgcct

SEQ ID NO: 5740439 - DNA, 13 bp, Homo sapiens
gactagctgcctt

SEQ ID NO: 5740440 - DNA, 14 bp, Homo sapiens
gactaggaaaagtt

SEQ ID NO: 5740441 - DNA, 24 bp, Homo sapiens
gactaggacctgagcctggtcctg

SEQ ID NO: 5740442 - DNA, 13 bp, Homo sapiens
gactaggagacca

SEQ ID NO: 5740443 - DNA, 23 bp, Homo sapiens
gactaggcatgtcagaggacccc

SEQ ID NO: 5740444 - DNA, 23 bp, Homo sapiens
gactagggaaatgatcagttttt

SEQ ID NO: 5740445 - DNA, 19 bp, Homo sapiens
gactagggaagggaggtct

SEQ ID NO: 5740446 - DNA, 21 bp, Homo sapiens
gactagggattcaggctgctt

SEQ ID NO: 5740447 - DNA, 23 bp, Homo sapiens
gactagggcctcggaggctcctc

SEQ ID NO: 5740448 - DNA, 16 bp, Homo sapiens
gactagggtcctcagg

SEQ ID NO: 5740449 - DNA, 19 bp, Homo sapiens
gactagggtcctcaggcag

SEQ ID NO: 5740450 - DNA, 22 bp, Homo sapiens
gactaggtattgtctactctga

SEQ ID NO: 5740451 - DNA, 14 bp, Homo sapiens
gactaggtcaattt

SEQ ID NO: 5740452 - DNA, 22 bp, Homo sapiens
gactaggttctgtagagccaat

SEQ ID NO: 5740453 - DNA, 13 bp, Homo sapiens
gactagtcacctg

SEQ ID NO: 5740454 - DNA, 16 bp, Homo sapiens
gactagtcacctgggg

SEQ ID NO: 5740455 - DNA, 21 bp, Homo sapiens
gactagtgagtcagcaccttg

SEQ ID NO: 5740456 - DNA, 23 bp, Homo sapiens
gactagtgctgaagcttattaat

SEQ ID NO: 5740457 - DNA, 20 bp, Homo sapiens
gactagttctcttgtcctgt

SEQ ID NO: 5740458 - DNA, 22 bp, Homo sapiens
gactagttctcttgtcctgtga

SEQ ID NO: 5740459 - DNA, 14 bp, Homo sapiens
gactataaacatta

SEQ ID NO: 5740460 - DNA, 15 bp, Homo sapiens
gactataaagctgtt

SEQ ID NO: 5740461 - DNA, 12 bp, Homo sapiens
gactataaatgt

SEQ ID NO: 5740462 - DNA, 17 bp, Homo sapiens
gactatagcccaggtcc

SEQ ID NO: 5740463 - DNA, 16 bp, Homo sapiens
gactatataatttatt

SEQ ID NO: 5740464 - DNA, 13 bp, Homo sapiens
gactatatacatg

SEQ ID NO: 5740465 - DNA, 16 bp, Homo sapiens
gactatatacatgtgt

SEQ ID NO: 5740466 - DNA, 21 bp, Homo sapiens
gactatatacatgtgtgtata

SEQ ID NO: 5740467 - DNA, 18 bp, Homo sapiens
gactatatatataaatgt

SEQ ID NO: 5740468 - DNA, 15 bp, Homo sapiens
gactatattgggact

SEQ ID NO: 5740469 - DNA, 18 bp, Homo sapiens
gactatattgtacacacc

SEQ ID NO: 5740470 - DNA, 19 bp, Homo sapiens
gactatatttgggcctgct

SEQ ID NO: 5740471 - DNA, 20 bp, Homo sapiens
gactatcacatacaatttgc

SEQ ID NO: 5740472 - DNA, 17 bp, Homo sapiens
gactatcttactatttc

SEQ ID NO: 5740473 - DNA, 16 bp, Homo sapiens
gactatctttgctgca

SEQ ID NO: 5740474 - DNA, 20 bp, Homo sapiens
gactatgaacttctctcaga

SEQ ID NO: 5740475 - DNA, 18 bp, Homo sapiens
gactatgcagaggcctgg

SEQ ID NO: 5740476 - DNA, 21 bp, Homo sapiens
gactatgccgtcttctgccct

SEQ ID NO: 5740477 - DNA, 20 bp, Homo sapiens
gactatgcgtggctggaacc

SEQ ID NO: 5740478 - DNA, 16 bp, Homo sapiens
gactatggagcctggc

SEQ ID NO: 5740479 - DNA, 20 bp, Homo sapiens
gactatggagtcttgtgaaa

SEQ ID NO: 5740480 - DNA, 22 bp, Homo sapiens
gactattaggtgcaatttcaag

SEQ ID NO: 5740481 - DNA, 15 bp, Homo sapiens
gactattatgtggaa

SEQ ID NO: 5740482 - DNA, 16 bp, Homo sapiens
gactattatgttgtta

SEQ ID NO: 5740483 - DNA, 20 bp, Homo sapiens
gactattatgttgttagaga

SEQ ID NO: 5740484 - DNA, 15 bp, Homo sapiens
gactattcaaacagt

SEQ ID NO: 5740485 - DNA, 16 bp, Homo sapiens
gactattcaaacagtc

SEQ ID NO: 5740486 - DNA, 14 bp, Homo sapiens
gactattcagtttt

SEQ ID NO: 5740487 - DNA, 18 bp, Homo sapiens
gactattccttttctgta

SEQ ID NO: 5740488 - DNA, 19 bp, Homo sapiens
gactattctgtatctttca

SEQ ID NO: 5740489 - DNA, 21 bp, Homo sapiens
gactattcttgatgtaaaatc

SEQ ID NO: 5740490 - DNA, 20 bp, Homo sapiens
gactattgtgccaactgcca

SEQ ID NO: 5740491 - DNA, 13 bp, Homo sapiens
gactatttatgaa

SEQ ID NO: 5740492 - DNA, 14 bp, Homo sapiens
gactatttccacca

SEQ ID NO: 5740493 - DNA, 17 bp, Homo sapiens
gactatttttgttttta

SEQ ID NO: 5740494 - DNA, 17 bp, Homo sapiens
gactattttttaataaa

SEQ ID NO: 5740495 - DNA, 18 bp, Homo sapiens
gactcaaaaaaacaaaaa

SEQ ID NO: 5740496 - DNA, 17 bp, Homo sapiens
gactcaaaacctggaga

SEQ ID NO: 5740497 - DNA, 18 bp, Homo sapiens
gactcaaagtttcagaga

SEQ ID NO: 5740498 - DNA, 19 bp, Homo sapiens
gactcaaatctccagtatt

SEQ ID NO: 5740499 - DNA, 22 bp, Homo sapiens
gactcaacatgttactgaccag

SEQ ID NO: 5740500 - DNA, 17 bp, Homo sapiens
gactcaagattcccagg

SEQ ID NO: 5740501 - DNA, 20 bp, Homo sapiens
gactcaagattcccaggagt

SEQ ID NO: 5740502 - DNA, 14 bp, Homo sapiens
gactcaagccccgg

SEQ ID NO: 5740503 - DNA, 17 bp, Homo sapiens
gactcaagggtccagaa

SEQ ID NO: 5740504 - DNA, 18 bp, Homo sapiens
gactcaagggtccagaag

SEQ ID NO: 5740505 - DNA, 14 bp, Homo sapiens
gactcaagtaccca

SEQ ID NO: 5740506 - DNA, 22 bp, Homo sapiens
gactcaagtacccattctgttt

SEQ ID NO: 5740507 - DNA, 17 bp, Homo sapiens
gactcaagtccttacct

SEQ ID NO: 5740508 - DNA, 14 bp, Homo sapiens
gactcaatgcactg

SEQ ID NO: 5740509 - DNA, 17 bp, Homo sapiens
gactcaatgcactgaca

SEQ ID NO: 5740510 - DNA, 16 bp, Homo sapiens
gactcaatttctcccc

SEQ ID NO: 5740511 - DNA, 19 bp, Homo sapiens
gactcacaacctgaaccta

SEQ ID NO: 5740512 - DNA, 15 bp, Homo sapiens
gactcacaagaagac

SEQ ID NO: 5740513 - DNA, 17 bp, Homo sapiens
gactcacaagaagacca

SEQ ID NO: 5740514 - DNA, 19 bp, Homo sapiens
gactcacactctctgcagc

SEQ ID NO: 5740515 - DNA, 20 bp, Homo sapiens
gactcacactctctgcagcc

SEQ ID NO: 5740516 - DNA, 17 bp, Homo sapiens
gactcacacttgtaatc

SEQ ID NO: 5740517 - DNA, 20 bp, Homo sapiens
gactcaccaacttttaatgg

SEQ ID NO: 5740518 - DNA, 22 bp, Homo sapiens
gactcacctcccccatctcttc

SEQ ID NO: 5740519 - DNA, 13 bp, Homo sapiens
gactcacctctgc

SEQ ID NO: 5740520 - DNA, 20 bp, Homo sapiens
gactcacggctgcacctgca

SEQ ID NO: 5740521 - DNA, 23 bp, Homo sapiens
gactcactccattcctaggtcac

SEQ ID NO: 5740522 - DNA, 14 bp, Homo sapiens
gactcactggcagc

SEQ ID NO: 5740523 - DNA, 22 bp, Homo sapiens
gactcactggcagccccagcac

SEQ ID NO: 5740524 - DNA, 19 bp, Homo sapiens
gactcacttcaatgtgtca

SEQ ID NO: 5740525 - DNA, 20 bp, Homo sapiens
gactcacttcaatgtgtcat

SEQ ID NO: 5740526 - DNA, 22 bp, Homo sapiens
gactcacttgccattgccagga

SEQ ID NO: 5740527 - DNA, 16 bp, Homo sapiens
gactcagaaactccat

SEQ ID NO: 5740528 - DNA, 17 bp, Homo sapiens
gactcagaagcctctgg

SEQ ID NO: 5740529 - DNA, 15 bp, Homo sapiens
gactcagactcctgg

SEQ ID NO: 5740530 - DNA, 18 bp, Homo sapiens
gactcagactcctggctt

SEQ ID NO: 5740531 - DNA, 15 bp, Homo sapiens
gactcagagcaattt

SEQ ID NO: 5740532 - DNA, 12 bp, Homo sapiens
gactcagagctt

SEQ ID NO: 5740533 - DNA, 12 bp, Homo sapiens
gactcagaggct

SEQ ID NO: 5740534 - DNA, 16 bp, Homo sapiens
gactcagaggctggga

SEQ ID NO: 5740535 - DNA, 19 bp, Homo sapiens
gactcagaggctgggagca

SEQ ID NO: 5740536 - DNA, 21 bp, Homo sapiens
gactcagagggaaggctctct

SEQ ID NO: 5740537 - DNA, 13 bp, Homo sapiens
gactcagaggtcc

SEQ ID NO: 5740538 - DNA, 14 bp, Homo sapiens
gactcagaggtcca

SEQ ID NO: 5740539 - DNA, 22 bp, Homo sapiens
gactcagatttatttactcttg

SEQ ID NO: 5740540 - DNA, 21 bp, Homo sapiens
gactcagcaactttcccttgc

SEQ ID NO: 5740541 - DNA, 11 bp, Homo sapiens
gactcagcacc

SEQ ID NO: 5740542 - DNA, 12 bp, Homo sapiens
gactcagcacca

SEQ ID NO: 5740543 - DNA, 22 bp, Homo sapiens
gactcagcaccacattgcctca

SEQ ID NO: 5740544 - DNA, 23 bp, Homo sapiens
gactcagcaccacattgcctcat

SEQ ID NO: 5740545 - DNA, 14 bp, Homo sapiens
gactcagcagaggc

SEQ ID NO: 5740546 - DNA, 13 bp, Homo sapiens
gactcagcagtga

SEQ ID NO: 5740547 - DNA, 12 bp, Homo sapiens
gactcagcccac

SEQ ID NO: 5740548 - DNA, 15 bp, Homo sapiens
gactcagcccacctg

SEQ ID NO: 5740549 - DNA, 17 bp, Homo sapiens
gactcagcccacctgca

SEQ ID NO: 5740550 - DNA, 11 bp, Homo sapiens
gactcagccct

SEQ ID NO: 5740551 - DNA, 13 bp, Homo sapiens
gactcagccctga

SEQ ID NO: 5740552 - DNA, 15 bp, Homo sapiens
gactcagccctgagg

SEQ ID NO: 5740553 - DNA, 20 bp, Homo sapiens
gactcagcctctgctggaga

SEQ ID NO: 5740554 - DNA, 12 bp, Homo sapiens
gactcagccttg

SEQ ID NO: 5740555 - DNA, 22 bp, Homo sapiens
gactcagcgctcctcctgtgtg

SEQ ID NO: 5740556 - DNA, 14 bp, Homo sapiens
gactcagctcccca

SEQ ID NO: 5740557 - DNA, 17 bp, Homo sapiens
gactcagctccccagag

SEQ ID NO: 5740558 - DNA, 23 bp, Homo sapiens
gactcagctctgacattctgatt

SEQ ID NO: 5740559 - DNA, 13 bp, Homo sapiens
gactcagctctgt

SEQ ID NO: 5740560 - DNA, 14 bp, Homo sapiens
gactcagctctgtc

SEQ ID NO: 5740561 - DNA, 14 bp, Homo sapiens
gactcaggaacttt

SEQ ID NO: 5740562 - DNA, 18 bp, Homo sapiens
gactcaggaccagatgtc

SEQ ID NO: 5740563 - DNA, 15 bp, Homo sapiens
gactcaggagcctgt

SEQ ID NO: 5740564 - DNA, 20 bp, Homo sapiens
gactcaggagtctgccactt

SEQ ID NO: 5740565 - DNA, 17 bp, Homo sapiens
gactcaggatgcccagg

SEQ ID NO: 5740566 - DNA, 14 bp, Homo sapiens
gactcaggcctgcc

SEQ ID NO: 5740567 - DNA, 19 bp, Homo sapiens
gactcaggcgcctggcaca

SEQ ID NO: 5740568 - DNA, 22 bp, Homo sapiens
gactcaggcgcctggcacattt

SEQ ID NO: 5740569 - DNA, 24 bp, Homo sapiens
gactcagggaccggtgctgcagga

SEQ ID NO: 5740570 - DNA, 13 bp, Homo sapiens
gactcagggacct

SEQ ID NO: 5740571 - DNA, 16 bp, Homo sapiens
gactcagggcagcgcc

SEQ ID NO: 5740572 - DNA, 17 bp, Homo sapiens
gactcagggcagcgcca

SEQ ID NO: 5740573 - DNA, 18 bp, Homo sapiens
gactcagggcagcgccag

SEQ ID NO: 5740574 - DNA, 15 bp, Homo sapiens
gactcagggccccag

SEQ ID NO: 5740575 - DNA, 12 bp, Homo sapiens
gactcagggctc

SEQ ID NO: 5740576 - DNA, 14 bp, Homo sapiens
gactcagggctcct

SEQ ID NO: 5740577 - DNA, 16 bp, Homo sapiens
gactcagggctcctgg

SEQ ID NO: 5740578 - DNA, 20 bp, Homo sapiens
gactcaggtctgtaactgcc

SEQ ID NO: 5740579 - DNA, 18 bp, Homo sapiens
gactcaggtggtgtcctt

SEQ ID NO: 5740580 - DNA, 21 bp, Homo sapiens
gactcaggtggtgtccttctt

SEQ ID NO: 5740581 - DNA, 15 bp, Homo sapiens
gactcaggttccaga

SEQ ID NO: 5740582 - DNA, 17 bp, Homo sapiens
gactcaggttccagaac

SEQ ID NO: 5740583 - DNA, 24 bp, Homo sapiens
gactcagtatgctttccctgagga

SEQ ID NO: 5740584 - DNA, 20 bp, Homo sapiens
gactcagtgcagggacagcc

SEQ ID NO: 5740585 - DNA, 15 bp, Homo sapiens
gactcagtgtatttt

SEQ ID NO: 5740586 - DNA, 12 bp, Homo sapiens
gactcagtgttc

SEQ ID NO: 5740587 - DNA, 12 bp, Homo sapiens
gactcagtgttg

SEQ ID NO: 5740588 - DNA, 19 bp, Homo sapiens
gactcagttttttgtaact

SEQ ID NO: 5740589 - DNA, 17 bp, Homo sapiens
gactcatccgcctggcc

SEQ ID NO: 5740590 - DNA, 20 bp, Homo sapiens
gactcatcctgaacagcatg

SEQ ID NO: 5740591 - DNA, 19 bp, Homo sapiens
gactcatccttgcccaggt

SEQ ID NO: 5740592 - DNA, 15 bp, Homo sapiens
gactcatctttccct

SEQ ID NO: 5740593 - DNA, 22 bp, Homo sapiens
gactcatctttccctccttggt

SEQ ID NO: 5740594 - DNA, 13 bp, Homo sapiens
gactcatgaggag

SEQ ID NO: 5740595 - DNA, 12 bp, Homo sapiens
gactcatggcag

SEQ ID NO: 5740596 - DNA, 14 bp, Homo sapiens
gactcatggcagct

SEQ ID NO: 5740597 - DNA, 18 bp, Homo sapiens
gactcatggtgtgttaca

SEQ ID NO: 5740598 - DNA, 19 bp, Homo sapiens
gactcattaaatattctgt

SEQ ID NO: 5740599 - DNA, 20 bp, Homo sapiens
gactcattccctagatcttt

SEQ ID NO: 5740600 - DNA, 16 bp, Homo sapiens
gactcattctgaagga

SEQ ID NO: 5740601 - DNA, 17 bp, Homo sapiens
gactcattctgaaggag

SEQ ID NO: 5740602 - DNA, 14 bp, Homo sapiens
gactcattcttctg

SEQ ID NO: 5740603 - DNA, 15 bp, Homo sapiens
gactcattcttctgt

SEQ ID NO: 5740604 - DNA, 12 bp, Homo sapiens
gactccaaagaa

SEQ ID NO: 5740605 - DNA, 13 bp, Homo sapiens
gactccaaccaag

SEQ ID NO: 5740606 - DNA, 18 bp, Homo sapiens
gactccaagccctggggc

SEQ ID NO: 5740607 - DNA, 19 bp, Homo sapiens
gactccaagccctggggca

SEQ ID NO: 5740608 - DNA, 22 bp, Homo sapiens
gactccaagccctggggcaggg

SEQ ID NO: 5740609 - DNA, 16 bp, Homo sapiens
gactccaatctggtaa

SEQ ID NO: 5740610 - DNA, 16 bp, Homo sapiens
gactccacccatccta

SEQ ID NO: 5740611 - DNA, 18 bp, Homo sapiens
gactccacgatcctgcca

SEQ ID NO: 5740612 - DNA, 23 bp, Homo sapiens
gactccacgatcctgccaccctg

SEQ ID NO: 5740613 - DNA, 16 bp, Homo sapiens
gactccacgatgcctt

SEQ ID NO: 5740614 - DNA, 18 bp, Homo sapiens
gactccacgatgcctttg

SEQ ID NO: 5740615 - DNA, 19 bp, Homo sapiens
gactccacgatgcctttga

SEQ ID NO: 5740616 - DNA, 23 bp, Homo sapiens
gactccacggatgcgtgggcaga

SEQ ID NO: 5740617 - DNA, 23 bp, Homo sapiens
gactccactactttactgttggt

SEQ ID NO: 5740618 - DNA, 12 bp, Homo sapiens
gactccactgga

SEQ ID NO: 5740619 - DNA, 14 bp, Homo sapiens
gactccactggaca

SEQ ID NO: 5740620 - DNA, 15 bp, Homo sapiens
gactccactggacag

SEQ ID NO: 5740621 - DNA, 18 bp, Homo sapiens
gactccactggacagacc

SEQ ID NO: 5740622 - DNA, 17 bp, Homo sapiens
gactccagaagcagcag

SEQ ID NO: 5740623 - DNA, 18 bp, Homo sapiens
gactccagaatctgctgt

SEQ ID NO: 5740624 - DNA, 22 bp, Homo sapiens
gactccagaatctgctgttgcc

SEQ ID NO: 5740625 - DNA, 15 bp, Homo sapiens
gactccagatctgca

SEQ ID NO: 5740626 - DNA, 12 bp, Homo sapiens
gactccagccag

SEQ ID NO: 5740627 - DNA, 15 bp, Homo sapiens
gactccagccagcgc

SEQ ID NO: 5740628 - DNA, 21 bp, Homo sapiens
gactccagccagcgcctccct

SEQ ID NO: 5740629 - DNA, 14 bp, Homo sapiens
gactccagcccctg

SEQ ID NO: 5740630 - DNA, 15 bp, Homo sapiens
gactccagcccctgg

SEQ ID NO: 5740631 - DNA, 18 bp, Homo sapiens
gactccagcccctggacc

SEQ ID NO: 5740632 - DNA, 12 bp, Homo sapiens
gactccagcctg

SEQ ID NO: 5740633 - DNA, 20 bp, Homo sapiens
gactccagcctgcctggcag

SEQ ID NO: 5740634 - DNA, 23 bp, Homo sapiens
gactccagcgcctgccctccctg

SEQ ID NO: 5740635 - DNA, 22 bp, Homo sapiens
gactccagctctacgtcccaca

SEQ ID NO: 5740636 - DNA, 16 bp, Homo sapiens
gactccaggaagaagg

SEQ ID NO: 5740637 - DNA, 21 bp, Homo sapiens
gactccaggcagcagacacat

SEQ ID NO: 5740638 - DNA, 14 bp, Homo sapiens
gactccaggcccaa

SEQ ID NO: 5740639 - DNA, 18 bp, Homo sapiens
gactccaggcccaaggct

SEQ ID NO: 5740640 - DNA, 13 bp, Homo sapiens
gactccaggcctg

SEQ ID NO: 5740641 - DNA, 14 bp, Homo sapiens
gactccaggcctga

SEQ ID NO: 5740642 - DNA, 22 bp, Homo sapiens
gactccagggtgacaaggcctg

SEQ ID NO: 5740643 - DNA, 13 bp, Homo sapiens
gactccaggtctt

SEQ ID NO: 5740644 - DNA, 12 bp, Homo sapiens
gactccatctct

SEQ ID NO: 5740645 - DNA, 14 bp, Homo sapiens
gactccatctcttc

SEQ ID NO: 5740646 - DNA, 16 bp, Homo sapiens
gactccatggcccttc

SEQ ID NO: 5740647 - DNA, 17 bp, Homo sapiens
gactcccaaagagctgc

SEQ ID NO: 5740648 - DNA, 15 bp, Homo sapiens
gactcccaaccctgg

SEQ ID NO: 5740649 - DNA, 17 bp, Homo sapiens
gactcccaagtttccat

SEQ ID NO: 5740650 - DNA, 13 bp, Homo sapiens
gactcccagaacc

SEQ ID NO: 5740651 - DNA, 21 bp, Homo sapiens
gactcccagcagagcccacca

SEQ ID NO: 5740652 - DNA, 15 bp, Homo sapiens
gactcccagctccgt

SEQ ID NO: 5740653 - DNA, 20 bp, Homo sapiens
gactcccaggaccctgtgcc

SEQ ID NO: 5740654 - DNA, 16 bp, Homo sapiens
gactcccagtgaactt

SEQ ID NO: 5740655 - DNA, 22 bp, Homo sapiens
gactcccattcctgaagaacca

SEQ ID NO: 5740656 - DNA, 23 bp, Homo sapiens
gactcccattcctgaagaaccag

SEQ ID NO: 5740657 - DNA, 22 bp, Homo sapiens
gactcccattttggtgtgcatc

SEQ ID NO: 5740658 - DNA, 15 bp, Homo sapiens
gactccccagcccag

SEQ ID NO: 5740659 - DNA, 19 bp, Homo sapiens
gactccccagcccagcacc

SEQ ID NO: 5740660 - DNA, 23 bp, Homo sapiens
gactccccagcccagcacccctt

SEQ ID NO: 5740661 - DNA, 15 bp, Homo sapiens
gactcccccctggcc

SEQ ID NO: 5740662 - DNA, 23 bp, Homo sapiens
gactccccgcccgccctcctctg

SEQ ID NO: 5740663 - DNA, 11 bp, Homo sapiens
gactcccctcc

SEQ ID NO: 5740664 - DNA, 12 bp, Homo sapiens
gactcccctccc

SEQ ID NO: 5740665 - DNA, 23 bp, Homo sapiens
gactcccgccccgggctggccct

SEQ ID NO: 5740666 - DNA, 22 bp, Homo sapiens
gactcccgggccacgccccagc

SEQ ID NO: 5740667 - DNA, 19 bp, Homo sapiens
gactccctccatgtggccc

SEQ ID NO: 5740668 - DNA, 18 bp, Homo sapiens
gactccctccccacccaa

SEQ ID NO: 5740669 - DNA, 20 bp, Homo sapiens
gactccctccccacccaaga

SEQ ID NO: 5740670 - DNA, 13 bp, Homo sapiens
gactccctcctca

SEQ ID NO: 5740671 - DNA, 16 bp, Homo sapiens
gactccctcctcacct

SEQ ID NO: 5740672 - DNA, 22 bp, Homo sapiens
gactccctgagtctggacctcc

SEQ ID NO: 5740673 - DNA, 18 bp, Homo sapiens
gactccctgatcccagac

SEQ ID NO: 5740674 - DNA, 24 bp, Homo sapiens
gactccctgtgggggtggccatcc

SEQ ID NO: 5740675 - DNA, 17 bp, Homo sapiens
gactccgaggtggttca

SEQ ID NO: 5740676 - DNA, 20 bp, Homo sapiens
gactccgaggtggttcagac

SEQ ID NO: 5740677 - DNA, 15 bp, Homo sapiens
gactccgctggaggt

SEQ ID NO: 5740678 - DNA, 20 bp, Homo sapiens
gactccggaggactgagccc

SEQ ID NO: 5740679 - DNA, 15 bp, Homo sapiens
gactccggccctcct

SEQ ID NO: 5740680 - DNA, 12 bp, Homo sapiens
gactccggcctg

SEQ ID NO: 5740681 - DNA, 18 bp, Homo sapiens
gactccggcctgtaatca

SEQ ID NO: 5740682 - DNA, 17 bp, Homo sapiens
gactccggctgtgctgg

SEQ ID NO: 5740683 - DNA, 18 bp, Homo sapiens
gactccggctgtgctggg

SEQ ID NO: 5740684 - DNA, 19 bp, Homo sapiens
gactcctacctgccctgga

SEQ ID NO: 5740685 - DNA, 15 bp, Homo sapiens
gactcctagctgtcc

SEQ ID NO: 5740686 - DNA, 14 bp, Homo sapiens
gactcctaggccct

SEQ ID NO: 5740687 - DNA, 18 bp, Homo sapiens
gactcctcaaaccacttg

SEQ ID NO: 5740688 - DNA, 22 bp, Homo sapiens
gactcctcaaaccacttgcctg

SEQ ID NO: 5740689 - DNA, 20 bp, Homo sapiens
gactcctcaattccagggaa

SEQ ID NO: 5740690 - DNA, 17 bp, Homo sapiens
gactcctcagcacccct

SEQ ID NO: 5740691 - DNA, 18 bp, Homo sapiens
gactcctcagcacccctc

SEQ ID NO: 5740692 - DNA, 14 bp, Homo sapiens
gactcctcaggaga

SEQ ID NO: 5740693 - DNA, 21 bp, Homo sapiens
gactcctccccaccctcctgg

SEQ ID NO: 5740694 - DNA, 22 bp, Homo sapiens
gactcctccccaccctcctggc

SEQ ID NO: 5740695 - DNA, 11 bp, Homo sapiens
gactcctccct

SEQ ID NO: 5740696 - DNA, 15 bp, Homo sapiens
gactcctccctgggg

SEQ ID NO: 5740697 - DNA, 13 bp, Homo sapiens
gactcctcccttc

SEQ ID NO: 5740698 - DNA, 18 bp, Homo sapiens
gactcctcccttccccac

SEQ ID NO: 5740699 - DNA, 17 bp, Homo sapiens
gactcctcctgggggct

SEQ ID NO: 5740700 - DNA, 22 bp, Homo sapiens
gactcctcctgggggctggctc

SEQ ID NO: 5740701 - DNA, 16 bp, Homo sapiens
gactcctcctttctcc

SEQ ID NO: 5740702 - DNA, 13 bp, Homo sapiens
gactcctcctttt

SEQ ID NO: 5740703 - DNA, 16 bp, Homo sapiens
gactcctcctttttcc

SEQ ID NO: 5740704 - DNA, 17 bp, Homo sapiens
gactcctcggcctggct

SEQ ID NO: 5740705 - DNA, 21 bp, Homo sapiens
gactcctcgggcaagggccgt

SEQ ID NO: 5740706 - DNA, 12 bp, Homo sapiens
gactcctctggg

SEQ ID NO: 5740707 - DNA, 11 bp, Homo sapiens
gactcctctgt

SEQ ID NO: 5740708 - DNA, 22 bp, Homo sapiens
gactcctgaaacctcttcctag

SEQ ID NO: 5740709 - DNA, 18 bp, Homo sapiens
gactcctgaggacagctg

SEQ ID NO: 5740710 - DNA, 23 bp, Homo sapiens
gactcctgcacacgctccttcct

SEQ ID NO: 5740711 - DNA, 16 bp, Homo sapiens
gactcctgcaggcagc

SEQ ID NO: 5740712 - DNA, 20 bp, Homo sapiens
gactcctgcaggcagccagg

SEQ ID NO: 5740713 - DNA, 14 bp, Homo sapiens
gactcctgcttctt

SEQ ID NO: 5740714 - DNA, 13 bp, Homo sapiens
gactcctggactc

SEQ ID NO: 5740715 - DNA, 21 bp, Homo sapiens
gactcctggactccggaggac

SEQ ID NO: 5740716 - DNA, 13 bp, Homo sapiens
gactcctggcagg

SEQ ID NO: 5740717 - DNA, 19 bp, Homo sapiens
gactcctggcttcatgtgg

SEQ ID NO: 5740718 - DNA, 13 bp, Homo sapiens
gactcctggtcct

SEQ ID NO: 5740719 - DNA, 24 bp, Homo sapiens
gactcctggtgcccctcgccagct

SEQ ID NO: 5740720 - DNA, 16 bp, Homo sapiens
gactcctgtgcaactt

SEQ ID NO: 5740721 - DNA, 22 bp, Homo sapiens
gactcctgtggagatgacttgg

SEQ ID NO: 5740722 - DNA, 22 bp, Homo sapiens
gactcctgttgccatggattca

SEQ ID NO: 5740723 - DNA, 18 bp, Homo sapiens
gactccttctccccaatc

SEQ ID NO: 5740724 - DNA, 18 bp, Homo sapiens
gactccttgttctgctct

SEQ ID NO: 5740725 - DNA, 14 bp, Homo sapiens
gactcgaaactgac

SEQ ID NO: 5740726 - DNA, 19 bp, Homo sapiens
gactcgagaactttcattt

SEQ ID NO: 5740727 - DNA, 16 bp, Homo sapiens
gactcgagagggctga

SEQ ID NO: 5740728 - DNA, 21 bp, Homo sapiens
gactcgagagggctgagcccc

SEQ ID NO: 5740729 - DNA, 20 bp, Homo sapiens
gactcgagtgtttaaatgct

SEQ ID NO: 5740730 - DNA, 19 bp, Homo sapiens
gactcgcagcacccacagc

SEQ ID NO: 5740731 - DNA, 15 bp, Homo sapiens
gactcgcttgtaaat

SEQ ID NO: 5740732 - DNA, 19 bp, Homo sapiens
gactcgcttgtaaatacca

SEQ ID NO: 5740733 - DNA, 13 bp, Homo sapiens
gactcggagacta

SEQ ID NO: 5740734 - DNA, 14 bp, Homo sapiens
gactcggccactgt

SEQ ID NO: 5740735 - DNA, 16 bp, Homo sapiens
gactcggccactgtgt

SEQ ID NO: 5740736 - DNA, 19 bp, Homo sapiens
gactcgggagctgcacaca

SEQ ID NO: 5740737 - DNA, 22 bp, Homo sapiens
gactcgggagctgcacacacct

SEQ ID NO: 5740738 - DNA, 15 bp, Homo sapiens
gactcgggctcctgt

SEQ ID NO: 5740739 - DNA, 16 bp, Homo sapiens
gactcgggctcctgtg

SEQ ID NO: 5740740 - DNA, 17 bp, Homo sapiens
gactcgggctcctgtgc

SEQ ID NO: 5740741 - DNA, 14 bp, Homo sapiens
gactcgggggtggg

SEQ ID NO: 5740742 - DNA, 19 bp, Homo sapiens
gactcggggtgcttccttg

SEQ ID NO: 5740743 - DNA, 13 bp, Homo sapiens
gactcggtttctc

SEQ ID NO: 5740744 - DNA, 16 bp, Homo sapiens
gactcgtaaagctgct

SEQ ID NO: 5740745 - DNA, 18 bp, Homo sapiens
gactcgtaaagctgctag

SEQ ID NO: 5740746 - DNA, 20 bp, Homo sapiens
gactcgttcccatagatttg

SEQ ID NO: 5740747 - DNA, 15 bp, Homo sapiens
gactctaaagaccaa

SEQ ID NO: 5740748 - DNA, 16 bp, Homo sapiens
gactctaaagaccaaa

SEQ ID NO: 5740749 - DNA, 19 bp, Homo sapiens
gactctaaagaccaaactt

SEQ ID NO: 5740750 - DNA, 13 bp, Homo sapiens
gactctaaatatt

SEQ ID NO: 5740751 - DNA, 15 bp, Homo sapiens
gactctaaatgcagt

SEQ ID NO: 5740752 - DNA, 23 bp, Homo sapiens
gactctaaatgcagttttaagaa

SEQ ID NO: 5740753 - DNA, 21 bp, Homo sapiens
gactctaaattctttatttct

SEQ ID NO: 5740754 - DNA, 23 bp, Homo sapiens
gactctaaattctttatttctgt

SEQ ID NO: 5740755 - DNA, 14 bp, Homo sapiens
gactctaagaaaga

SEQ ID NO: 5740756 - DNA, 16 bp, Homo sapiens
gactctaagctcagtg

SEQ ID NO: 5740757 - DNA, 15 bp, Homo sapiens
gactctaagctgtgt

SEQ ID NO: 5740758 - DNA, 18 bp, Homo sapiens
gactctaagctgtgtgca

SEQ ID NO: 5740759 - DNA, 20 bp, Homo sapiens
gactctaagctgtgtgcagg

SEQ ID NO: 5740760 - DNA, 18 bp, Homo sapiens
gactctacatgcttgttg

SEQ ID NO: 5740761 - DNA, 23 bp, Homo sapiens
gactctacctcatatcagtttgc

SEQ ID NO: 5740762 - DNA, 17 bp, Homo sapiens
gactctactcccagcgc

SEQ ID NO: 5740763 - DNA, 18 bp, Homo sapiens
gactctagaagctcaggt

SEQ ID NO: 5740764 - DNA, 20 bp, Homo sapiens
gactctagaagctcaggttc

SEQ ID NO: 5740765 - DNA, 15 bp, Homo sapiens
gactctagcaaggct

SEQ ID NO: 5740766 - DNA, 16 bp, Homo sapiens
gactctagcaaggctc

SEQ ID NO: 5740767 - DNA, 13 bp, Homo sapiens
gactctaggcttc

SEQ ID NO: 5740768 - DNA, 17 bp, Homo sapiens
gactctaggtgcccttg

SEQ ID NO: 5740769 - DNA, 18 bp, Homo sapiens
gactctaggttatacaat

SEQ ID NO: 5740770 - DNA, 23 bp, Homo sapiens
gactctagtactgtgaatccagt

SEQ ID NO: 5740771 - DNA, 15 bp, Homo sapiens
gactctatgctctgg

SEQ ID NO: 5740772 - DNA, 20 bp, Homo sapiens
gactctatggactcgatttt

SEQ ID NO: 5740773 - DNA, 16 bp, Homo sapiens
gactctattttaatgt

SEQ ID NO: 5740774 - DNA, 12 bp, Homo sapiens
gactctcaggga

SEQ ID NO: 5740775 - DNA, 18 bp, Homo sapiens
gactctcagtctctgagc

SEQ ID NO: 5740776 - DNA, 20 bp, Homo sapiens
gactctcagtctctgagcag

SEQ ID NO: 5740777 - DNA, 12 bp, Homo sapiens
gactctccaggc

SEQ ID NO: 5740778 - DNA, 22 bp, Homo sapiens
gactctcccaggcctgcctgca

SEQ ID NO: 5740779 - DNA, 22 bp, Homo sapiens
gactctcccctcttatgtacct

SEQ ID NO: 5740780 - DNA, 14 bp, Homo sapiens
gactctcctcctcc

SEQ ID NO: 5740781 - DNA, 17 bp, Homo sapiens
gactctcctcctcccct

SEQ ID NO: 5740782 - DNA, 13 bp, Homo sapiens
gactctctccagg

SEQ ID NO: 5740783 - DNA, 18 bp, Homo sapiens
gactctctccaggagggc

SEQ ID NO: 5740784 - DNA, 21 bp, Homo sapiens
gactctctccaggagggctcg

SEQ ID NO: 5740785 - DNA, 17 bp, Homo sapiens
gactctctccatcagaa

SEQ ID NO: 5740786 - DNA, 15 bp, Homo sapiens
gactctctcctctct

SEQ ID NO: 5740787 - DNA, 21 bp, Homo sapiens
gactctctcctctctctccct

SEQ ID NO: 5740788 - DNA, 19 bp, Homo sapiens
gactctctgagctggggag

SEQ ID NO: 5740789 - DNA, 13 bp, Homo sapiens
gactctctgtgac

SEQ ID NO: 5740790 - DNA, 12 bp, Homo sapiens
gactctctttct

SEQ ID NO: 5740791 - DNA, 20 bp, Homo sapiens
gactctgaactggagctgct

SEQ ID NO: 5740792 - DNA, 15 bp, Homo sapiens
gactctgaagcctct

SEQ ID NO: 5740793 - DNA, 16 bp, Homo sapiens
gactctgaagcctctg

SEQ ID NO: 5740794 - DNA, 19 bp, Homo sapiens
gactctgagccaagggagg

SEQ ID NO: 5740795 - DNA, 23 bp, Homo sapiens
gactctgagccaagggagggaag

SEQ ID NO: 5740796 - DNA, 20 bp, Homo sapiens
gactctgagcgggaggcaga

SEQ ID NO: 5740797 - DNA, 21 bp, Homo sapiens
gactctgagcgggaggcagag

SEQ ID NO: 5740798 - DNA, 20 bp, Homo sapiens
gactctgaggactcctgagg

SEQ ID NO: 5740799 - DNA, 19 bp, Homo sapiens
gactctgaggctctttctg

SEQ ID NO: 5740800 - DNA, 22 bp, Homo sapiens
gactctgatggaatgtgccacc

SEQ ID NO: 5740801 - DNA, 12 bp, Homo sapiens
gactctgcacat

SEQ ID NO: 5740802 - DNA, 14 bp, Homo sapiens
gactctgcacatga

SEQ ID NO: 5740803 - DNA, 15 bp, Homo sapiens
gactctgcacccgcc

SEQ ID NO: 5740804 - DNA, 21 bp, Homo sapiens
gactctgcacccgcctcgacc

SEQ ID NO: 5740805 - DNA, 14 bp, Homo sapiens
gactctgcactctc

SEQ ID NO: 5740806 - DNA, 23 bp, Homo sapiens
gactctgcactctccaccctggc

SEQ ID NO: 5740807 - DNA, 13 bp, Homo sapiens
gactctgcactga

SEQ ID NO: 5740808 - DNA, 14 bp, Homo sapiens
gactctgcagcctc

SEQ ID NO: 5740809 - DNA, 20 bp, Homo sapiens
gactctgcatcccagcacct

SEQ ID NO: 5740810 - DNA, 21 bp, Homo sapiens
gactctgcatcccagcacctg

SEQ ID NO: 5740811 - DNA, 12 bp, Homo sapiens
gactctgcccca

SEQ ID NO: 5740812 - DNA, 12 bp, Homo sapiens
gactctgccccc

SEQ ID NO: 5740813 - DNA, 17 bp, Homo sapiens
gactctgccccctgctg

SEQ ID NO: 5740814 - DNA, 14 bp, Homo sapiens
gactctgccgctgt

SEQ ID NO: 5740815 - DNA, 23 bp, Homo sapiens
gactctgcctaaccatgggctca

SEQ ID NO: 5740816 - DNA, 21 bp, Homo sapiens
gactctgcgggaggctggggc

SEQ ID NO: 5740817 - DNA, 12 bp, Homo sapiens
gactctgctctc

SEQ ID NO: 5740818 - DNA, 19 bp, Homo sapiens
gactctgcttaaacaaagc

SEQ ID NO: 5740819 - DNA, 15 bp, Homo sapiens
gactctgcttggctg

SEQ ID NO: 5740820 - DNA, 19 bp, Homo sapiens
gactctggaaccatcctct

SEQ ID NO: 5740821 - DNA, 15 bp, Homo sapiens
gactctggaagcccc

SEQ ID NO: 5740822 - DNA, 14 bp, Homo sapiens
gactctggagccaa

SEQ ID NO: 5740823 - DNA, 13 bp, Homo sapiens
gactctggatatt

SEQ ID NO: 5740824 - DNA, 16 bp, Homo sapiens
gactctggcaaagctt

SEQ ID NO: 5740825 - DNA, 12 bp, Homo sapiens
gactctggcaca

SEQ ID NO: 5740826 - DNA, 16 bp, Homo sapiens
gactctggccctggcc

SEQ ID NO: 5740827 - DNA, 17 bp, Homo sapiens
gactctggccctggccc

SEQ ID NO: 5740828 - DNA, 14 bp, Homo sapiens
gactctggctgcca

SEQ ID NO: 5740829 - DNA, 17 bp, Homo sapiens
gactctggctgccaaga

SEQ ID NO: 5740830 - DNA, 13 bp, Homo sapiens
gactctgggcagg

SEQ ID NO: 5740831 - DNA, 21 bp, Homo sapiens
gactctgggctatggacacag

SEQ ID NO: 5740832 - DNA, 14 bp, Homo sapiens
gactctgggctgtg

SEQ ID NO: 5740833 - DNA, 19 bp, Homo sapiens
gactctgggctgtgcctga

SEQ ID NO: 5740834 - DNA, 13 bp, Homo sapiens
gactctggggcgc

SEQ ID NO: 5740835 - DNA, 18 bp, Homo sapiens
gactctgggtccctcgga

SEQ ID NO: 5740836 - DNA, 13 bp, Homo sapiens
gactctgggtcct

SEQ ID NO: 5740837 - DNA, 19 bp, Homo sapiens
gactctgggtccttcctga

SEQ ID NO: 5740838 - DNA, 21 bp, Homo sapiens
gactctgggttcgttggggac

SEQ ID NO: 5740839 - DNA, 19 bp, Homo sapiens
gactctggtttctcattct

SEQ ID NO: 5740840 - DNA, 22 bp, Homo sapiens
gactctgtcaatttccctgact

SEQ ID NO: 5740841 - DNA, 13 bp, Homo sapiens
gactctgtcctga

SEQ ID NO: 5740842 - DNA, 12 bp, Homo sapiens
gactctgtctca

SEQ ID NO: 5740843 - DNA, 17 bp, Homo sapiens
gactctgtctggccagg

SEQ ID NO: 5740844 - DNA, 20 bp, Homo sapiens
gactctgtctggccagggag

SEQ ID NO: 5740845 - DNA, 14 bp, Homo sapiens
gactctgtgagatt

SEQ ID NO: 5740846 - DNA, 12 bp, Homo sapiens
gactctgtgctc

SEQ ID NO: 5740847 - DNA, 13 bp, Homo sapiens
gactctgtgctgg

SEQ ID NO: 5740848 - DNA, 16 bp, Homo sapiens
gactctgtgctggcca

SEQ ID NO: 5740849 - DNA, 17 bp, Homo sapiens
gactctgtgctggccag

SEQ ID NO: 5740850 - DNA, 17 bp, Homo sapiens
gactctgtggggccaca

SEQ ID NO: 5740851 - DNA, 18 bp, Homo sapiens
gactctgtggggccacac

SEQ ID NO: 5740852 - DNA, 15 bp, Homo sapiens
gactctgtgtggctg

SEQ ID NO: 5740853 - DNA, 18 bp, Homo sapiens
gactctgttgctggtctt

SEQ ID NO: 5740854 - DNA, 14 bp, Homo sapiens
gactcttaagaaga

SEQ ID NO: 5740855 - DNA, 17 bp, Homo sapiens
gactcttaagaagactg

SEQ ID NO: 5740856 - DNA, 18 bp, Homo sapiens
gactcttaagaagactgc

SEQ ID NO: 5740857 - DNA, 21 bp, Homo sapiens
gactcttagccctcaccacag

SEQ ID NO: 5740858 - DNA, 15 bp, Homo sapiens
gactcttcaaaaact

SEQ ID NO: 5740859 - DNA, 14 bp, Homo sapiens
gactcttcacagat

SEQ ID NO: 5740860 - DNA, 20 bp, Homo sapiens
gactcttccatcagagatgg

SEQ ID NO: 5740861 - DNA, 14 bp, Homo sapiens
gactcttccctggg

SEQ ID NO: 5740862 - DNA, 18 bp, Homo sapiens
gactcttcgatgtgccca

SEQ ID NO: 5740863 - DNA, 21 bp, Homo sapiens
gactcttctcggctcaggctc

SEQ ID NO: 5740864 - DNA, 17 bp, Homo sapiens
gactcttctgagcacct

SEQ ID NO: 5740865 - DNA, 19 bp, Homo sapiens
gactcttcttatcacactt

SEQ ID NO: 5740866 - DNA, 22 bp, Homo sapiens
gactcttcttatcacacttgca

SEQ ID NO: 5740867 - DNA, 18 bp, Homo sapiens
gactcttgactcttgcct

SEQ ID NO: 5740868 - DNA, 21 bp, Homo sapiens
gactcttgcctgtttcccagg

SEQ ID NO: 5740869 - DNA, 12 bp, Homo sapiens
gactcttggact

SEQ ID NO: 5740870 - DNA, 14 bp, Homo sapiens
gactcttgggaggg

SEQ ID NO: 5740871 - DNA, 14 bp, Homo sapiens
gactcttgttttca

SEQ ID NO: 5740872 - DNA, 19 bp, Homo sapiens
gactcttgttttcagtttc

SEQ ID NO: 5740873 - DNA, 15 bp, Homo sapiens
gactctttagagcag

SEQ ID NO: 5740874 - DNA, 16 bp, Homo sapiens
gactctttatgcttgc

SEQ ID NO: 5740875 - DNA, 21 bp, Homo sapiens
gactctttattgtctgtaaat

SEQ ID NO: 5740876 - DNA, 23 bp, Homo sapiens
gactctttattgtctgtaaatct

SEQ ID NO: 5740877 - DNA, 16 bp, Homo sapiens
gactctttatttttct

SEQ ID NO: 5740878 - DNA, 18 bp, Homo sapiens
gactctttatttttctct

SEQ ID NO: 5740879 - DNA, 19 bp, Homo sapiens
gactctttccgactgccca

SEQ ID NO: 5740880 - DNA, 20 bp, Homo sapiens
gactctttccgactgcccag

SEQ ID NO: 5740881 - DNA, 21 bp, Homo sapiens
gactctttccgactgcccaga

SEQ ID NO: 5740882 - DNA, 20 bp, Homo sapiens
gactctttctgaaggaagag

SEQ ID NO: 5740883 - DNA, 23 bp, Homo sapiens
gactctttctgaaggaagagaag

SEQ ID NO: 5740884 - DNA, 13 bp, Homo sapiens
gactctttgaaat

SEQ ID NO: 5740885 - DNA, 17 bp, Homo sapiens
gactctttgatatgcca

SEQ ID NO: 5740886 - DNA, 22 bp, Homo sapiens
gactcttttccaaacacaggca

SEQ ID NO: 5740887 - DNA, 17 bp, Homo sapiens
gactcttttgccattaa

SEQ ID NO: 5740888 - DNA, 23 bp, Homo sapiens
gactctttttggactcagcccac

SEQ ID NO: 5740889 - DNA, 23 bp, Homo sapiens
gactgaaaaaaaaaaagaagaag

SEQ ID NO: 5740890 - DNA, 15 bp, Homo sapiens
gactgaaaaactgtt

SEQ ID NO: 5740891 - DNA, 20 bp, Homo sapiens
gactgaaaatatataagctc

SEQ ID NO: 5740892 - DNA, 15 bp, Homo sapiens
gactgaaaatattgt

SEQ ID NO: 5740893 - DNA, 16 bp, Homo sapiens
gactgaaagaagaaca

SEQ ID NO: 5740894 - DNA, 15 bp, Homo sapiens
gactgaaagcagcag

SEQ ID NO: 5740895 - DNA, 23 bp, Homo sapiens
gactgaaaggtgtgaacagcttt

SEQ ID NO: 5740896 - DNA, 23 bp, Homo sapiens
gactgaaattgttttaccagctc

SEQ ID NO: 5740897 - DNA, 18 bp, Homo sapiens
gactgaaatttagtacac

SEQ ID NO: 5740898 - DNA, 16 bp, Homo sapiens
gactgaaccagagctg

SEQ ID NO: 5740899 - DNA, 23 bp, Homo sapiens
gactgaaccagagctggaacaca

SEQ ID NO: 5740900 - DNA, 13 bp, Homo sapiens
gactgaactgcac

SEQ ID NO: 5740901 - DNA, 11 bp, Homo sapiens
gactgaagaaa

SEQ ID NO: 5740902 - DNA, 19 bp, Homo sapiens
gactgaagaaaatccttca

SEQ ID NO: 5740903 - DNA, 16 bp, Homo sapiens
gactgaagaccagctg

SEQ ID NO: 5740904 - DNA, 16 bp, Homo sapiens
gactgaagactagccc

SEQ ID NO: 5740905 - DNA, 22 bp, Homo sapiens
gactgaagatttatttttaata

SEQ ID NO: 5740906 - DNA, 18 bp, Homo sapiens
gactgaagccgtgcctgt

SEQ ID NO: 5740907 - DNA, 16 bp, Homo sapiens
gactgaagcctgcagg

SEQ ID NO: 5740908 - DNA, 16 bp, Homo sapiens
gactgaagcgaacatc

SEQ ID NO: 5740909 - DNA, 19 bp, Homo sapiens
gactgaagcgaacatcttc

SEQ ID NO: 5740910 - DNA, 14 bp, Homo sapiens
gactgaaggaaaag

SEQ ID NO: 5740911 - DNA, 16 bp, Homo sapiens
gactgaaggggcacac

SEQ ID NO: 5740912 - DNA, 12 bp, Homo sapiens
gactgaatgcag

SEQ ID NO: 5740913 - DNA, 16 bp, Homo sapiens
gactgaatggactttg

SEQ ID NO: 5740914 - DNA, 18 bp, Homo sapiens
gactgaatgttttattta

SEQ ID NO: 5740915 - DNA, 21 bp, Homo sapiens
gactgaatgttttatttatca

SEQ ID NO: 5740916 - DNA, 13 bp, Homo sapiens
gactgaattcaaa

SEQ ID NO: 5740917 - DNA, 14 bp, Homo sapiens
gactgaattctgcc

SEQ ID NO: 5740918 - DNA, 15 bp, Homo sapiens
gactgaatttaacta

SEQ ID NO: 5740919 - DNA, 13 bp, Homo sapiens
gactgacacaggc

SEQ ID NO: 5740920 - DNA, 16 bp, Homo sapiens
gactgacacaggccag

SEQ ID NO: 5740921 - DNA, 18 bp, Homo sapiens
gactgacacaggccagcc

SEQ ID NO: 5740922 - DNA, 20 bp, Homo sapiens
gactgacacaggccagcccc

SEQ ID NO: 5740923 - DNA, 22 bp, Homo sapiens
gactgacacaggccagccccat

SEQ ID NO: 5740924 - DNA, 13 bp, Homo sapiens
gactgacactact

SEQ ID NO: 5740925 - DNA, 23 bp, Homo sapiens
gactgaccaaagactgcagaacc

SEQ ID NO: 5740926 - DNA, 22 bp, Homo sapiens
gactgaccaatattgtacagtt

SEQ ID NO: 5740927 - DNA, 22 bp, Homo sapiens
gactgaccatcatgccctctct

SEQ ID NO: 5740928 - DNA, 19 bp, Homo sapiens
gactgacccaaaatgtgaa

SEQ ID NO: 5740929 - DNA, 16 bp, Homo sapiens
gactgacccattcaca

SEQ ID NO: 5740930 - DNA, 20 bp, Homo sapiens
gactgacccattcacatttt

SEQ ID NO: 5740931 - DNA, 20 bp, Homo sapiens
gactgacccccatctgagct

SEQ ID NO: 5740932 - DNA, 21 bp, Homo sapiens
gactgaccctgaggaggccgc

SEQ ID NO: 5740933 - DNA, 14 bp, Homo sapiens
gactgacctgcccc

SEQ ID NO: 5740934 - DNA, 13 bp, Homo sapiens
gactgacgagaga

SEQ ID NO: 5740935 - DNA, 23 bp, Homo sapiens
gactgacggctgtgtatttctgt

SEQ ID NO: 5740936 - DNA, 19 bp, Homo sapiens
gactgactcacattgcctt

SEQ ID NO: 5740937 - DNA, 21 bp, Homo sapiens
gactgacttgtttgtcttcca

SEQ ID NO: 5740938 - DNA, 13 bp, Homo sapiens
gactgagaaattt

SEQ ID NO: 5740939 - DNA, 18 bp, Homo sapiens
gactgagaaccgtgacat

SEQ ID NO: 5740940 - DNA, 15 bp, Homo sapiens
gactgagaacttttt

SEQ ID NO: 5740941 - DNA, 20 bp, Homo sapiens
gactgagacacgatgccgag

SEQ ID NO: 5740942 - DNA, 21 bp, Homo sapiens
gactgagagcccactgcagtt

SEQ ID NO: 5740943 - DNA, 16 bp, Homo sapiens
gactgagatttgtaaa

SEQ ID NO: 5740944 - DNA, 19 bp, Homo sapiens
gactgagcagactggtgag

SEQ ID NO: 5740945 - DNA, 12 bp, Homo sapiens
gactgagcagcc

SEQ ID NO: 5740946 - DNA, 15 bp, Homo sapiens
gactgagcagccgcc

SEQ ID NO: 5740947 - DNA, 20 bp, Homo sapiens
gactgagcagccgccagctg

SEQ ID NO: 5740948 - DNA, 20 bp, Homo sapiens
gactgagccaaggaggcctg

SEQ ID NO: 5740949 - DNA, 21 bp, Homo sapiens
gactgagccaaggaggcctgg

SEQ ID NO: 5740950 - DNA, 14 bp, Homo sapiens
gactgagccagtcc

SEQ ID NO: 5740951 - DNA, 15 bp, Homo sapiens
gactgagcccccacc

SEQ ID NO: 5740952 - DNA, 17 bp, Homo sapiens
gactgagcccccaccgg

SEQ ID NO: 5740953 - DNA, 23 bp, Homo sapiens
gactgagcccccaccggaactgg

SEQ ID NO: 5740954 - DNA, 22 bp, Homo sapiens
gactgagccccgcagacctccc

SEQ ID NO: 5740955 - DNA, 22 bp, Homo sapiens
gactgagccctctcactccagc

SEQ ID NO: 5740956 - DNA, 15 bp, Homo sapiens
gactgagcgaggaaa

SEQ ID NO: 5740957 - DNA, 19 bp, Homo sapiens
gactgagcgaggaaaaaca

SEQ ID NO: 5740958 - DNA, 21 bp, Homo sapiens
gactgagcggccgcagagact

SEQ ID NO: 5740959 - DNA, 23 bp, Homo sapiens
gactgagcggccgcagagactgg

SEQ ID NO: 5740960 - DNA, 13 bp, Homo sapiens
gactgagctcaag

SEQ ID NO: 5740961 - DNA, 17 bp, Homo sapiens
gactgagctctccaggc

SEQ ID NO: 5740962 - DNA, 20 bp, Homo sapiens
gactgagctctccaggccag

SEQ ID NO: 5740963 - DNA, 18 bp, Homo sapiens
gactgagctggggaggga

SEQ ID NO: 5740964 - DNA, 14 bp, Homo sapiens
gactgaggacaggc

SEQ ID NO: 5740965 - DNA, 13 bp, Homo sapiens
gactgaggcaagc

SEQ ID NO: 5740966 - DNA, 12 bp, Homo sapiens
gactgaggcctg

SEQ ID NO: 5740967 - DNA, 14 bp, Homo sapiens
gactgaggcctgag

SEQ ID NO: 5740968 - DNA, 13 bp, Homo sapiens
gactgagggcagt

SEQ ID NO: 5740969 - DNA, 18 bp, Homo sapiens
gactgagggcctggtcac

SEQ ID NO: 5740970 - DNA, 16 bp, Homo sapiens
gactgagggggcctgg

SEQ ID NO: 5740971 - DNA, 17 bp, Homo sapiens
gactgagggggcctgga

SEQ ID NO: 5740972 - DNA, 18 bp, Homo sapiens
gactgagggggcctggat

SEQ ID NO: 5740973 - DNA, 18 bp, Homo sapiens
gactgaggtataaagaca

SEQ ID NO: 5740974 - DNA, 20 bp, Homo sapiens
gactgaggtataaagacaag

SEQ ID NO: 5740975 - DNA, 17 bp, Homo sapiens
gactgaggtgcctgctc

SEQ ID NO: 5740976 - DNA, 14 bp, Homo sapiens
gactgagtcagatg

SEQ ID NO: 5740977 - DNA, 21 bp, Homo sapiens
gactgagtcccctccaggaag

SEQ ID NO: 5740978 - DNA, 22 bp, Homo sapiens
gactgagtcctcgtagccatct

SEQ ID NO: 5740979 - DNA, 21 bp, Homo sapiens
gactgagtgagccttttgcag

SEQ ID NO: 5740980 - DNA, 17 bp, Homo sapiens
gactgatagacaccata

SEQ ID NO: 5740981 - DNA, 19 bp, Homo sapiens
gactgatagcttacactga

SEQ ID NO: 5740982 - DNA, 21 bp, Homo sapiens
gactgatcatccaggcctcag

SEQ ID NO: 5740983 - DNA, 20 bp, Homo sapiens
gactgatccctggccactga

SEQ ID NO: 5740984 - DNA, 10 bp, Homo sapiens
gactgatcct

SEQ ID NO: 5740985 - DNA, 19 bp, Homo sapiens
gactgatcctgaacaagaa

SEQ ID NO: 5740986 - DNA, 12 bp, Homo sapiens
gactgatctcag

SEQ ID NO: 5740987 - DNA, 16 bp, Homo sapiens
gactgatggtgtctga

SEQ ID NO: 5740988 - DNA, 18 bp, Homo sapiens
gactgatggttgctttga

SEQ ID NO: 5740989 - DNA, 20 bp, Homo sapiens
gactgatggtttggaaaata

SEQ ID NO: 5740990 - DNA, 21 bp, Homo sapiens
gactgatggtttggaaaataa

SEQ ID NO: 5740991 - DNA, 16 bp, Homo sapiens
gactgatgtctcctaa

SEQ ID NO: 5740992 - DNA, 18 bp, Homo sapiens
gactgatgtctcctaagc

SEQ ID NO: 5740993 - DNA, 18 bp, Homo sapiens
gactgattccttctctgg

SEQ ID NO: 5740994 - DNA, 16 bp, Homo sapiens
gactgattctgggatg

SEQ ID NO: 5740995 - DNA, 16 bp, Homo sapiens
gactgatttcagagtg

SEQ ID NO: 5740996 - DNA, 22 bp, Homo sapiens
gactgcaaacttttttatatct

SEQ ID NO: 5740997 - DNA, 21 bp, Homo sapiens
gactgcaacatacaggtgcct

SEQ ID NO: 5740998 - DNA, 17 bp, Homo sapiens
gactgcaacttctgtcc

SEQ ID NO: 5740999 - DNA, 19 bp, Homo sapiens
gactgcaagcatttttcca

SEQ ID NO: 5741000 - DNA, 20 bp, Homo sapiens
gactgcaagcatttttccat

SEQ ID NO: 5741001 - DNA, 17 bp, Homo sapiens
gactgcaagtgagcaaa

SEQ ID NO: 5741002 - DNA, 21 bp, Homo sapiens
gactgcaagtgagcaaacctg

SEQ ID NO: 5741003 - DNA, 15 bp, Homo sapiens
gactgcacagcggcc

SEQ ID NO: 5741004 - DNA, 21 bp, Homo sapiens
gactgcacagcgtcctgtcca

SEQ ID NO: 5741005 - DNA, 16 bp, Homo sapiens
gactgcacaggtgaca

SEQ ID NO: 5741006 - DNA, 13 bp, Homo sapiens
gactgcaccaaca

SEQ ID NO: 5741007 - DNA, 16 bp, Homo sapiens
gactgcaccagcgccc

SEQ ID NO: 5741008 - DNA, 19 bp, Homo sapiens
gactgcaccagcgccccca

SEQ ID NO: 5741009 - DNA, 17 bp, Homo sapiens
gactgcaccttgtgaag

SEQ ID NO: 5741010 - DNA, 20 bp, Homo sapiens
gactgcagaacccccaggtg

SEQ ID NO: 5741011 - DNA, 22 bp, Homo sapiens
gactgcagaacccccaggtggc

SEQ ID NO: 5741012 - DNA, 23 bp, Homo sapiens
gactgcagaacccccaggtggcc

SEQ ID NO: 5741013 - DNA, 14 bp, Homo sapiens
gactgcagaggagc

SEQ ID NO: 5741014 - DNA, 23 bp, Homo sapiens
gactgcagaggagccacctgggc

SEQ ID NO: 5741015 - DNA, 23 bp, Homo sapiens
gactgcagaggggaaagacttcc

SEQ ID NO: 5741016 - DNA, 22 bp, Homo sapiens
gactgcagggacacgggcagcc

SEQ ID NO: 5741017 - DNA, 19 bp, Homo sapiens
gactgcaggggccactcca

SEQ ID NO: 5741018 - DNA, 21 bp, Homo sapiens
gactgcaggtgggctgggccc

SEQ ID NO: 5741019 - DNA, 12 bp, Homo sapiens
gactgcagtgtg

SEQ ID NO: 5741020 - DNA, 15 bp, Homo sapiens
gactgcatgcaagct

SEQ ID NO: 5741021 - DNA, 17 bp, Homo sapiens
gactgcatggggaggca

SEQ ID NO: 5741022 - DNA, 18 bp, Homo sapiens
gactgcatggggaggcag

SEQ ID NO: 5741023 - DNA, 21 bp, Homo sapiens
gactgcatggggaggcagcag

SEQ ID NO: 5741024 - DNA, 23 bp, Homo sapiens
gactgcatgtaccatttgcatgg

SEQ ID NO: 5741025 - DNA, 14 bp, Homo sapiens
gactgcattgccgc

SEQ ID NO: 5741026 - DNA, 14 bp, Homo sapiens
gactgcatttgtgt

SEQ ID NO: 5741027 - DNA, 12 bp, Homo sapiens
gactgccaagcc

SEQ ID NO: 5741028 - DNA, 15 bp, Homo sapiens
gactgccaagccatg

SEQ ID NO: 5741029 - DNA, 21 bp, Homo sapiens
gactgccacgtgccttaggaa

SEQ ID NO: 5741030 - DNA, 13 bp, Homo sapiens
gactgccagctct

SEQ ID NO: 5741031 - DNA, 21 bp, Homo sapiens
gactgccagctcttcctagct

SEQ ID NO: 5741032 - DNA, 16 bp, Homo sapiens
gactgccaggctgttt

SEQ ID NO: 5741033 - DNA, 11 bp, Homo sapiens
gactgccaggt

SEQ ID NO: 5741034 - DNA, 12 bp, Homo sapiens
gactgcccaccc

SEQ ID NO: 5741035 - DNA, 20 bp, Homo sapiens
gactgcccaccctgggcctc

SEQ ID NO: 5741036 - DNA, 10 bp, Homo sapiens
gactgcccag

SEQ ID NO: 5741037 - DNA, 21 bp, Homo sapiens
gactgcccagaaagtgggggt

SEQ ID NO: 5741038 - DNA, 14 bp, Homo sapiens
gactgcccagccac

SEQ ID NO: 5741039 - DNA, 21 bp, Homo sapiens
gactgcccagccactccaagc

SEQ ID NO: 5741040 - DNA, 18 bp, Homo sapiens
gactgccccaactcctgg

SEQ ID NO: 5741041 - DNA, 13 bp, Homo sapiens
gactgccccagcc

SEQ ID NO: 5741042 - DNA, 15 bp, Homo sapiens
gactgccccagccaa

SEQ ID NO: 5741043 - DNA, 23 bp, Homo sapiens
gactgccccgtgcagactggagg

SEQ ID NO: 5741044 - DNA, 22 bp, Homo sapiens
gactgcccctgctgtgctgctc

SEQ ID NO: 5741045 - DNA, 18 bp, Homo sapiens
gactgccccttgcttctc

SEQ ID NO: 5741046 - DNA, 16 bp, Homo sapiens
gactgcccggcacaga

SEQ ID NO: 5741047 - DNA, 15 bp, Homo sapiens
gactgcccggcaggg

SEQ ID NO: 5741048 - DNA, 12 bp, Homo sapiens
gactgccctgcc

SEQ ID NO: 5741049 - DNA, 13 bp, Homo sapiens
gactgccctgccc

SEQ ID NO: 5741050 - DNA, 14 bp, Homo sapiens
gactgccctgccca

SEQ ID NO: 5741051 - DNA, 12 bp, Homo sapiens
gactgcctccct

SEQ ID NO: 5741052 - DNA, 12 bp, Homo sapiens
gactgcctctgc

SEQ ID NO: 5741053 - DNA, 18 bp, Homo sapiens
gactgcctgtctccatga

SEQ ID NO: 5741054 - DNA, 20 bp, Homo sapiens
gactgcgatcttcagagcag

SEQ ID NO: 5741055 - DNA, 13 bp, Homo sapiens
gactgcgctgctt

SEQ ID NO: 5741056 - DNA, 15 bp, Homo sapiens
gactgcgggagccag

SEQ ID NO: 5741057 - DNA, 14 bp, Homo sapiens
gactgcgttctgca

SEQ ID NO: 5741058 - DNA, 16 bp, Homo sapiens
gactgcgttctgcaag

SEQ ID NO: 5741059 - DNA, 12 bp, Homo sapiens
gactgctaaata

SEQ ID NO: 5741060 - DNA, 16 bp, Homo sapiens
gactgctacctctgag

SEQ ID NO: 5741061 - DNA, 19 bp, Homo sapiens
gactgctacctctgagaag

SEQ ID NO: 5741062 - DNA, 21 bp, Homo sapiens
gactgctacctttcaaagctt

SEQ ID NO: 5741063 - DNA, 21 bp, Homo sapiens
gactgctagaaccaagcacta

SEQ ID NO: 5741064 - DNA, 18 bp, Homo sapiens
gactgctagtgttctgtc

SEQ ID NO: 5741065 - DNA, 23 bp, Homo sapiens
gactgctattctagagcttttat

SEQ ID NO: 5741066 - DNA, 15 bp, Homo sapiens
gactgctcagaactt

SEQ ID NO: 5741067 - DNA, 20 bp, Homo sapiens
gactgctcagaacttgctgc

SEQ ID NO: 5741068 - DNA, 23 bp, Homo sapiens
gactgctcagaacttgctgctgt

SEQ ID NO: 5741069 - DNA, 14 bp, Homo sapiens
gactgctcaggcct

SEQ ID NO: 5741070 - DNA, 24 bp, Homo sapiens
gactgctccccagccctggctctg

SEQ ID NO: 5741071 - DNA, 17 bp, Homo sapiens
gactgctcctgagcccc

SEQ ID NO: 5741072 - DNA, 19 bp, Homo sapiens
gactgctcctgagccccca

SEQ ID NO: 5741073 - DNA, 15 bp, Homo sapiens
gactgctcctgggca

SEQ ID NO: 5741074 - DNA, 16 bp, Homo sapiens
gactgctcctgggcat

SEQ ID NO: 5741075 - DNA, 14 bp, Homo sapiens
gactgctgacccac

SEQ ID NO: 5741076 - DNA, 19 bp, Homo sapiens
gactgctgcgctgtgctgg

SEQ ID NO: 5741077 - DNA, 22 bp, Homo sapiens
gactgctgcgctgtgctggtct

SEQ ID NO: 5741078 - DNA, 17 bp, Homo sapiens
gactgctgctccccacc

SEQ ID NO: 5741079 - DNA, 13 bp, Homo sapiens
gactgctgctctc

SEQ ID NO: 5741080 - DNA, 19 bp, Homo sapiens
gactgctgctctcccaagg

SEQ ID NO: 5741081 - DNA, 14 bp, Homo sapiens
gactgctgctgcct

SEQ ID NO: 5741082 - DNA, 14 bp, Homo sapiens
gactgctgggactg

SEQ ID NO: 5741083 - DNA, 20 bp, Homo sapiens
gactgctggttgacatcaga

SEQ ID NO: 5741084 - DNA, 19 bp, Homo sapiens
gactgcttcacggactctt

SEQ ID NO: 5741085 - DNA, 12 bp, Homo sapiens
gactgcttccca

SEQ ID NO: 5741086 - DNA, 13 bp, Homo sapiens
gactgcttcccat

SEQ ID NO: 5741087 - DNA, 16 bp, Homo sapiens
gactgcttcccatcct

SEQ ID NO: 5741088 - DNA, 17 bp, Homo sapiens
gactgcttcccatccta

SEQ ID NO: 5741089 - DNA, 15 bp, Homo sapiens
gactgcttgccctaa

SEQ ID NO: 5741090 - DNA, 17 bp, Homo sapiens
gactgcttgccctaagc

SEQ ID NO: 5741091 - DNA, 21 bp, Homo sapiens
gactgcttgccctaagcagaa

SEQ ID NO: 5741092 - DNA, 23 bp, Homo sapiens
gactgcttgccctaagcagaaag

SEQ ID NO: 5741093 - DNA, 16 bp, Homo sapiens
gactgcttggccagat

SEQ ID NO: 5741094 - DNA, 18 bp, Homo sapiens
gactgcttggccagatgc

SEQ ID NO: 5741095 - DNA, 18 bp, Homo sapiens
gactgctttcagtgcctg

SEQ ID NO: 5741096 - DNA, 19 bp, Homo sapiens
gactgctttcagtgcctgc

SEQ ID NO: 5741097 - DNA, 22 bp, Homo sapiens
gactgctttcagtgcctgctgt

SEQ ID NO: 5741098 - DNA, 14 bp, Homo sapiens
gactggaaaaatga

SEQ ID NO: 5741099 - DNA, 22 bp, Homo sapiens
gactggaaaaatgaactgtatt

SEQ ID NO: 5741100 - DNA, 17 bp, Homo sapiens
gactggaaaaggtggac

SEQ ID NO: 5741101 - DNA, 22 bp, Homo sapiens
gactggaaaagtgatgtatttt

SEQ ID NO: 5741102 - DNA, 15 bp, Homo sapiens
gactggaaagcacaa

SEQ ID NO: 5741103 - DNA, 17 bp, Homo sapiens
gactggaaccagggaga

SEQ ID NO: 5741104 - DNA, 13 bp, Homo sapiens
gactggaactgca

SEQ ID NO: 5741105 - DNA, 14 bp, Homo sapiens
gactggaagacact

SEQ ID NO: 5741106 - DNA, 19 bp, Homo sapiens
gactggaagacacttcaga

SEQ ID NO: 5741107 - DNA, 18 bp, Homo sapiens
gactggaagcacagcttc

SEQ ID NO: 5741108 - DNA, 19 bp, Homo sapiens
gactggaagttcataccta

SEQ ID NO: 5741109 - DNA, 14 bp, Homo sapiens
gactggaattttta

SEQ ID NO: 5741110 - DNA, 16 bp, Homo sapiens
gactggacagccaggg

SEQ ID NO: 5741111 - DNA, 13 bp, Homo sapiens
gactggacagctt

SEQ ID NO: 5741112 - DNA, 14 bp, Homo sapiens
gactggaccagaca

SEQ ID NO: 5741113 - DNA, 15 bp, Homo sapiens
gactggactggacca

SEQ ID NO: 5741114 - DNA, 16 bp, Homo sapiens
gactggagacaatgca

SEQ ID NO: 5741115 - DNA, 23 bp, Homo sapiens
gactggagacaatgcagatgcca

SEQ ID NO: 5741116 - DNA, 13 bp, Homo sapiens
gactggagcccga

SEQ ID NO: 5741117 - DNA, 21 bp, Homo sapiens
gactggagcccgagggcctga

SEQ ID NO: 5741118 - DNA, 16 bp, Homo sapiens
gactggaggaacacag

SEQ ID NO: 5741119 - DNA, 20 bp, Homo sapiens
gactggaggaacacagagaa

SEQ ID NO: 5741120 - DNA, 20 bp, Homo sapiens
gactggaggaccacactcaa

SEQ ID NO: 5741121 - DNA, 21 bp, Homo sapiens
gactggaggcaggactcctgg

SEQ ID NO: 5741122 - DNA, 22 bp, Homo sapiens
gactggaggcaggactcctggg

SEQ ID NO: 5741123 - DNA, 16 bp, Homo sapiens
gactggaggcccctgg

SEQ ID NO: 5741124 - DNA, 20 bp, Homo sapiens
gactggaggcccctggagcc

SEQ ID NO: 5741125 - DNA, 15 bp, Homo sapiens
gactggaggtgggca

SEQ ID NO: 5741126 - DNA, 16 bp, Homo sapiens
gactggaggtgggcat

SEQ ID NO: 5741127 - DNA, 22 bp, Homo sapiens
gactggagtcagatgagcaagg

SEQ ID NO: 5741128 - DNA, 22 bp, Homo sapiens
gactggagtgaggcttccaggc

SEQ ID NO: 5741129 - DNA, 22 bp, Homo sapiens
gactggatactgcccggggcag

SEQ ID NO: 5741130 - DNA, 22 bp, Homo sapiens
gactggatagtccgtctctgct

SEQ ID NO: 5741131 - DNA, 19 bp, Homo sapiens
gactggatctgcaggtggg

SEQ ID NO: 5741132 - DNA, 18 bp, Homo sapiens
gactggatcttctatcat

SEQ ID NO: 5741133 - DNA, 16 bp, Homo sapiens
gactggatgctcgcca

SEQ ID NO: 5741134 - DNA, 18 bp, Homo sapiens
gactggcacagttttctg

SEQ ID NO: 5741135 - DNA, 22 bp, Homo sapiens
gactggcagactcaaggggctg

SEQ ID NO: 5741136 - DNA, 15 bp, Homo sapiens
gactggcagccaggg

SEQ ID NO: 5741137 - DNA, 23 bp, Homo sapiens
gactggcaggtgcagatgggctg

SEQ ID NO: 5741138 - DNA, 17 bp, Homo sapiens
gactggccagaggcagc

SEQ ID NO: 5741139 - DNA, 12 bp, Homo sapiens
gactggccaggg

SEQ ID NO: 5741140 - DNA, 20 bp, Homo sapiens
gactggccagttgcccagag

SEQ ID NO: 5741141 - DNA, 22 bp, Homo sapiens
gactggccagttgcccagagca

SEQ ID NO: 5741142 - DNA, 23 bp, Homo sapiens
gactggccagttgcccagagcac

SEQ ID NO: 5741143 - DNA, 17 bp, Homo sapiens
gactggccatttttctg

SEQ ID NO: 5741144 - DNA, 13 bp, Homo sapiens
gactggcccaccc

SEQ ID NO: 5741145 - DNA, 17 bp, Homo sapiens
gactggcccacccctct

SEQ ID NO: 5741146 - DNA, 22 bp, Homo sapiens
gactggcccacccctcttcccc

SEQ ID NO: 5741147 - DNA, 22 bp, Homo sapiens
gactggcccctgggtcagtctg

SEQ ID NO: 5741148 - DNA, 17 bp, Homo sapiens
gactggcccttgcccaa

SEQ ID NO: 5741149 - DNA, 15 bp, Homo sapiens
gactggccgggcagg

SEQ ID NO: 5741150 - DNA, 16 bp, Homo sapiens
gactggccgggcaggc

SEQ ID NO: 5741151 - DNA, 17 bp, Homo sapiens
gactggccgtggctcca

SEQ ID NO: 5741152 - DNA, 19 bp, Homo sapiens
gactggccgtggctccaga

SEQ ID NO: 5741153 - DNA, 21 bp, Homo sapiens
gactggcctaggggccagggc

SEQ ID NO: 5741154 - DNA, 18 bp, Homo sapiens
gactggcctgaggagcag

SEQ ID NO: 5741155 - DNA, 14 bp, Homo sapiens
gactggcggagaag

SEQ ID NO: 5741156 - DNA, 20 bp, Homo sapiens
gactggctagagtcctcact

SEQ ID NO: 5741157 - DNA, 21 bp, Homo sapiens
gactggctagagtcctcactc

SEQ ID NO: 5741158 - DNA, 13 bp, Homo sapiens
gactggctcaaga

SEQ ID NO: 5741159 - DNA, 14 bp, Homo sapiens
gactggctcaagaa

SEQ ID NO: 5741160 - DNA, 19 bp, Homo sapiens
gactggctcacccctctcc

SEQ ID NO: 5741161 - DNA, 20 bp, Homo sapiens
gactggctcacccctctccc

SEQ ID NO: 5741162 - DNA, 22 bp, Homo sapiens
gactggctcatgcctcagcccg

SEQ ID NO: 5741163 - DNA, 14 bp, Homo sapiens
gactggctgcacag

SEQ ID NO: 5741164 - DNA, 17 bp, Homo sapiens
gactggctgcacagccc

SEQ ID NO: 5741165 - DNA, 18 bp, Homo sapiens
gactggctgcacagccca

SEQ ID NO: 5741166 - DNA, 19 bp, Homo sapiens
gactggctgcacagcccaa

SEQ ID NO: 5741167 - DNA, 13 bp, Homo sapiens
gactggctgtgag

SEQ ID NO: 5741168 - DNA, 23 bp, Homo sapiens
gactggcttgctcccgccccagg

SEQ ID NO: 5741169 - DNA, 19 bp, Homo sapiens
gactggctttgtcccacag

SEQ ID NO: 5741170 - DNA, 20 bp, Homo sapiens
gactggcttttattaatgca

SEQ ID NO: 5741171 - DNA, 16 bp, Homo sapiens
gactgggaacagaact

SEQ ID NO: 5741172 - DNA, 23 bp, Homo sapiens
gactgggaagggggcaggcccct

SEQ ID NO: 5741173 - DNA, 18 bp, Homo sapiens
gactgggaccaggcacca

SEQ ID NO: 5741174 - DNA, 20 bp, Homo sapiens
gactgggaccaggcaccagg

SEQ ID NO: 5741175 - DNA, 20 bp, Homo sapiens
gactgggaccgtgcgagctg

SEQ ID NO: 5741176 - DNA, 22 bp, Homo sapiens
gactgggaccgtgcgagctgcc

SEQ ID NO: 5741177 - DNA, 23 bp, Homo sapiens
gactgggaccgtgcgagctgccg

SEQ ID NO: 5741178 - DNA, 19 bp, Homo sapiens
gactgggagccacttctcc

SEQ ID NO: 5741179 - DNA, 21 bp, Homo sapiens
gactgggagccacttctcccc

SEQ ID NO: 5741180 - DNA, 21 bp, Homo sapiens
gactgggagcccccagcctgt

SEQ ID NO: 5741181 - DNA, 23 bp, Homo sapiens
gactgggagcccccagcctgtca

SEQ ID NO: 5741182 - DNA, 23 bp, Homo sapiens
gactgggagccgcagcagctccc

SEQ ID NO: 5741183 - DNA, 14 bp, Homo sapiens
gactgggaggaggg

SEQ ID NO: 5741184 - DNA, 16 bp, Homo sapiens
gactgggaggaggggg

SEQ ID NO: 5741185 - DNA, 15 bp, Homo sapiens
gactgggagtcagag

SEQ ID NO: 5741186 - DNA, 23 bp, Homo sapiens
gactgggagtcagagccctggct

SEQ ID NO: 5741187 - DNA, 22 bp, Homo sapiens
gactgggcaacactgcaggaca

SEQ ID NO: 5741188 - DNA, 18 bp, Homo sapiens
gactgggcactggggcct

SEQ ID NO: 5741189 - DNA, 12 bp, Homo sapiens
gactgggcccag

SEQ ID NO: 5741190 - DNA, 14 bp, Homo sapiens
gactgggcccaggc

SEQ ID NO: 5741191 - DNA, 14 bp, Homo sapiens
gactgggccctgcc

SEQ ID NO: 5741192 - DNA, 17 bp, Homo sapiens
gactgggccctgtccag

SEQ ID NO: 5741193 - DNA, 18 bp, Homo sapiens
gactgggccgggcccagg

SEQ ID NO: 5741194 - DNA, 21 bp, Homo sapiens
gactgggccgggcccagggcc

SEQ ID NO: 5741195 - DNA, 22 bp, Homo sapiens
gactgggccgggcccagggcct

SEQ ID NO: 5741196 - DNA, 17 bp, Homo sapiens
gactgggcctcccttgg

SEQ ID NO: 5741197 - DNA, 20 bp, Homo sapiens
gactgggcctcccttgggct

SEQ ID NO: 5741198 - DNA, 15 bp, Homo sapiens
gactgggctagggag

SEQ ID NO: 5741199 - DNA, 12 bp, Homo sapiens
gactgggctctg

SEQ ID NO: 5741200 - DNA, 10 bp, Homo sapiens
gactgggctg

SEQ ID NO: 5741201 - DNA, 14 bp, Homo sapiens
gactgggctgaggg

SEQ ID NO: 5741202 - DNA, 21 bp, Homo sapiens
gactgggctgagggagcctgg

SEQ ID NO: 5741203 - DNA, 12 bp, Homo sapiens
gactgggctgct

SEQ ID NO: 5741204 - DNA, 15 bp, Homo sapiens
gactgggctggctgc

SEQ ID NO: 5741205 - DNA, 16 bp, Homo sapiens
gactgggctggctgcc

SEQ ID NO: 5741206 - DNA, 17 bp, Homo sapiens
gactgggctggctgcct

SEQ ID NO: 5741207 - DNA, 21 bp, Homo sapiens
gactgggctgggtttgctgtc

SEQ ID NO: 5741208 - DNA, 15 bp, Homo sapiens
gactggggagcacag

SEQ ID NO: 5741209 - DNA, 18 bp, Homo sapiens
gactggggatgtgggagg

SEQ ID NO: 5741210 - DNA, 20 bp, Homo sapiens
gactggggatgtgggaggga

SEQ ID NO: 5741211 - DNA, 17 bp, Homo sapiens
gactgggggactgggag

SEQ ID NO: 5741212 - DNA, 16 bp, Homo sapiens
gactgggggcctctgc

SEQ ID NO: 5741213 - DNA, 18 bp, Homo sapiens
gactgggggcctctgcct

SEQ ID NO: 5741214 - DNA, 14 bp, Homo sapiens
gactgggggtgcca

SEQ ID NO: 5741215 - DNA, 17 bp, Homo sapiens
gactggggtggcctcaa

SEQ ID NO: 5741216 - DNA, 18 bp, Homo sapiens
gactggggtggcctcaag

SEQ ID NO: 5741217 - DNA, 18 bp, Homo sapiens
gactgggtctgacctggt

SEQ ID NO: 5741218 - DNA, 14 bp, Homo sapiens
gactgggtgccacg

SEQ ID NO: 5741219 - DNA, 18 bp, Homo sapiens
gactgggtgggccccaca

SEQ ID NO: 5741220 - DNA, 16 bp, Homo sapiens
gactgggtttatgtcc

SEQ ID NO: 5741221 - DNA, 22 bp, Homo sapiens
gactgggtttggaccccagctg

SEQ ID NO: 5741222 - DNA, 17 bp, Homo sapiens
gactgggttttgtctct

SEQ ID NO: 5741223 - DNA, 14 bp, Homo sapiens
gactggtaggagga

SEQ ID NO: 5741224 - DNA, 19 bp, Homo sapiens
gactggtaggaggaggcat

SEQ ID NO: 5741225 - DNA, 11 bp, Homo sapiens
gactggtccag

SEQ ID NO: 5741226 - DNA, 20 bp, Homo sapiens
gactggtcccccatgggctg

SEQ ID NO: 5741227 - DNA, 22 bp, Homo sapiens
gactggtctcgaactcctggcc

SEQ ID NO: 5741228 - DNA, 18 bp, Homo sapiens
gactggtcttccttacct

SEQ ID NO: 5741229 - DNA, 23 bp, Homo sapiens
gactggtcttccttacctggaaa

SEQ ID NO: 5741230 - DNA, 17 bp, Homo sapiens
gactggtgaatataaat

SEQ ID NO: 5741231 - DNA, 12 bp, Homo sapiens
gactggtgactg

SEQ ID NO: 5741232 - DNA, 15 bp, Homo sapiens
gactggtgactgatt

SEQ ID NO: 5741233 - DNA, 18 bp, Homo sapiens
gactggtgactgattctt

SEQ ID NO: 5741234 - DNA, 19 bp, Homo sapiens
gactggtgagagaagaaaa

SEQ ID NO: 5741235 - DNA, 19 bp, Homo sapiens
gactggtgctataggctgg

SEQ ID NO: 5741236 - DNA, 23 bp, Homo sapiens
gactggtgctataggctggagaa

SEQ ID NO: 5741237 - DNA, 15 bp, Homo sapiens
gactggtgctgcagc

SEQ ID NO: 5741238 - DNA, 19 bp, Homo sapiens
gactggttagtgatgcagt

SEQ ID NO: 5741239 - DNA, 17 bp, Homo sapiens
gactggtttacaggccc

SEQ ID NO: 5741240 - DNA, 18 bp, Homo sapiens
gactggtttacaggccct

SEQ ID NO: 5741241 - DNA, 15 bp, Homo sapiens
gactggtttctcctg

SEQ ID NO: 5741242 - DNA, 17 bp, Homo sapiens
gactggtttgtttgctt

SEQ ID NO: 5741243 - DNA, 17 bp, Homo sapiens
gactgtaaattccaaag

SEQ ID NO: 5741244 - DNA, 22 bp, Homo sapiens
gactgtaaattccaaagatctg

SEQ ID NO: 5741245 - DNA, 18 bp, Homo sapiens
gactgtaacgattgacac

SEQ ID NO: 5741246 - DNA, 13 bp, Homo sapiens
gactgtaactttt

SEQ ID NO: 5741247 - DNA, 21 bp, Homo sapiens
gactgtaactttttttcagtt

SEQ ID NO: 5741248 - DNA, 14 bp, Homo sapiens
gactgtaagatgtt

SEQ ID NO: 5741249 - DNA, 14 bp, Homo sapiens
gactgtaagcagat

SEQ ID NO: 5741250 - DNA, 15 bp, Homo sapiens
gactgtaagcagatt

SEQ ID NO: 5741251 - DNA, 20 bp, Homo sapiens
gactgtaagttgggcttgct

SEQ ID NO: 5741252 - DNA, 16 bp, Homo sapiens
gactgtacacacttta

SEQ ID NO: 5741253 - DNA, 21 bp, Homo sapiens
gactgtacataattgcatgaa

SEQ ID NO: 5741254 - DNA, 21 bp, Homo sapiens
gactgtacctgtaggaaacag

SEQ ID NO: 5741255 - DNA, 17 bp, Homo sapiens
gactgtactcctcccag

SEQ ID NO: 5741256 - DNA, 11 bp, Homo sapiens
gactgtactgg

SEQ ID NO: 5741257 - DNA, 16 bp, Homo sapiens
gactgtactggccagt

SEQ ID NO: 5741258 - DNA, 18 bp, Homo sapiens
gactgtacttattttcca

SEQ ID NO: 5741259 - DNA, 11 bp, Homo sapiens
gactgtagaaa

SEQ ID NO: 5741260 - DNA, 17 bp, Homo sapiens
gactgtagccacagctg

SEQ ID NO: 5741261 - DNA, 19 bp, Homo sapiens
gactgtagccacagctgct

SEQ ID NO: 5741262 - DNA, 23 bp, Homo sapiens
gactgtagggagggcggcagggg

SEQ ID NO: 5741263 - DNA, 16 bp, Homo sapiens
gactgtatattgctaa

SEQ ID NO: 5741264 - DNA, 17 bp, Homo sapiens
gactgtatattgctaag

SEQ ID NO: 5741265 - DNA, 16 bp, Homo sapiens
gactgtatttctgtgg

SEQ ID NO: 5741266 - DNA, 19 bp, Homo sapiens
gactgtcacactggtgctg

SEQ ID NO: 5741267 - DNA, 21 bp, Homo sapiens
gactgtcacggggttccctcc

SEQ ID NO: 5741268 - DNA, 17 bp, Homo sapiens
gactgtcacttgctgct

SEQ ID NO: 5741269 - DNA, 14 bp, Homo sapiens
gactgtcagctgag

SEQ ID NO: 5741270 - DNA, 14 bp, Homo sapiens
gactgtcagggagg

SEQ ID NO: 5741271 - DNA, 14 bp, Homo sapiens
gactgtcagtgggg

SEQ ID NO: 5741272 - DNA, 22 bp, Homo sapiens
gactgtcagtggggcagcctct

SEQ ID NO: 5741273 - DNA, 16 bp, Homo sapiens
gactgtcattagaatt

SEQ ID NO: 5741274 - DNA, 15 bp, Homo sapiens
gactgtccactcggg

SEQ ID NO: 5741275 - DNA, 13 bp, Homo sapiens
gactgtccaggga

SEQ ID NO: 5741276 - DNA, 21 bp, Homo sapiens
gactgtcctcccacagacctg

SEQ ID NO: 5741277 - DNA, 17 bp, Homo sapiens
gactgtcctcgcagaga

SEQ ID NO: 5741278 - DNA, 20 bp, Homo sapiens
gactgtcctctcccctccag

SEQ ID NO: 5741279 - DNA, 23 bp, Homo sapiens
gactgtcctctcccctccagcct

SEQ ID NO: 5741280 - DNA, 15 bp, Homo sapiens
gactgtcctgaggag

SEQ ID NO: 5741281 - DNA, 17 bp, Homo sapiens
gactgtcgccacacgcc

SEQ ID NO: 5741282 - DNA, 20 bp, Homo sapiens
gactgtcgccacacgcctct

SEQ ID NO: 5741283 - DNA, 24 bp, Homo sapiens
gactgtctagccactccctcccag

SEQ ID NO: 5741284 - DNA, 21 bp, Homo sapiens
gactgtctcaagagggcactg

SEQ ID NO: 5741285 - DNA, 19 bp, Homo sapiens
gactgtctcacttaatcct

SEQ ID NO: 5741286 - DNA, 17 bp, Homo sapiens
gactgtctccacggcct

SEQ ID NO: 5741287 - DNA, 14 bp, Homo sapiens
gactgtctggggag

SEQ ID NO: 5741288 - DNA, 19 bp, Homo sapiens
gactgtcttcaaccctgcc

SEQ ID NO: 5741289 - DNA, 22 bp, Homo sapiens
gactgtcttcaaccctgccctg

SEQ ID NO: 5741290 - DNA, 15 bp, Homo sapiens
gactgtgaaatgatt

SEQ ID NO: 5741291 - DNA, 16 bp, Homo sapiens
gactgtgaaatgtttg

SEQ ID NO: 5741292 - DNA, 18 bp, Homo sapiens
gactgtgaacagcttgct

SEQ ID NO: 5741293 - DNA, 18 bp, Homo sapiens
gactgtgaatttcaaaaa

SEQ ID NO: 5741294 - DNA, 19 bp, Homo sapiens
gactgtgaatttcaaaaaa

SEQ ID NO: 5741295 - DNA, 12 bp, Homo sapiens
gactgtgacatc

SEQ ID NO: 5741296 - DNA, 13 bp, Homo sapiens
gactgtgaccaaa

SEQ ID NO: 5741297 - DNA, 22 bp, Homo sapiens
gactgtgaggccatacttgtga

SEQ ID NO: 5741298 - DNA, 20 bp, Homo sapiens
gactgtgataatcagaagct

SEQ ID NO: 5741299 - DNA, 19 bp, Homo sapiens
gactgtgatttatttggag

SEQ ID NO: 5741300 - DNA, 16 bp, Homo sapiens
gactgtgccagaggcc

SEQ ID NO: 5741301 - DNA, 14 bp, Homo sapiens
gactgtgccatctg

SEQ ID NO: 5741302 - DNA, 19 bp, Homo sapiens
gactgtgcctcaggccagg

SEQ ID NO: 5741303 - DNA, 23 bp, Homo sapiens
gactgtgcctcaggccagggctc

SEQ ID NO: 5741304 - DNA, 16 bp, Homo sapiens
gactgtgcctggctcc

SEQ ID NO: 5741305 - DNA, 19 bp, Homo sapiens
gactgtgcggcacaggaaa

SEQ ID NO: 5741306 - DNA, 22 bp, Homo sapiens
gactgtgcggcacaggaaacag

SEQ ID NO: 5741307 - DNA, 14 bp, Homo sapiens
gactgtgctgagaa

SEQ ID NO: 5741308 - DNA, 12 bp, Homo sapiens
gactgtgctgtg

SEQ ID NO: 5741309 - DNA, 22 bp, Homo sapiens
gactgtgcttgggagcctgtgg

SEQ ID NO: 5741310 - DNA, 15 bp, Homo sapiens
gactgtggaggggag

SEQ ID NO: 5741311 - DNA, 12 bp, Homo sapiens
gactgtggctgc

SEQ ID NO: 5741312 - DNA, 21 bp, Homo sapiens
gactgtggctgcagagacctt

SEQ ID NO: 5741313 - DNA, 14 bp, Homo sapiens
gactgtggctgcta

SEQ ID NO: 5741314 - DNA, 17 bp, Homo sapiens
gactgtgggtggggagg

SEQ ID NO: 5741315 - DNA, 21 bp, Homo sapiens
gactgtgggtttgtgggggga

SEQ ID NO: 5741316 - DNA, 14 bp, Homo sapiens
gactgtggtgactt

SEQ ID NO: 5741317 - DNA, 17 bp, Homo sapiens
gactgtggtgacttctg

SEQ ID NO: 5741318 - DNA, 17 bp, Homo sapiens
gactgtggtgactttgg

SEQ ID NO: 5741319 - DNA, 18 bp, Homo sapiens
gactgtggtgtggaggga

SEQ ID NO: 5741320 - DNA, 12 bp, Homo sapiens
gactgtgtatgt

SEQ ID NO: 5741321 - DNA, 22 bp, Homo sapiens
gactgtgtattctagttttgtc

SEQ ID NO: 5741322 - DNA, 11 bp, Homo sapiens
gactgtgtctg

SEQ ID NO: 5741323 - DNA, 22 bp, Homo sapiens
gactgtgtctgaatcatgtctg

SEQ ID NO: 5741324 - DNA, 15 bp, Homo sapiens
gactgtgtgtgccct

SEQ ID NO: 5741325 - DNA, 21 bp, Homo sapiens
gactgtgtttccaaaggttcc

SEQ ID NO: 5741326 - DNA, 16 bp, Homo sapiens
gactgttatctcggac

SEQ ID NO: 5741327 - DNA, 17 bp, Homo sapiens
gactgttatctcggact

SEQ ID NO: 5741328 - DNA, 18 bp, Homo sapiens
gactgttcaagagcacac

SEQ ID NO: 5741329 - DNA, 20 bp, Homo sapiens
gactgttccaaagccagtga

SEQ ID NO: 5741330 - DNA, 16 bp, Homo sapiens
gactgttccaggccct

SEQ ID NO: 5741331 - DNA, 20 bp, Homo sapiens
gactgttccaggccctccag

SEQ ID NO: 5741332 - DNA, 22 bp, Homo sapiens
gactgttctaactagtaatctt

SEQ ID NO: 5741333 - DNA, 15 bp, Homo sapiens
gactgttctcttact

SEQ ID NO: 5741334 - DNA, 18 bp, Homo sapiens
gactgttgaaaggagaat

SEQ ID NO: 5741335 - DNA, 11 bp, Homo sapiens
gactgttgatg

SEQ ID NO: 5741336 - DNA, 19 bp, Homo sapiens
gactgttggctctctgacg

SEQ ID NO: 5741337 - DNA, 22 bp, Homo sapiens
gactgttgggacagccattttc

SEQ ID NO: 5741338 - DNA, 13 bp, Homo sapiens
gactgttgtagca

SEQ ID NO: 5741339 - DNA, 19 bp, Homo sapiens
gactgttgtagcattttcc

SEQ ID NO: 5741340 - DNA, 20 bp, Homo sapiens
gactgttgtccctgcactct

SEQ ID NO: 5741341 - DNA, 14 bp, Homo sapiens
gactgttgttatct

SEQ ID NO: 5741342 - DNA, 20 bp, Homo sapiens
gactgttgttatctgtttga

SEQ ID NO: 5741343 - DNA, 21 bp, Homo sapiens
gactgttgttatctgtttgag

SEQ ID NO: 5741344 - DNA, 18 bp, Homo sapiens
gactgtttatttaaggat

SEQ ID NO: 5741345 - DNA, 15 bp, Homo sapiens
gactgtttcagtgtg

SEQ ID NO: 5741346 - DNA, 14 bp, Homo sapiens
gactgtttcatagt

SEQ ID NO: 5741347 - DNA, 19 bp, Homo sapiens
gactgtttcatagttttct

SEQ ID NO: 5741348 - DNA, 20 bp, Homo sapiens
gactgtttcatagttttcta

SEQ ID NO: 5741349 - DNA, 22 bp, Homo sapiens
gactgtttcattcactgtgcac

SEQ ID NO: 5741350 - DNA, 22 bp, Homo sapiens
gactgttttactgttttaattg

SEQ ID NO: 5741351 - DNA, 13 bp, Homo sapiens
gactgttttcaat

SEQ ID NO: 5741352 - DNA, 17 bp, Homo sapiens
gactgttttcagacctt

SEQ ID NO: 5741353 - DNA, 18 bp, Homo sapiens
gactgtttttacccatat

SEQ ID NO: 5741354 - DNA, 17 bp, Homo sapiens
gactgtttttgttttgt

SEQ ID NO: 5741355 - DNA, 20 bp, Homo sapiens
gactgttttttcctgagctt

SEQ ID NO: 5741356 - DNA, 12 bp, Homo sapiens
gacttaaaacat

SEQ ID NO: 5741357 - DNA, 16 bp, Homo sapiens
gacttaaaacatggtg

SEQ ID NO: 5741358 - DNA, 16 bp, Homo sapiens
gacttaaaagagctca

SEQ ID NO: 5741359 - DNA, 19 bp, Homo sapiens
gacttaaaattagtctttt

SEQ ID NO: 5741360 - DNA, 19 bp, Homo sapiens
gacttaaaggacaggagga

SEQ ID NO: 5741361 - DNA, 23 bp, Homo sapiens
gacttaaagggcccaatgaatta

SEQ ID NO: 5741362 - DNA, 21 bp, Homo sapiens
gacttaacgttctataaatga

SEQ ID NO: 5741363 - DNA, 16 bp, Homo sapiens
gacttaactccttcca

SEQ ID NO: 5741364 - DNA, 12 bp, Homo sapiens
gacttaagaaag

SEQ ID NO: 5741365 - DNA, 19 bp, Homo sapiens
gacttaagacaaatgggac

SEQ ID NO: 5741366 - DNA, 19 bp, Homo sapiens
gacttaagtgtgcaaaata

SEQ ID NO: 5741367 - DNA, 23 bp, Homo sapiens
gacttaatgagactttaaaagca

SEQ ID NO: 5741368 - DNA, 23 bp, Homo sapiens
gacttaatgtgattactgctcta

SEQ ID NO: 5741369 - DNA, 15 bp, Homo sapiens
gacttaatttagcag

SEQ ID NO: 5741370 - DNA, 16 bp, Homo sapiens
gacttactaataaaat

SEQ ID NO: 5741371 - DNA, 15 bp, Homo sapiens
gacttactctaagat

SEQ ID NO: 5741372 - DNA, 13 bp, Homo sapiens
gacttactgcatt

SEQ ID NO: 5741373 - DNA, 16 bp, Homo sapiens
gacttactgtacatga

SEQ ID NO: 5741374 - DNA, 18 bp, Homo sapiens
gacttactgtacatgaaa

SEQ ID NO: 5741375 - DNA, 23 bp, Homo sapiens
gacttagaatccctgtgttaatt

SEQ ID NO: 5741376 - DNA, 22 bp, Homo sapiens
gacttagacctatactgaaaga

SEQ ID NO: 5741377 - DNA, 20 bp, Homo sapiens
gacttagaggcaacaggatt

SEQ ID NO: 5741378 - DNA, 17 bp, Homo sapiens
gacttagcgtcaagaca

SEQ ID NO: 5741379 - DNA, 17 bp, Homo sapiens
gacttagctctgaggag

SEQ ID NO: 5741380 - DNA, 14 bp, Homo sapiens
gacttagctggcca

SEQ ID NO: 5741381 - DNA, 15 bp, Homo sapiens
gacttagctgggaga

SEQ ID NO: 5741382 - DNA, 17 bp, Homo sapiens
gacttaggaggctgagg

SEQ ID NO: 5741383 - DNA, 17 bp, Homo sapiens
gacttagggcaccaggg

SEQ ID NO: 5741384 - DNA, 15 bp, Homo sapiens
gacttaggtttttag

SEQ ID NO: 5741385 - DNA, 19 bp, Homo sapiens
gacttagtggacaggggag

SEQ ID NO: 5741386 - DNA, 22 bp, Homo sapiens
gacttagttatttctgcctata

SEQ ID NO: 5741387 - DNA, 18 bp, Homo sapiens
gacttatatgcaggctgt

SEQ ID NO: 5741388 - DNA, 18 bp, Homo sapiens
gacttatctgatcttcct

SEQ ID NO: 5741389 - DNA, 19 bp, Homo sapiens
gacttatctgatcttcctc

SEQ ID NO: 5741390 - DNA, 20 bp, Homo sapiens
gacttatctgatcttcctca

SEQ ID NO: 5741391 - DNA, 14 bp, Homo sapiens
gacttatgaaactt

SEQ ID NO: 5741392 - DNA, 15 bp, Homo sapiens
gacttattcttttat

SEQ ID NO: 5741393 - DNA, 16 bp, Homo sapiens
gacttattcttttata

SEQ ID NO: 5741394 - DNA, 22 bp, Homo sapiens
gacttattgtggataacaaaga

SEQ ID NO: 5741395 - DNA, 13 bp, Homo sapiens
gacttatttctgc

SEQ ID NO: 5741396 - DNA, 20 bp, Homo sapiens
gacttatttctgctctggaa

SEQ ID NO: 5741397 - DNA, 15 bp, Homo sapiens
gacttattttctctg

SEQ ID NO: 5741398 - DNA, 21 bp, Homo sapiens
gacttcaaaaggtgattaaat

SEQ ID NO: 5741399 - DNA, 17 bp, Homo sapiens
gacttcaaaatattgag

SEQ ID NO: 5741400 - DNA, 23 bp, Homo sapiens
gacttcaaatgtgtaactttatt

SEQ ID NO: 5741401 - DNA, 14 bp, Homo sapiens
gacttcaactgccc

SEQ ID NO: 5741402 - DNA, 21 bp, Homo sapiens
gacttcaagatgcctcttcta

SEQ ID NO: 5741403 - DNA, 21 bp, Homo sapiens
gacttcaagcatggctatttt

SEQ ID NO: 5741404 - DNA, 17 bp, Homo sapiens
gacttcaatttcccacc

SEQ ID NO: 5741405 - DNA, 23 bp, Homo sapiens
gacttcaatttcccacccatctc

SEQ ID NO: 5741406 - DNA, 15 bp, Homo sapiens
gacttcacagcagcc

SEQ ID NO: 5741407 - DNA, 18 bp, Homo sapiens
gacttcacagcgtctgct

SEQ ID NO: 5741408 - DNA, 19 bp, Homo sapiens
gacttcacagcgtctgctc

SEQ ID NO: 5741409 - DNA, 20 bp, Homo sapiens
gacttcacagcgtctgctca

SEQ ID NO: 5741410 - DNA, 17 bp, Homo sapiens
gacttcacataagctca

SEQ ID NO: 5741411 - DNA, 21 bp, Homo sapiens
gacttcacataagctcagaat

SEQ ID NO: 5741412 - DNA, 16 bp, Homo sapiens
gacttcactgcagcct

SEQ ID NO: 5741413 - DNA, 17 bp, Homo sapiens
gacttcactgcagcctt

SEQ ID NO: 5741414 - DNA, 12 bp, Homo sapiens
gacttcactgta

SEQ ID NO: 5741415 - DNA, 15 bp, Homo sapiens
gacttcactgtatat

SEQ ID NO: 5741416 - DNA, 17 bp, Homo sapiens
gacttcactgtatataa

SEQ ID NO: 5741417 - DNA, 14 bp, Homo sapiens
gacttcacttatta

SEQ ID NO: 5741418 - DNA, 21 bp, Homo sapiens
gacttcagaaactttttctaa

SEQ ID NO: 5741419 - DNA, 21 bp, Homo sapiens
gacttcagaacagtgtttgat

SEQ ID NO: 5741420 - DNA, 15 bp, Homo sapiens
gacttcagactctct

SEQ ID NO: 5741421 - DNA, 13 bp, Homo sapiens
gacttcagattcc

SEQ ID NO: 5741422 - DNA, 22 bp, Homo sapiens
gacttcagattccccactcagc

SEQ ID NO: 5741423 - DNA, 16 bp, Homo sapiens
gacttcagatttcaaa

SEQ ID NO: 5741424 - DNA, 17 bp, Homo sapiens
gacttcagatttcaaat

SEQ ID NO: 5741425 - DNA, 16 bp, Homo sapiens
gacttcagctgcctga

SEQ ID NO: 5741426 - DNA, 15 bp, Homo sapiens
gacttcaggagctga

SEQ ID NO: 5741427 - DNA, 14 bp, Homo sapiens
gacttcagggcagg

SEQ ID NO: 5741428 - DNA, 18 bp, Homo sapiens
gacttcagggcagggctc

SEQ ID NO: 5741429 - DNA, 21 bp, Homo sapiens
gacttcaggggctgcccgctc

SEQ ID NO: 5741430 - DNA, 15 bp, Homo sapiens
gacttcaggtcaggt

SEQ ID NO: 5741431 - DNA, 17 bp, Homo sapiens
gacttcaggtcaggtgg

SEQ ID NO: 5741432 - DNA, 20 bp, Homo sapiens
gacttcaggtcaggtggctg

SEQ ID NO: 5741433 - DNA, 13 bp, Homo sapiens
gacttcaggtgga

SEQ ID NO: 5741434 - DNA, 17 bp, Homo sapiens
gacttcagtatgttgtc

SEQ ID NO: 5741435 - DNA, 19 bp, Homo sapiens
gacttcagtatgttgtcaa

SEQ ID NO: 5741436 - DNA, 18 bp, Homo sapiens
gacttcagtcctggtctg

SEQ ID NO: 5741437 - DNA, 19 bp, Homo sapiens
gacttcagtcctggtctgc

SEQ ID NO: 5741438 - DNA, 15 bp, Homo sapiens
gacttcagtcttgcc

SEQ ID NO: 5741439 - DNA, 21 bp, Homo sapiens
gacttcatctggggttggcaa

SEQ ID NO: 5741440 - DNA, 13 bp, Homo sapiens
gacttcatgttca

SEQ ID NO: 5741441 - DNA, 18 bp, Homo sapiens
gacttcattttatattta

SEQ ID NO: 5741442 - DNA, 16 bp, Homo sapiens
gacttcatttttccta

SEQ ID NO: 5741443 - DNA, 13 bp, Homo sapiens
gacttccaccctg

SEQ ID NO: 5741444 - DNA, 13 bp, Homo sapiens
gacttccatttgg

SEQ ID NO: 5741445 - DNA, 15 bp, Homo sapiens
gacttccatttggaa

SEQ ID NO: 5741446 - DNA, 24 bp, Homo sapiens
gacttccatttggaatcatatggg

SEQ ID NO: 5741447 - DNA, 17 bp, Homo sapiens
gacttcccaacagcctt

SEQ ID NO: 5741448 - DNA, 22 bp, Homo sapiens
gacttcccaagccctggtgacc

SEQ ID NO: 5741449 - DNA, 18 bp, Homo sapiens
gacttcccacggctcctc

SEQ ID NO: 5741450 - DNA, 17 bp, Homo sapiens
gacttcccactgttctg

SEQ ID NO: 5741451 - DNA, 12 bp, Homo sapiens
gacttcccagct

SEQ ID NO: 5741452 - DNA, 13 bp, Homo sapiens
gacttcccagcta

SEQ ID NO: 5741453 - DNA, 18 bp, Homo sapiens
gacttcccagctaggaag

SEQ ID NO: 5741454 - DNA, 14 bp, Homo sapiens
gacttcccagctgg

SEQ ID NO: 5741455 - DNA, 16 bp, Homo sapiens
gacttcccagctggca

SEQ ID NO: 5741456 - DNA, 22 bp, Homo sapiens
gacttccccaaacccagaaaga

SEQ ID NO: 5741457 - DNA, 18 bp, Homo sapiens
gacttccccaagcctggc

SEQ ID NO: 5741458 - DNA, 18 bp, Homo sapiens
gacttccccaatatcttg

SEQ ID NO: 5741459 - DNA, 20 bp, Homo sapiens
gacttccccaatatcttgct

SEQ ID NO: 5741460 - DNA, 20 bp, Homo sapiens
gacttccccgcattccaggc

SEQ ID NO: 5741461 - DNA, 23 bp, Homo sapiens
gacttccccgcattccaggctcc

SEQ ID NO: 5741462 - DNA, 18 bp, Homo sapiens
gacttccccggagggctg

SEQ ID NO: 5741463 - DNA, 14 bp, Homo sapiens
gacttcccctgcct

SEQ ID NO: 5741464 - DNA, 22 bp, Homo sapiens
gacttccctggaggagaagtat

SEQ ID NO: 5741465 - DNA, 22 bp, Homo sapiens
gacttccctggtcaccaaggca

SEQ ID NO: 5741466 - DNA, 21 bp, Homo sapiens
gacttcctccaatccccactc

SEQ ID NO: 5741467 - DNA, 22 bp, Homo sapiens
gacttcctctctaccccccacc

SEQ ID NO: 5741468 - DNA, 19 bp, Homo sapiens
gacttcctctggctcccca

SEQ ID NO: 5741469 - DNA, 18 bp, Homo sapiens
gacttcctggggccccgc

SEQ ID NO: 5741470 - DNA, 23 bp, Homo sapiens
gacttcctggtgaggcccagcct

SEQ ID NO: 5741471 - DNA, 18 bp, Homo sapiens
gacttcctgtccagctcc

SEQ ID NO: 5741472 - DNA, 20 bp, Homo sapiens
gacttcctgtccagctccaa

SEQ ID NO: 5741473 - DNA, 14 bp, Homo sapiens
gacttccttgctct

SEQ ID NO: 5741474 - DNA, 18 bp, Homo sapiens
gacttccttgctctccct

SEQ ID NO: 5741475 - DNA, 18 bp, Homo sapiens
gacttcctttataatatt

SEQ ID NO: 5741476 - DNA, 15 bp, Homo sapiens
gacttcgactcagga

SEQ ID NO: 5741477 - DNA, 16 bp, Homo sapiens
gacttcgcagccccgg

SEQ ID NO: 5741478 - DNA, 21 bp, Homo sapiens
gacttcgctattcccaggcag

SEQ ID NO: 5741479 - DNA, 14 bp, Homo sapiens
gacttcggaccgct

SEQ ID NO: 5741480 - DNA, 17 bp, Homo sapiens
gacttcgggggcggctc

SEQ ID NO: 5741481 - DNA, 19 bp, Homo sapiens
gacttcggggtagaggctg

SEQ ID NO: 5741482 - DNA, 16 bp, Homo sapiens
gacttctaaaataaat

SEQ ID NO: 5741483 - DNA, 17 bp, Homo sapiens
gacttctaaaataaatg

SEQ ID NO: 5741484 - DNA, 22 bp, Homo sapiens
gacttctaaaataaatgttttg

SEQ ID NO: 5741485 - DNA, 21 bp, Homo sapiens
gacttctaaatcataatcatc

SEQ ID NO: 5741486 - DNA, 18 bp, Homo sapiens
gacttctaagtaaaacca

SEQ ID NO: 5741487 - DNA, 24 bp, Homo sapiens
gacttctaagtaaaaccacagcag

SEQ ID NO: 5741488 - DNA, 16 bp, Homo sapiens
gacttctagcagagac

SEQ ID NO: 5741489 - DNA, 20 bp, Homo sapiens
gacttctattttttaaagac

SEQ ID NO: 5741490 - DNA, 16 bp, Homo sapiens
gacttctcaaagagaa

SEQ ID NO: 5741491 - DNA, 13 bp, Homo sapiens
gacttctcaggac

SEQ ID NO: 5741492 - DNA, 21 bp, Homo sapiens
gacttctcccccgccctgccc

SEQ ID NO: 5741493 - DNA, 22 bp, Homo sapiens
gacttctcccctgcccttcctc

SEQ ID NO: 5741494 - DNA, 22 bp, Homo sapiens
gacttctcggaattcataataa

SEQ ID NO: 5741495 - DNA, 17 bp, Homo sapiens
gacttctctgaatcaga

SEQ ID NO: 5741496 - DNA, 14 bp, Homo sapiens
gacttctctgtgaa

SEQ ID NO: 5741497 - DNA, 18 bp, Homo sapiens
gacttctcttacattttc

SEQ ID NO: 5741498 - DNA, 18 bp, Homo sapiens
gacttctcttgaattatt

SEQ ID NO: 5741499 - DNA, 15 bp, Homo sapiens
gacttctctttctta

SEQ ID NO: 5741500 - DNA, 14 bp, Homo sapiens
gacttctgcctgga

SEQ ID NO: 5741501 - DNA, 15 bp, Homo sapiens
gacttctgcctggag

SEQ ID NO: 5741502 - DNA, 16 bp, Homo sapiens
gacttctgcctggaga

SEQ ID NO: 5741503 - DNA, 21 bp, Homo sapiens
gacttctgcggggcctgaggc

SEQ ID NO: 5741504 - DNA, 13 bp, Homo sapiens
gacttctgctgct

SEQ ID NO: 5741505 - DNA, 14 bp, Homo sapiens
gacttctggaaggc

SEQ ID NO: 5741506 - DNA, 17 bp, Homo sapiens
gacttctggaaggctgg

SEQ ID NO: 5741507 - DNA, 19 bp, Homo sapiens
gacttctggaaggctggct

SEQ ID NO: 5741508 - DNA, 17 bp, Homo sapiens
gacttctggtgctgctg

SEQ ID NO: 5741509 - DNA, 20 bp, Homo sapiens
gacttctgtcttcacaacag

SEQ ID NO: 5741510 - DNA, 14 bp, Homo sapiens
gacttctgttttca

SEQ ID NO: 5741511 - DNA, 18 bp, Homo sapiens
gacttctgttttcaatct

SEQ ID NO: 5741512 - DNA, 11 bp, Homo sapiens
gacttcttacc

SEQ ID NO: 5741513 - DNA, 16 bp, Homo sapiens
gacttcttcctctaga

SEQ ID NO: 5741514 - DNA, 19 bp, Homo sapiens
gacttcttgcttgtacata

SEQ ID NO: 5741515 - DNA, 18 bp, Homo sapiens
gacttcttggtgctgttg

SEQ ID NO: 5741516 - DNA, 20 bp, Homo sapiens
gacttcttggtttggggaga

SEQ ID NO: 5741517 - DNA, 20 bp, Homo sapiens
gacttcttggttttctctct

SEQ ID NO: 5741518 - DNA, 23 bp, Homo sapiens
gacttcttggttttctctctgga

SEQ ID NO: 5741519 - DNA, 12 bp, Homo sapiens
gacttcttttca

SEQ ID NO: 5741520 - DNA, 13 bp, Homo sapiens
gacttgaaagaaa

SEQ ID NO: 5741521 - DNA, 14 bp, Homo sapiens
gacttgaaagcatc

SEQ ID NO: 5741522 - DNA, 21 bp, Homo sapiens
gacttgaaagcatccatgtgt

SEQ ID NO: 5741523 - DNA, 21 bp, Homo sapiens
gacttgaaatacgtttgtgtt

SEQ ID NO: 5741524 - DNA, 20 bp, Homo sapiens
gacttgaaccacaagtgaat

SEQ ID NO: 5741525 - DNA, 16 bp, Homo sapiens
gacttgaataaagtac

SEQ ID NO: 5741526 - DNA, 20 bp, Homo sapiens
gacttgaatattcctggact

SEQ ID NO: 5741527 - DNA, 16 bp, Homo sapiens
gacttgacagaacact

SEQ ID NO: 5741528 - DNA, 18 bp, Homo sapiens
gacttgagaaatttgaaa

SEQ ID NO: 5741529 - DNA, 21 bp, Homo sapiens
gacttgagaagtctaattcac

SEQ ID NO: 5741530 - DNA, 13 bp, Homo sapiens
gacttgagatgaa

SEQ ID NO: 5741531 - DNA, 14 bp, Homo sapiens
gacttgagccactc

SEQ ID NO: 5741532 - DNA, 13 bp, Homo sapiens
gacttgagccatc

SEQ ID NO: 5741533 - DNA, 14 bp, Homo sapiens
gacttgagccctgc

SEQ ID NO: 5741534 - DNA, 16 bp, Homo sapiens
gacttgatgaataaac

SEQ ID NO: 5741535 - DNA, 21 bp, Homo sapiens
gacttgcaaagacctacctcc

SEQ ID NO: 5741536 - DNA, 16 bp, Homo sapiens
gacttgcaatccaggc

SEQ ID NO: 5741537 - DNA, 19 bp, Homo sapiens
gacttgcaatccaggctgt

SEQ ID NO: 5741538 - DNA, 18 bp, Homo sapiens
gacttgcaatttctacct

SEQ ID NO: 5741539 - DNA, 16 bp, Homo sapiens
gacttgcacagggatt

SEQ ID NO: 5741540 - DNA, 15 bp, Homo sapiens
gacttgcatcgtgga

SEQ ID NO: 5741541 - DNA, 13 bp, Homo sapiens
gacttgccactgc

SEQ ID NO: 5741542 - DNA, 20 bp, Homo sapiens
gacttgccatgaaggcacct

SEQ ID NO: 5741543 - DNA, 17 bp, Homo sapiens
gacttgcctccgtgtca

SEQ ID NO: 5741544 - DNA, 11 bp, Homo sapiens
gacttgcctgg

SEQ ID NO: 5741545 - DNA, 19 bp, Homo sapiens
gacttgcggccacagcact

SEQ ID NO: 5741546 - DNA, 14 bp, Homo sapiens
gacttgctgtccag

SEQ ID NO: 5741547 - DNA, 18 bp, Homo sapiens
gacttgctgtccaggcag

SEQ ID NO: 5741548 - DNA, 19 bp, Homo sapiens
gacttgctgttttgttctg

SEQ ID NO: 5741549 - DNA, 12 bp, Homo sapiens
gacttgctttaa

SEQ ID NO: 5741550 - DNA, 19 bp, Homo sapiens
gacttggacatctctctgg

SEQ ID NO: 5741551 - DNA, 18 bp, Homo sapiens
gacttggagactcctggt

SEQ ID NO: 5741552 - DNA, 21 bp, Homo sapiens
gacttggagactcctggtctg

SEQ ID NO: 5741553 - DNA, 20 bp, Homo sapiens
gacttggagggtctgggggc

SEQ ID NO: 5741554 - DNA, 16 bp, Homo sapiens
gacttggataggagct

SEQ ID NO: 5741555 - DNA, 20 bp, Homo sapiens
gacttggatgtcatatcttc

SEQ ID NO: 5741556 - DNA, 22 bp, Homo sapiens
gacttggatgtcatatcttctt

SEQ ID NO: 5741557 - DNA, 13 bp, Homo sapiens
gacttggcactta

SEQ ID NO: 5741558 - DNA, 22 bp, Homo sapiens
gacttggcacttaagtgcactt

SEQ ID NO: 5741559 - DNA, 18 bp, Homo sapiens
gacttggcaggtgcctgt

SEQ ID NO: 5741560 - DNA, 23 bp, Homo sapiens
gacttggccgcttccctacccac

SEQ ID NO: 5741561 - DNA, 15 bp, Homo sapiens
gacttggcctctctc

SEQ ID NO: 5741562 - DNA, 14 bp, Homo sapiens
gacttggctggtgt

SEQ ID NO: 5741563 - DNA, 22 bp, Homo sapiens
gacttggctggtgtggtacaga

SEQ ID NO: 5741564 - DNA, 23 bp, Homo sapiens
gacttggctggtgtggtacagag

SEQ ID NO: 5741565 - DNA, 18 bp, Homo sapiens
gacttggctgtccttccc

SEQ ID NO: 5741566 - DNA, 19 bp, Homo sapiens
gacttgggcacccccagcc

SEQ ID NO: 5741567 - DNA, 20 bp, Homo sapiens
gacttgggcacccccagcct

SEQ ID NO: 5741568 - DNA, 19 bp, Homo sapiens
gacttggggacaccccaga

SEQ ID NO: 5741569 - DNA, 20 bp, Homo sapiens
gacttggggagatggagttc

SEQ ID NO: 5741570 - DNA, 20 bp, Homo sapiens
gacttggggatttctggtca

SEQ ID NO: 5741571 - DNA, 13 bp, Homo sapiens
gacttggggccag

SEQ ID NO: 5741572 - DNA, 23 bp, Homo sapiens
gacttgggggcagagcagcacaa

SEQ ID NO: 5741573 - DNA, 20 bp, Homo sapiens
gacttgggttgatctcttag

SEQ ID NO: 5741574 - DNA, 21 bp, Homo sapiens
gacttggtacagttgcaggag

SEQ ID NO: 5741575 - DNA, 23 bp, Homo sapiens
gacttggtcttttttctgggtct

SEQ ID NO: 5741576 - DNA, 21 bp, Homo sapiens
gacttggtgattacctgaaag

SEQ ID NO: 5741577 - DNA, 22 bp, Homo sapiens
gacttggtggtctgagctgtcc

SEQ ID NO: 5741578 - DNA, 15 bp, Homo sapiens
gacttggttggtagg

SEQ ID NO: 5741579 - DNA, 12 bp, Homo sapiens
gacttgtaacat

SEQ ID NO: 5741580 - DNA, 17 bp, Homo sapiens
gacttgtacaaacagta

SEQ ID NO: 5741581 - DNA, 22 bp, Homo sapiens
gacttgtacaaacagtatttct

SEQ ID NO: 5741582 - DNA, 19 bp, Homo sapiens
gacttgtaggaatctgcct

SEQ ID NO: 5741583 - DNA, 23 bp, Homo sapiens
gacttgtaggaatctgccttcca

SEQ ID NO: 5741584 - DNA, 19 bp, Homo sapiens
gacttgtagggatgccttt

SEQ ID NO: 5741585 - DNA, 20 bp, Homo sapiens
gacttgtataacatcactgt

SEQ ID NO: 5741586 - DNA, 17 bp, Homo sapiens
gacttgtatgctgccca

SEQ ID NO: 5741587 - DNA, 14 bp, Homo sapiens
gacttgtctcccag

SEQ ID NO: 5741588 - DNA, 15 bp, Homo sapiens
gacttgtctcccagt

SEQ ID NO: 5741589 - DNA, 16 bp, Homo sapiens
gacttgtctcccagtc

SEQ ID NO: 5741590 - DNA, 15 bp, Homo sapiens
gacttgtctgcctcc

SEQ ID NO: 5741591 - DNA, 16 bp, Homo sapiens
gacttgtctgcctcct

SEQ ID NO: 5741592 - DNA, 21 bp, Homo sapiens
gacttgtctgcctcctgcttt

SEQ ID NO: 5741593 - DNA, 19 bp, Homo sapiens
gacttgtgacggtgtacct

SEQ ID NO: 5741594 - DNA, 15 bp, Homo sapiens
gacttgtgattggct

SEQ ID NO: 5741595 - DNA, 16 bp, Homo sapiens
gacttgtgattggctg

SEQ ID NO: 5741596 - DNA, 17 bp, Homo sapiens
gacttgtgattggctgc

SEQ ID NO: 5741597 - DNA, 18 bp, Homo sapiens
gacttgtgattggctgca

SEQ ID NO: 5741598 - DNA, 17 bp, Homo sapiens
gacttgtgcacaggcag

SEQ ID NO: 5741599 - DNA, 19 bp, Homo sapiens
gacttgtgcacaggcagag

SEQ ID NO: 5741600 - DNA, 15 bp, Homo sapiens
gacttgtgcatccct

SEQ ID NO: 5741601 - DNA, 21 bp, Homo sapiens
gacttgtgcctcttgggagac

SEQ ID NO: 5741602 - DNA, 13 bp, Homo sapiens
gacttgtgtccca

SEQ ID NO: 5741603 - DNA, 13 bp, Homo sapiens
gacttgtgtctct

SEQ ID NO: 5741604 - DNA, 14 bp, Homo sapiens
gacttgtgtgcatg

SEQ ID NO: 5741605 - DNA, 16 bp, Homo sapiens
gacttgttcttgatag

SEQ ID NO: 5741606 - DNA, 14 bp, Homo sapiens
gacttgttcttggt

SEQ ID NO: 5741607 - DNA, 23 bp, Homo sapiens
gacttgtttagagagcctgtcac

SEQ ID NO: 5741608 - DNA, 12 bp, Homo sapiens
gacttgtttcct

SEQ ID NO: 5741609 - DNA, 15 bp, Homo sapiens
gacttgtttctttct

SEQ ID NO: 5741610 - DNA, 18 bp, Homo sapiens
gacttgtttgtcttccat

SEQ ID NO: 5741611 - DNA, 22 bp, Homo sapiens
gacttgtttgtgcatcctgtga

SEQ ID NO: 5741612 - DNA, 13 bp, Homo sapiens
gacttgttttaat

SEQ ID NO: 5741613 - DNA, 18 bp, Homo sapiens
gacttgttttatgctcag

SEQ ID NO: 5741614 - DNA, 14 bp, Homo sapiens
gactttaaaaaaac

SEQ ID NO: 5741615 - DNA, 15 bp, Homo sapiens
gactttaaaagaaaa

SEQ ID NO: 5741616 - DNA, 14 bp, Homo sapiens
gactttaaaaggat

SEQ ID NO: 5741617 - DNA, 23 bp, Homo sapiens
gactttaaagatgattgttcttt

SEQ ID NO: 5741618 - DNA, 23 bp, Homo sapiens
gactttaaagtataaagtaaaat

SEQ ID NO: 5741619 - DNA, 14 bp, Homo sapiens
gactttaacataag

SEQ ID NO: 5741620 - DNA, 17 bp, Homo sapiens
gactttactaaaagaga

SEQ ID NO: 5741621 - DNA, 19 bp, Homo sapiens
gactttacttgtggtgtga

SEQ ID NO: 5741622 - DNA, 19 bp, Homo sapiens
gactttagaataatattgt

SEQ ID NO: 5741623 - DNA, 11 bp, Homo sapiens
gactttataaa

SEQ ID NO: 5741624 - DNA, 17 bp, Homo sapiens
gactttatgtagttttt

SEQ ID NO: 5741625 - DNA, 11 bp, Homo sapiens
gactttattag

SEQ ID NO: 5741626 - DNA, 15 bp, Homo sapiens
gactttattatttat

SEQ ID NO: 5741627 - DNA, 19 bp, Homo sapiens
gactttatttaatttcata

SEQ ID NO: 5741628 - DNA, 20 bp, Homo sapiens
gactttatttaatttcataa

SEQ ID NO: 5741629 - DNA, 22 bp, Homo sapiens
gactttatttaatttcataaat

SEQ ID NO: 5741630 - DNA, 15 bp, Homo sapiens
gactttatttatttc

SEQ ID NO: 5741631 - DNA, 19 bp, Homo sapiens
gactttatttatttctagt

SEQ ID NO: 5741632 - DNA, 21 bp, Homo sapiens
gactttatttttctaagtgta

SEQ ID NO: 5741633 - DNA, 18 bp, Homo sapiens
gactttcagattgtatct

SEQ ID NO: 5741634 - DNA, 17 bp, Homo sapiens
gactttcagtaaacata

SEQ ID NO: 5741635 - DNA, 15 bp, Homo sapiens
gactttccaccccct

SEQ ID NO: 5741636 - DNA, 18 bp, Homo sapiens
gactttccaccccctccc

SEQ ID NO: 5741637 - DNA, 15 bp, Homo sapiens
gactttcccaaatgt

SEQ ID NO: 5741638 - DNA, 17 bp, Homo sapiens
gactttcccaaatgtat

SEQ ID NO: 5741639 - DNA, 22 bp, Homo sapiens
gactttcccaaatgtattgatt

SEQ ID NO: 5741640 - DNA, 16 bp, Homo sapiens
gactttcccacccagg

SEQ ID NO: 5741641 - DNA, 21 bp, Homo sapiens
gactttccccaccagatgctg

SEQ ID NO: 5741642 - DNA, 13 bp, Homo sapiens
gactttcccctct

SEQ ID NO: 5741643 - DNA, 16 bp, Homo sapiens
gactttcctatgacac

SEQ ID NO: 5741644 - DNA, 13 bp, Homo sapiens
gactttcctccca

SEQ ID NO: 5741645 - DNA, 11 bp, Homo sapiens
gactttcctct

SEQ ID NO: 5741646 - DNA, 11 bp, Homo sapiens
gactttcctgc

SEQ ID NO: 5741647 - DNA, 12 bp, Homo sapiens
gactttcctgca

SEQ ID NO: 5741648 - DNA, 19 bp, Homo sapiens
gactttccttccctctcct

SEQ ID NO: 5741649 - DNA, 23 bp, Homo sapiens
gactttccttccctctcctgctt

SEQ ID NO: 5741650 - DNA, 15 bp, Homo sapiens
gactttcctttgcac

SEQ ID NO: 5741651 - DNA, 18 bp, Homo sapiens
gactttcggagttggggg

SEQ ID NO: 5741652 - DNA, 16 bp, Homo sapiens
gactttctattaatat

SEQ ID NO: 5741653 - DNA, 14 bp, Homo sapiens
gactttctcctggc

SEQ ID NO: 5741654 - DNA, 16 bp, Homo sapiens
gactttctctaataat

SEQ ID NO: 5741655 - DNA, 18 bp, Homo sapiens
gactttctctaataataa

SEQ ID NO: 5741656 - DNA, 19 bp, Homo sapiens
gactttctctaataataaa

SEQ ID NO: 5741657 - DNA, 18 bp, Homo sapiens
gactttctgaaaacactt

SEQ ID NO: 5741658 - DNA, 15 bp, Homo sapiens
gactttctgcctgga

SEQ ID NO: 5741659 - DNA, 18 bp, Homo sapiens
gactttctgcctggagtg

SEQ ID NO: 5741660 - DNA, 17 bp, Homo sapiens
gactttctgttttctgt

SEQ ID NO: 5741661 - DNA, 16 bp, Homo sapiens
gactttctttttctac

SEQ ID NO: 5741662 - DNA, 22 bp, Homo sapiens
gactttctttttctacatgtga

SEQ ID NO: 5741663 - DNA, 18 bp, Homo sapiens
gactttgaaaatatatac

SEQ ID NO: 5741664 - DNA, 14 bp, Homo sapiens
gactttgaatttat

SEQ ID NO: 5741665 - DNA, 15 bp, Homo sapiens
gactttgaatttata

SEQ ID NO: 5741666 - DNA, 21 bp, Homo sapiens
gactttgatactaccagggtc

SEQ ID NO: 5741667 - DNA, 16 bp, Homo sapiens
gactttgatccttgga

SEQ ID NO: 5741668 - DNA, 21 bp, Homo sapiens
gactttgctgatttcccctct

SEQ ID NO: 5741669 - DNA, 14 bp, Homo sapiens
gactttgcttgctt

SEQ ID NO: 5741670 - DNA, 18 bp, Homo sapiens
gactttggaaaactactt

SEQ ID NO: 5741671 - DNA, 15 bp, Homo sapiens
gactttggaatttgc

SEQ ID NO: 5741672 - DNA, 16 bp, Homo sapiens
gactttggctgattta

SEQ ID NO: 5741673 - DNA, 18 bp, Homo sapiens
gactttgggataggaaaa

SEQ ID NO: 5741674 - DNA, 18 bp, Homo sapiens
gactttggggacaccctc

SEQ ID NO: 5741675 - DNA, 15 bp, Homo sapiens
gactttggggacagg

SEQ ID NO: 5741676 - DNA, 14 bp, Homo sapiens
gactttgtaccccc

SEQ ID NO: 5741677 - DNA, 16 bp, Homo sapiens
gactttgtatacttta

SEQ ID NO: 5741678 - DNA, 17 bp, Homo sapiens
gactttgtctaataaag

SEQ ID NO: 5741679 - DNA, 15 bp, Homo sapiens
gactttgtctctcct

SEQ ID NO: 5741680 - DNA, 16 bp, Homo sapiens
gactttgtctctcctg

SEQ ID NO: 5741681 - DNA, 20 bp, Homo sapiens
gactttgtctctcctggctg

SEQ ID NO: 5741682 - DNA, 23 bp, Homo sapiens
gactttgtctctcctggctgggc

SEQ ID NO: 5741683 - DNA, 16 bp, Homo sapiens
gactttgtgaatctga

SEQ ID NO: 5741684 - DNA, 12 bp, Homo sapiens
gacttttaaaat

SEQ ID NO: 5741685 - DNA, 14 bp, Homo sapiens
gacttttaaaattt

SEQ ID NO: 5741686 - DNA, 18 bp, Homo sapiens
gacttttaatcagtgaag

SEQ ID NO: 5741687 - DNA, 21 bp, Homo sapiens
gacttttaatgtcatttgtta

SEQ ID NO: 5741688 - DNA, 16 bp, Homo sapiens
gacttttatgtgagat

SEQ ID NO: 5741689 - DNA, 20 bp, Homo sapiens
gacttttatgtgagatttcc

SEQ ID NO: 5741690 - DNA, 20 bp, Homo sapiens
gacttttattaataaaacaa

SEQ ID NO: 5741691 - DNA, 14 bp, Homo sapiens
gacttttattatgg

SEQ ID NO: 5741692 - DNA, 15 bp, Homo sapiens
gacttttattgagct

SEQ ID NO: 5741693 - DNA, 18 bp, Homo sapiens
gacttttattgagctctt

SEQ ID NO: 5741694 - DNA, 19 bp, Homo sapiens
gacttttcaagtatttaag

SEQ ID NO: 5741695 - DNA, 22 bp, Homo sapiens
gacttttcaagtatttaagcct

SEQ ID NO: 5741696 - DNA, 19 bp, Homo sapiens
gacttttccaaccctcatc

SEQ ID NO: 5741697 - DNA, 20 bp, Homo sapiens
gacttttccaaccctcatca

SEQ ID NO: 5741698 - DNA, 22 bp, Homo sapiens
gacttttccaatatgtgatttt

SEQ ID NO: 5741699 - DNA, 12 bp, Homo sapiens
gacttttcccca

SEQ ID NO: 5741700 - DNA, 19 bp, Homo sapiens
gacttttcgaccaattcaa

SEQ ID NO: 5741701 - DNA, 22 bp, Homo sapiens
gacttttcgaccaattcaaccc

SEQ ID NO: 5741702 - DNA, 13 bp, Homo sapiens
gacttttctgcaa

SEQ ID NO: 5741703 - DNA, 21 bp, Homo sapiens
gacttttctgtccgagctttg

SEQ ID NO: 5741704 - DNA, 23 bp, Homo sapiens
gacttttctgtccgagctttgaa

SEQ ID NO: 5741705 - DNA, 23 bp, Homo sapiens
gacttttctttcagccaagaatt

SEQ ID NO: 5741706 - DNA, 13 bp, Homo sapiens
gacttttgaaaaa

SEQ ID NO: 5741707 - DNA, 13 bp, Homo sapiens
gacttttgaagaa

SEQ ID NO: 5741708 - DNA, 21 bp, Homo sapiens
gacttttgcttaccttttcct

SEQ ID NO: 5741709 - DNA, 22 bp, Homo sapiens
gacttttgcttaccttttccta

SEQ ID NO: 5741710 - DNA, 15 bp, Homo sapiens
gacttttgctttaat

SEQ ID NO: 5741711 - DNA, 16 bp, Homo sapiens
gacttttggccccagc

SEQ ID NO: 5741712 - DNA, 12 bp, Homo sapiens
gacttttgtaaa

SEQ ID NO: 5741713 - DNA, 23 bp, Homo sapiens
gacttttgtaaaatcaaatcatc

SEQ ID NO: 5741714 - DNA, 21 bp, Homo sapiens
gactttttaaaaaatgctggg

SEQ ID NO: 5741715 - DNA, 16 bp, Homo sapiens
gactttttataaaatg

SEQ ID NO: 5741716 - DNA, 22 bp, Homo sapiens
gactttttataatgtggatttc

SEQ ID NO: 5741717 - DNA, 22 bp, Homo sapiens
gactttttatggcactagtatt

SEQ ID NO: 5741718 - DNA, 14 bp, Homo sapiens
gactttttctgtgc

SEQ ID NO: 5741719 - DNA, 16 bp, Homo sapiens
gactttttgcatttaa

SEQ ID NO: 5741720 - DNA, 18 bp, Homo sapiens
gactttttggtggatgta

SEQ ID NO: 5741721 - DNA, 14 bp, Homo sapiens
gacttttttataca

SEQ ID NO: 5741722 - DNA, 18 bp, Homo sapiens
gacttttttctagtacac

SEQ ID NO: 5741723 - DNA, 16 bp, Homo sapiens
gagaaaaaaaaaatag

SEQ ID NO: 5741724 - DNA, 22 bp, Homo sapiens
gagaaaaaaaaacacacaaaaa

SEQ ID NO: 5741725 - DNA, 18 bp, Homo sapiens
gagaaaaaaaaagcaaat

SEQ ID NO: 5741726 - DNA, 24 bp, Homo sapiens
gagaaaaaaaaagccactaaggtc

SEQ ID NO: 5741727 - DNA, 14 bp, Homo sapiens
gagaaaaaaaaagt

SEQ ID NO: 5741728 - DNA, 19 bp, Homo sapiens
gagaaaaaaaaatatgtgt

SEQ ID NO: 5741729 - DNA, 18 bp, Homo sapiens
gagaaaaaaaaccttgta

SEQ ID NO: 5741730 - DNA, 22 bp, Homo sapiens
gagaaaaaaaaccttgtaaaaa

SEQ ID NO: 5741731 - DNA, 13 bp, Homo sapiens
gagaaaaaaacaa

SEQ ID NO: 5741732 - DNA, 19 bp, Homo sapiens
gagaaaaaaattgctctgt

SEQ ID NO: 5741733 - DNA, 14 bp, Homo sapiens
gagaaaaaagaagt

SEQ ID NO: 5741734 - DNA, 15 bp, Homo sapiens
gagaaaaaagtcacc

SEQ ID NO: 5741735 - DNA, 21 bp, Homo sapiens
gagaaaaaagtcaccattctg

SEQ ID NO: 5741736 - DNA, 18 bp, Homo sapiens
gagaaaaaatcactgttt

SEQ ID NO: 5741737 - DNA, 11 bp, Homo sapiens
gagaaaaacaa

SEQ ID NO: 5741738 - DNA, 14 bp, Homo sapiens
gagaaaaaccaatg

SEQ ID NO: 5741739 - DNA, 15 bp, Homo sapiens
gagaaaaactgttct

SEQ ID NO: 5741740 - DNA, 20 bp, Homo sapiens
gagaaaaagaaaaaatatat

SEQ ID NO: 5741741 - DNA, 14 bp, Homo sapiens
gagaaaaagaaatg

SEQ ID NO: 5741742 - DNA, 17 bp, Homo sapiens
gagaaaaagaagaaaag

SEQ ID NO: 5741743 - DNA, 22 bp, Homo sapiens
gagaaaaagacagcgataagct

SEQ ID NO: 5741744 - DNA, 12 bp, Homo sapiens
gagaaaaagaga

SEQ ID NO: 5741745 - DNA, 14 bp, Homo sapiens
gagaaaaagagaga

SEQ ID NO: 5741746 - DNA, 23 bp, Homo sapiens
gagaaaaagcattaaaaataagc

SEQ ID NO: 5741747 - DNA, 17 bp, Homo sapiens
gagaaaaaggaaaaaaa

SEQ ID NO: 5741748 - DNA, 21 bp, Homo sapiens
gagaaaaaggctgaaaagaag

SEQ ID NO: 5741749 - DNA, 18 bp, Homo sapiens
gagaaaaatgctccccac

SEQ ID NO: 5741750 - DNA, 17 bp, Homo sapiens
gagaaaaccccttccca

SEQ ID NO: 5741751 - DNA, 12 bp, Homo sapiens
gagaaaactctt

SEQ ID NO: 5741752 - DNA, 13 bp, Homo sapiens
gagaaaactgaga

SEQ ID NO: 5741753 - DNA, 15 bp, Homo sapiens
gagaaaactgagagg

SEQ ID NO: 5741754 - DNA, 18 bp, Homo sapiens
gagaaaacttatttgagt

SEQ ID NO: 5741755 - DNA, 22 bp, Homo sapiens
gagaaaacttatttgagtgatt

SEQ ID NO: 5741756 - DNA, 19 bp, Homo sapiens
gagaaaagaaaaaaaaaga

SEQ ID NO: 5741757 - DNA, 14 bp, Homo sapiens
gagaaaagagagaa

SEQ ID NO: 5741758 - DNA, 17 bp, Homo sapiens
gagaaaagcacaatcaa

SEQ ID NO: 5741759 - DNA, 19 bp, Homo sapiens
gagaaaagcacaatcaact

SEQ ID NO: 5741760 - DNA, 23 bp, Homo sapiens
gagaaaagcaggcctttgcagat

SEQ ID NO: 5741761 - DNA, 14 bp, Homo sapiens
gagaaaaggagaaa

SEQ ID NO: 5741762 - DNA, 17 bp, Homo sapiens
gagaaaagggaaaaaag

SEQ ID NO: 5741763 - DNA, 19 bp, Homo sapiens
gagaaaagggaaaaaagaa

SEQ ID NO: 5741764 - DNA, 12 bp, Homo sapiens
gagaaaataaaa

SEQ ID NO: 5741765 - DNA, 15 bp, Homo sapiens
gagaaaataaaaagt

SEQ ID NO: 5741766 - DNA, 17 bp, Homo sapiens
gagaaaataaaaagtta

SEQ ID NO: 5741767 - DNA, 18 bp, Homo sapiens
gagaaaataaatttaact

SEQ ID NO: 5741768 - DNA, 19 bp, Homo sapiens
gagaaaatataataaaaga

SEQ ID NO: 5741769 - DNA, 12 bp, Homo sapiens
gagaaaatatat

SEQ ID NO: 5741770 - DNA, 16 bp, Homo sapiens
gagaaaatgctttctc

SEQ ID NO: 5741771 - DNA, 18 bp, Homo sapiens
gagaaaatgctttctcat

SEQ ID NO: 5741772 - DNA, 13 bp, Homo sapiens
gagaaaattgaaa

SEQ ID NO: 5741773 - DNA, 13 bp, Homo sapiens
gagaaaattgaat

SEQ ID NO: 5741774 - DNA, 15 bp, Homo sapiens
gagaaaattgaattt

SEQ ID NO: 5741775 - DNA, 18 bp, Homo sapiens
gagaaaattgaatttaac

SEQ ID NO: 5741776 - DNA, 17 bp, Homo sapiens
gagaaaattgcactaaa

SEQ ID NO: 5741777 - DNA, 21 bp, Homo sapiens
gagaaaattgttgcaaactat

SEQ ID NO: 5741778 - DNA, 15 bp, Homo sapiens
gagaaaatttatatc

SEQ ID NO: 5741779 - DNA, 20 bp, Homo sapiens
gagaaacaaataaactagtc

SEQ ID NO: 5741780 - DNA, 17 bp, Homo sapiens
gagaaacaataaagaga

SEQ ID NO: 5741781 - DNA, 21 bp, Homo sapiens
gagaaacactatttgtgactt

SEQ ID NO: 5741782 - DNA, 13 bp, Homo sapiens
gagaaacagacag

SEQ ID NO: 5741783 - DNA, 14 bp, Homo sapiens
gagaaacagacaga

SEQ ID NO: 5741784 - DNA, 13 bp, Homo sapiens
gagaaacagagac

SEQ ID NO: 5741785 - DNA, 15 bp, Homo sapiens
gagaaacagagatca

SEQ ID NO: 5741786 - DNA, 16 bp, Homo sapiens
gagaaacagcctgtgt

SEQ ID NO: 5741787 - DNA, 15 bp, Homo sapiens
gagaaacagctcagc

SEQ ID NO: 5741788 - DNA, 14 bp, Homo sapiens
gagaaacaggctct

SEQ ID NO: 5741789 - DNA, 15 bp, Homo sapiens
gagaaacaggctctg

SEQ ID NO: 5741790 - DNA, 18 bp, Homo sapiens
gagaaacaggctctgaga

SEQ ID NO: 5741791 - DNA, 13 bp, Homo sapiens
gagaaaccagctt

SEQ ID NO: 5741792 - DNA, 14 bp, Homo sapiens
gagaaaccagcttc

SEQ ID NO: 5741793 - DNA, 15 bp, Homo sapiens
gagaaaccagcttcc

SEQ ID NO: 5741794 - DNA, 17 bp, Homo sapiens
gagaaaccagcttcctt

SEQ ID NO: 5741795 - DNA, 14 bp, Homo sapiens
gagaaaccatcctc

SEQ ID NO: 5741796 - DNA, 21 bp, Homo sapiens
gagaaacccaagtggaatcat

SEQ ID NO: 5741797 - DNA, 14 bp, Homo sapiens
gagaaacccaggga

SEQ ID NO: 5741798 - DNA, 20 bp, Homo sapiens
gagaaacccctggggaccat

SEQ ID NO: 5741799 - DNA, 22 bp, Homo sapiens
gagaaaccctaaaaagagaaga

SEQ ID NO: 5741800 - DNA, 15 bp, Homo sapiens
gagaaaccgggagaa

SEQ ID NO: 5741801 - DNA, 22 bp, Homo sapiens
gagaaaccgtcctctttttcca

SEQ ID NO: 5741802 - DNA, 24 bp, Homo sapiens
gagaaacctccggtgtgagatata

SEQ ID NO: 5741803 - DNA, 18 bp, Homo sapiens
gagaaacctgtatctttc

SEQ ID NO: 5741804 - DNA, 21 bp, Homo sapiens
gagaaacctgtatctttctat

SEQ ID NO: 5741805 - DNA, 23 bp, Homo sapiens
gagaaaccttattgtacctctct

SEQ ID NO: 5741806 - DNA, 22 bp, Homo sapiens
gagaaacgcgctccttggcgga

SEQ ID NO: 5741807 - DNA, 22 bp, Homo sapiens
gagaaactgagaaatgaatgct

SEQ ID NO: 5741808 - DNA, 19 bp, Homo sapiens
gagaaactttatacattag

SEQ ID NO: 5741809 - DNA, 16 bp, Homo sapiens
gagaaagaaaaggcaa

SEQ ID NO: 5741810 - DNA, 19 bp, Homo sapiens
gagaaagaaaaggcaaaag

SEQ ID NO: 5741811 - DNA, 19 bp, Homo sapiens
gagaaagaaagtacccagc

SEQ ID NO: 5741812 - DNA, 21 bp, Homo sapiens
gagaaagaaagtacccagcaa

SEQ ID NO: 5741813 - DNA, 12 bp, Homo sapiens
gagaaagaaata

SEQ ID NO: 5741814 - DNA, 18 bp, Homo sapiens
gagaaagaagagacagga

SEQ ID NO: 5741815 - DNA, 12 bp, Homo sapiens
gagaaagaatga

SEQ ID NO: 5741816 - DNA, 14 bp, Homo sapiens
gagaaagaatgaga

SEQ ID NO: 5741817 - DNA, 21 bp, Homo sapiens
gagaaagacaaaatgtgacca

SEQ ID NO: 5741818 - DNA, 18 bp, Homo sapiens
gagaaagaccatgcattt

SEQ ID NO: 5741819 - DNA, 17 bp, Homo sapiens
gagaaagactattcaaa

SEQ ID NO: 5741820 - DNA, 15 bp, Homo sapiens
gagaaagagacagag

SEQ ID NO: 5741821 - DNA, 17 bp, Homo sapiens
gagaaagagagaagcca

SEQ ID NO: 5741822 - DNA, 18 bp, Homo sapiens
gagaaagagagaagccag

SEQ ID NO: 5741823 - DNA, 23 bp, Homo sapiens
gagaaagagagaagccagccaca

SEQ ID NO: 5741824 - DNA, 13 bp, Homo sapiens
gagaaagagagag

SEQ ID NO: 5741825 - DNA, 17 bp, Homo sapiens
gagaaagagctgcctgg

SEQ ID NO: 5741826 - DNA, 21 bp, Homo sapiens
gagaaagatgttccagtgagg

SEQ ID NO: 5741827 - DNA, 18 bp, Homo sapiens
gagaaagccacgccctcc

SEQ ID NO: 5741828 - DNA, 21 bp, Homo sapiens
gagaaagccacgccctccctg

SEQ ID NO: 5741829 - DNA, 22 bp, Homo sapiens
gagaaagccacgccctccctgc

SEQ ID NO: 5741830 - DNA, 22 bp, Homo sapiens
gagaaagcccacctgggctggg

SEQ ID NO: 5741831 - DNA, 18 bp, Homo sapiens
gagaaagccgggggaggg

SEQ ID NO: 5741832 - DNA, 15 bp, Homo sapiens
gagaaagctgacttg

SEQ ID NO: 5741833 - DNA, 11 bp, Homo sapiens
gagaaaggaaa

SEQ ID NO: 5741834 - DNA, 23 bp, Homo sapiens
gagaaaggaacttttaaactgca

SEQ ID NO: 5741835 - DNA, 18 bp, Homo sapiens
gagaaaggacaaccagga

SEQ ID NO: 5741836 - DNA, 13 bp, Homo sapiens
gagaaaggacaga

SEQ ID NO: 5741837 - DNA, 14 bp, Homo sapiens
gagaaaggacagag

SEQ ID NO: 5741838 - DNA, 21 bp, Homo sapiens
gagaaaggacagagccagcgg

SEQ ID NO: 5741839 - DNA, 20 bp, Homo sapiens
gagaaaggattaagatacac

SEQ ID NO: 5741840 - DNA, 19 bp, Homo sapiens
gagaaaggcctgcacacaa

SEQ ID NO: 5741841 - DNA, 24 bp, Homo sapiens
gagaaaggctcaatttggtgctca

SEQ ID NO: 5741842 - DNA, 15 bp, Homo sapiens
gagaaagggacaatg

SEQ ID NO: 5741843 - DNA, 22 bp, Homo sapiens
gagaaagggagagaaaactctt

SEQ ID NO: 5741844 - DNA, 18 bp, Homo sapiens
gagaaagggagaggaaga

SEQ ID NO: 5741845 - DNA, 19 bp, Homo sapiens
gagaaagggcagaggaaga

SEQ ID NO: 5741846 - DNA, 22 bp, Homo sapiens
gagaaaggggtgattgaaagaa

SEQ ID NO: 5741847 - DNA, 21 bp, Homo sapiens
gagaaaggtgaggagggcagt

SEQ ID NO: 5741848 - DNA, 19 bp, Homo sapiens
gagaaagtggaaaatgacc

SEQ ID NO: 5741849 - DNA, 17 bp, Homo sapiens
gagaaagttggtgctgc

SEQ ID NO: 5741850 - DNA, 19 bp, Homo sapiens
gagaaagttggtgctgctc

SEQ ID NO: 5741851 - DNA, 23 bp, Homo sapiens
gagaaataaagtttgcttagaaa

SEQ ID NO: 5741852 - DNA, 18 bp, Homo sapiens
gagaaatacaaaataaag

SEQ ID NO: 5741853 - DNA, 19 bp, Homo sapiens
gagaaatacataaaaaagt

SEQ ID NO: 5741854 - DNA, 23 bp, Homo sapiens
gagaaatagcttatgaaaagaat

SEQ ID NO: 5741855 - DNA, 19 bp, Homo sapiens
gagaaatatatttgtcact

SEQ ID NO: 5741856 - DNA, 20 bp, Homo sapiens
gagaaatatatttgtcactt

SEQ ID NO: 5741857 - DNA, 13 bp, Homo sapiens
gagaaatatttat

SEQ ID NO: 5741858 - DNA, 14 bp, Homo sapiens
gagaaatcaacagg

SEQ ID NO: 5741859 - DNA, 21 bp, Homo sapiens
gagaaatcaggcctgatgagg

SEQ ID NO: 5741860 - DNA, 18 bp, Homo sapiens
gagaaatctggctgtcct

SEQ ID NO: 5741861 - DNA, 23 bp, Homo sapiens
gagaaatctggcttctggccagg

SEQ ID NO: 5741862 - DNA, 17 bp, Homo sapiens
gagaaatcttaagtcat

SEQ ID NO: 5741863 - DNA, 12 bp, Homo sapiens
gagaaatgaaaa

SEQ ID NO: 5741864 - DNA, 20 bp, Homo sapiens
gagaaatgaatgctgagacc

SEQ ID NO: 5741865 - DNA, 14 bp, Homo sapiens
gagaaatgagcttg

SEQ ID NO: 5741866 - DNA, 16 bp, Homo sapiens
gagaaatgaggaagaa

SEQ ID NO: 5741867 - DNA, 15 bp, Homo sapiens
gagaaatgccccagt

SEQ ID NO: 5741868 - DNA, 17 bp, Homo sapiens
gagaaatggattcagta

SEQ ID NO: 5741869 - DNA, 11 bp, Homo sapiens
gagaaatgtaa

SEQ ID NO: 5741870 - DNA, 19 bp, Homo sapiens
gagaaatgtgaagggtggg

SEQ ID NO: 5741871 - DNA, 21 bp, Homo sapiens
gagaaatgtgaagggtggggt

SEQ ID NO: 5741872 - DNA, 13 bp, Homo sapiens
gagaaatgtttaa

SEQ ID NO: 5741873 - DNA, 14 bp, Homo sapiens
gagaaatttataaa

SEQ ID NO: 5741874 - DNA, 21 bp, Homo sapiens
gagaaattttactgacagaaa

SEQ ID NO: 5741875 - DNA, 13 bp, Homo sapiens
gagaaatttttat

SEQ ID NO: 5741876 - DNA, 15 bp, Homo sapiens
gagaacaaagctgtt

SEQ ID NO: 5741877 - DNA, 22 bp, Homo sapiens
gagaacaaagctgttaaactgt

SEQ ID NO: 5741878 - DNA, 23 bp, Homo sapiens
gagaacaacaaatatgttctctg

SEQ ID NO: 5741879 - DNA, 17 bp, Homo sapiens
gagaacaacaggcaggg

SEQ ID NO: 5741880 - DNA, 20 bp, Homo sapiens
gagaacaacaggcaggggcc

SEQ ID NO: 5741881 - DNA, 19 bp, Homo sapiens
gagaacaagaaagggccag

SEQ ID NO: 5741882 - DNA, 16 bp, Homo sapiens
gagaacaagtcacagc

SEQ ID NO: 5741883 - DNA, 20 bp, Homo sapiens
gagaacaagtcacagctgca

SEQ ID NO: 5741884 - DNA, 15 bp, Homo sapiens
gagaacacatttcta

SEQ ID NO: 5741885 - DNA, 17 bp, Homo sapiens
gagaacacatttctaat

SEQ ID NO: 5741886 - DNA, 17 bp, Homo sapiens
gagaacagataaagatt

SEQ ID NO: 5741887 - DNA, 18 bp, Homo sapiens
gagaacaggtggttttta

SEQ ID NO: 5741888 - DNA, 13 bp, Homo sapiens
gagaacagtggtt

SEQ ID NO: 5741889 - DNA, 23 bp, Homo sapiens
gagaacatgcaaaatcaggaaag

SEQ ID NO: 5741890 - DNA, 13 bp, Homo sapiens
gagaacatggcca

SEQ ID NO: 5741891 - DNA, 21 bp, Homo sapiens
gagaaccaaccagggaagctg

SEQ ID NO: 5741892 - DNA, 19 bp, Homo sapiens
gagaaccactacatgcagc

SEQ ID NO: 5741893 - DNA, 20 bp, Homo sapiens
gagaacccagcccacccccg

SEQ ID NO: 5741894 - DNA, 15 bp, Homo sapiens
gagaaccctgagcag

SEQ ID NO: 5741895 - DNA, 16 bp, Homo sapiens
gagaaccctgagcagg

SEQ ID NO: 5741896 - DNA, 17 bp, Homo sapiens
gagaaccctgagcaggg

SEQ ID NO: 5741897 - DNA, 22 bp, Homo sapiens
gagaaccgagcaaagatcaaaa

SEQ ID NO: 5741898 - DNA, 23 bp, Homo sapiens
gagaaccgagcaaagatcaaaat

SEQ ID NO: 5741899 - DNA, 21 bp, Homo sapiens
gagaacctagggtgatattaa

SEQ ID NO: 5741900 - DNA, 22 bp, Homo sapiens
gagaacctagggtgatattaac

SEQ ID NO: 5741901 - DNA, 22 bp, Homo sapiens
gagaacctcacgcacctcccat

SEQ ID NO: 5741902 - DNA, 14 bp, Homo sapiens
gagaacctcaggct

SEQ ID NO: 5741903 - DNA, 12 bp, Homo sapiens
gagaacctgagt

SEQ ID NO: 5741904 - DNA, 20 bp, Homo sapiens
gagaacctgagttcccggga

SEQ ID NO: 5741905 - DNA, 14 bp, Homo sapiens
gagaacctggcctt

SEQ ID NO: 5741906 - DNA, 16 bp, Homo sapiens
gagaacctggccttca

SEQ ID NO: 5741907 - DNA, 23 bp, Homo sapiens
gagaacctgggttgcagacagga

SEQ ID NO: 5741908 - DNA, 19 bp, Homo sapiens
gagaacctgtgggctgact

SEQ ID NO: 5741909 - DNA, 17 bp, Homo sapiens
gagaacctttagaatat

SEQ ID NO: 5741910 - DNA, 18 bp, Homo sapiens
gagaacctttccactccc

SEQ ID NO: 5741911 - DNA, 22 bp, Homo sapiens
gagaacgccagtctcccaggcc

SEQ ID NO: 5741912 - DNA, 17 bp, Homo sapiens
gagaacgggagtggcca

SEQ ID NO: 5741913 - DNA, 17 bp, Homo sapiens
gagaactaaagctggag

SEQ ID NO: 5741914 - DNA, 16 bp, Homo sapiens
gagaactaaaggtggc

SEQ ID NO: 5741915 - DNA, 19 bp, Homo sapiens
gagaactagaacctggagg

SEQ ID NO: 5741916 - DNA, 15 bp, Homo sapiens
gagaactcatttcaa

SEQ ID NO: 5741917 - DNA, 22 bp, Homo sapiens
gagaactccagctggtgccccc

SEQ ID NO: 5741918 - DNA, 15 bp, Homo sapiens
gagaactccatcaga

SEQ ID NO: 5741919 - DNA, 13 bp, Homo sapiens
gagaactcctgac

SEQ ID NO: 5741920 - DNA, 23 bp, Homo sapiens
gagaactcgaagcccttccagtg

SEQ ID NO: 5741921 - DNA, 16 bp, Homo sapiens
gagaactgactttctc

SEQ ID NO: 5741922 - DNA, 23 bp, Homo sapiens
gagaactgcatatgtttcgctga

SEQ ID NO: 5741923 - DNA, 20 bp, Homo sapiens
gagaactgggatttgaaccc

SEQ ID NO: 5741924 - DNA, 22 bp, Homo sapiens
gagaactggggttcaagcccag

SEQ ID NO: 5741925 - DNA, 22 bp, Homo sapiens
gagaactggttcttgccttccc

SEQ ID NO: 5741926 - DNA, 18 bp, Homo sapiens
gagaactgtcaccctgag

SEQ ID NO: 5741927 - DNA, 21 bp, Homo sapiens
gagaactgtgaatatgtgtaa

SEQ ID NO: 5741928 - DNA, 22 bp, Homo sapiens
gagaactgtgaatatgtgtaac

SEQ ID NO: 5741929 - DNA, 18 bp, Homo sapiens
gagaactgttctcatgga

SEQ ID NO: 5741930 - DNA, 22 bp, Homo sapiens
gagaacttccagatcctggaaa

SEQ ID NO: 5741931 - DNA, 16 bp, Homo sapiens
gagaactttcattttt

SEQ ID NO: 5741932 - DNA, 18 bp, Homo sapiens
gagaagaaaatgttcttc

SEQ ID NO: 5741933 - DNA, 11 bp, Homo sapiens
gagaagaaaga

SEQ ID NO: 5741934 - DNA, 12 bp, Homo sapiens
gagaagaaagaa

SEQ ID NO: 5741935 - DNA, 21 bp, Homo sapiens
gagaagaaagaacggaagaag

SEQ ID NO: 5741936 - DNA, 22 bp, Homo sapiens
gagaagaaagaagcactctgct

SEQ ID NO: 5741937 - DNA, 14 bp, Homo sapiens
gagaagaagaaaaa

SEQ ID NO: 5741938 - DNA, 13 bp, Homo sapiens
gagaagaagctga

SEQ ID NO: 5741939 - DNA, 14 bp, Homo sapiens
gagaagaatagcct

SEQ ID NO: 5741940 - DNA, 19 bp, Homo sapiens
gagaagaatattgttccta

SEQ ID NO: 5741941 - DNA, 21 bp, Homo sapiens
gagaagaattttcagacccca

SEQ ID NO: 5741942 - DNA, 18 bp, Homo sapiens
gagaagacaacagaaaga

SEQ ID NO: 5741943 - DNA, 18 bp, Homo sapiens
gagaagacactgcagtga

SEQ ID NO: 5741944 - DNA, 15 bp, Homo sapiens
gagaagacccctgcc

SEQ ID NO: 5741945 - DNA, 16 bp, Homo sapiens
gagaagacccctgccc

SEQ ID NO: 5741946 - DNA, 16 bp, Homo sapiens
gagaagactagcagct

SEQ ID NO: 5741947 - DNA, 16 bp, Homo sapiens
gagaagagaatgcaca

SEQ ID NO: 5741948 - DNA, 11 bp, Homo sapiens
gagaagagccc

SEQ ID NO: 5741949 - DNA, 13 bp, Homo sapiens
gagaagagctgtt

SEQ ID NO: 5741950 - DNA, 20 bp, Homo sapiens
gagaagaggcatcctgcctg

SEQ ID NO: 5741951 - DNA, 21 bp, Homo sapiens
gagaagaggctggtgctgtgg

SEQ ID NO: 5741952 - DNA, 21 bp, Homo sapiens
gagaagagggaaaacagaaaa

SEQ ID NO: 5741953 - DNA, 21 bp, Homo sapiens
gagaagagggcccagcccaga

SEQ ID NO: 5741954 - DNA, 16 bp, Homo sapiens
gagaagagggcctgtg

SEQ ID NO: 5741955 - DNA, 14 bp, Homo sapiens
gagaagagtccagg

SEQ ID NO: 5741956 - DNA, 16 bp, Homo sapiens
gagaagatcggaacag

SEQ ID NO: 5741957 - DNA, 20 bp, Homo sapiens
gagaagatctaccccaggga

SEQ ID NO: 5741958 - DNA, 14 bp, Homo sapiens
gagaagatggcact

SEQ ID NO: 5741959 - DNA, 23 bp, Homo sapiens
gagaagatggcactgtccagggc

SEQ ID NO: 5741960 - DNA, 18 bp, Homo sapiens
gagaagatgggggctgga

SEQ ID NO: 5741961 - DNA, 23 bp, Homo sapiens
gagaagattcttcccattctcca

SEQ ID NO: 5741962 - DNA, 23 bp, Homo sapiens
gagaagcaagaaagaaacccgac

SEQ ID NO: 5741963 - DNA, 21 bp, Homo sapiens
gagaagcacactctggtcttg

SEQ ID NO: 5741964 - DNA, 24 bp, Homo sapiens
gagaagcagcatcaacctaggagc

SEQ ID NO: 5741965 - DNA, 22 bp, Homo sapiens
gagaagcagcctcctaatttga

SEQ ID NO: 5741966 - DNA, 14 bp, Homo sapiens
gagaagcagtgagc

SEQ ID NO: 5741967 - DNA, 18 bp, Homo sapiens
gagaagcatatagaggca

SEQ ID NO: 5741968 - DNA, 19 bp, Homo sapiens
gagaagcatcctccacatc

SEQ ID NO: 5741969 - DNA, 18 bp, Homo sapiens
gagaagccaaaagattgg

SEQ ID NO: 5741970 - DNA, 12 bp, Homo sapiens
gagaagccaagc

SEQ ID NO: 5741971 - DNA, 21 bp, Homo sapiens
gagaagccaagggacacagga

SEQ ID NO: 5741972 - DNA, 17 bp, Homo sapiens
gagaagccacaggcctg

SEQ ID NO: 5741973 - DNA, 13 bp, Homo sapiens
gagaagccacctt

SEQ ID NO: 5741974 - DNA, 20 bp, Homo sapiens
gagaagccacgctgtcctct

SEQ ID NO: 5741975 - DNA, 19 bp, Homo sapiens
gagaagccagccacagacc

SEQ ID NO: 5741976 - DNA, 14 bp, Homo sapiens
gagaagccagcttg

SEQ ID NO: 5741977 - DNA, 14 bp, Homo sapiens
gagaagccaggagg

SEQ ID NO: 5741978 - DNA, 11 bp, Homo sapiens
gagaagccata

SEQ ID NO: 5741979 - DNA, 12 bp, Homo sapiens
gagaagccataa

SEQ ID NO: 5741980 - DNA, 19 bp, Homo sapiens
gagaagccatcacctcaga

SEQ ID NO: 5741981 - DNA, 23 bp, Homo sapiens
gagaagccatcacctcagatggc

SEQ ID NO: 5741982 - DNA, 13 bp, Homo sapiens
gagaagccccgca

SEQ ID NO: 5741983 - DNA, 12 bp, Homo sapiens
gagaagccgcag

SEQ ID NO: 5741984 - DNA, 19 bp, Homo sapiens
gagaagcctcagtccctcc

SEQ ID NO: 5741985 - DNA, 13 bp, Homo sapiens
gagaagccttcaa

SEQ ID NO: 5741986 - DNA, 18 bp, Homo sapiens
gagaagccttcagctcca

SEQ ID NO: 5741987 - DNA, 13 bp, Homo sapiens
gagaagcgctgcc

SEQ ID NO: 5741988 - DNA, 15 bp, Homo sapiens
gagaagcgctgccct

SEQ ID NO: 5741989 - DNA, 16 bp, Homo sapiens
gagaagcggctggcag

SEQ ID NO: 5741990 - DNA, 15 bp, Homo sapiens
gagaagcgggctggg

SEQ ID NO: 5741991 - DNA, 16 bp, Homo sapiens
gagaagcggtcatgag

SEQ ID NO: 5741992 - DNA, 13 bp, Homo sapiens
gagaagctcattt

SEQ ID NO: 5741993 - DNA, 14 bp, Homo sapiens
gagaagctcattta

SEQ ID NO: 5741994 - DNA, 17 bp, Homo sapiens
gagaagctcccaggaac

SEQ ID NO: 5741995 - DNA, 22 bp, Homo sapiens
gagaagctcctgctacttcccc

SEQ ID NO: 5741996 - DNA, 21 bp, Homo sapiens
gagaagctctcgggctaggaa

SEQ ID NO: 5741997 - DNA, 23 bp, Homo sapiens
gagaagctgagaagaagctgagg

SEQ ID NO: 5741998 - DNA, 17 bp, Homo sapiens
gagaagctgatccagtt

SEQ ID NO: 5741999 - DNA, 21 bp, Homo sapiens
gagaagctgatccagtttccg

SEQ ID NO: 5742000 - DNA, 13 bp, Homo sapiens
gagaagctgcagg

SEQ ID NO: 5742001 - DNA, 14 bp, Homo sapiens
gagaagctgcatcc

SEQ ID NO: 5742002 - DNA, 12 bp, Homo sapiens
gagaagctgctg

SEQ ID NO: 5742003 - DNA, 13 bp, Homo sapiens
gagaagctgctga

SEQ ID NO: 5742004 - DNA, 23 bp, Homo sapiens
gagaagcttgtggtgttcctgaa

SEQ ID NO: 5742005 - DNA, 20 bp, Homo sapiens
gagaagctttttttcttgct

SEQ ID NO: 5742006 - DNA, 11 bp, Homo sapiens
gagaaggaaat

SEQ ID NO: 5742007 - DNA, 15 bp, Homo sapiens
gagaaggaaataaaa

SEQ ID NO: 5742008 - DNA, 15 bp, Homo sapiens
gagaaggaactgata

SEQ ID NO: 5742009 - DNA, 22 bp, Homo sapiens
gagaaggagatgtaatgacaga

SEQ ID NO: 5742010 - DNA, 13 bp, Homo sapiens
gagaaggagcaga

SEQ ID NO: 5742011 - DNA, 14 bp, Homo sapiens
gagaaggaggaacc

SEQ ID NO: 5742012 - DNA, 12 bp, Homo sapiens
gagaaggcagga

SEQ ID NO: 5742013 - DNA, 18 bp, Homo sapiens
gagaaggcaggcctccgt

SEQ ID NO: 5742014 - DNA, 21 bp, Homo sapiens
gagaaggcagtagttttcaaa

SEQ ID NO: 5742015 - DNA, 21 bp, Homo sapiens
gagaaggcccataccttctgg

SEQ ID NO: 5742016 - DNA, 14 bp, Homo sapiens
gagaaggcctcccc

SEQ ID NO: 5742017 - DNA, 18 bp, Homo sapiens
gagaaggcctgcccccct

SEQ ID NO: 5742018 - DNA, 16 bp, Homo sapiens
gagaaggcctggaaga

SEQ ID NO: 5742019 - DNA, 15 bp, Homo sapiens
gagaaggcgaggaga

SEQ ID NO: 5742020 - DNA, 14 bp, Homo sapiens
gagaaggcggaaac

SEQ ID NO: 5742021 - DNA, 17 bp, Homo sapiens
gagaaggctcagccttg

SEQ ID NO: 5742022 - DNA, 24 bp, Homo sapiens
gagaagggaagaaggggccatcac

SEQ ID NO: 5742023 - DNA, 14 bp, Homo sapiens
gagaagggaagcct

SEQ ID NO: 5742024 - DNA, 15 bp, Homo sapiens
gagaagggacatggg

SEQ ID NO: 5742025 - DNA, 16 bp, Homo sapiens
gagaagggagaacagg

SEQ ID NO: 5742026 - DNA, 12 bp, Homo sapiens
gagaagggaggg

SEQ ID NO: 5742027 - DNA, 13 bp, Homo sapiens
gagaagggagggt

SEQ ID NO: 5742028 - DNA, 15 bp, Homo sapiens
gagaagggatggagg

SEQ ID NO: 5742029 - DNA, 12 bp, Homo sapiens
gagaagggcagg

SEQ ID NO: 5742030 - DNA, 17 bp, Homo sapiens
gagaagggcataaaaca

SEQ ID NO: 5742031 - DNA, 17 bp, Homo sapiens
gagaagggcatggtatt

SEQ ID NO: 5742032 - DNA, 16 bp, Homo sapiens
gagaagggcctgctct

SEQ ID NO: 5742033 - DNA, 17 bp, Homo sapiens
gagaagggcctgctctg

SEQ ID NO: 5742034 - DNA, 16 bp, Homo sapiens
gagaagggcgcaggaa

SEQ ID NO: 5742035 - DNA, 15 bp, Homo sapiens
gagaagggctggggc

SEQ ID NO: 5742036 - DNA, 12 bp, Homo sapiens
gagaaggggcag

SEQ ID NO: 5742037 - DNA, 19 bp, Homo sapiens
gagaaggggcccaagagag

SEQ ID NO: 5742038 - DNA, 23 bp, Homo sapiens
gagaaggggcccaagagagacag

SEQ ID NO: 5742039 - DNA, 19 bp, Homo sapiens
gagaagggggtcaaagcaa

SEQ ID NO: 5742040 - DNA, 23 bp, Homo sapiens
gagaagggtggtaaatattttca

SEQ ID NO: 5742041 - DNA, 19 bp, Homo sapiens
gagaagggttacttgctgc

SEQ ID NO: 5742042 - DNA, 18 bp, Homo sapiens
gagaagggttctgccctg

SEQ ID NO: 5742043 - DNA, 19 bp, Homo sapiens
gagaagggttctgccctgc

SEQ ID NO: 5742044 - DNA, 22 bp, Homo sapiens
gagaagggttctgccctgcctg

SEQ ID NO: 5742045 - DNA, 22 bp, Homo sapiens
gagaaggtctgtggtgcagtgt

SEQ ID NO: 5742046 - DNA, 15 bp, Homo sapiens
gagaaggtgcctgcc

SEQ ID NO: 5742047 - DNA, 23 bp, Homo sapiens
gagaaggtgggttttcatcaaga

SEQ ID NO: 5742048 - DNA, 17 bp, Homo sapiens
gagaaggttggaggtgg

SEQ ID NO: 5742049 - DNA, 15 bp, Homo sapiens
gagaaggtttattgt

SEQ ID NO: 5742050 - DNA, 18 bp, Homo sapiens
gagaagtaattcctctga

SEQ ID NO: 5742051 - DNA, 19 bp, Homo sapiens
gagaagtacttttgattat

SEQ ID NO: 5742052 - DNA, 18 bp, Homo sapiens
gagaagtatccaattatg

SEQ ID NO: 5742053 - DNA, 22 bp, Homo sapiens
gagaagtatccaattatgtgac

SEQ ID NO: 5742054 - DNA, 19 bp, Homo sapiens
gagaagtattcctgttgct

SEQ ID NO: 5742055 - DNA, 19 bp, Homo sapiens
gagaagtcagttggagaaa

SEQ ID NO: 5742056 - DNA, 15 bp, Homo sapiens
gagaagtcggccagg

SEQ ID NO: 5742057 - DNA, 18 bp, Homo sapiens
gagaagtcggccaggtag

SEQ ID NO: 5742058 - DNA, 13 bp, Homo sapiens
gagaagtctcagc

SEQ ID NO: 5742059 - DNA, 14 bp, Homo sapiens
gagaagtctcagct

SEQ ID NO: 5742060 - DNA, 21 bp, Homo sapiens
gagaagtctggtcagagccac

SEQ ID NO: 5742061 - DNA, 23 bp, Homo sapiens
gagaagtcttagacttgaaatac

SEQ ID NO: 5742062 - DNA, 21 bp, Homo sapiens
gagaagtcttctatttattta

SEQ ID NO: 5742063 - DNA, 19 bp, Homo sapiens
gagaagtgaataactgcaa

SEQ ID NO: 5742064 - DNA, 21 bp, Homo sapiens
gagaagtgagggctgggcagc

SEQ ID NO: 5742065 - DNA, 16 bp, Homo sapiens
gagaagtgccttctcc

SEQ ID NO: 5742066 - DNA, 18 bp, Homo sapiens
gagaagtggccagggctt

SEQ ID NO: 5742067 - DNA, 20 bp, Homo sapiens
gagaagtgggggcagcccag

SEQ ID NO: 5742068 - DNA, 18 bp, Homo sapiens
gagaagtgggtggggaca

SEQ ID NO: 5742069 - DNA, 18 bp, Homo sapiens
gagaagttcatatttctt

SEQ ID NO: 5742070 - DNA, 20 bp, Homo sapiens
gagaagttcccattattatt

SEQ ID NO: 5742071 - DNA, 12 bp, Homo sapiens
gagaagttctca

SEQ ID NO: 5742072 - DNA, 19 bp, Homo sapiens
gagaagttctcaaagttaa

SEQ ID NO: 5742073 - DNA, 20 bp, Homo sapiens
gagaagttgaggggagcatg

SEQ ID NO: 5742074 - DNA, 15 bp, Homo sapiens
gagaagttgtgaaag

SEQ ID NO: 5742075 - DNA, 21 bp, Homo sapiens
gagaagtttctggccctggct

SEQ ID NO: 5742076 - DNA, 16 bp, Homo sapiens
gagaataaagacttca

SEQ ID NO: 5742077 - DNA, 19 bp, Homo sapiens
gagaataactcagaatatt

SEQ ID NO: 5742078 - DNA, 20 bp, Homo sapiens
gagaataagagagtcataaa

SEQ ID NO: 5742079 - DNA, 18 bp, Homo sapiens
gagaataagttcatacaa

SEQ ID NO: 5742080 - DNA, 16 bp, Homo sapiens
gagaataattctttga

SEQ ID NO: 5742081 - DNA, 15 bp, Homo sapiens
gagaataattgtgta

SEQ ID NO: 5742082 - DNA, 16 bp, Homo sapiens
gagaataattgtgtac

SEQ ID NO: 5742083 - DNA, 21 bp, Homo sapiens
gagaatacaagatattatgta

SEQ ID NO: 5742084 - DNA, 21 bp, Homo sapiens
gagaatacacatataaaaaca

SEQ ID NO: 5742085 - DNA, 13 bp, Homo sapiens
gagaatacataaa

SEQ ID NO: 5742086 - DNA, 13 bp, Homo sapiens
gagaatacatctt

SEQ ID NO: 5742087 - DNA, 22 bp, Homo sapiens
gagaatactgccaaaacattta

SEQ ID NO: 5742088 - DNA, 19 bp, Homo sapiens
gagaatactttgcttcata

SEQ ID NO: 5742089 - DNA, 15 bp, Homo sapiens
gagaatagaaacgta

SEQ ID NO: 5742090 - DNA, 13 bp, Homo sapiens
gagaatagaagga

SEQ ID NO: 5742091 - DNA, 21 bp, Homo sapiens
gagaatagcagagagccaaat

SEQ ID NO: 5742092 - DNA, 14 bp, Homo sapiens
gagaatagcagttt

SEQ ID NO: 5742093 - DNA, 19 bp, Homo sapiens
gagaataggggagccaagg

SEQ ID NO: 5742094 - DNA, 15 bp, Homo sapiens
gagaatagtggagga

SEQ ID NO: 5742095 - DNA, 12 bp, Homo sapiens
gagaatatatac

SEQ ID NO: 5742096 - DNA, 23 bp, Homo sapiens
gagaatattagctttactgtttg

SEQ ID NO: 5742097 - DNA, 22 bp, Homo sapiens
gagaatattataaaaatatcaa

SEQ ID NO: 5742098 - DNA, 13 bp, Homo sapiens
gagaatattcaaa

SEQ ID NO: 5742099 - DNA, 22 bp, Homo sapiens
gagaatatttactaactaaata

SEQ ID NO: 5742100 - DNA, 22 bp, Homo sapiens
gagaatatttcaaatgaacacg

SEQ ID NO: 5742101 - DNA, 21 bp, Homo sapiens
gagaatattttaagtattgca

SEQ ID NO: 5742102 - DNA, 14 bp, Homo sapiens
gagaatatttttcc

SEQ ID NO: 5742103 - DNA, 22 bp, Homo sapiens
gagaatatttttggcattcctc

SEQ ID NO: 5742104 - DNA, 14 bp, Homo sapiens
gagaatcaaggccg

SEQ ID NO: 5742105 - DNA, 20 bp, Homo sapiens
gagaatcacctgaaccccag

SEQ ID NO: 5742106 - DNA, 23 bp, Homo sapiens
gagaatcacctgaaccccagagg

SEQ ID NO: 5742107 - DNA, 22 bp, Homo sapiens
gagaatcactaggtaacttatt

SEQ ID NO: 5742108 - DNA, 17 bp, Homo sapiens
gagaatcactgctccag

SEQ ID NO: 5742109 - DNA, 17 bp, Homo sapiens
gagaatcacttttctag

SEQ ID NO: 5742110 - DNA, 13 bp, Homo sapiens
gagaatcagggca

SEQ ID NO: 5742111 - DNA, 19 bp, Homo sapiens
gagaatcagggcaggcttg

SEQ ID NO: 5742112 - DNA, 12 bp, Homo sapiens
gagaatccaagc

SEQ ID NO: 5742113 - DNA, 14 bp, Homo sapiens
gagaatcccttaaa

SEQ ID NO: 5742114 - DNA, 18 bp, Homo sapiens
gagaatcctcccttccca

SEQ ID NO: 5742115 - DNA, 19 bp, Homo sapiens
gagaatcgcttgaacctgg

SEQ ID NO: 5742116 - DNA, 13 bp, Homo sapiens
gagaatctgaggg

SEQ ID NO: 5742117 - DNA, 21 bp, Homo sapiens
gagaatctgggggtgaggagg

SEQ ID NO: 5742118 - DNA, 21 bp, Homo sapiens
gagaatcttaaggtctaactg

SEQ ID NO: 5742119 - DNA, 13 bp, Homo sapiens
gagaatgaacaaa

SEQ ID NO: 5742120 - DNA, 17 bp, Homo sapiens
gagaatgaacaaagacc

SEQ ID NO: 5742121 - DNA, 19 bp, Homo sapiens
gagaatgagagcgacacag

SEQ ID NO: 5742122 - DNA, 22 bp, Homo sapiens
gagaatgagggcgtgaaacaca

SEQ ID NO: 5742123 - DNA, 14 bp, Homo sapiens
gagaatgagtggga

SEQ ID NO: 5742124 - DNA, 15 bp, Homo sapiens
gagaatgagtgggaa

SEQ ID NO: 5742125 - DNA, 22 bp, Homo sapiens
gagaatgcagcccaccaggagc

SEQ ID NO: 5742126 - DNA, 17 bp, Homo sapiens
gagaatgcccaactctt

SEQ ID NO: 5742127 - DNA, 21 bp, Homo sapiens
gagaatgcctaggccagctcc

SEQ ID NO: 5742128 - DNA, 13 bp, Homo sapiens
gagaatgctgtca

SEQ ID NO: 5742129 - DNA, 19 bp, Homo sapiens
gagaatgctttgaaaatgt

SEQ ID NO: 5742130 - DNA, 14 bp, Homo sapiens
gagaatggcctgag

SEQ ID NO: 5742131 - DNA, 15 bp, Homo sapiens
gagaatggcctggag

SEQ ID NO: 5742132 - DNA, 16 bp, Homo sapiens
gagaatggcctggagc

SEQ ID NO: 5742133 - DNA, 20 bp, Homo sapiens
gagaatggcgtgaacccggg

SEQ ID NO: 5742134 - DNA, 14 bp, Homo sapiens
gagaatggctctgg

SEQ ID NO: 5742135 - DNA, 17 bp, Homo sapiens
gagaatggctgggtcag

SEQ ID NO: 5742136 - DNA, 19 bp, Homo sapiens
gagaatggctttggtctct

SEQ ID NO: 5742137 - DNA, 16 bp, Homo sapiens
gagaatggggttcctg

SEQ ID NO: 5742138 - DNA, 23 bp, Homo sapiens
gagaatggtgtgaacccgggagc

SEQ ID NO: 5742139 - DNA, 16 bp, Homo sapiens
gagaatgtaagaacta

SEQ ID NO: 5742140 - DNA, 21 bp, Homo sapiens
gagaatgtagatattgtgaag

SEQ ID NO: 5742141 - DNA, 22 bp, Homo sapiens
gagaatgtatcagccagccttc

SEQ ID NO: 5742142 - DNA, 21 bp, Homo sapiens
gagaatgtattttcatagatg

SEQ ID NO: 5742143 - DNA, 17 bp, Homo sapiens
gagaatgtcagtatgtg

SEQ ID NO: 5742144 - DNA, 13 bp, Homo sapiens
gagaatgtcattt

SEQ ID NO: 5742145 - DNA, 20 bp, Homo sapiens
gagaatgtgattccttttga

SEQ ID NO: 5742146 - DNA, 15 bp, Homo sapiens
gagaatgtgccatgt

SEQ ID NO: 5742147 - DNA, 22 bp, Homo sapiens
gagaatgtgtgtgtgtggcagg

SEQ ID NO: 5742148 - DNA, 23 bp, Homo sapiens
gagaatgtgtgtgtgtggcaggg

SEQ ID NO: 5742149 - DNA, 17 bp, Homo sapiens
gagaatgtgtttcaaaa

SEQ ID NO: 5742150 - DNA, 16 bp, Homo sapiens
gagaatgttaccagac

SEQ ID NO: 5742151 - DNA, 16 bp, Homo sapiens
gagaatgttatagtga

SEQ ID NO: 5742152 - DNA, 22 bp, Homo sapiens
gagaatgtttgaaaattagaga

SEQ ID NO: 5742153 - DNA, 15 bp, Homo sapiens
gagaattaaaactca

SEQ ID NO: 5742154 - DNA, 18 bp, Homo sapiens
gagaattaagttttaaat

SEQ ID NO: 5742155 - DNA, 13 bp, Homo sapiens
gagaattactgtt

SEQ ID NO: 5742156 - DNA, 16 bp, Homo sapiens
gagaattatctcaagt

SEQ ID NO: 5742157 - DNA, 18 bp, Homo sapiens
gagaattatctcaagtaa

SEQ ID NO: 5742158 - DNA, 17 bp, Homo sapiens
gagaattcaaatcctct

SEQ ID NO: 5742159 - DNA, 18 bp, Homo sapiens
gagaattcaaatcctctt

SEQ ID NO: 5742160 - DNA, 14 bp, Homo sapiens
gagaattcacagaa

SEQ ID NO: 5742161 - DNA, 15 bp, Homo sapiens
gagaattcagctgcc

SEQ ID NO: 5742162 - DNA, 16 bp, Homo sapiens
gagaattcagctgccc

SEQ ID NO: 5742163 - DNA, 13 bp, Homo sapiens
gagaattctaaga

SEQ ID NO: 5742164 - DNA, 18 bp, Homo sapiens
gagaattgaaaaggactc

SEQ ID NO: 5742165 - DNA, 18 bp, Homo sapiens
gagaattgaggggaggtg

SEQ ID NO: 5742166 - DNA, 21 bp, Homo sapiens
gagaattgtatcatttgaaca

SEQ ID NO: 5742167 - DNA, 21 bp, Homo sapiens
gagaatttaagtagaaaagtt

SEQ ID NO: 5742168 - DNA, 23 bp, Homo sapiens
gagaatttaatttttaaaagact

SEQ ID NO: 5742169 - DNA, 18 bp, Homo sapiens
gagaatttcaaggcaggg

SEQ ID NO: 5742170 - DNA, 12 bp, Homo sapiens
gagaatttctaa

SEQ ID NO: 5742171 - DNA, 13 bp, Homo sapiens
gagaatttctaaa

SEQ ID NO: 5742172 - DNA, 11 bp, Homo sapiens
gagacaaaaat

SEQ ID NO: 5742173 - DNA, 13 bp, Homo sapiens
gagacaaaagaaa

SEQ ID NO: 5742174 - DNA, 16 bp, Homo sapiens
gagacaaaattttagt

SEQ ID NO: 5742175 - DNA, 19 bp, Homo sapiens
gagacaaacacctcccagg

SEQ ID NO: 5742176 - DNA, 19 bp, Homo sapiens
gagacaaacagcccttcct

SEQ ID NO: 5742177 - DNA, 20 bp, Homo sapiens
gagacaaacagcccttcctt

SEQ ID NO: 5742178 - DNA, 14 bp, Homo sapiens
gagacaaagcagga

SEQ ID NO: 5742179 - DNA, 14 bp, Homo sapiens
gagacaaatccttt

SEQ ID NO: 5742180 - DNA, 21 bp, Homo sapiens
gagacaaatcctttctgcccc

SEQ ID NO: 5742181 - DNA, 22 bp, Homo sapiens
gagacaaatcctttctgccccc

SEQ ID NO: 5742182 - DNA, 13 bp, Homo sapiens
gagacaaatcttt

SEQ ID NO: 5742183 - DNA, 16 bp, Homo sapiens
gagacaaatggaggcc

SEQ ID NO: 5742184 - DNA, 15 bp, Homo sapiens
gagacaacacacaca

SEQ ID NO: 5742185 - DNA, 17 bp, Homo sapiens
gagacaagaaatccctg

SEQ ID NO: 5742186 - DNA, 17 bp, Homo sapiens
gagacaagccctggcaa

SEQ ID NO: 5742187 - DNA, 15 bp, Homo sapiens
gagacaaggtgctaa

SEQ ID NO: 5742188 - DNA, 14 bp, Homo sapiens
gagacaataaaaca

SEQ ID NO: 5742189 - DNA, 16 bp, Homo sapiens
gagacaatgcagatgc

SEQ ID NO: 5742190 - DNA, 21 bp, Homo sapiens
gagacaatgcagatgccagag

SEQ ID NO: 5742191 - DNA, 23 bp, Homo sapiens
gagacaatgcagatgccagagca

SEQ ID NO: 5742192 - DNA, 19 bp, Homo sapiens
gagacaatgtctgcagccc

SEQ ID NO: 5742193 - DNA, 20 bp, Homo sapiens
gagacaatgtctgcagccct

SEQ ID NO: 5742194 - DNA, 20 bp, Homo sapiens
gagacaattagcagaatgga

SEQ ID NO: 5742195 - DNA, 18 bp, Homo sapiens
gagacacaaaagatggga

SEQ ID NO: 5742196 - DNA, 22 bp, Homo sapiens
gagacacagagtggagccctca

SEQ ID NO: 5742197 - DNA, 16 bp, Homo sapiens
gagacacagcgtccct

SEQ ID NO: 5742198 - DNA, 17 bp, Homo sapiens
gagacacagggcatcca

SEQ ID NO: 5742199 - DNA, 21 bp, Homo sapiens
gagacacatacagagtgggcc

SEQ ID NO: 5742200 - DNA, 15 bp, Homo sapiens
gagacacattcacaa

SEQ ID NO: 5742201 - DNA, 14 bp, Homo sapiens
gagacacattggac

SEQ ID NO: 5742202 - DNA, 21 bp, Homo sapiens
gagacaccaagctcacccttc

SEQ ID NO: 5742203 - DNA, 15 bp, Homo sapiens
gagacaccatcctga

SEQ ID NO: 5742204 - DNA, 19 bp, Homo sapiens
gagacaccccttcctgctg

SEQ ID NO: 5742205 - DNA, 15 bp, Homo sapiens
gagacaccctctggg

SEQ ID NO: 5742206 - DNA, 23 bp, Homo sapiens
gagacaccgcgcatctcttcctg

SEQ ID NO: 5742207 - DNA, 21 bp, Homo sapiens
gagacaccggagtatgtgcag

SEQ ID NO: 5742208 - DNA, 19 bp, Homo sapiens
gagacacctcagagccccg

SEQ ID NO: 5742209 - DNA, 18 bp, Homo sapiens
gagacacgacagcacaca

SEQ ID NO: 5742210 - DNA, 17 bp, Homo sapiens
gagacacgctggcgaca

SEQ ID NO: 5742211 - DNA, 19 bp, Homo sapiens
gagacacgtgtggcgggca

SEQ ID NO: 5742212 - DNA, 11 bp, Homo sapiens
gagacactgag

SEQ ID NO: 5742213 - DNA, 14 bp, Homo sapiens
gagacactgagcca

SEQ ID NO: 5742214 - DNA, 16 bp, Homo sapiens
gagacactgagccagt

SEQ ID NO: 5742215 - DNA, 19 bp, Homo sapiens
gagacactggtctcagagg

SEQ ID NO: 5742216 - DNA, 14 bp, Homo sapiens
gagacactggtggg

SEQ ID NO: 5742217 - DNA, 17 bp, Homo sapiens
gagacactggtggggat

SEQ ID NO: 5742218 - DNA, 13 bp, Homo sapiens
gagacagaaagcc

SEQ ID NO: 5742219 - DNA, 15 bp, Homo sapiens
gagacagaaagcctc

SEQ ID NO: 5742220 - DNA, 12 bp, Homo sapiens
gagacagaagca

SEQ ID NO: 5742221 - DNA, 21 bp, Homo sapiens
gagacagaagcctggactctg

SEQ ID NO: 5742222 - DNA, 14 bp, Homo sapiens
gagacagaatgtat

SEQ ID NO: 5742223 - DNA, 10 bp, Homo sapiens
gagacagaca

SEQ ID NO: 5742224 - DNA, 12 bp, Homo sapiens
gagacagacaca

SEQ ID NO: 5742225 - DNA, 19 bp, Homo sapiens
gagacagacacacactggc

SEQ ID NO: 5742226 - DNA, 20 bp, Homo sapiens
gagacagacagagaaggcag

SEQ ID NO: 5742227 - DNA, 15 bp, Homo sapiens
gagacagacattcac

SEQ ID NO: 5742228 - DNA, 22 bp, Homo sapiens
gagacagaccacttgccacgct

SEQ ID NO: 5742229 - DNA, 17 bp, Homo sapiens
gagacagactagaagtt

SEQ ID NO: 5742230 - DNA, 18 bp, Homo sapiens
gagacagagagagactga

SEQ ID NO: 5742231 - DNA, 22 bp, Homo sapiens
gagacagagaggacgtgggcgg

SEQ ID NO: 5742232 - DNA, 20 bp, Homo sapiens
gagacagagatgtgcagagt

SEQ ID NO: 5742233 - DNA, 19 bp, Homo sapiens
gagacagagccaagcactg

SEQ ID NO: 5742234 - DNA, 21 bp, Homo sapiens
gagacagagccaagcactgct

SEQ ID NO: 5742235 - DNA, 22 bp, Homo sapiens
gagacagagccaagcactgctc

SEQ ID NO: 5742236 - DNA, 15 bp, Homo sapiens
gagacagagccccca

SEQ ID NO: 5742237 - DNA, 17 bp, Homo sapiens
gagacagagcccccaag

SEQ ID NO: 5742238 - DNA, 20 bp, Homo sapiens
gagacagagcctcgctctgt

SEQ ID NO: 5742239 - DNA, 20 bp, Homo sapiens
gagacagagcgacagagcag

SEQ ID NO: 5742240 - DNA, 23 bp, Homo sapiens
gagacagaggaaagggctggctc

SEQ ID NO: 5742241 - DNA, 20 bp, Homo sapiens
gagacagatacctccaaccc

SEQ ID NO: 5742242 - DNA, 18 bp, Homo sapiens
gagacagatcactcctgg

SEQ ID NO: 5742243 - DNA, 14 bp, Homo sapiens
gagacagcacaggc

SEQ ID NO: 5742244 - DNA, 15 bp, Homo sapiens
gagacagcacaggca

SEQ ID NO: 5742245 - DNA, 22 bp, Homo sapiens
gagacagcaccactgctgagga

SEQ ID NO: 5742246 - DNA, 18 bp, Homo sapiens
gagacagccacttggttt

SEQ ID NO: 5742247 - DNA, 13 bp, Homo sapiens
gagacagcccagg

SEQ ID NO: 5742248 - DNA, 19 bp, Homo sapiens
gagacagccccagagcagg

SEQ ID NO: 5742249 - DNA, 12 bp, Homo sapiens
gagacagcccgg

SEQ ID NO: 5742250 - DNA, 17 bp, Homo sapiens
gagacagcccgggctct

SEQ ID NO: 5742251 - DNA, 21 bp, Homo sapiens
gagacagcccgggctctgcct

SEQ ID NO: 5742252 - DNA, 15 bp, Homo sapiens
gagacagccctgcct

SEQ ID NO: 5742253 - DNA, 22 bp, Homo sapiens
gagacagcggtcccaggggcct

SEQ ID NO: 5742254 - DNA, 15 bp, Homo sapiens
gagacagctctgcat

SEQ ID NO: 5742255 - DNA, 19 bp, Homo sapiens
gagacagcttgatcaaagg

SEQ ID NO: 5742256 - DNA, 15 bp, Homo sapiens
gagacaggaaagaat

SEQ ID NO: 5742257 - DNA, 12 bp, Homo sapiens
gagacaggaagg

SEQ ID NO: 5742258 - DNA, 14 bp, Homo sapiens
gagacaggcagagc

SEQ ID NO: 5742259 - DNA, 13 bp, Homo sapiens
gagacaggccttt

SEQ ID NO: 5742260 - DNA, 15 bp, Homo sapiens
gagacaggctgggtc

SEQ ID NO: 5742261 - DNA, 18 bp, Homo sapiens
gagacagggcccgggccc

SEQ ID NO: 5742262 - DNA, 19 bp, Homo sapiens
gagacagggtaggaaaggg

SEQ ID NO: 5742263 - DNA, 14 bp, Homo sapiens
gagacagggtcctg

SEQ ID NO: 5742264 - DNA, 14 bp, Homo sapiens
gagacagggtctca

SEQ ID NO: 5742265 - DNA, 15 bp, Homo sapiens
gagacagggtctcac

SEQ ID NO: 5742266 - DNA, 19 bp, Homo sapiens
gagacagggtctcactgtg

SEQ ID NO: 5742267 - DNA, 21 bp, Homo sapiens
gagacagggtctcactgtgtt

SEQ ID NO: 5742268 - DNA, 19 bp, Homo sapiens
gagacagggtttcaccatg

SEQ ID NO: 5742269 - DNA, 20 bp, Homo sapiens
gagacagggtttcaccatgt

SEQ ID NO: 5742270 - DNA, 22 bp, Homo sapiens
gagacagggtttggctgtgtct

SEQ ID NO: 5742271 - DNA, 20 bp, Homo sapiens
gagacagggttttgccatgt

SEQ ID NO: 5742272 - DNA, 15 bp, Homo sapiens
gagacaggtgcctgg

SEQ ID NO: 5742273 - DNA, 17 bp, Homo sapiens
gagacaggtggcctagc

SEQ ID NO: 5742274 - DNA, 16 bp, Homo sapiens
gagacagtagaggcat

SEQ ID NO: 5742275 - DNA, 15 bp, Homo sapiens
gagacagtcaggaag

SEQ ID NO: 5742276 - DNA, 16 bp, Homo sapiens
gagacagtgaatttgg

SEQ ID NO: 5742277 - DNA, 17 bp, Homo sapiens
gagacagtgatctccat

SEQ ID NO: 5742278 - DNA, 18 bp, Homo sapiens
gagacagtgatgcctgcc

SEQ ID NO: 5742279 - DNA, 23 bp, Homo sapiens
gagacagtgggcactaagggtgg

SEQ ID NO: 5742280 - DNA, 19 bp, Homo sapiens
gagacagtgggggtgcctg

SEQ ID NO: 5742281 - DNA, 18 bp, Homo sapiens
gagacagttatttatagt

SEQ ID NO: 5742282 - DNA, 21 bp, Homo sapiens
gagacagtttactttgccaac

SEQ ID NO: 5742283 - DNA, 19 bp, Homo sapiens
gagacataaccactgcttc

SEQ ID NO: 5742284 - DNA, 15 bp, Homo sapiens
gagacatacttgaag

SEQ ID NO: 5742285 - DNA, 13 bp, Homo sapiens
gagacatcagccc

SEQ ID NO: 5742286 - DNA, 16 bp, Homo sapiens
gagacatcagggagta

SEQ ID NO: 5742287 - DNA, 11 bp, Homo sapiens
gagacatccag

SEQ ID NO: 5742288 - DNA, 12 bp, Homo sapiens
gagacatccagc

SEQ ID NO: 5742289 - DNA, 21 bp, Homo sapiens
gagacatctgcacccctgagt

SEQ ID NO: 5742290 - DNA, 12 bp, Homo sapiens
gagacatgaatg

SEQ ID NO: 5742291 - DNA, 15 bp, Homo sapiens
gagacatggaagaga

SEQ ID NO: 5742292 - DNA, 13 bp, Homo sapiens
gagacatggacca

SEQ ID NO: 5742293 - DNA, 15 bp, Homo sapiens
gagacatggaccagc

SEQ ID NO: 5742294 - DNA, 15 bp, Homo sapiens
gagacatgggagtgg

SEQ ID NO: 5742295 - DNA, 13 bp, Homo sapiens
gagacatgtgaca

SEQ ID NO: 5742296 - DNA, 15 bp, Homo sapiens
gagacattagaaaaa

SEQ ID NO: 5742297 - DNA, 16 bp, Homo sapiens
gagacattgacaccag

SEQ ID NO: 5742298 - DNA, 20 bp, Homo sapiens
gagacattgcctccacctct

SEQ ID NO: 5742299 - DNA, 13 bp, Homo sapiens
gagacattgctct

SEQ ID NO: 5742300 - DNA, 10 bp, Homo sapiens
gagaccaaat

SEQ ID NO: 5742301 - DNA, 17 bp, Homo sapiens
gagaccaaataattaaa

SEQ ID NO: 5742302 - DNA, 14 bp, Homo sapiens
gagaccaacctgac

SEQ ID NO: 5742303 - DNA, 17 bp, Homo sapiens
gagaccaacctgaccaa

SEQ ID NO: 5742304 - DNA, 19 bp, Homo sapiens
gagaccaacttttcaatgt

SEQ ID NO: 5742305 - DNA, 22 bp, Homo sapiens
gagaccaagatggcccatcctg

SEQ ID NO: 5742306 - DNA, 19 bp, Homo sapiens
gagaccaagtcctggctac

SEQ ID NO: 5742307 - DNA, 16 bp, Homo sapiens
gagaccaagtctctct

SEQ ID NO: 5742308 - DNA, 23 bp, Homo sapiens
gagaccacagcaattggctcctc

SEQ ID NO: 5742309 - DNA, 22 bp, Homo sapiens
gagaccacccccgagcttgcct

SEQ ID NO: 5742310 - DNA, 24 bp, Homo sapiens
gagaccacccccgagcttgcctca

SEQ ID NO: 5742311 - DNA, 21 bp, Homo sapiens
gagaccaccgcgcccctctgc

SEQ ID NO: 5742312 - DNA, 22 bp, Homo sapiens
gagaccaccgcgcccctctgcg

SEQ ID NO: 5742313 - DNA, 18 bp, Homo sapiens
gagaccacttccttaaca

SEQ ID NO: 5742314 - DNA, 13 bp, Homo sapiens
gagaccagaagaa

SEQ ID NO: 5742315 - DNA, 20 bp, Homo sapiens
gagaccagaagaaaagactt

SEQ ID NO: 5742316 - DNA, 23 bp, Homo sapiens
gagaccagaagtgaatgggaaag

SEQ ID NO: 5742317 - DNA, 11 bp, Homo sapiens
gagaccagcac

SEQ ID NO: 5742318 - DNA, 13 bp, Homo sapiens
gagaccagcctgc

SEQ ID NO: 5742319 - DNA, 16 bp, Homo sapiens
gagaccagcctgccag

SEQ ID NO: 5742320 - DNA, 14 bp, Homo sapiens
gagaccagcctggc

SEQ ID NO: 5742321 - DNA, 15 bp, Homo sapiens
gagaccagcctgggc

SEQ ID NO: 5742322 - DNA, 13 bp, Homo sapiens
gagaccagccttt

SEQ ID NO: 5742323 - DNA, 14 bp, Homo sapiens
gagaccagcctttc

SEQ ID NO: 5742324 - DNA, 14 bp, Homo sapiens
gagaccaggactct

SEQ ID NO: 5742325 - DNA, 12 bp, Homo sapiens
gagaccagggct

SEQ ID NO: 5742326 - DNA, 21 bp, Homo sapiens
gagaccagggtcttacctctc

SEQ ID NO: 5742327 - DNA, 20 bp, Homo sapiens
gagaccataagagaaacctg

SEQ ID NO: 5742328 - DNA, 23 bp, Homo sapiens
gagaccataagagaaacctgcca

SEQ ID NO: 5742329 - DNA, 21 bp, Homo sapiens
gagaccatccctgaaggcccc

SEQ ID NO: 5742330 - DNA, 16 bp, Homo sapiens
gagaccatcctggcca

SEQ ID NO: 5742331 - DNA, 23 bp, Homo sapiens
gagaccatcctggcccctccaga

SEQ ID NO: 5742332 - DNA, 17 bp, Homo sapiens
gagaccatgcagagcgc

SEQ ID NO: 5742333 - DNA, 18 bp, Homo sapiens
gagaccatgcagagcgcc

SEQ ID NO: 5742334 - DNA, 22 bp, Homo sapiens
gagaccatttgtattaccatta

SEQ ID NO: 5742335 - DNA, 15 bp, Homo sapiens
gagacccaagggcag

SEQ ID NO: 5742336 - DNA, 13 bp, Homo sapiens
gagacccacagcc

SEQ ID NO: 5742337 - DNA, 15 bp, Homo sapiens
gagacccacagccct

SEQ ID NO: 5742338 - DNA, 16 bp, Homo sapiens
gagacccacagccctg

SEQ ID NO: 5742339 - DNA, 20 bp, Homo sapiens
gagacccacagccctgaaac

SEQ ID NO: 5742340 - DNA, 19 bp, Homo sapiens
gagacccaccccacctgca

SEQ ID NO: 5742341 - DNA, 23 bp, Homo sapiens
gagacccacctgaggctcagccc

SEQ ID NO: 5742342 - DNA, 18 bp, Homo sapiens
gagacccagatctcatgg

SEQ ID NO: 5742343 - DNA, 22 bp, Homo sapiens
gagacccagatctcatggaaac

SEQ ID NO: 5742344 - DNA, 14 bp, Homo sapiens
gagacccagcccct

SEQ ID NO: 5742345 - DNA, 19 bp, Homo sapiens
gagacccagccccttcccc

SEQ ID NO: 5742346 - DNA, 23 bp, Homo sapiens
gagacccagccccttcccctggg

SEQ ID NO: 5742347 - DNA, 18 bp, Homo sapiens
gagacccagcggacacac

SEQ ID NO: 5742348 - DNA, 14 bp, Homo sapiens
gagacccaggagac

SEQ ID NO: 5742349 - DNA, 22 bp, Homo sapiens
gagacccatttccttgtgctcc

SEQ ID NO: 5742350 - DNA, 20 bp, Homo sapiens
gagaccccaaagactctgga

SEQ ID NO: 5742351 - DNA, 15 bp, Homo sapiens
gagaccccaccgcca

SEQ ID NO: 5742352 - DNA, 16 bp, Homo sapiens
gagaccccaccgccac

SEQ ID NO: 5742353 - DNA, 13 bp, Homo sapiens
gagaccccaggat

SEQ ID NO: 5742354 - DNA, 14 bp, Homo sapiens
gagaccccaggatc

SEQ ID NO: 5742355 - DNA, 20 bp, Homo sapiens
gagaccccagtcaagctcct

SEQ ID NO: 5742356 - DNA, 16 bp, Homo sapiens
gagacccccaggcaga

SEQ ID NO: 5742357 - DNA, 16 bp, Homo sapiens
gagacccccaggcctg

SEQ ID NO: 5742358 - DNA, 16 bp, Homo sapiens
gagacccccatccagc

SEQ ID NO: 5742359 - DNA, 17 bp, Homo sapiens
gagacccccatccagcc

SEQ ID NO: 5742360 - DNA, 22 bp, Homo sapiens
gagacccccatccagcctccag

SEQ ID NO: 5742361 - DNA, 23 bp, Homo sapiens
gagacccccccccaactccagga

SEQ ID NO: 5742362 - DNA, 16 bp, Homo sapiens
gagaccccgcacccgg

SEQ ID NO: 5742363 - DNA, 15 bp, Homo sapiens
gagaccccgcactgc

SEQ ID NO: 5742364 - DNA, 22 bp, Homo sapiens
gagaccccgcactgcagacggg

SEQ ID NO: 5742365 - DNA, 14 bp, Homo sapiens
gagacccctcccct

SEQ ID NO: 5742366 - DNA, 14 bp, Homo sapiens
gagacccctggcct

SEQ ID NO: 5742367 - DNA, 16 bp, Homo sapiens
gagacccctggcctcc

SEQ ID NO: 5742368 - DNA, 15 bp, Homo sapiens
gagacccctgtctcc

SEQ ID NO: 5742369 - DNA, 19 bp, Homo sapiens
gagaccccttgttgcactg

SEQ ID NO: 5742370 - DNA, 22 bp, Homo sapiens
gagaccccttgttgcactgccc

SEQ ID NO: 5742371 - DNA, 19 bp, Homo sapiens
gagacccctttaaactgtc

SEQ ID NO: 5742372 - DNA, 20 bp, Homo sapiens
gagacccctttgcaggactt

SEQ ID NO: 5742373 - DNA, 23 bp, Homo sapiens
gagacccgggaaggaaggctctc

SEQ ID NO: 5742374 - DNA, 16 bp, Homo sapiens
gagaccctacagacag

SEQ ID NO: 5742375 - DNA, 17 bp, Homo sapiens
gagaccctacaggagag

SEQ ID NO: 5742376 - DNA, 20 bp, Homo sapiens
gagaccctactgaagtggct

SEQ ID NO: 5742377 - DNA, 23 bp, Homo sapiens
gagaccctcgcccaactccacca

SEQ ID NO: 5742378 - DNA, 19 bp, Homo sapiens
gagaccctcgtggccttcc

SEQ ID NO: 5742379 - DNA, 18 bp, Homo sapiens
gagaccctcttctctggg

SEQ ID NO: 5742380 - DNA, 23 bp, Homo sapiens
gagaccctgcaagaccacggagg

SEQ ID NO: 5742381 - DNA, 20 bp, Homo sapiens
gagaccctgccaactttcca

SEQ ID NO: 5742382 - DNA, 23 bp, Homo sapiens
gagaccctgccaactttccagac

SEQ ID NO: 5742383 - DNA, 23 bp, Homo sapiens
gagaccctgccacagccagagga

SEQ ID NO: 5742384 - DNA, 15 bp, Homo sapiens
gagaccctgcgcccc

SEQ ID NO: 5742385 - DNA, 17 bp, Homo sapiens
gagaccctgcgcccctg

SEQ ID NO: 5742386 - DNA, 14 bp, Homo sapiens
gagaccctgggaga

SEQ ID NO: 5742387 - DNA, 15 bp, Homo sapiens
gagaccctgggagag

SEQ ID NO: 5742388 - DNA, 18 bp, Homo sapiens
gagaccctgggagagaag

SEQ ID NO: 5742389 - DNA, 17 bp, Homo sapiens
gagaccctgtctcaata

SEQ ID NO: 5742390 - DNA, 13 bp, Homo sapiens
gagacccttttct

SEQ ID NO: 5742391 - DNA, 15 bp, Homo sapiens
gagaccgaggccaga

SEQ ID NO: 5742392 - DNA, 19 bp, Homo sapiens
gagaccgaggccagaaggc

SEQ ID NO: 5742393 - DNA, 17 bp, Homo sapiens
gagaccgcttcacccct

SEQ ID NO: 5742394 - DNA, 20 bp, Homo sapiens
gagaccgcttcacccctgca

SEQ ID NO: 5742395 - DNA, 21 bp, Homo sapiens
gagaccggacaagagcctgca

SEQ ID NO: 5742396 - DNA, 15 bp, Homo sapiens
gagaccgtcctcacc

SEQ ID NO: 5742397 - DNA, 22 bp, Homo sapiens
gagaccgtgaagatactttgta

SEQ ID NO: 5742398 - DNA, 15 bp, Homo sapiens
gagacctacaggctg

SEQ ID NO: 5742399 - DNA, 14 bp, Homo sapiens
gagacctacctcag

SEQ ID NO: 5742400 - DNA, 16 bp, Homo sapiens
gagacctacctcaggt

SEQ ID NO: 5742401 - DNA, 21 bp, Homo sapiens
gagacctcaaatcactgcatt

SEQ ID NO: 5742402 - DNA, 14 bp, Homo sapiens
gagacctcagccat

SEQ ID NO: 5742403 - DNA, 11 bp, Homo sapiens
gagacctcatc

SEQ ID NO: 5742404 - DNA, 13 bp, Homo sapiens
gagacctcatcct

SEQ ID NO: 5742405 - DNA, 22 bp, Homo sapiens
gagacctccaataaagtgcctt

SEQ ID NO: 5742406 - DNA, 14 bp, Homo sapiens
gagacctccagcta

SEQ ID NO: 5742407 - DNA, 13 bp, Homo sapiens
gagacctgaggca

SEQ ID NO: 5742408 - DNA, 18 bp, Homo sapiens
gagacctgccctcaagag

SEQ ID NO: 5742409 - DNA, 19 bp, Homo sapiens
gagacctgccctctctgcg

SEQ ID NO: 5742410 - DNA, 19 bp, Homo sapiens
gagacctgctccagatcct

SEQ ID NO: 5742411 - DNA, 15 bp, Homo sapiens
gagacctgtgtgaac

SEQ ID NO: 5742412 - DNA, 12 bp, Homo sapiens
gagaccttaccc

SEQ ID NO: 5742413 - DNA, 13 bp, Homo sapiens
gagaccttcaggc

SEQ ID NO: 5742414 - DNA, 14 bp, Homo sapiens
gagaccttctctta

SEQ ID NO: 5742415 - DNA, 22 bp, Homo sapiens
gagacctttgatgaattcttcc

SEQ ID NO: 5742416 - DNA, 15 bp, Homo sapiens
gagacgacaggcgag

SEQ ID NO: 5742417 - DNA, 16 bp, Homo sapiens
gagacgaggcattcgg

SEQ ID NO: 5742418 - DNA, 22 bp, Homo sapiens
gagacgcagccctgggggccag

SEQ ID NO: 5742419 - DNA, 20 bp, Homo sapiens
gagacgccactccctgggac

SEQ ID NO: 5742420 - DNA, 21 bp, Homo sapiens
gagacgccctatttctatgtc

SEQ ID NO: 5742421 - DNA, 21 bp, Homo sapiens
gagacggaggttgcagtgagc

SEQ ID NO: 5742422 - DNA, 14 bp, Homo sapiens
gagacggctggacc

SEQ ID NO: 5742423 - DNA, 15 bp, Homo sapiens
gagacggctggacct

SEQ ID NO: 5742424 - DNA, 19 bp, Homo sapiens
gagacggctggacctgcac

SEQ ID NO: 5742425 - DNA, 17 bp, Homo sapiens
gagacggggtctccctg

SEQ ID NO: 5742426 - DNA, 16 bp, Homo sapiens
gagacggggtttcacc

SEQ ID NO: 5742427 - DNA, 18 bp, Homo sapiens
gagacgggtgggcggctg

SEQ ID NO: 5742428 - DNA, 15 bp, Homo sapiens
gagacggtcgagcag

SEQ ID NO: 5742429 - DNA, 21 bp, Homo sapiens
gagacggtgctcgcttctcct

SEQ ID NO: 5742430 - DNA, 19 bp, Homo sapiens
gagacggtgtcttgttctg

SEQ ID NO: 5742431 - DNA, 18 bp, Homo sapiens
gagacggtgttttgccat

SEQ ID NO: 5742432 - DNA, 19 bp, Homo sapiens
gagacggtttccagggagg

SEQ ID NO: 5742433 - DNA, 22 bp, Homo sapiens
gagacgtccacccgtttccaag

SEQ ID NO: 5742434 - DNA, 23 bp, Homo sapiens
gagacgtttataaacagaaatgg

SEQ ID NO: 5742435 - DNA, 12 bp, Homo sapiens
gagactaaatga

SEQ ID NO: 5742436 - DNA, 13 bp, Homo sapiens
gagactaaatgag

SEQ ID NO: 5742437 - DNA, 15 bp, Homo sapiens
gagactaagccctgt

SEQ ID NO: 5742438 - DNA, 16 bp, Homo sapiens
gagactaagccctgtc

SEQ ID NO: 5742439 - DNA, 22 bp, Homo sapiens
gagactaaggggcagctcctga

SEQ ID NO: 5742440 - DNA, 23 bp, Homo sapiens
gagactaaggggcagctcctgac

SEQ ID NO: 5742441 - DNA, 15 bp, Homo sapiens
gagactactaagagg

SEQ ID NO: 5742442 - DNA, 16 bp, Homo sapiens
gagactactctgcctg

SEQ ID NO: 5742443 - DNA, 17 bp, Homo sapiens
gagactagacaaataac

SEQ ID NO: 5742444 - DNA, 18 bp, Homo sapiens
gagactagattctcacct

SEQ ID NO: 5742445 - DNA, 16 bp, Homo sapiens
gagactagattgcctt

SEQ ID NO: 5742446 - DNA, 21 bp, Homo sapiens
gagactagatttatgaataca

SEQ ID NO: 5742447 - DNA, 14 bp, Homo sapiens
gagactagggaagg

SEQ ID NO: 5742448 - DNA, 14 bp, Homo sapiens
gagactatggagcc

SEQ ID NO: 5742449 - DNA, 22 bp, Homo sapiens
gagactatttaaacttataaat

SEQ ID NO: 5742450 - DNA, 14 bp, Homo sapiens
gagactatttaagt

SEQ ID NO: 5742451 - DNA, 17 bp, Homo sapiens
gagactcacactctctg

SEQ ID NO: 5742452 - DNA, 14 bp, Homo sapiens
gagactcagacagg

SEQ ID NO: 5742453 - DNA, 21 bp, Homo sapiens
gagactcagaggacccacctg

SEQ ID NO: 5742454 - DNA, 15 bp, Homo sapiens
gagactcagagggag

SEQ ID NO: 5742455 - DNA, 22 bp, Homo sapiens
gagactcagcctctgctggaga

SEQ ID NO: 5742456 - DNA, 13 bp, Homo sapiens
gagactcagcctg

SEQ ID NO: 5742457 - DNA, 12 bp, Homo sapiens
gagactcaggcc

SEQ ID NO: 5742458 - DNA, 15 bp, Homo sapiens
gagactcaggcccac

SEQ ID NO: 5742459 - DNA, 17 bp, Homo sapiens
gagactcagggccccag

SEQ ID NO: 5742460 - DNA, 22 bp, Homo sapiens
gagactccactcaggtgcacac

SEQ ID NO: 5742461 - DNA, 21 bp, Homo sapiens
gagactccagaatctgctgtt

SEQ ID NO: 5742462 - DNA, 14 bp, Homo sapiens
gagactccatcttg

SEQ ID NO: 5742463 - DNA, 14 bp, Homo sapiens
gagactcccaggag

SEQ ID NO: 5742464 - DNA, 17 bp, Homo sapiens
gagactcccgcctttga

SEQ ID NO: 5742465 - DNA, 20 bp, Homo sapiens
gagactcctcagttcttgcc

SEQ ID NO: 5742466 - DNA, 14 bp, Homo sapiens
gagactcctcgggc

SEQ ID NO: 5742467 - DNA, 22 bp, Homo sapiens
gagactcctgaaggtctgggtc

SEQ ID NO: 5742468 - DNA, 14 bp, Homo sapiens
gagactcctgcagg

SEQ ID NO: 5742469 - DNA, 17 bp, Homo sapiens
gagactcctgcaggcag

SEQ ID NO: 5742470 - DNA, 21 bp, Homo sapiens
gagactcctgcaggcagccag

SEQ ID NO: 5742471 - DNA, 22 bp, Homo sapiens
gagactcctgcaggcagccagg

SEQ ID NO: 5742472 - DNA, 12 bp, Homo sapiens
gagactcctggg

SEQ ID NO: 5742473 - DNA, 16 bp, Homo sapiens
gagactcgactctgtg

SEQ ID NO: 5742474 - DNA, 17 bp, Homo sapiens
gagactcgactctgtgc

SEQ ID NO: 5742475 - DNA, 18 bp, Homo sapiens
gagactcgagtccccatg

SEQ ID NO: 5742476 - DNA, 16 bp, Homo sapiens
gagactcgcgacaatg

SEQ ID NO: 5742477 - DNA, 18 bp, Homo sapiens
gagactcgcgacaatgca

SEQ ID NO: 5742478 - DNA, 14 bp, Homo sapiens
gagactctatttta

SEQ ID NO: 5742479 - DNA, 15 bp, Homo sapiens
gagactctattttaa

SEQ ID NO: 5742480 - DNA, 12 bp, Homo sapiens
gagactctgagg

SEQ ID NO: 5742481 - DNA, 16 bp, Homo sapiens
gagactctggaagccc

SEQ ID NO: 5742482 - DNA, 13 bp, Homo sapiens
gagactctggcct

SEQ ID NO: 5742483 - DNA, 13 bp, Homo sapiens
gagactctgtctc

SEQ ID NO: 5742484 - DNA, 12 bp, Homo sapiens
gagactctgtgg

SEQ ID NO: 5742485 - DNA, 22 bp, Homo sapiens
gagactctgtttgcttgtgttt

SEQ ID NO: 5742486 - DNA, 13 bp, Homo sapiens
gagactcttaaat

SEQ ID NO: 5742487 - DNA, 15 bp, Homo sapiens
gagactgaaagcagc

SEQ ID NO: 5742488 - DNA, 17 bp, Homo sapiens
gagactgagaggcagaa

SEQ ID NO: 5742489 - DNA, 22 bp, Homo sapiens
gagactgataacttggggaggc

SEQ ID NO: 5742490 - DNA, 23 bp, Homo sapiens
gagactgcaagctgcttgcccaa

SEQ ID NO: 5742491 - DNA, 15 bp, Homo sapiens
gagactgcaagtaag

SEQ ID NO: 5742492 - DNA, 15 bp, Homo sapiens
gagactgccatacat

SEQ ID NO: 5742493 - DNA, 12 bp, Homo sapiens
gagactgcccac

SEQ ID NO: 5742494 - DNA, 16 bp, Homo sapiens
gagactgcccaccctg

SEQ ID NO: 5742495 - DNA, 11 bp, Homo sapiens
gagactgcccc

SEQ ID NO: 5742496 - DNA, 13 bp, Homo sapiens
gagactgccccac

SEQ ID NO: 5742497 - DNA, 22 bp, Homo sapiens
gagactgccccacggccctgtc

SEQ ID NO: 5742498 - DNA, 15 bp, Homo sapiens
gagactgccctgccc

SEQ ID NO: 5742499 - DNA, 19 bp, Homo sapiens
gagactgccctgcccaggt

SEQ ID NO: 5742500 - DNA, 16 bp, Homo sapiens
gagactgcccttctca

SEQ ID NO: 5742501 - DNA, 14 bp, Homo sapiens
gagactgctaagta

SEQ ID NO: 5742502 - DNA, 18 bp, Homo sapiens
gagactgctcctgagccc

SEQ ID NO: 5742503 - DNA, 19 bp, Homo sapiens
gagactggaggcatttctt

SEQ ID NO: 5742504 - DNA, 12 bp, Homo sapiens
gagactggcagc

SEQ ID NO: 5742505 - DNA, 12 bp, Homo sapiens
gagactggcagg

SEQ ID NO: 5742506 - DNA, 14 bp, Homo sapiens
gagactgggaaggc

SEQ ID NO: 5742507 - DNA, 16 bp, Homo sapiens
gagactgggagccact

SEQ ID NO: 5742508 - DNA, 15 bp, Homo sapiens
gagactgggatggga

SEQ ID NO: 5742509 - DNA, 16 bp, Homo sapiens
gagactgggctctggc

SEQ ID NO: 5742510 - DNA, 13 bp, Homo sapiens
gagactgggctga

SEQ ID NO: 5742511 - DNA, 15 bp, Homo sapiens
gagactgggctgagg

SEQ ID NO: 5742512 - DNA, 14 bp, Homo sapiens
gagactggggggct

SEQ ID NO: 5742513 - DNA, 15 bp, Homo sapiens
gagactgggtaggaa

SEQ ID NO: 5742514 - DNA, 20 bp, Homo sapiens
gagactgggtgaaagtgact

SEQ ID NO: 5742515 - DNA, 22 bp, Homo sapiens
gagactggtaggaggaggcatg

SEQ ID NO: 5742516 - DNA, 22 bp, Homo sapiens
gagactggtctcgaactcctgg

SEQ ID NO: 5742517 - DNA, 23 bp, Homo sapiens
gagactggtctcgaactcctggc

SEQ ID NO: 5742518 - DNA, 17 bp, Homo sapiens
gagactggttagtgatg

SEQ ID NO: 5742519 - DNA, 19 bp, Homo sapiens
gagactggttagtgatgca

SEQ ID NO: 5742520 - DNA, 13 bp, Homo sapiens
gagactgtacata

SEQ ID NO: 5742521 - DNA, 16 bp, Homo sapiens
gagactgtacataatt

SEQ ID NO: 5742522 - DNA, 13 bp, Homo sapiens
gagactgtagatt

SEQ ID NO: 5742523 - DNA, 23 bp, Homo sapiens
gagactgtagattgcttctgtag

SEQ ID NO: 5742524 - DNA, 16 bp, Homo sapiens
gagactgtcggagagg

SEQ ID NO: 5742525 - DNA, 17 bp, Homo sapiens
gagactgtcggagaggc

SEQ ID NO: 5742526 - DNA, 23 bp, Homo sapiens
gagactgtcggagaggctgtctg

SEQ ID NO: 5742527 - DNA, 16 bp, Homo sapiens
gagactgtgccatggt

SEQ ID NO: 5742528 - DNA, 15 bp, Homo sapiens
gagactgtggggagg

SEQ ID NO: 5742529 - DNA, 21 bp, Homo sapiens
gagactgtggtaggggcaggg

SEQ ID NO: 5742530 - DNA, 23 bp, Homo sapiens
gagactgtggtaggggcagggag

SEQ ID NO: 5742531 - DNA, 17 bp, Homo sapiens
gagactgtgtgtgccct

SEQ ID NO: 5742532 - DNA, 18 bp, Homo sapiens
gagacttaaaacatggtg

SEQ ID NO: 5742533 - DNA, 15 bp, Homo sapiens
gagacttactgggtg

SEQ ID NO: 5742534 - DNA, 23 bp, Homo sapiens
gagacttactgggtgaggaaatc

SEQ ID NO: 5742535 - DNA, 23 bp, Homo sapiens
gagacttcgaagacccagcagat

SEQ ID NO: 5742536 - DNA, 18 bp, Homo sapiens
gagacttctaaatcataa

SEQ ID NO: 5742537 - DNA, 19 bp, Homo sapiens
gagacttctgcttttcaac

SEQ ID NO: 5742538 - DNA, 14 bp, Homo sapiens
gagacttctgtctt

SEQ ID NO: 5742539 - DNA, 14 bp, Homo sapiens
gagacttgatattt

SEQ ID NO: 5742540 - DNA, 18 bp, Homo sapiens
gagacttggatgaggagt

SEQ ID NO: 5742541 - DNA, 13 bp, Homo sapiens
gagacttgtatga

SEQ ID NO: 5742542 - DNA, 20 bp, Homo sapiens
gagacttgttcttggttcct

SEQ ID NO: 5742543 - DNA, 11 bp, Homo sapiens
gagacttgttt

SEQ ID NO: 5742544 - DNA, 18 bp, Homo sapiens
gagactttacaaaccttt

SEQ ID NO: 5742545 - DNA, 17 bp, Homo sapiens
gagactttattgcctat

SEQ ID NO: 5742546 - DNA, 21 bp, Homo sapiens
gagactttccattacaagtat

SEQ ID NO: 5742547 - DNA, 16 bp, Homo sapiens
gagactttcccctctc

SEQ ID NO: 5742548 - DNA, 14 bp, Homo sapiens
gagactttctgaag

SEQ ID NO: 5742549 - DNA, 16 bp, Homo sapiens
gagactttctgatgca

SEQ ID NO: 5742550 - DNA, 15 bp, Homo sapiens
gagactttgatgtca

SEQ ID NO: 5742551 - DNA, 13 bp, Homo sapiens
gagactttgctgt

SEQ ID NO: 5742552 - DNA, 13 bp, Homo sapiens
gagactttgtaga

SEQ ID NO: 5742553 - DNA, 15 bp, Homo sapiens
gagagaaaaaattaa

SEQ ID NO: 5742554 - DNA, 14 bp, Homo sapiens
gagagaaaaacaaa

SEQ ID NO: 5742555 - DNA, 11 bp, Homo sapiens
gagagaaaaag

SEQ ID NO: 5742556 - DNA, 12 bp, Homo sapiens
gagagaaaaaga

SEQ ID NO: 5742557 - DNA, 15 bp, Homo sapiens
gagagaaaaagaaag

SEQ ID NO: 5742558 - DNA, 18 bp, Homo sapiens
gagagaaaaagaaagaac

SEQ ID NO: 5742559 - DNA, 18 bp, Homo sapiens
gagagaaaaagagagagc

SEQ ID NO: 5742560 - DNA, 18 bp, Homo sapiens
gagagaaaaagtgcccct

SEQ ID NO: 5742561 - DNA, 22 bp, Homo sapiens
gagagaaaacagacctaatgct

SEQ ID NO: 5742562 - DNA, 20 bp, Homo sapiens
gagagaaaagaaaaatatga

SEQ ID NO: 5742563 - DNA, 13 bp, Homo sapiens
gagagaaaataaa

SEQ ID NO: 5742564 - DNA, 20 bp, Homo sapiens
gagagaaaataaaaagttaa

SEQ ID NO: 5742565 - DNA, 17 bp, Homo sapiens
gagagaaaatatatgta

SEQ ID NO: 5742566 - DNA, 14 bp, Homo sapiens
gagagaaagaatga

SEQ ID NO: 5742567 - DNA, 14 bp, Homo sapiens
gagagaaagagaga

SEQ ID NO: 5742568 - DNA, 21 bp, Homo sapiens
gagagaaagcaaaacattttg

SEQ ID NO: 5742569 - DNA, 15 bp, Homo sapiens
gagagaaaggagggc

SEQ ID NO: 5742570 - DNA, 15 bp, Homo sapiens
gagagaaagtgggtg

SEQ ID NO: 5742571 - DNA, 22 bp, Homo sapiens
gagagaaagtgggtgagatgct

SEQ ID NO: 5742572 - DNA, 21 bp, Homo sapiens
gagagaacaacaggcaggggc

SEQ ID NO: 5742573 - DNA, 21 bp, Homo sapiens
gagagaacctaactgtatctt

SEQ ID NO: 5742574 - DNA, 13 bp, Homo sapiens
gagagaagaaagt

SEQ ID NO: 5742575 - DNA, 15 bp, Homo sapiens
gagagaagaaagtgt

SEQ ID NO: 5742576 - DNA, 15 bp, Homo sapiens
gagagaagagcccca

SEQ ID NO: 5742577 - DNA, 20 bp, Homo sapiens
gagagaagccacgctgtcct

SEQ ID NO: 5742578 - DNA, 13 bp, Homo sapiens
gagagaagccagc

SEQ ID NO: 5742579 - DNA, 15 bp, Homo sapiens
gagagaagccagcca

SEQ ID NO: 5742580 - DNA, 19 bp, Homo sapiens
gagagaagccagccacaga

SEQ ID NO: 5742581 - DNA, 12 bp, Homo sapiens
gagagaagctgg

SEQ ID NO: 5742582 - DNA, 12 bp, Homo sapiens
gagagaaggaca

SEQ ID NO: 5742583 - DNA, 15 bp, Homo sapiens
gagagaaggggagga

SEQ ID NO: 5742584 - DNA, 14 bp, Homo sapiens
gagagaaggggccc

SEQ ID NO: 5742585 - DNA, 16 bp, Homo sapiens
gagagaagtcggccag

SEQ ID NO: 5742586 - DNA, 15 bp, Homo sapiens
gagagaatagagctg

SEQ ID NO: 5742587 - DNA, 15 bp, Homo sapiens
gagagaatcagacct

SEQ ID NO: 5742588 - DNA, 17 bp, Homo sapiens
gagagaatcagacctgg

SEQ ID NO: 5742589 - DNA, 20 bp, Homo sapiens
gagagacaacttgctccttt

SEQ ID NO: 5742590 - DNA, 19 bp, Homo sapiens
gagagacacactgaagaag

SEQ ID NO: 5742591 - DNA, 13 bp, Homo sapiens
gagagacactccc

SEQ ID NO: 5742592 - DNA, 18 bp, Homo sapiens
gagagacagcacaggcag

SEQ ID NO: 5742593 - DNA, 14 bp, Homo sapiens
gagagacaggcagc

SEQ ID NO: 5742594 - DNA, 17 bp, Homo sapiens
gagagaccacacatttt

SEQ ID NO: 5742595 - DNA, 22 bp, Homo sapiens
gagagaccagcctttcttcctt

SEQ ID NO: 5742596 - DNA, 20 bp, Homo sapiens
gagagacccaaggaggaaaa

SEQ ID NO: 5742597 - DNA, 20 bp, Homo sapiens
gagagaccccgcacccggct

SEQ ID NO: 5742598 - DNA, 20 bp, Homo sapiens
gagagacccctcccctccca

SEQ ID NO: 5742599 - DNA, 16 bp, Homo sapiens
gagagacccgggaagg

SEQ ID NO: 5742600 - DNA, 18 bp, Homo sapiens
gagagaccctacagacag

SEQ ID NO: 5742601 - DNA, 13 bp, Homo sapiens
gagagaccctggc

SEQ ID NO: 5742602 - DNA, 17 bp, Homo sapiens
gagagacctcatcagga

SEQ ID NO: 5742603 - DNA, 18 bp, Homo sapiens
gagagacctcatcaggat

SEQ ID NO: 5742604 - DNA, 14 bp, Homo sapiens
gagagacctgccct

SEQ ID NO: 5742605 - DNA, 16 bp, Homo sapiens
gagagacctgctcagg

SEQ ID NO: 5742606 - DNA, 17 bp, Homo sapiens
gagagacctgctcaggc

SEQ ID NO: 5742607 - DNA, 19 bp, Homo sapiens
gagagacctgctcaggcgt

SEQ ID NO: 5742608 - DNA, 15 bp, Homo sapiens
gagagacctgtgtga

SEQ ID NO: 5742609 - DNA, 21 bp, Homo sapiens
gagagacgcagtccgcccagg

SEQ ID NO: 5742610 - DNA, 14 bp, Homo sapiens
gagagacgctgtga

SEQ ID NO: 5742611 - DNA, 16 bp, Homo sapiens
gagagacgtgtacata

SEQ ID NO: 5742612 - DNA, 17 bp, Homo sapiens
gagagacgtgtacatag

SEQ ID NO: 5742613 - DNA, 21 bp, Homo sapiens
gagagactcccatgaagcctt

SEQ ID NO: 5742614 - DNA, 16 bp, Homo sapiens
gagagactgaaagcag

SEQ ID NO: 5742615 - DNA, 18 bp, Homo sapiens
gagagactgaaagcagca

SEQ ID NO: 5742616 - DNA, 17 bp, Homo sapiens
gagagactgagcagccg

SEQ ID NO: 5742617 - DNA, 13 bp, Homo sapiens
gagagactgatgg

SEQ ID NO: 5742618 - DNA, 21 bp, Homo sapiens
gagagactggccagaggcagc

SEQ ID NO: 5742619 - DNA, 20 bp, Homo sapiens
gagagactggttttttccag

SEQ ID NO: 5742620 - DNA, 13 bp, Homo sapiens
gagagactgtgtg

SEQ ID NO: 5742621 - DNA, 11 bp, Homo sapiens
gagagagaaaa

SEQ ID NO: 5742622 - DNA, 15 bp, Homo sapiens
gagagagaaagagag

SEQ ID NO: 5742623 - DNA, 12 bp, Homo sapiens
gagagagaaagc

SEQ ID NO: 5742624 - DNA, 15 bp, Homo sapiens
gagagagaaagccag

SEQ ID NO: 5742625 - DNA, 16 bp, Homo sapiens
gagagagaagcaggca

SEQ ID NO: 5742626 - DNA, 13 bp, Homo sapiens
gagagagacctag

SEQ ID NO: 5742627 - DNA, 14 bp, Homo sapiens
gagagagagaaggg

SEQ ID NO: 5742628 - DNA, 11 bp, Homo sapiens
gagagagagag

SEQ ID NO: 5742629 - DNA, 12 bp, Homo sapiens
gagagagagaga

SEQ ID NO: 5742630 - DNA, 13 bp, Homo sapiens
gagagagagagaa

SEQ ID NO: 5742631 - DNA, 14 bp, Homo sapiens
gagagagagagaga

SEQ ID NO: 5742632 - DNA, 16 bp, Homo sapiens
gagagagagagagaag

SEQ ID NO: 5742633 - DNA, 13 bp, Homo sapiens
gagagagagagcg

SEQ ID NO: 5742634 - DNA, 14 bp, Homo sapiens
gagagagagaggac

SEQ ID NO: 5742635 - DNA, 11 bp, Homo sapiens
gagagagagcc

SEQ ID NO: 5742636 - DNA, 12 bp, Homo sapiens
gagagagagcct

SEQ ID NO: 5742637 - DNA, 12 bp, Homo sapiens
gagagagaggac

SEQ ID NO: 5742638 - DNA, 14 bp, Homo sapiens
gagagagaggctgc

SEQ ID NO: 5742639 - DNA, 12 bp, Homo sapiens
gagagagagggc

SEQ ID NO: 5742640 - DNA, 13 bp, Homo sapiens
gagagagagggga

SEQ ID NO: 5742641 - DNA, 15 bp, Homo sapiens
gagagagaggtattt

SEQ ID NO: 5742642 - DNA, 15 bp, Homo sapiens
gagagagaggttctg

SEQ ID NO: 5742643 - DNA, 14 bp, Homo sapiens
gagagagagtgaga

SEQ ID NO: 5742644 - DNA, 15 bp, Homo sapiens
gagagagagtgtgtg

SEQ ID NO: 5742645 - DNA, 16 bp, Homo sapiens
gagagagcaaggaagc

SEQ ID NO: 5742646 - DNA, 15 bp, Homo sapiens
gagagagcagcttct

SEQ ID NO: 5742647 - DNA, 13 bp, Homo sapiens
gagagagcagggc

SEQ ID NO: 5742648 - DNA, 14 bp, Homo sapiens
gagagagcagggct

SEQ ID NO: 5742649 - DNA, 11 bp, Homo sapiens
gagagagcctt

SEQ ID NO: 5742650 - DNA, 21 bp, Homo sapiens
gagagagcttcctgtttctaa

SEQ ID NO: 5742651 - DNA, 19 bp, Homo sapiens
gagagagcttctgttgctg

SEQ ID NO: 5742652 - DNA, 14 bp, Homo sapiens
gagagaggacctcc

SEQ ID NO: 5742653 - DNA, 22 bp, Homo sapiens
gagagaggaggtttgcctgtga

SEQ ID NO: 5742654 - DNA, 16 bp, Homo sapiens
gagagaggcagagagc

SEQ ID NO: 5742655 - DNA, 17 bp, Homo sapiens
gagagaggcagagagcg

SEQ ID NO: 5742656 - DNA, 13 bp, Homo sapiens
gagagaggcctgg

SEQ ID NO: 5742657 - DNA, 18 bp, Homo sapiens
gagagaggcctgggtgtg

SEQ ID NO: 5742658 - DNA, 19 bp, Homo sapiens
gagagaggcgtcctggtga

SEQ ID NO: 5742659 - DNA, 17 bp, Homo sapiens
gagagaggctgcctcag

SEQ ID NO: 5742660 - DNA, 16 bp, Homo sapiens
gagagagggcgcccag

SEQ ID NO: 5742661 - DNA, 21 bp, Homo sapiens
gagagagggcgcccagcccag

SEQ ID NO: 5742662 - DNA, 22 bp, Homo sapiens
gagagagggcgcccagcccagg

SEQ ID NO: 5742663 - DNA, 15 bp, Homo sapiens
gagagaggggaagag

SEQ ID NO: 5742664 - DNA, 18 bp, Homo sapiens
gagagaggttctggggag

SEQ ID NO: 5742665 - DNA, 21 bp, Homo sapiens
gagagaggttctggggaggaa

SEQ ID NO: 5742666 - DNA, 22 bp, Homo sapiens
gagagaggttctggggaggaag

SEQ ID NO: 5742667 - DNA, 19 bp, Homo sapiens
gagagaggttgaaaaacaa

SEQ ID NO: 5742668 - DNA, 18 bp, Homo sapiens
gagagagtattaaatatt

SEQ ID NO: 5742669 - DNA, 20 bp, Homo sapiens
gagagagtcttccaggtact

SEQ ID NO: 5742670 - DNA, 20 bp, Homo sapiens
gagagagtgagagcacaaag

SEQ ID NO: 5742671 - DNA, 14 bp, Homo sapiens
gagagagttagcat

SEQ ID NO: 5742672 - DNA, 14 bp, Homo sapiens
gagagagtttcaaa

SEQ ID NO: 5742673 - DNA, 15 bp, Homo sapiens
gagagatactctggg

SEQ ID NO: 5742674 - DNA, 22 bp, Homo sapiens
gagagatagccgggctccaggg

SEQ ID NO: 5742675 - DNA, 11 bp, Homo sapiens
gagagatgaga

SEQ ID NO: 5742676 - DNA, 14 bp, Homo sapiens
gagagatgagaaag

SEQ ID NO: 5742677 - DNA, 15 bp, Homo sapiens
gagagatgagtgggt

SEQ ID NO: 5742678 - DNA, 22 bp, Homo sapiens
gagagatgtgtgttgatactgt

SEQ ID NO: 5742679 - DNA, 13 bp, Homo sapiens
gagagattattaa

SEQ ID NO: 5742680 - DNA, 14 bp, Homo sapiens
gagagattattaaa

SEQ ID NO: 5742681 - DNA, 15 bp, Homo sapiens
gagagattctgtgat

SEQ ID NO: 5742682 - DNA, 23 bp, Homo sapiens
gagagattgggactgagtgctga

SEQ ID NO: 5742683 - DNA, 20 bp, Homo sapiens
gagagcaaaggagaaatctg

SEQ ID NO: 5742684 - DNA, 16 bp, Homo sapiens
gagagcaaaggcccat

SEQ ID NO: 5742685 - DNA, 18 bp, Homo sapiens
gagagcaaaggcccatgc

SEQ ID NO: 5742686 - DNA, 23 bp, Homo sapiens
gagagcaaaggcccatgccccct

SEQ ID NO: 5742687 - DNA, 17 bp, Homo sapiens
gagagcaaagtgacctg

SEQ ID NO: 5742688 - DNA, 14 bp, Homo sapiens
gagagcacaaagat

SEQ ID NO: 5742689 - DNA, 19 bp, Homo sapiens
gagagcacccacagccgca

SEQ ID NO: 5742690 - DNA, 22 bp, Homo sapiens
gagagcacctgttgtgtgcctg

SEQ ID NO: 5742691 - DNA, 13 bp, Homo sapiens
gagagcagaatga

SEQ ID NO: 5742692 - DNA, 17 bp, Homo sapiens
gagagcagagaatataa

SEQ ID NO: 5742693 - DNA, 13 bp, Homo sapiens
gagagcagcagca

SEQ ID NO: 5742694 - DNA, 14 bp, Homo sapiens
gagagcagcagcac

SEQ ID NO: 5742695 - DNA, 20 bp, Homo sapiens
gagagcagcaggtgctgtgc

SEQ ID NO: 5742696 - DNA, 13 bp, Homo sapiens
gagagcagcctgg

SEQ ID NO: 5742697 - DNA, 14 bp, Homo sapiens
gagagcagcctggc

SEQ ID NO: 5742698 - DNA, 15 bp, Homo sapiens
gagagcagcctggcc

SEQ ID NO: 5742699 - DNA, 17 bp, Homo sapiens
gagagcagcctggccaa

SEQ ID NO: 5742700 - DNA, 15 bp, Homo sapiens
gagagcagcgcccag

SEQ ID NO: 5742701 - DNA, 20 bp, Homo sapiens
gagagcagcgcccaggcctg

SEQ ID NO: 5742702 - DNA, 23 bp, Homo sapiens
gagagcagcgcccaggcctgctg

SEQ ID NO: 5742703 - DNA, 13 bp, Homo sapiens
gagagcagctccc

SEQ ID NO: 5742704 - DNA, 11 bp, Homo sapiens
gagagcagctg

SEQ ID NO: 5742705 - DNA, 13 bp, Homo sapiens
gagagcagctggc

SEQ ID NO: 5742706 - DNA, 19 bp, Homo sapiens
gagagcagctggctctcca

SEQ ID NO: 5742707 - DNA, 18 bp, Homo sapiens
gagagcagcttctgccac

SEQ ID NO: 5742708 - DNA, 19 bp, Homo sapiens
gagagcagcttctgccact

SEQ ID NO: 5742709 - DNA, 13 bp, Homo sapiens
gagagcaggcagg

SEQ ID NO: 5742710 - DNA, 22 bp, Homo sapiens
gagagcaggcaggggcatctgt

SEQ ID NO: 5742711 - DNA, 21 bp, Homo sapiens
gagagcaggctggcagctctc

SEQ ID NO: 5742712 - DNA, 18 bp, Homo sapiens
gagagcagtgggcaggtg

SEQ ID NO: 5742713 - DNA, 21 bp, Homo sapiens
gagagcagtgggcaggtggcc

SEQ ID NO: 5742714 - DNA, 23 bp, Homo sapiens
gagagcatctcaggaggggcagc

SEQ ID NO: 5742715 - DNA, 13 bp, Homo sapiens
gagagcatgtgag

SEQ ID NO: 5742716 - DNA, 15 bp, Homo sapiens
gagagcatgtgaggg

SEQ ID NO: 5742717 - DNA, 18 bp, Homo sapiens
gagagccaacctcggctt

SEQ ID NO: 5742718 - DNA, 13 bp, Homo sapiens
gagagccaagacg

SEQ ID NO: 5742719 - DNA, 23 bp, Homo sapiens
gagagccacgctggccttcgtct

SEQ ID NO: 5742720 - DNA, 18 bp, Homo sapiens
gagagccactgggcccct

SEQ ID NO: 5742721 - DNA, 20 bp, Homo sapiens
gagagccagatgcctcccca

SEQ ID NO: 5742722 - DNA, 11 bp, Homo sapiens
gagagccagcc

SEQ ID NO: 5742723 - DNA, 12 bp, Homo sapiens
gagagccagccc

SEQ ID NO: 5742724 - DNA, 17 bp, Homo sapiens
gagagccagctctctct

SEQ ID NO: 5742725 - DNA, 17 bp, Homo sapiens
gagagccagtggcgggt

SEQ ID NO: 5742726 - DNA, 16 bp, Homo sapiens
gagagccatacataaa

SEQ ID NO: 5742727 - DNA, 15 bp, Homo sapiens
gagagccatgaagca

SEQ ID NO: 5742728 - DNA, 17 bp, Homo sapiens
gagagccattttgtgaa

SEQ ID NO: 5742729 - DNA, 14 bp, Homo sapiens
gagagcccaggagc

SEQ ID NO: 5742730 - DNA, 14 bp, Homo sapiens
gagagcccattccc

SEQ ID NO: 5742731 - DNA, 14 bp, Homo sapiens
gagagcccccacca

SEQ ID NO: 5742732 - DNA, 16 bp, Homo sapiens
gagagccctggtccta

SEQ ID NO: 5742733 - DNA, 15 bp, Homo sapiens
gagagccctgtccct

SEQ ID NO: 5742734 - DNA, 16 bp, Homo sapiens
gagagcccttcatttg

SEQ ID NO: 5742735 - DNA, 16 bp, Homo sapiens
gagagcccttcccagg

SEQ ID NO: 5742736 - DNA, 17 bp, Homo sapiens
gagagcccttcccaggg

SEQ ID NO: 5742737 - DNA, 21 bp, Homo sapiens
gagagccgtggtccctgagga

SEQ ID NO: 5742738 - DNA, 22 bp, Homo sapiens
gagagcctagaacatccctggg

SEQ ID NO: 5742739 - DNA, 17 bp, Homo sapiens
gagagcctgcaggatct

SEQ ID NO: 5742740 - DNA, 22 bp, Homo sapiens
gagagcctgctcccccaccccc

SEQ ID NO: 5742741 - DNA, 13 bp, Homo sapiens
gagagcctgctgc

SEQ ID NO: 5742742 - DNA, 14 bp, Homo sapiens
gagagcctgctggc

SEQ ID NO: 5742743 - DNA, 11 bp, Homo sapiens
gagagcctggc

SEQ ID NO: 5742744 - DNA, 11 bp, Homo sapiens
gagagcctggt

SEQ ID NO: 5742745 - DNA, 17 bp, Homo sapiens
gagagcctggtgctgct

SEQ ID NO: 5742746 - DNA, 14 bp, Homo sapiens
gagagcctgtggag

SEQ ID NO: 5742747 - DNA, 20 bp, Homo sapiens
gagagccttaatggatgctc

SEQ ID NO: 5742748 - DNA, 23 bp, Homo sapiens
gagagccttacttcaaagtgcct

SEQ ID NO: 5742749 - DNA, 16 bp, Homo sapiens
gagagccttccagggg

SEQ ID NO: 5742750 - DNA, 19 bp, Homo sapiens
gagagccttgggagccact

SEQ ID NO: 5742751 - DNA, 23 bp, Homo sapiens
gagagcctttctccagcccatgc

SEQ ID NO: 5742752 - DNA, 19 bp, Homo sapiens
gagagcgaccagcaggctc

SEQ ID NO: 5742753 - DNA, 13 bp, Homo sapiens
gagagcgccaccc

SEQ ID NO: 5742754 - DNA, 14 bp, Homo sapiens
gagagcgccacccg

SEQ ID NO: 5742755 - DNA, 22 bp, Homo sapiens
gagagcgcctcttcctctgggc

SEQ ID NO: 5742756 - DNA, 14 bp, Homo sapiens
gagagcgctggcct

SEQ ID NO: 5742757 - DNA, 13 bp, Homo sapiens
gagagcggctgga

SEQ ID NO: 5742758 - DNA, 21 bp, Homo sapiens
gagagcgggtgggtgggtgtg

SEQ ID NO: 5742759 - DNA, 14 bp, Homo sapiens
gagagcggtctcag

SEQ ID NO: 5742760 - DNA, 21 bp, Homo sapiens
gagagcggtctcaggctggtg

SEQ ID NO: 5742761 - DNA, 22 bp, Homo sapiens
gagagcgtgctccagcctggct

SEQ ID NO: 5742762 - DNA, 17 bp, Homo sapiens
gagagctagaacctaga

SEQ ID NO: 5742763 - DNA, 20 bp, Homo sapiens
gagagctagaacctggagag

SEQ ID NO: 5742764 - DNA, 21 bp, Homo sapiens
gagagctagcagcagggaggg

SEQ ID NO: 5742765 - DNA, 18 bp, Homo sapiens
gagagctcaccatggaat

SEQ ID NO: 5742766 - DNA, 16 bp, Homo sapiens
gagagctcgctcttgg

SEQ ID NO: 5742767 - DNA, 19 bp, Homo sapiens
gagagctcttagtttttaa

SEQ ID NO: 5742768 - DNA, 13 bp, Homo sapiens
gagagctgctcct

SEQ ID NO: 5742769 - DNA, 17 bp, Homo sapiens
gagagctgctcctttgg

SEQ ID NO: 5742770 - DNA, 19 bp, Homo sapiens
gagagctgctgagggacct

SEQ ID NO: 5742771 - DNA, 13 bp, Homo sapiens
gagagctggagcc

SEQ ID NO: 5742772 - DNA, 14 bp, Homo sapiens
gagagctggagcct

SEQ ID NO: 5742773 - DNA, 21 bp, Homo sapiens
gagagctggagcctggtgccc

SEQ ID NO: 5742774 - DNA, 12 bp, Homo sapiens
gagagctggagt

SEQ ID NO: 5742775 - DNA, 19 bp, Homo sapiens
gagagctgggatggggcca

SEQ ID NO: 5742776 - DNA, 19 bp, Homo sapiens
gagagctgggcagacaggt

SEQ ID NO: 5742777 - DNA, 13 bp, Homo sapiens
gagagctgggctt

SEQ ID NO: 5742778 - DNA, 14 bp, Homo sapiens
gagagctggggaag

SEQ ID NO: 5742779 - DNA, 19 bp, Homo sapiens
gagagctgtttttgacagc

SEQ ID NO: 5742780 - DNA, 18 bp, Homo sapiens
gagagcttagcctggagc

SEQ ID NO: 5742781 - DNA, 19 bp, Homo sapiens
gagagcttagggtctcagg

SEQ ID NO: 5742782 - DNA, 22 bp, Homo sapiens
gagagcttctgttgctgcctca

SEQ ID NO: 5742783 - DNA, 17 bp, Homo sapiens
gagagcttggactacac

SEQ ID NO: 5742784 - DNA, 18 bp, Homo sapiens
gagagcttggactacaca

SEQ ID NO: 5742785 - DNA, 21 bp, Homo sapiens
gagagctttattgctgcattt

SEQ ID NO: 5742786 - DNA, 23 bp, Homo sapiens
gagagctttctgtccttttggca

SEQ ID NO: 5742787 - DNA, 15 bp, Homo sapiens
gagagctttgtgctt

SEQ ID NO: 5742788 - DNA, 23 bp, Homo sapiens
gagaggaaaaacgatcgctgtga

SEQ ID NO: 5742789 - DNA, 15 bp, Homo sapiens
gagaggaaaaaggct

SEQ ID NO: 5742790 - DNA, 17 bp, Homo sapiens
gagaggaaaagctgcct

SEQ ID NO: 5742791 - DNA, 22 bp, Homo sapiens
gagaggaaataacagagagaat

SEQ ID NO: 5742792 - DNA, 20 bp, Homo sapiens
gagaggaaatattgctgggg

SEQ ID NO: 5742793 - DNA, 21 bp, Homo sapiens
gagaggaaatattgctggggt

SEQ ID NO: 5742794 - DNA, 12 bp, Homo sapiens
gagaggaaatca

SEQ ID NO: 5742795 - DNA, 22 bp, Homo sapiens
gagaggaacgggcagcctgggc

SEQ ID NO: 5742796 - DNA, 13 bp, Homo sapiens
gagaggaagaaac

SEQ ID NO: 5742797 - DNA, 18 bp, Homo sapiens
gagaggaagatgaagaga

SEQ ID NO: 5742798 - DNA, 19 bp, Homo sapiens
gagaggaagccacgtgctg

SEQ ID NO: 5742799 - DNA, 23 bp, Homo sapiens
gagaggaagccacgtgctggaga

SEQ ID NO: 5742800 - DNA, 18 bp, Homo sapiens
gagaggaaggacccctca

SEQ ID NO: 5742801 - DNA, 18 bp, Homo sapiens
gagaggaaggagattcca

SEQ ID NO: 5742802 - DNA, 14 bp, Homo sapiens
gagaggaagggtgg

SEQ ID NO: 5742803 - DNA, 15 bp, Homo sapiens
gagaggacaaaataa

SEQ ID NO: 5742804 - DNA, 19 bp, Homo sapiens
gagaggacaatactggggt

SEQ ID NO: 5742805 - DNA, 23 bp, Homo sapiens
gagaggacacttcaaactgcgga

SEQ ID NO: 5742806 - DNA, 18 bp, Homo sapiens
gagaggacagcttgagcc

SEQ ID NO: 5742807 - DNA, 21 bp, Homo sapiens
gagaggaccccattctgggac

SEQ ID NO: 5742808 - DNA, 12 bp, Homo sapiens
gagaggacctcc

SEQ ID NO: 5742809 - DNA, 13 bp, Homo sapiens
gagaggacctcca

SEQ ID NO: 5742810 - DNA, 16 bp, Homo sapiens
gagaggacctccatgc

SEQ ID NO: 5742811 - DNA, 18 bp, Homo sapiens
gagaggacctccatgccc

SEQ ID NO: 5742812 - DNA, 16 bp, Homo sapiens
gagaggacggccctgc

SEQ ID NO: 5742813 - DNA, 16 bp, Homo sapiens
gagaggacgtgggcgg

SEQ ID NO: 5742814 - DNA, 16 bp, Homo sapiens
gagaggactctgcctt

SEQ ID NO: 5742815 - DNA, 18 bp, Homo sapiens
gagaggagaaaaaaaaag

SEQ ID NO: 5742816 - DNA, 19 bp, Homo sapiens
gagaggagaaactgagaaa

SEQ ID NO: 5742817 - DNA, 17 bp, Homo sapiens
gagaggagaacagtagg

SEQ ID NO: 5742818 - DNA, 11 bp, Homo sapiens
gagaggagaga

SEQ ID NO: 5742819 - DNA, 13 bp, Homo sapiens
gagaggagagaat

SEQ ID NO: 5742820 - DNA, 15 bp, Homo sapiens
gagaggagagaggca

SEQ ID NO: 5742821 - DNA, 14 bp, Homo sapiens
gagaggagagcatc

SEQ ID NO: 5742822 - DNA, 19 bp, Homo sapiens
gagaggagagccagagaag

SEQ ID NO: 5742823 - DNA, 17 bp, Homo sapiens
gagaggagccagacaga

SEQ ID NO: 5742824 - DNA, 22 bp, Homo sapiens
gagaggagcgggacctgtggct

SEQ ID NO: 5742825 - DNA, 17 bp, Homo sapiens
gagaggaggcagcagga

SEQ ID NO: 5742826 - DNA, 19 bp, Homo sapiens
gagaggaggggtaaatata

SEQ ID NO: 5742827 - DNA, 19 bp, Homo sapiens
gagaggaggtgtggagtgg

SEQ ID NO: 5742828 - DNA, 15 bp, Homo sapiens
gagaggagttcaatg

SEQ ID NO: 5742829 - DNA, 18 bp, Homo sapiens
gagaggagttcaatgatc

SEQ ID NO: 5742830 - DNA, 19 bp, Homo sapiens
gagaggagttcaatgatct

SEQ ID NO: 5742831 - DNA, 15 bp, Homo sapiens
gagaggatgaacatc

SEQ ID NO: 5742832 - DNA, 12 bp, Homo sapiens
gagaggatgaat

SEQ ID NO: 5742833 - DNA, 20 bp, Homo sapiens
gagaggatgtggaaagcact

SEQ ID NO: 5742834 - DNA, 20 bp, Homo sapiens
gagaggcaatggctccttca

SEQ ID NO: 5742835 - DNA, 17 bp, Homo sapiens
gagaggcaccagtccag

SEQ ID NO: 5742836 - DNA, 17 bp, Homo sapiens
gagaggcacctgctgga

SEQ ID NO: 5742837 - DNA, 19 bp, Homo sapiens
gagaggcactcagtgagcc

SEQ ID NO: 5742838 - DNA, 22 bp, Homo sapiens
gagaggcactcagtgagcctcc

SEQ ID NO: 5742839 - DNA, 12 bp, Homo sapiens
gagaggcagaga

SEQ ID NO: 5742840 - DNA, 16 bp, Homo sapiens
gagaggcagagaaaga

SEQ ID NO: 5742841 - DNA, 13 bp, Homo sapiens
gagaggcagagag

SEQ ID NO: 5742842 - DNA, 14 bp, Homo sapiens
gagaggcagagagc

SEQ ID NO: 5742843 - DNA, 13 bp, Homo sapiens
gagaggcagagtg

SEQ ID NO: 5742844 - DNA, 15 bp, Homo sapiens
gagaggcagccagac

SEQ ID NO: 5742845 - DNA, 15 bp, Homo sapiens
gagaggcaggaatgg

SEQ ID NO: 5742846 - DNA, 18 bp, Homo sapiens
gagaggcaggaatggggg

SEQ ID NO: 5742847 - DNA, 22 bp, Homo sapiens
gagaggcaggaatgggggtcag

SEQ ID NO: 5742848 - DNA, 12 bp, Homo sapiens
gagaggcaggca

SEQ ID NO: 5742849 - DNA, 15 bp, Homo sapiens
gagaggcaggcatag

SEQ ID NO: 5742850 - DNA, 17 bp, Homo sapiens
gagaggcatgacagctg

SEQ ID NO: 5742851 - DNA, 16 bp, Homo sapiens
gagaggcccccaccct

SEQ ID NO: 5742852 - DNA, 23 bp, Homo sapiens
gagaggccccggctgggtgagct

SEQ ID NO: 5742853 - DNA, 16 bp, Homo sapiens
gagaggcccgcccgcc

SEQ ID NO: 5742854 - DNA, 21 bp, Homo sapiens
gagaggccctggatcagcgtg

SEQ ID NO: 5742855 - DNA, 21 bp, Homo sapiens
gagaggcctcggctgtctcct

SEQ ID NO: 5742856 - DNA, 12 bp, Homo sapiens
gagaggcctgct

SEQ ID NO: 5742857 - DNA, 13 bp, Homo sapiens
gagaggcctggag

SEQ ID NO: 5742858 - DNA, 14 bp, Homo sapiens
gagaggcctggagc

SEQ ID NO: 5742859 - DNA, 12 bp, Homo sapiens
gagaggcctggg

SEQ ID NO: 5742860 - DNA, 13 bp, Homo sapiens
gagaggcctgggg

SEQ ID NO: 5742861 - DNA, 14 bp, Homo sapiens
gagaggcctggggt

SEQ ID NO: 5742862 - DNA, 19 bp, Homo sapiens
gagaggcgcgtctgcccca

SEQ ID NO: 5742863 - DNA, 13 bp, Homo sapiens
gagaggcggcctc

SEQ ID NO: 5742864 - DNA, 18 bp, Homo sapiens
gagaggcgggagaactga

SEQ ID NO: 5742865 - DNA, 16 bp, Homo sapiens
gagaggctaaaatgtt

SEQ ID NO: 5742866 - DNA, 14 bp, Homo sapiens
gagaggctctccgt

SEQ ID NO: 5742867 - DNA, 17 bp, Homo sapiens
gagaggctctccgtgca

SEQ ID NO: 5742868 - DNA, 23 bp, Homo sapiens
gagaggctctgaaagctgcttct

SEQ ID NO: 5742869 - DNA, 22 bp, Homo sapiens
gagaggctgcctccgcacctga

SEQ ID NO: 5742870 - DNA, 16 bp, Homo sapiens
gagaggctggatgact

SEQ ID NO: 5742871 - DNA, 15 bp, Homo sapiens
gagaggcttccctac

SEQ ID NO: 5742872 - DNA, 20 bp, Homo sapiens
gagaggcttccctacacagg

SEQ ID NO: 5742873 - DNA, 17 bp, Homo sapiens
gagagggaagagggaga

SEQ ID NO: 5742874 - DNA, 16 bp, Homo sapiens
gagagggaagctgagg

SEQ ID NO: 5742875 - DNA, 18 bp, Homo sapiens
gagagggaagctgaggcc

SEQ ID NO: 5742876 - DNA, 14 bp, Homo sapiens
gagagggaagctgg

SEQ ID NO: 5742877 - DNA, 20 bp, Homo sapiens
gagagggacacatgcccctc

SEQ ID NO: 5742878 - DNA, 20 bp, Homo sapiens
gagagggacactcctcctcg

SEQ ID NO: 5742879 - DNA, 15 bp, Homo sapiens
gagagggacaggcac

SEQ ID NO: 5742880 - DNA, 15 bp, Homo sapiens
gagagggactcaagg

SEQ ID NO: 5742881 - DNA, 14 bp, Homo sapiens
gagagggagaagaa

SEQ ID NO: 5742882 - DNA, 13 bp, Homo sapiens
gagagggagcaag

SEQ ID NO: 5742883 - DNA, 10 bp, Homo sapiens
gagagggagt

SEQ ID NO: 5742884 - DNA, 18 bp, Homo sapiens
gagagggagtacaaagac

SEQ ID NO: 5742885 - DNA, 21 bp, Homo sapiens
gagagggagtacaaagacagg

SEQ ID NO: 5742886 - DNA, 13 bp, Homo sapiens
gagagggatggaa

SEQ ID NO: 5742887 - DNA, 18 bp, Homo sapiens
gagagggcagtgtttcct

SEQ ID NO: 5742888 - DNA, 14 bp, Homo sapiens
gagagggcccagct

SEQ ID NO: 5742889 - DNA, 15 bp, Homo sapiens
gagagggcccagctg

SEQ ID NO: 5742890 - DNA, 17 bp, Homo sapiens
gagagggcctctgcctg

SEQ ID NO: 5742891 - DNA, 19 bp, Homo sapiens
gagagggcctctgcctggg

SEQ ID NO: 5742892 - DNA, 20 bp, Homo sapiens
gagagggcctctgcctggga

SEQ ID NO: 5742893 - DNA, 18 bp, Homo sapiens
gagagggcgcaggccgtg

SEQ ID NO: 5742894 - DNA, 15 bp, Homo sapiens
gagagggcgcccagc

SEQ ID NO: 5742895 - DNA, 22 bp, Homo sapiens
gagagggcggtgggtatgcgag

SEQ ID NO: 5742896 - DNA, 16 bp, Homo sapiens
gagagggctagccctg

SEQ ID NO: 5742897 - DNA, 22 bp, Homo sapiens
gagagggctagccctgagcccg

SEQ ID NO: 5742898 - DNA, 21 bp, Homo sapiens
gagagggctcgaggggtgggc

SEQ ID NO: 5742899 - DNA, 19 bp, Homo sapiens
gagagggctgagcccctcc

SEQ ID NO: 5742900 - DNA, 12 bp, Homo sapiens
gagagggctgtg

SEQ ID NO: 5742901 - DNA, 10 bp, Homo sapiens
gagaggggaa

SEQ ID NO: 5742902 - DNA, 15 bp, Homo sapiens
gagaggggaaagtgt

SEQ ID NO: 5742903 - DNA, 13 bp, Homo sapiens
gagaggggaagag

SEQ ID NO: 5742904 - DNA, 17 bp, Homo sapiens
gagaggggaagggccag

SEQ ID NO: 5742905 - DNA, 18 bp, Homo sapiens
gagaggggaagggccagt

SEQ ID NO: 5742906 - DNA, 21 bp, Homo sapiens
gagaggggaataatagaagaa

SEQ ID NO: 5742907 - DNA, 18 bp, Homo sapiens
gagaggggacgcaggccc

SEQ ID NO: 5742908 - DNA, 19 bp, Homo sapiens
gagaggggacgcaggcccc

SEQ ID NO: 5742909 - DNA, 20 bp, Homo sapiens
gagaggggacgcaggcccct

SEQ ID NO: 5742910 - DNA, 15 bp, Homo sapiens
gagaggggacttgga

SEQ ID NO: 5742911 - DNA, 22 bp, Homo sapiens
gagaggggacttggataggagc

SEQ ID NO: 5742912 - DNA, 19 bp, Homo sapiens
gagaggggagacagggcaa

SEQ ID NO: 5742913 - DNA, 19 bp, Homo sapiens
gagaggggcctctggctgc

SEQ ID NO: 5742914 - DNA, 13 bp, Homo sapiens
gagaggggcctgc

SEQ ID NO: 5742915 - DNA, 13 bp, Homo sapiens
gagaggggcctgg

SEQ ID NO: 5742916 - DNA, 14 bp, Homo sapiens
gagaggggcctggg

SEQ ID NO: 5742917 - DNA, 13 bp, Homo sapiens
gagagggggaggt

SEQ ID NO: 5742918 - DNA, 22 bp, Homo sapiens
gagagggggatgcccctggccc

SEQ ID NO: 5742919 - DNA, 19 bp, Homo sapiens
gagagggggcctgggactt

SEQ ID NO: 5742920 - DNA, 16 bp, Homo sapiens
gagagggggctctcca

SEQ ID NO: 5742921 - DNA, 23 bp, Homo sapiens
gagagggggtaatggaggccaag

SEQ ID NO: 5742922 - DNA, 13 bp, Homo sapiens
gagagggtctgga

SEQ ID NO: 5742923 - DNA, 20 bp, Homo sapiens
gagagggtgccgcgggcgag

SEQ ID NO: 5742924 - DNA, 23 bp, Homo sapiens
gagaggtatgtgcccctcctggg

SEQ ID NO: 5742925 - DNA, 11 bp, Homo sapiens
gagaggtcagc

SEQ ID NO: 5742926 - DNA, 14 bp, Homo sapiens
gagaggtcagcctt

SEQ ID NO: 5742927 - DNA, 15 bp, Homo sapiens
gagaggtccctgctt

SEQ ID NO: 5742928 - DNA, 16 bp, Homo sapiens
gagaggtccctgctta

SEQ ID NO: 5742929 - DNA, 23 bp, Homo sapiens
gagaggtgccggggaggggcaga

SEQ ID NO: 5742930 - DNA, 15 bp, Homo sapiens
gagaggtggctgcgc

SEQ ID NO: 5742931 - DNA, 22 bp, Homo sapiens
gagaggtgggccagtctgtgga

SEQ ID NO: 5742932 - DNA, 23 bp, Homo sapiens
gagaggtgggccagtctgtggat

SEQ ID NO: 5742933 - DNA, 20 bp, Homo sapiens
gagaggttaaagcaaaccag

SEQ ID NO: 5742934 - DNA, 17 bp, Homo sapiens
gagaggttctggggagg

SEQ ID NO: 5742935 - DNA, 20 bp, Homo sapiens
gagaggtttttcttgggaaa

SEQ ID NO: 5742936 - DNA, 18 bp, Homo sapiens
gagagtaaacagacagct

SEQ ID NO: 5742937 - DNA, 18 bp, Homo sapiens
gagagtacagactgcaga

SEQ ID NO: 5742938 - DNA, 16 bp, Homo sapiens
gagagtacctgtgtgt

SEQ ID NO: 5742939 - DNA, 17 bp, Homo sapiens
gagagtagctgcagcct

SEQ ID NO: 5742940 - DNA, 23 bp, Homo sapiens
gagagtagctgcagccttcatca

SEQ ID NO: 5742941 - DNA, 15 bp, Homo sapiens
gagagtagggccctg

SEQ ID NO: 5742942 - DNA, 20 bp, Homo sapiens
gagagtcaacatatgtgatt

SEQ ID NO: 5742943 - DNA, 14 bp, Homo sapiens
gagagtcaggcagg

SEQ ID NO: 5742944 - DNA, 17 bp, Homo sapiens
gagagtcatattttgat

SEQ ID NO: 5742945 - DNA, 15 bp, Homo sapiens
gagagtcccactgcc

SEQ ID NO: 5742946 - DNA, 18 bp, Homo sapiens
gagagtcccagagcagga

SEQ ID NO: 5742947 - DNA, 15 bp, Homo sapiens
gagagtcctctggat

SEQ ID NO: 5742948 - DNA, 14 bp, Homo sapiens
gagagtcctgggag

SEQ ID NO: 5742949 - DNA, 17 bp, Homo sapiens
gagagtcggtctgcttt

SEQ ID NO: 5742950 - DNA, 13 bp, Homo sapiens
gagagtctagatt

SEQ ID NO: 5742951 - DNA, 15 bp, Homo sapiens
gagagtctcccaggg

SEQ ID NO: 5742952 - DNA, 17 bp, Homo sapiens
gagagtctgaatatttt

SEQ ID NO: 5742953 - DNA, 13 bp, Homo sapiens
gagagtctggtct

SEQ ID NO: 5742954 - DNA, 14 bp, Homo sapiens
gagagtcttgggcc

SEQ ID NO: 5742955 - DNA, 15 bp, Homo sapiens
gagagtcttgggcct

SEQ ID NO: 5742956 - DNA, 23 bp, Homo sapiens
gagagtgagaataattgtgtaca

SEQ ID NO: 5742957 - DNA, 24 bp, Homo sapiens
gagagtgagaataattgtgtacaa

SEQ ID NO: 5742958 - DNA, 16 bp, Homo sapiens
gagagtgagcaaccag

SEQ ID NO: 5742959 - DNA, 17 bp, Homo sapiens
gagagtgagctacagag

SEQ ID NO: 5742960 - DNA, 15 bp, Homo sapiens
gagagtgaggtggaa

SEQ ID NO: 5742961 - DNA, 15 bp, Homo sapiens
gagagtgagtgcctt

SEQ ID NO: 5742962 - DNA, 15 bp, Homo sapiens
gagagtgcacatgcc

SEQ ID NO: 5742963 - DNA, 18 bp, Homo sapiens
gagagtgcacatgcccct

SEQ ID NO: 5742964 - DNA, 13 bp, Homo sapiens
gagagtgcactgc

SEQ ID NO: 5742965 - DNA, 23 bp, Homo sapiens
gagagtgctcaacctacagtgga

SEQ ID NO: 5742966 - DNA, 22 bp, Homo sapiens
gagagtggaaattacccactgt

SEQ ID NO: 5742967 - DNA, 17 bp, Homo sapiens
gagagtggaaggactgt

SEQ ID NO: 5742968 - DNA, 24 bp, Homo sapiens
gagagtggcaggtgggctgcctgc

SEQ ID NO: 5742969 - DNA, 13 bp, Homo sapiens
gagagtggcctgg

SEQ ID NO: 5742970 - DNA, 14 bp, Homo sapiens
gagagtggcctggg

SEQ ID NO: 5742971 - DNA, 15 bp, Homo sapiens
gagagtggcctgggt

SEQ ID NO: 5742972 - DNA, 16 bp, Homo sapiens
gagagtggcctgggtc

SEQ ID NO: 5742973 - DNA, 13 bp, Homo sapiens
gagagtggctcct

SEQ ID NO: 5742974 - DNA, 17 bp, Homo sapiens
gagagtggctggggcat

SEQ ID NO: 5742975 - DNA, 12 bp, Homo sapiens
gagagtgggggt

SEQ ID NO: 5742976 - DNA, 15 bp, Homo sapiens
gagagtgggggtggg

SEQ ID NO: 5742977 - DNA, 21 bp, Homo sapiens
gagagtggtaaaaaagaaatg

SEQ ID NO: 5742978 - DNA, 18 bp, Homo sapiens
gagagtggtgagtggaag

SEQ ID NO: 5742979 - DNA, 23 bp, Homo sapiens
gagagtgtcaaccagacagaggg

SEQ ID NO: 5742980 - DNA, 16 bp, Homo sapiens
gagagtgtgagcaggg

SEQ ID NO: 5742981 - DNA, 12 bp, Homo sapiens
gagagtgtgctc

SEQ ID NO: 5742982 - DNA, 13 bp, Homo sapiens
gagagtgttgaaa

SEQ ID NO: 5742983 - DNA, 15 bp, Homo sapiens
gagagttaaaagcag

SEQ ID NO: 5742984 - DNA, 14 bp, Homo sapiens
gagagttaaatggt

SEQ ID NO: 5742985 - DNA, 22 bp, Homo sapiens
gagagttaatcaactgaaagtg

SEQ ID NO: 5742986 - DNA, 14 bp, Homo sapiens
gagagttagcatgt

SEQ ID NO: 5742987 - DNA, 22 bp, Homo sapiens
gagagttagcatgtatgaatgt

SEQ ID NO: 5742988 - DNA, 23 bp, Homo sapiens
gagagttagcatgtatgaatgta

SEQ ID NO: 5742989 - DNA, 21 bp, Homo sapiens
gagagttcaatggctgctgaa

SEQ ID NO: 5742990 - DNA, 22 bp, Homo sapiens
gagagttcaatggctgctgaag

SEQ ID NO: 5742991 - DNA, 14 bp, Homo sapiens
gagagttccgggaa

SEQ ID NO: 5742992 - DNA, 14 bp, Homo sapiens
gagagttccgggga

SEQ ID NO: 5742993 - DNA, 17 bp, Homo sapiens
gagagttgctcctcagg

SEQ ID NO: 5742994 - DNA, 21 bp, Homo sapiens
gagagttggctcaggcagaca

SEQ ID NO: 5742995 - DNA, 19 bp, Homo sapiens
gagagttgggggccagcac

SEQ ID NO: 5742996 - DNA, 16 bp, Homo sapiens
gagagttgtgatggag

SEQ ID NO: 5742997 - DNA, 17 bp, Homo sapiens
gagagttgtgatggagg

SEQ ID NO: 5742998 - DNA, 16 bp, Homo sapiens
gagagtttagctgtaa

SEQ ID NO: 5742999 - DNA, 11 bp, Homo sapiens
gagagtttcct

SEQ ID NO: 5743000 - DNA, 14 bp, Homo sapiens
gagagtttcctcag

SEQ ID NO: 5743001 - DNA, 14 bp, Homo sapiens
gagagttttggatg

SEQ ID NO: 5743002 - DNA, 17 bp, Homo sapiens
gagataaaagcaattct

SEQ ID NO: 5743003 - DNA, 19 bp, Homo sapiens
gagataaaagcaattctga

SEQ ID NO: 5743004 - DNA, 19 bp, Homo sapiens
gagataaaccaataaatcc

SEQ ID NO: 5743005 - DNA, 15 bp, Homo sapiens
gagataaactgaaat

SEQ ID NO: 5743006 - DNA, 12 bp, Homo sapiens
gagataaatatc

SEQ ID NO: 5743007 - DNA, 14 bp, Homo sapiens
gagataaatattta

SEQ ID NO: 5743008 - DNA, 14 bp, Homo sapiens
gagataacttcctt

SEQ ID NO: 5743009 - DNA, 12 bp, Homo sapiens
gagataagaaaa

SEQ ID NO: 5743010 - DNA, 22 bp, Homo sapiens
gagataagaaaagcctgaacta

SEQ ID NO: 5743011 - DNA, 13 bp, Homo sapiens
gagataaggtttt

SEQ ID NO: 5743012 - DNA, 13 bp, Homo sapiens
gagataataagat

SEQ ID NO: 5743013 - DNA, 21 bp, Homo sapiens
gagataatgttagaggtttta

SEQ ID NO: 5743014 - DNA, 18 bp, Homo sapiens
gagataattactgccttg

SEQ ID NO: 5743015 - DNA, 20 bp, Homo sapiens
gagatacaaggcccagaagc

SEQ ID NO: 5743016 - DNA, 21 bp, Homo sapiens
gagataccaagatgccatctg

SEQ ID NO: 5743017 - DNA, 13 bp, Homo sapiens
gagatacccagag

SEQ ID NO: 5743018 - DNA, 16 bp, Homo sapiens
gagatacccagagaga

SEQ ID NO: 5743019 - DNA, 17 bp, Homo sapiens
gagatacccagagagaa

SEQ ID NO: 5743020 - DNA, 21 bp, Homo sapiens
gagatactctccctgacattt

SEQ ID NO: 5743021 - DNA, 19 bp, Homo sapiens
gagatactcttctgcctcc

SEQ ID NO: 5743022 - DNA, 14 bp, Homo sapiens
gagatactggtgga

SEQ ID NO: 5743023 - DNA, 15 bp, Homo sapiens
gagatactggtggaa

SEQ ID NO: 5743024 - DNA, 11 bp, Homo sapiens
gagatactgtg

SEQ ID NO: 5743025 - DNA, 13 bp, Homo sapiens
gagatactgtgta

SEQ ID NO: 5743026 - DNA, 23 bp, Homo sapiens
gagatacttggtcacagccaggc

SEQ ID NO: 5743027 - DNA, 23 bp, Homo sapiens
gagatactttttcttttgtaagt

SEQ ID NO: 5743028 - DNA, 15 bp, Homo sapiens
gagatagaagcctct

SEQ ID NO: 5743029 - DNA, 16 bp, Homo sapiens
gagatagcagaggaaa

SEQ ID NO: 5743030 - DNA, 19 bp, Homo sapiens
gagatagcagaggggctcc

SEQ ID NO: 5743031 - DNA, 15 bp, Homo sapiens
gagatagcattgtga

SEQ ID NO: 5743032 - DNA, 16 bp, Homo sapiens
gagatagcattgtgaa

SEQ ID NO: 5743033 - DNA, 20 bp, Homo sapiens
gagatagcattgtgaactga

SEQ ID NO: 5743034 - DNA, 23 bp, Homo sapiens
gagatagcattgtgaactgacag

SEQ ID NO: 5743035 - DNA, 14 bp, Homo sapiens
gagatagccaaggc

SEQ ID NO: 5743036 - DNA, 19 bp, Homo sapiens
gagatagcctgtggccctg

SEQ ID NO: 5743037 - DNA, 17 bp, Homo sapiens
gagataggcacatgcat

SEQ ID NO: 5743038 - DNA, 13 bp, Homo sapiens
gagataggggagg

SEQ ID NO: 5743039 - DNA, 15 bp, Homo sapiens
gagataggggagggg

SEQ ID NO: 5743040 - DNA, 18 bp, Homo sapiens
gagataggggagggggga

SEQ ID NO: 5743041 - DNA, 14 bp, Homo sapiens
gagatagttttcat

SEQ ID NO: 5743042 - DNA, 15 bp, Homo sapiens
gagatagttttcatc

SEQ ID NO: 5743043 - DNA, 23 bp, Homo sapiens
gagatataaatgaagtattatct

SEQ ID NO: 5743044 - DNA, 18 bp, Homo sapiens
gagatatgcaataaatat

SEQ ID NO: 5743045 - DNA, 16 bp, Homo sapiens
gagatatgcagaagga

SEQ ID NO: 5743046 - DNA, 17 bp, Homo sapiens
gagatatggcagcgaaa

SEQ ID NO: 5743047 - DNA, 21 bp, Homo sapiens
gagatattattttaaatttct

SEQ ID NO: 5743048 - DNA, 19 bp, Homo sapiens
gagatatttaaaagacaaa

SEQ ID NO: 5743049 - DNA, 19 bp, Homo sapiens
gagatatttaggaaaatgc

SEQ ID NO: 5743050 - DNA, 14 bp, Homo sapiens
gagatattttgtaa

SEQ ID NO: 5743051 - DNA, 13 bp, Homo sapiens
gagatcaaagatg

SEQ ID NO: 5743052 - DNA, 23 bp, Homo sapiens
gagatcaaccccttcgctcctgt

SEQ ID NO: 5743053 - DNA, 15 bp, Homo sapiens
gagatcacagcccca

SEQ ID NO: 5743054 - DNA, 16 bp, Homo sapiens
gagatcacagcctcca

SEQ ID NO: 5743055 - DNA, 21 bp, Homo sapiens
gagatcacagcctccagggcc

SEQ ID NO: 5743056 - DNA, 15 bp, Homo sapiens
gagatcacccactcc

SEQ ID NO: 5743057 - DNA, 16 bp, Homo sapiens
gagatcacgccactgc

SEQ ID NO: 5743058 - DNA, 18 bp, Homo sapiens
gagatcacgccactgcac

SEQ ID NO: 5743059 - DNA, 21 bp, Homo sapiens
gagatcacgccactgcactcc

SEQ ID NO: 5743060 - DNA, 21 bp, Homo sapiens
gagatcactgaacttttcaaa

SEQ ID NO: 5743061 - DNA, 14 bp, Homo sapiens
gagatcagaattga

SEQ ID NO: 5743062 - DNA, 14 bp, Homo sapiens
gagatcagcattca

SEQ ID NO: 5743063 - DNA, 15 bp, Homo sapiens
gagatcagcattcaa

SEQ ID NO: 5743064 - DNA, 18 bp, Homo sapiens
gagatcagcattcaaaat

SEQ ID NO: 5743065 - DNA, 23 bp, Homo sapiens
gagatcaggagtgacagatcaca

SEQ ID NO: 5743066 - DNA, 18 bp, Homo sapiens
gagatcaggctctgcctc

SEQ ID NO: 5743067 - DNA, 14 bp, Homo sapiens
gagatcagggcctg

SEQ ID NO: 5743068 - DNA, 19 bp, Homo sapiens
gagatcagggcgacctgca

SEQ ID NO: 5743069 - DNA, 17 bp, Homo sapiens
gagatcatatcctcaga

SEQ ID NO: 5743070 - DNA, 16 bp, Homo sapiens
gagatcatcctttcca

SEQ ID NO: 5743071 - DNA, 20 bp, Homo sapiens
gagatcatcctttccagcat

SEQ ID NO: 5743072 - DNA, 19 bp, Homo sapiens
gagatcatgaattatataa

SEQ ID NO: 5743073 - DNA, 12 bp, Homo sapiens
gagatcatgaga

SEQ ID NO: 5743074 - DNA, 18 bp, Homo sapiens
gagatccagggcaaggcc

SEQ ID NO: 5743075 - DNA, 22 bp, Homo sapiens
gagatccagtgcagttgtgatt

SEQ ID NO: 5743076 - DNA, 18 bp, Homo sapiens
gagatcccaacactgcca

SEQ ID NO: 5743077 - DNA, 15 bp, Homo sapiens
gagatcccctgagcc

SEQ ID NO: 5743078 - DNA, 20 bp, Homo sapiens
gagatccctgcagaacccac

SEQ ID NO: 5743079 - DNA, 17 bp, Homo sapiens
gagatcctcaaaaatca

SEQ ID NO: 5743080 - DNA, 12 bp, Homo sapiens
gagatcctcctg

SEQ ID NO: 5743081 - DNA, 23 bp, Homo sapiens
gagatcctcctgcagaccacgcc

SEQ ID NO: 5743082 - DNA, 17 bp, Homo sapiens
gagatccttcacaggca

SEQ ID NO: 5743083 - DNA, 22 bp, Homo sapiens
gagatccttcacaggcagtgca

SEQ ID NO: 5743084 - DNA, 18 bp, Homo sapiens
gagatcgaagaggccagt

SEQ ID NO: 5743085 - DNA, 17 bp, Homo sapiens
gagatcgagaccatcct

SEQ ID NO: 5743086 - DNA, 18 bp, Homo sapiens
gagatcgagaccatcctg

SEQ ID NO: 5743087 - DNA, 20 bp, Homo sapiens
gagatcgcgccactgcactc

SEQ ID NO: 5743088 - DNA, 17 bp, Homo sapiens
gagatcgctggcagaga

SEQ ID NO: 5743089 - DNA, 15 bp, Homo sapiens
gagatcgggaagcag

SEQ ID NO: 5743090 - DNA, 16 bp, Homo sapiens
gagatcgggaagcaga

SEQ ID NO: 5743091 - DNA, 18 bp, Homo sapiens
gagatcggggccagaggc

SEQ ID NO: 5743092 - DNA, 17 bp, Homo sapiens
gagatcggggtggcaga

SEQ ID NO: 5743093 - DNA, 21 bp, Homo sapiens
gagatcgtgccattgcactcc

SEQ ID NO: 5743094 - DNA, 21 bp, Homo sapiens
gagatcgtgccgttactctcc

SEQ ID NO: 5743095 - DNA, 20 bp, Homo sapiens
gagatctaagcctttccata

SEQ ID NO: 5743096 - DNA, 17 bp, Homo sapiens
gagatctatgggcattt

SEQ ID NO: 5743097 - DNA, 18 bp, Homo sapiens
gagatctatgggcatttg

SEQ ID NO: 5743098 - DNA, 15 bp, Homo sapiens
gagatctccaactct

SEQ ID NO: 5743099 - DNA, 23 bp, Homo sapiens
gagatctcccttctcatctcccc

SEQ ID NO: 5743100 - DNA, 18 bp, Homo sapiens
gagatctgggaggtctcc

SEQ ID NO: 5743101 - DNA, 23 bp, Homo sapiens
gagatctggggaggcaggcattc

SEQ ID NO: 5743102 - DNA, 16 bp, Homo sapiens
gagatctggttttgct

SEQ ID NO: 5743103 - DNA, 20 bp, Homo sapiens
gagatctgtgtggctcctgg

SEQ ID NO: 5743104 - DNA, 22 bp, Homo sapiens
gagatctgtgtggctcctgggc

SEQ ID NO: 5743105 - DNA, 19 bp, Homo sapiens
gagatcttacaggtatcag

SEQ ID NO: 5743106 - DNA, 21 bp, Homo sapiens
gagatcttgagagagaaatgc

SEQ ID NO: 5743107 - DNA, 17 bp, Homo sapiens
gagatctttctttccaa

SEQ ID NO: 5743108 - DNA, 22 bp, Homo sapiens
gagatctttctttccaaaacat

SEQ ID NO: 5743109 - DNA, 12 bp, Homo sapiens
gagatgaaaacc

SEQ ID NO: 5743110 - DNA, 21 bp, Homo sapiens
gagatgaagagtgagagggca

SEQ ID NO: 5743111 - DNA, 21 bp, Homo sapiens
gagatgaagggggctaagcta

SEQ ID NO: 5743112 - DNA, 15 bp, Homo sapiens
gagatgaatagaaga

SEQ ID NO: 5743113 - DNA, 18 bp, Homo sapiens
gagatgaatagaagaaag

SEQ ID NO: 5743114 - DNA, 16 bp, Homo sapiens
gagatgaattaaattt

SEQ ID NO: 5743115 - DNA, 16 bp, Homo sapiens
gagatgaccagggatg

SEQ ID NO: 5743116 - DNA, 17 bp, Homo sapiens
gagatgaccagggatgc

SEQ ID NO: 5743117 - DNA, 21 bp, Homo sapiens
gagatgaccagggatgctggg

SEQ ID NO: 5743118 - DNA, 22 bp, Homo sapiens
gagatgaccagggatgctgggc

SEQ ID NO: 5743119 - DNA, 17 bp, Homo sapiens
gagatgacccctacccc

SEQ ID NO: 5743120 - DNA, 20 bp, Homo sapiens
gagatgactattacttttct

SEQ ID NO: 5743121 - DNA, 14 bp, Homo sapiens
gagatgagaaatga

SEQ ID NO: 5743122 - DNA, 17 bp, Homo sapiens
gagatgagaggggagag

SEQ ID NO: 5743123 - DNA, 16 bp, Homo sapiens
gagatgagaggtagcc

SEQ ID NO: 5743124 - DNA, 17 bp, Homo sapiens
gagatgaggccgccatg

SEQ ID NO: 5743125 - DNA, 15 bp, Homo sapiens
gagatgagttgcagt

SEQ ID NO: 5743126 - DNA, 22 bp, Homo sapiens
gagatgatacatccaaagcaga

SEQ ID NO: 5743127 - DNA, 12 bp, Homo sapiens
gagatgatcagt

SEQ ID NO: 5743128 - DNA, 13 bp, Homo sapiens
gagatgatgatga

SEQ ID NO: 5743129 - DNA, 16 bp, Homo sapiens
gagatgatgatgatga

SEQ ID NO: 5743130 - DNA, 12 bp, Homo sapiens
gagatgatgtga

SEQ ID NO: 5743131 - DNA, 13 bp, Homo sapiens
gagatgatttgta

SEQ ID NO: 5743132 - DNA, 15 bp, Homo sapiens
gagatgcagtattga

SEQ ID NO: 5743133 - DNA, 17 bp, Homo sapiens
gagatgcatgcgcaggc

SEQ ID NO: 5743134 - DNA, 20 bp, Homo sapiens
gagatgcatgcgcaggctca

SEQ ID NO: 5743135 - DNA, 15 bp, Homo sapiens
gagatgcatggcctc

SEQ ID NO: 5743136 - DNA, 23 bp, Homo sapiens
gagatgcattcttggttggctgg

SEQ ID NO: 5743137 - DNA, 15 bp, Homo sapiens
gagatgccagccctt

SEQ ID NO: 5743138 - DNA, 15 bp, Homo sapiens
gagatgcctccaccg

SEQ ID NO: 5743139 - DNA, 14 bp, Homo sapiens
gagatgcctccctg

SEQ ID NO: 5743140 - DNA, 17 bp, Homo sapiens
gagatgctaatttattt

SEQ ID NO: 5743141 - DNA, 16 bp, Homo sapiens
gagatgctagaactcc

SEQ ID NO: 5743142 - DNA, 12 bp, Homo sapiens
gagatgctctct

SEQ ID NO: 5743143 - DNA, 22 bp, Homo sapiens
gagatgctctctgaggcaaggc

SEQ ID NO: 5743144 - DNA, 15 bp, Homo sapiens
gagatgctggagaag

SEQ ID NO: 5743145 - DNA, 19 bp, Homo sapiens
gagatgctggagaagagag

SEQ ID NO: 5743146 - DNA, 21 bp, Homo sapiens
gagatgctggagaagagagga

SEQ ID NO: 5743147 - DNA, 12 bp, Homo sapiens
gagatgctggct

SEQ ID NO: 5743148 - DNA, 16 bp, Homo sapiens
gagatgctgggaccct

SEQ ID NO: 5743149 - DNA, 13 bp, Homo sapiens
gagatgctgggag

SEQ ID NO: 5743150 - DNA, 14 bp, Homo sapiens
gagatgctgtgccc

SEQ ID NO: 5743151 - DNA, 20 bp, Homo sapiens
gagatgcttggagcaatcag

SEQ ID NO: 5743152 - DNA, 21 bp, Homo sapiens
gagatgcttggagcaatcaga

SEQ ID NO: 5743153 - DNA, 12 bp, Homo sapiens
gagatggacaga

SEQ ID NO: 5743154 - DNA, 13 bp, Homo sapiens
gagatggacatgg

SEQ ID NO: 5743155 - DNA, 22 bp, Homo sapiens
gagatggacatggctcattgta

SEQ ID NO: 5743156 - DNA, 22 bp, Homo sapiens
gagatggacccctcccttgctc

SEQ ID NO: 5743157 - DNA, 23 bp, Homo sapiens
gagatggactcaggatccagtga

SEQ ID NO: 5743158 - DNA, 13 bp, Homo sapiens
gagatggagctac

SEQ ID NO: 5743159 - DNA, 12 bp, Homo sapiens
gagatggaggag

SEQ ID NO: 5743160 - DNA, 15 bp, Homo sapiens
gagatggaggaggag

SEQ ID NO: 5743161 - DNA, 19 bp, Homo sapiens
gagatggaggtagggctgg

SEQ ID NO: 5743162 - DNA, 24 bp, Homo sapiens
gagatggaggtagggctggctgga

SEQ ID NO: 5743163 - DNA, 23 bp, Homo sapiens
gagatggaggtttccttttggaa

SEQ ID NO: 5743164 - DNA, 21 bp, Homo sapiens
gagatggagtatacatgactg

SEQ ID NO: 5743165 - DNA, 16 bp, Homo sapiens
gagatggagtctcact

SEQ ID NO: 5743166 - DNA, 21 bp, Homo sapiens
gagatggagtctcactcttgt

SEQ ID NO: 5743167 - DNA, 14 bp, Homo sapiens
gagatggctcccag

SEQ ID NO: 5743168 - DNA, 20 bp, Homo sapiens
gagatgggaatgaggtggga

SEQ ID NO: 5743169 - DNA, 19 bp, Homo sapiens
gagatgggactgggagggc

SEQ ID NO: 5743170 - DNA, 14 bp, Homo sapiens
gagatgggagctcc

SEQ ID NO: 5743171 - DNA, 17 bp, Homo sapiens
gagatgggccaggcaga

SEQ ID NO: 5743172 - DNA, 21 bp, Homo sapiens
gagatgggccggcccccttcc

SEQ ID NO: 5743173 - DNA, 17 bp, Homo sapiens
gagatggggcgggggtg

SEQ ID NO: 5743174 - DNA, 19 bp, Homo sapiens
gagatgggggcttcttcct

SEQ ID NO: 5743175 - DNA, 14 bp, Homo sapiens
gagatggtgatgta

SEQ ID NO: 5743176 - DNA, 19 bp, Homo sapiens
gagatggttaaaaaggcca

SEQ ID NO: 5743177 - DNA, 19 bp, Homo sapiens
gagatgtaatgacagagag

SEQ ID NO: 5743178 - DNA, 14 bp, Homo sapiens
gagatgtagcccct

SEQ ID NO: 5743179 - DNA, 23 bp, Homo sapiens
gagatgtatgaaggcttttggtc

SEQ ID NO: 5743180 - DNA, 15 bp, Homo sapiens
gagatgtcaaaatgt

SEQ ID NO: 5743181 - DNA, 13 bp, Homo sapiens
gagatgtctagag

SEQ ID NO: 5743182 - DNA, 12 bp, Homo sapiens
gagatgtctctt

SEQ ID NO: 5743183 - DNA, 15 bp, Homo sapiens
gagatgtcttggaac

SEQ ID NO: 5743184 - DNA, 16 bp, Homo sapiens
gagatgtgacccacca

SEQ ID NO: 5743185 - DNA, 15 bp, Homo sapiens
gagatgtgagccttg

SEQ ID NO: 5743186 - DNA, 13 bp, Homo sapiens
gagatgtgagtcc

SEQ ID NO: 5743187 - DNA, 17 bp, Homo sapiens
gagatgtgcccccaccc

SEQ ID NO: 5743188 - DNA, 21 bp, Homo sapiens
gagatgtgtgagcatcctgca

SEQ ID NO: 5743189 - DNA, 20 bp, Homo sapiens
gagatgtgtggactgtggca

SEQ ID NO: 5743190 - DNA, 18 bp, Homo sapiens
gagatgtgttcctcctgc

SEQ ID NO: 5743191 - DNA, 19 bp, Homo sapiens
gagatgtgttcctcctgct

SEQ ID NO: 5743192 - DNA, 17 bp, Homo sapiens
gagatgttattactgtt

SEQ ID NO: 5743193 - DNA, 19 bp, Homo sapiens
gagatgttgaggggaggag

SEQ ID NO: 5743194 - DNA, 20 bp, Homo sapiens
gagatgttgaggggaggagg

SEQ ID NO: 5743195 - DNA, 14 bp, Homo sapiens
gagatgtttttaaa

SEQ ID NO: 5743196 - DNA, 19 bp, Homo sapiens
gagatgtttttaaaagttt

SEQ ID NO: 5743197 - DNA, 22 bp, Homo sapiens
gagattaacacactgaaccgct

SEQ ID NO: 5743198 - DNA, 15 bp, Homo sapiens
gagattacctcctga

SEQ ID NO: 5743199 - DNA, 13 bp, Homo sapiens
gagattataataa

SEQ ID NO: 5743200 - DNA, 17 bp, Homo sapiens
gagattatcagtagaaa

SEQ ID NO: 5743201 - DNA, 20 bp, Homo sapiens
gagattatcagtagaaagag

SEQ ID NO: 5743202 - DNA, 13 bp, Homo sapiens
gagattattcctt

SEQ ID NO: 5743203 - DNA, 18 bp, Homo sapiens
gagattcaagacaagagc

SEQ ID NO: 5743204 - DNA, 22 bp, Homo sapiens
gagattcaagacaagagctgtt

SEQ ID NO: 5743205 - DNA, 14 bp, Homo sapiens
gagattcaatattg

SEQ ID NO: 5743206 - DNA, 21 bp, Homo sapiens
gagattcacatgctggctcct

SEQ ID NO: 5743207 - DNA, 19 bp, Homo sapiens
gagattccagaacgccctg

SEQ ID NO: 5743208 - DNA, 22 bp, Homo sapiens
gagattccagaacgccctgtgt

SEQ ID NO: 5743209 - DNA, 14 bp, Homo sapiens
gagattcccaagcc

SEQ ID NO: 5743210 - DNA, 23 bp, Homo sapiens
gagattctcataacttgagacct

SEQ ID NO: 5743211 - DNA, 16 bp, Homo sapiens
gagattctgggaaagg

SEQ ID NO: 5743212 - DNA, 20 bp, Homo sapiens
gagattctgggaaaggtgct

SEQ ID NO: 5743213 - DNA, 18 bp, Homo sapiens
gagattctgggtttgccc

SEQ ID NO: 5743214 - DNA, 21 bp, Homo sapiens
gagattcttagctcttgggat

SEQ ID NO: 5743215 - DNA, 14 bp, Homo sapiens
gagattgaatttca

SEQ ID NO: 5743216 - DNA, 18 bp, Homo sapiens
gagattgagaaggagaga

SEQ ID NO: 5743217 - DNA, 18 bp, Homo sapiens
gagattgcaccactgcac

SEQ ID NO: 5743218 - DNA, 13 bp, Homo sapiens
gagattgcactgc

SEQ ID NO: 5743219 - DNA, 14 bp, Homo sapiens
gagattgctctggg

SEQ ID NO: 5743220 - DNA, 19 bp, Homo sapiens
gagattggaaaaaattaga

SEQ ID NO: 5743221 - DNA, 16 bp, Homo sapiens
gagattggcatggctt

SEQ ID NO: 5743222 - DNA, 16 bp, Homo sapiens
gagattggccagcaaa

SEQ ID NO: 5743223 - DNA, 19 bp, Homo sapiens
gagattggccagtgagaag

SEQ ID NO: 5743224 - DNA, 19 bp, Homo sapiens
gagattgggggggcttggg

SEQ ID NO: 5743225 - DNA, 13 bp, Homo sapiens
gagattgtactgt

SEQ ID NO: 5743226 - DNA, 22 bp, Homo sapiens
gagattgtagtatttagtatat

SEQ ID NO: 5743227 - DNA, 14 bp, Homo sapiens
gagattgtggggag

SEQ ID NO: 5743228 - DNA, 18 bp, Homo sapiens
gagattgtggtggtgcta

SEQ ID NO: 5743229 - DNA, 20 bp, Homo sapiens
gagattgtggtggtgctaaa

SEQ ID NO: 5743230 - DNA, 17 bp, Homo sapiens
gagatttattaaagaaa

SEQ ID NO: 5743231 - DNA, 13 bp, Homo sapiens
gagatttcagtta

SEQ ID NO: 5743232 - DNA, 20 bp, Homo sapiens
gagatttcatctgctctcct

SEQ ID NO: 5743233 - DNA, 22 bp, Homo sapiens
gagatttcatctgctctccttc

SEQ ID NO: 5743234 - DNA, 16 bp, Homo sapiens
gagatttcccttcatt

SEQ ID NO: 5743235 - DNA, 16 bp, Homo sapiens
gagatttcctcctggc

SEQ ID NO: 5743236 - DNA, 16 bp, Homo sapiens
gagatttcttaaatct

SEQ ID NO: 5743237 - DNA, 19 bp, Homo sapiens
gagatttgccagcacaggg

SEQ ID NO: 5743238 - DNA, 20 bp, Homo sapiens
gagatttggggctaaagact

SEQ ID NO: 5743239 - DNA, 18 bp, Homo sapiens
gagattttattttttgtg

SEQ ID NO: 5743240 - DNA, 21 bp, Homo sapiens
gagattttcaacatttcaaaa

SEQ ID NO: 5743241 - DNA, 12 bp, Homo sapiens
gagattttctct

SEQ ID NO: 5743242 - DNA, 17 bp, Homo sapiens
gagatttttaagaactt

SEQ ID NO: 5743243 - DNA, 12 bp, Homo sapiens
gagatttttcat

SEQ ID NO: 5743244 - DNA, 20 bp, Homo sapiens
gagatttttcatacttttct

SEQ ID NO: 5743245 - DNA, 16 bp, Homo sapiens
gagatttttggttttt

SEQ ID NO: 5743246 - DNA, 20 bp, Homo sapiens
gagattttttagatcttcct

SEQ ID NO: 5743247 - DNA, 14 bp, Homo sapiens
gagcaaaaagtgta

SEQ ID NO: 5743248 - DNA, 17 bp, Homo sapiens
gagcaaaaatgccaggc

SEQ ID NO: 5743249 - DNA, 19 bp, Homo sapiens
gagcaaaaatgccaggcag

SEQ ID NO: 5743250 - DNA, 21 bp, Homo sapiens
gagcaaaaatgtaaaaaacaa

SEQ ID NO: 5743251 - DNA, 17 bp, Homo sapiens
gagcaaaacaaagctga

SEQ ID NO: 5743252 - DNA, 20 bp, Homo sapiens
gagcaaaactccgtctcaaa

SEQ ID NO: 5743253 - DNA, 23 bp, Homo sapiens
gagcaaaagacttgagccatcca

SEQ ID NO: 5743254 - DNA, 16 bp, Homo sapiens
gagcaaaaggcagctc

SEQ ID NO: 5743255 - DNA, 14 bp, Homo sapiens
gagcaaaataagga

SEQ ID NO: 5743256 - DNA, 19 bp, Homo sapiens
gagcaaaataaggaagagg

SEQ ID NO: 5743257 - DNA, 12 bp, Homo sapiens
gagcaaaataat

SEQ ID NO: 5743258 - DNA, 13 bp, Homo sapiens
gagcaaaataatg

SEQ ID NO: 5743259 - DNA, 22 bp, Homo sapiens
gagcaaaatatgccccttcttg

SEQ ID NO: 5743260 - DNA, 13 bp, Homo sapiens
gagcaaaatcaac

SEQ ID NO: 5743261 - DNA, 13 bp, Homo sapiens
gagcaaacagagg

SEQ ID NO: 5743262 - DNA, 15 bp, Homo sapiens
gagcaaacagaggag

SEQ ID NO: 5743263 - DNA, 14 bp, Homo sapiens
gagcaaacccagag

SEQ ID NO: 5743264 - DNA, 22 bp, Homo sapiens
gagcaaactgcatgcccagaga

SEQ ID NO: 5743265 - DNA, 12 bp, Homo sapiens
gagcaaacttta

SEQ ID NO: 5743266 - DNA, 13 bp, Homo sapiens
gagcaaagatcaa

SEQ ID NO: 5743267 - DNA, 14 bp, Homo sapiens
gagcaaagatcaaa

SEQ ID NO: 5743268 - DNA, 20 bp, Homo sapiens
gagcaaagatggcttccgtg

SEQ ID NO: 5743269 - DNA, 13 bp, Homo sapiens
gagcaaagcctgt

SEQ ID NO: 5743270 - DNA, 23 bp, Homo sapiens
gagcaaagcctgttcatggcaga

SEQ ID NO: 5743271 - DNA, 22 bp, Homo sapiens
gagcaaagcgcccacccaggtc

SEQ ID NO: 5743272 - DNA, 23 bp, Homo sapiens
gagcaaagcgcccacccaggtcc

SEQ ID NO: 5743273 - DNA, 13 bp, Homo sapiens
gagcaaagctgat

SEQ ID NO: 5743274 - DNA, 15 bp, Homo sapiens
gagcaaaggcccatg

SEQ ID NO: 5743275 - DNA, 18 bp, Homo sapiens
gagcaaaggcccatgccc

SEQ ID NO: 5743276 - DNA, 15 bp, Homo sapiens
gagcaaaggccctgg

SEQ ID NO: 5743277 - DNA, 16 bp, Homo sapiens
gagcaaagggtggtga

SEQ ID NO: 5743278 - DNA, 16 bp, Homo sapiens
gagcaaagtctaaagt

SEQ ID NO: 5743279 - DNA, 18 bp, Homo sapiens
gagcaaagtgcaggttat

SEQ ID NO: 5743280 - DNA, 18 bp, Homo sapiens
gagcaaatattaaaattg

SEQ ID NO: 5743281 - DNA, 18 bp, Homo sapiens
gagcaaatgcaaaaataa

SEQ ID NO: 5743282 - DNA, 21 bp, Homo sapiens
gagcaacaagtagagatgaag

SEQ ID NO: 5743283 - DNA, 20 bp, Homo sapiens
gagcaacagagtgagaccct

SEQ ID NO: 5743284 - DNA, 18 bp, Homo sapiens
gagcaacccctgtaccca

SEQ ID NO: 5743285 - DNA, 23 bp, Homo sapiens
gagcaacccctgtacccagctcc

SEQ ID NO: 5743286 - DNA, 17 bp, Homo sapiens
gagcaaccctctgaaga

SEQ ID NO: 5743287 - DNA, 20 bp, Homo sapiens
gagcaaccgtggcccttcct

SEQ ID NO: 5743288 - DNA, 21 bp, Homo sapiens
gagcaaccgtggcccttcctg

SEQ ID NO: 5743289 - DNA, 14 bp, Homo sapiens
gagcaacctactgt

SEQ ID NO: 5743290 - DNA, 20 bp, Homo sapiens
gagcaacctctcactcccca

SEQ ID NO: 5743291 - DNA, 21 bp, Homo sapiens
gagcaacctctcactccccat

SEQ ID NO: 5743292 - DNA, 19 bp, Homo sapiens
gagcaacctcttcagctgg

SEQ ID NO: 5743293 - DNA, 20 bp, Homo sapiens
gagcaacgaccagggccgag

SEQ ID NO: 5743294 - DNA, 19 bp, Homo sapiens
gagcaacggcccatagcct

SEQ ID NO: 5743295 - DNA, 13 bp, Homo sapiens
gagcaactgcgac

SEQ ID NO: 5743296 - DNA, 22 bp, Homo sapiens
gagcaactggactatagcaggg

SEQ ID NO: 5743297 - DNA, 19 bp, Homo sapiens
gagcaactgtgcagcaccc

SEQ ID NO: 5743298 - DNA, 15 bp, Homo sapiens
gagcaacttgagggt

SEQ ID NO: 5743299 - DNA, 18 bp, Homo sapiens
gagcaagaaaaaagtaca

SEQ ID NO: 5743300 - DNA, 16 bp, Homo sapiens
gagcaagaagaaaatg

SEQ ID NO: 5743301 - DNA, 22 bp, Homo sapiens
gagcaagacgctgtgctgccct

SEQ ID NO: 5743302 - DNA, 20 bp, Homo sapiens
gagcaagactccatttcaaa

SEQ ID NO: 5743303 - DNA, 22 bp, Homo sapiens
gagcaagaggggcatactattg

SEQ ID NO: 5743304 - DNA, 21 bp, Homo sapiens
gagcaagcaccaacctccaga

SEQ ID NO: 5743305 - DNA, 22 bp, Homo sapiens
gagcaagcaccaacctccagac

SEQ ID NO: 5743306 - DNA, 18 bp, Homo sapiens
gagcaagcaggaatcaga

SEQ ID NO: 5743307 - DNA, 14 bp, Homo sapiens
gagcaagccttcct

SEQ ID NO: 5743308 - DNA, 12 bp, Homo sapiens
gagcaagccttt

SEQ ID NO: 5743309 - DNA, 23 bp, Homo sapiens
gagcaagcctttgacctgttcag

SEQ ID NO: 5743310 - DNA, 13 bp, Homo sapiens
gagcaagctctgc

SEQ ID NO: 5743311 - DNA, 16 bp, Homo sapiens
gagcaagctctgccct

SEQ ID NO: 5743312 - DNA, 17 bp, Homo sapiens
gagcaagctctgccctg

SEQ ID NO: 5743313 - DNA, 18 bp, Homo sapiens
gagcaagctctgccctgg

SEQ ID NO: 5743314 - DNA, 22 bp, Homo sapiens
gagcaagctctgccctggctgt

SEQ ID NO: 5743315 - DNA, 21 bp, Homo sapiens
gagcaagctcttcccttgctc

SEQ ID NO: 5743316 - DNA, 23 bp, Homo sapiens
gagcaagctgtacaaagggaagc

SEQ ID NO: 5743317 - DNA, 21 bp, Homo sapiens
gagcaaggaaggtaaaaagtt

SEQ ID NO: 5743318 - DNA, 21 bp, Homo sapiens
gagcaaggacattgccccaag

SEQ ID NO: 5743319 - DNA, 21 bp, Homo sapiens
gagcaaggctgctaagtggaa

SEQ ID NO: 5743320 - DNA, 18 bp, Homo sapiens
gagcaagggcagggacag

SEQ ID NO: 5743321 - DNA, 20 bp, Homo sapiens
gagcaagtatccttcattgt

SEQ ID NO: 5743322 - DNA, 14 bp, Homo sapiens
gagcaagttgcagt

SEQ ID NO: 5743323 - DNA, 16 bp, Homo sapiens
gagcaataaagtggaa

SEQ ID NO: 5743324 - DNA, 18 bp, Homo sapiens
gagcaataacttctatgt

SEQ ID NO: 5743325 - DNA, 17 bp, Homo sapiens
gagcaataccctgtctt

SEQ ID NO: 5743326 - DNA, 16 bp, Homo sapiens
gagcaatatttatgga

SEQ ID NO: 5743327 - DNA, 13 bp, Homo sapiens
gagcaatcacagg

SEQ ID NO: 5743328 - DNA, 18 bp, Homo sapiens
gagcaatcacaggaaaat

SEQ ID NO: 5743329 - DNA, 12 bp, Homo sapiens
gagcaatgggac

SEQ ID NO: 5743330 - DNA, 18 bp, Homo sapiens
gagcaatgggactggagt

SEQ ID NO: 5743331 - DNA, 22 bp, Homo sapiens
gagcaatgggactggagtcaga

SEQ ID NO: 5743332 - DNA, 16 bp, Homo sapiens
gagcaatgtctgtgct

SEQ ID NO: 5743333 - DNA, 19 bp, Homo sapiens
gagcaatgttggtttttta

SEQ ID NO: 5743334 - DNA, 19 bp, Homo sapiens
gagcaatgtttttctcaaa

SEQ ID NO: 5743335 - DNA, 21 bp, Homo sapiens
gagcaatgtttttctcaaaaa

SEQ ID NO: 5743336 - DNA, 16 bp, Homo sapiens
gagcaattccaggctg

SEQ ID NO: 5743337 - DNA, 18 bp, Homo sapiens
gagcaattccaggctgag

SEQ ID NO: 5743338 - DNA, 20 bp, Homo sapiens
gagcaattccaggctgagcc

SEQ ID NO: 5743339 - DNA, 24 bp, Homo sapiens
gagcaattccaggctgagccatga

SEQ ID NO: 5743340 - DNA, 20 bp, Homo sapiens
gagcaatttacctggtacta

SEQ ID NO: 5743341 - DNA, 13 bp, Homo sapiens
gagcaatttgcac

SEQ ID NO: 5743342 - DNA, 14 bp, Homo sapiens
gagcacaaacattt

SEQ ID NO: 5743343 - DNA, 19 bp, Homo sapiens
gagcacaaagaagaaagct

SEQ ID NO: 5743344 - DNA, 20 bp, Homo sapiens
gagcacaaagaagaaagctg

SEQ ID NO: 5743345 - DNA, 20 bp, Homo sapiens
gagcacaaagaccctggctt

SEQ ID NO: 5743346 - DNA, 18 bp, Homo sapiens
gagcacaagttccagctg

SEQ ID NO: 5743347 - DNA, 23 bp, Homo sapiens
gagcacaagttccagctggtctt

SEQ ID NO: 5743348 - DNA, 22 bp, Homo sapiens
gagcacaataatttgttttcat

SEQ ID NO: 5743349 - DNA, 13 bp, Homo sapiens
gagcacaatctgt

SEQ ID NO: 5743350 - DNA, 16 bp, Homo sapiens
gagcacaatctgttct

SEQ ID NO: 5743351 - DNA, 22 bp, Homo sapiens
gagcacacccgtgtgcacactc

SEQ ID NO: 5743352 - DNA, 16 bp, Homo sapiens
gagcacacggccctgc

SEQ ID NO: 5743353 - DNA, 18 bp, Homo sapiens
gagcacacggccctgccc

SEQ ID NO: 5743354 - DNA, 20 bp, Homo sapiens
gagcacacggccctgcccca

SEQ ID NO: 5743355 - DNA, 22 bp, Homo sapiens
gagcacacggccctgccccatc

SEQ ID NO: 5743356 - DNA, 15 bp, Homo sapiens
gagcacactgtagca

SEQ ID NO: 5743357 - DNA, 18 bp, Homo sapiens
gagcacacttggcccaag

SEQ ID NO: 5743358 - DNA, 21 bp, Homo sapiens
gagcacagccaatctccaggc

SEQ ID NO: 5743359 - DNA, 18 bp, Homo sapiens
gagcacagccatagcaga

SEQ ID NO: 5743360 - DNA, 15 bp, Homo sapiens
gagcacagcccacgg

SEQ ID NO: 5743361 - DNA, 14 bp, Homo sapiens
gagcacagccctcc

SEQ ID NO: 5743362 - DNA, 18 bp, Homo sapiens
gagcacagccctcccgcc

SEQ ID NO: 5743363 - DNA, 18 bp, Homo sapiens
gagcacagcttcttctgc

SEQ ID NO: 5743364 - DNA, 20 bp, Homo sapiens
gagcacagctttcctgggtc

SEQ ID NO: 5743365 - DNA, 23 bp, Homo sapiens
gagcacaggtcccacctccagcc

SEQ ID NO: 5743366 - DNA, 13 bp, Homo sapiens
gagcacaggtgtc

SEQ ID NO: 5743367 - DNA, 20 bp, Homo sapiens
gagcacaggtgtctgcctag

SEQ ID NO: 5743368 - DNA, 19 bp, Homo sapiens
gagcacaggttagggcatg

SEQ ID NO: 5743369 - DNA, 16 bp, Homo sapiens
gagcacagtcaggggc

SEQ ID NO: 5743370 - DNA, 15 bp, Homo sapiens
gagcacatagccctg

SEQ ID NO: 5743371 - DNA, 16 bp, Homo sapiens
gagcacatagccctgt

SEQ ID NO: 5743372 - DNA, 18 bp, Homo sapiens
gagcacatagtgtcctgc

SEQ ID NO: 5743373 - DNA, 18 bp, Homo sapiens
gagcaccacggccagaag

SEQ ID NO: 5743374 - DNA, 17 bp, Homo sapiens
gagcaccacggggtcgg

SEQ ID NO: 5743375 - DNA, 21 bp, Homo sapiens
gagcaccagatgacacataaa

SEQ ID NO: 5743376 - DNA, 14 bp, Homo sapiens
gagcaccaggtgtt

SEQ ID NO: 5743377 - DNA, 22 bp, Homo sapiens
gagcacccagagcaccccctgc

SEQ ID NO: 5743378 - DNA, 16 bp, Homo sapiens
gagcacccattccaaa

SEQ ID NO: 5743379 - DNA, 19 bp, Homo sapiens
gagcacccattccaaagct

SEQ ID NO: 5743380 - DNA, 11 bp, Homo sapiens
gagcaccccca

SEQ ID NO: 5743381 - DNA, 13 bp, Homo sapiens
gagcacccccagc

SEQ ID NO: 5743382 - DNA, 12 bp, Homo sapiens
gagcaccccctc

SEQ ID NO: 5743383 - DNA, 17 bp, Homo sapiens
gagcaccccctcattcc

SEQ ID NO: 5743384 - DNA, 18 bp, Homo sapiens
gagcaccccctcattccc

SEQ ID NO: 5743385 - DNA, 15 bp, Homo sapiens
gagcaccccctgctc

SEQ ID NO: 5743386 - DNA, 20 bp, Homo sapiens
gagcaccccctgctccacca

SEQ ID NO: 5743387 - DNA, 17 bp, Homo sapiens
gagcaccgaatattgag

SEQ ID NO: 5743388 - DNA, 13 bp, Homo sapiens
gagcacctcacct

SEQ ID NO: 5743389 - DNA, 18 bp, Homo sapiens
gagcacctcaggaccctc

SEQ ID NO: 5743390 - DNA, 22 bp, Homo sapiens
gagcacctcaggaccctcccca

SEQ ID NO: 5743391 - DNA, 15 bp, Homo sapiens
gagcacctcccagcc

SEQ ID NO: 5743392 - DNA, 16 bp, Homo sapiens
gagcacctcccagccc

SEQ ID NO: 5743393 - DNA, 17 bp, Homo sapiens
gagcacctctcagagca

SEQ ID NO: 5743394 - DNA, 23 bp, Homo sapiens
gagcacctctcagagcaagcctt

SEQ ID NO: 5743395 - DNA, 16 bp, Homo sapiens
gagcacctgcaggcgt

SEQ ID NO: 5743396 - DNA, 23 bp, Homo sapiens
gagcacctgccagaggatgctct

SEQ ID NO: 5743397 - DNA, 20 bp, Homo sapiens
gagcacctggaccccctgcc

SEQ ID NO: 5743398 - DNA, 21 bp, Homo sapiens
gagcacctgggccccactgga

SEQ ID NO: 5743399 - DNA, 11 bp, Homo sapiens
gagcacctgtc

SEQ ID NO: 5743400 - DNA, 15 bp, Homo sapiens
gagcacctgtctgga

SEQ ID NO: 5743401 - DNA, 19 bp, Homo sapiens
gagcaccttagacagtccc

SEQ ID NO: 5743402 - DNA, 22 bp, Homo sapiens
gagcaccttagacagtccctgc

SEQ ID NO: 5743403 - DNA, 16 bp, Homo sapiens
gagcaccttcctcact

SEQ ID NO: 5743404 - DNA, 19 bp, Homo sapiens
gagcacgagctggaaccca

SEQ ID NO: 5743405 - DNA, 21 bp, Homo sapiens
gagcacggtcccccaggaggc

SEQ ID NO: 5743406 - DNA, 22 bp, Homo sapiens
gagcacgtggagatagtgccag

SEQ ID NO: 5743407 - DNA, 20 bp, Homo sapiens
gagcacgttggcgaggaaaa

SEQ ID NO: 5743408 - DNA, 15 bp, Homo sapiens
gagcactaaggtgtg

SEQ ID NO: 5743409 - DNA, 18 bp, Homo sapiens
gagcactagaatgagaaa

SEQ ID NO: 5743410 - DNA, 17 bp, Homo sapiens
gagcactattctaagga

SEQ ID NO: 5743411 - DNA, 15 bp, Homo sapiens
gagcactcccaagtc

SEQ ID NO: 5743412 - DNA, 19 bp, Homo sapiens
gagcactcctggtgcaggt

SEQ ID NO: 5743413 - DNA, 16 bp, Homo sapiens
gagcactctcacccca

SEQ ID NO: 5743414 - DNA, 21 bp, Homo sapiens
gagcactctcaccccaagcgg

SEQ ID NO: 5743415 - DNA, 24 bp, Homo sapiens
gagcactctcaccccaagcggcct

SEQ ID NO: 5743416 - DNA, 18 bp, Homo sapiens
gagcactctggggtggga

SEQ ID NO: 5743417 - DNA, 19 bp, Homo sapiens
gagcactctggggtgggag

SEQ ID NO: 5743418 - DNA, 14 bp, Homo sapiens
gagcactgatggaa

SEQ ID NO: 5743419 - DNA, 19 bp, Homo sapiens
gagcactgcacctgcctcc

SEQ ID NO: 5743420 - DNA, 13 bp, Homo sapiens
gagcactgccagg

SEQ ID NO: 5743421 - DNA, 14 bp, Homo sapiens
gagcactgccagga

SEQ ID NO: 5743422 - DNA, 17 bp, Homo sapiens
gagcactgccaggaggg

SEQ ID NO: 5743423 - DNA, 21 bp, Homo sapiens
gagcactgcctctatgccctg

SEQ ID NO: 5743424 - DNA, 13 bp, Homo sapiens
gagcactgctcca

SEQ ID NO: 5743425 - DNA, 19 bp, Homo sapiens
gagcactggactccggggc

SEQ ID NO: 5743426 - DNA, 15 bp, Homo sapiens
gagcactggccagag

SEQ ID NO: 5743427 - DNA, 18 bp, Homo sapiens
gagcactggccagagagg

SEQ ID NO: 5743428 - DNA, 22 bp, Homo sapiens
gagcactggccagagagggccc

SEQ ID NO: 5743429 - DNA, 23 bp, Homo sapiens
gagcactggggtgggggtggaat

SEQ ID NO: 5743430 - DNA, 17 bp, Homo sapiens
gagcactgggttgactt

SEQ ID NO: 5743431 - DNA, 19 bp, Homo sapiens
gagcacttaagagaatatt

SEQ ID NO: 5743432 - DNA, 18 bp, Homo sapiens
gagcacttcacacagaca

SEQ ID NO: 5743433 - DNA, 19 bp, Homo sapiens
gagcacttgcgtcctgcag

SEQ ID NO: 5743434 - DNA, 17 bp, Homo sapiens
gagcactttaaaaacag

SEQ ID NO: 5743435 - DNA, 20 bp, Homo sapiens
gagcactttaaaaacaggcc

SEQ ID NO: 5743436 - DNA, 21 bp, Homo sapiens
gagcactttaaaaacaggcca

SEQ ID NO: 5743437 - DNA, 16 bp, Homo sapiens
gagcacttttaacaaa

SEQ ID NO: 5743438 - DNA, 22 bp, Homo sapiens
gagcagaaaacccttgggccag

SEQ ID NO: 5743439 - DNA, 15 bp, Homo sapiens
gagcagaaacagcca

SEQ ID NO: 5743440 - DNA, 17 bp, Homo sapiens
gagcagaaagattaaat

SEQ ID NO: 5743441 - DNA, 17 bp, Homo sapiens
gagcagaaagccagggt

SEQ ID NO: 5743442 - DNA, 20 bp, Homo sapiens
gagcagaaataaaaagcatg

SEQ ID NO: 5743443 - DNA, 12 bp, Homo sapiens
gagcagaacagg

SEQ ID NO: 5743444 - DNA, 23 bp, Homo sapiens
gagcagaacggagccccaggcct

SEQ ID NO: 5743445 - DNA, 21 bp, Homo sapiens
gagcagaatgttgtacttgaa

SEQ ID NO: 5743446 - DNA, 12 bp, Homo sapiens
gagcagacagag

SEQ ID NO: 5743447 - DNA, 15 bp, Homo sapiens
gagcagacagagaaa

SEQ ID NO: 5743448 - DNA, 21 bp, Homo sapiens
gagcagacaggaggaatcatg

SEQ ID NO: 5743449 - DNA, 17 bp, Homo sapiens
gagcagacaggctacaa

SEQ ID NO: 5743450 - DNA, 18 bp, Homo sapiens
gagcagactggtgagcag

SEQ ID NO: 5743451 - DNA, 23 bp, Homo sapiens
gagcagactggtgagcagactgg

SEQ ID NO: 5743452 - DNA, 15 bp, Homo sapiens
gagcagactggtggg

SEQ ID NO: 5743453 - DNA, 13 bp, Homo sapiens
gagcagagacact

SEQ ID NO: 5743454 - DNA, 24 bp, Homo sapiens
gagcagagacatgactcagcctgt

SEQ ID NO: 5743455 - DNA, 23 bp, Homo sapiens
gagcagagaccatccctgaaggc

SEQ ID NO: 5743456 - DNA, 18 bp, Homo sapiens
gagcagagacggcagccc

SEQ ID NO: 5743457 - DNA, 19 bp, Homo sapiens
gagcagagacggcagcccc

SEQ ID NO: 5743458 - DNA, 12 bp, Homo sapiens
gagcagagagct

SEQ ID NO: 5743459 - DNA, 23 bp, Homo sapiens
gagcagagaggtggatcctgtag

SEQ ID NO: 5743460 - DNA, 19 bp, Homo sapiens
gagcagagcccccatggcc

SEQ ID NO: 5743461 - DNA, 18 bp, Homo sapiens
gagcagagcgcagccccc

SEQ ID NO: 5743462 - DNA, 13 bp, Homo sapiens
gagcagagctctc

SEQ ID NO: 5743463 - DNA, 19 bp, Homo sapiens
gagcagaggaattatgaac

SEQ ID NO: 5743464 - DNA, 19 bp, Homo sapiens
gagcagaggagtccagggc

SEQ ID NO: 5743465 - DNA, 13 bp, Homo sapiens
gagcagaggcagc

SEQ ID NO: 5743466 - DNA, 15 bp, Homo sapiens
gagcagagggcaggg

SEQ ID NO: 5743467 - DNA, 17 bp, Homo sapiens
gagcagagggcaggggt

SEQ ID NO: 5743468 - DNA, 15 bp, Homo sapiens
gagcagaggggctga

SEQ ID NO: 5743469 - DNA, 16 bp, Homo sapiens
gagcagaggggctgaa

SEQ ID NO: 5743470 - DNA, 20 bp, Homo sapiens
gagcagagtataggatggat

SEQ ID NO: 5743471 - DNA, 14 bp, Homo sapiens
gagcagagtctggg

SEQ ID NO: 5743472 - DNA, 19 bp, Homo sapiens
gagcagagtctgggcctct

SEQ ID NO: 5743473 - DNA, 15 bp, Homo sapiens
gagcagatcttggaa

SEQ ID NO: 5743474 - DNA, 16 bp, Homo sapiens
gagcagatgcagagag

SEQ ID NO: 5743475 - DNA, 17 bp, Homo sapiens
gagcagatgccattttg

SEQ ID NO: 5743476 - DNA, 20 bp, Homo sapiens
gagcagcaagaagcagcctg

SEQ ID NO: 5743477 - DNA, 17 bp, Homo sapiens
gagcagcacccatccac

SEQ ID NO: 5743478 - DNA, 11 bp, Homo sapiens
gagcagcacct

SEQ ID NO: 5743479 - DNA, 21 bp, Homo sapiens
gagcagcagcaccaaccacag

SEQ ID NO: 5743480 - DNA, 13 bp, Homo sapiens
gagcagcagccag

SEQ ID NO: 5743481 - DNA, 23 bp, Homo sapiens
gagcagcagcgctcggcccggag

SEQ ID NO: 5743482 - DNA, 15 bp, Homo sapiens
gagcagcagctgagg

SEQ ID NO: 5743483 - DNA, 23 bp, Homo sapiens
gagcagcagctgaggccccaggg

SEQ ID NO: 5743484 - DNA, 17 bp, Homo sapiens
gagcagcagcttgggga

SEQ ID NO: 5743485 - DNA, 11 bp, Homo sapiens
gagcagcaggc

SEQ ID NO: 5743486 - DNA, 16 bp, Homo sapiens
gagcagcaggcctctg

SEQ ID NO: 5743487 - DNA, 12 bp, Homo sapiens
gagcagcaggtg

SEQ ID NO: 5743488 - DNA, 16 bp, Homo sapiens
gagcagcagtgaaaac

SEQ ID NO: 5743489 - DNA, 18 bp, Homo sapiens
gagcagcatctagtttcc

SEQ ID NO: 5743490 - DNA, 20 bp, Homo sapiens
gagcagccaccccatgctgg

SEQ ID NO: 5743491 - DNA, 13 bp, Homo sapiens
gagcagccaggac

SEQ ID NO: 5743492 - DNA, 16 bp, Homo sapiens
gagcagccaggacccg

SEQ ID NO: 5743493 - DNA, 14 bp, Homo sapiens
gagcagccaggaga

SEQ ID NO: 5743494 - DNA, 16 bp, Homo sapiens
gagcagcccacccagc

SEQ ID NO: 5743495 - DNA, 18 bp, Homo sapiens
gagcagcccacccagcag

SEQ ID NO: 5743496 - DNA, 18 bp, Homo sapiens
gagcagcccacctgctgc

SEQ ID NO: 5743497 - DNA, 15 bp, Homo sapiens
gagcagcccccaaag

SEQ ID NO: 5743498 - DNA, 19 bp, Homo sapiens
gagcagcccccgggccgct

SEQ ID NO: 5743499 - DNA, 23 bp, Homo sapiens
gagcagcccccgggccgctggct

SEQ ID NO: 5743500 - DNA, 24 bp, Homo sapiens
gagcagccctggcccccatcagcc

SEQ ID NO: 5743501 - DNA, 17 bp, Homo sapiens
gagcagcctcagaacaa

SEQ ID NO: 5743502 - DNA, 16 bp, Homo sapiens
gagcagcctccactgt

SEQ ID NO: 5743503 - DNA, 19 bp, Homo sapiens
gagcagcctccagtgctgg

SEQ ID NO: 5743504 - DNA, 14 bp, Homo sapiens
gagcagcctcgtgg

SEQ ID NO: 5743505 - DNA, 15 bp, Homo sapiens
gagcagcctcgtgga

SEQ ID NO: 5743506 - DNA, 15 bp, Homo sapiens
gagcagcctctgcca

SEQ ID NO: 5743507 - DNA, 16 bp, Homo sapiens
gagcagcctctgccag

SEQ ID NO: 5743508 - DNA, 18 bp, Homo sapiens
gagcagcctctgccaggc

SEQ ID NO: 5743509 - DNA, 19 bp, Homo sapiens
gagcagcctctgccaggcc

SEQ ID NO: 5743510 - DNA, 14 bp, Homo sapiens
gagcagcctctgga

SEQ ID NO: 5743511 - DNA, 17 bp, Homo sapiens
gagcagcctctgtcctg

SEQ ID NO: 5743512 - DNA, 15 bp, Homo sapiens
gagcagcctgatggc

SEQ ID NO: 5743513 - DNA, 11 bp, Homo sapiens
gagcagcctgg

SEQ ID NO: 5743514 - DNA, 15 bp, Homo sapiens
gagcagcctggagcc

SEQ ID NO: 5743515 - DNA, 21 bp, Homo sapiens
gagcagcctggagccctggag

SEQ ID NO: 5743516 - DNA, 13 bp, Homo sapiens
gagcagcctggcc

SEQ ID NO: 5743517 - DNA, 14 bp, Homo sapiens
gagcagcctggcca

SEQ ID NO: 5743518 - DNA, 13 bp, Homo sapiens
gagcagcctgtgg

SEQ ID NO: 5743519 - DNA, 14 bp, Homo sapiens
gagcagcctgtggc

SEQ ID NO: 5743520 - DNA, 18 bp, Homo sapiens
gagcagcctgtggcatct

SEQ ID NO: 5743521 - DNA, 17 bp, Homo sapiens
gagcagcgcccaggcct

SEQ ID NO: 5743522 - DNA, 18 bp, Homo sapiens
gagcagcgcccaggcctg

SEQ ID NO: 5743523 - DNA, 23 bp, Homo sapiens
gagcagcggattgctctggagca

SEQ ID NO: 5743524 - DNA, 18 bp, Homo sapiens
gagcagcggtttggggag

SEQ ID NO: 5743525 - DNA, 16 bp, Homo sapiens
gagcagcgtgcaggag

SEQ ID NO: 5743526 - DNA, 18 bp, Homo sapiens
gagcagcgtgcaggagca

SEQ ID NO: 5743527 - DNA, 19 bp, Homo sapiens
gagcagcgtgcaggagcaa

SEQ ID NO: 5743528 - DNA, 22 bp, Homo sapiens
gagcagctaactccgagagcag

SEQ ID NO: 5743529 - DNA, 21 bp, Homo sapiens
gagcagctactgtaacttttt

SEQ ID NO: 5743530 - DNA, 12 bp, Homo sapiens
gagcagctagct

SEQ ID NO: 5743531 - DNA, 16 bp, Homo sapiens
gagcagctagtggtgg

SEQ ID NO: 5743532 - DNA, 17 bp, Homo sapiens
gagcagctccaccactg

SEQ ID NO: 5743533 - DNA, 18 bp, Homo sapiens
gagcagctccaccactgt

SEQ ID NO: 5743534 - DNA, 20 bp, Homo sapiens
gagcagctccaccactgtgc

SEQ ID NO: 5743535 - DNA, 12 bp, Homo sapiens
gagcagctcccc

SEQ ID NO: 5743536 - DNA, 13 bp, Homo sapiens
gagcagctcccca

SEQ ID NO: 5743537 - DNA, 16 bp, Homo sapiens
gagcagctccccagga

SEQ ID NO: 5743538 - DNA, 12 bp, Homo sapiens
gagcagctccct

SEQ ID NO: 5743539 - DNA, 18 bp, Homo sapiens
gagcagctccctttctca

SEQ ID NO: 5743540 - DNA, 20 bp, Homo sapiens
gagcagctccctttctcagg

SEQ ID NO: 5743541 - DNA, 22 bp, Homo sapiens
gagcagctgaataacctgcaca

SEQ ID NO: 5743542 - DNA, 19 bp, Homo sapiens
gagcagctgagcagggccg

SEQ ID NO: 5743543 - DNA, 20 bp, Homo sapiens
gagcagctggcactgacagc

SEQ ID NO: 5743544 - DNA, 22 bp, Homo sapiens
gagcagctggcactgacagcct

SEQ ID NO: 5743545 - DNA, 16 bp, Homo sapiens
gagcagctggctctcc

SEQ ID NO: 5743546 - DNA, 18 bp, Homo sapiens
gagcagctgggaactgac

SEQ ID NO: 5743547 - DNA, 16 bp, Homo sapiens
gagcagctggggtagg

SEQ ID NO: 5743548 - DNA, 16 bp, Homo sapiens
gagcagcttccttctg

SEQ ID NO: 5743549 - DNA, 19 bp, Homo sapiens
gagcagcttccttctggga

SEQ ID NO: 5743550 - DNA, 17 bp, Homo sapiens
gagcagcttctgccact

SEQ ID NO: 5743551 - DNA, 20 bp, Homo sapiens
gagcagcttctgccacttcc

SEQ ID NO: 5743552 - DNA, 21 bp, Homo sapiens
gagcagcttctgccacttccc

SEQ ID NO: 5743553 - DNA, 17 bp, Homo sapiens
gagcagctttgggatcc

SEQ ID NO: 5743554 - DNA, 17 bp, Homo sapiens
gagcaggaacagagact

SEQ ID NO: 5743555 - DNA, 19 bp, Homo sapiens
gagcaggaacagagactct

SEQ ID NO: 5743556 - DNA, 19 bp, Homo sapiens
gagcaggaaggacaggaag

SEQ ID NO: 5743557 - DNA, 18 bp, Homo sapiens
gagcaggaaggcctgggt

SEQ ID NO: 5743558 - DNA, 14 bp, Homo sapiens
gagcaggaatggga

SEQ ID NO: 5743559 - DNA, 17 bp, Homo sapiens
gagcaggacagccagca

SEQ ID NO: 5743560 - DNA, 18 bp, Homo sapiens
gagcaggacagccagcag

SEQ ID NO: 5743561 - DNA, 23 bp, Homo sapiens
gagcaggacagccagcagcagga

SEQ ID NO: 5743562 - DNA, 12 bp, Homo sapiens
gagcaggacctc

SEQ ID NO: 5743563 - DNA, 20 bp, Homo sapiens
gagcaggacctcccttccga

SEQ ID NO: 5743564 - DNA, 20 bp, Homo sapiens
gagcaggactgatgtctcct

SEQ ID NO: 5743565 - DNA, 20 bp, Homo sapiens
gagcaggagattgagaagga

SEQ ID NO: 5743566 - DNA, 17 bp, Homo sapiens
gagcaggagcccctggg

SEQ ID NO: 5743567 - DNA, 15 bp, Homo sapiens
gagcaggagcttggg

SEQ ID NO: 5743568 - DNA, 23 bp, Homo sapiens
gagcaggaggccaataaaaagtt

SEQ ID NO: 5743569 - DNA, 15 bp, Homo sapiens
gagcaggatagctct

SEQ ID NO: 5743570 - DNA, 21 bp, Homo sapiens
gagcaggcaaaaaagggacag

SEQ ID NO: 5743571 - DNA, 22 bp, Homo sapiens
gagcaggcacgggtggtccccg

SEQ ID NO: 5743572 - DNA, 11 bp, Homo sapiens
gagcaggcagc

SEQ ID NO: 5743573 - DNA, 15 bp, Homo sapiens
gagcaggcagggctg

SEQ ID NO: 5743574 - DNA, 20 bp, Homo sapiens
gagcaggcagggctgggcca

SEQ ID NO: 5743575 - DNA, 13 bp, Homo sapiens
gagcaggcagggg

SEQ ID NO: 5743576 - DNA, 23 bp, Homo sapiens
gagcaggcaggggcatctgtctg

SEQ ID NO: 5743577 - DNA, 11 bp, Homo sapiens
gagcaggcagt

SEQ ID NO: 5743578 - DNA, 16 bp, Homo sapiens
gagcaggccagcccgg

SEQ ID NO: 5743579 - DNA, 19 bp, Homo sapiens
gagcaggcccaatgctgct

SEQ ID NO: 5743580 - DNA, 17 bp, Homo sapiens
gagcaggcccgacagag

SEQ ID NO: 5743581 - DNA, 23 bp, Homo sapiens
gagcaggccctgggcctccacct

SEQ ID NO: 5743582 - DNA, 15 bp, Homo sapiens
gagcaggctcagact

SEQ ID NO: 5743583 - DNA, 18 bp, Homo sapiens
gagcaggctcagactctg

SEQ ID NO: 5743584 - DNA, 16 bp, Homo sapiens
gagcaggctgtggggt

SEQ ID NO: 5743585 - DNA, 17 bp, Homo sapiens
gagcaggctttgggaac

SEQ ID NO: 5743586 - DNA, 18 bp, Homo sapiens
gagcaggctttgtgagag

SEQ ID NO: 5743587 - DNA, 19 bp, Homo sapiens
gagcagggagagctcacca

SEQ ID NO: 5743588 - DNA, 17 bp, Homo sapiens
gagcagggatctgcccc

SEQ ID NO: 5743589 - DNA, 21 bp, Homo sapiens
gagcagggccaaagcacagct

SEQ ID NO: 5743590 - DNA, 15 bp, Homo sapiens
gagcagggccgggga

SEQ ID NO: 5743591 - DNA, 16 bp, Homo sapiens
gagcagggccggggaa

SEQ ID NO: 5743592 - DNA, 21 bp, Homo sapiens
gagcagggcggctgccgactc

SEQ ID NO: 5743593 - DNA, 20 bp, Homo sapiens
gagcaggggaagcaggaccc

SEQ ID NO: 5743594 - DNA, 14 bp, Homo sapiens
gagcaggggagctt

SEQ ID NO: 5743595 - DNA, 16 bp, Homo sapiens
gagcaggggagcttgg

SEQ ID NO: 5743596 - DNA, 18 bp, Homo sapiens
gagcaggggagcttggga

SEQ ID NO: 5743597 - DNA, 14 bp, Homo sapiens
gagcaggggcaggc

SEQ ID NO: 5743598 - DNA, 16 bp, Homo sapiens
gagcaggggcagggtg

SEQ ID NO: 5743599 - DNA, 13 bp, Homo sapiens
gagcaggggctcc

SEQ ID NO: 5743600 - DNA, 19 bp, Homo sapiens
gagcaggggctgctggggg

SEQ ID NO: 5743601 - DNA, 20 bp, Homo sapiens
gagcaggggctgctgggggc

SEQ ID NO: 5743602 - DNA, 22 bp, Homo sapiens
gagcagggggacctaggctcct

SEQ ID NO: 5743603 - DNA, 16 bp, Homo sapiens
gagcaggggtctgagc

SEQ ID NO: 5743604 - DNA, 17 bp, Homo sapiens
gagcagggtcaagcctc

SEQ ID NO: 5743605 - DNA, 17 bp, Homo sapiens
gagcagggtcagtggaa

SEQ ID NO: 5743606 - DNA, 22 bp, Homo sapiens
gagcagggtccacagctggaaa

SEQ ID NO: 5743607 - DNA, 13 bp, Homo sapiens
gagcagggtcctg

SEQ ID NO: 5743608 - DNA, 15 bp, Homo sapiens
gagcaggtctctggc

SEQ ID NO: 5743609 - DNA, 18 bp, Homo sapiens
gagcaggtctgcaggcca

SEQ ID NO: 5743610 - DNA, 16 bp, Homo sapiens
gagcaggtgactgtgc

SEQ ID NO: 5743611 - DNA, 18 bp, Homo sapiens
gagcaggtgcccccaggt

SEQ ID NO: 5743612 - DNA, 20 bp, Homo sapiens
gagcaggtgcccccaggtga

SEQ ID NO: 5743613 - DNA, 18 bp, Homo sapiens
gagcaggttactaaggaa

SEQ ID NO: 5743614 - DNA, 23 bp, Homo sapiens
gagcagtaactgtccctgctttc

SEQ ID NO: 5743615 - DNA, 16 bp, Homo sapiens
gagcagtatcatgaag

SEQ ID NO: 5743616 - DNA, 17 bp, Homo sapiens
gagcagtatcatgaagc

SEQ ID NO: 5743617 - DNA, 14 bp, Homo sapiens
gagcagtcacactg

SEQ ID NO: 5743618 - DNA, 16 bp, Homo sapiens
gagcagtccatgcatg

SEQ ID NO: 5743619 - DNA, 18 bp, Homo sapiens
gagcagtccatgcatgac

SEQ ID NO: 5743620 - DNA, 13 bp, Homo sapiens
gagcagtccctgc

SEQ ID NO: 5743621 - DNA, 20 bp, Homo sapiens
gagcagtcctgcctcagcct

SEQ ID NO: 5743622 - DNA, 13 bp, Homo sapiens
gagcagtccttgg

SEQ ID NO: 5743623 - DNA, 14 bp, Homo sapiens
gagcagtccttggc

SEQ ID NO: 5743624 - DNA, 22 bp, Homo sapiens
gagcagtccttggcctgctaag

SEQ ID NO: 5743625 - DNA, 23 bp, Homo sapiens
gagcagtccttggcctgctaagg

SEQ ID NO: 5743626 - DNA, 15 bp, Homo sapiens
gagcagtcgcctgcc

SEQ ID NO: 5743627 - DNA, 21 bp, Homo sapiens
gagcagtcgcctgcctgcagc

SEQ ID NO: 5743628 - DNA, 19 bp, Homo sapiens
gagcagtctacttctgtgt

SEQ ID NO: 5743629 - DNA, 19 bp, Homo sapiens
gagcagtgagcactgaaac

SEQ ID NO: 5743630 - DNA, 15 bp, Homo sapiens
gagcagtgagcagaa

SEQ ID NO: 5743631 - DNA, 23 bp, Homo sapiens
gagcagtgcttttggcggggagg

SEQ ID NO: 5743632 - DNA, 22 bp, Homo sapiens
gagcagtggccgcaagcgcagg

SEQ ID NO: 5743633 - DNA, 20 bp, Homo sapiens
gagcagtggccgggctgggg

SEQ ID NO: 5743634 - DNA, 21 bp, Homo sapiens
gagcagtggccgggctgggga

SEQ ID NO: 5743635 - DNA, 23 bp, Homo sapiens
gagcagtggctggtccagggcta

SEQ ID NO: 5743636 - DNA, 21 bp, Homo sapiens
gagcagtgggagggtaccagc

SEQ ID NO: 5743637 - DNA, 17 bp, Homo sapiens
gagcagtgggcaggtgg

SEQ ID NO: 5743638 - DNA, 20 bp, Homo sapiens
gagcagtgggccctggctct

SEQ ID NO: 5743639 - DNA, 24 bp, Homo sapiens
gagcagtgggccctggctctgtca

SEQ ID NO: 5743640 - DNA, 11 bp, Homo sapiens
gagcagtgggg

SEQ ID NO: 5743641 - DNA, 23 bp, Homo sapiens
gagcagtgtcctgtgctttctgc

SEQ ID NO: 5743642 - DNA, 12 bp, Homo sapiens
gagcagtgtctt

SEQ ID NO: 5743643 - DNA, 15 bp, Homo sapiens
gagcagttagaaata

SEQ ID NO: 5743644 - DNA, 21 bp, Homo sapiens
gagcagttggccaagcagaaa

SEQ ID NO: 5743645 - DNA, 19 bp, Homo sapiens
gagcagtttcatctggttg

SEQ ID NO: 5743646 - DNA, 16 bp, Homo sapiens
gagcataaaacctaaa

SEQ ID NO: 5743647 - DNA, 19 bp, Homo sapiens
gagcataatggtaaatctt

SEQ ID NO: 5743648 - DNA, 12 bp, Homo sapiens
gagcataattta

SEQ ID NO: 5743649 - DNA, 17 bp, Homo sapiens
gagcatagaagccacat

SEQ ID NO: 5743650 - DNA, 18 bp, Homo sapiens
gagcatagcagaggggcc

SEQ ID NO: 5743651 - DNA, 20 bp, Homo sapiens
gagcatagcagaggggccag

SEQ ID NO: 5743652 - DNA, 22 bp, Homo sapiens
gagcatagtccaaaaagctcct

SEQ ID NO: 5743653 - DNA, 21 bp, Homo sapiens
gagcatataaggctaaatgta

SEQ ID NO: 5743654 - DNA, 19 bp, Homo sapiens
gagcatatctggtatatgt

SEQ ID NO: 5743655 - DNA, 19 bp, Homo sapiens
gagcatatgttccatgcct

SEQ ID NO: 5743656 - DNA, 23 bp, Homo sapiens
gagcatattttcttacttttatt

SEQ ID NO: 5743657 - DNA, 14 bp, Homo sapiens
gagcatcaagaatt

SEQ ID NO: 5743658 - DNA, 18 bp, Homo sapiens
gagcatcagagaaggcca

SEQ ID NO: 5743659 - DNA, 14 bp, Homo sapiens
gagcatcagagggc

SEQ ID NO: 5743660 - DNA, 14 bp, Homo sapiens
gagcatcaggccag

SEQ ID NO: 5743661 - DNA, 20 bp, Homo sapiens
gagcatcaggccaggccctc

SEQ ID NO: 5743662 - DNA, 22 bp, Homo sapiens
gagcatcaggctaagaccctgt

SEQ ID NO: 5743663 - DNA, 18 bp, Homo sapiens
gagcatcatgcctctgag

SEQ ID NO: 5743664 - DNA, 23 bp, Homo sapiens
gagcatcatgcctctgaggccag

SEQ ID NO: 5743665 - DNA, 24 bp, Homo sapiens
gagcatcatgcctctgaggccagc

SEQ ID NO: 5743666 - DNA, 17 bp, Homo sapiens
gagcatccacctccttc

SEQ ID NO: 5743667 - DNA, 14 bp, Homo sapiens
gagcatccagacct

SEQ ID NO: 5743668 - DNA, 18 bp, Homo sapiens
gagcatccgtctcccctc

SEQ ID NO: 5743669 - DNA, 11 bp, Homo sapiens
gagcatcctga

SEQ ID NO: 5743670 - DNA, 16 bp, Homo sapiens
gagcatcctgagcccc

SEQ ID NO: 5743671 - DNA, 19 bp, Homo sapiens
gagcatcctgctgcttagg

SEQ ID NO: 5743672 - DNA, 20 bp, Homo sapiens
gagcatcggcctagggcccc

SEQ ID NO: 5743673 - DNA, 13 bp, Homo sapiens
gagcatctcagga

SEQ ID NO: 5743674 - DNA, 20 bp, Homo sapiens
gagcatctcttgaggccagg

SEQ ID NO: 5743675 - DNA, 22 bp, Homo sapiens
gagcatctcttgaggccaggag

SEQ ID NO: 5743676 - DNA, 18 bp, Homo sapiens
gagcatctgcaacaaaaa

SEQ ID NO: 5743677 - DNA, 14 bp, Homo sapiens
gagcatctgcccca

SEQ ID NO: 5743678 - DNA, 13 bp, Homo sapiens
gagcatgcctgga

SEQ ID NO: 5743679 - DNA, 22 bp, Homo sapiens
gagcatgcctggatggggctgc

SEQ ID NO: 5743680 - DNA, 22 bp, Homo sapiens
gagcatgctccctcatgcagat

SEQ ID NO: 5743681 - DNA, 20 bp, Homo sapiens
gagcatgcttaccttctgct

SEQ ID NO: 5743682 - DNA, 20 bp, Homo sapiens
gagcatgcttccctgcagct

SEQ ID NO: 5743683 - DNA, 21 bp, Homo sapiens
gagcatgcttccctgcagctg

SEQ ID NO: 5743684 - DNA, 18 bp, Homo sapiens
gagcatggaacacttcga

SEQ ID NO: 5743685 - DNA, 12 bp, Homo sapiens
gagcatggatgc

SEQ ID NO: 5743686 - DNA, 19 bp, Homo sapiens
gagcatggatgcatttcaa

SEQ ID NO: 5743687 - DNA, 22 bp, Homo sapiens
gagcatggccgcaacttcccag

SEQ ID NO: 5743688 - DNA, 14 bp, Homo sapiens
gagcatggctgtga

SEQ ID NO: 5743689 - DNA, 21 bp, Homo sapiens
gagcatggggataaaggagaa

SEQ ID NO: 5743690 - DNA, 14 bp, Homo sapiens
gagcatggggcgct

SEQ ID NO: 5743691 - DNA, 20 bp, Homo sapiens
gagcatggggcgctcccact

SEQ ID NO: 5743692 - DNA, 14 bp, Homo sapiens
gagcatgtgagggg

SEQ ID NO: 5743693 - DNA, 13 bp, Homo sapiens
gagcatgtggagc

SEQ ID NO: 5743694 - DNA, 17 bp, Homo sapiens
gagcatgttttgtatac

SEQ ID NO: 5743695 - DNA, 17 bp, Homo sapiens
gagcattaaaataacta

SEQ ID NO: 5743696 - DNA, 14 bp, Homo sapiens
gagcattacaggca

SEQ ID NO: 5743697 - DNA, 15 bp, Homo sapiens
gagcattacaggcaa

SEQ ID NO: 5743698 - DNA, 16 bp, Homo sapiens
gagcattacaggcaag

SEQ ID NO: 5743699 - DNA, 17 bp, Homo sapiens
gagcattacgtgagcca

SEQ ID NO: 5743700 - DNA, 21 bp, Homo sapiens
gagcattacgtgagccaggta

SEQ ID NO: 5743701 - DNA, 15 bp, Homo sapiens
gagcattagatttct

SEQ ID NO: 5743702 - DNA, 21 bp, Homo sapiens
gagcattagatttctcatttg

SEQ ID NO: 5743703 - DNA, 22 bp, Homo sapiens
gagcattataatcaccagggcc

SEQ ID NO: 5743704 - DNA, 18 bp, Homo sapiens
gagcattctggggtgggg

SEQ ID NO: 5743705 - DNA, 13 bp, Homo sapiens
gagcattgcagcc

SEQ ID NO: 5743706 - DNA, 14 bp, Homo sapiens
gagcattgcagcct

SEQ ID NO: 5743707 - DNA, 16 bp, Homo sapiens
gagcattgcagcctaa

SEQ ID NO: 5743708 - DNA, 23 bp, Homo sapiens
gagcattgcttttgtttcttaag

SEQ ID NO: 5743709 - DNA, 21 bp, Homo sapiens
gagcattggggatgtttttct

SEQ ID NO: 5743710 - DNA, 22 bp, Homo sapiens
gagcatttaatggcagctagtg

SEQ ID NO: 5743711 - DNA, 20 bp, Homo sapiens
gagcatttatgtagacattg

SEQ ID NO: 5743712 - DNA, 21 bp, Homo sapiens
gagcatttatgtagacattgt

SEQ ID NO: 5743713 - DNA, 12 bp, Homo sapiens
gagcatttgcac

SEQ ID NO: 5743714 - DNA, 16 bp, Homo sapiens
gagcattttgtgtctt

SEQ ID NO: 5743715 - DNA, 13 bp, Homo sapiens
gagcatttttcag

SEQ ID NO: 5743716 - DNA, 22 bp, Homo sapiens
gagccaaaatggttaatttttc

SEQ ID NO: 5743717 - DNA, 19 bp, Homo sapiens
gagccaaacacactgtaaa

SEQ ID NO: 5743718 - DNA, 16 bp, Homo sapiens
gagccaaagccagagt

SEQ ID NO: 5743719 - DNA, 20 bp, Homo sapiens
gagccaaaggcatccaggcc

SEQ ID NO: 5743720 - DNA, 21 bp, Homo sapiens
gagccaaatgaccgagccctg

SEQ ID NO: 5743721 - DNA, 22 bp, Homo sapiens
gagccaaatgaccgagccctgg

SEQ ID NO: 5743722 - DNA, 23 bp, Homo sapiens
gagccaaatgaccgagccctgga

SEQ ID NO: 5743723 - DNA, 14 bp, Homo sapiens
gagccaacagcagc

SEQ ID NO: 5743724 - DNA, 21 bp, Homo sapiens
gagccaacctggacttcctgt

SEQ ID NO: 5743725 - DNA, 22 bp, Homo sapiens
gagccaagacggaggaggggaa

SEQ ID NO: 5743726 - DNA, 16 bp, Homo sapiens
gagccaagcactgctc

SEQ ID NO: 5743727 - DNA, 22 bp, Homo sapiens
gagccaagccttaaactgtaca

SEQ ID NO: 5743728 - DNA, 13 bp, Homo sapiens
gagccaagctgca

SEQ ID NO: 5743729 - DNA, 14 bp, Homo sapiens
gagccaagctgcac

SEQ ID NO: 5743730 - DNA, 18 bp, Homo sapiens
gagccaagcttcaaccct

SEQ ID NO: 5743731 - DNA, 23 bp, Homo sapiens
gagccaaggacagggctggctcc

SEQ ID NO: 5743732 - DNA, 12 bp, Homo sapiens
gagccaaggagg

SEQ ID NO: 5743733 - DNA, 20 bp, Homo sapiens
gagccaaggaggaaatgtgg

SEQ ID NO: 5743734 - DNA, 20 bp, Homo sapiens
gagccaaggaggcctgggga

SEQ ID NO: 5743735 - DNA, 13 bp, Homo sapiens
gagccaaggcaga

SEQ ID NO: 5743736 - DNA, 12 bp, Homo sapiens
gagccaaggcca

SEQ ID NO: 5743737 - DNA, 14 bp, Homo sapiens
gagccaaggccacc

SEQ ID NO: 5743738 - DNA, 23 bp, Homo sapiens
gagccaagggagggaagggccac

SEQ ID NO: 5743739 - DNA, 15 bp, Homo sapiens
gagccaagggatgga

SEQ ID NO: 5743740 - DNA, 18 bp, Homo sapiens
gagccaaggggcttcagg

SEQ ID NO: 5743741 - DNA, 17 bp, Homo sapiens
gagccaagggggcagag

SEQ ID NO: 5743742 - DNA, 19 bp, Homo sapiens
gagccaaggggtctgctcc

SEQ ID NO: 5743743 - DNA, 19 bp, Homo sapiens
gagccaagggttcagagac

SEQ ID NO: 5743744 - DNA, 16 bp, Homo sapiens
gagccaagtcctccct

SEQ ID NO: 5743745 - DNA, 17 bp, Homo sapiens
gagccaagtggtccagc

SEQ ID NO: 5743746 - DNA, 15 bp, Homo sapiens
gagccaatgaacagc

SEQ ID NO: 5743747 - DNA, 18 bp, Homo sapiens
gagccaatgaacagctcc

SEQ ID NO: 5743748 - DNA, 22 bp, Homo sapiens
gagccaatggagtagacccctg

SEQ ID NO: 5743749 - DNA, 18 bp, Homo sapiens
gagccaattagacttgaa

SEQ ID NO: 5743750 - DNA, 20 bp, Homo sapiens
gagccaattagacttgaaat

SEQ ID NO: 5743751 - DNA, 13 bp, Homo sapiens
gagccacaaaaga

SEQ ID NO: 5743752 - DNA, 23 bp, Homo sapiens
gagccacagaccacctgcttctg

SEQ ID NO: 5743753 - DNA, 21 bp, Homo sapiens
gagccacagggtctgcctcca

SEQ ID NO: 5743754 - DNA, 14 bp, Homo sapiens
gagccacagtggga

SEQ ID NO: 5743755 - DNA, 22 bp, Homo sapiens
gagccacagtggggcccatggc

SEQ ID NO: 5743756 - DNA, 23 bp, Homo sapiens
gagccacagtggggcccatggcc

SEQ ID NO: 5743757 - DNA, 17 bp, Homo sapiens
gagccaccaaagtcaca

SEQ ID NO: 5743758 - DNA, 23 bp, Homo sapiens
gagccaccatgcttgcctgaagc

SEQ ID NO: 5743759 - DNA, 16 bp, Homo sapiens
gagccaccccaggaaa

SEQ ID NO: 5743760 - DNA, 22 bp, Homo sapiens
gagccaccccatgagctcgggg

SEQ ID NO: 5743761 - DNA, 23 bp, Homo sapiens
gagccaccgcgcccagccaagaa

SEQ ID NO: 5743762 - DNA, 14 bp, Homo sapiens
gagccaccgctgcc

SEQ ID NO: 5743763 - DNA, 16 bp, Homo sapiens
gagccaccgctgccag

SEQ ID NO: 5743764 - DNA, 14 bp, Homo sapiens
gagccaccgtgcct

SEQ ID NO: 5743765 - DNA, 21 bp, Homo sapiens
gagccaccgtgcctggccaga

SEQ ID NO: 5743766 - DNA, 23 bp, Homo sapiens
gagccaccgtgcctggccagatt

SEQ ID NO: 5743767 - DNA, 13 bp, Homo sapiens
gagccacctgcaa

SEQ ID NO: 5743768 - DNA, 13 bp, Homo sapiens
gagccacctggat

SEQ ID NO: 5743769 - DNA, 15 bp, Homo sapiens
gagccacctggatct

SEQ ID NO: 5743770 - DNA, 13 bp, Homo sapiens
gagccacctggca

SEQ ID NO: 5743771 - DNA, 16 bp, Homo sapiens
gagccacctggcaggg

SEQ ID NO: 5743772 - DNA, 20 bp, Homo sapiens
gagccacctggcagggctca

SEQ ID NO: 5743773 - DNA, 13 bp, Homo sapiens
gagccacctgggc

SEQ ID NO: 5743774 - DNA, 19 bp, Homo sapiens
gagccacctgtcccacctc

SEQ ID NO: 5743775 - DNA, 22 bp, Homo sapiens
gagccacgcagtgcctggagtt

SEQ ID NO: 5743776 - DNA, 22 bp, Homo sapiens
gagccacggaccgcatcctcca

SEQ ID NO: 5743777 - DNA, 23 bp, Homo sapiens
gagccacggaccgcatcctccag

SEQ ID NO: 5743778 - DNA, 15 bp, Homo sapiens
gagccactacctttg

SEQ ID NO: 5743779 - DNA, 20 bp, Homo sapiens
gagccactcagtctcttcca

SEQ ID NO: 5743780 - DNA, 12 bp, Homo sapiens
gagccactcctg

SEQ ID NO: 5743781 - DNA, 14 bp, Homo sapiens
gagccactcttcaa

SEQ ID NO: 5743782 - DNA, 22 bp, Homo sapiens
gagccactgcaccgggccacag

SEQ ID NO: 5743783 - DNA, 21 bp, Homo sapiens
gagccactgccactccagtcc

SEQ ID NO: 5743784 - DNA, 19 bp, Homo sapiens
gagccactgcgcccggccc

SEQ ID NO: 5743785 - DNA, 16 bp, Homo sapiens
gagccactggaggaag

SEQ ID NO: 5743786 - DNA, 13 bp, Homo sapiens
gagccactgggcc

SEQ ID NO: 5743787 - DNA, 16 bp, Homo sapiens
gagccactgggcccct

SEQ ID NO: 5743788 - DNA, 17 bp, Homo sapiens
gagccactgggcccctg

SEQ ID NO: 5743789 - DNA, 23 bp, Homo sapiens
gagccactgggcccctgtcccca

SEQ ID NO: 5743790 - DNA, 18 bp, Homo sapiens
gagccactggggtgggag

SEQ ID NO: 5743791 - DNA, 20 bp, Homo sapiens
gagccactggggtgggaggg

SEQ ID NO: 5743792 - DNA, 18 bp, Homo sapiens
gagccactgtgcccagca

SEQ ID NO: 5743793 - DNA, 15 bp, Homo sapiens
gagccactgtgcctg

SEQ ID NO: 5743794 - DNA, 19 bp, Homo sapiens
gagccactttcaagctgca

SEQ ID NO: 5743795 - DNA, 16 bp, Homo sapiens
gagccagaacctggag

SEQ ID NO: 5743796 - DNA, 21 bp, Homo sapiens
gagccagaacctggagggcta

SEQ ID NO: 5743797 - DNA, 16 bp, Homo sapiens
gagccagaattcacta

SEQ ID NO: 5743798 - DNA, 23 bp, Homo sapiens
gagccagactctggtcttctttg

SEQ ID NO: 5743799 - DNA, 14 bp, Homo sapiens
gagccagactctgt

SEQ ID NO: 5743800 - DNA, 14 bp, Homo sapiens
gagccagagaagtg

SEQ ID NO: 5743801 - DNA, 15 bp, Homo sapiens
gagccagagaagtga

SEQ ID NO: 5743802 - DNA, 16 bp, Homo sapiens
gagccagagaagtgac

SEQ ID NO: 5743803 - DNA, 19 bp, Homo sapiens
gagccagagaagtgacagg

SEQ ID NO: 5743804 - DNA, 20 bp, Homo sapiens
gagccagagaagtgacaggg

SEQ ID NO: 5743805 - DNA, 22 bp, Homo sapiens
gagccagagaagtgacagggaa

SEQ ID NO: 5743806 - DNA, 15 bp, Homo sapiens
gagccagaggccagg

SEQ ID NO: 5743807 - DNA, 20 bp, Homo sapiens
gagccagaggccaggatgcc

SEQ ID NO: 5743808 - DNA, 16 bp, Homo sapiens
gagccagagggagctg

SEQ ID NO: 5743809 - DNA, 15 bp, Homo sapiens
gagccagatgcagga

SEQ ID NO: 5743810 - DNA, 18 bp, Homo sapiens
gagccagatgcaggacag

SEQ ID NO: 5743811 - DNA, 17 bp, Homo sapiens
gagccagatgcctcccc

SEQ ID NO: 5743812 - DNA, 20 bp, Homo sapiens
gagccagatttcactctcct

SEQ ID NO: 5743813 - DNA, 12 bp, Homo sapiens
gagccagcagac

SEQ ID NO: 5743814 - DNA, 11 bp, Homo sapiens
gagccagcagg

SEQ ID NO: 5743815 - DNA, 15 bp, Homo sapiens
gagccagcagggcgg

SEQ ID NO: 5743816 - DNA, 18 bp, Homo sapiens
gagccagcagggctgtga

SEQ ID NO: 5743817 - DNA, 14 bp, Homo sapiens
gagccagccaggac

SEQ ID NO: 5743818 - DNA, 12 bp, Homo sapiens
gagccagcccaa

SEQ ID NO: 5743819 - DNA, 19 bp, Homo sapiens
gagccagcccaagtagagg

SEQ ID NO: 5743820 - DNA, 19 bp, Homo sapiens
gagccagccgagcaggagg

SEQ ID NO: 5743821 - DNA, 11 bp, Homo sapiens
gagccagcctg

SEQ ID NO: 5743822 - DNA, 15 bp, Homo sapiens
gagccagcctgctcc

SEQ ID NO: 5743823 - DNA, 12 bp, Homo sapiens
gagccagcctgg

SEQ ID NO: 5743824 - DNA, 13 bp, Homo sapiens
gagccagcctggc

SEQ ID NO: 5743825 - DNA, 15 bp, Homo sapiens
gagccagcctgggac

SEQ ID NO: 5743826 - DNA, 18 bp, Homo sapiens
gagccagctaaggggtgg

SEQ ID NO: 5743827 - DNA, 14 bp, Homo sapiens
gagccagctcccag

SEQ ID NO: 5743828 - DNA, 13 bp, Homo sapiens
gagccagctccct

SEQ ID NO: 5743829 - DNA, 20 bp, Homo sapiens
gagccagctctgtcccagga

SEQ ID NO: 5743830 - DNA, 11 bp, Homo sapiens
gagccagctgc

SEQ ID NO: 5743831 - DNA, 20 bp, Homo sapiens
gagccaggaagatcccccag

SEQ ID NO: 5743832 - DNA, 10 bp, Homo sapiens
gagccaggag

SEQ ID NO: 5743833 - DNA, 14 bp, Homo sapiens
gagccaggagaagc

SEQ ID NO: 5743834 - DNA, 17 bp, Homo sapiens
gagccaggagaagctca

SEQ ID NO: 5743835 - DNA, 16 bp, Homo sapiens
gagccaggatgcccag

SEQ ID NO: 5743836 - DNA, 18 bp, Homo sapiens
gagccaggatgggtctcc

SEQ ID NO: 5743837 - DNA, 12 bp, Homo sapiens
gagccaggcaca

SEQ ID NO: 5743838 - DNA, 22 bp, Homo sapiens
gagccaggcctgggtctgtgtc

SEQ ID NO: 5743839 - DNA, 21 bp, Homo sapiens
gagccaggctagctggagcct

SEQ ID NO: 5743840 - DNA, 12 bp, Homo sapiens
gagccaggctct

SEQ ID NO: 5743841 - DNA, 17 bp, Homo sapiens
gagccagggaacagccc

SEQ ID NO: 5743842 - DNA, 18 bp, Homo sapiens
gagccagggaacagcccc

SEQ ID NO: 5743843 - DNA, 14 bp, Homo sapiens
gagccagggcagag

SEQ ID NO: 5743844 - DNA, 17 bp, Homo sapiens
gagccagggcagaggaa

SEQ ID NO: 5743845 - DNA, 13 bp, Homo sapiens
gagccagggcagg

SEQ ID NO: 5743846 - DNA, 22 bp, Homo sapiens
gagccagggcagggcgagctgc

SEQ ID NO: 5743847 - DNA, 13 bp, Homo sapiens
gagccagggcctc

SEQ ID NO: 5743848 - DNA, 11 bp, Homo sapiens
gagccagggct

SEQ ID NO: 5743849 - DNA, 13 bp, Homo sapiens
gagccagggctgt

SEQ ID NO: 5743850 - DNA, 22 bp, Homo sapiens
gagccaggggtgtcccagtccc

SEQ ID NO: 5743851 - DNA, 13 bp, Homo sapiens
gagccagggtaga

SEQ ID NO: 5743852 - DNA, 23 bp, Homo sapiens
gagccagggtagagcaaaggaga

SEQ ID NO: 5743853 - DNA, 19 bp, Homo sapiens
gagccagggtctcactatg

SEQ ID NO: 5743854 - DNA, 17 bp, Homo sapiens
gagccagggtctccaga

SEQ ID NO: 5743855 - DNA, 13 bp, Homo sapiens
gagccagtgatta

SEQ ID NO: 5743856 - DNA, 22 bp, Homo sapiens
gagccagtgggccagccacaga

SEQ ID NO: 5743857 - DNA, 23 bp, Homo sapiens
gagccagttcagtacctggagga

SEQ ID NO: 5743858 - DNA, 23 bp, Homo sapiens
gagccagttgtcctatggacaac

SEQ ID NO: 5743859 - DNA, 11 bp, Homo sapiens
gagccataatg

SEQ ID NO: 5743860 - DNA, 23 bp, Homo sapiens
gagccataccgaccatcgtccag

SEQ ID NO: 5743861 - DNA, 23 bp, Homo sapiens
gagccatataagtttgaaggaaa

SEQ ID NO: 5743862 - DNA, 18 bp, Homo sapiens
gagccatcaccctcaccc

SEQ ID NO: 5743863 - DNA, 22 bp, Homo sapiens
gagccatcaccctcacccactc

SEQ ID NO: 5743864 - DNA, 20 bp, Homo sapiens
gagccatcactagaagaaaa

SEQ ID NO: 5743865 - DNA, 19 bp, Homo sapiens
gagccatccaccctgagga

SEQ ID NO: 5743866 - DNA, 22 bp, Homo sapiens
gagccatgatcgagccactgca

SEQ ID NO: 5743867 - DNA, 20 bp, Homo sapiens
gagccatgatttcccactgc

SEQ ID NO: 5743868 - DNA, 16 bp, Homo sapiens
gagccatgccaggctg

SEQ ID NO: 5743869 - DNA, 23 bp, Homo sapiens
gagccatgcctccctgggccacc

SEQ ID NO: 5743870 - DNA, 13 bp, Homo sapiens
gagccatgctctt

SEQ ID NO: 5743871 - DNA, 18 bp, Homo sapiens
gagccatggcggcccctc

SEQ ID NO: 5743872 - DNA, 17 bp, Homo sapiens
gagccatgggcacaaag

SEQ ID NO: 5743873 - DNA, 18 bp, Homo sapiens
gagccatgggcacaaagg

SEQ ID NO: 5743874 - DNA, 21 bp, Homo sapiens
gagccatgggcctgggcctgc

SEQ ID NO: 5743875 - DNA, 22 bp, Homo sapiens
gagccatgggcctgggcctgct

SEQ ID NO: 5743876 - DNA, 22 bp, Homo sapiens
gagccatggtgtgtttgtaata

SEQ ID NO: 5743877 - DNA, 22 bp, Homo sapiens
gagccattagagcacagcttct

SEQ ID NO: 5743878 - DNA, 17 bp, Homo sapiens
gagccattctgtcccag

SEQ ID NO: 5743879 - DNA, 21 bp, Homo sapiens
gagccattgagtgctggggga

SEQ ID NO: 5743880 - DNA, 20 bp, Homo sapiens
gagccatttatacctttgaa

SEQ ID NO: 5743881 - DNA, 16 bp, Homo sapiens
gagccattttgtgaat

SEQ ID NO: 5743882 - DNA, 14 bp, Homo sapiens
gagcccaagtgcca

SEQ ID NO: 5743883 - DNA, 22 bp, Homo sapiens
gagcccaagttatctttccctc

SEQ ID NO: 5743884 - DNA, 16 bp, Homo sapiens
gagcccacaaagcctt

SEQ ID NO: 5743885 - DNA, 23 bp, Homo sapiens
gagcccacaccatctggcccagg

SEQ ID NO: 5743886 - DNA, 17 bp, Homo sapiens
gagcccacagcgagcct

SEQ ID NO: 5743887 - DNA, 19 bp, Homo sapiens
gagcccacagcgagcctgt

SEQ ID NO: 5743888 - DNA, 21 bp, Homo sapiens
gagcccacaggagctcccttt

SEQ ID NO: 5743889 - DNA, 12 bp, Homo sapiens
gagcccaccagc

SEQ ID NO: 5743890 - DNA, 14 bp, Homo sapiens
gagcccaccagcca

SEQ ID NO: 5743891 - DNA, 20 bp, Homo sapiens
gagcccaccagccagccctg

SEQ ID NO: 5743892 - DNA, 21 bp, Homo sapiens
gagcccaccagccagccctgg

SEQ ID NO: 5743893 - DNA, 15 bp, Homo sapiens
gagcccaccttggct

SEQ ID NO: 5743894 - DNA, 17 bp, Homo sapiens
gagcccaccttggctca

SEQ ID NO: 5743895 - DNA, 12 bp, Homo sapiens
gagcccacgccc

SEQ ID NO: 5743896 - DNA, 15 bp, Homo sapiens
gagcccacgccccca

SEQ ID NO: 5743897 - DNA, 21 bp, Homo sapiens
gagcccacgcccgactagcag

SEQ ID NO: 5743898 - DNA, 17 bp, Homo sapiens
gagcccacggggcaaag

SEQ ID NO: 5743899 - DNA, 11 bp, Homo sapiens
gagcccactcc

SEQ ID NO: 5743900 - DNA, 14 bp, Homo sapiens
gagcccactccatc

SEQ ID NO: 5743901 - DNA, 17 bp, Homo sapiens
gagcccagaaaaaagga

SEQ ID NO: 5743902 - DNA, 18 bp, Homo sapiens
gagcccagaaaaaaggac

SEQ ID NO: 5743903 - DNA, 19 bp, Homo sapiens
gagcccagaaaaaaggact

SEQ ID NO: 5743904 - DNA, 21 bp, Homo sapiens
gagcccagaagctcaaggctg

SEQ ID NO: 5743905 - DNA, 16 bp, Homo sapiens
gagcccagacctcccc

SEQ ID NO: 5743906 - DNA, 19 bp, Homo sapiens
gagcccagagggtggcaag

SEQ ID NO: 5743907 - DNA, 21 bp, Homo sapiens
gagcccagaggtaacagaaca

SEQ ID NO: 5743908 - DNA, 22 bp, Homo sapiens
gagcccagaggtaacagaacag

SEQ ID NO: 5743909 - DNA, 12 bp, Homo sapiens
gagcccagccac

SEQ ID NO: 5743910 - DNA, 13 bp, Homo sapiens
gagcccagcctgg

SEQ ID NO: 5743911 - DNA, 21 bp, Homo sapiens
gagcccagcctgggagcccag

SEQ ID NO: 5743912 - DNA, 23 bp, Homo sapiens
gagcccagcctgggagcccagag

SEQ ID NO: 5743913 - DNA, 13 bp, Homo sapiens
gagcccagctcca

SEQ ID NO: 5743914 - DNA, 14 bp, Homo sapiens
gagcccagctctga

SEQ ID NO: 5743915 - DNA, 13 bp, Homo sapiens
gagcccagctctt

SEQ ID NO: 5743916 - DNA, 14 bp, Homo sapiens
gagcccagctcttg

SEQ ID NO: 5743917 - DNA, 15 bp, Homo sapiens
gagcccagctgcctg

SEQ ID NO: 5743918 - DNA, 17 bp, Homo sapiens
gagcccagctgcctgga

SEQ ID NO: 5743919 - DNA, 19 bp, Homo sapiens
gagcccagctgcctggaga

SEQ ID NO: 5743920 - DNA, 13 bp, Homo sapiens
gagcccagctggg

SEQ ID NO: 5743921 - DNA, 13 bp, Homo sapiens
gagcccaggaagt

SEQ ID NO: 5743922 - DNA, 13 bp, Homo sapiens
gagcccaggagct

SEQ ID NO: 5743923 - DNA, 12 bp, Homo sapiens
gagcccaggagt

SEQ ID NO: 5743924 - DNA, 21 bp, Homo sapiens
gagcccaggagtttgaatcca

SEQ ID NO: 5743925 - DNA, 20 bp, Homo sapiens
gagcccaggcagctatttca

SEQ ID NO: 5743926 - DNA, 23 bp, Homo sapiens
gagcccaggcagctatttcagcc

SEQ ID NO: 5743927 - DNA, 13 bp, Homo sapiens
gagcccaggccag

SEQ ID NO: 5743928 - DNA, 12 bp, Homo sapiens
gagcccaggccg

SEQ ID NO: 5743929 - DNA, 13 bp, Homo sapiens
gagcccaggcctc

SEQ ID NO: 5743930 - DNA, 13 bp, Homo sapiens
gagcccaggcggg

SEQ ID NO: 5743931 - DNA, 21 bp, Homo sapiens
gagcccaggctcggcctgccc

SEQ ID NO: 5743932 - DNA, 22 bp, Homo sapiens
gagcccaggctcggcctgcccc

SEQ ID NO: 5743933 - DNA, 22 bp, Homo sapiens
gagcccaggggagaatgcagcc

SEQ ID NO: 5743934 - DNA, 19 bp, Homo sapiens
gagcccaggggaggcacaa

SEQ ID NO: 5743935 - DNA, 21 bp, Homo sapiens
gagcccagtcgagacctcaca

SEQ ID NO: 5743936 - DNA, 17 bp, Homo sapiens
gagcccagtgaagcctc

SEQ ID NO: 5743937 - DNA, 20 bp, Homo sapiens
gagcccagtgggctgcacgc

SEQ ID NO: 5743938 - DNA, 18 bp, Homo sapiens
gagcccagttggaaaatt

SEQ ID NO: 5743939 - DNA, 22 bp, Homo sapiens
gagcccatgttctgcccccagc

SEQ ID NO: 5743940 - DNA, 19 bp, Homo sapiens
gagcccattaatcttgatc

SEQ ID NO: 5743941 - DNA, 13 bp, Homo sapiens
gagcccattccca

SEQ ID NO: 5743942 - DNA, 18 bp, Homo sapiens
gagcccattcttctgggt

SEQ ID NO: 5743943 - DNA, 16 bp, Homo sapiens
gagcccatttctgggg

SEQ ID NO: 5743944 - DNA, 18 bp, Homo sapiens
gagcccatttggagggcc

SEQ ID NO: 5743945 - DNA, 13 bp, Homo sapiens
gagccccaagact

SEQ ID NO: 5743946 - DNA, 18 bp, Homo sapiens
gagccccaagactctgct

SEQ ID NO: 5743947 - DNA, 11 bp, Homo sapiens
gagccccaagt

SEQ ID NO: 5743948 - DNA, 22 bp, Homo sapiens
gagccccacactggggtgccgc

SEQ ID NO: 5743949 - DNA, 12 bp, Homo sapiens
gagccccacagc

SEQ ID NO: 5743950 - DNA, 14 bp, Homo sapiens
gagccccactcccg

SEQ ID NO: 5743951 - DNA, 14 bp, Homo sapiens
gagccccactctca

SEQ ID NO: 5743952 - DNA, 19 bp, Homo sapiens
gagccccactctcagaggc

SEQ ID NO: 5743953 - DNA, 22 bp, Homo sapiens
gagccccactctcagaggcccc

SEQ ID NO: 5743954 - DNA, 15 bp, Homo sapiens
gagccccagccagcc

SEQ ID NO: 5743955 - DNA, 17 bp, Homo sapiens
gagccccagccagccct

SEQ ID NO: 5743956 - DNA, 12 bp, Homo sapiens
gagccccagccc

SEQ ID NO: 5743957 - DNA, 22 bp, Homo sapiens
gagccccagccccaatccagag

SEQ ID NO: 5743958 - DNA, 16 bp, Homo sapiens
gagccccagctaccct

SEQ ID NO: 5743959 - DNA, 16 bp, Homo sapiens
gagccccagcttcctg

SEQ ID NO: 5743960 - DNA, 12 bp, Homo sapiens
gagccccaggag

SEQ ID NO: 5743961 - DNA, 13 bp, Homo sapiens
gagccccaggcct

SEQ ID NO: 5743962 - DNA, 14 bp, Homo sapiens
gagccccagggaga

SEQ ID NO: 5743963 - DNA, 12 bp, Homo sapiens
gagccccagggg

SEQ ID NO: 5743964 - DNA, 13 bp, Homo sapiens
gagccccagggtc

SEQ ID NO: 5743965 - DNA, 14 bp, Homo sapiens
gagccccagggtct

SEQ ID NO: 5743966 - DNA, 19 bp, Homo sapiens
gagccccagggtcttccct

SEQ ID NO: 5743967 - DNA, 19 bp, Homo sapiens
gagccccagggtgcccaga

SEQ ID NO: 5743968 - DNA, 17 bp, Homo sapiens
gagccccagtgccaagc

SEQ ID NO: 5743969 - DNA, 14 bp, Homo sapiens
gagccccagtgctg

SEQ ID NO: 5743970 - DNA, 16 bp, Homo sapiens
gagccccagtgctgga

SEQ ID NO: 5743971 - DNA, 19 bp, Homo sapiens
gagccccatcttcacccag

SEQ ID NO: 5743972 - DNA, 18 bp, Homo sapiens
gagccccatggtgggtag

SEQ ID NO: 5743973 - DNA, 16 bp, Homo sapiens
gagccccattcctggg

SEQ ID NO: 5743974 - DNA, 17 bp, Homo sapiens
gagccccattcctggga

SEQ ID NO: 5743975 - DNA, 17 bp, Homo sapiens
gagcccccaacacaggc

SEQ ID NO: 5743976 - DNA, 13 bp, Homo sapiens
gagcccccaagcc

SEQ ID NO: 5743977 - DNA, 16 bp, Homo sapiens
gagcccccaagcctct

SEQ ID NO: 5743978 - DNA, 16 bp, Homo sapiens
gagcccccacattctc

SEQ ID NO: 5743979 - DNA, 14 bp, Homo sapiens
gagcccccaccctg

SEQ ID NO: 5743980 - DNA, 15 bp, Homo sapiens
gagcccccaccctgt

SEQ ID NO: 5743981 - DNA, 22 bp, Homo sapiens
gagcccccaccctgttcctgct

SEQ ID NO: 5743982 - DNA, 23 bp, Homo sapiens
gagcccccaccctgttcctgctg

SEQ ID NO: 5743983 - DNA, 23 bp, Homo sapiens
gagcccccaccggaactgggctg

SEQ ID NO: 5743984 - DNA, 18 bp, Homo sapiens
gagcccccacctgcctga

SEQ ID NO: 5743985 - DNA, 14 bp, Homo sapiens
gagcccccaccttg

SEQ ID NO: 5743986 - DNA, 15 bp, Homo sapiens
gagcccccagcagag

SEQ ID NO: 5743987 - DNA, 16 bp, Homo sapiens
gagcccccagctgcca

SEQ ID NO: 5743988 - DNA, 21 bp, Homo sapiens
gagcccccagcttccagcagg

SEQ ID NO: 5743989 - DNA, 22 bp, Homo sapiens
gagcccccagcttccagcagga

SEQ ID NO: 5743990 - DNA, 15 bp, Homo sapiens
gagccccccactcag

SEQ ID NO: 5743991 - DNA, 22 bp, Homo sapiens
gagcccccccaacactgtgccc

SEQ ID NO: 5743992 - DNA, 17 bp, Homo sapiens
gagccccccgtgtggct

SEQ ID NO: 5743993 - DNA, 20 bp, Homo sapiens
gagccccccgtgttcacaca

SEQ ID NO: 5743994 - DNA, 17 bp, Homo sapiens
gagcccccgccccgccc

SEQ ID NO: 5743995 - DNA, 15 bp, Homo sapiens
gagcccccgcccctc

SEQ ID NO: 5743996 - DNA, 17 bp, Homo sapiens
gagcccccgcccctccc

SEQ ID NO: 5743997 - DNA, 18 bp, Homo sapiens
gagcccccgcccctcccc

SEQ ID NO: 5743998 - DNA, 19 bp, Homo sapiens
gagcccccgcccctccccc

SEQ ID NO: 5743999 - DNA, 12 bp, Homo sapiens
gagccccctggc

SEQ ID NO: 5744000 - DNA, 13 bp, Homo sapiens
gagccccctggcg

SEQ ID NO: 5744001 - DNA, 14 bp, Homo sapiens
gagccccgaggcct

SEQ ID NO: 5744002 - DNA, 22 bp, Homo sapiens
gagccccgcagacctccccagc

SEQ ID NO: 5744003 - DNA, 13 bp, Homo sapiens
gagccccgccctc

SEQ ID NO: 5744004 - DNA, 21 bp, Homo sapiens
gagccccgccctcttcctgac

SEQ ID NO: 5744005 - DNA, 22 bp, Homo sapiens
gagccccgccgtgtctgtggcc

SEQ ID NO: 5744006 - DNA, 24 bp, Homo sapiens
gagccccgccgtgtctgtggccct

SEQ ID NO: 5744007 - DNA, 16 bp, Homo sapiens
gagcccctactgtggg

SEQ ID NO: 5744008 - DNA, 13 bp, Homo sapiens
gagcccctaggaa

SEQ ID NO: 5744009 - DNA, 17 bp, Homo sapiens
gagcccctccccagcca

SEQ ID NO: 5744010 - DNA, 22 bp, Homo sapiens
gagcccctcctccagcccctgt

SEQ ID NO: 5744011 - DNA, 13 bp, Homo sapiens
gagcccctcctct

SEQ ID NO: 5744012 - DNA, 15 bp, Homo sapiens
gagcccctcctctcc

SEQ ID NO: 5744013 - DNA, 12 bp, Homo sapiens
gagcccctcctt

SEQ ID NO: 5744014 - DNA, 13 bp, Homo sapiens
gagcccctcggct

SEQ ID NO: 5744015 - DNA, 19 bp, Homo sapiens
gagcccctcggctctggag

SEQ ID NO: 5744016 - DNA, 20 bp, Homo sapiens
gagcccctcggctctggagg

SEQ ID NO: 5744017 - DNA, 20 bp, Homo sapiens
gagcccctggacatgcctgt

SEQ ID NO: 5744018 - DNA, 12 bp, Homo sapiens
gagcccctgggt

SEQ ID NO: 5744019 - DNA, 13 bp, Homo sapiens
gagcccctgggtg

SEQ ID NO: 5744020 - DNA, 14 bp, Homo sapiens
gagcccctgggtgg

SEQ ID NO: 5744021 - DNA, 13 bp, Homo sapiens
gagcccctggtct

SEQ ID NO: 5744022 - DNA, 20 bp, Homo sapiens
gagcccctgtctagagaggg

SEQ ID NO: 5744023 - DNA, 19 bp, Homo sapiens
gagcccctgtgtgggaggg

SEQ ID NO: 5744024 - DNA, 19 bp, Homo sapiens
gagcccctgtttctcctcc

SEQ ID NO: 5744025 - DNA, 22 bp, Homo sapiens
gagccccttctgctcagctctg

SEQ ID NO: 5744026 - DNA, 18 bp, Homo sapiens
gagcccgaatttctcact

SEQ ID NO: 5744027 - DNA, 16 bp, Homo sapiens
gagcccgaggcaccag

SEQ ID NO: 5744028 - DNA, 19 bp, Homo sapiens
gagcccgagggcctgacag

SEQ ID NO: 5744029 - DNA, 17 bp, Homo sapiens
gagcccgatattctccc

SEQ ID NO: 5744030 - DNA, 19 bp, Homo sapiens
gagcccgcacccccaccct

SEQ ID NO: 5744031 - DNA, 14 bp, Homo sapiens
gagcccgcactgtc

SEQ ID NO: 5744032 - DNA, 17 bp, Homo sapiens
gagcccgcactgtccca

SEQ ID NO: 5744033 - DNA, 15 bp, Homo sapiens
gagcccgcagcccag

SEQ ID NO: 5744034 - DNA, 22 bp, Homo sapiens
gagcccgcagggccatgcagac

SEQ ID NO: 5744035 - DNA, 18 bp, Homo sapiens
gagcccgcccacctgggc

SEQ ID NO: 5744036 - DNA, 17 bp, Homo sapiens
gagcccgcgtgctggag

SEQ ID NO: 5744037 - DNA, 18 bp, Homo sapiens
gagcccgcgtgctggaga

SEQ ID NO: 5744038 - DNA, 18 bp, Homo sapiens
gagcccgcttcaagctct

SEQ ID NO: 5744039 - DNA, 19 bp, Homo sapiens
gagcccgcttcaagctctc

SEQ ID NO: 5744040 - DNA, 22 bp, Homo sapiens
gagcccgcttcaagctctctgt

SEQ ID NO: 5744041 - DNA, 17 bp, Homo sapiens
gagcccggatgcttctc

SEQ ID NO: 5744042 - DNA, 21 bp, Homo sapiens
gagcccggcagtgcaccccct

SEQ ID NO: 5744043 - DNA, 14 bp, Homo sapiens
gagcccggccccac

SEQ ID NO: 5744044 - DNA, 13 bp, Homo sapiens
gagcccggccctc

SEQ ID NO: 5744045 - DNA, 22 bp, Homo sapiens
gagcccggccctcccccagctc

SEQ ID NO: 5744046 - DNA, 19 bp, Homo sapiens
gagcccgggctgcctgggc

SEQ ID NO: 5744047 - DNA, 19 bp, Homo sapiens
gagcccggggcagagctca

SEQ ID NO: 5744048 - DNA, 20 bp, Homo sapiens
gagcccggggcagagctcag

SEQ ID NO: 5744049 - DNA, 15 bp, Homo sapiens
gagcccgtcaggcca

SEQ ID NO: 5744050 - DNA, 20 bp, Homo sapiens
gagcccgtcaggccacagcc

SEQ ID NO: 5744051 - DNA, 21 bp, Homo sapiens
gagcccgtcgcgctggacagc

SEQ ID NO: 5744052 - DNA, 20 bp, Homo sapiens
gagcccgtgcagtacaggca

SEQ ID NO: 5744053 - DNA, 22 bp, Homo sapiens
gagcccgtgccacccccagccc

SEQ ID NO: 5744054 - DNA, 21 bp, Homo sapiens
gagccctaaccccttccagat

SEQ ID NO: 5744055 - DNA, 18 bp, Homo sapiens
gagccctactccctgcag

SEQ ID NO: 5744056 - DNA, 22 bp, Homo sapiens
gagccctactccctgcagatgc

SEQ ID NO: 5744057 - DNA, 21 bp, Homo sapiens
gagccctcaaagtgaggggaa

SEQ ID NO: 5744058 - DNA, 16 bp, Homo sapiens
gagccctcaactattc

SEQ ID NO: 5744059 - DNA, 19 bp, Homo sapiens
gagccctcaactattctgt

SEQ ID NO: 5744060 - DNA, 17 bp, Homo sapiens
gagccctcacaccctgg

SEQ ID NO: 5744061 - DNA, 15 bp, Homo sapiens
gagccctcagaaccc

SEQ ID NO: 5744062 - DNA, 12 bp, Homo sapiens
gagccctcaggc

SEQ ID NO: 5744063 - DNA, 15 bp, Homo sapiens
gagccctcaggctcc

SEQ ID NO: 5744064 - DNA, 21 bp, Homo sapiens
gagccctcagtcggggcaggc

SEQ ID NO: 5744065 - DNA, 13 bp, Homo sapiens
gagccctccaggc

SEQ ID NO: 5744066 - DNA, 12 bp, Homo sapiens
gagccctcccca

SEQ ID NO: 5744067 - DNA, 13 bp, Homo sapiens
gagccctccccag

SEQ ID NO: 5744068 - DNA, 13 bp, Homo sapiens
gagccctccctct

SEQ ID NO: 5744069 - DNA, 22 bp, Homo sapiens
gagccctccctcttcccagcac

SEQ ID NO: 5744070 - DNA, 20 bp, Homo sapiens
gagccctcctggaatggagc

SEQ ID NO: 5744071 - DNA, 11 bp, Homo sapiens
gagccctcctt

SEQ ID NO: 5744072 - DNA, 18 bp, Homo sapiens
gagccctccttcttgccc

SEQ ID NO: 5744073 - DNA, 20 bp, Homo sapiens
gagccctccttcttgccctg

SEQ ID NO: 5744074 - DNA, 16 bp, Homo sapiens
gagccctctagggcag

SEQ ID NO: 5744075 - DNA, 21 bp, Homo sapiens
gagccctctcactccagccaa

SEQ ID NO: 5744076 - DNA, 13 bp, Homo sapiens
gagccctctcctc

SEQ ID NO: 5744077 - DNA, 16 bp, Homo sapiens
gagccctctgagccgc

SEQ ID NO: 5744078 - DNA, 16 bp, Homo sapiens
gagccctcttgcccag

SEQ ID NO: 5744079 - DNA, 19 bp, Homo sapiens
gagccctgagcctggcagg

SEQ ID NO: 5744080 - DNA, 14 bp, Homo sapiens
gagccctgagctca

SEQ ID NO: 5744081 - DNA, 22 bp, Homo sapiens
gagccctgagctcaggctgagc

SEQ ID NO: 5744082 - DNA, 13 bp, Homo sapiens
gagccctgaggac

SEQ ID NO: 5744083 - DNA, 22 bp, Homo sapiens
gagccctgaggggctgggctgg

SEQ ID NO: 5744084 - DNA, 21 bp, Homo sapiens
gagccctgccactcaatggga

SEQ ID NO: 5744085 - DNA, 17 bp, Homo sapiens
gagccctgccctcactc

SEQ ID NO: 5744086 - DNA, 18 bp, Homo sapiens
gagccctgcctctccgcc

SEQ ID NO: 5744087 - DNA, 23 bp, Homo sapiens
gagccctgctcttctctccccag

SEQ ID NO: 5744088 - DNA, 17 bp, Homo sapiens
gagccctgctgtgggag

SEQ ID NO: 5744089 - DNA, 19 bp, Homo sapiens
gagccctggacacccctgc

SEQ ID NO: 5744090 - DNA, 21 bp, Homo sapiens
gagccctggacacccctgctc

SEQ ID NO: 5744091 - DNA, 22 bp, Homo sapiens
gagccctggaccccaggctctt

SEQ ID NO: 5744092 - DNA, 14 bp, Homo sapiens
gagccctggacctt

SEQ ID NO: 5744093 - DNA, 13 bp, Homo sapiens
gagccctggagag

SEQ ID NO: 5744094 - DNA, 18 bp, Homo sapiens
gagccctggagagcccca

SEQ ID NO: 5744095 - DNA, 13 bp, Homo sapiens
gagccctggcagg

SEQ ID NO: 5744096 - DNA, 23 bp, Homo sapiens
gagccctggcaggatgaccctgc

SEQ ID NO: 5744097 - DNA, 13 bp, Homo sapiens
gagccctggccag

SEQ ID NO: 5744098 - DNA, 14 bp, Homo sapiens
gagccctggccagc

SEQ ID NO: 5744099 - DNA, 12 bp, Homo sapiens
gagccctggctc

SEQ ID NO: 5744100 - DNA, 23 bp, Homo sapiens
gagccctggctctgcccctcagg

SEQ ID NO: 5744101 - DNA, 15 bp, Homo sapiens
gagccctgggccagg

SEQ ID NO: 5744102 - DNA, 12 bp, Homo sapiens
gagccctgggga

SEQ ID NO: 5744103 - DNA, 13 bp, Homo sapiens
gagccctggggac

SEQ ID NO: 5744104 - DNA, 16 bp, Homo sapiens
gagccctggggactgt

SEQ ID NO: 5744105 - DNA, 23 bp, Homo sapiens
gagccctggggtttccacacagg

SEQ ID NO: 5744106 - DNA, 20 bp, Homo sapiens
gagccctgggttccggttgt

SEQ ID NO: 5744107 - DNA, 13 bp, Homo sapiens
gagccctggtggc

SEQ ID NO: 5744108 - DNA, 18 bp, Homo sapiens
gagccctgtacccacccc

SEQ ID NO: 5744109 - DNA, 21 bp, Homo sapiens
gagccctgtacccaccccagc

SEQ ID NO: 5744110 - DNA, 21 bp, Homo sapiens
gagccctgtggatgagccctc

SEQ ID NO: 5744111 - DNA, 22 bp, Homo sapiens
gagccctgtggccgccacctga

SEQ ID NO: 5744112 - DNA, 17 bp, Homo sapiens
gagccctgttggcagct

SEQ ID NO: 5744113 - DNA, 22 bp, Homo sapiens
gagcccttagccttgctgtaga

SEQ ID NO: 5744114 - DNA, 13 bp, Homo sapiens
gagcccttccagg

SEQ ID NO: 5744115 - DNA, 13 bp, Homo sapiens
gagcccttcccag

SEQ ID NO: 5744116 - DNA, 15 bp, Homo sapiens
gagcccttcccaggg

SEQ ID NO: 5744117 - DNA, 24 bp, Homo sapiens
gagcccttcggaggaccagggctg

SEQ ID NO: 5744118 - DNA, 16 bp, Homo sapiens
gagcccttctctttga

SEQ ID NO: 5744119 - DNA, 18 bp, Homo sapiens
gagcccttgcccatgctg

SEQ ID NO: 5744120 - DNA, 15 bp, Homo sapiens
gagcccttgcctccc

SEQ ID NO: 5744121 - DNA, 16 bp, Homo sapiens
gagcccttgcctcccc

SEQ ID NO: 5744122 - DNA, 17 bp, Homo sapiens
gagccgacaatgccctg

SEQ ID NO: 5744123 - DNA, 22 bp, Homo sapiens
gagccgacaatgccctgctggc

SEQ ID NO: 5744124 - DNA, 22 bp, Homo sapiens
gagccgagattgcaccactgca

SEQ ID NO: 5744125 - DNA, 16 bp, Homo sapiens
gagccgagggcgtcag

SEQ ID NO: 5744126 - DNA, 17 bp, Homo sapiens
gagccgcaccctggctg

SEQ ID NO: 5744127 - DNA, 16 bp, Homo sapiens
gagccgcagaggcccg

SEQ ID NO: 5744128 - DNA, 23 bp, Homo sapiens
gagccgcagaggcccgaggcacc

SEQ ID NO: 5744129 - DNA, 15 bp, Homo sapiens
gagccgcagggcctg

SEQ ID NO: 5744130 - DNA, 13 bp, Homo sapiens
gagccgcaggggc

SEQ ID NO: 5744131 - DNA, 18 bp, Homo sapiens
gagccgcaggggcccctc

SEQ ID NO: 5744132 - DNA, 21 bp, Homo sapiens
gagccgcaggggcccctcctc

SEQ ID NO: 5744133 - DNA, 21 bp, Homo sapiens
gagccgcatcttctccatctg

SEQ ID NO: 5744134 - DNA, 14 bp, Homo sapiens
gagccgccaccggg

SEQ ID NO: 5744135 - DNA, 13 bp, Homo sapiens
gagccgcccaagg

SEQ ID NO: 5744136 - DNA, 13 bp, Homo sapiens
gagccgcctcgga

SEQ ID NO: 5744137 - DNA, 22 bp, Homo sapiens
gagccgcctctggttccactca

SEQ ID NO: 5744138 - DNA, 21 bp, Homo sapiens
gagccgcgctttcccctcctc

SEQ ID NO: 5744139 - DNA, 19 bp, Homo sapiens
gagccgctggcagaaggga

SEQ ID NO: 5744140 - DNA, 19 bp, Homo sapiens
gagccgctgtgagcccctg

SEQ ID NO: 5744141 - DNA, 19 bp, Homo sapiens
gagccgcttccccagctca

SEQ ID NO: 5744142 - DNA, 18 bp, Homo sapiens
gagccggacacttctcag

SEQ ID NO: 5744143 - DNA, 20 bp, Homo sapiens
gagccggacacttctcagga

SEQ ID NO: 5744144 - DNA, 21 bp, Homo sapiens
gagccggagggcaccagggac

SEQ ID NO: 5744145 - DNA, 20 bp, Homo sapiens
gagccggcatccttgcctgt

SEQ ID NO: 5744146 - DNA, 16 bp, Homo sapiens
gagccggccccaggct

SEQ ID NO: 5744147 - DNA, 15 bp, Homo sapiens
gagccggccgtggaa

SEQ ID NO: 5744148 - DNA, 14 bp, Homo sapiens
gagccggcggcctc

SEQ ID NO: 5744149 - DNA, 22 bp, Homo sapiens
gagccgggaaagaagagccgga

SEQ ID NO: 5744150 - DNA, 13 bp, Homo sapiens
gagccgggaaagc

SEQ ID NO: 5744151 - DNA, 17 bp, Homo sapiens
gagccgggaccctcagg

SEQ ID NO: 5744152 - DNA, 19 bp, Homo sapiens
gagccgggaccctcaggtg

SEQ ID NO: 5744153 - DNA, 15 bp, Homo sapiens
gagccgggcccctgg

SEQ ID NO: 5744154 - DNA, 15 bp, Homo sapiens
gagccgggccgcaga

SEQ ID NO: 5744155 - DNA, 14 bp, Homo sapiens
gagccgggcctccc

SEQ ID NO: 5744156 - DNA, 15 bp, Homo sapiens
gagccgggcctccca

SEQ ID NO: 5744157 - DNA, 14 bp, Homo sapiens
gagccgggcctggg

SEQ ID NO: 5744158 - DNA, 19 bp, Homo sapiens
gagccgggtccggcctctc

SEQ ID NO: 5744159 - DNA, 17 bp, Homo sapiens
gagccgggtctgcctct

SEQ ID NO: 5744160 - DNA, 20 bp, Homo sapiens
gagccgggtctgcctcttct

SEQ ID NO: 5744161 - DNA, 21 bp, Homo sapiens
gagccggtaactgtcctgtcc

SEQ ID NO: 5744162 - DNA, 16 bp, Homo sapiens
gagccgtagagggtgg

SEQ ID NO: 5744163 - DNA, 16 bp, Homo sapiens
gagccgtggtccctga

SEQ ID NO: 5744164 - DNA, 16 bp, Homo sapiens
gagcctaactccctcc

SEQ ID NO: 5744165 - DNA, 16 bp, Homo sapiens
gagcctaatgaaaggg

SEQ ID NO: 5744166 - DNA, 16 bp, Homo sapiens
gagcctaccccctgaa

SEQ ID NO: 5744167 - DNA, 15 bp, Homo sapiens
gagcctacctctgtc

SEQ ID NO: 5744168 - DNA, 14 bp, Homo sapiens
gagcctactgtctc

SEQ ID NO: 5744169 - DNA, 23 bp, Homo sapiens
gagcctagaacatccctgggcaa

SEQ ID NO: 5744170 - DNA, 23 bp, Homo sapiens
gagcctagcggagcccagcctgg

SEQ ID NO: 5744171 - DNA, 14 bp, Homo sapiens
gagcctagctcctg

SEQ ID NO: 5744172 - DNA, 20 bp, Homo sapiens
gagcctaggaccactcagcc

SEQ ID NO: 5744173 - DNA, 16 bp, Homo sapiens
gagcctaggccaggtg

SEQ ID NO: 5744174 - DNA, 17 bp, Homo sapiens
gagcctaggccaggtgc

SEQ ID NO: 5744175 - DNA, 14 bp, Homo sapiens
gagcctcagaagaa

SEQ ID NO: 5744176 - DNA, 17 bp, Homo sapiens
gagcctcagcatcctgg

SEQ ID NO: 5744177 - DNA, 12 bp, Homo sapiens
gagcctcagctt

SEQ ID NO: 5744178 - DNA, 15 bp, Homo sapiens
gagcctcagcttctg

SEQ ID NO: 5744179 - DNA, 16 bp, Homo sapiens
gagcctcagcttctgg

SEQ ID NO: 5744180 - DNA, 17 bp, Homo sapiens
gagcctcatccgaggca

SEQ ID NO: 5744181 - DNA, 20 bp, Homo sapiens
gagcctcatccgaggcaggg

SEQ ID NO: 5744182 - DNA, 21 bp, Homo sapiens
gagcctcatgttctcttccca

SEQ ID NO: 5744183 - DNA, 19 bp, Homo sapiens
gagcctccaggttcctcaa

SEQ ID NO: 5744184 - DNA, 21 bp, Homo sapiens
gagcctcccaaggagaacaaa

SEQ ID NO: 5744185 - DNA, 12 bp, Homo sapiens
gagcctcccacc

SEQ ID NO: 5744186 - DNA, 21 bp, Homo sapiens
gagcctccccatctgtccagc

SEQ ID NO: 5744187 - DNA, 16 bp, Homo sapiens
gagcctcccccaaagc

SEQ ID NO: 5744188 - DNA, 14 bp, Homo sapiens
gagcctccccctca

SEQ ID NO: 5744189 - DNA, 12 bp, Homo sapiens
gagcctccctgc

SEQ ID NO: 5744190 - DNA, 13 bp, Homo sapiens
gagcctccctgcc

SEQ ID NO: 5744191 - DNA, 14 bp, Homo sapiens
gagcctccctgcct

SEQ ID NO: 5744192 - DNA, 15 bp, Homo sapiens
gagcctccctgcctc

SEQ ID NO: 5744193 - DNA, 19 bp, Homo sapiens
gagcctccctgcctcaggc

SEQ ID NO: 5744194 - DNA, 15 bp, Homo sapiens
gagcctcctgcccag

SEQ ID NO: 5744195 - DNA, 18 bp, Homo sapiens
gagcctcctgcccagtcc

SEQ ID NO: 5744196 - DNA, 14 bp, Homo sapiens
gagcctcctgccct

SEQ ID NO: 5744197 - DNA, 20 bp, Homo sapiens
gagcctcctgcccttacctg

SEQ ID NO: 5744198 - DNA, 11 bp, Homo sapiens
gagcctcctgg

SEQ ID NO: 5744199 - DNA, 15 bp, Homo sapiens
gagcctcctgtgcct

SEQ ID NO: 5744200 - DNA, 17 bp, Homo sapiens
gagcctcctgtgcctgg

SEQ ID NO: 5744201 - DNA, 20 bp, Homo sapiens
gagcctcgcaacccgtgcca

SEQ ID NO: 5744202 - DNA, 21 bp, Homo sapiens
gagcctcgcccctccagtgtt

SEQ ID NO: 5744203 - DNA, 14 bp, Homo sapiens
gagcctcgctctgt

SEQ ID NO: 5744204 - DNA, 20 bp, Homo sapiens
gagcctcgctttttcatcct

SEQ ID NO: 5744205 - DNA, 17 bp, Homo sapiens
gagcctcgtccctccct

SEQ ID NO: 5744206 - DNA, 19 bp, Homo sapiens
gagcctcgtgtccagactc

SEQ ID NO: 5744207 - DNA, 14 bp, Homo sapiens
gagcctcgtgtcct

SEQ ID NO: 5744208 - DNA, 18 bp, Homo sapiens
gagcctcgtgtcctgcta

SEQ ID NO: 5744209 - DNA, 19 bp, Homo sapiens
gagcctcgtgtcctgctag

SEQ ID NO: 5744210 - DNA, 13 bp, Homo sapiens
gagcctctccttg

SEQ ID NO: 5744211 - DNA, 21 bp, Homo sapiens
gagcctctccttgccccagtc

SEQ ID NO: 5744212 - DNA, 14 bp, Homo sapiens
gagcctctgcgcct

SEQ ID NO: 5744213 - DNA, 18 bp, Homo sapiens
gagcctctgcgcctctcc

SEQ ID NO: 5744214 - DNA, 12 bp, Homo sapiens
gagcctctgtca

SEQ ID NO: 5744215 - DNA, 12 bp, Homo sapiens
gagcctctgttt

SEQ ID NO: 5744216 - DNA, 18 bp, Homo sapiens
gagcctctgttttgtaaa

SEQ ID NO: 5744217 - DNA, 12 bp, Homo sapiens
gagcctcttagt

SEQ ID NO: 5744218 - DNA, 16 bp, Homo sapiens
gagcctcttggggaag

SEQ ID NO: 5744219 - DNA, 14 bp, Homo sapiens
gagcctctttgtaa

SEQ ID NO: 5744220 - DNA, 18 bp, Homo sapiens
gagcctgaaatagtggtt

SEQ ID NO: 5744221 - DNA, 23 bp, Homo sapiens
gagcctgaaccgtgtgctcctcg

SEQ ID NO: 5744222 - DNA, 17 bp, Homo sapiens
gagcctgaagctggcct

SEQ ID NO: 5744223 - DNA, 15 bp, Homo sapiens
gagcctgacgctcag

SEQ ID NO: 5744224 - DNA, 18 bp, Homo sapiens
gagcctgacgctcagccc

SEQ ID NO: 5744225 - DNA, 19 bp, Homo sapiens
gagcctgactgccaggacc

SEQ ID NO: 5744226 - DNA, 18 bp, Homo sapiens
gagcctgaggcaggagaa

SEQ ID NO: 5744227 - DNA, 17 bp, Homo sapiens
gagcctgatctcttcct

SEQ ID NO: 5744228 - DNA, 12 bp, Homo sapiens
gagcctgcaccc

SEQ ID NO: 5744229 - DNA, 23 bp, Homo sapiens
gagcctgcacggtgaatggcttt

SEQ ID NO: 5744230 - DNA, 12 bp, Homo sapiens
gagcctgcagag

SEQ ID NO: 5744231 - DNA, 15 bp, Homo sapiens
gagcctgcagagctg

SEQ ID NO: 5744232 - DNA, 15 bp, Homo sapiens
gagcctgcaggatct

SEQ ID NO: 5744233 - DNA, 20 bp, Homo sapiens
gagcctgcagggtggtgctg

SEQ ID NO: 5744234 - DNA, 18 bp, Homo sapiens
gagcctgcaggtgctgct

SEQ ID NO: 5744235 - DNA, 19 bp, Homo sapiens
gagcctgcatcttcttgca

SEQ ID NO: 5744236 - DNA, 15 bp, Homo sapiens
gagcctgcattctgc

SEQ ID NO: 5744237 - DNA, 23 bp, Homo sapiens
gagcctgcattctgcacgctgcc

SEQ ID NO: 5744238 - DNA, 12 bp, Homo sapiens
gagcctgccaag

SEQ ID NO: 5744239 - DNA, 22 bp, Homo sapiens
gagcctgcccagttggaggaga

SEQ ID NO: 5744240 - DNA, 17 bp, Homo sapiens
gagcctgccccagcgct

SEQ ID NO: 5744241 - DNA, 18 bp, Homo sapiens
gagcctgcccggccggag

SEQ ID NO: 5744242 - DNA, 18 bp, Homo sapiens
gagcctgccctcactccc

SEQ ID NO: 5744243 - DNA, 15 bp, Homo sapiens
gagcctgccgagcaa

SEQ ID NO: 5744244 - DNA, 16 bp, Homo sapiens
gagcctgccgagcaac

SEQ ID NO: 5744245 - DNA, 13 bp, Homo sapiens
gagcctgcctaac

SEQ ID NO: 5744246 - DNA, 22 bp, Homo sapiens
gagcctgcctaaccaggcccag

SEQ ID NO: 5744247 - DNA, 23 bp, Homo sapiens
gagcctgcctaaccaggcccagc

SEQ ID NO: 5744248 - DNA, 15 bp, Homo sapiens
gagcctgcggctgct

SEQ ID NO: 5744249 - DNA, 16 bp, Homo sapiens
gagcctgcggctgctg

SEQ ID NO: 5744250 - DNA, 17 bp, Homo sapiens
gagcctgcggctgctgg

SEQ ID NO: 5744251 - DNA, 19 bp, Homo sapiens
gagcctgcggctgctggca

SEQ ID NO: 5744252 - DNA, 18 bp, Homo sapiens
gagcctgcggggcagcag

SEQ ID NO: 5744253 - DNA, 19 bp, Homo sapiens
gagcctgcggggcagcagg

SEQ ID NO: 5744254 - DNA, 20 bp, Homo sapiens
gagcctgcggggcagcaggg

SEQ ID NO: 5744255 - DNA, 12 bp, Homo sapiens
gagcctgctaag

SEQ ID NO: 5744256 - DNA, 20 bp, Homo sapiens
gagcctgctaaggaacaatg

SEQ ID NO: 5744257 - DNA, 13 bp, Homo sapiens
gagcctgctcccc

SEQ ID NO: 5744258 - DNA, 17 bp, Homo sapiens
gagcctgctcccccacc

SEQ ID NO: 5744259 - DNA, 18 bp, Homo sapiens
gagcctgctctccgcgcc

SEQ ID NO: 5744260 - DNA, 12 bp, Homo sapiens
gagcctgctgga

SEQ ID NO: 5744261 - DNA, 15 bp, Homo sapiens
gagcctgctggaagc

SEQ ID NO: 5744262 - DNA, 12 bp, Homo sapiens
gagcctgctggc

SEQ ID NO: 5744263 - DNA, 13 bp, Homo sapiens
gagcctgctggca

SEQ ID NO: 5744264 - DNA, 12 bp, Homo sapiens
gagcctgctggt

SEQ ID NO: 5744265 - DNA, 21 bp, Homo sapiens
gagcctgctggtcacagcctc

SEQ ID NO: 5744266 - DNA, 16 bp, Homo sapiens
gagcctgcttgctgat

SEQ ID NO: 5744267 - DNA, 10 bp, Homo sapiens
gagcctggca

SEQ ID NO: 5744268 - DNA, 22 bp, Homo sapiens
gagcctggcaaggcattcctca

SEQ ID NO: 5744269 - DNA, 17 bp, Homo sapiens
gagcctggcacaggact

SEQ ID NO: 5744270 - DNA, 23 bp, Homo sapiens
gagcctggccatgtcctcaaccc

SEQ ID NO: 5744271 - DNA, 14 bp, Homo sapiens
gagcctggccccag

SEQ ID NO: 5744272 - DNA, 20 bp, Homo sapiens
gagcctggccccaggcccca

SEQ ID NO: 5744273 - DNA, 23 bp, Homo sapiens
gagcctggccccaggccccagac

SEQ ID NO: 5744274 - DNA, 16 bp, Homo sapiens
gagcctggctgcccat

SEQ ID NO: 5744275 - DNA, 16 bp, Homo sapiens
gagcctggctgtccaa

SEQ ID NO: 5744276 - DNA, 19 bp, Homo sapiens
gagcctggctgtccaacca

SEQ ID NO: 5744277 - DNA, 13 bp, Homo sapiens
gagcctgggccag

SEQ ID NO: 5744278 - DNA, 11 bp, Homo sapiens
gagcctggggc

SEQ ID NO: 5744279 - DNA, 23 bp, Homo sapiens
gagcctggggctctaacgcctga

SEQ ID NO: 5744280 - DNA, 16 bp, Homo sapiens
gagcctgggggctcct

SEQ ID NO: 5744281 - DNA, 11 bp, Homo sapiens
gagcctggggt

SEQ ID NO: 5744282 - DNA, 12 bp, Homo sapiens
gagcctggggtg

SEQ ID NO: 5744283 - DNA, 23 bp, Homo sapiens
gagcctggtcccacgagggtgcc

SEQ ID NO: 5744284 - DNA, 15 bp, Homo sapiens
gagcctggtcctggc

SEQ ID NO: 5744285 - DNA, 17 bp, Homo sapiens
gagcctggtccttccct

SEQ ID NO: 5744286 - DNA, 17 bp, Homo sapiens
gagcctggtgctgctgc

SEQ ID NO: 5744287 - DNA, 22 bp, Homo sapiens
gagcctggttcagacacagctc

SEQ ID NO: 5744288 - DNA, 15 bp, Homo sapiens
gagcctgtaaacttt

SEQ ID NO: 5744289 - DNA, 12 bp, Homo sapiens
gagcctgtcacc

SEQ ID NO: 5744290 - DNA, 16 bp, Homo sapiens
gagcctgtcaccagag

SEQ ID NO: 5744291 - DNA, 17 bp, Homo sapiens
gagcctgtcaccagagc

SEQ ID NO: 5744292 - DNA, 22 bp, Homo sapiens
gagcctgtccccgccttccctc

SEQ ID NO: 5744293 - DNA, 17 bp, Homo sapiens
gagcctgtcctgcctgt

SEQ ID NO: 5744294 - DNA, 15 bp, Homo sapiens
gagcctgtctctccc

SEQ ID NO: 5744295 - DNA, 18 bp, Homo sapiens
gagcctgtgaacccagga

SEQ ID NO: 5744296 - DNA, 17 bp, Homo sapiens
gagcctgtgccttcctc

SEQ ID NO: 5744297 - DNA, 18 bp, Homo sapiens
gagcctgtgcgtcccagc

SEQ ID NO: 5744298 - DNA, 19 bp, Homo sapiens
gagcctgtgcgtcccagct

SEQ ID NO: 5744299 - DNA, 18 bp, Homo sapiens
gagcctgtgggtccccac

SEQ ID NO: 5744300 - DNA, 15 bp, Homo sapiens
gagcctgtgtaacag

SEQ ID NO: 5744301 - DNA, 18 bp, Homo sapiens
gagcctgtgttagtgtct

SEQ ID NO: 5744302 - DNA, 12 bp, Homo sapiens
gagcctgtttat

SEQ ID NO: 5744303 - DNA, 16 bp, Homo sapiens
gagcctgttttaaaaa

SEQ ID NO: 5744304 - DNA, 16 bp, Homo sapiens
gagcctgtttttgtga

SEQ ID NO: 5744305 - DNA, 18 bp, Homo sapiens
gagccttaatggatgctc

SEQ ID NO: 5744306 - DNA, 15 bp, Homo sapiens
gagccttagctccca

SEQ ID NO: 5744307 - DNA, 21 bp, Homo sapiens
gagccttagtttcagctgacc

SEQ ID NO: 5744308 - DNA, 21 bp, Homo sapiens
gagccttagttttttcatctg

SEQ ID NO: 5744309 - DNA, 17 bp, Homo sapiens
gagccttattaaaatat

SEQ ID NO: 5744310 - DNA, 19 bp, Homo sapiens
gagccttcaagtgccaaac

SEQ ID NO: 5744311 - DNA, 21 bp, Homo sapiens
gagccttcacaaccagccaca

SEQ ID NO: 5744312 - DNA, 22 bp, Homo sapiens
gagccttcagaatgctcctgag

SEQ ID NO: 5744313 - DNA, 14 bp, Homo sapiens
gagccttcaggcca

SEQ ID NO: 5744314 - DNA, 15 bp, Homo sapiens
gagccttcaggccag

SEQ ID NO: 5744315 - DNA, 13 bp, Homo sapiens
gagccttccaggg

SEQ ID NO: 5744316 - DNA, 18 bp, Homo sapiens
gagccttctcagaagcac

SEQ ID NO: 5744317 - DNA, 13 bp, Homo sapiens
gagccttctcctg

SEQ ID NO: 5744318 - DNA, 12 bp, Homo sapiens
gagccttctgcc

SEQ ID NO: 5744319 - DNA, 13 bp, Homo sapiens
gagccttctgcca

SEQ ID NO: 5744320 - DNA, 21 bp, Homo sapiens
gagccttctgccaccagcccc

SEQ ID NO: 5744321 - DNA, 21 bp, Homo sapiens
gagccttgcagatatctgcat

SEQ ID NO: 5744322 - DNA, 23 bp, Homo sapiens
gagccttgcagatatctgcatgt

SEQ ID NO: 5744323 - DNA, 13 bp, Homo sapiens
gagccttgcatgt

SEQ ID NO: 5744324 - DNA, 15 bp, Homo sapiens
gagccttgcatgtac

SEQ ID NO: 5744325 - DNA, 20 bp, Homo sapiens
gagccttgcatgtacttgaa

SEQ ID NO: 5744326 - DNA, 14 bp, Homo sapiens
gagccttgctgcca

SEQ ID NO: 5744327 - DNA, 17 bp, Homo sapiens
gagccttgctgggccag

SEQ ID NO: 5744328 - DNA, 19 bp, Homo sapiens
gagccttgctgggccaggg

SEQ ID NO: 5744329 - DNA, 22 bp, Homo sapiens
gagccttggtgtccacctggcc

SEQ ID NO: 5744330 - DNA, 22 bp, Homo sapiens
gagccttgtgagatccttcaca

SEQ ID NO: 5744331 - DNA, 14 bp, Homo sapiens
gagcctttgccttt

SEQ ID NO: 5744332 - DNA, 22 bp, Homo sapiens
gagcctttggaagtctgcgccc

SEQ ID NO: 5744333 - DNA, 20 bp, Homo sapiens
gagcctttggggggccaccc

SEQ ID NO: 5744334 - DNA, 19 bp, Homo sapiens
gagcctttgttgctatcaa

SEQ ID NO: 5744335 - DNA, 18 bp, Homo sapiens
gagccttttaactgtgca

SEQ ID NO: 5744336 - DNA, 23 bp, Homo sapiens
gagccttttccctctttggctcc

SEQ ID NO: 5744337 - DNA, 14 bp, Homo sapiens
gagccttttcttat

SEQ ID NO: 5744338 - DNA, 18 bp, Homo sapiens
gagccttttgcaggaaaa

SEQ ID NO: 5744339 - DNA, 12 bp, Homo sapiens
gagccttttgct

SEQ ID NO: 5744340 - DNA, 14 bp, Homo sapiens
gagccttttgctct

SEQ ID NO: 5744341 - DNA, 17 bp, Homo sapiens
gagccttttgctctctg

SEQ ID NO: 5744342 - DNA, 20 bp, Homo sapiens
gagcgaaactccatctcaaa

SEQ ID NO: 5744343 - DNA, 14 bp, Homo sapiens
gagcgaattgtgtg

SEQ ID NO: 5744344 - DNA, 13 bp, Homo sapiens
gagcgacagtgag

SEQ ID NO: 5744345 - DNA, 13 bp, Homo sapiens
gagcgaccctggc

SEQ ID NO: 5744346 - DNA, 21 bp, Homo sapiens
gagcgaccctggctctgccag

SEQ ID NO: 5744347 - DNA, 21 bp, Homo sapiens
gagcgagacttggtttcaaaa

SEQ ID NO: 5744348 - DNA, 18 bp, Homo sapiens
gagcgaggagatgctcct

SEQ ID NO: 5744349 - DNA, 21 bp, Homo sapiens
gagcgaggaggcgcggcctcc

SEQ ID NO: 5744350 - DNA, 14 bp, Homo sapiens
gagcgagtaaagtc

SEQ ID NO: 5744351 - DNA, 12 bp, Homo sapiens
gagcgagttggt

SEQ ID NO: 5744352 - DNA, 18 bp, Homo sapiens
gagcgatccaggggaagc

SEQ ID NO: 5744353 - DNA, 17 bp, Homo sapiens
gagcgatcgctcccctg

SEQ ID NO: 5744354 - DNA, 18 bp, Homo sapiens
gagcgatcgctcccctgg

SEQ ID NO: 5744355 - DNA, 18 bp, Homo sapiens
gagcgcaagccacagcct

SEQ ID NO: 5744356 - DNA, 21 bp, Homo sapiens
gagcgcacagggagtgcacat

SEQ ID NO: 5744357 - DNA, 18 bp, Homo sapiens
gagcgcacctgccccctg

SEQ ID NO: 5744358 - DNA, 14 bp, Homo sapiens
gagcgcagccccca

SEQ ID NO: 5744359 - DNA, 15 bp, Homo sapiens
gagcgcaggcagcgc

SEQ ID NO: 5744360 - DNA, 16 bp, Homo sapiens
gagcgcatcaggcctg

SEQ ID NO: 5744361 - DNA, 12 bp, Homo sapiens
gagcgccacctc

SEQ ID NO: 5744362 - DNA, 13 bp, Homo sapiens
gagcgccagctcc

SEQ ID NO: 5744363 - DNA, 14 bp, Homo sapiens
gagcgccagctcct

SEQ ID NO: 5744364 - DNA, 19 bp, Homo sapiens
gagcgccaggaagccagag

SEQ ID NO: 5744365 - DNA, 23 bp, Homo sapiens
gagcgcccagctcctgacactgc

SEQ ID NO: 5744366 - DNA, 14 bp, Homo sapiens
gagcgcccccgagc

SEQ ID NO: 5744367 - DNA, 17 bp, Homo sapiens
gagcgcccccgagccct

SEQ ID NO: 5744368 - DNA, 21 bp, Homo sapiens
gagcgcccccgagccctgact

SEQ ID NO: 5744369 - DNA, 21 bp, Homo sapiens
gagcgccctgcagaccctgcc

SEQ ID NO: 5744370 - DNA, 21 bp, Homo sapiens
gagcgccgtgagttctcaggg

SEQ ID NO: 5744371 - DNA, 19 bp, Homo sapiens
gagcgcctccatccaaggc

SEQ ID NO: 5744372 - DNA, 16 bp, Homo sapiens
gagcgcctgaccctgg

SEQ ID NO: 5744373 - DNA, 15 bp, Homo sapiens
gagcgcctgcccctc

SEQ ID NO: 5744374 - DNA, 16 bp, Homo sapiens
gagcgcctgcccctcc

SEQ ID NO: 5744375 - DNA, 17 bp, Homo sapiens
gagcgcctgtgcacaca

SEQ ID NO: 5744376 - DNA, 14 bp, Homo sapiens
gagcgccttggtat

SEQ ID NO: 5744377 - DNA, 17 bp, Homo sapiens
gagcgcgcccctagccg

SEQ ID NO: 5744378 - DNA, 15 bp, Homo sapiens
gagcgcgtgccttcc

SEQ ID NO: 5744379 - DNA, 17 bp, Homo sapiens
gagcgcgtgccttcccc

SEQ ID NO: 5744380 - DNA, 15 bp, Homo sapiens
gagcgctacccactt

SEQ ID NO: 5744381 - DNA, 17 bp, Homo sapiens
gagcgctactcttggat

SEQ ID NO: 5744382 - DNA, 21 bp, Homo sapiens
gagcgctcctctgccttggac

SEQ ID NO: 5744383 - DNA, 15 bp, Homo sapiens
gagcgctcctgccgc

SEQ ID NO: 5744384 - DNA, 14 bp, Homo sapiens
gagcgctggcctct

SEQ ID NO: 5744385 - DNA, 18 bp, Homo sapiens
gagcgctggtcccctccc

SEQ ID NO: 5744386 - DNA, 14 bp, Homo sapiens
gagcggaaagcagc

SEQ ID NO: 5744387 - DNA, 17 bp, Homo sapiens
gagcggaaagcagctca

SEQ ID NO: 5744388 - DNA, 15 bp, Homo sapiens
gagcggagcttgcct

SEQ ID NO: 5744389 - DNA, 17 bp, Homo sapiens
gagcggagcttggccct

SEQ ID NO: 5744390 - DNA, 18 bp, Homo sapiens
gagcggattgcaaagcaa

SEQ ID NO: 5744391 - DNA, 12 bp, Homo sapiens
gagcggccgcct

SEQ ID NO: 5744392 - DNA, 19 bp, Homo sapiens
gagcggccgcctgtccttg

SEQ ID NO: 5744393 - DNA, 15 bp, Homo sapiens
gagcggcgcagagcc

SEQ ID NO: 5744394 - DNA, 21 bp, Homo sapiens
gagcggcgcagagccctccag

SEQ ID NO: 5744395 - DNA, 15 bp, Homo sapiens
gagcggctctcctga

SEQ ID NO: 5744396 - DNA, 13 bp, Homo sapiens
gagcggctgagga

SEQ ID NO: 5744397 - DNA, 22 bp, Homo sapiens
gagcggctgctcgcccaggaag

SEQ ID NO: 5744398 - DNA, 14 bp, Homo sapiens
gagcgggacctgtg

SEQ ID NO: 5744399 - DNA, 15 bp, Homo sapiens
gagcgggaggcagag

SEQ ID NO: 5744400 - DNA, 23 bp, Homo sapiens
gagcgggaggcagcgccccacca

SEQ ID NO: 5744401 - DNA, 13 bp, Homo sapiens
gagcgggagggag

SEQ ID NO: 5744402 - DNA, 22 bp, Homo sapiens
gagcgggagggagtctcaggag

SEQ ID NO: 5744403 - DNA, 12 bp, Homo sapiens
gagcgggatggg

SEQ ID NO: 5744404 - DNA, 12 bp, Homo sapiens
gagcgggcaggg

SEQ ID NO: 5744405 - DNA, 18 bp, Homo sapiens
gagcgggcctcttccctc

SEQ ID NO: 5744406 - DNA, 20 bp, Homo sapiens
gagcgggcctcttccctcag

SEQ ID NO: 5744407 - DNA, 22 bp, Homo sapiens
gagcgggctcgaagaaaataat

SEQ ID NO: 5744408 - DNA, 22 bp, Homo sapiens
gagcgggggctaactggcccca

SEQ ID NO: 5744409 - DNA, 15 bp, Homo sapiens
gagcgggtctgctcc

SEQ ID NO: 5744410 - DNA, 15 bp, Homo sapiens
gagcgggtgcaagca

SEQ ID NO: 5744411 - DNA, 13 bp, Homo sapiens
gagcgggtggggt

SEQ ID NO: 5744412 - DNA, 16 bp, Homo sapiens
gagcggtctcaggctg

SEQ ID NO: 5744413 - DNA, 17 bp, Homo sapiens
gagcggtctcaggctgg

SEQ ID NO: 5744414 - DNA, 19 bp, Homo sapiens
gagcggtgctgtcctcagg

SEQ ID NO: 5744415 - DNA, 13 bp, Homo sapiens
gagcggtggggga

SEQ ID NO: 5744416 - DNA, 16 bp, Homo sapiens
gagcgtcaaagaaaat

SEQ ID NO: 5744417 - DNA, 14 bp, Homo sapiens
gagcgtcactgccc

SEQ ID NO: 5744418 - DNA, 15 bp, Homo sapiens
gagcgtccaggtgat

SEQ ID NO: 5744419 - DNA, 22 bp, Homo sapiens
gagcgtggactggttggttttg

SEQ ID NO: 5744420 - DNA, 13 bp, Homo sapiens
gagcgtggccttg

SEQ ID NO: 5744421 - DNA, 18 bp, Homo sapiens
gagcgtggggaggggctg

SEQ ID NO: 5744422 - DNA, 23 bp, Homo sapiens
gagcgtggggaggggctgaggat

SEQ ID NO: 5744423 - DNA, 14 bp, Homo sapiens
gagcgtgtccacag

SEQ ID NO: 5744424 - DNA, 17 bp, Homo sapiens
gagcgtgtccacagagt

SEQ ID NO: 5744425 - DNA, 17 bp, Homo sapiens
gagcgtttggttaaagt

SEQ ID NO: 5744426 - DNA, 20 bp, Homo sapiens
gagctaaaaaggcccttaga

SEQ ID NO: 5744427 - DNA, 18 bp, Homo sapiens
gagctaaactccttcctg

SEQ ID NO: 5744428 - DNA, 21 bp, Homo sapiens
gagctaaattacaattgtcat

SEQ ID NO: 5744429 - DNA, 14 bp, Homo sapiens
gagctaacactggc

SEQ ID NO: 5744430 - DNA, 16 bp, Homo sapiens
gagctaaggccaatgg

SEQ ID NO: 5744431 - DNA, 22 bp, Homo sapiens
gagctaaggccaatgggctaga

SEQ ID NO: 5744432 - DNA, 20 bp, Homo sapiens
gagctaagggtgggtgctca

SEQ ID NO: 5744433 - DNA, 21 bp, Homo sapiens
gagctacaaagcatgggaaaa

SEQ ID NO: 5744434 - DNA, 14 bp, Homo sapiens
gagctaccaggaag

SEQ ID NO: 5744435 - DNA, 15 bp, Homo sapiens
gagctaccaggaaga

SEQ ID NO: 5744436 - DNA, 19 bp, Homo sapiens
gagctacctgtgtggacag

SEQ ID NO: 5744437 - DNA, 15 bp, Homo sapiens
gagctacgtatttaa

SEQ ID NO: 5744438 - DNA, 20 bp, Homo sapiens
gagctacgtatttaatagca

SEQ ID NO: 5744439 - DNA, 13 bp, Homo sapiens
gagctactcagaa

SEQ ID NO: 5744440 - DNA, 20 bp, Homo sapiens
gagctactccccacctccca

SEQ ID NO: 5744441 - DNA, 17 bp, Homo sapiens
gagctactctcttgcca

SEQ ID NO: 5744442 - DNA, 21 bp, Homo sapiens
gagctactctcttgccagcat

SEQ ID NO: 5744443 - DNA, 16 bp, Homo sapiens
gagctagaacattcca

SEQ ID NO: 5744444 - DNA, 14 bp, Homo sapiens
gagctagaacctgg

SEQ ID NO: 5744445 - DNA, 17 bp, Homo sapiens
gagctagaacctggagg

SEQ ID NO: 5744446 - DNA, 15 bp, Homo sapiens
gagctagaagctgga

SEQ ID NO: 5744447 - DNA, 22 bp, Homo sapiens
gagctagaggccacctatgcca

SEQ ID NO: 5744448 - DNA, 18 bp, Homo sapiens
gagctagccagaggactg

SEQ ID NO: 5744449 - DNA, 15 bp, Homo sapiens
gagctagcctccagc

SEQ ID NO: 5744450 - DNA, 19 bp, Homo sapiens
gagctagcgctgccgcacc

SEQ ID NO: 5744451 - DNA, 17 bp, Homo sapiens
gagctagctagcgcacc

SEQ ID NO: 5744452 - DNA, 14 bp, Homo sapiens
gagctagctgccac

SEQ ID NO: 5744453 - DNA, 15 bp, Homo sapiens
gagctagctgccact

SEQ ID NO: 5744454 - DNA, 15 bp, Homo sapiens
gagctaggaaagagt

SEQ ID NO: 5744455 - DNA, 17 bp, Homo sapiens
gagctaggagaagggct

SEQ ID NO: 5744456 - DNA, 19 bp, Homo sapiens
gagctaggagcaaagcctg

SEQ ID NO: 5744457 - DNA, 21 bp, Homo sapiens
gagctaggagcaaagcctgtt

SEQ ID NO: 5744458 - DNA, 13 bp, Homo sapiens
gagctaggctgtg

SEQ ID NO: 5744459 - DNA, 16 bp, Homo sapiens
gagctagggctgctgc

SEQ ID NO: 5744460 - DNA, 20 bp, Homo sapiens
gagctagggctgctgcttct

SEQ ID NO: 5744461 - DNA, 21 bp, Homo sapiens
gagctaggggcgggggcggag

SEQ ID NO: 5744462 - DNA, 14 bp, Homo sapiens
gagctagtgtcacc

SEQ ID NO: 5744463 - DNA, 19 bp, Homo sapiens
gagctagtgttaatccaga

SEQ ID NO: 5744464 - DNA, 19 bp, Homo sapiens
gagctatacagttttccta

SEQ ID NO: 5744465 - DNA, 23 bp, Homo sapiens
gagctatatttaagtattcaaga

SEQ ID NO: 5744466 - DNA, 15 bp, Homo sapiens
gagctatgagcccag

SEQ ID NO: 5744467 - DNA, 17 bp, Homo sapiens
gagctatgatatgtgct

SEQ ID NO: 5744468 - DNA, 22 bp, Homo sapiens
gagctatgatatgtgcttgtgt

SEQ ID NO: 5744469 - DNA, 15 bp, Homo sapiens
gagctatgcacacca

SEQ ID NO: 5744470 - DNA, 17 bp, Homo sapiens
gagctatgcacaccaaa

SEQ ID NO: 5744471 - DNA, 22 bp, Homo sapiens
gagctatgcacaccaaattgct

SEQ ID NO: 5744472 - DNA, 16 bp, Homo sapiens
gagctatgttccctcc

SEQ ID NO: 5744473 - DNA, 16 bp, Homo sapiens
gagctattcacctcag

SEQ ID NO: 5744474 - DNA, 20 bp, Homo sapiens
gagctatttccttccagcct

SEQ ID NO: 5744475 - DNA, 21 bp, Homo sapiens
gagctatttgtggttgttgag

SEQ ID NO: 5744476 - DNA, 20 bp, Homo sapiens
gagctattttagaaagctaa

SEQ ID NO: 5744477 - DNA, 22 bp, Homo sapiens
gagctattttagaaagctaaat

SEQ ID NO: 5744478 - DNA, 20 bp, Homo sapiens
gagctcaacggtctggcagg

SEQ ID NO: 5744479 - DNA, 21 bp, Homo sapiens
gagctcaagcccttggggagg

SEQ ID NO: 5744480 - DNA, 20 bp, Homo sapiens
gagctcaaggatcagagtaa

SEQ ID NO: 5744481 - DNA, 17 bp, Homo sapiens
gagctcaatctctgcag

SEQ ID NO: 5744482 - DNA, 17 bp, Homo sapiens
gagctcacaaggcagca

SEQ ID NO: 5744483 - DNA, 20 bp, Homo sapiens
gagctcacaaggcagcaagg

SEQ ID NO: 5744484 - DNA, 17 bp, Homo sapiens
gagctcacatgggactg

SEQ ID NO: 5744485 - DNA, 19 bp, Homo sapiens
gagctcacatgggactggg

SEQ ID NO: 5744486 - DNA, 15 bp, Homo sapiens
gagctcaccatggaa

SEQ ID NO: 5744487 - DNA, 21 bp, Homo sapiens
gagctcaccctgcccgctccc

SEQ ID NO: 5744488 - DNA, 16 bp, Homo sapiens
gagctcactcggcacc

SEQ ID NO: 5744489 - DNA, 19 bp, Homo sapiens
gagctcactgtggtgtctg

SEQ ID NO: 5744490 - DNA, 20 bp, Homo sapiens
gagctcagacattttctttt

SEQ ID NO: 5744491 - DNA, 18 bp, Homo sapiens
gagctcagagagggcagg

SEQ ID NO: 5744492 - DNA, 20 bp, Homo sapiens
gagctcagagagggcaggca

SEQ ID NO: 5744493 - DNA, 21 bp, Homo sapiens
gagctcagagagggcaggcat

SEQ ID NO: 5744494 - DNA, 14 bp, Homo sapiens
gagctcagaggacg

SEQ ID NO: 5744495 - DNA, 18 bp, Homo sapiens
gagctcagaggagtctgg

SEQ ID NO: 5744496 - DNA, 14 bp, Homo sapiens
gagctcagctcact

SEQ ID NO: 5744497 - DNA, 12 bp, Homo sapiens
gagctcagctcg

SEQ ID NO: 5744498 - DNA, 20 bp, Homo sapiens
gagctcaggaaccgaggcag

SEQ ID NO: 5744499 - DNA, 15 bp, Homo sapiens
gagctcaggagaagg

SEQ ID NO: 5744500 - DNA, 16 bp, Homo sapiens
gagctcaggagaaggc

SEQ ID NO: 5744501 - DNA, 14 bp, Homo sapiens
gagctcaggctgag

SEQ ID NO: 5744502 - DNA, 20 bp, Homo sapiens
gagctcaggctgagcccagc

SEQ ID NO: 5744503 - DNA, 16 bp, Homo sapiens
gagctcagggctggat

SEQ ID NO: 5744504 - DNA, 14 bp, Homo sapiens
gagctcagtacagg

SEQ ID NO: 5744505 - DNA, 18 bp, Homo sapiens
gagctcagtacagggcag

SEQ ID NO: 5744506 - DNA, 14 bp, Homo sapiens
gagctcatcccccc

SEQ ID NO: 5744507 - DNA, 22 bp, Homo sapiens
gagctcatcccccctgctgccc

SEQ ID NO: 5744508 - DNA, 23 bp, Homo sapiens
gagctcatcccccctgctgccca

SEQ ID NO: 5744509 - DNA, 14 bp, Homo sapiens
gagctcatccctct

SEQ ID NO: 5744510 - DNA, 14 bp, Homo sapiens
gagctcatgtcagc

SEQ ID NO: 5744511 - DNA, 23 bp, Homo sapiens
gagctcattttccacatggcaag

SEQ ID NO: 5744512 - DNA, 13 bp, Homo sapiens
gagctccaccctc

SEQ ID NO: 5744513 - DNA, 14 bp, Homo sapiens
gagctccaccctcc

SEQ ID NO: 5744514 - DNA, 15 bp, Homo sapiens
gagctccaccctccc

SEQ ID NO: 5744515 - DNA, 17 bp, Homo sapiens
gagctccaccctcccct

SEQ ID NO: 5744516 - DNA, 20 bp, Homo sapiens
gagctccacctctggtggct

SEQ ID NO: 5744517 - DNA, 23 bp, Homo sapiens
gagctccacctctggtggctcct

SEQ ID NO: 5744518 - DNA, 22 bp, Homo sapiens
gagctccactctgcttctctga

SEQ ID NO: 5744519 - DNA, 14 bp, Homo sapiens
gagctccagctcct

SEQ ID NO: 5744520 - DNA, 17 bp, Homo sapiens
gagctccaggatgggga

SEQ ID NO: 5744521 - DNA, 23 bp, Homo sapiens
gagctccaggatggggaggggct

SEQ ID NO: 5744522 - DNA, 14 bp, Homo sapiens
gagctccagtggaa

SEQ ID NO: 5744523 - DNA, 18 bp, Homo sapiens
gagctccagtgtcctgag

SEQ ID NO: 5744524 - DNA, 22 bp, Homo sapiens
gagctccagtgtcctgagctca

SEQ ID NO: 5744525 - DNA, 21 bp, Homo sapiens
gagctccatacacacgctgcc

SEQ ID NO: 5744526 - DNA, 22 bp, Homo sapiens
gagctccatacacacgctgcct

SEQ ID NO: 5744527 - DNA, 17 bp, Homo sapiens
gagctccatgttgcttc

SEQ ID NO: 5744528 - DNA, 20 bp, Homo sapiens
gagctcccacaagcctgagg

SEQ ID NO: 5744529 - DNA, 18 bp, Homo sapiens
gagctcccacctcccttc

SEQ ID NO: 5744530 - DNA, 20 bp, Homo sapiens
gagctcccacttctgccaga

SEQ ID NO: 5744531 - DNA, 13 bp, Homo sapiens
gagctcccaggac

SEQ ID NO: 5744532 - DNA, 16 bp, Homo sapiens
gagctcccaggtgcag

SEQ ID NO: 5744533 - DNA, 19 bp, Homo sapiens
gagctccccaccaccccag

SEQ ID NO: 5744534 - DNA, 20 bp, Homo sapiens
gagctccccaccaccccagc

SEQ ID NO: 5744535 - DNA, 22 bp, Homo sapiens
gagctccccaccaccccagctg

SEQ ID NO: 5744536 - DNA, 19 bp, Homo sapiens
gagctccccagatctccca

SEQ ID NO: 5744537 - DNA, 22 bp, Homo sapiens
gagctccccagatctcccactg

SEQ ID NO: 5744538 - DNA, 19 bp, Homo sapiens
gagctcccccgtggtgcct

SEQ ID NO: 5744539 - DNA, 20 bp, Homo sapiens
gagctcccccgtggtgcctg

SEQ ID NO: 5744540 - DNA, 19 bp, Homo sapiens
gagctcccctccacagctg

SEQ ID NO: 5744541 - DNA, 22 bp, Homo sapiens
gagctcccctccacagctgcag

SEQ ID NO: 5744542 - DNA, 15 bp, Homo sapiens
gagctcccctcccca

SEQ ID NO: 5744543 - DNA, 18 bp, Homo sapiens
gagctcccctccccaact

SEQ ID NO: 5744544 - DNA, 23 bp, Homo sapiens
gagctcccctgtttgcatgagaa

SEQ ID NO: 5744545 - DNA, 21 bp, Homo sapiens
gagctcccgaggaagcacagc

SEQ ID NO: 5744546 - DNA, 19 bp, Homo sapiens
gagctcccggcgtggtgga

SEQ ID NO: 5744547 - DNA, 15 bp, Homo sapiens
gagctcccttcctga

SEQ ID NO: 5744548 - DNA, 20 bp, Homo sapiens
gagctccctttttgaattgt

SEQ ID NO: 5744549 - DNA, 22 bp, Homo sapiens
gagctccgtcagcttctcccaa

SEQ ID NO: 5744550 - DNA, 20 bp, Homo sapiens
gagctcctccctccagctgc

SEQ ID NO: 5744551 - DNA, 23 bp, Homo sapiens
gagctcctccctccagctgcgac

SEQ ID NO: 5744552 - DNA, 17 bp, Homo sapiens
gagctcctccgcagaag

SEQ ID NO: 5744553 - DNA, 17 bp, Homo sapiens
gagctcctctcctggag

SEQ ID NO: 5744554 - DNA, 18 bp, Homo sapiens
gagctcctctcctggagg

SEQ ID NO: 5744555 - DNA, 19 bp, Homo sapiens
gagctcctctcctggagga

SEQ ID NO: 5744556 - DNA, 14 bp, Homo sapiens
gagctcctctgggc

SEQ ID NO: 5744557 - DNA, 16 bp, Homo sapiens
gagctcctctgggcag

SEQ ID NO: 5744558 - DNA, 23 bp, Homo sapiens
gagctcctgctgcggaggagctg

SEQ ID NO: 5744559 - DNA, 11 bp, Homo sapiens
gagctcctggc

SEQ ID NO: 5744560 - DNA, 14 bp, Homo sapiens
gagctcctggccag

SEQ ID NO: 5744561 - DNA, 16 bp, Homo sapiens
gagctcctggccagga

SEQ ID NO: 5744562 - DNA, 12 bp, Homo sapiens
gagctcctggga

SEQ ID NO: 5744563 - DNA, 21 bp, Homo sapiens
gagctcctggggagctcctgg

SEQ ID NO: 5744564 - DNA, 17 bp, Homo sapiens
gagctcctgtcccctgc

SEQ ID NO: 5744565 - DNA, 16 bp, Homo sapiens
gagctcctgtccctac

SEQ ID NO: 5744566 - DNA, 17 bp, Homo sapiens
gagctcctgtccctacc

SEQ ID NO: 5744567 - DNA, 18 bp, Homo sapiens
gagctcctgtccctaccc

SEQ ID NO: 5744568 - DNA, 19 bp, Homo sapiens
gagctcctgtccctaccca

SEQ ID NO: 5744569 - DNA, 17 bp, Homo sapiens
gagctcgcagcccccgc

SEQ ID NO: 5744570 - DNA, 15 bp, Homo sapiens
gagctcgcccctccc

SEQ ID NO: 5744571 - DNA, 23 bp, Homo sapiens
gagctcgcccctcccctcagcct

SEQ ID NO: 5744572 - DNA, 18 bp, Homo sapiens
gagctcgctcttgggagt

SEQ ID NO: 5744573 - DNA, 14 bp, Homo sapiens
gagctcggggctgg

SEQ ID NO: 5744574 - DNA, 16 bp, Homo sapiens
gagctcggggctgggg

SEQ ID NO: 5744575 - DNA, 18 bp, Homo sapiens
gagctcggggggctctgc

SEQ ID NO: 5744576 - DNA, 20 bp, Homo sapiens
gagctcggggggctctgcct

SEQ ID NO: 5744577 - DNA, 21 bp, Homo sapiens
gagctcggggggctctgcctt

SEQ ID NO: 5744578 - DNA, 16 bp, Homo sapiens
gagctcgtgggacagt

SEQ ID NO: 5744579 - DNA, 18 bp, Homo sapiens
gagctcgtgtatcctggg

SEQ ID NO: 5744580 - DNA, 20 bp, Homo sapiens
gagctcgtgtatcctggggc

SEQ ID NO: 5744581 - DNA, 22 bp, Homo sapiens
gagctcgtgtatcctggggctc

SEQ ID NO: 5744582 - DNA, 13 bp, Homo sapiens
gagctctacaggc

SEQ ID NO: 5744583 - DNA, 19 bp, Homo sapiens
gagctctacaggcctgcag

SEQ ID NO: 5744584 - DNA, 19 bp, Homo sapiens
gagctctattatgaatgtg

SEQ ID NO: 5744585 - DNA, 13 bp, Homo sapiens
gagctctccagct

SEQ ID NO: 5744586 - DNA, 15 bp, Homo sapiens
gagctctccaggcca

SEQ ID NO: 5744587 - DNA, 16 bp, Homo sapiens
gagctctcccctcctg

SEQ ID NO: 5744588 - DNA, 22 bp, Homo sapiens
gagctctcccctcctgctgggc

SEQ ID NO: 5744589 - DNA, 17 bp, Homo sapiens
gagctctcctccgcctt

SEQ ID NO: 5744590 - DNA, 18 bp, Homo sapiens
gagctctcctgggccagg

SEQ ID NO: 5744591 - DNA, 19 bp, Homo sapiens
gagctctcctgtgcattgt

SEQ ID NO: 5744592 - DNA, 18 bp, Homo sapiens
gagctctctcttctctgt

SEQ ID NO: 5744593 - DNA, 17 bp, Homo sapiens
gagctctctgcccttga

SEQ ID NO: 5744594 - DNA, 16 bp, Homo sapiens
gagctctctgctgagc

SEQ ID NO: 5744595 - DNA, 19 bp, Homo sapiens
gagctctgaaatcttccca

SEQ ID NO: 5744596 - DNA, 12 bp, Homo sapiens
gagctctgagag

SEQ ID NO: 5744597 - DNA, 14 bp, Homo sapiens
gagctctgcgccag

SEQ ID NO: 5744598 - DNA, 23 bp, Homo sapiens
gagctctgcgccaggcagagctg

SEQ ID NO: 5744599 - DNA, 13 bp, Homo sapiens
gagctctggagcc

SEQ ID NO: 5744600 - DNA, 17 bp, Homo sapiens
gagctctggagccacct

SEQ ID NO: 5744601 - DNA, 20 bp, Homo sapiens
gagctctggagccacctgtc

SEQ ID NO: 5744602 - DNA, 15 bp, Homo sapiens
gagctctggctttcg

SEQ ID NO: 5744603 - DNA, 13 bp, Homo sapiens
gagctctggggac

SEQ ID NO: 5744604 - DNA, 20 bp, Homo sapiens
gagctctggtgataaggaca

SEQ ID NO: 5744605 - DNA, 21 bp, Homo sapiens
gagctctgtagcctggtctgt

SEQ ID NO: 5744606 - DNA, 17 bp, Homo sapiens
gagctctgtatggtcag

SEQ ID NO: 5744607 - DNA, 15 bp, Homo sapiens
gagctctgtctgtcc

SEQ ID NO: 5744608 - DNA, 16 bp, Homo sapiens
gagctctgtgggaaaa

SEQ ID NO: 5744609 - DNA, 20 bp, Homo sapiens
gagctctgtgggtctctgga

SEQ ID NO: 5744610 - DNA, 15 bp, Homo sapiens
gagctcttaatgttg

SEQ ID NO: 5744611 - DNA, 20 bp, Homo sapiens
gagctcttcaagctgtcccc

SEQ ID NO: 5744612 - DNA, 19 bp, Homo sapiens
gagctcttcaggcctccct

SEQ ID NO: 5744613 - DNA, 13 bp, Homo sapiens
gagctcttccctt

SEQ ID NO: 5744614 - DNA, 15 bp, Homo sapiens
gagctcttgctatct

SEQ ID NO: 5744615 - DNA, 13 bp, Homo sapiens
gagctcttggaag

SEQ ID NO: 5744616 - DNA, 13 bp, Homo sapiens
gagctcttggccc

SEQ ID NO: 5744617 - DNA, 22 bp, Homo sapiens
gagctcttggcccggcagggcc

SEQ ID NO: 5744618 - DNA, 13 bp, Homo sapiens
gagctcttggcct

SEQ ID NO: 5744619 - DNA, 20 bp, Homo sapiens
gagctcttggcctttgcatt

SEQ ID NO: 5744620 - DNA, 20 bp, Homo sapiens
gagctcttgtgttcagaaga

SEQ ID NO: 5744621 - DNA, 22 bp, Homo sapiens
gagctcttgttccgtgccaggc

SEQ ID NO: 5744622 - DNA, 23 bp, Homo sapiens
gagctcttgttccgtgccaggca

SEQ ID NO: 5744623 - DNA, 20 bp, Homo sapiens
gagctgaaaaatcacatcct

SEQ ID NO: 5744624 - DNA, 19 bp, Homo sapiens
gagctgaaagggagcccct

SEQ ID NO: 5744625 - DNA, 12 bp, Homo sapiens
gagctgaagaaa

SEQ ID NO: 5744626 - DNA, 22 bp, Homo sapiens
gagctgaaggttgtggcctttg

SEQ ID NO: 5744627 - DNA, 12 bp, Homo sapiens
gagctgaatgtt

SEQ ID NO: 5744628 - DNA, 19 bp, Homo sapiens
gagctgaattttctggaaa

SEQ ID NO: 5744629 - DNA, 23 bp, Homo sapiens
gagctgacacaaacctgcctggg

SEQ ID NO: 5744630 - DNA, 13 bp, Homo sapiens
gagctgacagagc

SEQ ID NO: 5744631 - DNA, 14 bp, Homo sapiens
gagctgagaagact

SEQ ID NO: 5744632 - DNA, 19 bp, Homo sapiens
gagctgagaagaggaggag

SEQ ID NO: 5744633 - DNA, 15 bp, Homo sapiens
gagctgagaatagaa

SEQ ID NO: 5744634 - DNA, 20 bp, Homo sapiens
gagctgagaatagaaggaaa

SEQ ID NO: 5744635 - DNA, 10 bp, Homo sapiens
gagctgagat

SEQ ID NO: 5744636 - DNA, 13 bp, Homo sapiens
gagctgagatcgt

SEQ ID NO: 5744637 - DNA, 19 bp, Homo sapiens
gagctgaggactctgcaag

SEQ ID NO: 5744638 - DNA, 12 bp, Homo sapiens
gagctgaggcct

SEQ ID NO: 5744639 - DNA, 17 bp, Homo sapiens
gagctgagggagggagc

SEQ ID NO: 5744640 - DNA, 21 bp, Homo sapiens
gagctgagggagggagccatg

SEQ ID NO: 5744641 - DNA, 15 bp, Homo sapiens
gagctgagggccctg

SEQ ID NO: 5744642 - DNA, 17 bp, Homo sapiens
gagctgagggccctgtg

SEQ ID NO: 5744643 - DNA, 20 bp, Homo sapiens
gagctgagtcacctcctcca

SEQ ID NO: 5744644 - DNA, 18 bp, Homo sapiens
gagctgagtcggctgggc

SEQ ID NO: 5744645 - DNA, 17 bp, Homo sapiens
gagctgagttgggggtg

SEQ ID NO: 5744646 - DNA, 17 bp, Homo sapiens
gagctgatataaattct

SEQ ID NO: 5744647 - DNA, 13 bp, Homo sapiens
gagctgatccaga

SEQ ID NO: 5744648 - DNA, 21 bp, Homo sapiens
gagctgatcgcttctccccca

SEQ ID NO: 5744649 - DNA, 21 bp, Homo sapiens
gagctgatgaaactcacaaat

SEQ ID NO: 5744650 - DNA, 19 bp, Homo sapiens
gagctgatgccccttctcc

SEQ ID NO: 5744651 - DNA, 16 bp, Homo sapiens
gagctgatggagaagg

SEQ ID NO: 5744652 - DNA, 15 bp, Homo sapiens
gagctgatttccagg

SEQ ID NO: 5744653 - DNA, 20 bp, Homo sapiens
gagctgatttccaggcccct

SEQ ID NO: 5744654 - DNA, 21 bp, Homo sapiens
gagctgcacaaagtcagcagg

SEQ ID NO: 5744655 - DNA, 16 bp, Homo sapiens
gagctgcaccaggtag

SEQ ID NO: 5744656 - DNA, 22 bp, Homo sapiens
gagctgcactgatcacccaatg

SEQ ID NO: 5744657 - DNA, 14 bp, Homo sapiens
gagctgcagaatga

SEQ ID NO: 5744658 - DNA, 12 bp, Homo sapiens
gagctgcagagc

SEQ ID NO: 5744659 - DNA, 15 bp, Homo sapiens
gagctgcagcctggc

SEQ ID NO: 5744660 - DNA, 23 bp, Homo sapiens
gagctgcaggaatcacccctctg

SEQ ID NO: 5744661 - DNA, 18 bp, Homo sapiens
gagctgcatggacgcctg

SEQ ID NO: 5744662 - DNA, 19 bp, Homo sapiens
gagctgcatggacgcctgg

SEQ ID NO: 5744663 - DNA, 13 bp, Homo sapiens
gagctgccacctg

SEQ ID NO: 5744664 - DNA, 16 bp, Homo sapiens
gagctgccacctgcct

SEQ ID NO: 5744665 - DNA, 11 bp, Homo sapiens
gagctgccact

SEQ ID NO: 5744666 - DNA, 16 bp, Homo sapiens
gagctgccactgggca

SEQ ID NO: 5744667 - DNA, 20 bp, Homo sapiens
gagctgccactgggcacctg

SEQ ID NO: 5744668 - DNA, 17 bp, Homo sapiens
gagctgccagaatcagg

SEQ ID NO: 5744669 - DNA, 21 bp, Homo sapiens
gagctgccagcctgaggtgcc

SEQ ID NO: 5744670 - DNA, 18 bp, Homo sapiens
gagctgcccacagcaggc

SEQ ID NO: 5744671 - DNA, 15 bp, Homo sapiens
gagctgcccctctct

SEQ ID NO: 5744672 - DNA, 19 bp, Homo sapiens
gagctgcccctctctgggc

SEQ ID NO: 5744673 - DNA, 17 bp, Homo sapiens
gagctgcccggcgcctg

SEQ ID NO: 5744674 - DNA, 21 bp, Homo sapiens
gagctgcccggcgcctgccct

SEQ ID NO: 5744675 - DNA, 21 bp, Homo sapiens
gagctgccctccttgtccacc

SEQ ID NO: 5744676 - DNA, 15 bp, Homo sapiens
gagctgccctctcct

SEQ ID NO: 5744677 - DNA, 18 bp, Homo sapiens
gagctgccctctcctggg

SEQ ID NO: 5744678 - DNA, 23 bp, Homo sapiens
gagctgccctctcctgggcagct

SEQ ID NO: 5744679 - DNA, 19 bp, Homo sapiens
gagctgccgacttggagac

SEQ ID NO: 5744680 - DNA, 13 bp, Homo sapiens
gagctgccgcaag

SEQ ID NO: 5744681 - DNA, 16 bp, Homo sapiens
gagctgccgcaaggcc

SEQ ID NO: 5744682 - DNA, 22 bp, Homo sapiens
gagctgccgcaaggccctgtcc

SEQ ID NO: 5744683 - DNA, 14 bp, Homo sapiens
gagctgccgtgtgg

SEQ ID NO: 5744684 - DNA, 20 bp, Homo sapiens
gagctgcctatgcccagcct

SEQ ID NO: 5744685 - DNA, 11 bp, Homo sapiens
gagctgcctcc

SEQ ID NO: 5744686 - DNA, 17 bp, Homo sapiens
gagctgcctccagcctg

SEQ ID NO: 5744687 - DNA, 15 bp, Homo sapiens
gagctgcctccccaa

SEQ ID NO: 5744688 - DNA, 12 bp, Homo sapiens
gagctgcctgca

SEQ ID NO: 5744689 - DNA, 17 bp, Homo sapiens
gagctgcctgcagcaca

SEQ ID NO: 5744690 - DNA, 19 bp, Homo sapiens
gagctgcctgctctgcagc

SEQ ID NO: 5744691 - DNA, 23 bp, Homo sapiens
gagctgcctgctctgcagcccac

SEQ ID NO: 5744692 - DNA, 20 bp, Homo sapiens
gagctgcctgcttggcccgg

SEQ ID NO: 5744693 - DNA, 11 bp, Homo sapiens
gagctgcctgg

SEQ ID NO: 5744694 - DNA, 12 bp, Homo sapiens
gagctgcctgga

SEQ ID NO: 5744695 - DNA, 14 bp, Homo sapiens
gagctgcctggacc

SEQ ID NO: 5744696 - DNA, 21 bp, Homo sapiens
gagctgcctggatgagaaaca

SEQ ID NO: 5744697 - DNA, 22 bp, Homo sapiens
gagctgcctgttcagctccagc

SEQ ID NO: 5744698 - DNA, 11 bp, Homo sapiens
gagctgccttc

SEQ ID NO: 5744699 - DNA, 19 bp, Homo sapiens
gagctgccttccctagctt

SEQ ID NO: 5744700 - DNA, 18 bp, Homo sapiens
gagctgccttggctcaga

SEQ ID NO: 5744701 - DNA, 21 bp, Homo sapiens
gagctgccttggctcagacat

SEQ ID NO: 5744702 - DNA, 19 bp, Homo sapiens
gagctgctaaaataaacct

SEQ ID NO: 5744703 - DNA, 13 bp, Homo sapiens
gagctgctcacta

SEQ ID NO: 5744704 - DNA, 15 bp, Homo sapiens
gagctgctcctttgg

SEQ ID NO: 5744705 - DNA, 15 bp, Homo sapiens
gagctgctgccatga

SEQ ID NO: 5744706 - DNA, 13 bp, Homo sapiens
gagctgctggcca

SEQ ID NO: 5744707 - DNA, 22 bp, Homo sapiens
gagctgctggctgacctgggcc

SEQ ID NO: 5744708 - DNA, 21 bp, Homo sapiens
gagctgctggcttgcagtgcg

SEQ ID NO: 5744709 - DNA, 23 bp, Homo sapiens
gagctgctgggccccgagccacg

SEQ ID NO: 5744710 - DNA, 13 bp, Homo sapiens
gagctgctgggct

SEQ ID NO: 5744711 - DNA, 14 bp, Homo sapiens
gagctgctgggcta

SEQ ID NO: 5744712 - DNA, 13 bp, Homo sapiens
gagctgctgggtg

SEQ ID NO: 5744713 - DNA, 19 bp, Homo sapiens
gagctgctgggtggcaggg

SEQ ID NO: 5744714 - DNA, 22 bp, Homo sapiens
gagctgctggtctcatttgggg

SEQ ID NO: 5744715 - DNA, 12 bp, Homo sapiens
gagctgctgtcc

SEQ ID NO: 5744716 - DNA, 17 bp, Homo sapiens
gagctgcttccagttgg

SEQ ID NO: 5744717 - DNA, 18 bp, Homo sapiens
gagctgctttttttgaaa

SEQ ID NO: 5744718 - DNA, 13 bp, Homo sapiens
gagctggaaataa

SEQ ID NO: 5744719 - DNA, 22 bp, Homo sapiens
gagctggaaataaacctggaga

SEQ ID NO: 5744720 - DNA, 14 bp, Homo sapiens
gagctggaacacaa

SEQ ID NO: 5744721 - DNA, 15 bp, Homo sapiens
gagctggaacacaat

SEQ ID NO: 5744722 - DNA, 16 bp, Homo sapiens
gagctggaaggcaggg

SEQ ID NO: 5744723 - DNA, 19 bp, Homo sapiens
gagctggaaggcagggcag

SEQ ID NO: 5744724 - DNA, 20 bp, Homo sapiens
gagctggaaggcagggcaga

SEQ ID NO: 5744725 - DNA, 15 bp, Homo sapiens
gagctggaaggggcc

SEQ ID NO: 5744726 - DNA, 22 bp, Homo sapiens
gagctggaaggggccacgtgga

SEQ ID NO: 5744727 - DNA, 15 bp, Homo sapiens
gagctggaccagtgg

SEQ ID NO: 5744728 - DNA, 21 bp, Homo sapiens
gagctggagatgaggccagac

SEQ ID NO: 5744729 - DNA, 22 bp, Homo sapiens
gagctggagatgaggccagacc

SEQ ID NO: 5744730 - DNA, 14 bp, Homo sapiens
gagctggagccccc

SEQ ID NO: 5744731 - DNA, 15 bp, Homo sapiens
gagctggagccccca

SEQ ID NO: 5744732 - DNA, 19 bp, Homo sapiens
gagctggagcccccagcag

SEQ ID NO: 5744733 - DNA, 12 bp, Homo sapiens
gagctggagcct

SEQ ID NO: 5744734 - DNA, 19 bp, Homo sapiens
gagctggagctaaggccag

SEQ ID NO: 5744735 - DNA, 12 bp, Homo sapiens
gagctggagggg

SEQ ID NO: 5744736 - DNA, 19 bp, Homo sapiens
gagctggatagacttggga

SEQ ID NO: 5744737 - DNA, 22 bp, Homo sapiens
gagctggatagacttgggatgg

SEQ ID NO: 5744738 - DNA, 17 bp, Homo sapiens
gagctggcaaccagcca

SEQ ID NO: 5744739 - DNA, 16 bp, Homo sapiens
gagctggcagcctcca

SEQ ID NO: 5744740 - DNA, 18 bp, Homo sapiens
gagctggccaaagagcct

SEQ ID NO: 5744741 - DNA, 19 bp, Homo sapiens
gagctggccaaagagcctt

SEQ ID NO: 5744742 - DNA, 14 bp, Homo sapiens
gagctggcccaggg

SEQ ID NO: 5744743 - DNA, 22 bp, Homo sapiens
gagctggcccagggggcctgga

SEQ ID NO: 5744744 - DNA, 17 bp, Homo sapiens
gagctggccgacggacc

SEQ ID NO: 5744745 - DNA, 21 bp, Homo sapiens
gagctggcctaggtgggagcc

SEQ ID NO: 5744746 - DNA, 11 bp, Homo sapiens
gagctggcctc

SEQ ID NO: 5744747 - DNA, 16 bp, Homo sapiens
gagctggcctctctag

SEQ ID NO: 5744748 - DNA, 15 bp, Homo sapiens
gagctggcctgcggt

SEQ ID NO: 5744749 - DNA, 17 bp, Homo sapiens
gagctggcgctcagcag

SEQ ID NO: 5744750 - DNA, 24 bp, Homo sapiens
gagctggcgctcagcagccctagc

SEQ ID NO: 5744751 - DNA, 14 bp, Homo sapiens
gagctggctccagc

SEQ ID NO: 5744752 - DNA, 12 bp, Homo sapiens
gagctggctctg

SEQ ID NO: 5744753 - DNA, 17 bp, Homo sapiens
gagctggctctgagcgc

SEQ ID NO: 5744754 - DNA, 22 bp, Homo sapiens
gagctggctctgagcgcctcca

SEQ ID NO: 5744755 - DNA, 12 bp, Homo sapiens
gagctggctgac

SEQ ID NO: 5744756 - DNA, 13 bp, Homo sapiens
gagctggctggca

SEQ ID NO: 5744757 - DNA, 16 bp, Homo sapiens
gagctggctgtcttcc

SEQ ID NO: 5744758 - DNA, 19 bp, Homo sapiens
gagctggctttgccaagct

SEQ ID NO: 5744759 - DNA, 18 bp, Homo sapiens
gagctgggaaacagggag

SEQ ID NO: 5744760 - DNA, 20 bp, Homo sapiens
gagctgggaaacagggagcc

SEQ ID NO: 5744761 - DNA, 16 bp, Homo sapiens
gagctgggaaggttcc

SEQ ID NO: 5744762 - DNA, 21 bp, Homo sapiens
gagctgggacacttaacagat

SEQ ID NO: 5744763 - DNA, 22 bp, Homo sapiens
gagctgggagccgggccgcaga

SEQ ID NO: 5744764 - DNA, 17 bp, Homo sapiens
gagctgggaggaaaaga

SEQ ID NO: 5744765 - DNA, 18 bp, Homo sapiens
gagctgggaggcatggcc

SEQ ID NO: 5744766 - DNA, 19 bp, Homo sapiens
gagctgggatcccacagcc

SEQ ID NO: 5744767 - DNA, 20 bp, Homo sapiens
gagctgggatcccacagccc

SEQ ID NO: 5744768 - DNA, 17 bp, Homo sapiens
gagctgggcagaaggcc

SEQ ID NO: 5744769 - DNA, 14 bp, Homo sapiens
gagctgggcatggt

SEQ ID NO: 5744770 - DNA, 11 bp, Homo sapiens
gagctgggccc

SEQ ID NO: 5744771 - DNA, 22 bp, Homo sapiens
gagctgggcccagcccctccac

SEQ ID NO: 5744772 - DNA, 13 bp, Homo sapiens
gagctgggcccga

SEQ ID NO: 5744773 - DNA, 14 bp, Homo sapiens
gagctgggccctgc

SEQ ID NO: 5744774 - DNA, 18 bp, Homo sapiens
gagctgggccctgcctgc

SEQ ID NO: 5744775 - DNA, 21 bp, Homo sapiens
gagctgggccctgcctgcagc

SEQ ID NO: 5744776 - DNA, 14 bp, Homo sapiens
gagctgggcctggt

SEQ ID NO: 5744777 - DNA, 16 bp, Homo sapiens
gagctgggcctggtct

SEQ ID NO: 5744778 - DNA, 12 bp, Homo sapiens
gagctggggaag

SEQ ID NO: 5744779 - DNA, 22 bp, Homo sapiens
gagctggggaatcccctcgctt

SEQ ID NO: 5744780 - DNA, 15 bp, Homo sapiens
gagctggggacctgg

SEQ ID NO: 5744781 - DNA, 19 bp, Homo sapiens
gagctggggacctggtacc

SEQ ID NO: 5744782 - DNA, 20 bp, Homo sapiens
gagctggggaggtgggaggc

SEQ ID NO: 5744783 - DNA, 24 bp, Homo sapiens
gagctggggaggtgggaggccagg

SEQ ID NO: 5744784 - DNA, 17 bp, Homo sapiens
gagctggggcctggaga

SEQ ID NO: 5744785 - DNA, 21 bp, Homo sapiens
gagctggggctgaagttgctc

SEQ ID NO: 5744786 - DNA, 18 bp, Homo sapiens
gagctggggctgccagcc

SEQ ID NO: 5744787 - DNA, 24 bp, Homo sapiens
gagctggggctgccagcctgagcg

SEQ ID NO: 5744788 - DNA, 21 bp, Homo sapiens
gagctggggcttctttctgct

SEQ ID NO: 5744789 - DNA, 21 bp, Homo sapiens
gagctgggggaaggcaggagc

SEQ ID NO: 5744790 - DNA, 14 bp, Homo sapiens
gagctggggggaag

SEQ ID NO: 5744791 - DNA, 21 bp, Homo sapiens
gagctggggggttggcagccc

SEQ ID NO: 5744792 - DNA, 17 bp, Homo sapiens
gagctggggtctgggca

SEQ ID NO: 5744793 - DNA, 22 bp, Homo sapiens
gagctggggtctgggcagtgcc

SEQ ID NO: 5744794 - DNA, 13 bp, Homo sapiens
gagctggggtggg

SEQ ID NO: 5744795 - DNA, 20 bp, Homo sapiens
gagctggggtgggagctcct

SEQ ID NO: 5744796 - DNA, 19 bp, Homo sapiens
gagctgggtaccaggccac

SEQ ID NO: 5744797 - DNA, 14 bp, Homo sapiens
gagctgggtactga

SEQ ID NO: 5744798 - DNA, 16 bp, Homo sapiens
gagctgggtatctcaa

SEQ ID NO: 5744799 - DNA, 15 bp, Homo sapiens
gagctgggtggcctg

SEQ ID NO: 5744800 - DNA, 16 bp, Homo sapiens
gagctgggtggcctgt

SEQ ID NO: 5744801 - DNA, 16 bp, Homo sapiens
gagctggtgactttgg

SEQ ID NO: 5744802 - DNA, 23 bp, Homo sapiens
gagctggtgactttggggacagg

SEQ ID NO: 5744803 - DNA, 18 bp, Homo sapiens
gagctggtgcattacaga

SEQ ID NO: 5744804 - DNA, 15 bp, Homo sapiens
gagctggtgcccgga

SEQ ID NO: 5744805 - DNA, 16 bp, Homo sapiens
gagctggtgcccggag

SEQ ID NO: 5744806 - DNA, 16 bp, Homo sapiens
gagctggtggacccag

SEQ ID NO: 5744807 - DNA, 22 bp, Homo sapiens
gagctggttcctctctcccacc

SEQ ID NO: 5744808 - DNA, 16 bp, Homo sapiens
gagctggtttcctgcc

SEQ ID NO: 5744809 - DNA, 21 bp, Homo sapiens
gagctgtaatttcgccttaaa

SEQ ID NO: 5744810 - DNA, 14 bp, Homo sapiens
gagctgtaggagag

SEQ ID NO: 5744811 - DNA, 23 bp, Homo sapiens
gagctgtatatatatatgtgtgt

SEQ ID NO: 5744812 - DNA, 16 bp, Homo sapiens
gagctgtcaccaagga

SEQ ID NO: 5744813 - DNA, 22 bp, Homo sapiens
gagctgtcaggcagtagcagct

SEQ ID NO: 5744814 - DNA, 15 bp, Homo sapiens
gagctgtcgctgcct

SEQ ID NO: 5744815 - DNA, 16 bp, Homo sapiens
gagctgtcgctgcctc

SEQ ID NO: 5744816 - DNA, 17 bp, Homo sapiens
gagctgtcgctgcctcc

SEQ ID NO: 5744817 - DNA, 18 bp, Homo sapiens
gagctgtcgctgcctcca

SEQ ID NO: 5744818 - DNA, 15 bp, Homo sapiens
gagctgtcggagggc

SEQ ID NO: 5744819 - DNA, 22 bp, Homo sapiens
gagctgtctgaagcccaaagcc

SEQ ID NO: 5744820 - DNA, 15 bp, Homo sapiens
gagctgtctgactgc

SEQ ID NO: 5744821 - DNA, 13 bp, Homo sapiens
gagctgtctgtct

SEQ ID NO: 5744822 - DNA, 13 bp, Homo sapiens
gagctgtcttgtc

SEQ ID NO: 5744823 - DNA, 15 bp, Homo sapiens
gagctgtgacattgc

SEQ ID NO: 5744824 - DNA, 20 bp, Homo sapiens
gagctgtgagttctccctgt

SEQ ID NO: 5744825 - DNA, 17 bp, Homo sapiens
gagctgtgccagctgct

SEQ ID NO: 5744826 - DNA, 20 bp, Homo sapiens
gagctgtgccagctgcttct

SEQ ID NO: 5744827 - DNA, 22 bp, Homo sapiens
gagctgtgccagctgcttctgc

SEQ ID NO: 5744828 - DNA, 19 bp, Homo sapiens
gagctgtgcctgctcagca

SEQ ID NO: 5744829 - DNA, 17 bp, Homo sapiens
gagctgtgcgctgctct

SEQ ID NO: 5744830 - DNA, 22 bp, Homo sapiens
gagctgtggaggattgctatct

SEQ ID NO: 5744831 - DNA, 11 bp, Homo sapiens
gagctgtggct

SEQ ID NO: 5744832 - DNA, 16 bp, Homo sapiens
gagctgtggctggggg

SEQ ID NO: 5744833 - DNA, 19 bp, Homo sapiens
gagctgtgttttgtctgag

SEQ ID NO: 5744834 - DNA, 22 bp, Homo sapiens
gagctgtgttttgtctgagcct

SEQ ID NO: 5744835 - DNA, 16 bp, Homo sapiens
gagctgttataaattt

SEQ ID NO: 5744836 - DNA, 14 bp, Homo sapiens
gagctgttatgctg

SEQ ID NO: 5744837 - DNA, 18 bp, Homo sapiens
gagctgttatgctgtttc

SEQ ID NO: 5744838 - DNA, 22 bp, Homo sapiens
gagctgttatgctgtttcctag

SEQ ID NO: 5744839 - DNA, 16 bp, Homo sapiens
gagctgttgcctcagt

SEQ ID NO: 5744840 - DNA, 21 bp, Homo sapiens
gagctgttggcctcgcctggg

SEQ ID NO: 5744841 - DNA, 22 bp, Homo sapiens
gagctgttggcctcgcctgggc

SEQ ID NO: 5744842 - DNA, 17 bp, Homo sapiens
gagctgttggggcaggg

SEQ ID NO: 5744843 - DNA, 19 bp, Homo sapiens
gagctgtttatggcctcag

SEQ ID NO: 5744844 - DNA, 14 bp, Homo sapiens
gagctgttttggat

SEQ ID NO: 5744845 - DNA, 17 bp, Homo sapiens
gagcttaaaatacaaga

SEQ ID NO: 5744846 - DNA, 15 bp, Homo sapiens
gagcttaacagtgtg

SEQ ID NO: 5744847 - DNA, 17 bp, Homo sapiens
gagcttaagccactgcc

SEQ ID NO: 5744848 - DNA, 22 bp, Homo sapiens
gagcttaagccactgcctctcc

SEQ ID NO: 5744849 - DNA, 22 bp, Homo sapiens
gagcttaatgctacatgtgagt

SEQ ID NO: 5744850 - DNA, 13 bp, Homo sapiens
gagcttacccaag

SEQ ID NO: 5744851 - DNA, 20 bp, Homo sapiens
gagcttacccaagctgtggc

SEQ ID NO: 5744852 - DNA, 17 bp, Homo sapiens
gagcttagccaatgtgg

SEQ ID NO: 5744853 - DNA, 17 bp, Homo sapiens
gagcttagccttgtgcc

SEQ ID NO: 5744854 - DNA, 18 bp, Homo sapiens
gagcttagtgaaattact

SEQ ID NO: 5744855 - DNA, 19 bp, Homo sapiens
gagcttattggccactggg

SEQ ID NO: 5744856 - DNA, 13 bp, Homo sapiens
gagcttattgttt

SEQ ID NO: 5744857 - DNA, 15 bp, Homo sapiens
gagcttcaatataag

SEQ ID NO: 5744858 - DNA, 18 bp, Homo sapiens
gagcttcaggccccagga

SEQ ID NO: 5744859 - DNA, 19 bp, Homo sapiens
gagcttcagggctgggcag

SEQ ID NO: 5744860 - DNA, 12 bp, Homo sapiens
gagcttccaaat

SEQ ID NO: 5744861 - DNA, 19 bp, Homo sapiens
gagcttccactgtcagccc

SEQ ID NO: 5744862 - DNA, 20 bp, Homo sapiens
gagcttccagagctctgacc

SEQ ID NO: 5744863 - DNA, 18 bp, Homo sapiens
gagcttccagtgcatgtt

SEQ ID NO: 5744864 - DNA, 17 bp, Homo sapiens
gagcttcccacacctgc

SEQ ID NO: 5744865 - DNA, 22 bp, Homo sapiens
gagcttcccacacctgcctgcg

SEQ ID NO: 5744866 - DNA, 23 bp, Homo sapiens
gagcttcccaggatccctcccag

SEQ ID NO: 5744867 - DNA, 15 bp, Homo sapiens
gagcttcctggctct

SEQ ID NO: 5744868 - DNA, 16 bp, Homo sapiens
gagcttcctggctctg

SEQ ID NO: 5744869 - DNA, 16 bp, Homo sapiens
gagcttcggggcctcc

SEQ ID NO: 5744870 - DNA, 18 bp, Homo sapiens
gagcttcggttctccaga

SEQ ID NO: 5744871 - DNA, 19 bp, Homo sapiens
gagcttcggttctccagaa

SEQ ID NO: 5744872 - DNA, 20 bp, Homo sapiens
gagcttcggttctccagaat

SEQ ID NO: 5744873 - DNA, 13 bp, Homo sapiens
gagcttctccagc

SEQ ID NO: 5744874 - DNA, 23 bp, Homo sapiens
gagcttctccagccaccaaggct

SEQ ID NO: 5744875 - DNA, 15 bp, Homo sapiens
gagcttctcctctgc

SEQ ID NO: 5744876 - DNA, 19 bp, Homo sapiens
gagcttctcctgaccaggg

SEQ ID NO: 5744877 - DNA, 10 bp, Homo sapiens
gagcttctct

SEQ ID NO: 5744878 - DNA, 14 bp, Homo sapiens
gagcttctctgggc

SEQ ID NO: 5744879 - DNA, 16 bp, Homo sapiens
gagcttctctgggctg

SEQ ID NO: 5744880 - DNA, 19 bp, Homo sapiens
gagcttctctttaactcag

SEQ ID NO: 5744881 - DNA, 23 bp, Homo sapiens
gagcttctctttaactcaggact

SEQ ID NO: 5744882 - DNA, 14 bp, Homo sapiens
gagcttctggcact

SEQ ID NO: 5744883 - DNA, 15 bp, Homo sapiens
gagcttctgtatttt

SEQ ID NO: 5744884 - DNA, 18 bp, Homo sapiens
gagcttgaaatagtgtct

SEQ ID NO: 5744885 - DNA, 20 bp, Homo sapiens
gagcttgaaatagtgtctga

SEQ ID NO: 5744886 - DNA, 13 bp, Homo sapiens
gagcttgaggtgg

SEQ ID NO: 5744887 - DNA, 23 bp, Homo sapiens
gagcttgatctgtgatttcttct

SEQ ID NO: 5744888 - DNA, 21 bp, Homo sapiens
gagcttgcaagaagcaggaag

SEQ ID NO: 5744889 - DNA, 20 bp, Homo sapiens
gagcttgcaatgagccaaga

SEQ ID NO: 5744890 - DNA, 23 bp, Homo sapiens
gagcttgcacagccaacgagaca

SEQ ID NO: 5744891 - DNA, 20 bp, Homo sapiens
gagcttgcctcagggccaag

SEQ ID NO: 5744892 - DNA, 21 bp, Homo sapiens
gagcttgcctcagggccaagc

SEQ ID NO: 5744893 - DNA, 13 bp, Homo sapiens
gagcttgctccag

SEQ ID NO: 5744894 - DNA, 13 bp, Homo sapiens
gagcttgcttctt

SEQ ID NO: 5744895 - DNA, 19 bp, Homo sapiens
gagcttgctttgatttaca

SEQ ID NO: 5744896 - DNA, 23 bp, Homo sapiens
gagcttggagccccctggcggca

SEQ ID NO: 5744897 - DNA, 20 bp, Homo sapiens
gagcttgggactcaggtctg

SEQ ID NO: 5744898 - DNA, 19 bp, Homo sapiens
gagcttgggataaagcaag

SEQ ID NO: 5744899 - DNA, 22 bp, Homo sapiens
gagcttgggcagtgccccaggg

SEQ ID NO: 5744900 - DNA, 16 bp, Homo sapiens
gagcttggtggctgag

SEQ ID NO: 5744901 - DNA, 17 bp, Homo sapiens
gagcttggtggctgagc

SEQ ID NO: 5744902 - DNA, 15 bp, Homo sapiens
gagcttgtagccctg

SEQ ID NO: 5744903 - DNA, 21 bp, Homo sapiens
gagcttgtcttttctgctgag

SEQ ID NO: 5744904 - DNA, 24 bp, Homo sapiens
gagcttgtgctcctcttgattcct

SEQ ID NO: 5744905 - DNA, 14 bp, Homo sapiens
gagcttgtgtcctg

SEQ ID NO: 5744906 - DNA, 16 bp, Homo sapiens
gagctttacaaaaaga

SEQ ID NO: 5744907 - DNA, 15 bp, Homo sapiens
gagctttagacagca

SEQ ID NO: 5744908 - DNA, 22 bp, Homo sapiens
gagctttatgtaataatgtgaa

SEQ ID NO: 5744909 - DNA, 21 bp, Homo sapiens
gagctttccagttagggctgt

SEQ ID NO: 5744910 - DNA, 21 bp, Homo sapiens
gagctttccatgttgctgcca

SEQ ID NO: 5744911 - DNA, 19 bp, Homo sapiens
gagctttcccagagacccg

SEQ ID NO: 5744912 - DNA, 17 bp, Homo sapiens
gagctttccggggagga

SEQ ID NO: 5744913 - DNA, 23 bp, Homo sapiens
gagctttccggggaggagccttg

SEQ ID NO: 5744914 - DNA, 18 bp, Homo sapiens
gagctttctcaatgtctt

SEQ ID NO: 5744915 - DNA, 22 bp, Homo sapiens
gagctttctgctatcaaagagg

SEQ ID NO: 5744916 - DNA, 21 bp, Homo sapiens
gagctttctgtgcatgtgcag

SEQ ID NO: 5744917 - DNA, 14 bp, Homo sapiens
gagctttcttttgt

SEQ ID NO: 5744918 - DNA, 23 bp, Homo sapiens
gagctttgagacaggtgcctggg

SEQ ID NO: 5744919 - DNA, 15 bp, Homo sapiens
gagctttgctcttgg

SEQ ID NO: 5744920 - DNA, 14 bp, Homo sapiens
gagctttgctgcta

SEQ ID NO: 5744921 - DNA, 14 bp, Homo sapiens
gagctttggacaca

SEQ ID NO: 5744922 - DNA, 23 bp, Homo sapiens
gagctttggggacagttggcaga

SEQ ID NO: 5744923 - DNA, 17 bp, Homo sapiens
gagctttgggtgaccag

SEQ ID NO: 5744924 - DNA, 21 bp, Homo sapiens
gagctttgggtgaccagccac

SEQ ID NO: 5744925 - DNA, 16 bp, Homo sapiens
gagctttgtcacttgc

SEQ ID NO: 5744926 - DNA, 17 bp, Homo sapiens
gagctttgtcacttgcc

SEQ ID NO: 5744927 - DNA, 20 bp, Homo sapiens
gagctttgtcacttgccaca

SEQ ID NO: 5744928 - DNA, 13 bp, Homo sapiens
gagctttgtgctt

SEQ ID NO: 5744929 - DNA, 14 bp, Homo sapiens
gagctttgttactg

SEQ ID NO: 5744930 - DNA, 11 bp, Homo sapiens
gagcttttaaa

SEQ ID NO: 5744931 - DNA, 16 bp, Homo sapiens
gagcttttcagaacat

SEQ ID NO: 5744932 - DNA, 20 bp, Homo sapiens
gagcttttgagtgttcccaa

SEQ ID NO: 5744933 - DNA, 13 bp, Homo sapiens
gagcttttgatgc

SEQ ID NO: 5744934 - DNA, 15 bp, Homo sapiens
gagcttttgcatttc

SEQ ID NO: 5744935 - DNA, 19 bp, Homo sapiens
gagctttttaatagcacta

SEQ ID NO: 5744936 - DNA, 23 bp, Homo sapiens
gagctttttcagaaacagggcag

SEQ ID NO: 5744937 - DNA, 24 bp, Homo sapiens
gagctttttcagaaacagggcagc

SEQ ID NO: 5744938 - DNA, 21 bp, Homo sapiens
gagcttttttgtaccctgaag

SEQ ID NO: 5744939 - DNA, 16 bp, Homo sapiens
gaggaaaaaagaacca

SEQ ID NO: 5744940 - DNA, 16 bp, Homo sapiens
gaggaaaaacaacaaa

SEQ ID NO: 5744941 - DNA, 17 bp, Homo sapiens
gaggaaaaacaacaaat

SEQ ID NO: 5744942 - DNA, 16 bp, Homo sapiens
gaggaaaaaggctggt

SEQ ID NO: 5744943 - DNA, 21 bp, Homo sapiens
gaggaaaaatactaagagatt

SEQ ID NO: 5744944 - DNA, 20 bp, Homo sapiens
gaggaaaaatgggagccagg

SEQ ID NO: 5744945 - DNA, 21 bp, Homo sapiens
gaggaaaaatgggagccagga

SEQ ID NO: 5744946 - DNA, 15 bp, Homo sapiens
gaggaaaagcccagg

SEQ ID NO: 5744947 - DNA, 13 bp, Homo sapiens
gaggaaaagctaa

SEQ ID NO: 5744948 - DNA, 18 bp, Homo sapiens
gaggaaaaggcccctgca

SEQ ID NO: 5744949 - DNA, 16 bp, Homo sapiens
gaggaaaaggcttgag

SEQ ID NO: 5744950 - DNA, 16 bp, Homo sapiens
gaggaaaaggtccttg

SEQ ID NO: 5744951 - DNA, 16 bp, Homo sapiens
gaggaaaagtgcaatg

SEQ ID NO: 5744952 - DNA, 21 bp, Homo sapiens
gaggaaaataatgtaattgta

SEQ ID NO: 5744953 - DNA, 12 bp, Homo sapiens
gaggaaaatatt

SEQ ID NO: 5744954 - DNA, 12 bp, Homo sapiens
gaggaaaattct

SEQ ID NO: 5744955 - DNA, 18 bp, Homo sapiens
gaggaaacaacagcttta

SEQ ID NO: 5744956 - DNA, 19 bp, Homo sapiens
gaggaaacaggcctcaagc

SEQ ID NO: 5744957 - DNA, 20 bp, Homo sapiens
gaggaaacgggttaaaaatt

SEQ ID NO: 5744958 - DNA, 22 bp, Homo sapiens
gaggaaactactgcctttagaa

SEQ ID NO: 5744959 - DNA, 20 bp, Homo sapiens
gaggaaactcacctgctggc

SEQ ID NO: 5744960 - DNA, 19 bp, Homo sapiens
gaggaaactggcgatctcc

SEQ ID NO: 5744961 - DNA, 18 bp, Homo sapiens
gaggaaacttaagatgaa

SEQ ID NO: 5744962 - DNA, 13 bp, Homo sapiens
gaggaaagagagc

SEQ ID NO: 5744963 - DNA, 16 bp, Homo sapiens
gaggaaagcaaaggag

SEQ ID NO: 5744964 - DNA, 19 bp, Homo sapiens
gaggaaagcacagaggcct

SEQ ID NO: 5744965 - DNA, 13 bp, Homo sapiens
gaggaaaggccag

SEQ ID NO: 5744966 - DNA, 14 bp, Homo sapiens
gaggaaagggctgg

SEQ ID NO: 5744967 - DNA, 17 bp, Homo sapiens
gaggaaagggctggctc

SEQ ID NO: 5744968 - DNA, 21 bp, Homo sapiens
gaggaaaggtgacttcctctg

SEQ ID NO: 5744969 - DNA, 20 bp, Homo sapiens
gaggaaagtacattttttga

SEQ ID NO: 5744970 - DNA, 20 bp, Homo sapiens
gaggaaagtcaaatcttggt

SEQ ID NO: 5744971 - DNA, 21 bp, Homo sapiens
gaggaaataaagttaagtttg

SEQ ID NO: 5744972 - DNA, 21 bp, Homo sapiens
gaggaaataagaaaaatcatg

SEQ ID NO: 5744973 - DNA, 20 bp, Homo sapiens
gaggaaatcaaagtgctatt

SEQ ID NO: 5744974 - DNA, 18 bp, Homo sapiens
gaggaaatctgcagaggg

SEQ ID NO: 5744975 - DNA, 16 bp, Homo sapiens
gaggaaattaaataat

SEQ ID NO: 5744976 - DNA, 19 bp, Homo sapiens
gaggaacaggttcctgtgg

SEQ ID NO: 5744977 - DNA, 21 bp, Homo sapiens
gaggaacagtggccttgcttc

SEQ ID NO: 5744978 - DNA, 20 bp, Homo sapiens
gaggaacatgcataagaaat

SEQ ID NO: 5744979 - DNA, 22 bp, Homo sapiens
gaggaaccacatataacactta

SEQ ID NO: 5744980 - DNA, 23 bp, Homo sapiens
gaggaaccacatataacacttaa

SEQ ID NO: 5744981 - DNA, 23 bp, Homo sapiens
gaggaacgggcagccacaggact

SEQ ID NO: 5744982 - DNA, 20 bp, Homo sapiens
gaggaactagccaccaactc

SEQ ID NO: 5744983 - DNA, 16 bp, Homo sapiens
gaggaactccaggacg

SEQ ID NO: 5744984 - DNA, 15 bp, Homo sapiens
gaggaactccttggc

SEQ ID NO: 5744985 - DNA, 16 bp, Homo sapiens
gaggaactccttggcc

SEQ ID NO: 5744986 - DNA, 23 bp, Homo sapiens
gaggaactccttggcctagccca

SEQ ID NO: 5744987 - DNA, 17 bp, Homo sapiens
gaggaactgtccagaga

SEQ ID NO: 5744988 - DNA, 18 bp, Homo sapiens
gaggaactgtccagagag

SEQ ID NO: 5744989 - DNA, 21 bp, Homo sapiens
gaggaactgtccagagagcaa

SEQ ID NO: 5744990 - DNA, 17 bp, Homo sapiens
gaggaacttgctgctgt

SEQ ID NO: 5744991 - DNA, 14 bp, Homo sapiens
gaggaagaataggg

SEQ ID NO: 5744992 - DNA, 13 bp, Homo sapiens
gaggaagagccac

SEQ ID NO: 5744993 - DNA, 15 bp, Homo sapiens
gaggaagagccacct

SEQ ID NO: 5744994 - DNA, 17 bp, Homo sapiens
gaggaagagccacctgc

SEQ ID NO: 5744995 - DNA, 18 bp, Homo sapiens
gaggaagagccacctgca

SEQ ID NO: 5744996 - DNA, 16 bp, Homo sapiens
gaggaagatgaagaga

SEQ ID NO: 5744997 - DNA, 21 bp, Homo sapiens
gaggaagatgaagagaagctg

SEQ ID NO: 5744998 - DNA, 18 bp, Homo sapiens
gaggaagatttgtctact

SEQ ID NO: 5744999 - DNA, 14 bp, Homo sapiens
gaggaagcacctct

SEQ ID NO: 5745000 - DNA, 13 bp, Homo sapiens
gaggaagcagaat

SEQ ID NO: 5745001 - DNA, 15 bp, Homo sapiens
gaggaagcagaataa

SEQ ID NO: 5745002 - DNA, 20 bp, Homo sapiens
gaggaagcagaataaagcaa

SEQ ID NO: 5745003 - DNA, 22 bp, Homo sapiens
gaggaagcagaataaagcaatt

SEQ ID NO: 5745004 - DNA, 21 bp, Homo sapiens
gaggaagcagttggggccctc

SEQ ID NO: 5745005 - DNA, 16 bp, Homo sapiens
gaggaagccagtggag

SEQ ID NO: 5745006 - DNA, 13 bp, Homo sapiens
gaggaagccgctg

SEQ ID NO: 5745007 - DNA, 17 bp, Homo sapiens
gaggaagccgctggggc

SEQ ID NO: 5745008 - DNA, 18 bp, Homo sapiens
gaggaagccgctggggcc

SEQ ID NO: 5745009 - DNA, 15 bp, Homo sapiens
gaggaagccttgccc

SEQ ID NO: 5745010 - DNA, 21 bp, Homo sapiens
gaggaagctccagtcctgctc

SEQ ID NO: 5745011 - DNA, 22 bp, Homo sapiens
gaggaagctctcccttgtttac

SEQ ID NO: 5745012 - DNA, 19 bp, Homo sapiens
gaggaagctggacagcggc

SEQ ID NO: 5745013 - DNA, 22 bp, Homo sapiens
gaggaaggaaaaggaggaaatt

SEQ ID NO: 5745014 - DNA, 22 bp, Homo sapiens
gaggaaggaaacatagaaagac

SEQ ID NO: 5745015 - DNA, 13 bp, Homo sapiens
gaggaaggaaacc

SEQ ID NO: 5745016 - DNA, 19 bp, Homo sapiens
gaggaaggaaacccagctc

SEQ ID NO: 5745017 - DNA, 16 bp, Homo sapiens
gaggaaggaggaccca

SEQ ID NO: 5745018 - DNA, 18 bp, Homo sapiens
gaggaaggaggacccagg

SEQ ID NO: 5745019 - DNA, 13 bp, Homo sapiens
gaggaaggaggcc

SEQ ID NO: 5745020 - DNA, 16 bp, Homo sapiens
gaggaaggatgcaaag

SEQ ID NO: 5745021 - DNA, 16 bp, Homo sapiens
gaggaaggattgtaaa

SEQ ID NO: 5745022 - DNA, 10 bp, Homo sapiens
gaggaaggca

SEQ ID NO: 5745023 - DNA, 13 bp, Homo sapiens
gaggaaggcaaga

SEQ ID NO: 5745024 - DNA, 21 bp, Homo sapiens
gaggaaggcaagagggggtgg

SEQ ID NO: 5745025 - DNA, 21 bp, Homo sapiens
gaggaaggcatgcctggacaa

SEQ ID NO: 5745026 - DNA, 16 bp, Homo sapiens
gaggaaggcccagggg

SEQ ID NO: 5745027 - DNA, 18 bp, Homo sapiens
gaggaaggcctttcttct

SEQ ID NO: 5745028 - DNA, 20 bp, Homo sapiens
gaggaaggcctttcttctgt

SEQ ID NO: 5745029 - DNA, 13 bp, Homo sapiens
gaggaagggaggc

SEQ ID NO: 5745030 - DNA, 18 bp, Homo sapiens
gaggaagggaggcctgag

SEQ ID NO: 5745031 - DNA, 22 bp, Homo sapiens
gaggaagggccaggagagagat

SEQ ID NO: 5745032 - DNA, 18 bp, Homo sapiens
gaggaagggctgggccac

SEQ ID NO: 5745033 - DNA, 21 bp, Homo sapiens
gaggaagggctgggccaccag

SEQ ID NO: 5745034 - DNA, 19 bp, Homo sapiens
gaggaaggggtgctgtgag

SEQ ID NO: 5745035 - DNA, 21 bp, Homo sapiens
gaggaaggtcccatggcctgc

SEQ ID NO: 5745036 - DNA, 23 bp, Homo sapiens
gaggaaggtcccatggcctgctg

SEQ ID NO: 5745037 - DNA, 18 bp, Homo sapiens
gaggaaggtgctgagctt

SEQ ID NO: 5745038 - DNA, 16 bp, Homo sapiens
gaggaagtacaaacta

SEQ ID NO: 5745039 - DNA, 16 bp, Homo sapiens
gaggaagtgagcagtc

SEQ ID NO: 5745040 - DNA, 17 bp, Homo sapiens
gaggaagtggatctgct

SEQ ID NO: 5745041 - DNA, 17 bp, Homo sapiens
gaggaagtggggtctgg

SEQ ID NO: 5745042 - DNA, 20 bp, Homo sapiens
gaggaagtggggtctggcct

SEQ ID NO: 5745043 - DNA, 13 bp, Homo sapiens
gaggaagttctcc

SEQ ID NO: 5745044 - DNA, 21 bp, Homo sapiens
gaggaagttggctgagccatt

SEQ ID NO: 5745045 - DNA, 21 bp, Homo sapiens
gaggaataaagctgtgagcaa

SEQ ID NO: 5745046 - DNA, 19 bp, Homo sapiens
gaggaataaatgcctttat

SEQ ID NO: 5745047 - DNA, 22 bp, Homo sapiens
gaggaataagaatggagcagta

SEQ ID NO: 5745048 - DNA, 17 bp, Homo sapiens
gaggaataattatttat

SEQ ID NO: 5745049 - DNA, 18 bp, Homo sapiens
gaggaataattatttatt

SEQ ID NO: 5745050 - DNA, 17 bp, Homo sapiens
gaggaatactgaacatc

SEQ ID NO: 5745051 - DNA, 22 bp, Homo sapiens
gaggaatagtgcttgctggcca

SEQ ID NO: 5745052 - DNA, 21 bp, Homo sapiens
gaggaatcatgtcaggcctgt

SEQ ID NO: 5745053 - DNA, 17 bp, Homo sapiens
gaggaatcctggcagcc

SEQ ID NO: 5745054 - DNA, 19 bp, Homo sapiens
gaggaatcctggcagccca

SEQ ID NO: 5745055 - DNA, 20 bp, Homo sapiens
gaggaatcgaggaaccagag

SEQ ID NO: 5745056 - DNA, 20 bp, Homo sapiens
gaggaatctgtgggtctggg

SEQ ID NO: 5745057 - DNA, 17 bp, Homo sapiens
gaggaatgatgaagctt

SEQ ID NO: 5745058 - DNA, 17 bp, Homo sapiens
gaggaatgctggactgg

SEQ ID NO: 5745059 - DNA, 22 bp, Homo sapiens
gaggaatggccctcattcagta

SEQ ID NO: 5745060 - DNA, 14 bp, Homo sapiens
gaggaatgtagggc

SEQ ID NO: 5745061 - DNA, 13 bp, Homo sapiens
gaggaatgtgctt

SEQ ID NO: 5745062 - DNA, 18 bp, Homo sapiens
gaggaatgtgcttttcca

SEQ ID NO: 5745063 - DNA, 20 bp, Homo sapiens
gaggaatgtgtgccttgttc

SEQ ID NO: 5745064 - DNA, 22 bp, Homo sapiens
gaggaattcttctgttctctgg

SEQ ID NO: 5745065 - DNA, 18 bp, Homo sapiens
gaggaattggggtttctg

SEQ ID NO: 5745066 - DNA, 14 bp, Homo sapiens
gaggaatttgaagc

SEQ ID NO: 5745067 - DNA, 20 bp, Homo sapiens
gaggaatttgaagctcagaa

SEQ ID NO: 5745068 - DNA, 13 bp, Homo sapiens
gaggacaaaactt

SEQ ID NO: 5745069 - DNA, 14 bp, Homo sapiens
gaggacaaaacttc

SEQ ID NO: 5745070 - DNA, 15 bp, Homo sapiens
gaggacaaaacttct

SEQ ID NO: 5745071 - DNA, 21 bp, Homo sapiens
gaggacaaccatgcaaattgt

SEQ ID NO: 5745072 - DNA, 17 bp, Homo sapiens
gaggacaagaccctctc

SEQ ID NO: 5745073 - DNA, 21 bp, Homo sapiens
gaggacaagaccctctcaggc

SEQ ID NO: 5745074 - DNA, 15 bp, Homo sapiens
gaggacaagttacac

SEQ ID NO: 5745075 - DNA, 20 bp, Homo sapiens
gaggacaattcatgaacttc

SEQ ID NO: 5745076 - DNA, 13 bp, Homo sapiens
gaggacacaatgg

SEQ ID NO: 5745077 - DNA, 17 bp, Homo sapiens
gaggacacagcacaagg

SEQ ID NO: 5745078 - DNA, 21 bp, Homo sapiens
gaggacacagcacaagggcac

SEQ ID NO: 5745079 - DNA, 23 bp, Homo sapiens
gaggacacagcacaagggcacat

SEQ ID NO: 5745080 - DNA, 14 bp, Homo sapiens
gaggacacaggcag

SEQ ID NO: 5745081 - DNA, 12 bp, Homo sapiens
gaggacacatgt

SEQ ID NO: 5745082 - DNA, 21 bp, Homo sapiens
gaggacacctgtactggagag

SEQ ID NO: 5745083 - DNA, 20 bp, Homo sapiens
gaggacactaggagactggt

SEQ ID NO: 5745084 - DNA, 15 bp, Homo sapiens
gaggacagaaggact

SEQ ID NO: 5745085 - DNA, 17 bp, Homo sapiens
gaggacagaaggactgg

SEQ ID NO: 5745086 - DNA, 14 bp, Homo sapiens
gaggacagagcttg

SEQ ID NO: 5745087 - DNA, 22 bp, Homo sapiens
gaggacagagggagacagggct

SEQ ID NO: 5745088 - DNA, 17 bp, Homo sapiens
gaggacagagggcacat

SEQ ID NO: 5745089 - DNA, 18 bp, Homo sapiens
gaggacagagtgccctgg

SEQ ID NO: 5745090 - DNA, 12 bp, Homo sapiens
gaggacagcctg

SEQ ID NO: 5745091 - DNA, 15 bp, Homo sapiens
gaggacagcctgcct

SEQ ID NO: 5745092 - DNA, 16 bp, Homo sapiens
gaggacagcctgcctc

SEQ ID NO: 5745093 - DNA, 15 bp, Homo sapiens
gaggacagctctggg

SEQ ID NO: 5745094 - DNA, 18 bp, Homo sapiens
gaggacagcttgagccgg

SEQ ID NO: 5745095 - DNA, 16 bp, Homo sapiens
gaggacaggcaggcca

SEQ ID NO: 5745096 - DNA, 21 bp, Homo sapiens
gaggacagggacttcgcagag

SEQ ID NO: 5745097 - DNA, 22 bp, Homo sapiens
gaggacagggaggtgaccccag

SEQ ID NO: 5745098 - DNA, 12 bp, Homo sapiens
gaggacagggcc

SEQ ID NO: 5745099 - DNA, 22 bp, Homo sapiens
gaggacaggtggaggcgagcca

SEQ ID NO: 5745100 - DNA, 22 bp, Homo sapiens
gaggacagtatttgtggggagg

SEQ ID NO: 5745101 - DNA, 19 bp, Homo sapiens
gaggacatcaaagtggtaa

SEQ ID NO: 5745102 - DNA, 14 bp, Homo sapiens
gaggacatcacctg

SEQ ID NO: 5745103 - DNA, 11 bp, Homo sapiens
gaggacatcat

SEQ ID NO: 5745104 - DNA, 19 bp, Homo sapiens
gaggacatgcgtgtgtcag

SEQ ID NO: 5745105 - DNA, 17 bp, Homo sapiens
gaggacatggagagaga

SEQ ID NO: 5745106 - DNA, 21 bp, Homo sapiens
gaggacatttgtgggcaagca

SEQ ID NO: 5745107 - DNA, 13 bp, Homo sapiens
gaggaccaccagc

SEQ ID NO: 5745108 - DNA, 23 bp, Homo sapiens
gaggaccactttggagactgggg

SEQ ID NO: 5745109 - DNA, 12 bp, Homo sapiens
gaggaccagagg

SEQ ID NO: 5745110 - DNA, 14 bp, Homo sapiens
gaggaccagaggag

SEQ ID NO: 5745111 - DNA, 16 bp, Homo sapiens
gaggaccagaggagca

SEQ ID NO: 5745112 - DNA, 16 bp, Homo sapiens
gaggaccagggccctg

SEQ ID NO: 5745113 - DNA, 14 bp, Homo sapiens
gaggaccagggtgg

SEQ ID NO: 5745114 - DNA, 20 bp, Homo sapiens
gaggaccagggtggagctga

SEQ ID NO: 5745115 - DNA, 13 bp, Homo sapiens
gaggaccatcggg

SEQ ID NO: 5745116 - DNA, 19 bp, Homo sapiens
gaggacccacactgctaca

SEQ ID NO: 5745117 - DNA, 22 bp, Homo sapiens
gaggacccacctgggccaagga

SEQ ID NO: 5745118 - DNA, 14 bp, Homo sapiens
gaggacccaggaca

SEQ ID NO: 5745119 - DNA, 16 bp, Homo sapiens
gaggacccagggctct

SEQ ID NO: 5745120 - DNA, 12 bp, Homo sapiens
gaggaccccagg

SEQ ID NO: 5745121 - DNA, 14 bp, Homo sapiens
gaggacccctgccc

SEQ ID NO: 5745122 - DNA, 16 bp, Homo sapiens
gaggacccctgccctc

SEQ ID NO: 5745123 - DNA, 14 bp, Homo sapiens
gaggacccctgcct

SEQ ID NO: 5745124 - DNA, 21 bp, Homo sapiens
gaggaccccttaatcttgctt

SEQ ID NO: 5745125 - DNA, 18 bp, Homo sapiens
gaggaccctcagccccag

SEQ ID NO: 5745126 - DNA, 20 bp, Homo sapiens
gaggaccctggttactctgg

SEQ ID NO: 5745127 - DNA, 22 bp, Homo sapiens
gaggaccgaggctacagctcca

SEQ ID NO: 5745128 - DNA, 19 bp, Homo sapiens
gaggaccgccccaaccctc

SEQ ID NO: 5745129 - DNA, 22 bp, Homo sapiens
gaggaccgccccaccctggaat

SEQ ID NO: 5745130 - DNA, 12 bp, Homo sapiens
gaggaccgggca

SEQ ID NO: 5745131 - DNA, 16 bp, Homo sapiens
gaggacctccacctgg

SEQ ID NO: 5745132 - DNA, 21 bp, Homo sapiens
gaggacctccacctgggagat

SEQ ID NO: 5745133 - DNA, 22 bp, Homo sapiens
gaggacctccacctgggagatg

SEQ ID NO: 5745134 - DNA, 12 bp, Homo sapiens
gaggacctccct

SEQ ID NO: 5745135 - DNA, 14 bp, Homo sapiens
gaggacctccctgt

SEQ ID NO: 5745136 - DNA, 14 bp, Homo sapiens
gaggacctctgggc

SEQ ID NO: 5745137 - DNA, 18 bp, Homo sapiens
gaggacctgcggccttgg

SEQ ID NO: 5745138 - DNA, 17 bp, Homo sapiens
gaggacctgtatttaag

SEQ ID NO: 5745139 - DNA, 23 bp, Homo sapiens
gaggacctgtatttaagcaaata

SEQ ID NO: 5745140 - DNA, 12 bp, Homo sapiens
gaggacctttct

SEQ ID NO: 5745141 - DNA, 13 bp, Homo sapiens
gaggacgagaccc

SEQ ID NO: 5745142 - DNA, 15 bp, Homo sapiens
gaggacgagaccccc

SEQ ID NO: 5745143 - DNA, 20 bp, Homo sapiens
gaggacgcacgctcgctgcc

SEQ ID NO: 5745144 - DNA, 21 bp, Homo sapiens
gaggacgcacgctcgctgcca

SEQ ID NO: 5745145 - DNA, 17 bp, Homo sapiens
gaggacggccctgcctg

SEQ ID NO: 5745146 - DNA, 16 bp, Homo sapiens
gaggacggggcagagc

SEQ ID NO: 5745147 - DNA, 22 bp, Homo sapiens
gaggacggggcagagctgagtc

SEQ ID NO: 5745148 - DNA, 16 bp, Homo sapiens
gaggacgtgggcggca

SEQ ID NO: 5745149 - DNA, 21 bp, Homo sapiens
gaggactactatttgaagcaa

SEQ ID NO: 5745150 - DNA, 23 bp, Homo sapiens
gaggactccaggcagcagacaca

SEQ ID NO: 5745151 - DNA, 18 bp, Homo sapiens
gaggactcccaaccctgg

SEQ ID NO: 5745152 - DNA, 20 bp, Homo sapiens
gaggactcccaaccctggct

SEQ ID NO: 5745153 - DNA, 18 bp, Homo sapiens
gaggactccctccatgtg

SEQ ID NO: 5745154 - DNA, 18 bp, Homo sapiens
gaggactccgggaccatt

SEQ ID NO: 5745155 - DNA, 23 bp, Homo sapiens
gaggactccgggaccattgacct

SEQ ID NO: 5745156 - DNA, 20 bp, Homo sapiens
gaggactcgcttgtaaatac

SEQ ID NO: 5745157 - DNA, 18 bp, Homo sapiens
gaggactcggccactgtg

SEQ ID NO: 5745158 - DNA, 12 bp, Homo sapiens
gaggactctaga

SEQ ID NO: 5745159 - DNA, 20 bp, Homo sapiens
gaggactctagaagctcagg

SEQ ID NO: 5745160 - DNA, 22 bp, Homo sapiens
gaggactctgcttaaacaaagc

SEQ ID NO: 5745161 - DNA, 22 bp, Homo sapiens
gaggactctttccgactgccca

SEQ ID NO: 5745162 - DNA, 17 bp, Homo sapiens
gaggactgaagctgggg

SEQ ID NO: 5745163 - DNA, 18 bp, Homo sapiens
gaggactgaagctggggc

SEQ ID NO: 5745164 - DNA, 21 bp, Homo sapiens
gaggactgaagctggggcttg

SEQ ID NO: 5745165 - DNA, 15 bp, Homo sapiens
gaggactgagactgg

SEQ ID NO: 5745166 - DNA, 12 bp, Homo sapiens
gaggactgagcc

SEQ ID NO: 5745167 - DNA, 19 bp, Homo sapiens
gaggactgagcccccaccg

SEQ ID NO: 5745168 - DNA, 21 bp, Homo sapiens
gaggactgtagggagggcggc

SEQ ID NO: 5745169 - DNA, 21 bp, Homo sapiens
gaggactgttctaactagtaa

SEQ ID NO: 5745170 - DNA, 22 bp, Homo sapiens
gaggacttcggggtagaggctg

SEQ ID NO: 5745171 - DNA, 22 bp, Homo sapiens
gaggacttggagggtctggggg

SEQ ID NO: 5745172 - DNA, 22 bp, Homo sapiens
gaggacttgggggcagagcagc

SEQ ID NO: 5745173 - DNA, 22 bp, Homo sapiens
gaggacttgtgtctctgtgctt

SEQ ID NO: 5745174 - DNA, 23 bp, Homo sapiens
gaggactttggtcacccagacta

SEQ ID NO: 5745175 - DNA, 16 bp, Homo sapiens
gaggacttttctttgt

SEQ ID NO: 5745176 - DNA, 23 bp, Homo sapiens
gaggacttttctttgtggcttcc

SEQ ID NO: 5745177 - DNA, 9 bp, Homo sapiens
gaggagaaa

SEQ ID NO: 5745178 - DNA, 20 bp, Homo sapiens
gaggagaaaaaaaaagtgaa

SEQ ID NO: 5745179 - DNA, 16 bp, Homo sapiens
gaggagaaactgagaa

SEQ ID NO: 5745180 - DNA, 14 bp, Homo sapiens
gaggagaaactgga

SEQ ID NO: 5745181 - DNA, 12 bp, Homo sapiens
gaggagaaaggg

SEQ ID NO: 5745182 - DNA, 13 bp, Homo sapiens
gaggagaaataaa

SEQ ID NO: 5745183 - DNA, 21 bp, Homo sapiens
gaggagaaatgcaataactct

SEQ ID NO: 5745184 - DNA, 14 bp, Homo sapiens
gaggagaagacaac

SEQ ID NO: 5745185 - DNA, 15 bp, Homo sapiens
gaggagaaggaaaac

SEQ ID NO: 5745186 - DNA, 20 bp, Homo sapiens
gaggagaagggggtctctgt

SEQ ID NO: 5745187 - DNA, 22 bp, Homo sapiens
gaggagaagtattcctgttgct

SEQ ID NO: 5745188 - DNA, 16 bp, Homo sapiens
gaggagacagaaagcc

SEQ ID NO: 5745189 - DNA, 15 bp, Homo sapiens
gaggagacagaggga

SEQ ID NO: 5745190 - DNA, 21 bp, Homo sapiens
gaggagaccagcggtccatgg

SEQ ID NO: 5745191 - DNA, 13 bp, Homo sapiens
gaggagaccagct

SEQ ID NO: 5745192 - DNA, 16 bp, Homo sapiens
gaggagaccagctcag

SEQ ID NO: 5745193 - DNA, 19 bp, Homo sapiens
gaggagaccctcccctgcc

SEQ ID NO: 5745194 - DNA, 13 bp, Homo sapiens
gaggagaccctgg

SEQ ID NO: 5745195 - DNA, 14 bp, Homo sapiens
gaggagacctttga

SEQ ID NO: 5745196 - DNA, 23 bp, Homo sapiens
gaggagacggaggggagtagaga

SEQ ID NO: 5745197 - DNA, 22 bp, Homo sapiens
gaggagactagatttatgaata

SEQ ID NO: 5745198 - DNA, 12 bp, Homo sapiens
gaggagactggg

SEQ ID NO: 5745199 - DNA, 14 bp, Homo sapiens
gaggagagaagaat

SEQ ID NO: 5745200 - DNA, 21 bp, Homo sapiens
gaggagagaagaatgagccta

SEQ ID NO: 5745201 - DNA, 12 bp, Homo sapiens
gaggagagaagg

SEQ ID NO: 5745202 - DNA, 14 bp, Homo sapiens
gaggagagagaccc

SEQ ID NO: 5745203 - DNA, 12 bp, Homo sapiens
gaggagagagga

SEQ ID NO: 5745204 - DNA, 13 bp, Homo sapiens
gaggagagaggag

SEQ ID NO: 5745205 - DNA, 20 bp, Homo sapiens
gaggagagaggaggaaaagt

SEQ ID NO: 5745206 - DNA, 16 bp, Homo sapiens
gaggagagaggcagag

SEQ ID NO: 5745207 - DNA, 17 bp, Homo sapiens
gaggagagaggcagaga

SEQ ID NO: 5745208 - DNA, 21 bp, Homo sapiens
gaggagagagggggagacccc

SEQ ID NO: 5745209 - DNA, 19 bp, Homo sapiens
gaggagagcatctgctctg

SEQ ID NO: 5745210 - DNA, 16 bp, Homo sapiens
gaggagagccactggg

SEQ ID NO: 5745211 - DNA, 18 bp, Homo sapiens
gaggagagccactgggcc

SEQ ID NO: 5745212 - DNA, 20 bp, Homo sapiens
gaggagagccactgggcccc

SEQ ID NO: 5745213 - DNA, 16 bp, Homo sapiens
gaggagaggagacaga

SEQ ID NO: 5745214 - DNA, 13 bp, Homo sapiens
gaggagaggagag

SEQ ID NO: 5745215 - DNA, 16 bp, Homo sapiens
gaggagaggagagagg

SEQ ID NO: 5745216 - DNA, 14 bp, Homo sapiens
gaggagagggcaga

SEQ ID NO: 5745217 - DNA, 16 bp, Homo sapiens
gaggagagtggcctgg

SEQ ID NO: 5745218 - DNA, 21 bp, Homo sapiens
gaggagatgtgatcaggcccc

SEQ ID NO: 5745219 - DNA, 23 bp, Homo sapiens
gaggagatgtgatcaggccccac

SEQ ID NO: 5745220 - DNA, 18 bp, Homo sapiens
gaggagatgttgagggga

SEQ ID NO: 5745221 - DNA, 21 bp, Homo sapiens
gaggagcaaacaggaaaatga

SEQ ID NO: 5745222 - DNA, 15 bp, Homo sapiens
gaggagcaagggtgg

SEQ ID NO: 5745223 - DNA, 10 bp, Homo sapiens
gaggagcacc

SEQ ID NO: 5745224 - DNA, 13 bp, Homo sapiens
gaggagcaccccc

SEQ ID NO: 5745225 - DNA, 17 bp, Homo sapiens
gaggagcacccccagcc

SEQ ID NO: 5745226 - DNA, 20 bp, Homo sapiens
gaggagcacccccagcctcc

SEQ ID NO: 5745227 - DNA, 21 bp, Homo sapiens
gaggagcacccccagcctccc

SEQ ID NO: 5745228 - DNA, 17 bp, Homo sapiens
gaggagcacctgaaccc

SEQ ID NO: 5745229 - DNA, 19 bp, Homo sapiens
gaggagcagagggcagggg

SEQ ID NO: 5745230 - DNA, 15 bp, Homo sapiens
gaggagcagcaggag

SEQ ID NO: 5745231 - DNA, 20 bp, Homo sapiens
gaggagcagcaggagggggg

SEQ ID NO: 5745232 - DNA, 17 bp, Homo sapiens
gaggagcagcccgggga

SEQ ID NO: 5745233 - DNA, 15 bp, Homo sapiens
gaggagcagcctcga

SEQ ID NO: 5745234 - DNA, 22 bp, Homo sapiens
gaggagcagcctcgaggctggt

SEQ ID NO: 5745235 - DNA, 19 bp, Homo sapiens
gaggagcagcttccttctg

SEQ ID NO: 5745236 - DNA, 13 bp, Homo sapiens
gaggagcaggaag

SEQ ID NO: 5745237 - DNA, 14 bp, Homo sapiens
gaggagcatgtttt

SEQ ID NO: 5745238 - DNA, 16 bp, Homo sapiens
gaggagccacctgggc

SEQ ID NO: 5745239 - DNA, 13 bp, Homo sapiens
gaggagccaggcc

SEQ ID NO: 5745240 - DNA, 21 bp, Homo sapiens
gaggagccaggccccacccct

SEQ ID NO: 5745241 - DNA, 22 bp, Homo sapiens
gaggagcccacggggcaaagct

SEQ ID NO: 5745242 - DNA, 21 bp, Homo sapiens
gaggagcccaggccaggactc

SEQ ID NO: 5745243 - DNA, 14 bp, Homo sapiens
gaggagcccagtgg

SEQ ID NO: 5745244 - DNA, 18 bp, Homo sapiens
gaggagcccagtgggctg

SEQ ID NO: 5745245 - DNA, 21 bp, Homo sapiens
gaggagcccatactcagcctg

SEQ ID NO: 5745246 - DNA, 17 bp, Homo sapiens
gaggagccccagccccg

SEQ ID NO: 5745247 - DNA, 13 bp, Homo sapiens
gaggagccccatc

SEQ ID NO: 5745248 - DNA, 17 bp, Homo sapiens
gaggagcccctggacat

SEQ ID NO: 5745249 - DNA, 14 bp, Homo sapiens
gaggagccctgagg

SEQ ID NO: 5745250 - DNA, 21 bp, Homo sapiens
gaggagccctgaggacctctc

SEQ ID NO: 5745251 - DNA, 18 bp, Homo sapiens
gaggagccctgcctctcc

SEQ ID NO: 5745252 - DNA, 14 bp, Homo sapiens
gaggagcctcagaa

SEQ ID NO: 5745253 - DNA, 13 bp, Homo sapiens
gaggagcctctga

SEQ ID NO: 5745254 - DNA, 16 bp, Homo sapiens
gaggagcctctggctt

SEQ ID NO: 5745255 - DNA, 18 bp, Homo sapiens
gaggagcctctggcttcc

SEQ ID NO: 5745256 - DNA, 20 bp, Homo sapiens
gaggagcctctggcttccct

SEQ ID NO: 5745257 - DNA, 14 bp, Homo sapiens
gaggagcctggagt

SEQ ID NO: 5745258 - DNA, 20 bp, Homo sapiens
gaggagcctgggggctcctc

SEQ ID NO: 5745259 - DNA, 14 bp, Homo sapiens
gaggagcctgtcct

SEQ ID NO: 5745260 - DNA, 19 bp, Homo sapiens
gaggagcctgtcctgcctg

SEQ ID NO: 5745261 - DNA, 22 bp, Homo sapiens
gaggagccttgctgggccaggg

SEQ ID NO: 5745262 - DNA, 14 bp, Homo sapiens
gaggagccttggag

SEQ ID NO: 5745263 - DNA, 21 bp, Homo sapiens
gaggagcctttccagaactac

SEQ ID NO: 5745264 - DNA, 19 bp, Homo sapiens
gaggagctcaacggtctgg

SEQ ID NO: 5745265 - DNA, 15 bp, Homo sapiens
gaggagctcagggtt

SEQ ID NO: 5745266 - DNA, 21 bp, Homo sapiens
gaggagctcagggtttcggaa

SEQ ID NO: 5745267 - DNA, 20 bp, Homo sapiens
gaggagctctaccctgctcc

SEQ ID NO: 5745268 - DNA, 21 bp, Homo sapiens
gaggagctctaccctgctccc

SEQ ID NO: 5745269 - DNA, 22 bp, Homo sapiens
gaggagctctaccctgctccct

SEQ ID NO: 5745270 - DNA, 16 bp, Homo sapiens
gaggagctctccccct

SEQ ID NO: 5745271 - DNA, 22 bp, Homo sapiens
gaggagctgagggagggagcca

SEQ ID NO: 5745272 - DNA, 16 bp, Homo sapiens
gaggagctgccgcaag

SEQ ID NO: 5745273 - DNA, 13 bp, Homo sapiens
gaggagctgcctg

SEQ ID NO: 5745274 - DNA, 11 bp, Homo sapiens
gaggagctgga

SEQ ID NO: 5745275 - DNA, 18 bp, Homo sapiens
gaggagctggaggggtgg

SEQ ID NO: 5745276 - DNA, 23 bp, Homo sapiens
gaggagctggaggggtggggagc

SEQ ID NO: 5745277 - DNA, 14 bp, Homo sapiens
gaggagctggcctg

SEQ ID NO: 5745278 - DNA, 17 bp, Homo sapiens
gaggagctggcctgtgg

SEQ ID NO: 5745279 - DNA, 22 bp, Homo sapiens
gaggagctggcctgtggcacag

SEQ ID NO: 5745280 - DNA, 16 bp, Homo sapiens
gaggagcttctcccag

SEQ ID NO: 5745281 - DNA, 22 bp, Homo sapiens
gaggagcttctcccagtgtgag

SEQ ID NO: 5745282 - DNA, 10 bp, Homo sapiens
gaggaggaag

SEQ ID NO: 5745283 - DNA, 15 bp, Homo sapiens
gaggaggaagaccat

SEQ ID NO: 5745284 - DNA, 11 bp, Homo sapiens
gaggaggaagc

SEQ ID NO: 5745285 - DNA, 13 bp, Homo sapiens
gaggaggaagccg

SEQ ID NO: 5745286 - DNA, 15 bp, Homo sapiens
gaggaggacacagca

SEQ ID NO: 5745287 - DNA, 11 bp, Homo sapiens
gaggaggagga

SEQ ID NO: 5745288 - DNA, 16 bp, Homo sapiens
gaggaggaggagaagg

SEQ ID NO: 5745289 - DNA, 14 bp, Homo sapiens
gaggaggaggagcc

SEQ ID NO: 5745290 - DNA, 16 bp, Homo sapiens
gaggaggaggaggaag

SEQ ID NO: 5745291 - DNA, 14 bp, Homo sapiens
gaggaggagggagg

SEQ ID NO: 5745292 - DNA, 23 bp, Homo sapiens
gaggaggagtcagatgaggccct

SEQ ID NO: 5745293 - DNA, 23 bp, Homo sapiens
gaggaggatgtccctgggccagg

SEQ ID NO: 5745294 - DNA, 18 bp, Homo sapiens
gaggaggcaattgggatg

SEQ ID NO: 5745295 - DNA, 15 bp, Homo sapiens
gaggaggcagaacca

SEQ ID NO: 5745296 - DNA, 21 bp, Homo sapiens
gaggaggcagagagggtcact

SEQ ID NO: 5745297 - DNA, 15 bp, Homo sapiens
gaggaggcatggaaa

SEQ ID NO: 5745298 - DNA, 14 bp, Homo sapiens
gaggaggccacctc

SEQ ID NO: 5745299 - DNA, 15 bp, Homo sapiens
gaggaggccacctct

SEQ ID NO: 5745300 - DNA, 16 bp, Homo sapiens
gaggaggccacctctc

SEQ ID NO: 5745301 - DNA, 18 bp, Homo sapiens
gaggaggccacctctcca

SEQ ID NO: 5745302 - DNA, 21 bp, Homo sapiens
gaggaggccgactgggctgct

SEQ ID NO: 5745303 - DNA, 14 bp, Homo sapiens
gaggaggccgcctc

SEQ ID NO: 5745304 - DNA, 13 bp, Homo sapiens
gaggaggcctcca

SEQ ID NO: 5745305 - DNA, 13 bp, Homo sapiens
gaggaggcctgga

SEQ ID NO: 5745306 - DNA, 18 bp, Homo sapiens
gaggaggcctggaccgag

SEQ ID NO: 5745307 - DNA, 16 bp, Homo sapiens
gaggaggcctgtccca

SEQ ID NO: 5745308 - DNA, 15 bp, Homo sapiens
gaggaggcgcggcct

SEQ ID NO: 5745309 - DNA, 12 bp, Homo sapiens
gaggagggagaa

SEQ ID NO: 5745310 - DNA, 13 bp, Homo sapiens
gaggagggagaag

SEQ ID NO: 5745311 - DNA, 16 bp, Homo sapiens
gaggagggagagccct

SEQ ID NO: 5745312 - DNA, 14 bp, Homo sapiens
gaggagggaggcca

SEQ ID NO: 5745313 - DNA, 22 bp, Homo sapiens
gaggagggaggccgggcggtca

SEQ ID NO: 5745314 - DNA, 20 bp, Homo sapiens
gaggagggatagagacgcag

SEQ ID NO: 5745315 - DNA, 19 bp, Homo sapiens
gaggagggatgctgctccg

SEQ ID NO: 5745316 - DNA, 12 bp, Homo sapiens
gaggagggatgt

SEQ ID NO: 5745317 - DNA, 13 bp, Homo sapiens
gaggagggatgtg

SEQ ID NO: 5745318 - DNA, 12 bp, Homo sapiens
gaggagggcaga

SEQ ID NO: 5745319 - DNA, 13 bp, Homo sapiens
gaggagggcagag

SEQ ID NO: 5745320 - DNA, 13 bp, Homo sapiens
gaggagggcatgg

SEQ ID NO: 5745321 - DNA, 15 bp, Homo sapiens
gaggagggccctgag

SEQ ID NO: 5745322 - DNA, 21 bp, Homo sapiens
gaggagggccgagacaggagc

SEQ ID NO: 5745323 - DNA, 13 bp, Homo sapiens
gaggaggggaagc

SEQ ID NO: 5745324 - DNA, 18 bp, Homo sapiens
gaggaggggaagctgggc

SEQ ID NO: 5745325 - DNA, 11 bp, Homo sapiens
gaggaggggag

SEQ ID NO: 5745326 - DNA, 12 bp, Homo sapiens
gaggaggggagg

SEQ ID NO: 5745327 - DNA, 15 bp, Homo sapiens
gaggaggggcacctg

SEQ ID NO: 5745328 - DNA, 17 bp, Homo sapiens
gaggaggggccgctgcc

SEQ ID NO: 5745329 - DNA, 13 bp, Homo sapiens
gaggagggggagg

SEQ ID NO: 5745330 - DNA, 22 bp, Homo sapiens
gaggagggggtaggtgatgggg

SEQ ID NO: 5745331 - DNA, 17 bp, Homo sapiens
gaggaggggtaaatata

SEQ ID NO: 5745332 - DNA, 18 bp, Homo sapiens
gaggaggggtaaatatat

SEQ ID NO: 5745333 - DNA, 22 bp, Homo sapiens
gaggaggggtgtgggcaccccc

SEQ ID NO: 5745334 - DNA, 20 bp, Homo sapiens
gaggaggtaacatagatgcc

SEQ ID NO: 5745335 - DNA, 22 bp, Homo sapiens
gaggaggtaacatagatgcctg

SEQ ID NO: 5745336 - DNA, 23 bp, Homo sapiens
gaggaggtaacatagatgcctgg

SEQ ID NO: 5745337 - DNA, 23 bp, Homo sapiens
gaggaggtgacaaaccatttcca

SEQ ID NO: 5745338 - DNA, 16 bp, Homo sapiens
gaggaggtgcccgggc

SEQ ID NO: 5745339 - DNA, 17 bp, Homo sapiens
gaggaggtgcccgggca

SEQ ID NO: 5745340 - DNA, 15 bp, Homo sapiens
gaggaggtgcctgga

SEQ ID NO: 5745341 - DNA, 15 bp, Homo sapiens
gaggaggtggcagcc

SEQ ID NO: 5745342 - DNA, 22 bp, Homo sapiens
gaggaggtggcagccctgtagg

SEQ ID NO: 5745343 - DNA, 15 bp, Homo sapiens
gaggaggtgggggct

SEQ ID NO: 5745344 - DNA, 22 bp, Homo sapiens
gaggaggtgtctcaggctgcct

SEQ ID NO: 5745345 - DNA, 18 bp, Homo sapiens
gaggaggtgtctggggtg

SEQ ID NO: 5745346 - DNA, 22 bp, Homo sapiens
gaggaggtgtctggggtgaggg

SEQ ID NO: 5745347 - DNA, 21 bp, Homo sapiens
gaggaggtgtgaggaggaggc

SEQ ID NO: 5745348 - DNA, 23 bp, Homo sapiens
gaggaggttcgggattccctggt

SEQ ID NO: 5745349 - DNA, 17 bp, Homo sapiens
gaggaggtttaggtcaa

SEQ ID NO: 5745350 - DNA, 20 bp, Homo sapiens
gaggaggtttggggtctgcc

SEQ ID NO: 5745351 - DNA, 21 bp, Homo sapiens
gaggagtaaaattcagttttt

SEQ ID NO: 5745352 - DNA, 11 bp, Homo sapiens
gaggagtaaca

SEQ ID NO: 5745353 - DNA, 20 bp, Homo sapiens
gaggagtaaccgctccaggt

SEQ ID NO: 5745354 - DNA, 17 bp, Homo sapiens
gaggagtaagtgtacaa

SEQ ID NO: 5745355 - DNA, 22 bp, Homo sapiens
gaggagtacccccagcccaaga

SEQ ID NO: 5745356 - DNA, 18 bp, Homo sapiens
gaggagtcaggggctctg

SEQ ID NO: 5745357 - DNA, 13 bp, Homo sapiens
gaggagtccagca

SEQ ID NO: 5745358 - DNA, 18 bp, Homo sapiens
gaggagtccagggcggga

SEQ ID NO: 5745359 - DNA, 19 bp, Homo sapiens
gaggagtccagggcgggag

SEQ ID NO: 5745360 - DNA, 22 bp, Homo sapiens
gaggagtccagtttgtgcaaga

SEQ ID NO: 5745361 - DNA, 14 bp, Homo sapiens
gaggagtctcaaca

SEQ ID NO: 5745362 - DNA, 19 bp, Homo sapiens
gaggagtctgaggtcctga

SEQ ID NO: 5745363 - DNA, 22 bp, Homo sapiens
gaggagtctgaggtcctgagca

SEQ ID NO: 5745364 - DNA, 19 bp, Homo sapiens
gaggagtctgggaaggggc

SEQ ID NO: 5745365 - DNA, 22 bp, Homo sapiens
gaggagtgaccgggcactggca

SEQ ID NO: 5745366 - DNA, 18 bp, Homo sapiens
gaggagtgatgggcaagg

SEQ ID NO: 5745367 - DNA, 20 bp, Homo sapiens
gaggagtggattcctcccca

SEQ ID NO: 5745368 - DNA, 20 bp, Homo sapiens
gaggagtgggacagacagca

SEQ ID NO: 5745369 - DNA, 23 bp, Homo sapiens
gaggagtggttgggctgtgcctg

SEQ ID NO: 5745370 - DNA, 20 bp, Homo sapiens
gaggagtgtcctgtctgctg

SEQ ID NO: 5745371 - DNA, 13 bp, Homo sapiens
gaggagtgttatt

SEQ ID NO: 5745372 - DNA, 11 bp, Homo sapiens
gaggagttcaa

SEQ ID NO: 5745373 - DNA, 16 bp, Homo sapiens
gaggagttcaatgatc

SEQ ID NO: 5745374 - DNA, 18 bp, Homo sapiens
gaggagttgtctgtcctg

SEQ ID NO: 5745375 - DNA, 12 bp, Homo sapiens
gaggagtttcct

SEQ ID NO: 5745376 - DNA, 18 bp, Homo sapiens
gaggagtttcctaaaagt

SEQ ID NO: 5745377 - DNA, 16 bp, Homo sapiens
gaggagtttcgaggta

SEQ ID NO: 5745378 - DNA, 16 bp, Homo sapiens
gaggagttttctgtgt

SEQ ID NO: 5745379 - DNA, 21 bp, Homo sapiens
gaggagttttctgtgtggtct

SEQ ID NO: 5745380 - DNA, 19 bp, Homo sapiens
gaggataaataataaaggt

SEQ ID NO: 5745381 - DNA, 21 bp, Homo sapiens
gaggataacttccttgcccct

SEQ ID NO: 5745382 - DNA, 15 bp, Homo sapiens
gaggatacaaattta

SEQ ID NO: 5745383 - DNA, 13 bp, Homo sapiens
gaggatacgacag

SEQ ID NO: 5745384 - DNA, 16 bp, Homo sapiens
gaggatagaaaaagga

SEQ ID NO: 5745385 - DNA, 16 bp, Homo sapiens
gaggatagagacttgc

SEQ ID NO: 5745386 - DNA, 20 bp, Homo sapiens
gaggatagtagttaaataac

SEQ ID NO: 5745387 - DNA, 17 bp, Homo sapiens
gaggatatttattactt

SEQ ID NO: 5745388 - DNA, 18 bp, Homo sapiens
gaggatcacagtgctgag

SEQ ID NO: 5745389 - DNA, 16 bp, Homo sapiens
gaggatcaccagtgca

SEQ ID NO: 5745390 - DNA, 22 bp, Homo sapiens
gaggatcacttgggcccaggag

SEQ ID NO: 5745391 - DNA, 24 bp, Homo sapiens
gaggatcatatgaattagccaaaa

SEQ ID NO: 5745392 - DNA, 17 bp, Homo sapiens
gaggatccactcccagg

SEQ ID NO: 5745393 - DNA, 21 bp, Homo sapiens
gaggatccactcccaggatga

SEQ ID NO: 5745394 - DNA, 23 bp, Homo sapiens
gaggatccagggcagcaggccag

SEQ ID NO: 5745395 - DNA, 23 bp, Homo sapiens
gaggatctagcttcatgcctcag

SEQ ID NO: 5745396 - DNA, 22 bp, Homo sapiens
gaggatctcttgagcctgggag

SEQ ID NO: 5745397 - DNA, 14 bp, Homo sapiens
gaggatgagagccc

SEQ ID NO: 5745398 - DNA, 13 bp, Homo sapiens
gaggatgagcaga

SEQ ID NO: 5745399 - DNA, 17 bp, Homo sapiens
gaggatgagcagaccag

SEQ ID NO: 5745400 - DNA, 22 bp, Homo sapiens
gaggatgagctctacccagggc

SEQ ID NO: 5745401 - DNA, 17 bp, Homo sapiens
gaggatgcactggcctg

SEQ ID NO: 5745402 - DNA, 18 bp, Homo sapiens
gaggatgccacagcccca

SEQ ID NO: 5745403 - DNA, 23 bp, Homo sapiens
gaggatgccacagccccacagca

SEQ ID NO: 5745404 - DNA, 17 bp, Homo sapiens
gaggatgctgtgcctcc

SEQ ID NO: 5745405 - DNA, 23 bp, Homo sapiens
gaggatgcttagtcttaaaataa

SEQ ID NO: 5745406 - DNA, 13 bp, Homo sapiens
gaggatggacgag

SEQ ID NO: 5745407 - DNA, 21 bp, Homo sapiens
gaggatggcttccccattgcc

SEQ ID NO: 5745408 - DNA, 19 bp, Homo sapiens
gaggatgggcagctggggg

SEQ ID NO: 5745409 - DNA, 23 bp, Homo sapiens
gaggatggtcatcgtgacagcag

SEQ ID NO: 5745410 - DNA, 15 bp, Homo sapiens
gaggatggtgtcctg

SEQ ID NO: 5745411 - DNA, 18 bp, Homo sapiens
gaggatgtatgtgtatat

SEQ ID NO: 5745412 - DNA, 19 bp, Homo sapiens
gaggatgtccctgggccag

SEQ ID NO: 5745413 - DNA, 15 bp, Homo sapiens
gaggatgtctgggcc

SEQ ID NO: 5745414 - DNA, 17 bp, Homo sapiens
gaggatgtggcaggggc

SEQ ID NO: 5745415 - DNA, 18 bp, Homo sapiens
gaggatgtggcaggggca

SEQ ID NO: 5745416 - DNA, 14 bp, Homo sapiens
gaggatgtgggcag

SEQ ID NO: 5745417 - DNA, 15 bp, Homo sapiens
gaggatgtgggcagc

SEQ ID NO: 5745418 - DNA, 17 bp, Homo sapiens
gaggattctatgaggca

SEQ ID NO: 5745419 - DNA, 12 bp, Homo sapiens
gaggattctgtc

SEQ ID NO: 5745420 - DNA, 16 bp, Homo sapiens
gaggattgctgccaga

SEQ ID NO: 5745421 - DNA, 20 bp, Homo sapiens
gaggattgctgccagagaag

SEQ ID NO: 5745422 - DNA, 18 bp, Homo sapiens
gaggattgcttgagccca

SEQ ID NO: 5745423 - DNA, 19 bp, Homo sapiens
gaggattgcttgagcccag

SEQ ID NO: 5745424 - DNA, 22 bp, Homo sapiens
gaggattgcttgagcccaggag

SEQ ID NO: 5745425 - DNA, 16 bp, Homo sapiens
gaggattgcttgagct

SEQ ID NO: 5745426 - DNA, 14 bp, Homo sapiens
gaggattgtggaaa

SEQ ID NO: 5745427 - DNA, 18 bp, Homo sapiens
gaggatttaactgtgaac

SEQ ID NO: 5745428 - DNA, 20 bp, Homo sapiens
gaggatttaagggatggaaa

SEQ ID NO: 5745429 - DNA, 22 bp, Homo sapiens
gaggatttagaagtgtcatgtt

SEQ ID NO: 5745430 - DNA, 20 bp, Homo sapiens
gaggatttccctgaagctat

SEQ ID NO: 5745431 - DNA, 14 bp, Homo sapiens
gaggatttcctgga

SEQ ID NO: 5745432 - DNA, 17 bp, Homo sapiens
gaggatttcctggagtg

SEQ ID NO: 5745433 - DNA, 22 bp, Homo sapiens
gaggatttcctggagtgccctg

SEQ ID NO: 5745434 - DNA, 17 bp, Homo sapiens
gaggatttggctcgctg

SEQ ID NO: 5745435 - DNA, 14 bp, Homo sapiens
gaggattttccagt

SEQ ID NO: 5745436 - DNA, 23 bp, Homo sapiens
gaggcaaaaggcagtggggctgg

SEQ ID NO: 5745437 - DNA, 16 bp, Homo sapiens
gaggcaaacatttctt

SEQ ID NO: 5745438 - DNA, 21 bp, Homo sapiens
gaggcaaccccctcggagcct

SEQ ID NO: 5745439 - DNA, 13 bp, Homo sapiens
gaggcaagaaaag

SEQ ID NO: 5745440 - DNA, 15 bp, Homo sapiens
gaggcaagagaaatg

SEQ ID NO: 5745441 - DNA, 23 bp, Homo sapiens
gaggcaagagaaatgaggaagaa

SEQ ID NO: 5745442 - DNA, 13 bp, Homo sapiens
gaggcaagagaat

SEQ ID NO: 5745443 - DNA, 14 bp, Homo sapiens
gaggcaagagggag

SEQ ID NO: 5745444 - DNA, 15 bp, Homo sapiens
gaggcaagagggagg

SEQ ID NO: 5745445 - DNA, 20 bp, Homo sapiens
gaggcaagccatggagtgag

SEQ ID NO: 5745446 - DNA, 13 bp, Homo sapiens
gaggcaagccctg

SEQ ID NO: 5745447 - DNA, 15 bp, Homo sapiens
gaggcaaggcccaga

SEQ ID NO: 5745448 - DNA, 19 bp, Homo sapiens
gaggcaaggcccagacctg

SEQ ID NO: 5745449 - DNA, 20 bp, Homo sapiens
gaggcaaggcccagacctgg

SEQ ID NO: 5745450 - DNA, 19 bp, Homo sapiens
gaggcaataaataaatgtt

SEQ ID NO: 5745451 - DNA, 16 bp, Homo sapiens
gaggcaatgactgtga

SEQ ID NO: 5745452 - DNA, 18 bp, Homo sapiens
gaggcaatgactgtgagc

SEQ ID NO: 5745453 - DNA, 20 bp, Homo sapiens
gaggcacacagctgcagaga

SEQ ID NO: 5745454 - DNA, 14 bp, Homo sapiens
gaggcacactttct

SEQ ID NO: 5745455 - DNA, 16 bp, Homo sapiens
gaggcacactttctgg

SEQ ID NO: 5745456 - DNA, 19 bp, Homo sapiens
gaggcacactttctggcaa

SEQ ID NO: 5745457 - DNA, 16 bp, Homo sapiens
gaggcacagagccaaa

SEQ ID NO: 5745458 - DNA, 13 bp, Homo sapiens
gaggcacagcagt

SEQ ID NO: 5745459 - DNA, 22 bp, Homo sapiens
gaggcacagttttagaataagg

SEQ ID NO: 5745460 - DNA, 14 bp, Homo sapiens
gaggcaccagctct

SEQ ID NO: 5745461 - DNA, 15 bp, Homo sapiens
gaggcaccagctctg

SEQ ID NO: 5745462 - DNA, 16 bp, Homo sapiens
gaggcaccagctctgt

SEQ ID NO: 5745463 - DNA, 15 bp, Homo sapiens
gaggcaccagtccag

SEQ ID NO: 5745464 - DNA, 19 bp, Homo sapiens
gaggcaccagtgtcctccc

SEQ ID NO: 5745465 - DNA, 18 bp, Homo sapiens
gaggcaccgtccaggccc

SEQ ID NO: 5745466 - DNA, 13 bp, Homo sapiens
gaggcacctccag

SEQ ID NO: 5745467 - DNA, 20 bp, Homo sapiens
gaggcacctccaggcaggcc

SEQ ID NO: 5745468 - DNA, 17 bp, Homo sapiens
gaggcactcagtgagcc

SEQ ID NO: 5745469 - DNA, 22 bp, Homo sapiens
gaggcactcagtgagcctcctg

SEQ ID NO: 5745470 - DNA, 13 bp, Homo sapiens
gaggcactgaagc

SEQ ID NO: 5745471 - DNA, 18 bp, Homo sapiens
gaggcactgaagtgctta

SEQ ID NO: 5745472 - DNA, 17 bp, Homo sapiens
gaggcacttcctcccct

SEQ ID NO: 5745473 - DNA, 22 bp, Homo sapiens
gaggcacttcctcccctcgccc

SEQ ID NO: 5745474 - DNA, 22 bp, Homo sapiens
gaggcagaaacctatctcaggg

SEQ ID NO: 5745475 - DNA, 23 bp, Homo sapiens
gaggcagaaagatttggaaaatt

SEQ ID NO: 5745476 - DNA, 19 bp, Homo sapiens
gaggcagaaagcagaggct

SEQ ID NO: 5745477 - DNA, 15 bp, Homo sapiens
gaggcagaaagggaa

SEQ ID NO: 5745478 - DNA, 16 bp, Homo sapiens
gaggcagaaagggaaa

SEQ ID NO: 5745479 - DNA, 23 bp, Homo sapiens
gaggcagaagaattgaacccagg

SEQ ID NO: 5745480 - DNA, 23 bp, Homo sapiens
gaggcagaatggtgggctccaga

SEQ ID NO: 5745481 - DNA, 19 bp, Homo sapiens
gaggcagacagcagctcag

SEQ ID NO: 5745482 - DNA, 19 bp, Homo sapiens
gaggcagacgtctgtcagg

SEQ ID NO: 5745483 - DNA, 13 bp, Homo sapiens
gaggcagactcct

SEQ ID NO: 5745484 - DNA, 17 bp, Homo sapiens
gaggcagactcgagggc

SEQ ID NO: 5745485 - DNA, 17 bp, Homo sapiens
gaggcagagaaagaaga

SEQ ID NO: 5745486 - DNA, 19 bp, Homo sapiens
gaggcagagaatctcttgg

SEQ ID NO: 5745487 - DNA, 20 bp, Homo sapiens
gaggcagagaatctcttggg

SEQ ID NO: 5745488 - DNA, 19 bp, Homo sapiens
gaggcagagacctccaata

SEQ ID NO: 5745489 - DNA, 12 bp, Homo sapiens
gaggcagagagc

SEQ ID NO: 5745490 - DNA, 15 bp, Homo sapiens
gaggcagagagcggt

SEQ ID NO: 5745491 - DNA, 22 bp, Homo sapiens
gaggcagagagcggtctcaggc

SEQ ID NO: 5745492 - DNA, 15 bp, Homo sapiens
gaggcagagaggagt

SEQ ID NO: 5745493 - DNA, 20 bp, Homo sapiens
gaggcagaggttgcagtgag

SEQ ID NO: 5745494 - DNA, 14 bp, Homo sapiens
gaggcagagtgccc

SEQ ID NO: 5745495 - DNA, 22 bp, Homo sapiens
gaggcagagtgccccacctgcc

SEQ ID NO: 5745496 - DNA, 19 bp, Homo sapiens
gaggcagatgcccttgctg

SEQ ID NO: 5745497 - DNA, 13 bp, Homo sapiens
gaggcagcaacag

SEQ ID NO: 5745498 - DNA, 13 bp, Homo sapiens
gaggcagcagagc

SEQ ID NO: 5745499 - DNA, 15 bp, Homo sapiens
gaggcagcaggactg

SEQ ID NO: 5745500 - DNA, 13 bp, Homo sapiens
gaggcagcaggag

SEQ ID NO: 5745501 - DNA, 16 bp, Homo sapiens
gaggcagcaggagcca

SEQ ID NO: 5745502 - DNA, 16 bp, Homo sapiens
gaggcagcccaggaag

SEQ ID NO: 5745503 - DNA, 13 bp, Homo sapiens
gaggcagccccat

SEQ ID NO: 5745504 - DNA, 21 bp, Homo sapiens
gaggcagccgaggcctggcca

SEQ ID NO: 5745505 - DNA, 21 bp, Homo sapiens
gaggcagcgtgaaagcagatg

SEQ ID NO: 5745506 - DNA, 16 bp, Homo sapiens
gaggcagcgtgggctc

SEQ ID NO: 5745507 - DNA, 17 bp, Homo sapiens
gaggcagcgtgggctct

SEQ ID NO: 5745508 - DNA, 15 bp, Homo sapiens
gaggcagctcaggat

SEQ ID NO: 5745509 - DNA, 12 bp, Homo sapiens
gaggcagctcca

SEQ ID NO: 5745510 - DNA, 20 bp, Homo sapiens
gaggcagctccaacagcttg

SEQ ID NO: 5745511 - DNA, 12 bp, Homo sapiens
gaggcaggaatg

SEQ ID NO: 5745512 - DNA, 16 bp, Homo sapiens
gaggcaggaatggggg

SEQ ID NO: 5745513 - DNA, 15 bp, Homo sapiens
gaggcaggaccagaa

SEQ ID NO: 5745514 - DNA, 14 bp, Homo sapiens
gaggcaggactcct

SEQ ID NO: 5745515 - DNA, 12 bp, Homo sapiens
gaggcaggagaa

SEQ ID NO: 5745516 - DNA, 18 bp, Homo sapiens
gaggcaggagaatcactt

SEQ ID NO: 5745517 - DNA, 17 bp, Homo sapiens
gaggcaggaggagcccg

SEQ ID NO: 5745518 - DNA, 22 bp, Homo sapiens
gaggcaggatatccccagggaa

SEQ ID NO: 5745519 - DNA, 17 bp, Homo sapiens
gaggcaggcattcctga

SEQ ID NO: 5745520 - DNA, 13 bp, Homo sapiens
gaggcaggctggg

SEQ ID NO: 5745521 - DNA, 9 bp, Homo sapiens
gaggcaggg

SEQ ID NO: 5745522 - DNA, 18 bp, Homo sapiens
gaggcagggacaagtctt

SEQ ID NO: 5745523 - DNA, 12 bp, Homo sapiens
gaggcagggacc

SEQ ID NO: 5745524 - DNA, 18 bp, Homo sapiens
gaggcagggacctaaagg

SEQ ID NO: 5745525 - DNA, 17 bp, Homo sapiens
gaggcagggaggcagcc

SEQ ID NO: 5745526 - DNA, 15 bp, Homo sapiens
gaggcagggagggga

SEQ ID NO: 5745527 - DNA, 23 bp, Homo sapiens
gaggcagggcaaatgacatgcac

SEQ ID NO: 5745528 - DNA, 13 bp, Homo sapiens
gaggcagggcagc

SEQ ID NO: 5745529 - DNA, 21 bp, Homo sapiens
gaggcagggcagcatggagac

SEQ ID NO: 5745530 - DNA, 16 bp, Homo sapiens
gaggcagggccctggg

SEQ ID NO: 5745531 - DNA, 18 bp, Homo sapiens
gaggcagggccttgccca

SEQ ID NO: 5745532 - DNA, 12 bp, Homo sapiens
gaggcagggctg

SEQ ID NO: 5745533 - DNA, 14 bp, Homo sapiens
gaggcagggctgga

SEQ ID NO: 5745534 - DNA, 15 bp, Homo sapiens
gaggcaggggagtct

SEQ ID NO: 5745535 - DNA, 14 bp, Homo sapiens
gaggcaggggcgga

SEQ ID NO: 5745536 - DNA, 15 bp, Homo sapiens
gaggcaggggcggag

SEQ ID NO: 5745537 - DNA, 17 bp, Homo sapiens
gaggcaggggctctgct

SEQ ID NO: 5745538 - DNA, 18 bp, Homo sapiens
gaggcaggggcttcctgg

SEQ ID NO: 5745539 - DNA, 21 bp, Homo sapiens
gaggcaggggtcctgcaggtc

SEQ ID NO: 5745540 - DNA, 14 bp, Homo sapiens
gaggcagggtctca

SEQ ID NO: 5745541 - DNA, 20 bp, Homo sapiens
gaggcagggtctcactctgt

SEQ ID NO: 5745542 - DNA, 12 bp, Homo sapiens
gaggcaggtccc

SEQ ID NO: 5745543 - DNA, 16 bp, Homo sapiens
gaggcaggtcccgagc

SEQ ID NO: 5745544 - DNA, 20 bp, Homo sapiens
gaggcaggtcgggctgccag

SEQ ID NO: 5745545 - DNA, 10 bp, Homo sapiens
gaggcaggtg

SEQ ID NO: 5745546 - DNA, 11 bp, Homo sapiens
gaggcaggtga

SEQ ID NO: 5745547 - DNA, 19 bp, Homo sapiens
gaggcaggtggacgctgca

SEQ ID NO: 5745548 - DNA, 21 bp, Homo sapiens
gaggcaggtggacgctgcaga

SEQ ID NO: 5745549 - DNA, 17 bp, Homo sapiens
gaggcaggttagaagaa

SEQ ID NO: 5745550 - DNA, 21 bp, Homo sapiens
gaggcagtgatgacttgctgt

SEQ ID NO: 5745551 - DNA, 16 bp, Homo sapiens
gaggcagtgctgatcc

SEQ ID NO: 5745552 - DNA, 14 bp, Homo sapiens
gaggcagtggcagc

SEQ ID NO: 5745553 - DNA, 18 bp, Homo sapiens
gaggcatacacacagcag

SEQ ID NO: 5745554 - DNA, 17 bp, Homo sapiens
gaggcatagtcacctag

SEQ ID NO: 5745555 - DNA, 23 bp, Homo sapiens
gaggcatcacgctacccagcttc

SEQ ID NO: 5745556 - DNA, 13 bp, Homo sapiens
gaggcatccagca

SEQ ID NO: 5745557 - DNA, 15 bp, Homo sapiens
gaggcatcccaagac

SEQ ID NO: 5745558 - DNA, 16 bp, Homo sapiens
gaggcatcctctgact

SEQ ID NO: 5745559 - DNA, 20 bp, Homo sapiens
gaggcatcctctgactccac

SEQ ID NO: 5745560 - DNA, 14 bp, Homo sapiens
gaggcatcctgcct

SEQ ID NO: 5745561 - DNA, 17 bp, Homo sapiens
gaggcatcctgcctggg

SEQ ID NO: 5745562 - DNA, 20 bp, Homo sapiens
gaggcatcctgcctgggtgg

SEQ ID NO: 5745563 - DNA, 17 bp, Homo sapiens
gaggcatcgcaatgtaa

SEQ ID NO: 5745564 - DNA, 17 bp, Homo sapiens
gaggcatctggaaaggg

SEQ ID NO: 5745565 - DNA, 13 bp, Homo sapiens
gaggcatgacagc

SEQ ID NO: 5745566 - DNA, 20 bp, Homo sapiens
gaggcatgacagctgttcca

SEQ ID NO: 5745567 - DNA, 18 bp, Homo sapiens
gaggcatgcacatctgga

SEQ ID NO: 5745568 - DNA, 12 bp, Homo sapiens
gaggcatggaaa

SEQ ID NO: 5745569 - DNA, 13 bp, Homo sapiens
gaggcatggccct

SEQ ID NO: 5745570 - DNA, 18 bp, Homo sapiens
gaggcatggccctggggt

SEQ ID NO: 5745571 - DNA, 15 bp, Homo sapiens
gaggcatggggcatg

SEQ ID NO: 5745572 - DNA, 18 bp, Homo sapiens
gaggcatggggcatgtcc

SEQ ID NO: 5745573 - DNA, 19 bp, Homo sapiens
gaggcatggggcatgtcct

SEQ ID NO: 5745574 - DNA, 17 bp, Homo sapiens
gaggcatgggggcccaa

SEQ ID NO: 5745575 - DNA, 19 bp, Homo sapiens
gaggcatgggggcccaaag

SEQ ID NO: 5745576 - DNA, 21 bp, Homo sapiens
gaggcatgggggcccaaaggg

SEQ ID NO: 5745577 - DNA, 16 bp, Homo sapiens
gaggcatgggtgagca

SEQ ID NO: 5745578 - DNA, 19 bp, Homo sapiens
gaggcatggtctgccctct

SEQ ID NO: 5745579 - DNA, 21 bp, Homo sapiens
gaggcatgtgatgtgcaagga

SEQ ID NO: 5745580 - DNA, 13 bp, Homo sapiens
gaggcattacaaa

SEQ ID NO: 5745581 - DNA, 22 bp, Homo sapiens
gaggcattacttgctttcaatt

SEQ ID NO: 5745582 - DNA, 21 bp, Homo sapiens
gaggcattcagcaattaaaga

SEQ ID NO: 5745583 - DNA, 19 bp, Homo sapiens
gaggcattcccagaggtgg

SEQ ID NO: 5745584 - DNA, 20 bp, Homo sapiens
gaggcattcccagaggtggg

SEQ ID NO: 5745585 - DNA, 17 bp, Homo sapiens
gaggcattcggggaagc

SEQ ID NO: 5745586 - DNA, 20 bp, Homo sapiens
gaggcatttgagcagctgaa

SEQ ID NO: 5745587 - DNA, 21 bp, Homo sapiens
gaggcatttgtcttagagaga

SEQ ID NO: 5745588 - DNA, 22 bp, Homo sapiens
gaggccaaacacccaagcacaa

SEQ ID NO: 5745589 - DNA, 20 bp, Homo sapiens
gaggccaaactgtccctccc

SEQ ID NO: 5745590 - DNA, 17 bp, Homo sapiens
gaggccaaccagcccga

SEQ ID NO: 5745591 - DNA, 20 bp, Homo sapiens
gaggccaaccagcccgacag

SEQ ID NO: 5745592 - DNA, 16 bp, Homo sapiens
gaggccaagagtggcc

SEQ ID NO: 5745593 - DNA, 12 bp, Homo sapiens
gaggccaagatc

SEQ ID NO: 5745594 - DNA, 20 bp, Homo sapiens
gaggccaagcagtgcctgcc

SEQ ID NO: 5745595 - DNA, 21 bp, Homo sapiens
gaggccaagcagtgcctgcct

SEQ ID NO: 5745596 - DNA, 13 bp, Homo sapiens
gaggccaaggcag

SEQ ID NO: 5745597 - DNA, 13 bp, Homo sapiens
gaggccaataaaa

SEQ ID NO: 5745598 - DNA, 15 bp, Homo sapiens
gaggccaataaaaag

SEQ ID NO: 5745599 - DNA, 17 bp, Homo sapiens
gaggccaataaaaagtt

SEQ ID NO: 5745600 - DNA, 20 bp, Homo sapiens
gaggccaataaaaagttcag

SEQ ID NO: 5745601 - DNA, 21 bp, Homo sapiens
gaggccacactcagcacaagg

SEQ ID NO: 5745602 - DNA, 15 bp, Homo sapiens
gaggccacactttct

SEQ ID NO: 5745603 - DNA, 22 bp, Homo sapiens
gaggccacatgagtcccagtgg

SEQ ID NO: 5745604 - DNA, 19 bp, Homo sapiens
gaggccacattgctggctg

SEQ ID NO: 5745605 - DNA, 12 bp, Homo sapiens
gaggccacccca

SEQ ID NO: 5745606 - DNA, 14 bp, Homo sapiens
gaggccaccccaaa

SEQ ID NO: 5745607 - DNA, 23 bp, Homo sapiens
gaggccaccccaaaccccagccc

SEQ ID NO: 5745608 - DNA, 23 bp, Homo sapiens
gaggccaccgggacagacctgga

SEQ ID NO: 5745609 - DNA, 10 bp, Homo sapiens
gaggccacct

SEQ ID NO: 5745610 - DNA, 15 bp, Homo sapiens
gaggccacctatgcc

SEQ ID NO: 5745611 - DNA, 12 bp, Homo sapiens
gaggccacctcc

SEQ ID NO: 5745612 - DNA, 12 bp, Homo sapiens
gaggccacctct

SEQ ID NO: 5745613 - DNA, 20 bp, Homo sapiens
gaggccacctctccaagggc

SEQ ID NO: 5745614 - DNA, 10 bp, Homo sapiens
gaggccacgg

SEQ ID NO: 5745615 - DNA, 15 bp, Homo sapiens
gaggccactgaagag

SEQ ID NO: 5745616 - DNA, 19 bp, Homo sapiens
gaggccactgaagaggagg

SEQ ID NO: 5745617 - DNA, 18 bp, Homo sapiens
gaggccactttgagaggg

SEQ ID NO: 5745618 - DNA, 21 bp, Homo sapiens
gaggccagacacaggccgtgg

SEQ ID NO: 5745619 - DNA, 20 bp, Homo sapiens
gaggccagagacacaagcct

SEQ ID NO: 5745620 - DNA, 15 bp, Homo sapiens
gaggccagaggaagg

SEQ ID NO: 5745621 - DNA, 21 bp, Homo sapiens
gaggccagaggcccccagccc

SEQ ID NO: 5745622 - DNA, 22 bp, Homo sapiens
gaggccagagtcaccttttctg

SEQ ID NO: 5745623 - DNA, 13 bp, Homo sapiens
gaggccagcctgg

SEQ ID NO: 5745624 - DNA, 17 bp, Homo sapiens
gaggccagcctggcctc

SEQ ID NO: 5745625 - DNA, 18 bp, Homo sapiens
gaggccagctatctgcct

SEQ ID NO: 5745626 - DNA, 22 bp, Homo sapiens
gaggccagctatctgcctgaca

SEQ ID NO: 5745627 - DNA, 22 bp, Homo sapiens
gaggccaggagtttgagaccag

SEQ ID NO: 5745628 - DNA, 12 bp, Homo sapiens
gaggccaggatg

SEQ ID NO: 5745629 - DNA, 22 bp, Homo sapiens
gaggccaggatgcctgagcccc

SEQ ID NO: 5745630 - DNA, 12 bp, Homo sapiens
gaggccaggccc

SEQ ID NO: 5745631 - DNA, 14 bp, Homo sapiens
gaggccaggccctc

SEQ ID NO: 5745632 - DNA, 22 bp, Homo sapiens
gaggccaggcgagcctgactct

SEQ ID NO: 5745633 - DNA, 11 bp, Homo sapiens
gaggccaggga

SEQ ID NO: 5745634 - DNA, 13 bp, Homo sapiens
gaggccagggata

SEQ ID NO: 5745635 - DNA, 16 bp, Homo sapiens
gaggccagtaggagac

SEQ ID NO: 5745636 - DNA, 16 bp, Homo sapiens
gaggccagtgagccac

SEQ ID NO: 5745637 - DNA, 23 bp, Homo sapiens
gaggccagtggcccccgggcctg

SEQ ID NO: 5745638 - DNA, 12 bp, Homo sapiens
gaggccagtggg

SEQ ID NO: 5745639 - DNA, 13 bp, Homo sapiens
gaggccagtgggc

SEQ ID NO: 5745640 - DNA, 22 bp, Homo sapiens
gaggccagttgatctgctctgt

SEQ ID NO: 5745641 - DNA, 14 bp, Homo sapiens
gaggccatcagggc

SEQ ID NO: 5745642 - DNA, 15 bp, Homo sapiens
gaggccatcagggcc

SEQ ID NO: 5745643 - DNA, 16 bp, Homo sapiens
gaggccatcagggccc

SEQ ID NO: 5745644 - DNA, 18 bp, Homo sapiens
gaggccatcagggccctg

SEQ ID NO: 5745645 - DNA, 20 bp, Homo sapiens
gaggccatcagggccctgcc

SEQ ID NO: 5745646 - DNA, 12 bp, Homo sapiens
gaggccatctgg

SEQ ID NO: 5745647 - DNA, 16 bp, Homo sapiens
gaggccatctggagag

SEQ ID NO: 5745648 - DNA, 19 bp, Homo sapiens
gaggccatctggagagccc

SEQ ID NO: 5745649 - DNA, 20 bp, Homo sapiens
gaggccatgattcgcccaaa

SEQ ID NO: 5745650 - DNA, 19 bp, Homo sapiens
gaggccatggactctgtcc

SEQ ID NO: 5745651 - DNA, 14 bp, Homo sapiens
gaggccatggcgag

SEQ ID NO: 5745652 - DNA, 17 bp, Homo sapiens
gaggccatgggcctcct

SEQ ID NO: 5745653 - DNA, 24 bp, Homo sapiens
gaggccatgggggcccctcggcat

SEQ ID NO: 5745654 - DNA, 17 bp, Homo sapiens
gaggccatgtctcctgc

SEQ ID NO: 5745655 - DNA, 18 bp, Homo sapiens
gaggccatgtctcctgca

SEQ ID NO: 5745656 - DNA, 21 bp, Homo sapiens
gaggccatgtgcatagtttct

SEQ ID NO: 5745657 - DNA, 15 bp, Homo sapiens
gaggccattccctgt

SEQ ID NO: 5745658 - DNA, 20 bp, Homo sapiens
gaggccatttgctgccctgg

SEQ ID NO: 5745659 - DNA, 13 bp, Homo sapiens
gaggcccaaggag

SEQ ID NO: 5745660 - DNA, 18 bp, Homo sapiens
gaggcccacattggaaga

SEQ ID NO: 5745661 - DNA, 18 bp, Homo sapiens
gaggcccactagagggcc

SEQ ID NO: 5745662 - DNA, 21 bp, Homo sapiens
gaggcccactgtgtctaggca

SEQ ID NO: 5745663 - DNA, 13 bp, Homo sapiens
gaggcccagagag

SEQ ID NO: 5745664 - DNA, 17 bp, Homo sapiens
gaggcccagagagctga

SEQ ID NO: 5745665 - DNA, 16 bp, Homo sapiens
gaggcccagagaggga

SEQ ID NO: 5745666 - DNA, 17 bp, Homo sapiens
gaggcccagagagggaa

SEQ ID NO: 5745667 - DNA, 13 bp, Homo sapiens
gaggcccagaggg

SEQ ID NO: 5745668 - DNA, 11 bp, Homo sapiens
gaggcccagca

SEQ ID NO: 5745669 - DNA, 15 bp, Homo sapiens
gaggcccagcagagc

SEQ ID NO: 5745670 - DNA, 16 bp, Homo sapiens
gaggcccagcagagcc

SEQ ID NO: 5745671 - DNA, 18 bp, Homo sapiens
gaggcccagcagagccgt

SEQ ID NO: 5745672 - DNA, 16 bp, Homo sapiens
gaggcccagcccctcc

SEQ ID NO: 5745673 - DNA, 15 bp, Homo sapiens
gaggcccagccgcag

SEQ ID NO: 5745674 - DNA, 16 bp, Homo sapiens
gaggcccagccgcagg

SEQ ID NO: 5745675 - DNA, 14 bp, Homo sapiens
gaggcccagcctgt

SEQ ID NO: 5745676 - DNA, 15 bp, Homo sapiens
gaggcccagcctgtc

SEQ ID NO: 5745677 - DNA, 21 bp, Homo sapiens
gaggcccagcctgtcctggta

SEQ ID NO: 5745678 - DNA, 20 bp, Homo sapiens
gaggcccagcgggcagatgg

SEQ ID NO: 5745679 - DNA, 23 bp, Homo sapiens
gaggcccaggcaccaccaggagc

SEQ ID NO: 5745680 - DNA, 17 bp, Homo sapiens
gaggcccaggctgggaa

SEQ ID NO: 5745681 - DNA, 13 bp, Homo sapiens
gaggcccatgccc

SEQ ID NO: 5745682 - DNA, 16 bp, Homo sapiens
gaggcccatggccaca

SEQ ID NO: 5745683 - DNA, 19 bp, Homo sapiens
gaggcccatgggcagaaga

SEQ ID NO: 5745684 - DNA, 14 bp, Homo sapiens
gaggccccaaagga

SEQ ID NO: 5745685 - DNA, 19 bp, Homo sapiens
gaggccccaaaggaaaaag

SEQ ID NO: 5745686 - DNA, 15 bp, Homo sapiens
gaggccccaaccctg

SEQ ID NO: 5745687 - DNA, 13 bp, Homo sapiens
gaggccccaactc

SEQ ID NO: 5745688 - DNA, 14 bp, Homo sapiens
gaggccccaactca

SEQ ID NO: 5745689 - DNA, 12 bp, Homo sapiens
gaggccccagcc

SEQ ID NO: 5745690 - DNA, 14 bp, Homo sapiens
gaggccccagctct

SEQ ID NO: 5745691 - DNA, 15 bp, Homo sapiens
gaggccccagctctg

SEQ ID NO: 5745692 - DNA, 14 bp, Homo sapiens
gaggccccaggggg

SEQ ID NO: 5745693 - DNA, 16 bp, Homo sapiens
gaggcccccacccttg

SEQ ID NO: 5745694 - DNA, 20 bp, Homo sapiens
gaggcccccagtggggacag

SEQ ID NO: 5745695 - DNA, 14 bp, Homo sapiens
gaggcccccctctg

SEQ ID NO: 5745696 - DNA, 23 bp, Homo sapiens
gaggcccccctctgcctttgagc

SEQ ID NO: 5745697 - DNA, 13 bp, Homo sapiens
gaggcccccgacc

SEQ ID NO: 5745698 - DNA, 13 bp, Homo sapiens
gaggcccccggag

SEQ ID NO: 5745699 - DNA, 17 bp, Homo sapiens
gaggcccccggaggcgc

SEQ ID NO: 5745700 - DNA, 21 bp, Homo sapiens
gaggccccgccttttccccca

SEQ ID NO: 5745701 - DNA, 12 bp, Homo sapiens
gaggcccctgcc

SEQ ID NO: 5745702 - DNA, 17 bp, Homo sapiens
gaggcccctggagccag

SEQ ID NO: 5745703 - DNA, 15 bp, Homo sapiens
gaggcccctgggctc

SEQ ID NO: 5745704 - DNA, 18 bp, Homo sapiens
gaggcccctgggctctca

SEQ ID NO: 5745705 - DNA, 19 bp, Homo sapiens
gaggcccctgggctctcac

SEQ ID NO: 5745706 - DNA, 22 bp, Homo sapiens
gaggcccctgggctctcaccca

SEQ ID NO: 5745707 - DNA, 15 bp, Homo sapiens
gaggcccctgtgcag

SEQ ID NO: 5745708 - DNA, 17 bp, Homo sapiens
gaggccccttgctgctg

SEQ ID NO: 5745709 - DNA, 21 bp, Homo sapiens
gaggccccttgctgctggctc

SEQ ID NO: 5745710 - DNA, 22 bp, Homo sapiens
gaggccccttgctgctggctcc

SEQ ID NO: 5745711 - DNA, 23 bp, Homo sapiens
gaggccccttgctgctggctccc

SEQ ID NO: 5745712 - DNA, 22 bp, Homo sapiens
gaggcccgccctgcccgggctc

SEQ ID NO: 5745713 - DNA, 20 bp, Homo sapiens
gaggcccgtggggccggggc

SEQ ID NO: 5745714 - DNA, 18 bp, Homo sapiens
gaggccctcccaaagagg

SEQ ID NO: 5745715 - DNA, 17 bp, Homo sapiens
gaggccctcgggcccag

SEQ ID NO: 5745716 - DNA, 18 bp, Homo sapiens
gaggccctcgggcccagc

SEQ ID NO: 5745717 - DNA, 21 bp, Homo sapiens
gaggccctcgggcccagcccc

SEQ ID NO: 5745718 - DNA, 17 bp, Homo sapiens
gaggccctctggagtgg

SEQ ID NO: 5745719 - DNA, 23 bp, Homo sapiens
gaggccctgaagcctccgtggaa

SEQ ID NO: 5745720 - DNA, 13 bp, Homo sapiens
gaggccctgcatg

SEQ ID NO: 5745721 - DNA, 19 bp, Homo sapiens
gaggccctgcatgggccag

SEQ ID NO: 5745722 - DNA, 15 bp, Homo sapiens
gaggccctgccacgt

SEQ ID NO: 5745723 - DNA, 18 bp, Homo sapiens
gaggccctgcccaatgag

SEQ ID NO: 5745724 - DNA, 21 bp, Homo sapiens
gaggccctgcccccacccctt

SEQ ID NO: 5745725 - DNA, 23 bp, Homo sapiens
gaggccctgcccccaccccttcc

SEQ ID NO: 5745726 - DNA, 10 bp, Homo sapiens
gaggccctgg

SEQ ID NO: 5745727 - DNA, 11 bp, Homo sapiens
gaggccctgga

SEQ ID NO: 5745728 - DNA, 12 bp, Homo sapiens
gaggccctggag

SEQ ID NO: 5745729 - DNA, 22 bp, Homo sapiens
gaggccctggagggaaggacag

SEQ ID NO: 5745730 - DNA, 14 bp, Homo sapiens
gaggccctggatca

SEQ ID NO: 5745731 - DNA, 23 bp, Homo sapiens
gaggccctggatcagcgtggcct

SEQ ID NO: 5745732 - DNA, 20 bp, Homo sapiens
gaggccctggtgtcaggcag

SEQ ID NO: 5745733 - DNA, 21 bp, Homo sapiens
gaggccctggtgtcaggcagg

SEQ ID NO: 5745734 - DNA, 22 bp, Homo sapiens
gaggccctgtgatatggcggcc

SEQ ID NO: 5745735 - DNA, 17 bp, Homo sapiens
gaggccctgttccctgg

SEQ ID NO: 5745736 - DNA, 12 bp, Homo sapiens
gaggcccttcct

SEQ ID NO: 5745737 - DNA, 14 bp, Homo sapiens
gaggcccttctctc

SEQ ID NO: 5745738 - DNA, 21 bp, Homo sapiens
gaggcccttctctccagcccc

SEQ ID NO: 5745739 - DNA, 24 bp, Homo sapiens
gaggcccttctctccagcccctgg

SEQ ID NO: 5745740 - DNA, 23 bp, Homo sapiens
gaggcccttgtcgtgggatggca

SEQ ID NO: 5745741 - DNA, 15 bp, Homo sapiens
gaggccgaaggtgcc

SEQ ID NO: 5745742 - DNA, 17 bp, Homo sapiens
gaggccgaaggtgcctc

SEQ ID NO: 5745743 - DNA, 18 bp, Homo sapiens
gaggccgaaggtgcctca

SEQ ID NO: 5745744 - DNA, 17 bp, Homo sapiens
gaggccgactgggctgc

SEQ ID NO: 5745745 - DNA, 18 bp, Homo sapiens
gaggccgactgggctgct

SEQ ID NO: 5745746 - DNA, 15 bp, Homo sapiens
gaggccgaggcaggg

SEQ ID NO: 5745747 - DNA, 18 bp, Homo sapiens
gaggccgaggcaggggct

SEQ ID NO: 5745748 - DNA, 15 bp, Homo sapiens
gaggccgaggcaggt

SEQ ID NO: 5745749 - DNA, 18 bp, Homo sapiens
gaggccgagtctgtcctg

SEQ ID NO: 5745750 - DNA, 22 bp, Homo sapiens
gaggccgctagaggcctgagga

SEQ ID NO: 5745751 - DNA, 15 bp, Homo sapiens
gaggccgctgcaggg

SEQ ID NO: 5745752 - DNA, 15 bp, Homo sapiens
gaggccgctgcccct

SEQ ID NO: 5745753 - DNA, 18 bp, Homo sapiens
gaggccgctgcccctgag

SEQ ID NO: 5745754 - DNA, 17 bp, Homo sapiens
gaggccgcttagtgctg

SEQ ID NO: 5745755 - DNA, 18 bp, Homo sapiens
gaggccggccctgcccct

SEQ ID NO: 5745756 - DNA, 19 bp, Homo sapiens
gaggccgggcggtcacagc

SEQ ID NO: 5745757 - DNA, 19 bp, Homo sapiens
gaggccgggtgctcagggc

SEQ ID NO: 5745758 - DNA, 22 bp, Homo sapiens
gaggccgtatgaagacagaggc

SEQ ID NO: 5745759 - DNA, 18 bp, Homo sapiens
gaggcctaccccgcagac

SEQ ID NO: 5745760 - DNA, 13 bp, Homo sapiens
gaggcctacctct

SEQ ID NO: 5745761 - DNA, 14 bp, Homo sapiens
gaggcctacctctc

SEQ ID NO: 5745762 - DNA, 16 bp, Homo sapiens
gaggcctacctgctcc

SEQ ID NO: 5745763 - DNA, 15 bp, Homo sapiens
gaggcctaggagggt

SEQ ID NO: 5745764 - DNA, 16 bp, Homo sapiens
gaggcctatgcagaca

SEQ ID NO: 5745765 - DNA, 10 bp, Homo sapiens
gaggcctcac

SEQ ID NO: 5745766 - DNA, 18 bp, Homo sapiens
gaggcctcaccccaggga

SEQ ID NO: 5745767 - DNA, 16 bp, Homo sapiens
gaggcctcaccctgct

SEQ ID NO: 5745768 - DNA, 12 bp, Homo sapiens
gaggcctcaggt

SEQ ID NO: 5745769 - DNA, 14 bp, Homo sapiens
gaggcctcaggtgc

SEQ ID NO: 5745770 - DNA, 20 bp, Homo sapiens
gaggcctcaggtgctgtcca

SEQ ID NO: 5745771 - DNA, 11 bp, Homo sapiens
gaggcctcagt

SEQ ID NO: 5745772 - DNA, 17 bp, Homo sapiens
gaggcctcatccagggc

SEQ ID NO: 5745773 - DNA, 15 bp, Homo sapiens
gaggcctcatgcctg

SEQ ID NO: 5745774 - DNA, 18 bp, Homo sapiens
gaggcctccactccttcc

SEQ ID NO: 5745775 - DNA, 12 bp, Homo sapiens
gaggcctccctt

SEQ ID NO: 5745776 - DNA, 22 bp, Homo sapiens
gaggcctcggctgtctcctgtc

SEQ ID NO: 5745777 - DNA, 20 bp, Homo sapiens
gaggcctcgtaccagccagg

SEQ ID NO: 5745778 - DNA, 22 bp, Homo sapiens
gaggcctctcattccagaggaa

SEQ ID NO: 5745779 - DNA, 22 bp, Homo sapiens
gaggcctctctcaggagcaggg

SEQ ID NO: 5745780 - DNA, 23 bp, Homo sapiens
gaggcctctgcaagattctgtgg

SEQ ID NO: 5745781 - DNA, 18 bp, Homo sapiens
gaggcctctggaaagcaa

SEQ ID NO: 5745782 - DNA, 18 bp, Homo sapiens
gaggcctcttggacctct

SEQ ID NO: 5745783 - DNA, 24 bp, Homo sapiens
gaggcctcttggacctctgctctg

SEQ ID NO: 5745784 - DNA, 21 bp, Homo sapiens
gaggcctcttttcctgaagaa

SEQ ID NO: 5745785 - DNA, 22 bp, Homo sapiens
gaggcctgaaatcctggttcct

SEQ ID NO: 5745786 - DNA, 13 bp, Homo sapiens
gaggcctgaagcc

SEQ ID NO: 5745787 - DNA, 20 bp, Homo sapiens
gaggcctgaagccagctgcc

SEQ ID NO: 5745788 - DNA, 20 bp, Homo sapiens
gaggcctgacacaggccagc

SEQ ID NO: 5745789 - DNA, 20 bp, Homo sapiens
gaggcctgacgtgggcatca

SEQ ID NO: 5745790 - DNA, 20 bp, Homo sapiens
gaggcctgactgccaagcca

SEQ ID NO: 5745791 - DNA, 14 bp, Homo sapiens
gaggcctgagaccc

SEQ ID NO: 5745792 - DNA, 21 bp, Homo sapiens
gaggcctgaggatgagctgga

SEQ ID NO: 5745793 - DNA, 20 bp, Homo sapiens
gaggcctgcaaaccttcctg

SEQ ID NO: 5745794 - DNA, 21 bp, Homo sapiens
gaggcctgcaaaccttcctgg

SEQ ID NO: 5745795 - DNA, 22 bp, Homo sapiens
gaggcctgcaaaccttcctggg

SEQ ID NO: 5745796 - DNA, 14 bp, Homo sapiens
gaggcctgcacagg

SEQ ID NO: 5745797 - DNA, 18 bp, Homo sapiens
gaggcctgccccctgggc

SEQ ID NO: 5745798 - DNA, 16 bp, Homo sapiens
gaggcctgcccgggcg

SEQ ID NO: 5745799 - DNA, 20 bp, Homo sapiens
gaggcctgccctcagggatc

SEQ ID NO: 5745800 - DNA, 23 bp, Homo sapiens
gaggcctgccctcagggatcttg

SEQ ID NO: 5745801 - DNA, 16 bp, Homo sapiens
gaggcctgcgaccctg

SEQ ID NO: 5745802 - DNA, 14 bp, Homo sapiens
gaggcctgcttccc

SEQ ID NO: 5745803 - DNA, 12 bp, Homo sapiens
gaggcctggacc

SEQ ID NO: 5745804 - DNA, 19 bp, Homo sapiens
gaggcctggaccgagatgt

SEQ ID NO: 5745805 - DNA, 13 bp, Homo sapiens
gaggcctggactt

SEQ ID NO: 5745806 - DNA, 20 bp, Homo sapiens
gaggcctggactttcctgca

SEQ ID NO: 5745807 - DNA, 21 bp, Homo sapiens
gaggcctggcatcttctggag

SEQ ID NO: 5745808 - DNA, 13 bp, Homo sapiens
gaggcctggccag

SEQ ID NO: 5745809 - DNA, 14 bp, Homo sapiens
gaggcctggccagg

SEQ ID NO: 5745810 - DNA, 17 bp, Homo sapiens
gaggcctggctctggag

SEQ ID NO: 5745811 - DNA, 14 bp, Homo sapiens
gaggcctgggaggg

SEQ ID NO: 5745812 - DNA, 16 bp, Homo sapiens
gaggcctgggccgctg

SEQ ID NO: 5745813 - DNA, 18 bp, Homo sapiens
gaggcctgggctgggaaa

SEQ ID NO: 5745814 - DNA, 18 bp, Homo sapiens
gaggcctggggaggccct

SEQ ID NO: 5745815 - DNA, 21 bp, Homo sapiens
gaggcctgggggtgggggagg

SEQ ID NO: 5745816 - DNA, 15 bp, Homo sapiens
gaggcctggtctgga

SEQ ID NO: 5745817 - DNA, 13 bp, Homo sapiens
gaggcctggtgcc

SEQ ID NO: 5745818 - DNA, 18 bp, Homo sapiens
gaggcctggtgccctggc

SEQ ID NO: 5745819 - DNA, 21 bp, Homo sapiens
gaggccttacttaaacccagc

SEQ ID NO: 5745820 - DNA, 20 bp, Homo sapiens
gaggccttatcattcattct

SEQ ID NO: 5745821 - DNA, 20 bp, Homo sapiens
gaggccttcagaaaagacac

SEQ ID NO: 5745822 - DNA, 18 bp, Homo sapiens
gaggccttccagctgctg

SEQ ID NO: 5745823 - DNA, 20 bp, Homo sapiens
gaggccttccagctgctgtc

SEQ ID NO: 5745824 - DNA, 20 bp, Homo sapiens
gaggccttgggctctgctga

SEQ ID NO: 5745825 - DNA, 18 bp, Homo sapiens
gaggccttggggtggggg

SEQ ID NO: 5745826 - DNA, 17 bp, Homo sapiens
gaggccttgtgtgtcag

SEQ ID NO: 5745827 - DNA, 21 bp, Homo sapiens
gaggccttgtgtgtcaggccc

SEQ ID NO: 5745828 - DNA, 22 bp, Homo sapiens
gaggccttgtgtgtcaggccct

SEQ ID NO: 5745829 - DNA, 21 bp, Homo sapiens
gaggcgaagcgttgtcctcag

SEQ ID NO: 5745830 - DNA, 20 bp, Homo sapiens
gaggcgaataaatgttcaaa

SEQ ID NO: 5745831 - DNA, 20 bp, Homo sapiens
gaggcgacttcctctccagc

SEQ ID NO: 5745832 - DNA, 17 bp, Homo sapiens
gaggcgagcagggcagg

SEQ ID NO: 5745833 - DNA, 13 bp, Homo sapiens
gaggcgagccagg

SEQ ID NO: 5745834 - DNA, 15 bp, Homo sapiens
gaggcgagccaggca

SEQ ID NO: 5745835 - DNA, 14 bp, Homo sapiens
gaggcgagcctggc

SEQ ID NO: 5745836 - DNA, 15 bp, Homo sapiens
gaggcgaggctgcct

SEQ ID NO: 5745837 - DNA, 23 bp, Homo sapiens
gaggcgaggctgcctctgggtga

SEQ ID NO: 5745838 - DNA, 18 bp, Homo sapiens
gaggcgagtcaccctcct

SEQ ID NO: 5745839 - DNA, 21 bp, Homo sapiens
gaggcgcagggacatggggca

SEQ ID NO: 5745840 - DNA, 21 bp, Homo sapiens
gaggcgcatgaatttgtgaag

SEQ ID NO: 5745841 - DNA, 12 bp, Homo sapiens
gaggcgcccacc

SEQ ID NO: 5745842 - DNA, 17 bp, Homo sapiens
gaggcgcccacctgccc

SEQ ID NO: 5745843 - DNA, 20 bp, Homo sapiens
gaggcgccccaacccgtgga

SEQ ID NO: 5745844 - DNA, 21 bp, Homo sapiens
gaggcgccccaacccgtggag

SEQ ID NO: 5745845 - DNA, 20 bp, Homo sapiens
gaggcgccttcctgggttgg

SEQ ID NO: 5745846 - DNA, 13 bp, Homo sapiens
gaggcgctgctgg

SEQ ID NO: 5745847 - DNA, 14 bp, Homo sapiens
gaggcggaagaatc

SEQ ID NO: 5745848 - DNA, 19 bp, Homo sapiens
gaggcggagcttgcagtga

SEQ ID NO: 5745849 - DNA, 20 bp, Homo sapiens
gaggcggagcttgcagtgag

SEQ ID NO: 5745850 - DNA, 19 bp, Homo sapiens
gaggcggatctttggacag

SEQ ID NO: 5745851 - DNA, 13 bp, Homo sapiens
gaggcggcagctg

SEQ ID NO: 5745852 - DNA, 21 bp, Homo sapiens
gaggcggcccggccagcgggc

SEQ ID NO: 5745853 - DNA, 21 bp, Homo sapiens
gaggcggccggccgcactggg

SEQ ID NO: 5745854 - DNA, 18 bp, Homo sapiens
gaggcggctccaggtccg

SEQ ID NO: 5745855 - DNA, 19 bp, Homo sapiens
gaggcgggccagccaggcg

SEQ ID NO: 5745856 - DNA, 15 bp, Homo sapiens
gaggcggggaggagg

SEQ ID NO: 5745857 - DNA, 16 bp, Homo sapiens
gaggcggggctctagg

SEQ ID NO: 5745858 - DNA, 15 bp, Homo sapiens
gaggcgggggagcct

SEQ ID NO: 5745859 - DNA, 17 bp, Homo sapiens
gaggcgggggatcctgg

SEQ ID NO: 5745860 - DNA, 18 bp, Homo sapiens
gaggcgggggatcctgga

SEQ ID NO: 5745861 - DNA, 20 bp, Homo sapiens
gaggcgggggatcctggagc

SEQ ID NO: 5745862 - DNA, 22 bp, Homo sapiens
gaggcgggggatcctggagccc

SEQ ID NO: 5745863 - DNA, 12 bp, Homo sapiens
gaggcgggtgga

SEQ ID NO: 5745864 - DNA, 12 bp, Homo sapiens
gaggcggtgggg

SEQ ID NO: 5745865 - DNA, 15 bp, Homo sapiens
gaggcggtttcctga

SEQ ID NO: 5745866 - DNA, 21 bp, Homo sapiens
gaggcgtactacccagctctg

SEQ ID NO: 5745867 - DNA, 20 bp, Homo sapiens
gaggcgtatgtggcaaaatg

SEQ ID NO: 5745868 - DNA, 20 bp, Homo sapiens
gaggcgtcctggtgaggaca

SEQ ID NO: 5745869 - DNA, 18 bp, Homo sapiens
gaggcgtgcccccctcct

SEQ ID NO: 5745870 - DNA, 17 bp, Homo sapiens
gaggcgtggaggagagg

SEQ ID NO: 5745871 - DNA, 17 bp, Homo sapiens
gaggcgtgtgcaggccg

SEQ ID NO: 5745872 - DNA, 13 bp, Homo sapiens
gaggctaaaatgt

SEQ ID NO: 5745873 - DNA, 23 bp, Homo sapiens
gaggctaaattactcaggaagaa

SEQ ID NO: 5745874 - DNA, 23 bp, Homo sapiens
gaggctaagatgagatttgccag

SEQ ID NO: 5745875 - DNA, 13 bp, Homo sapiens
gaggctaagcctg

SEQ ID NO: 5745876 - DNA, 18 bp, Homo sapiens
gaggctaagttgggatct

SEQ ID NO: 5745877 - DNA, 16 bp, Homo sapiens
gaggctacagctccac

SEQ ID NO: 5745878 - DNA, 19 bp, Homo sapiens
gaggctacccgctgtggcc

SEQ ID NO: 5745879 - DNA, 22 bp, Homo sapiens
gaggctacctcacctgggcagg

SEQ ID NO: 5745880 - DNA, 13 bp, Homo sapiens
gaggctagcccca

SEQ ID NO: 5745881 - DNA, 21 bp, Homo sapiens
gaggctagtctcttctcagag

SEQ ID NO: 5745882 - DNA, 22 bp, Homo sapiens
gaggctagtgtggtgtttcctg

SEQ ID NO: 5745883 - DNA, 16 bp, Homo sapiens
gaggctcaagaggccc

SEQ ID NO: 5745884 - DNA, 21 bp, Homo sapiens
gaggctcaagaggcccaggga

SEQ ID NO: 5745885 - DNA, 23 bp, Homo sapiens
gaggctcaagaggcccagggagc

SEQ ID NO: 5745886 - DNA, 16 bp, Homo sapiens
gaggctcactgagtga

SEQ ID NO: 5745887 - DNA, 22 bp, Homo sapiens
gaggctcagagactgcaagctg

SEQ ID NO: 5745888 - DNA, 14 bp, Homo sapiens
gaggctcagagagg

SEQ ID NO: 5745889 - DNA, 16 bp, Homo sapiens
gaggctcagagaggta

SEQ ID NO: 5745890 - DNA, 12 bp, Homo sapiens
gaggctcaggtc

SEQ ID NO: 5745891 - DNA, 19 bp, Homo sapiens
gaggctccagctctggcac

SEQ ID NO: 5745892 - DNA, 12 bp, Homo sapiens
gaggctccagga

SEQ ID NO: 5745893 - DNA, 15 bp, Homo sapiens
gaggctccaggactc

SEQ ID NO: 5745894 - DNA, 15 bp, Homo sapiens
gaggctccaggcagc

SEQ ID NO: 5745895 - DNA, 16 bp, Homo sapiens
gaggctccaggcagca

SEQ ID NO: 5745896 - DNA, 21 bp, Homo sapiens
gaggctccatccttctcccca

SEQ ID NO: 5745897 - DNA, 18 bp, Homo sapiens
gaggctcccatgggctag

SEQ ID NO: 5745898 - DNA, 21 bp, Homo sapiens
gaggctcccatgggctaggag

SEQ ID NO: 5745899 - DNA, 13 bp, Homo sapiens
gaggctccccagg

SEQ ID NO: 5745900 - DNA, 20 bp, Homo sapiens
gaggctccccgcctccactc

SEQ ID NO: 5745901 - DNA, 21 bp, Homo sapiens
gaggctccccgcctccactct

SEQ ID NO: 5745902 - DNA, 17 bp, Homo sapiens
gaggctcccggggcctg

SEQ ID NO: 5745903 - DNA, 21 bp, Homo sapiens
gaggctccgtgagcccttggt

SEQ ID NO: 5745904 - DNA, 17 bp, Homo sapiens
gaggctcctccctctgc

SEQ ID NO: 5745905 - DNA, 19 bp, Homo sapiens
gaggctcctccctctgcct

SEQ ID NO: 5745906 - DNA, 12 bp, Homo sapiens
gaggctcctcta

SEQ ID NO: 5745907 - DNA, 15 bp, Homo sapiens
gaggctcctctaggc

SEQ ID NO: 5745908 - DNA, 12 bp, Homo sapiens
gaggctcctgga

SEQ ID NO: 5745909 - DNA, 15 bp, Homo sapiens
gaggctcctggtggg

SEQ ID NO: 5745910 - DNA, 12 bp, Homo sapiens
gaggctcctgtg

SEQ ID NO: 5745911 - DNA, 15 bp, Homo sapiens
gaggctcctgtggta

SEQ ID NO: 5745912 - DNA, 17 bp, Homo sapiens
gaggctcctgtggtagt

SEQ ID NO: 5745913 - DNA, 20 bp, Homo sapiens
gaggctcgagctcggggctg

SEQ ID NO: 5745914 - DNA, 21 bp, Homo sapiens
gaggctcgagctcggggctgg

SEQ ID NO: 5745915 - DNA, 20 bp, Homo sapiens
gaggctcggagcacccttgc

SEQ ID NO: 5745916 - DNA, 20 bp, Homo sapiens
gaggctctaaccacacagcc

SEQ ID NO: 5745917 - DNA, 19 bp, Homo sapiens
gaggctctattgagccaag

SEQ ID NO: 5745918 - DNA, 15 bp, Homo sapiens
gaggctctccgtgca

SEQ ID NO: 5745919 - DNA, 17 bp, Homo sapiens
gaggctctctaagaaaa

SEQ ID NO: 5745920 - DNA, 20 bp, Homo sapiens
gaggctctctaagaaaagag

SEQ ID NO: 5745921 - DNA, 17 bp, Homo sapiens
gaggctctgagggtctg

SEQ ID NO: 5745922 - DNA, 12 bp, Homo sapiens
gaggctctgccc

SEQ ID NO: 5745923 - DNA, 15 bp, Homo sapiens
gaggctctgcccttg

SEQ ID NO: 5745924 - DNA, 17 bp, Homo sapiens
gaggctctgcccttggt

SEQ ID NO: 5745925 - DNA, 14 bp, Homo sapiens
gaggctctggacag

SEQ ID NO: 5745926 - DNA, 21 bp, Homo sapiens
gaggctgacacagaggctggc

SEQ ID NO: 5745927 - DNA, 21 bp, Homo sapiens
gaggctgacatgctcacacat

SEQ ID NO: 5745928 - DNA, 23 bp, Homo sapiens
gaggctgacatgctcacacatta

SEQ ID NO: 5745929 - DNA, 12 bp, Homo sapiens
gaggctgactcc

SEQ ID NO: 5745930 - DNA, 18 bp, Homo sapiens
gaggctgacttttccaaa

SEQ ID NO: 5745931 - DNA, 14 bp, Homo sapiens
gaggctgagaaagc

SEQ ID NO: 5745932 - DNA, 19 bp, Homo sapiens
gaggctgagactgcagagg

SEQ ID NO: 5745933 - DNA, 14 bp, Homo sapiens
gaggctgagccctg

SEQ ID NO: 5745934 - DNA, 16 bp, Homo sapiens
gaggctgaggcaagag

SEQ ID NO: 5745935 - DNA, 14 bp, Homo sapiens
gaggctgaggcaga

SEQ ID NO: 5745936 - DNA, 16 bp, Homo sapiens
gaggctgaggcagaag

SEQ ID NO: 5745937 - DNA, 16 bp, Homo sapiens
gaggctgaggcaggag

SEQ ID NO: 5745938 - DNA, 21 bp, Homo sapiens
gaggctgaggcaggagaatca

SEQ ID NO: 5745939 - DNA, 18 bp, Homo sapiens
gaggctgaggcaggagac

SEQ ID NO: 5745940 - DNA, 19 bp, Homo sapiens
gaggctgaggcctggactt

SEQ ID NO: 5745941 - DNA, 16 bp, Homo sapiens
gaggctgagggacagg

SEQ ID NO: 5745942 - DNA, 18 bp, Homo sapiens
gaggctgaggtgggagga

SEQ ID NO: 5745943 - DNA, 16 bp, Homo sapiens
gaggctgcacccctgg

SEQ ID NO: 5745944 - DNA, 15 bp, Homo sapiens
gaggctgcactgcag

SEQ ID NO: 5745945 - DNA, 16 bp, Homo sapiens
gaggctgcagagctga

SEQ ID NO: 5745946 - DNA, 11 bp, Homo sapiens
gaggctgcagc

SEQ ID NO: 5745947 - DNA, 22 bp, Homo sapiens
gaggctgcagcaggtgctgggc

SEQ ID NO: 5745948 - DNA, 12 bp, Homo sapiens
gaggctgcagcc

SEQ ID NO: 5745949 - DNA, 21 bp, Homo sapiens
gaggctgcagccaggcctcgc

SEQ ID NO: 5745950 - DNA, 15 bp, Homo sapiens
gaggctgcaggactt

SEQ ID NO: 5745951 - DNA, 15 bp, Homo sapiens
gaggctgcagtcagc

SEQ ID NO: 5745952 - DNA, 16 bp, Homo sapiens
gaggctgcatgctctg

SEQ ID NO: 5745953 - DNA, 11 bp, Homo sapiens
gaggctgcccc

SEQ ID NO: 5745954 - DNA, 23 bp, Homo sapiens
gaggctgccccacccctccccat

SEQ ID NO: 5745955 - DNA, 13 bp, Homo sapiens
gaggctgccccag

SEQ ID NO: 5745956 - DNA, 14 bp, Homo sapiens
gaggctgccccagg

SEQ ID NO: 5745957 - DNA, 18 bp, Homo sapiens
gaggctgccccaggccgg

SEQ ID NO: 5745958 - DNA, 23 bp, Homo sapiens
gaggctgccccaggccggagccc

SEQ ID NO: 5745959 - DNA, 15 bp, Homo sapiens
gaggctgcccctctc

SEQ ID NO: 5745960 - DNA, 13 bp, Homo sapiens
gaggctgccctcc

SEQ ID NO: 5745961 - DNA, 14 bp, Homo sapiens
gaggctgccctcct

SEQ ID NO: 5745962 - DNA, 23 bp, Homo sapiens
gaggctgccgagacagaccctct

SEQ ID NO: 5745963 - DNA, 19 bp, Homo sapiens
gaggctgccggagggagcc

SEQ ID NO: 5745964 - DNA, 16 bp, Homo sapiens
gaggctgcctcagcca

SEQ ID NO: 5745965 - DNA, 16 bp, Homo sapiens
gaggctgcctctgggt

SEQ ID NO: 5745966 - DNA, 18 bp, Homo sapiens
gaggctgcctctgggtga

SEQ ID NO: 5745967 - DNA, 17 bp, Homo sapiens
gaggctgcgtcctgagg

SEQ ID NO: 5745968 - DNA, 13 bp, Homo sapiens
gaggctgctcggg

SEQ ID NO: 5745969 - DNA, 11 bp, Homo sapiens
gaggctgctgc

SEQ ID NO: 5745970 - DNA, 15 bp, Homo sapiens
gaggctgctgccagg

SEQ ID NO: 5745971 - DNA, 19 bp, Homo sapiens
gaggctgctgccaggcccg

SEQ ID NO: 5745972 - DNA, 21 bp, Homo sapiens
gaggctgctgccccctggctt

SEQ ID NO: 5745973 - DNA, 12 bp, Homo sapiens
gaggctgctttc

SEQ ID NO: 5745974 - DNA, 19 bp, Homo sapiens
gaggctgctttctgccctt

SEQ ID NO: 5745975 - DNA, 17 bp, Homo sapiens
gaggctggaccaactgc

SEQ ID NO: 5745976 - DNA, 19 bp, Homo sapiens
gaggctggactccagatct

SEQ ID NO: 5745977 - DNA, 23 bp, Homo sapiens
gaggctggactccagatctgcac

SEQ ID NO: 5745978 - DNA, 16 bp, Homo sapiens
gaggctggaggcaggg

SEQ ID NO: 5745979 - DNA, 17 bp, Homo sapiens
gaggctggaggcagggc

SEQ ID NO: 5745980 - DNA, 18 bp, Homo sapiens
gaggctggaggcagggcc

SEQ ID NO: 5745981 - DNA, 19 bp, Homo sapiens
gaggctggatgacttgctc

SEQ ID NO: 5745982 - DNA, 14 bp, Homo sapiens
gaggctggatggct

SEQ ID NO: 5745983 - DNA, 14 bp, Homo sapiens
gaggctggcaagga

SEQ ID NO: 5745984 - DNA, 13 bp, Homo sapiens
gaggctggcacag

SEQ ID NO: 5745985 - DNA, 18 bp, Homo sapiens
gaggctggcactcccctg

SEQ ID NO: 5745986 - DNA, 21 bp, Homo sapiens
gaggctggcagggtccctcca

SEQ ID NO: 5745987 - DNA, 16 bp, Homo sapiens
gaggctggcatcctgg

SEQ ID NO: 5745988 - DNA, 17 bp, Homo sapiens
gaggctggcatcctggc

SEQ ID NO: 5745989 - DNA, 17 bp, Homo sapiens
gaggctggcggggtctg

SEQ ID NO: 5745990 - DNA, 13 bp, Homo sapiens
gaggctggctggg

SEQ ID NO: 5745991 - DNA, 19 bp, Homo sapiens
gaggctggctgggggcagg

SEQ ID NO: 5745992 - DNA, 23 bp, Homo sapiens
gaggctgggaatggaggggcaga

SEQ ID NO: 5745993 - DNA, 12 bp, Homo sapiens
gaggctgggagg

SEQ ID NO: 5745994 - DNA, 13 bp, Homo sapiens
gaggctgggaggt

SEQ ID NO: 5745995 - DNA, 20 bp, Homo sapiens
gaggctgggaggttgggagg

SEQ ID NO: 5745996 - DNA, 15 bp, Homo sapiens
gaggctgggagtccc

SEQ ID NO: 5745997 - DNA, 17 bp, Homo sapiens
gaggctgggccaagcca

SEQ ID NO: 5745998 - DNA, 16 bp, Homo sapiens
gaggctgggccagcct

SEQ ID NO: 5745999 - DNA, 13 bp, Homo sapiens
gaggctgggctcc

SEQ ID NO: 5746000 - DNA, 20 bp, Homo sapiens
gaggctgggctcccttccca

SEQ ID NO: 5746001 - DNA, 23 bp, Homo sapiens
gaggctggggcggggctggaggt

SEQ ID NO: 5746002 - DNA, 22 bp, Homo sapiens
gaggctgggtggccggccctgc

SEQ ID NO: 5746003 - DNA, 16 bp, Homo sapiens
gaggctggtcctatgg

SEQ ID NO: 5746004 - DNA, 18 bp, Homo sapiens
gaggctggtcctatggcc

SEQ ID NO: 5746005 - DNA, 23 bp, Homo sapiens
gaggctggtctccctccagctgg

SEQ ID NO: 5746006 - DNA, 22 bp, Homo sapiens
gaggctggtggttttcagagca

SEQ ID NO: 5746007 - DNA, 24 bp, Homo sapiens
gaggctggtggttttcagagcagg

SEQ ID NO: 5746008 - DNA, 20 bp, Homo sapiens
gaggctggtgtatgcactgc

SEQ ID NO: 5746009 - DNA, 22 bp, Homo sapiens
gaggctggttttgatggctggg

SEQ ID NO: 5746010 - DNA, 23 bp, Homo sapiens
gaggctgtaggactcgcagtcag

SEQ ID NO: 5746011 - DNA, 16 bp, Homo sapiens
gaggctgtgagcagct

SEQ ID NO: 5746012 - DNA, 16 bp, Homo sapiens
gaggctgtggtcagag

SEQ ID NO: 5746013 - DNA, 12 bp, Homo sapiens
gaggctgtgtcc

SEQ ID NO: 5746014 - DNA, 17 bp, Homo sapiens
gaggctgtgtccctgct

SEQ ID NO: 5746015 - DNA, 24 bp, Homo sapiens
gaggctgtgtccctgctggggtct

SEQ ID NO: 5746016 - DNA, 13 bp, Homo sapiens
gaggctgtgtctc

SEQ ID NO: 5746017 - DNA, 15 bp, Homo sapiens
gaggctgtgtctctg

SEQ ID NO: 5746018 - DNA, 17 bp, Homo sapiens
gaggctgtgtgcctggg

SEQ ID NO: 5746019 - DNA, 21 bp, Homo sapiens
gaggctgtgtgcctgggggag

SEQ ID NO: 5746020 - DNA, 22 bp, Homo sapiens
gaggctgtgtgcctgggggagt

SEQ ID NO: 5746021 - DNA, 18 bp, Homo sapiens
gaggctgtgtggccaacc

SEQ ID NO: 5746022 - DNA, 15 bp, Homo sapiens
gaggcttaacaatgt

SEQ ID NO: 5746023 - DNA, 19 bp, Homo sapiens
gaggcttaattctgagctg

SEQ ID NO: 5746024 - DNA, 22 bp, Homo sapiens
gaggcttagctttgctctgcca

SEQ ID NO: 5746025 - DNA, 15 bp, Homo sapiens
gaggcttcaggggac

SEQ ID NO: 5746026 - DNA, 16 bp, Homo sapiens
gaggcttccagagagt

SEQ ID NO: 5746027 - DNA, 13 bp, Homo sapiens
gaggcttccaggc

SEQ ID NO: 5746028 - DNA, 14 bp, Homo sapiens
gaggcttcccagag

SEQ ID NO: 5746029 - DNA, 17 bp, Homo sapiens
gaggcttcccagagacc

SEQ ID NO: 5746030 - DNA, 22 bp, Homo sapiens
gaggcttccctacacagggcct

SEQ ID NO: 5746031 - DNA, 23 bp, Homo sapiens
gaggcttccctacacagggcctg

SEQ ID NO: 5746032 - DNA, 13 bp, Homo sapiens
gaggcttcctgcg

SEQ ID NO: 5746033 - DNA, 18 bp, Homo sapiens
gaggcttcggagtttctt

SEQ ID NO: 5746034 - DNA, 15 bp, Homo sapiens
gaggcttctccgcca

SEQ ID NO: 5746035 - DNA, 23 bp, Homo sapiens
gaggcttctccgccagcctcctc

SEQ ID NO: 5746036 - DNA, 23 bp, Homo sapiens
gaggcttctcctgttttatatat

SEQ ID NO: 5746037 - DNA, 14 bp, Homo sapiens
gaggcttctccttc

SEQ ID NO: 5746038 - DNA, 22 bp, Homo sapiens
gaggcttcttcagatcagtgct

SEQ ID NO: 5746039 - DNA, 14 bp, Homo sapiens
gaggcttcttcctg

SEQ ID NO: 5746040 - DNA, 18 bp, Homo sapiens
gaggcttcttcctggatg

SEQ ID NO: 5746041 - DNA, 23 bp, Homo sapiens
gaggcttcttcctggatggggca

SEQ ID NO: 5746042 - DNA, 20 bp, Homo sapiens
gaggcttgctgagaggggct

SEQ ID NO: 5746043 - DNA, 18 bp, Homo sapiens
gaggcttgggaccgccag

SEQ ID NO: 5746044 - DNA, 22 bp, Homo sapiens
gaggcttgggaccgccagatgg

SEQ ID NO: 5746045 - DNA, 21 bp, Homo sapiens
gaggcttgtcagagctgggag

SEQ ID NO: 5746046 - DNA, 18 bp, Homo sapiens
gaggctttaagctccagc

SEQ ID NO: 5746047 - DNA, 13 bp, Homo sapiens
gaggctttcagtg

SEQ ID NO: 5746048 - DNA, 23 bp, Homo sapiens
gaggctttctgggctctggactc

SEQ ID NO: 5746049 - DNA, 16 bp, Homo sapiens
gaggctttggatttga

SEQ ID NO: 5746050 - DNA, 16 bp, Homo sapiens
gaggctttgtgttgta

SEQ ID NO: 5746051 - DNA, 15 bp, Homo sapiens
gaggcttttcactgc

SEQ ID NO: 5746052 - DNA, 14 bp, Homo sapiens
gaggcttttccagt

SEQ ID NO: 5746053 - DNA, 17 bp, Homo sapiens
gagggaaaaagagctgg

SEQ ID NO: 5746054 - DNA, 17 bp, Homo sapiens
gagggaaaacagaaaac

SEQ ID NO: 5746055 - DNA, 10 bp, Homo sapiens
gagggaaaag

SEQ ID NO: 5746056 - DNA, 15 bp, Homo sapiens
gagggaaaaggcagg

SEQ ID NO: 5746057 - DNA, 13 bp, Homo sapiens
gagggaaacaaaa

SEQ ID NO: 5746058 - DNA, 14 bp, Homo sapiens
gagggaaaccagag

SEQ ID NO: 5746059 - DNA, 18 bp, Homo sapiens
gagggaaactctggagag

SEQ ID NO: 5746060 - DNA, 16 bp, Homo sapiens
gagggaaactgtgaat

SEQ ID NO: 5746061 - DNA, 22 bp, Homo sapiens
gagggaaactgtgaatgcttct

SEQ ID NO: 5746062 - DNA, 14 bp, Homo sapiens
gagggaaagccagc

SEQ ID NO: 5746063 - DNA, 15 bp, Homo sapiens
gagggaaagccagcc

SEQ ID NO: 5746064 - DNA, 21 bp, Homo sapiens
gagggaaagcccagaaaagga

SEQ ID NO: 5746065 - DNA, 23 bp, Homo sapiens
gagggaaagggtcctgctttctc

SEQ ID NO: 5746066 - DNA, 21 bp, Homo sapiens
gagggaaatctgtaaagccag

SEQ ID NO: 5746067 - DNA, 22 bp, Homo sapiens
gagggaaattgtaaatcctgtg

SEQ ID NO: 5746068 - DNA, 23 bp, Homo sapiens
gagggaacatttccgaataaagt

SEQ ID NO: 5746069 - DNA, 19 bp, Homo sapiens
gagggaagaccagaattcc

SEQ ID NO: 5746070 - DNA, 14 bp, Homo sapiens
gagggaagagggag

SEQ ID NO: 5746071 - DNA, 15 bp, Homo sapiens
gagggaagagggaga

SEQ ID NO: 5746072 - DNA, 23 bp, Homo sapiens
gagggaagatcttgatggtgttt

SEQ ID NO: 5746073 - DNA, 13 bp, Homo sapiens
gagggaagccagg

SEQ ID NO: 5746074 - DNA, 21 bp, Homo sapiens
gagggaagccagtcagggccc

SEQ ID NO: 5746075 - DNA, 20 bp, Homo sapiens
gagggaagcccacccgcccc

SEQ ID NO: 5746076 - DNA, 16 bp, Homo sapiens
gagggaagctgaggcc

SEQ ID NO: 5746077 - DNA, 19 bp, Homo sapiens
gagggaagctgaggcccat

SEQ ID NO: 5746078 - DNA, 20 bp, Homo sapiens
gagggaagctgaggcccatg

SEQ ID NO: 5746079 - DNA, 22 bp, Homo sapiens
gagggaagctgaggcccatggc

SEQ ID NO: 5746080 - DNA, 18 bp, Homo sapiens
gagggaagctggctgggc

SEQ ID NO: 5746081 - DNA, 16 bp, Homo sapiens
gagggaaggagctgtt

SEQ ID NO: 5746082 - DNA, 14 bp, Homo sapiens
gagggaagggacgg

SEQ ID NO: 5746083 - DNA, 15 bp, Homo sapiens
gagggaagggagcca

SEQ ID NO: 5746084 - DNA, 17 bp, Homo sapiens
gagggaagggagccaag

SEQ ID NO: 5746085 - DNA, 17 bp, Homo sapiens
gagggaagggccaccct

SEQ ID NO: 5746086 - DNA, 22 bp, Homo sapiens
gagggaagggccaccctgctgc

SEQ ID NO: 5746087 - DNA, 15 bp, Homo sapiens
gagggaaggggaatg

SEQ ID NO: 5746088 - DNA, 21 bp, Homo sapiens
gagggaaggggaatggaagag

SEQ ID NO: 5746089 - DNA, 16 bp, Homo sapiens
gagggaaggggatgga

SEQ ID NO: 5746090 - DNA, 17 bp, Homo sapiens
gagggaatctagcccaa

SEQ ID NO: 5746091 - DNA, 18 bp, Homo sapiens
gagggaatgacaccatca

SEQ ID NO: 5746092 - DNA, 16 bp, Homo sapiens
gagggaatgggacagg

SEQ ID NO: 5746093 - DNA, 18 bp, Homo sapiens
gagggaattgaggtctgc

SEQ ID NO: 5746094 - DNA, 15 bp, Homo sapiens
gagggaatttaacca

SEQ ID NO: 5746095 - DNA, 16 bp, Homo sapiens
gagggacaaaggagcc

SEQ ID NO: 5746096 - DNA, 19 bp, Homo sapiens
gagggacaaaggagcctgt

SEQ ID NO: 5746097 - DNA, 20 bp, Homo sapiens
gagggacaaaggagcctgtg

SEQ ID NO: 5746098 - DNA, 21 bp, Homo sapiens
gagggacaaaggagcctgtga

SEQ ID NO: 5746099 - DNA, 22 bp, Homo sapiens
gagggacaaaggagcctgtgaa

SEQ ID NO: 5746100 - DNA, 15 bp, Homo sapiens
gagggacaagggatt

SEQ ID NO: 5746101 - DNA, 14 bp, Homo sapiens
gagggacaatgcca

SEQ ID NO: 5746102 - DNA, 15 bp, Homo sapiens
gagggacactcctcc

SEQ ID NO: 5746103 - DNA, 20 bp, Homo sapiens
gagggacagagcccgggaga

SEQ ID NO: 5746104 - DNA, 14 bp, Homo sapiens
gagggacaggctga

SEQ ID NO: 5746105 - DNA, 17 bp, Homo sapiens
gagggacaggctgaaga

SEQ ID NO: 5746106 - DNA, 21 bp, Homo sapiens
gagggacaggctgaagagagg

SEQ ID NO: 5746107 - DNA, 16 bp, Homo sapiens
gagggacagggcaggc

SEQ ID NO: 5746108 - DNA, 17 bp, Homo sapiens
gagggacagggcaggcg

SEQ ID NO: 5746109 - DNA, 13 bp, Homo sapiens
gagggacagggtg

SEQ ID NO: 5746110 - DNA, 20 bp, Homo sapiens
gagggacatagaatctgtga

SEQ ID NO: 5746111 - DNA, 19 bp, Homo sapiens
gagggacatgctcacctct

SEQ ID NO: 5746112 - DNA, 21 bp, Homo sapiens
gagggaccaggtgtctagagg

SEQ ID NO: 5746113 - DNA, 23 bp, Homo sapiens
gagggaccaggtgtctagaggca

SEQ ID NO: 5746114 - DNA, 15 bp, Homo sapiens
gagggaccatgtgtc

SEQ ID NO: 5746115 - DNA, 21 bp, Homo sapiens
gagggaccatgtgtcacttgt

SEQ ID NO: 5746116 - DNA, 19 bp, Homo sapiens
gagggacccttcgagatca

SEQ ID NO: 5746117 - DNA, 18 bp, Homo sapiens
gagggacctctcccaggg

SEQ ID NO: 5746118 - DNA, 20 bp, Homo sapiens
gagggaccttggagagctca

SEQ ID NO: 5746119 - DNA, 15 bp, Homo sapiens
gagggacgaagaaag

SEQ ID NO: 5746120 - DNA, 19 bp, Homo sapiens
gagggacgactttctttaa

SEQ ID NO: 5746121 - DNA, 16 bp, Homo sapiens
gagggacgagcagagc

SEQ ID NO: 5746122 - DNA, 18 bp, Homo sapiens
gagggacgagcagagcgc

SEQ ID NO: 5746123 - DNA, 19 bp, Homo sapiens
gagggacgcggaggaggaa

SEQ ID NO: 5746124 - DNA, 19 bp, Homo sapiens
gagggactcaagggaaagg

SEQ ID NO: 5746125 - DNA, 14 bp, Homo sapiens
gagggactccaagc

SEQ ID NO: 5746126 - DNA, 16 bp, Homo sapiens
gagggactccaagccc

SEQ ID NO: 5746127 - DNA, 20 bp, Homo sapiens
gagggactctgtctggccag

SEQ ID NO: 5746128 - DNA, 15 bp, Homo sapiens
gagggactgcctctg

SEQ ID NO: 5746129 - DNA, 18 bp, Homo sapiens
gagggactgcctctgcca

SEQ ID NO: 5746130 - DNA, 18 bp, Homo sapiens
gagggactgtcgctgctt

SEQ ID NO: 5746131 - DNA, 20 bp, Homo sapiens
gagggacttgagccagttac

SEQ ID NO: 5746132 - DNA, 23 bp, Homo sapiens
gagggacttgagccagttacctt

SEQ ID NO: 5746133 - DNA, 19 bp, Homo sapiens
gagggacttggctgtcctt

SEQ ID NO: 5746134 - DNA, 21 bp, Homo sapiens
gagggacttttaatcagtgaa

SEQ ID NO: 5746135 - DNA, 16 bp, Homo sapiens
gagggagaacaagacc

SEQ ID NO: 5746136 - DNA, 12 bp, Homo sapiens
gagggagaagga

SEQ ID NO: 5746137 - DNA, 15 bp, Homo sapiens
gagggagaaggagag

SEQ ID NO: 5746138 - DNA, 13 bp, Homo sapiens
gagggagaaggga

SEQ ID NO: 5746139 - DNA, 22 bp, Homo sapiens
gagggagaatccaagggttgag

SEQ ID NO: 5746140 - DNA, 21 bp, Homo sapiens
gagggagacactggcccctca

SEQ ID NO: 5746141 - DNA, 15 bp, Homo sapiens
gagggagacggccct

SEQ ID NO: 5746142 - DNA, 16 bp, Homo sapiens
gagggagactgtggta

SEQ ID NO: 5746143 - DNA, 18 bp, Homo sapiens
gagggagagaactgagca

SEQ ID NO: 5746144 - DNA, 14 bp, Homo sapiens
gagggagaggtgga

SEQ ID NO: 5746145 - DNA, 19 bp, Homo sapiens
gagggagcaagccctactc

SEQ ID NO: 5746146 - DNA, 14 bp, Homo sapiens
gagggagcaagcct

SEQ ID NO: 5746147 - DNA, 17 bp, Homo sapiens
gagggagcacaaccccc

SEQ ID NO: 5746148 - DNA, 20 bp, Homo sapiens
gagggagcatagaaggcagg

SEQ ID NO: 5746149 - DNA, 13 bp, Homo sapiens
gagggagcgacac

SEQ ID NO: 5746150 - DNA, 14 bp, Homo sapiens
gagggagctgaggc

SEQ ID NO: 5746151 - DNA, 16 bp, Homo sapiens
gagggagctgaggcct

SEQ ID NO: 5746152 - DNA, 13 bp, Homo sapiens
gagggagctggga

SEQ ID NO: 5746153 - DNA, 13 bp, Homo sapiens
gagggagctgtgg

SEQ ID NO: 5746154 - DNA, 15 bp, Homo sapiens
gagggagcttagcca

SEQ ID NO: 5746155 - DNA, 18 bp, Homo sapiens
gagggaggaacacctgat

SEQ ID NO: 5746156 - DNA, 12 bp, Homo sapiens
gagggaggaggc

SEQ ID NO: 5746157 - DNA, 17 bp, Homo sapiens
gagggaggaggccacct

SEQ ID NO: 5746158 - DNA, 20 bp, Homo sapiens
gagggaggcactagtcaccg

SEQ ID NO: 5746159 - DNA, 14 bp, Homo sapiens
gagggaggccaggc

SEQ ID NO: 5746160 - DNA, 15 bp, Homo sapiens
gagggagggctccag

SEQ ID NO: 5746161 - DNA, 20 bp, Homo sapiens
gagggagggctccagacaca

SEQ ID NO: 5746162 - DNA, 12 bp, Homo sapiens
gagggaggggaa

SEQ ID NO: 5746163 - DNA, 21 bp, Homo sapiens
gagggaggggaaaagcatttt

SEQ ID NO: 5746164 - DNA, 17 bp, Homo sapiens
gagggaggggaaatgta

SEQ ID NO: 5746165 - DNA, 18 bp, Homo sapiens
gagggaggggaaatgtaa

SEQ ID NO: 5746166 - DNA, 13 bp, Homo sapiens
gagggagggggaa

SEQ ID NO: 5746167 - DNA, 16 bp, Homo sapiens
gagggagggtttctct

SEQ ID NO: 5746168 - DNA, 18 bp, Homo sapiens
gagggagtacaaagacag

SEQ ID NO: 5746169 - DNA, 15 bp, Homo sapiens
gagggagtagaatac

SEQ ID NO: 5746170 - DNA, 15 bp, Homo sapiens
gagggagtctcagga

SEQ ID NO: 5746171 - DNA, 22 bp, Homo sapiens
gagggagtctcaggaggaggct

SEQ ID NO: 5746172 - DNA, 17 bp, Homo sapiens
gagggagttagggagag

SEQ ID NO: 5746173 - DNA, 22 bp, Homo sapiens
gagggagtttaatacaggaaat

SEQ ID NO: 5746174 - DNA, 22 bp, Homo sapiens
gagggagttttgtctgtctccc

SEQ ID NO: 5746175 - DNA, 22 bp, Homo sapiens
gagggataaccccaggcactgt

SEQ ID NO: 5746176 - DNA, 23 bp, Homo sapiens
gagggataaccccaggcactgtt

SEQ ID NO: 5746177 - DNA, 16 bp, Homo sapiens
gagggataagcaaaag

SEQ ID NO: 5746178 - DNA, 20 bp, Homo sapiens
gagggatctgagtaggtctg

SEQ ID NO: 5746179 - DNA, 19 bp, Homo sapiens
gagggatgaaatgccaaga

SEQ ID NO: 5746180 - DNA, 14 bp, Homo sapiens
gagggatgaccttc

SEQ ID NO: 5746181 - DNA, 12 bp, Homo sapiens
gagggatgatga

SEQ ID NO: 5746182 - DNA, 16 bp, Homo sapiens
gagggatgatgaggga

SEQ ID NO: 5746183 - DNA, 15 bp, Homo sapiens
gagggatgcaggtgg

SEQ ID NO: 5746184 - DNA, 22 bp, Homo sapiens
gagggatgcagtgcctttcccc

SEQ ID NO: 5746185 - DNA, 15 bp, Homo sapiens
gagggatgcccccag

SEQ ID NO: 5746186 - DNA, 19 bp, Homo sapiens
gagggatgcccccaggcag

SEQ ID NO: 5746187 - DNA, 20 bp, Homo sapiens
gagggatgctgcctgagtca

SEQ ID NO: 5746188 - DNA, 19 bp, Homo sapiens
gagggatgctgctccgccc

SEQ ID NO: 5746189 - DNA, 14 bp, Homo sapiens
gagggatggactga

SEQ ID NO: 5746190 - DNA, 15 bp, Homo sapiens
gagggatggagaaag

SEQ ID NO: 5746191 - DNA, 18 bp, Homo sapiens
gagggatggcgggtgggg

SEQ ID NO: 5746192 - DNA, 16 bp, Homo sapiens
gagggatgggcctggc

SEQ ID NO: 5746193 - DNA, 21 bp, Homo sapiens
gagggatgtaactattgaatt

SEQ ID NO: 5746194 - DNA, 22 bp, Homo sapiens
gagggatgtgggtaagaggagc

SEQ ID NO: 5746195 - DNA, 22 bp, Homo sapiens
gagggattcggccgcggctccg

SEQ ID NO: 5746196 - DNA, 15 bp, Homo sapiens
gagggattgctgtga

SEQ ID NO: 5746197 - DNA, 15 bp, Homo sapiens
gagggatttccctgc

SEQ ID NO: 5746198 - DNA, 15 bp, Homo sapiens
gagggattttattaa

SEQ ID NO: 5746199 - DNA, 16 bp, Homo sapiens
gagggcaaaccaggct

SEQ ID NO: 5746200 - DNA, 20 bp, Homo sapiens
gagggcaaagatggtggctg

SEQ ID NO: 5746201 - DNA, 22 bp, Homo sapiens
gagggcaaagatggtggctgtg

SEQ ID NO: 5746202 - DNA, 14 bp, Homo sapiens
gagggcaaagtcat

SEQ ID NO: 5746203 - DNA, 14 bp, Homo sapiens
gagggcaagaggtg

SEQ ID NO: 5746204 - DNA, 16 bp, Homo sapiens
gagggcaagaggtgcc

SEQ ID NO: 5746205 - DNA, 17 bp, Homo sapiens
gagggcaagaggtgcct

SEQ ID NO: 5746206 - DNA, 15 bp, Homo sapiens
gagggcaagccctgc

SEQ ID NO: 5746207 - DNA, 16 bp, Homo sapiens
gagggcaagccctgcc

SEQ ID NO: 5746208 - DNA, 15 bp, Homo sapiens
gagggcaagcctcta

SEQ ID NO: 5746209 - DNA, 22 bp, Homo sapiens
gagggcaagggccatgctgaag

SEQ ID NO: 5746210 - DNA, 15 bp, Homo sapiens
gagggcacacactgt

SEQ ID NO: 5746211 - DNA, 23 bp, Homo sapiens
gagggcacaccgccatcctctgc

SEQ ID NO: 5746212 - DNA, 23 bp, Homo sapiens
gagggcacagaaaatggaagaca

SEQ ID NO: 5746213 - DNA, 17 bp, Homo sapiens
gagggcacagccctccg

SEQ ID NO: 5746214 - DNA, 19 bp, Homo sapiens
gagggcacagccctccgac

SEQ ID NO: 5746215 - DNA, 16 bp, Homo sapiens
gagggcacatctccag

SEQ ID NO: 5746216 - DNA, 16 bp, Homo sapiens
gagggcacatgaacag

SEQ ID NO: 5746217 - DNA, 21 bp, Homo sapiens
gagggcacattaactccctcc

SEQ ID NO: 5746218 - DNA, 15 bp, Homo sapiens
gagggcaccagggac

SEQ ID NO: 5746219 - DNA, 19 bp, Homo sapiens
gagggcactctctgccagc

SEQ ID NO: 5746220 - DNA, 21 bp, Homo sapiens
gagggcactctctgccagctc

SEQ ID NO: 5746221 - DNA, 20 bp, Homo sapiens
gagggcactggagctgggag

SEQ ID NO: 5746222 - DNA, 18 bp, Homo sapiens
gagggcactggtggcccg

SEQ ID NO: 5746223 - DNA, 22 bp, Homo sapiens
gagggcacttcaggtccgtggg

SEQ ID NO: 5746224 - DNA, 18 bp, Homo sapiens
gagggcacttcctccaca

SEQ ID NO: 5746225 - DNA, 22 bp, Homo sapiens
gagggcagaaaggttctgcccg

SEQ ID NO: 5746226 - DNA, 23 bp, Homo sapiens
gagggcagaaaggttctgcccgg

SEQ ID NO: 5746227 - DNA, 21 bp, Homo sapiens
gagggcagactggggcatcct

SEQ ID NO: 5746228 - DNA, 11 bp, Homo sapiens
gagggcagagc

SEQ ID NO: 5746229 - DNA, 21 bp, Homo sapiens
gagggcagagccatgggcctg

SEQ ID NO: 5746230 - DNA, 14 bp, Homo sapiens
gagggcagagctgg

SEQ ID NO: 5746231 - DNA, 17 bp, Homo sapiens
gagggcagagctggtgc

SEQ ID NO: 5746232 - DNA, 15 bp, Homo sapiens
gagggcagagggaga

SEQ ID NO: 5746233 - DNA, 20 bp, Homo sapiens
gagggcagagggagaatcca

SEQ ID NO: 5746234 - DNA, 19 bp, Homo sapiens
gagggcagaggtcccctga

SEQ ID NO: 5746235 - DNA, 11 bp, Homo sapiens
gagggcagagt

SEQ ID NO: 5746236 - DNA, 14 bp, Homo sapiens
gagggcagagtggg

SEQ ID NO: 5746237 - DNA, 16 bp, Homo sapiens
gagggcagagtgggct

SEQ ID NO: 5746238 - DNA, 22 bp, Homo sapiens
gagggcagagtgggctgcctgg

SEQ ID NO: 5746239 - DNA, 19 bp, Homo sapiens
gagggcagcagaagggggt

SEQ ID NO: 5746240 - DNA, 21 bp, Homo sapiens
gagggcagcagaagggggtgg

SEQ ID NO: 5746241 - DNA, 16 bp, Homo sapiens
gagggcagcgggagcc

SEQ ID NO: 5746242 - DNA, 18 bp, Homo sapiens
gagggcagcgggagcctc

SEQ ID NO: 5746243 - DNA, 13 bp, Homo sapiens
gagggcagctggc

SEQ ID NO: 5746244 - DNA, 13 bp, Homo sapiens
gagggcaggctga

SEQ ID NO: 5746245 - DNA, 22 bp, Homo sapiens
gagggcaggctgaggtggggaa

SEQ ID NO: 5746246 - DNA, 18 bp, Homo sapiens
gagggcaggcttggggaa

SEQ ID NO: 5746247 - DNA, 19 bp, Homo sapiens
gagggcaggcttggggaaa

SEQ ID NO: 5746248 - DNA, 11 bp, Homo sapiens
gagggcaggga

SEQ ID NO: 5746249 - DNA, 20 bp, Homo sapiens
gagggcagggtccacgcctc

SEQ ID NO: 5746250 - DNA, 15 bp, Homo sapiens
gagggcaggtccagc

SEQ ID NO: 5746251 - DNA, 23 bp, Homo sapiens
gagggcagtgccctttgagatct

SEQ ID NO: 5746252 - DNA, 18 bp, Homo sapiens
gagggcagttcgcagcca

SEQ ID NO: 5746253 - DNA, 19 bp, Homo sapiens
gagggcagttcgcagccac

SEQ ID NO: 5746254 - DNA, 15 bp, Homo sapiens
gagggcagttctgca

SEQ ID NO: 5746255 - DNA, 16 bp, Homo sapiens
gagggcagttctgcac

SEQ ID NO: 5746256 - DNA, 23 bp, Homo sapiens
gagggcagttctgcacccagcca

SEQ ID NO: 5746257 - DNA, 14 bp, Homo sapiens
gagggcatgtgcag

SEQ ID NO: 5746258 - DNA, 20 bp, Homo sapiens
gagggcatttggcttcctct

SEQ ID NO: 5746259 - DNA, 16 bp, Homo sapiens
gagggccacatgggag

SEQ ID NO: 5746260 - DNA, 19 bp, Homo sapiens
gagggccacctccacaccc

SEQ ID NO: 5746261 - DNA, 12 bp, Homo sapiens
gagggccagagc

SEQ ID NO: 5746262 - DNA, 21 bp, Homo sapiens
gagggccagagctagggctgc

SEQ ID NO: 5746263 - DNA, 15 bp, Homo sapiens
gagggccagggaggc

SEQ ID NO: 5746264 - DNA, 11 bp, Homo sapiens
gagggccagtg

SEQ ID NO: 5746265 - DNA, 17 bp, Homo sapiens
gagggcccaaagaattg

SEQ ID NO: 5746266 - DNA, 14 bp, Homo sapiens
gagggcccagagca

SEQ ID NO: 5746267 - DNA, 15 bp, Homo sapiens
gagggcccagagcag

SEQ ID NO: 5746268 - DNA, 18 bp, Homo sapiens
gagggcccagagcaggaa

SEQ ID NO: 5746269 - DNA, 20 bp, Homo sapiens
gagggcccagagcaggaagc

SEQ ID NO: 5746270 - DNA, 12 bp, Homo sapiens
gagggcccagcc

SEQ ID NO: 5746271 - DNA, 15 bp, Homo sapiens
gagggcccagccagg

SEQ ID NO: 5746272 - DNA, 19 bp, Homo sapiens
gagggcccagccaggagca

SEQ ID NO: 5746273 - DNA, 16 bp, Homo sapiens
gagggcccagcccaga

SEQ ID NO: 5746274 - DNA, 12 bp, Homo sapiens
gagggcccagct

SEQ ID NO: 5746275 - DNA, 14 bp, Homo sapiens
gagggcccagctgt

SEQ ID NO: 5746276 - DNA, 23 bp, Homo sapiens
gagggcccagctgtagccatggc

SEQ ID NO: 5746277 - DNA, 13 bp, Homo sapiens
gagggcccctcac

SEQ ID NO: 5746278 - DNA, 19 bp, Homo sapiens
gagggcccctcactggctg

SEQ ID NO: 5746279 - DNA, 20 bp, Homo sapiens
gagggcccctctgcccagct

SEQ ID NO: 5746280 - DNA, 16 bp, Homo sapiens
gagggcccgtgtaaat

SEQ ID NO: 5746281 - DNA, 12 bp, Homo sapiens
gagggccctgag

SEQ ID NO: 5746282 - DNA, 16 bp, Homo sapiens
gagggccctgaggaat

SEQ ID NO: 5746283 - DNA, 22 bp, Homo sapiens
gagggccctgaggaataaagct

SEQ ID NO: 5746284 - DNA, 23 bp, Homo sapiens
gagggccctgtggagtccagctc

SEQ ID NO: 5746285 - DNA, 22 bp, Homo sapiens
gagggccgagacaggagcagcc

SEQ ID NO: 5746286 - DNA, 16 bp, Homo sapiens
gagggccgagtgagag

SEQ ID NO: 5746287 - DNA, 14 bp, Homo sapiens
gagggccgcagggc

SEQ ID NO: 5746288 - DNA, 16 bp, Homo sapiens
gagggccgcagggccc

SEQ ID NO: 5746289 - DNA, 17 bp, Homo sapiens
gagggccgcctgcctta

SEQ ID NO: 5746290 - DNA, 19 bp, Homo sapiens
gagggccggcggctctgag

SEQ ID NO: 5746291 - DNA, 20 bp, Homo sapiens
gagggccggcggctctgagc

SEQ ID NO: 5746292 - DNA, 22 bp, Homo sapiens
gagggccggcggctctgagcag

SEQ ID NO: 5746293 - DNA, 23 bp, Homo sapiens
gagggccggcggctctgagcagg

SEQ ID NO: 5746294 - DNA, 18 bp, Homo sapiens
gagggccgtaccccaccc

SEQ ID NO: 5746295 - DNA, 21 bp, Homo sapiens
gagggccgtaccccaccctca

SEQ ID NO: 5746296 - DNA, 22 bp, Homo sapiens
gagggccgtgtgacactctcgt

SEQ ID NO: 5746297 - DNA, 13 bp, Homo sapiens
gagggcctcagag

SEQ ID NO: 5746298 - DNA, 14 bp, Homo sapiens
gagggcctcagaga

SEQ ID NO: 5746299 - DNA, 17 bp, Homo sapiens
gagggcctcagagcctg

SEQ ID NO: 5746300 - DNA, 14 bp, Homo sapiens
gagggcctctgcct

SEQ ID NO: 5746301 - DNA, 14 bp, Homo sapiens
gagggcctctggac

SEQ ID NO: 5746302 - DNA, 16 bp, Homo sapiens
gagggcctgcagtgat

SEQ ID NO: 5746303 - DNA, 21 bp, Homo sapiens
gagggcctgctggaggcctca

SEQ ID NO: 5746304 - DNA, 16 bp, Homo sapiens
gagggccttcccctcc

SEQ ID NO: 5746305 - DNA, 21 bp, Homo sapiens
gagggccttcccctcccagcc

SEQ ID NO: 5746306 - DNA, 23 bp, Homo sapiens
gagggccttcccctcccagccct

SEQ ID NO: 5746307 - DNA, 16 bp, Homo sapiens
gagggcgaaggccatt

SEQ ID NO: 5746308 - DNA, 14 bp, Homo sapiens
gagggcgcctgggt

SEQ ID NO: 5746309 - DNA, 16 bp, Homo sapiens
gagggcggagccggcc

SEQ ID NO: 5746310 - DNA, 14 bp, Homo sapiens
gagggcgtggaggg

SEQ ID NO: 5746311 - DNA, 21 bp, Homo sapiens
gagggctaaaaaggtcctgta

SEQ ID NO: 5746312 - DNA, 16 bp, Homo sapiens
gagggctactcagcag

SEQ ID NO: 5746313 - DNA, 18 bp, Homo sapiens
gagggctagaatctggag

SEQ ID NO: 5746314 - DNA, 21 bp, Homo sapiens
gagggctagaatctggagagc

SEQ ID NO: 5746315 - DNA, 15 bp, Homo sapiens
gagggctagccctga

SEQ ID NO: 5746316 - DNA, 17 bp, Homo sapiens
gagggctcactcagcca

SEQ ID NO: 5746317 - DNA, 17 bp, Homo sapiens
gagggctcagggcagtg

SEQ ID NO: 5746318 - DNA, 15 bp, Homo sapiens
gagggctcctccatg

SEQ ID NO: 5746319 - DNA, 16 bp, Homo sapiens
gagggctcctggggca

SEQ ID NO: 5746320 - DNA, 17 bp, Homo sapiens
gagggctcctggggcag

SEQ ID NO: 5746321 - DNA, 19 bp, Homo sapiens
gagggctcgaggggtgggc

SEQ ID NO: 5746322 - DNA, 22 bp, Homo sapiens
gagggctctgatctaacaaaat

SEQ ID NO: 5746323 - DNA, 14 bp, Homo sapiens
gagggctctgtttg

SEQ ID NO: 5746324 - DNA, 14 bp, Homo sapiens
gagggctgagaggg

SEQ ID NO: 5746325 - DNA, 17 bp, Homo sapiens
gagggctgagagggctg

SEQ ID NO: 5746326 - DNA, 13 bp, Homo sapiens
gagggctgagcca

SEQ ID NO: 5746327 - DNA, 14 bp, Homo sapiens
gagggctgagcccc

SEQ ID NO: 5746328 - DNA, 15 bp, Homo sapiens
gagggctgagcccct

SEQ ID NO: 5746329 - DNA, 17 bp, Homo sapiens
gagggctgagcccctcc

SEQ ID NO: 5746330 - DNA, 18 bp, Homo sapiens
gagggctgagcccctcct

SEQ ID NO: 5746331 - DNA, 21 bp, Homo sapiens
gagggctgagcccctcctctc

SEQ ID NO: 5746332 - DNA, 22 bp, Homo sapiens
gagggctgaggagcagccagga

SEQ ID NO: 5746333 - DNA, 9 bp, Homo sapiens
gagggctgc

SEQ ID NO: 5746334 - DNA, 16 bp, Homo sapiens
gagggctgcagagcct

SEQ ID NO: 5746335 - DNA, 15 bp, Homo sapiens
gagggctgccagcag

SEQ ID NO: 5746336 - DNA, 14 bp, Homo sapiens
gagggctgcgagca

SEQ ID NO: 5746337 - DNA, 10 bp, Homo sapiens
gagggctgga

SEQ ID NO: 5746338 - DNA, 13 bp, Homo sapiens
gagggctggaatc

SEQ ID NO: 5746339 - DNA, 18 bp, Homo sapiens
gagggctggaatctggag

SEQ ID NO: 5746340 - DNA, 22 bp, Homo sapiens
gagggctggacatttgtggcag

SEQ ID NO: 5746341 - DNA, 19 bp, Homo sapiens
gagggctggaggcccaggc

SEQ ID NO: 5746342 - DNA, 10 bp, Homo sapiens
gagggctggc

SEQ ID NO: 5746343 - DNA, 13 bp, Homo sapiens
gagggctggccgg

SEQ ID NO: 5746344 - DNA, 12 bp, Homo sapiens
gagggctgggca

SEQ ID NO: 5746345 - DNA, 18 bp, Homo sapiens
gagggctgggcagggccc

SEQ ID NO: 5746346 - DNA, 14 bp, Homo sapiens
gagggctgtaggaa

SEQ ID NO: 5746347 - DNA, 16 bp, Homo sapiens
gagggctgtggctggg

SEQ ID NO: 5746348 - DNA, 21 bp, Homo sapiens
gagggctgttggacagctgct

SEQ ID NO: 5746349 - DNA, 23 bp, Homo sapiens
gagggctgttggacagctgcttg

SEQ ID NO: 5746350 - DNA, 16 bp, Homo sapiens
gagggcttggcccagc

SEQ ID NO: 5746351 - DNA, 15 bp, Homo sapiens
gagggcttgtgaaca

SEQ ID NO: 5746352 - DNA, 23 bp, Homo sapiens
gagggctttcagcgcccccaggc

SEQ ID NO: 5746353 - DNA, 16 bp, Homo sapiens
gagggctttgtgtctg

SEQ ID NO: 5746354 - DNA, 20 bp, Homo sapiens
gaggggaaacaatgaaaaca

SEQ ID NO: 5746355 - DNA, 18 bp, Homo sapiens
gaggggaaaggggagagg

SEQ ID NO: 5746356 - DNA, 19 bp, Homo sapiens
gaggggaaatggggaaagc

SEQ ID NO: 5746357 - DNA, 14 bp, Homo sapiens
gaggggaaatgtaa

SEQ ID NO: 5746358 - DNA, 21 bp, Homo sapiens
gaggggaactgagtcacgctg

SEQ ID NO: 5746359 - DNA, 15 bp, Homo sapiens
gaggggaagaattta

SEQ ID NO: 5746360 - DNA, 14 bp, Homo sapiens
gaggggaagagaga

SEQ ID NO: 5746361 - DNA, 17 bp, Homo sapiens
gaggggaagagagaggc

SEQ ID NO: 5746362 - DNA, 16 bp, Homo sapiens
gaggggaagaggcctg

SEQ ID NO: 5746363 - DNA, 17 bp, Homo sapiens
gaggggaagctgggccc

SEQ ID NO: 5746364 - DNA, 15 bp, Homo sapiens
gaggggaagggccag

SEQ ID NO: 5746365 - DNA, 14 bp, Homo sapiens
gaggggaaggggct

SEQ ID NO: 5746366 - DNA, 19 bp, Homo sapiens
gaggggacagagctgagga

SEQ ID NO: 5746367 - DNA, 14 bp, Homo sapiens
gaggggacagaggc

SEQ ID NO: 5746368 - DNA, 13 bp, Homo sapiens
gaggggacaggtc

SEQ ID NO: 5746369 - DNA, 20 bp, Homo sapiens
gaggggacatttccctcctg

SEQ ID NO: 5746370 - DNA, 13 bp, Homo sapiens
gaggggaccagga

SEQ ID NO: 5746371 - DNA, 17 bp, Homo sapiens
gaggggaccaggagtgg

SEQ ID NO: 5746372 - DNA, 21 bp, Homo sapiens
gaggggaccaggagtgggtgg

SEQ ID NO: 5746373 - DNA, 12 bp, Homo sapiens
gaggggacccag

SEQ ID NO: 5746374 - DNA, 20 bp, Homo sapiens
gaggggacccagctcctctg

SEQ ID NO: 5746375 - DNA, 15 bp, Homo sapiens
gaggggacgctgagg

SEQ ID NO: 5746376 - DNA, 21 bp, Homo sapiens
gaggggacgctggtagagatg

SEQ ID NO: 5746377 - DNA, 15 bp, Homo sapiens
gaggggacgggacag

SEQ ID NO: 5746378 - DNA, 15 bp, Homo sapiens
gaggggacgggcaag

SEQ ID NO: 5746379 - DNA, 16 bp, Homo sapiens
gaggggactcaccatg

SEQ ID NO: 5746380 - DNA, 14 bp, Homo sapiens
gaggggactgcatg

SEQ ID NO: 5746381 - DNA, 16 bp, Homo sapiens
gaggggactgggggac

SEQ ID NO: 5746382 - DNA, 15 bp, Homo sapiens
gaggggagaaaggaa

SEQ ID NO: 5746383 - DNA, 20 bp, Homo sapiens
gaggggagactttgatgtca

SEQ ID NO: 5746384 - DNA, 11 bp, Homo sapiens
gaggggagaga

SEQ ID NO: 5746385 - DNA, 14 bp, Homo sapiens
gaggggagagaagg

SEQ ID NO: 5746386 - DNA, 14 bp, Homo sapiens
gaggggagagacag

SEQ ID NO: 5746387 - DNA, 12 bp, Homo sapiens
gaggggagagag

SEQ ID NO: 5746388 - DNA, 19 bp, Homo sapiens
gaggggagagagggactca

SEQ ID NO: 5746389 - DNA, 13 bp, Homo sapiens
gaggggagaggaa

SEQ ID NO: 5746390 - DNA, 20 bp, Homo sapiens
gaggggagaggtcagccttg

SEQ ID NO: 5746391 - DNA, 14 bp, Homo sapiens
gaggggagcaaggc

SEQ ID NO: 5746392 - DNA, 20 bp, Homo sapiens
gaggggagcatgcttccctg

SEQ ID NO: 5746393 - DNA, 19 bp, Homo sapiens
gaggggagcgtctgggaac

SEQ ID NO: 5746394 - DNA, 13 bp, Homo sapiens
gaggggagctctg

SEQ ID NO: 5746395 - DNA, 18 bp, Homo sapiens
gaggggagctctgtctgt

SEQ ID NO: 5746396 - DNA, 14 bp, Homo sapiens
gaggggagggaggg

SEQ ID NO: 5746397 - DNA, 13 bp, Homo sapiens
gaggggagggctc

SEQ ID NO: 5746398 - DNA, 16 bp, Homo sapiens
gaggggagggctcctg

SEQ ID NO: 5746399 - DNA, 18 bp, Homo sapiens
gaggggagggctcctggg

SEQ ID NO: 5746400 - DNA, 11 bp, Homo sapiens
gaggggagggg

SEQ ID NO: 5746401 - DNA, 12 bp, Homo sapiens
gaggggagggta

SEQ ID NO: 5746402 - DNA, 16 bp, Homo sapiens
gaggggatccagccac

SEQ ID NO: 5746403 - DNA, 17 bp, Homo sapiens
gaggggatgataaagga

SEQ ID NO: 5746404 - DNA, 18 bp, Homo sapiens
gaggggatggcagacagt

SEQ ID NO: 5746405 - DNA, 18 bp, Homo sapiens
gaggggatggggatagag

SEQ ID NO: 5746406 - DNA, 23 bp, Homo sapiens
gaggggatgtgtgtgtgcagagc

SEQ ID NO: 5746407 - DNA, 20 bp, Homo sapiens
gaggggattctctactgcca

SEQ ID NO: 5746408 - DNA, 18 bp, Homo sapiens
gaggggcaacgaagaaaa

SEQ ID NO: 5746409 - DNA, 20 bp, Homo sapiens
gaggggcaacgaagaaaaaa

SEQ ID NO: 5746410 - DNA, 17 bp, Homo sapiens
gaggggcaagctaggcc

SEQ ID NO: 5746411 - DNA, 22 bp, Homo sapiens
gaggggcacctgccaccgccag

SEQ ID NO: 5746412 - DNA, 13 bp, Homo sapiens
gaggggcagagcc

SEQ ID NO: 5746413 - DNA, 20 bp, Homo sapiens
gaggggcagagccaggaaga

SEQ ID NO: 5746414 - DNA, 13 bp, Homo sapiens
gaggggcagccgc

SEQ ID NO: 5746415 - DNA, 16 bp, Homo sapiens
gaggggcagcctgtgc

SEQ ID NO: 5746416 - DNA, 13 bp, Homo sapiens
gaggggcagcgca

SEQ ID NO: 5746417 - DNA, 14 bp, Homo sapiens
gaggggcaggacct

SEQ ID NO: 5746418 - DNA, 20 bp, Homo sapiens
gaggggcagggaaggacagg

SEQ ID NO: 5746419 - DNA, 23 bp, Homo sapiens
gaggggcaggtctagtgttcctg

SEQ ID NO: 5746420 - DNA, 12 bp, Homo sapiens
gaggggccactg

SEQ ID NO: 5746421 - DNA, 15 bp, Homo sapiens
gaggggccactgggc

SEQ ID NO: 5746422 - DNA, 15 bp, Homo sapiens
gaggggccaggccca

SEQ ID NO: 5746423 - DNA, 17 bp, Homo sapiens
gaggggccaggcccagg

SEQ ID NO: 5746424 - DNA, 15 bp, Homo sapiens
gaggggcccacagga

SEQ ID NO: 5746425 - DNA, 14 bp, Homo sapiens
gaggggcccaccca

SEQ ID NO: 5746426 - DNA, 16 bp, Homo sapiens
gaggggcccagggaag

SEQ ID NO: 5746427 - DNA, 22 bp, Homo sapiens
gaggggcccctgcttctccagc

SEQ ID NO: 5746428 - DNA, 18 bp, Homo sapiens
gaggggcccggtggcggc

SEQ ID NO: 5746429 - DNA, 21 bp, Homo sapiens
gaggggcccgttgtctccctg

SEQ ID NO: 5746430 - DNA, 13 bp, Homo sapiens
gaggggccctcag

SEQ ID NO: 5746431 - DNA, 15 bp, Homo sapiens
gaggggccctcaggc

SEQ ID NO: 5746432 - DNA, 18 bp, Homo sapiens
gaggggccctcaggccat

SEQ ID NO: 5746433 - DNA, 13 bp, Homo sapiens
gaggggccctccg

SEQ ID NO: 5746434 - DNA, 13 bp, Homo sapiens
gaggggccctggc

SEQ ID NO: 5746435 - DNA, 18 bp, Homo sapiens
gaggggccctggccagga

SEQ ID NO: 5746436 - DNA, 19 bp, Homo sapiens
gaggggccctggccaggac

SEQ ID NO: 5746437 - DNA, 22 bp, Homo sapiens
gaggggccctgtcactgtccag

SEQ ID NO: 5746438 - DNA, 19 bp, Homo sapiens
gaggggccgatgcccagag

SEQ ID NO: 5746439 - DNA, 17 bp, Homo sapiens
gaggggccggctggcct

SEQ ID NO: 5746440 - DNA, 16 bp, Homo sapiens
gaggggcctagggagc

SEQ ID NO: 5746441 - DNA, 17 bp, Homo sapiens
gaggggcctagggagcc

SEQ ID NO: 5746442 - DNA, 18 bp, Homo sapiens
gaggggcctcccggggcc

SEQ ID NO: 5746443 - DNA, 20 bp, Homo sapiens
gaggggcctcccggggccca

SEQ ID NO: 5746444 - DNA, 16 bp, Homo sapiens
gaggggcctctggctg

SEQ ID NO: 5746445 - DNA, 21 bp, Homo sapiens
gaggggcctctggctgcctgg

SEQ ID NO: 5746446 - DNA, 22 bp, Homo sapiens
gaggggcctcttatgggctggg

SEQ ID NO: 5746447 - DNA, 22 bp, Homo sapiens
gaggggcctgccacctggaccc

SEQ ID NO: 5746448 - DNA, 13 bp, Homo sapiens
gaggggcctggag

SEQ ID NO: 5746449 - DNA, 18 bp, Homo sapiens
gaggggcctggcagccgt

SEQ ID NO: 5746450 - DNA, 13 bp, Homo sapiens
gaggggcctggcc

SEQ ID NO: 5746451 - DNA, 14 bp, Homo sapiens
gaggggcctgggca

SEQ ID NO: 5746452 - DNA, 21 bp, Homo sapiens
gaggggcctgggcagccccac

SEQ ID NO: 5746453 - DNA, 23 bp, Homo sapiens
gaggggcctgtgtggaggcctca

SEQ ID NO: 5746454 - DNA, 17 bp, Homo sapiens
gaggggcctttgctgcc

SEQ ID NO: 5746455 - DNA, 17 bp, Homo sapiens
gaggggcgcaccccaca

SEQ ID NO: 5746456 - DNA, 14 bp, Homo sapiens
gaggggcgcgggag

SEQ ID NO: 5746457 - DNA, 18 bp, Homo sapiens
gaggggcgcgggaggggg

SEQ ID NO: 5746458 - DNA, 19 bp, Homo sapiens
gaggggcgcgggagggggc

SEQ ID NO: 5746459 - DNA, 17 bp, Homo sapiens
gaggggcgctgccccca

SEQ ID NO: 5746460 - DNA, 16 bp, Homo sapiens
gaggggcgctggccca

SEQ ID NO: 5746461 - DNA, 20 bp, Homo sapiens
gaggggcgctggcccagccg

SEQ ID NO: 5746462 - DNA, 22 bp, Homo sapiens
gaggggcgctggcccagccggc

SEQ ID NO: 5746463 - DNA, 19 bp, Homo sapiens
gaggggcgggctcagagct

SEQ ID NO: 5746464 - DNA, 21 bp, Homo sapiens
gaggggcgttctcccaaagat

SEQ ID NO: 5746465 - DNA, 15 bp, Homo sapiens
gaggggctcaggaaa

SEQ ID NO: 5746466 - DNA, 16 bp, Homo sapiens
gaggggctcaggaaaa

SEQ ID NO: 5746467 - DNA, 13 bp, Homo sapiens
gaggggctccccg

SEQ ID NO: 5746468 - DNA, 12 bp, Homo sapiens
gaggggctctca

SEQ ID NO: 5746469 - DNA, 17 bp, Homo sapiens
gaggggctgagtctggc

SEQ ID NO: 5746470 - DNA, 20 bp, Homo sapiens
gaggggctgagtctggctag

SEQ ID NO: 5746471 - DNA, 17 bp, Homo sapiens
gaggggctgcagggcca

SEQ ID NO: 5746472 - DNA, 11 bp, Homo sapiens
gaggggctggg

SEQ ID NO: 5746473 - DNA, 21 bp, Homo sapiens
gaggggcttccctctgctcca

SEQ ID NO: 5746474 - DNA, 17 bp, Homo sapiens
gaggggcttggagcaga

SEQ ID NO: 5746475 - DNA, 18 bp, Homo sapiens
gagggggaagtcgaagga

SEQ ID NO: 5746476 - DNA, 16 bp, Homo sapiens
gagggggaagtgagaa

SEQ ID NO: 5746477 - DNA, 19 bp, Homo sapiens
gagggggaagtgagaaggg

SEQ ID NO: 5746478 - DNA, 20 bp, Homo sapiens
gagggggaagtgagaagggc

SEQ ID NO: 5746479 - DNA, 17 bp, Homo sapiens
gagggggaattcctgga

SEQ ID NO: 5746480 - DNA, 21 bp, Homo sapiens
gagggggacgcgcacacacac

SEQ ID NO: 5746481 - DNA, 20 bp, Homo sapiens
gagggggactaaactcaacc

SEQ ID NO: 5746482 - DNA, 14 bp, Homo sapiens
gagggggagggggt

SEQ ID NO: 5746483 - DNA, 13 bp, Homo sapiens
gagggggagggtg

SEQ ID NO: 5746484 - DNA, 17 bp, Homo sapiens
gagggggagtagccaag

SEQ ID NO: 5746485 - DNA, 21 bp, Homo sapiens
gagggggatgcccctggccct

SEQ ID NO: 5746486 - DNA, 13 bp, Homo sapiens
gagggggcagagt

SEQ ID NO: 5746487 - DNA, 17 bp, Homo sapiens
gagggggcagagtggcc

SEQ ID NO: 5746488 - DNA, 15 bp, Homo sapiens
gagggggcagggggc

SEQ ID NO: 5746489 - DNA, 20 bp, Homo sapiens
gagggggccacctccccagg

SEQ ID NO: 5746490 - DNA, 14 bp, Homo sapiens
gagggggccgggcg

SEQ ID NO: 5746491 - DNA, 21 bp, Homo sapiens
gagggggccgggcgcggtggc

SEQ ID NO: 5746492 - DNA, 16 bp, Homo sapiens
gagggggcctcattgt

SEQ ID NO: 5746493 - DNA, 17 bp, Homo sapiens
gagggggcggcagggct

SEQ ID NO: 5746494 - DNA, 12 bp, Homo sapiens
gagggggctctc

SEQ ID NO: 5746495 - DNA, 14 bp, Homo sapiens
gagggggctctcca

SEQ ID NO: 5746496 - DNA, 15 bp, Homo sapiens
gagggggctctgccc

SEQ ID NO: 5746497 - DNA, 15 bp, Homo sapiens
gagggggctggccat

SEQ ID NO: 5746498 - DNA, 12 bp, Homo sapiens
gagggggctggg

SEQ ID NO: 5746499 - DNA, 17 bp, Homo sapiens
gagggggctgggaaaga

SEQ ID NO: 5746500 - DNA, 14 bp, Homo sapiens
gagggggctggggt

SEQ ID NO: 5746501 - DNA, 13 bp, Homo sapiens
gaggggggagcca

SEQ ID NO: 5746502 - DNA, 18 bp, Homo sapiens
gaggggggagccagaggc

SEQ ID NO: 5746503 - DNA, 17 bp, Homo sapiens
gaggggggagggggaag

SEQ ID NO: 5746504 - DNA, 15 bp, Homo sapiens
gaggggggcacatgc

SEQ ID NO: 5746505 - DNA, 14 bp, Homo sapiens
gaggggggcgggtg

SEQ ID NO: 5746506 - DNA, 12 bp, Homo sapiens
gaggggggctgg

SEQ ID NO: 5746507 - DNA, 19 bp, Homo sapiens
gaggggggggtgggtgaga

SEQ ID NO: 5746508 - DNA, 21 bp, Homo sapiens
gaggggggtgctggcccccag

SEQ ID NO: 5746509 - DNA, 13 bp, Homo sapiens
gagggggtaaagc

SEQ ID NO: 5746510 - DNA, 18 bp, Homo sapiens
gagggggtcagttgggcc

SEQ ID NO: 5746511 - DNA, 16 bp, Homo sapiens
gagggggtcctcctcg

SEQ ID NO: 5746512 - DNA, 17 bp, Homo sapiens
gagggggtcgtggagag

SEQ ID NO: 5746513 - DNA, 21 bp, Homo sapiens
gagggggtgtctggaagctga

SEQ ID NO: 5746514 - DNA, 14 bp, Homo sapiens
gaggggtaaatata

SEQ ID NO: 5746515 - DNA, 18 bp, Homo sapiens
gaggggtaggcagagcct

SEQ ID NO: 5746516 - DNA, 13 bp, Homo sapiens
gaggggtagtggg

SEQ ID NO: 5746517 - DNA, 23 bp, Homo sapiens
gaggggtataggacaaggggtgg

SEQ ID NO: 5746518 - DNA, 16 bp, Homo sapiens
gaggggtcagcagggg

SEQ ID NO: 5746519 - DNA, 15 bp, Homo sapiens
gaggggtcagctctg

SEQ ID NO: 5746520 - DNA, 15 bp, Homo sapiens
gaggggtctagaggc

SEQ ID NO: 5746521 - DNA, 23 bp, Homo sapiens
gaggggtgagtcccctactccct

SEQ ID NO: 5746522 - DNA, 19 bp, Homo sapiens
gaggggtgcagaggctgtg

SEQ ID NO: 5746523 - DNA, 22 bp, Homo sapiens
gaggggtgcggcggtcccagct

SEQ ID NO: 5746524 - DNA, 13 bp, Homo sapiens
gaggggtgctgcc

SEQ ID NO: 5746525 - DNA, 19 bp, Homo sapiens
gaggggtggtacttggcac

SEQ ID NO: 5746526 - DNA, 23 bp, Homo sapiens
gaggggtggtggggggcagggcc

SEQ ID NO: 5746527 - DNA, 11 bp, Homo sapiens
gaggggtgtcc

SEQ ID NO: 5746528 - DNA, 23 bp, Homo sapiens
gaggggtgtccgagaggctggtg

SEQ ID NO: 5746529 - DNA, 18 bp, Homo sapiens
gaggggtgtggcagtggt

SEQ ID NO: 5746530 - DNA, 16 bp, Homo sapiens
gaggggttacctccct

SEQ ID NO: 5746531 - DNA, 18 bp, Homo sapiens
gaggggttacctccctcg

SEQ ID NO: 5746532 - DNA, 21 bp, Homo sapiens
gaggggttacttctcccctgg

SEQ ID NO: 5746533 - DNA, 20 bp, Homo sapiens
gaggggttccttccacttct

SEQ ID NO: 5746534 - DNA, 19 bp, Homo sapiens
gagggtaactggggggcca

SEQ ID NO: 5746535 - DNA, 21 bp, Homo sapiens
gagggtaactggggggccacc

SEQ ID NO: 5746536 - DNA, 23 bp, Homo sapiens
gagggtaactggggggccaccat

SEQ ID NO: 5746537 - DNA, 19 bp, Homo sapiens
gagggtaagacaatatgaa

SEQ ID NO: 5746538 - DNA, 13 bp, Homo sapiens
gagggtaggcagg

SEQ ID NO: 5746539 - DNA, 19 bp, Homo sapiens
gagggtatactgaggggtc

SEQ ID NO: 5746540 - DNA, 14 bp, Homo sapiens
gagggtatttattg

SEQ ID NO: 5746541 - DNA, 13 bp, Homo sapiens
gagggtcagagag

SEQ ID NO: 5746542 - DNA, 14 bp, Homo sapiens
gagggtcagccagg

SEQ ID NO: 5746543 - DNA, 18 bp, Homo sapiens
gagggtcagccagggcct

SEQ ID NO: 5746544 - DNA, 15 bp, Homo sapiens
gagggtcaggaagga

SEQ ID NO: 5746545 - DNA, 16 bp, Homo sapiens
gagggtcaggaaggat

SEQ ID NO: 5746546 - DNA, 14 bp, Homo sapiens
gagggtcagggcag

SEQ ID NO: 5746547 - DNA, 15 bp, Homo sapiens
gagggtcagggcagt

SEQ ID NO: 5746548 - DNA, 16 bp, Homo sapiens
gagggtcagggcagta

SEQ ID NO: 5746549 - DNA, 15 bp, Homo sapiens
gagggtccacctgga

SEQ ID NO: 5746550 - DNA, 18 bp, Homo sapiens
gagggtccacctggagag

SEQ ID NO: 5746551 - DNA, 16 bp, Homo sapiens
gagggtcccagggctg

SEQ ID NO: 5746552 - DNA, 17 bp, Homo sapiens
gagggtcccagggctgc

SEQ ID NO: 5746553 - DNA, 17 bp, Homo sapiens
gagggtccccagctggt

SEQ ID NO: 5746554 - DNA, 22 bp, Homo sapiens
gagggtcccggtgtatcctggc

SEQ ID NO: 5746555 - DNA, 23 bp, Homo sapiens
gagggtcccggtgtatcctggcc

SEQ ID NO: 5746556 - DNA, 18 bp, Homo sapiens
gagggtccctaattctct

SEQ ID NO: 5746557 - DNA, 21 bp, Homo sapiens
gagggtcctggctcctgaggg

SEQ ID NO: 5746558 - DNA, 16 bp, Homo sapiens
gagggtcgtgggaaag

SEQ ID NO: 5746559 - DNA, 17 bp, Homo sapiens
gagggtcgtgggaaagg

SEQ ID NO: 5746560 - DNA, 19 bp, Homo sapiens
gagggtcgtgggaaagggg

SEQ ID NO: 5746561 - DNA, 17 bp, Homo sapiens
gagggtctatggggaga

SEQ ID NO: 5746562 - DNA, 17 bp, Homo sapiens
gagggtctcccctcctg

SEQ ID NO: 5746563 - DNA, 20 bp, Homo sapiens
gagggtctcccctcctgcac

SEQ ID NO: 5746564 - DNA, 21 bp, Homo sapiens
gagggtctcccctcctgcaca

SEQ ID NO: 5746565 - DNA, 13 bp, Homo sapiens
gagggtctccctg

SEQ ID NO: 5746566 - DNA, 22 bp, Homo sapiens
gagggtctcgctgtcactggct

SEQ ID NO: 5746567 - DNA, 13 bp, Homo sapiens
gagggtctgagga

SEQ ID NO: 5746568 - DNA, 15 bp, Homo sapiens
gagggtctggagaag

SEQ ID NO: 5746569 - DNA, 24 bp, Homo sapiens
gagggtctggagaagcagtgagcc

SEQ ID NO: 5746570 - DNA, 13 bp, Homo sapiens
gagggtctggggg

SEQ ID NO: 5746571 - DNA, 21 bp, Homo sapiens
gagggtctgggggcagctgtc

SEQ ID NO: 5746572 - DNA, 22 bp, Homo sapiens
gagggtgacatggggaaggcag

SEQ ID NO: 5746573 - DNA, 20 bp, Homo sapiens
gagggtgacgcccagctccg

SEQ ID NO: 5746574 - DNA, 11 bp, Homo sapiens
gagggtgactg

SEQ ID NO: 5746575 - DNA, 14 bp, Homo sapiens
gagggtgagggcct

SEQ ID NO: 5746576 - DNA, 16 bp, Homo sapiens
gagggtgagggccttc

SEQ ID NO: 5746577 - DNA, 17 bp, Homo sapiens
gagggtgagggccttct

SEQ ID NO: 5746578 - DNA, 16 bp, Homo sapiens
gagggtgagttggctt

SEQ ID NO: 5746579 - DNA, 13 bp, Homo sapiens
gagggtgcaggga

SEQ ID NO: 5746580 - DNA, 14 bp, Homo sapiens
gagggtgcagggac

SEQ ID NO: 5746581 - DNA, 17 bp, Homo sapiens
gagggtgcccctgggaa

SEQ ID NO: 5746582 - DNA, 24 bp, Homo sapiens
gagggtgccgcgggcgagaagggc

SEQ ID NO: 5746583 - DNA, 20 bp, Homo sapiens
gagggtggagactaagccct

SEQ ID NO: 5746584 - DNA, 15 bp, Homo sapiens
gagggtggcagagac

SEQ ID NO: 5746585 - DNA, 17 bp, Homo sapiens
gagggtggcagagacag

SEQ ID NO: 5746586 - DNA, 18 bp, Homo sapiens
gagggtggctttgctgtt

SEQ ID NO: 5746587 - DNA, 19 bp, Homo sapiens
gagggtgggagagcccagc

SEQ ID NO: 5746588 - DNA, 12 bp, Homo sapiens
gagggtgggagg

SEQ ID NO: 5746589 - DNA, 20 bp, Homo sapiens
gagggtgggaggggccatgc

SEQ ID NO: 5746590 - DNA, 15 bp, Homo sapiens
gagggtgggccagca

SEQ ID NO: 5746591 - DNA, 18 bp, Homo sapiens
gagggtggggccgggtga

SEQ ID NO: 5746592 - DNA, 14 bp, Homo sapiens
gagggtgggggagg

SEQ ID NO: 5746593 - DNA, 15 bp, Homo sapiens
gagggtgggggaggg

SEQ ID NO: 5746594 - DNA, 19 bp, Homo sapiens
gagggtgggggccacctgc

SEQ ID NO: 5746595 - DNA, 20 bp, Homo sapiens
gagggtggggtgccccagct

SEQ ID NO: 5746596 - DNA, 21 bp, Homo sapiens
gagggtggtgacctctgcctg

SEQ ID NO: 5746597 - DNA, 20 bp, Homo sapiens
gagggtggttcaacaaagaa

SEQ ID NO: 5746598 - DNA, 14 bp, Homo sapiens
gagggtggttcctg

SEQ ID NO: 5746599 - DNA, 18 bp, Homo sapiens
gagggtgttcagaggcag

SEQ ID NO: 5746600 - DNA, 16 bp, Homo sapiens
gagggttcagagagga

SEQ ID NO: 5746601 - DNA, 23 bp, Homo sapiens
gagggttcatcatccctccctgc

SEQ ID NO: 5746602 - DNA, 14 bp, Homo sapiens
gagggttccaggct

SEQ ID NO: 5746603 - DNA, 17 bp, Homo sapiens
gagggttccaggctgtg

SEQ ID NO: 5746604 - DNA, 14 bp, Homo sapiens
gagggttcccctgg

SEQ ID NO: 5746605 - DNA, 18 bp, Homo sapiens
gagggttcccctggcctt

SEQ ID NO: 5746606 - DNA, 12 bp, Homo sapiens
gagggttcctgt

SEQ ID NO: 5746607 - DNA, 18 bp, Homo sapiens
gagggttgattaaggcag

SEQ ID NO: 5746608 - DNA, 20 bp, Homo sapiens
gagggttgctggtcctgcac

SEQ ID NO: 5746609 - DNA, 17 bp, Homo sapiens
gagggttggagtgctct

SEQ ID NO: 5746610 - DNA, 17 bp, Homo sapiens
gagggttggcacctgca

SEQ ID NO: 5746611 - DNA, 19 bp, Homo sapiens
gagggttgggaggtttctt

SEQ ID NO: 5746612 - DNA, 15 bp, Homo sapiens
gagggttgggctggt

SEQ ID NO: 5746613 - DNA, 22 bp, Homo sapiens
gagggtttggttagctcacagg

SEQ ID NO: 5746614 - DNA, 15 bp, Homo sapiens
gagggtttgtgccca

SEQ ID NO: 5746615 - DNA, 12 bp, Homo sapiens
gaggtaaaaaaa

SEQ ID NO: 5746616 - DNA, 22 bp, Homo sapiens
gaggtaaaagtgtgagcagtga

SEQ ID NO: 5746617 - DNA, 21 bp, Homo sapiens
gaggtaacagaacagcttcag

SEQ ID NO: 5746618 - DNA, 17 bp, Homo sapiens
gaggtacccaaggtcac

SEQ ID NO: 5746619 - DNA, 14 bp, Homo sapiens
gaggtagagtttga

SEQ ID NO: 5746620 - DNA, 19 bp, Homo sapiens
gaggtagcgagctgctctg

SEQ ID NO: 5746621 - DNA, 21 bp, Homo sapiens
gaggtagcgagctgctctgct

SEQ ID NO: 5746622 - DNA, 18 bp, Homo sapiens
gaggtagctacacagcat

SEQ ID NO: 5746623 - DNA, 15 bp, Homo sapiens
gaggtagctcccagc

SEQ ID NO: 5746624 - DNA, 20 bp, Homo sapiens
gaggtagctcccagcactca

SEQ ID NO: 5746625 - DNA, 21 bp, Homo sapiens
gaggtaggcgggaaaggatgg

SEQ ID NO: 5746626 - DNA, 20 bp, Homo sapiens
gaggtaggctgtggggtggg

SEQ ID NO: 5746627 - DNA, 12 bp, Homo sapiens
gaggtagggctg

SEQ ID NO: 5746628 - DNA, 14 bp, Homo sapiens
gaggtagggctggc

SEQ ID NO: 5746629 - DNA, 18 bp, Homo sapiens
gaggtagggctggctgga

SEQ ID NO: 5746630 - DNA, 21 bp, Homo sapiens
gaggtaggtggatcacctgag

SEQ ID NO: 5746631 - DNA, 16 bp, Homo sapiens
gaggtagttaagggat

SEQ ID NO: 5746632 - DNA, 15 bp, Homo sapiens
gaggtataattgtgt

SEQ ID NO: 5746633 - DNA, 14 bp, Homo sapiens
gaggtatattggaa

SEQ ID NO: 5746634 - DNA, 17 bp, Homo sapiens
gaggtatcctgtgtgtc

SEQ ID NO: 5746635 - DNA, 16 bp, Homo sapiens
gaggtatgatgtgctg

SEQ ID NO: 5746636 - DNA, 15 bp, Homo sapiens
gaggtatggcagagg

SEQ ID NO: 5746637 - DNA, 23 bp, Homo sapiens
gaggtatgtcagaaaaaatatgt

SEQ ID NO: 5746638 - DNA, 16 bp, Homo sapiens
gaggtcaagcccagga

SEQ ID NO: 5746639 - DNA, 20 bp, Homo sapiens
gaggtcaagcccaggaggac

SEQ ID NO: 5746640 - DNA, 19 bp, Homo sapiens
gaggtcacaataaagtgta

SEQ ID NO: 5746641 - DNA, 16 bp, Homo sapiens
gaggtcacattcagga

SEQ ID NO: 5746642 - DNA, 19 bp, Homo sapiens
gaggtcacattcaggaaga

SEQ ID NO: 5746643 - DNA, 21 bp, Homo sapiens
gaggtcacattcaggaagatg

SEQ ID NO: 5746644 - DNA, 13 bp, Homo sapiens
gaggtcaccagct

SEQ ID NO: 5746645 - DNA, 18 bp, Homo sapiens
gaggtcaccagctgctgt

SEQ ID NO: 5746646 - DNA, 22 bp, Homo sapiens
gaggtcaccagctgctgtgccc

SEQ ID NO: 5746647 - DNA, 15 bp, Homo sapiens
gaggtcaccagggga

SEQ ID NO: 5746648 - DNA, 16 bp, Homo sapiens
gaggtcaccaggggag

SEQ ID NO: 5746649 - DNA, 15 bp, Homo sapiens
gaggtcactctgggc

SEQ ID NO: 5746650 - DNA, 15 bp, Homo sapiens
gaggtcactcttttg

SEQ ID NO: 5746651 - DNA, 11 bp, Homo sapiens
gaggtcactgc

SEQ ID NO: 5746652 - DNA, 16 bp, Homo sapiens
gaggtcactggaaagg

SEQ ID NO: 5746653 - DNA, 14 bp, Homo sapiens
gaggtcactgggtt

SEQ ID NO: 5746654 - DNA, 19 bp, Homo sapiens
gaggtcagaagaaaattgg

SEQ ID NO: 5746655 - DNA, 12 bp, Homo sapiens
gaggtcagagcc

SEQ ID NO: 5746656 - DNA, 16 bp, Homo sapiens
gaggtcagaggagggc

SEQ ID NO: 5746657 - DNA, 23 bp, Homo sapiens
gaggtcagcatgtctattcagct

SEQ ID NO: 5746658 - DNA, 11 bp, Homo sapiens
gaggtcagcct

SEQ ID NO: 5746659 - DNA, 13 bp, Homo sapiens
gaggtcaggagtt

SEQ ID NO: 5746660 - DNA, 15 bp, Homo sapiens
gaggtcaggccctgg

SEQ ID NO: 5746661 - DNA, 24 bp, Homo sapiens
gaggtcatcccggggccatggaag

SEQ ID NO: 5746662 - DNA, 24 bp, Homo sapiens
gaggtcatctggcggaggtctctg

SEQ ID NO: 5746663 - DNA, 14 bp, Homo sapiens
gaggtcatctgtaa

SEQ ID NO: 5746664 - DNA, 24 bp, Homo sapiens
gaggtcatctgtaaaatagtctca

SEQ ID NO: 5746665 - DNA, 17 bp, Homo sapiens
gaggtccaagattctgg

SEQ ID NO: 5746666 - DNA, 14 bp, Homo sapiens
gaggtccagcccat

SEQ ID NO: 5746667 - DNA, 19 bp, Homo sapiens
gaggtccagccctggctga

SEQ ID NO: 5746668 - DNA, 20 bp, Homo sapiens
gaggtccagccctggctgaa

SEQ ID NO: 5746669 - DNA, 20 bp, Homo sapiens
gaggtccagctgggcctcct

SEQ ID NO: 5746670 - DNA, 14 bp, Homo sapiens
gaggtccaggcagg

SEQ ID NO: 5746671 - DNA, 15 bp, Homo sapiens
gaggtccaggcagga

SEQ ID NO: 5746672 - DNA, 16 bp, Homo sapiens
gaggtccaggtcccag

SEQ ID NO: 5746673 - DNA, 22 bp, Homo sapiens
gaggtccatggagaaggcatat

SEQ ID NO: 5746674 - DNA, 21 bp, Homo sapiens
gaggtcccagacatgctgccc

SEQ ID NO: 5746675 - DNA, 15 bp, Homo sapiens
gaggtcccagcccca

SEQ ID NO: 5746676 - DNA, 17 bp, Homo sapiens
gaggtcccagccccagg

SEQ ID NO: 5746677 - DNA, 21 bp, Homo sapiens
gaggtcccagccccaggcctg

SEQ ID NO: 5746678 - DNA, 13 bp, Homo sapiens
gaggtcccaggaa

SEQ ID NO: 5746679 - DNA, 13 bp, Homo sapiens
gaggtcccagggc

SEQ ID NO: 5746680 - DNA, 14 bp, Homo sapiens
gaggtcccagggcc

SEQ ID NO: 5746681 - DNA, 20 bp, Homo sapiens
gaggtccccggttgctggtc

SEQ ID NO: 5746682 - DNA, 18 bp, Homo sapiens
gaggtcccctcacgtgac

SEQ ID NO: 5746683 - DNA, 14 bp, Homo sapiens
gaggtcccctgagg

SEQ ID NO: 5746684 - DNA, 20 bp, Homo sapiens
gaggtccctgctgccagctt

SEQ ID NO: 5746685 - DNA, 22 bp, Homo sapiens
gaggtccctgtgtgtaggctgg

SEQ ID NO: 5746686 - DNA, 13 bp, Homo sapiens
gaggtcctcaggt

SEQ ID NO: 5746687 - DNA, 14 bp, Homo sapiens
gaggtcctcaggtc

SEQ ID NO: 5746688 - DNA, 16 bp, Homo sapiens
gaggtcctcaggtcag

SEQ ID NO: 5746689 - DNA, 21 bp, Homo sapiens
gaggtcctcaggtcagctggg

SEQ ID NO: 5746690 - DNA, 13 bp, Homo sapiens
gaggtcctgagca

SEQ ID NO: 5746691 - DNA, 21 bp, Homo sapiens
gaggtcctgagcactgccagg

SEQ ID NO: 5746692 - DNA, 22 bp, Homo sapiens
gaggtcctgagcactgccagga

SEQ ID NO: 5746693 - DNA, 16 bp, Homo sapiens
gaggtcctgggggcct

SEQ ID NO: 5746694 - DNA, 22 bp, Homo sapiens
gaggtcctgtcctggctcccag

SEQ ID NO: 5746695 - DNA, 16 bp, Homo sapiens
gaggtcctttggacag

SEQ ID NO: 5746696 - DNA, 18 bp, Homo sapiens
gaggtcctttggacagct

SEQ ID NO: 5746697 - DNA, 14 bp, Homo sapiens
gaggtcgctgcagc

SEQ ID NO: 5746698 - DNA, 20 bp, Homo sapiens
gaggtcgggagttcgagacc

SEQ ID NO: 5746699 - DNA, 22 bp, Homo sapiens
gaggtcggtaggttcagccaag

SEQ ID NO: 5746700 - DNA, 13 bp, Homo sapiens
gaggtctaatcta

SEQ ID NO: 5746701 - DNA, 15 bp, Homo sapiens
gaggtctagagagaa

SEQ ID NO: 5746702 - DNA, 21 bp, Homo sapiens
gaggtctcagcccctttccct

SEQ ID NO: 5746703 - DNA, 21 bp, Homo sapiens
gaggtctcaggttctttccat

SEQ ID NO: 5746704 - DNA, 12 bp, Homo sapiens
gaggtctccagg

SEQ ID NO: 5746705 - DNA, 13 bp, Homo sapiens
gaggtctccaggg

SEQ ID NO: 5746706 - DNA, 21 bp, Homo sapiens
gaggtctccaggggcctgcag

SEQ ID NO: 5746707 - DNA, 23 bp, Homo sapiens
gaggtctctccctcccccagagc

SEQ ID NO: 5746708 - DNA, 18 bp, Homo sapiens
gaggtctctgggagccca

SEQ ID NO: 5746709 - DNA, 20 bp, Homo sapiens
gaggtctctgggagcccaga

SEQ ID NO: 5746710 - DNA, 17 bp, Homo sapiens
gaggtctcttgagggag

SEQ ID NO: 5746711 - DNA, 14 bp, Homo sapiens
gaggtctgagccct

SEQ ID NO: 5746712 - DNA, 19 bp, Homo sapiens
gaggtctgagccctggtgt

SEQ ID NO: 5746713 - DNA, 20 bp, Homo sapiens
gaggtctgagccctggtgtg

SEQ ID NO: 5746714 - DNA, 15 bp, Homo sapiens
gaggtctgattggct

SEQ ID NO: 5746715 - DNA, 16 bp, Homo sapiens
gaggtctgattggctg

SEQ ID NO: 5746716 - DNA, 12 bp, Homo sapiens
gaggtctggcca

SEQ ID NO: 5746717 - DNA, 13 bp, Homo sapiens
gaggtctggctga

SEQ ID NO: 5746718 - DNA, 17 bp, Homo sapiens
gaggtctggctgagccc

SEQ ID NO: 5746719 - DNA, 15 bp, Homo sapiens
gaggtctgtaaagaa

SEQ ID NO: 5746720 - DNA, 21 bp, Homo sapiens
gaggtctgtacgttacctctt

SEQ ID NO: 5746721 - DNA, 13 bp, Homo sapiens
gaggtctgtgctg

SEQ ID NO: 5746722 - DNA, 14 bp, Homo sapiens
gaggtctgttcctt

SEQ ID NO: 5746723 - DNA, 12 bp, Homo sapiens
gaggtctgttta

SEQ ID NO: 5746724 - DNA, 13 bp, Homo sapiens
gaggtctgtttaa

SEQ ID NO: 5746725 - DNA, 12 bp, Homo sapiens
gaggtcttgcta

SEQ ID NO: 5746726 - DNA, 16 bp, Homo sapiens
gaggtcttggccgact

SEQ ID NO: 5746727 - DNA, 15 bp, Homo sapiens
gaggtctttctcctc

SEQ ID NO: 5746728 - DNA, 19 bp, Homo sapiens
gaggtcttttgacatgtgg

SEQ ID NO: 5746729 - DNA, 20 bp, Homo sapiens
gaggtgaaaagggcagaggc

SEQ ID NO: 5746730 - DNA, 21 bp, Homo sapiens
gaggtgaaaagggcagaggca

SEQ ID NO: 5746731 - DNA, 14 bp, Homo sapiens
gaggtgaaaatgaa

SEQ ID NO: 5746732 - DNA, 18 bp, Homo sapiens
gaggtgaaaatgaagaag

SEQ ID NO: 5746733 - DNA, 17 bp, Homo sapiens
gaggtgaaagcataaca

SEQ ID NO: 5746734 - DNA, 16 bp, Homo sapiens
gaggtgaaagggagct

SEQ ID NO: 5746735 - DNA, 13 bp, Homo sapiens
gaggtgaaatggg

SEQ ID NO: 5746736 - DNA, 21 bp, Homo sapiens
gaggtgacaaaccatttccaa

SEQ ID NO: 5746737 - DNA, 17 bp, Homo sapiens
gaggtgaccccagggca

SEQ ID NO: 5746738 - DNA, 19 bp, Homo sapiens
gaggtgaccccagggcaca

SEQ ID NO: 5746739 - DNA, 23 bp, Homo sapiens
gaggtgaccccagggcacaggag

SEQ ID NO: 5746740 - DNA, 23 bp, Homo sapiens
gaggtgaccccaggtttctatgt

SEQ ID NO: 5746741 - DNA, 14 bp, Homo sapiens
gaggtgagaaaact

SEQ ID NO: 5746742 - DNA, 15 bp, Homo sapiens
gaggtgagaccacct

SEQ ID NO: 5746743 - DNA, 19 bp, Homo sapiens
gaggtgagctactttgtga

SEQ ID NO: 5746744 - DNA, 17 bp, Homo sapiens
gaggtgagggaggcctg

SEQ ID NO: 5746745 - DNA, 21 bp, Homo sapiens
gaggtgattccagtgaagata

SEQ ID NO: 5746746 - DNA, 15 bp, Homo sapiens
gaggtgcaaggagtg

SEQ ID NO: 5746747 - DNA, 16 bp, Homo sapiens
gaggtgcactgggagg

SEQ ID NO: 5746748 - DNA, 18 bp, Homo sapiens
gaggtgcagagtgcccag

SEQ ID NO: 5746749 - DNA, 14 bp, Homo sapiens
gaggtgccactgga

SEQ ID NO: 5746750 - DNA, 14 bp, Homo sapiens
gaggtgccagcaaa

SEQ ID NO: 5746751 - DNA, 17 bp, Homo sapiens
gaggtgccagcaaagcc

SEQ ID NO: 5746752 - DNA, 21 bp, Homo sapiens
gaggtgcccactccgccagcc

SEQ ID NO: 5746753 - DNA, 14 bp, Homo sapiens
gaggtgcccaggag

SEQ ID NO: 5746754 - DNA, 16 bp, Homo sapiens
gaggtgcccgggcagg

SEQ ID NO: 5746755 - DNA, 14 bp, Homo sapiens
gaggtgcctgagag

SEQ ID NO: 5746756 - DNA, 18 bp, Homo sapiens
gaggtgcctgagctgggg

SEQ ID NO: 5746757 - DNA, 23 bp, Homo sapiens
gaggtgcctgagctggggcctgg

SEQ ID NO: 5746758 - DNA, 22 bp, Homo sapiens
gaggtgccttcttcagggcctg

SEQ ID NO: 5746759 - DNA, 22 bp, Homo sapiens
gaggtgcgctcacctcagagca

SEQ ID NO: 5746760 - DNA, 19 bp, Homo sapiens
gaggtgcgtgttcagcaga

SEQ ID NO: 5746761 - DNA, 16 bp, Homo sapiens
gaggtgctaaattgtc

SEQ ID NO: 5746762 - DNA, 20 bp, Homo sapiens
gaggtgctatgaagccaact

SEQ ID NO: 5746763 - DNA, 16 bp, Homo sapiens
gaggtgctgctttgct

SEQ ID NO: 5746764 - DNA, 16 bp, Homo sapiens
gaggtgctgggaggga

SEQ ID NO: 5746765 - DNA, 23 bp, Homo sapiens
gaggtgctgtccccactgcccca

SEQ ID NO: 5746766 - DNA, 22 bp, Homo sapiens
gaggtgcttaagcagaagcatt

SEQ ID NO: 5746767 - DNA, 23 bp, Homo sapiens
gaggtgcttctagttctgccagg

SEQ ID NO: 5746768 - DNA, 19 bp, Homo sapiens
gaggtggaagaagggagaa

SEQ ID NO: 5746769 - DNA, 20 bp, Homo sapiens
gaggtggaagagggctgcaa

SEQ ID NO: 5746770 - DNA, 18 bp, Homo sapiens
gaggtggaagcagaggcc

SEQ ID NO: 5746771 - DNA, 21 bp, Homo sapiens
gaggtggaagcagaggccctg

SEQ ID NO: 5746772 - DNA, 22 bp, Homo sapiens
gaggtggaaggaccctgtgccc

SEQ ID NO: 5746773 - DNA, 19 bp, Homo sapiens
gaggtggaggctgcagtga

SEQ ID NO: 5746774 - DNA, 18 bp, Homo sapiens
gaggtggagggagggaag

SEQ ID NO: 5746775 - DNA, 19 bp, Homo sapiens
gaggtggagggtagccctg

SEQ ID NO: 5746776 - DNA, 13 bp, Homo sapiens
gaggtggaggtgg

SEQ ID NO: 5746777 - DNA, 19 bp, Homo sapiens
gaggtggaggttgcagtga

SEQ ID NO: 5746778 - DNA, 15 bp, Homo sapiens
gaggtggagtggcca

SEQ ID NO: 5746779 - DNA, 18 bp, Homo sapiens
gaggtggagtggccactg

SEQ ID NO: 5746780 - DNA, 22 bp, Homo sapiens
gaggtggatactggggggcagg

SEQ ID NO: 5746781 - DNA, 22 bp, Homo sapiens
gaggtggatgttatgaacagct

SEQ ID NO: 5746782 - DNA, 21 bp, Homo sapiens
gaggtggattcctgggcaaga

SEQ ID NO: 5746783 - DNA, 20 bp, Homo sapiens
gaggtggcagggaagggtgc

SEQ ID NO: 5746784 - DNA, 21 bp, Homo sapiens
gaggtggcagggaagggtgcc

SEQ ID NO: 5746785 - DNA, 13 bp, Homo sapiens
gaggtggccaccg

SEQ ID NO: 5746786 - DNA, 19 bp, Homo sapiens
gaggtggccaggcctgcca

SEQ ID NO: 5746787 - DNA, 21 bp, Homo sapiens
gaggtggccatgttatgctgg

SEQ ID NO: 5746788 - DNA, 20 bp, Homo sapiens
gaggtggcccaggcccccgg

SEQ ID NO: 5746789 - DNA, 20 bp, Homo sapiens
gaggtggccctcccaggctg

SEQ ID NO: 5746790 - DNA, 12 bp, Homo sapiens
gaggtggccctt

SEQ ID NO: 5746791 - DNA, 16 bp, Homo sapiens
gaggtggcccttgttt

SEQ ID NO: 5746792 - DNA, 19 bp, Homo sapiens
gaggtggcccttgtttaca

SEQ ID NO: 5746793 - DNA, 13 bp, Homo sapiens
gaggtggccgcca

SEQ ID NO: 5746794 - DNA, 13 bp, Homo sapiens
gaggtggcctcct

SEQ ID NO: 5746795 - DNA, 19 bp, Homo sapiens
gaggtggcgccccctggtg

SEQ ID NO: 5746796 - DNA, 20 bp, Homo sapiens
gaggtggctgcgcccccagc

SEQ ID NO: 5746797 - DNA, 22 bp, Homo sapiens
gaggtggctgcgcccccagctt

SEQ ID NO: 5746798 - DNA, 14 bp, Homo sapiens
gaggtggctgggtt

SEQ ID NO: 5746799 - DNA, 11 bp, Homo sapiens
gaggtgggagg

SEQ ID NO: 5746800 - DNA, 15 bp, Homo sapiens
gaggtgggaggccag

SEQ ID NO: 5746801 - DNA, 13 bp, Homo sapiens
gaggtgggagggc

SEQ ID NO: 5746802 - DNA, 16 bp, Homo sapiens
gaggtgggatatccct

SEQ ID NO: 5746803 - DNA, 17 bp, Homo sapiens
gaggtgggatcctccag

SEQ ID NO: 5746804 - DNA, 18 bp, Homo sapiens
gaggtgggatcctccagg

SEQ ID NO: 5746805 - DNA, 21 bp, Homo sapiens
gaggtgggatcctccaggtgc

SEQ ID NO: 5746806 - DNA, 15 bp, Homo sapiens
gaggtgggcagcagc

SEQ ID NO: 5746807 - DNA, 15 bp, Homo sapiens
gaggtgggcagctgg

SEQ ID NO: 5746808 - DNA, 17 bp, Homo sapiens
gaggtgggcagctgggc

SEQ ID NO: 5746809 - DNA, 21 bp, Homo sapiens
gaggtgggcaggtggtggcac

SEQ ID NO: 5746810 - DNA, 19 bp, Homo sapiens
gaggtgggcatgccaccct

SEQ ID NO: 5746811 - DNA, 20 bp, Homo sapiens
gaggtgggcatgccaccctc

SEQ ID NO: 5746812 - DNA, 17 bp, Homo sapiens
gaggtgggccacaccca

SEQ ID NO: 5746813 - DNA, 21 bp, Homo sapiens
gaggtgggccagtctgtggat

SEQ ID NO: 5746814 - DNA, 12 bp, Homo sapiens
gaggtgggccca

SEQ ID NO: 5746815 - DNA, 14 bp, Homo sapiens
gaggtgggcccagg

SEQ ID NO: 5746816 - DNA, 23 bp, Homo sapiens
gaggtgggcccaggaccagctgg

SEQ ID NO: 5746817 - DNA, 22 bp, Homo sapiens
gaggtgggccttccatgggcat

SEQ ID NO: 5746818 - DNA, 20 bp, Homo sapiens
gaggtgggcgtatcacctga

SEQ ID NO: 5746819 - DNA, 14 bp, Homo sapiens
gaggtgggctgggg

SEQ ID NO: 5746820 - DNA, 24 bp, Homo sapiens
gaggtgggctggggctgctcccct

SEQ ID NO: 5746821 - DNA, 21 bp, Homo sapiens
gaggtggggaagagagcctgc

SEQ ID NO: 5746822 - DNA, 17 bp, Homo sapiens
gaggtggggaaggaggg

SEQ ID NO: 5746823 - DNA, 17 bp, Homo sapiens
gaggtggggagggcctc

SEQ ID NO: 5746824 - DNA, 19 bp, Homo sapiens
gaggtggggagggcctctg

SEQ ID NO: 5746825 - DNA, 23 bp, Homo sapiens
gaggtgggggcagcggccccgca

SEQ ID NO: 5746826 - DNA, 14 bp, Homo sapiens
gaggtgggggtctg

SEQ ID NO: 5746827 - DNA, 21 bp, Homo sapiens
gaggtgggggtctggcctagt

SEQ ID NO: 5746828 - DNA, 12 bp, Homo sapiens
gaggtggggtgc

SEQ ID NO: 5746829 - DNA, 14 bp, Homo sapiens
gaggtggggtgctg

SEQ ID NO: 5746830 - DNA, 15 bp, Homo sapiens
gaggtggggttggga

SEQ ID NO: 5746831 - DNA, 21 bp, Homo sapiens
gaggtgggtgagcgggtgggg

SEQ ID NO: 5746832 - DNA, 17 bp, Homo sapiens
gaggtgggtgtgggtgg

SEQ ID NO: 5746833 - DNA, 18 bp, Homo sapiens
gaggtgggtgtgggtgga

SEQ ID NO: 5746834 - DNA, 17 bp, Homo sapiens
gaggtggtagctctgag

SEQ ID NO: 5746835 - DNA, 18 bp, Homo sapiens
gaggtggtagctctgagc

SEQ ID NO: 5746836 - DNA, 20 bp, Homo sapiens
gaggtggtagctctgagccc

SEQ ID NO: 5746837 - DNA, 21 bp, Homo sapiens
gaggtggtagctctgagccct

SEQ ID NO: 5746838 - DNA, 17 bp, Homo sapiens
gaggtggtctgaatgtt

SEQ ID NO: 5746839 - DNA, 15 bp, Homo sapiens
gaggtggtgaatttt

SEQ ID NO: 5746840 - DNA, 16 bp, Homo sapiens
gaggtggtggaggagg

SEQ ID NO: 5746841 - DNA, 18 bp, Homo sapiens
gaggtggtggaggaggag

SEQ ID NO: 5746842 - DNA, 20 bp, Homo sapiens
gaggtggtggagtggagtga

SEQ ID NO: 5746843 - DNA, 23 bp, Homo sapiens
gaggtggtggggaccagctaatt

SEQ ID NO: 5746844 - DNA, 23 bp, Homo sapiens
gaggtggttcagacaagacagag

SEQ ID NO: 5746845 - DNA, 12 bp, Homo sapiens
gaggtggtttta

SEQ ID NO: 5746846 - DNA, 17 bp, Homo sapiens
gaggtgtacactaacat

SEQ ID NO: 5746847 - DNA, 20 bp, Homo sapiens
gaggtgtacactaacatttc

SEQ ID NO: 5746848 - DNA, 15 bp, Homo sapiens
gaggtgtcaccctgc

SEQ ID NO: 5746849 - DNA, 22 bp, Homo sapiens
gaggtgtcaggctgctggcgcc

SEQ ID NO: 5746850 - DNA, 14 bp, Homo sapiens
gaggtgtcccaagc

SEQ ID NO: 5746851 - DNA, 16 bp, Homo sapiens
gaggtgtctcaggctg

SEQ ID NO: 5746852 - DNA, 17 bp, Homo sapiens
gaggtgtctcaggctgc

SEQ ID NO: 5746853 - DNA, 19 bp, Homo sapiens
gaggtgtctcaggctgcct

SEQ ID NO: 5746854 - DNA, 17 bp, Homo sapiens
gaggtgtctggggtgag

SEQ ID NO: 5746855 - DNA, 21 bp, Homo sapiens
gaggtgtctggggtgagggag

SEQ ID NO: 5746856 - DNA, 18 bp, Homo sapiens
gaggtgtgcctggcctct

SEQ ID NO: 5746857 - DNA, 19 bp, Homo sapiens
gaggtgtgcctggcctctg

SEQ ID NO: 5746858 - DNA, 17 bp, Homo sapiens
gaggtgtggagtggagg

SEQ ID NO: 5746859 - DNA, 15 bp, Homo sapiens
gaggtgtgggggctg

SEQ ID NO: 5746860 - DNA, 21 bp, Homo sapiens
gaggtgtgtgacgtttttcca

SEQ ID NO: 5746861 - DNA, 16 bp, Homo sapiens
gaggtgttacagagga

SEQ ID NO: 5746862 - DNA, 16 bp, Homo sapiens
gaggtgttgccagtgc

SEQ ID NO: 5746863 - DNA, 19 bp, Homo sapiens
gaggtgtttaaagagaggt

SEQ ID NO: 5746864 - DNA, 16 bp, Homo sapiens
gaggttaaaaagaaaa

SEQ ID NO: 5746865 - DNA, 15 bp, Homo sapiens
gaggttaaaatataa

SEQ ID NO: 5746866 - DNA, 18 bp, Homo sapiens
gaggttaaagaagctgca

SEQ ID NO: 5746867 - DNA, 18 bp, Homo sapiens
gaggttaaagcaaaccag

SEQ ID NO: 5746868 - DNA, 14 bp, Homo sapiens
gaggttaaggtggg

SEQ ID NO: 5746869 - DNA, 19 bp, Homo sapiens
gaggttactttagttagca

SEQ ID NO: 5746870 - DNA, 21 bp, Homo sapiens
gaggttagcccaatggagaaa

SEQ ID NO: 5746871 - DNA, 17 bp, Homo sapiens
gaggttaggaacccggc

SEQ ID NO: 5746872 - DNA, 22 bp, Homo sapiens
gaggttataggtcactcctggg

SEQ ID NO: 5746873 - DNA, 13 bp, Homo sapiens
gaggttatctgcc

SEQ ID NO: 5746874 - DNA, 16 bp, Homo sapiens
gaggttatctgcctgg

SEQ ID NO: 5746875 - DNA, 18 bp, Homo sapiens
gaggttatctgcctggcc

SEQ ID NO: 5746876 - DNA, 22 bp, Homo sapiens
gaggttatctgcctggcctggc

SEQ ID NO: 5746877 - DNA, 15 bp, Homo sapiens
gaggttcaaaagtaa

SEQ ID NO: 5746878 - DNA, 17 bp, Homo sapiens
gaggttcatttcaaata

SEQ ID NO: 5746879 - DNA, 14 bp, Homo sapiens
gaggttcatttttc

SEQ ID NO: 5746880 - DNA, 16 bp, Homo sapiens
gaggttctcagagcca

SEQ ID NO: 5746881 - DNA, 18 bp, Homo sapiens
gaggttgaaaaacaaaat

SEQ ID NO: 5746882 - DNA, 19 bp, Homo sapiens
gaggttgacctgtttctct

SEQ ID NO: 5746883 - DNA, 19 bp, Homo sapiens
gaggttgagctatgatatg

SEQ ID NO: 5746884 - DNA, 15 bp, Homo sapiens
gaggttgcagcatga

SEQ ID NO: 5746885 - DNA, 16 bp, Homo sapiens
gaggttgcagtgagct

SEQ ID NO: 5746886 - DNA, 16 bp, Homo sapiens
gaggttgggaattctt

SEQ ID NO: 5746887 - DNA, 15 bp, Homo sapiens
gaggttgggaggcca

SEQ ID NO: 5746888 - DNA, 17 bp, Homo sapiens
gaggttgggaggccatt

SEQ ID NO: 5746889 - DNA, 12 bp, Homo sapiens
gaggttgggctt

SEQ ID NO: 5746890 - DNA, 17 bp, Homo sapiens
gaggttggggtgtacta

SEQ ID NO: 5746891 - DNA, 16 bp, Homo sapiens
gaggttggtgtggagt

SEQ ID NO: 5746892 - DNA, 22 bp, Homo sapiens
gaggttggtttaatgcaataga

SEQ ID NO: 5746893 - DNA, 13 bp, Homo sapiens
gaggttgtagtga

SEQ ID NO: 5746894 - DNA, 19 bp, Homo sapiens
gaggtttagcaatagctag

SEQ ID NO: 5746895 - DNA, 16 bp, Homo sapiens
gaggtttagcgtttta

SEQ ID NO: 5746896 - DNA, 19 bp, Homo sapiens
gaggtttaggtcaagaaga

SEQ ID NO: 5746897 - DNA, 18 bp, Homo sapiens
gaggtttatagttaatct

SEQ ID NO: 5746898 - DNA, 16 bp, Homo sapiens
gaggtttcaaacctcc

SEQ ID NO: 5746899 - DNA, 19 bp, Homo sapiens
gaggtttcacttgcacatc

SEQ ID NO: 5746900 - DNA, 18 bp, Homo sapiens
gaggtttcattttcatct

SEQ ID NO: 5746901 - DNA, 22 bp, Homo sapiens
gaggtttcattttcatctcatt

SEQ ID NO: 5746902 - DNA, 20 bp, Homo sapiens
gaggtttctcaaagaaattt

SEQ ID NO: 5746903 - DNA, 11 bp, Homo sapiens
gaggtttgaag

SEQ ID NO: 5746904 - DNA, 16 bp, Homo sapiens
gaggtttgcagtccca

SEQ ID NO: 5746905 - DNA, 19 bp, Homo sapiens
gaggtttgcagtcccaagc

SEQ ID NO: 5746906 - DNA, 15 bp, Homo sapiens
gaggtttgcctgtga

SEQ ID NO: 5746907 - DNA, 15 bp, Homo sapiens
gaggtttggaagagt

SEQ ID NO: 5746908 - DNA, 18 bp, Homo sapiens
gaggtttgtcaacaaaaa

SEQ ID NO: 5746909 - DNA, 16 bp, Homo sapiens
gaggtttgtcaacaca

SEQ ID NO: 5746910 - DNA, 22 bp, Homo sapiens
gaggtttgtcaacacaaagaca

SEQ ID NO: 5746911 - DNA, 21 bp, Homo sapiens
gaggttttgaataaaaagtga

SEQ ID NO: 5746912 - DNA, 13 bp, Homo sapiens
gaggttttgtatt

SEQ ID NO: 5746913 - DNA, 20 bp, Homo sapiens
gagtaaaaattcatataaag

SEQ ID NO: 5746914 - DNA, 23 bp, Homo sapiens
gagtaaaaattcatataaagtgc

SEQ ID NO: 5746915 - DNA, 23 bp, Homo sapiens
gagtaaaataaatattgtctttt

SEQ ID NO: 5746916 - DNA, 15 bp, Homo sapiens
gagtaaaattacaga

SEQ ID NO: 5746917 - DNA, 19 bp, Homo sapiens
gagtaaacggcccaggcca

SEQ ID NO: 5746918 - DNA, 15 bp, Homo sapiens
gagtaaactgtttct

SEQ ID NO: 5746919 - DNA, 17 bp, Homo sapiens
gagtaaactgtttctca

SEQ ID NO: 5746920 - DNA, 14 bp, Homo sapiens
gagtaaataaactg

SEQ ID NO: 5746921 - DNA, 19 bp, Homo sapiens
gagtaaatattgaggcttt

SEQ ID NO: 5746922 - DNA, 16 bp, Homo sapiens
gagtaaattgctctgt

SEQ ID NO: 5746923 - DNA, 21 bp, Homo sapiens
gagtaacaatacaaatggatt

SEQ ID NO: 5746924 - DNA, 15 bp, Homo sapiens
gagtaacagggcaga

SEQ ID NO: 5746925 - DNA, 23 bp, Homo sapiens
gagtaacgttttccttgtgacta

SEQ ID NO: 5746926 - DNA, 21 bp, Homo sapiens
gagtaactattattataggta

SEQ ID NO: 5746927 - DNA, 13 bp, Homo sapiens
gagtaacttagaa

SEQ ID NO: 5746928 - DNA, 15 bp, Homo sapiens
gagtaacttagaaaa

SEQ ID NO: 5746929 - DNA, 21 bp, Homo sapiens
gagtaagaaatgggcctcagc

SEQ ID NO: 5746930 - DNA, 21 bp, Homo sapiens
gagtaagcacctttagaatat

SEQ ID NO: 5746931 - DNA, 14 bp, Homo sapiens
gagtaagctgcttt

SEQ ID NO: 5746932 - DNA, 23 bp, Homo sapiens
gagtaataaagatacaaaatgtt

SEQ ID NO: 5746933 - DNA, 21 bp, Homo sapiens
gagtaatattacatttcattt

SEQ ID NO: 5746934 - DNA, 23 bp, Homo sapiens
gagtaatcaatacagacaaggtt

SEQ ID NO: 5746935 - DNA, 15 bp, Homo sapiens
gagtaatctgagaaa

SEQ ID NO: 5746936 - DNA, 13 bp, Homo sapiens
gagtaatctgtgt

SEQ ID NO: 5746937 - DNA, 17 bp, Homo sapiens
gagtaatcttgttggtt

SEQ ID NO: 5746938 - DNA, 14 bp, Homo sapiens
gagtaatgatgtaa

SEQ ID NO: 5746939 - DNA, 20 bp, Homo sapiens
gagtaatgcagacatttaca

SEQ ID NO: 5746940 - DNA, 17 bp, Homo sapiens
gagtaatggtgtagaac

SEQ ID NO: 5746941 - DNA, 22 bp, Homo sapiens
gagtaatggtgtagaacactaa

SEQ ID NO: 5746942 - DNA, 14 bp, Homo sapiens
gagtaattatctgt

SEQ ID NO: 5746943 - DNA, 19 bp, Homo sapiens
gagtaattctgtcattcct

SEQ ID NO: 5746944 - DNA, 18 bp, Homo sapiens
gagtaattgcatttgctt

SEQ ID NO: 5746945 - DNA, 14 bp, Homo sapiens
gagtacaaaacaat

SEQ ID NO: 5746946 - DNA, 15 bp, Homo sapiens
gagtacaaagacagg

SEQ ID NO: 5746947 - DNA, 14 bp, Homo sapiens
gagtacaaatgcct

SEQ ID NO: 5746948 - DNA, 23 bp, Homo sapiens
gagtacaaatgccttaaaatgga

SEQ ID NO: 5746949 - DNA, 19 bp, Homo sapiens
gagtacaaggacagacagc

SEQ ID NO: 5746950 - DNA, 13 bp, Homo sapiens
gagtacaattgtt

SEQ ID NO: 5746951 - DNA, 18 bp, Homo sapiens
gagtacactcagccactg

SEQ ID NO: 5746952 - DNA, 19 bp, Homo sapiens
gagtacagacgtctcaaga

SEQ ID NO: 5746953 - DNA, 16 bp, Homo sapiens
gagtacagactgcaga

SEQ ID NO: 5746954 - DNA, 14 bp, Homo sapiens
gagtacagatactg

SEQ ID NO: 5746955 - DNA, 13 bp, Homo sapiens
gagtacattgtgc

SEQ ID NO: 5746956 - DNA, 16 bp, Homo sapiens
gagtacattgtgccct

SEQ ID NO: 5746957 - DNA, 18 bp, Homo sapiens
gagtaccaggggctgggc

SEQ ID NO: 5746958 - DNA, 23 bp, Homo sapiens
gagtacctccagtcacactcccc

SEQ ID NO: 5746959 - DNA, 18 bp, Homo sapiens
gagtacctgcaaaaatga

SEQ ID NO: 5746960 - DNA, 18 bp, Homo sapiens
gagtacctgctgccccag

SEQ ID NO: 5746961 - DNA, 16 bp, Homo sapiens
gagtacgtcctgcctg

SEQ ID NO: 5746962 - DNA, 23 bp, Homo sapiens
gagtacgttaaaagcaaaaagat

SEQ ID NO: 5746963 - DNA, 20 bp, Homo sapiens
gagtacgttgtgcatttggt

SEQ ID NO: 5746964 - DNA, 15 bp, Homo sapiens
gagtactacagtcct

SEQ ID NO: 5746965 - DNA, 20 bp, Homo sapiens
gagtactacagtcctcccat

SEQ ID NO: 5746966 - DNA, 20 bp, Homo sapiens
gagtactatatttgtgaata

SEQ ID NO: 5746967 - DNA, 19 bp, Homo sapiens
gagtactcacttttcactt

SEQ ID NO: 5746968 - DNA, 16 bp, Homo sapiens
gagtactcataaagga

SEQ ID NO: 5746969 - DNA, 22 bp, Homo sapiens
gagtactcataaaggacactgg

SEQ ID NO: 5746970 - DNA, 21 bp, Homo sapiens
gagtactccacactgcacaat

SEQ ID NO: 5746971 - DNA, 13 bp, Homo sapiens
gagtactgggaga

SEQ ID NO: 5746972 - DNA, 15 bp, Homo sapiens
gagtactgtgggcaa

SEQ ID NO: 5746973 - DNA, 23 bp, Homo sapiens
gagtactgtgggcaatttagaaa

SEQ ID NO: 5746974 - DNA, 23 bp, Homo sapiens
gagtagaaaatgtgaccctccaa

SEQ ID NO: 5746975 - DNA, 17 bp, Homo sapiens
gagtagaaagacagagc

SEQ ID NO: 5746976 - DNA, 19 bp, Homo sapiens
gagtagaaattgttcctga

SEQ ID NO: 5746977 - DNA, 12 bp, Homo sapiens
gagtagaatgta

SEQ ID NO: 5746978 - DNA, 15 bp, Homo sapiens
gagtagacacattta

SEQ ID NO: 5746979 - DNA, 17 bp, Homo sapiens
gagtagacccctggctg

SEQ ID NO: 5746980 - DNA, 15 bp, Homo sapiens
gagtagacctgagat

SEQ ID NO: 5746981 - DNA, 12 bp, Homo sapiens
gagtagagaagt

SEQ ID NO: 5746982 - DNA, 21 bp, Homo sapiens
gagtagatactctcagcacca

SEQ ID NO: 5746983 - DNA, 18 bp, Homo sapiens
gagtagatggtgaaattt

SEQ ID NO: 5746984 - DNA, 17 bp, Homo sapiens
gagtagcaaggaaggac

SEQ ID NO: 5746985 - DNA, 17 bp, Homo sapiens
gagtagcacccccagcc

SEQ ID NO: 5746986 - DNA, 13 bp, Homo sapiens
gagtagcagtgat

SEQ ID NO: 5746987 - DNA, 21 bp, Homo sapiens
gagtagccagggtgtggccct

SEQ ID NO: 5746988 - DNA, 18 bp, Homo sapiens
gagtagccatgaggaggc

SEQ ID NO: 5746989 - DNA, 23 bp, Homo sapiens
gagtagccccaacccaaacctgg

SEQ ID NO: 5746990 - DNA, 19 bp, Homo sapiens
gagtagccgagagcctgct

SEQ ID NO: 5746991 - DNA, 14 bp, Homo sapiens
gagtagcctggact

SEQ ID NO: 5746992 - DNA, 20 bp, Homo sapiens
gagtagcctggactgtttca

SEQ ID NO: 5746993 - DNA, 15 bp, Homo sapiens
gagtagcggtccaag

SEQ ID NO: 5746994 - DNA, 17 bp, Homo sapiens
gagtagctgagaggaag

SEQ ID NO: 5746995 - DNA, 14 bp, Homo sapiens
gagtagctgcagcc

SEQ ID NO: 5746996 - DNA, 16 bp, Homo sapiens
gagtagctgcttcctg

SEQ ID NO: 5746997 - DNA, 19 bp, Homo sapiens
gagtagctgggactacagg

SEQ ID NO: 5746998 - DNA, 20 bp, Homo sapiens
gagtagctgggactagaggc

SEQ ID NO: 5746999 - DNA, 15 bp, Homo sapiens
gagtagctgggatta

SEQ ID NO: 5747000 - DNA, 18 bp, Homo sapiens
gagtagctgggattacag

SEQ ID NO: 5747001 - DNA, 15 bp, Homo sapiens
gagtagctgggcctg

SEQ ID NO: 5747002 - DNA, 18 bp, Homo sapiens
gagtagctgggcctgtgc

SEQ ID NO: 5747003 - DNA, 13 bp, Homo sapiens
gagtaggaagact

SEQ ID NO: 5747004 - DNA, 21 bp, Homo sapiens
gagtaggcggcgatttttgta

SEQ ID NO: 5747005 - DNA, 17 bp, Homo sapiens
gagtaggctccagacag

SEQ ID NO: 5747006 - DNA, 18 bp, Homo sapiens
gagtaggctccagacagg

SEQ ID NO: 5747007 - DNA, 19 bp, Homo sapiens
gagtaggctccagacagga

SEQ ID NO: 5747008 - DNA, 13 bp, Homo sapiens
gagtagggccctg

SEQ ID NO: 5747009 - DNA, 22 bp, Homo sapiens
gagtagggccctgacaggcctt

SEQ ID NO: 5747010 - DNA, 17 bp, Homo sapiens
gagtagggcttagtgtt

SEQ ID NO: 5747011 - DNA, 21 bp, Homo sapiens
gagtaggtctgggatggacag

SEQ ID NO: 5747012 - DNA, 22 bp, Homo sapiens
gagtaggtctgggatggacagg

SEQ ID NO: 5747013 - DNA, 15 bp, Homo sapiens
gagtaggtgggtctt

SEQ ID NO: 5747014 - DNA, 18 bp, Homo sapiens
gagtagtcagaactataa

SEQ ID NO: 5747015 - DNA, 15 bp, Homo sapiens
gagtagtgcatttaa

SEQ ID NO: 5747016 - DNA, 13 bp, Homo sapiens
gagtagtggccac

SEQ ID NO: 5747017 - DNA, 14 bp, Homo sapiens
gagtagtggccact

SEQ ID NO: 5747018 - DNA, 23 bp, Homo sapiens
gagtagttatataattgttgaac

SEQ ID NO: 5747019 - DNA, 20 bp, Homo sapiens
gagtagttgatgttgcattt

SEQ ID NO: 5747020 - DNA, 20 bp, Homo sapiens
gagtagtttgttatgtgtct

SEQ ID NO: 5747021 - DNA, 20 bp, Homo sapiens
gagtataaaataaagcaaat

SEQ ID NO: 5747022 - DNA, 15 bp, Homo sapiens
gagtataagaaatgc

SEQ ID NO: 5747023 - DNA, 18 bp, Homo sapiens
gagtataagaaatgcata

SEQ ID NO: 5747024 - DNA, 23 bp, Homo sapiens
gagtataatacattacatgtaaa

SEQ ID NO: 5747025 - DNA, 16 bp, Homo sapiens
gagtataggccggtct

SEQ ID NO: 5747026 - DNA, 12 bp, Homo sapiens
gagtatatatgt

SEQ ID NO: 5747027 - DNA, 16 bp, Homo sapiens
gagtatatgtaacagt

SEQ ID NO: 5747028 - DNA, 21 bp, Homo sapiens
gagtatatttttgtctgcagc

SEQ ID NO: 5747029 - DNA, 21 bp, Homo sapiens
gagtatcactttaactcagga

SEQ ID NO: 5747030 - DNA, 15 bp, Homo sapiens
gagtatcagaattga

SEQ ID NO: 5747031 - DNA, 19 bp, Homo sapiens
gagtatcagttgcaggtgc

SEQ ID NO: 5747032 - DNA, 13 bp, Homo sapiens
gagtatcataata

SEQ ID NO: 5747033 - DNA, 14 bp, Homo sapiens
gagtatccttcctt

SEQ ID NO: 5747034 - DNA, 16 bp, Homo sapiens
gagtatccttccttca

SEQ ID NO: 5747035 - DNA, 23 bp, Homo sapiens
gagtatctcggacctttcagctg

SEQ ID NO: 5747036 - DNA, 14 bp, Homo sapiens
gagtatgaacttga

SEQ ID NO: 5747037 - DNA, 16 bp, Homo sapiens
gagtatgaacttgaga

SEQ ID NO: 5747038 - DNA, 22 bp, Homo sapiens
gagtatgagtgcaagcaaagca

SEQ ID NO: 5747039 - DNA, 22 bp, Homo sapiens
gagtatgcaagaagaatataaa

SEQ ID NO: 5747040 - DNA, 18 bp, Homo sapiens
gagtatgcttgggccctg

SEQ ID NO: 5747041 - DNA, 13 bp, Homo sapiens
gagtatgtgcagt

SEQ ID NO: 5747042 - DNA, 16 bp, Homo sapiens
gagtatgtgcagtgtg

SEQ ID NO: 5747043 - DNA, 17 bp, Homo sapiens
gagtatgtgcagtgtgg

SEQ ID NO: 5747044 - DNA, 10 bp, Homo sapiens
gagtatgtgt

SEQ ID NO: 5747045 - DNA, 14 bp, Homo sapiens
gagtatgtgtatgt

SEQ ID NO: 5747046 - DNA, 15 bp, Homo sapiens
gagtatgtgtatgta

SEQ ID NO: 5747047 - DNA, 16 bp, Homo sapiens
gagtatgtgtatgtac

SEQ ID NO: 5747048 - DNA, 19 bp, Homo sapiens
gagtatgtgtttgtgtgtg

SEQ ID NO: 5747049 - DNA, 21 bp, Homo sapiens
gagtatgttcttgaagaaagg

SEQ ID NO: 5747050 - DNA, 15 bp, Homo sapiens
gagtatgttgtcata

SEQ ID NO: 5747051 - DNA, 21 bp, Homo sapiens
gagtattccatgagctgctca

SEQ ID NO: 5747052 - DNA, 21 bp, Homo sapiens
gagtattctcataggagactg

SEQ ID NO: 5747053 - DNA, 14 bp, Homo sapiens
gagtattggtctcc

SEQ ID NO: 5747054 - DNA, 20 bp, Homo sapiens
gagtattgtttaaaatgtaa

SEQ ID NO: 5747055 - DNA, 14 bp, Homo sapiens
gagtatttcccttc

SEQ ID NO: 5747056 - DNA, 12 bp, Homo sapiens
gagtatttctgg

SEQ ID NO: 5747057 - DNA, 17 bp, Homo sapiens
gagtatttctgttcctt

SEQ ID NO: 5747058 - DNA, 20 bp, Homo sapiens
gagtattttaagaagacata

SEQ ID NO: 5747059 - DNA, 23 bp, Homo sapiens
gagtattttctggtaaaaagaaa

SEQ ID NO: 5747060 - DNA, 21 bp, Homo sapiens
gagtatttttaaaaaatatgt

SEQ ID NO: 5747061 - DNA, 20 bp, Homo sapiens
gagtatttttataattttat

SEQ ID NO: 5747062 - DNA, 15 bp, Homo sapiens
gagtcaaaaattaaa

SEQ ID NO: 5747063 - DNA, 15 bp, Homo sapiens
gagtcaaaacaaagc

SEQ ID NO: 5747064 - DNA, 14 bp, Homo sapiens
gagtcaaaacactt

SEQ ID NO: 5747065 - DNA, 22 bp, Homo sapiens
gagtcaaaatttcaaaagtgat

SEQ ID NO: 5747066 - DNA, 17 bp, Homo sapiens
gagtcaaatccagtggt

SEQ ID NO: 5747067 - DNA, 19 bp, Homo sapiens
gagtcaacaaattaaataa

SEQ ID NO: 5747068 - DNA, 15 bp, Homo sapiens
gagtcaaggcctgct

SEQ ID NO: 5747069 - DNA, 18 bp, Homo sapiens
gagtcaagtgtgcctgct

SEQ ID NO: 5747070 - DNA, 20 bp, Homo sapiens
gagtcaatcccctcattcag

SEQ ID NO: 5747071 - DNA, 15 bp, Homo sapiens
gagtcaatgtgcagt

SEQ ID NO: 5747072 - DNA, 15 bp, Homo sapiens
gagtcaatttgctga

SEQ ID NO: 5747073 - DNA, 22 bp, Homo sapiens
gagtcacaaagaacatgtagaa

SEQ ID NO: 5747074 - DNA, 12 bp, Homo sapiens
gagtcacactca

SEQ ID NO: 5747075 - DNA, 18 bp, Homo sapiens
gagtcacagatgaggccc

SEQ ID NO: 5747076 - DNA, 19 bp, Homo sapiens
gagtcacagatgaggcccc

SEQ ID NO: 5747077 - DNA, 19 bp, Homo sapiens
gagtcacagctttcccagg

SEQ ID NO: 5747078 - DNA, 22 bp, Homo sapiens
gagtcacaggtgtgggatggag

SEQ ID NO: 5747079 - DNA, 16 bp, Homo sapiens
gagtcaccaagcccag

SEQ ID NO: 5747080 - DNA, 14 bp, Homo sapiens
gagtcaccaggaat

SEQ ID NO: 5747081 - DNA, 20 bp, Homo sapiens
gagtcacccatgaagacagg

SEQ ID NO: 5747082 - DNA, 17 bp, Homo sapiens
gagtcacccccccaggc

SEQ ID NO: 5747083 - DNA, 20 bp, Homo sapiens
gagtcacccccccaggcctc

SEQ ID NO: 5747084 - DNA, 20 bp, Homo sapiens
gagtcacccctctgtccagc

SEQ ID NO: 5747085 - DNA, 24 bp, Homo sapiens
gagtcacccctctgtccagccagc

SEQ ID NO: 5747086 - DNA, 15 bp, Homo sapiens
gagtcacctgcaagc

SEQ ID NO: 5747087 - DNA, 21 bp, Homo sapiens
gagtcacctgcaagccccagg

SEQ ID NO: 5747088 - DNA, 22 bp, Homo sapiens
gagtcacctgcaagccccaggg

SEQ ID NO: 5747089 - DNA, 16 bp, Homo sapiens
gagtcacctgctccag

SEQ ID NO: 5747090 - DNA, 17 bp, Homo sapiens
gagtcacctgctccaga

SEQ ID NO: 5747091 - DNA, 23 bp, Homo sapiens
gagtcaccttcattttggcaaga

SEQ ID NO: 5747092 - DNA, 15 bp, Homo sapiens
gagtcaccttccagg

SEQ ID NO: 5747093 - DNA, 23 bp, Homo sapiens
gagtcaccttccaggacccctgg

SEQ ID NO: 5747094 - DNA, 14 bp, Homo sapiens
gagtcaccttttct

SEQ ID NO: 5747095 - DNA, 21 bp, Homo sapiens
gagtcaccttttctgtggctg

SEQ ID NO: 5747096 - DNA, 16 bp, Homo sapiens
gagtcacgctggggct

SEQ ID NO: 5747097 - DNA, 17 bp, Homo sapiens
gagtcactgcagaggga

SEQ ID NO: 5747098 - DNA, 18 bp, Homo sapiens
gagtcagaagtttctgcc

SEQ ID NO: 5747099 - DNA, 22 bp, Homo sapiens
gagtcagacatttctttggaaa

SEQ ID NO: 5747100 - DNA, 22 bp, Homo sapiens
gagtcagacattttaagatggt

SEQ ID NO: 5747101 - DNA, 12 bp, Homo sapiens
gagtcagagccc

SEQ ID NO: 5747102 - DNA, 13 bp, Homo sapiens
gagtcagagccct

SEQ ID NO: 5747103 - DNA, 15 bp, Homo sapiens
gagtcagagccctgg

SEQ ID NO: 5747104 - DNA, 20 bp, Homo sapiens
gagtcagagccctggctggg

SEQ ID NO: 5747105 - DNA, 22 bp, Homo sapiens
gagtcagagccctggctgggtt

SEQ ID NO: 5747106 - DNA, 11 bp, Homo sapiens
gagtcagatga

SEQ ID NO: 5747107 - DNA, 12 bp, Homo sapiens
gagtcagatgag

SEQ ID NO: 5747108 - DNA, 12 bp, Homo sapiens
gagtcagcacct

SEQ ID NO: 5747109 - DNA, 20 bp, Homo sapiens
gagtcagcaccttggcccag

SEQ ID NO: 5747110 - DNA, 22 bp, Homo sapiens
gagtcagcaccttggcccagga

SEQ ID NO: 5747111 - DNA, 16 bp, Homo sapiens
gagtcagccaggagct

SEQ ID NO: 5747112 - DNA, 15 bp, Homo sapiens
gagtcagctctctgc

SEQ ID NO: 5747113 - DNA, 17 bp, Homo sapiens
gagtcagctctctgccc

SEQ ID NO: 5747114 - DNA, 18 bp, Homo sapiens
gagtcagctgaccccctc

SEQ ID NO: 5747115 - DNA, 22 bp, Homo sapiens
gagtcagctgaccccctccccc

SEQ ID NO: 5747116 - DNA, 16 bp, Homo sapiens
gagtcagctgtttcta

SEQ ID NO: 5747117 - DNA, 12 bp, Homo sapiens
gagtcaggaaga

SEQ ID NO: 5747118 - DNA, 21 bp, Homo sapiens
gagtcaggagttttactgcct

SEQ ID NO: 5747119 - DNA, 16 bp, Homo sapiens
gagtcaggcaattgat

SEQ ID NO: 5747120 - DNA, 21 bp, Homo sapiens
gagtcaggcaattgattgtga

SEQ ID NO: 5747121 - DNA, 20 bp, Homo sapiens
gagtcaggcccggcctattg

SEQ ID NO: 5747122 - DNA, 24 bp, Homo sapiens
gagtcaggcctgggcaggaccctg

SEQ ID NO: 5747123 - DNA, 19 bp, Homo sapiens
gagtcaggcttctcttgct

SEQ ID NO: 5747124 - DNA, 18 bp, Homo sapiens
gagtcagggagagctgaa

SEQ ID NO: 5747125 - DNA, 16 bp, Homo sapiens
gagtcagggcccagag

SEQ ID NO: 5747126 - DNA, 17 bp, Homo sapiens
gagtcagggctgtgctt

SEQ ID NO: 5747127 - DNA, 16 bp, Homo sapiens
gagtcaggggctctgt

SEQ ID NO: 5747128 - DNA, 18 bp, Homo sapiens
gagtcaggggctctgtgt

SEQ ID NO: 5747129 - DNA, 22 bp, Homo sapiens
gagtcagggtgaactgcaaagc

SEQ ID NO: 5747130 - DNA, 19 bp, Homo sapiens
gagtcagggtggagatgag

SEQ ID NO: 5747131 - DNA, 22 bp, Homo sapiens
gagtcaggtgaggcatctttac

SEQ ID NO: 5747132 - DNA, 16 bp, Homo sapiens
gagtcagtagccagag

SEQ ID NO: 5747133 - DNA, 21 bp, Homo sapiens
gagtcagtctctttctgtaca

SEQ ID NO: 5747134 - DNA, 20 bp, Homo sapiens
gagtcagtgaagtctagaat

SEQ ID NO: 5747135 - DNA, 19 bp, Homo sapiens
gagtcagtgtctggctttt

SEQ ID NO: 5747136 - DNA, 20 bp, Homo sapiens
gagtcataaaccttaagtaa

SEQ ID NO: 5747137 - DNA, 21 bp, Homo sapiens
gagtcataacggttaagaaag

SEQ ID NO: 5747138 - DNA, 17 bp, Homo sapiens
gagtcatcaaaaagagt

SEQ ID NO: 5747139 - DNA, 18 bp, Homo sapiens
gagtcatgatctccctgc

SEQ ID NO: 5747140 - DNA, 12 bp, Homo sapiens
gagtcatgccaa

SEQ ID NO: 5747141 - DNA, 14 bp, Homo sapiens
gagtcatgcgtgtt

SEQ ID NO: 5747142 - DNA, 16 bp, Homo sapiens
gagtcattaccacgcc

SEQ ID NO: 5747143 - DNA, 17 bp, Homo sapiens
gagtcattatgtagctg

SEQ ID NO: 5747144 - DNA, 18 bp, Homo sapiens
gagtcattcaggtgacct

SEQ ID NO: 5747145 - DNA, 14 bp, Homo sapiens
gagtcattcatatt

SEQ ID NO: 5747146 - DNA, 15 bp, Homo sapiens
gagtcattgacttca

SEQ ID NO: 5747147 - DNA, 13 bp, Homo sapiens
gagtcatttaaat

SEQ ID NO: 5747148 - DNA, 16 bp, Homo sapiens
gagtcatttaaatgtg

SEQ ID NO: 5747149 - DNA, 13 bp, Homo sapiens
gagtcatttgagt

SEQ ID NO: 5747150 - DNA, 18 bp, Homo sapiens
gagtcatttgtttaaaca

SEQ ID NO: 5747151 - DNA, 14 bp, Homo sapiens
gagtccaaaatcat

SEQ ID NO: 5747152 - DNA, 23 bp, Homo sapiens
gagtccaacagacacaatttata

SEQ ID NO: 5747153 - DNA, 22 bp, Homo sapiens
gagtccaacgtggggcagcaca

SEQ ID NO: 5747154 - DNA, 21 bp, Homo sapiens
gagtccaactcacttccagtg

SEQ ID NO: 5747155 - DNA, 12 bp, Homo sapiens
gagtccaagctg

SEQ ID NO: 5747156 - DNA, 12 bp, Homo sapiens
gagtccaaggcc

SEQ ID NO: 5747157 - DNA, 15 bp, Homo sapiens
gagtccacacttgaa

SEQ ID NO: 5747158 - DNA, 23 bp, Homo sapiens
gagtccacgcccaccagccttgc

SEQ ID NO: 5747159 - DNA, 21 bp, Homo sapiens
gagtccactgcctccatgatg

SEQ ID NO: 5747160 - DNA, 14 bp, Homo sapiens
gagtccactttcct

SEQ ID NO: 5747161 - DNA, 18 bp, Homo sapiens
gagtccactttcctctct

SEQ ID NO: 5747162 - DNA, 20 bp, Homo sapiens
gagtccactttcctctctct

SEQ ID NO: 5747163 - DNA, 21 bp, Homo sapiens
gagtccactttcctctctctc

SEQ ID NO: 5747164 - DNA, 13 bp, Homo sapiens
gagtccagacccc

SEQ ID NO: 5747165 - DNA, 22 bp, Homo sapiens
gagtccagaccccccagcccct

SEQ ID NO: 5747166 - DNA, 15 bp, Homo sapiens
gagtccagcccctcc

SEQ ID NO: 5747167 - DNA, 21 bp, Homo sapiens
gagtccagcccctcctccctc

SEQ ID NO: 5747168 - DNA, 13 bp, Homo sapiens
gagtccagctccc

SEQ ID NO: 5747169 - DNA, 15 bp, Homo sapiens
gagtccagctccccc

SEQ ID NO: 5747170 - DNA, 15 bp, Homo sapiens
gagtccaggagctca

SEQ ID NO: 5747171 - DNA, 18 bp, Homo sapiens
gagtccaggagctcagga

SEQ ID NO: 5747172 - DNA, 13 bp, Homo sapiens
gagtccaggcccc

SEQ ID NO: 5747173 - DNA, 16 bp, Homo sapiens
gagtccaggcccccag

SEQ ID NO: 5747174 - DNA, 16 bp, Homo sapiens
gagtccaggcctgggt

SEQ ID NO: 5747175 - DNA, 23 bp, Homo sapiens
gagtccagggtttctctgcagat

SEQ ID NO: 5747176 - DNA, 17 bp, Homo sapiens
gagtccaggtaaatggt

SEQ ID NO: 5747177 - DNA, 13 bp, Homo sapiens
gagtccagtctct

SEQ ID NO: 5747178 - DNA, 21 bp, Homo sapiens
gagtccagtgctctgcctcag

SEQ ID NO: 5747179 - DNA, 22 bp, Homo sapiens
gagtccagtgctctgcctcaga

SEQ ID NO: 5747180 - DNA, 13 bp, Homo sapiens
gagtccagtgtgg

SEQ ID NO: 5747181 - DNA, 15 bp, Homo sapiens
gagtccatcagcctc

SEQ ID NO: 5747182 - DNA, 18 bp, Homo sapiens
gagtccattctcccaggt

SEQ ID NO: 5747183 - DNA, 20 bp, Homo sapiens
gagtccattctcccaggtac

SEQ ID NO: 5747184 - DNA, 15 bp, Homo sapiens
gagtcccacccggac

SEQ ID NO: 5747185 - DNA, 18 bp, Homo sapiens
gagtcccacccggacagg

SEQ ID NO: 5747186 - DNA, 12 bp, Homo sapiens
gagtcccacctt

SEQ ID NO: 5747187 - DNA, 20 bp, Homo sapiens
gagtcccaccttggctgcag

SEQ ID NO: 5747188 - DNA, 21 bp, Homo sapiens
gagtcccagagcaggaggccc

SEQ ID NO: 5747189 - DNA, 23 bp, Homo sapiens
gagtcccagagcaggaggcccct

SEQ ID NO: 5747190 - DNA, 19 bp, Homo sapiens
gagtcccaggagctgccca

SEQ ID NO: 5747191 - DNA, 22 bp, Homo sapiens
gagtcccaggggcagccacacc

SEQ ID NO: 5747192 - DNA, 23 bp, Homo sapiens
gagtcccaggggcagccacacca

SEQ ID NO: 5747193 - DNA, 21 bp, Homo sapiens
gagtcccaggttggctctgcc

SEQ ID NO: 5747194 - DNA, 13 bp, Homo sapiens
gagtccccccacc

SEQ ID NO: 5747195 - DNA, 14 bp, Homo sapiens
gagtccccccaccc

SEQ ID NO: 5747196 - DNA, 20 bp, Homo sapiens
gagtccccgggcatctttgg

SEQ ID NO: 5747197 - DNA, 17 bp, Homo sapiens
gagtccccggggttccc

SEQ ID NO: 5747198 - DNA, 22 bp, Homo sapiens
gagtcccctactcccctgatcc

SEQ ID NO: 5747199 - DNA, 18 bp, Homo sapiens
gagtcccctactccctct

SEQ ID NO: 5747200 - DNA, 24 bp, Homo sapiens
gagtccctatagtttcaccactcc

SEQ ID NO: 5747201 - DNA, 16 bp, Homo sapiens
gagtccctccaaaggg

SEQ ID NO: 5747202 - DNA, 21 bp, Homo sapiens
gagtccctcctcccccacgcc

SEQ ID NO: 5747203 - DNA, 23 bp, Homo sapiens
gagtccctcctcccccacgcctc

SEQ ID NO: 5747204 - DNA, 23 bp, Homo sapiens
gagtccctgcctggaccagcctc

SEQ ID NO: 5747205 - DNA, 14 bp, Homo sapiens
gagtccctggcaag

SEQ ID NO: 5747206 - DNA, 21 bp, Homo sapiens
gagtcccttaatcttatgggg

SEQ ID NO: 5747207 - DNA, 14 bp, Homo sapiens
gagtcccttccagg

SEQ ID NO: 5747208 - DNA, 18 bp, Homo sapiens
gagtccctttgaagataa

SEQ ID NO: 5747209 - DNA, 15 bp, Homo sapiens
gagtccgcccatccc

SEQ ID NO: 5747210 - DNA, 14 bp, Homo sapiens
gagtccggatttct

SEQ ID NO: 5747211 - DNA, 23 bp, Homo sapiens
gagtccgtactcggcttcctgtg

SEQ ID NO: 5747212 - DNA, 21 bp, Homo sapiens
gagtcctacagtggctgtcac

SEQ ID NO: 5747213 - DNA, 16 bp, Homo sapiens
gagtcctacagtgtca

SEQ ID NO: 5747214 - DNA, 17 bp, Homo sapiens
gagtcctagagctacag

SEQ ID NO: 5747215 - DNA, 11 bp, Homo sapiens
gagtcctcagg

SEQ ID NO: 5747216 - DNA, 12 bp, Homo sapiens
gagtcctcaggt

SEQ ID NO: 5747217 - DNA, 22 bp, Homo sapiens
gagtcctcattgttcagaaaag

SEQ ID NO: 5747218 - DNA, 14 bp, Homo sapiens
gagtcctccacccc

SEQ ID NO: 5747219 - DNA, 17 bp, Homo sapiens
gagtcctccttcccagc

SEQ ID NO: 5747220 - DNA, 17 bp, Homo sapiens
gagtcctctagcaggcc

SEQ ID NO: 5747221 - DNA, 12 bp, Homo sapiens
gagtcctctgga

SEQ ID NO: 5747222 - DNA, 15 bp, Homo sapiens
gagtcctgaggcaga

SEQ ID NO: 5747223 - DNA, 22 bp, Homo sapiens
gagtcctgccgacggagccact

SEQ ID NO: 5747224 - DNA, 13 bp, Homo sapiens
gagtcctgggagc

SEQ ID NO: 5747225 - DNA, 15 bp, Homo sapiens
gagtcctgggagccc

SEQ ID NO: 5747226 - DNA, 11 bp, Homo sapiens
gagtcctgggg

SEQ ID NO: 5747227 - DNA, 23 bp, Homo sapiens
gagtcctggtccctctgaggcag

SEQ ID NO: 5747228 - DNA, 22 bp, Homo sapiens
gagtcctggtttcctggcagcc

SEQ ID NO: 5747229 - DNA, 13 bp, Homo sapiens
gagtcctgtctct

SEQ ID NO: 5747230 - DNA, 17 bp, Homo sapiens
gagtcctgtctctgcct

SEQ ID NO: 5747231 - DNA, 18 bp, Homo sapiens
gagtcctgtctctgcctg

SEQ ID NO: 5747232 - DNA, 18 bp, Homo sapiens
gagtccttaaacagggca

SEQ ID NO: 5747233 - DNA, 17 bp, Homo sapiens
gagtccttagcctgggc

SEQ ID NO: 5747234 - DNA, 19 bp, Homo sapiens
gagtccttagcctgggcct

SEQ ID NO: 5747235 - DNA, 14 bp, Homo sapiens
gagtcgaggacagg

SEQ ID NO: 5747236 - DNA, 16 bp, Homo sapiens
gagtcgaggacaggga

SEQ ID NO: 5747237 - DNA, 13 bp, Homo sapiens
gagtcggaagggc

SEQ ID NO: 5747238 - DNA, 20 bp, Homo sapiens
gagtcggagtggacaccgct

SEQ ID NO: 5747239 - DNA, 23 bp, Homo sapiens
gagtcggctgggcagggccgcag

SEQ ID NO: 5747240 - DNA, 20 bp, Homo sapiens
gagtcgtcactctctattgt

SEQ ID NO: 5747241 - DNA, 23 bp, Homo sapiens
gagtcgtcatcacttttcagtga

SEQ ID NO: 5747242 - DNA, 11 bp, Homo sapiens
gagtctaaaga

SEQ ID NO: 5747243 - DNA, 13 bp, Homo sapiens
gagtctaaagatg

SEQ ID NO: 5747244 - DNA, 21 bp, Homo sapiens
gagtctagaacatccttaaat

SEQ ID NO: 5747245 - DNA, 20 bp, Homo sapiens
gagtctagaagttgtttgtc

SEQ ID NO: 5747246 - DNA, 15 bp, Homo sapiens
gagtctagatacaga

SEQ ID NO: 5747247 - DNA, 20 bp, Homo sapiens
gagtctagatacagaagccc

SEQ ID NO: 5747248 - DNA, 23 bp, Homo sapiens
gagtctagatacagaagcccatg

SEQ ID NO: 5747249 - DNA, 11 bp, Homo sapiens
gagtctagatg

SEQ ID NO: 5747250 - DNA, 14 bp, Homo sapiens
gagtctagattctc

SEQ ID NO: 5747251 - DNA, 20 bp, Homo sapiens
gagtctagcactcattttct

SEQ ID NO: 5747252 - DNA, 17 bp, Homo sapiens
gagtctatgttcaaaga

SEQ ID NO: 5747253 - DNA, 21 bp, Homo sapiens
gagtctatttacggaactcaa

SEQ ID NO: 5747254 - DNA, 12 bp, Homo sapiens
gagtctcaataa

SEQ ID NO: 5747255 - DNA, 22 bp, Homo sapiens
gagtctcactgttgcccaggct

SEQ ID NO: 5747256 - DNA, 23 bp, Homo sapiens
gagtctcactgttgcccaggctg

SEQ ID NO: 5747257 - DNA, 14 bp, Homo sapiens
gagtctcaggagga

SEQ ID NO: 5747258 - DNA, 19 bp, Homo sapiens
gagtctcaggaggaggctg

SEQ ID NO: 5747259 - DNA, 22 bp, Homo sapiens
gagtctcccactgcaacttgtg

SEQ ID NO: 5747260 - DNA, 21 bp, Homo sapiens
gagtctccctccgactccaga

SEQ ID NO: 5747261 - DNA, 17 bp, Homo sapiens
gagtctcctcactgcca

SEQ ID NO: 5747262 - DNA, 12 bp, Homo sapiens
gagtctcctgtg

SEQ ID NO: 5747263 - DNA, 19 bp, Homo sapiens
gagtctccttctcttctct

SEQ ID NO: 5747264 - DNA, 15 bp, Homo sapiens
gagtctcgctctgct

SEQ ID NO: 5747265 - DNA, 22 bp, Homo sapiens
gagtctcgctctgtcgcccagg

SEQ ID NO: 5747266 - DNA, 18 bp, Homo sapiens
gagtctctatttcacaat

SEQ ID NO: 5747267 - DNA, 11 bp, Homo sapiens
gagtctctcca

SEQ ID NO: 5747268 - DNA, 14 bp, Homo sapiens
gagtctctccagcc

SEQ ID NO: 5747269 - DNA, 14 bp, Homo sapiens
gagtctctgccacc

SEQ ID NO: 5747270 - DNA, 14 bp, Homo sapiens
gagtctctgccagt

SEQ ID NO: 5747271 - DNA, 19 bp, Homo sapiens
gagtctctggctcagctgt

SEQ ID NO: 5747272 - DNA, 12 bp, Homo sapiens
gagtctcttctc

SEQ ID NO: 5747273 - DNA, 16 bp, Homo sapiens
gagtctcttctccact

SEQ ID NO: 5747274 - DNA, 18 bp, Homo sapiens
gagtctcttctccactgg

SEQ ID NO: 5747275 - DNA, 20 bp, Homo sapiens
gagtctgaaatggggctact

SEQ ID NO: 5747276 - DNA, 19 bp, Homo sapiens
gagtctgaaccaatagaaa

SEQ ID NO: 5747277 - DNA, 22 bp, Homo sapiens
gagtctgaaccaatagaaagca

SEQ ID NO: 5747278 - DNA, 15 bp, Homo sapiens
gagtctgaagcagat

SEQ ID NO: 5747279 - DNA, 19 bp, Homo sapiens
gagtctgaaggagaggagt

SEQ ID NO: 5747280 - DNA, 12 bp, Homo sapiens
gagtctgaaggc

SEQ ID NO: 5747281 - DNA, 21 bp, Homo sapiens
gagtctgaaggctgggttctg

SEQ ID NO: 5747282 - DNA, 21 bp, Homo sapiens
gagtctgaccctttaatccaa

SEQ ID NO: 5747283 - DNA, 13 bp, Homo sapiens
gagtctgagcccc

SEQ ID NO: 5747284 - DNA, 20 bp, Homo sapiens
gagtctgagggcttgtagtt

SEQ ID NO: 5747285 - DNA, 22 bp, Homo sapiens
gagtctgaggtcctgagcactg

SEQ ID NO: 5747286 - DNA, 14 bp, Homo sapiens
gagtctgagtctga

SEQ ID NO: 5747287 - DNA, 18 bp, Homo sapiens
gagtctgagtctgagtcc

SEQ ID NO: 5747288 - DNA, 16 bp, Homo sapiens
gagtctgattgcagga

SEQ ID NO: 5747289 - DNA, 11 bp, Homo sapiens
gagtctgcaca

SEQ ID NO: 5747290 - DNA, 15 bp, Homo sapiens
gagtctgcataaact

SEQ ID NO: 5747291 - DNA, 13 bp, Homo sapiens
gagtctgccaggg

SEQ ID NO: 5747292 - DNA, 23 bp, Homo sapiens
gagtctgccccacatgtggccat

SEQ ID NO: 5747293 - DNA, 13 bp, Homo sapiens
gagtctgcttgtc

SEQ ID NO: 5747294 - DNA, 18 bp, Homo sapiens
gagtctgcttgtcttaga

SEQ ID NO: 5747295 - DNA, 17 bp, Homo sapiens
gagtctggacctccatc

SEQ ID NO: 5747296 - DNA, 21 bp, Homo sapiens
gagtctggacctccatccctg

SEQ ID NO: 5747297 - DNA, 13 bp, Homo sapiens
gagtctggacttt

SEQ ID NO: 5747298 - DNA, 14 bp, Homo sapiens
gagtctggagtggg

SEQ ID NO: 5747299 - DNA, 18 bp, Homo sapiens
gagtctggccctagactc

SEQ ID NO: 5747300 - DNA, 15 bp, Homo sapiens
gagtctggcctgcca

SEQ ID NO: 5747301 - DNA, 13 bp, Homo sapiens
gagtctgggcctc

SEQ ID NO: 5747302 - DNA, 20 bp, Homo sapiens
gagtctgggtccatcctggt

SEQ ID NO: 5747303 - DNA, 20 bp, Homo sapiens
gagtctggtggaggagctga

SEQ ID NO: 5747304 - DNA, 21 bp, Homo sapiens
gagtctgtcctggaaccaggc

SEQ ID NO: 5747305 - DNA, 12 bp, Homo sapiens
gagtctgtctct

SEQ ID NO: 5747306 - DNA, 15 bp, Homo sapiens
gagtctgtctctgtc

SEQ ID NO: 5747307 - DNA, 12 bp, Homo sapiens
gagtctgtggac

SEQ ID NO: 5747308 - DNA, 20 bp, Homo sapiens
gagtctgtgtggccagcagc

SEQ ID NO: 5747309 - DNA, 23 bp, Homo sapiens
gagtctgtgtgtagccaggaagc

SEQ ID NO: 5747310 - DNA, 20 bp, Homo sapiens
gagtctgtgttgtgtcctga

SEQ ID NO: 5747311 - DNA, 20 bp, Homo sapiens
gagtctgttgtgtgtcatgc

SEQ ID NO: 5747312 - DNA, 18 bp, Homo sapiens
gagtctgtttcccaagct

SEQ ID NO: 5747313 - DNA, 16 bp, Homo sapiens
gagtctgttttgtaaa

SEQ ID NO: 5747314 - DNA, 22 bp, Homo sapiens
gagtcttaactgtatttcagta

SEQ ID NO: 5747315 - DNA, 15 bp, Homo sapiens
gagtcttaattttct

SEQ ID NO: 5747316 - DNA, 16 bp, Homo sapiens
gagtcttaattttcta

SEQ ID NO: 5747317 - DNA, 14 bp, Homo sapiens
gagtcttcacattt

SEQ ID NO: 5747318 - DNA, 15 bp, Homo sapiens
gagtcttcagaccca

SEQ ID NO: 5747319 - DNA, 20 bp, Homo sapiens
gagtcttccaggtgcctggc

SEQ ID NO: 5747320 - DNA, 15 bp, Homo sapiens
gagtcttcctgtagt

SEQ ID NO: 5747321 - DNA, 13 bp, Homo sapiens
gagtcttgctctg

SEQ ID NO: 5747322 - DNA, 16 bp, Homo sapiens
gagtcttgctctgtct

SEQ ID NO: 5747323 - DNA, 21 bp, Homo sapiens
gagtcttggcctgcctcccag

SEQ ID NO: 5747324 - DNA, 23 bp, Homo sapiens
gagtcttggttctaaaggtacca

SEQ ID NO: 5747325 - DNA, 20 bp, Homo sapiens
gagtctttgagactaaattc

SEQ ID NO: 5747326 - DNA, 23 bp, Homo sapiens
gagtctttgtaagtaaactgccc

SEQ ID NO: 5747327 - DNA, 20 bp, Homo sapiens
gagtctttgtaatgcttgta

SEQ ID NO: 5747328 - DNA, 15 bp, Homo sapiens
gagtgaaaaagagaa

SEQ ID NO: 5747329 - DNA, 18 bp, Homo sapiens
gagtgaaacagagaaaga

SEQ ID NO: 5747330 - DNA, 21 bp, Homo sapiens
gagtgaaacctttagggcagc

SEQ ID NO: 5747331 - DNA, 23 bp, Homo sapiens
gagtgaaacctttagggcagctt

SEQ ID NO: 5747332 - DNA, 13 bp, Homo sapiens
gagtgaaatatta

SEQ ID NO: 5747333 - DNA, 22 bp, Homo sapiens
gagtgaacaaatttacagagac

SEQ ID NO: 5747334 - DNA, 15 bp, Homo sapiens
gagtgaaccatcatt

SEQ ID NO: 5747335 - DNA, 17 bp, Homo sapiens
gagtgaagaggggcagc

SEQ ID NO: 5747336 - DNA, 18 bp, Homo sapiens
gagtgaagaggggcagcc

SEQ ID NO: 5747337 - DNA, 21 bp, Homo sapiens
gagtgaagcatttaaaagagt

SEQ ID NO: 5747338 - DNA, 17 bp, Homo sapiens
gagtgaagtattgctga

SEQ ID NO: 5747339 - DNA, 15 bp, Homo sapiens
gagtgaataaatgtc

SEQ ID NO: 5747340 - DNA, 18 bp, Homo sapiens
gagtgaatacactggaat

SEQ ID NO: 5747341 - DNA, 15 bp, Homo sapiens
gagtgaatagctttc

SEQ ID NO: 5747342 - DNA, 17 bp, Homo sapiens
gagtgaatcaaagtgtc

SEQ ID NO: 5747343 - DNA, 18 bp, Homo sapiens
gagtgaatgtaatagtct

SEQ ID NO: 5747344 - DNA, 15 bp, Homo sapiens
gagtgaatgtggcag

SEQ ID NO: 5747345 - DNA, 12 bp, Homo sapiens
gagtgaatgtta

SEQ ID NO: 5747346 - DNA, 18 bp, Homo sapiens
gagtgaattccctcactc

SEQ ID NO: 5747347 - DNA, 20 bp, Homo sapiens
gagtgacacccaagagggct

SEQ ID NO: 5747348 - DNA, 21 bp, Homo sapiens
gagtgacacccaagagggctg

SEQ ID NO: 5747349 - DNA, 16 bp, Homo sapiens
gagtgacagaggcagc

SEQ ID NO: 5747350 - DNA, 17 bp, Homo sapiens
gagtgacagaggcagcc

SEQ ID NO: 5747351 - DNA, 20 bp, Homo sapiens
gagtgacagaggcagcccca

SEQ ID NO: 5747352 - DNA, 21 bp, Homo sapiens
gagtgacagctttctgggatg

SEQ ID NO: 5747353 - DNA, 23 bp, Homo sapiens
gagtgacagctttctgggatgtc

SEQ ID NO: 5747354 - DNA, 19 bp, Homo sapiens
gagtgacagtggattgcat

SEQ ID NO: 5747355 - DNA, 19 bp, Homo sapiens
gagtgacatcggttcagga

SEQ ID NO: 5747356 - DNA, 22 bp, Homo sapiens
gagtgacatcggttcaggagga

SEQ ID NO: 5747357 - DNA, 16 bp, Homo sapiens
gagtgacatgaagcat

SEQ ID NO: 5747358 - DNA, 23 bp, Homo sapiens
gagtgacatgggtgtgccaggct

SEQ ID NO: 5747359 - DNA, 18 bp, Homo sapiens
gagtgaccctcagctgtc

SEQ ID NO: 5747360 - DNA, 19 bp, Homo sapiens
gagtgaccctcagctgtca

SEQ ID NO: 5747361 - DNA, 17 bp, Homo sapiens
gagtgaccgggcactgg

SEQ ID NO: 5747362 - DNA, 21 bp, Homo sapiens
gagtgaccgggggctgctggg

SEQ ID NO: 5747363 - DNA, 21 bp, Homo sapiens
gagtgacctccttctgcaaag

SEQ ID NO: 5747364 - DNA, 23 bp, Homo sapiens
gagtgacctccttctgcaaagtg

SEQ ID NO: 5747365 - DNA, 18 bp, Homo sapiens
gagtgacctcggacagag

SEQ ID NO: 5747366 - DNA, 19 bp, Homo sapiens
gagtgacctcggacagagc

SEQ ID NO: 5747367 - DNA, 20 bp, Homo sapiens
gagtgaccttttaatcagag

SEQ ID NO: 5747368 - DNA, 20 bp, Homo sapiens
gagtgacggtcccacactgg

SEQ ID NO: 5747369 - DNA, 15 bp, Homo sapiens
gagtgactcgagggt

SEQ ID NO: 5747370 - DNA, 21 bp, Homo sapiens
gagtgactcggtgtaaaacca

SEQ ID NO: 5747371 - DNA, 12 bp, Homo sapiens
gagtgactctgg

SEQ ID NO: 5747372 - DNA, 21 bp, Homo sapiens
gagtgactgtaggcagggaac

SEQ ID NO: 5747373 - DNA, 14 bp, Homo sapiens
gagtgagaatctgg

SEQ ID NO: 5747374 - DNA, 14 bp, Homo sapiens
gagtgagacagact

SEQ ID NO: 5747375 - DNA, 17 bp, Homo sapiens
gagtgagacaggctggg

SEQ ID NO: 5747376 - DNA, 22 bp, Homo sapiens
gagtgagacccagccctcatcc

SEQ ID NO: 5747377 - DNA, 14 bp, Homo sapiens
gagtgagacccagg

SEQ ID NO: 5747378 - DNA, 18 bp, Homo sapiens
gagtgagactccacctca

SEQ ID NO: 5747379 - DNA, 12 bp, Homo sapiens
gagtgagactga

SEQ ID NO: 5747380 - DNA, 22 bp, Homo sapiens
gagtgagagagagtgagagcac

SEQ ID NO: 5747381 - DNA, 15 bp, Homo sapiens
gagtgagagcacaaa

SEQ ID NO: 5747382 - DNA, 15 bp, Homo sapiens
gagtgagaggccccc

SEQ ID NO: 5747383 - DNA, 19 bp, Homo sapiens
gagtgagaggcccccaccc

SEQ ID NO: 5747384 - DNA, 19 bp, Homo sapiens
gagtgagatgtagaaagtt

SEQ ID NO: 5747385 - DNA, 18 bp, Homo sapiens
gagtgagcaagggggccc

SEQ ID NO: 5747386 - DNA, 19 bp, Homo sapiens
gagtgagcacacccgtgtg

SEQ ID NO: 5747387 - DNA, 21 bp, Homo sapiens
gagtgagcacacccgtgtgca

SEQ ID NO: 5747388 - DNA, 12 bp, Homo sapiens
gagtgagcagct

SEQ ID NO: 5747389 - DNA, 13 bp, Homo sapiens
gagtgagccagtg

SEQ ID NO: 5747390 - DNA, 17 bp, Homo sapiens
gagtgagcccttctctg

SEQ ID NO: 5747391 - DNA, 21 bp, Homo sapiens
gagtgagcccttctctgtgtt

SEQ ID NO: 5747392 - DNA, 22 bp, Homo sapiens
gagtgaggaatagttgagcccc

SEQ ID NO: 5747393 - DNA, 20 bp, Homo sapiens
gagtgaggcttccaggctct

SEQ ID NO: 5747394 - DNA, 16 bp, Homo sapiens
gagtgagggcctcaga

SEQ ID NO: 5747395 - DNA, 22 bp, Homo sapiens
gagtgagggcctcagagcctga

SEQ ID NO: 5747396 - DNA, 13 bp, Homo sapiens
gagtgagggcctg

SEQ ID NO: 5747397 - DNA, 14 bp, Homo sapiens
gagtgagtcacctg

SEQ ID NO: 5747398 - DNA, 16 bp, Homo sapiens
gagtgagtcacctgct

SEQ ID NO: 5747399 - DNA, 22 bp, Homo sapiens
gagtgagtcacctgctccagaa

SEQ ID NO: 5747400 - DNA, 19 bp, Homo sapiens
gagtgagtcagtgatgagg

SEQ ID NO: 5747401 - DNA, 14 bp, Homo sapiens
gagtgagtggccct

SEQ ID NO: 5747402 - DNA, 23 bp, Homo sapiens
gagtgataataggggattttaaa

SEQ ID NO: 5747403 - DNA, 21 bp, Homo sapiens
gagtgataatctggtgacaaa

SEQ ID NO: 5747404 - DNA, 15 bp, Homo sapiens
gagtgatagctactg

SEQ ID NO: 5747405 - DNA, 15 bp, Homo sapiens
gagtgatatggagca

SEQ ID NO: 5747406 - DNA, 17 bp, Homo sapiens
gagtgatatggagcaag

SEQ ID NO: 5747407 - DNA, 23 bp, Homo sapiens
gagtgatcctcccgccccagcct

SEQ ID NO: 5747408 - DNA, 21 bp, Homo sapiens
gagtgatctcagctcactgca

SEQ ID NO: 5747409 - DNA, 15 bp, Homo sapiens
gagtgatgggcaagg

SEQ ID NO: 5747410 - DNA, 15 bp, Homo sapiens
gagtgatggtgtcct

SEQ ID NO: 5747411 - DNA, 13 bp, Homo sapiens
gagtgattaagaa

SEQ ID NO: 5747412 - DNA, 17 bp, Homo sapiens
gagtgatttccatctct

SEQ ID NO: 5747413 - DNA, 22 bp, Homo sapiens
gagtgcaaatccatagcacaag

SEQ ID NO: 5747414 - DNA, 16 bp, Homo sapiens
gagtgcaacagtagca

SEQ ID NO: 5747415 - DNA, 20 bp, Homo sapiens
gagtgcaagagcctgagact

SEQ ID NO: 5747416 - DNA, 15 bp, Homo sapiens
gagtgcacagctgtc

SEQ ID NO: 5747417 - DNA, 14 bp, Homo sapiens
gagtgcaccaaaga

SEQ ID NO: 5747418 - DNA, 17 bp, Homo sapiens
gagtgcacctgcctcca

SEQ ID NO: 5747419 - DNA, 22 bp, Homo sapiens
gagtgcacctgcctccaccagc

SEQ ID NO: 5747420 - DNA, 17 bp, Homo sapiens
gagtgcactgctccctg

SEQ ID NO: 5747421 - DNA, 13 bp, Homo sapiens
gagtgcagagaaa

SEQ ID NO: 5747422 - DNA, 16 bp, Homo sapiens
gagtgcagagaaagaa

SEQ ID NO: 5747423 - DNA, 20 bp, Homo sapiens
gagtgcagaggctgagcagg

SEQ ID NO: 5747424 - DNA, 17 bp, Homo sapiens
gagtgcagatctgtgct

SEQ ID NO: 5747425 - DNA, 13 bp, Homo sapiens
gagtgcagccaaa

SEQ ID NO: 5747426 - DNA, 20 bp, Homo sapiens
gagtgcagccaaaggggagc

SEQ ID NO: 5747427 - DNA, 22 bp, Homo sapiens
gagtgcagccaaaggggagcca

SEQ ID NO: 5747428 - DNA, 23 bp, Homo sapiens
gagtgcagccgtttgagaagaaa

SEQ ID NO: 5747429 - DNA, 18 bp, Homo sapiens
gagtgcaggcccaccctg

SEQ ID NO: 5747430 - DNA, 18 bp, Homo sapiens
gagtgcaggtttctattg

SEQ ID NO: 5747431 - DNA, 23 bp, Homo sapiens
gagtgcagtagtaattgatttga

SEQ ID NO: 5747432 - DNA, 14 bp, Homo sapiens
gagtgcagtcctga

SEQ ID NO: 5747433 - DNA, 18 bp, Homo sapiens
gagtgcagtcctgatcag

SEQ ID NO: 5747434 - DNA, 22 bp, Homo sapiens
gagtgcagtcctgatcagagcc

SEQ ID NO: 5747435 - DNA, 13 bp, Homo sapiens
gagtgcagtgagc

SEQ ID NO: 5747436 - DNA, 13 bp, Homo sapiens
gagtgcagtggcg

SEQ ID NO: 5747437 - DNA, 14 bp, Homo sapiens
gagtgcagtggctc

SEQ ID NO: 5747438 - DNA, 18 bp, Homo sapiens
gagtgcatggccacagcc

SEQ ID NO: 5747439 - DNA, 20 bp, Homo sapiens
gagtgcatggccacagccac

SEQ ID NO: 5747440 - DNA, 18 bp, Homo sapiens
gagtgccaacttctttca

SEQ ID NO: 5747441 - DNA, 19 bp, Homo sapiens
gagtgccacgtggccgctg

SEQ ID NO: 5747442 - DNA, 12 bp, Homo sapiens
gagtgccaggac

SEQ ID NO: 5747443 - DNA, 15 bp, Homo sapiens
gagtgccaggaccag

SEQ ID NO: 5747444 - DNA, 16 bp, Homo sapiens
gagtgccaggaccagc

SEQ ID NO: 5747445 - DNA, 18 bp, Homo sapiens
gagtgccaggaccagcct

SEQ ID NO: 5747446 - DNA, 13 bp, Homo sapiens
gagtgccaggact

SEQ ID NO: 5747447 - DNA, 22 bp, Homo sapiens
gagtgccaggactccccaggcc

SEQ ID NO: 5747448 - DNA, 20 bp, Homo sapiens
gagtgccataccttctccca

SEQ ID NO: 5747449 - DNA, 13 bp, Homo sapiens
gagtgccatggct

SEQ ID NO: 5747450 - DNA, 15 bp, Homo sapiens
gagtgccatggctgg

SEQ ID NO: 5747451 - DNA, 13 bp, Homo sapiens
gagtgccccactt

SEQ ID NO: 5747452 - DNA, 19 bp, Homo sapiens
gagtgcccccagcccagag

SEQ ID NO: 5747453 - DNA, 20 bp, Homo sapiens
gagtgcccccagcccagagc

SEQ ID NO: 5747454 - DNA, 21 bp, Homo sapiens
gagtgcccccagcccagagcc

SEQ ID NO: 5747455 - DNA, 14 bp, Homo sapiens
gagtgcccccggga

SEQ ID NO: 5747456 - DNA, 21 bp, Homo sapiens
gagtgcccctgtcccacctgg

SEQ ID NO: 5747457 - DNA, 22 bp, Homo sapiens
gagtgcccctgtcccacctggc

SEQ ID NO: 5747458 - DNA, 23 bp, Homo sapiens
gagtgcccctgtcccacctggct

SEQ ID NO: 5747459 - DNA, 17 bp, Homo sapiens
gagtgccctgctttgca

SEQ ID NO: 5747460 - DNA, 18 bp, Homo sapiens
gagtgccctgctttgcaa

SEQ ID NO: 5747461 - DNA, 22 bp, Homo sapiens
gagtgcccttaaaataatgatt

SEQ ID NO: 5747462 - DNA, 19 bp, Homo sapiens
gagtgccgcatctcacagc

SEQ ID NO: 5747463 - DNA, 15 bp, Homo sapiens
gagtgcctggagtca

SEQ ID NO: 5747464 - DNA, 14 bp, Homo sapiens
gagtgccttttgca

SEQ ID NO: 5747465 - DNA, 14 bp, Homo sapiens
gagtgcgctagagc

SEQ ID NO: 5747466 - DNA, 18 bp, Homo sapiens
gagtgcggaccaccctca

SEQ ID NO: 5747467 - DNA, 16 bp, Homo sapiens
gagtgcgggctgaggc

SEQ ID NO: 5747468 - DNA, 20 bp, Homo sapiens
gagtgcgggctgaggccaga

SEQ ID NO: 5747469 - DNA, 23 bp, Homo sapiens
gagtgcgggctgaggccagagtc

SEQ ID NO: 5747470 - DNA, 14 bp, Homo sapiens
gagtgcgtgctcag

SEQ ID NO: 5747471 - DNA, 17 bp, Homo sapiens
gagtgcgtgtgagaaga

SEQ ID NO: 5747472 - DNA, 15 bp, Homo sapiens
gagtgctaagagcct

SEQ ID NO: 5747473 - DNA, 19 bp, Homo sapiens
gagtgctaagagcctctgg

SEQ ID NO: 5747474 - DNA, 11 bp, Homo sapiens
gagtgctaagt

SEQ ID NO: 5747475 - DNA, 17 bp, Homo sapiens
gagtgctatgtgtgctt

SEQ ID NO: 5747476 - DNA, 23 bp, Homo sapiens
gagtgctcaacctacagtggagg

SEQ ID NO: 5747477 - DNA, 21 bp, Homo sapiens
gagtgctcttcccactccagc

SEQ ID NO: 5747478 - DNA, 22 bp, Homo sapiens
gagtgctcttcccactccagct

SEQ ID NO: 5747479 - DNA, 17 bp, Homo sapiens
gagtgctgattcaaacc

SEQ ID NO: 5747480 - DNA, 14 bp, Homo sapiens
gagtgctggactgt

SEQ ID NO: 5747481 - DNA, 19 bp, Homo sapiens
gagtgctggactgttccag

SEQ ID NO: 5747482 - DNA, 14 bp, Homo sapiens
gagtgctggcactt

SEQ ID NO: 5747483 - DNA, 14 bp, Homo sapiens
gagtgctggctcac

SEQ ID NO: 5747484 - DNA, 18 bp, Homo sapiens
gagtgctggctcacagta

SEQ ID NO: 5747485 - DNA, 21 bp, Homo sapiens
gagtgctggctcacagtacag

SEQ ID NO: 5747486 - DNA, 22 bp, Homo sapiens
gagtgctggctccacgccctgg

SEQ ID NO: 5747487 - DNA, 23 bp, Homo sapiens
gagtgctggctccacgccctggg

SEQ ID NO: 5747488 - DNA, 15 bp, Homo sapiens
gagtgctgggcactg

SEQ ID NO: 5747489 - DNA, 20 bp, Homo sapiens
gagtgctgggcactgctcca

SEQ ID NO: 5747490 - DNA, 16 bp, Homo sapiens
gagtgctgtcgggacc

SEQ ID NO: 5747491 - DNA, 19 bp, Homo sapiens
gagtgctgtcgggaccaca

SEQ ID NO: 5747492 - DNA, 18 bp, Homo sapiens
gagtgcttactctttgta

SEQ ID NO: 5747493 - DNA, 20 bp, Homo sapiens
gagtgcttgttagagagaaa

SEQ ID NO: 5747494 - DNA, 11 bp, Homo sapiens
gagtggaagga

SEQ ID NO: 5747495 - DNA, 19 bp, Homo sapiens
gagtggaaggactgtggct

SEQ ID NO: 5747496 - DNA, 15 bp, Homo sapiens
gagtggaagggagga

SEQ ID NO: 5747497 - DNA, 16 bp, Homo sapiens
gagtggaagggaggag

SEQ ID NO: 5747498 - DNA, 13 bp, Homo sapiens
gagtggaaggtga

SEQ ID NO: 5747499 - DNA, 13 bp, Homo sapiens
gagtggaatgcag

SEQ ID NO: 5747500 - DNA, 17 bp, Homo sapiens
gagtggaatgcagggaa

SEQ ID NO: 5747501 - DNA, 14 bp, Homo sapiens
gagtggacagcagc

SEQ ID NO: 5747502 - DNA, 22 bp, Homo sapiens
gagtggacagcagctggactgg

SEQ ID NO: 5747503 - DNA, 13 bp, Homo sapiens
gagtggaccacga

SEQ ID NO: 5747504 - DNA, 21 bp, Homo sapiens
gagtggacgctgtccattgcc

SEQ ID NO: 5747505 - DNA, 15 bp, Homo sapiens
gagtggactgcattt

SEQ ID NO: 5747506 - DNA, 17 bp, Homo sapiens
gagtggactggagtgga

SEQ ID NO: 5747507 - DNA, 20 bp, Homo sapiens
gagtggagagagcagggcta

SEQ ID NO: 5747508 - DNA, 15 bp, Homo sapiens
gagtggagcccaggg

SEQ ID NO: 5747509 - DNA, 17 bp, Homo sapiens
gagtggaggaggcctgg

SEQ ID NO: 5747510 - DNA, 10 bp, Homo sapiens
gagtggaggc

SEQ ID NO: 5747511 - DNA, 12 bp, Homo sapiens
gagtggaggcat

SEQ ID NO: 5747512 - DNA, 23 bp, Homo sapiens
gagtggagtctgagtctgagtcc

SEQ ID NO: 5747513 - DNA, 19 bp, Homo sapiens
gagtggagtctgccaccca

SEQ ID NO: 5747514 - DNA, 20 bp, Homo sapiens
gagtggagtctgccacccag

SEQ ID NO: 5747515 - DNA, 16 bp, Homo sapiens
gagtggataatcagga

SEQ ID NO: 5747516 - DNA, 20 bp, Homo sapiens
gagtggatagatgccctgct

SEQ ID NO: 5747517 - DNA, 18 bp, Homo sapiens
gagtggatctggagtctg

SEQ ID NO: 5747518 - DNA, 16 bp, Homo sapiens
gagtggattcctcccc

SEQ ID NO: 5747519 - DNA, 14 bp, Homo sapiens
gagtggcagcagcc

SEQ ID NO: 5747520 - DNA, 12 bp, Homo sapiens
gagtggcagcca

SEQ ID NO: 5747521 - DNA, 13 bp, Homo sapiens
gagtggcagccat

SEQ ID NO: 5747522 - DNA, 18 bp, Homo sapiens
gagtggcagcccagccag

SEQ ID NO: 5747523 - DNA, 20 bp, Homo sapiens
gagtggcagctgtcccctct

SEQ ID NO: 5747524 - DNA, 14 bp, Homo sapiens
gagtggcaggggac

SEQ ID NO: 5747525 - DNA, 17 bp, Homo sapiens
gagtggcaggtgggctg

SEQ ID NO: 5747526 - DNA, 18 bp, Homo sapiens
gagtggcaggtgggctgc

SEQ ID NO: 5747527 - DNA, 17 bp, Homo sapiens
gagtggcatctggggct

SEQ ID NO: 5747528 - DNA, 22 bp, Homo sapiens
gagtggcatcttctttgcatcc

SEQ ID NO: 5747529 - DNA, 16 bp, Homo sapiens
gagtggcatggtcctg

SEQ ID NO: 5747530 - DNA, 20 bp, Homo sapiens
gagtggcatggtcctgtgcc

SEQ ID NO: 5747531 - DNA, 23 bp, Homo sapiens
gagtggccaaataggagggagac

SEQ ID NO: 5747532 - DNA, 18 bp, Homo sapiens
gagtggccacggcccagg

SEQ ID NO: 5747533 - DNA, 20 bp, Homo sapiens
gagtggccacggcccaggga

SEQ ID NO: 5747534 - DNA, 20 bp, Homo sapiens
gagtggccagccagtgccat

SEQ ID NO: 5747535 - DNA, 16 bp, Homo sapiens
gagtggccagcgccag

SEQ ID NO: 5747536 - DNA, 19 bp, Homo sapiens
gagtggccagcgccagggc

SEQ ID NO: 5747537 - DNA, 19 bp, Homo sapiens
gagtggccatctggaaatc

SEQ ID NO: 5747538 - DNA, 19 bp, Homo sapiens
gagtggccccacctggccc

SEQ ID NO: 5747539 - DNA, 20 bp, Homo sapiens
gagtggccccacctggccct

SEQ ID NO: 5747540 - DNA, 23 bp, Homo sapiens
gagtggcccctcacctgggcctt

SEQ ID NO: 5747541 - DNA, 22 bp, Homo sapiens
gagtggccctttcggatccagg

SEQ ID NO: 5747542 - DNA, 17 bp, Homo sapiens
gagtggccggggaagct

SEQ ID NO: 5747543 - DNA, 11 bp, Homo sapiens
gagtggcctcc

SEQ ID NO: 5747544 - DNA, 19 bp, Homo sapiens
gagtggcctggccaggagc

SEQ ID NO: 5747545 - DNA, 20 bp, Homo sapiens
gagtggcctggccaggagct

SEQ ID NO: 5747546 - DNA, 13 bp, Homo sapiens
gagtggcctgggt

SEQ ID NO: 5747547 - DNA, 20 bp, Homo sapiens
gagtggcctgggtcccaggg

SEQ ID NO: 5747548 - DNA, 15 bp, Homo sapiens
gagtggcctgtgagc

SEQ ID NO: 5747549 - DNA, 22 bp, Homo sapiens
gagtggcctgtgagcaagagcc

SEQ ID NO: 5747550 - DNA, 20 bp, Homo sapiens
gagtggcgcgcgccaccacg

SEQ ID NO: 5747551 - DNA, 18 bp, Homo sapiens
gagtggcgtgagctgccc

SEQ ID NO: 5747552 - DNA, 21 bp, Homo sapiens
gagtggctcactggctgggag

SEQ ID NO: 5747553 - DNA, 22 bp, Homo sapiens
gagtggctcactggctgggagt

SEQ ID NO: 5747554 - DNA, 13 bp, Homo sapiens
gagtggctcccgt

SEQ ID NO: 5747555 - DNA, 15 bp, Homo sapiens
gagtggctcctcccg

SEQ ID NO: 5747556 - DNA, 14 bp, Homo sapiens
gagtggctcgtgtt

SEQ ID NO: 5747557 - DNA, 13 bp, Homo sapiens
gagtggctgacag

SEQ ID NO: 5747558 - DNA, 23 bp, Homo sapiens
gagtggctgacagagcaggtctg

SEQ ID NO: 5747559 - DNA, 13 bp, Homo sapiens
gagtggctggggc

SEQ ID NO: 5747560 - DNA, 23 bp, Homo sapiens
gagtggcttgtgattctgggatg

SEQ ID NO: 5747561 - DNA, 23 bp, Homo sapiens
gagtgggaagggagcattgcagc

SEQ ID NO: 5747562 - DNA, 19 bp, Homo sapiens
gagtgggacagacagcagc

SEQ ID NO: 5747563 - DNA, 20 bp, Homo sapiens
gagtgggacagacagcagct

SEQ ID NO: 5747564 - DNA, 22 bp, Homo sapiens
gagtgggacagacagcagctgg

SEQ ID NO: 5747565 - DNA, 23 bp, Homo sapiens
gagtgggacagacagcagctgga

SEQ ID NO: 5747566 - DNA, 18 bp, Homo sapiens
gagtgggacttggagagc

SEQ ID NO: 5747567 - DNA, 19 bp, Homo sapiens
gagtgggacttggagagca

SEQ ID NO: 5747568 - DNA, 19 bp, Homo sapiens
gagtgggagaaggcagtga

SEQ ID NO: 5747569 - DNA, 19 bp, Homo sapiens
gagtgggagaggctgggag

SEQ ID NO: 5747570 - DNA, 23 bp, Homo sapiens
gagtgggagagtacctgtgtgtt

SEQ ID NO: 5747571 - DNA, 15 bp, Homo sapiens
gagtgggcacctcag

SEQ ID NO: 5747572 - DNA, 12 bp, Homo sapiens
gagtgggcccaa

SEQ ID NO: 5747573 - DNA, 14 bp, Homo sapiens
gagtgggccccctc

SEQ ID NO: 5747574 - DNA, 19 bp, Homo sapiens
gagtgggccccgggctgga

SEQ ID NO: 5747575 - DNA, 20 bp, Homo sapiens
gagtgggccccgggctggag

SEQ ID NO: 5747576 - DNA, 22 bp, Homo sapiens
gagtgggccccgggctggagaa

SEQ ID NO: 5747577 - DNA, 21 bp, Homo sapiens
gagtgggccctgcccggggag

SEQ ID NO: 5747578 - DNA, 23 bp, Homo sapiens
gagtgggccctgcccggggagct

SEQ ID NO: 5747579 - DNA, 14 bp, Homo sapiens
gagtgggctgtagt

SEQ ID NO: 5747580 - DNA, 15 bp, Homo sapiens
gagtgggctttccag

SEQ ID NO: 5747581 - DNA, 15 bp, Homo sapiens
gagtggggcagcctc

SEQ ID NO: 5747582 - DNA, 13 bp, Homo sapiens
gagtggggcctgc

SEQ ID NO: 5747583 - DNA, 16 bp, Homo sapiens
gagtggggcctgccct

SEQ ID NO: 5747584 - DNA, 24 bp, Homo sapiens
gagtggggcctttgccagcagagc

SEQ ID NO: 5747585 - DNA, 20 bp, Homo sapiens
gagtggggctagactgggct

SEQ ID NO: 5747586 - DNA, 22 bp, Homo sapiens
gagtggggctagactgggctgg

SEQ ID NO: 5747587 - DNA, 14 bp, Homo sapiens
gagtggggcttcct

SEQ ID NO: 5747588 - DNA, 15 bp, Homo sapiens
gagtgggggaggggg

SEQ ID NO: 5747589 - DNA, 17 bp, Homo sapiens
gagtggggggaggaagc

SEQ ID NO: 5747590 - DNA, 17 bp, Homo sapiens
gagtggggtagaggaag

SEQ ID NO: 5747591 - DNA, 21 bp, Homo sapiens
gagtggggttatctctgtgtt

SEQ ID NO: 5747592 - DNA, 22 bp, Homo sapiens
gagtgggtaaatcagggacagg

SEQ ID NO: 5747593 - DNA, 15 bp, Homo sapiens
gagtgggtgacaaga

SEQ ID NO: 5747594 - DNA, 21 bp, Homo sapiens
gagtgggtgcgtggtatacat

SEQ ID NO: 5747595 - DNA, 15 bp, Homo sapiens
gagtgggtggaggca

SEQ ID NO: 5747596 - DNA, 17 bp, Homo sapiens
gagtgggtgggacacag

SEQ ID NO: 5747597 - DNA, 14 bp, Homo sapiens
gagtgggttttgtc

SEQ ID NO: 5747598 - DNA, 18 bp, Homo sapiens
gagtggtaaaaaagaaat

SEQ ID NO: 5747599 - DNA, 22 bp, Homo sapiens
gagtggtaacaagaggagcagg

SEQ ID NO: 5747600 - DNA, 21 bp, Homo sapiens
gagtggtaacagctctcttct

SEQ ID NO: 5747601 - DNA, 20 bp, Homo sapiens
gagtggtctcctctcagctt

SEQ ID NO: 5747602 - DNA, 14 bp, Homo sapiens
gagtggtctttctg

SEQ ID NO: 5747603 - DNA, 15 bp, Homo sapiens
gagtggtgcagacag

SEQ ID NO: 5747604 - DNA, 17 bp, Homo sapiens
gagtggtggttcctttg

SEQ ID NO: 5747605 - DNA, 15 bp, Homo sapiens
gagtggttcctgtgg

SEQ ID NO: 5747606 - DNA, 19 bp, Homo sapiens
gagtggtttttgctctagg

SEQ ID NO: 5747607 - DNA, 22 bp, Homo sapiens
gagtgtaaaatgtatattttta

SEQ ID NO: 5747608 - DNA, 15 bp, Homo sapiens
gagtgtaaataattt

SEQ ID NO: 5747609 - DNA, 19 bp, Homo sapiens
gagtgtaaataattttaaa

SEQ ID NO: 5747610 - DNA, 21 bp, Homo sapiens
gagtgtaacaagaaaggagag

SEQ ID NO: 5747611 - DNA, 14 bp, Homo sapiens
gagtgtaagtgtga

SEQ ID NO: 5747612 - DNA, 18 bp, Homo sapiens
gagtgtacttaactattc

SEQ ID NO: 5747613 - DNA, 20 bp, Homo sapiens
gagtgtagaagcattccttc

SEQ ID NO: 5747614 - DNA, 18 bp, Homo sapiens
gagtgtagcctaaagggc

SEQ ID NO: 5747615 - DNA, 20 bp, Homo sapiens
gagtgtagcctaaagggcag

SEQ ID NO: 5747616 - DNA, 18 bp, Homo sapiens
gagtgtagctgtgaaatc

SEQ ID NO: 5747617 - DNA, 19 bp, Homo sapiens
gagtgtagggggccttgcg

SEQ ID NO: 5747618 - DNA, 13 bp, Homo sapiens
gagtgtatgagta

SEQ ID NO: 5747619 - DNA, 13 bp, Homo sapiens
gagtgtatgcata

SEQ ID NO: 5747620 - DNA, 21 bp, Homo sapiens
gagtgtatgtagggcataatg

SEQ ID NO: 5747621 - DNA, 14 bp, Homo sapiens
gagtgtatgtatac

SEQ ID NO: 5747622 - DNA, 21 bp, Homo sapiens
gagtgtcaaacgtgcccccca

SEQ ID NO: 5747623 - DNA, 21 bp, Homo sapiens
gagtgtcaaccagacagaggg

SEQ ID NO: 5747624 - DNA, 14 bp, Homo sapiens
gagtgtcaggctct

SEQ ID NO: 5747625 - DNA, 16 bp, Homo sapiens
gagtgtcctgcccatg

SEQ ID NO: 5747626 - DNA, 19 bp, Homo sapiens
gagtgtcctgcccatgccc

SEQ ID NO: 5747627 - DNA, 17 bp, Homo sapiens
gagtgtcctggctgtga

SEQ ID NO: 5747628 - DNA, 18 bp, Homo sapiens
gagtgtcctgtctgctgg

SEQ ID NO: 5747629 - DNA, 20 bp, Homo sapiens
gagtgtccttcctctgtcct

SEQ ID NO: 5747630 - DNA, 23 bp, Homo sapiens
gagtgtccttgcaggggccggag

SEQ ID NO: 5747631 - DNA, 18 bp, Homo sapiens
gagtgtcggatcctgtga

SEQ ID NO: 5747632 - DNA, 19 bp, Homo sapiens
gagtgtcggatcctgtgag

SEQ ID NO: 5747633 - DNA, 17 bp, Homo sapiens
gagtgtctatggagcag

SEQ ID NO: 5747634 - DNA, 16 bp, Homo sapiens
gagtgtctctgcctgg

SEQ ID NO: 5747635 - DNA, 20 bp, Homo sapiens
gagtgtctctgcctggagca

SEQ ID NO: 5747636 - DNA, 17 bp, Homo sapiens
gagtgtctgcgccccgc

SEQ ID NO: 5747637 - DNA, 20 bp, Homo sapiens
gagtgtctgcgccccgcctc

SEQ ID NO: 5747638 - DNA, 18 bp, Homo sapiens
gagtgtctggaattgtgg

SEQ ID NO: 5747639 - DNA, 11 bp, Homo sapiens
gagtgtgaagg

SEQ ID NO: 5747640 - DNA, 18 bp, Homo sapiens
gagtgtgaatataaatgt

SEQ ID NO: 5747641 - DNA, 22 bp, Homo sapiens
gagtgtgaatataaatgtgtgt

SEQ ID NO: 5747642 - DNA, 11 bp, Homo sapiens
gagtgtgacag

SEQ ID NO: 5747643 - DNA, 18 bp, Homo sapiens
gagtgtgagccacctaag

SEQ ID NO: 5747644 - DNA, 21 bp, Homo sapiens
gagtgtgaggagagggtggca

SEQ ID NO: 5747645 - DNA, 15 bp, Homo sapiens
gagtgtgagggcagc

SEQ ID NO: 5747646 - DNA, 16 bp, Homo sapiens
gagtgtgagggcagca

SEQ ID NO: 5747647 - DNA, 18 bp, Homo sapiens
gagtgtgcaactggccag

SEQ ID NO: 5747648 - DNA, 15 bp, Homo sapiens
gagtgtgcaatatgt

SEQ ID NO: 5747649 - DNA, 13 bp, Homo sapiens
gagtgtgcagaca

SEQ ID NO: 5747650 - DNA, 14 bp, Homo sapiens
gagtgtgcagactg

SEQ ID NO: 5747651 - DNA, 21 bp, Homo sapiens
gagtgtgcgaatcaaacctga

SEQ ID NO: 5747652 - DNA, 20 bp, Homo sapiens
gagtgtgcgtgtgtgcatgt

SEQ ID NO: 5747653 - DNA, 14 bp, Homo sapiens
gagtgtgctcggga

SEQ ID NO: 5747654 - DNA, 12 bp, Homo sapiens
gagtgtgctgct

SEQ ID NO: 5747655 - DNA, 13 bp, Homo sapiens
gagtgtgctgcta

SEQ ID NO: 5747656 - DNA, 17 bp, Homo sapiens
gagtgtggctcccctct

SEQ ID NO: 5747657 - DNA, 16 bp, Homo sapiens
gagtgtggctgaggag

SEQ ID NO: 5747658 - DNA, 21 bp, Homo sapiens
gagtgtgtaatttaaaattgt

SEQ ID NO: 5747659 - DNA, 22 bp, Homo sapiens
gagtgtgtaatttaaaattgtg

SEQ ID NO: 5747660 - DNA, 16 bp, Homo sapiens
gagtgtgtattgttcc

SEQ ID NO: 5747661 - DNA, 17 bp, Homo sapiens
gagtgtgtattgttccc

SEQ ID NO: 5747662 - DNA, 17 bp, Homo sapiens
gagtgtgtcagagccca

SEQ ID NO: 5747663 - DNA, 18 bp, Homo sapiens
gagtgtgtcagagcccag

SEQ ID NO: 5747664 - DNA, 14 bp, Homo sapiens
gagtgtgtctgctg

SEQ ID NO: 5747665 - DNA, 16 bp, Homo sapiens
gagtgtgtggtctctg

SEQ ID NO: 5747666 - DNA, 10 bp, Homo sapiens
gagtgtgtgt

SEQ ID NO: 5747667 - DNA, 19 bp, Homo sapiens
gagtgtgtgtgtgtgtctg

SEQ ID NO: 5747668 - DNA, 17 bp, Homo sapiens
gagtgtgtttgtcaccg

SEQ ID NO: 5747669 - DNA, 23 bp, Homo sapiens
gagtgtgtttttgcactgtctgt

SEQ ID NO: 5747670 - DNA, 22 bp, Homo sapiens
gagtgttcattttagtgactgt

SEQ ID NO: 5747671 - DNA, 19 bp, Homo sapiens
gagtgttcccgtgcctggg

SEQ ID NO: 5747672 - DNA, 17 bp, Homo sapiens
gagtgttcctgagacag

SEQ ID NO: 5747673 - DNA, 13 bp, Homo sapiens
gagtgttcctgtg

SEQ ID NO: 5747674 - DNA, 14 bp, Homo sapiens
gagtgttctgggat

SEQ ID NO: 5747675 - DNA, 23 bp, Homo sapiens
gagtgttctgtgggcttggcctt

SEQ ID NO: 5747676 - DNA, 15 bp, Homo sapiens
gagtgtttaataaag

SEQ ID NO: 5747677 - DNA, 18 bp, Homo sapiens
gagtgtttctaataaact

SEQ ID NO: 5747678 - DNA, 18 bp, Homo sapiens
gagtgtttgaaaactgac

SEQ ID NO: 5747679 - DNA, 17 bp, Homo sapiens
gagtgtttgggggacgt

SEQ ID NO: 5747680 - DNA, 23 bp, Homo sapiens
gagtgtttgggggacgtttctca

SEQ ID NO: 5747681 - DNA, 13 bp, Homo sapiens
gagttaaaatgca

SEQ ID NO: 5747682 - DNA, 21 bp, Homo sapiens
gagttaaaatgtttactgtaa

SEQ ID NO: 5747683 - DNA, 22 bp, Homo sapiens
gagttaaatagagtatatgcac

SEQ ID NO: 5747684 - DNA, 20 bp, Homo sapiens
gagttaactgtgaaatacca

SEQ ID NO: 5747685 - DNA, 14 bp, Homo sapiens
gagttaagacctgg

SEQ ID NO: 5747686 - DNA, 14 bp, Homo sapiens
gagttacagttctg

SEQ ID NO: 5747687 - DNA, 15 bp, Homo sapiens
gagttacagttctgt

SEQ ID NO: 5747688 - DNA, 22 bp, Homo sapiens
gagttacttagaatgccataaa

SEQ ID NO: 5747689 - DNA, 18 bp, Homo sapiens
gagttacttgtctgaggc

SEQ ID NO: 5747690 - DNA, 16 bp, Homo sapiens
gagttagaataataaa

SEQ ID NO: 5747691 - DNA, 21 bp, Homo sapiens
gagttagaataataaatattt

SEQ ID NO: 5747692 - DNA, 22 bp, Homo sapiens
gagttagaataataaatattta

SEQ ID NO: 5747693 - DNA, 21 bp, Homo sapiens
gagttagactcaagggggtga

SEQ ID NO: 5747694 - DNA, 12 bp, Homo sapiens
gagttagactgt

SEQ ID NO: 5747695 - DNA, 18 bp, Homo sapiens
gagttagaggccagcctg

SEQ ID NO: 5747696 - DNA, 17 bp, Homo sapiens
gagttagatattatttt

SEQ ID NO: 5747697 - DNA, 19 bp, Homo sapiens
gagttagccaaacaacaac

SEQ ID NO: 5747698 - DNA, 19 bp, Homo sapiens
gagttagggactgaccagc

SEQ ID NO: 5747699 - DNA, 21 bp, Homo sapiens
gagttagggactgaccagcag

SEQ ID NO: 5747700 - DNA, 20 bp, Homo sapiens
gagttagggagagagaagca

SEQ ID NO: 5747701 - DNA, 19 bp, Homo sapiens
gagttaggttaataaatca

SEQ ID NO: 5747702 - DNA, 21 bp, Homo sapiens
gagttagtcgccctacagaaa

SEQ ID NO: 5747703 - DNA, 13 bp, Homo sapiens
gagttataaaaat

SEQ ID NO: 5747704 - DNA, 16 bp, Homo sapiens
gagttataaatatttt

SEQ ID NO: 5747705 - DNA, 15 bp, Homo sapiens
gagttatatgacttc

SEQ ID NO: 5747706 - DNA, 20 bp, Homo sapiens
gagttatatgacttcttgtt

SEQ ID NO: 5747707 - DNA, 23 bp, Homo sapiens
gagttatcatgaattttaaagta

SEQ ID NO: 5747708 - DNA, 16 bp, Homo sapiens
gagttatctaaaagaa

SEQ ID NO: 5747709 - DNA, 20 bp, Homo sapiens
gagttatcttctttattatt

SEQ ID NO: 5747710 - DNA, 22 bp, Homo sapiens
gagttatcttctttattattcc

SEQ ID NO: 5747711 - DNA, 16 bp, Homo sapiens
gagttattcaaatgaa

SEQ ID NO: 5747712 - DNA, 17 bp, Homo sapiens
gagttattcaaatgaag

SEQ ID NO: 5747713 - DNA, 21 bp, Homo sapiens
gagttattcactctcccagag

SEQ ID NO: 5747714 - DNA, 14 bp, Homo sapiens
gagttcaaatactt

SEQ ID NO: 5747715 - DNA, 17 bp, Homo sapiens
gagttcaagaccagcct

SEQ ID NO: 5747716 - DNA, 18 bp, Homo sapiens
gagttcaagcctgtggga

SEQ ID NO: 5747717 - DNA, 22 bp, Homo sapiens
gagttcaataaatgtctgttga

SEQ ID NO: 5747718 - DNA, 15 bp, Homo sapiens
gagttcaatgatcta

SEQ ID NO: 5747719 - DNA, 19 bp, Homo sapiens
gagttcaatgatctaggtt

SEQ ID NO: 5747720 - DNA, 15 bp, Homo sapiens
gagttcaatggctgc

SEQ ID NO: 5747721 - DNA, 20 bp, Homo sapiens
gagttcacaggaggccagtg

SEQ ID NO: 5747722 - DNA, 23 bp, Homo sapiens
gagttcacaggaggccagtgggc

SEQ ID NO: 5747723 - DNA, 18 bp, Homo sapiens
gagttcacatgtgccctg

SEQ ID NO: 5747724 - DNA, 19 bp, Homo sapiens
gagttcacatgtgccctgc

SEQ ID NO: 5747725 - DNA, 15 bp, Homo sapiens
gagttcaccatctct

SEQ ID NO: 5747726 - DNA, 17 bp, Homo sapiens
gagttcagggaggggct

SEQ ID NO: 5747727 - DNA, 21 bp, Homo sapiens
gagttcagggaggggctgagt

SEQ ID NO: 5747728 - DNA, 21 bp, Homo sapiens
gagttcaggtagctgcccctg

SEQ ID NO: 5747729 - DNA, 22 bp, Homo sapiens
gagttcaggtagctgcccctgg

SEQ ID NO: 5747730 - DNA, 16 bp, Homo sapiens
gagttcagtatttaat

SEQ ID NO: 5747731 - DNA, 20 bp, Homo sapiens
gagttcatactgatgccctg

SEQ ID NO: 5747732 - DNA, 14 bp, Homo sapiens
gagttcatcttgaa

SEQ ID NO: 5747733 - DNA, 23 bp, Homo sapiens
gagttcatcttgaattgtaagga

SEQ ID NO: 5747734 - DNA, 23 bp, Homo sapiens
gagttcattcaaaatgtccagct

SEQ ID NO: 5747735 - DNA, 20 bp, Homo sapiens
gagttccaagttgaagggaa

SEQ ID NO: 5747736 - DNA, 16 bp, Homo sapiens
gagttccacagattgt

SEQ ID NO: 5747737 - DNA, 19 bp, Homo sapiens
gagttccagttcctctttg

SEQ ID NO: 5747738 - DNA, 15 bp, Homo sapiens
gagttccatgaagac

SEQ ID NO: 5747739 - DNA, 17 bp, Homo sapiens
gagttccatgaagacca

SEQ ID NO: 5747740 - DNA, 17 bp, Homo sapiens
gagttcccaaagggagg

SEQ ID NO: 5747741 - DNA, 14 bp, Homo sapiens
gagttcccaaatgt

SEQ ID NO: 5747742 - DNA, 15 bp, Homo sapiens
gagttcccaagaaag

SEQ ID NO: 5747743 - DNA, 20 bp, Homo sapiens
gagttcccccaaccatcttc

SEQ ID NO: 5747744 - DNA, 21 bp, Homo sapiens
gagttcccgggagctgggccc

SEQ ID NO: 5747745 - DNA, 21 bp, Homo sapiens
gagttccctaaacaaaagcaa

SEQ ID NO: 5747746 - DNA, 22 bp, Homo sapiens
gagttccctcagtactattcct

SEQ ID NO: 5747747 - DNA, 20 bp, Homo sapiens
gagttccctgcaaccaattg

SEQ ID NO: 5747748 - DNA, 22 bp, Homo sapiens
gagttcccttgaaactttggga

SEQ ID NO: 5747749 - DNA, 16 bp, Homo sapiens
gagttcctctgcagtt

SEQ ID NO: 5747750 - DNA, 14 bp, Homo sapiens
gagttcctctgggt

SEQ ID NO: 5747751 - DNA, 14 bp, Homo sapiens
gagttcctgcatgc

SEQ ID NO: 5747752 - DNA, 22 bp, Homo sapiens
gagttccttatccctctcttcc

SEQ ID NO: 5747753 - DNA, 13 bp, Homo sapiens
gagttccttctca

SEQ ID NO: 5747754 - DNA, 21 bp, Homo sapiens
gagttccttgatctgtatata

SEQ ID NO: 5747755 - DNA, 20 bp, Homo sapiens
gagttcctttccctccgaac

SEQ ID NO: 5747756 - DNA, 13 bp, Homo sapiens
gagttcctttctg

SEQ ID NO: 5747757 - DNA, 19 bp, Homo sapiens
gagttcgagaccagcccag

SEQ ID NO: 5747758 - DNA, 19 bp, Homo sapiens
gagttcgagaccagcctga

SEQ ID NO: 5747759 - DNA, 20 bp, Homo sapiens
gagttcgaggcgagcctggc

SEQ ID NO: 5747760 - DNA, 23 bp, Homo sapiens
gagttcgtgaagagggaagccag

SEQ ID NO: 5747761 - DNA, 11 bp, Homo sapiens
gagttctacat

SEQ ID NO: 5747762 - DNA, 14 bp, Homo sapiens
gagttctagaacca

SEQ ID NO: 5747763 - DNA, 20 bp, Homo sapiens
gagttctagatttttaagag

SEQ ID NO: 5747764 - DNA, 16 bp, Homo sapiens
gagttctcagggctcc

SEQ ID NO: 5747765 - DNA, 17 bp, Homo sapiens
gagttctctttcttagt

SEQ ID NO: 5747766 - DNA, 21 bp, Homo sapiens
gagttctctttcttagtccct

SEQ ID NO: 5747767 - DNA, 23 bp, Homo sapiens
gagttctgattgtgttgaagaag

SEQ ID NO: 5747768 - DNA, 12 bp, Homo sapiens
gagttctgcaca

SEQ ID NO: 5747769 - DNA, 13 bp, Homo sapiens
gagttctggaaaa

SEQ ID NO: 5747770 - DNA, 21 bp, Homo sapiens
gagttctgtgtattttcagtc

SEQ ID NO: 5747771 - DNA, 13 bp, Homo sapiens
gagttcttaaagt

SEQ ID NO: 5747772 - DNA, 21 bp, Homo sapiens
gagttcttaaggattgtgata

SEQ ID NO: 5747773 - DNA, 19 bp, Homo sapiens
gagttcttgtgtcctggta

SEQ ID NO: 5747774 - DNA, 20 bp, Homo sapiens
gagttctttaggtgcctcct

SEQ ID NO: 5747775 - DNA, 12 bp, Homo sapiens
gagttctttgca

SEQ ID NO: 5747776 - DNA, 16 bp, Homo sapiens
gagttctttgctgccc

SEQ ID NO: 5747777 - DNA, 19 bp, Homo sapiens
gagttctttgctgcccctg

SEQ ID NO: 5747778 - DNA, 21 bp, Homo sapiens
gagttgaaaatcttataattt

SEQ ID NO: 5747779 - DNA, 22 bp, Homo sapiens
gagttgaaagagttaagaatgt

SEQ ID NO: 5747780 - DNA, 14 bp, Homo sapiens
gagttgaagacaga

SEQ ID NO: 5747781 - DNA, 15 bp, Homo sapiens
gagttgaagacagag

SEQ ID NO: 5747782 - DNA, 17 bp, Homo sapiens
gagttgaagacagagct

SEQ ID NO: 5747783 - DNA, 22 bp, Homo sapiens
gagttgaccgttttcatcctgg

SEQ ID NO: 5747784 - DNA, 14 bp, Homo sapiens
gagttgactctgga

SEQ ID NO: 5747785 - DNA, 23 bp, Homo sapiens
gagttgacttgacagaacactgt

SEQ ID NO: 5747786 - DNA, 23 bp, Homo sapiens
gagttgaggtctttctcctcagg

SEQ ID NO: 5747787 - DNA, 17 bp, Homo sapiens
gagttgagtctcctctc

SEQ ID NO: 5747788 - DNA, 20 bp, Homo sapiens
gagttgagtgggtatttctt

SEQ ID NO: 5747789 - DNA, 22 bp, Homo sapiens
gagttgatagcacagaccctgc

SEQ ID NO: 5747790 - DNA, 17 bp, Homo sapiens
gagttgatctggaaccc

SEQ ID NO: 5747791 - DNA, 21 bp, Homo sapiens
gagttgatctggaacccagac

SEQ ID NO: 5747792 - DNA, 22 bp, Homo sapiens
gagttgatgggggccaggacac

SEQ ID NO: 5747793 - DNA, 16 bp, Homo sapiens
gagttgattcagctct

SEQ ID NO: 5747794 - DNA, 16 bp, Homo sapiens
gagttgattgtctagt

SEQ ID NO: 5747795 - DNA, 23 bp, Homo sapiens
gagttgattgtctagtgaggaag

SEQ ID NO: 5747796 - DNA, 14 bp, Homo sapiens
gagttgcatgtttt

SEQ ID NO: 5747797 - DNA, 17 bp, Homo sapiens
gagttgccaagacaaat

SEQ ID NO: 5747798 - DNA, 17 bp, Homo sapiens
gagttgccccgtctctg

SEQ ID NO: 5747799 - DNA, 14 bp, Homo sapiens
gagttgctcactca

SEQ ID NO: 5747800 - DNA, 19 bp, Homo sapiens
gagttgctcactcaggact

SEQ ID NO: 5747801 - DNA, 14 bp, Homo sapiens
gagttgctcctcag

SEQ ID NO: 5747802 - DNA, 18 bp, Homo sapiens
gagttgctgcaaacctga

SEQ ID NO: 5747803 - DNA, 17 bp, Homo sapiens
gagttgctggaaaatca

SEQ ID NO: 5747804 - DNA, 18 bp, Homo sapiens
gagttgctttgccagagc

SEQ ID NO: 5747805 - DNA, 19 bp, Homo sapiens
gagttgctttgccagagca

SEQ ID NO: 5747806 - DNA, 21 bp, Homo sapiens
gagttggaacaacatgttcta

SEQ ID NO: 5747807 - DNA, 17 bp, Homo sapiens
gagttggagtagaatgt

SEQ ID NO: 5747808 - DNA, 20 bp, Homo sapiens
gagttggagtagaatgtagt

SEQ ID NO: 5747809 - DNA, 17 bp, Homo sapiens
gagttggagttttattt

SEQ ID NO: 5747810 - DNA, 22 bp, Homo sapiens
gagttggccagattgtggggtg

SEQ ID NO: 5747811 - DNA, 23 bp, Homo sapiens
gagttggcgttgtgggcaggcta

SEQ ID NO: 5747812 - DNA, 16 bp, Homo sapiens
gagttggctcaggcag

SEQ ID NO: 5747813 - DNA, 20 bp, Homo sapiens
gagttgggcaaaacccagga

SEQ ID NO: 5747814 - DNA, 17 bp, Homo sapiens
gagttgggcagccagga

SEQ ID NO: 5747815 - DNA, 17 bp, Homo sapiens
gagttggggaaggcaag

SEQ ID NO: 5747816 - DNA, 22 bp, Homo sapiens
gagttgggggctaggggagggg

SEQ ID NO: 5747817 - DNA, 21 bp, Homo sapiens
gagttgggggtcgggtggggg

SEQ ID NO: 5747818 - DNA, 12 bp, Homo sapiens
gagttgtaaata

SEQ ID NO: 5747819 - DNA, 19 bp, Homo sapiens
gagttgtaaatatataaat

SEQ ID NO: 5747820 - DNA, 14 bp, Homo sapiens
gagttgtcacagaa

SEQ ID NO: 5747821 - DNA, 14 bp, Homo sapiens
gagttgtcactgct

SEQ ID NO: 5747822 - DNA, 14 bp, Homo sapiens
gagttgtctgtcct

SEQ ID NO: 5747823 - DNA, 15 bp, Homo sapiens
gagttgtctgtcctg

SEQ ID NO: 5747824 - DNA, 15 bp, Homo sapiens
gagttgtgatgaatc

SEQ ID NO: 5747825 - DNA, 17 bp, Homo sapiens
gagttgtgattgaaagt

SEQ ID NO: 5747826 - DNA, 19 bp, Homo sapiens
gagttgtgcatgcccctga

SEQ ID NO: 5747827 - DNA, 14 bp, Homo sapiens
gagttgttctcagg

SEQ ID NO: 5747828 - DNA, 15 bp, Homo sapiens
gagttgttctcaggg

SEQ ID NO: 5747829 - DNA, 22 bp, Homo sapiens
gagttgttttcagactcagact

SEQ ID NO: 5747830 - DNA, 21 bp, Homo sapiens
gagtttaaaaatggtatcaaa

SEQ ID NO: 5747831 - DNA, 14 bp, Homo sapiens
gagtttaaacaaaa

SEQ ID NO: 5747832 - DNA, 16 bp, Homo sapiens
gagtttaaattgtaat

SEQ ID NO: 5747833 - DNA, 18 bp, Homo sapiens
gagtttaacagatattta

SEQ ID NO: 5747834 - DNA, 14 bp, Homo sapiens
gagtttaccatttg

SEQ ID NO: 5747835 - DNA, 17 bp, Homo sapiens
gagtttaccatttgtaa

SEQ ID NO: 5747836 - DNA, 14 bp, Homo sapiens
gagtttagggtggg

SEQ ID NO: 5747837 - DNA, 19 bp, Homo sapiens
gagtttatacagtgtacat

SEQ ID NO: 5747838 - DNA, 23 bp, Homo sapiens
gagtttatacagtgtacatgtac

SEQ ID NO: 5747839 - DNA, 14 bp, Homo sapiens
gagtttatattctg

SEQ ID NO: 5747840 - DNA, 15 bp, Homo sapiens
gagtttatccatcct

SEQ ID NO: 5747841 - DNA, 22 bp, Homo sapiens
gagtttattacaatgtatcttt

SEQ ID NO: 5747842 - DNA, 23 bp, Homo sapiens
gagtttatttttttgatggctaa

SEQ ID NO: 5747843 - DNA, 23 bp, Homo sapiens
gagtttcacgcttattgcccagg

SEQ ID NO: 5747844 - DNA, 21 bp, Homo sapiens
gagtttcacttttgttgccca

SEQ ID NO: 5747845 - DNA, 11 bp, Homo sapiens
gagtttcagaa

SEQ ID NO: 5747846 - DNA, 16 bp, Homo sapiens
gagtttcagctggaaa

SEQ ID NO: 5747847 - DNA, 12 bp, Homo sapiens
gagtttcagctt

SEQ ID NO: 5747848 - DNA, 15 bp, Homo sapiens
gagtttcatgtacaa

SEQ ID NO: 5747849 - DNA, 18 bp, Homo sapiens
gagtttcattctcctgcc

SEQ ID NO: 5747850 - DNA, 18 bp, Homo sapiens
gagtttccactatcccaa

SEQ ID NO: 5747851 - DNA, 15 bp, Homo sapiens
gagtttccatttgga

SEQ ID NO: 5747852 - DNA, 21 bp, Homo sapiens
gagtttccatttggattttaa

SEQ ID NO: 5747853 - DNA, 14 bp, Homo sapiens
gagtttcccttcct

SEQ ID NO: 5747854 - DNA, 15 bp, Homo sapiens
gagtttcctaaaagt

SEQ ID NO: 5747855 - DNA, 20 bp, Homo sapiens
gagtttcctcaggctgctgg

SEQ ID NO: 5747856 - DNA, 13 bp, Homo sapiens
gagtttctattta

SEQ ID NO: 5747857 - DNA, 12 bp, Homo sapiens
gagtttctgttt

SEQ ID NO: 5747858 - DNA, 21 bp, Homo sapiens
gagtttgacagtttttgacat

SEQ ID NO: 5747859 - DNA, 17 bp, Homo sapiens
gagtttgatgaggccct

SEQ ID NO: 5747860 - DNA, 14 bp, Homo sapiens
gagtttgccttcct

SEQ ID NO: 5747861 - DNA, 18 bp, Homo sapiens
gagtttgctattagagca

SEQ ID NO: 5747862 - DNA, 23 bp, Homo sapiens
gagtttgctggttgtaaatactt

SEQ ID NO: 5747863 - DNA, 14 bp, Homo sapiens
gagtttgctgtttt

SEQ ID NO: 5747864 - DNA, 12 bp, Homo sapiens
gagtttggccag

SEQ ID NO: 5747865 - DNA, 21 bp, Homo sapiens
gagtttgggagagtggtgagt

SEQ ID NO: 5747866 - DNA, 15 bp, Homo sapiens
gagtttgggctggag

SEQ ID NO: 5747867 - DNA, 16 bp, Homo sapiens
gagtttgggctggagc

SEQ ID NO: 5747868 - DNA, 13 bp, Homo sapiens
gagtttggtctgg

SEQ ID NO: 5747869 - DNA, 19 bp, Homo sapiens
gagtttggtctggactgac

SEQ ID NO: 5747870 - DNA, 20 bp, Homo sapiens
gagtttggttaatcagtgtt

SEQ ID NO: 5747871 - DNA, 18 bp, Homo sapiens
gagtttgtaaatgacttt

SEQ ID NO: 5747872 - DNA, 11 bp, Homo sapiens
gagtttgtagg

SEQ ID NO: 5747873 - DNA, 17 bp, Homo sapiens
gagtttgtcgctcatgt

SEQ ID NO: 5747874 - DNA, 21 bp, Homo sapiens
gagtttgttctgttctggggg

SEQ ID NO: 5747875 - DNA, 22 bp, Homo sapiens
gagtttgttctgttctggggga

SEQ ID NO: 5747876 - DNA, 14 bp, Homo sapiens
gagtttgtttcttt

SEQ ID NO: 5747877 - DNA, 18 bp, Homo sapiens
gagtttgtttctttgaat

SEQ ID NO: 5747878 - DNA, 19 bp, Homo sapiens
gagttttaaattatgtata

SEQ ID NO: 5747879 - DNA, 18 bp, Homo sapiens
gagttttaacaatccatt

SEQ ID NO: 5747880 - DNA, 17 bp, Homo sapiens
gagttttacccagactc

SEQ ID NO: 5747881 - DNA, 15 bp, Homo sapiens
gagttttactgcctg

SEQ ID NO: 5747882 - DNA, 16 bp, Homo sapiens
gagttttataaattaa

SEQ ID NO: 5747883 - DNA, 17 bp, Homo sapiens
gagttttataaattaaa

SEQ ID NO: 5747884 - DNA, 18 bp, Homo sapiens
gagttttatatactgtgt

SEQ ID NO: 5747885 - DNA, 14 bp, Homo sapiens
gagttttattcctt

SEQ ID NO: 5747886 - DNA, 14 bp, Homo sapiens
gagttttcaaagat

SEQ ID NO: 5747887 - DNA, 12 bp, Homo sapiens
gagttttcacct

SEQ ID NO: 5747888 - DNA, 18 bp, Homo sapiens
gagttttccatggcagga

SEQ ID NO: 5747889 - DNA, 13 bp, Homo sapiens
gagttttccccac

SEQ ID NO: 5747890 - DNA, 23 bp, Homo sapiens
gagttttcctctatacatctctc

SEQ ID NO: 5747891 - DNA, 16 bp, Homo sapiens
gagttttctttagtat

SEQ ID NO: 5747892 - DNA, 13 bp, Homo sapiens
gagttttgatttg

SEQ ID NO: 5747893 - DNA, 16 bp, Homo sapiens
gagttttggcagccag

SEQ ID NO: 5747894 - DNA, 16 bp, Homo sapiens
gagttttgtagcagtg

SEQ ID NO: 5747895 - DNA, 15 bp, Homo sapiens
gagttttgtgtttgt

SEQ ID NO: 5747896 - DNA, 18 bp, Homo sapiens
gagttttgtgtttgttgt

SEQ ID NO: 5747897 - DNA, 22 bp, Homo sapiens
gagttttgtgtttgttgtagat

SEQ ID NO: 5747898 - DNA, 17 bp, Homo sapiens
gagttttgtttcctctg

SEQ ID NO: 5747899 - DNA, 19 bp, Homo sapiens
gagttttgttttaaaatta

SEQ ID NO: 5747900 - DNA, 16 bp, Homo sapiens
gagtttttaaagcctt

SEQ ID NO: 5747901 - DNA, 21 bp, Homo sapiens
gagtttttaaagccttctgga

SEQ ID NO: 5747902 - DNA, 13 bp, Homo sapiens
gagtttttagttt

SEQ ID NO: 5747903 - DNA, 18 bp, Homo sapiens
gagtttttatgcctttct

SEQ ID NO: 5747904 - DNA, 22 bp, Homo sapiens
gagtttttcccagctacacctt

SEQ ID NO: 5747905 - DNA, 15 bp, Homo sapiens
gagtttttcctccca

SEQ ID NO: 5747906 - DNA, 16 bp, Homo sapiens
gataaaaaaacagctt

SEQ ID NO: 5747907 - DNA, 19 bp, Homo sapiens
gataaaaaagaaaacattc

SEQ ID NO: 5747908 - DNA, 22 bp, Homo sapiens
gataaaaacaatatatgtaaat

SEQ ID NO: 5747909 - DNA, 14 bp, Homo sapiens
gataaaaagatggc

SEQ ID NO: 5747910 - DNA, 18 bp, Homo sapiens
gataaaaagccagggctg

SEQ ID NO: 5747911 - DNA, 19 bp, Homo sapiens
gataaaaagccagggctgg

SEQ ID NO: 5747912 - DNA, 20 bp, Homo sapiens
gataaaaagccagggctgga

SEQ ID NO: 5747913 - DNA, 14 bp, Homo sapiens
gataaaaaggaagg

SEQ ID NO: 5747914 - DNA, 14 bp, Homo sapiens
gataaaaatcagta

SEQ ID NO: 5747915 - DNA, 12 bp, Homo sapiens
gataaaaatcat

SEQ ID NO: 5747916 - DNA, 20 bp, Homo sapiens
gataaaacagaatcttctgg

SEQ ID NO: 5747917 - DNA, 14 bp, Homo sapiens
gataaaactgtgta

SEQ ID NO: 5747918 - DNA, 15 bp, Homo sapiens
gataaaactgtgtaa

SEQ ID NO: 5747919 - DNA, 16 bp, Homo sapiens
gataaaactgtgtaaa

SEQ ID NO: 5747920 - DNA, 17 bp, Homo sapiens
gataaaagaaccccaga

SEQ ID NO: 5747921 - DNA, 23 bp, Homo sapiens
gataaaagatacatttgtatgtt

SEQ ID NO: 5747922 - DNA, 12 bp, Homo sapiens
gataaaaggaag

SEQ ID NO: 5747923 - DNA, 17 bp, Homo sapiens
gataaaaggagaataag

SEQ ID NO: 5747924 - DNA, 12 bp, Homo sapiens
gataaaagtcat

SEQ ID NO: 5747925 - DNA, 16 bp, Homo sapiens
gataaaataaataatt

SEQ ID NO: 5747926 - DNA, 16 bp, Homo sapiens
gataaaataagtaaca

SEQ ID NO: 5747927 - DNA, 20 bp, Homo sapiens
gataaaatattttaagtatg

SEQ ID NO: 5747928 - DNA, 20 bp, Homo sapiens
gataaaatctactccaaatt

SEQ ID NO: 5747929 - DNA, 16 bp, Homo sapiens
gataaaatgactactt

SEQ ID NO: 5747930 - DNA, 15 bp, Homo sapiens
gataaaatgttcagt

SEQ ID NO: 5747931 - DNA, 16 bp, Homo sapiens
gataaacaacaaggtg

SEQ ID NO: 5747932 - DNA, 18 bp, Homo sapiens
gataaacaacaaggtggt

SEQ ID NO: 5747933 - DNA, 21 bp, Homo sapiens
gataaacacagaggttttaaa

SEQ ID NO: 5747934 - DNA, 16 bp, Homo sapiens
gataaacacaggcagg

SEQ ID NO: 5747935 - DNA, 17 bp, Homo sapiens
gataaacacaggcaggt

SEQ ID NO: 5747936 - DNA, 13 bp, Homo sapiens
gataaacagtagt

SEQ ID NO: 5747937 - DNA, 17 bp, Homo sapiens
gataaacataattattt

SEQ ID NO: 5747938 - DNA, 18 bp, Homo sapiens
gataaacattaaacactg

SEQ ID NO: 5747939 - DNA, 19 bp, Homo sapiens
gataaacattaaacactgt

SEQ ID NO: 5747940 - DNA, 18 bp, Homo sapiens
gataaaccaaaaacattt

SEQ ID NO: 5747941 - DNA, 16 bp, Homo sapiens
gataaactgaattttt

SEQ ID NO: 5747942 - DNA, 14 bp, Homo sapiens
gataaactgagcct

SEQ ID NO: 5747943 - DNA, 22 bp, Homo sapiens
gataaactgagcctcacttgcc

SEQ ID NO: 5747944 - DNA, 17 bp, Homo sapiens
gataaactgatgtttga

SEQ ID NO: 5747945 - DNA, 15 bp, Homo sapiens
gataaacttttagaa

SEQ ID NO: 5747946 - DNA, 18 bp, Homo sapiens
gataaagaaaaaaatact

SEQ ID NO: 5747947 - DNA, 21 bp, Homo sapiens
gataaagaaactgaggcccac

SEQ ID NO: 5747948 - DNA, 16 bp, Homo sapiens
gataaagaataataat

SEQ ID NO: 5747949 - DNA, 16 bp, Homo sapiens
gataaagaccagaaat

SEQ ID NO: 5747950 - DNA, 13 bp, Homo sapiens
gataaagactttt

SEQ ID NO: 5747951 - DNA, 14 bp, Homo sapiens
gataaagagacagt

SEQ ID NO: 5747952 - DNA, 23 bp, Homo sapiens
gataaagagggatgtaactattg

SEQ ID NO: 5747953 - DNA, 12 bp, Homo sapiens
gataaagatgat

SEQ ID NO: 5747954 - DNA, 20 bp, Homo sapiens
gataaagatgatattaagaa

SEQ ID NO: 5747955 - DNA, 13 bp, Homo sapiens
gataaagatttct

SEQ ID NO: 5747956 - DNA, 19 bp, Homo sapiens
gataaagatttctagtagg

SEQ ID NO: 5747957 - DNA, 14 bp, Homo sapiens
gataaagcacagct

SEQ ID NO: 5747958 - DNA, 21 bp, Homo sapiens
gataaagctgccccatctggg

SEQ ID NO: 5747959 - DNA, 17 bp, Homo sapiens
gataaagcttaggtcaa

SEQ ID NO: 5747960 - DNA, 20 bp, Homo sapiens
gataaaggaagtcaccaaaa

SEQ ID NO: 5747961 - DNA, 17 bp, Homo sapiens
gataaaggattcaaaag

SEQ ID NO: 5747962 - DNA, 13 bp, Homo sapiens
gataaagtcctga

SEQ ID NO: 5747963 - DNA, 14 bp, Homo sapiens
gataaataaaagat

SEQ ID NO: 5747964 - DNA, 19 bp, Homo sapiens
gataaataaaagatagcaa

SEQ ID NO: 5747965 - DNA, 21 bp, Homo sapiens
gataaataatgtagttttgtt

SEQ ID NO: 5747966 - DNA, 13 bp, Homo sapiens
gataaatagaact

SEQ ID NO: 5747967 - DNA, 18 bp, Homo sapiens
gataaatagctaaatggc

SEQ ID NO: 5747968 - DNA, 15 bp, Homo sapiens
gataaatatttatgc

SEQ ID NO: 5747969 - DNA, 19 bp, Homo sapiens
gataaatatttatgcagaa

SEQ ID NO: 5747970 - DNA, 14 bp, Homo sapiens
gataaatatttgac

SEQ ID NO: 5747971 - DNA, 18 bp, Homo sapiens
gataaatcagtggttatt

SEQ ID NO: 5747972 - DNA, 15 bp, Homo sapiens
gataaatcatttcag

SEQ ID NO: 5747973 - DNA, 16 bp, Homo sapiens
gataaatcatttcagt

SEQ ID NO: 5747974 - DNA, 18 bp, Homo sapiens
gataaatcatttcagtat

SEQ ID NO: 5747975 - DNA, 20 bp, Homo sapiens
gataaatccttaacatttct

SEQ ID NO: 5747976 - DNA, 12 bp, Homo sapiens
gataaatgaaat

SEQ ID NO: 5747977 - DNA, 12 bp, Homo sapiens
gataaatgaaca

SEQ ID NO: 5747978 - DNA, 15 bp, Homo sapiens
gataaatgattcaaa

SEQ ID NO: 5747979 - DNA, 17 bp, Homo sapiens
gataaatgcacatttca

SEQ ID NO: 5747980 - DNA, 15 bp, Homo sapiens
gataaatgccatcaa

SEQ ID NO: 5747981 - DNA, 20 bp, Homo sapiens
gataaatgccatcaataaaa

SEQ ID NO: 5747982 - DNA, 15 bp, Homo sapiens
gataaatgctttaaa

SEQ ID NO: 5747983 - DNA, 21 bp, Homo sapiens
gataaattgccataatatgat

SEQ ID NO: 5747984 - DNA, 23 bp, Homo sapiens
gataaatttaaaacacagtattg

SEQ ID NO: 5747985 - DNA, 20 bp, Homo sapiens
gataaatttggccatgaaag

SEQ ID NO: 5747986 - DNA, 19 bp, Homo sapiens
gataaatttgttgaatatt

SEQ ID NO: 5747987 - DNA, 21 bp, Homo sapiens
gataaattttggaagaattca

SEQ ID NO: 5747988 - DNA, 22 bp, Homo sapiens
gataacaaaaaataaattttaa

SEQ ID NO: 5747989 - DNA, 13 bp, Homo sapiens
gataacaaaatca

SEQ ID NO: 5747990 - DNA, 13 bp, Homo sapiens
gataacaaagata

SEQ ID NO: 5747991 - DNA, 19 bp, Homo sapiens
gataacaaccttttacatt

SEQ ID NO: 5747992 - DNA, 12 bp, Homo sapiens
gataacaccttg

SEQ ID NO: 5747993 - DNA, 13 bp, Homo sapiens
gataacactgact

SEQ ID NO: 5747994 - DNA, 15 bp, Homo sapiens
gataacacttaaaat

SEQ ID NO: 5747995 - DNA, 13 bp, Homo sapiens
gataacagaattg

SEQ ID NO: 5747996 - DNA, 13 bp, Homo sapiens
gataacagaggca

SEQ ID NO: 5747997 - DNA, 20 bp, Homo sapiens
gataacagagtgatttgtaa

SEQ ID NO: 5747998 - DNA, 22 bp, Homo sapiens
gataacagagtgatttgtaaaa

SEQ ID NO: 5747999 - DNA, 13 bp, Homo sapiens
gataacagcactg

SEQ ID NO: 5748000 - DNA, 16 bp, Homo sapiens
gataacagcactgact

SEQ ID NO: 5748001 - DNA, 23 bp, Homo sapiens
gataacagggattgattttaaaa

SEQ ID NO: 5748002 - DNA, 22 bp, Homo sapiens
gataacatgtatcactcactgc

SEQ ID NO: 5748003 - DNA, 17 bp, Homo sapiens
gataacatttgtgtgtt

SEQ ID NO: 5748004 - DNA, 14 bp, Homo sapiens
gataacattttcaa

SEQ ID NO: 5748005 - DNA, 15 bp, Homo sapiens
gataaccaagaatgt

SEQ ID NO: 5748006 - DNA, 15 bp, Homo sapiens
gataaccaattttca

SEQ ID NO: 5748007 - DNA, 22 bp, Homo sapiens
gataaccacaaccaggaagaac

SEQ ID NO: 5748008 - DNA, 19 bp, Homo sapiens
gataaccagtaaggaaata

SEQ ID NO: 5748009 - DNA, 14 bp, Homo sapiens
gataaccatagcat

SEQ ID NO: 5748010 - DNA, 22 bp, Homo sapiens
gataacccaaacaaaaatgact

SEQ ID NO: 5748011 - DNA, 19 bp, Homo sapiens
gataaccccaggcactgtt

SEQ ID NO: 5748012 - DNA, 17 bp, Homo sapiens
gataacccttattccat

SEQ ID NO: 5748013 - DNA, 14 bp, Homo sapiens
gataacgcaggaga

SEQ ID NO: 5748014 - DNA, 18 bp, Homo sapiens
gataacgcaggagagaga

SEQ ID NO: 5748015 - DNA, 16 bp, Homo sapiens
gataacggctctccag

SEQ ID NO: 5748016 - DNA, 17 bp, Homo sapiens
gataacggctctccaga

SEQ ID NO: 5748017 - DNA, 16 bp, Homo sapiens
gataactaaaattctg

SEQ ID NO: 5748018 - DNA, 15 bp, Homo sapiens
gataactagccagac

SEQ ID NO: 5748019 - DNA, 14 bp, Homo sapiens
gataactctttgga

SEQ ID NO: 5748020 - DNA, 15 bp, Homo sapiens
gataactctttggat

SEQ ID NO: 5748021 - DNA, 20 bp, Homo sapiens
gataactgaaaattatttaa

SEQ ID NO: 5748022 - DNA, 12 bp, Homo sapiens
gataactgattt

SEQ ID NO: 5748023 - DNA, 16 bp, Homo sapiens
gataactgatttctat

SEQ ID NO: 5748024 - DNA, 18 bp, Homo sapiens
gataactgcaattttaat

SEQ ID NO: 5748025 - DNA, 18 bp, Homo sapiens
gataacttaaataattta

SEQ ID NO: 5748026 - DNA, 23 bp, Homo sapiens
gataacttccttgcccctgctct

SEQ ID NO: 5748027 - DNA, 15 bp, Homo sapiens
gataacttctttagg

SEQ ID NO: 5748028 - DNA, 16 bp, Homo sapiens
gataactttacagaaa

SEQ ID NO: 5748029 - DNA, 14 bp, Homo sapiens
gataactttttaaa

SEQ ID NO: 5748030 - DNA, 15 bp, Homo sapiens
gataagaaccacaga

SEQ ID NO: 5748031 - DNA, 20 bp, Homo sapiens
gataagaataggtcattttc

SEQ ID NO: 5748032 - DNA, 17 bp, Homo sapiens
gataagaatgctggttt

SEQ ID NO: 5748033 - DNA, 22 bp, Homo sapiens
gataagaatgctggttttccta

SEQ ID NO: 5748034 - DNA, 14 bp, Homo sapiens
gataagattgaaat

SEQ ID NO: 5748035 - DNA, 23 bp, Homo sapiens
gataagccactctgtcccttcct

SEQ ID NO: 5748036 - DNA, 16 bp, Homo sapiens
gataagcctgagcctt

SEQ ID NO: 5748037 - DNA, 12 bp, Homo sapiens
gataaggaagaa

SEQ ID NO: 5748038 - DNA, 13 bp, Homo sapiens
gataaggaagaaa

SEQ ID NO: 5748039 - DNA, 19 bp, Homo sapiens
gataaggagactgaggctt

SEQ ID NO: 5748040 - DNA, 19 bp, Homo sapiens
gataaggcagaactaggag

SEQ ID NO: 5748041 - DNA, 17 bp, Homo sapiens
gataaggccgagcccac

SEQ ID NO: 5748042 - DNA, 20 bp, Homo sapiens
gataaggctgttctttaaat

SEQ ID NO: 5748043 - DNA, 14 bp, Homo sapiens
gataagggaaaaga

SEQ ID NO: 5748044 - DNA, 16 bp, Homo sapiens
gataagggaaaagata

SEQ ID NO: 5748045 - DNA, 12 bp, Homo sapiens
gataaggggcct

SEQ ID NO: 5748046 - DNA, 21 bp, Homo sapiens
gataaggggccttgctctgag

SEQ ID NO: 5748047 - DNA, 14 bp, Homo sapiens
gataaggggtgggg

SEQ ID NO: 5748048 - DNA, 17 bp, Homo sapiens
gataaggtaaaatgcca

SEQ ID NO: 5748049 - DNA, 14 bp, Homo sapiens
gataagtaagagta

SEQ ID NO: 5748050 - DNA, 22 bp, Homo sapiens
gataagtggaaaaaagagaaaa

SEQ ID NO: 5748051 - DNA, 14 bp, Homo sapiens
gataagtgtaaata

SEQ ID NO: 5748052 - DNA, 16 bp, Homo sapiens
gataagtgtatttttc

SEQ ID NO: 5748053 - DNA, 17 bp, Homo sapiens
gataagtgttcttcagt

SEQ ID NO: 5748054 - DNA, 21 bp, Homo sapiens
gataagtgttcttcagtgtaa

SEQ ID NO: 5748055 - DNA, 13 bp, Homo sapiens
gataagttattta

SEQ ID NO: 5748056 - DNA, 14 bp, Homo sapiens
gataagttcataca

SEQ ID NO: 5748057 - DNA, 21 bp, Homo sapiens
gataagttccaaaaataccat

SEQ ID NO: 5748058 - DNA, 23 bp, Homo sapiens
gataagttcttatgccatgttaa

SEQ ID NO: 5748059 - DNA, 19 bp, Homo sapiens
gataagttggaaacactaa

SEQ ID NO: 5748060 - DNA, 17 bp, Homo sapiens
gataagttggagcaggg

SEQ ID NO: 5748061 - DNA, 22 bp, Homo sapiens
gataataaaattcattccattt

SEQ ID NO: 5748062 - DNA, 16 bp, Homo sapiens
gataataaaatttaga

SEQ ID NO: 5748063 - DNA, 15 bp, Homo sapiens
gataataactagatc

SEQ ID NO: 5748064 - DNA, 20 bp, Homo sapiens
gataataactgtcttctgga

SEQ ID NO: 5748065 - DNA, 20 bp, Homo sapiens
gataataaggaaaagtttaa

SEQ ID NO: 5748066 - DNA, 22 bp, Homo sapiens
gataataaggaaaagtttaata

SEQ ID NO: 5748067 - DNA, 22 bp, Homo sapiens
gataataatactgacctacctc

SEQ ID NO: 5748068 - DNA, 18 bp, Homo sapiens
gataataatattgttttt

SEQ ID NO: 5748069 - DNA, 18 bp, Homo sapiens
gataatacacacagttac

SEQ ID NO: 5748070 - DNA, 22 bp, Homo sapiens
gataatacaccactacattctg

SEQ ID NO: 5748071 - DNA, 23 bp, Homo sapiens
gataatacaccactacattctgt

SEQ ID NO: 5748072 - DNA, 15 bp, Homo sapiens
gataatacagatttg

SEQ ID NO: 5748073 - DNA, 19 bp, Homo sapiens
gataatacagatttgtaac

SEQ ID NO: 5748074 - DNA, 22 bp, Homo sapiens
gataatacagatttgtaacatt

SEQ ID NO: 5748075 - DNA, 13 bp, Homo sapiens
gataatagattct

SEQ ID NO: 5748076 - DNA, 15 bp, Homo sapiens
gataatagcattttt

SEQ ID NO: 5748077 - DNA, 19 bp, Homo sapiens
gataatagcatttttgtaa

SEQ ID NO: 5748078 - DNA, 19 bp, Homo sapiens
gataataggggattttaaa

SEQ ID NO: 5748079 - DNA, 14 bp, Homo sapiens
gataataggtcata

SEQ ID NO: 5748080 - DNA, 23 bp, Homo sapiens
gataatagtaatggttctagaag

SEQ ID NO: 5748081 - DNA, 22 bp, Homo sapiens
gataatagttttttcttttaac

SEQ ID NO: 5748082 - DNA, 14 bp, Homo sapiens
gataatattgtctg

SEQ ID NO: 5748083 - DNA, 20 bp, Homo sapiens
gataatattgtctgtctcta

SEQ ID NO: 5748084 - DNA, 22 bp, Homo sapiens
gataatattgtttggtaaatgt

SEQ ID NO: 5748085 - DNA, 14 bp, Homo sapiens
gataatatttaaaa

SEQ ID NO: 5748086 - DNA, 18 bp, Homo sapiens
gataatatttaaaatagt

SEQ ID NO: 5748087 - DNA, 21 bp, Homo sapiens
gataatcaattattacattta

SEQ ID NO: 5748088 - DNA, 22 bp, Homo sapiens
gataatcaattattacatttat

SEQ ID NO: 5748089 - DNA, 14 bp, Homo sapiens
gataatcagcctct

SEQ ID NO: 5748090 - DNA, 14 bp, Homo sapiens
gataatcaggaaaa

SEQ ID NO: 5748091 - DNA, 18 bp, Homo sapiens
gataatcaggaaaaatga

SEQ ID NO: 5748092 - DNA, 21 bp, Homo sapiens
gataatcagtgtgtctaaatt

SEQ ID NO: 5748093 - DNA, 15 bp, Homo sapiens
gataatcagtttcca

SEQ ID NO: 5748094 - DNA, 17 bp, Homo sapiens
gataatcagtttccact

SEQ ID NO: 5748095 - DNA, 20 bp, Homo sapiens
gataatctcagtgctttcct

SEQ ID NO: 5748096 - DNA, 21 bp, Homo sapiens
gataatcttcaggtgaacact

SEQ ID NO: 5748097 - DNA, 18 bp, Homo sapiens
gataatcttcggccaatt

SEQ ID NO: 5748098 - DNA, 16 bp, Homo sapiens
gataatcttttacatt

SEQ ID NO: 5748099 - DNA, 23 bp, Homo sapiens
gataatgaaatagttattttaat

SEQ ID NO: 5748100 - DNA, 20 bp, Homo sapiens
gataatgacactgtttcctg

SEQ ID NO: 5748101 - DNA, 16 bp, Homo sapiens
gataatgagatgtaat

SEQ ID NO: 5748102 - DNA, 22 bp, Homo sapiens
gataatgagttttacattacaa

SEQ ID NO: 5748103 - DNA, 23 bp, Homo sapiens
gataatgatctgaatctgtttct

SEQ ID NO: 5748104 - DNA, 21 bp, Homo sapiens
gataatgcagataaatacatt

SEQ ID NO: 5748105 - DNA, 17 bp, Homo sapiens
gataatgcatgaagcaa

SEQ ID NO: 5748106 - DNA, 18 bp, Homo sapiens
gataatgccaccaaagga

SEQ ID NO: 5748107 - DNA, 20 bp, Homo sapiens
gataatgccccaaggacaag

SEQ ID NO: 5748108 - DNA, 20 bp, Homo sapiens
gataatgccggtgagaataa

SEQ ID NO: 5748109 - DNA, 18 bp, Homo sapiens
gataatggtaatttagtg

SEQ ID NO: 5748110 - DNA, 23 bp, Homo sapiens
gataatgtccaaatactctgaaa

SEQ ID NO: 5748111 - DNA, 21 bp, Homo sapiens
gataatgtccaactaaaaaca

SEQ ID NO: 5748112 - DNA, 12 bp, Homo sapiens
gataatgttaaa

SEQ ID NO: 5748113 - DNA, 15 bp, Homo sapiens
gataatgttatacat

SEQ ID NO: 5748114 - DNA, 22 bp, Homo sapiens
gataatgttcattttgaaaata

SEQ ID NO: 5748115 - DNA, 21 bp, Homo sapiens
gataatgttgtggtttgttgc

SEQ ID NO: 5748116 - DNA, 15 bp, Homo sapiens
gataattaaggccag

SEQ ID NO: 5748117 - DNA, 23 bp, Homo sapiens
gataattaaggccagaggcccat

SEQ ID NO: 5748118 - DNA, 13 bp, Homo sapiens
gataattacaata

SEQ ID NO: 5748119 - DNA, 19 bp, Homo sapiens
gataattacgtttaaagtg

SEQ ID NO: 5748120 - DNA, 17 bp, Homo sapiens
gataattattggtaatt

SEQ ID NO: 5748121 - DNA, 14 bp, Homo sapiens
gataattcatttgt

SEQ ID NO: 5748122 - DNA, 20 bp, Homo sapiens
gataattcatttgtattgct

SEQ ID NO: 5748123 - DNA, 12 bp, Homo sapiens
gataattcttac

SEQ ID NO: 5748124 - DNA, 16 bp, Homo sapiens
gataattgctatttat

SEQ ID NO: 5748125 - DNA, 17 bp, Homo sapiens
gataattgtaaaggtga

SEQ ID NO: 5748126 - DNA, 12 bp, Homo sapiens
gataattgtgta

SEQ ID NO: 5748127 - DNA, 19 bp, Homo sapiens
gataattgtgtagtaatgt

SEQ ID NO: 5748128 - DNA, 14 bp, Homo sapiens
gataattgtgtatt

SEQ ID NO: 5748129 - DNA, 16 bp, Homo sapiens
gataattgtgtatttt

SEQ ID NO: 5748130 - DNA, 13 bp, Homo sapiens
gataattttacaa

SEQ ID NO: 5748131 - DNA, 21 bp, Homo sapiens
gataattttatttataaacta

SEQ ID NO: 5748132 - DNA, 12 bp, Homo sapiens
gataattttgca

SEQ ID NO: 5748133 - DNA, 17 bp, Homo sapiens
gataattttgcataaaa

SEQ ID NO: 5748134 - DNA, 18 bp, Homo sapiens
gataattttttaattatt

SEQ ID NO: 5748135 - DNA, 16 bp, Homo sapiens
gatacaaaagcatgtg

SEQ ID NO: 5748136 - DNA, 18 bp, Homo sapiens
gatacaaaagctttttaa

SEQ ID NO: 5748137 - DNA, 23 bp, Homo sapiens
gatacaaaagctttttaaaattt

SEQ ID NO: 5748138 - DNA, 16 bp, Homo sapiens
gatacaaaatgttact

SEQ ID NO: 5748139 - DNA, 19 bp, Homo sapiens
gatacaaacactacagaca

SEQ ID NO: 5748140 - DNA, 11 bp, Homo sapiens
gatacaagaaa

SEQ ID NO: 5748141 - DNA, 23 bp, Homo sapiens
gatacaagaaaaagtagaaaaaa

SEQ ID NO: 5748142 - DNA, 16 bp, Homo sapiens
gatacaagattagaag

SEQ ID NO: 5748143 - DNA, 23 bp, Homo sapiens
gatacaaggcccagaagcctgat

SEQ ID NO: 5748144 - DNA, 19 bp, Homo sapiens
gatacaagtttcagacagg

SEQ ID NO: 5748145 - DNA, 20 bp, Homo sapiens
gatacacaagagggactgta

SEQ ID NO: 5748146 - DNA, 11 bp, Homo sapiens
gatacacagct

SEQ ID NO: 5748147 - DNA, 22 bp, Homo sapiens
gatacactgaagttaacagaga

SEQ ID NO: 5748148 - DNA, 22 bp, Homo sapiens
gatacactgtatctaaaaaata

SEQ ID NO: 5748149 - DNA, 15 bp, Homo sapiens
gatacacttgtaaat

SEQ ID NO: 5748150 - DNA, 11 bp, Homo sapiens
gatacagaaaa

SEQ ID NO: 5748151 - DNA, 13 bp, Homo sapiens
gatacagagccac

SEQ ID NO: 5748152 - DNA, 21 bp, Homo sapiens
gatacagatccgcatgtgtct

SEQ ID NO: 5748153 - DNA, 16 bp, Homo sapiens
gatacagatctcaggg

SEQ ID NO: 5748154 - DNA, 18 bp, Homo sapiens
gatacagcagtagacatt

SEQ ID NO: 5748155 - DNA, 23 bp, Homo sapiens
gatacagccccaaaccagggtgc

SEQ ID NO: 5748156 - DNA, 15 bp, Homo sapiens
gatacagctcttctc

SEQ ID NO: 5748157 - DNA, 16 bp, Homo sapiens
gatacagcttggcact

SEQ ID NO: 5748158 - DNA, 23 bp, Homo sapiens
gatacaggaaaagctgctgacag

SEQ ID NO: 5748159 - DNA, 18 bp, Homo sapiens
gatacaggactggttcct

SEQ ID NO: 5748160 - DNA, 19 bp, Homo sapiens
gatacagtacggatttgtc

SEQ ID NO: 5748161 - DNA, 20 bp, Homo sapiens
gatacagtagtgtcatcact

SEQ ID NO: 5748162 - DNA, 22 bp, Homo sapiens
gatacagtcattatttaaagca

SEQ ID NO: 5748163 - DNA, 19 bp, Homo sapiens
gatacagtccctaaagaaa

SEQ ID NO: 5748164 - DNA, 15 bp, Homo sapiens
gatacagtgcccacc

SEQ ID NO: 5748165 - DNA, 20 bp, Homo sapiens
gatacagtgttttttaggaa

SEQ ID NO: 5748166 - DNA, 19 bp, Homo sapiens
gatacagttttcagaaaaa

SEQ ID NO: 5748167 - DNA, 21 bp, Homo sapiens
gatacataactaaatttgata

SEQ ID NO: 5748168 - DNA, 13 bp, Homo sapiens
gatacataataaa

SEQ ID NO: 5748169 - DNA, 14 bp, Homo sapiens
gatacataataaaa

SEQ ID NO: 5748170 - DNA, 12 bp, Homo sapiens
gatacatagatg

SEQ ID NO: 5748171 - DNA, 22 bp, Homo sapiens
gatacatagatggaccagtaga

SEQ ID NO: 5748172 - DNA, 21 bp, Homo sapiens
gatacatcactgcttgatgaa

SEQ ID NO: 5748173 - DNA, 11 bp, Homo sapiens
gatacatctgc

SEQ ID NO: 5748174 - DNA, 12 bp, Homo sapiens
gatacatctgct

SEQ ID NO: 5748175 - DNA, 13 bp, Homo sapiens
gatacatctgctg

SEQ ID NO: 5748176 - DNA, 14 bp, Homo sapiens
gatacatctgctgt

SEQ ID NO: 5748177 - DNA, 15 bp, Homo sapiens
gatacatctgctgtg

SEQ ID NO: 5748178 - DNA, 16 bp, Homo sapiens
gatacatctgctgtgt

SEQ ID NO: 5748179 - DNA, 15 bp, Homo sapiens
gatacatgaacttca

SEQ ID NO: 5748180 - DNA, 22 bp, Homo sapiens
gatacatgctaagaaagcaaat

SEQ ID NO: 5748181 - DNA, 17 bp, Homo sapiens
gatacatgtctttctcc

SEQ ID NO: 5748182 - DNA, 13 bp, Homo sapiens
gatacatgttgta

SEQ ID NO: 5748183 - DNA, 22 bp, Homo sapiens
gatacattaggaagctgaatta

SEQ ID NO: 5748184 - DNA, 12 bp, Homo sapiens
gatacattccct

SEQ ID NO: 5748185 - DNA, 18 bp, Homo sapiens
gatacattccctatcaaa

SEQ ID NO: 5748186 - DNA, 14 bp, Homo sapiens
gatacatttaataa

SEQ ID NO: 5748187 - DNA, 14 bp, Homo sapiens
gatacatttatctt

SEQ ID NO: 5748188 - DNA, 16 bp, Homo sapiens
gatacatttatcttct

SEQ ID NO: 5748189 - DNA, 17 bp, Homo sapiens
gatacatttatcttctg

SEQ ID NO: 5748190 - DNA, 19 bp, Homo sapiens
gatacatttatcttctgtt

SEQ ID NO: 5748191 - DNA, 21 bp, Homo sapiens
gataccaaagagacagggccc

SEQ ID NO: 5748192 - DNA, 19 bp, Homo sapiens
gataccaagatgccatctg

SEQ ID NO: 5748193 - DNA, 18 bp, Homo sapiens
gataccaaggtacaactg

SEQ ID NO: 5748194 - DNA, 18 bp, Homo sapiens
gataccacaaaccctgct

SEQ ID NO: 5748195 - DNA, 20 bp, Homo sapiens
gataccacaaaccctgctga

SEQ ID NO: 5748196 - DNA, 18 bp, Homo sapiens
gataccacctttactgtg

SEQ ID NO: 5748197 - DNA, 20 bp, Homo sapiens
gataccacttttcattgcaa

SEQ ID NO: 5748198 - DNA, 14 bp, Homo sapiens
gataccagaaggga

SEQ ID NO: 5748199 - DNA, 16 bp, Homo sapiens
gataccagaggaagtt

SEQ ID NO: 5748200 - DNA, 15 bp, Homo sapiens
gataccagctcaggg

SEQ ID NO: 5748201 - DNA, 16 bp, Homo sapiens
gataccatagagtcca

SEQ ID NO: 5748202 - DNA, 18 bp, Homo sapiens
gataccatatgaatgaaa

SEQ ID NO: 5748203 - DNA, 19 bp, Homo sapiens
gataccatcttctgtacca

SEQ ID NO: 5748204 - DNA, 18 bp, Homo sapiens
gataccatgatgctgagc

SEQ ID NO: 5748205 - DNA, 16 bp, Homo sapiens
gataccattctattct

SEQ ID NO: 5748206 - DNA, 21 bp, Homo sapiens
gataccattctattctccaga

SEQ ID NO: 5748207 - DNA, 22 bp, Homo sapiens
gataccattctattctccagac

SEQ ID NO: 5748208 - DNA, 16 bp, Homo sapiens
gataccattttgaaat

SEQ ID NO: 5748209 - DNA, 18 bp, Homo sapiens
gatacccaacagtttatt

SEQ ID NO: 5748210 - DNA, 14 bp, Homo sapiens
gatacccagagaga

SEQ ID NO: 5748211 - DNA, 13 bp, Homo sapiens
gatacccagtccc

SEQ ID NO: 5748212 - DNA, 20 bp, Homo sapiens
gatacccatagcttccatga

SEQ ID NO: 5748213 - DNA, 21 bp, Homo sapiens
gatacccggtggcttctggca

SEQ ID NO: 5748214 - DNA, 14 bp, Homo sapiens
gataccctctgaga

SEQ ID NO: 5748215 - DNA, 17 bp, Homo sapiens
gatacctccaaccctgc

SEQ ID NO: 5748216 - DNA, 15 bp, Homo sapiens
gatacctgcctggga

SEQ ID NO: 5748217 - DNA, 13 bp, Homo sapiens
gatacctggagca

SEQ ID NO: 5748218 - DNA, 12 bp, Homo sapiens
gatacctgtgag

SEQ ID NO: 5748219 - DNA, 13 bp, Homo sapiens
gatacctgtgagg

SEQ ID NO: 5748220 - DNA, 16 bp, Homo sapiens
gatacctgtgaggact

SEQ ID NO: 5748221 - DNA, 16 bp, Homo sapiens
gataccttgaaaaagt

SEQ ID NO: 5748222 - DNA, 13 bp, Homo sapiens
gatacgactttat

SEQ ID NO: 5748223 - DNA, 22 bp, Homo sapiens
gatacgagttttggccgggtgc

SEQ ID NO: 5748224 - DNA, 18 bp, Homo sapiens
gatacgatgactgacact

SEQ ID NO: 5748225 - DNA, 22 bp, Homo sapiens
gatacgctactataaagagaag

SEQ ID NO: 5748226 - DNA, 20 bp, Homo sapiens
gatacgcttaaggtggaaag

SEQ ID NO: 5748227 - DNA, 17 bp, Homo sapiens
gatacggggtcttgctc

SEQ ID NO: 5748228 - DNA, 17 bp, Homo sapiens
gatacggttgtctagag

SEQ ID NO: 5748229 - DNA, 15 bp, Homo sapiens
gatacgtgtcaatgt

SEQ ID NO: 5748230 - DNA, 16 bp, Homo sapiens
gatactaaaaaggcca

SEQ ID NO: 5748231 - DNA, 18 bp, Homo sapiens
gatactaaagcaaattgt

SEQ ID NO: 5748232 - DNA, 22 bp, Homo sapiens
gatactaataaactaataattg

SEQ ID NO: 5748233 - DNA, 19 bp, Homo sapiens
gatactatttagataacaa

SEQ ID NO: 5748234 - DNA, 14 bp, Homo sapiens
gatactcaaagtgg

SEQ ID NO: 5748235 - DNA, 16 bp, Homo sapiens
gatactcacatgagtt

SEQ ID NO: 5748236 - DNA, 20 bp, Homo sapiens
gatactccatggggtggggg

SEQ ID NO: 5748237 - DNA, 19 bp, Homo sapiens
gatactcctaaaactttta

SEQ ID NO: 5748238 - DNA, 15 bp, Homo sapiens
gatactctcagattt

SEQ ID NO: 5748239 - DNA, 22 bp, Homo sapiens
gatactctccctgacatttcta

SEQ ID NO: 5748240 - DNA, 11 bp, Homo sapiens
gatactctggg

SEQ ID NO: 5748241 - DNA, 13 bp, Homo sapiens
gatactctgggaa

SEQ ID NO: 5748242 - DNA, 13 bp, Homo sapiens
gatactctgtcag

SEQ ID NO: 5748243 - DNA, 12 bp, Homo sapiens
gatactgaaata

SEQ ID NO: 5748244 - DNA, 23 bp, Homo sapiens
gatactgaaatgtgaaaagagca

SEQ ID NO: 5748245 - DNA, 15 bp, Homo sapiens
gatactgaagtgcag

SEQ ID NO: 5748246 - DNA, 15 bp, Homo sapiens
gatactgaatgcata

SEQ ID NO: 5748247 - DNA, 21 bp, Homo sapiens
gatactgacagaagttatttc

SEQ ID NO: 5748248 - DNA, 21 bp, Homo sapiens
gatactgactagtcatagaaa

SEQ ID NO: 5748249 - DNA, 15 bp, Homo sapiens
gatactgacttttta

SEQ ID NO: 5748250 - DNA, 14 bp, Homo sapiens
gatactgcaaaggc

SEQ ID NO: 5748251 - DNA, 18 bp, Homo sapiens
gatactgcagggccagga

SEQ ID NO: 5748252 - DNA, 21 bp, Homo sapiens
gatactgcagggccaggactg

SEQ ID NO: 5748253 - DNA, 23 bp, Homo sapiens
gatactgcgactttctgcctgga

SEQ ID NO: 5748254 - DNA, 23 bp, Homo sapiens
gatactgctactgtaattttata

SEQ ID NO: 5748255 - DNA, 19 bp, Homo sapiens
gatactgcttattttatga

SEQ ID NO: 5748256 - DNA, 14 bp, Homo sapiens
gatactggaagttt

SEQ ID NO: 5748257 - DNA, 16 bp, Homo sapiens
gatactggaagttttg

SEQ ID NO: 5748258 - DNA, 16 bp, Homo sapiens
gatactggattgtact

SEQ ID NO: 5748259 - DNA, 20 bp, Homo sapiens
gatactggggggcaggcctc

SEQ ID NO: 5748260 - DNA, 21 bp, Homo sapiens
gatactggggggcaggcctcc

SEQ ID NO: 5748261 - DNA, 17 bp, Homo sapiens
gatactgtatcatgaca

SEQ ID NO: 5748262 - DNA, 21 bp, Homo sapiens
gatactgtatcatgacaaaga

SEQ ID NO: 5748263 - DNA, 12 bp, Homo sapiens
gatactgtctct

SEQ ID NO: 5748264 - DNA, 17 bp, Homo sapiens
gatactgtcttagaaga

SEQ ID NO: 5748265 - DNA, 13 bp, Homo sapiens
gatactgtgagct

SEQ ID NO: 5748266 - DNA, 19 bp, Homo sapiens
gatactgtgagcttacatt

SEQ ID NO: 5748267 - DNA, 22 bp, Homo sapiens
gatactgtgagcttacattgaa

SEQ ID NO: 5748268 - DNA, 14 bp, Homo sapiens
gatactgtgtatat

SEQ ID NO: 5748269 - DNA, 14 bp, Homo sapiens
gatactgttgcacg

SEQ ID NO: 5748270 - DNA, 16 bp, Homo sapiens
gatactgttgcacgtg

SEQ ID NO: 5748271 - DNA, 21 bp, Homo sapiens
gatactgttgcacgtgtgttt

SEQ ID NO: 5748272 - DNA, 14 bp, Homo sapiens
gatacttaacaaat

SEQ ID NO: 5748273 - DNA, 14 bp, Homo sapiens
gatacttacatgtt

SEQ ID NO: 5748274 - DNA, 17 bp, Homo sapiens
gatacttacatttccat

SEQ ID NO: 5748275 - DNA, 22 bp, Homo sapiens
gatacttacatttccatttatt

SEQ ID NO: 5748276 - DNA, 21 bp, Homo sapiens
gatacttagtggtatgtctct

SEQ ID NO: 5748277 - DNA, 14 bp, Homo sapiens
gatacttatatttt

SEQ ID NO: 5748278 - DNA, 19 bp, Homo sapiens
gatacttatattttcgtat

SEQ ID NO: 5748279 - DNA, 16 bp, Homo sapiens
gatacttatttaaata

SEQ ID NO: 5748280 - DNA, 18 bp, Homo sapiens
gatacttcatttaaaaaa

SEQ ID NO: 5748281 - DNA, 19 bp, Homo sapiens
gatacttcccacaccacaa

SEQ ID NO: 5748282 - DNA, 18 bp, Homo sapiens
gatacttgatgcacttat

SEQ ID NO: 5748283 - DNA, 15 bp, Homo sapiens
gatacttgttttcaa

SEQ ID NO: 5748284 - DNA, 17 bp, Homo sapiens
gatactttagccatcat

SEQ ID NO: 5748285 - DNA, 18 bp, Homo sapiens
gatactttgatattttca

SEQ ID NO: 5748286 - DNA, 19 bp, Homo sapiens
gatactttgtattgtccta

SEQ ID NO: 5748287 - DNA, 21 bp, Homo sapiens
gatactttgtatttttctttt

SEQ ID NO: 5748288 - DNA, 23 bp, Homo sapiens
gatactttttcttttgtaagtgc

SEQ ID NO: 5748289 - DNA, 11 bp, Homo sapiens
gatagaaacag

SEQ ID NO: 5748290 - DNA, 13 bp, Homo sapiens
gatagaactgtac

SEQ ID NO: 5748291 - DNA, 22 bp, Homo sapiens
gatagaagaaggactgaagaaa

SEQ ID NO: 5748292 - DNA, 23 bp, Homo sapiens
gatagaagaaggactgaagaaaa

SEQ ID NO: 5748293 - DNA, 14 bp, Homo sapiens
gatagaagatgttt

SEQ ID NO: 5748294 - DNA, 17 bp, Homo sapiens
gatagaagatgtttgct

SEQ ID NO: 5748295 - DNA, 22 bp, Homo sapiens
gatagaatatttacaataaaga

SEQ ID NO: 5748296 - DNA, 20 bp, Homo sapiens
gatagaatgatgttttaaaa

SEQ ID NO: 5748297 - DNA, 20 bp, Homo sapiens
gatagaatttggcccagaga

SEQ ID NO: 5748298 - DNA, 21 bp, Homo sapiens
gatagacacatatgaggggga

SEQ ID NO: 5748299 - DNA, 13 bp, Homo sapiens
gatagacactgga

SEQ ID NO: 5748300 - DNA, 15 bp, Homo sapiens
gatagacactggaca

SEQ ID NO: 5748301 - DNA, 16 bp, Homo sapiens
gatagacactggacat

SEQ ID NO: 5748302 - DNA, 21 bp, Homo sapiens
gatagacagtaacggtgttta

SEQ ID NO: 5748303 - DNA, 19 bp, Homo sapiens
gatagacagtgctgccctg

SEQ ID NO: 5748304 - DNA, 13 bp, Homo sapiens
gatagacatatac

SEQ ID NO: 5748305 - DNA, 17 bp, Homo sapiens
gatagacctgacaattt

SEQ ID NO: 5748306 - DNA, 18 bp, Homo sapiens
gatagacctgtgacctgg

SEQ ID NO: 5748307 - DNA, 18 bp, Homo sapiens
gatagacgggttgaaaga

SEQ ID NO: 5748308 - DNA, 20 bp, Homo sapiens
gatagacgggttgaaagaca

SEQ ID NO: 5748309 - DNA, 14 bp, Homo sapiens
gatagacttactaa

SEQ ID NO: 5748310 - DNA, 22 bp, Homo sapiens
gatagacttactaataaaatgt

SEQ ID NO: 5748311 - DNA, 19 bp, Homo sapiens
gatagacttcgaaaacaga

SEQ ID NO: 5748312 - DNA, 15 bp, Homo sapiens
gatagacttgggatg

SEQ ID NO: 5748313 - DNA, 20 bp, Homo sapiens
gatagagattcccctggacc

SEQ ID NO: 5748314 - DNA, 14 bp, Homo sapiens
gatagagcctttga

SEQ ID NO: 5748315 - DNA, 14 bp, Homo sapiens
gatagaggaagcct

SEQ ID NO: 5748316 - DNA, 21 bp, Homo sapiens
gatagaggaagcctgattaaa

SEQ ID NO: 5748317 - DNA, 22 bp, Homo sapiens
gatagaggaagcctgattaaag

SEQ ID NO: 5748318 - DNA, 21 bp, Homo sapiens
gatagagtaaaaagaaaacaa

SEQ ID NO: 5748319 - DNA, 12 bp, Homo sapiens
gatagagtgatt

SEQ ID NO: 5748320 - DNA, 14 bp, Homo sapiens
gatagagtgcagtg

SEQ ID NO: 5748321 - DNA, 17 bp, Homo sapiens
gatagataactctttgg

SEQ ID NO: 5748322 - DNA, 23 bp, Homo sapiens
gatagatccatttggacaaaatg

SEQ ID NO: 5748323 - DNA, 21 bp, Homo sapiens
gatagatgtcgtggactccag

SEQ ID NO: 5748324 - DNA, 20 bp, Homo sapiens
gatagatgtgattcctgcat

SEQ ID NO: 5748325 - DNA, 21 bp, Homo sapiens
gatagatgtgattcctgcatt

SEQ ID NO: 5748326 - DNA, 13 bp, Homo sapiens
gatagatgtgtgg

SEQ ID NO: 5748327 - DNA, 22 bp, Homo sapiens
gatagatgtgtggacacattgg

SEQ ID NO: 5748328 - DNA, 20 bp, Homo sapiens
gatagattgtatctcttaaa

SEQ ID NO: 5748329 - DNA, 15 bp, Homo sapiens
gatagatttggaata

SEQ ID NO: 5748330 - DNA, 15 bp, Homo sapiens
gatagatttgtttct

SEQ ID NO: 5748331 - DNA, 23 bp, Homo sapiens
gatagcaaagcgacgttagtcgt

SEQ ID NO: 5748332 - DNA, 20 bp, Homo sapiens
gatagcaagtgaatttttct

SEQ ID NO: 5748333 - DNA, 15 bp, Homo sapiens
gatagcacagaccct

SEQ ID NO: 5748334 - DNA, 20 bp, Homo sapiens
gatagcactttctacaatgt

SEQ ID NO: 5748335 - DNA, 19 bp, Homo sapiens
gatagcagacattgttaca

SEQ ID NO: 5748336 - DNA, 20 bp, Homo sapiens
gatagcaggtgtaataagac

SEQ ID NO: 5748337 - DNA, 23 bp, Homo sapiens
gatagcatatattcatacctgtt

SEQ ID NO: 5748338 - DNA, 16 bp, Homo sapiens
gatagcatatgacaaa

SEQ ID NO: 5748339 - DNA, 23 bp, Homo sapiens
gatagcatcccatctcagaagat

SEQ ID NO: 5748340 - DNA, 13 bp, Homo sapiens
gatagcattgctt

SEQ ID NO: 5748341 - DNA, 17 bp, Homo sapiens
gatagcattgtgaactg

SEQ ID NO: 5748342 - DNA, 23 bp, Homo sapiens
gatagcatttttgatttatgcat

SEQ ID NO: 5748343 - DNA, 19 bp, Homo sapiens
gatagccatttccatggct

SEQ ID NO: 5748344 - DNA, 14 bp, Homo sapiens
gatagcccaggagc

SEQ ID NO: 5748345 - DNA, 15 bp, Homo sapiens
gatagccttgaaaac

SEQ ID NO: 5748346 - DNA, 20 bp, Homo sapiens
gatagccttgaaaacaaaca

SEQ ID NO: 5748347 - DNA, 11 bp, Homo sapiens
gatagcctttg

SEQ ID NO: 5748348 - DNA, 17 bp, Homo sapiens
gatagcgtgcagtagag

SEQ ID NO: 5748349 - DNA, 23 bp, Homo sapiens
gatagcgttggaattaaaacaat

SEQ ID NO: 5748350 - DNA, 19 bp, Homo sapiens
gatagctaactgtaaatca

SEQ ID NO: 5748351 - DNA, 21 bp, Homo sapiens
gatagctactgtagaaaggaa

SEQ ID NO: 5748352 - DNA, 22 bp, Homo sapiens
gatagctactgtagaaaggaaa

SEQ ID NO: 5748353 - DNA, 23 bp, Homo sapiens
gatagctactgtagaaaggaaat

SEQ ID NO: 5748354 - DNA, 15 bp, Homo sapiens
gatagctattaagat

SEQ ID NO: 5748355 - DNA, 16 bp, Homo sapiens
gatagctattaagata

SEQ ID NO: 5748356 - DNA, 21 bp, Homo sapiens
gatagctattttcttacagtg

SEQ ID NO: 5748357 - DNA, 22 bp, Homo sapiens
gatagctcaatactctctgagt

SEQ ID NO: 5748358 - DNA, 17 bp, Homo sapiens
gatagctgactttcatt

SEQ ID NO: 5748359 - DNA, 16 bp, Homo sapiens
gatagcttacactgag

SEQ ID NO: 5748360 - DNA, 23 bp, Homo sapiens
gatagcttacactgaggactgtg

SEQ ID NO: 5748361 - DNA, 16 bp, Homo sapiens
gatagcttgagctcag

SEQ ID NO: 5748362 - DNA, 13 bp, Homo sapiens
gataggaaaagaa

SEQ ID NO: 5748363 - DNA, 14 bp, Homo sapiens
gataggaaactgaa

SEQ ID NO: 5748364 - DNA, 17 bp, Homo sapiens
gataggaactgtctcaa

SEQ ID NO: 5748365 - DNA, 17 bp, Homo sapiens
gataggaaggtcatttc

SEQ ID NO: 5748366 - DNA, 18 bp, Homo sapiens
gataggaatgtgaaagca

SEQ ID NO: 5748367 - DNA, 17 bp, Homo sapiens
gataggaccttgggcca

SEQ ID NO: 5748368 - DNA, 17 bp, Homo sapiens
gataggagaggaaaagg

SEQ ID NO: 5748369 - DNA, 14 bp, Homo sapiens
gataggagctgcag

SEQ ID NO: 5748370 - DNA, 22 bp, Homo sapiens
gataggagggggcggcagggct

SEQ ID NO: 5748371 - DNA, 18 bp, Homo sapiens
gataggagggtgcccctg

SEQ ID NO: 5748372 - DNA, 20 bp, Homo sapiens
gataggagggtgcccctggg

SEQ ID NO: 5748373 - DNA, 21 bp, Homo sapiens
gataggagggtgcccctggga

SEQ ID NO: 5748374 - DNA, 16 bp, Homo sapiens
gataggagttctctga

SEQ ID NO: 5748375 - DNA, 17 bp, Homo sapiens
gataggagttctctgat

SEQ ID NO: 5748376 - DNA, 18 bp, Homo sapiens
gataggcaaggatgaaag

SEQ ID NO: 5748377 - DNA, 23 bp, Homo sapiens
gataggcaggaacatacagacac

SEQ ID NO: 5748378 - DNA, 22 bp, Homo sapiens
gataggcccaaggtcccctcca

SEQ ID NO: 5748379 - DNA, 22 bp, Homo sapiens
gatagggaacactcatccctgg

SEQ ID NO: 5748380 - DNA, 16 bp, Homo sapiens
gatagggagttttaaa

SEQ ID NO: 5748381 - DNA, 21 bp, Homo sapiens
gatagggatacatgctcttag

SEQ ID NO: 5748382 - DNA, 20 bp, Homo sapiens
gataggtcatgcaagtgaga

SEQ ID NO: 5748383 - DNA, 20 bp, Homo sapiens
gataggttttctgctagcca

SEQ ID NO: 5748384 - DNA, 15 bp, Homo sapiens
gatagtaacaatgaa

SEQ ID NO: 5748385 - DNA, 17 bp, Homo sapiens
gatagtactaagcattt

SEQ ID NO: 5748386 - DNA, 14 bp, Homo sapiens
gatagtagatctgt

SEQ ID NO: 5748387 - DNA, 21 bp, Homo sapiens
gatagtagtaaaattagaaaa

SEQ ID NO: 5748388 - DNA, 22 bp, Homo sapiens
gatagtagttaaataactgtgt

SEQ ID NO: 5748389 - DNA, 14 bp, Homo sapiens
gatagtatttataa

SEQ ID NO: 5748390 - DNA, 14 bp, Homo sapiens
gatagtcacctgct

SEQ ID NO: 5748391 - DNA, 17 bp, Homo sapiens
gatagtcacctgctggt

SEQ ID NO: 5748392 - DNA, 22 bp, Homo sapiens
gatagtcatgctgctagatctt

SEQ ID NO: 5748393 - DNA, 22 bp, Homo sapiens
gatagtcctgacctcatgatct

SEQ ID NO: 5748394 - DNA, 18 bp, Homo sapiens
gatagtctctgttcttca

SEQ ID NO: 5748395 - DNA, 14 bp, Homo sapiens
gatagtctggaaag

SEQ ID NO: 5748396 - DNA, 14 bp, Homo sapiens
gatagtctgggtca

SEQ ID NO: 5748397 - DNA, 19 bp, Homo sapiens
gatagtgccaggtggctca

SEQ ID NO: 5748398 - DNA, 13 bp, Homo sapiens
gatagtgctttat

SEQ ID NO: 5748399 - DNA, 13 bp, Homo sapiens
gatagtgggacca

SEQ ID NO: 5748400 - DNA, 17 bp, Homo sapiens
gatagtgggatttccag

SEQ ID NO: 5748401 - DNA, 23 bp, Homo sapiens
gatagtgggcaccccactgcaat

SEQ ID NO: 5748402 - DNA, 23 bp, Homo sapiens
gatagtggggagacttcttggct

SEQ ID NO: 5748403 - DNA, 20 bp, Homo sapiens
gatagtgtgaagatctttgg

SEQ ID NO: 5748404 - DNA, 20 bp, Homo sapiens
gatagtgttctgctcctgct

SEQ ID NO: 5748405 - DNA, 18 bp, Homo sapiens
gatagttgatgcatgtta

SEQ ID NO: 5748406 - DNA, 17 bp, Homo sapiens
gatagtttcatttacaa

SEQ ID NO: 5748407 - DNA, 13 bp, Homo sapiens
gatagttttcatt

SEQ ID NO: 5748408 - DNA, 14 bp, Homo sapiens
gatagttttctcct

SEQ ID NO: 5748409 - DNA, 16 bp, Homo sapiens
gatataaaactctggg

SEQ ID NO: 5748410 - DNA, 20 bp, Homo sapiens
gatataaaaggatgttacaa

SEQ ID NO: 5748411 - DNA, 17 bp, Homo sapiens
gatataaaatgaaagat

SEQ ID NO: 5748412 - DNA, 15 bp, Homo sapiens
gatataaataaaaca

SEQ ID NO: 5748413 - DNA, 22 bp, Homo sapiens
gatataaatactgacaatgtat

SEQ ID NO: 5748414 - DNA, 21 bp, Homo sapiens
gatataaatgcaatattaatg

SEQ ID NO: 5748415 - DNA, 17 bp, Homo sapiens
gatataaattaattgtg

SEQ ID NO: 5748416 - DNA, 12 bp, Homo sapiens
gatataaattct

SEQ ID NO: 5748417 - DNA, 13 bp, Homo sapiens
gatataaattctg

SEQ ID NO: 5748418 - DNA, 14 bp, Homo sapiens
gatataaattctgt

SEQ ID NO: 5748419 - DNA, 21 bp, Homo sapiens
gatataaatttttaagagaaa

SEQ ID NO: 5748420 - DNA, 19 bp, Homo sapiens
gatataacattcagttccc

SEQ ID NO: 5748421 - DNA, 16 bp, Homo sapiens
gatataactttagaaa

SEQ ID NO: 5748422 - DNA, 12 bp, Homo sapiens
gatataagagaa

SEQ ID NO: 5748423 - DNA, 15 bp, Homo sapiens
gatataagagaagtc

SEQ ID NO: 5748424 - DNA, 18 bp, Homo sapiens
gatataagagggcttttt

SEQ ID NO: 5748425 - DNA, 15 bp, Homo sapiens
gatataagatttgta

SEQ ID NO: 5748426 - DNA, 18 bp, Homo sapiens
gatataagatttgtacat

SEQ ID NO: 5748427 - DNA, 13 bp, Homo sapiens
gatataagccata

SEQ ID NO: 5748428 - DNA, 17 bp, Homo sapiens
gatataagtgtgtgttt

SEQ ID NO: 5748429 - DNA, 21 bp, Homo sapiens
gatataataattacttaatgt

SEQ ID NO: 5748430 - DNA, 22 bp, Homo sapiens
gatataatcttggcttcttaaa

SEQ ID NO: 5748431 - DNA, 18 bp, Homo sapiens
gatataatgaacaaaatt

SEQ ID NO: 5748432 - DNA, 17 bp, Homo sapiens
gatataatgtattttca

SEQ ID NO: 5748433 - DNA, 13 bp, Homo sapiens
gatataatgtgtg

SEQ ID NO: 5748434 - DNA, 18 bp, Homo sapiens
gatatacaaagtgtacca

SEQ ID NO: 5748435 - DNA, 21 bp, Homo sapiens
gatatacaaatatatttaatt

SEQ ID NO: 5748436 - DNA, 17 bp, Homo sapiens
gatatacagatgaaaat

SEQ ID NO: 5748437 - DNA, 19 bp, Homo sapiens
gatatacagatgaaaattt

SEQ ID NO: 5748438 - DNA, 21 bp, Homo sapiens
gatatacagatgaaaatttga

SEQ ID NO: 5748439 - DNA, 13 bp, Homo sapiens
gatataccaaatt

SEQ ID NO: 5748440 - DNA, 15 bp, Homo sapiens
gatatactccaggac

SEQ ID NO: 5748441 - DNA, 20 bp, Homo sapiens
gatatagacagtccttaaaa

SEQ ID NO: 5748442 - DNA, 20 bp, Homo sapiens
gatatagatcacataacaga

SEQ ID NO: 5748443 - DNA, 20 bp, Homo sapiens
gatatagcattaataaaact

SEQ ID NO: 5748444 - DNA, 21 bp, Homo sapiens
gatatagctaggtgacatata

SEQ ID NO: 5748445 - DNA, 13 bp, Homo sapiens
gatataggaaaat

SEQ ID NO: 5748446 - DNA, 17 bp, Homo sapiens
gatataggaaaatacat

SEQ ID NO: 5748447 - DNA, 20 bp, Homo sapiens
gatatagtagttacttgtga

SEQ ID NO: 5748448 - DNA, 21 bp, Homo sapiens
gatatagttttacttttaaac

SEQ ID NO: 5748449 - DNA, 24 bp, Homo sapiens
gatatagttttacttttaaactgt

SEQ ID NO: 5748450 - DNA, 15 bp, Homo sapiens
gatatataagtgtac

SEQ ID NO: 5748451 - DNA, 17 bp, Homo sapiens
gatatataagtgtacat

SEQ ID NO: 5748452 - DNA, 15 bp, Homo sapiens
gatatatacaaggtg

SEQ ID NO: 5748453 - DNA, 19 bp, Homo sapiens
gatatataggctattttct

SEQ ID NO: 5748454 - DNA, 13 bp, Homo sapiens
gatatatatcata

SEQ ID NO: 5748455 - DNA, 15 bp, Homo sapiens
gatatatatgtataa

SEQ ID NO: 5748456 - DNA, 16 bp, Homo sapiens
gatatatatttccaaa

SEQ ID NO: 5748457 - DNA, 17 bp, Homo sapiens
gatatatatttccaaat

SEQ ID NO: 5748458 - DNA, 18 bp, Homo sapiens
gatatatgctctgcatgt

SEQ ID NO: 5748459 - DNA, 18 bp, Homo sapiens
gatatatggaggattctt

SEQ ID NO: 5748460 - DNA, 18 bp, Homo sapiens
gatatatgtatctttata

SEQ ID NO: 5748461 - DNA, 22 bp, Homo sapiens
gatatatgtatttattgtcatt

SEQ ID NO: 5748462 - DNA, 21 bp, Homo sapiens
gatatatgtgtatacatacat

SEQ ID NO: 5748463 - DNA, 20 bp, Homo sapiens
gatatatgtgtttttcacat

SEQ ID NO: 5748464 - DNA, 21 bp, Homo sapiens
gatatattctctaataaaatt

SEQ ID NO: 5748465 - DNA, 19 bp, Homo sapiens
gatatatttaaaaatattt

SEQ ID NO: 5748466 - DNA, 14 bp, Homo sapiens
gatatattttacaa

SEQ ID NO: 5748467 - DNA, 16 bp, Homo sapiens
gatatattttctttct

SEQ ID NO: 5748468 - DNA, 12 bp, Homo sapiens
gatatcaaaatt

SEQ ID NO: 5748469 - DNA, 13 bp, Homo sapiens
gatatcaaaggca

SEQ ID NO: 5748470 - DNA, 20 bp, Homo sapiens
gatatcaaggtggaaatggc

SEQ ID NO: 5748471 - DNA, 19 bp, Homo sapiens
gatatcacagtctaatttt

SEQ ID NO: 5748472 - DNA, 19 bp, Homo sapiens
gatatcaccatgatttaat

SEQ ID NO: 5748473 - DNA, 12 bp, Homo sapiens
gatatcacctct

SEQ ID NO: 5748474 - DNA, 18 bp, Homo sapiens
gatatcactaataaagtc

SEQ ID NO: 5748475 - DNA, 18 bp, Homo sapiens
gatatcagagctcttaat

SEQ ID NO: 5748476 - DNA, 18 bp, Homo sapiens
gatatcagagctgggaaa

SEQ ID NO: 5748477 - DNA, 16 bp, Homo sapiens
gatatcagggcacagt

SEQ ID NO: 5748478 - DNA, 22 bp, Homo sapiens
gatatcatgcttggttttcttt

SEQ ID NO: 5748479 - DNA, 22 bp, Homo sapiens
gatatcattttaaaaactttat

SEQ ID NO: 5748480 - DNA, 19 bp, Homo sapiens
gatatccacaaatgctatt

SEQ ID NO: 5748481 - DNA, 19 bp, Homo sapiens
gatatccattctttctgat

SEQ ID NO: 5748482 - DNA, 17 bp, Homo sapiens
gatatccccagggaaac

SEQ ID NO: 5748483 - DNA, 14 bp, Homo sapiens
gatatcctctcccc

SEQ ID NO: 5748484 - DNA, 16 bp, Homo sapiens
gatatcctctccccct

SEQ ID NO: 5748485 - DNA, 16 bp, Homo sapiens
gatatccttatcagag

SEQ ID NO: 5748486 - DNA, 14 bp, Homo sapiens
gatatcgtcatttt

SEQ ID NO: 5748487 - DNA, 17 bp, Homo sapiens
gatatctataaaataga

SEQ ID NO: 5748488 - DNA, 14 bp, Homo sapiens
gatatctatattct

SEQ ID NO: 5748489 - DNA, 17 bp, Homo sapiens
gatatctatattctaaa

SEQ ID NO: 5748490 - DNA, 18 bp, Homo sapiens
gatatctcaatctgcagc

SEQ ID NO: 5748491 - DNA, 20 bp, Homo sapiens
gatatctcaatctgcagcca

SEQ ID NO: 5748492 - DNA, 16 bp, Homo sapiens
gatatctgaaaatatt

SEQ ID NO: 5748493 - DNA, 14 bp, Homo sapiens
gatatctgcatgtg

SEQ ID NO: 5748494 - DNA, 16 bp, Homo sapiens
gatatcttcagtttaa

SEQ ID NO: 5748495 - DNA, 17 bp, Homo sapiens
gatatcttcagtttaat

SEQ ID NO: 5748496 - DNA, 17 bp, Homo sapiens
gatatcttgaaatgaaa

SEQ ID NO: 5748497 - DNA, 13 bp, Homo sapiens
gatatctttctca

SEQ ID NO: 5748498 - DNA, 14 bp, Homo sapiens
gatatctttctcat

SEQ ID NO: 5748499 - DNA, 20 bp, Homo sapiens
gatatctttctcattaccag

SEQ ID NO: 5748500 - DNA, 16 bp, Homo sapiens
gatatcttttctttag

SEQ ID NO: 5748501 - DNA, 22 bp, Homo sapiens
gatatcttttctttagagaact

SEQ ID NO: 5748502 - DNA, 16 bp, Homo sapiens
gatatctttttattga

SEQ ID NO: 5748503 - DNA, 21 bp, Homo sapiens
gatatgaagagcaactgggac

SEQ ID NO: 5748504 - DNA, 12 bp, Homo sapiens
gatatgacaagc

SEQ ID NO: 5748505 - DNA, 17 bp, Homo sapiens
gatatgacccacactgc

SEQ ID NO: 5748506 - DNA, 19 bp, Homo sapiens
gatatgacccacactgcca

SEQ ID NO: 5748507 - DNA, 17 bp, Homo sapiens
gatatgactaattcagg

SEQ ID NO: 5748508 - DNA, 14 bp, Homo sapiens
gatatgagagggat

SEQ ID NO: 5748509 - DNA, 16 bp, Homo sapiens
gatatgagtacatact

SEQ ID NO: 5748510 - DNA, 13 bp, Homo sapiens
gatatgatccaga

SEQ ID NO: 5748511 - DNA, 17 bp, Homo sapiens
gatatgattgtaacata

SEQ ID NO: 5748512 - DNA, 22 bp, Homo sapiens
gatatgcaaattccatagctca

SEQ ID NO: 5748513 - DNA, 14 bp, Homo sapiens
gatatgcagaagga

SEQ ID NO: 5748514 - DNA, 17 bp, Homo sapiens
gatatgcattcaagaga

SEQ ID NO: 5748515 - DNA, 21 bp, Homo sapiens
gatatgccactaacttctaaa

SEQ ID NO: 5748516 - DNA, 11 bp, Homo sapiens
gatatgcctta

SEQ ID NO: 5748517 - DNA, 16 bp, Homo sapiens
gatatgctgagaaatt

SEQ ID NO: 5748518 - DNA, 19 bp, Homo sapiens
gatatgctgcttgtgacct

SEQ ID NO: 5748519 - DNA, 20 bp, Homo sapiens
gatatgctgtattttaaagg

SEQ ID NO: 5748520 - DNA, 14 bp, Homo sapiens
gatatgcttactaa

SEQ ID NO: 5748521 - DNA, 22 bp, Homo sapiens
gatatgcttgtaactaaaataa

SEQ ID NO: 5748522 - DNA, 19 bp, Homo sapiens
gatatgctttaagacagaa

SEQ ID NO: 5748523 - DNA, 20 bp, Homo sapiens
gatatggcaggactcctggc

SEQ ID NO: 5748524 - DNA, 22 bp, Homo sapiens
gatatggcaggactcctggcag

SEQ ID NO: 5748525 - DNA, 22 bp, Homo sapiens
gatatggcattgcactgcttat

SEQ ID NO: 5748526 - DNA, 16 bp, Homo sapiens
gatatggcggcctgca

SEQ ID NO: 5748527 - DNA, 16 bp, Homo sapiens
gatatggctgcccagg

SEQ ID NO: 5748528 - DNA, 20 bp, Homo sapiens
gatatgggactgagcctggc

SEQ ID NO: 5748529 - DNA, 22 bp, Homo sapiens
gatatgggactgagcctggccc

SEQ ID NO: 5748530 - DNA, 18 bp, Homo sapiens
gatatgggtagtattttt

SEQ ID NO: 5748531 - DNA, 15 bp, Homo sapiens
gatatgtaaattaaa

SEQ ID NO: 5748532 - DNA, 20 bp, Homo sapiens
gatatgtacctaacgaagta

SEQ ID NO: 5748533 - DNA, 17 bp, Homo sapiens
gatatgtatatttttga

SEQ ID NO: 5748534 - DNA, 20 bp, Homo sapiens
gatatgtatgttgtgaatta

SEQ ID NO: 5748535 - DNA, 22 bp, Homo sapiens
gatatgtattacttttctgcaa

SEQ ID NO: 5748536 - DNA, 14 bp, Homo sapiens
gatatgtattctaa

SEQ ID NO: 5748537 - DNA, 20 bp, Homo sapiens
gatatgtccagtcatcctgc

SEQ ID NO: 5748538 - DNA, 15 bp, Homo sapiens
gatatgtctttaaaa

SEQ ID NO: 5748539 - DNA, 13 bp, Homo sapiens
gatatgtgaacag

SEQ ID NO: 5748540 - DNA, 18 bp, Homo sapiens
gatatgtgcttgtgtgta

SEQ ID NO: 5748541 - DNA, 16 bp, Homo sapiens
gatatgttgatgaaat

SEQ ID NO: 5748542 - DNA, 18 bp, Homo sapiens
gatattaaaacacaaagt

SEQ ID NO: 5748543 - DNA, 16 bp, Homo sapiens
gatattaaaatgctag

SEQ ID NO: 5748544 - DNA, 13 bp, Homo sapiens
gatattaaatttc

SEQ ID NO: 5748545 - DNA, 14 bp, Homo sapiens
gatattaaatttca

SEQ ID NO: 5748546 - DNA, 22 bp, Homo sapiens
gatattaagaactgctgtttca

SEQ ID NO: 5748547 - DNA, 13 bp, Homo sapiens
gatattaagaatc

SEQ ID NO: 5748548 - DNA, 12 bp, Homo sapiens
gatattaatcaa

SEQ ID NO: 5748549 - DNA, 17 bp, Homo sapiens
gatattaatgcccagac

SEQ ID NO: 5748550 - DNA, 13 bp, Homo sapiens
gatattactttat

SEQ ID NO: 5748551 - DNA, 16 bp, Homo sapiens
gatattagtcctacac

SEQ ID NO: 5748552 - DNA, 12 bp, Homo sapiens
gatattatagaa

SEQ ID NO: 5748553 - DNA, 15 bp, Homo sapiens
gatattatagaaaat

SEQ ID NO: 5748554 - DNA, 18 bp, Homo sapiens
gatattatatacaacaca

SEQ ID NO: 5748555 - DNA, 16 bp, Homo sapiens
gatattatggcaagtg

SEQ ID NO: 5748556 - DNA, 19 bp, Homo sapiens
gatattatgtataaaatgt

SEQ ID NO: 5748557 - DNA, 21 bp, Homo sapiens
gatattatgtataaaatgtaa

SEQ ID NO: 5748558 - DNA, 18 bp, Homo sapiens
gatattatgtatagaaaa

SEQ ID NO: 5748559 - DNA, 20 bp, Homo sapiens
gatattatgtatagaaaata

SEQ ID NO: 5748560 - DNA, 16 bp, Homo sapiens
gatattatgtggcttt

SEQ ID NO: 5748561 - DNA, 13 bp, Homo sapiens
gatattatttctt

SEQ ID NO: 5748562 - DNA, 18 bp, Homo sapiens
gatattatttcttctctt

SEQ ID NO: 5748563 - DNA, 20 bp, Homo sapiens
gatattattttaaatttctt

SEQ ID NO: 5748564 - DNA, 23 bp, Homo sapiens
gatattattttagcttcagttgt

SEQ ID NO: 5748565 - DNA, 16 bp, Homo sapiens
gatattcaaacacaca

SEQ ID NO: 5748566 - DNA, 18 bp, Homo sapiens
gatattcaaacacacagt

SEQ ID NO: 5748567 - DNA, 16 bp, Homo sapiens
gatattcaagcctttg

SEQ ID NO: 5748568 - DNA, 19 bp, Homo sapiens
gatattcaagcctttggat

SEQ ID NO: 5748569 - DNA, 18 bp, Homo sapiens
gatattcaaggctttaaa

SEQ ID NO: 5748570 - DNA, 17 bp, Homo sapiens
gatattcaatcttaaca

SEQ ID NO: 5748571 - DNA, 16 bp, Homo sapiens
gatattcatattcaag

SEQ ID NO: 5748572 - DNA, 15 bp, Homo sapiens
gatattccaaaataa

SEQ ID NO: 5748573 - DNA, 16 bp, Homo sapiens
gatattccatgaatgt

SEQ ID NO: 5748574 - DNA, 19 bp, Homo sapiens
gatattccatgaatgtatc

SEQ ID NO: 5748575 - DNA, 14 bp, Homo sapiens
gatattcccagggc

SEQ ID NO: 5748576 - DNA, 22 bp, Homo sapiens
gatattcctattgtgcaatgta

SEQ ID NO: 5748577 - DNA, 23 bp, Homo sapiens
gatattctaagaaatatctgtga

SEQ ID NO: 5748578 - DNA, 18 bp, Homo sapiens
gatattctggattataaa

SEQ ID NO: 5748579 - DNA, 14 bp, Homo sapiens
gatattctttacaa

SEQ ID NO: 5748580 - DNA, 21 bp, Homo sapiens
gatattctttgttaatttgga

SEQ ID NO: 5748581 - DNA, 20 bp, Homo sapiens
gatattgaaggagaaaatag

SEQ ID NO: 5748582 - DNA, 13 bp, Homo sapiens
gatattgaatgtt

SEQ ID NO: 5748583 - DNA, 16 bp, Homo sapiens
gatattgaccatgtga

SEQ ID NO: 5748584 - DNA, 24 bp, Homo sapiens
gatattgatgataacacttaaaat

SEQ ID NO: 5748585 - DNA, 11 bp, Homo sapiens
gatattgcctt

SEQ ID NO: 5748586 - DNA, 18 bp, Homo sapiens
gatattgctaattgtgta

SEQ ID NO: 5748587 - DNA, 17 bp, Homo sapiens
gatattgctactataat

SEQ ID NO: 5748588 - DNA, 15 bp, Homo sapiens
gatattggaacttgc

SEQ ID NO: 5748589 - DNA, 22 bp, Homo sapiens
gatattgggaaggaaatatatt

SEQ ID NO: 5748590 - DNA, 22 bp, Homo sapiens
gatattgggacacacatcaaaa

SEQ ID NO: 5748591 - DNA, 20 bp, Homo sapiens
gatattggtgtgaatgctgt

SEQ ID NO: 5748592 - DNA, 14 bp, Homo sapiens
gatattgtacataa

SEQ ID NO: 5748593 - DNA, 16 bp, Homo sapiens
gatattgtacataaaa

SEQ ID NO: 5748594 - DNA, 14 bp, Homo sapiens
gatattgtattatc

SEQ ID NO: 5748595 - DNA, 17 bp, Homo sapiens
gatattgtattatcata

SEQ ID NO: 5748596 - DNA, 22 bp, Homo sapiens
gatattgtcagagttctgctct

SEQ ID NO: 5748597 - DNA, 19 bp, Homo sapiens
gatattgtcctaagtgtca

SEQ ID NO: 5748598 - DNA, 20 bp, Homo sapiens
gatattgtgaacatttgtga

SEQ ID NO: 5748599 - DNA, 13 bp, Homo sapiens
gatattgttcaaa

SEQ ID NO: 5748600 - DNA, 16 bp, Homo sapiens
gatattgtttaaaatt

SEQ ID NO: 5748601 - DNA, 20 bp, Homo sapiens
gatattgtttgctgttgggt

SEQ ID NO: 5748602 - DNA, 20 bp, Homo sapiens
gatatttaaaagacaaacac

SEQ ID NO: 5748603 - DNA, 14 bp, Homo sapiens
gatatttaaattta

SEQ ID NO: 5748604 - DNA, 15 bp, Homo sapiens
gatatttaagaaaat

SEQ ID NO: 5748605 - DNA, 20 bp, Homo sapiens
gatatttaagaaaatacaat

SEQ ID NO: 5748606 - DNA, 23 bp, Homo sapiens
gatatttaagaaaatacaataaa

SEQ ID NO: 5748607 - DNA, 15 bp, Homo sapiens
gatatttatatgtta

SEQ ID NO: 5748608 - DNA, 13 bp, Homo sapiens
gatatttatgtat

SEQ ID NO: 5748609 - DNA, 15 bp, Homo sapiens
gatatttatgtatct

SEQ ID NO: 5748610 - DNA, 16 bp, Homo sapiens
gatatttatgtatctt

SEQ ID NO: 5748611 - DNA, 18 bp, Homo sapiens
gatatttatgtatcttga

SEQ ID NO: 5748612 - DNA, 16 bp, Homo sapiens
gatatttattgatgtt

SEQ ID NO: 5748613 - DNA, 17 bp, Homo sapiens
gatatttattgatgttt

SEQ ID NO: 5748614 - DNA, 19 bp, Homo sapiens
gatatttatttaaacaaat

SEQ ID NO: 5748615 - DNA, 23 bp, Homo sapiens
gatatttatttaaacaaatgtgt

SEQ ID NO: 5748616 - DNA, 16 bp, Homo sapiens
gatatttcaaatgatt

SEQ ID NO: 5748617 - DNA, 13 bp, Homo sapiens
gatatttcaatct

SEQ ID NO: 5748618 - DNA, 16 bp, Homo sapiens
gatatttcagaaatac

SEQ ID NO: 5748619 - DNA, 20 bp, Homo sapiens
gatatttcatgtgctataga

SEQ ID NO: 5748620 - DNA, 13 bp, Homo sapiens
gatatttccaaga

SEQ ID NO: 5748621 - DNA, 17 bp, Homo sapiens
gatatttccatcattaa

SEQ ID NO: 5748622 - DNA, 22 bp, Homo sapiens
gatatttccatttcttcctcac

SEQ ID NO: 5748623 - DNA, 17 bp, Homo sapiens
gatatttcctaaggcat

SEQ ID NO: 5748624 - DNA, 18 bp, Homo sapiens
gatatttcgtgtactgca

SEQ ID NO: 5748625 - DNA, 15 bp, Homo sapiens
gatatttctagctta

SEQ ID NO: 5748626 - DNA, 22 bp, Homo sapiens
gatatttctctagtagttaaaa

SEQ ID NO: 5748627 - DNA, 14 bp, Homo sapiens
gatatttcttgctt

SEQ ID NO: 5748628 - DNA, 16 bp, Homo sapiens
gatatttcttgctttc

SEQ ID NO: 5748629 - DNA, 12 bp, Homo sapiens
gatatttgaaat

SEQ ID NO: 5748630 - DNA, 14 bp, Homo sapiens
gatatttgaatctt

SEQ ID NO: 5748631 - DNA, 17 bp, Homo sapiens
gatatttgatatttggt

SEQ ID NO: 5748632 - DNA, 18 bp, Homo sapiens
gatatttgcacttatgta

SEQ ID NO: 5748633 - DNA, 18 bp, Homo sapiens
gatatttgcagtttttca

SEQ ID NO: 5748634 - DNA, 22 bp, Homo sapiens
gatatttgctggagtgctggct

SEQ ID NO: 5748635 - DNA, 13 bp, Homo sapiens
gatatttgtgcat

SEQ ID NO: 5748636 - DNA, 14 bp, Homo sapiens
gatatttgtgtaaa

SEQ ID NO: 5748637 - DNA, 23 bp, Homo sapiens
gatattttatctattggcctgtt

SEQ ID NO: 5748638 - DNA, 18 bp, Homo sapiens
gatattttcaaattgtat

SEQ ID NO: 5748639 - DNA, 19 bp, Homo sapiens
gatattttccatatattgg

SEQ ID NO: 5748640 - DNA, 18 bp, Homo sapiens
gatattttccctacctaa

SEQ ID NO: 5748641 - DNA, 21 bp, Homo sapiens
gatattttccctttttaaaaa

SEQ ID NO: 5748642 - DNA, 23 bp, Homo sapiens
gatattttccctttttaaaaaat

SEQ ID NO: 5748643 - DNA, 14 bp, Homo sapiens
gatattttctctag

SEQ ID NO: 5748644 - DNA, 20 bp, Homo sapiens
gatattttgaaatgaacttt

SEQ ID NO: 5748645 - DNA, 13 bp, Homo sapiens
gatatttttaaaa

SEQ ID NO: 5748646 - DNA, 13 bp, Homo sapiens
gatatttttaata

SEQ ID NO: 5748647 - DNA, 17 bp, Homo sapiens
gatatttttcataaaca

SEQ ID NO: 5748648 - DNA, 18 bp, Homo sapiens
gatatttttcataaacaa

SEQ ID NO: 5748649 - DNA, 14 bp, Homo sapiens
gatatttttgtact

SEQ ID NO: 5748650 - DNA, 15 bp, Homo sapiens
gatatttttgtactt

SEQ ID NO: 5748651 - DNA, 21 bp, Homo sapiens
gatatttttgtacttgatttg

SEQ ID NO: 5748652 - DNA, 16 bp, Homo sapiens
gatattttttctgaat

SEQ ID NO: 5748653 - DNA, 22 bp, Homo sapiens
gatattttttggtgtgccctgt

SEQ ID NO: 5748654 - DNA, 21 bp, Homo sapiens
gatatttttttacttgagcaa

SEQ ID NO: 5748655 - DNA, 17 bp, Homo sapiens
gatatttttttcttttc

SEQ ID NO: 5748656 - DNA, 15 bp, Homo sapiens
gatcaaaaaaatata

SEQ ID NO: 5748657 - DNA, 13 bp, Homo sapiens
gatcaaaaataaa

SEQ ID NO: 5748658 - DNA, 14 bp, Homo sapiens
gatcaaaaataaac

SEQ ID NO: 5748659 - DNA, 15 bp, Homo sapiens
gatcaaaaccttcct

SEQ ID NO: 5748660 - DNA, 19 bp, Homo sapiens
gatcaaaaccttccttccc

SEQ ID NO: 5748661 - DNA, 17 bp, Homo sapiens
gatcaaaataaaaagtg

SEQ ID NO: 5748662 - DNA, 20 bp, Homo sapiens
gatcaaaataaaaagtgaca

SEQ ID NO: 5748663 - DNA, 13 bp, Homo sapiens
gatcaaaatcaaa

SEQ ID NO: 5748664 - DNA, 14 bp, Homo sapiens
gatcaaaatgcata

SEQ ID NO: 5748665 - DNA, 15 bp, Homo sapiens
gatcaaagatgaaaa

SEQ ID NO: 5748666 - DNA, 17 bp, Homo sapiens
gatcaaaggcacacagc

SEQ ID NO: 5748667 - DNA, 17 bp, Homo sapiens
gatcaaatactttaaag

SEQ ID NO: 5748668 - DNA, 17 bp, Homo sapiens
gatcaaatatagaaagt

SEQ ID NO: 5748669 - DNA, 14 bp, Homo sapiens
gatcaaatgtacat

SEQ ID NO: 5748670 - DNA, 16 bp, Homo sapiens
gatcaaattctacaac

SEQ ID NO: 5748671 - DNA, 19 bp, Homo sapiens
gatcaacaacatccactgt

SEQ ID NO: 5748672 - DNA, 16 bp, Homo sapiens
gatcaacatcttttct

SEQ ID NO: 5748673 - DNA, 17 bp, Homo sapiens
gatcaacatcttttctt

SEQ ID NO: 5748674 - DNA, 17 bp, Homo sapiens
gatcaacatttatgacc

SEQ ID NO: 5748675 - DNA, 18 bp, Homo sapiens
gatcaaccagctaagaaa

SEQ ID NO: 5748676 - DNA, 16 bp, Homo sapiens
gatcaaccaggcagag

SEQ ID NO: 5748677 - DNA, 16 bp, Homo sapiens
gatcaacgcctcactg

SEQ ID NO: 5748678 - DNA, 13 bp, Homo sapiens
gatcaactgttca

SEQ ID NO: 5748679 - DNA, 13 bp, Homo sapiens
gatcaagaatctt

SEQ ID NO: 5748680 - DNA, 20 bp, Homo sapiens
gatcaagcaataataatttt

SEQ ID NO: 5748681 - DNA, 20 bp, Homo sapiens
gatcaagcatgaaaggcttt

SEQ ID NO: 5748682 - DNA, 12 bp, Homo sapiens
gatcaagccagt

SEQ ID NO: 5748683 - DNA, 15 bp, Homo sapiens
gatcaagcctgcctc

SEQ ID NO: 5748684 - DNA, 19 bp, Homo sapiens
gatcaaggagggagaaagg

SEQ ID NO: 5748685 - DNA, 22 bp, Homo sapiens
gatcaaggccttattggaaagc

SEQ ID NO: 5748686 - DNA, 22 bp, Homo sapiens
gatcaaggggttcccactggct

SEQ ID NO: 5748687 - DNA, 22 bp, Homo sapiens
gatcaaggtgctcttctcattt

SEQ ID NO: 5748688 - DNA, 22 bp, Homo sapiens
gatcaagtcctttgtgaatatt

SEQ ID NO: 5748689 - DNA, 17 bp, Homo sapiens
gatcaagttcagccacc

SEQ ID NO: 5748690 - DNA, 16 bp, Homo sapiens
gatcaagttgttgact

SEQ ID NO: 5748691 - DNA, 18 bp, Homo sapiens
gatcaataaaatgtgatt

SEQ ID NO: 5748692 - DNA, 22 bp, Homo sapiens
gatcaatcctttattattattt

SEQ ID NO: 5748693 - DNA, 13 bp, Homo sapiens
gatcaatgaaatg

SEQ ID NO: 5748694 - DNA, 18 bp, Homo sapiens
gatcaatgacagagcctt

SEQ ID NO: 5748695 - DNA, 22 bp, Homo sapiens
gatcaatggcgcagtgcctctg

SEQ ID NO: 5748696 - DNA, 16 bp, Homo sapiens
gatcaattatagtttc

SEQ ID NO: 5748697 - DNA, 18 bp, Homo sapiens
gatcaattatagtttctg

SEQ ID NO: 5748698 - DNA, 18 bp, Homo sapiens
gatcaattccctctctca

SEQ ID NO: 5748699 - DNA, 20 bp, Homo sapiens
gatcaattccctctctcagc

SEQ ID NO: 5748700 - DNA, 19 bp, Homo sapiens
gatcaattttcattaaact

SEQ ID NO: 5748701 - DNA, 12 bp, Homo sapiens
gatcacaaatga

SEQ ID NO: 5748702 - DNA, 13 bp, Homo sapiens
gatcacaaatgac

SEQ ID NO: 5748703 - DNA, 16 bp, Homo sapiens
gatcacaacgtgcatt

SEQ ID NO: 5748704 - DNA, 17 bp, Homo sapiens
gatcacaacgtgcattg

SEQ ID NO: 5748705 - DNA, 18 bp, Homo sapiens
gatcacaacgtgcattgt

SEQ ID NO: 5748706 - DNA, 14 bp, Homo sapiens
gatcacaagatgga

SEQ ID NO: 5748707 - DNA, 23 bp, Homo sapiens
gatcacacacaccaaaccagaca

SEQ ID NO: 5748708 - DNA, 15 bp, Homo sapiens
gatcacacagctaat

SEQ ID NO: 5748709 - DNA, 15 bp, Homo sapiens
gatcacacagtgtta

SEQ ID NO: 5748710 - DNA, 22 bp, Homo sapiens
gatcacaccactgcactccagc

SEQ ID NO: 5748711 - DNA, 18 bp, Homo sapiens
gatcacacctcagtggga

SEQ ID NO: 5748712 - DNA, 13 bp, Homo sapiens
gatcacagaccac

SEQ ID NO: 5748713 - DNA, 19 bp, Homo sapiens
gatcacagagacattcctc

SEQ ID NO: 5748714 - DNA, 13 bp, Homo sapiens
gatcacagatgtg

SEQ ID NO: 5748715 - DNA, 14 bp, Homo sapiens
gatcacagatgtgc

SEQ ID NO: 5748716 - DNA, 24 bp, Homo sapiens
gatcacagatgtgcccagagtagc

SEQ ID NO: 5748717 - DNA, 16 bp, Homo sapiens
gatcacagcagcttct

SEQ ID NO: 5748718 - DNA, 19 bp, Homo sapiens
gatcacagcctccagggcc

SEQ ID NO: 5748719 - DNA, 15 bp, Homo sapiens
gatcacagctcacgg

SEQ ID NO: 5748720 - DNA, 12 bp, Homo sapiens
gatcacagctcc

SEQ ID NO: 5748721 - DNA, 13 bp, Homo sapiens
gatcacagctgct

SEQ ID NO: 5748722 - DNA, 20 bp, Homo sapiens
gatcacagctgctttctgtt

SEQ ID NO: 5748723 - DNA, 13 bp, Homo sapiens
gatcacaggcctt

SEQ ID NO: 5748724 - DNA, 22 bp, Homo sapiens
gatcacagtggcgagaggagag

SEQ ID NO: 5748725 - DNA, 16 bp, Homo sapiens
gatcacatattctagt

SEQ ID NO: 5748726 - DNA, 17 bp, Homo sapiens
gatcacatctaaagctt

SEQ ID NO: 5748727 - DNA, 17 bp, Homo sapiens
gatcacatcttaaattc

SEQ ID NO: 5748728 - DNA, 16 bp, Homo sapiens
gatcacatgtggactt

SEQ ID NO: 5748729 - DNA, 23 bp, Homo sapiens
gatcacatttcaggacatttgga

SEQ ID NO: 5748730 - DNA, 14 bp, Homo sapiens
gatcaccagcccgg

SEQ ID NO: 5748731 - DNA, 15 bp, Homo sapiens
gatcaccagcccggc

SEQ ID NO: 5748732 - DNA, 20 bp, Homo sapiens
gatcaccatgttagccttag

SEQ ID NO: 5748733 - DNA, 15 bp, Homo sapiens
gatcaccattatatt

SEQ ID NO: 5748734 - DNA, 16 bp, Homo sapiens
gatcaccccagccccc

SEQ ID NO: 5748735 - DNA, 17 bp, Homo sapiens
gatcaccctgaattcat

SEQ ID NO: 5748736 - DNA, 13 bp, Homo sapiens
gatcacctgaggt

SEQ ID NO: 5748737 - DNA, 14 bp, Homo sapiens
gatcacgccactgc

SEQ ID NO: 5748738 - DNA, 24 bp, Homo sapiens
gatcacgccactgcactccagcct

SEQ ID NO: 5748739 - DNA, 14 bp, Homo sapiens
gatcacgctccccg

SEQ ID NO: 5748740 - DNA, 22 bp, Homo sapiens
gatcacgctccccgcctgttcc

SEQ ID NO: 5748741 - DNA, 12 bp, Homo sapiens
gatcacggctca

SEQ ID NO: 5748742 - DNA, 18 bp, Homo sapiens
gatcactagcctgtcatc

SEQ ID NO: 5748743 - DNA, 18 bp, Homo sapiens
gatcactatgcattttaa

SEQ ID NO: 5748744 - DNA, 22 bp, Homo sapiens
gatcactcccagcactcccctt

SEQ ID NO: 5748745 - DNA, 16 bp, Homo sapiens
gatcactctctgctgg

SEQ ID NO: 5748746 - DNA, 17 bp, Homo sapiens
gatcactctctgctggc

SEQ ID NO: 5748747 - DNA, 20 bp, Homo sapiens
gatcactctctgctggcagg

SEQ ID NO: 5748748 - DNA, 18 bp, Homo sapiens
gatcactgaaataaaagc

SEQ ID NO: 5748749 - DNA, 17 bp, Homo sapiens
gatcactgaatttataa

SEQ ID NO: 5748750 - DNA, 18 bp, Homo sapiens
gatcactgccctttttga

SEQ ID NO: 5748751 - DNA, 12 bp, Homo sapiens
gatcactggagc

SEQ ID NO: 5748752 - DNA, 14 bp, Homo sapiens
gatcactggagccc

SEQ ID NO: 5748753 - DNA, 18 bp, Homo sapiens
gatcactggagcccagga

SEQ ID NO: 5748754 - DNA, 21 bp, Homo sapiens
gatcactggctggcctgagca

SEQ ID NO: 5748755 - DNA, 21 bp, Homo sapiens
gatcactgtagtttagttctg

SEQ ID NO: 5748756 - DNA, 22 bp, Homo sapiens
gatcactgtagtttagttctgt

SEQ ID NO: 5748757 - DNA, 18 bp, Homo sapiens
gatcactgtttagatttg

SEQ ID NO: 5748758 - DNA, 21 bp, Homo sapiens
gatcactgtttagatttgcca

SEQ ID NO: 5748759 - DNA, 15 bp, Homo sapiens
gatcacttgttgttt

SEQ ID NO: 5748760 - DNA, 22 bp, Homo sapiens
gatcactttctcagttttcata

SEQ ID NO: 5748761 - DNA, 18 bp, Homo sapiens
gatcagaaaaatggagca

SEQ ID NO: 5748762 - DNA, 11 bp, Homo sapiens
gatcagaaagt

SEQ ID NO: 5748763 - DNA, 15 bp, Homo sapiens
gatcagaaagtgaca

SEQ ID NO: 5748764 - DNA, 16 bp, Homo sapiens
gatcagaaagtgacat

SEQ ID NO: 5748765 - DNA, 15 bp, Homo sapiens
gatcagaaatacaga

SEQ ID NO: 5748766 - DNA, 13 bp, Homo sapiens
gatcagaacaaat

SEQ ID NO: 5748767 - DNA, 20 bp, Homo sapiens
gatcagaacattcagctctg

SEQ ID NO: 5748768 - DNA, 22 bp, Homo sapiens
gatcagaactgggaaaacagtg

SEQ ID NO: 5748769 - DNA, 13 bp, Homo sapiens
gatcagaaggctg

SEQ ID NO: 5748770 - DNA, 21 bp, Homo sapiens
gatcagaaggctggggccagt

SEQ ID NO: 5748771 - DNA, 16 bp, Homo sapiens
gatcagaagtaggaag

SEQ ID NO: 5748772 - DNA, 22 bp, Homo sapiens
gatcagaagtaggaaggaaaaa

SEQ ID NO: 5748773 - DNA, 21 bp, Homo sapiens
gatcagacagatctggaatgt

SEQ ID NO: 5748774 - DNA, 20 bp, Homo sapiens
gatcagaccaaacagtgctg

SEQ ID NO: 5748775 - DNA, 17 bp, Homo sapiens
gatcagacttgatttac

SEQ ID NO: 5748776 - DNA, 22 bp, Homo sapiens
gatcagacttgatttacaagca

SEQ ID NO: 5748777 - DNA, 12 bp, Homo sapiens
gatcagagagca

SEQ ID NO: 5748778 - DNA, 13 bp, Homo sapiens
gatcagagagcaa

SEQ ID NO: 5748779 - DNA, 14 bp, Homo sapiens
gatcagagcagcag

SEQ ID NO: 5748780 - DNA, 15 bp, Homo sapiens
gatcagagcaggacc

SEQ ID NO: 5748781 - DNA, 15 bp, Homo sapiens
gatcagagcaggagc

SEQ ID NO: 5748782 - DNA, 15 bp, Homo sapiens
gatcagagcattgtg

SEQ ID NO: 5748783 - DNA, 15 bp, Homo sapiens
gatcagagcatttat

SEQ ID NO: 5748784 - DNA, 15 bp, Homo sapiens
gatcagaggagtaaa

SEQ ID NO: 5748785 - DNA, 21 bp, Homo sapiens
gatcagaggcatttgagcagc

SEQ ID NO: 5748786 - DNA, 22 bp, Homo sapiens
gatcagaggcatttgagcagct

SEQ ID NO: 5748787 - DNA, 23 bp, Homo sapiens
gatcagaggcatttgagcagctg

SEQ ID NO: 5748788 - DNA, 15 bp, Homo sapiens
gatcagaggtgtaca

SEQ ID NO: 5748789 - DNA, 20 bp, Homo sapiens
gatcagatagcaggaggaac

SEQ ID NO: 5748790 - DNA, 19 bp, Homo sapiens
gatcagatcttacaagttt

SEQ ID NO: 5748791 - DNA, 17 bp, Homo sapiens
gatcagatgactagaaa

SEQ ID NO: 5748792 - DNA, 16 bp, Homo sapiens
gatcagattcttgctg

SEQ ID NO: 5748793 - DNA, 21 bp, Homo sapiens
gatcagattcttgctgtgacc

SEQ ID NO: 5748794 - DNA, 19 bp, Homo sapiens
gatcagcaaaccggggcct

SEQ ID NO: 5748795 - DNA, 16 bp, Homo sapiens
gatcagcaaatttaag

SEQ ID NO: 5748796 - DNA, 14 bp, Homo sapiens
gatcagcagaagat

SEQ ID NO: 5748797 - DNA, 13 bp, Homo sapiens
gatcagcattgtg

SEQ ID NO: 5748798 - DNA, 14 bp, Homo sapiens
gatcagccagaagc

SEQ ID NO: 5748799 - DNA, 15 bp, Homo sapiens
gatcagccagaagcc

SEQ ID NO: 5748800 - DNA, 16 bp, Homo sapiens
gatcagccattaaaat

SEQ ID NO: 5748801 - DNA, 18 bp, Homo sapiens
gatcagccattaaaataa

SEQ ID NO: 5748802 - DNA, 21 bp, Homo sapiens
gatcagccccaccctggccta

SEQ ID NO: 5748803 - DNA, 23 bp, Homo sapiens
gatcagccccaccctggcctaga

SEQ ID NO: 5748804 - DNA, 11 bp, Homo sapiens
gatcagcctcc

SEQ ID NO: 5748805 - DNA, 14 bp, Homo sapiens
gatcagcctgtgcc

SEQ ID NO: 5748806 - DNA, 13 bp, Homo sapiens
gatcagcgtggcc

SEQ ID NO: 5748807 - DNA, 15 bp, Homo sapiens
gatcagcgtggcctt

SEQ ID NO: 5748808 - DNA, 20 bp, Homo sapiens
gatcagctattcccttctga

SEQ ID NO: 5748809 - DNA, 17 bp, Homo sapiens
gatcagctgtttgtcat

SEQ ID NO: 5748810 - DNA, 20 bp, Homo sapiens
gatcagctttgaaggctgga

SEQ ID NO: 5748811 - DNA, 22 bp, Homo sapiens
gatcaggaaccagggcctccct

SEQ ID NO: 5748812 - DNA, 18 bp, Homo sapiens
gatcaggaagagaaggag

SEQ ID NO: 5748813 - DNA, 16 bp, Homo sapiens
gatcaggagagcaagg

SEQ ID NO: 5748814 - DNA, 11 bp, Homo sapiens
gatcaggagcc

SEQ ID NO: 5748815 - DNA, 22 bp, Homo sapiens
gatcaggagcccccaacacagg

SEQ ID NO: 5748816 - DNA, 14 bp, Homo sapiens
gatcaggaggaagt

SEQ ID NO: 5748817 - DNA, 17 bp, Homo sapiens
gatcaggatcagctttg

SEQ ID NO: 5748818 - DNA, 13 bp, Homo sapiens
gatcaggcacagg

SEQ ID NO: 5748819 - DNA, 15 bp, Homo sapiens
gatcaggcacaggtc

SEQ ID NO: 5748820 - DNA, 16 bp, Homo sapiens
gatcaggcacaggtca

SEQ ID NO: 5748821 - DNA, 12 bp, Homo sapiens
gatcaggcccca

SEQ ID NO: 5748822 - DNA, 17 bp, Homo sapiens
gatcaggccccacccct

SEQ ID NO: 5748823 - DNA, 17 bp, Homo sapiens
gatcaggctagccctgc

SEQ ID NO: 5748824 - DNA, 14 bp, Homo sapiens
gatcaggctcccag

SEQ ID NO: 5748825 - DNA, 15 bp, Homo sapiens
gatcaggctcccagg

SEQ ID NO: 5748826 - DNA, 16 bp, Homo sapiens
gatcaggcttcctggt

SEQ ID NO: 5748827 - DNA, 19 bp, Homo sapiens
gatcagggaatccagctcc

SEQ ID NO: 5748828 - DNA, 20 bp, Homo sapiens
gatcagggaatccagctccc

SEQ ID NO: 5748829 - DNA, 18 bp, Homo sapiens
gatcagggcattgcctgt

SEQ ID NO: 5748830 - DNA, 14 bp, Homo sapiens
gatcagggcctgcc

SEQ ID NO: 5748831 - DNA, 19 bp, Homo sapiens
gatcaggtaccaaggaaat

SEQ ID NO: 5748832 - DNA, 14 bp, Homo sapiens
gatcaggtggggag

SEQ ID NO: 5748833 - DNA, 14 bp, Homo sapiens
gatcagtaaaatta

SEQ ID NO: 5748834 - DNA, 17 bp, Homo sapiens
gatcagtagtttgcatt

SEQ ID NO: 5748835 - DNA, 20 bp, Homo sapiens
gatcagtataattttttaaa

SEQ ID NO: 5748836 - DNA, 19 bp, Homo sapiens
gatcagtatttaactaatt

SEQ ID NO: 5748837 - DNA, 15 bp, Homo sapiens
gatcagtccaactga

SEQ ID NO: 5748838 - DNA, 14 bp, Homo sapiens
gatcagtctgtctg

SEQ ID NO: 5748839 - DNA, 21 bp, Homo sapiens
gatcagtctttgtcaatgctc

SEQ ID NO: 5748840 - DNA, 22 bp, Homo sapiens
gatcagtggggccccaaagccc

SEQ ID NO: 5748841 - DNA, 15 bp, Homo sapiens
gatcagtgtgctaac

SEQ ID NO: 5748842 - DNA, 24 bp, Homo sapiens
gatcagttattaaataatgttcat

SEQ ID NO: 5748843 - DNA, 20 bp, Homo sapiens
gatcagttgctctctgttca

SEQ ID NO: 5748844 - DNA, 16 bp, Homo sapiens
gatcataaactggaaa

SEQ ID NO: 5748845 - DNA, 19 bp, Homo sapiens
gatcataaagttagaatct

SEQ ID NO: 5748846 - DNA, 17 bp, Homo sapiens
gatcataaggcttcaaa

SEQ ID NO: 5748847 - DNA, 17 bp, Homo sapiens
gatcataagtgaattta

SEQ ID NO: 5748848 - DNA, 19 bp, Homo sapiens
gatcataagtgaatttata

SEQ ID NO: 5748849 - DNA, 17 bp, Homo sapiens
gatcatagctcactgca

SEQ ID NO: 5748850 - DNA, 19 bp, Homo sapiens
gatcatagctcactgcacc

SEQ ID NO: 5748851 - DNA, 20 bp, Homo sapiens
gatcatagctcactgcagcc

SEQ ID NO: 5748852 - DNA, 22 bp, Homo sapiens
gatcatagctcactgcagcctc

SEQ ID NO: 5748853 - DNA, 22 bp, Homo sapiens
gatcatagctcactgtaacctc

SEQ ID NO: 5748854 - DNA, 18 bp, Homo sapiens
gatcataggaagtggctg

SEQ ID NO: 5748855 - DNA, 12 bp, Homo sapiens
gatcatagtttt

SEQ ID NO: 5748856 - DNA, 14 bp, Homo sapiens
gatcatagttttat

SEQ ID NO: 5748857 - DNA, 16 bp, Homo sapiens
gatcatagttttattt

SEQ ID NO: 5748858 - DNA, 19 bp, Homo sapiens
gatcatagttttatttata

SEQ ID NO: 5748859 - DNA, 19 bp, Homo sapiens
gatcatatgaattgctgtc

SEQ ID NO: 5748860 - DNA, 20 bp, Homo sapiens
gatcatatgaattgctgtct

SEQ ID NO: 5748861 - DNA, 22 bp, Homo sapiens
gatcatatggagctcatgtcag

SEQ ID NO: 5748862 - DNA, 20 bp, Homo sapiens
gatcatatggtaggaccctc

SEQ ID NO: 5748863 - DNA, 22 bp, Homo sapiens
gatcatatttaaagatctttta

SEQ ID NO: 5748864 - DNA, 21 bp, Homo sapiens
gatcatcaacaagatttcctt

SEQ ID NO: 5748865 - DNA, 13 bp, Homo sapiens
gatcatcatgcag

SEQ ID NO: 5748866 - DNA, 23 bp, Homo sapiens
gatcatcccatctaagctgcagc

SEQ ID NO: 5748867 - DNA, 14 bp, Homo sapiens
gatcatccccgagg

SEQ ID NO: 5748868 - DNA, 18 bp, Homo sapiens
gatcatccccgagggcgg

SEQ ID NO: 5748869 - DNA, 22 bp, Homo sapiens
gatcatccgtctgtgtggggtt

SEQ ID NO: 5748870 - DNA, 21 bp, Homo sapiens
gatcatcgccagaggtgcttc

SEQ ID NO: 5748871 - DNA, 14 bp, Homo sapiens
gatcatctctgtga

SEQ ID NO: 5748872 - DNA, 19 bp, Homo sapiens
gatcatctgaatcccgggc

SEQ ID NO: 5748873 - DNA, 12 bp, Homo sapiens
gatcatcttgaa

SEQ ID NO: 5748874 - DNA, 18 bp, Homo sapiens
gatcatcttgaatatttg

SEQ ID NO: 5748875 - DNA, 19 bp, Homo sapiens
gatcatgcaggaactgaaa

SEQ ID NO: 5748876 - DNA, 14 bp, Homo sapiens
gatcatgcattgtt

SEQ ID NO: 5748877 - DNA, 14 bp, Homo sapiens
gatcatggcatcca

SEQ ID NO: 5748878 - DNA, 22 bp, Homo sapiens
gatcatgggagcatgcttacct

SEQ ID NO: 5748879 - DNA, 20 bp, Homo sapiens
gatcatggtgtaataagaca

SEQ ID NO: 5748880 - DNA, 23 bp, Homo sapiens
gatcatggtgtaataagacataa

SEQ ID NO: 5748881 - DNA, 22 bp, Homo sapiens
gatcatggtttttgctctactt

SEQ ID NO: 5748882 - DNA, 15 bp, Homo sapiens
gatcatgtacttttt

SEQ ID NO: 5748883 - DNA, 19 bp, Homo sapiens
gatcatgttgttaaaatta

SEQ ID NO: 5748884 - DNA, 18 bp, Homo sapiens
gatcatgttttggtgaaa

SEQ ID NO: 5748885 - DNA, 17 bp, Homo sapiens
gatcattatcttcatgt

SEQ ID NO: 5748886 - DNA, 13 bp, Homo sapiens
gatcattgcattt

SEQ ID NO: 5748887 - DNA, 17 bp, Homo sapiens
gatcattgccatcacca

SEQ ID NO: 5748888 - DNA, 20 bp, Homo sapiens
gatcattggtatctgatatc

SEQ ID NO: 5748889 - DNA, 14 bp, Homo sapiens
gatcattgtgaaat

SEQ ID NO: 5748890 - DNA, 20 bp, Homo sapiens
gatcattgtgaaattattca

SEQ ID NO: 5748891 - DNA, 18 bp, Homo sapiens
gatcatttataatactgt

SEQ ID NO: 5748892 - DNA, 13 bp, Homo sapiens
gatcatttctgcc

SEQ ID NO: 5748893 - DNA, 19 bp, Homo sapiens
gatcatttgcagctgctgg

SEQ ID NO: 5748894 - DNA, 18 bp, Homo sapiens
gatcatttgttggaatga

SEQ ID NO: 5748895 - DNA, 19 bp, Homo sapiens
gatcattttagacactggg

SEQ ID NO: 5748896 - DNA, 14 bp, Homo sapiens
gatcattttccccc

SEQ ID NO: 5748897 - DNA, 21 bp, Homo sapiens
gatcatttttaactgattctt

SEQ ID NO: 5748898 - DNA, 21 bp, Homo sapiens
gatcatttttatatgaaataa

SEQ ID NO: 5748899 - DNA, 20 bp, Homo sapiens
gatccaaaagaagcccccag

SEQ ID NO: 5748900 - DNA, 11 bp, Homo sapiens
gatccaaagac

SEQ ID NO: 5748901 - DNA, 19 bp, Homo sapiens
gatccaactaatgccttac

SEQ ID NO: 5748902 - DNA, 20 bp, Homo sapiens
gatccaagcaaaactttact

SEQ ID NO: 5748903 - DNA, 22 bp, Homo sapiens
gatccaagctaagcactgccac

SEQ ID NO: 5748904 - DNA, 19 bp, Homo sapiens
gatccaagctggtcccact

SEQ ID NO: 5748905 - DNA, 19 bp, Homo sapiens
gatccaaggccgcggccca

SEQ ID NO: 5748906 - DNA, 19 bp, Homo sapiens
gatccaagtttactcaacc

SEQ ID NO: 5748907 - DNA, 16 bp, Homo sapiens
gatccacagtaatctt

SEQ ID NO: 5748908 - DNA, 14 bp, Homo sapiens
gatccacccacctc

SEQ ID NO: 5748909 - DNA, 18 bp, Homo sapiens
gatccacccacctcagcc

SEQ ID NO: 5748910 - DNA, 20 bp, Homo sapiens
gatccacccacctcagcctc

SEQ ID NO: 5748911 - DNA, 21 bp, Homo sapiens
gatccacccaccttggcctcc

SEQ ID NO: 5748912 - DNA, 16 bp, Homo sapiens
gatccaccccctgccc

SEQ ID NO: 5748913 - DNA, 21 bp, Homo sapiens
gatccacccgcctcagcctcc

SEQ ID NO: 5748914 - DNA, 16 bp, Homo sapiens
gatccaccctatccct

SEQ ID NO: 5748915 - DNA, 18 bp, Homo sapiens
gatccaccctcaaatgtc

SEQ ID NO: 5748916 - DNA, 19 bp, Homo sapiens
gatccaccctcaaatgtca

SEQ ID NO: 5748917 - DNA, 19 bp, Homo sapiens
gatccaccggcctcggcct

SEQ ID NO: 5748918 - DNA, 15 bp, Homo sapiens
gatccacctgcacaa

SEQ ID NO: 5748919 - DNA, 18 bp, Homo sapiens
gatccacctgtctcagcc

SEQ ID NO: 5748920 - DNA, 19 bp, Homo sapiens
gatccacctgtctcagcct

SEQ ID NO: 5748921 - DNA, 19 bp, Homo sapiens
gatccacgtgtggcctccg

SEQ ID NO: 5748922 - DNA, 14 bp, Homo sapiens
gatccactcccagg

SEQ ID NO: 5748923 - DNA, 18 bp, Homo sapiens
gatccactcgcctcagcc

SEQ ID NO: 5748924 - DNA, 13 bp, Homo sapiens
gatccactgtgca

SEQ ID NO: 5748925 - DNA, 14 bp, Homo sapiens
gatccactgtgcag

SEQ ID NO: 5748926 - DNA, 16 bp, Homo sapiens
gatccactgtgcagga

SEQ ID NO: 5748927 - DNA, 13 bp, Homo sapiens
gatccagaaatac

SEQ ID NO: 5748928 - DNA, 13 bp, Homo sapiens
gatccagaagagc

SEQ ID NO: 5748929 - DNA, 16 bp, Homo sapiens
gatccagaagagccca

SEQ ID NO: 5748930 - DNA, 21 bp, Homo sapiens
gatccagactgtaagatgttg

SEQ ID NO: 5748931 - DNA, 15 bp, Homo sapiens
gatccagagagaagc

SEQ ID NO: 5748932 - DNA, 19 bp, Homo sapiens
gatccagagagcagctccc

SEQ ID NO: 5748933 - DNA, 13 bp, Homo sapiens
gatccagagaggc

SEQ ID NO: 5748934 - DNA, 22 bp, Homo sapiens
gatccagagtttcctagaacgc

SEQ ID NO: 5748935 - DNA, 19 bp, Homo sapiens
gatccagcagattattcac

SEQ ID NO: 5748936 - DNA, 13 bp, Homo sapiens
gatccagccactt

SEQ ID NO: 5748937 - DNA, 14 bp, Homo sapiens
gatccagccacttc

SEQ ID NO: 5748938 - DNA, 17 bp, Homo sapiens
gatccagccctggttct

SEQ ID NO: 5748939 - DNA, 22 bp, Homo sapiens
gatccagccctggttctggctg

SEQ ID NO: 5748940 - DNA, 21 bp, Homo sapiens
gatccagcctggggtctggag

SEQ ID NO: 5748941 - DNA, 17 bp, Homo sapiens
gatccagctctgggagc

SEQ ID NO: 5748942 - DNA, 21 bp, Homo sapiens
gatccagctgtgtgttttcaa

SEQ ID NO: 5748943 - DNA, 13 bp, Homo sapiens
gatccaggagctc

SEQ ID NO: 5748944 - DNA, 15 bp, Homo sapiens
gatccaggagctcca

SEQ ID NO: 5748945 - DNA, 21 bp, Homo sapiens
gatccaggcccctccctctcc

SEQ ID NO: 5748946 - DNA, 12 bp, Homo sapiens
gatccagggaca

SEQ ID NO: 5748947 - DNA, 13 bp, Homo sapiens
gatccagggacag

SEQ ID NO: 5748948 - DNA, 18 bp, Homo sapiens
gatccagggacagaggcc

SEQ ID NO: 5748949 - DNA, 20 bp, Homo sapiens
gatccagggaggctggtcct

SEQ ID NO: 5748950 - DNA, 17 bp, Homo sapiens
gatccagggcagcaggc

SEQ ID NO: 5748951 - DNA, 18 bp, Homo sapiens
gatccagggcagcaggcc

SEQ ID NO: 5748952 - DNA, 19 bp, Homo sapiens
gatccagggcagcaggcca

SEQ ID NO: 5748953 - DNA, 20 bp, Homo sapiens
gatccaggggaagccagtga

SEQ ID NO: 5748954 - DNA, 17 bp, Homo sapiens
gatccagtataagacta

SEQ ID NO: 5748955 - DNA, 12 bp, Homo sapiens
gatccagttttg

SEQ ID NO: 5748956 - DNA, 22 bp, Homo sapiens
gatccagttttgtttggaccaa

SEQ ID NO: 5748957 - DNA, 21 bp, Homo sapiens
gatccataggactaccgcagg

SEQ ID NO: 5748958 - DNA, 13 bp, Homo sapiens
gatccatccagct

SEQ ID NO: 5748959 - DNA, 18 bp, Homo sapiens
gatccatccagcttgcca

SEQ ID NO: 5748960 - DNA, 15 bp, Homo sapiens
gatccatccatctcc

SEQ ID NO: 5748961 - DNA, 16 bp, Homo sapiens
gatccatccatctcca

SEQ ID NO: 5748962 - DNA, 17 bp, Homo sapiens
gatccatccatctccag

SEQ ID NO: 5748963 - DNA, 15 bp, Homo sapiens
gatccatccatctct

SEQ ID NO: 5748964 - DNA, 15 bp, Homo sapiens
gatccatcttgagcc

SEQ ID NO: 5748965 - DNA, 22 bp, Homo sapiens
gatccatgagtttgccctggtt

SEQ ID NO: 5748966 - DNA, 14 bp, Homo sapiens
gatccatgggggga

SEQ ID NO: 5748967 - DNA, 17 bp, Homo sapiens
gatccatgtaactgcct

SEQ ID NO: 5748968 - DNA, 19 bp, Homo sapiens
gatccatgtagcaggactg

SEQ ID NO: 5748969 - DNA, 19 bp, Homo sapiens
gatccattaatttaaatga

SEQ ID NO: 5748970 - DNA, 20 bp, Homo sapiens
gatccattcccttttgttat

SEQ ID NO: 5748971 - DNA, 17 bp, Homo sapiens
gatccatttccattgct

SEQ ID NO: 5748972 - DNA, 15 bp, Homo sapiens
gatccatttctaatt

SEQ ID NO: 5748973 - DNA, 17 bp, Homo sapiens
gatccatttgcctttct

SEQ ID NO: 5748974 - DNA, 19 bp, Homo sapiens
gatcccaacactgccagca

SEQ ID NO: 5748975 - DNA, 22 bp, Homo sapiens
gatcccaagagattatgtaact

SEQ ID NO: 5748976 - DNA, 22 bp, Homo sapiens
gatcccaagatggagaggaaga

SEQ ID NO: 5748977 - DNA, 20 bp, Homo sapiens
gatcccaatagaatacctcc

SEQ ID NO: 5748978 - DNA, 15 bp, Homo sapiens
gatcccacacaggct

SEQ ID NO: 5748979 - DNA, 13 bp, Homo sapiens
gatcccacagccc

SEQ ID NO: 5748980 - DNA, 16 bp, Homo sapiens
gatcccacagccctag

SEQ ID NO: 5748981 - DNA, 22 bp, Homo sapiens
gatcccaccccctcctccccca

SEQ ID NO: 5748982 - DNA, 22 bp, Homo sapiens
gatcccactcctaggacatgtt

SEQ ID NO: 5748983 - DNA, 21 bp, Homo sapiens
gatcccagacccattccttag

SEQ ID NO: 5748984 - DNA, 21 bp, Homo sapiens
gatcccagagagcccgaggag

SEQ ID NO: 5748985 - DNA, 16 bp, Homo sapiens
gatcccagcccaccct

SEQ ID NO: 5748986 - DNA, 20 bp, Homo sapiens
gatcccagctcactgcaacc

SEQ ID NO: 5748987 - DNA, 20 bp, Homo sapiens
gatcccagctcactgcagcc

SEQ ID NO: 5748988 - DNA, 11 bp, Homo sapiens
gatcccagggt

SEQ ID NO: 5748989 - DNA, 22 bp, Homo sapiens
gatcccagggtacactcttctc

SEQ ID NO: 5748990 - DNA, 20 bp, Homo sapiens
gatcccataaagaaagtgag

SEQ ID NO: 5748991 - DNA, 21 bp, Homo sapiens
gatcccatatttacttactgc

SEQ ID NO: 5748992 - DNA, 15 bp, Homo sapiens
gatcccatcaaagaa

SEQ ID NO: 5748993 - DNA, 22 bp, Homo sapiens
gatcccatcaaagaaccttgaa

SEQ ID NO: 5748994 - DNA, 20 bp, Homo sapiens
gatcccatccatcagctccc

SEQ ID NO: 5748995 - DNA, 12 bp, Homo sapiens
gatcccatctct

SEQ ID NO: 5748996 - DNA, 22 bp, Homo sapiens
gatcccatgtcacctcagctga

SEQ ID NO: 5748997 - DNA, 14 bp, Homo sapiens
gatccccaacctgc

SEQ ID NO: 5748998 - DNA, 17 bp, Homo sapiens
gatccccaactgctcca

SEQ ID NO: 5748999 - DNA, 21 bp, Homo sapiens
gatccccaactgctccagcct

SEQ ID NO: 5749000 - DNA, 14 bp, Homo sapiens
gatccccaagtgtg

SEQ ID NO: 5749001 - DNA, 21 bp, Homo sapiens
gatccccacgccacagccctt

SEQ ID NO: 5749002 - DNA, 15 bp, Homo sapiens
gatccccactgtcct

SEQ ID NO: 5749003 - DNA, 22 bp, Homo sapiens
gatccccagcccctcctccctc

SEQ ID NO: 5749004 - DNA, 23 bp, Homo sapiens
gatccccagcccctcctccctca

SEQ ID NO: 5749005 - DNA, 18 bp, Homo sapiens
gatccccagggcagcctc

SEQ ID NO: 5749006 - DNA, 21 bp, Homo sapiens
gatccccagggcagcctggat

SEQ ID NO: 5749007 - DNA, 19 bp, Homo sapiens
gatccccatggaacagccc

SEQ ID NO: 5749008 - DNA, 20 bp, Homo sapiens
gatcccccaaacagcatgtg

SEQ ID NO: 5749009 - DNA, 20 bp, Homo sapiens
gatcccccgccccatcctcc

SEQ ID NO: 5749010 - DNA, 18 bp, Homo sapiens
gatccccgacagtggctc

SEQ ID NO: 5749011 - DNA, 19 bp, Homo sapiens
gatccccgcctggccagga

SEQ ID NO: 5749012 - DNA, 22 bp, Homo sapiens
gatccccgcctggccaggagca

SEQ ID NO: 5749013 - DNA, 16 bp, Homo sapiens
gatccccgcttcccct

SEQ ID NO: 5749014 - DNA, 17 bp, Homo sapiens
gatccccgttcctgaca

SEQ ID NO: 5749015 - DNA, 14 bp, Homo sapiens
gatcccctccccca

SEQ ID NO: 5749016 - DNA, 12 bp, Homo sapiens
gatcccctctct

SEQ ID NO: 5749017 - DNA, 20 bp, Homo sapiens
gatcccctctctgtggctcc

SEQ ID NO: 5749018 - DNA, 14 bp, Homo sapiens
gatcccctgagccc

SEQ ID NO: 5749019 - DNA, 13 bp, Homo sapiens
gatcccctgaggt

SEQ ID NO: 5749020 - DNA, 16 bp, Homo sapiens
gatcccctgcttctgg

SEQ ID NO: 5749021 - DNA, 20 bp, Homo sapiens
gatcccctttggttttacta

SEQ ID NO: 5749022 - DNA, 22 bp, Homo sapiens
gatcccggccggccctggcttg

SEQ ID NO: 5749023 - DNA, 20 bp, Homo sapiens
gatcccgtctccgaagaaaa

SEQ ID NO: 5749024 - DNA, 21 bp, Homo sapiens
gatcccgtctccgaagaaaag

SEQ ID NO: 5749025 - DNA, 21 bp, Homo sapiens
gatccctagctgtgacctctc

SEQ ID NO: 5749026 - DNA, 16 bp, Homo sapiens
gatccctcatcctcat

SEQ ID NO: 5749027 - DNA, 14 bp, Homo sapiens
gatccctcatctgt

SEQ ID NO: 5749028 - DNA, 13 bp, Homo sapiens
gatccctcccccc

SEQ ID NO: 5749029 - DNA, 21 bp, Homo sapiens
gatccctcccccccatgcact

SEQ ID NO: 5749030 - DNA, 23 bp, Homo sapiens
gatccctcccccccatgcactgt

SEQ ID NO: 5749031 - DNA, 22 bp, Homo sapiens
gatccctcccctcagcctcctg

SEQ ID NO: 5749032 - DNA, 16 bp, Homo sapiens
gatccctcctccagcc

SEQ ID NO: 5749033 - DNA, 11 bp, Homo sapiens
gatccctcctg

SEQ ID NO: 5749034 - DNA, 18 bp, Homo sapiens
gatccctcggtcagcacc

SEQ ID NO: 5749035 - DNA, 19 bp, Homo sapiens
gatccctcggtcagcaccg

SEQ ID NO: 5749036 - DNA, 20 bp, Homo sapiens
gatccctgaacccctggcca

SEQ ID NO: 5749037 - DNA, 16 bp, Homo sapiens
gatccctgctctctga

SEQ ID NO: 5749038 - DNA, 13 bp, Homo sapiens
gatccctggccac

SEQ ID NO: 5749039 - DNA, 18 bp, Homo sapiens
gatccctgtgttgtctct

SEQ ID NO: 5749040 - DNA, 19 bp, Homo sapiens
gatccctgtgttgtctcta

SEQ ID NO: 5749041 - DNA, 17 bp, Homo sapiens
gatcccttaagaagtta

SEQ ID NO: 5749042 - DNA, 20 bp, Homo sapiens
gatcccttccccctgctgat

SEQ ID NO: 5749043 - DNA, 17 bp, Homo sapiens
gatccgactgctttgga

SEQ ID NO: 5749044 - DNA, 15 bp, Homo sapiens
gatccgagggcccct

SEQ ID NO: 5749045 - DNA, 23 bp, Homo sapiens
gatccgcaacccatgccctggac

SEQ ID NO: 5749046 - DNA, 21 bp, Homo sapiens
gatccgcccacctcagcctcc

SEQ ID NO: 5749047 - DNA, 23 bp, Homo sapiens
gatccgcccgcctcagcatccca

SEQ ID NO: 5749048 - DNA, 20 bp, Homo sapiens
gatccgcctacctcagcctc

SEQ ID NO: 5749049 - DNA, 19 bp, Homo sapiens
gatccgcctgcctctgcct

SEQ ID NO: 5749050 - DNA, 14 bp, Homo sapiens
gatccgtttgacca

SEQ ID NO: 5749051 - DNA, 19 bp, Homo sapiens
gatccgtttgaccaatttg

SEQ ID NO: 5749052 - DNA, 18 bp, Homo sapiens
gatcctaaaattgtttcc

SEQ ID NO: 5749053 - DNA, 15 bp, Homo sapiens
gatcctaaactctct

SEQ ID NO: 5749054 - DNA, 17 bp, Homo sapiens
gatcctaaatatgacag

SEQ ID NO: 5749055 - DNA, 19 bp, Homo sapiens
gatcctaactgagaatttt

SEQ ID NO: 5749056 - DNA, 18 bp, Homo sapiens
gatcctaagggctcaccg

SEQ ID NO: 5749057 - DNA, 17 bp, Homo sapiens
gatcctacaatatttta

SEQ ID NO: 5749058 - DNA, 18 bp, Homo sapiens
gatcctagttccaccatc

SEQ ID NO: 5749059 - DNA, 19 bp, Homo sapiens
gatcctattctcaccagga

SEQ ID NO: 5749060 - DNA, 20 bp, Homo sapiens
gatcctcaaaaatcatcaaa

SEQ ID NO: 5749061 - DNA, 17 bp, Homo sapiens
gatcctcaaacacacaa

SEQ ID NO: 5749062 - DNA, 18 bp, Homo sapiens
gatcctcacgccttggcc

SEQ ID NO: 5749063 - DNA, 16 bp, Homo sapiens
gatcctccaatgtcta

SEQ ID NO: 5749064 - DNA, 20 bp, Homo sapiens
gatcctccaatgtctaattt

SEQ ID NO: 5749065 - DNA, 13 bp, Homo sapiens
gatcctccacaga

SEQ ID NO: 5749066 - DNA, 15 bp, Homo sapiens
gatcctccacagaga

SEQ ID NO: 5749067 - DNA, 11 bp, Homo sapiens
gatcctcccac

SEQ ID NO: 5749068 - DNA, 15 bp, Homo sapiens
gatcctcccacctca

SEQ ID NO: 5749069 - DNA, 20 bp, Homo sapiens
gatcctcccacctcagcctc

SEQ ID NO: 5749070 - DNA, 21 bp, Homo sapiens
gatcctcccacctcagcctcc

SEQ ID NO: 5749071 - DNA, 16 bp, Homo sapiens
gatcctcccaggcttc

SEQ ID NO: 5749072 - DNA, 20 bp, Homo sapiens
gatcctccgcggaggcccct

SEQ ID NO: 5749073 - DNA, 23 bp, Homo sapiens
gatcctccgcggaggcccctgag

SEQ ID NO: 5749074 - DNA, 22 bp, Homo sapiens
gatcctcctgcagaccacgccc

SEQ ID NO: 5749075 - DNA, 21 bp, Homo sapiens
gatcctcctgtcttggcctcc

SEQ ID NO: 5749076 - DNA, 15 bp, Homo sapiens
gatcctccttccagg

SEQ ID NO: 5749077 - DNA, 13 bp, Homo sapiens
gatcctctatttt

SEQ ID NO: 5749078 - DNA, 14 bp, Homo sapiens
gatcctctattttg

SEQ ID NO: 5749079 - DNA, 16 bp, Homo sapiens
gatcctctcacctcag

SEQ ID NO: 5749080 - DNA, 19 bp, Homo sapiens
gatcctctctccaggcccc

SEQ ID NO: 5749081 - DNA, 23 bp, Homo sapiens
gatcctcttgccacatcttgaaa

SEQ ID NO: 5749082 - DNA, 17 bp, Homo sapiens
gatcctctttactctgg

SEQ ID NO: 5749083 - DNA, 19 bp, Homo sapiens
gatcctctttactctgggc

SEQ ID NO: 5749084 - DNA, 14 bp, Homo sapiens
gatcctgagccaga

SEQ ID NO: 5749085 - DNA, 19 bp, Homo sapiens
gatcctgagccagatttca

SEQ ID NO: 5749086 - DNA, 22 bp, Homo sapiens
gatcctgagccagatttcactc

SEQ ID NO: 5749087 - DNA, 15 bp, Homo sapiens
gatcctgagctgctg

SEQ ID NO: 5749088 - DNA, 22 bp, Homo sapiens
gatcctgcaccccagcattcca

SEQ ID NO: 5749089 - DNA, 12 bp, Homo sapiens
gatcctgccccc

SEQ ID NO: 5749090 - DNA, 14 bp, Homo sapiens
gatcctgcccccaa

SEQ ID NO: 5749091 - DNA, 14 bp, Homo sapiens
gatcctgctccagc

SEQ ID NO: 5749092 - DNA, 10 bp, Homo sapiens
gatcctgctg

SEQ ID NO: 5749093 - DNA, 15 bp, Homo sapiens
gatcctgctgacctc

SEQ ID NO: 5749094 - DNA, 19 bp, Homo sapiens
gatcctgctgacctcactg

SEQ ID NO: 5749095 - DNA, 15 bp, Homo sapiens
gatcctgctgtggcc

SEQ ID NO: 5749096 - DNA, 17 bp, Homo sapiens
gatcctgctgtggcctc

SEQ ID NO: 5749097 - DNA, 18 bp, Homo sapiens
gatcctgctgtggcctca

SEQ ID NO: 5749098 - DNA, 19 bp, Homo sapiens
gatcctgctgtggcctcac

SEQ ID NO: 5749099 - DNA, 13 bp, Homo sapiens
gatcctggaaatc

SEQ ID NO: 5749100 - DNA, 17 bp, Homo sapiens
gatcctggaaccactga

SEQ ID NO: 5749101 - DNA, 11 bp, Homo sapiens
gatcctggagc

SEQ ID NO: 5749102 - DNA, 14 bp, Homo sapiens
gatcctggagcccc

SEQ ID NO: 5749103 - DNA, 16 bp, Homo sapiens
gatcctggagcccctg

SEQ ID NO: 5749104 - DNA, 12 bp, Homo sapiens
gatcctggaggc

SEQ ID NO: 5749105 - DNA, 17 bp, Homo sapiens
gatcctgggctgggtgg

SEQ ID NO: 5749106 - DNA, 22 bp, Homo sapiens
gatcctgggtactgaaagcctt

SEQ ID NO: 5749107 - DNA, 15 bp, Homo sapiens
gatcctgggtttcca

SEQ ID NO: 5749108 - DNA, 17 bp, Homo sapiens
gatcctggtattgtaat

SEQ ID NO: 5749109 - DNA, 12 bp, Homo sapiens
gatcctgtcaca

SEQ ID NO: 5749110 - DNA, 18 bp, Homo sapiens
gatcctgtcccatgggct

SEQ ID NO: 5749111 - DNA, 20 bp, Homo sapiens
gatcctgtcccatgggctct

SEQ ID NO: 5749112 - DNA, 16 bp, Homo sapiens
gatcctgtccttttaa

SEQ ID NO: 5749113 - DNA, 12 bp, Homo sapiens
gatcctgtctct

SEQ ID NO: 5749114 - DNA, 19 bp, Homo sapiens
gatcctgtctttaaggaaa

SEQ ID NO: 5749115 - DNA, 19 bp, Homo sapiens
gatcctgtgtggagaggga

SEQ ID NO: 5749116 - DNA, 20 bp, Homo sapiens
gatcctgtgtggagagggaa

SEQ ID NO: 5749117 - DNA, 23 bp, Homo sapiens
gatcctgttacttgcttcagtgg

SEQ ID NO: 5749118 - DNA, 13 bp, Homo sapiens
gatccttcaaagt

SEQ ID NO: 5749119 - DNA, 19 bp, Homo sapiens
gatccttcaactctgtgag

SEQ ID NO: 5749120 - DNA, 15 bp, Homo sapiens
gatccttcacaggca

SEQ ID NO: 5749121 - DNA, 16 bp, Homo sapiens
gatccttcacaggcag

SEQ ID NO: 5749122 - DNA, 15 bp, Homo sapiens
gatccttcagcacag

SEQ ID NO: 5749123 - DNA, 23 bp, Homo sapiens
gatccttcatcgaacaaactgat

SEQ ID NO: 5749124 - DNA, 15 bp, Homo sapiens
gatccttcccaaggt

SEQ ID NO: 5749125 - DNA, 19 bp, Homo sapiens
gatccttcccctcttttgg

SEQ ID NO: 5749126 - DNA, 16 bp, Homo sapiens
gatccttcctactttg

SEQ ID NO: 5749127 - DNA, 16 bp, Homo sapiens
gatccttgcacagaca

SEQ ID NO: 5749128 - DNA, 13 bp, Homo sapiens
gatccttggaaac

SEQ ID NO: 5749129 - DNA, 17 bp, Homo sapiens
gatccttggtgctgtgt

SEQ ID NO: 5749130 - DNA, 18 bp, Homo sapiens
gatccttggtgctgtgtg

SEQ ID NO: 5749131 - DNA, 20 bp, Homo sapiens
gatccttgtgtttatcagaa

SEQ ID NO: 5749132 - DNA, 13 bp, Homo sapiens
gatccttgtttta

SEQ ID NO: 5749133 - DNA, 14 bp, Homo sapiens
gatccttgttttaa

SEQ ID NO: 5749134 - DNA, 14 bp, Homo sapiens
gatccttttattct

SEQ ID NO: 5749135 - DNA, 14 bp, Homo sapiens
gatcctttttccat

SEQ ID NO: 5749136 - DNA, 16 bp, Homo sapiens
gatcctttttccatca

SEQ ID NO: 5749137 - DNA, 15 bp, Homo sapiens
gatccttttttgtca

SEQ ID NO: 5749138 - DNA, 16 bp, Homo sapiens
gatccttttttgtcat

SEQ ID NO: 5749139 - DNA, 19 bp, Homo sapiens
gatcgacaccatcctggct

SEQ ID NO: 5749140 - DNA, 18 bp, Homo sapiens
gatcgacagacagccagg

SEQ ID NO: 5749141 - DNA, 15 bp, Homo sapiens
gatcgagccactgca

SEQ ID NO: 5749142 - DNA, 14 bp, Homo sapiens
gatcgatgtgctca

SEQ ID NO: 5749143 - DNA, 18 bp, Homo sapiens
gatcgcagtttgcctggt

SEQ ID NO: 5749144 - DNA, 15 bp, Homo sapiens
gatcgcatttcctaa

SEQ ID NO: 5749145 - DNA, 17 bp, Homo sapiens
gatcgcctctttgacat

SEQ ID NO: 5749146 - DNA, 14 bp, Homo sapiens
gatcgccttcccca

SEQ ID NO: 5749147 - DNA, 17 bp, Homo sapiens
gatcgcgccactgcact

SEQ ID NO: 5749148 - DNA, 14 bp, Homo sapiens
gatcgcgttagcca

SEQ ID NO: 5749149 - DNA, 14 bp, Homo sapiens
gatcgctcccctgg

SEQ ID NO: 5749150 - DNA, 18 bp, Homo sapiens
gatcgctcccttggcttt

SEQ ID NO: 5749151 - DNA, 22 bp, Homo sapiens
gatcgctgcacatggcctgagc

SEQ ID NO: 5749152 - DNA, 18 bp, Homo sapiens
gatcgctggcagagaagg

SEQ ID NO: 5749153 - DNA, 16 bp, Homo sapiens
gatcgcttgagcccag

SEQ ID NO: 5749154 - DNA, 18 bp, Homo sapiens
gatcgcttgagcccagga

SEQ ID NO: 5749155 - DNA, 15 bp, Homo sapiens
gatcggactctgccc

SEQ ID NO: 5749156 - DNA, 16 bp, Homo sapiens
gatcggactctgcccc

SEQ ID NO: 5749157 - DNA, 22 bp, Homo sapiens
gatcggaggcttgtcagagctg

SEQ ID NO: 5749158 - DNA, 16 bp, Homo sapiens
gatcggcttcctcagg

SEQ ID NO: 5749159 - DNA, 18 bp, Homo sapiens
gatcgggataacaaaatc

SEQ ID NO: 5749160 - DNA, 17 bp, Homo sapiens
gatcggttaacaaataa

SEQ ID NO: 5749161 - DNA, 23 bp, Homo sapiens
gatcggtttcatattttaaatct

SEQ ID NO: 5749162 - DNA, 14 bp, Homo sapiens
gatcgtacttgaaa

SEQ ID NO: 5749163 - DNA, 16 bp, Homo sapiens
gatcgtattaattatc

SEQ ID NO: 5749164 - DNA, 20 bp, Homo sapiens
gatcgtgacgctgaataaat

SEQ ID NO: 5749165 - DNA, 22 bp, Homo sapiens
gatcgtgacgctgaataaatgt

SEQ ID NO: 5749166 - DNA, 13 bp, Homo sapiens
gatcgtgcatttg

SEQ ID NO: 5749167 - DNA, 14 bp, Homo sapiens
gatcgtgccgtgga

SEQ ID NO: 5749168 - DNA, 16 bp, Homo sapiens
gatcgtgccgtggagc

SEQ ID NO: 5749169 - DNA, 17 bp, Homo sapiens
gatcgtgccgtggagct

SEQ ID NO: 5749170 - DNA, 19 bp, Homo sapiens
gatcgtgccgtggagcttg

SEQ ID NO: 5749171 - DNA, 23 bp, Homo sapiens
gatcgtgccgttactctccaacc

SEQ ID NO: 5749172 - DNA, 13 bp, Homo sapiens
gatcgtgcggccg

SEQ ID NO: 5749173 - DNA, 21 bp, Homo sapiens
gatcgtggaagaagggccacc

SEQ ID NO: 5749174 - DNA, 21 bp, Homo sapiens
gatcgtggccaacgtggacct

SEQ ID NO: 5749175 - DNA, 20 bp, Homo sapiens
gatcgtttcacatctgtata

SEQ ID NO: 5749176 - DNA, 17 bp, Homo sapiens
gatctaaaaaaatgttt

SEQ ID NO: 5749177 - DNA, 20 bp, Homo sapiens
gatctaaaaggaggacaggg

SEQ ID NO: 5749178 - DNA, 23 bp, Homo sapiens
gatctaaacagttatttctgttt

SEQ ID NO: 5749179 - DNA, 14 bp, Homo sapiens
gatctaaacttttg

SEQ ID NO: 5749180 - DNA, 18 bp, Homo sapiens
gatctaaataaaatgcta

SEQ ID NO: 5749181 - DNA, 19 bp, Homo sapiens
gatctaaatggaagcatct

SEQ ID NO: 5749182 - DNA, 13 bp, Homo sapiens
gatctaacaaaat

SEQ ID NO: 5749183 - DNA, 15 bp, Homo sapiens
gatctaactgttgtt

SEQ ID NO: 5749184 - DNA, 18 bp, Homo sapiens
gatctaagaagggctgag

SEQ ID NO: 5749185 - DNA, 18 bp, Homo sapiens
gatctaagcctttccata

SEQ ID NO: 5749186 - DNA, 23 bp, Homo sapiens
gatctaaggatgtcacagggcca

SEQ ID NO: 5749187 - DNA, 15 bp, Homo sapiens
gatctaataaacttt

SEQ ID NO: 5749188 - DNA, 16 bp, Homo sapiens
gatctaataaacttta

SEQ ID NO: 5749189 - DNA, 15 bp, Homo sapiens
gatctacacatgttg

SEQ ID NO: 5749190 - DNA, 13 bp, Homo sapiens
gatctacatgaat

SEQ ID NO: 5749191 - DNA, 19 bp, Homo sapiens
gatctacctgcaacacaac

SEQ ID NO: 5749192 - DNA, 20 bp, Homo sapiens
gatctacttctgtaattgtg

SEQ ID NO: 5749193 - DNA, 14 bp, Homo sapiens
gatctactttccct

SEQ ID NO: 5749194 - DNA, 21 bp, Homo sapiens
gatctactttccctctgggat

SEQ ID NO: 5749195 - DNA, 20 bp, Homo sapiens
gatctagaatgtgttttctg

SEQ ID NO: 5749196 - DNA, 15 bp, Homo sapiens
gatctagccaggcct

SEQ ID NO: 5749197 - DNA, 16 bp, Homo sapiens
gatctagccaggcctc

SEQ ID NO: 5749198 - DNA, 13 bp, Homo sapiens
gatctagccatgg

SEQ ID NO: 5749199 - DNA, 14 bp, Homo sapiens
gatctagccatggc

SEQ ID NO: 5749200 - DNA, 16 bp, Homo sapiens
gatctagccatggctg

SEQ ID NO: 5749201 - DNA, 22 bp, Homo sapiens
gatctagcttcatgcctcagtt

SEQ ID NO: 5749202 - DNA, 20 bp, Homo sapiens
gatctaggaagactttggaa

SEQ ID NO: 5749203 - DNA, 15 bp, Homo sapiens
gatctaggtgaggat

SEQ ID NO: 5749204 - DNA, 16 bp, Homo sapiens
gatctaggtttaactc

SEQ ID NO: 5749205 - DNA, 18 bp, Homo sapiens
gatctaggtttaactcag

SEQ ID NO: 5749206 - DNA, 22 bp, Homo sapiens
gatctaggtttaactcagatca

SEQ ID NO: 5749207 - DNA, 19 bp, Homo sapiens
gatctagtgccattatttc

SEQ ID NO: 5749208 - DNA, 13 bp, Homo sapiens
gatctataaagcg

SEQ ID NO: 5749209 - DNA, 21 bp, Homo sapiens
gatctataggcagcttctaag

SEQ ID NO: 5749210 - DNA, 16 bp, Homo sapiens
gatctatcaatagtca

SEQ ID NO: 5749211 - DNA, 19 bp, Homo sapiens
gatctatcacctgtcatca

SEQ ID NO: 5749212 - DNA, 21 bp, Homo sapiens
gatctatccctgcggcctcca

SEQ ID NO: 5749213 - DNA, 14 bp, Homo sapiens
gatctatgcaattt

SEQ ID NO: 5749214 - DNA, 20 bp, Homo sapiens
gatctatgtttgtgtgattt

SEQ ID NO: 5749215 - DNA, 22 bp, Homo sapiens
gatctattactctgacataaac

SEQ ID NO: 5749216 - DNA, 12 bp, Homo sapiens
gatctattgctc

SEQ ID NO: 5749217 - DNA, 18 bp, Homo sapiens
gatctattgtttgttgca

SEQ ID NO: 5749218 - DNA, 15 bp, Homo sapiens
gatctcaagccagcc

SEQ ID NO: 5749219 - DNA, 14 bp, Homo sapiens
gatctcaccaggca

SEQ ID NO: 5749220 - DNA, 13 bp, Homo sapiens
gatctcagctcac

SEQ ID NO: 5749221 - DNA, 17 bp, Homo sapiens
gatctcagctcactaca

SEQ ID NO: 5749222 - DNA, 16 bp, Homo sapiens
gatctcagctcactgc

SEQ ID NO: 5749223 - DNA, 17 bp, Homo sapiens
gatctcagctcactgca

SEQ ID NO: 5749224 - DNA, 19 bp, Homo sapiens
gatctcagctcactgcaac

SEQ ID NO: 5749225 - DNA, 14 bp, Homo sapiens
gatctcagctttga

SEQ ID NO: 5749226 - DNA, 13 bp, Homo sapiens
gatctcaggagct

SEQ ID NO: 5749227 - DNA, 13 bp, Homo sapiens
gatctcagggcag

SEQ ID NO: 5749228 - DNA, 17 bp, Homo sapiens
gatctcaggggctgttt

SEQ ID NO: 5749229 - DNA, 18 bp, Homo sapiens
gatctcaggggctgtttg

SEQ ID NO: 5749230 - DNA, 21 bp, Homo sapiens
gatctcaggggtcttaccttg

SEQ ID NO: 5749231 - DNA, 12 bp, Homo sapiens
gatctcagtttt

SEQ ID NO: 5749232 - DNA, 13 bp, Homo sapiens
gatctcatgtcct

SEQ ID NO: 5749233 - DNA, 21 bp, Homo sapiens
gatctcattggacccttccat

SEQ ID NO: 5749234 - DNA, 16 bp, Homo sapiens
gatctccaaggaccag

SEQ ID NO: 5749235 - DNA, 22 bp, Homo sapiens
gatctccactgataagactgtt

SEQ ID NO: 5749236 - DNA, 20 bp, Homo sapiens
gatctccactgttgggtggg

SEQ ID NO: 5749237 - DNA, 11 bp, Homo sapiens
gatctccagcg

SEQ ID NO: 5749238 - DNA, 11 bp, Homo sapiens
gatctccaggc

SEQ ID NO: 5749239 - DNA, 13 bp, Homo sapiens
gatctccaggccc

SEQ ID NO: 5749240 - DNA, 17 bp, Homo sapiens
gatctccaggcccagcc

SEQ ID NO: 5749241 - DNA, 21 bp, Homo sapiens
gatctcccactgcggggagac

SEQ ID NO: 5749242 - DNA, 21 bp, Homo sapiens
gatctcccagggctctctgga

SEQ ID NO: 5749243 - DNA, 14 bp, Homo sapiens
gatctccctccagg

SEQ ID NO: 5749244 - DNA, 12 bp, Homo sapiens
gatctccctgcc

SEQ ID NO: 5749245 - DNA, 14 bp, Homo sapiens
gatctccctgccgc

SEQ ID NO: 5749246 - DNA, 20 bp, Homo sapiens
gatctccctgccgcctcaat

SEQ ID NO: 5749247 - DNA, 19 bp, Homo sapiens
gatctcccttctcatctcc

SEQ ID NO: 5749248 - DNA, 17 bp, Homo sapiens
gatctccctttcctata

SEQ ID NO: 5749249 - DNA, 13 bp, Homo sapiens
gatctcctgacct

SEQ ID NO: 5749250 - DNA, 18 bp, Homo sapiens
gatctcctgacctcgtga

SEQ ID NO: 5749251 - DNA, 15 bp, Homo sapiens
gatctcctgaccttg

SEQ ID NO: 5749252 - DNA, 22 bp, Homo sapiens
gatctcctgccagcccagctgg

SEQ ID NO: 5749253 - DNA, 12 bp, Homo sapiens
gatctcctgtgc

SEQ ID NO: 5749254 - DNA, 21 bp, Homo sapiens
gatctcgatgcaggtggatct

SEQ ID NO: 5749255 - DNA, 21 bp, Homo sapiens
gatctcgcctggaaacagagg

SEQ ID NO: 5749256 - DNA, 17 bp, Homo sapiens
gatctcggctcactgca

SEQ ID NO: 5749257 - DNA, 16 bp, Homo sapiens
gatctcggctcagtgc

SEQ ID NO: 5749258 - DNA, 19 bp, Homo sapiens
gatctctcaggagcacagg

SEQ ID NO: 5749259 - DNA, 16 bp, Homo sapiens
gatctctctacaagag

SEQ ID NO: 5749260 - DNA, 19 bp, Homo sapiens
gatctctctagctttgtca

SEQ ID NO: 5749261 - DNA, 23 bp, Homo sapiens
gatctctcttgtcctcttctgct

SEQ ID NO: 5749262 - DNA, 19 bp, Homo sapiens
gatctctgaaacatattta

SEQ ID NO: 5749263 - DNA, 19 bp, Homo sapiens
gatctctgaagccacaaat

SEQ ID NO: 5749264 - DNA, 19 bp, Homo sapiens
gatctctgacctctgctga

SEQ ID NO: 5749265 - DNA, 15 bp, Homo sapiens
gatctctgcagggcc

SEQ ID NO: 5749266 - DNA, 22 bp, Homo sapiens
gatctctgctccctgcaagctc

SEQ ID NO: 5749267 - DNA, 13 bp, Homo sapiens
gatctctgctggg

SEQ ID NO: 5749268 - DNA, 12 bp, Homo sapiens
gatctctgtcac

SEQ ID NO: 5749269 - DNA, 16 bp, Homo sapiens
gatctctgttctttca

SEQ ID NO: 5749270 - DNA, 15 bp, Homo sapiens
gatctcttaggaagc

SEQ ID NO: 5749271 - DNA, 19 bp, Homo sapiens
gatctcttgagcctgggag

SEQ ID NO: 5749272 - DNA, 21 bp, Homo sapiens
gatctctttgatcctggaaat

SEQ ID NO: 5749273 - DNA, 21 bp, Homo sapiens
gatctctttttatttaaatgt

SEQ ID NO: 5749274 - DNA, 21 bp, Homo sapiens
gatctgaaaactcattagaga

SEQ ID NO: 5749275 - DNA, 22 bp, Homo sapiens
gatctgaaaggcacactttgat

SEQ ID NO: 5749276 - DNA, 23 bp, Homo sapiens
gatctgaaattggtgggaagcaa

SEQ ID NO: 5749277 - DNA, 15 bp, Homo sapiens
gatctgaacatctgg

SEQ ID NO: 5749278 - DNA, 15 bp, Homo sapiens
gatctgaacccagct

SEQ ID NO: 5749279 - DNA, 22 bp, Homo sapiens
gatctgacatgattccttcctg

SEQ ID NO: 5749280 - DNA, 14 bp, Homo sapiens
gatctgaccctccc

SEQ ID NO: 5749281 - DNA, 13 bp, Homo sapiens
gatctgactgcac

SEQ ID NO: 5749282 - DNA, 23 bp, Homo sapiens
gatctgagaacacgttgccaggg

SEQ ID NO: 5749283 - DNA, 15 bp, Homo sapiens
gatctgagctcccac

SEQ ID NO: 5749284 - DNA, 22 bp, Homo sapiens
gatctgagtacatattgtggtg

SEQ ID NO: 5749285 - DNA, 17 bp, Homo sapiens
gatctgagtaggtctgg

SEQ ID NO: 5749286 - DNA, 20 bp, Homo sapiens
gatctgatagaaagcaagtg

SEQ ID NO: 5749287 - DNA, 19 bp, Homo sapiens
gatctgatagggtttgtga

SEQ ID NO: 5749288 - DNA, 13 bp, Homo sapiens
gatctgatcaaga

SEQ ID NO: 5749289 - DNA, 19 bp, Homo sapiens
gatctgatggtgagctggg

SEQ ID NO: 5749290 - DNA, 22 bp, Homo sapiens
gatctgatggtgagctgggaag

SEQ ID NO: 5749291 - DNA, 16 bp, Homo sapiens
gatctgattgaccgtg

SEQ ID NO: 5749292 - DNA, 22 bp, Homo sapiens
gatctgcaagaacactggacct

SEQ ID NO: 5749293 - DNA, 18 bp, Homo sapiens
gatctgcaccaccatgcc

SEQ ID NO: 5749294 - DNA, 16 bp, Homo sapiens
gatctgcactcctgtc

SEQ ID NO: 5749295 - DNA, 17 bp, Homo sapiens
gatctgcactcctgtct

SEQ ID NO: 5749296 - DNA, 15 bp, Homo sapiens
gatctgcaggctgca

SEQ ID NO: 5749297 - DNA, 17 bp, Homo sapiens
gatctgcatctgataga

SEQ ID NO: 5749298 - DNA, 15 bp, Homo sapiens
gatctgccagacctg

SEQ ID NO: 5749299 - DNA, 19 bp, Homo sapiens
gatctgccagacctgcatg

SEQ ID NO: 5749300 - DNA, 21 bp, Homo sapiens
gatctgcccatcgtgaagaag

SEQ ID NO: 5749301 - DNA, 23 bp, Homo sapiens
gatctgcccatcgtgaagaagcc

SEQ ID NO: 5749302 - DNA, 22 bp, Homo sapiens
gatctgcccgcctcggcctccc

SEQ ID NO: 5749303 - DNA, 17 bp, Homo sapiens
gatctgcctaaggactt

SEQ ID NO: 5749304 - DNA, 23 bp, Homo sapiens
gatctgcctaaggacttctttaa

SEQ ID NO: 5749305 - DNA, 14 bp, Homo sapiens
gatctgcctgggcc

SEQ ID NO: 5749306 - DNA, 18 bp, Homo sapiens
gatctgcctgggcctgtg

SEQ ID NO: 5749307 - DNA, 20 bp, Homo sapiens
gatctgcctgggcctgtgca

SEQ ID NO: 5749308 - DNA, 18 bp, Homo sapiens
gatctgcgaagttgaacc

SEQ ID NO: 5749309 - DNA, 17 bp, Homo sapiens
gatctgcggatctcagc

SEQ ID NO: 5749310 - DNA, 15 bp, Homo sapiens
gatctgctcagccct

SEQ ID NO: 5749311 - DNA, 16 bp, Homo sapiens
gatctgctcagccctg

SEQ ID NO: 5749312 - DNA, 17 bp, Homo sapiens
gatctgctcagccctgg

SEQ ID NO: 5749313 - DNA, 21 bp, Homo sapiens
gatctgctcagccctggaggt

SEQ ID NO: 5749314 - DNA, 15 bp, Homo sapiens
gatctgctccatgca

SEQ ID NO: 5749315 - DNA, 21 bp, Homo sapiens
gatctgctgacagatgttcca

SEQ ID NO: 5749316 - DNA, 17 bp, Homo sapiens
gatctgctgcagagcag

SEQ ID NO: 5749317 - DNA, 19 bp, Homo sapiens
gatctgctgggctctgcct

SEQ ID NO: 5749318 - DNA, 16 bp, Homo sapiens
gatctgcttccctggg

SEQ ID NO: 5749319 - DNA, 15 bp, Homo sapiens
gatctgcttcttcat

SEQ ID NO: 5749320 - DNA, 14 bp, Homo sapiens
gatctgctttctgt

SEQ ID NO: 5749321 - DNA, 18 bp, Homo sapiens
gatctgctttctgttcat

SEQ ID NO: 5749322 - DNA, 22 bp, Homo sapiens
gatctgctttctgttcatctct

SEQ ID NO: 5749323 - DNA, 12 bp, Homo sapiens
gatctggaaccc

SEQ ID NO: 5749324 - DNA, 14 bp, Homo sapiens
gatctggaacccag

SEQ ID NO: 5749325 - DNA, 12 bp, Homo sapiens
gatctggaacct

SEQ ID NO: 5749326 - DNA, 19 bp, Homo sapiens
gatctggaacctcagcctg

SEQ ID NO: 5749327 - DNA, 14 bp, Homo sapiens
gatctggagtctga

SEQ ID NO: 5749328 - DNA, 15 bp, Homo sapiens
gatctggagtctgaa

SEQ ID NO: 5749329 - DNA, 18 bp, Homo sapiens
gatctggattttaaatgt

SEQ ID NO: 5749330 - DNA, 12 bp, Homo sapiens
gatctggcatgt

SEQ ID NO: 5749331 - DNA, 20 bp, Homo sapiens
gatctggcccaagctgggct

SEQ ID NO: 5749332 - DNA, 21 bp, Homo sapiens
gatctggcccaagctgggctc

SEQ ID NO: 5749333 - DNA, 22 bp, Homo sapiens
gatctggcccaagctgggctcc

SEQ ID NO: 5749334 - DNA, 11 bp, Homo sapiens
gatctgggagg

SEQ ID NO: 5749335 - DNA, 21 bp, Homo sapiens
gatctgggaggtctccactga

SEQ ID NO: 5749336 - DNA, 18 bp, Homo sapiens
gatctgggcattttcctc

SEQ ID NO: 5749337 - DNA, 20 bp, Homo sapiens
gatctgggcattttcctcct

SEQ ID NO: 5749338 - DNA, 15 bp, Homo sapiens
gatctggggaaggac

SEQ ID NO: 5749339 - DNA, 22 bp, Homo sapiens
gatctggggagagcggctggag

SEQ ID NO: 5749340 - DNA, 15 bp, Homo sapiens
gatctggggaggcag

SEQ ID NO: 5749341 - DNA, 16 bp, Homo sapiens
gatctggggaggcagg

SEQ ID NO: 5749342 - DNA, 17 bp, Homo sapiens
gatctggggaggcaggc

SEQ ID NO: 5749343 - DNA, 18 bp, Homo sapiens
gatctggggcatgaaaaa

SEQ ID NO: 5749344 - DNA, 15 bp, Homo sapiens
gatctggggggtggg

SEQ ID NO: 5749345 - DNA, 16 bp, Homo sapiens
gatctggggtgggagt

SEQ ID NO: 5749346 - DNA, 21 bp, Homo sapiens
gatctgggttttgcctctgcc

SEQ ID NO: 5749347 - DNA, 16 bp, Homo sapiens
gatctggtcctaccca

SEQ ID NO: 5749348 - DNA, 21 bp, Homo sapiens
gatctggtctcgtgttcgctg

SEQ ID NO: 5749349 - DNA, 23 bp, Homo sapiens
gatctggtgcgtgtggccctgtg

SEQ ID NO: 5749350 - DNA, 16 bp, Homo sapiens
gatctggtttgactcc

SEQ ID NO: 5749351 - DNA, 14 bp, Homo sapiens
gatctggttttgct

SEQ ID NO: 5749352 - DNA, 17 bp, Homo sapiens
gatctgtactttgtgtt

SEQ ID NO: 5749353 - DNA, 19 bp, Homo sapiens
gatctgtataaaaatgtaa

SEQ ID NO: 5749354 - DNA, 15 bp, Homo sapiens
gatctgtatatacaa

SEQ ID NO: 5749355 - DNA, 23 bp, Homo sapiens
gatctgtatctagaaagagatca

SEQ ID NO: 5749356 - DNA, 17 bp, Homo sapiens
gatctgtcaaagtgaga

SEQ ID NO: 5749357 - DNA, 16 bp, Homo sapiens
gatctgtcacaccagc

SEQ ID NO: 5749358 - DNA, 18 bp, Homo sapiens
gatctgtcacaccagcca

SEQ ID NO: 5749359 - DNA, 17 bp, Homo sapiens
gatctgtcccttaataa

SEQ ID NO: 5749360 - DNA, 15 bp, Homo sapiens
gatctgtcctcagcc

SEQ ID NO: 5749361 - DNA, 21 bp, Homo sapiens
gatctgtgatagttcaccccc

SEQ ID NO: 5749362 - DNA, 16 bp, Homo sapiens
gatctgtgattggctg

SEQ ID NO: 5749363 - DNA, 18 bp, Homo sapiens
gatctgtgattggctggt

SEQ ID NO: 5749364 - DNA, 14 bp, Homo sapiens
gatctgtgccccat

SEQ ID NO: 5749365 - DNA, 22 bp, Homo sapiens
gatctgtgccttttttatatct

SEQ ID NO: 5749366 - DNA, 14 bp, Homo sapiens
gatctgtgtaaaat

SEQ ID NO: 5749367 - DNA, 22 bp, Homo sapiens
gatctgttaaaaaagaaatctg

SEQ ID NO: 5749368 - DNA, 12 bp, Homo sapiens
gatctgttgtaa

SEQ ID NO: 5749369 - DNA, 15 bp, Homo sapiens
gatctgtttccaaat

SEQ ID NO: 5749370 - DNA, 18 bp, Homo sapiens
gatctgtttgaggagagc

SEQ ID NO: 5749371 - DNA, 19 bp, Homo sapiens
gatctgttttacaggaaac

SEQ ID NO: 5749372 - DNA, 16 bp, Homo sapiens
gatctgttttctggaa

SEQ ID NO: 5749373 - DNA, 23 bp, Homo sapiens
gatctgttttggatgttgctata

SEQ ID NO: 5749374 - DNA, 22 bp, Homo sapiens
gatctgttttgtggtttggaat

SEQ ID NO: 5749375 - DNA, 13 bp, Homo sapiens
gatcttaaagatc

SEQ ID NO: 5749376 - DNA, 23 bp, Homo sapiens
gatcttaagcagtaatctgtcag

SEQ ID NO: 5749377 - DNA, 15 bp, Homo sapiens
gatcttaatataaat

SEQ ID NO: 5749378 - DNA, 16 bp, Homo sapiens
gatcttacccacttcc

SEQ ID NO: 5749379 - DNA, 14 bp, Homo sapiens
gatcttagattctc

SEQ ID NO: 5749380 - DNA, 20 bp, Homo sapiens
gatcttaggcaaaataccag

SEQ ID NO: 5749381 - DNA, 20 bp, Homo sapiens
gatcttaggcatgtgctggt

SEQ ID NO: 5749382 - DNA, 18 bp, Homo sapiens
gatcttagggatgattaa

SEQ ID NO: 5749383 - DNA, 21 bp, Homo sapiens
gatcttatttttctaaacgta

SEQ ID NO: 5749384 - DNA, 13 bp, Homo sapiens
gatcttcaacaaa

SEQ ID NO: 5749385 - DNA, 15 bp, Homo sapiens
gatcttcaatggctt

SEQ ID NO: 5749386 - DNA, 14 bp, Homo sapiens
gatcttcactgtat

SEQ ID NO: 5749387 - DNA, 13 bp, Homo sapiens
gatcttcagaact

SEQ ID NO: 5749388 - DNA, 18 bp, Homo sapiens
gatcttcagaactgccct

SEQ ID NO: 5749389 - DNA, 20 bp, Homo sapiens
gatcttcagaactgcccttg

SEQ ID NO: 5749390 - DNA, 23 bp, Homo sapiens
gatcttcaggatgcacggtttct

SEQ ID NO: 5749391 - DNA, 16 bp, Homo sapiens
gatcttcatctgacta

SEQ ID NO: 5749392 - DNA, 22 bp, Homo sapiens
gatcttcccacctcacagtgat

SEQ ID NO: 5749393 - DNA, 20 bp, Homo sapiens
gatcttcccacgtgggcctc

SEQ ID NO: 5749394 - DNA, 17 bp, Homo sapiens
gatcttccgtggtcaga

SEQ ID NO: 5749395 - DNA, 18 bp, Homo sapiens
gatcttcctctgctaaat

SEQ ID NO: 5749396 - DNA, 12 bp, Homo sapiens
gatcttctgaaa

SEQ ID NO: 5749397 - DNA, 14 bp, Homo sapiens
gatcttctgaaatg

SEQ ID NO: 5749398 - DNA, 18 bp, Homo sapiens
gatcttctgaaatgaaac

SEQ ID NO: 5749399 - DNA, 22 bp, Homo sapiens
gatcttctgtgggtttctaaag

SEQ ID NO: 5749400 - DNA, 19 bp, Homo sapiens
gatcttctttataattcta

SEQ ID NO: 5749401 - DNA, 14 bp, Homo sapiens
gatcttgaatgtgg

SEQ ID NO: 5749402 - DNA, 13 bp, Homo sapiens
gatcttgatttgg

SEQ ID NO: 5749403 - DNA, 17 bp, Homo sapiens
gatcttgcattcatttt

SEQ ID NO: 5749404 - DNA, 19 bp, Homo sapiens
gatcttgccacatttctga

SEQ ID NO: 5749405 - DNA, 17 bp, Homo sapiens
gatcttgccactgtact

SEQ ID NO: 5749406 - DNA, 20 bp, Homo sapiens
gatcttgctctatctcacag

SEQ ID NO: 5749407 - DNA, 15 bp, Homo sapiens
gatcttgctggagaa

SEQ ID NO: 5749408 - DNA, 19 bp, Homo sapiens
gatcttgctggcagggcct

SEQ ID NO: 5749409 - DNA, 15 bp, Homo sapiens
gatcttgtgctatga

SEQ ID NO: 5749410 - DNA, 16 bp, Homo sapiens
gatcttgttaatgcat

SEQ ID NO: 5749411 - DNA, 14 bp, Homo sapiens
gatctttaaataca

SEQ ID NO: 5749412 - DNA, 18 bp, Homo sapiens
gatctttaaatacagtca

SEQ ID NO: 5749413 - DNA, 11 bp, Homo sapiens
gatctttacat

SEQ ID NO: 5749414 - DNA, 19 bp, Homo sapiens
gatctttacataattcaga

SEQ ID NO: 5749415 - DNA, 11 bp, Homo sapiens
gatctttactc

SEQ ID NO: 5749416 - DNA, 21 bp, Homo sapiens
gatctttattatggaaaacat

SEQ ID NO: 5749417 - DNA, 20 bp, Homo sapiens
gatctttcacccacagaaag

SEQ ID NO: 5749418 - DNA, 23 bp, Homo sapiens
gatctttcacccacagaaagaga

SEQ ID NO: 5749419 - DNA, 12 bp, Homo sapiens
gatctttcagga

SEQ ID NO: 5749420 - DNA, 15 bp, Homo sapiens
gatctttcaggaaag

SEQ ID NO: 5749421 - DNA, 22 bp, Homo sapiens
gatctttcgttggttgtttctc

SEQ ID NO: 5749422 - DNA, 23 bp, Homo sapiens
gatctttcgttggttgtttctct

SEQ ID NO: 5749423 - DNA, 13 bp, Homo sapiens
gatctttctagag

SEQ ID NO: 5749424 - DNA, 17 bp, Homo sapiens
gatctttctcttccctg

SEQ ID NO: 5749425 - DNA, 18 bp, Homo sapiens
gatctttctcttccctga

SEQ ID NO: 5749426 - DNA, 20 bp, Homo sapiens
gatctttctttccaaaacat

SEQ ID NO: 5749427 - DNA, 13 bp, Homo sapiens
gatctttgactga

SEQ ID NO: 5749428 - DNA, 13 bp, Homo sapiens
gatctttggacag

SEQ ID NO: 5749429 - DNA, 13 bp, Homo sapiens
gatctttgtttaa

SEQ ID NO: 5749430 - DNA, 17 bp, Homo sapiens
gatctttgtttaaatgc

SEQ ID NO: 5749431 - DNA, 22 bp, Homo sapiens
gatctttgttttttgttttcat

SEQ ID NO: 5749432 - DNA, 13 bp, Homo sapiens
gatcttttaaagt

SEQ ID NO: 5749433 - DNA, 16 bp, Homo sapiens
gatcttttcaagttaa

SEQ ID NO: 5749434 - DNA, 18 bp, Homo sapiens
gatcttttcgaagctgtt

SEQ ID NO: 5749435 - DNA, 15 bp, Homo sapiens
gatcttttggacctg

SEQ ID NO: 5749436 - DNA, 14 bp, Homo sapiens
gatcttttgtaaat

SEQ ID NO: 5749437 - DNA, 24 bp, Homo sapiens
gatcttttgttcccatcctcttct

SEQ ID NO: 5749438 - DNA, 18 bp, Homo sapiens
gatctttttatacacaat

SEQ ID NO: 5749439 - DNA, 14 bp, Homo sapiens
gatcttttttgtca

SEQ ID NO: 5749440 - DNA, 20 bp, Homo sapiens
gatgaaaaaaagggaaaaca

SEQ ID NO: 5749441 - DNA, 15 bp, Homo sapiens
gatgaaaaaataaca

SEQ ID NO: 5749442 - DNA, 17 bp, Homo sapiens
gatgaaaaagcatgtac

SEQ ID NO: 5749443 - DNA, 20 bp, Homo sapiens
gatgaaaaagcatgtacagt

SEQ ID NO: 5749444 - DNA, 15 bp, Homo sapiens
gatgaaaaattatag

SEQ ID NO: 5749445 - DNA, 14 bp, Homo sapiens
gatgaaaagaaaac

SEQ ID NO: 5749446 - DNA, 14 bp, Homo sapiens
gatgaaaagccata

SEQ ID NO: 5749447 - DNA, 23 bp, Homo sapiens
gatgaaaagccatatctagtcaa

SEQ ID NO: 5749448 - DNA, 18 bp, Homo sapiens
gatgaaaagctaccatca

SEQ ID NO: 5749449 - DNA, 17 bp, Homo sapiens
gatgaaaataaaataaa

SEQ ID NO: 5749450 - DNA, 16 bp, Homo sapiens
gatgaaaataaagaat

SEQ ID NO: 5749451 - DNA, 14 bp, Homo sapiens
gatgaaaataattt

SEQ ID NO: 5749452 - DNA, 21 bp, Homo sapiens
gatgaaaatatcagcttttct

SEQ ID NO: 5749453 - DNA, 17 bp, Homo sapiens
gatgaaaatatttaaag

SEQ ID NO: 5749454 - DNA, 14 bp, Homo sapiens
gatgaaaatatttg

SEQ ID NO: 5749455 - DNA, 14 bp, Homo sapiens
gatgaaacattcat

SEQ ID NO: 5749456 - DNA, 17 bp, Homo sapiens
gatgaaaccgtccctga

SEQ ID NO: 5749457 - DNA, 19 bp, Homo sapiens
gatgaaactaaagcaatag

SEQ ID NO: 5749458 - DNA, 22 bp, Homo sapiens
gatgaaactaaagcaatagaaa

SEQ ID NO: 5749459 - DNA, 16 bp, Homo sapiens
gatgaaactcacaaat

SEQ ID NO: 5749460 - DNA, 14 bp, Homo sapiens
gatgaaacttctca

SEQ ID NO: 5749461 - DNA, 23 bp, Homo sapiens
gatgaaatatgtgattttctcta

SEQ ID NO: 5749462 - DNA, 18 bp, Homo sapiens
gatgaaatctgctagaaa

SEQ ID NO: 5749463 - DNA, 20 bp, Homo sapiens
gatgaaatgccaagactcta

SEQ ID NO: 5749464 - DNA, 13 bp, Homo sapiens
gatgaacaatgta

SEQ ID NO: 5749465 - DNA, 17 bp, Homo sapiens
gatgaaccctggcattt

SEQ ID NO: 5749466 - DNA, 17 bp, Homo sapiens
gatgaactcaatgcatg

SEQ ID NO: 5749467 - DNA, 18 bp, Homo sapiens
gatgaactctgaactttg

SEQ ID NO: 5749468 - DNA, 19 bp, Homo sapiens
gatgaactctttctggcct

SEQ ID NO: 5749469 - DNA, 16 bp, Homo sapiens
gatgaactgagaaggt

SEQ ID NO: 5749470 - DNA, 19 bp, Homo sapiens
gatgaacttattctgtaga

SEQ ID NO: 5749471 - DNA, 13 bp, Homo sapiens
gatgaactttctc

SEQ ID NO: 5749472 - DNA, 18 bp, Homo sapiens
gatgaactttgtcattat

SEQ ID NO: 5749473 - DNA, 13 bp, Homo sapiens
gatgaagaaagag

SEQ ID NO: 5749474 - DNA, 22 bp, Homo sapiens
gatgaagaaagagactgtgggg

SEQ ID NO: 5749475 - DNA, 17 bp, Homo sapiens
gatgaagaacacagcat

SEQ ID NO: 5749476 - DNA, 22 bp, Homo sapiens
gatgaagaacacagcatgtgcc

SEQ ID NO: 5749477 - DNA, 15 bp, Homo sapiens
gatgaagaagggggt

SEQ ID NO: 5749478 - DNA, 14 bp, Homo sapiens
gatgaagacagccc

SEQ ID NO: 5749479 - DNA, 19 bp, Homo sapiens
gatgaagaccctatctccc

SEQ ID NO: 5749480 - DNA, 11 bp, Homo sapiens
gatgaagagaa

SEQ ID NO: 5749481 - DNA, 13 bp, Homo sapiens
gatgaagagaagc

SEQ ID NO: 5749482 - DNA, 21 bp, Homo sapiens
gatgaagagaagctgagaaga

SEQ ID NO: 5749483 - DNA, 18 bp, Homo sapiens
gatgaagagaaggcacac

SEQ ID NO: 5749484 - DNA, 21 bp, Homo sapiens
gatgaagcaaggaagatatac

SEQ ID NO: 5749485 - DNA, 23 bp, Homo sapiens
gatgaagcaaggaagatatacat

SEQ ID NO: 5749486 - DNA, 16 bp, Homo sapiens
gatgaagctgaggctg

SEQ ID NO: 5749487 - DNA, 21 bp, Homo sapiens
gatgaaggcgtgcaaggggct

SEQ ID NO: 5749488 - DNA, 23 bp, Homo sapiens
gatgaaggcgtgcaaggggctca

SEQ ID NO: 5749489 - DNA, 23 bp, Homo sapiens
gatgaaggtcatctttttcccct

SEQ ID NO: 5749490 - DNA, 15 bp, Homo sapiens
gatgaaggtctgttt

SEQ ID NO: 5749491 - DNA, 19 bp, Homo sapiens
gatgaagttatctggcttc

SEQ ID NO: 5749492 - DNA, 17 bp, Homo sapiens
gatgaatagaagaaaga

SEQ ID NO: 5749493 - DNA, 13 bp, Homo sapiens
gatgaatcactgt

SEQ ID NO: 5749494 - DNA, 20 bp, Homo sapiens
gatgaatcactgtttttaga

SEQ ID NO: 5749495 - DNA, 21 bp, Homo sapiens
gatgaatcagtatgaagacac

SEQ ID NO: 5749496 - DNA, 21 bp, Homo sapiens
gatgaatcctagcttcttcca

SEQ ID NO: 5749497 - DNA, 16 bp, Homo sapiens
gatgaatctacatttg

SEQ ID NO: 5749498 - DNA, 23 bp, Homo sapiens
gatgaatgaggtcccaggcagag

SEQ ID NO: 5749499 - DNA, 15 bp, Homo sapiens
gatgaatgggaaagt

SEQ ID NO: 5749500 - DNA, 14 bp, Homo sapiens
gatgaatgtactat

SEQ ID NO: 5749501 - DNA, 13 bp, Homo sapiens
gatgaatgtcagt

SEQ ID NO: 5749502 - DNA, 14 bp, Homo sapiens
gatgaatgtcagtt

SEQ ID NO: 5749503 - DNA, 21 bp, Homo sapiens
gatgaatgtcagttgttattt

SEQ ID NO: 5749504 - DNA, 22 bp, Homo sapiens
gatgaatgtcagttgttattta

SEQ ID NO: 5749505 - DNA, 20 bp, Homo sapiens
gatgaattatcttggatgag

SEQ ID NO: 5749506 - DNA, 14 bp, Homo sapiens
gatgaattatgata

SEQ ID NO: 5749507 - DNA, 15 bp, Homo sapiens
gatgaattgataaaa

SEQ ID NO: 5749508 - DNA, 15 bp, Homo sapiens
gatgaattgcattat

SEQ ID NO: 5749509 - DNA, 18 bp, Homo sapiens
gatgaattgcattatttt

SEQ ID NO: 5749510 - DNA, 22 bp, Homo sapiens
gatgaattgcgttggtctctgc

SEQ ID NO: 5749511 - DNA, 19 bp, Homo sapiens
gatgaattgtcacatctat

SEQ ID NO: 5749512 - DNA, 14 bp, Homo sapiens
gatgaatttgtcca

SEQ ID NO: 5749513 - DNA, 18 bp, Homo sapiens
gatgacaactacagaaaa

SEQ ID NO: 5749514 - DNA, 20 bp, Homo sapiens
gatgacaactggaatagttt

SEQ ID NO: 5749515 - DNA, 16 bp, Homo sapiens
gatgacaataaagctt

SEQ ID NO: 5749516 - DNA, 15 bp, Homo sapiens
gatgacacaaatacc

SEQ ID NO: 5749517 - DNA, 22 bp, Homo sapiens
gatgacacatttaatgaacaca

SEQ ID NO: 5749518 - DNA, 23 bp, Homo sapiens
gatgacacccaccctgtgccatc

SEQ ID NO: 5749519 - DNA, 16 bp, Homo sapiens
gatgacaccctggcct

SEQ ID NO: 5749520 - DNA, 18 bp, Homo sapiens
gatgacaccctggcctga

SEQ ID NO: 5749521 - DNA, 15 bp, Homo sapiens
gatgacacttgtaca

SEQ ID NO: 5749522 - DNA, 17 bp, Homo sapiens
gatgacacttgtacaat

SEQ ID NO: 5749523 - DNA, 23 bp, Homo sapiens
gatgacagaggtttgaaggagaa

SEQ ID NO: 5749524 - DNA, 15 bp, Homo sapiens
gatgacagccaccct

SEQ ID NO: 5749525 - DNA, 18 bp, Homo sapiens
gatgacaggctctcctgg

SEQ ID NO: 5749526 - DNA, 13 bp, Homo sapiens
gatgacagggagc

SEQ ID NO: 5749527 - DNA, 22 bp, Homo sapiens
gatgacagggcagagcaggaag

SEQ ID NO: 5749528 - DNA, 20 bp, Homo sapiens
gatgacatgcactcagctct

SEQ ID NO: 5749529 - DNA, 15 bp, Homo sapiens
gatgacattccctgc

SEQ ID NO: 5749530 - DNA, 17 bp, Homo sapiens
gatgacattccctgcta

SEQ ID NO: 5749531 - DNA, 16 bp, Homo sapiens
gatgacattgctaaga

SEQ ID NO: 5749532 - DNA, 23 bp, Homo sapiens
gatgacatttcgttttttacacg

SEQ ID NO: 5749533 - DNA, 18 bp, Homo sapiens
gatgaccaaaccagcctt

SEQ ID NO: 5749534 - DNA, 23 bp, Homo sapiens
gatgaccacacccgaagtcctgt

SEQ ID NO: 5749535 - DNA, 17 bp, Homo sapiens
gatgaccacgcacctcc

SEQ ID NO: 5749536 - DNA, 17 bp, Homo sapiens
gatgaccagggatgctg

SEQ ID NO: 5749537 - DNA, 16 bp, Homo sapiens
gatgaccatactcaga

SEQ ID NO: 5749538 - DNA, 18 bp, Homo sapiens
gatgacccactaaagagt

SEQ ID NO: 5749539 - DNA, 21 bp, Homo sapiens
gatgacccaggctgcctgagc

SEQ ID NO: 5749540 - DNA, 23 bp, Homo sapiens
gatgaccccatcaaccccagggc

SEQ ID NO: 5749541 - DNA, 22 bp, Homo sapiens
gatgacccccaggtattgtctt

SEQ ID NO: 5749542 - DNA, 16 bp, Homo sapiens
gatgacccctccccta

SEQ ID NO: 5749543 - DNA, 17 bp, Homo sapiens
gatgacccctcccctaa

SEQ ID NO: 5749544 - DNA, 19 bp, Homo sapiens
gatgacccggggcagctgg

SEQ ID NO: 5749545 - DNA, 20 bp, Homo sapiens
gatgacccggggcagctggc

SEQ ID NO: 5749546 - DNA, 16 bp, Homo sapiens
gatgaccgtgtacaat

SEQ ID NO: 5749547 - DNA, 14 bp, Homo sapiens
gatgacctccagaa

SEQ ID NO: 5749548 - DNA, 15 bp, Homo sapiens
gatgacctccagaag

SEQ ID NO: 5749549 - DNA, 22 bp, Homo sapiens
gatgacctccttagaaaagact

SEQ ID NO: 5749550 - DNA, 20 bp, Homo sapiens
gatgacctcgtactcaggag

SEQ ID NO: 5749551 - DNA, 21 bp, Homo sapiens
gatgacctcgtactcaggagc

SEQ ID NO: 5749552 - DNA, 21 bp, Homo sapiens
gatgacgacgacaacgatgat

SEQ ID NO: 5749553 - DNA, 19 bp, Homo sapiens
gatgacggtattatgcttc

SEQ ID NO: 5749554 - DNA, 20 bp, Homo sapiens
gatgacggtattatgcttct

SEQ ID NO: 5749555 - DNA, 12 bp, Homo sapiens
gatgactaaaat

SEQ ID NO: 5749556 - DNA, 14 bp, Homo sapiens
gatgactaacaaga

SEQ ID NO: 5749557 - DNA, 14 bp, Homo sapiens
gatgactcaagatt

SEQ ID NO: 5749558 - DNA, 23 bp, Homo sapiens
gatgactcaagattcccaggagt

SEQ ID NO: 5749559 - DNA, 21 bp, Homo sapiens
gatgactcccttaaaatagaa

SEQ ID NO: 5749560 - DNA, 16 bp, Homo sapiens
gatgactcgaaactga

SEQ ID NO: 5749561 - DNA, 13 bp, Homo sapiens
gatgactctgaga

SEQ ID NO: 5749562 - DNA, 22 bp, Homo sapiens
gatgactctgtctcattgacct

SEQ ID NO: 5749563 - DNA, 12 bp, Homo sapiens
gatgactgagtc

SEQ ID NO: 5749564 - DNA, 17 bp, Homo sapiens
gatgactgagtcctcgt

SEQ ID NO: 5749565 - DNA, 14 bp, Homo sapiens
gatgactgcttgta

SEQ ID NO: 5749566 - DNA, 23 bp, Homo sapiens
gatgacttagcgtcaagacattt

SEQ ID NO: 5749567 - DNA, 14 bp, Homo sapiens
gatgacttcagtga

SEQ ID NO: 5749568 - DNA, 13 bp, Homo sapiens
gatgacttgctca

SEQ ID NO: 5749569 - DNA, 17 bp, Homo sapiens
gatgacttgctgtccag

SEQ ID NO: 5749570 - DNA, 21 bp, Homo sapiens
gatgacttggggacaccccag

SEQ ID NO: 5749571 - DNA, 22 bp, Homo sapiens
gatgacttggtggcttttcctt

SEQ ID NO: 5749572 - DNA, 20 bp, Homo sapiens
gatgactttctgttttctgt

SEQ ID NO: 5749573 - DNA, 18 bp, Homo sapiens
gatgactttgcagatgga

SEQ ID NO: 5749574 - DNA, 19 bp, Homo sapiens
gatgactttttttctgatt

SEQ ID NO: 5749575 - DNA, 13 bp, Homo sapiens
gatgagaaaacag

SEQ ID NO: 5749576 - DNA, 17 bp, Homo sapiens
gatgagaaaactgagag

SEQ ID NO: 5749577 - DNA, 23 bp, Homo sapiens
gatgagaaataaagtttctgttg

SEQ ID NO: 5749578 - DNA, 14 bp, Homo sapiens
gatgagaacaaagc

SEQ ID NO: 5749579 - DNA, 15 bp, Homo sapiens
gatgagaacaaagct

SEQ ID NO: 5749580 - DNA, 17 bp, Homo sapiens
gatgagaacaaagctgt

SEQ ID NO: 5749581 - DNA, 20 bp, Homo sapiens
gatgagaacagataaagatt

SEQ ID NO: 5749582 - DNA, 12 bp, Homo sapiens
gatgagaagtta

SEQ ID NO: 5749583 - DNA, 20 bp, Homo sapiens
gatgagaatgtgacctttaa

SEQ ID NO: 5749584 - DNA, 18 bp, Homo sapiens
gatgagaattcagctgcc

SEQ ID NO: 5749585 - DNA, 21 bp, Homo sapiens
gatgagaatttctaaaaagat

SEQ ID NO: 5749586 - DNA, 14 bp, Homo sapiens
gatgagacaacaca

SEQ ID NO: 5749587 - DNA, 16 bp, Homo sapiens
gatgagacccagcccc

SEQ ID NO: 5749588 - DNA, 17 bp, Homo sapiens
gatgagacccagcccct

SEQ ID NO: 5749589 - DNA, 23 bp, Homo sapiens
gatgagactccactcaggtgcac

SEQ ID NO: 5749590 - DNA, 15 bp, Homo sapiens
gatgagactgtttat

SEQ ID NO: 5749591 - DNA, 12 bp, Homo sapiens
gatgagagaatg

SEQ ID NO: 5749592 - DNA, 13 bp, Homo sapiens
gatgagagaatgt

SEQ ID NO: 5749593 - DNA, 18 bp, Homo sapiens
gatgagagaatgtggaaa

SEQ ID NO: 5749594 - DNA, 14 bp, Homo sapiens
gatgagaggaaatc

SEQ ID NO: 5749595 - DNA, 16 bp, Homo sapiens
gatgagaggaaatcac

SEQ ID NO: 5749596 - DNA, 15 bp, Homo sapiens
gatgagattccctct

SEQ ID NO: 5749597 - DNA, 16 bp, Homo sapiens
gatgagatttgccagc

SEQ ID NO: 5749598 - DNA, 17 bp, Homo sapiens
gatgagatttgccagca

SEQ ID NO: 5749599 - DNA, 16 bp, Homo sapiens
gatgagatttttaaaa

SEQ ID NO: 5749600 - DNA, 14 bp, Homo sapiens
gatgagcaaggaca

SEQ ID NO: 5749601 - DNA, 19 bp, Homo sapiens
gatgagcaaggacattgcc

SEQ ID NO: 5749602 - DNA, 12 bp, Homo sapiens
gatgagcagagc

SEQ ID NO: 5749603 - DNA, 19 bp, Homo sapiens
gatgagcagagggaggaag

SEQ ID NO: 5749604 - DNA, 17 bp, Homo sapiens
gatgagcatcccaggat

SEQ ID NO: 5749605 - DNA, 16 bp, Homo sapiens
gatgagcatggagctg

SEQ ID NO: 5749606 - DNA, 17 bp, Homo sapiens
gatgagcatggagctgg

SEQ ID NO: 5749607 - DNA, 23 bp, Homo sapiens
gatgagccaaaccagcagggagt

SEQ ID NO: 5749608 - DNA, 21 bp, Homo sapiens
gatgagcccagccctgttctg

SEQ ID NO: 5749609 - DNA, 20 bp, Homo sapiens
gatgagccccacgtggagct

SEQ ID NO: 5749610 - DNA, 19 bp, Homo sapiens
gatgagccctcagaaccct

SEQ ID NO: 5749611 - DNA, 16 bp, Homo sapiens
gatgagccgggtccgg

SEQ ID NO: 5749612 - DNA, 13 bp, Homo sapiens
gatgagctcccac

SEQ ID NO: 5749613 - DNA, 16 bp, Homo sapiens
gatgagctctacccag

SEQ ID NO: 5749614 - DNA, 19 bp, Homo sapiens
gatgagctctacccagggc

SEQ ID NO: 5749615 - DNA, 17 bp, Homo sapiens
gatgagctgaaaagtga

SEQ ID NO: 5749616 - DNA, 20 bp, Homo sapiens
gatgagctggaaggagtgag

SEQ ID NO: 5749617 - DNA, 12 bp, Homo sapiens
gatgaggaccca

SEQ ID NO: 5749618 - DNA, 19 bp, Homo sapiens
gatgaggcaaacagcaaga

SEQ ID NO: 5749619 - DNA, 12 bp, Homo sapiens
gatgaggccaac

SEQ ID NO: 5749620 - DNA, 13 bp, Homo sapiens
gatgaggccagac

SEQ ID NO: 5749621 - DNA, 17 bp, Homo sapiens
gatgaggccccgccttt

SEQ ID NO: 5749622 - DNA, 20 bp, Homo sapiens
gatgaggccctccacacctg

SEQ ID NO: 5749623 - DNA, 22 bp, Homo sapiens
gatgaggcctcttggacctctg

SEQ ID NO: 5749624 - DNA, 20 bp, Homo sapiens
gatgaggcttcttcctggat

SEQ ID NO: 5749625 - DNA, 12 bp, Homo sapiens
gatgagggaagg

SEQ ID NO: 5749626 - DNA, 19 bp, Homo sapiens
gatgagggagacagaccac

SEQ ID NO: 5749627 - DNA, 18 bp, Homo sapiens
gatgagggatgggcctgg

SEQ ID NO: 5749628 - DNA, 16 bp, Homo sapiens
gatgagggcagcagcc

SEQ ID NO: 5749629 - DNA, 14 bp, Homo sapiens
gatgaggggaggaa

SEQ ID NO: 5749630 - DNA, 24 bp, Homo sapiens
gatgaggggccactgacccacctg

SEQ ID NO: 5749631 - DNA, 20 bp, Homo sapiens
gatgaggtcaccaggggagg

SEQ ID NO: 5749632 - DNA, 13 bp, Homo sapiens
gatgaggtctgat

SEQ ID NO: 5749633 - DNA, 14 bp, Homo sapiens
gatgaggtgctggg

SEQ ID NO: 5749634 - DNA, 16 bp, Homo sapiens
gatgaggtgctgggag

SEQ ID NO: 5749635 - DNA, 20 bp, Homo sapiens
gatgagtaaactgtttctca

SEQ ID NO: 5749636 - DNA, 21 bp, Homo sapiens
gatgagtaaactgtttctcag

SEQ ID NO: 5749637 - DNA, 23 bp, Homo sapiens
gatgagtcttgatctagatacag

SEQ ID NO: 5749638 - DNA, 20 bp, Homo sapiens
gatgagtgattgacacacag

SEQ ID NO: 5749639 - DNA, 21 bp, Homo sapiens
gatgagtgtaacaagaaagga

SEQ ID NO: 5749640 - DNA, 14 bp, Homo sapiens
gatgagttaactgt

SEQ ID NO: 5749641 - DNA, 19 bp, Homo sapiens
gatgagtttcactgtactg

SEQ ID NO: 5749642 - DNA, 20 bp, Homo sapiens
gatgagtttttcattatttg

SEQ ID NO: 5749643 - DNA, 19 bp, Homo sapiens
gatgataaagagacagtga

SEQ ID NO: 5749644 - DNA, 15 bp, Homo sapiens
gatgataaaggaaat

SEQ ID NO: 5749645 - DNA, 20 bp, Homo sapiens
gatgataaaggaaataggat

SEQ ID NO: 5749646 - DNA, 14 bp, Homo sapiens
gatgataaagtccc

SEQ ID NO: 5749647 - DNA, 18 bp, Homo sapiens
gatgataaatatggttaa

SEQ ID NO: 5749648 - DNA, 19 bp, Homo sapiens
gatgataatgatgatgacg

SEQ ID NO: 5749649 - DNA, 21 bp, Homo sapiens
gatgatacaagattagaagct

SEQ ID NO: 5749650 - DNA, 19 bp, Homo sapiens
gatgatactaataaactaa

SEQ ID NO: 5749651 - DNA, 14 bp, Homo sapiens
gatgatactgtttc

SEQ ID NO: 5749652 - DNA, 20 bp, Homo sapiens
gatgatagacttcgaaaaca

SEQ ID NO: 5749653 - DNA, 23 bp, Homo sapiens
gatgataggttaataaagatgat

SEQ ID NO: 5749654 - DNA, 14 bp, Homo sapiens
gatgatatctatat

SEQ ID NO: 5749655 - DNA, 14 bp, Homo sapiens
gatgatatggaggt

SEQ ID NO: 5749656 - DNA, 15 bp, Homo sapiens
gatgatattaagaac

SEQ ID NO: 5749657 - DNA, 16 bp, Homo sapiens
gatgatcactgtgaaa

SEQ ID NO: 5749658 - DNA, 13 bp, Homo sapiens
gatgatccagaac

SEQ ID NO: 5749659 - DNA, 22 bp, Homo sapiens
gatgatccagagacatgtggca

SEQ ID NO: 5749660 - DNA, 16 bp, Homo sapiens
gatgatccatttgaac

SEQ ID NO: 5749661 - DNA, 21 bp, Homo sapiens
gatgatcccagtcactcctct

SEQ ID NO: 5749662 - DNA, 13 bp, Homo sapiens
gatgatcctaggc

SEQ ID NO: 5749663 - DNA, 20 bp, Homo sapiens
gatgatcgcccgataaagac

SEQ ID NO: 5749664 - DNA, 16 bp, Homo sapiens
gatgatcgctgtattt

SEQ ID NO: 5749665 - DNA, 22 bp, Homo sapiens
gatgatcgctgtattttgagtt

SEQ ID NO: 5749666 - DNA, 17 bp, Homo sapiens
gatgatcgtagacacag

SEQ ID NO: 5749667 - DNA, 19 bp, Homo sapiens
gatgatctcttaggaagcc

SEQ ID NO: 5749668 - DNA, 22 bp, Homo sapiens
gatgatctcttaggaagccttt

SEQ ID NO: 5749669 - DNA, 14 bp, Homo sapiens
gatgatctttgcag

SEQ ID NO: 5749670 - DNA, 21 bp, Homo sapiens
gatgatctttgcagacaggca

SEQ ID NO: 5749671 - DNA, 14 bp, Homo sapiens
gatgatgactatgg

SEQ ID NO: 5749672 - DNA, 14 bp, Homo sapiens
gatgatgagggaag

SEQ ID NO: 5749673 - DNA, 14 bp, Homo sapiens
gatgatgatgatga

SEQ ID NO: 5749674 - DNA, 15 bp, Homo sapiens
gatgatgatgatgat

SEQ ID NO: 5749675 - DNA, 17 bp, Homo sapiens
gatgatgatgatgatga

SEQ ID NO: 5749676 - DNA, 16 bp, Homo sapiens
gatgatgcatggagga

SEQ ID NO: 5749677 - DNA, 15 bp, Homo sapiens
gatgatgccagctgt

SEQ ID NO: 5749678 - DNA, 22 bp, Homo sapiens
gatgatgcttgtaacaagaaaa

SEQ ID NO: 5749679 - DNA, 12 bp, Homo sapiens
gatgatggaaaa

SEQ ID NO: 5749680 - DNA, 16 bp, Homo sapiens
gatgatggcagagcca

SEQ ID NO: 5749681 - DNA, 19 bp, Homo sapiens
gatgatggcagagccaggc

SEQ ID NO: 5749682 - DNA, 17 bp, Homo sapiens
gatgatggccatttcta

SEQ ID NO: 5749683 - DNA, 18 bp, Homo sapiens
gatgatgggctggagcag

SEQ ID NO: 5749684 - DNA, 18 bp, Homo sapiens
gatgatggggtcagcagg

SEQ ID NO: 5749685 - DNA, 22 bp, Homo sapiens
gatgatggggtcagcaggccca

SEQ ID NO: 5749686 - DNA, 18 bp, Homo sapiens
gatgatggtgttggtgaa

SEQ ID NO: 5749687 - DNA, 15 bp, Homo sapiens
gatgatggtgttttg

SEQ ID NO: 5749688 - DNA, 14 bp, Homo sapiens
gatgatgtgcctgg

SEQ ID NO: 5749689 - DNA, 15 bp, Homo sapiens
gatgatgtgcctggg

SEQ ID NO: 5749690 - DNA, 17 bp, Homo sapiens
gatgatgtgcctgggtg

SEQ ID NO: 5749691 - DNA, 17 bp, Homo sapiens
gatgattaaacacctga

SEQ ID NO: 5749692 - DNA, 23 bp, Homo sapiens
gatgattaaacacctgacacatc

SEQ ID NO: 5749693 - DNA, 13 bp, Homo sapiens
gatgattaaattt

SEQ ID NO: 5749694 - DNA, 16 bp, Homo sapiens
gatgattcaggtgcag

SEQ ID NO: 5749695 - DNA, 18 bp, Homo sapiens
gatgattcttctaggcat

SEQ ID NO: 5749696 - DNA, 15 bp, Homo sapiens
gatgattgaagaaac

SEQ ID NO: 5749697 - DNA, 22 bp, Homo sapiens
gatgattgcttccacccacacg

SEQ ID NO: 5749698 - DNA, 18 bp, Homo sapiens
gatgattgttcataatac

SEQ ID NO: 5749699 - DNA, 14 bp, Homo sapiens
gatgattgttcttt

SEQ ID NO: 5749700 - DNA, 12 bp, Homo sapiens
gatgatttaagt

SEQ ID NO: 5749701 - DNA, 14 bp, Homo sapiens
gatgatttaagtgt

SEQ ID NO: 5749702 - DNA, 19 bp, Homo sapiens
gatgatttcagttctagga

SEQ ID NO: 5749703 - DNA, 20 bp, Homo sapiens
gatgatttcatcttctggaa

SEQ ID NO: 5749704 - DNA, 14 bp, Homo sapiens
gatgatttccaagc

SEQ ID NO: 5749705 - DNA, 12 bp, Homo sapiens
gatgatttctat

SEQ ID NO: 5749706 - DNA, 13 bp, Homo sapiens
gatgatttctatg

SEQ ID NO: 5749707 - DNA, 22 bp, Homo sapiens
gatgatttcttgaaaagggtgt

SEQ ID NO: 5749708 - DNA, 15 bp, Homo sapiens
gatgatttgggggag

SEQ ID NO: 5749709 - DNA, 18 bp, Homo sapiens
gatgatttgggggaggct

SEQ ID NO: 5749710 - DNA, 19 bp, Homo sapiens
gatgatttttaagtacaaa

SEQ ID NO: 5749711 - DNA, 15 bp, Homo sapiens
gatgattttttaagc

SEQ ID NO: 5749712 - DNA, 18 bp, Homo sapiens
gatgattttttgaaagtt

SEQ ID NO: 5749713 - DNA, 14 bp, Homo sapiens
gatgcaaagaaaat

SEQ ID NO: 5749714 - DNA, 21 bp, Homo sapiens
gatgcaaagtacaatgtgttt

SEQ ID NO: 5749715 - DNA, 23 bp, Homo sapiens
gatgcaaagtacaatgtgttttt

SEQ ID NO: 5749716 - DNA, 21 bp, Homo sapiens
gatgcaaatagattcagagaa

SEQ ID NO: 5749717 - DNA, 20 bp, Homo sapiens
gatgcaacaagccctgcttt

SEQ ID NO: 5749718 - DNA, 20 bp, Homo sapiens
gatgcaacacgcatggtcaa

SEQ ID NO: 5749719 - DNA, 17 bp, Homo sapiens
gatgcaaggaccaggac

SEQ ID NO: 5749720 - DNA, 18 bp, Homo sapiens
gatgcaaggaccaggact

SEQ ID NO: 5749721 - DNA, 19 bp, Homo sapiens
gatgcaaggaccaggactc

SEQ ID NO: 5749722 - DNA, 13 bp, Homo sapiens
gatgcaagtcact

SEQ ID NO: 5749723 - DNA, 18 bp, Homo sapiens
gatgcaatactaggaagt

SEQ ID NO: 5749724 - DNA, 22 bp, Homo sapiens
gatgcaatcacttttggacatg

SEQ ID NO: 5749725 - DNA, 18 bp, Homo sapiens
gatgcaatccttacaaat

SEQ ID NO: 5749726 - DNA, 20 bp, Homo sapiens
gatgcaatcttggctcactg

SEQ ID NO: 5749727 - DNA, 17 bp, Homo sapiens
gatgcaatgtagagggg

SEQ ID NO: 5749728 - DNA, 20 bp, Homo sapiens
gatgcacacgcacatagaga

SEQ ID NO: 5749729 - DNA, 13 bp, Homo sapiens
gatgcacagagaa

SEQ ID NO: 5749730 - DNA, 17 bp, Homo sapiens
gatgcacagagaagctg

SEQ ID NO: 5749731 - DNA, 18 bp, Homo sapiens
gatgcacagagaagctgg

SEQ ID NO: 5749732 - DNA, 21 bp, Homo sapiens
gatgcacagagaagctgggga

SEQ ID NO: 5749733 - DNA, 14 bp, Homo sapiens
gatgcacagagata

SEQ ID NO: 5749734 - DNA, 14 bp, Homo sapiens
gatgcacagtgcct

SEQ ID NO: 5749735 - DNA, 14 bp, Homo sapiens
gatgcacatttctg

SEQ ID NO: 5749736 - DNA, 18 bp, Homo sapiens
gatgcacatttctggatt

SEQ ID NO: 5749737 - DNA, 17 bp, Homo sapiens
gatgcaccaagtacagc

SEQ ID NO: 5749738 - DNA, 21 bp, Homo sapiens
gatgcaccaagtacagccttc

SEQ ID NO: 5749739 - DNA, 16 bp, Homo sapiens
gatgcaccaccaagcc

SEQ ID NO: 5749740 - DNA, 18 bp, Homo sapiens
gatgcaccacccatggag

SEQ ID NO: 5749741 - DNA, 23 bp, Homo sapiens
gatgcaccagcccttagcaggga

SEQ ID NO: 5749742 - DNA, 14 bp, Homo sapiens
gatgcacggcggca

SEQ ID NO: 5749743 - DNA, 18 bp, Homo sapiens
gatgcacggcggcagggt

SEQ ID NO: 5749744 - DNA, 22 bp, Homo sapiens
gatgcacggcggcagggtgggg

SEQ ID NO: 5749745 - DNA, 15 bp, Homo sapiens
gatgcacggtttctg

SEQ ID NO: 5749746 - DNA, 16 bp, Homo sapiens
gatgcacggtttctgt

SEQ ID NO: 5749747 - DNA, 17 bp, Homo sapiens
gatgcacggtttctgtt

SEQ ID NO: 5749748 - DNA, 16 bp, Homo sapiens
gatgcactacactttt

SEQ ID NO: 5749749 - DNA, 19 bp, Homo sapiens
gatgcactcgcactgcaaa

SEQ ID NO: 5749750 - DNA, 15 bp, Homo sapiens
gatgcactgacctgc

SEQ ID NO: 5749751 - DNA, 13 bp, Homo sapiens
gatgcactggcct

SEQ ID NO: 5749752 - DNA, 14 bp, Homo sapiens
gatgcactggcctg

SEQ ID NO: 5749753 - DNA, 22 bp, Homo sapiens
gatgcactttgctttaatataa

SEQ ID NO: 5749754 - DNA, 23 bp, Homo sapiens
gatgcactttgctttaatataaa

SEQ ID NO: 5749755 - DNA, 13 bp, Homo sapiens
gatgcagaaatga

SEQ ID NO: 5749756 - DNA, 22 bp, Homo sapiens
gatgcagaactttctcttttga

SEQ ID NO: 5749757 - DNA, 21 bp, Homo sapiens
gatgcagacagggggccagaa

SEQ ID NO: 5749758 - DNA, 23 bp, Homo sapiens
gatgcagagagccattttgtgaa

SEQ ID NO: 5749759 - DNA, 23 bp, Homo sapiens
gatgcagaggtaaaagtgtgagc

SEQ ID NO: 5749760 - DNA, 18 bp, Homo sapiens
gatgcagagtaagtatta

SEQ ID NO: 5749761 - DNA, 19 bp, Homo sapiens
gatgcagagtaagtattat

SEQ ID NO: 5749762 - DNA, 13 bp, Homo sapiens
gatgcagcatttg

SEQ ID NO: 5749763 - DNA, 19 bp, Homo sapiens
gatgcagcctcacagtcct

SEQ ID NO: 5749764 - DNA, 21 bp, Homo sapiens
gatgcagcctgtggcttggag

SEQ ID NO: 5749765 - DNA, 12 bp, Homo sapiens
gatgcagccttc

SEQ ID NO: 5749766 - DNA, 18 bp, Homo sapiens
gatgcagctgttgagaaa

SEQ ID NO: 5749767 - DNA, 14 bp, Homo sapiens
gatgcagcttatac

SEQ ID NO: 5749768 - DNA, 19 bp, Homo sapiens
gatgcaggaagaccacatg

SEQ ID NO: 5749769 - DNA, 13 bp, Homo sapiens
gatgcaggtcagc

SEQ ID NO: 5749770 - DNA, 17 bp, Homo sapiens
gatgcaggtcagcccat

SEQ ID NO: 5749771 - DNA, 18 bp, Homo sapiens
gatgcaggtttgaccagg

SEQ ID NO: 5749772 - DNA, 16 bp, Homo sapiens
gatgcagtcctcagga

SEQ ID NO: 5749773 - DNA, 19 bp, Homo sapiens
gatgcagtctcctctttaa

SEQ ID NO: 5749774 - DNA, 12 bp, Homo sapiens
gatgcagtgatg

SEQ ID NO: 5749775 - DNA, 13 bp, Homo sapiens
gatgcagtgatgt

SEQ ID NO: 5749776 - DNA, 16 bp, Homo sapiens
gatgcagtgccctaga

SEQ ID NO: 5749777 - DNA, 17 bp, Homo sapiens
gatgcagtgccctagaa

SEQ ID NO: 5749778 - DNA, 15 bp, Homo sapiens
gatgcagtggctcat

SEQ ID NO: 5749779 - DNA, 19 bp, Homo sapiens
gatgcagtggctcatgcct

SEQ ID NO: 5749780 - DNA, 16 bp, Homo sapiens
gatgcagttttcaaat

SEQ ID NO: 5749781 - DNA, 18 bp, Homo sapiens
gatgcatacagttttcta

SEQ ID NO: 5749782 - DNA, 16 bp, Homo sapiens
gatgcatatagacaca

SEQ ID NO: 5749783 - DNA, 22 bp, Homo sapiens
gatgcatcacactcaaggacag

SEQ ID NO: 5749784 - DNA, 18 bp, Homo sapiens
gatgcatcatctcttcct

SEQ ID NO: 5749785 - DNA, 18 bp, Homo sapiens
gatgcatcgggaaagaag

SEQ ID NO: 5749786 - DNA, 20 bp, Homo sapiens
gatgcatcgggaaagaagaa

SEQ ID NO: 5749787 - DNA, 22 bp, Homo sapiens
gatgcatctaccgctcttggga

SEQ ID NO: 5749788 - DNA, 20 bp, Homo sapiens
gatgcatgatccagctgtgt

SEQ ID NO: 5749789 - DNA, 20 bp, Homo sapiens
gatgcatggagatagcccca

SEQ ID NO: 5749790 - DNA, 16 bp, Homo sapiens
gatgcatgtcttttaa

SEQ ID NO: 5749791 - DNA, 20 bp, Homo sapiens
gatgcatgttactgccaaaa

SEQ ID NO: 5749792 - DNA, 23 bp, Homo sapiens
gatgcattcccggtgcagaacag

SEQ ID NO: 5749793 - DNA, 20 bp, Homo sapiens
gatgcattctgataggaggg

SEQ ID NO: 5749794 - DNA, 21 bp, Homo sapiens
gatgcattcttggttggctgg

SEQ ID NO: 5749795 - DNA, 15 bp, Homo sapiens
gatgcatttccattt

SEQ ID NO: 5749796 - DNA, 15 bp, Homo sapiens
gatgcatttgggtcc

SEQ ID NO: 5749797 - DNA, 16 bp, Homo sapiens
gatgcatttgggtcca

SEQ ID NO: 5749798 - DNA, 22 bp, Homo sapiens
gatgcatttgggtccaggagga

SEQ ID NO: 5749799 - DNA, 17 bp, Homo sapiens
gatgcattttaaatgtc

SEQ ID NO: 5749800 - DNA, 19 bp, Homo sapiens
gatgccaaaaaaaaataca

SEQ ID NO: 5749801 - DNA, 19 bp, Homo sapiens
gatgccaaaaaagatgcca

SEQ ID NO: 5749802 - DNA, 20 bp, Homo sapiens
gatgccaaagatgtttgaaa

SEQ ID NO: 5749803 - DNA, 17 bp, Homo sapiens
gatgccaaagcagacat

SEQ ID NO: 5749804 - DNA, 14 bp, Homo sapiens
gatgccaaagctgc

SEQ ID NO: 5749805 - DNA, 15 bp, Homo sapiens
gatgccaaagctgct

SEQ ID NO: 5749806 - DNA, 20 bp, Homo sapiens
gatgccaaagctgctttctt

SEQ ID NO: 5749807 - DNA, 15 bp, Homo sapiens
gatgccaacctctgg

SEQ ID NO: 5749808 - DNA, 22 bp, Homo sapiens
gatgccaacctctggagcaatg

SEQ ID NO: 5749809 - DNA, 19 bp, Homo sapiens
gatgccaacttcccacacg

SEQ ID NO: 5749810 - DNA, 21 bp, Homo sapiens
gatgccaagaagtttaaggaa

SEQ ID NO: 5749811 - DNA, 20 bp, Homo sapiens
gatgccaatttcctctccac

SEQ ID NO: 5749812 - DNA, 17 bp, Homo sapiens
gatgccacacagagtgg

SEQ ID NO: 5749813 - DNA, 21 bp, Homo sapiens
gatgccacaccaagctgtgcc

SEQ ID NO: 5749814 - DNA, 13 bp, Homo sapiens
gatgccacagccc

SEQ ID NO: 5749815 - DNA, 18 bp, Homo sapiens
gatgccactcctccctcc

SEQ ID NO: 5749816 - DNA, 19 bp, Homo sapiens
gatgccactcctccctccg

SEQ ID NO: 5749817 - DNA, 24 bp, Homo sapiens
gatgccacttcccagaggcagagc

SEQ ID NO: 5749818 - DNA, 13 bp, Homo sapiens
gatgccagagggc

SEQ ID NO: 5749819 - DNA, 12 bp, Homo sapiens
gatgccagcccc

SEQ ID NO: 5749820 - DNA, 19 bp, Homo sapiens
gatgccagccccgtgccag

SEQ ID NO: 5749821 - DNA, 14 bp, Homo sapiens
gatgccagcccctg

SEQ ID NO: 5749822 - DNA, 12 bp, Homo sapiens
gatgccagccct

SEQ ID NO: 5749823 - DNA, 17 bp, Homo sapiens
gatgccagctgtctccc

SEQ ID NO: 5749824 - DNA, 16 bp, Homo sapiens
gatgccagcttctctc

SEQ ID NO: 5749825 - DNA, 19 bp, Homo sapiens
gatgccagcttctctctcc

SEQ ID NO: 5749826 - DNA, 14 bp, Homo sapiens
gatgccaggttcta

SEQ ID NO: 5749827 - DNA, 15 bp, Homo sapiens
gatgccataaataca

SEQ ID NO: 5749828 - DNA, 15 bp, Homo sapiens
gatgccatagcataa

SEQ ID NO: 5749829 - DNA, 21 bp, Homo sapiens
gatgccatagcataatatgaa

SEQ ID NO: 5749830 - DNA, 16 bp, Homo sapiens
gatgccatctgtgtcc

SEQ ID NO: 5749831 - DNA, 13 bp, Homo sapiens
gatgccatggcct

SEQ ID NO: 5749832 - DNA, 14 bp, Homo sapiens
gatgcccacccctg

SEQ ID NO: 5749833 - DNA, 20 bp, Homo sapiens
gatgcccaccgaggagcccc

SEQ ID NO: 5749834 - DNA, 15 bp, Homo sapiens
gatgcccactgagga

SEQ ID NO: 5749835 - DNA, 18 bp, Homo sapiens
gatgcccagaggactccc

SEQ ID NO: 5749836 - DNA, 20 bp, Homo sapiens
gatgcccagagggcccaggc

SEQ ID NO: 5749837 - DNA, 22 bp, Homo sapiens
gatgcccagagggcccaggcag

SEQ ID NO: 5749838 - DNA, 23 bp, Homo sapiens
gatgcccagagggcccaggcagg

SEQ ID NO: 5749839 - DNA, 13 bp, Homo sapiens
gatgcccagtggt

SEQ ID NO: 5749840 - DNA, 19 bp, Homo sapiens
gatgcccattcctgcctgg

SEQ ID NO: 5749841 - DNA, 22 bp, Homo sapiens
gatgcccattcctgcctggtcc

SEQ ID NO: 5749842 - DNA, 15 bp, Homo sapiens
gatgccccagggatg

SEQ ID NO: 5749843 - DNA, 13 bp, Homo sapiens
gatgcccccccag

SEQ ID NO: 5749844 - DNA, 16 bp, Homo sapiens
gatgcccccccaggcc

SEQ ID NO: 5749845 - DNA, 19 bp, Homo sapiens
gatgccccctccaggagag

SEQ ID NO: 5749846 - DNA, 24 bp, Homo sapiens
gatgccccctccaggagagagcca

SEQ ID NO: 5749847 - DNA, 14 bp, Homo sapiens
gatgcccctggccc

SEQ ID NO: 5749848 - DNA, 17 bp, Homo sapiens
gatgcccctggccctgc

SEQ ID NO: 5749849 - DNA, 19 bp, Homo sapiens
gatgcccctggccctgcct

SEQ ID NO: 5749850 - DNA, 21 bp, Homo sapiens
gatgcccctggccctgcctca

SEQ ID NO: 5749851 - DNA, 17 bp, Homo sapiens
gatgccccttccccaag

SEQ ID NO: 5749852 - DNA, 23 bp, Homo sapiens
gatgcccgcacagtaatgtagaa

SEQ ID NO: 5749853 - DNA, 19 bp, Homo sapiens
gatgcccgttgtctaggag

SEQ ID NO: 5749854 - DNA, 13 bp, Homo sapiens
gatgccctgccct

SEQ ID NO: 5749855 - DNA, 12 bp, Homo sapiens
gatgccctgcta

SEQ ID NO: 5749856 - DNA, 17 bp, Homo sapiens
gatgcccttgctgggcc

SEQ ID NO: 5749857 - DNA, 21 bp, Homo sapiens
gatgccctttggaaagccatt

SEQ ID NO: 5749858 - DNA, 20 bp, Homo sapiens
gatgccgaacattaggaatt

SEQ ID NO: 5749859 - DNA, 20 bp, Homo sapiens
gatgccgctcttctgtcatc

SEQ ID NO: 5749860 - DNA, 16 bp, Homo sapiens
gatgccgggcgccagg

SEQ ID NO: 5749861 - DNA, 21 bp, Homo sapiens
gatgccgggcgccaggacagc

SEQ ID NO: 5749862 - DNA, 17 bp, Homo sapiens
gatgccgtcctgctgga

SEQ ID NO: 5749863 - DNA, 14 bp, Homo sapiens
gatgccgtgcgggc

SEQ ID NO: 5749864 - DNA, 21 bp, Homo sapiens
gatgcctaaaaattcccttcc

SEQ ID NO: 5749865 - DNA, 12 bp, Homo sapiens
gatgcctaagta

SEQ ID NO: 5749866 - DNA, 23 bp, Homo sapiens
gatgcctacaaccatccctgcca

SEQ ID NO: 5749867 - DNA, 13 bp, Homo sapiens
gatgcctactttt

SEQ ID NO: 5749868 - DNA, 20 bp, Homo sapiens
gatgcctacttttggcctca

SEQ ID NO: 5749869 - DNA, 22 bp, Homo sapiens
gatgcctcaccacacccaggtc

SEQ ID NO: 5749870 - DNA, 12 bp, Homo sapiens
gatgcctccacc

SEQ ID NO: 5749871 - DNA, 16 bp, Homo sapiens
gatgcctccaccgctg

SEQ ID NO: 5749872 - DNA, 17 bp, Homo sapiens
gatgcctccaccgctgc

SEQ ID NO: 5749873 - DNA, 20 bp, Homo sapiens
gatgcctccaccgctgccta

SEQ ID NO: 5749874 - DNA, 13 bp, Homo sapiens
gatgcctccccaa

SEQ ID NO: 5749875 - DNA, 15 bp, Homo sapiens
gatgcctcctctgtc

SEQ ID NO: 5749876 - DNA, 20 bp, Homo sapiens
gatgcctctccccagagcat

SEQ ID NO: 5749877 - DNA, 14 bp, Homo sapiens
gatgcctgaacttg

SEQ ID NO: 5749878 - DNA, 16 bp, Homo sapiens
gatgcctgagccccct

SEQ ID NO: 5749879 - DNA, 17 bp, Homo sapiens
gatgcctgagccccctg

SEQ ID NO: 5749880 - DNA, 18 bp, Homo sapiens
gatgcctggcctgccaga

SEQ ID NO: 5749881 - DNA, 11 bp, Homo sapiens
gatgcctgggc

SEQ ID NO: 5749882 - DNA, 14 bp, Homo sapiens
gatgcctgggcctg

SEQ ID NO: 5749883 - DNA, 15 bp, Homo sapiens
gatgcctggtgagca

SEQ ID NO: 5749884 - DNA, 23 bp, Homo sapiens
gatgcctgttaatttataatgta

SEQ ID NO: 5749885 - DNA, 20 bp, Homo sapiens
gatgccttatctcttctcac

SEQ ID NO: 5749886 - DNA, 12 bp, Homo sapiens
gatgccttcccc

SEQ ID NO: 5749887 - DNA, 21 bp, Homo sapiens
gatgccttccgacaccactgg

SEQ ID NO: 5749888 - DNA, 23 bp, Homo sapiens
gatgccttccgacaccactggga

SEQ ID NO: 5749889 - DNA, 22 bp, Homo sapiens
gatgcgagcgctatcttcacat

SEQ ID NO: 5749890 - DNA, 15 bp, Homo sapiens
gatgcgcagttgctg

SEQ ID NO: 5749891 - DNA, 23 bp, Homo sapiens
gatgcgcattctaacctggaggt

SEQ ID NO: 5749892 - DNA, 14 bp, Homo sapiens
gatgcgcttcaaag

SEQ ID NO: 5749893 - DNA, 15 bp, Homo sapiens
gatgcggatcctgct

SEQ ID NO: 5749894 - DNA, 20 bp, Homo sapiens
gatgcggatcctgctggggc

SEQ ID NO: 5749895 - DNA, 19 bp, Homo sapiens
gatgcggctttctctgcct

SEQ ID NO: 5749896 - DNA, 23 bp, Homo sapiens
gatgcgggcattttgaatgtgat

SEQ ID NO: 5749897 - DNA, 13 bp, Homo sapiens
gatgcggggacag

SEQ ID NO: 5749898 - DNA, 16 bp, Homo sapiens
gatgcgtattctgtgg

SEQ ID NO: 5749899 - DNA, 18 bp, Homo sapiens
gatgcgtggctcccagca

SEQ ID NO: 5749900 - DNA, 17 bp, Homo sapiens
gatgcgtgggaggcaga

SEQ ID NO: 5749901 - DNA, 16 bp, Homo sapiens
gatgcgtgggcagagg

SEQ ID NO: 5749902 - DNA, 17 bp, Homo sapiens
gatgcgtgggcagagga

SEQ ID NO: 5749903 - DNA, 18 bp, Homo sapiens
gatgcgtgggcagaggaa

SEQ ID NO: 5749904 - DNA, 19 bp, Homo sapiens
gatgcgttcagcagactgg

SEQ ID NO: 5749905 - DNA, 20 bp, Homo sapiens
gatgcgttgttacaggaagt

SEQ ID NO: 5749906 - DNA, 17 bp, Homo sapiens
gatgcgtttgcctcctg

SEQ ID NO: 5749907 - DNA, 15 bp, Homo sapiens
gatgctaataaactg

SEQ ID NO: 5749908 - DNA, 13 bp, Homo sapiens
gatgctaatttat

SEQ ID NO: 5749909 - DNA, 16 bp, Homo sapiens
gatgctactactgcag

SEQ ID NO: 5749910 - DNA, 19 bp, Homo sapiens
gatgctactactgcagtct

SEQ ID NO: 5749911 - DNA, 20 bp, Homo sapiens
gatgctagaactccctttca

SEQ ID NO: 5749912 - DNA, 15 bp, Homo sapiens
gatgctagagcctct

SEQ ID NO: 5749913 - DNA, 14 bp, Homo sapiens
gatgctagccccag

SEQ ID NO: 5749914 - DNA, 20 bp, Homo sapiens
gatgctattaaagtttcatt

SEQ ID NO: 5749915 - DNA, 15 bp, Homo sapiens
gatgctatttatgca

SEQ ID NO: 5749916 - DNA, 14 bp, Homo sapiens
gatgctatttgcaa

SEQ ID NO: 5749917 - DNA, 21 bp, Homo sapiens
gatgctcaggcttgaaatgca

SEQ ID NO: 5749918 - DNA, 23 bp, Homo sapiens
gatgctcaggtacagagaaggaa

SEQ ID NO: 5749919 - DNA, 19 bp, Homo sapiens
gatgctcagttgctaaaca

SEQ ID NO: 5749920 - DNA, 15 bp, Homo sapiens
gatgctcagttttaa

SEQ ID NO: 5749921 - DNA, 20 bp, Homo sapiens
gatgctcagttttaaacgtt

SEQ ID NO: 5749922 - DNA, 17 bp, Homo sapiens
gatgctcatctgagcca

SEQ ID NO: 5749923 - DNA, 19 bp, Homo sapiens
gatgctccaagattctaga

SEQ ID NO: 5749924 - DNA, 16 bp, Homo sapiens
gatgctccagccaacc

SEQ ID NO: 5749925 - DNA, 17 bp, Homo sapiens
gatgctccagccaaccc

SEQ ID NO: 5749926 - DNA, 15 bp, Homo sapiens
gatgctccatttcaa

SEQ ID NO: 5749927 - DNA, 20 bp, Homo sapiens
gatgctcccaagcaaaggaa

SEQ ID NO: 5749928 - DNA, 23 bp, Homo sapiens
gatgctccctcagcctcagagga

SEQ ID NO: 5749929 - DNA, 21 bp, Homo sapiens
gatgctccctcccctgccctg

SEQ ID NO: 5749930 - DNA, 15 bp, Homo sapiens
gatgctcctccgggt

SEQ ID NO: 5749931 - DNA, 14 bp, Homo sapiens
gatgctccttgggc

SEQ ID NO: 5749932 - DNA, 21 bp, Homo sapiens
gatgctccttgggccctttga

SEQ ID NO: 5749933 - DNA, 22 bp, Homo sapiens
gatgctctggcttgccccagga

SEQ ID NO: 5749934 - DNA, 23 bp, Homo sapiens
gatgctctggcttgccccaggac

SEQ ID NO: 5749935 - DNA, 15 bp, Homo sapiens
gatgctcttctgtgg

SEQ ID NO: 5749936 - DNA, 17 bp, Homo sapiens
gatgctgaaaatgtcct

SEQ ID NO: 5749937 - DNA, 20 bp, Homo sapiens
gatgctgaaacaggagagaa

SEQ ID NO: 5749938 - DNA, 19 bp, Homo sapiens
gatgctgaaagagaaaaga

SEQ ID NO: 5749939 - DNA, 16 bp, Homo sapiens
gatgctgaagtacagt

SEQ ID NO: 5749940 - DNA, 20 bp, Homo sapiens
gatgctgacattcacctgcc

SEQ ID NO: 5749941 - DNA, 18 bp, Homo sapiens
gatgctgacccaggaata

SEQ ID NO: 5749942 - DNA, 19 bp, Homo sapiens
gatgctgacctcacctggt

SEQ ID NO: 5749943 - DNA, 24 bp, Homo sapiens
gatgctgacctcacctggtcctcc

SEQ ID NO: 5749944 - DNA, 15 bp, Homo sapiens
gatgctgactagtga

SEQ ID NO: 5749945 - DNA, 17 bp, Homo sapiens
gatgctgactgtactcc

SEQ ID NO: 5749946 - DNA, 12 bp, Homo sapiens
gatgctgagccc

SEQ ID NO: 5749947 - DNA, 13 bp, Homo sapiens
gatgctgagcccg

SEQ ID NO: 5749948 - DNA, 13 bp, Homo sapiens
gatgctgaggcca

SEQ ID NO: 5749949 - DNA, 15 bp, Homo sapiens
gatgctgaggccacc

SEQ ID NO: 5749950 - DNA, 17 bp, Homo sapiens
gatgctgaggccaccca

SEQ ID NO: 5749951 - DNA, 16 bp, Homo sapiens
gatgctgcagcagagt

SEQ ID NO: 5749952 - DNA, 23 bp, Homo sapiens
gatgctgccagggcgccatcgcc

SEQ ID NO: 5749953 - DNA, 12 bp, Homo sapiens
gatgctgcccct

SEQ ID NO: 5749954 - DNA, 13 bp, Homo sapiens
gatgctgcccctc

SEQ ID NO: 5749955 - DNA, 16 bp, Homo sapiens
gatgctgccggcacag

SEQ ID NO: 5749956 - DNA, 17 bp, Homo sapiens
gatgctgccggcacagc

SEQ ID NO: 5749957 - DNA, 14 bp, Homo sapiens
gatgctgctcccgc

SEQ ID NO: 5749958 - DNA, 14 bp, Homo sapiens
gatgctgctccgcc

SEQ ID NO: 5749959 - DNA, 19 bp, Homo sapiens
gatgctgctggcctccctc

SEQ ID NO: 5749960 - DNA, 23 bp, Homo sapiens
gatgctggaaatatgaaatgtat

SEQ ID NO: 5749961 - DNA, 20 bp, Homo sapiens
gatgctggagaagagaggag

SEQ ID NO: 5749962 - DNA, 21 bp, Homo sapiens
gatgctggagaagagaggaga

SEQ ID NO: 5749963 - DNA, 13 bp, Homo sapiens
gatgctggcccag

SEQ ID NO: 5749964 - DNA, 19 bp, Homo sapiens
gatgctggcccagggccca

SEQ ID NO: 5749965 - DNA, 21 bp, Homo sapiens
gatgctggcccagggcccaga

SEQ ID NO: 5749966 - DNA, 11 bp, Homo sapiens
gatgctggcct

SEQ ID NO: 5749967 - DNA, 12 bp, Homo sapiens
gatgctggcctc

SEQ ID NO: 5749968 - DNA, 13 bp, Homo sapiens
gatgctggcctct

SEQ ID NO: 5749969 - DNA, 14 bp, Homo sapiens
gatgctggcctctt

SEQ ID NO: 5749970 - DNA, 21 bp, Homo sapiens
gatgctggcctcttggcacct

SEQ ID NO: 5749971 - DNA, 23 bp, Homo sapiens
gatgctggcctcttggcacctgc

SEQ ID NO: 5749972 - DNA, 14 bp, Homo sapiens
gatgctgggagggc

SEQ ID NO: 5749973 - DNA, 11 bp, Homo sapiens
gatgctgggat

SEQ ID NO: 5749974 - DNA, 15 bp, Homo sapiens
gatgctgggatagcc

SEQ ID NO: 5749975 - DNA, 17 bp, Homo sapiens
gatgctgggcaatgagg

SEQ ID NO: 5749976 - DNA, 13 bp, Homo sapiens
gatgctgggctgg

SEQ ID NO: 5749977 - DNA, 16 bp, Homo sapiens
gatgctgggctggctc

SEQ ID NO: 5749978 - DNA, 14 bp, Homo sapiens
gatgctgggctggg

SEQ ID NO: 5749979 - DNA, 15 bp, Homo sapiens
gatgctgggctgggc

SEQ ID NO: 5749980 - DNA, 17 bp, Homo sapiens
gatgctgggtggccctg

SEQ ID NO: 5749981 - DNA, 18 bp, Homo sapiens
gatgctgggttctggggc

SEQ ID NO: 5749982 - DNA, 19 bp, Homo sapiens
gatgctgggttctggggct

SEQ ID NO: 5749983 - DNA, 19 bp, Homo sapiens
gatgctgggttggtgcaca

SEQ ID NO: 5749984 - DNA, 20 bp, Homo sapiens
gatgctgggttggtgcacag

SEQ ID NO: 5749985 - DNA, 17 bp, Homo sapiens
gatgctggtaatggcca

SEQ ID NO: 5749986 - DNA, 19 bp, Homo sapiens
gatgctggtcatcctgggc

SEQ ID NO: 5749987 - DNA, 21 bp, Homo sapiens
gatgctggtcatcctgggcat

SEQ ID NO: 5749988 - DNA, 20 bp, Homo sapiens
gatgctggtcatgtgtttga

SEQ ID NO: 5749989 - DNA, 16 bp, Homo sapiens
gatgctggtggctggt

SEQ ID NO: 5749990 - DNA, 18 bp, Homo sapiens
gatgctggtggctggtga

SEQ ID NO: 5749991 - DNA, 13 bp, Homo sapiens
gatgctgtaaata

SEQ ID NO: 5749992 - DNA, 17 bp, Homo sapiens
gatgctgtaaataggtt

SEQ ID NO: 5749993 - DNA, 13 bp, Homo sapiens
gatgctgtgcctg

SEQ ID NO: 5749994 - DNA, 12 bp, Homo sapiens
gatgctgtgcta

SEQ ID NO: 5749995 - DNA, 17 bp, Homo sapiens
gatgctgtgtatatggt

SEQ ID NO: 5749996 - DNA, 15 bp, Homo sapiens
gatgctgtgtgccca

SEQ ID NO: 5749997 - DNA, 16 bp, Homo sapiens
gatgctgtgtgcccaa

SEQ ID NO: 5749998 - DNA, 17 bp, Homo sapiens
gatgctgttgagggcca

SEQ ID NO: 5749999 - DNA, 16 bp, Homo sapiens
gatgctgttgtgaagc

SEQ ID NO: 5750000 - DNA, 22 bp, Homo sapiens
gatgcttagagggatttctttg

SEQ ID NO: 5750001 - DNA, 16 bp, Homo sapiens
gatgcttctctccttg

SEQ ID NO: 5750002 - DNA, 20 bp, Homo sapiens
gatgcttctgctcacattcc

SEQ ID NO: 5750003 - DNA, 20 bp, Homo sapiens
gatgcttgcggcaaaaggaa

SEQ ID NO: 5750004 - DNA, 23 bp, Homo sapiens
gatgcttgcggcaaaaggaaagc

SEQ ID NO: 5750005 - DNA, 14 bp, Homo sapiens
gatgcttgtacata

SEQ ID NO: 5750006 - DNA, 16 bp, Homo sapiens
gatgctttaattgtgt

SEQ ID NO: 5750007 - DNA, 20 bp, Homo sapiens
gatgctttaccaaacagcaa

SEQ ID NO: 5750008 - DNA, 20 bp, Homo sapiens
gatgctttaggttgcttcag

SEQ ID NO: 5750009 - DNA, 20 bp, Homo sapiens
gatgctttgcccaggcttct

SEQ ID NO: 5750010 - DNA, 17 bp, Homo sapiens
gatgcttttctgtctct

SEQ ID NO: 5750011 - DNA, 21 bp, Homo sapiens
gatgcttttctgtctctgcct

SEQ ID NO: 5750012 - DNA, 18 bp, Homo sapiens
gatgcttttgctgctgct

SEQ ID NO: 5750013 - DNA, 17 bp, Homo sapiens
gatgcttttgtgagaaa

SEQ ID NO: 5750014 - DNA, 18 bp, Homo sapiens
gatggaaaaaaaaaacaa

SEQ ID NO: 5750015 - DNA, 22 bp, Homo sapiens
gatggaaaaaaaaaacaaaaaa

SEQ ID NO: 5750016 - DNA, 14 bp, Homo sapiens
gatggaaaaataaa

SEQ ID NO: 5750017 - DNA, 12 bp, Homo sapiens
gatggaaaataa

SEQ ID NO: 5750018 - DNA, 17 bp, Homo sapiens
gatggaaaataaacatc

SEQ ID NO: 5750019 - DNA, 17 bp, Homo sapiens
gatggaaaattcatttt

SEQ ID NO: 5750020 - DNA, 16 bp, Homo sapiens
gatggaaacaaagtgg

SEQ ID NO: 5750021 - DNA, 14 bp, Homo sapiens
gatggaaacaatgt

SEQ ID NO: 5750022 - DNA, 14 bp, Homo sapiens
gatggaaactgcca

SEQ ID NO: 5750023 - DNA, 23 bp, Homo sapiens
gatggaaaggattgtaggtgcaa

SEQ ID NO: 5750024 - DNA, 21 bp, Homo sapiens
gatggaaataacgggtggcat

SEQ ID NO: 5750025 - DNA, 15 bp, Homo sapiens
gatggaacacacaca

SEQ ID NO: 5750026 - DNA, 19 bp, Homo sapiens
gatggaacatcagtggatg

SEQ ID NO: 5750027 - DNA, 20 bp, Homo sapiens
gatggaacccttttggcccc

SEQ ID NO: 5750028 - DNA, 18 bp, Homo sapiens
gatggaaccgcaggaagc

SEQ ID NO: 5750029 - DNA, 22 bp, Homo sapiens
gatggaaccgcaggaagctgct

SEQ ID NO: 5750030 - DNA, 19 bp, Homo sapiens
gatggaacgggcatgggcc

SEQ ID NO: 5750031 - DNA, 17 bp, Homo sapiens
gatggaactgtgtattt

SEQ ID NO: 5750032 - DNA, 20 bp, Homo sapiens
gatggaagaaaatggaatta

SEQ ID NO: 5750033 - DNA, 13 bp, Homo sapiens
gatggaagaaaga

SEQ ID NO: 5750034 - DNA, 15 bp, Homo sapiens
gatggaagatggtcc

SEQ ID NO: 5750035 - DNA, 23 bp, Homo sapiens
gatggaagatggtccgtgcccag

SEQ ID NO: 5750036 - DNA, 19 bp, Homo sapiens
gatggaagtgggccagtcc

SEQ ID NO: 5750037 - DNA, 16 bp, Homo sapiens
gatggaagtgttcaga

SEQ ID NO: 5750038 - DNA, 18 bp, Homo sapiens
gatggaatcacagccaat

SEQ ID NO: 5750039 - DNA, 14 bp, Homo sapiens
gatggaatggaaaa

SEQ ID NO: 5750040 - DNA, 16 bp, Homo sapiens
gatggaatggaaaagc

SEQ ID NO: 5750041 - DNA, 16 bp, Homo sapiens
gatggaattattgtac

SEQ ID NO: 5750042 - DNA, 17 bp, Homo sapiens
gatggacacccccagct

SEQ ID NO: 5750043 - DNA, 18 bp, Homo sapiens
gatggacacccccagctg

SEQ ID NO: 5750044 - DNA, 17 bp, Homo sapiens
gatggacacgagccaca

SEQ ID NO: 5750045 - DNA, 23 bp, Homo sapiens
gatggacacgagccacaagctgc

SEQ ID NO: 5750046 - DNA, 14 bp, Homo sapiens
gatggacactccag

SEQ ID NO: 5750047 - DNA, 15 bp, Homo sapiens
gatggacactccagg

SEQ ID NO: 5750048 - DNA, 17 bp, Homo sapiens
gatggacactgccaaga

SEQ ID NO: 5750049 - DNA, 12 bp, Homo sapiens
gatggacagaca

SEQ ID NO: 5750050 - DNA, 13 bp, Homo sapiens
gatggacagacag

SEQ ID NO: 5750051 - DNA, 14 bp, Homo sapiens
gatggacagacaga

SEQ ID NO: 5750052 - DNA, 21 bp, Homo sapiens
gatggacagagaactttattt

SEQ ID NO: 5750053 - DNA, 13 bp, Homo sapiens
gatggacagatgg

SEQ ID NO: 5750054 - DNA, 19 bp, Homo sapiens
gatggacagatggaccaaa

SEQ ID NO: 5750055 - DNA, 20 bp, Homo sapiens
gatggacagatggaccaaaa

SEQ ID NO: 5750056 - DNA, 20 bp, Homo sapiens
gatggacagttcacaccctg

SEQ ID NO: 5750057 - DNA, 18 bp, Homo sapiens
gatggacagtttgtttcc

SEQ ID NO: 5750058 - DNA, 23 bp, Homo sapiens
gatggacattttaggaatcacca

SEQ ID NO: 5750059 - DNA, 18 bp, Homo sapiens
gatggaccaaagccacct

SEQ ID NO: 5750060 - DNA, 23 bp, Homo sapiens
gatggaccaaagccacctgctgc

SEQ ID NO: 5750061 - DNA, 15 bp, Homo sapiens
gatggacccctccct

SEQ ID NO: 5750062 - DNA, 16 bp, Homo sapiens
gatggacccctccctt

SEQ ID NO: 5750063 - DNA, 23 bp, Homo sapiens
gatggaccctcgcagcaggtgca

SEQ ID NO: 5750064 - DNA, 18 bp, Homo sapiens
gatggaccgggtgggcct

SEQ ID NO: 5750065 - DNA, 23 bp, Homo sapiens
gatggaccgggtgggcctggcct

SEQ ID NO: 5750066 - DNA, 19 bp, Homo sapiens
gatggacgaacaggggcca

SEQ ID NO: 5750067 - DNA, 15 bp, Homo sapiens
gatggacgcaggccc

SEQ ID NO: 5750068 - DNA, 17 bp, Homo sapiens
gatggacgcaggccctg

SEQ ID NO: 5750069 - DNA, 19 bp, Homo sapiens
gatggacgctgccgggaga

SEQ ID NO: 5750070 - DNA, 21 bp, Homo sapiens
gatggactcaggatccagtga

SEQ ID NO: 5750071 - DNA, 17 bp, Homo sapiens
gatggactcctgaccat

SEQ ID NO: 5750072 - DNA, 14 bp, Homo sapiens
gatggactggggag

SEQ ID NO: 5750073 - DNA, 17 bp, Homo sapiens
gatggactggggagcac

SEQ ID NO: 5750074 - DNA, 18 bp, Homo sapiens
gatggacttacctggcag

SEQ ID NO: 5750075 - DNA, 21 bp, Homo sapiens
gatggacttgtgattggctgc

SEQ ID NO: 5750076 - DNA, 17 bp, Homo sapiens
gatggacttttgggggt

SEQ ID NO: 5750077 - DNA, 21 bp, Homo sapiens
gatggagaaacaggctctgag

SEQ ID NO: 5750078 - DNA, 23 bp, Homo sapiens
gatggagaaagggcagaggaaga

SEQ ID NO: 5750079 - DNA, 13 bp, Homo sapiens
gatggagaaggaa

SEQ ID NO: 5750080 - DNA, 15 bp, Homo sapiens
gatggagaaggaaaa

SEQ ID NO: 5750081 - DNA, 21 bp, Homo sapiens
gatggagaaggaaaaggctgg

SEQ ID NO: 5750082 - DNA, 18 bp, Homo sapiens
gatggagaatgccagccc

SEQ ID NO: 5750083 - DNA, 20 bp, Homo sapiens
gatggagaatgccagcccaa

SEQ ID NO: 5750084 - DNA, 23 bp, Homo sapiens
gatggagacttcaggttgttctg

SEQ ID NO: 5750085 - DNA, 14 bp, Homo sapiens
gatggagagagggg

SEQ ID NO: 5750086 - DNA, 15 bp, Homo sapiens
gatggagagagggga

SEQ ID NO: 5750087 - DNA, 13 bp, Homo sapiens
gatggagaggctg

SEQ ID NO: 5750088 - DNA, 16 bp, Homo sapiens
gatggagatgggaagg

SEQ ID NO: 5750089 - DNA, 19 bp, Homo sapiens
gatggagcaaacctagccc

SEQ ID NO: 5750090 - DNA, 22 bp, Homo sapiens
gatggagcaaacctagccccca

SEQ ID NO: 5750091 - DNA, 14 bp, Homo sapiens
gatggagcccaggc

SEQ ID NO: 5750092 - DNA, 19 bp, Homo sapiens
gatggagcccaggcgggag

SEQ ID NO: 5750093 - DNA, 14 bp, Homo sapiens
gatggagccccacc

SEQ ID NO: 5750094 - DNA, 14 bp, Homo sapiens
gatggagccccagg

SEQ ID NO: 5750095 - DNA, 14 bp, Homo sapiens
gatggagcccccag

SEQ ID NO: 5750096 - DNA, 16 bp, Homo sapiens
gatggagcgcacctgc

SEQ ID NO: 5750097 - DNA, 23 bp, Homo sapiens
gatggaggaaaaccaagccgtgg

SEQ ID NO: 5750098 - DNA, 19 bp, Homo sapiens
gatggaggagaaataaact

SEQ ID NO: 5750099 - DNA, 14 bp, Homo sapiens
gatggaggagaaga

SEQ ID NO: 5750100 - DNA, 12 bp, Homo sapiens
gatggaggagga

SEQ ID NO: 5750101 - DNA, 21 bp, Homo sapiens
gatggagggagggggaagtcg

SEQ ID NO: 5750102 - DNA, 16 bp, Homo sapiens
gatggagggggctggg

SEQ ID NO: 5750103 - DNA, 16 bp, Homo sapiens
gatggagggtggaaat

SEQ ID NO: 5750104 - DNA, 15 bp, Homo sapiens
gatggagtgagccca

SEQ ID NO: 5750105 - DNA, 20 bp, Homo sapiens
gatggagtgtgcagacagcc

SEQ ID NO: 5750106 - DNA, 16 bp, Homo sapiens
gatggagtgttttagt

SEQ ID NO: 5750107 - DNA, 19 bp, Homo sapiens
gatggagttcttgtgccat

SEQ ID NO: 5750108 - DNA, 13 bp, Homo sapiens
gatggagtttcta

SEQ ID NO: 5750109 - DNA, 15 bp, Homo sapiens
gatggagtttctaag

SEQ ID NO: 5750110 - DNA, 17 bp, Homo sapiens
gatggagtttctaaggt

SEQ ID NO: 5750111 - DNA, 19 bp, Homo sapiens
gatggatagtatgtaattt

SEQ ID NO: 5750112 - DNA, 19 bp, Homo sapiens
gatggatatatgtttttga

SEQ ID NO: 5750113 - DNA, 16 bp, Homo sapiens
gatggatcaccattat

SEQ ID NO: 5750114 - DNA, 20 bp, Homo sapiens
gatggatctgctccatgcag

SEQ ID NO: 5750115 - DNA, 17 bp, Homo sapiens
gatggatgcatcacact

SEQ ID NO: 5750116 - DNA, 23 bp, Homo sapiens
gatggatgccaatattaaatctg

SEQ ID NO: 5750117 - DNA, 14 bp, Homo sapiens
gatggatgctgggg

SEQ ID NO: 5750118 - DNA, 13 bp, Homo sapiens
gatggatggacag

SEQ ID NO: 5750119 - DNA, 12 bp, Homo sapiens
gatggatggcac

SEQ ID NO: 5750120 - DNA, 16 bp, Homo sapiens
gatggatggcacaatg

SEQ ID NO: 5750121 - DNA, 15 bp, Homo sapiens
gatggatggcagact

SEQ ID NO: 5750122 - DNA, 14 bp, Homo sapiens
gatggattctcaga

SEQ ID NO: 5750123 - DNA, 22 bp, Homo sapiens
gatggattctcagatatttata

SEQ ID NO: 5750124 - DNA, 19 bp, Homo sapiens
gatggattggcctccaggg

SEQ ID NO: 5750125 - DNA, 14 bp, Homo sapiens
gatggatttaacag

SEQ ID NO: 5750126 - DNA, 15 bp, Homo sapiens
gatggatttgaagca

SEQ ID NO: 5750127 - DNA, 15 bp, Homo sapiens
gatggatttgacaca

SEQ ID NO: 5750128 - DNA, 15 bp, Homo sapiens
gatggatttgtatca

SEQ ID NO: 5750129 - DNA, 13 bp, Homo sapiens
gatggattttata

SEQ ID NO: 5750130 - DNA, 17 bp, Homo sapiens
gatggcaacagatctgg

SEQ ID NO: 5750131 - DNA, 18 bp, Homo sapiens
gatggcaccctggaaccg

SEQ ID NO: 5750132 - DNA, 15 bp, Homo sapiens
gatggcacctgtggc

SEQ ID NO: 5750133 - DNA, 18 bp, Homo sapiens
gatggcacctgtggccag

SEQ ID NO: 5750134 - DNA, 14 bp, Homo sapiens
gatggcactgtcca

SEQ ID NO: 5750135 - DNA, 17 bp, Homo sapiens
gatggcacttttgagct

SEQ ID NO: 5750136 - DNA, 23 bp, Homo sapiens
gatggcagactctttaataaatt

SEQ ID NO: 5750137 - DNA, 13 bp, Homo sapiens
gatggcagagcca

SEQ ID NO: 5750138 - DNA, 11 bp, Homo sapiens
gatggcagagg

SEQ ID NO: 5750139 - DNA, 15 bp, Homo sapiens
gatggcagaggagct

SEQ ID NO: 5750140 - DNA, 16 bp, Homo sapiens
gatggcagcagtgaag

SEQ ID NO: 5750141 - DNA, 22 bp, Homo sapiens
gatggcagcctcagggcttcct

SEQ ID NO: 5750142 - DNA, 18 bp, Homo sapiens
gatggcagcttttaaaag

SEQ ID NO: 5750143 - DNA, 17 bp, Homo sapiens
gatggcaggcctgaccc

SEQ ID NO: 5750144 - DNA, 15 bp, Homo sapiens
gatggcagtggctgt

SEQ ID NO: 5750145 - DNA, 18 bp, Homo sapiens
gatggcagtgtggggagg

SEQ ID NO: 5750146 - DNA, 17 bp, Homo sapiens
gatggcattactctgca

SEQ ID NO: 5750147 - DNA, 20 bp, Homo sapiens
gatggcatttggtctcaggc

SEQ ID NO: 5750148 - DNA, 22 bp, Homo sapiens
gatggcatttggtctcaggcag

SEQ ID NO: 5750149 - DNA, 18 bp, Homo sapiens
gatggccaaagcaaagga

SEQ ID NO: 5750150 - DNA, 16 bp, Homo sapiens
gatggccaagaaagaa

SEQ ID NO: 5750151 - DNA, 18 bp, Homo sapiens
gatggccaagggggtgga

SEQ ID NO: 5750152 - DNA, 22 bp, Homo sapiens
gatggccaagggggtggacgca

SEQ ID NO: 5750153 - DNA, 12 bp, Homo sapiens
gatggccaggcc

SEQ ID NO: 5750154 - DNA, 15 bp, Homo sapiens
gatggccaggccagg

SEQ ID NO: 5750155 - DNA, 21 bp, Homo sapiens
gatggccaggcctcagggacc

SEQ ID NO: 5750156 - DNA, 15 bp, Homo sapiens
gatggccaggtacaa

SEQ ID NO: 5750157 - DNA, 20 bp, Homo sapiens
gatggccagtcatgtgctgg

SEQ ID NO: 5750158 - DNA, 23 bp, Homo sapiens
gatggccagtttgaagcctgtgc

SEQ ID NO: 5750159 - DNA, 14 bp, Homo sapiens
gatggccatgctca

SEQ ID NO: 5750160 - DNA, 14 bp, Homo sapiens
gatggcccagcagg

SEQ ID NO: 5750161 - DNA, 16 bp, Homo sapiens
gatggcccattaagag

SEQ ID NO: 5750162 - DNA, 20 bp, Homo sapiens
gatggccccaacaagcaccc

SEQ ID NO: 5750163 - DNA, 13 bp, Homo sapiens
gatggcccctcca

SEQ ID NO: 5750164 - DNA, 14 bp, Homo sapiens
gatggcccctccac

SEQ ID NO: 5750165 - DNA, 16 bp, Homo sapiens
gatggcccctccactg

SEQ ID NO: 5750166 - DNA, 16 bp, Homo sapiens
gatggcccctccagca

SEQ ID NO: 5750167 - DNA, 17 bp, Homo sapiens
gatggcccgagagctgg

SEQ ID NO: 5750168 - DNA, 20 bp, Homo sapiens
gatggcccgagagctgggac

SEQ ID NO: 5750169 - DNA, 13 bp, Homo sapiens
gatggccctcatc

SEQ ID NO: 5750170 - DNA, 18 bp, Homo sapiens
gatggccctcatctccag

SEQ ID NO: 5750171 - DNA, 14 bp, Homo sapiens
gatggccctctggt

SEQ ID NO: 5750172 - DNA, 15 bp, Homo sapiens
gatggcccttcccac

SEQ ID NO: 5750173 - DNA, 22 bp, Homo sapiens
gatggcccttcctcctccacca

SEQ ID NO: 5750174 - DNA, 18 bp, Homo sapiens
gatggccggagaggaccg

SEQ ID NO: 5750175 - DNA, 17 bp, Homo sapiens
gatggccggctggttgt

SEQ ID NO: 5750176 - DNA, 14 bp, Homo sapiens
gatggccgggctgc

SEQ ID NO: 5750177 - DNA, 22 bp, Homo sapiens
gatggcctctggggcaggacca

SEQ ID NO: 5750178 - DNA, 17 bp, Homo sapiens
gatggccttaatttcct

SEQ ID NO: 5750179 - DNA, 22 bp, Homo sapiens
gatggcgatggggactctgccg

SEQ ID NO: 5750180 - DNA, 21 bp, Homo sapiens
gatggcgattccctctcaccc

SEQ ID NO: 5750181 - DNA, 15 bp, Homo sapiens
gatggcgcacccggc

SEQ ID NO: 5750182 - DNA, 20 bp, Homo sapiens
gatggcgcgggaggcaccag

SEQ ID NO: 5750183 - DNA, 14 bp, Homo sapiens
gatggcgctagggg

SEQ ID NO: 5750184 - DNA, 16 bp, Homo sapiens
gatggcgggtgggggt

SEQ ID NO: 5750185 - DNA, 19 bp, Homo sapiens
gatggcgtgtcccctgcct

SEQ ID NO: 5750186 - DNA, 22 bp, Homo sapiens
gatggctatgtagacataaaga

SEQ ID NO: 5750187 - DNA, 14 bp, Homo sapiens
gatggctcagaggg

SEQ ID NO: 5750188 - DNA, 15 bp, Homo sapiens
gatggctcagagggg

SEQ ID NO: 5750189 - DNA, 18 bp, Homo sapiens
gatggctcccaggggctc

SEQ ID NO: 5750190 - DNA, 16 bp, Homo sapiens
gatggctccctgggct

SEQ ID NO: 5750191 - DNA, 12 bp, Homo sapiens
gatggctcctct

SEQ ID NO: 5750192 - DNA, 20 bp, Homo sapiens
gatggctccttgggatgaag

SEQ ID NO: 5750193 - DNA, 15 bp, Homo sapiens
gatggctgcccctgc

SEQ ID NO: 5750194 - DNA, 16 bp, Homo sapiens
gatggctgctgctcac

SEQ ID NO: 5750195 - DNA, 20 bp, Homo sapiens
gatggctgtgaaaattacac

SEQ ID NO: 5750196 - DNA, 13 bp, Homo sapiens
gatggctgtgcct

SEQ ID NO: 5750197 - DNA, 22 bp, Homo sapiens
gatggcttagttaagtcatcca

SEQ ID NO: 5750198 - DNA, 20 bp, Homo sapiens
gatggcttccgtgagacaca

SEQ ID NO: 5750199 - DNA, 21 bp, Homo sapiens
gatggcttccgtgagacacaa

SEQ ID NO: 5750200 - DNA, 17 bp, Homo sapiens
gatggcttgacatgtgc

SEQ ID NO: 5750201 - DNA, 18 bp, Homo sapiens
gatggcttgacatgtgca

SEQ ID NO: 5750202 - DNA, 15 bp, Homo sapiens
gatggcttgtctata

SEQ ID NO: 5750203 - DNA, 17 bp, Homo sapiens
gatggctttcagggcag

SEQ ID NO: 5750204 - DNA, 21 bp, Homo sapiens
gatgggaaagcggcgccacag

SEQ ID NO: 5750205 - DNA, 16 bp, Homo sapiens
gatgggaaataaagaa

SEQ ID NO: 5750206 - DNA, 19 bp, Homo sapiens
gatgggaacactggtgggc

SEQ ID NO: 5750207 - DNA, 18 bp, Homo sapiens
gatgggaagaaaaaggaa

SEQ ID NO: 5750208 - DNA, 16 bp, Homo sapiens
gatgggaagatggtag

SEQ ID NO: 5750209 - DNA, 20 bp, Homo sapiens
gatgggaagatggtagcaga

SEQ ID NO: 5750210 - DNA, 15 bp, Homo sapiens
gatgggaaggagggg

SEQ ID NO: 5750211 - DNA, 14 bp, Homo sapiens
gatgggaatgaagc

SEQ ID NO: 5750212 - DNA, 18 bp, Homo sapiens
gatgggaatgaagcttgt

SEQ ID NO: 5750213 - DNA, 22 bp, Homo sapiens
gatgggaatgaagcttgtgtat

SEQ ID NO: 5750214 - DNA, 16 bp, Homo sapiens
gatgggacaagaagcc

SEQ ID NO: 5750215 - DNA, 16 bp, Homo sapiens
gatgggacagggaggc

SEQ ID NO: 5750216 - DNA, 20 bp, Homo sapiens
gatgggaccagggatggggg

SEQ ID NO: 5750217 - DNA, 23 bp, Homo sapiens
gatgggactagagctttctttca

SEQ ID NO: 5750218 - DNA, 14 bp, Homo sapiens
gatgggactgggag

SEQ ID NO: 5750219 - DNA, 19 bp, Homo sapiens
gatgggagagcaacaagta

SEQ ID NO: 5750220 - DNA, 22 bp, Homo sapiens
gatgggaggagagccactgggc

SEQ ID NO: 5750221 - DNA, 23 bp, Homo sapiens
gatgggaggtggaagcagaggcc

SEQ ID NO: 5750222 - DNA, 14 bp, Homo sapiens
gatgggaggtgtgc

SEQ ID NO: 5750223 - DNA, 16 bp, Homo sapiens
gatgggaggttgattt

SEQ ID NO: 5750224 - DNA, 23 bp, Homo sapiens
gatgggagtaggctccagacagg

SEQ ID NO: 5750225 - DNA, 15 bp, Homo sapiens
gatgggagtgagaca

SEQ ID NO: 5750226 - DNA, 18 bp, Homo sapiens
gatgggagtgggcacctc

SEQ ID NO: 5750227 - DNA, 19 bp, Homo sapiens
gatgggatgattgaagaaa

SEQ ID NO: 5750228 - DNA, 20 bp, Homo sapiens
gatgggatggtggagggcca

SEQ ID NO: 5750229 - DNA, 13 bp, Homo sapiens
gatgggattctgg

SEQ ID NO: 5750230 - DNA, 15 bp, Homo sapiens
gatgggatttcaccg

SEQ ID NO: 5750231 - DNA, 16 bp, Homo sapiens
gatgggatttttgttt

SEQ ID NO: 5750232 - DNA, 22 bp, Homo sapiens
gatgggcaaaccctggtgcttt

SEQ ID NO: 5750233 - DNA, 18 bp, Homo sapiens
gatgggcaaagcttgtca

SEQ ID NO: 5750234 - DNA, 12 bp, Homo sapiens
gatgggcacagg

SEQ ID NO: 5750235 - DNA, 15 bp, Homo sapiens
gatgggcacaggctg

SEQ ID NO: 5750236 - DNA, 19 bp, Homo sapiens
gatgggcacaggctgcccc

SEQ ID NO: 5750237 - DNA, 16 bp, Homo sapiens
gatgggcacatgagga

SEQ ID NO: 5750238 - DNA, 20 bp, Homo sapiens
gatgggcacatgaggagggt

SEQ ID NO: 5750239 - DNA, 22 bp, Homo sapiens
gatgggcagcccaacagcactt

SEQ ID NO: 5750240 - DNA, 21 bp, Homo sapiens
gatgggcattgggctgacacc

SEQ ID NO: 5750241 - DNA, 19 bp, Homo sapiens
gatgggccaaacccagaca

SEQ ID NO: 5750242 - DNA, 21 bp, Homo sapiens
gatgggccacccaccagggct

SEQ ID NO: 5750243 - DNA, 20 bp, Homo sapiens
gatgggccacggctgagcct

SEQ ID NO: 5750244 - DNA, 16 bp, Homo sapiens
gatgggcccaattctt

SEQ ID NO: 5750245 - DNA, 17 bp, Homo sapiens
gatgggcccctggcccc

SEQ ID NO: 5750246 - DNA, 22 bp, Homo sapiens
gatgggccggcccccttcctgg

SEQ ID NO: 5750247 - DNA, 12 bp, Homo sapiens
gatgggcctgag

SEQ ID NO: 5750248 - DNA, 14 bp, Homo sapiens
gatgggcctggcat

SEQ ID NO: 5750249 - DNA, 15 bp, Homo sapiens
gatgggctaggcctc

SEQ ID NO: 5750250 - DNA, 16 bp, Homo sapiens
gatgggctccccagga

SEQ ID NO: 5750251 - DNA, 14 bp, Homo sapiens
gatgggctcgctga

SEQ ID NO: 5750252 - DNA, 12 bp, Homo sapiens
gatgggctgggg

SEQ ID NO: 5750253 - DNA, 14 bp, Homo sapiens
gatgggctggggca

SEQ ID NO: 5750254 - DNA, 15 bp, Homo sapiens
gatgggcttcccaag

SEQ ID NO: 5750255 - DNA, 21 bp, Homo sapiens
gatgggcttctgttctctgct

SEQ ID NO: 5750256 - DNA, 21 bp, Homo sapiens
gatgggctttcccaacagctc

SEQ ID NO: 5750257 - DNA, 14 bp, Homo sapiens
gatgggctttctct

SEQ ID NO: 5750258 - DNA, 18 bp, Homo sapiens
gatgggcttttgttctga

SEQ ID NO: 5750259 - DNA, 20 bp, Homo sapiens
gatgggcttttgttctgagg

SEQ ID NO: 5750260 - DNA, 21 bp, Homo sapiens
gatggggaaactgagggcaga

SEQ ID NO: 5750261 - DNA, 13 bp, Homo sapiens
gatggggaaggag

SEQ ID NO: 5750262 - DNA, 19 bp, Homo sapiens
gatggggacagactgaaga

SEQ ID NO: 5750263 - DNA, 15 bp, Homo sapiens
gatggggactctgcc

SEQ ID NO: 5750264 - DNA, 14 bp, Homo sapiens
gatggggagaaagg

SEQ ID NO: 5750265 - DNA, 20 bp, Homo sapiens
gatggggagatcggggccag

SEQ ID NO: 5750266 - DNA, 16 bp, Homo sapiens
gatggggagcagctgg

SEQ ID NO: 5750267 - DNA, 20 bp, Homo sapiens
gatggggaggaagagagaga

SEQ ID NO: 5750268 - DNA, 20 bp, Homo sapiens
gatggggagggaaagacggt

SEQ ID NO: 5750269 - DNA, 21 bp, Homo sapiens
gatggggataaaatgactact

SEQ ID NO: 5750270 - DNA, 14 bp, Homo sapiens
gatggggataagaa

SEQ ID NO: 5750271 - DNA, 18 bp, Homo sapiens
gatggggatagaggaaag

SEQ ID NO: 5750272 - DNA, 18 bp, Homo sapiens
gatggggcaagacagaaa

SEQ ID NO: 5750273 - DNA, 22 bp, Homo sapiens
gatggggcaagacagaaaagtg

SEQ ID NO: 5750274 - DNA, 19 bp, Homo sapiens
gatggggcacggctctggg

SEQ ID NO: 5750275 - DNA, 21 bp, Homo sapiens
gatggggccctaattcagcca

SEQ ID NO: 5750276 - DNA, 22 bp, Homo sapiens
gatggggcctccctccttgggt

SEQ ID NO: 5750277 - DNA, 23 bp, Homo sapiens
gatggggcggcctgcagaccctg

SEQ ID NO: 5750278 - DNA, 12 bp, Homo sapiens
gatggggctccc

SEQ ID NO: 5750279 - DNA, 19 bp, Homo sapiens
gatggggctcccgcccgtg

SEQ ID NO: 5750280 - DNA, 13 bp, Homo sapiens
gatggggctgcac

SEQ ID NO: 5750281 - DNA, 15 bp, Homo sapiens
gatggggctgcaccg

SEQ ID NO: 5750282 - DNA, 14 bp, Homo sapiens
gatgggggaaaaaa

SEQ ID NO: 5750283 - DNA, 16 bp, Homo sapiens
gatgggggaactcaga

SEQ ID NO: 5750284 - DNA, 22 bp, Homo sapiens
gatgggggacgagggccaggca

SEQ ID NO: 5750285 - DNA, 21 bp, Homo sapiens
gatgggggagtctgaagcaga

SEQ ID NO: 5750286 - DNA, 16 bp, Homo sapiens
gatgggggatgggcca

SEQ ID NO: 5750287 - DNA, 14 bp, Homo sapiens
gatgggggccagga

SEQ ID NO: 5750288 - DNA, 13 bp, Homo sapiens
gatgggggcctct

SEQ ID NO: 5750289 - DNA, 12 bp, Homo sapiens
gatgggggctgg

SEQ ID NO: 5750290 - DNA, 14 bp, Homo sapiens
gatgggggtggctg

SEQ ID NO: 5750291 - DNA, 18 bp, Homo sapiens
gatgggggtttcaccata

SEQ ID NO: 5750292 - DNA, 14 bp, Homo sapiens
gatggggtcagcag

SEQ ID NO: 5750293 - DNA, 17 bp, Homo sapiens
gatggggtcagcaggcc

SEQ ID NO: 5750294 - DNA, 18 bp, Homo sapiens
gatggggtcagcaggccc

SEQ ID NO: 5750295 - DNA, 18 bp, Homo sapiens
gatggggtctgtgactgg

SEQ ID NO: 5750296 - DNA, 15 bp, Homo sapiens
gatgggtcagagcta

SEQ ID NO: 5750297 - DNA, 21 bp, Homo sapiens
gatgggtcagttgtatcagca

SEQ ID NO: 5750298 - DNA, 22 bp, Homo sapiens
gatgggtccagaagaccccact

SEQ ID NO: 5750299 - DNA, 18 bp, Homo sapiens
gatgggtcccctccgcca

SEQ ID NO: 5750300 - DNA, 20 bp, Homo sapiens
gatgggtctccattctgtgt

SEQ ID NO: 5750301 - DNA, 17 bp, Homo sapiens
gatgggtgattatgaaa

SEQ ID NO: 5750302 - DNA, 18 bp, Homo sapiens
gatgggtgattatgaaat

SEQ ID NO: 5750303 - DNA, 14 bp, Homo sapiens
gatgggtgctgccc

SEQ ID NO: 5750304 - DNA, 14 bp, Homo sapiens
gatgggtggacctg

SEQ ID NO: 5750305 - DNA, 10 bp, Homo sapiens
gatgggtggg

SEQ ID NO: 5750306 - DNA, 19 bp, Homo sapiens
gatgggtgggggctcctgg

SEQ ID NO: 5750307 - DNA, 20 bp, Homo sapiens
gatgggtgtcccctggtgcc

SEQ ID NO: 5750308 - DNA, 22 bp, Homo sapiens
gatgggttctaattttggatgg

SEQ ID NO: 5750309 - DNA, 23 bp, Homo sapiens
gatgggttctaattttggatgga

SEQ ID NO: 5750310 - DNA, 23 bp, Homo sapiens
gatgggttttgttaggggtgggg

SEQ ID NO: 5750311 - DNA, 15 bp, Homo sapiens
gatggtaagaaacaa

SEQ ID NO: 5750312 - DNA, 15 bp, Homo sapiens
gatggtaagagaaaa

SEQ ID NO: 5750313 - DNA, 15 bp, Homo sapiens
gatggtactgctgag

SEQ ID NO: 5750314 - DNA, 13 bp, Homo sapiens
gatggtagcagat

SEQ ID NO: 5750315 - DNA, 19 bp, Homo sapiens
gatggtatactactgcttt

SEQ ID NO: 5750316 - DNA, 23 bp, Homo sapiens
gatggtatctgggtaagaagaaa

SEQ ID NO: 5750317 - DNA, 22 bp, Homo sapiens
gatggtattaatcttgtgtagt

SEQ ID NO: 5750318 - DNA, 15 bp, Homo sapiens
gatggtcagctccct

SEQ ID NO: 5750319 - DNA, 15 bp, Homo sapiens
gatggtcaggcccag

SEQ ID NO: 5750320 - DNA, 13 bp, Homo sapiens
gatggtcatccag

SEQ ID NO: 5750321 - DNA, 18 bp, Homo sapiens
gatggtccatttgttcct

SEQ ID NO: 5750322 - DNA, 15 bp, Homo sapiens
gatggtcccaggaag

SEQ ID NO: 5750323 - DNA, 16 bp, Homo sapiens
gatggtcccaggaagc

SEQ ID NO: 5750324 - DNA, 24 bp, Homo sapiens
gatggtcctggggctctgtgcagg

SEQ ID NO: 5750325 - DNA, 18 bp, Homo sapiens
gatggtctccacctgtgc

SEQ ID NO: 5750326 - DNA, 19 bp, Homo sapiens
gatggtctcgatctcctga

SEQ ID NO: 5750327 - DNA, 23 bp, Homo sapiens
gatggtctgcatcagctttttgt

SEQ ID NO: 5750328 - DNA, 13 bp, Homo sapiens
gatggtctggtct

SEQ ID NO: 5750329 - DNA, 21 bp, Homo sapiens
gatggtcttacagcaggcagt

SEQ ID NO: 5750330 - DNA, 17 bp, Homo sapiens
gatggtgacttttgaag

SEQ ID NO: 5750331 - DNA, 15 bp, Homo sapiens
gatggtgagctggga

SEQ ID NO: 5750332 - DNA, 18 bp, Homo sapiens
gatggtgatggagaggga

SEQ ID NO: 5750333 - DNA, 15 bp, Homo sapiens
gatggtgcaatgacc

SEQ ID NO: 5750334 - DNA, 23 bp, Homo sapiens
gatggtgcaatgacctttcaata

SEQ ID NO: 5750335 - DNA, 18 bp, Homo sapiens
gatggtgccagagagggg

SEQ ID NO: 5750336 - DNA, 12 bp, Homo sapiens
gatggtgctgag

SEQ ID NO: 5750337 - DNA, 17 bp, Homo sapiens
gatggtgctgagaagct

SEQ ID NO: 5750338 - DNA, 15 bp, Homo sapiens
gatggtgctgcccag

SEQ ID NO: 5750339 - DNA, 16 bp, Homo sapiens
gatggtgctgcccagg

SEQ ID NO: 5750340 - DNA, 17 bp, Homo sapiens
gatggtgctgcccaggc

SEQ ID NO: 5750341 - DNA, 18 bp, Homo sapiens
gatggtggcacaggcact

SEQ ID NO: 5750342 - DNA, 13 bp, Homo sapiens
gatggtggctgtg

SEQ ID NO: 5750343 - DNA, 19 bp, Homo sapiens
gatggtggggcccccagca

SEQ ID NO: 5750344 - DNA, 21 bp, Homo sapiens
gatggtggtgagcacatctgg

SEQ ID NO: 5750345 - DNA, 16 bp, Homo sapiens
gatggtgtccttccct

SEQ ID NO: 5750346 - DNA, 17 bp, Homo sapiens
gatggtgtccttccctg

SEQ ID NO: 5750347 - DNA, 19 bp, Homo sapiens
gatggtgtggcctgtggct

SEQ ID NO: 5750348 - DNA, 17 bp, Homo sapiens
gatggtgtgggtgtcct

SEQ ID NO: 5750349 - DNA, 15 bp, Homo sapiens
gatggtgttaaagct

SEQ ID NO: 5750350 - DNA, 17 bp, Homo sapiens
gatggtgttttggggat

SEQ ID NO: 5750351 - DNA, 18 bp, Homo sapiens
gatggttaaaaaggccaa

SEQ ID NO: 5750352 - DNA, 15 bp, Homo sapiens
gatggttacactgtt

SEQ ID NO: 5750353 - DNA, 17 bp, Homo sapiens
gatggttacactgttag

SEQ ID NO: 5750354 - DNA, 18 bp, Homo sapiens
gatggttacactgttaga

SEQ ID NO: 5750355 - DNA, 18 bp, Homo sapiens
gatggttactgaggacca

SEQ ID NO: 5750356 - DNA, 23 bp, Homo sapiens
gatggttattttcttttctttca

SEQ ID NO: 5750357 - DNA, 13 bp, Homo sapiens
gatggttccccag

SEQ ID NO: 5750358 - DNA, 18 bp, Homo sapiens
gatggttcccctgttcac

SEQ ID NO: 5750359 - DNA, 17 bp, Homo sapiens
gatggttcgttctgttt

SEQ ID NO: 5750360 - DNA, 14 bp, Homo sapiens
gatggttctagcat

SEQ ID NO: 5750361 - DNA, 14 bp, Homo sapiens
gatggttctgtgac

SEQ ID NO: 5750362 - DNA, 16 bp, Homo sapiens
gatggttgcaattgat

SEQ ID NO: 5750363 - DNA, 14 bp, Homo sapiens
gatggttgctttga

SEQ ID NO: 5750364 - DNA, 12 bp, Homo sapiens
gatggtttccgt

SEQ ID NO: 5750365 - DNA, 23 bp, Homo sapiens
gatgtaaaaaatattaaagatat

SEQ ID NO: 5750366 - DNA, 12 bp, Homo sapiens
gatgtaaaacag

SEQ ID NO: 5750367 - DNA, 18 bp, Homo sapiens
gatgtaaaagactttttt

SEQ ID NO: 5750368 - DNA, 15 bp, Homo sapiens
gatgtaaaatgagtt

SEQ ID NO: 5750369 - DNA, 21 bp, Homo sapiens
gatgtaaacagtgcctgctga

SEQ ID NO: 5750370 - DNA, 14 bp, Homo sapiens
gatgtaaagatgtt

SEQ ID NO: 5750371 - DNA, 11 bp, Homo sapiens
gatgtaaatcc

SEQ ID NO: 5750372 - DNA, 16 bp, Homo sapiens
gatgtaaattgaagaa

SEQ ID NO: 5750373 - DNA, 20 bp, Homo sapiens
gatgtaaattgaagaagcct

SEQ ID NO: 5750374 - DNA, 16 bp, Homo sapiens
gatgtaaccaagctgt

SEQ ID NO: 5750375 - DNA, 18 bp, Homo sapiens
gatgtaactattgaattg

SEQ ID NO: 5750376 - DNA, 17 bp, Homo sapiens
gatgtaagaagcccgat

SEQ ID NO: 5750377 - DNA, 12 bp, Homo sapiens
gatgtaaggact

SEQ ID NO: 5750378 - DNA, 16 bp, Homo sapiens
gatgtaaggactgtaa

SEQ ID NO: 5750379 - DNA, 18 bp, Homo sapiens
gatgtaaggccttagcca

SEQ ID NO: 5750380 - DNA, 13 bp, Homo sapiens
gatgtaatacacc

SEQ ID NO: 5750381 - DNA, 22 bp, Homo sapiens
gatgtaatacttcttgtgtgta

SEQ ID NO: 5750382 - DNA, 13 bp, Homo sapiens
gatgtaatgtttt

SEQ ID NO: 5750383 - DNA, 22 bp, Homo sapiens
gatgtaattagctctggggggc

SEQ ID NO: 5750384 - DNA, 19 bp, Homo sapiens
gatgtaattttgtgtaaga

SEQ ID NO: 5750385 - DNA, 17 bp, Homo sapiens
gatgtacagattttatt

SEQ ID NO: 5750386 - DNA, 17 bp, Homo sapiens
gatgtacaggcagatga

SEQ ID NO: 5750387 - DNA, 18 bp, Homo sapiens
gatgtacagtctgtcatg

SEQ ID NO: 5750388 - DNA, 16 bp, Homo sapiens
gatgtacatttaataa

SEQ ID NO: 5750389 - DNA, 19 bp, Homo sapiens
gatgtacatttaataatat

SEQ ID NO: 5750390 - DNA, 22 bp, Homo sapiens
gatgtacatttaataatatcaa

SEQ ID NO: 5750391 - DNA, 22 bp, Homo sapiens
gatgtacatttccaaattcaca

SEQ ID NO: 5750392 - DNA, 19 bp, Homo sapiens
gatgtaccatgttaaagag

SEQ ID NO: 5750393 - DNA, 18 bp, Homo sapiens
gatgtactctaaatactg

SEQ ID NO: 5750394 - DNA, 22 bp, Homo sapiens
gatgtactgcaaagtcgccagt

SEQ ID NO: 5750395 - DNA, 17 bp, Homo sapiens
gatgtagaggagaaact

SEQ ID NO: 5750396 - DNA, 16 bp, Homo sapiens
gatgtagatacagatc

SEQ ID NO: 5750397 - DNA, 16 bp, Homo sapiens
gatgtagatataaata

SEQ ID NO: 5750398 - DNA, 21 bp, Homo sapiens
gatgtagcaaaccctgtcaaa

SEQ ID NO: 5750399 - DNA, 18 bp, Homo sapiens
gatgtagcagaatatttc

SEQ ID NO: 5750400 - DNA, 15 bp, Homo sapiens
gatgtagcattatgc

SEQ ID NO: 5750401 - DNA, 13 bp, Homo sapiens
gatgtagcattgt

SEQ ID NO: 5750402 - DNA, 18 bp, Homo sapiens
gatgtagccatgacctta

SEQ ID NO: 5750403 - DNA, 14 bp, Homo sapiens
gatgtagcttgaga

SEQ ID NO: 5750404 - DNA, 13 bp, Homo sapiens
gatgtaggagctg

SEQ ID NO: 5750405 - DNA, 17 bp, Homo sapiens
gatgtaggcattctgga

SEQ ID NO: 5750406 - DNA, 16 bp, Homo sapiens
gatgtaggctccacct

SEQ ID NO: 5750407 - DNA, 19 bp, Homo sapiens
gatgtagggtaaggtgcct

SEQ ID NO: 5750408 - DNA, 13 bp, Homo sapiens
gatgtagtatttt

SEQ ID NO: 5750409 - DNA, 15 bp, Homo sapiens
gatgtagtctgaggc

SEQ ID NO: 5750410 - DNA, 19 bp, Homo sapiens
gatgtagtgattaaatata

SEQ ID NO: 5750411 - DNA, 15 bp, Homo sapiens
gatgtagttctgcca

SEQ ID NO: 5750412 - DNA, 16 bp, Homo sapiens
gatgtataatgtaatg

SEQ ID NO: 5750413 - DNA, 14 bp, Homo sapiens
gatgtatacatctt

SEQ ID NO: 5750414 - DNA, 14 bp, Homo sapiens
gatgtatattcctt

SEQ ID NO: 5750415 - DNA, 13 bp, Homo sapiens
gatgtatctgagt

SEQ ID NO: 5750416 - DNA, 19 bp, Homo sapiens
gatgtatctgagttgccaa

SEQ ID NO: 5750417 - DNA, 18 bp, Homo sapiens
gatgtatgatctctctag

SEQ ID NO: 5750418 - DNA, 13 bp, Homo sapiens
gatgtatgcccaa

SEQ ID NO: 5750419 - DNA, 17 bp, Homo sapiens
gatgtatggtatcttta

SEQ ID NO: 5750420 - DNA, 13 bp, Homo sapiens
gatgtatgtgtat

SEQ ID NO: 5750421 - DNA, 13 bp, Homo sapiens
gatgtatgtgtga

SEQ ID NO: 5750422 - DNA, 14 bp, Homo sapiens
gatgtatgtgtgaa

SEQ ID NO: 5750423 - DNA, 13 bp, Homo sapiens
gatgtatgttatt

SEQ ID NO: 5750424 - DNA, 20 bp, Homo sapiens
gatgtatgttgaagcctttg

SEQ ID NO: 5750425 - DNA, 19 bp, Homo sapiens
gatgtattaacctacctgt

SEQ ID NO: 5750426 - DNA, 20 bp, Homo sapiens
gatgtattagtagagcaacc

SEQ ID NO: 5750427 - DNA, 15 bp, Homo sapiens
gatgtattattatat

SEQ ID NO: 5750428 - DNA, 16 bp, Homo sapiens
gatgtattcagagcca

SEQ ID NO: 5750429 - DNA, 12 bp, Homo sapiens
gatgtattcttt

SEQ ID NO: 5750430 - DNA, 13 bp, Homo sapiens
gatgtattggaac

SEQ ID NO: 5750431 - DNA, 18 bp, Homo sapiens
gatgtattttcatagtga

SEQ ID NO: 5750432 - DNA, 21 bp, Homo sapiens
gatgtattttgtgagtttgtt

SEQ ID NO: 5750433 - DNA, 22 bp, Homo sapiens
gatgtatttttgatgtatatat

SEQ ID NO: 5750434 - DNA, 23 bp, Homo sapiens
gatgtcaaaggtcgggacagctg

SEQ ID NO: 5750435 - DNA, 21 bp, Homo sapiens
gatgtcaaagtgtaacagata

SEQ ID NO: 5750436 - DNA, 20 bp, Homo sapiens
gatgtcaaatatctcagagg

SEQ ID NO: 5750437 - DNA, 18 bp, Homo sapiens
gatgtcaaccttgtgtga

SEQ ID NO: 5750438 - DNA, 17 bp, Homo sapiens
gatgtcaagctggccgt

SEQ ID NO: 5750439 - DNA, 20 bp, Homo sapiens
gatgtcaagctggccgtgga

SEQ ID NO: 5750440 - DNA, 20 bp, Homo sapiens
gatgtcaatgctatggactg

SEQ ID NO: 5750441 - DNA, 23 bp, Homo sapiens
gatgtcaatgctatggactgcac

SEQ ID NO: 5750442 - DNA, 15 bp, Homo sapiens
gatgtcacagggcca

SEQ ID NO: 5750443 - DNA, 15 bp, Homo sapiens
gatgtcaccaagaag

SEQ ID NO: 5750444 - DNA, 19 bp, Homo sapiens
gatgtcagcagttgctggt

SEQ ID NO: 5750445 - DNA, 11 bp, Homo sapiens
gatgtcagcct

SEQ ID NO: 5750446 - DNA, 14 bp, Homo sapiens
gatgtcagccttgc

SEQ ID NO: 5750447 - DNA, 15 bp, Homo sapiens
gatgtcagccttgca

SEQ ID NO: 5750448 - DNA, 18 bp, Homo sapiens
gatgtcagcttcccagcc

SEQ ID NO: 5750449 - DNA, 22 bp, Homo sapiens
gatgtcaggatgttgctccatc

SEQ ID NO: 5750450 - DNA, 18 bp, Homo sapiens
gatgtcataataaagttg

SEQ ID NO: 5750451 - DNA, 20 bp, Homo sapiens
gatgtcatacagagaagtca

SEQ ID NO: 5750452 - DNA, 13 bp, Homo sapiens
gatgtcatcccct

SEQ ID NO: 5750453 - DNA, 16 bp, Homo sapiens
gatgtcatcttgagct

SEQ ID NO: 5750454 - DNA, 21 bp, Homo sapiens
gatgtcatgtacttcctgtgt

SEQ ID NO: 5750455 - DNA, 22 bp, Homo sapiens
gatgtcatgtacttcctgtgta

SEQ ID NO: 5750456 - DNA, 18 bp, Homo sapiens
gatgtcatgtctgcttgt

SEQ ID NO: 5750457 - DNA, 18 bp, Homo sapiens
gatgtcattcagcagtca

SEQ ID NO: 5750458 - DNA, 16 bp, Homo sapiens
gatgtccaacaaggaa

SEQ ID NO: 5750459 - DNA, 15 bp, Homo sapiens
gatgtccagagctgg

SEQ ID NO: 5750460 - DNA, 17 bp, Homo sapiens
gatgtcccaacttgtaa

SEQ ID NO: 5750461 - DNA, 18 bp, Homo sapiens
gatgtcccaacttgtaaa

SEQ ID NO: 5750462 - DNA, 14 bp, Homo sapiens
gatgtcccacaggg

SEQ ID NO: 5750463 - DNA, 22 bp, Homo sapiens
gatgtcccagtgctcaccagcc

SEQ ID NO: 5750464 - DNA, 13 bp, Homo sapiens
gatgtccccagca

SEQ ID NO: 5750465 - DNA, 19 bp, Homo sapiens
gatgtcccccaggggccca

SEQ ID NO: 5750466 - DNA, 16 bp, Homo sapiens
gatgtcccctgcgggc

SEQ ID NO: 5750467 - DNA, 16 bp, Homo sapiens
gatgtcccctgtccca

SEQ ID NO: 5750468 - DNA, 22 bp, Homo sapiens
gatgtcccctgtcccaccaact

SEQ ID NO: 5750469 - DNA, 20 bp, Homo sapiens
gatgtccctattctgccatg

SEQ ID NO: 5750470 - DNA, 23 bp, Homo sapiens
gatgtccctattctgccatggga

SEQ ID NO: 5750471 - DNA, 15 bp, Homo sapiens
gatgtccctgtcccc

SEQ ID NO: 5750472 - DNA, 22 bp, Homo sapiens
gatgtcccttgatgcacagaga

SEQ ID NO: 5750473 - DNA, 17 bp, Homo sapiens
gatgtcctcaccacatg

SEQ ID NO: 5750474 - DNA, 14 bp, Homo sapiens
gatgtcctcctctg

SEQ ID NO: 5750475 - DNA, 22 bp, Homo sapiens
gatgtcctctttactcccttcc

SEQ ID NO: 5750476 - DNA, 16 bp, Homo sapiens
gatgtcctgactttgc

SEQ ID NO: 5750477 - DNA, 19 bp, Homo sapiens
gatgtccttaaaatgtggt

SEQ ID NO: 5750478 - DNA, 16 bp, Homo sapiens
gatgtcgctgggtcct

SEQ ID NO: 5750479 - DNA, 22 bp, Homo sapiens
gatgtcgctgggtcctctgcag

SEQ ID NO: 5750480 - DNA, 15 bp, Homo sapiens
gatgtcgttcatttt

SEQ ID NO: 5750481 - DNA, 18 bp, Homo sapiens
gatgtcgttcattttctg

SEQ ID NO: 5750482 - DNA, 15 bp, Homo sapiens
gatgtctaaaagatt

SEQ ID NO: 5750483 - DNA, 20 bp, Homo sapiens
gatgtctaaaagattcttta

SEQ ID NO: 5750484 - DNA, 18 bp, Homo sapiens
gatgtctcctcaagcctg

SEQ ID NO: 5750485 - DNA, 20 bp, Homo sapiens
gatgtctcctcaagcctgtg

SEQ ID NO: 5750486 - DNA, 12 bp, Homo sapiens
gatgtctctggg

SEQ ID NO: 5750487 - DNA, 13 bp, Homo sapiens
gatgtctctgggg

SEQ ID NO: 5750488 - DNA, 16 bp, Homo sapiens
gatgtctcttggaaat

SEQ ID NO: 5750489 - DNA, 21 bp, Homo sapiens
gatgtctcttggaaatgttaa

SEQ ID NO: 5750490 - DNA, 13 bp, Homo sapiens
gatgtctcttgta

SEQ ID NO: 5750491 - DNA, 21 bp, Homo sapiens
gatgtctgaactttgggaagc

SEQ ID NO: 5750492 - DNA, 21 bp, Homo sapiens
gatgtctgccaatttttgcct

SEQ ID NO: 5750493 - DNA, 22 bp, Homo sapiens
gatgtctgccaatttttgcctt

SEQ ID NO: 5750494 - DNA, 14 bp, Homo sapiens
gatgtctgtgtata

SEQ ID NO: 5750495 - DNA, 20 bp, Homo sapiens
gatgtctgtttgctgatggt

SEQ ID NO: 5750496 - DNA, 20 bp, Homo sapiens
gatgtcttatttttagatgg

SEQ ID NO: 5750497 - DNA, 22 bp, Homo sapiens
gatgtcttccttggagggggga

SEQ ID NO: 5750498 - DNA, 21 bp, Homo sapiens
gatgtcttcgtacagttcttc

SEQ ID NO: 5750499 - DNA, 15 bp, Homo sapiens
gatgtcttctgcctg

SEQ ID NO: 5750500 - DNA, 16 bp, Homo sapiens
gatgtcttctgcctgt

SEQ ID NO: 5750501 - DNA, 21 bp, Homo sapiens
gatgtcttggaacattggaat

SEQ ID NO: 5750502 - DNA, 16 bp, Homo sapiens
gatgtctttttattaa

SEQ ID NO: 5750503 - DNA, 19 bp, Homo sapiens
gatgtctttttattaaaat

SEQ ID NO: 5750504 - DNA, 23 bp, Homo sapiens
gatgtctttttattaaaatattt

SEQ ID NO: 5750505 - DNA, 23 bp, Homo sapiens
gatgtgaaaaagcctaagaaaaa

SEQ ID NO: 5750506 - DNA, 13 bp, Homo sapiens
gatgtgaaaactc

SEQ ID NO: 5750507 - DNA, 12 bp, Homo sapiens
gatgtgaagcca

SEQ ID NO: 5750508 - DNA, 23 bp, Homo sapiens
gatgtgaattgcctgcagagaga

SEQ ID NO: 5750509 - DNA, 14 bp, Homo sapiens
gatgtgacatttgt

SEQ ID NO: 5750510 - DNA, 17 bp, Homo sapiens
gatgtgacatttgtcat

SEQ ID NO: 5750511 - DNA, 15 bp, Homo sapiens
gatgtgacccaccag

SEQ ID NO: 5750512 - DNA, 21 bp, Homo sapiens
gatgtgacccaccagtgcctt

SEQ ID NO: 5750513 - DNA, 23 bp, Homo sapiens
gatgtgactgcatcatatattta

SEQ ID NO: 5750514 - DNA, 11 bp, Homo sapiens
gatgtgacttt

SEQ ID NO: 5750515 - DNA, 12 bp, Homo sapiens
gatgtgactttt

SEQ ID NO: 5750516 - DNA, 13 bp, Homo sapiens
gatgtgacttttt

SEQ ID NO: 5750517 - DNA, 13 bp, Homo sapiens
gatgtgagcagaa

SEQ ID NO: 5750518 - DNA, 23 bp, Homo sapiens
gatgtgagccaccgtgcctggcc

SEQ ID NO: 5750519 - DNA, 13 bp, Homo sapiens
gatgtgagccagc

SEQ ID NO: 5750520 - DNA, 14 bp, Homo sapiens
gatgtgagccccag

SEQ ID NO: 5750521 - DNA, 15 bp, Homo sapiens
gatgtgagccccagg

SEQ ID NO: 5750522 - DNA, 23 bp, Homo sapiens
gatgtgagccccaggggggcctc

SEQ ID NO: 5750523 - DNA, 13 bp, Homo sapiens
gatgtgagtcctg

SEQ ID NO: 5750524 - DNA, 16 bp, Homo sapiens
gatgtgagtgtgtgtg

SEQ ID NO: 5750525 - DNA, 19 bp, Homo sapiens
gatgtgagttgcacagcta

SEQ ID NO: 5750526 - DNA, 15 bp, Homo sapiens
gatgtgatattctaa

SEQ ID NO: 5750527 - DNA, 14 bp, Homo sapiens
gatgtgatcaggcc

SEQ ID NO: 5750528 - DNA, 17 bp, Homo sapiens
gatgtgatcaggcccca

SEQ ID NO: 5750529 - DNA, 23 bp, Homo sapiens
gatgtgatcaggccccacccctg

SEQ ID NO: 5750530 - DNA, 20 bp, Homo sapiens
gatgtgattcaaaagatgcc

SEQ ID NO: 5750531 - DNA, 23 bp, Homo sapiens
gatgtgatttaatagtgttaatc

SEQ ID NO: 5750532 - DNA, 16 bp, Homo sapiens
gatgtgcaaaaatttt

SEQ ID NO: 5750533 - DNA, 22 bp, Homo sapiens
gatgtgcaaaaatttttggatt

SEQ ID NO: 5750534 - DNA, 20 bp, Homo sapiens
gatgtgcaaaaccttttact

SEQ ID NO: 5750535 - DNA, 22 bp, Homo sapiens
gatgtgcaacctgtggctcagg

SEQ ID NO: 5750536 - DNA, 12 bp, Homo sapiens
gatgtgcaataa

SEQ ID NO: 5750537 - DNA, 16 bp, Homo sapiens
gatgtgcaattgattt

SEQ ID NO: 5750538 - DNA, 19 bp, Homo sapiens
gatgtgcaattgatttctt

SEQ ID NO: 5750539 - DNA, 14 bp, Homo sapiens
gatgtgcagcagat

SEQ ID NO: 5750540 - DNA, 21 bp, Homo sapiens
gatgtgcagcagattggaagg

SEQ ID NO: 5750541 - DNA, 23 bp, Homo sapiens
gatgtgcagcagattggaaggag

SEQ ID NO: 5750542 - DNA, 19 bp, Homo sapiens
gatgtgcagcatttcactt

SEQ ID NO: 5750543 - DNA, 17 bp, Homo sapiens
gatgtgcaggaagaaaa

SEQ ID NO: 5750544 - DNA, 18 bp, Homo sapiens
gatgtgcatctggcctat

SEQ ID NO: 5750545 - DNA, 20 bp, Homo sapiens
gatgtgccattttaaaaaaa

SEQ ID NO: 5750546 - DNA, 13 bp, Homo sapiens
gatgtgcccagag

SEQ ID NO: 5750547 - DNA, 21 bp, Homo sapiens
gatgtgcccagagtagcccag

SEQ ID NO: 5750548 - DNA, 17 bp, Homo sapiens
gatgtgcccaggggagc

SEQ ID NO: 5750549 - DNA, 17 bp, Homo sapiens
gatgtgcccccaccccc

SEQ ID NO: 5750550 - DNA, 14 bp, Homo sapiens
gatgtgcctgtaat

SEQ ID NO: 5750551 - DNA, 18 bp, Homo sapiens
gatgtgcgtgctgtctgt

SEQ ID NO: 5750552 - DNA, 24 bp, Homo sapiens
gatgtgcgtgctgtctgtcctatg

SEQ ID NO: 5750553 - DNA, 19 bp, Homo sapiens
gatgtgctcccaccaggca

SEQ ID NO: 5750554 - DNA, 14 bp, Homo sapiens
gatgtgctggagct

SEQ ID NO: 5750555 - DNA, 16 bp, Homo sapiens
gatgtgctggagctgg

SEQ ID NO: 5750556 - DNA, 17 bp, Homo sapiens
gatgtgctggagctggc

SEQ ID NO: 5750557 - DNA, 21 bp, Homo sapiens
gatgtgctggaggggtggccc

SEQ ID NO: 5750558 - DNA, 19 bp, Homo sapiens
gatgtgcttgttaactgag

SEQ ID NO: 5750559 - DNA, 17 bp, Homo sapiens
gatgtgctttgctgcac

SEQ ID NO: 5750560 - DNA, 14 bp, Homo sapiens
gatgtggacatgca

SEQ ID NO: 5750561 - DNA, 22 bp, Homo sapiens
gatgtggacgtcacgctccctg

SEQ ID NO: 5750562 - DNA, 12 bp, Homo sapiens
gatgtggagcac

SEQ ID NO: 5750563 - DNA, 11 bp, Homo sapiens
gatgtggagcc

SEQ ID NO: 5750564 - DNA, 15 bp, Homo sapiens
gatgtggagccaggc

SEQ ID NO: 5750565 - DNA, 24 bp, Homo sapiens
gatgtggagctactgatgaaatct

SEQ ID NO: 5750566 - DNA, 17 bp, Homo sapiens
gatgtggaggaagagcc

SEQ ID NO: 5750567 - DNA, 21 bp, Homo sapiens
gatgtggaggaagagccacct

SEQ ID NO: 5750568 - DNA, 19 bp, Homo sapiens
gatgtggcaaagtgctgta

SEQ ID NO: 5750569 - DNA, 19 bp, Homo sapiens
gatgtggcaggagggcagt

SEQ ID NO: 5750570 - DNA, 23 bp, Homo sapiens
gatgtggcaggggcagtggcctg

SEQ ID NO: 5750571 - DNA, 20 bp, Homo sapiens
gatgtggccctggcctgctg

SEQ ID NO: 5750572 - DNA, 16 bp, Homo sapiens
gatgtggctgcagcag

SEQ ID NO: 5750573 - DNA, 23 bp, Homo sapiens
gatgtgggctcagatcctgggca

SEQ ID NO: 5750574 - DNA, 18 bp, Homo sapiens
gatgtggggctgagctgg

SEQ ID NO: 5750575 - DNA, 16 bp, Homo sapiens
gatgtgggtaagagga

SEQ ID NO: 5750576 - DNA, 18 bp, Homo sapiens
gatgtgggtccctctctt

SEQ ID NO: 5750577 - DNA, 16 bp, Homo sapiens
gatgtgggttccacag

SEQ ID NO: 5750578 - DNA, 22 bp, Homo sapiens
gatgtggtgaggcaggctttgt

SEQ ID NO: 5750579 - DNA, 22 bp, Homo sapiens
gatgtggttattttctccatgt

SEQ ID NO: 5750580 - DNA, 12 bp, Homo sapiens
gatgtgtaaaca

SEQ ID NO: 5750581 - DNA, 12 bp, Homo sapiens
gatgtgtacatc

SEQ ID NO: 5750582 - DNA, 18 bp, Homo sapiens
gatgtgtcctcagggagc

SEQ ID NO: 5750583 - DNA, 13 bp, Homo sapiens
gatgtgtcctgac

SEQ ID NO: 5750584 - DNA, 18 bp, Homo sapiens
gatgtgtcctgacactgc

SEQ ID NO: 5750585 - DNA, 22 bp, Homo sapiens
gatgtgtctcctgtttcagacc

SEQ ID NO: 5750586 - DNA, 14 bp, Homo sapiens
gatgtgtctgggag

SEQ ID NO: 5750587 - DNA, 17 bp, Homo sapiens
gatgtgtctgggagagc

SEQ ID NO: 5750588 - DNA, 17 bp, Homo sapiens
gatgtgtcttcaatttg

SEQ ID NO: 5750589 - DNA, 17 bp, Homo sapiens
gatgtgtgcaatgtggc

SEQ ID NO: 5750590 - DNA, 18 bp, Homo sapiens
gatgtgtggactgtggca

SEQ ID NO: 5750591 - DNA, 15 bp, Homo sapiens
gatgtgtggggcatg

SEQ ID NO: 5750592 - DNA, 14 bp, Homo sapiens
gatgtgtgtgtgtg

SEQ ID NO: 5750593 - DNA, 22 bp, Homo sapiens
gatgtgtgttgatactgttgca

SEQ ID NO: 5750594 - DNA, 23 bp, Homo sapiens
gatgtgtgttgatactgttgcac

SEQ ID NO: 5750595 - DNA, 17 bp, Homo sapiens
gatgtgtgttgtcagcc

SEQ ID NO: 5750596 - DNA, 19 bp, Homo sapiens
gatgtgtgttgtcagcctg

SEQ ID NO: 5750597 - DNA, 20 bp, Homo sapiens
gatgtgtgttgtcagcctgt

SEQ ID NO: 5750598 - DNA, 20 bp, Homo sapiens
gatgtgttattacttcctca

SEQ ID NO: 5750599 - DNA, 19 bp, Homo sapiens
gatgtgttcattcaagcta

SEQ ID NO: 5750600 - DNA, 22 bp, Homo sapiens
gatgtgttcattcaagctattt

SEQ ID NO: 5750601 - DNA, 23 bp, Homo sapiens
gatgtgttcattcaagctattta

SEQ ID NO: 5750602 - DNA, 19 bp, Homo sapiens
gatgtgttcctcctgctgt

SEQ ID NO: 5750603 - DNA, 12 bp, Homo sapiens
gatgtgttgtga

SEQ ID NO: 5750604 - DNA, 14 bp, Homo sapiens
gatgtgttgtgata

SEQ ID NO: 5750605 - DNA, 23 bp, Homo sapiens
gatgtgtttacatttactgaaat

SEQ ID NO: 5750606 - DNA, 16 bp, Homo sapiens
gatgtgtttgctttct

SEQ ID NO: 5750607 - DNA, 23 bp, Homo sapiens
gatgtgttttgcacgtcttgcta

SEQ ID NO: 5750608 - DNA, 13 bp, Homo sapiens
gatgtgtttttgt

SEQ ID NO: 5750609 - DNA, 22 bp, Homo sapiens
gatgttaaaaaaataagaagaa

SEQ ID NO: 5750610 - DNA, 15 bp, Homo sapiens
gatgttaaatgcctt

SEQ ID NO: 5750611 - DNA, 14 bp, Homo sapiens
gatgttaaatgtta

SEQ ID NO: 5750612 - DNA, 15 bp, Homo sapiens
gatgttaaatgttat

SEQ ID NO: 5750613 - DNA, 18 bp, Homo sapiens
gatgttaacacattttgt

SEQ ID NO: 5750614 - DNA, 19 bp, Homo sapiens
gatgttaacacattttgta

SEQ ID NO: 5750615 - DNA, 17 bp, Homo sapiens
gatgttaacagtatttt

SEQ ID NO: 5750616 - DNA, 19 bp, Homo sapiens
gatgttaatttactttctg

SEQ ID NO: 5750617 - DNA, 12 bp, Homo sapiens
gatgttacaagt

SEQ ID NO: 5750618 - DNA, 21 bp, Homo sapiens
gatgttacaagtttatatata

SEQ ID NO: 5750619 - DNA, 17 bp, Homo sapiens
gatgttacaagtttgct

SEQ ID NO: 5750620 - DNA, 20 bp, Homo sapiens
gatgttacaagtttgctaaa

SEQ ID NO: 5750621 - DNA, 16 bp, Homo sapiens
gatgttacattaggaa

SEQ ID NO: 5750622 - DNA, 22 bp, Homo sapiens
gatgttagcctgcaaacaacat

SEQ ID NO: 5750623 - DNA, 21 bp, Homo sapiens
gatgttagtgtttagataata

SEQ ID NO: 5750624 - DNA, 14 bp, Homo sapiens
gatgttagtgtttt

SEQ ID NO: 5750625 - DNA, 17 bp, Homo sapiens
gatgttagttttcctta

SEQ ID NO: 5750626 - DNA, 17 bp, Homo sapiens
gatgttatattaaagaa

SEQ ID NO: 5750627 - DNA, 23 bp, Homo sapiens
gatgttatgaacagctgtgtctg

SEQ ID NO: 5750628 - DNA, 22 bp, Homo sapiens
gatgttattactgttttgggcc

SEQ ID NO: 5750629 - DNA, 19 bp, Homo sapiens
gatgttattttgtacgtgt

SEQ ID NO: 5750630 - DNA, 13 bp, Homo sapiens
gatgttcaaatat

SEQ ID NO: 5750631 - DNA, 15 bp, Homo sapiens
gatgttcacctcctg

SEQ ID NO: 5750632 - DNA, 23 bp, Homo sapiens
gatgttcacctttatatatgtac

SEQ ID NO: 5750633 - DNA, 19 bp, Homo sapiens
gatgttcagattgctttga

SEQ ID NO: 5750634 - DNA, 20 bp, Homo sapiens
gatgttcagattgctttgat

SEQ ID NO: 5750635 - DNA, 22 bp, Homo sapiens
gatgttcagcactgtcccttgc

SEQ ID NO: 5750636 - DNA, 13 bp, Homo sapiens
gatgttcagtgta

SEQ ID NO: 5750637 - DNA, 15 bp, Homo sapiens
gatgttcatggaatt

SEQ ID NO: 5750638 - DNA, 16 bp, Homo sapiens
gatgttcatggaattg

SEQ ID NO: 5750639 - DNA, 20 bp, Homo sapiens
gatgttccttccagattgtg

SEQ ID NO: 5750640 - DNA, 14 bp, Homo sapiens
gatgttctaaggct

SEQ ID NO: 5750641 - DNA, 23 bp, Homo sapiens
gatgttctactttgttctgctgt

SEQ ID NO: 5750642 - DNA, 20 bp, Homo sapiens
gatgttctgcctctccctgg

SEQ ID NO: 5750643 - DNA, 21 bp, Homo sapiens
gatgttctgcctctccctggg

SEQ ID NO: 5750644 - DNA, 14 bp, Homo sapiens
gatgttctgggaca

SEQ ID NO: 5750645 - DNA, 16 bp, Homo sapiens
gatgttctgggacaca

SEQ ID NO: 5750646 - DNA, 22 bp, Homo sapiens
gatgttctgggctaatatactt

SEQ ID NO: 5750647 - DNA, 16 bp, Homo sapiens
gatgttctttccatga

SEQ ID NO: 5750648 - DNA, 13 bp, Homo sapiens
gatgttgaactgg

SEQ ID NO: 5750649 - DNA, 14 bp, Homo sapiens
gatgttgaactttt

SEQ ID NO: 5750650 - DNA, 18 bp, Homo sapiens
gatgttgaagaatacagt

SEQ ID NO: 5750651 - DNA, 16 bp, Homo sapiens
gatgttgagaaacctg

SEQ ID NO: 5750652 - DNA, 18 bp, Homo sapiens
gatgttgaggggaggagg

SEQ ID NO: 5750653 - DNA, 13 bp, Homo sapiens
gatgttgccatgt

SEQ ID NO: 5750654 - DNA, 17 bp, Homo sapiens
gatgttgccatgtgttt

SEQ ID NO: 5750655 - DNA, 12 bp, Homo sapiens
gatgttgctgtt

SEQ ID NO: 5750656 - DNA, 15 bp, Homo sapiens
gatgttgcttctgaa

SEQ ID NO: 5750657 - DNA, 21 bp, Homo sapiens
gatgttgcttctgaatcactg

SEQ ID NO: 5750658 - DNA, 22 bp, Homo sapiens
gatgttgcttttgaaaagttga

SEQ ID NO: 5750659 - DNA, 14 bp, Homo sapiens
gatgttggctggga

SEQ ID NO: 5750660 - DNA, 18 bp, Homo sapiens
gatgttggtcttggtcat

SEQ ID NO: 5750661 - DNA, 16 bp, Homo sapiens
gatgttgtgtattgtg

SEQ ID NO: 5750662 - DNA, 20 bp, Homo sapiens
gatgtttaacaaatctaatc

SEQ ID NO: 5750663 - DNA, 20 bp, Homo sapiens
gatgtttaatcaagagagac

SEQ ID NO: 5750664 - DNA, 13 bp, Homo sapiens
gatgtttacattt

SEQ ID NO: 5750665 - DNA, 14 bp, Homo sapiens
gatgtttacatttt

SEQ ID NO: 5750666 - DNA, 16 bp, Homo sapiens
gatgtttacctggtgc

SEQ ID NO: 5750667 - DNA, 19 bp, Homo sapiens
gatgtttacctggtgctcg

SEQ ID NO: 5750668 - DNA, 17 bp, Homo sapiens
gatgtttagatgaggtt

SEQ ID NO: 5750669 - DNA, 14 bp, Homo sapiens
gatgtttagtagct

SEQ ID NO: 5750670 - DNA, 17 bp, Homo sapiens
gatgtttagtagctgat

SEQ ID NO: 5750671 - DNA, 15 bp, Homo sapiens
gatgtttatatcaaa

SEQ ID NO: 5750672 - DNA, 20 bp, Homo sapiens
gatgtttatgttcttataga

SEQ ID NO: 5750673 - DNA, 19 bp, Homo sapiens
gatgtttattcttctagag

SEQ ID NO: 5750674 - DNA, 19 bp, Homo sapiens
gatgtttcattttactgta

SEQ ID NO: 5750675 - DNA, 12 bp, Homo sapiens
gatgtttccaga

SEQ ID NO: 5750676 - DNA, 16 bp, Homo sapiens
gatgtttccagctgcc

SEQ ID NO: 5750677 - DNA, 17 bp, Homo sapiens
gatgtttccctctcctt

SEQ ID NO: 5750678 - DNA, 18 bp, Homo sapiens
gatgtttccctctccttc

SEQ ID NO: 5750679 - DNA, 13 bp, Homo sapiens
gatgtttcctgga

SEQ ID NO: 5750680 - DNA, 12 bp, Homo sapiens
gatgtttctgtg

SEQ ID NO: 5750681 - DNA, 20 bp, Homo sapiens
gatgtttcttttgtatgtaa

SEQ ID NO: 5750682 - DNA, 17 bp, Homo sapiens
gatgtttggcaagaaat

SEQ ID NO: 5750683 - DNA, 13 bp, Homo sapiens
gatgtttgtggcc

SEQ ID NO: 5750684 - DNA, 15 bp, Homo sapiens
gatgtttgtggcctc

SEQ ID NO: 5750685 - DNA, 17 bp, Homo sapiens
gatgtttgtggcctcag

SEQ ID NO: 5750686 - DNA, 18 bp, Homo sapiens
gatgtttgtggcctcaga

SEQ ID NO: 5750687 - DNA, 10 bp, Homo sapiens
gatgtttgtt

SEQ ID NO: 5750688 - DNA, 14 bp, Homo sapiens
gatgttttaaaaaa

SEQ ID NO: 5750689 - DNA, 19 bp, Homo sapiens
gatgttttaaaaaaatttg

SEQ ID NO: 5750690 - DNA, 14 bp, Homo sapiens
gatgttttaactta

SEQ ID NO: 5750691 - DNA, 13 bp, Homo sapiens
gatgttttaattc

SEQ ID NO: 5750692 - DNA, 22 bp, Homo sapiens
gatgttttacgcaaggaaggac

SEQ ID NO: 5750693 - DNA, 23 bp, Homo sapiens
gatgttttagagataaatattta

SEQ ID NO: 5750694 - DNA, 16 bp, Homo sapiens
gatgttttagcatttt

SEQ ID NO: 5750695 - DNA, 17 bp, Homo sapiens
gatgttttatccttaca

SEQ ID NO: 5750696 - DNA, 14 bp, Homo sapiens
gatgttttccatga

SEQ ID NO: 5750697 - DNA, 23 bp, Homo sapiens
gatgttttccatgagtcccctgt

SEQ ID NO: 5750698 - DNA, 12 bp, Homo sapiens
gatgttttgcaa

SEQ ID NO: 5750699 - DNA, 18 bp, Homo sapiens
gatgttttgggatcagga

SEQ ID NO: 5750700 - DNA, 20 bp, Homo sapiens
gatgttttgggatcaggagc

SEQ ID NO: 5750701 - DNA, 21 bp, Homo sapiens
gatgttttgtataaaatctga

SEQ ID NO: 5750702 - DNA, 14 bp, Homo sapiens
gatgtttttcttta

SEQ ID NO: 5750703 - DNA, 21 bp, Homo sapiens
gatgttttttctgtaatgtaa

SEQ ID NO: 5750704 - DNA, 14 bp, Homo sapiens
gattaaaaaaattt

SEQ ID NO: 5750705 - DNA, 22 bp, Homo sapiens
gattaaaaatatcaaattaatt

SEQ ID NO: 5750706 - DNA, 14 bp, Homo sapiens
gattaaaaattata

SEQ ID NO: 5750707 - DNA, 13 bp, Homo sapiens
gattaaaatctct

SEQ ID NO: 5750708 - DNA, 12 bp, Homo sapiens
gattaaaccttt

SEQ ID NO: 5750709 - DNA, 12 bp, Homo sapiens
gattaaacttat

SEQ ID NO: 5750710 - DNA, 16 bp, Homo sapiens
gattaaagagattgtg

SEQ ID NO: 5750711 - DNA, 20 bp, Homo sapiens
gattaaagatgagctttgtc

SEQ ID NO: 5750712 - DNA, 22 bp, Homo sapiens
gattaaagattgctttatccag

SEQ ID NO: 5750713 - DNA, 18 bp, Homo sapiens
gattaaagctaaggacct

SEQ ID NO: 5750714 - DNA, 13 bp, Homo sapiens
gattaaaggaagg

SEQ ID NO: 5750715 - DNA, 16 bp, Homo sapiens
gattaaaggaaggaaa

SEQ ID NO: 5750716 - DNA, 17 bp, Homo sapiens
gattaaaggcagcattt

SEQ ID NO: 5750717 - DNA, 18 bp, Homo sapiens
gattaaaggcagcatttg

SEQ ID NO: 5750718 - DNA, 13 bp, Homo sapiens
gattaaatacata

SEQ ID NO: 5750719 - DNA, 19 bp, Homo sapiens
gattaaatacatatggatg

SEQ ID NO: 5750720 - DNA, 20 bp, Homo sapiens
gattaaatacatatggatgt

SEQ ID NO: 5750721 - DNA, 21 bp, Homo sapiens
gattaaatatatctttgtaaa

SEQ ID NO: 5750722 - DNA, 15 bp, Homo sapiens
gattaaatatttgaa

SEQ ID NO: 5750723 - DNA, 21 bp, Homo sapiens
gattaaatgacactcatataa

SEQ ID NO: 5750724 - DNA, 19 bp, Homo sapiens
gattaaatggcacctgtat

SEQ ID NO: 5750725 - DNA, 20 bp, Homo sapiens
gattaaatgtgtcattggaa

SEQ ID NO: 5750726 - DNA, 14 bp, Homo sapiens
gattaaattacagc

SEQ ID NO: 5750727 - DNA, 20 bp, Homo sapiens
gattaaattatatctgaggc

SEQ ID NO: 5750728 - DNA, 18 bp, Homo sapiens
gattaaattatcattgtt

SEQ ID NO: 5750729 - DNA, 20 bp, Homo sapiens
gattaaattatcattgtttg

SEQ ID NO: 5750730 - DNA, 17 bp, Homo sapiens
gattaaattctgggtga

SEQ ID NO: 5750731 - DNA, 13 bp, Homo sapiens
gattaacaaataa

SEQ ID NO: 5750732 - DNA, 13 bp, Homo sapiens
gattaacaaatat

SEQ ID NO: 5750733 - DNA, 16 bp, Homo sapiens
gattaacaaatatgct

SEQ ID NO: 5750734 - DNA, 14 bp, Homo sapiens
gattaacaatgtat

SEQ ID NO: 5750735 - DNA, 16 bp, Homo sapiens
gattaacaatgtattt

SEQ ID NO: 5750736 - DNA, 19 bp, Homo sapiens
gattaacaatgtattttaa

SEQ ID NO: 5750737 - DNA, 20 bp, Homo sapiens
gattaacactcatttccaat

SEQ ID NO: 5750738 - DNA, 19 bp, Homo sapiens
gattaacctaatgcagaat

SEQ ID NO: 5750739 - DNA, 14 bp, Homo sapiens
gattaacctctgca

SEQ ID NO: 5750740 - DNA, 22 bp, Homo sapiens
gattaacctgaaagaacataca

SEQ ID NO: 5750741 - DNA, 17 bp, Homo sapiens
gattaaccttttcaaat

SEQ ID NO: 5750742 - DNA, 12 bp, Homo sapiens
gattaacttgga

SEQ ID NO: 5750743 - DNA, 18 bp, Homo sapiens
gattaacttggatgagtt

SEQ ID NO: 5750744 - DNA, 16 bp, Homo sapiens
gattaactttcaaaag

SEQ ID NO: 5750745 - DNA, 20 bp, Homo sapiens
gattaactttcaaaagcaaa

SEQ ID NO: 5750746 - DNA, 13 bp, Homo sapiens
gattaagaaacct

SEQ ID NO: 5750747 - DNA, 16 bp, Homo sapiens
gattaagaaaggaagt

SEQ ID NO: 5750748 - DNA, 15 bp, Homo sapiens
gattaagatgtatat

SEQ ID NO: 5750749 - DNA, 12 bp, Homo sapiens
gattaagatttt

SEQ ID NO: 5750750 - DNA, 18 bp, Homo sapiens
gattaagattttacaaaa

SEQ ID NO: 5750751 - DNA, 21 bp, Homo sapiens
gattaagattttactttaaca

SEQ ID NO: 5750752 - DNA, 16 bp, Homo sapiens
gattaagcttttcatt

SEQ ID NO: 5750753 - DNA, 16 bp, Homo sapiens
gattaaggactacaga

SEQ ID NO: 5750754 - DNA, 16 bp, Homo sapiens
gattaaggtctctctt

SEQ ID NO: 5750755 - DNA, 22 bp, Homo sapiens
gattaagtaatgataactggaa

SEQ ID NO: 5750756 - DNA, 20 bp, Homo sapiens
gattaagttataccagcaaa

SEQ ID NO: 5750757 - DNA, 13 bp, Homo sapiens
gattaataaaata

SEQ ID NO: 5750758 - DNA, 14 bp, Homo sapiens
gattaataaaatat

SEQ ID NO: 5750759 - DNA, 21 bp, Homo sapiens
gattaataacagaaatacatc

SEQ ID NO: 5750760 - DNA, 17 bp, Homo sapiens
gattaatacaatattaa

SEQ ID NO: 5750761 - DNA, 14 bp, Homo sapiens
gattaatatattta

SEQ ID NO: 5750762 - DNA, 18 bp, Homo sapiens
gattaatatggggatgca

SEQ ID NO: 5750763 - DNA, 19 bp, Homo sapiens
gattaatctctaaaattct

SEQ ID NO: 5750764 - DNA, 20 bp, Homo sapiens
gattaatctctaaaattcta

SEQ ID NO: 5750765 - DNA, 22 bp, Homo sapiens
gattaatctctaaaattctagt

SEQ ID NO: 5750766 - DNA, 17 bp, Homo sapiens
gattaatctttaataac

SEQ ID NO: 5750767 - DNA, 12 bp, Homo sapiens
gattaatgaaaa

SEQ ID NO: 5750768 - DNA, 17 bp, Homo sapiens
gattaatgtacttttta

SEQ ID NO: 5750769 - DNA, 22 bp, Homo sapiens
gattaatgtcaatgttaatcag

SEQ ID NO: 5750770 - DNA, 23 bp, Homo sapiens
gattaatgtgtatttactgtact

SEQ ID NO: 5750771 - DNA, 17 bp, Homo sapiens
gattaatgttttcatta

SEQ ID NO: 5750772 - DNA, 15 bp, Homo sapiens
gattaatgttttgta

SEQ ID NO: 5750773 - DNA, 15 bp, Homo sapiens
gattaattaaatgca

SEQ ID NO: 5750774 - DNA, 19 bp, Homo sapiens
gattaattagttgattgct

SEQ ID NO: 5750775 - DNA, 19 bp, Homo sapiens
gattaatttatggtttctg

SEQ ID NO: 5750776 - DNA, 13 bp, Homo sapiens
gattaatttcatc

SEQ ID NO: 5750777 - DNA, 20 bp, Homo sapiens
gattaatttgagaattattc

SEQ ID NO: 5750778 - DNA, 23 bp, Homo sapiens
gattaatttgtgtagattgtgta

SEQ ID NO: 5750779 - DNA, 22 bp, Homo sapiens
gattacaaataaacagttgtta

SEQ ID NO: 5750780 - DNA, 20 bp, Homo sapiens
gattacaaatcagaagtcat

SEQ ID NO: 5750781 - DNA, 13 bp, Homo sapiens
gattacaagcgtg

SEQ ID NO: 5750782 - DNA, 16 bp, Homo sapiens
gattacaataaatcct

SEQ ID NO: 5750783 - DNA, 15 bp, Homo sapiens
gattacagaaactga

SEQ ID NO: 5750784 - DNA, 18 bp, Homo sapiens
gattacagaaactgatgc

SEQ ID NO: 5750785 - DNA, 18 bp, Homo sapiens
gattacagacatgagcca

SEQ ID NO: 5750786 - DNA, 13 bp, Homo sapiens
gattacagaggaa

SEQ ID NO: 5750787 - DNA, 19 bp, Homo sapiens
gattacaggaatgaagaac

SEQ ID NO: 5750788 - DNA, 16 bp, Homo sapiens
gattacaggcatgagc

SEQ ID NO: 5750789 - DNA, 22 bp, Homo sapiens
gattacaggcatgagccactgc

SEQ ID NO: 5750790 - DNA, 18 bp, Homo sapiens
gattacaggcatgtgcca

SEQ ID NO: 5750791 - DNA, 18 bp, Homo sapiens
gattacaggcgtgagcca

SEQ ID NO: 5750792 - DNA, 21 bp, Homo sapiens
gattacaggcttgaaagtcta

SEQ ID NO: 5750793 - DNA, 21 bp, Homo sapiens
gattacaggtgtgagccacag

SEQ ID NO: 5750794 - DNA, 23 bp, Homo sapiens
gattacaggtgtgagccactgca

SEQ ID NO: 5750795 - DNA, 22 bp, Homo sapiens
gattacaggtgtgagccactgt

SEQ ID NO: 5750796 - DNA, 11 bp, Homo sapiens
gattacataga

SEQ ID NO: 5750797 - DNA, 15 bp, Homo sapiens
gattacatagatcag

SEQ ID NO: 5750798 - DNA, 16 bp, Homo sapiens
gattacatgtatgttc

SEQ ID NO: 5750799 - DNA, 19 bp, Homo sapiens
gattaccagtctgattata

SEQ ID NO: 5750800 - DNA, 14 bp, Homo sapiens
gattacccaagcaa

SEQ ID NO: 5750801 - DNA, 21 bp, Homo sapiens
gattacccaagcaaaatcatg

SEQ ID NO: 5750802 - DNA, 22 bp, Homo sapiens
gattacctagtagtcatttcat

SEQ ID NO: 5750803 - DNA, 17 bp, Homo sapiens
gattacctcctgagaaa

SEQ ID NO: 5750804 - DNA, 20 bp, Homo sapiens
gattacctcctgtgtggaag

SEQ ID NO: 5750805 - DNA, 20 bp, Homo sapiens
gattacgtgtatgtttcttc

SEQ ID NO: 5750806 - DNA, 21 bp, Homo sapiens
gattactagtcaaacaaaaaa

SEQ ID NO: 5750807 - DNA, 18 bp, Homo sapiens
gattactcagagcagatg

SEQ ID NO: 5750808 - DNA, 23 bp, Homo sapiens
gattactctccatatcccttcct

SEQ ID NO: 5750809 - DNA, 23 bp, Homo sapiens
gattactctttgagatagaagaa

SEQ ID NO: 5750810 - DNA, 19 bp, Homo sapiens
gattactgacttttctttt

SEQ ID NO: 5750811 - DNA, 17 bp, Homo sapiens
gattactgtcaataaac

SEQ ID NO: 5750812 - DNA, 12 bp, Homo sapiens
gattacttaaat

SEQ ID NO: 5750813 - DNA, 19 bp, Homo sapiens
gattacttctctataaaaa

SEQ ID NO: 5750814 - DNA, 16 bp, Homo sapiens
gattagaaagaattag

SEQ ID NO: 5750815 - DNA, 21 bp, Homo sapiens
gattagaaatgaccaatatta

SEQ ID NO: 5750816 - DNA, 20 bp, Homo sapiens
gattagaaattacctgtgga

SEQ ID NO: 5750817 - DNA, 17 bp, Homo sapiens
gattagaatgaaaattg

SEQ ID NO: 5750818 - DNA, 19 bp, Homo sapiens
gattagacagaacacctat

SEQ ID NO: 5750819 - DNA, 18 bp, Homo sapiens
gattagacctttatccag

SEQ ID NO: 5750820 - DNA, 20 bp, Homo sapiens
gattagactggacagcttgt

SEQ ID NO: 5750821 - DNA, 13 bp, Homo sapiens
gattagagaccag

SEQ ID NO: 5750822 - DNA, 18 bp, Homo sapiens
gattagagagtgttgaaa

SEQ ID NO: 5750823 - DNA, 16 bp, Homo sapiens
gattagaggtttgtca

SEQ ID NO: 5750824 - DNA, 18 bp, Homo sapiens
gattagagtggttattca

SEQ ID NO: 5750825 - DNA, 19 bp, Homo sapiens
gattagagtggttattcat

SEQ ID NO: 5750826 - DNA, 23 bp, Homo sapiens
gattagataatcttttacattga

SEQ ID NO: 5750827 - DNA, 15 bp, Homo sapiens
gattagatgtgccaa

SEQ ID NO: 5750828 - DNA, 15 bp, Homo sapiens
gattagattgcaaag

SEQ ID NO: 5750829 - DNA, 16 bp, Homo sapiens
gattagattgcaaagc

SEQ ID NO: 5750830 - DNA, 14 bp, Homo sapiens
gattagcatgaaag

SEQ ID NO: 5750831 - DNA, 15 bp, Homo sapiens
gattagcctttgaca

SEQ ID NO: 5750832 - DNA, 13 bp, Homo sapiens
gattagctttatt

SEQ ID NO: 5750833 - DNA, 12 bp, Homo sapiens
gattagctttgt

SEQ ID NO: 5750834 - DNA, 19 bp, Homo sapiens
gattagctttgtcactgtt

SEQ ID NO: 5750835 - DNA, 14 bp, Homo sapiens
gattagctttgtgt

SEQ ID NO: 5750836 - DNA, 17 bp, Homo sapiens
gattagctttgtgtttg

SEQ ID NO: 5750837 - DNA, 14 bp, Homo sapiens
gattaggattaaaa

SEQ ID NO: 5750838 - DNA, 16 bp, Homo sapiens
gattaggattaaaatg

SEQ ID NO: 5750839 - DNA, 14 bp, Homo sapiens
gattaggcctggag

SEQ ID NO: 5750840 - DNA, 23 bp, Homo sapiens
gattaggcctggagttgggctgg

SEQ ID NO: 5750841 - DNA, 16 bp, Homo sapiens
gattagggaaaatgga

SEQ ID NO: 5750842 - DNA, 13 bp, Homo sapiens
gattaggtaacgt

SEQ ID NO: 5750843 - DNA, 11 bp, Homo sapiens
gattaggtatg

SEQ ID NO: 5750844 - DNA, 17 bp, Homo sapiens
gattaggtatgtttgta

SEQ ID NO: 5750845 - DNA, 15 bp, Homo sapiens
gattaggtgtaagac

SEQ ID NO: 5750846 - DNA, 19 bp, Homo sapiens
gattagtaaatatgtgaag

SEQ ID NO: 5750847 - DNA, 22 bp, Homo sapiens
gattagtaaatatgtgaagaaa

SEQ ID NO: 5750848 - DNA, 19 bp, Homo sapiens
gattagtagaaaatacatt

SEQ ID NO: 5750849 - DNA, 17 bp, Homo sapiens
gattagtagtaaatgct

SEQ ID NO: 5750850 - DNA, 17 bp, Homo sapiens
gattagtataatatttc

SEQ ID NO: 5750851 - DNA, 21 bp, Homo sapiens
gattagtataatatttcttaa

SEQ ID NO: 5750852 - DNA, 22 bp, Homo sapiens
gattagtgtagtgttaaagtga

SEQ ID NO: 5750853 - DNA, 18 bp, Homo sapiens
gattagttgacagtatta

SEQ ID NO: 5750854 - DNA, 12 bp, Homo sapiens
gattagttggac

SEQ ID NO: 5750855 - DNA, 14 bp, Homo sapiens
gattagtttagaac

SEQ ID NO: 5750856 - DNA, 22 bp, Homo sapiens
gattagttttcttgttgctttg

SEQ ID NO: 5750857 - DNA, 15 bp, Homo sapiens
gattataaaaaatgt

SEQ ID NO: 5750858 - DNA, 23 bp, Homo sapiens
gattataaaaaatgtaacatcat

SEQ ID NO: 5750859 - DNA, 16 bp, Homo sapiens
gattataaaaatgaat

SEQ ID NO: 5750860 - DNA, 20 bp, Homo sapiens
gattataaaattaatcacaa

SEQ ID NO: 5750861 - DNA, 12 bp, Homo sapiens
gattataaatgt

SEQ ID NO: 5750862 - DNA, 14 bp, Homo sapiens
gattataataaatt

SEQ ID NO: 5750863 - DNA, 14 bp, Homo sapiens
gattataatgctat

SEQ ID NO: 5750864 - DNA, 13 bp, Homo sapiens
gattataattgtt

SEQ ID NO: 5750865 - DNA, 13 bp, Homo sapiens
gattatagattct

SEQ ID NO: 5750866 - DNA, 21 bp, Homo sapiens
gattatagcaatgtgattttg

SEQ ID NO: 5750867 - DNA, 23 bp, Homo sapiens
gattatagcaatgtgattttgta

SEQ ID NO: 5750868 - DNA, 23 bp, Homo sapiens
gattatagtaactataagataca

SEQ ID NO: 5750869 - DNA, 21 bp, Homo sapiens
gattatagttgtgggtgggag

SEQ ID NO: 5750870 - DNA, 15 bp, Homo sapiens
gattatatatcataa

SEQ ID NO: 5750871 - DNA, 19 bp, Homo sapiens
gattatatatcataaagta

SEQ ID NO: 5750872 - DNA, 20 bp, Homo sapiens
gattatatatcataaagtat

SEQ ID NO: 5750873 - DNA, 14 bp, Homo sapiens
gattatatgaagtt

SEQ ID NO: 5750874 - DNA, 19 bp, Homo sapiens
gattatattgagacaaaaa

SEQ ID NO: 5750875 - DNA, 23 bp, Homo sapiens
gattatcagtatcacgatttgca

SEQ ID NO: 5750876 - DNA, 13 bp, Homo sapiens
gattatcgttttc

SEQ ID NO: 5750877 - DNA, 20 bp, Homo sapiens
gattatcgttttcttaaagt

SEQ ID NO: 5750878 - DNA, 21 bp, Homo sapiens
gattatcgttttcttaaagtg

SEQ ID NO: 5750879 - DNA, 21 bp, Homo sapiens
gattatctctttgatctactt

SEQ ID NO: 5750880 - DNA, 20 bp, Homo sapiens
gattatctgattcctttaaa

SEQ ID NO: 5750881 - DNA, 16 bp, Homo sapiens
gattatgactaaagta

SEQ ID NO: 5750882 - DNA, 22 bp, Homo sapiens
gattatgattagttatgtcttt

SEQ ID NO: 5750883 - DNA, 17 bp, Homo sapiens
gattatggaaaaataaa

SEQ ID NO: 5750884 - DNA, 18 bp, Homo sapiens
gattatggaaaaataaaa

SEQ ID NO: 5750885 - DNA, 17 bp, Homo sapiens
gattatggcctttttaa

SEQ ID NO: 5750886 - DNA, 13 bp, Homo sapiens
gattatgggtcct

SEQ ID NO: 5750887 - DNA, 17 bp, Homo sapiens
gattatggttttgtgat

SEQ ID NO: 5750888 - DNA, 14 bp, Homo sapiens
gattatgtattaac

SEQ ID NO: 5750889 - DNA, 21 bp, Homo sapiens
gattatgtattaacttgtaga

SEQ ID NO: 5750890 - DNA, 20 bp, Homo sapiens
gattatgtcttttatatttg

SEQ ID NO: 5750891 - DNA, 21 bp, Homo sapiens
gattatgtcttttatatttgt

SEQ ID NO: 5750892 - DNA, 12 bp, Homo sapiens
gattatgtgact

SEQ ID NO: 5750893 - DNA, 17 bp, Homo sapiens
gattattactaattcta

SEQ ID NO: 5750894 - DNA, 19 bp, Homo sapiens
gattattacttctgtttct

SEQ ID NO: 5750895 - DNA, 16 bp, Homo sapiens
gattattatgtttatt

SEQ ID NO: 5750896 - DNA, 19 bp, Homo sapiens
gattattatgtttattaca

SEQ ID NO: 5750897 - DNA, 18 bp, Homo sapiens
gattattatttgtacttt

SEQ ID NO: 5750898 - DNA, 22 bp, Homo sapiens
gattattcactgatttgacata

SEQ ID NO: 5750899 - DNA, 13 bp, Homo sapiens
gattattcagtgt

SEQ ID NO: 5750900 - DNA, 15 bp, Homo sapiens
gattattcagtgtca

SEQ ID NO: 5750901 - DNA, 13 bp, Homo sapiens
gattattcattta

SEQ ID NO: 5750902 - DNA, 16 bp, Homo sapiens
gattattcatttaaaa

SEQ ID NO: 5750903 - DNA, 20 bp, Homo sapiens
gattattcatttaaaatgat

SEQ ID NO: 5750904 - DNA, 22 bp, Homo sapiens
gattattcatttaaaatgatta

SEQ ID NO: 5750905 - DNA, 23 bp, Homo sapiens
gattattccctgtacaatattta

SEQ ID NO: 5750906 - DNA, 19 bp, Homo sapiens
gattattcttcttacatta

SEQ ID NO: 5750907 - DNA, 13 bp, Homo sapiens
gattattgaaata

SEQ ID NO: 5750908 - DNA, 21 bp, Homo sapiens
gattattgagttccagttgaa

SEQ ID NO: 5750909 - DNA, 19 bp, Homo sapiens
gattattggctgctttgcc

SEQ ID NO: 5750910 - DNA, 23 bp, Homo sapiens
gattattggctgctttgcctcta

SEQ ID NO: 5750911 - DNA, 23 bp, Homo sapiens
gattattgtctgattgaaacatg

SEQ ID NO: 5750912 - DNA, 12 bp, Homo sapiens
gattatttaata

SEQ ID NO: 5750913 - DNA, 13 bp, Homo sapiens
gattatttaataa

SEQ ID NO: 5750914 - DNA, 16 bp, Homo sapiens
gattatttatttctgt

SEQ ID NO: 5750915 - DNA, 14 bp, Homo sapiens
gattatttcacttt

SEQ ID NO: 5750916 - DNA, 22 bp, Homo sapiens
gattatttcactttagatgctg

SEQ ID NO: 5750917 - DNA, 16 bp, Homo sapiens
gattatttcatatact

SEQ ID NO: 5750918 - DNA, 19 bp, Homo sapiens
gattatttcatatactata

SEQ ID NO: 5750919 - DNA, 11 bp, Homo sapiens
gattatttgca

SEQ ID NO: 5750920 - DNA, 13 bp, Homo sapiens
gattatttgcatg

SEQ ID NO: 5750921 - DNA, 17 bp, Homo sapiens
gattatttgcatgttat

SEQ ID NO: 5750922 - DNA, 18 bp, Homo sapiens
gattatttgggagggaaa

SEQ ID NO: 5750923 - DNA, 21 bp, Homo sapiens
gattatttgttatttgtacag

SEQ ID NO: 5750924 - DNA, 16 bp, Homo sapiens
gattattttagctaaa

SEQ ID NO: 5750925 - DNA, 18 bp, Homo sapiens
gattattttagtctgtca

SEQ ID NO: 5750926 - DNA, 20 bp, Homo sapiens
gattattttagtctgtcatc

SEQ ID NO: 5750927 - DNA, 16 bp, Homo sapiens
gattattttcagaagc

SEQ ID NO: 5750928 - DNA, 14 bp, Homo sapiens
gattattttctata

SEQ ID NO: 5750929 - DNA, 23 bp, Homo sapiens
gattattttggaaagtttttgta

SEQ ID NO: 5750930 - DNA, 14 bp, Homo sapiens
gattattttttcag

SEQ ID NO: 5750931 - DNA, 18 bp, Homo sapiens
gattattttttcagaccg

SEQ ID NO: 5750932 - DNA, 21 bp, Homo sapiens
gattattttttcagaccgaaa

SEQ ID NO: 5750933 - DNA, 18 bp, Homo sapiens
gattcaaaatatttaaaa

SEQ ID NO: 5750934 - DNA, 18 bp, Homo sapiens
gattcaaaccaaagctgc

SEQ ID NO: 5750935 - DNA, 19 bp, Homo sapiens
gattcaaaccaaagctgcc

SEQ ID NO: 5750936 - DNA, 21 bp, Homo sapiens
gattcaaaccaaagctgcctg

SEQ ID NO: 5750937 - DNA, 22 bp, Homo sapiens
gattcaaaccaaagctgcctgt

SEQ ID NO: 5750938 - DNA, 16 bp, Homo sapiens
gattcaaacccaggct

SEQ ID NO: 5750939 - DNA, 19 bp, Homo sapiens
gattcaaactgctccaagt

SEQ ID NO: 5750940 - DNA, 13 bp, Homo sapiens
gattcaaaggttc

SEQ ID NO: 5750941 - DNA, 15 bp, Homo sapiens
gattcaaaggttcta

SEQ ID NO: 5750942 - DNA, 16 bp, Homo sapiens
gattcaaagtagtttt

SEQ ID NO: 5750943 - DNA, 22 bp, Homo sapiens
gattcaaagtgttgtgttcctg

SEQ ID NO: 5750944 - DNA, 21 bp, Homo sapiens
gattcaaataaccctgaatca

SEQ ID NO: 5750945 - DNA, 21 bp, Homo sapiens
gattcaaatatcaaaaggaag

SEQ ID NO: 5750946 - DNA, 14 bp, Homo sapiens
gattcaaatgtttt

SEQ ID NO: 5750947 - DNA, 18 bp, Homo sapiens
gattcaaatgttttaaag

SEQ ID NO: 5750948 - DNA, 10 bp, Homo sapiens
gattcaaatt

SEQ ID NO: 5750949 - DNA, 18 bp, Homo sapiens
gattcaaattgctgcttg

SEQ ID NO: 5750950 - DNA, 16 bp, Homo sapiens
gattcaagaacaagca

SEQ ID NO: 5750951 - DNA, 23 bp, Homo sapiens
gattcaagacaagagctgttatg

SEQ ID NO: 5750952 - DNA, 22 bp, Homo sapiens
gattcaagactcaatgtggaaa

SEQ ID NO: 5750953 - DNA, 20 bp, Homo sapiens
gattcaatctgtaaactgtg

SEQ ID NO: 5750954 - DNA, 21 bp, Homo sapiens
gattcaatctgtaaactgtgt

SEQ ID NO: 5750955 - DNA, 18 bp, Homo sapiens
gattcaatgcctctggct

SEQ ID NO: 5750956 - DNA, 11 bp, Homo sapiens
gattcaatgtg

SEQ ID NO: 5750957 - DNA, 22 bp, Homo sapiens
gattcacaactaggacctcata

SEQ ID NO: 5750958 - DNA, 18 bp, Homo sapiens
gattcacaatgaaatgct

SEQ ID NO: 5750959 - DNA, 22 bp, Homo sapiens
gattcacaatgaaatgctctcc

SEQ ID NO: 5750960 - DNA, 21 bp, Homo sapiens
gattcacacatgccactatga

SEQ ID NO: 5750961 - DNA, 17 bp, Homo sapiens
gattcacaccccacctg

SEQ ID NO: 5750962 - DNA, 13 bp, Homo sapiens
gattcacagcctc

SEQ ID NO: 5750963 - DNA, 16 bp, Homo sapiens
gattcacatctcattt

SEQ ID NO: 5750964 - DNA, 19 bp, Homo sapiens
gattcacatgttttcaaat

SEQ ID NO: 5750965 - DNA, 20 bp, Homo sapiens
gattcacccccctctgctgc

SEQ ID NO: 5750966 - DNA, 19 bp, Homo sapiens
gattcacctcctaaaacaa

SEQ ID NO: 5750967 - DNA, 14 bp, Homo sapiens
gattcacctcttcc

SEQ ID NO: 5750968 - DNA, 18 bp, Homo sapiens
gattcacctgtaaaactt

SEQ ID NO: 5750969 - DNA, 22 bp, Homo sapiens
gattcacctgtaaaactttatt

SEQ ID NO: 5750970 - DNA, 15 bp, Homo sapiens
gattcacgcttttgt

SEQ ID NO: 5750971 - DNA, 15 bp, Homo sapiens
gattcactatttaaa

SEQ ID NO: 5750972 - DNA, 17 bp, Homo sapiens
gattcactgtcttttga

SEQ ID NO: 5750973 - DNA, 23 bp, Homo sapiens
gattcagaaaatgttctgtttgc

SEQ ID NO: 5750974 - DNA, 18 bp, Homo sapiens
gattcagaaatgaggcca

SEQ ID NO: 5750975 - DNA, 12 bp, Homo sapiens
gattcagaaatt

SEQ ID NO: 5750976 - DNA, 15 bp, Homo sapiens
gattcagaatgagaa

SEQ ID NO: 5750977 - DNA, 13 bp, Homo sapiens
gattcagacagct

SEQ ID NO: 5750978 - DNA, 18 bp, Homo sapiens
gattcagactgcttcatt

SEQ ID NO: 5750979 - DNA, 15 bp, Homo sapiens
gattcagatcgaaat

SEQ ID NO: 5750980 - DNA, 18 bp, Homo sapiens
gattcagattgttatcta

SEQ ID NO: 5750981 - DNA, 12 bp, Homo sapiens
gattcagcagtg

SEQ ID NO: 5750982 - DNA, 15 bp, Homo sapiens
gattcagcagtgtct

SEQ ID NO: 5750983 - DNA, 13 bp, Homo sapiens
gattcagccttct

SEQ ID NO: 5750984 - DNA, 15 bp, Homo sapiens
gattcagccttcttt

SEQ ID NO: 5750985 - DNA, 23 bp, Homo sapiens
gattcagcgaagtctcatgggaa

SEQ ID NO: 5750986 - DNA, 15 bp, Homo sapiens
gattcagctctgcaa

SEQ ID NO: 5750987 - DNA, 19 bp, Homo sapiens
gattcaggaaaaggcctgg

SEQ ID NO: 5750988 - DNA, 21 bp, Homo sapiens
gattcaggaaaaggcctgggg

SEQ ID NO: 5750989 - DNA, 23 bp, Homo sapiens
gattcaggaaaaggcctggggtg

SEQ ID NO: 5750990 - DNA, 13 bp, Homo sapiens
gattcaggaatgt

SEQ ID NO: 5750991 - DNA, 15 bp, Homo sapiens
gattcaggagctcag

SEQ ID NO: 5750992 - DNA, 17 bp, Homo sapiens
gattcaggagctcagtt

SEQ ID NO: 5750993 - DNA, 19 bp, Homo sapiens
gattcaggagttttaatgt

SEQ ID NO: 5750994 - DNA, 18 bp, Homo sapiens
gattcaggccagcccagc

SEQ ID NO: 5750995 - DNA, 21 bp, Homo sapiens
gattcaggcctctgaggagcc

SEQ ID NO: 5750996 - DNA, 12 bp, Homo sapiens
gattcaggctgc

SEQ ID NO: 5750997 - DNA, 17 bp, Homo sapiens
gattcaggggctttggg

SEQ ID NO: 5750998 - DNA, 22 bp, Homo sapiens
gattcaggggctttgggcccaa

SEQ ID NO: 5750999 - DNA, 17 bp, Homo sapiens
gattcagggttatttga

SEQ ID NO: 5751000 - DNA, 18 bp, Homo sapiens
gattcaggtgcagaggaa

SEQ ID NO: 5751001 - DNA, 20 bp, Homo sapiens
gattcaggtgcagaggaagt

SEQ ID NO: 5751002 - DNA, 14 bp, Homo sapiens
gattcagtcacatg

SEQ ID NO: 5751003 - DNA, 22 bp, Homo sapiens
gattcagtcacatggcatggtt

SEQ ID NO: 5751004 - DNA, 14 bp, Homo sapiens
gattcagtcttgcc

SEQ ID NO: 5751005 - DNA, 20 bp, Homo sapiens
gattcagtttaagagttttc

SEQ ID NO: 5751006 - DNA, 11 bp, Homo sapiens
gattcataaca

SEQ ID NO: 5751007 - DNA, 19 bp, Homo sapiens
gattcatagtaacttctta

SEQ ID NO: 5751008 - DNA, 13 bp, Homo sapiens
gattcatcctggg

SEQ ID NO: 5751009 - DNA, 22 bp, Homo sapiens
gattcatcctgggatgtaaacc

SEQ ID NO: 5751010 - DNA, 15 bp, Homo sapiens
gattcatctatggag

SEQ ID NO: 5751011 - DNA, 17 bp, Homo sapiens
gattcatctatggaggg

SEQ ID NO: 5751012 - DNA, 22 bp, Homo sapiens
gattcatggagtagcctggact

SEQ ID NO: 5751013 - DNA, 23 bp, Homo sapiens
gattcatggagtagcctggactg

SEQ ID NO: 5751014 - DNA, 18 bp, Homo sapiens
gattcatggctttgtatc

SEQ ID NO: 5751015 - DNA, 18 bp, Homo sapiens
gattcatgtagagagaca

SEQ ID NO: 5751016 - DNA, 20 bp, Homo sapiens
gattcatgtgcttgtgccta

SEQ ID NO: 5751017 - DNA, 22 bp, Homo sapiens
gattcatgtttagccagtgttt

SEQ ID NO: 5751018 - DNA, 17 bp, Homo sapiens
gattcattaactcaaat

SEQ ID NO: 5751019 - DNA, 18 bp, Homo sapiens
gattcattgtttgtttta

SEQ ID NO: 5751020 - DNA, 13 bp, Homo sapiens
gattcatttcctg

SEQ ID NO: 5751021 - DNA, 10 bp, Homo sapiens
gattcatttt

SEQ ID NO: 5751022 - DNA, 18 bp, Homo sapiens
gattccaaaaagcacata

SEQ ID NO: 5751023 - DNA, 16 bp, Homo sapiens
gattccaaaccaggac

SEQ ID NO: 5751024 - DNA, 23 bp, Homo sapiens
gattccaaagagtagaattgcat

SEQ ID NO: 5751025 - DNA, 13 bp, Homo sapiens
gattccaaagcat

SEQ ID NO: 5751026 - DNA, 13 bp, Homo sapiens
gattccaaataaa

SEQ ID NO: 5751027 - DNA, 23 bp, Homo sapiens
gattccaaggctttaaagctgag

SEQ ID NO: 5751028 - DNA, 16 bp, Homo sapiens
gattccaagggcccag

SEQ ID NO: 5751029 - DNA, 20 bp, Homo sapiens
gattccaagttctcacctct

SEQ ID NO: 5751030 - DNA, 16 bp, Homo sapiens
gattccacacaaaatg

SEQ ID NO: 5751031 - DNA, 19 bp, Homo sapiens
gattccacacaaaatgtca

SEQ ID NO: 5751032 - DNA, 15 bp, Homo sapiens
gattccacaggacac

SEQ ID NO: 5751033 - DNA, 21 bp, Homo sapiens
gattccactgaaacctctgtt

SEQ ID NO: 5751034 - DNA, 22 bp, Homo sapiens
gattccactgaaacctctgttc

SEQ ID NO: 5751035 - DNA, 19 bp, Homo sapiens
gattccagaacgccctgtg

SEQ ID NO: 5751036 - DNA, 21 bp, Homo sapiens
gattccagaacgccctgtgtc

SEQ ID NO: 5751037 - DNA, 17 bp, Homo sapiens
gattccaggtggcatca

SEQ ID NO: 5751038 - DNA, 21 bp, Homo sapiens
gattccagtgcagtagtgcca

SEQ ID NO: 5751039 - DNA, 21 bp, Homo sapiens
gattccatgtgaaaataaaat

SEQ ID NO: 5751040 - DNA, 15 bp, Homo sapiens
gattcccaagctccc

SEQ ID NO: 5751041 - DNA, 19 bp, Homo sapiens
gattcccaagctctgctcc

SEQ ID NO: 5751042 - DNA, 16 bp, Homo sapiens
gattcccacatttgtc

SEQ ID NO: 5751043 - DNA, 11 bp, Homo sapiens
gattcccagag

SEQ ID NO: 5751044 - DNA, 12 bp, Homo sapiens
gattcccagaga

SEQ ID NO: 5751045 - DNA, 14 bp, Homo sapiens
gattcccagagaca

SEQ ID NO: 5751046 - DNA, 14 bp, Homo sapiens
gattcccagagaga

SEQ ID NO: 5751047 - DNA, 15 bp, Homo sapiens
gattcccagagcaga

SEQ ID NO: 5751048 - DNA, 19 bp, Homo sapiens
gattcccaggagttctgct

SEQ ID NO: 5751049 - DNA, 21 bp, Homo sapiens
gattcccaggagttctgctca

SEQ ID NO: 5751050 - DNA, 17 bp, Homo sapiens
gattccccattgcctcc

SEQ ID NO: 5751051 - DNA, 22 bp, Homo sapiens
gattccccattgcctcctcctt

SEQ ID NO: 5751052 - DNA, 16 bp, Homo sapiens
gattccccggagctgg

SEQ ID NO: 5751053 - DNA, 20 bp, Homo sapiens
gattccccggagctgggaag

SEQ ID NO: 5751054 - DNA, 23 bp, Homo sapiens
gattcccctggaccacacctccg

SEQ ID NO: 5751055 - DNA, 15 bp, Homo sapiens
gattcccctgtgtca

SEQ ID NO: 5751056 - DNA, 18 bp, Homo sapiens
gattcccggctggacttt

SEQ ID NO: 5751057 - DNA, 12 bp, Homo sapiens
gattccctctcc

SEQ ID NO: 5751058 - DNA, 13 bp, Homo sapiens
gattccctgtccc

SEQ ID NO: 5751059 - DNA, 16 bp, Homo sapiens
gattcccttgttattc

SEQ ID NO: 5751060 - DNA, 17 bp, Homo sapiens
gattccgcaccctgcct

SEQ ID NO: 5751061 - DNA, 16 bp, Homo sapiens
gattccgcagtgagag

SEQ ID NO: 5751062 - DNA, 18 bp, Homo sapiens
gattccggatcctaagca

SEQ ID NO: 5751063 - DNA, 17 bp, Homo sapiens
gattccggccctggctg

SEQ ID NO: 5751064 - DNA, 23 bp, Homo sapiens
gattcctaagcagtgcttgtaaa

SEQ ID NO: 5751065 - DNA, 15 bp, Homo sapiens
gattcctaaggccca

SEQ ID NO: 5751066 - DNA, 16 bp, Homo sapiens
gattcctaaggcccag

SEQ ID NO: 5751067 - DNA, 17 bp, Homo sapiens
gattcctaaggcccagc

SEQ ID NO: 5751068 - DNA, 17 bp, Homo sapiens
gattcctacccctcttc

SEQ ID NO: 5751069 - DNA, 21 bp, Homo sapiens
gattcctacttaaacaaaaac

SEQ ID NO: 5751070 - DNA, 16 bp, Homo sapiens
gattcctattactgca

SEQ ID NO: 5751071 - DNA, 20 bp, Homo sapiens
gattcctccccaccctgtcc

SEQ ID NO: 5751072 - DNA, 17 bp, Homo sapiens
gattcctcccccagagc

SEQ ID NO: 5751073 - DNA, 18 bp, Homo sapiens
gattcctcccctggaagt

SEQ ID NO: 5751074 - DNA, 22 bp, Homo sapiens
gattcctcgcgacatcttctca

SEQ ID NO: 5751075 - DNA, 14 bp, Homo sapiens
gattcctctcattt

SEQ ID NO: 5751076 - DNA, 13 bp, Homo sapiens
gattcctgaccca

SEQ ID NO: 5751077 - DNA, 16 bp, Homo sapiens
gattcctgacccaggc

SEQ ID NO: 5751078 - DNA, 14 bp, Homo sapiens
gattcctgctgcct

SEQ ID NO: 5751079 - DNA, 16 bp, Homo sapiens
gattcctgggcaagaa

SEQ ID NO: 5751080 - DNA, 15 bp, Homo sapiens
gattcctgggcctgt

SEQ ID NO: 5751081 - DNA, 10 bp, Homo sapiens
gattcctggt

SEQ ID NO: 5751082 - DNA, 18 bp, Homo sapiens
gattccttagactctttt

SEQ ID NO: 5751083 - DNA, 13 bp, Homo sapiens
gattccttcccat

SEQ ID NO: 5751084 - DNA, 17 bp, Homo sapiens
gattccttggcagccgg

SEQ ID NO: 5751085 - DNA, 14 bp, Homo sapiens
gattcctttaacaa

SEQ ID NO: 5751086 - DNA, 20 bp, Homo sapiens
gattcctttaacaacatgtt

SEQ ID NO: 5751087 - DNA, 20 bp, Homo sapiens
gattcctttccctttagcac

SEQ ID NO: 5751088 - DNA, 14 bp, Homo sapiens
gattcctttcctgt

SEQ ID NO: 5751089 - DNA, 17 bp, Homo sapiens
gattcctttgaagagga

SEQ ID NO: 5751090 - DNA, 21 bp, Homo sapiens
gattcctttgaagaggaaaat

SEQ ID NO: 5751091 - DNA, 20 bp, Homo sapiens
gattcctttggccactgtat

SEQ ID NO: 5751092 - DNA, 22 bp, Homo sapiens
gattccttttgatggggagaaa

SEQ ID NO: 5751093 - DNA, 23 bp, Homo sapiens
gattccttttgatggggagaaag

SEQ ID NO: 5751094 - DNA, 16 bp, Homo sapiens
gattcgaatgacactg

SEQ ID NO: 5751095 - DNA, 17 bp, Homo sapiens
gattcgaatgacactgt

SEQ ID NO: 5751096 - DNA, 12 bp, Homo sapiens
gattcgctgtcc

SEQ ID NO: 5751097 - DNA, 13 bp, Homo sapiens
gattcgctgtccc

SEQ ID NO: 5751098 - DNA, 15 bp, Homo sapiens
gattcgctgtcccct

SEQ ID NO: 5751099 - DNA, 20 bp, Homo sapiens
gattcgctgtcccctcagcg

SEQ ID NO: 5751100 - DNA, 13 bp, Homo sapiens
gattcggctgtct

SEQ ID NO: 5751101 - DNA, 16 bp, Homo sapiens
gattcggggctgacct

SEQ ID NO: 5751102 - DNA, 19 bp, Homo sapiens
gattcgtctgcgattttat

SEQ ID NO: 5751103 - DNA, 20 bp, Homo sapiens
gattcgtctgcgattttatc

SEQ ID NO: 5751104 - DNA, 18 bp, Homo sapiens
gattcgtggtcttttcct

SEQ ID NO: 5751105 - DNA, 12 bp, Homo sapiens
gattctaaaaca

SEQ ID NO: 5751106 - DNA, 14 bp, Homo sapiens
gattctaaaacatt

SEQ ID NO: 5751107 - DNA, 22 bp, Homo sapiens
gattctaaaatgtgatgttcta

SEQ ID NO: 5751108 - DNA, 13 bp, Homo sapiens
gattctaaagatt

SEQ ID NO: 5751109 - DNA, 15 bp, Homo sapiens
gattctaaagattct

SEQ ID NO: 5751110 - DNA, 16 bp, Homo sapiens
gattctaaagctcaat

SEQ ID NO: 5751111 - DNA, 18 bp, Homo sapiens
gattctaaaggggacaga

SEQ ID NO: 5751112 - DNA, 13 bp, Homo sapiens
gattctaaataca

SEQ ID NO: 5751113 - DNA, 14 bp, Homo sapiens
gattctaaatacat

SEQ ID NO: 5751114 - DNA, 14 bp, Homo sapiens
gattctaaggactc

SEQ ID NO: 5751115 - DNA, 23 bp, Homo sapiens
gattctaccacacagcagcagtt

SEQ ID NO: 5751116 - DNA, 22 bp, Homo sapiens
gattctaccgtaattgctttgt

SEQ ID NO: 5751117 - DNA, 18 bp, Homo sapiens
gattctagatcagatgct

SEQ ID NO: 5751118 - DNA, 21 bp, Homo sapiens
gattctagatcagatgctcca

SEQ ID NO: 5751119 - DNA, 21 bp, Homo sapiens
gattctagcacatcatggcag

SEQ ID NO: 5751120 - DNA, 20 bp, Homo sapiens
gattctagccaaactattct

SEQ ID NO: 5751121 - DNA, 17 bp, Homo sapiens
gattctagcctgcactt

SEQ ID NO: 5751122 - DNA, 13 bp, Homo sapiens
gattctaggacct

SEQ ID NO: 5751123 - DNA, 15 bp, Homo sapiens
gattctatagttcta

SEQ ID NO: 5751124 - DNA, 14 bp, Homo sapiens
gattctatatttca

SEQ ID NO: 5751125 - DNA, 18 bp, Homo sapiens
gattctatatttcatatt

SEQ ID NO: 5751126 - DNA, 22 bp, Homo sapiens
gattctatgcctgtatttccaa

SEQ ID NO: 5751127 - DNA, 18 bp, Homo sapiens
gattctatgtaatgtaaa

SEQ ID NO: 5751128 - DNA, 22 bp, Homo sapiens
gattctatgtaatgtaaaccag

SEQ ID NO: 5751129 - DNA, 17 bp, Homo sapiens
gattctatttaattgaa

SEQ ID NO: 5751130 - DNA, 11 bp, Homo sapiens
gattctcagat

SEQ ID NO: 5751131 - DNA, 15 bp, Homo sapiens
gattctcagggctgg

SEQ ID NO: 5751132 - DNA, 17 bp, Homo sapiens
gattctcagggtctctg

SEQ ID NO: 5751133 - DNA, 15 bp, Homo sapiens
gattctcatgtctca

SEQ ID NO: 5751134 - DNA, 16 bp, Homo sapiens
gattctcccaaagtac

SEQ ID NO: 5751135 - DNA, 20 bp, Homo sapiens
gattctcccgcctcagcctc

SEQ ID NO: 5751136 - DNA, 12 bp, Homo sapiens
gattctccctgg

SEQ ID NO: 5751137 - DNA, 14 bp, Homo sapiens
gattctcctgcctc

SEQ ID NO: 5751138 - DNA, 21 bp, Homo sapiens
gattctcctgcctcagcctcc

SEQ ID NO: 5751139 - DNA, 19 bp, Homo sapiens
gattctcctgcctcagctt

SEQ ID NO: 5751140 - DNA, 15 bp, Homo sapiens
gattctcctgtctca

SEQ ID NO: 5751141 - DNA, 12 bp, Homo sapiens
gattctccttca

SEQ ID NO: 5751142 - DNA, 13 bp, Homo sapiens
gattctccttcag

SEQ ID NO: 5751143 - DNA, 17 bp, Homo sapiens
gattctccttcagccct

SEQ ID NO: 5751144 - DNA, 16 bp, Homo sapiens
gattctcgactgcttt

SEQ ID NO: 5751145 - DNA, 16 bp, Homo sapiens
gattctcgccccttcc

SEQ ID NO: 5751146 - DNA, 17 bp, Homo sapiens
gattctcgccccttccc

SEQ ID NO: 5751147 - DNA, 13 bp, Homo sapiens
gattctctattgg

SEQ ID NO: 5751148 - DNA, 23 bp, Homo sapiens
gattctctctccatttggaatta

SEQ ID NO: 5751149 - DNA, 15 bp, Homo sapiens
gattctctcttctct

SEQ ID NO: 5751150 - DNA, 16 bp, Homo sapiens
gattctctctttaacc

SEQ ID NO: 5751151 - DNA, 12 bp, Homo sapiens
gattctctgagt

SEQ ID NO: 5751152 - DNA, 12 bp, Homo sapiens
gattctctgcag

SEQ ID NO: 5751153 - DNA, 15 bp, Homo sapiens
gattctctgcagccc

SEQ ID NO: 5751154 - DNA, 23 bp, Homo sapiens
gattctcttgatgccaccttcag

SEQ ID NO: 5751155 - DNA, 16 bp, Homo sapiens
gattctcttgcctcaa

SEQ ID NO: 5751156 - DNA, 18 bp, Homo sapiens
gattctgaaacaggccct

SEQ ID NO: 5751157 - DNA, 16 bp, Homo sapiens
gattctgaaaccacag

SEQ ID NO: 5751158 - DNA, 19 bp, Homo sapiens
gattctgaaaccacagttt

SEQ ID NO: 5751159 - DNA, 21 bp, Homo sapiens
gattctgaaatttttttccta

SEQ ID NO: 5751160 - DNA, 15 bp, Homo sapiens
gattctgaagcttat

SEQ ID NO: 5751161 - DNA, 20 bp, Homo sapiens
gattctgaagcttatgtttc

SEQ ID NO: 5751162 - DNA, 22 bp, Homo sapiens
gattctgaagcttatgtttctt

SEQ ID NO: 5751163 - DNA, 15 bp, Homo sapiens
gattctgaagtttta

SEQ ID NO: 5751164 - DNA, 20 bp, Homo sapiens
gattctgaccttaaatgcaa

SEQ ID NO: 5751165 - DNA, 21 bp, Homo sapiens
gattctgaccttaaatgcaac

SEQ ID NO: 5751166 - DNA, 11 bp, Homo sapiens
gattctgagca

SEQ ID NO: 5751167 - DNA, 19 bp, Homo sapiens
gattctgataatgctcact

SEQ ID NO: 5751168 - DNA, 14 bp, Homo sapiens
gattctgattgcta

SEQ ID NO: 5751169 - DNA, 16 bp, Homo sapiens
gattctgattgctatc

SEQ ID NO: 5751170 - DNA, 17 bp, Homo sapiens
gattctgattgctatca

SEQ ID NO: 5751171 - DNA, 15 bp, Homo sapiens
gattctgatttcagt

SEQ ID NO: 5751172 - DNA, 20 bp, Homo sapiens
gattctgatttcagtttttc

SEQ ID NO: 5751173 - DNA, 16 bp, Homo sapiens
gattctgatttgtatt

SEQ ID NO: 5751174 - DNA, 19 bp, Homo sapiens
gattctgcagtaaatcttt

SEQ ID NO: 5751175 - DNA, 21 bp, Homo sapiens
gattctgcagtaaatctttta

SEQ ID NO: 5751176 - DNA, 14 bp, Homo sapiens
gattctgcctctct

SEQ ID NO: 5751177 - DNA, 15 bp, Homo sapiens
gattctgcctctctg

SEQ ID NO: 5751178 - DNA, 19 bp, Homo sapiens
gattctgctggcctctgcg

SEQ ID NO: 5751179 - DNA, 22 bp, Homo sapiens
gattctgctggcctctgcgagt

SEQ ID NO: 5751180 - DNA, 12 bp, Homo sapiens
gattctggaata

SEQ ID NO: 5751181 - DNA, 21 bp, Homo sapiens
gattctggacagtcagctctt

SEQ ID NO: 5751182 - DNA, 19 bp, Homo sapiens
gattctggatggccgggct

SEQ ID NO: 5751183 - DNA, 20 bp, Homo sapiens
gattctgggaaaggtgctca

SEQ ID NO: 5751184 - DNA, 23 bp, Homo sapiens
gattctgggaagcttgagcctcc

SEQ ID NO: 5751185 - DNA, 21 bp, Homo sapiens
gattctgggaggcaagaaaag

SEQ ID NO: 5751186 - DNA, 11 bp, Homo sapiens
gattctgggat

SEQ ID NO: 5751187 - DNA, 17 bp, Homo sapiens
gattctgggatgctcct

SEQ ID NO: 5751188 - DNA, 12 bp, Homo sapiens
gattctgggttt

SEQ ID NO: 5751189 - DNA, 19 bp, Homo sapiens
gattctgggtttgcccagt

SEQ ID NO: 5751190 - DNA, 23 bp, Homo sapiens
gattctgtcttccaggcccagtc

SEQ ID NO: 5751191 - DNA, 18 bp, Homo sapiens
gattctgtgcctccagga

SEQ ID NO: 5751192 - DNA, 16 bp, Homo sapiens
gattctgtgttttcag

SEQ ID NO: 5751193 - DNA, 19 bp, Homo sapiens
gattctgttctgcaactcc

SEQ ID NO: 5751194 - DNA, 19 bp, Homo sapiens
gattctgtttattcttcca

SEQ ID NO: 5751195 - DNA, 15 bp, Homo sapiens
gattcttaaagttga

SEQ ID NO: 5751196 - DNA, 21 bp, Homo sapiens
gattcttaaagttgaatttat

SEQ ID NO: 5751197 - DNA, 19 bp, Homo sapiens
gattcttccacctcagcct

SEQ ID NO: 5751198 - DNA, 13 bp, Homo sapiens
gattcttccagat

SEQ ID NO: 5751199 - DNA, 22 bp, Homo sapiens
gattcttccagatgtgatgctt

SEQ ID NO: 5751200 - DNA, 18 bp, Homo sapiens
gattcttcctccctccct

SEQ ID NO: 5751201 - DNA, 12 bp, Homo sapiens
gattcttccttg

SEQ ID NO: 5751202 - DNA, 18 bp, Homo sapiens
gattcttccttgccacaa

SEQ ID NO: 5751203 - DNA, 15 bp, Homo sapiens
gattcttctcttgtg

SEQ ID NO: 5751204 - DNA, 12 bp, Homo sapiens
gattcttctgct

SEQ ID NO: 5751205 - DNA, 15 bp, Homo sapiens
gattcttctgcttca

SEQ ID NO: 5751206 - DNA, 10 bp, Homo sapiens
gattcttctt

SEQ ID NO: 5751207 - DNA, 11 bp, Homo sapiens
gattcttctta

SEQ ID NO: 5751208 - DNA, 16 bp, Homo sapiens
gattcttgattcctgg

SEQ ID NO: 5751209 - DNA, 18 bp, Homo sapiens
gattcttgtaaatctttt

SEQ ID NO: 5751210 - DNA, 19 bp, Homo sapiens
gattcttgtaaatcttttt

SEQ ID NO: 5751211 - DNA, 18 bp, Homo sapiens
gattctttaaactactga

SEQ ID NO: 5751212 - DNA, 14 bp, Homo sapiens
gattctttaaggag

SEQ ID NO: 5751213 - DNA, 19 bp, Homo sapiens
gattctttaatagaagttt

SEQ ID NO: 5751214 - DNA, 17 bp, Homo sapiens
gattctttccatttgca

SEQ ID NO: 5751215 - DNA, 18 bp, Homo sapiens
gattctttccatttgcat

SEQ ID NO: 5751216 - DNA, 20 bp, Homo sapiens
gattctttcccaattcacat

SEQ ID NO: 5751217 - DNA, 14 bp, Homo sapiens
gattctttccccag

SEQ ID NO: 5751218 - DNA, 23 bp, Homo sapiens
gattctttccccagaggctccca

SEQ ID NO: 5751219 - DNA, 22 bp, Homo sapiens
gattctttcctgaggctgggct

SEQ ID NO: 5751220 - DNA, 22 bp, Homo sapiens
gattcttttcccatcaccagaa

SEQ ID NO: 5751221 - DNA, 23 bp, Homo sapiens
gattcttttctataatgtgcctg

SEQ ID NO: 5751222 - DNA, 23 bp, Homo sapiens
gattcttttgtatgtaacaattg

SEQ ID NO: 5751223 - DNA, 20 bp, Homo sapiens
gattctttttaaagtgtttc

SEQ ID NO: 5751224 - DNA, 18 bp, Homo sapiens
gattcttttttcaatgta

SEQ ID NO: 5751225 - DNA, 14 bp, Homo sapiens
gattgaaaactttt

SEQ ID NO: 5751226 - DNA, 12 bp, Homo sapiens
gattgaaaagaa

SEQ ID NO: 5751227 - DNA, 20 bp, Homo sapiens
gattgaaaatgtccaggaaa

SEQ ID NO: 5751228 - DNA, 13 bp, Homo sapiens
gattgaaagaaaa

SEQ ID NO: 5751229 - DNA, 14 bp, Homo sapiens
gattgaaagaaaaa

SEQ ID NO: 5751230 - DNA, 15 bp, Homo sapiens
gattgaaagaaaaaa

SEQ ID NO: 5751231 - DNA, 13 bp, Homo sapiens
gattgaacacagg

SEQ ID NO: 5751232 - DNA, 16 bp, Homo sapiens
gattgaacacaggcaa

SEQ ID NO: 5751233 - DNA, 15 bp, Homo sapiens
gattgaacgttctca

SEQ ID NO: 5751234 - DNA, 15 bp, Homo sapiens
gattgaactccaaga

SEQ ID NO: 5751235 - DNA, 14 bp, Homo sapiens
gattgaagaatctg

SEQ ID NO: 5751236 - DNA, 20 bp, Homo sapiens
gattgaagaatctgcccctg

SEQ ID NO: 5751237 - DNA, 16 bp, Homo sapiens
gattgaagggtcctgc

SEQ ID NO: 5751238 - DNA, 21 bp, Homo sapiens
gattgaagtattttgctggaa

SEQ ID NO: 5751239 - DNA, 16 bp, Homo sapiens
gattgaatgtgtgatg

SEQ ID NO: 5751240 - DNA, 16 bp, Homo sapiens
gattgaatttttaagc

SEQ ID NO: 5751241 - DNA, 17 bp, Homo sapiens
gattgacaactgaagag

SEQ ID NO: 5751242 - DNA, 15 bp, Homo sapiens
gattgacacacagca

SEQ ID NO: 5751243 - DNA, 16 bp, Homo sapiens
gattgacacacagcac

SEQ ID NO: 5751244 - DNA, 16 bp, Homo sapiens
gattgacagctttgct

SEQ ID NO: 5751245 - DNA, 18 bp, Homo sapiens
gattgacagtaacttggt

SEQ ID NO: 5751246 - DNA, 20 bp, Homo sapiens
gattgacagtaacttggtta

SEQ ID NO: 5751247 - DNA, 24 bp, Homo sapiens
gattgaccgtgttggtctgtactg

SEQ ID NO: 5751248 - DNA, 14 bp, Homo sapiens
gattgacctgctcc

SEQ ID NO: 5751249 - DNA, 18 bp, Homo sapiens
gattgacctgctccgctg

SEQ ID NO: 5751250 - DNA, 21 bp, Homo sapiens
gattgacttcagaaacttttt

SEQ ID NO: 5751251 - DNA, 14 bp, Homo sapiens
gattgagaactgac

SEQ ID NO: 5751252 - DNA, 12 bp, Homo sapiens
gattgagaagcc

SEQ ID NO: 5751253 - DNA, 14 bp, Homo sapiens
gattgagaagccat

SEQ ID NO: 5751254 - DNA, 13 bp, Homo sapiens
gattgagaaggag

SEQ ID NO: 5751255 - DNA, 16 bp, Homo sapiens
gattgagaaggagaga

SEQ ID NO: 5751256 - DNA, 17 bp, Homo sapiens
gattgagaaggagagaa

SEQ ID NO: 5751257 - DNA, 19 bp, Homo sapiens
gattgagaaggagagaaag

SEQ ID NO: 5751258 - DNA, 23 bp, Homo sapiens
gattgagaaggagctcccaggag

SEQ ID NO: 5751259 - DNA, 22 bp, Homo sapiens
gattgagaagttactttccatt

SEQ ID NO: 5751260 - DNA, 21 bp, Homo sapiens
gattgagacctacaggctgac

SEQ ID NO: 5751261 - DNA, 21 bp, Homo sapiens
gattgaggataaaaaggaagg

SEQ ID NO: 5751262 - DNA, 16 bp, Homo sapiens
gattgagtctgtgcca

SEQ ID NO: 5751263 - DNA, 17 bp, Homo sapiens
gattgagttgtaaagaa

SEQ ID NO: 5751264 - DNA, 20 bp, Homo sapiens
gattgagttgtaaagaaaac

SEQ ID NO: 5751265 - DNA, 22 bp, Homo sapiens
gattgatagaaaatccttcagc

SEQ ID NO: 5751266 - DNA, 19 bp, Homo sapiens
gattgatagagtgttatca

SEQ ID NO: 5751267 - DNA, 19 bp, Homo sapiens
gattgatatctataaaata

SEQ ID NO: 5751268 - DNA, 20 bp, Homo sapiens
gattgattcagctaagcaaa

SEQ ID NO: 5751269 - DNA, 17 bp, Homo sapiens
gattgattcagtatctt

SEQ ID NO: 5751270 - DNA, 22 bp, Homo sapiens
gattgattcagtatcttagagt

SEQ ID NO: 5751271 - DNA, 18 bp, Homo sapiens
gattgattcagtcttctg

SEQ ID NO: 5751272 - DNA, 19 bp, Homo sapiens
gattgattcagtcttctgg

SEQ ID NO: 5751273 - DNA, 16 bp, Homo sapiens
gattgattgatacatt

SEQ ID NO: 5751274 - DNA, 15 bp, Homo sapiens
gattgatttgaagaa

SEQ ID NO: 5751275 - DNA, 11 bp, Homo sapiens
gattgattttc

SEQ ID NO: 5751276 - DNA, 14 bp, Homo sapiens
gattgcaatttgca

SEQ ID NO: 5751277 - DNA, 15 bp, Homo sapiens
gattgcacagaattt

SEQ ID NO: 5751278 - DNA, 16 bp, Homo sapiens
gattgcacagagctgg

SEQ ID NO: 5751279 - DNA, 19 bp, Homo sapiens
gattgcaccactgcactcc

SEQ ID NO: 5751280 - DNA, 16 bp, Homo sapiens
gattgcacgtggcctc

SEQ ID NO: 5751281 - DNA, 17 bp, Homo sapiens
gattgcacgtggcctct

SEQ ID NO: 5751282 - DNA, 13 bp, Homo sapiens
gattgcactaaat

SEQ ID NO: 5751283 - DNA, 21 bp, Homo sapiens
gattgcagaaaggagagacgt

SEQ ID NO: 5751284 - DNA, 19 bp, Homo sapiens
gattgcagaattgtttaga

SEQ ID NO: 5751285 - DNA, 11 bp, Homo sapiens
gattgcagctt

SEQ ID NO: 5751286 - DNA, 18 bp, Homo sapiens
gattgcagctttatgttc

SEQ ID NO: 5751287 - DNA, 12 bp, Homo sapiens
gattgcatctcc

SEQ ID NO: 5751288 - DNA, 22 bp, Homo sapiens
gattgcattagaaatagacagt

SEQ ID NO: 5751289 - DNA, 22 bp, Homo sapiens
gattgcatttttattaaagcat

SEQ ID NO: 5751290 - DNA, 22 bp, Homo sapiens
gattgccatttcttcccaaggc

SEQ ID NO: 5751291 - DNA, 23 bp, Homo sapiens
gattgccccagagccccactccc

SEQ ID NO: 5751292 - DNA, 19 bp, Homo sapiens
gattgcccctggctttgcc

SEQ ID NO: 5751293 - DNA, 22 bp, Homo sapiens
gattgcccctggctttgcctct

SEQ ID NO: 5751294 - DNA, 13 bp, Homo sapiens
gattgcctctgaa

SEQ ID NO: 5751295 - DNA, 13 bp, Homo sapiens
gattgcgagagat

SEQ ID NO: 5751296 - DNA, 15 bp, Homo sapiens
gattgcgagagatgt

SEQ ID NO: 5751297 - DNA, 23 bp, Homo sapiens
gattgcgccactgcactccagcc

SEQ ID NO: 5751298 - DNA, 24 bp, Homo sapiens
gattgcggtgtgagatggtgcccc

SEQ ID NO: 5751299 - DNA, 14 bp, Homo sapiens
gattgctaaatgta

SEQ ID NO: 5751300 - DNA, 15 bp, Homo sapiens
gattgctatgaatga

SEQ ID NO: 5751301 - DNA, 13 bp, Homo sapiens
gattgctccagag

SEQ ID NO: 5751302 - DNA, 19 bp, Homo sapiens
gattgctctggaagcctgc

SEQ ID NO: 5751303 - DNA, 20 bp, Homo sapiens
gattgctctggaagcctgct

SEQ ID NO: 5751304 - DNA, 21 bp, Homo sapiens
gattgctgaggcaccgtccag

SEQ ID NO: 5751305 - DNA, 18 bp, Homo sapiens
gattgctgataataaatt

SEQ ID NO: 5751306 - DNA, 13 bp, Homo sapiens
gattgctgccact

SEQ ID NO: 5751307 - DNA, 23 bp, Homo sapiens
gattgctgtgtccaactccagta

SEQ ID NO: 5751308 - DNA, 16 bp, Homo sapiens
gattgcttctgtagta

SEQ ID NO: 5751309 - DNA, 17 bp, Homo sapiens
gattgcttcttgtgaaa

SEQ ID NO: 5751310 - DNA, 16 bp, Homo sapiens
gattgcttgagctcag

SEQ ID NO: 5751311 - DNA, 18 bp, Homo sapiens
gattgctttatccagcag

SEQ ID NO: 5751312 - DNA, 21 bp, Homo sapiens
gattgctttatccagcagtca

SEQ ID NO: 5751313 - DNA, 18 bp, Homo sapiens
gattgctttgctgcacag

SEQ ID NO: 5751314 - DNA, 22 bp, Homo sapiens
gattgctttgctgcacagcagg

SEQ ID NO: 5751315 - DNA, 16 bp, Homo sapiens
gattgcttttaaaatt

SEQ ID NO: 5751316 - DNA, 21 bp, Homo sapiens
gattgcttttattacattagt

SEQ ID NO: 5751317 - DNA, 22 bp, Homo sapiens
gattgcttttattacattagtt

SEQ ID NO: 5751318 - DNA, 22 bp, Homo sapiens
gattgcttttgttttcctgctg

SEQ ID NO: 5751319 - DNA, 23 bp, Homo sapiens
gattgcttttgttttcctgctgg

SEQ ID NO: 5751320 - DNA, 13 bp, Homo sapiens
gattggaaagaca

SEQ ID NO: 5751321 - DNA, 20 bp, Homo sapiens
gattggaaggagacacagat

SEQ ID NO: 5751322 - DNA, 15 bp, Homo sapiens
gattggaatgcagag

SEQ ID NO: 5751323 - DNA, 22 bp, Homo sapiens
gattggaatttctggcctccta

SEQ ID NO: 5751324 - DNA, 14 bp, Homo sapiens
gattggacaaaatg

SEQ ID NO: 5751325 - DNA, 23 bp, Homo sapiens
gattggacataactgacttagtt

SEQ ID NO: 5751326 - DNA, 15 bp, Homo sapiens
gattggagaatactt

SEQ ID NO: 5751327 - DNA, 23 bp, Homo sapiens
gattggagaatactttgcttcat

SEQ ID NO: 5751328 - DNA, 15 bp, Homo sapiens
gattggagctgaaga

SEQ ID NO: 5751329 - DNA, 22 bp, Homo sapiens
gattggatacgcatcagacaga

SEQ ID NO: 5751330 - DNA, 14 bp, Homo sapiens
gattggattattca

SEQ ID NO: 5751331 - DNA, 20 bp, Homo sapiens
gattggattatttaataaca

SEQ ID NO: 5751332 - DNA, 22 bp, Homo sapiens
gattggattatttaataacatt

SEQ ID NO: 5751333 - DNA, 20 bp, Homo sapiens
gattggcaagtaacttctga

SEQ ID NO: 5751334 - DNA, 20 bp, Homo sapiens
gattggcacaagctccctgg

SEQ ID NO: 5751335 - DNA, 18 bp, Homo sapiens
gattggcacccctttcta

SEQ ID NO: 5751336 - DNA, 22 bp, Homo sapiens
gattggcagcttcaaaacagaa

SEQ ID NO: 5751337 - DNA, 20 bp, Homo sapiens
gattggcaggtgtgggctcc

SEQ ID NO: 5751338 - DNA, 13 bp, Homo sapiens
gattggcatggct

SEQ ID NO: 5751339 - DNA, 14 bp, Homo sapiens
gattggccactgga

SEQ ID NO: 5751340 - DNA, 16 bp, Homo sapiens
gattggccactggatc

SEQ ID NO: 5751341 - DNA, 21 bp, Homo sapiens
gattggccactggatcctgct

SEQ ID NO: 5751342 - DNA, 13 bp, Homo sapiens
gattggccagccg

SEQ ID NO: 5751343 - DNA, 19 bp, Homo sapiens
gattggccctgcccctccc

SEQ ID NO: 5751344 - DNA, 22 bp, Homo sapiens
gattggccctgcccctccccct

SEQ ID NO: 5751345 - DNA, 16 bp, Homo sapiens
gattggcctccagggc

SEQ ID NO: 5751346 - DNA, 11 bp, Homo sapiens
gattggcctgt

SEQ ID NO: 5751347 - DNA, 16 bp, Homo sapiens
gattggcctgtagagt

SEQ ID NO: 5751348 - DNA, 23 bp, Homo sapiens
gattggcctgtagagttgctgag

SEQ ID NO: 5751349 - DNA, 21 bp, Homo sapiens
gattggcctgtgtctggcccc

SEQ ID NO: 5751350 - DNA, 22 bp, Homo sapiens
gattggcgggtccacttgccag

SEQ ID NO: 5751351 - DNA, 16 bp, Homo sapiens
gattggctgcaggaag

SEQ ID NO: 5751352 - DNA, 23 bp, Homo sapiens
gattggctgcttaaactggaaag

SEQ ID NO: 5751353 - DNA, 18 bp, Homo sapiens
gattggcttaaagtgaag

SEQ ID NO: 5751354 - DNA, 22 bp, Homo sapiens
gattggcttaaagtgaaggaaa

SEQ ID NO: 5751355 - DNA, 16 bp, Homo sapiens
gattggcttgtagaat

SEQ ID NO: 5751356 - DNA, 20 bp, Homo sapiens
gattggcttgtagaattgtt

SEQ ID NO: 5751357 - DNA, 19 bp, Homo sapiens
gattggcttgtgtgtttca

SEQ ID NO: 5751358 - DNA, 13 bp, Homo sapiens
gattgggactgag

SEQ ID NO: 5751359 - DNA, 19 bp, Homo sapiens
gattgggagaagtggaaat

SEQ ID NO: 5751360 - DNA, 16 bp, Homo sapiens
gattgggagggacagg

SEQ ID NO: 5751361 - DNA, 20 bp, Homo sapiens
gattgggcacatcatttcaa

SEQ ID NO: 5751362 - DNA, 20 bp, Homo sapiens
gattgggcagaatcctgggc

SEQ ID NO: 5751363 - DNA, 15 bp, Homo sapiens
gattgggcccctgcc

SEQ ID NO: 5751364 - DNA, 17 bp, Homo sapiens
gattgggcccctgccag

SEQ ID NO: 5751365 - DNA, 18 bp, Homo sapiens
gattgggcggggcttctc

SEQ ID NO: 5751366 - DNA, 20 bp, Homo sapiens
gattgggcggggcttctctt

SEQ ID NO: 5751367 - DNA, 15 bp, Homo sapiens
gattgggctggctct

SEQ ID NO: 5751368 - DNA, 16 bp, Homo sapiens
gattgggctggctctg

SEQ ID NO: 5751369 - DNA, 22 bp, Homo sapiens
gattggggaagagagcctgcag

SEQ ID NO: 5751370 - DNA, 15 bp, Homo sapiens
gattggggaattaaa

SEQ ID NO: 5751371 - DNA, 21 bp, Homo sapiens
gattgggggatgtgaagaaat

SEQ ID NO: 5751372 - DNA, 19 bp, Homo sapiens
gattggggggtgggctttg

SEQ ID NO: 5751373 - DNA, 15 bp, Homo sapiens
gattggggtgataag

SEQ ID NO: 5751374 - DNA, 18 bp, Homo sapiens
gattgggtcagctggctt

SEQ ID NO: 5751375 - DNA, 16 bp, Homo sapiens
gattgggtcgtggtgg

SEQ ID NO: 5751376 - DNA, 19 bp, Homo sapiens
gattgggtgggcaggaaaa

SEQ ID NO: 5751377 - DNA, 16 bp, Homo sapiens
gattggtaccagagcc

SEQ ID NO: 5751378 - DNA, 12 bp, Homo sapiens
gattggtgttcg

SEQ ID NO: 5751379 - DNA, 16 bp, Homo sapiens
gattggtgttttatct

SEQ ID NO: 5751380 - DNA, 18 bp, Homo sapiens
gattggttaaaatgtgat

SEQ ID NO: 5751381 - DNA, 15 bp, Homo sapiens
gattggttcatgcct

SEQ ID NO: 5751382 - DNA, 16 bp, Homo sapiens
gattggttcatgcctg

SEQ ID NO: 5751383 - DNA, 15 bp, Homo sapiens
gattggtttctcttc

SEQ ID NO: 5751384 - DNA, 17 bp, Homo sapiens
gattggtttctcttctc

SEQ ID NO: 5751385 - DNA, 21 bp, Homo sapiens
gattggtttctcttctcccct

SEQ ID NO: 5751386 - DNA, 23 bp, Homo sapiens
gattgtaaaatagcttgtatagt

SEQ ID NO: 5751387 - DNA, 23 bp, Homo sapiens
gattgtaaaccgctttggcctga

SEQ ID NO: 5751388 - DNA, 16 bp, Homo sapiens
gattgtaaactaaagt

SEQ ID NO: 5751389 - DNA, 13 bp, Homo sapiens
gattgtaaacttc

SEQ ID NO: 5751390 - DNA, 19 bp, Homo sapiens
gattgtaaaggtaggtgca

SEQ ID NO: 5751391 - DNA, 11 bp, Homo sapiens
gattgtaactc

SEQ ID NO: 5751392 - DNA, 16 bp, Homo sapiens
gattgtaatacacata

SEQ ID NO: 5751393 - DNA, 17 bp, Homo sapiens
gattgtaatacacatat

SEQ ID NO: 5751394 - DNA, 11 bp, Homo sapiens
gattgtacacg

SEQ ID NO: 5751395 - DNA, 18 bp, Homo sapiens
gattgtacgtagccacag

SEQ ID NO: 5751396 - DNA, 14 bp, Homo sapiens
gattgtataagcat

SEQ ID NO: 5751397 - DNA, 20 bp, Homo sapiens
gattgtataagcatgctttc

SEQ ID NO: 5751398 - DNA, 18 bp, Homo sapiens
gattgtataatgtgattt

SEQ ID NO: 5751399 - DNA, 14 bp, Homo sapiens
gattgtatgttgag

SEQ ID NO: 5751400 - DNA, 10 bp, Homo sapiens
gattgtattg

SEQ ID NO: 5751401 - DNA, 21 bp, Homo sapiens
gattgtcaccatgatcactta

SEQ ID NO: 5751402 - DNA, 20 bp, Homo sapiens
gattgtcctttaaaaaagaa

SEQ ID NO: 5751403 - DNA, 16 bp, Homo sapiens
gattgtccttttgcaa

SEQ ID NO: 5751404 - DNA, 17 bp, Homo sapiens
gattgtctgaaattttc

SEQ ID NO: 5751405 - DNA, 21 bp, Homo sapiens
gattgtctttcccccctccct

SEQ ID NO: 5751406 - DNA, 19 bp, Homo sapiens
gattgtgcaatagtcagag

SEQ ID NO: 5751407 - DNA, 19 bp, Homo sapiens
gattgtgccagtgcactcc

SEQ ID NO: 5751408 - DNA, 18 bp, Homo sapiens
gattgtgctctgcagcga

SEQ ID NO: 5751409 - DNA, 16 bp, Homo sapiens
gattgtggaaaaccag

SEQ ID NO: 5751410 - DNA, 13 bp, Homo sapiens
gattgtggatgtg

SEQ ID NO: 5751411 - DNA, 23 bp, Homo sapiens
gattgtgggaattaaggaagtga

SEQ ID NO: 5751412 - DNA, 21 bp, Homo sapiens
gattgtggggtgcagctgggt

SEQ ID NO: 5751413 - DNA, 11 bp, Homo sapiens
gattgtgtaca

SEQ ID NO: 5751414 - DNA, 14 bp, Homo sapiens
gattgtgtacatag

SEQ ID NO: 5751415 - DNA, 18 bp, Homo sapiens
gattgtgtacttttcctt

SEQ ID NO: 5751416 - DNA, 20 bp, Homo sapiens
gattgtgtacttttcctttg

SEQ ID NO: 5751417 - DNA, 19 bp, Homo sapiens
gattgtgtcccattccccc

SEQ ID NO: 5751418 - DNA, 14 bp, Homo sapiens
gattgttaaaataa

SEQ ID NO: 5751419 - DNA, 16 bp, Homo sapiens
gattgttaaaataact

SEQ ID NO: 5751420 - DNA, 13 bp, Homo sapiens
gattgttaaattc

SEQ ID NO: 5751421 - DNA, 21 bp, Homo sapiens
gattgttaggagtggttctca

SEQ ID NO: 5751422 - DNA, 18 bp, Homo sapiens
gattgttatgtaaaactc

SEQ ID NO: 5751423 - DNA, 20 bp, Homo sapiens
gattgttcataatacataaa

SEQ ID NO: 5751424 - DNA, 21 bp, Homo sapiens
gattgttcatatcaagaaatt

SEQ ID NO: 5751425 - DNA, 12 bp, Homo sapiens
gattgttcctcc

SEQ ID NO: 5751426 - DNA, 19 bp, Homo sapiens
gattgttcttttgtttcat

SEQ ID NO: 5751427 - DNA, 20 bp, Homo sapiens
gattgttggtgaattttcaa

SEQ ID NO: 5751428 - DNA, 11 bp, Homo sapiens
gattgtttaag

SEQ ID NO: 5751429 - DNA, 18 bp, Homo sapiens
gattgtttacaggatatt

SEQ ID NO: 5751430 - DNA, 21 bp, Homo sapiens
gattgtttatctagatgtaaa

SEQ ID NO: 5751431 - DNA, 15 bp, Homo sapiens
gattgtttctataca

SEQ ID NO: 5751432 - DNA, 15 bp, Homo sapiens
gattgtttgcacaga

SEQ ID NO: 5751433 - DNA, 17 bp, Homo sapiens
gattgtttgctctgaga

SEQ ID NO: 5751434 - DNA, 13 bp, Homo sapiens
gattgttttaaca

SEQ ID NO: 5751435 - DNA, 20 bp, Homo sapiens
gattgttttattttggaatt

SEQ ID NO: 5751436 - DNA, 15 bp, Homo sapiens
gattgttttgttcac

SEQ ID NO: 5751437 - DNA, 19 bp, Homo sapiens
gatttaaaaaataaatata

SEQ ID NO: 5751438 - DNA, 23 bp, Homo sapiens
gatttaaaaacaaccaacagaaa

SEQ ID NO: 5751439 - DNA, 15 bp, Homo sapiens
gatttaaaagggaag

SEQ ID NO: 5751440 - DNA, 11 bp, Homo sapiens
gatttaaaatt

SEQ ID NO: 5751441 - DNA, 16 bp, Homo sapiens
gatttaaacaaacaaa

SEQ ID NO: 5751442 - DNA, 15 bp, Homo sapiens
gatttaaacacacag

SEQ ID NO: 5751443 - DNA, 17 bp, Homo sapiens
gatttaaactccagcat

SEQ ID NO: 5751444 - DNA, 19 bp, Homo sapiens
gatttaaagtattttaatt

SEQ ID NO: 5751445 - DNA, 20 bp, Homo sapiens
gatttaaagtgaacacacac

SEQ ID NO: 5751446 - DNA, 21 bp, Homo sapiens
gatttaaagtgaacacacaca

SEQ ID NO: 5751447 - DNA, 12 bp, Homo sapiens
gatttaaatcag

SEQ ID NO: 5751448 - DNA, 14 bp, Homo sapiens
gatttaaatttaag

SEQ ID NO: 5751449 - DNA, 22 bp, Homo sapiens
gatttaacactaaaattccact

SEQ ID NO: 5751450 - DNA, 19 bp, Homo sapiens
gatttaacagaaatgtaca

SEQ ID NO: 5751451 - DNA, 23 bp, Homo sapiens
gatttaacagaaatgtacagcaa

SEQ ID NO: 5751452 - DNA, 18 bp, Homo sapiens
gatttaacagtcatttaa

SEQ ID NO: 5751453 - DNA, 15 bp, Homo sapiens
gatttaaccattcca

SEQ ID NO: 5751454 - DNA, 21 bp, Homo sapiens
gatttaaccattccataatca

SEQ ID NO: 5751455 - DNA, 18 bp, Homo sapiens
gatttaacctgttatttc

SEQ ID NO: 5751456 - DNA, 21 bp, Homo sapiens
gatttaacctgttatttctat

SEQ ID NO: 5751457 - DNA, 15 bp, Homo sapiens
gatttaagccttaca

SEQ ID NO: 5751458 - DNA, 22 bp, Homo sapiens
gatttaagggatggaaaaggaa

SEQ ID NO: 5751459 - DNA, 11 bp, Homo sapiens
gatttaagtaa

SEQ ID NO: 5751460 - DNA, 17 bp, Homo sapiens
gatttaagtgaatacat

SEQ ID NO: 5751461 - DNA, 17 bp, Homo sapiens
gatttaagttcctgctg

SEQ ID NO: 5751462 - DNA, 22 bp, Homo sapiens
gatttaataaaataattctaaa

SEQ ID NO: 5751463 - DNA, 20 bp, Homo sapiens
gatttaatagtgttaatcaa

SEQ ID NO: 5751464 - DNA, 23 bp, Homo sapiens
gatttaatagtgttaatcaattt

SEQ ID NO: 5751465 - DNA, 14 bp, Homo sapiens
gatttaatatgcaa

SEQ ID NO: 5751466 - DNA, 12 bp, Homo sapiens
gatttaatgttt

SEQ ID NO: 5751467 - DNA, 13 bp, Homo sapiens
gatttaattctct

SEQ ID NO: 5751468 - DNA, 16 bp, Homo sapiens
gatttaatttgaaata

SEQ ID NO: 5751469 - DNA, 16 bp, Homo sapiens
gatttacagtgcctgt

SEQ ID NO: 5751470 - DNA, 13 bp, Homo sapiens
gatttacattcaa

SEQ ID NO: 5751471 - DNA, 21 bp, Homo sapiens
gatttaccaattcacccactc

SEQ ID NO: 5751472 - DNA, 19 bp, Homo sapiens
gatttacctcgttctgctc

SEQ ID NO: 5751473 - DNA, 20 bp, Homo sapiens
gatttacctgttttcgcacc

SEQ ID NO: 5751474 - DNA, 15 bp, Homo sapiens
gatttactaacagta

SEQ ID NO: 5751475 - DNA, 16 bp, Homo sapiens
gatttacttaattcag

SEQ ID NO: 5751476 - DNA, 15 bp, Homo sapiens
gatttagaactgtat

SEQ ID NO: 5751477 - DNA, 20 bp, Homo sapiens
gatttagaggtaaaagtaca

SEQ ID NO: 5751478 - DNA, 16 bp, Homo sapiens
gatttagatttaatga

SEQ ID NO: 5751479 - DNA, 20 bp, Homo sapiens
gatttagcaatgctgtgaat

SEQ ID NO: 5751480 - DNA, 21 bp, Homo sapiens
gatttagcaatgctgtgaata

SEQ ID NO: 5751481 - DNA, 16 bp, Homo sapiens
gatttagccatgtgaa

SEQ ID NO: 5751482 - DNA, 13 bp, Homo sapiens
gatttagctattt

SEQ ID NO: 5751483 - DNA, 15 bp, Homo sapiens
gatttagctatttat

SEQ ID NO: 5751484 - DNA, 18 bp, Homo sapiens
gatttagctgtggctccc

SEQ ID NO: 5751485 - DNA, 20 bp, Homo sapiens
gatttaggagaagccaggaa

SEQ ID NO: 5751486 - DNA, 15 bp, Homo sapiens
gatttaggagcagaa

SEQ ID NO: 5751487 - DNA, 16 bp, Homo sapiens
gatttaggagcagaaa

SEQ ID NO: 5751488 - DNA, 23 bp, Homo sapiens
gatttaggcttctatgtccaaca

SEQ ID NO: 5751489 - DNA, 22 bp, Homo sapiens
gatttagtgaaagctagagata

SEQ ID NO: 5751490 - DNA, 15 bp, Homo sapiens
gatttagttttgtaa

SEQ ID NO: 5751491 - DNA, 17 bp, Homo sapiens
gatttataaaactttgg

SEQ ID NO: 5751492 - DNA, 21 bp, Homo sapiens
gatttataaagatttttgtta

SEQ ID NO: 5751493 - DNA, 13 bp, Homo sapiens
gatttataaagca

SEQ ID NO: 5751494 - DNA, 15 bp, Homo sapiens
gatttataaatttga

SEQ ID NO: 5751495 - DNA, 18 bp, Homo sapiens
gatttatacatacagaga

SEQ ID NO: 5751496 - DNA, 14 bp, Homo sapiens
gatttatatataag

SEQ ID NO: 5751497 - DNA, 20 bp, Homo sapiens
gatttatatgtgtaattttt

SEQ ID NO: 5751498 - DNA, 20 bp, Homo sapiens
gatttatattactgtctttt

SEQ ID NO: 5751499 - DNA, 12 bp, Homo sapiens
gatttatcaaat

SEQ ID NO: 5751500 - DNA, 15 bp, Homo sapiens
gatttatcaatattt

SEQ ID NO: 5751501 - DNA, 16 bp, Homo sapiens
gatttatcaatatttg

SEQ ID NO: 5751502 - DNA, 17 bp, Homo sapiens
gatttatcacacaaagc

SEQ ID NO: 5751503 - DNA, 19 bp, Homo sapiens
gatttatctaaggtcccca

SEQ ID NO: 5751504 - DNA, 12 bp, Homo sapiens
gatttatcttta

SEQ ID NO: 5751505 - DNA, 16 bp, Homo sapiens
gatttatgtattttga

SEQ ID NO: 5751506 - DNA, 15 bp, Homo sapiens
gatttatgtcagcac

SEQ ID NO: 5751507 - DNA, 17 bp, Homo sapiens
gatttatgttgtataga

SEQ ID NO: 5751508 - DNA, 13 bp, Homo sapiens
gatttattaaaga

SEQ ID NO: 5751509 - DNA, 15 bp, Homo sapiens
gatttattaaagaaa

SEQ ID NO: 5751510 - DNA, 12 bp, Homo sapiens
gatttattaact

SEQ ID NO: 5751511 - DNA, 15 bp, Homo sapiens
gatttattctcagaa

SEQ ID NO: 5751512 - DNA, 12 bp, Homo sapiens
gatttattgtaa

SEQ ID NO: 5751513 - DNA, 15 bp, Homo sapiens
gatttattgtaagca

SEQ ID NO: 5751514 - DNA, 17 bp, Homo sapiens
gatttatttatttctac

SEQ ID NO: 5751515 - DNA, 22 bp, Homo sapiens
gatttatttcatcatattatac

SEQ ID NO: 5751516 - DNA, 16 bp, Homo sapiens
gatttatttgtttgat

SEQ ID NO: 5751517 - DNA, 18 bp, Homo sapiens
gatttatttttaatatgt

SEQ ID NO: 5751518 - DNA, 21 bp, Homo sapiens
gatttatttttaatatgttga

SEQ ID NO: 5751519 - DNA, 22 bp, Homo sapiens
gatttattttttaatcatttaa

SEQ ID NO: 5751520 - DNA, 20 bp, Homo sapiens
gatttcaaaagattgtgttc

SEQ ID NO: 5751521 - DNA, 11 bp, Homo sapiens
gatttcaaact

SEQ ID NO: 5751522 - DNA, 20 bp, Homo sapiens
gatttcaaacttaaacaaaa

SEQ ID NO: 5751523 - DNA, 17 bp, Homo sapiens
gatttcaacatatcatt

SEQ ID NO: 5751524 - DNA, 12 bp, Homo sapiens
gatttcaagaaa

SEQ ID NO: 5751525 - DNA, 15 bp, Homo sapiens
gatttcaagatcctc

SEQ ID NO: 5751526 - DNA, 18 bp, Homo sapiens
gatttcaaggccatattt

SEQ ID NO: 5751527 - DNA, 22 bp, Homo sapiens
gatttcaaggccatattttaaa

SEQ ID NO: 5751528 - DNA, 17 bp, Homo sapiens
gatttcaagggactggg

SEQ ID NO: 5751529 - DNA, 14 bp, Homo sapiens
gatttcaatgattg

SEQ ID NO: 5751530 - DNA, 19 bp, Homo sapiens
gatttcacaaatattaaaa

SEQ ID NO: 5751531 - DNA, 22 bp, Homo sapiens
gatttcacagttggcacttctg

SEQ ID NO: 5751532 - DNA, 20 bp, Homo sapiens
gatttcactaggactcagaa

SEQ ID NO: 5751533 - DNA, 12 bp, Homo sapiens
gatttcactctc

SEQ ID NO: 5751534 - DNA, 16 bp, Homo sapiens
gatttcactctccttg

SEQ ID NO: 5751535 - DNA, 12 bp, Homo sapiens
gatttcagaaac

SEQ ID NO: 5751536 - DNA, 21 bp, Homo sapiens
gatttcagaaagagcaagtct

SEQ ID NO: 5751537 - DNA, 14 bp, Homo sapiens
gatttcagaagaga

SEQ ID NO: 5751538 - DNA, 16 bp, Homo sapiens
gatttcagaagagact

SEQ ID NO: 5751539 - DNA, 16 bp, Homo sapiens
gatttcagaggctgca

SEQ ID NO: 5751540 - DNA, 18 bp, Homo sapiens
gatttcagctatgcagaa

SEQ ID NO: 5751541 - DNA, 20 bp, Homo sapiens
gatttcagctcactgcaacc

SEQ ID NO: 5751542 - DNA, 23 bp, Homo sapiens
gatttcagggagacaagagggaa

SEQ ID NO: 5751543 - DNA, 14 bp, Homo sapiens
gatttcagtagaat

SEQ ID NO: 5751544 - DNA, 15 bp, Homo sapiens
gatttcagtagaatt

SEQ ID NO: 5751545 - DNA, 16 bp, Homo sapiens
gatttcagtcttttcc

SEQ ID NO: 5751546 - DNA, 15 bp, Homo sapiens
gatttcagtttttca

SEQ ID NO: 5751547 - DNA, 16 bp, Homo sapiens
gatttcagtttttcat

SEQ ID NO: 5751548 - DNA, 18 bp, Homo sapiens
gatttcagtttttcattt

SEQ ID NO: 5751549 - DNA, 15 bp, Homo sapiens
gatttcatagttcag

SEQ ID NO: 5751550 - DNA, 17 bp, Homo sapiens
gatttcatagttcagaa

SEQ ID NO: 5751551 - DNA, 18 bp, Homo sapiens
gatttcatagttcagaat

SEQ ID NO: 5751552 - DNA, 13 bp, Homo sapiens
gatttcatatcta

SEQ ID NO: 5751553 - DNA, 15 bp, Homo sapiens
gatttcatattgatc

SEQ ID NO: 5751554 - DNA, 22 bp, Homo sapiens
gatttcatattgatctttttat

SEQ ID NO: 5751555 - DNA, 12 bp, Homo sapiens
gatttcatctgc

SEQ ID NO: 5751556 - DNA, 18 bp, Homo sapiens
gatttcatcttctggaat

SEQ ID NO: 5751557 - DNA, 19 bp, Homo sapiens
gatttcatcttctggaata

SEQ ID NO: 5751558 - DNA, 19 bp, Homo sapiens
gatttcatgattagacaat

SEQ ID NO: 5751559 - DNA, 13 bp, Homo sapiens
gatttcatgattt

SEQ ID NO: 5751560 - DNA, 13 bp, Homo sapiens
gatttcatgcatt

SEQ ID NO: 5751561 - DNA, 19 bp, Homo sapiens
gatttcatgtactgcatta

SEQ ID NO: 5751562 - DNA, 21 bp, Homo sapiens
gatttcatgtactgcattatt

SEQ ID NO: 5751563 - DNA, 20 bp, Homo sapiens
gatttccaagtaatataatg

SEQ ID NO: 5751564 - DNA, 14 bp, Homo sapiens
gatttccaggcccc

SEQ ID NO: 5751565 - DNA, 13 bp, Homo sapiens
gatttccatctta

SEQ ID NO: 5751566 - DNA, 14 bp, Homo sapiens
gatttccatttctg

SEQ ID NO: 5751567 - DNA, 19 bp, Homo sapiens
gatttcccaaaaacactaa

SEQ ID NO: 5751568 - DNA, 21 bp, Homo sapiens
gatttcccactgcactccagc

SEQ ID NO: 5751569 - DNA, 12 bp, Homo sapiens
gatttcccctct

SEQ ID NO: 5751570 - DNA, 16 bp, Homo sapiens
gatttccccttttgca

SEQ ID NO: 5751571 - DNA, 16 bp, Homo sapiens
gatttcccgtggcccc

SEQ ID NO: 5751572 - DNA, 21 bp, Homo sapiens
gatttcccgtggccccagcct

SEQ ID NO: 5751573 - DNA, 22 bp, Homo sapiens
gatttcccgtggccccagcctg

SEQ ID NO: 5751574 - DNA, 22 bp, Homo sapiens
gatttccctaaggagcctggga

SEQ ID NO: 5751575 - DNA, 20 bp, Homo sapiens
gatttccctccagagaaagc

SEQ ID NO: 5751576 - DNA, 18 bp, Homo sapiens
gatttccctgaagctatg

SEQ ID NO: 5751577 - DNA, 15 bp, Homo sapiens
gatttccctgcagac

SEQ ID NO: 5751578 - DNA, 23 bp, Homo sapiens
gatttccctgcagacctcaagcc

SEQ ID NO: 5751579 - DNA, 19 bp, Homo sapiens
gatttcccttttttcttcc

SEQ ID NO: 5751580 - DNA, 23 bp, Homo sapiens
gatttccgtgaaaatgcaagtgt

SEQ ID NO: 5751581 - DNA, 18 bp, Homo sapiens
gatttccgttaaaatacc

SEQ ID NO: 5751582 - DNA, 22 bp, Homo sapiens
gatttccgttaaaataccagcc

SEQ ID NO: 5751583 - DNA, 14 bp, Homo sapiens
gatttcctatttta

SEQ ID NO: 5751584 - DNA, 22 bp, Homo sapiens
gatttcctccatggtggaaggg

SEQ ID NO: 5751585 - DNA, 23 bp, Homo sapiens
gatttcctcctcccagtgccttc

SEQ ID NO: 5751586 - DNA, 21 bp, Homo sapiens
gatttcctcttgaaccagaac

SEQ ID NO: 5751587 - DNA, 18 bp, Homo sapiens
gatttcctggagtgccct

SEQ ID NO: 5751588 - DNA, 19 bp, Homo sapiens
gatttcctggagtgccctg

SEQ ID NO: 5751589 - DNA, 23 bp, Homo sapiens
gatttcctggagtgccctgcagg

SEQ ID NO: 5751590 - DNA, 11 bp, Homo sapiens
gatttcctgtg

SEQ ID NO: 5751591 - DNA, 18 bp, Homo sapiens
gatttcctttgacctctc

SEQ ID NO: 5751592 - DNA, 20 bp, Homo sapiens
gatttccttttttcttttct

SEQ ID NO: 5751593 - DNA, 19 bp, Homo sapiens
gatttcgtgggtctgtttt

SEQ ID NO: 5751594 - DNA, 18 bp, Homo sapiens
gatttcgtgtgccgctgc

SEQ ID NO: 5751595 - DNA, 14 bp, Homo sapiens
gatttctaagtgtt

SEQ ID NO: 5751596 - DNA, 14 bp, Homo sapiens
gatttctaatcaaa

SEQ ID NO: 5751597 - DNA, 16 bp, Homo sapiens
gatttctaatcaaaag

SEQ ID NO: 5751598 - DNA, 15 bp, Homo sapiens
gatttctaattgtaa

SEQ ID NO: 5751599 - DNA, 19 bp, Homo sapiens
gatttctagaaaagcttcc

SEQ ID NO: 5751600 - DNA, 21 bp, Homo sapiens
gatttctagaaaagcttccta

SEQ ID NO: 5751601 - DNA, 16 bp, Homo sapiens
gatttctagcaggcag

SEQ ID NO: 5751602 - DNA, 18 bp, Homo sapiens
gatttctaggtaggaaat

SEQ ID NO: 5751603 - DNA, 16 bp, Homo sapiens
gatttctagtatctat

SEQ ID NO: 5751604 - DNA, 13 bp, Homo sapiens
gatttctagtgta

SEQ ID NO: 5751605 - DNA, 15 bp, Homo sapiens
gatttctagttattt

SEQ ID NO: 5751606 - DNA, 14 bp, Homo sapiens
gatttctatggctt

SEQ ID NO: 5751607 - DNA, 15 bp, Homo sapiens
gatttctcattgact

SEQ ID NO: 5751608 - DNA, 22 bp, Homo sapiens
gatttctccaggtttgctgtgt

SEQ ID NO: 5751609 - DNA, 22 bp, Homo sapiens
gatttctctttgaaacatgctt

SEQ ID NO: 5751610 - DNA, 16 bp, Homo sapiens
gatttctgaagtgctt

SEQ ID NO: 5751611 - DNA, 14 bp, Homo sapiens
gatttctgaggaaa

SEQ ID NO: 5751612 - DNA, 19 bp, Homo sapiens
gatttctgcccttgttcca

SEQ ID NO: 5751613 - DNA, 13 bp, Homo sapiens
gatttctgccttc

SEQ ID NO: 5751614 - DNA, 17 bp, Homo sapiens
gatttctgccttccttg

SEQ ID NO: 5751615 - DNA, 16 bp, Homo sapiens
gatttctgccttgaaa

SEQ ID NO: 5751616 - DNA, 20 bp, Homo sapiens
gatttctgctaagttctccc

SEQ ID NO: 5751617 - DNA, 17 bp, Homo sapiens
gatttctggcatatgtt

SEQ ID NO: 5751618 - DNA, 11 bp, Homo sapiens
gatttctggga

SEQ ID NO: 5751619 - DNA, 19 bp, Homo sapiens
gatttctgtctactaagtg

SEQ ID NO: 5751620 - DNA, 15 bp, Homo sapiens
gatttctgtgaagtt

SEQ ID NO: 5751621 - DNA, 11 bp, Homo sapiens
gatttctgttt

SEQ ID NO: 5751622 - DNA, 21 bp, Homo sapiens
gatttctgtttagataataca

SEQ ID NO: 5751623 - DNA, 13 bp, Homo sapiens
gatttcttaaata

SEQ ID NO: 5751624 - DNA, 19 bp, Homo sapiens
gatttcttaaatctttctt

SEQ ID NO: 5751625 - DNA, 13 bp, Homo sapiens
gatttcttaatgt

SEQ ID NO: 5751626 - DNA, 12 bp, Homo sapiens
gatttcttaggg

SEQ ID NO: 5751627 - DNA, 17 bp, Homo sapiens
gatttcttcagaattag

SEQ ID NO: 5751628 - DNA, 24 bp, Homo sapiens
gatttcttcgctgctctagctggc

SEQ ID NO: 5751629 - DNA, 17 bp, Homo sapiens
gatttctttatataagg

SEQ ID NO: 5751630 - DNA, 11 bp, Homo sapiens
gatttctttcc

SEQ ID NO: 5751631 - DNA, 15 bp, Homo sapiens
gatttctttccagag

SEQ ID NO: 5751632 - DNA, 19 bp, Homo sapiens
gatttctttccttcccaat

SEQ ID NO: 5751633 - DNA, 23 bp, Homo sapiens
gatttctttccttcccaataggt

SEQ ID NO: 5751634 - DNA, 22 bp, Homo sapiens
gatttctttctttgcaccaaag

SEQ ID NO: 5751635 - DNA, 17 bp, Homo sapiens
gatttctttgaatgtat

SEQ ID NO: 5751636 - DNA, 17 bp, Homo sapiens
gatttctttgctgtaag

SEQ ID NO: 5751637 - DNA, 18 bp, Homo sapiens
gatttcttttcttcctgg

SEQ ID NO: 5751638 - DNA, 22 bp, Homo sapiens
gatttcttttgtaataaactat

SEQ ID NO: 5751639 - DNA, 16 bp, Homo sapiens
gatttcttttttatgt

SEQ ID NO: 5751640 - DNA, 21 bp, Homo sapiens
gatttgaaaaaaagcatggta

SEQ ID NO: 5751641 - DNA, 14 bp, Homo sapiens
gatttgaaaaactt

SEQ ID NO: 5751642 - DNA, 16 bp, Homo sapiens
gatttgaaaaactttt

SEQ ID NO: 5751643 - DNA, 15 bp, Homo sapiens
gatttgaaaaatata

SEQ ID NO: 5751644 - DNA, 21 bp, Homo sapiens
gatttgaaaaatataaaatta

SEQ ID NO: 5751645 - DNA, 21 bp, Homo sapiens
gatttgaaaacaaacttctcg

SEQ ID NO: 5751646 - DNA, 12 bp, Homo sapiens
gatttgaaaaga

SEQ ID NO: 5751647 - DNA, 16 bp, Homo sapiens
gatttgaaaagaattt

SEQ ID NO: 5751648 - DNA, 15 bp, Homo sapiens
gatttgaaacttggt

SEQ ID NO: 5751649 - DNA, 21 bp, Homo sapiens
gatttgaaccaggccttctga

SEQ ID NO: 5751650 - DNA, 16 bp, Homo sapiens
gatttgaagcaaagca

SEQ ID NO: 5751651 - DNA, 18 bp, Homo sapiens
gatttgaagctgtaccca

SEQ ID NO: 5751652 - DNA, 17 bp, Homo sapiens
gatttgaaggtcttgat

SEQ ID NO: 5751653 - DNA, 13 bp, Homo sapiens
gatttgacattgc

SEQ ID NO: 5751654 - DNA, 16 bp, Homo sapiens
gatttgaccactgaca

SEQ ID NO: 5751655 - DNA, 12 bp, Homo sapiens
gatttgactgtt

SEQ ID NO: 5751656 - DNA, 22 bp, Homo sapiens
gatttgaggagcagcttcagtt

SEQ ID NO: 5751657 - DNA, 22 bp, Homo sapiens
gatttgagtccattgcaaaagg

SEQ ID NO: 5751658 - DNA, 23 bp, Homo sapiens
gatttgagtccattgcaaaaggt

SEQ ID NO: 5751659 - DNA, 18 bp, Homo sapiens
gatttgatgcttttctct

SEQ ID NO: 5751660 - DNA, 24 bp, Homo sapiens
gatttgatgcttttctctcagcat

SEQ ID NO: 5751661 - DNA, 14 bp, Homo sapiens
gatttgatgtgact

SEQ ID NO: 5751662 - DNA, 15 bp, Homo sapiens
gatttgatgtgactt

SEQ ID NO: 5751663 - DNA, 17 bp, Homo sapiens
gatttgatgtgactttt

SEQ ID NO: 5751664 - DNA, 19 bp, Homo sapiens
gatttgattcattttcctg

SEQ ID NO: 5751665 - DNA, 21 bp, Homo sapiens
gatttgattcattttcctgtt

SEQ ID NO: 5751666 - DNA, 22 bp, Homo sapiens
gatttgcacacattggccgctt

SEQ ID NO: 5751667 - DNA, 19 bp, Homo sapiens
gatttgcacgttggggagc

SEQ ID NO: 5751668 - DNA, 14 bp, Homo sapiens
gatttgcactgctt

SEQ ID NO: 5751669 - DNA, 15 bp, Homo sapiens
gatttgcactgcttt

SEQ ID NO: 5751670 - DNA, 12 bp, Homo sapiens
gatttgcaggat

SEQ ID NO: 5751671 - DNA, 19 bp, Homo sapiens
gatttgcaggattcccttc

SEQ ID NO: 5751672 - DNA, 19 bp, Homo sapiens
gatttgcatattcattcat

SEQ ID NO: 5751673 - DNA, 19 bp, Homo sapiens
gatttgcatttttgtattt

SEQ ID NO: 5751674 - DNA, 18 bp, Homo sapiens
gatttgcattttttaaat

SEQ ID NO: 5751675 - DNA, 17 bp, Homo sapiens
gatttgccagcacaggg

SEQ ID NO: 5751676 - DNA, 20 bp, Homo sapiens
gatttgccagcacaggggcc

SEQ ID NO: 5751677 - DNA, 13 bp, Homo sapiens
gatttgccataga

SEQ ID NO: 5751678 - DNA, 21 bp, Homo sapiens
gatttgctatcaaaataaatt

SEQ ID NO: 5751679 - DNA, 23 bp, Homo sapiens
gatttgctcagtgtctggctgca

SEQ ID NO: 5751680 - DNA, 14 bp, Homo sapiens
gatttgctggattt

SEQ ID NO: 5751681 - DNA, 22 bp, Homo sapiens
gatttgctgttaccaaatctca

SEQ ID NO: 5751682 - DNA, 13 bp, Homo sapiens
gatttggaaaatt

SEQ ID NO: 5751683 - DNA, 20 bp, Homo sapiens
gatttggaatacacatgcag

SEQ ID NO: 5751684 - DNA, 19 bp, Homo sapiens
gatttggcactagccaaag

SEQ ID NO: 5751685 - DNA, 12 bp, Homo sapiens
gatttggcagga

SEQ ID NO: 5751686 - DNA, 16 bp, Homo sapiens
gatttggcatgggaca

SEQ ID NO: 5751687 - DNA, 19 bp, Homo sapiens
gatttggccacactggggc

SEQ ID NO: 5751688 - DNA, 15 bp, Homo sapiens
gatttggctcgctgt

SEQ ID NO: 5751689 - DNA, 17 bp, Homo sapiens
gatttgggatgaaatac

SEQ ID NO: 5751690 - DNA, 17 bp, Homo sapiens
gatttgggctgaatgta

SEQ ID NO: 5751691 - DNA, 23 bp, Homo sapiens
gatttgggctggaacagattcac

SEQ ID NO: 5751692 - DNA, 15 bp, Homo sapiens
gatttgggggctcgg

SEQ ID NO: 5751693 - DNA, 18 bp, Homo sapiens
gatttggtgatggaaaaa

SEQ ID NO: 5751694 - DNA, 22 bp, Homo sapiens
gatttggtgtaggtaggtctgt

SEQ ID NO: 5751695 - DNA, 14 bp, Homo sapiens
gatttggttgttta

SEQ ID NO: 5751696 - DNA, 16 bp, Homo sapiens
gatttggtttttgtct

SEQ ID NO: 5751697 - DNA, 22 bp, Homo sapiens
gatttggtttttgtcttgcatt

SEQ ID NO: 5751698 - DNA, 16 bp, Homo sapiens
gatttgtaaaacagtg

SEQ ID NO: 5751699 - DNA, 18 bp, Homo sapiens
gatttgtaaaacagtggt

SEQ ID NO: 5751700 - DNA, 14 bp, Homo sapiens
gatttgtaaatctt

SEQ ID NO: 5751701 - DNA, 21 bp, Homo sapiens
gatttgtaatatgattttata

SEQ ID NO: 5751702 - DNA, 18 bp, Homo sapiens
gatttgtaattaaattgt

SEQ ID NO: 5751703 - DNA, 21 bp, Homo sapiens
gatttgtaattacaggaggga

SEQ ID NO: 5751704 - DNA, 15 bp, Homo sapiens
gatttgtacatatta

SEQ ID NO: 5751705 - DNA, 12 bp, Homo sapiens
gatttgtaccat

SEQ ID NO: 5751706 - DNA, 21 bp, Homo sapiens
gatttgtactacagttctttt

SEQ ID NO: 5751707 - DNA, 18 bp, Homo sapiens
gatttgtagcataactgt

SEQ ID NO: 5751708 - DNA, 19 bp, Homo sapiens
gatttgtagcataactgta

SEQ ID NO: 5751709 - DNA, 12 bp, Homo sapiens
gatttgtattaa

SEQ ID NO: 5751710 - DNA, 20 bp, Homo sapiens
gatttgtcagagaacctgtt

SEQ ID NO: 5751711 - DNA, 14 bp, Homo sapiens
gatttgtcccagcc

SEQ ID NO: 5751712 - DNA, 20 bp, Homo sapiens
gatttgtcccagcctggggc

SEQ ID NO: 5751713 - DNA, 14 bp, Homo sapiens
gatttgtcccaggt

SEQ ID NO: 5751714 - DNA, 17 bp, Homo sapiens
gatttgtctcatatatt

SEQ ID NO: 5751715 - DNA, 15 bp, Homo sapiens
gatttgtctctgagc

SEQ ID NO: 5751716 - DNA, 19 bp, Homo sapiens
gatttgtcttcccttcttt

SEQ ID NO: 5751717 - DNA, 20 bp, Homo sapiens
gatttgtctttggtgaacat

SEQ ID NO: 5751718 - DNA, 20 bp, Homo sapiens
gatttgtgaaataaaacagg

SEQ ID NO: 5751719 - DNA, 11 bp, Homo sapiens
gatttgtgaac

SEQ ID NO: 5751720 - DNA, 16 bp, Homo sapiens
gatttgtgaactggaa

SEQ ID NO: 5751721 - DNA, 21 bp, Homo sapiens
gatttgtgcaaacatggagaa

SEQ ID NO: 5751722 - DNA, 23 bp, Homo sapiens
gatttgtggggacctcagcctgc

SEQ ID NO: 5751723 - DNA, 22 bp, Homo sapiens
gatttgtgtctgtgacttttgt

SEQ ID NO: 5751724 - DNA, 20 bp, Homo sapiens
gatttgtgttttacagtata

SEQ ID NO: 5751725 - DNA, 19 bp, Homo sapiens
gatttgttaatgatagcta

SEQ ID NO: 5751726 - DNA, 11 bp, Homo sapiens
gatttgttcat

SEQ ID NO: 5751727 - DNA, 12 bp, Homo sapiens
gatttgttcatt

SEQ ID NO: 5751728 - DNA, 16 bp, Homo sapiens
gatttgttgaaatctt

SEQ ID NO: 5751729 - DNA, 22 bp, Homo sapiens
gatttgttgacagcaaaatgtt

SEQ ID NO: 5751730 - DNA, 21 bp, Homo sapiens
gatttgttgttctttcagaaa

SEQ ID NO: 5751731 - DNA, 18 bp, Homo sapiens
gatttgttttgcattcct

SEQ ID NO: 5751732 - DNA, 21 bp, Homo sapiens
gatttgtttttaaactgtaca

SEQ ID NO: 5751733 - DNA, 23 bp, Homo sapiens
gatttgtttttaaactgtacagt

SEQ ID NO: 5751734 - DNA, 19 bp, Homo sapiens
gatttgtttttgtattttt

SEQ ID NO: 5751735 - DNA, 19 bp, Homo sapiens
gattttaaaaaatcaatca

SEQ ID NO: 5751736 - DNA, 14 bp, Homo sapiens
gattttaaaaacat

SEQ ID NO: 5751737 - DNA, 21 bp, Homo sapiens
gattttaaaaacatgagaaat

SEQ ID NO: 5751738 - DNA, 23 bp, Homo sapiens
gattttaaaaacatgagaaatgt

SEQ ID NO: 5751739 - DNA, 15 bp, Homo sapiens
gattttaaaaataca

SEQ ID NO: 5751740 - DNA, 23 bp, Homo sapiens
gattttaaaacttttctgcattt

SEQ ID NO: 5751741 - DNA, 13 bp, Homo sapiens
gattttaaaatgt

SEQ ID NO: 5751742 - DNA, 18 bp, Homo sapiens
gattttaaaatgtacatg

SEQ ID NO: 5751743 - DNA, 13 bp, Homo sapiens
gattttaaacaaa

SEQ ID NO: 5751744 - DNA, 19 bp, Homo sapiens
gattttaaacaaaatttat

SEQ ID NO: 5751745 - DNA, 14 bp, Homo sapiens
gattttaaactaga

SEQ ID NO: 5751746 - DNA, 15 bp, Homo sapiens
gattttaacaataac

SEQ ID NO: 5751747 - DNA, 15 bp, Homo sapiens
gattttaagaatggt

SEQ ID NO: 5751748 - DNA, 17 bp, Homo sapiens
gattttaatcaagttga

SEQ ID NO: 5751749 - DNA, 22 bp, Homo sapiens
gattttaatgaaatcaaatgta

SEQ ID NO: 5751750 - DNA, 20 bp, Homo sapiens
gattttaatggattgttaat

SEQ ID NO: 5751751 - DNA, 15 bp, Homo sapiens
gattttaattcaggt

SEQ ID NO: 5751752 - DNA, 16 bp, Homo sapiens
gattttaattgtcatg

SEQ ID NO: 5751753 - DNA, 18 bp, Homo sapiens
gattttaatttatttgtt

SEQ ID NO: 5751754 - DNA, 16 bp, Homo sapiens
gattttacaaaagatg

SEQ ID NO: 5751755 - DNA, 15 bp, Homo sapiens
gattttacaaattaa

SEQ ID NO: 5751756 - DNA, 21 bp, Homo sapiens
gattttacaaattaatatttg

SEQ ID NO: 5751757 - DNA, 13 bp, Homo sapiens
gattttacaagta

SEQ ID NO: 5751758 - DNA, 14 bp, Homo sapiens
gattttacaagtat

SEQ ID NO: 5751759 - DNA, 18 bp, Homo sapiens
gattttacaattgaaatg

SEQ ID NO: 5751760 - DNA, 19 bp, Homo sapiens
gattttacaattgaaatga

SEQ ID NO: 5751761 - DNA, 15 bp, Homo sapiens
gattttacagagaat

SEQ ID NO: 5751762 - DNA, 12 bp, Homo sapiens
gattttacatga

SEQ ID NO: 5751763 - DNA, 13 bp, Homo sapiens
gattttacatgaa

SEQ ID NO: 5751764 - DNA, 20 bp, Homo sapiens
gattttacatgaagtatttt

SEQ ID NO: 5751765 - DNA, 16 bp, Homo sapiens
gattttagacttacct

SEQ ID NO: 5751766 - DNA, 17 bp, Homo sapiens
gattttagcctcttccc

SEQ ID NO: 5751767 - DNA, 24 bp, Homo sapiens
gattttagctaggatttgaacact

SEQ ID NO: 5751768 - DNA, 19 bp, Homo sapiens
gattttaggagctaaggct

SEQ ID NO: 5751769 - DNA, 19 bp, Homo sapiens
gattttatgatcagtgttg

SEQ ID NO: 5751770 - DNA, 14 bp, Homo sapiens
gattttatgcttta

SEQ ID NO: 5751771 - DNA, 16 bp, Homo sapiens
gattttatgtgcttga

SEQ ID NO: 5751772 - DNA, 20 bp, Homo sapiens
gattttatgtgcttgaagat

SEQ ID NO: 5751773 - DNA, 21 bp, Homo sapiens
gattttatgtgcttgaagatt

SEQ ID NO: 5751774 - DNA, 12 bp, Homo sapiens
gattttattaca

SEQ ID NO: 5751775 - DNA, 20 bp, Homo sapiens
gattttattacagaaatgtt

SEQ ID NO: 5751776 - DNA, 22 bp, Homo sapiens
gattttattacagaaatgtttt

SEQ ID NO: 5751777 - DNA, 22 bp, Homo sapiens
gattttattactggcgtggatt

SEQ ID NO: 5751778 - DNA, 15 bp, Homo sapiens
gattttattatgtaa

SEQ ID NO: 5751779 - DNA, 18 bp, Homo sapiens
gattttattatgtaaatc

SEQ ID NO: 5751780 - DNA, 18 bp, Homo sapiens
gattttattcttatttca

SEQ ID NO: 5751781 - DNA, 20 bp, Homo sapiens
gattttattttcaagcaaat

SEQ ID NO: 5751782 - DNA, 21 bp, Homo sapiens
gattttatttttgcaaaataa

SEQ ID NO: 5751783 - DNA, 19 bp, Homo sapiens
gattttcaaagctttttcc

SEQ ID NO: 5751784 - DNA, 20 bp, Homo sapiens
gattttcaagattctaaagc

SEQ ID NO: 5751785 - DNA, 18 bp, Homo sapiens
gattttcaagttattcag

SEQ ID NO: 5751786 - DNA, 13 bp, Homo sapiens
gattttcacacat

SEQ ID NO: 5751787 - DNA, 22 bp, Homo sapiens
gattttcacagctttgaggaac

SEQ ID NO: 5751788 - DNA, 15 bp, Homo sapiens
gattttcagccctca

SEQ ID NO: 5751789 - DNA, 23 bp, Homo sapiens
gattttcataacttattgctgat

SEQ ID NO: 5751790 - DNA, 22 bp, Homo sapiens
gattttcatatcccgtgaaagt

SEQ ID NO: 5751791 - DNA, 12 bp, Homo sapiens
gattttcatttt

SEQ ID NO: 5751792 - DNA, 11 bp, Homo sapiens
gattttccatc

SEQ ID NO: 5751793 - DNA, 18 bp, Homo sapiens
gattttccattaactatt

SEQ ID NO: 5751794 - DNA, 18 bp, Homo sapiens
gattttcctgaatattaa

SEQ ID NO: 5751795 - DNA, 21 bp, Homo sapiens
gattttccttttttatacaca

SEQ ID NO: 5751796 - DNA, 17 bp, Homo sapiens
gattttctagaaatgtt

SEQ ID NO: 5751797 - DNA, 18 bp, Homo sapiens
gattttctattgttactc

SEQ ID NO: 5751798 - DNA, 20 bp, Homo sapiens
gattttctcactgaactcca

SEQ ID NO: 5751799 - DNA, 23 bp, Homo sapiens
gattttctcactgaactccaccg

SEQ ID NO: 5751800 - DNA, 14 bp, Homo sapiens
gattttctctggaa

SEQ ID NO: 5751801 - DNA, 15 bp, Homo sapiens
gattttctggttcta

SEQ ID NO: 5751802 - DNA, 20 bp, Homo sapiens
gattttcttaaggaattttg

SEQ ID NO: 5751803 - DNA, 11 bp, Homo sapiens
gattttcttct

SEQ ID NO: 5751804 - DNA, 13 bp, Homo sapiens
gattttctttaaa

SEQ ID NO: 5751805 - DNA, 12 bp, Homo sapiens
gattttctttct

SEQ ID NO: 5751806 - DNA, 16 bp, Homo sapiens
gattttctttctatgt

SEQ ID NO: 5751807 - DNA, 17 bp, Homo sapiens
gattttctttctatgta

SEQ ID NO: 5751808 - DNA, 18 bp, Homo sapiens
gattttctttttaacttt

SEQ ID NO: 5751809 - DNA, 21 bp, Homo sapiens
gattttgaaaaattacctgta

SEQ ID NO: 5751810 - DNA, 12 bp, Homo sapiens
gattttgaaaac

SEQ ID NO: 5751811 - DNA, 21 bp, Homo sapiens
gattttgaaaactacatttta

SEQ ID NO: 5751812 - DNA, 13 bp, Homo sapiens
gattttgaaaagt

SEQ ID NO: 5751813 - DNA, 17 bp, Homo sapiens
gattttgaggtaaagat

SEQ ID NO: 5751814 - DNA, 13 bp, Homo sapiens
gattttgataact

SEQ ID NO: 5751815 - DNA, 19 bp, Homo sapiens
gattttgatccaagctggt

SEQ ID NO: 5751816 - DNA, 15 bp, Homo sapiens
gattttgcaaaatga

SEQ ID NO: 5751817 - DNA, 20 bp, Homo sapiens
gattttgcagttctttggct

SEQ ID NO: 5751818 - DNA, 16 bp, Homo sapiens
gattttgccctcctgc

SEQ ID NO: 5751819 - DNA, 13 bp, Homo sapiens
gattttgctgact

SEQ ID NO: 5751820 - DNA, 18 bp, Homo sapiens
gattttgctgtatatttg

SEQ ID NO: 5751821 - DNA, 20 bp, Homo sapiens
gattttggaaactcaaggaa

SEQ ID NO: 5751822 - DNA, 17 bp, Homo sapiens
gattttggataataaac

SEQ ID NO: 5751823 - DNA, 21 bp, Homo sapiens
gattttggtattacactgtat

SEQ ID NO: 5751824 - DNA, 17 bp, Homo sapiens
gattttgtaagaagttt

SEQ ID NO: 5751825 - DNA, 11 bp, Homo sapiens
gattttgtaat

SEQ ID NO: 5751826 - DNA, 15 bp, Homo sapiens
gattttgtaattctt

SEQ ID NO: 5751827 - DNA, 12 bp, Homo sapiens
gattttgtacag

SEQ ID NO: 5751828 - DNA, 14 bp, Homo sapiens
gattttgtacagaa

SEQ ID NO: 5751829 - DNA, 23 bp, Homo sapiens
gattttgtatctgcaggcagaca

SEQ ID NO: 5751830 - DNA, 22 bp, Homo sapiens
gattttgtatctttttgaaaat

SEQ ID NO: 5751831 - DNA, 16 bp, Homo sapiens
gattttgtattgccat

SEQ ID NO: 5751832 - DNA, 17 bp, Homo sapiens
gattttgtcttatatga

SEQ ID NO: 5751833 - DNA, 17 bp, Homo sapiens
gattttgtgaaatttca

SEQ ID NO: 5751834 - DNA, 21 bp, Homo sapiens
gatttttaaaaaatattttct

SEQ ID NO: 5751835 - DNA, 16 bp, Homo sapiens
gatttttaaagtactt

SEQ ID NO: 5751836 - DNA, 23 bp, Homo sapiens
gatttttaaagtttaaataccag

SEQ ID NO: 5751837 - DNA, 14 bp, Homo sapiens
gatttttaaattaa

SEQ ID NO: 5751838 - DNA, 17 bp, Homo sapiens
gatttttaagtacaaaa

SEQ ID NO: 5751839 - DNA, 22 bp, Homo sapiens
gatttttaattaaaaactagta

SEQ ID NO: 5751840 - DNA, 16 bp, Homo sapiens
gatttttacaagatcc

SEQ ID NO: 5751841 - DNA, 15 bp, Homo sapiens
gatttttacactaat

SEQ ID NO: 5751842 - DNA, 12 bp, Homo sapiens
gatttttaccag

SEQ ID NO: 5751843 - DNA, 14 bp, Homo sapiens
gatttttactaata

SEQ ID NO: 5751844 - DNA, 16 bp, Homo sapiens
gatttttactgtgttt

SEQ ID NO: 5751845 - DNA, 18 bp, Homo sapiens
gatttttatccatttctt

SEQ ID NO: 5751846 - DNA, 16 bp, Homo sapiens
gatttttatgtacata

SEQ ID NO: 5751847 - DNA, 15 bp, Homo sapiens
gatttttatgtttta

SEQ ID NO: 5751848 - DNA, 20 bp, Homo sapiens
gatttttattaactgctttt

SEQ ID NO: 5751849 - DNA, 19 bp, Homo sapiens
gatttttcatatgtggaaa

SEQ ID NO: 5751850 - DNA, 22 bp, Homo sapiens
gatttttcatatgtggaaatat

SEQ ID NO: 5751851 - DNA, 23 bp, Homo sapiens
gatttttcggaggccccactgat

SEQ ID NO: 5751852 - DNA, 16 bp, Homo sapiens
gatttttctataatca

SEQ ID NO: 5751853 - DNA, 12 bp, Homo sapiens
gatttttctcaa

SEQ ID NO: 5751854 - DNA, 14 bp, Homo sapiens
gatttttctcttca

SEQ ID NO: 5751855 - DNA, 23 bp, Homo sapiens
gatttttcttcaggtaacactac

SEQ ID NO: 5751856 - DNA, 12 bp, Homo sapiens
gatttttcttct

SEQ ID NO: 5751857 - DNA, 20 bp, Homo sapiens
gatttttctttacaaaacaa

SEQ ID NO: 5751858 - DNA, 21 bp, Homo sapiens
gatttttgagcccttgtttca

SEQ ID NO: 5751859 - DNA, 18 bp, Homo sapiens
gatttttgatatctcaat

SEQ ID NO: 5751860 - DNA, 20 bp, Homo sapiens
gatttttgcaataccaagta

SEQ ID NO: 5751861 - DNA, 17 bp, Homo sapiens
gatttttgccctgcgtc

SEQ ID NO: 5751862 - DNA, 13 bp, Homo sapiens
gatttttgcctct

SEQ ID NO: 5751863 - DNA, 21 bp, Homo sapiens
gatttttgttaagctcaggat

SEQ ID NO: 5751864 - DNA, 18 bp, Homo sapiens
gatttttgtttttgtaat

SEQ ID NO: 5751865 - DNA, 19 bp, Homo sapiens
gattttttaaaaaaaatgt

SEQ ID NO: 5751866 - DNA, 15 bp, Homo sapiens
gattttttaaaagaa

SEQ ID NO: 5751867 - DNA, 14 bp, Homo sapiens
gattttttaaaatt

SEQ ID NO: 5751868 - DNA, 23 bp, Homo sapiens
gattttttaagactgtgtctgta

SEQ ID NO: 5751869 - DNA, 20 bp, Homo sapiens
gattttttactgccctttca

SEQ ID NO: 5751870 - DNA, 14 bp, Homo sapiens
gattttttattgct

SEQ ID NO: 5751871 - DNA, 11 bp, Homo sapiens
gattttttcca

SEQ ID NO: 5751872 - DNA, 14 bp, Homo sapiens
gattttttccaaaa

SEQ ID NO: 5751873 - DNA, 14 bp, Homo sapiens
gattttttcccttt

SEQ ID NO: 5751874 - DNA, 21 bp, Homo sapiens
gattttttgaggccagtaatt

SEQ ID NO: 5751875 - DNA, 10 bp, Homo sapiens
gattttttgt

SEQ ID NO: 5751876 - DNA, 11 bp, Homo sapiens
gatttttttgt

SEQ ID NO: 5751877 - DNA, 17 bp, Homo sapiens
gatttttttgtgtatgt

SEQ ID NO: 5751878 - DNA, 15 bp, Homo sapiens
gatttttttgttcat

SEQ ID NO: 5751879 - DNA, 23 bp, Homo sapiens
gatttttttttagaacagaaaac

SEQ ID NO: 5751880 - DNA, 16 bp, Homo sapiens
gatttttttttccttc

SEQ ID NO: 5751881 - DNA, 21 bp, Homo sapiens
gatttttttttccttcagtgc

SEQ ID NO: 5751882 - DNA, 21 bp, Homo sapiens
gattttttttttaagtgacat

SEQ ID NO: 5751883 - DNA, 14 bp, Homo sapiens
gattttttttttca

SEQ ID NO: 5751884 - DNA, 20 bp, Homo sapiens
gatttttttttttttttcct

SEQ ID NO: 5751885 - DNA, 21 bp, Homo sapiens
gatttttttttttttttcctt

SEQ ID NO: 5751886 - DNA, 22 bp, Homo sapiens
gcaaaaaaaaaattgtttttcc

SEQ ID NO: 5751887 - DNA, 13 bp, Homo sapiens
gcaaaaaaaaact

SEQ ID NO: 5751888 - DNA, 14 bp, Homo sapiens
gcaaaaaaaaattt

SEQ ID NO: 5751889 - DNA, 13 bp, Homo sapiens
gcaaaaaaagaaa

SEQ ID NO: 5751890 - DNA, 20 bp, Homo sapiens
gcaaaaaactcgaggactgt

SEQ ID NO: 5751891 - DNA, 23 bp, Homo sapiens
gcaaaaaactcttaatctgtgtg

SEQ ID NO: 5751892 - DNA, 17 bp, Homo sapiens
gcaaaaaagaaaacctt

SEQ ID NO: 5751893 - DNA, 13 bp, Homo sapiens
gcaaaaaagaaca

SEQ ID NO: 5751894 - DNA, 12 bp, Homo sapiens
gcaaaaaatact

SEQ ID NO: 5751895 - DNA, 18 bp, Homo sapiens
gcaaaaaatactttttct

SEQ ID NO: 5751896 - DNA, 21 bp, Homo sapiens
gcaaaaaatactttttctaat

SEQ ID NO: 5751897 - DNA, 12 bp, Homo sapiens
gcaaaaaatctt

SEQ ID NO: 5751898 - DNA, 22 bp, Homo sapiens
gcaaaaaattctttagagatta

SEQ ID NO: 5751899 - DNA, 22 bp, Homo sapiens
gcaaaaacatgtatgtgcattt

SEQ ID NO: 5751900 - DNA, 19 bp, Homo sapiens
gcaaaaactacattttgca

SEQ ID NO: 5751901 - DNA, 14 bp, Homo sapiens
gcaaaaactgtaaa

SEQ ID NO: 5751902 - DNA, 14 bp, Homo sapiens
gcaaaaacttcctt

SEQ ID NO: 5751903 - DNA, 19 bp, Homo sapiens
gcaaaaagaaaaaaagaaa

SEQ ID NO: 5751904 - DNA, 22 bp, Homo sapiens
gcaaaaagcaagggagaaaaga

SEQ ID NO: 5751905 - DNA, 13 bp, Homo sapiens
gcaaaaaggactg

SEQ ID NO: 5751906 - DNA, 14 bp, Homo sapiens
gcaaaaaggcagga

SEQ ID NO: 5751907 - DNA, 22 bp, Homo sapiens
gcaaaaagtagacttggtgtga

SEQ ID NO: 5751908 - DNA, 16 bp, Homo sapiens
gcaaaaatagctcttg

SEQ ID NO: 5751909 - DNA, 14 bp, Homo sapiens
gcaaaaatagttaa

SEQ ID NO: 5751910 - DNA, 11 bp, Homo sapiens
gcaaaaatata

SEQ ID NO: 5751911 - DNA, 14 bp, Homo sapiens
gcaaaaatataaaa

SEQ ID NO: 5751912 - DNA, 16 bp, Homo sapiens
gcaaaaatataaaata

SEQ ID NO: 5751913 - DNA, 17 bp, Homo sapiens
gcaaaaatattttgcaa

SEQ ID NO: 5751914 - DNA, 20 bp, Homo sapiens
gcaaaaatgacaacagaaaa

SEQ ID NO: 5751915 - DNA, 15 bp, Homo sapiens
gcaaaaatgctaata

SEQ ID NO: 5751916 - DNA, 15 bp, Homo sapiens
gcaaaaatgtaaaaa

SEQ ID NO: 5751917 - DNA, 19 bp, Homo sapiens
gcaaaaatgtaaaaaacaa

SEQ ID NO: 5751918 - DNA, 20 bp, Homo sapiens
gcaaaaatgtaaaaaacaaa

SEQ ID NO: 5751919 - DNA, 15 bp, Homo sapiens
gcaaaaattatatat

SEQ ID NO: 5751920 - DNA, 11 bp, Homo sapiens
gcaaaaatttt

SEQ ID NO: 5751921 - DNA, 15 bp, Homo sapiens
gcaaaacagacatca

SEQ ID NO: 5751922 - DNA, 17 bp, Homo sapiens
gcaaaacagattcaaag

SEQ ID NO: 5751923 - DNA, 21 bp, Homo sapiens
gcaaaacagccctcagactgt

SEQ ID NO: 5751924 - DNA, 22 bp, Homo sapiens
gcaaaacagcgtttaagactgt

SEQ ID NO: 5751925 - DNA, 16 bp, Homo sapiens
gcaaaacatcacattc

SEQ ID NO: 5751926 - DNA, 12 bp, Homo sapiens
gcaaaaccaaac

SEQ ID NO: 5751927 - DNA, 15 bp, Homo sapiens
gcaaaaccaaactgg

SEQ ID NO: 5751928 - DNA, 18 bp, Homo sapiens
gcaaaaccattgcttcac

SEQ ID NO: 5751929 - DNA, 20 bp, Homo sapiens
gcaaaacgcatggagtgtgt

SEQ ID NO: 5751930 - DNA, 16 bp, Homo sapiens
gcaaaacggatgagtt

SEQ ID NO: 5751931 - DNA, 17 bp, Homo sapiens
gcaaaactcaggcagaa

SEQ ID NO: 5751932 - DNA, 14 bp, Homo sapiens
gcaaaactgtgctt

SEQ ID NO: 5751933 - DNA, 14 bp, Homo sapiens
gcaaaacttttaaa

SEQ ID NO: 5751934 - DNA, 14 bp, Homo sapiens
gcaaaagaaactat

SEQ ID NO: 5751935 - DNA, 14 bp, Homo sapiens
gcaaaagaaagcaa

SEQ ID NO: 5751936 - DNA, 15 bp, Homo sapiens
gcaaaagaagaagtt

SEQ ID NO: 5751937 - DNA, 16 bp, Homo sapiens
gcaaaagaagtaaaag

SEQ ID NO: 5751938 - DNA, 18 bp, Homo sapiens
gcaaaagaagtaaaagct

SEQ ID NO: 5751939 - DNA, 14 bp, Homo sapiens
gcaaaagaagtaac

SEQ ID NO: 5751940 - DNA, 13 bp, Homo sapiens
gcaaaagaagttg

SEQ ID NO: 5751941 - DNA, 16 bp, Homo sapiens
gcaaaagactaattta

SEQ ID NO: 5751942 - DNA, 22 bp, Homo sapiens
gcaaaagactggtttgtttgct

SEQ ID NO: 5751943 - DNA, 21 bp, Homo sapiens
gcaaaagacttgagccatcca

SEQ ID NO: 5751944 - DNA, 13 bp, Homo sapiens
gcaaaagagaaaa

SEQ ID NO: 5751945 - DNA, 23 bp, Homo sapiens
gcaaaagagggtttattttcagt

SEQ ID NO: 5751946 - DNA, 12 bp, Homo sapiens
gcaaaagagtgt

SEQ ID NO: 5751947 - DNA, 21 bp, Homo sapiens
gcaaaagagtgtaaaatattt

SEQ ID NO: 5751948 - DNA, 18 bp, Homo sapiens
gcaaaagcctcagaaagg

SEQ ID NO: 5751949 - DNA, 23 bp, Homo sapiens
gcaaaagccttgtgtatatttgt

SEQ ID NO: 5751950 - DNA, 19 bp, Homo sapiens
gcaaaagcttacaaatact

SEQ ID NO: 5751951 - DNA, 11 bp, Homo sapiens
gcaaaaggaaa

SEQ ID NO: 5751952 - DNA, 20 bp, Homo sapiens
gcaaaaggatctttgtggcc

SEQ ID NO: 5751953 - DNA, 23 bp, Homo sapiens
gcaaaaggatctttgtggccaag

SEQ ID NO: 5751954 - DNA, 12 bp, Homo sapiens
gcaaaaggcagc

SEQ ID NO: 5751955 - DNA, 16 bp, Homo sapiens
gcaaaaggcagctcac

SEQ ID NO: 5751956 - DNA, 23 bp, Homo sapiens
gcaaaaggcagctcacccctggg

SEQ ID NO: 5751957 - DNA, 16 bp, Homo sapiens
gcaaaaggcctcttgt

SEQ ID NO: 5751958 - DNA, 17 bp, Homo sapiens
gcaaaagggcagctgtg

SEQ ID NO: 5751959 - DNA, 19 bp, Homo sapiens
gcaaaagggcagctgtgat

SEQ ID NO: 5751960 - DNA, 17 bp, Homo sapiens
gcaaaaggttaagccat

SEQ ID NO: 5751961 - DNA, 23 bp, Homo sapiens
gcaaaagtgctgcagggctttaa

SEQ ID NO: 5751962 - DNA, 13 bp, Homo sapiens
gcaaaagtgtaac

SEQ ID NO: 5751963 - DNA, 19 bp, Homo sapiens
gcaaaagttctgacttgac

SEQ ID NO: 5751964 - DNA, 15 bp, Homo sapiens
gcaaaataaaacata

SEQ ID NO: 5751965 - DNA, 14 bp, Homo sapiens
gcaaaataaaatga

SEQ ID NO: 5751966 - DNA, 22 bp, Homo sapiens
gcaaaataacaaaaaagagaaa

SEQ ID NO: 5751967 - DNA, 15 bp, Homo sapiens
gcaaaataattttaa

SEQ ID NO: 5751968 - DNA, 11 bp, Homo sapiens
gcaaaatacat

SEQ ID NO: 5751969 - DNA, 13 bp, Homo sapiens
gcaaaatacatga

SEQ ID NO: 5751970 - DNA, 15 bp, Homo sapiens
gcaaaatagaagaag

SEQ ID NO: 5751971 - DNA, 22 bp, Homo sapiens
gcaaaatagaagaagaggaagt

SEQ ID NO: 5751972 - DNA, 15 bp, Homo sapiens
gcaaaatagacatct

SEQ ID NO: 5751973 - DNA, 17 bp, Homo sapiens
gcaaaatagacatcttt

SEQ ID NO: 5751974 - DNA, 13 bp, Homo sapiens
gcaaaatagcatt

SEQ ID NO: 5751975 - DNA, 10 bp, Homo sapiens
gcaaaatatg

SEQ ID NO: 5751976 - DNA, 18 bp, Homo sapiens
gcaaaatatgccccttct

SEQ ID NO: 5751977 - DNA, 18 bp, Homo sapiens
gcaaaatattatgttatg

SEQ ID NO: 5751978 - DNA, 21 bp, Homo sapiens
gcaaaatattcttctttgata

SEQ ID NO: 5751979 - DNA, 21 bp, Homo sapiens
gcaaaatattggtattaaaga

SEQ ID NO: 5751980 - DNA, 23 bp, Homo sapiens
gcaaaatcagaatggaatgctct

SEQ ID NO: 5751981 - DNA, 12 bp, Homo sapiens
gcaaaatccaaa

SEQ ID NO: 5751982 - DNA, 17 bp, Homo sapiens
gcaaaatccaaactgct

SEQ ID NO: 5751983 - DNA, 18 bp, Homo sapiens
gcaaaatccaaactgctg

SEQ ID NO: 5751984 - DNA, 21 bp, Homo sapiens
gcaaaatccaaactgctgtct

SEQ ID NO: 5751985 - DNA, 23 bp, Homo sapiens
gcaaaatccttacttccagcaaa

SEQ ID NO: 5751986 - DNA, 17 bp, Homo sapiens
gcaaaatcgccataggc

SEQ ID NO: 5751987 - DNA, 18 bp, Homo sapiens
gcaaaatcgccataggcc

SEQ ID NO: 5751988 - DNA, 17 bp, Homo sapiens
gcaaaatgaggaatgta

SEQ ID NO: 5751989 - DNA, 21 bp, Homo sapiens
gcaaaatggaagcaaagacaa

SEQ ID NO: 5751990 - DNA, 15 bp, Homo sapiens
gcaaaatgtagaaat

SEQ ID NO: 5751991 - DNA, 16 bp, Homo sapiens
gcaaaatgtcttgtgt

SEQ ID NO: 5751992 - DNA, 19 bp, Homo sapiens
gcaaaatgtcttgtgtatt

SEQ ID NO: 5751993 - DNA, 15 bp, Homo sapiens
gcaaaatgtgtttca

SEQ ID NO: 5751994 - DNA, 12 bp, Homo sapiens
gcaaaattaaat

SEQ ID NO: 5751995 - DNA, 16 bp, Homo sapiens
gcaaaattcccaggga

SEQ ID NO: 5751996 - DNA, 21 bp, Homo sapiens
gcaaaatttgatgccaggaca

SEQ ID NO: 5751997 - DNA, 14 bp, Homo sapiens
gcaaaatttttaaa

SEQ ID NO: 5751998 - DNA, 15 bp, Homo sapiens
gcaaacaaaatgatg

SEQ ID NO: 5751999 - DNA, 13 bp, Homo sapiens
gcaaacaacctga

SEQ ID NO: 5752000 - DNA, 24 bp, Homo sapiens
gcaaacaatgaagaattatgtaat

SEQ ID NO: 5752001 - DNA, 22 bp, Homo sapiens
gcaaacaattttaatgatggtg

SEQ ID NO: 5752002 - DNA, 16 bp, Homo sapiens
gcaaacacaccttgga

SEQ ID NO: 5752003 - DNA, 15 bp, Homo sapiens
gcaaacacctgctga

SEQ ID NO: 5752004 - DNA, 15 bp, Homo sapiens
gcaaacactccaccc

SEQ ID NO: 5752005 - DNA, 12 bp, Homo sapiens
gcaaacacttaa

SEQ ID NO: 5752006 - DNA, 13 bp, Homo sapiens
gcaaacagaacag

SEQ ID NO: 5752007 - DNA, 17 bp, Homo sapiens
gcaaacagaagtgcatc

SEQ ID NO: 5752008 - DNA, 21 bp, Homo sapiens
gcaaacagagctactgagact

SEQ ID NO: 5752009 - DNA, 12 bp, Homo sapiens
gcaaacagagga

SEQ ID NO: 5752010 - DNA, 22 bp, Homo sapiens
gcaaacagctgaaagaggagga

SEQ ID NO: 5752011 - DNA, 18 bp, Homo sapiens
gcaaacagggcctctgcg

SEQ ID NO: 5752012 - DNA, 19 bp, Homo sapiens
gcaaacaggttgttttcta

SEQ ID NO: 5752013 - DNA, 12 bp, Homo sapiens
gcaaacatcaaa

SEQ ID NO: 5752014 - DNA, 19 bp, Homo sapiens
gcaaacatcaaataaattt

SEQ ID NO: 5752015 - DNA, 21 bp, Homo sapiens
gcaaacatcaaataaatttct

SEQ ID NO: 5752016 - DNA, 13 bp, Homo sapiens
gcaaacatggaga

SEQ ID NO: 5752017 - DNA, 20 bp, Homo sapiens
gcaaacatttctttttcctt

SEQ ID NO: 5752018 - DNA, 22 bp, Homo sapiens
gcaaaccaagagattgctaatt

SEQ ID NO: 5752019 - DNA, 14 bp, Homo sapiens
gcaaaccaggagca

SEQ ID NO: 5752020 - DNA, 17 bp, Homo sapiens
gcaaaccaggctgcagg

SEQ ID NO: 5752021 - DNA, 17 bp, Homo sapiens
gcaaaccatcattgaaa

SEQ ID NO: 5752022 - DNA, 17 bp, Homo sapiens
gcaaaccattatacctt

SEQ ID NO: 5752023 - DNA, 14 bp, Homo sapiens
gcaaacccatgaag

SEQ ID NO: 5752024 - DNA, 20 bp, Homo sapiens
gcaaacccatgaagctggcc

SEQ ID NO: 5752025 - DNA, 22 bp, Homo sapiens
gcaaaccccctttgtgctgtgg

SEQ ID NO: 5752026 - DNA, 15 bp, Homo sapiens
gcaaaccctgtcaaa

SEQ ID NO: 5752027 - DNA, 20 bp, Homo sapiens
gcaaaccctgtcaaacatta

SEQ ID NO: 5752028 - DNA, 23 bp, Homo sapiens
gcaaaccctgttcaggctggctc

SEQ ID NO: 5752029 - DNA, 19 bp, Homo sapiens
gcaaacccttctcttctcc

SEQ ID NO: 5752030 - DNA, 21 bp, Homo sapiens
gcaaaccgcatgctcttaccc

SEQ ID NO: 5752031 - DNA, 19 bp, Homo sapiens
gcaaacctaattgcacaac

SEQ ID NO: 5752032 - DNA, 16 bp, Homo sapiens
gcaaacctagccccca

SEQ ID NO: 5752033 - DNA, 21 bp, Homo sapiens
gcaaacctagccggaaggccg

SEQ ID NO: 5752034 - DNA, 22 bp, Homo sapiens
gcaaacctcagtcatattctta

SEQ ID NO: 5752035 - DNA, 14 bp, Homo sapiens
gcaaacctctcctt

SEQ ID NO: 5752036 - DNA, 19 bp, Homo sapiens
gcaaacctgacccctgctc

SEQ ID NO: 5752037 - DNA, 14 bp, Homo sapiens
gcaaacctgcccca

SEQ ID NO: 5752038 - DNA, 21 bp, Homo sapiens
gcaaaccttcctgggaggaca

SEQ ID NO: 5752039 - DNA, 13 bp, Homo sapiens
gcaaacctttccc

SEQ ID NO: 5752040 - DNA, 14 bp, Homo sapiens
gcaaacgctaaaga

SEQ ID NO: 5752041 - DNA, 18 bp, Homo sapiens
gcaaacgctgcctgcccg

SEQ ID NO: 5752042 - DNA, 22 bp, Homo sapiens
gcaaacggcaacgtagcctggg

SEQ ID NO: 5752043 - DNA, 22 bp, Homo sapiens
gcaaacgggcttgactttggct

SEQ ID NO: 5752044 - DNA, 16 bp, Homo sapiens
gcaaacgtccacaaag

SEQ ID NO: 5752045 - DNA, 17 bp, Homo sapiens
gcaaactcactgctcaa

SEQ ID NO: 5752046 - DNA, 23 bp, Homo sapiens
gcaaactctataaagaaactttt

SEQ ID NO: 5752047 - DNA, 14 bp, Homo sapiens
gcaaactctctaaa

SEQ ID NO: 5752048 - DNA, 10 bp, Homo sapiens
gcaaactctt

SEQ ID NO: 5752049 - DNA, 19 bp, Homo sapiens
gcaaactgaaattagtgtt

SEQ ID NO: 5752050 - DNA, 16 bp, Homo sapiens
gcaaactgaggcagca

SEQ ID NO: 5752051 - DNA, 19 bp, Homo sapiens
gcaaactgatgctgaggat

SEQ ID NO: 5752052 - DNA, 13 bp, Homo sapiens
gcaaactgcatgc

SEQ ID NO: 5752053 - DNA, 22 bp, Homo sapiens
gcaaactgcatgcccagagacc

SEQ ID NO: 5752054 - DNA, 22 bp, Homo sapiens
gcaaactgggaacccctttccc

SEQ ID NO: 5752055 - DNA, 21 bp, Homo sapiens
gcaaactgtcctctacatcaa

SEQ ID NO: 5752056 - DNA, 22 bp, Homo sapiens
gcaaacttacaggtcctgctga

SEQ ID NO: 5752057 - DNA, 17 bp, Homo sapiens
gcaaacttataaatcat

SEQ ID NO: 5752058 - DNA, 23 bp, Homo sapiens
gcaaacttggaatttgtaacctc

SEQ ID NO: 5752059 - DNA, 20 bp, Homo sapiens
gcaaactttattttgtgttt

SEQ ID NO: 5752060 - DNA, 12 bp, Homo sapiens
gcaaactttttt

SEQ ID NO: 5752061 - DNA, 11 bp, Homo sapiens
gcaaagaaaac

SEQ ID NO: 5752062 - DNA, 21 bp, Homo sapiens
gcaaagaaaacacacaaaaga

SEQ ID NO: 5752063 - DNA, 15 bp, Homo sapiens
gcaaagaaaagaact

SEQ ID NO: 5752064 - DNA, 15 bp, Homo sapiens
gcaaagaaaattctc

SEQ ID NO: 5752065 - DNA, 14 bp, Homo sapiens
gcaaagaaaggaga

SEQ ID NO: 5752066 - DNA, 18 bp, Homo sapiens
gcaaagaaaggagataca

SEQ ID NO: 5752067 - DNA, 15 bp, Homo sapiens
gcaaagaactgcccc

SEQ ID NO: 5752068 - DNA, 15 bp, Homo sapiens
gcaaagaagcttcat

SEQ ID NO: 5752069 - DNA, 17 bp, Homo sapiens
gcaaagaaggagctgag

SEQ ID NO: 5752070 - DNA, 18 bp, Homo sapiens
gcaaagaaggagctgaga

SEQ ID NO: 5752071 - DNA, 18 bp, Homo sapiens
gcaaagaagtaagtttat

SEQ ID NO: 5752072 - DNA, 22 bp, Homo sapiens
gcaaagaatttcaatttgttca

SEQ ID NO: 5752073 - DNA, 16 bp, Homo sapiens
gcaaagacaaaagaaa

SEQ ID NO: 5752074 - DNA, 20 bp, Homo sapiens
gcaaagacaaaagaaactta

SEQ ID NO: 5752075 - DNA, 16 bp, Homo sapiens
gcaaagacagaagcct

SEQ ID NO: 5752076 - DNA, 20 bp, Homo sapiens
gcaaagacagtatttattgg

SEQ ID NO: 5752077 - DNA, 23 bp, Homo sapiens
gcaaagacagtttcttgcaagct

SEQ ID NO: 5752078 - DNA, 15 bp, Homo sapiens
gcaaagaccacctcc

SEQ ID NO: 5752079 - DNA, 21 bp, Homo sapiens
gcaaagacgtaataaaattaa

SEQ ID NO: 5752080 - DNA, 16 bp, Homo sapiens
gcaaagactctgagcc

SEQ ID NO: 5752081 - DNA, 17 bp, Homo sapiens
gcaaagagacatttcaa

SEQ ID NO: 5752082 - DNA, 22 bp, Homo sapiens
gcaaagagacatttcaaaactg

SEQ ID NO: 5752083 - DNA, 23 bp, Homo sapiens
gcaaagaggactcgcttgtaaat

SEQ ID NO: 5752084 - DNA, 13 bp, Homo sapiens
gcaaagaggcaag

SEQ ID NO: 5752085 - DNA, 18 bp, Homo sapiens
gcaaagaggcaagaggct

SEQ ID NO: 5752086 - DNA, 23 bp, Homo sapiens
gcaaagaggggcgctgtcctgcg

SEQ ID NO: 5752087 - DNA, 15 bp, Homo sapiens
gcaaagaggtgctgc

SEQ ID NO: 5752088 - DNA, 17 bp, Homo sapiens
gcaaagagtgagaaaga

SEQ ID NO: 5752089 - DNA, 14 bp, Homo sapiens
gcaaagatatatat

SEQ ID NO: 5752090 - DNA, 19 bp, Homo sapiens
gcaaagatatatattcacc

SEQ ID NO: 5752091 - DNA, 12 bp, Homo sapiens
gcaaagatcaaa

SEQ ID NO: 5752092 - DNA, 21 bp, Homo sapiens
gcaaagatccagcggggcttc

SEQ ID NO: 5752093 - DNA, 17 bp, Homo sapiens
gcaaagatctcagcagc

SEQ ID NO: 5752094 - DNA, 15 bp, Homo sapiens
gcaaagatctctaga

SEQ ID NO: 5752095 - DNA, 18 bp, Homo sapiens
gcaaagatgaaggtctgt

SEQ ID NO: 5752096 - DNA, 12 bp, Homo sapiens
gcaaagatgcat

SEQ ID NO: 5752097 - DNA, 22 bp, Homo sapiens
gcaaagatggtggctgtgtctc

SEQ ID NO: 5752098 - DNA, 20 bp, Homo sapiens
gcaaagattttcaaacaaaa

SEQ ID NO: 5752099 - DNA, 21 bp, Homo sapiens
gcaaagcaaaaggctgagaag

SEQ ID NO: 5752100 - DNA, 12 bp, Homo sapiens
gcaaagcacaga

SEQ ID NO: 5752101 - DNA, 13 bp, Homo sapiens
gcaaagcacagag

SEQ ID NO: 5752102 - DNA, 18 bp, Homo sapiens
gcaaagcatcggtcatgt

SEQ ID NO: 5752103 - DNA, 23 bp, Homo sapiens
gcaaagcatcggtcatgtgtgta

SEQ ID NO: 5752104 - DNA, 21 bp, Homo sapiens
gcaaagcatgccaatttctct

SEQ ID NO: 5752105 - DNA, 19 bp, Homo sapiens
gcaaagccacaaggctggc

SEQ ID NO: 5752106 - DNA, 16 bp, Homo sapiens
gcaaagccagaaaaag

SEQ ID NO: 5752107 - DNA, 16 bp, Homo sapiens
gcaaagccaggtccct

SEQ ID NO: 5752108 - DNA, 15 bp, Homo sapiens
gcaaagccatattct

SEQ ID NO: 5752109 - DNA, 21 bp, Homo sapiens
gcaaagcccagcttgaaacct

SEQ ID NO: 5752110 - DNA, 19 bp, Homo sapiens
gcaaagccccatgctggag

SEQ ID NO: 5752111 - DNA, 20 bp, Homo sapiens
gcaaagccccatgctggagc

SEQ ID NO: 5752112 - DNA, 21 bp, Homo sapiens
gcaaagccccatgctggagcc

SEQ ID NO: 5752113 - DNA, 22 bp, Homo sapiens
gcaaagccccatgctggagcct

SEQ ID NO: 5752114 - DNA, 13 bp, Homo sapiens
gcaaagcccccag

SEQ ID NO: 5752115 - DNA, 15 bp, Homo sapiens
gcaaagcccctcaca

SEQ ID NO: 5752116 - DNA, 20 bp, Homo sapiens
gcaaagcctgttcatggcag

SEQ ID NO: 5752117 - DNA, 15 bp, Homo sapiens
gcaaagcgacagatt

SEQ ID NO: 5752118 - DNA, 16 bp, Homo sapiens
gcaaagcgacagattc

SEQ ID NO: 5752119 - DNA, 19 bp, Homo sapiens
gcaaagcgcccacccaggt

SEQ ID NO: 5752120 - DNA, 21 bp, Homo sapiens
gcaaagcgctaagtaaaaata

SEQ ID NO: 5752121 - DNA, 23 bp, Homo sapiens
gcaaagcgctaagtaaaaatatt

SEQ ID NO: 5752122 - DNA, 19 bp, Homo sapiens
gcaaagcgggttataatga

SEQ ID NO: 5752123 - DNA, 17 bp, Homo sapiens
gcaaagctacaggactg

SEQ ID NO: 5752124 - DNA, 14 bp, Homo sapiens
gcaaagctgatttt

SEQ ID NO: 5752125 - DNA, 19 bp, Homo sapiens
gcaaagctgctgggccagt

SEQ ID NO: 5752126 - DNA, 21 bp, Homo sapiens
gcaaagctgctgggccagtgg

SEQ ID NO: 5752127 - DNA, 14 bp, Homo sapiens
gcaaagctgcttga

SEQ ID NO: 5752128 - DNA, 14 bp, Homo sapiens
gcaaagctggttgt

SEQ ID NO: 5752129 - DNA, 12 bp, Homo sapiens
gcaaagctgttc

SEQ ID NO: 5752130 - DNA, 19 bp, Homo sapiens
gcaaagctgttcttcctgg

SEQ ID NO: 5752131 - DNA, 20 bp, Homo sapiens
gcaaagctttggctgagacc

SEQ ID NO: 5752132 - DNA, 15 bp, Homo sapiens
gcaaaggaaaccaaa

SEQ ID NO: 5752133 - DNA, 23 bp, Homo sapiens
gcaaaggaaactttgcagatgtg

SEQ ID NO: 5752134 - DNA, 17 bp, Homo sapiens
gcaaaggagaaatctgg

SEQ ID NO: 5752135 - DNA, 14 bp, Homo sapiens
gcaaaggagaagca

SEQ ID NO: 5752136 - DNA, 12 bp, Homo sapiens
gcaaaggagaca

SEQ ID NO: 5752137 - DNA, 12 bp, Homo sapiens
gcaaaggagccg

SEQ ID NO: 5752138 - DNA, 22 bp, Homo sapiens
gcaaaggagggcaacctgacag

SEQ ID NO: 5752139 - DNA, 20 bp, Homo sapiens
gcaaaggagggcctcagaga

SEQ ID NO: 5752140 - DNA, 22 bp, Homo sapiens
gcaaaggatgtgttttcagtct

SEQ ID NO: 5752141 - DNA, 11 bp, Homo sapiens
gcaaaggcaga

SEQ ID NO: 5752142 - DNA, 12 bp, Homo sapiens
gcaaaggcagtc

SEQ ID NO: 5752143 - DNA, 18 bp, Homo sapiens
gcaaaggcccatgccccc

SEQ ID NO: 5752144 - DNA, 17 bp, Homo sapiens
gcaaaggctggctgtgt

SEQ ID NO: 5752145 - DNA, 12 bp, Homo sapiens
gcaaagggacat

SEQ ID NO: 5752146 - DNA, 14 bp, Homo sapiens
gcaaaggggacagc

SEQ ID NO: 5752147 - DNA, 19 bp, Homo sapiens
gcaaaggggacagctgtgt

SEQ ID NO: 5752148 - DNA, 20 bp, Homo sapiens
gcaaaggggtcccatagagg

SEQ ID NO: 5752149 - DNA, 23 bp, Homo sapiens
gcaaaggggtcccatagaggtga

SEQ ID NO: 5752150 - DNA, 18 bp, Homo sapiens
gcaaagggtctgtggcca

SEQ ID NO: 5752151 - DNA, 17 bp, Homo sapiens
gcaaaggtcttgaatag

SEQ ID NO: 5752152 - DNA, 22 bp, Homo sapiens
gcaaaggtgcactccagactct

SEQ ID NO: 5752153 - DNA, 23 bp, Homo sapiens
gcaaaggtgcctcatagcatagc

SEQ ID NO: 5752154 - DNA, 21 bp, Homo sapiens
gcaaaggtggggagaagggat

SEQ ID NO: 5752155 - DNA, 21 bp, Homo sapiens
gcaaaggttccaactgtatat

SEQ ID NO: 5752156 - DNA, 20 bp, Homo sapiens
gcaaagtaaaaaaatatgaa

SEQ ID NO: 5752157 - DNA, 19 bp, Homo sapiens
gcaaagtacaatgtgtttt

SEQ ID NO: 5752158 - DNA, 22 bp, Homo sapiens
gcaaagtaccaactgagccaaa

SEQ ID NO: 5752159 - DNA, 21 bp, Homo sapiens
gcaaagtagaatctcttttct

SEQ ID NO: 5752160 - DNA, 13 bp, Homo sapiens
gcaaagtagtact

SEQ ID NO: 5752161 - DNA, 14 bp, Homo sapiens
gcaaagtagtactt

SEQ ID NO: 5752162 - DNA, 16 bp, Homo sapiens
gcaaagtataaaatta

SEQ ID NO: 5752163 - DNA, 23 bp, Homo sapiens
gcaaagtatcaaagaaaaacaat

SEQ ID NO: 5752164 - DNA, 16 bp, Homo sapiens
gcaaagtatgccaggg

SEQ ID NO: 5752165 - DNA, 16 bp, Homo sapiens
gcaaagtattgtaaat

SEQ ID NO: 5752166 - DNA, 18 bp, Homo sapiens
gcaaagtattgtaaatta

SEQ ID NO: 5752167 - DNA, 16 bp, Homo sapiens
gcaaagtattgtgaaa

SEQ ID NO: 5752168 - DNA, 16 bp, Homo sapiens
gcaaagtcatgcaaag

SEQ ID NO: 5752169 - DNA, 22 bp, Homo sapiens
gcaaagtcatgcaaaggctggg

SEQ ID NO: 5752170 - DNA, 23 bp, Homo sapiens
gcaaagtcatgcaaaggctggga

SEQ ID NO: 5752171 - DNA, 17 bp, Homo sapiens
gcaaagtcctcctttca

SEQ ID NO: 5752172 - DNA, 21 bp, Homo sapiens
gcaaagtcgccagtcactgct

SEQ ID NO: 5752173 - DNA, 15 bp, Homo sapiens
gcaaagtgacaaagc

SEQ ID NO: 5752174 - DNA, 17 bp, Homo sapiens
gcaaagtgacaaagcaa

SEQ ID NO: 5752175 - DNA, 20 bp, Homo sapiens
gcaaagtgacaaagcaattt

SEQ ID NO: 5752176 - DNA, 14 bp, Homo sapiens
gcaaagtgccctca

SEQ ID NO: 5752177 - DNA, 15 bp, Homo sapiens
gcaaagtgctagcca

SEQ ID NO: 5752178 - DNA, 17 bp, Homo sapiens
gcaaagtggaattaaag

SEQ ID NO: 5752179 - DNA, 14 bp, Homo sapiens
gcaaagtggcaggg

SEQ ID NO: 5752180 - DNA, 18 bp, Homo sapiens
gcaaagtgttttgtacca

SEQ ID NO: 5752181 - DNA, 11 bp, Homo sapiens
gcaaagttaaa

SEQ ID NO: 5752182 - DNA, 13 bp, Homo sapiens
gcaaagttatatt

SEQ ID NO: 5752183 - DNA, 21 bp, Homo sapiens
gcaaagttatcttaaatatga

SEQ ID NO: 5752184 - DNA, 23 bp, Homo sapiens
gcaaagttccctacttcctgtga

SEQ ID NO: 5752185 - DNA, 16 bp, Homo sapiens
gcaaagttctgtgttt

SEQ ID NO: 5752186 - DNA, 15 bp, Homo sapiens
gcaaagtttaaatgt

SEQ ID NO: 5752187 - DNA, 14 bp, Homo sapiens
gcaaagtttccatg

SEQ ID NO: 5752188 - DNA, 15 bp, Homo sapiens
gcaaagttttacaga

SEQ ID NO: 5752189 - DNA, 14 bp, Homo sapiens
gcaaagttttcaga

SEQ ID NO: 5752190 - DNA, 21 bp, Homo sapiens
gcaaataaaacccaatacttt

SEQ ID NO: 5752191 - DNA, 12 bp, Homo sapiens
gcaaataaaagt

SEQ ID NO: 5752192 - DNA, 17 bp, Homo sapiens
gcaaataaacttacaga

SEQ ID NO: 5752193 - DNA, 15 bp, Homo sapiens
gcaaataaagcctgc

SEQ ID NO: 5752194 - DNA, 17 bp, Homo sapiens
gcaaataaagcctgctc

SEQ ID NO: 5752195 - DNA, 16 bp, Homo sapiens
gcaaataaagcctttt

SEQ ID NO: 5752196 - DNA, 19 bp, Homo sapiens
gcaaataacaaatgccaaa

SEQ ID NO: 5752197 - DNA, 15 bp, Homo sapiens
gcaaataaggacagc

SEQ ID NO: 5752198 - DNA, 19 bp, Homo sapiens
gcaaataaggacagcagct

SEQ ID NO: 5752199 - DNA, 21 bp, Homo sapiens
gcaaataagtgtattttgaaa

SEQ ID NO: 5752200 - DNA, 15 bp, Homo sapiens
gcaaatacaaaatga

SEQ ID NO: 5752201 - DNA, 20 bp, Homo sapiens
gcaaatacaattcacagcac

SEQ ID NO: 5752202 - DNA, 13 bp, Homo sapiens
gcaaataccaaag

SEQ ID NO: 5752203 - DNA, 17 bp, Homo sapiens
gcaaataccaaagcagt

SEQ ID NO: 5752204 - DNA, 19 bp, Homo sapiens
gcaaataccttagctccct

SEQ ID NO: 5752205 - DNA, 14 bp, Homo sapiens
gcaaatactccaag

SEQ ID NO: 5752206 - DNA, 19 bp, Homo sapiens
gcaaatactgattttcaaa

SEQ ID NO: 5752207 - DNA, 22 bp, Homo sapiens
gcaaatacttagcaaaaagtgg

SEQ ID NO: 5752208 - DNA, 21 bp, Homo sapiens
gcaaatagcgtgggatagatt

SEQ ID NO: 5752209 - DNA, 17 bp, Homo sapiens
gcaaatagtagacattt

SEQ ID NO: 5752210 - DNA, 19 bp, Homo sapiens
gcaaatagtagacatttgt

SEQ ID NO: 5752211 - DNA, 23 bp, Homo sapiens
gcaaatagtagagtatcagttgc

SEQ ID NO: 5752212 - DNA, 14 bp, Homo sapiens
gcaaatataaaact

SEQ ID NO: 5752213 - DNA, 16 bp, Homo sapiens
gcaaatataaacatct

SEQ ID NO: 5752214 - DNA, 17 bp, Homo sapiens
gcaaatataaacatctc

SEQ ID NO: 5752215 - DNA, 19 bp, Homo sapiens
gcaaatataagctgggaaa

SEQ ID NO: 5752216 - DNA, 12 bp, Homo sapiens
gcaaatatatga

SEQ ID NO: 5752217 - DNA, 17 bp, Homo sapiens
gcaaatattagcaaaga

SEQ ID NO: 5752218 - DNA, 20 bp, Homo sapiens
gcaaatattgaagttgttta

SEQ ID NO: 5752219 - DNA, 15 bp, Homo sapiens
gcaaatattttgtca

SEQ ID NO: 5752220 - DNA, 17 bp, Homo sapiens
gcaaatattttgtcact

SEQ ID NO: 5752221 - DNA, 20 bp, Homo sapiens
gcaaatcaaccccagactca

SEQ ID NO: 5752222 - DNA, 14 bp, Homo sapiens
gcaaatcagaaaac

SEQ ID NO: 5752223 - DNA, 17 bp, Homo sapiens
gcaaatcagaaaaccca

SEQ ID NO: 5752224 - DNA, 15 bp, Homo sapiens
gcaaatcagaaactt

SEQ ID NO: 5752225 - DNA, 13 bp, Homo sapiens
gcaaatcaggggc

SEQ ID NO: 5752226 - DNA, 16 bp, Homo sapiens
gcaaatcaggggccag

SEQ ID NO: 5752227 - DNA, 17 bp, Homo sapiens
gcaaatcaggggccaga

SEQ ID NO: 5752228 - DNA, 16 bp, Homo sapiens
gcaaatcagtatattt

SEQ ID NO: 5752229 - DNA, 21 bp, Homo sapiens
gcaaatcagtatattttctgt

SEQ ID NO: 5752230 - DNA, 23 bp, Homo sapiens
gcaaatcagtatattttctgtat

SEQ ID NO: 5752231 - DNA, 13 bp, Homo sapiens
gcaaatcagtctc

SEQ ID NO: 5752232 - DNA, 15 bp, Homo sapiens
gcaaatcatagctgg

SEQ ID NO: 5752233 - DNA, 14 bp, Homo sapiens
gcaaatcatctgca

SEQ ID NO: 5752234 - DNA, 18 bp, Homo sapiens
gcaaatccataccccctg

SEQ ID NO: 5752235 - DNA, 23 bp, Homo sapiens
gcaaatccatagcacaagataaa

SEQ ID NO: 5752236 - DNA, 16 bp, Homo sapiens
gcaaatccgaaatcag

SEQ ID NO: 5752237 - DNA, 15 bp, Homo sapiens
gcaaatcctatgtga

SEQ ID NO: 5752238 - DNA, 23 bp, Homo sapiens
gcaaatcctatgtgattttaact

SEQ ID NO: 5752239 - DNA, 18 bp, Homo sapiens
gcaaatcctggcaagtga

SEQ ID NO: 5752240 - DNA, 18 bp, Homo sapiens
gcaaatcctttgtgaaaa

SEQ ID NO: 5752241 - DNA, 18 bp, Homo sapiens
gcaaatctattacttttg

SEQ ID NO: 5752242 - DNA, 13 bp, Homo sapiens
gcaaatctctttt

SEQ ID NO: 5752243 - DNA, 15 bp, Homo sapiens
gcaaatctgactttt

SEQ ID NO: 5752244 - DNA, 18 bp, Homo sapiens
gcaaatctgtataaatgt

SEQ ID NO: 5752245 - DNA, 14 bp, Homo sapiens
gcaaatctgttacc

SEQ ID NO: 5752246 - DNA, 19 bp, Homo sapiens
gcaaatctttctgtaaaca

SEQ ID NO: 5752247 - DNA, 20 bp, Homo sapiens
gcaaatctttctgtaaacag

SEQ ID NO: 5752248 - DNA, 23 bp, Homo sapiens
gcaaatctttctgtaaacagaat

SEQ ID NO: 5752249 - DNA, 19 bp, Homo sapiens
gcaaatgaaggaatgcaat

SEQ ID NO: 5752250 - DNA, 15 bp, Homo sapiens
gcaaatgaaggatga

SEQ ID NO: 5752251 - DNA, 15 bp, Homo sapiens
gcaaatgaatcattg

SEQ ID NO: 5752252 - DNA, 22 bp, Homo sapiens
gcaaatgaatgcctttcaaaca

SEQ ID NO: 5752253 - DNA, 16 bp, Homo sapiens
gcaaatgacatgcact

SEQ ID NO: 5752254 - DNA, 13 bp, Homo sapiens
gcaaatgactttg

SEQ ID NO: 5752255 - DNA, 18 bp, Homo sapiens
gcaaatgcaacaaaatat

SEQ ID NO: 5752256 - DNA, 22 bp, Homo sapiens
gcaaatgcacacacctcatgct

SEQ ID NO: 5752257 - DNA, 14 bp, Homo sapiens
gcaaatgccagggc

SEQ ID NO: 5752258 - DNA, 15 bp, Homo sapiens
gcaaatgccagggcc

SEQ ID NO: 5752259 - DNA, 17 bp, Homo sapiens
gcaaatgccagggcccg

SEQ ID NO: 5752260 - DNA, 20 bp, Homo sapiens
gcaaatggaggcttttcact

SEQ ID NO: 5752261 - DNA, 13 bp, Homo sapiens
gcaaatggcagtt

SEQ ID NO: 5752262 - DNA, 20 bp, Homo sapiens
gcaaatgggagctgagcagc

SEQ ID NO: 5752263 - DNA, 23 bp, Homo sapiens
gcaaatgggtgcccgtatccaga

SEQ ID NO: 5752264 - DNA, 18 bp, Homo sapiens
gcaaatgtcatgctgcct

SEQ ID NO: 5752265 - DNA, 17 bp, Homo sapiens
gcaaatgtcttccaggt

SEQ ID NO: 5752266 - DNA, 23 bp, Homo sapiens
gcaaatgtgaatcattttacctt

SEQ ID NO: 5752267 - DNA, 15 bp, Homo sapiens
gcaaatgtggctcct

SEQ ID NO: 5752268 - DNA, 12 bp, Homo sapiens
gcaaatgttaca

SEQ ID NO: 5752269 - DNA, 19 bp, Homo sapiens
gcaaatgttgggaaagtat

SEQ ID NO: 5752270 - DNA, 13 bp, Homo sapiens
gcaaatgtttact

SEQ ID NO: 5752271 - DNA, 20 bp, Homo sapiens
gcaaatgtttatttaaaaga

SEQ ID NO: 5752272 - DNA, 12 bp, Homo sapiens
gcaaatgttttg

SEQ ID NO: 5752273 - DNA, 18 bp, Homo sapiens
gcaaattaaacaatataa

SEQ ID NO: 5752274 - DNA, 15 bp, Homo sapiens
gcaaattaactgtat

SEQ ID NO: 5752275 - DNA, 23 bp, Homo sapiens
gcaaattaatgtataatttgagg

SEQ ID NO: 5752276 - DNA, 14 bp, Homo sapiens
gcaaattaatgtgt

SEQ ID NO: 5752277 - DNA, 15 bp, Homo sapiens
gcaaattaatgtgta

SEQ ID NO: 5752278 - DNA, 14 bp, Homo sapiens
gcaaattactccaa

SEQ ID NO: 5752279 - DNA, 15 bp, Homo sapiens
gcaaattagaaacac

SEQ ID NO: 5752280 - DNA, 13 bp, Homo sapiens
gcaaattattcta

SEQ ID NO: 5752281 - DNA, 15 bp, Homo sapiens
gcaaattattctagt

SEQ ID NO: 5752282 - DNA, 22 bp, Homo sapiens
gcaaattattctagtcaactgc

SEQ ID NO: 5752283 - DNA, 18 bp, Homo sapiens
gcaaattatttattactt

SEQ ID NO: 5752284 - DNA, 23 bp, Homo sapiens
gcaaattatttttaaaagaaaaa

SEQ ID NO: 5752285 - DNA, 16 bp, Homo sapiens
gcaaattcagaactga

SEQ ID NO: 5752286 - DNA, 16 bp, Homo sapiens
gcaaattcttttgaat

SEQ ID NO: 5752287 - DNA, 17 bp, Homo sapiens
gcaaattcttttgaatt

SEQ ID NO: 5752288 - DNA, 16 bp, Homo sapiens
gcaaattgctagtcag

SEQ ID NO: 5752289 - DNA, 14 bp, Homo sapiens
gcaaattgtgaaat

SEQ ID NO: 5752290 - DNA, 18 bp, Homo sapiens
gcaaattgtttcagtttt

SEQ ID NO: 5752291 - DNA, 13 bp, Homo sapiens
gcaaatttagttt

SEQ ID NO: 5752292 - DNA, 19 bp, Homo sapiens
gcaaatttagtttgttaaa

SEQ ID NO: 5752293 - DNA, 16 bp, Homo sapiens
gcaaatttcatctttc

SEQ ID NO: 5752294 - DNA, 18 bp, Homo sapiens
gcaaatttctataaattt

SEQ ID NO: 5752295 - DNA, 19 bp, Homo sapiens
gcaaatttgcattaaatta

SEQ ID NO: 5752296 - DNA, 16 bp, Homo sapiens
gcaacaaaatatttaa

SEQ ID NO: 5752297 - DNA, 14 bp, Homo sapiens
gcaacaaactgcac

SEQ ID NO: 5752298 - DNA, 15 bp, Homo sapiens
gcaacaaactgcaca

SEQ ID NO: 5752299 - DNA, 22 bp, Homo sapiens
gcaacaaactgcacatgatttc

SEQ ID NO: 5752300 - DNA, 18 bp, Homo sapiens
gcaacaaagacttgcttt

SEQ ID NO: 5752301 - DNA, 20 bp, Homo sapiens
gcaacaaagacttgctttaa

SEQ ID NO: 5752302 - DNA, 22 bp, Homo sapiens
gcaacaacaattggtaaaactc

SEQ ID NO: 5752303 - DNA, 18 bp, Homo sapiens
gcaacaactgtcagttca

SEQ ID NO: 5752304 - DNA, 17 bp, Homo sapiens
gcaacaagactgccagg

SEQ ID NO: 5752305 - DNA, 20 bp, Homo sapiens
gcaacaagactgccaggtgg

SEQ ID NO: 5752306 - DNA, 12 bp, Homo sapiens
gcaacaagagca

SEQ ID NO: 5752307 - DNA, 18 bp, Homo sapiens
gcaacaagagcaaaatga

SEQ ID NO: 5752308 - DNA, 14 bp, Homo sapiens
gcaacaagctattt

SEQ ID NO: 5752309 - DNA, 20 bp, Homo sapiens
gcaacaaggtcctctgtcag

SEQ ID NO: 5752310 - DNA, 16 bp, Homo sapiens
gcaacaataataaatg

SEQ ID NO: 5752311 - DNA, 13 bp, Homo sapiens
gcaacaatgcaaa

SEQ ID NO: 5752312 - DNA, 21 bp, Homo sapiens
gcaacaatggatattgcctgt

SEQ ID NO: 5752313 - DNA, 23 bp, Homo sapiens
gcaacaattctcccgggactctg

SEQ ID NO: 5752314 - DNA, 14 bp, Homo sapiens
gcaacaatttatga

SEQ ID NO: 5752315 - DNA, 14 bp, Homo sapiens
gcaacaattttcag

SEQ ID NO: 5752316 - DNA, 15 bp, Homo sapiens
gcaacaattttcaga

SEQ ID NO: 5752317 - DNA, 16 bp, Homo sapiens
gcaacacaagctggaa

SEQ ID NO: 5752318 - DNA, 12 bp, Homo sapiens
gcaacacacaga

SEQ ID NO: 5752319 - DNA, 23 bp, Homo sapiens
gcaacacagcctgggccccagct

SEQ ID NO: 5752320 - DNA, 14 bp, Homo sapiens
gcaacaccctcttc

SEQ ID NO: 5752321 - DNA, 19 bp, Homo sapiens
gcaacacctccttgctttg

SEQ ID NO: 5752322 - DNA, 16 bp, Homo sapiens
gcaacacgcatggtca

SEQ ID NO: 5752323 - DNA, 17 bp, Homo sapiens
gcaacacgtcattgtgt

SEQ ID NO: 5752324 - DNA, 16 bp, Homo sapiens
gcaacacgtggaggtg

SEQ ID NO: 5752325 - DNA, 22 bp, Homo sapiens
gcaacactcactgcctgcagct

SEQ ID NO: 5752326 - DNA, 22 bp, Homo sapiens
gcaacactccggtcagcccctg

SEQ ID NO: 5752327 - DNA, 16 bp, Homo sapiens
gcaacactgctgtcca

SEQ ID NO: 5752328 - DNA, 19 bp, Homo sapiens
gcaacactggtctgctgtt

SEQ ID NO: 5752329 - DNA, 18 bp, Homo sapiens
gcaacactttttatgtta

SEQ ID NO: 5752330 - DNA, 16 bp, Homo sapiens
gcaacagaaaccaaga

SEQ ID NO: 5752331 - DNA, 19 bp, Homo sapiens
gcaacagacaagtgactgt

SEQ ID NO: 5752332 - DNA, 13 bp, Homo sapiens
gcaacagagcact

SEQ ID NO: 5752333 - DNA, 14 bp, Homo sapiens
gcaacagagtgaga

SEQ ID NO: 5752334 - DNA, 22 bp, Homo sapiens
gcaacagatagatgttgctctt

SEQ ID NO: 5752335 - DNA, 15 bp, Homo sapiens
gcaacagatcagtaa

SEQ ID NO: 5752336 - DNA, 16 bp, Homo sapiens
gcaacagatctggaac

SEQ ID NO: 5752337 - DNA, 17 bp, Homo sapiens
gcaacagatctggaacc

SEQ ID NO: 5752338 - DNA, 22 bp, Homo sapiens
gcaacagatctggaacctcagc

SEQ ID NO: 5752339 - DNA, 15 bp, Homo sapiens
gcaacagcaaattaa

SEQ ID NO: 5752340 - DNA, 13 bp, Homo sapiens
gcaacagcactgg

SEQ ID NO: 5752341 - DNA, 15 bp, Homo sapiens
gcaacagcagagctc

SEQ ID NO: 5752342 - DNA, 17 bp, Homo sapiens
gcaacagcataacaagg

SEQ ID NO: 5752343 - DNA, 22 bp, Homo sapiens
gcaacagcctaatcccgtgccc

SEQ ID NO: 5752344 - DNA, 11 bp, Homo sapiens
gcaacagcctg

SEQ ID NO: 5752345 - DNA, 19 bp, Homo sapiens
gcaacagctggacaccccc

SEQ ID NO: 5752346 - DNA, 20 bp, Homo sapiens
gcaacagctggacaccccct

SEQ ID NO: 5752347 - DNA, 16 bp, Homo sapiens
gcaacagctgtgtgtg

SEQ ID NO: 5752348 - DNA, 13 bp, Homo sapiens
gcaacagcttcag

SEQ ID NO: 5752349 - DNA, 21 bp, Homo sapiens
gcaacaggaatctcagagaca

SEQ ID NO: 5752350 - DNA, 12 bp, Homo sapiens
gcaacaggacag

SEQ ID NO: 5752351 - DNA, 19 bp, Homo sapiens
gcaacaggacagagttcac

SEQ ID NO: 5752352 - DNA, 23 bp, Homo sapiens
gcaacaggacagagttcacagga

SEQ ID NO: 5752353 - DNA, 17 bp, Homo sapiens
gcaacaggaccaggagc

SEQ ID NO: 5752354 - DNA, 18 bp, Homo sapiens
gcaacaggaccaggagcc

SEQ ID NO: 5752355 - DNA, 20 bp, Homo sapiens
gcaacaggattgatcattct

SEQ ID NO: 5752356 - DNA, 17 bp, Homo sapiens
gcaacagggcttctctt

SEQ ID NO: 5752357 - DNA, 21 bp, Homo sapiens
gcaacaggggcacaagcccag

SEQ ID NO: 5752358 - DNA, 22 bp, Homo sapiens
gcaacagggtatggactatctg

SEQ ID NO: 5752359 - DNA, 22 bp, Homo sapiens
gcaacaggtaaacagaaatcct

SEQ ID NO: 5752360 - DNA, 23 bp, Homo sapiens
gcaacaggttgaggctaaaacaa

SEQ ID NO: 5752361 - DNA, 22 bp, Homo sapiens
gcaacataataagacttttctc

SEQ ID NO: 5752362 - DNA, 17 bp, Homo sapiens
gcaacatatctctgccg

SEQ ID NO: 5752363 - DNA, 21 bp, Homo sapiens
gcaacatcagctttctaatgt

SEQ ID NO: 5752364 - DNA, 17 bp, Homo sapiens
gcaacatccaaaatagt

SEQ ID NO: 5752365 - DNA, 15 bp, Homo sapiens
gcaacatctctgaat

SEQ ID NO: 5752366 - DNA, 18 bp, Homo sapiens
gcaacatgaagaatgcat

SEQ ID NO: 5752367 - DNA, 19 bp, Homo sapiens
gcaacatgaagaatgcatt

SEQ ID NO: 5752368 - DNA, 22 bp, Homo sapiens
gcaacatgaagaatgcattcaa

SEQ ID NO: 5752369 - DNA, 16 bp, Homo sapiens
gcaacatggatatgta

SEQ ID NO: 5752370 - DNA, 13 bp, Homo sapiens
gcaacatggcttt

SEQ ID NO: 5752371 - DNA, 18 bp, Homo sapiens
gcaacattaccttgtctt

SEQ ID NO: 5752372 - DNA, 14 bp, Homo sapiens
gcaacattcattgc

SEQ ID NO: 5752373 - DNA, 19 bp, Homo sapiens
gcaacattccacagctgcc

SEQ ID NO: 5752374 - DNA, 11 bp, Homo sapiens
gcaacattcct

SEQ ID NO: 5752375 - DNA, 12 bp, Homo sapiens
gcaacattcctt

SEQ ID NO: 5752376 - DNA, 22 bp, Homo sapiens
gcaacattgttcacctttgtag

SEQ ID NO: 5752377 - DNA, 15 bp, Homo sapiens
gcaacatttctgtat

SEQ ID NO: 5752378 - DNA, 20 bp, Homo sapiens
gcaacatttggggagagata

SEQ ID NO: 5752379 - DNA, 19 bp, Homo sapiens
gcaaccaaaagggaaaaaa

SEQ ID NO: 5752380 - DNA, 15 bp, Homo sapiens
gcaaccaaactccca

SEQ ID NO: 5752381 - DNA, 16 bp, Homo sapiens
gcaaccaactgcccca

SEQ ID NO: 5752382 - DNA, 15 bp, Homo sapiens
gcaaccaagtcacac

SEQ ID NO: 5752383 - DNA, 15 bp, Homo sapiens
gcaaccaataaaagt

SEQ ID NO: 5752384 - DNA, 19 bp, Homo sapiens
gcaaccacatgtcccagat

SEQ ID NO: 5752385 - DNA, 16 bp, Homo sapiens
gcaaccactctgtggc

SEQ ID NO: 5752386 - DNA, 19 bp, Homo sapiens
gcaaccactctgtggccag

SEQ ID NO: 5752387 - DNA, 19 bp, Homo sapiens
gcaaccagagcactgtata

SEQ ID NO: 5752388 - DNA, 14 bp, Homo sapiens
gcaaccagcaaatt

SEQ ID NO: 5752389 - DNA, 14 bp, Homo sapiens
gcaaccagccagcg

SEQ ID NO: 5752390 - DNA, 13 bp, Homo sapiens
gcaaccaggcagc

SEQ ID NO: 5752391 - DNA, 14 bp, Homo sapiens
gcaaccaggcagct

SEQ ID NO: 5752392 - DNA, 16 bp, Homo sapiens
gcaaccaggcagctga

SEQ ID NO: 5752393 - DNA, 12 bp, Homo sapiens
gcaacccaaact

SEQ ID NO: 5752394 - DNA, 16 bp, Homo sapiens
gcaacccaaggactga

SEQ ID NO: 5752395 - DNA, 16 bp, Homo sapiens
gcaacccacagctcag

SEQ ID NO: 5752396 - DNA, 15 bp, Homo sapiens
gcaaccccagaccca

SEQ ID NO: 5752397 - DNA, 19 bp, Homo sapiens
gcaaccccagttctgctcc

SEQ ID NO: 5752398 - DNA, 14 bp, Homo sapiens
gcaacccccagcct

SEQ ID NO: 5752399 - DNA, 16 bp, Homo sapiens
gcaaccccctcggagc

SEQ ID NO: 5752400 - DNA, 14 bp, Homo sapiens
gcaacccctgcagc

SEQ ID NO: 5752401 - DNA, 13 bp, Homo sapiens
gcaacccctggac

SEQ ID NO: 5752402 - DNA, 15 bp, Homo sapiens
gcaacccgctggagc

SEQ ID NO: 5752403 - DNA, 21 bp, Homo sapiens
gcaacccgctggagcccacag

SEQ ID NO: 5752404 - DNA, 22 bp, Homo sapiens
gcaaccctacagtatataagct

SEQ ID NO: 5752405 - DNA, 19 bp, Homo sapiens
gcaaccctcagctgcctca

SEQ ID NO: 5752406 - DNA, 15 bp, Homo sapiens
gcaaccctctgaaga

SEQ ID NO: 5752407 - DNA, 13 bp, Homo sapiens
gcaaccctgcctg

SEQ ID NO: 5752408 - DNA, 20 bp, Homo sapiens
gcaaccctggtgtgctgggc

SEQ ID NO: 5752409 - DNA, 21 bp, Homo sapiens
gcaacccttaccccttagcct

SEQ ID NO: 5752410 - DNA, 18 bp, Homo sapiens
gcaaccgcctcaaaatgt

SEQ ID NO: 5752411 - DNA, 20 bp, Homo sapiens
gcaaccgtggcccttcctgg

SEQ ID NO: 5752412 - DNA, 22 bp, Homo sapiens
gcaaccgtggcccttcctggac

SEQ ID NO: 5752413 - DNA, 18 bp, Homo sapiens
gcaacctacccagcgtgg

SEQ ID NO: 5752414 - DNA, 18 bp, Homo sapiens
gcaacctcaccttcctgt

SEQ ID NO: 5752415 - DNA, 19 bp, Homo sapiens
gcaacctcagtaatttaga

SEQ ID NO: 5752416 - DNA, 13 bp, Homo sapiens
gcaacctccacct

SEQ ID NO: 5752417 - DNA, 19 bp, Homo sapiens
gcaacctccacctcccagg

SEQ ID NO: 5752418 - DNA, 17 bp, Homo sapiens
gcaacctccacctcctg

SEQ ID NO: 5752419 - DNA, 18 bp, Homo sapiens
gcaacctccgcctcttgg

SEQ ID NO: 5752420 - DNA, 20 bp, Homo sapiens
gcaacctccgcctcttgggt

SEQ ID NO: 5752421 - DNA, 23 bp, Homo sapiens
gcaacctctgcctcctgggttca

SEQ ID NO: 5752422 - DNA, 20 bp, Homo sapiens
gcaacctctgcttcccaggt

SEQ ID NO: 5752423 - DNA, 17 bp, Homo sapiens
gcaacctcttcagctgg

SEQ ID NO: 5752424 - DNA, 17 bp, Homo sapiens
gcaacctcttcctcctg

SEQ ID NO: 5752425 - DNA, 23 bp, Homo sapiens
gcaacctcttggcctgatcagac

SEQ ID NO: 5752426 - DNA, 20 bp, Homo sapiens
gcaacctgacagcaaacaca

SEQ ID NO: 5752427 - DNA, 18 bp, Homo sapiens
gcaacctgattgtaaact

SEQ ID NO: 5752428 - DNA, 15 bp, Homo sapiens
gcaacctgcaggctc

SEQ ID NO: 5752429 - DNA, 18 bp, Homo sapiens
gcaacctgggtccaaata

SEQ ID NO: 5752430 - DNA, 19 bp, Homo sapiens
gcaacctgggtccaaataa

SEQ ID NO: 5752431 - DNA, 14 bp, Homo sapiens
gcaacctgtaactg

SEQ ID NO: 5752432 - DNA, 20 bp, Homo sapiens
gcaacctgtgcaaaataaaa

SEQ ID NO: 5752433 - DNA, 23 bp, Homo sapiens
gcaacctgtgcaaaataaaatga

SEQ ID NO: 5752434 - DNA, 13 bp, Homo sapiens
gcaacctgttctt

SEQ ID NO: 5752435 - DNA, 20 bp, Homo sapiens
gcaacctgttcttcctacca

SEQ ID NO: 5752436 - DNA, 17 bp, Homo sapiens
gcaaccttcattttaca

SEQ ID NO: 5752437 - DNA, 15 bp, Homo sapiens
gcaacctttcccttc

SEQ ID NO: 5752438 - DNA, 12 bp, Homo sapiens
gcaacctttgtg

SEQ ID NO: 5752439 - DNA, 14 bp, Homo sapiens
gcaacgaagaaaaa

SEQ ID NO: 5752440 - DNA, 23 bp, Homo sapiens
gcaacgaagaaaaaaaataacac

SEQ ID NO: 5752441 - DNA, 22 bp, Homo sapiens
gcaacgatcacaaatgacttta

SEQ ID NO: 5752442 - DNA, 15 bp, Homo sapiens
gcaacgattcacagc

SEQ ID NO: 5752443 - DNA, 15 bp, Homo sapiens
gcaacgcccctccaa

SEQ ID NO: 5752444 - DNA, 22 bp, Homo sapiens
gcaacgccgtgggctgcgtcct

SEQ ID NO: 5752445 - DNA, 21 bp, Homo sapiens
gcaacgcctgccttctgggca

SEQ ID NO: 5752446 - DNA, 18 bp, Homo sapiens
gcaacgctattccagctg

SEQ ID NO: 5752447 - DNA, 15 bp, Homo sapiens
gcaacggccagggtt

SEQ ID NO: 5752448 - DNA, 16 bp, Homo sapiens
gcaacggccagggttg

SEQ ID NO: 5752449 - DNA, 15 bp, Homo sapiens
gcaacggccccagcg

SEQ ID NO: 5752450 - DNA, 17 bp, Homo sapiens
gcaacggccccagcgcg

SEQ ID NO: 5752451 - DNA, 23 bp, Homo sapiens
gcaacgtgcgtgtctctgccatg

SEQ ID NO: 5752452 - DNA, 13 bp, Homo sapiens
gcaacgtgttaat

SEQ ID NO: 5752453 - DNA, 14 bp, Homo sapiens
gcaacgtgttaatt

SEQ ID NO: 5752454 - DNA, 17 bp, Homo sapiens
gcaacgtgttaattata

SEQ ID NO: 5752455 - DNA, 19 bp, Homo sapiens
gcaacgtgttaattataaa

SEQ ID NO: 5752456 - DNA, 18 bp, Homo sapiens
gcaacgttagtagaactt

SEQ ID NO: 5752457 - DNA, 22 bp, Homo sapiens
gcaacgtttacaccgactagcc

SEQ ID NO: 5752458 - DNA, 14 bp, Homo sapiens
gcaactaaggacaa

SEQ ID NO: 5752459 - DNA, 15 bp, Homo sapiens
gcaactattaataat

SEQ ID NO: 5752460 - DNA, 13 bp, Homo sapiens
gcaactattcaca

SEQ ID NO: 5752461 - DNA, 13 bp, Homo sapiens
gcaactcaaagag

SEQ ID NO: 5752462 - DNA, 20 bp, Homo sapiens
gcaactcaagttataggaaa

SEQ ID NO: 5752463 - DNA, 14 bp, Homo sapiens
gcaactcatcttag

SEQ ID NO: 5752464 - DNA, 20 bp, Homo sapiens
gcaactcatgaacaaaatga

SEQ ID NO: 5752465 - DNA, 16 bp, Homo sapiens
gcaactccagcgtcct

SEQ ID NO: 5752466 - DNA, 22 bp, Homo sapiens
gcaactccagcgtcctcagcac

SEQ ID NO: 5752467 - DNA, 23 bp, Homo sapiens
gcaactccagcgtcctcagcacc

SEQ ID NO: 5752468 - DNA, 23 bp, Homo sapiens
gcaactccatgcctatttactgg

SEQ ID NO: 5752469 - DNA, 15 bp, Homo sapiens
gcaactcctgttctt

SEQ ID NO: 5752470 - DNA, 13 bp, Homo sapiens
gcaactccttact

SEQ ID NO: 5752471 - DNA, 21 bp, Homo sapiens
gcaactcgccctgtttggcat

SEQ ID NO: 5752472 - DNA, 14 bp, Homo sapiens
gcaactctccagcc

SEQ ID NO: 5752473 - DNA, 14 bp, Homo sapiens
gcaactctggctcc

SEQ ID NO: 5752474 - DNA, 22 bp, Homo sapiens
gcaactctggctccaggcagaa

SEQ ID NO: 5752475 - DNA, 21 bp, Homo sapiens
gcaactcttatttctttcctt

SEQ ID NO: 5752476 - DNA, 13 bp, Homo sapiens
gcaactcttgtat

SEQ ID NO: 5752477 - DNA, 15 bp, Homo sapiens
gcaactgaacaaaaa

SEQ ID NO: 5752478 - DNA, 16 bp, Homo sapiens
gcaactgaacaaaaaa

SEQ ID NO: 5752479 - DNA, 10 bp, Homo sapiens
gcaactgaag

SEQ ID NO: 5752480 - DNA, 15 bp, Homo sapiens
gcaactgaagacaat

SEQ ID NO: 5752481 - DNA, 12 bp, Homo sapiens
gcaactgaataa

SEQ ID NO: 5752482 - DNA, 18 bp, Homo sapiens
gcaactgaataaatacct

SEQ ID NO: 5752483 - DNA, 19 bp, Homo sapiens
gcaactgaataaatacctc

SEQ ID NO: 5752484 - DNA, 17 bp, Homo sapiens
gcaactgaatacttgaa

SEQ ID NO: 5752485 - DNA, 15 bp, Homo sapiens
gcaactgacactccc

SEQ ID NO: 5752486 - DNA, 15 bp, Homo sapiens
gcaactgacagatga

SEQ ID NO: 5752487 - DNA, 20 bp, Homo sapiens
gcaactgacttcatttgtgc

SEQ ID NO: 5752488 - DNA, 21 bp, Homo sapiens
gcaactgacttcatttgtgcc

SEQ ID NO: 5752489 - DNA, 13 bp, Homo sapiens
gcaactgagagct

SEQ ID NO: 5752490 - DNA, 22 bp, Homo sapiens
gcaactgagagctgagcgcttt

SEQ ID NO: 5752491 - DNA, 12 bp, Homo sapiens
gcaactgcaaga

SEQ ID NO: 5752492 - DNA, 16 bp, Homo sapiens
gcaactgcccttccag

SEQ ID NO: 5752493 - DNA, 17 bp, Homo sapiens
gcaactgcccttccagg

SEQ ID NO: 5752494 - DNA, 16 bp, Homo sapiens
gcaactggtatatatt

SEQ ID NO: 5752495 - DNA, 19 bp, Homo sapiens
gcaactgtattaaagaaaa

SEQ ID NO: 5752496 - DNA, 20 bp, Homo sapiens
gcaactgttatgaaataaag

SEQ ID NO: 5752497 - DNA, 15 bp, Homo sapiens
gcaacttaggatggc

SEQ ID NO: 5752498 - DNA, 15 bp, Homo sapiens
gcaacttcagtttta

SEQ ID NO: 5752499 - DNA, 15 bp, Homo sapiens
gcaacttcatcccag

SEQ ID NO: 5752500 - DNA, 23 bp, Homo sapiens
gcaacttcatcccagctgctgag

SEQ ID NO: 5752501 - DNA, 18 bp, Homo sapiens
gcaacttccgcctcctgt

SEQ ID NO: 5752502 - DNA, 19 bp, Homo sapiens
gcaacttcctttgactttc

SEQ ID NO: 5752503 - DNA, 18 bp, Homo sapiens
gcaacttctatcctttct

SEQ ID NO: 5752504 - DNA, 14 bp, Homo sapiens
gcaacttcttctcc

SEQ ID NO: 5752505 - DNA, 16 bp, Homo sapiens
gcaacttggtccagat

SEQ ID NO: 5752506 - DNA, 19 bp, Homo sapiens
gcaacttgtcctagcacag

SEQ ID NO: 5752507 - DNA, 22 bp, Homo sapiens
gcaacttgtcctagcacagatg

SEQ ID NO: 5752508 - DNA, 12 bp, Homo sapiens
gcaacttgtgaa

SEQ ID NO: 5752509 - DNA, 14 bp, Homo sapiens
gcaacttgtgaact

SEQ ID NO: 5752510 - DNA, 13 bp, Homo sapiens
gcaactttagaaa

SEQ ID NO: 5752511 - DNA, 20 bp, Homo sapiens
gcaactttcccttgccctgg

SEQ ID NO: 5752512 - DNA, 21 bp, Homo sapiens
gcaactttcccttgccctggg

SEQ ID NO: 5752513 - DNA, 22 bp, Homo sapiens
gcaactttgtataaaagggact

SEQ ID NO: 5752514 - DNA, 16 bp, Homo sapiens
gcaacttttaaagctc

SEQ ID NO: 5752515 - DNA, 10 bp, Homo sapiens
gcaacttttc

SEQ ID NO: 5752516 - DNA, 16 bp, Homo sapiens
gcaacttttccaacat

SEQ ID NO: 5752517 - DNA, 17 bp, Homo sapiens
gcaagaaaaaaaaatgc

SEQ ID NO: 5752518 - DNA, 20 bp, Homo sapiens
gcaagaaaagcgcagagaaa

SEQ ID NO: 5752519 - DNA, 23 bp, Homo sapiens
gcaagaaagagggagggaaatct

SEQ ID NO: 5752520 - DNA, 17 bp, Homo sapiens
gcaagaaagcttccttc

SEQ ID NO: 5752521 - DNA, 13 bp, Homo sapiens
gcaagaaatgaac

SEQ ID NO: 5752522 - DNA, 19 bp, Homo sapiens
gcaagaaattcattaaaga

SEQ ID NO: 5752523 - DNA, 22 bp, Homo sapiens
gcaagaaattcattaaagaaaa

SEQ ID NO: 5752524 - DNA, 16 bp, Homo sapiens
gcaagaactcatcact

SEQ ID NO: 5752525 - DNA, 13 bp, Homo sapiens
gcaagaacttgtt

SEQ ID NO: 5752526 - DNA, 15 bp, Homo sapiens
gcaagaacttgttta

SEQ ID NO: 5752527 - DNA, 18 bp, Homo sapiens
gcaagaagattctaaaac

SEQ ID NO: 5752528 - DNA, 19 bp, Homo sapiens
gcaagaagattctaaaaca

SEQ ID NO: 5752529 - DNA, 12 bp, Homo sapiens
gcaagaagctgc

SEQ ID NO: 5752530 - DNA, 21 bp, Homo sapiens
gcaagaagctgcttctgccca

SEQ ID NO: 5752531 - DNA, 22 bp, Homo sapiens
gcaagaagctgcttctgcccac

SEQ ID NO: 5752532 - DNA, 16 bp, Homo sapiens
gcaagaaggcaaaaat

SEQ ID NO: 5752533 - DNA, 21 bp, Homo sapiens
gcaagaaggcaaaaatagttt

SEQ ID NO: 5752534 - DNA, 13 bp, Homo sapiens
gcaagaagtggga

SEQ ID NO: 5752535 - DNA, 21 bp, Homo sapiens
gcaagaatcagagaaggaaca

SEQ ID NO: 5752536 - DNA, 20 bp, Homo sapiens
gcaagaatggtggcttcttt

SEQ ID NO: 5752537 - DNA, 16 bp, Homo sapiens
gcaagaattaaaactg

SEQ ID NO: 5752538 - DNA, 17 bp, Homo sapiens
gcaagaattaaaactga

SEQ ID NO: 5752539 - DNA, 18 bp, Homo sapiens
gcaagaattaaaactgag

SEQ ID NO: 5752540 - DNA, 20 bp, Homo sapiens
gcaagaattaaaactgagtc

SEQ ID NO: 5752541 - DNA, 24 bp, Homo sapiens
gcaagaattataacagcaaggaaa

SEQ ID NO: 5752542 - DNA, 20 bp, Homo sapiens
gcaagaatttctggaagaaa

SEQ ID NO: 5752543 - DNA, 15 bp, Homo sapiens
gcaagacaccttccc

SEQ ID NO: 5752544 - DNA, 19 bp, Homo sapiens
gcaagacaccttcccagct

SEQ ID NO: 5752545 - DNA, 21 bp, Homo sapiens
gcaagacagaaaagtgcctga

SEQ ID NO: 5752546 - DNA, 13 bp, Homo sapiens
gcaagacagaaac

SEQ ID NO: 5752547 - DNA, 17 bp, Homo sapiens
gcaagacagtggcacta

SEQ ID NO: 5752548 - DNA, 15 bp, Homo sapiens
gcaagaccagttgaa

SEQ ID NO: 5752549 - DNA, 21 bp, Homo sapiens
gcaagaccatggggtggaagg

SEQ ID NO: 5752550 - DNA, 15 bp, Homo sapiens
gcaagaccctgcctc

SEQ ID NO: 5752551 - DNA, 23 bp, Homo sapiens
gcaagacctcttccctctgggcc

SEQ ID NO: 5752552 - DNA, 15 bp, Homo sapiens
gcaagacctgttggt

SEQ ID NO: 5752553 - DNA, 16 bp, Homo sapiens
gcaagaccttttttta

SEQ ID NO: 5752554 - DNA, 16 bp, Homo sapiens
gcaagacgccctctcg

SEQ ID NO: 5752555 - DNA, 16 bp, Homo sapiens
gcaagacgtcctggaa

SEQ ID NO: 5752556 - DNA, 18 bp, Homo sapiens
gcaagacgtcctggaatg

SEQ ID NO: 5752557 - DNA, 15 bp, Homo sapiens
gcaagactgcaaact

SEQ ID NO: 5752558 - DNA, 19 bp, Homo sapiens
gcaagactgcaaacttttt

SEQ ID NO: 5752559 - DNA, 20 bp, Homo sapiens
gcaagactgggccccacatg

SEQ ID NO: 5752560 - DNA, 19 bp, Homo sapiens
gcaagacttcactgcagcc

SEQ ID NO: 5752561 - DNA, 15 bp, Homo sapiens
gcaagagaaaataaa

SEQ ID NO: 5752562 - DNA, 16 bp, Homo sapiens
gcaagagaaggagatg

SEQ ID NO: 5752563 - DNA, 13 bp, Homo sapiens
gcaagagaattat

SEQ ID NO: 5752564 - DNA, 13 bp, Homo sapiens
gcaagagatgaga

SEQ ID NO: 5752565 - DNA, 12 bp, Homo sapiens
gcaagagccagg

SEQ ID NO: 5752566 - DNA, 19 bp, Homo sapiens
gcaagagcctgagactgga

SEQ ID NO: 5752567 - DNA, 22 bp, Homo sapiens
gcaagagccttggtgtccacct

SEQ ID NO: 5752568 - DNA, 18 bp, Homo sapiens
gcaagaggatgaaggaag

SEQ ID NO: 5752569 - DNA, 18 bp, Homo sapiens
gcaagaggcatcccaaga

SEQ ID NO: 5752570 - DNA, 20 bp, Homo sapiens
gcaagaggccgtggctgctg

SEQ ID NO: 5752571 - DNA, 22 bp, Homo sapiens
gcaagaggccgtggctgctgtg

SEQ ID NO: 5752572 - DNA, 23 bp, Homo sapiens
gcaagaggcctcatgcctgctga

SEQ ID NO: 5752573 - DNA, 16 bp, Homo sapiens
gcaagagggaaggtga

SEQ ID NO: 5752574 - DNA, 13 bp, Homo sapiens
gcaagagggaggg

SEQ ID NO: 5752575 - DNA, 23 bp, Homo sapiens
gcaagagggaggggacagaggcc

SEQ ID NO: 5752576 - DNA, 22 bp, Homo sapiens
gcaagagggggtggaggggtgt

SEQ ID NO: 5752577 - DNA, 23 bp, Homo sapiens
gcaagagggtctctttgttcaat

SEQ ID NO: 5752578 - DNA, 16 bp, Homo sapiens
gcaagaggtgcctggg

SEQ ID NO: 5752579 - DNA, 22 bp, Homo sapiens
gcaagaggtgcctgggaggagt

SEQ ID NO: 5752580 - DNA, 21 bp, Homo sapiens
gcaagaggtttcagcattccc

SEQ ID NO: 5752581 - DNA, 17 bp, Homo sapiens
gcaagagtaagcagtgt

SEQ ID NO: 5752582 - DNA, 19 bp, Homo sapiens
gcaagagtgatgggaaaga

SEQ ID NO: 5752583 - DNA, 21 bp, Homo sapiens
gcaagagtgatgggaaagacc

SEQ ID NO: 5752584 - DNA, 14 bp, Homo sapiens
gcaagagtttcttg

SEQ ID NO: 5752585 - DNA, 18 bp, Homo sapiens
gcaagataaacattatta

SEQ ID NO: 5752586 - DNA, 14 bp, Homo sapiens
gcaagatccaggtg

SEQ ID NO: 5752587 - DNA, 17 bp, Homo sapiens
gcaagatcgctgtgcta

SEQ ID NO: 5752588 - DNA, 14 bp, Homo sapiens
gcaagatgagctgt

SEQ ID NO: 5752589 - DNA, 15 bp, Homo sapiens
gcaagatgagctgtg

SEQ ID NO: 5752590 - DNA, 16 bp, Homo sapiens
gcaagatgatttttaa

SEQ ID NO: 5752591 - DNA, 23 bp, Homo sapiens
gcaagatggggagtgagaggctg

SEQ ID NO: 5752592 - DNA, 12 bp, Homo sapiens
gcaagatgtggg

SEQ ID NO: 5752593 - DNA, 16 bp, Homo sapiens
gcaagatgtgggcagt

SEQ ID NO: 5752594 - DNA, 16 bp, Homo sapiens
gcaagatgtttcttat

SEQ ID NO: 5752595 - DNA, 18 bp, Homo sapiens
gcaagatgttttgtataa

SEQ ID NO: 5752596 - DNA, 22 bp, Homo sapiens
gcaagatgttttgtataaaatc

SEQ ID NO: 5752597 - DNA, 18 bp, Homo sapiens
gcaagattctgaaacatt

SEQ ID NO: 5752598 - DNA, 14 bp, Homo sapiens
gcaagattctgtgg

SEQ ID NO: 5752599 - DNA, 23 bp, Homo sapiens
gcaagattctgtgggcagctggc

SEQ ID NO: 5752600 - DNA, 13 bp, Homo sapiens
gcaagattgctta

SEQ ID NO: 5752601 - DNA, 16 bp, Homo sapiens
gcaagatttaacacta

SEQ ID NO: 5752602 - DNA, 19 bp, Homo sapiens
gcaagcaaacagggtggcc

SEQ ID NO: 5752603 - DNA, 22 bp, Homo sapiens
gcaagcaaacagggtggcccag

SEQ ID NO: 5752604 - DNA, 21 bp, Homo sapiens
gcaagcaacttgcaggctcca

SEQ ID NO: 5752605 - DNA, 16 bp, Homo sapiens
gcaagcaagagctctt

SEQ ID NO: 5752606 - DNA, 17 bp, Homo sapiens
gcaagcaagagctcttg

SEQ ID NO: 5752607 - DNA, 14 bp, Homo sapiens
gcaagcaagaggcc

SEQ ID NO: 5752608 - DNA, 22 bp, Homo sapiens
gcaagcacaatggtttcaaaga

SEQ ID NO: 5752609 - DNA, 14 bp, Homo sapiens
gcaagcacatctgc

SEQ ID NO: 5752610 - DNA, 18 bp, Homo sapiens
gcaagcaccaacctccag

SEQ ID NO: 5752611 - DNA, 21 bp, Homo sapiens
gcaagcaccaacctccagact

SEQ ID NO: 5752612 - DNA, 15 bp, Homo sapiens
gcaagcaccatcccc

SEQ ID NO: 5752613 - DNA, 17 bp, Homo sapiens
gcaagcaccatcccctc

SEQ ID NO: 5752614 - DNA, 15 bp, Homo sapiens
gcaagcacctgggtg

SEQ ID NO: 5752615 - DNA, 22 bp, Homo sapiens
gcaagcacctgggtgtgctcca

SEQ ID NO: 5752616 - DNA, 18 bp, Homo sapiens
gcaagcagaaaaattaaa

SEQ ID NO: 5752617 - DNA, 19 bp, Homo sapiens
gcaagcagaaaaattaaat

SEQ ID NO: 5752618 - DNA, 12 bp, Homo sapiens
gcaagcagaact

SEQ ID NO: 5752619 - DNA, 12 bp, Homo sapiens
gcaagcagagga

SEQ ID NO: 5752620 - DNA, 13 bp, Homo sapiens
gcaagcagaggac

SEQ ID NO: 5752621 - DNA, 16 bp, Homo sapiens
gcaagcagaggaccag

SEQ ID NO: 5752622 - DNA, 21 bp, Homo sapiens
gcaagcagaggaccagggcct

SEQ ID NO: 5752623 - DNA, 14 bp, Homo sapiens
gcaagcagatgaca

SEQ ID NO: 5752624 - DNA, 16 bp, Homo sapiens
gcaagcagcctcctgg

SEQ ID NO: 5752625 - DNA, 17 bp, Homo sapiens
gcaagcagctggtcagt

SEQ ID NO: 5752626 - DNA, 19 bp, Homo sapiens
gcaagcagctggtcagtct

SEQ ID NO: 5752627 - DNA, 16 bp, Homo sapiens
gcaagcaggacctggc

SEQ ID NO: 5752628 - DNA, 16 bp, Homo sapiens
gcaagcaggagtgtgc

SEQ ID NO: 5752629 - DNA, 22 bp, Homo sapiens
gcaagcatgaataaaattaggt

SEQ ID NO: 5752630 - DNA, 15 bp, Homo sapiens
gcaagcatgcttgtg

SEQ ID NO: 5752631 - DNA, 11 bp, Homo sapiens
gcaagcatgtt

SEQ ID NO: 5752632 - DNA, 17 bp, Homo sapiens
gcaagcattcagaagaa

SEQ ID NO: 5752633 - DNA, 20 bp, Homo sapiens
gcaagcatttatgtttattt

SEQ ID NO: 5752634 - DNA, 13 bp, Homo sapiens
gcaagccacagcc

SEQ ID NO: 5752635 - DNA, 17 bp, Homo sapiens
gcaagccacaggaagga

SEQ ID NO: 5752636 - DNA, 23 bp, Homo sapiens
gcaagccagacctagcaggctgt

SEQ ID NO: 5752637 - DNA, 20 bp, Homo sapiens
gcaagccagcttcctgtgca

SEQ ID NO: 5752638 - DNA, 22 bp, Homo sapiens
gcaagccagcttcctgtgcaga

SEQ ID NO: 5752639 - DNA, 14 bp, Homo sapiens
gcaagccagggccc

SEQ ID NO: 5752640 - DNA, 17 bp, Homo sapiens
gcaagccagggcccaga

SEQ ID NO: 5752641 - DNA, 20 bp, Homo sapiens
gcaagccagggcccagagcc

SEQ ID NO: 5752642 - DNA, 22 bp, Homo sapiens
gcaagccagggcccagagccct

SEQ ID NO: 5752643 - DNA, 13 bp, Homo sapiens
gcaagccataacg

SEQ ID NO: 5752644 - DNA, 19 bp, Homo sapiens
gcaagccataacgtgcccc

SEQ ID NO: 5752645 - DNA, 22 bp, Homo sapiens
gcaagccataacgtgcccccag

SEQ ID NO: 5752646 - DNA, 14 bp, Homo sapiens
gcaagccccagggc

SEQ ID NO: 5752647 - DNA, 15 bp, Homo sapiens
gcaagccccagggcc

SEQ ID NO: 5752648 - DNA, 17 bp, Homo sapiens
gcaagccccagggcctg

SEQ ID NO: 5752649 - DNA, 20 bp, Homo sapiens
gcaagccccagggcctgggg

SEQ ID NO: 5752650 - DNA, 20 bp, Homo sapiens
gcaagccctacagagctgtg

SEQ ID NO: 5752651 - DNA, 12 bp, Homo sapiens
gcaagccctgcc

SEQ ID NO: 5752652 - DNA, 15 bp, Homo sapiens
gcaagccctgttgac

SEQ ID NO: 5752653 - DNA, 20 bp, Homo sapiens
gcaagcccttcggtcacctg

SEQ ID NO: 5752654 - DNA, 16 bp, Homo sapiens
gcaagcctcagccact

SEQ ID NO: 5752655 - DNA, 18 bp, Homo sapiens
gcaagcctcagccactcc

SEQ ID NO: 5752656 - DNA, 22 bp, Homo sapiens
gcaagccttctaaatgagtcac

SEQ ID NO: 5752657 - DNA, 20 bp, Homo sapiens
gcaagcctttgacctgttca

SEQ ID NO: 5752658 - DNA, 15 bp, Homo sapiens
gcaagcgaaagagca

SEQ ID NO: 5752659 - DNA, 16 bp, Homo sapiens
gcaagcgacacaggct

SEQ ID NO: 5752660 - DNA, 16 bp, Homo sapiens
gcaagcgacgacagat

SEQ ID NO: 5752661 - DNA, 15 bp, Homo sapiens
gcaagcgagcacagt

SEQ ID NO: 5752662 - DNA, 16 bp, Homo sapiens
gcaagcgcagggagga

SEQ ID NO: 5752663 - DNA, 18 bp, Homo sapiens
gcaagcgcttctgctgaa

SEQ ID NO: 5752664 - DNA, 15 bp, Homo sapiens
gcaagcgtgctgcct

SEQ ID NO: 5752665 - DNA, 14 bp, Homo sapiens
gcaagctaacctta

SEQ ID NO: 5752666 - DNA, 19 bp, Homo sapiens
gcaagctagaacctggagg

SEQ ID NO: 5752667 - DNA, 17 bp, Homo sapiens
gcaagctaggccccaga

SEQ ID NO: 5752668 - DNA, 18 bp, Homo sapiens
gcaagctcatagcacatg

SEQ ID NO: 5752669 - DNA, 23 bp, Homo sapiens
gcaagctcatagcacatgtttta

SEQ ID NO: 5752670 - DNA, 17 bp, Homo sapiens
gcaagctccagtagctc

SEQ ID NO: 5752671 - DNA, 13 bp, Homo sapiens
gcaagctcccaag

SEQ ID NO: 5752672 - DNA, 19 bp, Homo sapiens
gcaagctcccaagggatgg

SEQ ID NO: 5752673 - DNA, 15 bp, Homo sapiens
gcaagctccgcagga

SEQ ID NO: 5752674 - DNA, 18 bp, Homo sapiens
gcaagctccgcctcccgg

SEQ ID NO: 5752675 - DNA, 20 bp, Homo sapiens
gcaagctccgcctcccgggt

SEQ ID NO: 5752676 - DNA, 14 bp, Homo sapiens
gcaagctctcagca

SEQ ID NO: 5752677 - DNA, 14 bp, Homo sapiens
gcaagctctcttgc

SEQ ID NO: 5752678 - DNA, 12 bp, Homo sapiens
gcaagctctgcc

SEQ ID NO: 5752679 - DNA, 15 bp, Homo sapiens
gcaagctctgccctg

SEQ ID NO: 5752680 - DNA, 18 bp, Homo sapiens
gcaagctctgccctggct

SEQ ID NO: 5752681 - DNA, 17 bp, Homo sapiens
gcaagctctgcctcccg

SEQ ID NO: 5752682 - DNA, 17 bp, Homo sapiens
gcaagctcttctcctca

SEQ ID NO: 5752683 - DNA, 11 bp, Homo sapiens
gcaagctgcag

SEQ ID NO: 5752684 - DNA, 14 bp, Homo sapiens
gcaagctgcccagc

SEQ ID NO: 5752685 - DNA, 15 bp, Homo sapiens
gcaagctgcccagcc

SEQ ID NO: 5752686 - DNA, 17 bp, Homo sapiens
gcaagctgcccagccct

SEQ ID NO: 5752687 - DNA, 19 bp, Homo sapiens
gcaagctggatgcagtggc

SEQ ID NO: 5752688 - DNA, 13 bp, Homo sapiens
gcaagctggcagg

SEQ ID NO: 5752689 - DNA, 13 bp, Homo sapiens
gcaagctgggtaa

SEQ ID NO: 5752690 - DNA, 11 bp, Homo sapiens
gcaagctgtgt

SEQ ID NO: 5752691 - DNA, 12 bp, Homo sapiens
gcaagctgtgtt

SEQ ID NO: 5752692 - DNA, 21 bp, Homo sapiens
gcaagctgtgttacttgaagt

SEQ ID NO: 5752693 - DNA, 20 bp, Homo sapiens
gcaagcttgaggccaagatg

SEQ ID NO: 5752694 - DNA, 21 bp, Homo sapiens
gcaagcttggctgtagaagga

SEQ ID NO: 5752695 - DNA, 22 bp, Homo sapiens
gcaagcttggctgtagaaggag

SEQ ID NO: 5752696 - DNA, 19 bp, Homo sapiens
gcaagcttggtcaaacttt

SEQ ID NO: 5752697 - DNA, 19 bp, Homo sapiens
gcaagcttttttatttttt

SEQ ID NO: 5752698 - DNA, 14 bp, Homo sapiens
gcaaggaaaaagaa

SEQ ID NO: 5752699 - DNA, 17 bp, Homo sapiens
gcaaggaaaaagaaaat

SEQ ID NO: 5752700 - DNA, 14 bp, Homo sapiens
gcaaggaaaataat

SEQ ID NO: 5752701 - DNA, 18 bp, Homo sapiens
gcaaggaaatgtcctgca

SEQ ID NO: 5752702 - DNA, 16 bp, Homo sapiens
gcaaggaagctttgga

SEQ ID NO: 5752703 - DNA, 15 bp, Homo sapiens
gcaaggaaggaaaga

SEQ ID NO: 5752704 - DNA, 14 bp, Homo sapiens
gcaaggaaggactt

SEQ ID NO: 5752705 - DNA, 20 bp, Homo sapiens
gcaaggaatgactcatgcct

SEQ ID NO: 5752706 - DNA, 19 bp, Homo sapiens
gcaaggacaacctgcccct

SEQ ID NO: 5752707 - DNA, 22 bp, Homo sapiens
gcaaggacattgccccaagata

SEQ ID NO: 5752708 - DNA, 17 bp, Homo sapiens
gcaaggaccagtgagac

SEQ ID NO: 5752709 - DNA, 19 bp, Homo sapiens
gcaaggaggctggctgggg

SEQ ID NO: 5752710 - DNA, 21 bp, Homo sapiens
gcaaggagtggggagggagtc

SEQ ID NO: 5752711 - DNA, 20 bp, Homo sapiens
gcaaggagtttattacaatg

SEQ ID NO: 5752712 - DNA, 21 bp, Homo sapiens
gcaaggatgatccagggattg

SEQ ID NO: 5752713 - DNA, 23 bp, Homo sapiens
gcaaggatggtggggcccccagc

SEQ ID NO: 5752714 - DNA, 14 bp, Homo sapiens
gcaaggattacaga

SEQ ID NO: 5752715 - DNA, 21 bp, Homo sapiens
gcaaggatttttccatgtgtg

SEQ ID NO: 5752716 - DNA, 15 bp, Homo sapiens
gcaaggattttttaa

SEQ ID NO: 5752717 - DNA, 17 bp, Homo sapiens
gcaaggattttttaaaa

SEQ ID NO: 5752718 - DNA, 16 bp, Homo sapiens
gcaaggcaagaagtgg

SEQ ID NO: 5752719 - DNA, 20 bp, Homo sapiens
gcaaggcacaggctcctgta

SEQ ID NO: 5752720 - DNA, 14 bp, Homo sapiens
gcaaggcacctgca

SEQ ID NO: 5752721 - DNA, 18 bp, Homo sapiens
gcaaggcagaaggccagg

SEQ ID NO: 5752722 - DNA, 14 bp, Homo sapiens
gcaaggcagagcct

SEQ ID NO: 5752723 - DNA, 15 bp, Homo sapiens
gcaaggcagctccca

SEQ ID NO: 5752724 - DNA, 19 bp, Homo sapiens
gcaaggcaggttggatggg

SEQ ID NO: 5752725 - DNA, 16 bp, Homo sapiens
gcaaggccagccctgg

SEQ ID NO: 5752726 - DNA, 19 bp, Homo sapiens
gcaaggccagccctggttc

SEQ ID NO: 5752727 - DNA, 13 bp, Homo sapiens
gcaaggccagggc

SEQ ID NO: 5752728 - DNA, 15 bp, Homo sapiens
gcaaggccagggcac

SEQ ID NO: 5752729 - DNA, 13 bp, Homo sapiens
gcaaggcccacag

SEQ ID NO: 5752730 - DNA, 14 bp, Homo sapiens
gcaaggcccacagg

SEQ ID NO: 5752731 - DNA, 16 bp, Homo sapiens
gcaaggcccacaggag

SEQ ID NO: 5752732 - DNA, 23 bp, Homo sapiens
gcaaggcccagacctggcctctg

SEQ ID NO: 5752733 - DNA, 15 bp, Homo sapiens
gcaaggccccttcca

SEQ ID NO: 5752734 - DNA, 18 bp, Homo sapiens
gcaaggcccgagcagctg

SEQ ID NO: 5752735 - DNA, 22 bp, Homo sapiens
gcaaggcccgagcagctgagca

SEQ ID NO: 5752736 - DNA, 13 bp, Homo sapiens
gcaaggccctgcc

SEQ ID NO: 5752737 - DNA, 16 bp, Homo sapiens
gcaaggccctgccctg

SEQ ID NO: 5752738 - DNA, 19 bp, Homo sapiens
gcaaggccctgctgcccaa

SEQ ID NO: 5752739 - DNA, 13 bp, Homo sapiens
gcaaggccctgtc

SEQ ID NO: 5752740 - DNA, 22 bp, Homo sapiens
gcaaggccgagcgttcccagca

SEQ ID NO: 5752741 - DNA, 21 bp, Homo sapiens
gcaaggccgctgttcacccac

SEQ ID NO: 5752742 - DNA, 19 bp, Homo sapiens
gcaaggccttgaagacatg

SEQ ID NO: 5752743 - DNA, 17 bp, Homo sapiens
gcaaggccttggtgttt

SEQ ID NO: 5752744 - DNA, 16 bp, Homo sapiens
gcaaggcgctaacttg

SEQ ID NO: 5752745 - DNA, 14 bp, Homo sapiens
gcaaggctgaggtg

SEQ ID NO: 5752746 - DNA, 14 bp, Homo sapiens
gcaaggctgccctg

SEQ ID NO: 5752747 - DNA, 17 bp, Homo sapiens
gcaaggctgccggctgc

SEQ ID NO: 5752748 - DNA, 13 bp, Homo sapiens
gcaaggctgctgc

SEQ ID NO: 5752749 - DNA, 12 bp, Homo sapiens
gcaaggctgtgc

SEQ ID NO: 5752750 - DNA, 13 bp, Homo sapiens
gcaaggctgtgct

SEQ ID NO: 5752751 - DNA, 14 bp, Homo sapiens
gcaaggctgtgctc

SEQ ID NO: 5752752 - DNA, 18 bp, Homo sapiens
gcaaggctgtgctccctg

SEQ ID NO: 5752753 - DNA, 23 bp, Homo sapiens
gcaaggctgtgctcttcctctgg

SEQ ID NO: 5752754 - DNA, 21 bp, Homo sapiens
gcaagggaatttcttcaactc

SEQ ID NO: 5752755 - DNA, 17 bp, Homo sapiens
gcaagggacaggaaggt

SEQ ID NO: 5752756 - DNA, 19 bp, Homo sapiens
gcaagggagaagaaatcca

SEQ ID NO: 5752757 - DNA, 14 bp, Homo sapiens
gcaagggaggccca

SEQ ID NO: 5752758 - DNA, 15 bp, Homo sapiens
gcaagggaggcccag

SEQ ID NO: 5752759 - DNA, 21 bp, Homo sapiens
gcaagggcacaaactgcagct

SEQ ID NO: 5752760 - DNA, 22 bp, Homo sapiens
gcaagggcacaaactgcagctg

SEQ ID NO: 5752761 - DNA, 21 bp, Homo sapiens
gcaagggcagggacagggccg

SEQ ID NO: 5752762 - DNA, 18 bp, Homo sapiens
gcaagggcatcaggcact

SEQ ID NO: 5752763 - DNA, 15 bp, Homo sapiens
gcaagggcccagagt

SEQ ID NO: 5752764 - DNA, 16 bp, Homo sapiens
gcaagggcccagagtg

SEQ ID NO: 5752765 - DNA, 12 bp, Homo sapiens
gcaagggcctgg

SEQ ID NO: 5752766 - DNA, 14 bp, Homo sapiens
gcaagggctccagc

SEQ ID NO: 5752767 - DNA, 15 bp, Homo sapiens
gcaagggctccagca

SEQ ID NO: 5752768 - DNA, 22 bp, Homo sapiens
gcaagggctccagcatccagcc

SEQ ID NO: 5752769 - DNA, 23 bp, Homo sapiens
gcaaggggaccccgagaaccctg

SEQ ID NO: 5752770 - DNA, 20 bp, Homo sapiens
gcaaggggaccgccccaggc

SEQ ID NO: 5752771 - DNA, 21 bp, Homo sapiens
gcaaggggccaggaaggggac

SEQ ID NO: 5752772 - DNA, 22 bp, Homo sapiens
gcaagggggtgtcatctgagga

SEQ ID NO: 5752773 - DNA, 23 bp, Homo sapiens
gcaagggggtgtcatctgaggag

SEQ ID NO: 5752774 - DNA, 17 bp, Homo sapiens
gcaaggggtgaggatag

SEQ ID NO: 5752775 - DNA, 15 bp, Homo sapiens
gcaaggggtgatggc

SEQ ID NO: 5752776 - DNA, 16 bp, Homo sapiens
gcaaggggtgggactg

SEQ ID NO: 5752777 - DNA, 21 bp, Homo sapiens
gcaaggggtgggactggtggg

SEQ ID NO: 5752778 - DNA, 22 bp, Homo sapiens
gcaaggggttcccttgagggct

SEQ ID NO: 5752779 - DNA, 22 bp, Homo sapiens
gcaagggtcctacggagggacc

SEQ ID NO: 5752780 - DNA, 18 bp, Homo sapiens
gcaagggttccctcaaga

SEQ ID NO: 5752781 - DNA, 14 bp, Homo sapiens
gcaaggtaaaattt

SEQ ID NO: 5752782 - DNA, 22 bp, Homo sapiens
gcaaggtattggtaggttactc

SEQ ID NO: 5752783 - DNA, 15 bp, Homo sapiens
gcaaggtcatagaca

SEQ ID NO: 5752784 - DNA, 19 bp, Homo sapiens
gcaaggtcctcttgaaatg

SEQ ID NO: 5752785 - DNA, 23 bp, Homo sapiens
gcaaggtctccttactctgagcc

SEQ ID NO: 5752786 - DNA, 22 bp, Homo sapiens
gcaaggtctggcctcaggtggg

SEQ ID NO: 5752787 - DNA, 16 bp, Homo sapiens
gcaaggtgagagaggt

SEQ ID NO: 5752788 - DNA, 21 bp, Homo sapiens
gcaaggtgcacctgccccagg

SEQ ID NO: 5752789 - DNA, 21 bp, Homo sapiens
gcaaggtgctcacaccccatt

SEQ ID NO: 5752790 - DNA, 16 bp, Homo sapiens
gcaaggtggacatctt

SEQ ID NO: 5752791 - DNA, 13 bp, Homo sapiens
gcaaggtggagtg

SEQ ID NO: 5752792 - DNA, 20 bp, Homo sapiens
gcaaggtggcctctgcctgg

SEQ ID NO: 5752793 - DNA, 16 bp, Homo sapiens
gcaaggtgggggagcc

SEQ ID NO: 5752794 - DNA, 23 bp, Homo sapiens
gcaaggtgggggagcctggagcc

SEQ ID NO: 5752795 - DNA, 18 bp, Homo sapiens
gcaaggtgggttccaggg

SEQ ID NO: 5752796 - DNA, 19 bp, Homo sapiens
gcaaggtgggttccaggga

SEQ ID NO: 5752797 - DNA, 14 bp, Homo sapiens
gcaaggtgtccctg

SEQ ID NO: 5752798 - DNA, 17 bp, Homo sapiens
gcaaggtgtccctgcct

SEQ ID NO: 5752799 - DNA, 15 bp, Homo sapiens
gcaaggtgtgctctg

SEQ ID NO: 5752800 - DNA, 21 bp, Homo sapiens
gcaaggtgtgctctgagccac

SEQ ID NO: 5752801 - DNA, 22 bp, Homo sapiens
gcaaggtgtggaggctcctgtg

SEQ ID NO: 5752802 - DNA, 19 bp, Homo sapiens
gcaaggtgtttaagtaatt

SEQ ID NO: 5752803 - DNA, 16 bp, Homo sapiens
gcaaggttccacagag

SEQ ID NO: 5752804 - DNA, 17 bp, Homo sapiens
gcaaggtttaagttatt

SEQ ID NO: 5752805 - DNA, 22 bp, Homo sapiens
gcaaggtttacactgcggaagc

SEQ ID NO: 5752806 - DNA, 21 bp, Homo sapiens
gcaaggtttaggctggtggcc

SEQ ID NO: 5752807 - DNA, 23 bp, Homo sapiens
gcaaggtttaggctggtggccca

SEQ ID NO: 5752808 - DNA, 24 bp, Homo sapiens
gcaaggtttaggctggtggcccag

SEQ ID NO: 5752809 - DNA, 18 bp, Homo sapiens
gcaagtagataaatattt

SEQ ID NO: 5752810 - DNA, 14 bp, Homo sapiens
gcaagtatatttat

SEQ ID NO: 5752811 - DNA, 21 bp, Homo sapiens
gcaagtatgaaccacatggaa

SEQ ID NO: 5752812 - DNA, 14 bp, Homo sapiens
gcaagtatgtgagt

SEQ ID NO: 5752813 - DNA, 23 bp, Homo sapiens
gcaagtatgttttagcatgtgtt

SEQ ID NO: 5752814 - DNA, 15 bp, Homo sapiens
gcaagtatttggcta

SEQ ID NO: 5752815 - DNA, 19 bp, Homo sapiens
gcaagtcagaggatggcca

SEQ ID NO: 5752816 - DNA, 24 bp, Homo sapiens
gcaagtcagaggatggccagtgtc

SEQ ID NO: 5752817 - DNA, 19 bp, Homo sapiens
gcaagtcagattgctggga

SEQ ID NO: 5752818 - DNA, 20 bp, Homo sapiens
gcaagtcagattgctgggag

SEQ ID NO: 5752819 - DNA, 17 bp, Homo sapiens
gcaagtcatggctgtgc

SEQ ID NO: 5752820 - DNA, 22 bp, Homo sapiens
gcaagtcattattactggtatt

SEQ ID NO: 5752821 - DNA, 23 bp, Homo sapiens
gcaagtcccagggagctctgcat

SEQ ID NO: 5752822 - DNA, 23 bp, Homo sapiens
gcaagtcccttcagactggccct

SEQ ID NO: 5752823 - DNA, 15 bp, Homo sapiens
gcaagtccttttgta

SEQ ID NO: 5752824 - DNA, 11 bp, Homo sapiens
gcaagtctctt

SEQ ID NO: 5752825 - DNA, 21 bp, Homo sapiens
gcaagtctgcagcccggcgcc

SEQ ID NO: 5752826 - DNA, 17 bp, Homo sapiens
gcaagtctggatctggg

SEQ ID NO: 5752827 - DNA, 13 bp, Homo sapiens
gcaagtctgtgag

SEQ ID NO: 5752828 - DNA, 13 bp, Homo sapiens
gcaagtgaagaaa

SEQ ID NO: 5752829 - DNA, 18 bp, Homo sapiens
gcaagtgaaggtttacaa

SEQ ID NO: 5752830 - DNA, 23 bp, Homo sapiens
gcaagtgaccgacaaaattccag

SEQ ID NO: 5752831 - DNA, 14 bp, Homo sapiens
gcaagtgagagggg

SEQ ID NO: 5752832 - DNA, 16 bp, Homo sapiens
gcaagtgagaggggag

SEQ ID NO: 5752833 - DNA, 21 bp, Homo sapiens
gcaagtgagcaaacctgcccc

SEQ ID NO: 5752834 - DNA, 15 bp, Homo sapiens
gcaagtgagcagaga

SEQ ID NO: 5752835 - DNA, 22 bp, Homo sapiens
gcaagtgagcagagatgtactg

SEQ ID NO: 5752836 - DNA, 17 bp, Homo sapiens
gcaagtgaggcaagaga

SEQ ID NO: 5752837 - DNA, 18 bp, Homo sapiens
gcaagtgaggcaagagaa

SEQ ID NO: 5752838 - DNA, 12 bp, Homo sapiens
gcaagtgcattt

SEQ ID NO: 5752839 - DNA, 14 bp, Homo sapiens
gcaagtgcccagtg

SEQ ID NO: 5752840 - DNA, 20 bp, Homo sapiens
gcaagtgcccgccctgcccc

SEQ ID NO: 5752841 - DNA, 19 bp, Homo sapiens
gcaagtgcctgggattcta

SEQ ID NO: 5752842 - DNA, 22 bp, Homo sapiens
gcaagtggagctgtctgtctct

SEQ ID NO: 5752843 - DNA, 14 bp, Homo sapiens
gcaagtggatggcc

SEQ ID NO: 5752844 - DNA, 21 bp, Homo sapiens
gcaagtgtatgcacgtgtgca

SEQ ID NO: 5752845 - DNA, 13 bp, Homo sapiens
gcaagtgtctgga

SEQ ID NO: 5752846 - DNA, 19 bp, Homo sapiens
gcaagtgtctggagcggct

SEQ ID NO: 5752847 - DNA, 16 bp, Homo sapiens
gcaagtgtctgtgtgc

SEQ ID NO: 5752848 - DNA, 13 bp, Homo sapiens
gcaagtgtgaata

SEQ ID NO: 5752849 - DNA, 22 bp, Homo sapiens
gcaagtgtgctggcctctctga

SEQ ID NO: 5752850 - DNA, 23 bp, Homo sapiens
gcaagtgtgtatgtgcgtgtgtg

SEQ ID NO: 5752851 - DNA, 14 bp, Homo sapiens
gcaagtgtgtgagt

SEQ ID NO: 5752852 - DNA, 23 bp, Homo sapiens
gcaagtgtgtgcacatgtgtgcg

SEQ ID NO: 5752853 - DNA, 19 bp, Homo sapiens
gcaagtgtgtgcatgtgtg

SEQ ID NO: 5752854 - DNA, 21 bp, Homo sapiens
gcaagtgtgtgcatgtgtgcg

SEQ ID NO: 5752855 - DNA, 13 bp, Homo sapiens
gcaagtgttcact

SEQ ID NO: 5752856 - DNA, 16 bp, Homo sapiens
gcaagtgtttcttctg

SEQ ID NO: 5752857 - DNA, 21 bp, Homo sapiens
gcaagtgtttgaagtctgctc

SEQ ID NO: 5752858 - DNA, 19 bp, Homo sapiens
gcaagttcagggaagcagg

SEQ ID NO: 5752859 - DNA, 15 bp, Homo sapiens
gcaagttcatgtgtg

SEQ ID NO: 5752860 - DNA, 21 bp, Homo sapiens
gcaagttctagagaagaggct

SEQ ID NO: 5752861 - DNA, 12 bp, Homo sapiens
gcaagttgcagt

SEQ ID NO: 5752862 - DNA, 15 bp, Homo sapiens
gcaagttgccatttt

SEQ ID NO: 5752863 - DNA, 14 bp, Homo sapiens
gcaagtttactttt

SEQ ID NO: 5752864 - DNA, 16 bp, Homo sapiens
gcaagtttctgtttca

SEQ ID NO: 5752865 - DNA, 19 bp, Homo sapiens
gcaagttttccctgaagtt

SEQ ID NO: 5752866 - DNA, 18 bp, Homo sapiens
gcaataaaaaatatattt

SEQ ID NO: 5752867 - DNA, 18 bp, Homo sapiens
gcaataaaaactgtctgt

SEQ ID NO: 5752868 - DNA, 13 bp, Homo sapiens
gcaataaaactgc

SEQ ID NO: 5752869 - DNA, 17 bp, Homo sapiens
gcaataaaactgctagt

SEQ ID NO: 5752870 - DNA, 17 bp, Homo sapiens
gcaataaaagcccagga

SEQ ID NO: 5752871 - DNA, 17 bp, Homo sapiens
gcaataaaatagtattg

SEQ ID NO: 5752872 - DNA, 13 bp, Homo sapiens
gcaataaaattta

SEQ ID NO: 5752873 - DNA, 15 bp, Homo sapiens
gcaataaaatttaaa

SEQ ID NO: 5752874 - DNA, 19 bp, Homo sapiens
gcaataaacgcattatcag

SEQ ID NO: 5752875 - DNA, 19 bp, Homo sapiens
gcaataaaggagaagagat

SEQ ID NO: 5752876 - DNA, 13 bp, Homo sapiens
gcaataaagtata

SEQ ID NO: 5752877 - DNA, 14 bp, Homo sapiens
gcaataaataacac

SEQ ID NO: 5752878 - DNA, 15 bp, Homo sapiens
gcaataaataacact

SEQ ID NO: 5752879 - DNA, 18 bp, Homo sapiens
gcaataaatctgacccag

SEQ ID NO: 5752880 - DNA, 18 bp, Homo sapiens
gcaataaatgtcccaaat

SEQ ID NO: 5752881 - DNA, 23 bp, Homo sapiens
gcaataaatgtcccaaataaatt

SEQ ID NO: 5752882 - DNA, 13 bp, Homo sapiens
gcaataaattttg

SEQ ID NO: 5752883 - DNA, 16 bp, Homo sapiens
gcaataacagctgcaa

SEQ ID NO: 5752884 - DNA, 13 bp, Homo sapiens
gcaataacagttt

SEQ ID NO: 5752885 - DNA, 17 bp, Homo sapiens
gcaataactccaagcag

SEQ ID NO: 5752886 - DNA, 23 bp, Homo sapiens
gcaataactccaagcagactcca

SEQ ID NO: 5752887 - DNA, 12 bp, Homo sapiens
gcaataacttct

SEQ ID NO: 5752888 - DNA, 13 bp, Homo sapiens
gcaataacttcta

SEQ ID NO: 5752889 - DNA, 22 bp, Homo sapiens
gcaataacttctatattttaat

SEQ ID NO: 5752890 - DNA, 14 bp, Homo sapiens
gcaataacttctga

SEQ ID NO: 5752891 - DNA, 14 bp, Homo sapiens
gcaataagaaatga

SEQ ID NO: 5752892 - DNA, 21 bp, Homo sapiens
gcaataagaatttagggagaa

SEQ ID NO: 5752893 - DNA, 13 bp, Homo sapiens
gcaataagataca

SEQ ID NO: 5752894 - DNA, 13 bp, Homo sapiens
gcaataagattta

SEQ ID NO: 5752895 - DNA, 17 bp, Homo sapiens
gcaataagctggactag

SEQ ID NO: 5752896 - DNA, 22 bp, Homo sapiens
gcaataaggatttattctcaga

SEQ ID NO: 5752897 - DNA, 20 bp, Homo sapiens
gcaataagttccatgttaaa

SEQ ID NO: 5752898 - DNA, 17 bp, Homo sapiens
gcaataagttgaatgat

SEQ ID NO: 5752899 - DNA, 20 bp, Homo sapiens
gcaataatatgtgagaggac

SEQ ID NO: 5752900 - DNA, 13 bp, Homo sapiens
gcaataatgcagt

SEQ ID NO: 5752901 - DNA, 18 bp, Homo sapiens
gcaataatggtcccatcc

SEQ ID NO: 5752902 - DNA, 19 bp, Homo sapiens
gcaataatggtcccatcca

SEQ ID NO: 5752903 - DNA, 22 bp, Homo sapiens
gcaataatggtcccatccaggc

SEQ ID NO: 5752904 - DNA, 17 bp, Homo sapiens
gcaataatgtgcaaatt

SEQ ID NO: 5752905 - DNA, 23 bp, Homo sapiens
gcaataatgtgcaaattttgcat

SEQ ID NO: 5752906 - DNA, 24 bp, Homo sapiens
gcaataattaggatctatgcaatt

SEQ ID NO: 5752907 - DNA, 16 bp, Homo sapiens
gcaataattgtttcca

SEQ ID NO: 5752908 - DNA, 19 bp, Homo sapiens
gcaataatttgtacaatgg

SEQ ID NO: 5752909 - DNA, 14 bp, Homo sapiens
gcaatacagggagg

SEQ ID NO: 5752910 - DNA, 15 bp, Homo sapiens
gcaatacagggaggc

SEQ ID NO: 5752911 - DNA, 18 bp, Homo sapiens
gcaatacagggaggctcc

SEQ ID NO: 5752912 - DNA, 13 bp, Homo sapiens
gcaatacatacca

SEQ ID NO: 5752913 - DNA, 13 bp, Homo sapiens
gcaatacattttt

SEQ ID NO: 5752914 - DNA, 13 bp, Homo sapiens
gcaataccaagta

SEQ ID NO: 5752915 - DNA, 16 bp, Homo sapiens
gcaataccctgtcttt

SEQ ID NO: 5752916 - DNA, 23 bp, Homo sapiens
gcaataccgtgttggttttgact

SEQ ID NO: 5752917 - DNA, 23 bp, Homo sapiens
gcaatacgacgtgggaatttcaa

SEQ ID NO: 5752918 - DNA, 20 bp, Homo sapiens
gcaatacgggagtgacccag

SEQ ID NO: 5752919 - DNA, 13 bp, Homo sapiens
gcaatacgtttgt

SEQ ID NO: 5752920 - DNA, 19 bp, Homo sapiens
gcaatactaggaagtaaag

SEQ ID NO: 5752921 - DNA, 20 bp, Homo sapiens
gcaatacttggagggcccag

SEQ ID NO: 5752922 - DNA, 12 bp, Homo sapiens
gcaatagaaaca

SEQ ID NO: 5752923 - DNA, 12 bp, Homo sapiens
gcaatagaaata

SEQ ID NO: 5752924 - DNA, 17 bp, Homo sapiens
gcaatagagactgtaga

SEQ ID NO: 5752925 - DNA, 18 bp, Homo sapiens
gcaatagattactgatgt

SEQ ID NO: 5752926 - DNA, 19 bp, Homo sapiens
gcaataggtgagagaatgt

SEQ ID NO: 5752927 - DNA, 18 bp, Homo sapiens
gcaatagtcaaattgtgt

SEQ ID NO: 5752928 - DNA, 22 bp, Homo sapiens
gcaatagtcaaattgtgtgaaa

SEQ ID NO: 5752929 - DNA, 13 bp, Homo sapiens
gcaatagtgtgtt

SEQ ID NO: 5752930 - DNA, 16 bp, Homo sapiens
gcaatagttttttact

SEQ ID NO: 5752931 - DNA, 18 bp, Homo sapiens
gcaatataaaaatgtgaa

SEQ ID NO: 5752932 - DNA, 14 bp, Homo sapiens
gcaatatagaaaca

SEQ ID NO: 5752933 - DNA, 23 bp, Homo sapiens
gcaatatatctaaattgaataat

SEQ ID NO: 5752934 - DNA, 21 bp, Homo sapiens
gcaatatattaccagcaagaa

SEQ ID NO: 5752935 - DNA, 18 bp, Homo sapiens
gcaatatattttgtatgc

SEQ ID NO: 5752936 - DNA, 20 bp, Homo sapiens
gcaatatattttgtatgcaa

SEQ ID NO: 5752937 - DNA, 14 bp, Homo sapiens
gcaatatcaaaagg

SEQ ID NO: 5752938 - DNA, 19 bp, Homo sapiens
gcaatatcatattctaaaa

SEQ ID NO: 5752939 - DNA, 22 bp, Homo sapiens
gcaatatctttaataggttaat

SEQ ID NO: 5752940 - DNA, 21 bp, Homo sapiens
gcaatatgtaacatgtctaaa

SEQ ID NO: 5752941 - DNA, 22 bp, Homo sapiens
gcaatattccttagtcaaatca

SEQ ID NO: 5752942 - DNA, 15 bp, Homo sapiens
gcaatattttgtata

SEQ ID NO: 5752943 - DNA, 21 bp, Homo sapiens
gcaatcaagagcttccagaaa

SEQ ID NO: 5752944 - DNA, 14 bp, Homo sapiens
gcaatcaatacagc

SEQ ID NO: 5752945 - DNA, 14 bp, Homo sapiens
gcaatcacaggaaa

SEQ ID NO: 5752946 - DNA, 14 bp, Homo sapiens
gcaatcactgggcc

SEQ ID NO: 5752947 - DNA, 15 bp, Homo sapiens
gcaatcactgggccc

SEQ ID NO: 5752948 - DNA, 19 bp, Homo sapiens
gcaatcactgggcccagag

SEQ ID NO: 5752949 - DNA, 17 bp, Homo sapiens
gcaatcacttttggaca

SEQ ID NO: 5752950 - DNA, 15 bp, Homo sapiens
gcaatcagaagaaag

SEQ ID NO: 5752951 - DNA, 19 bp, Homo sapiens
gcaatcagacaccctctcc

SEQ ID NO: 5752952 - DNA, 14 bp, Homo sapiens
gcaatcattttata

SEQ ID NO: 5752953 - DNA, 23 bp, Homo sapiens
gcaatcattttatataaagaaaa

SEQ ID NO: 5752954 - DNA, 20 bp, Homo sapiens
gcaatcattttatgctgttt

SEQ ID NO: 5752955 - DNA, 18 bp, Homo sapiens
gcaatccacctgccttgg

SEQ ID NO: 5752956 - DNA, 23 bp, Homo sapiens
gcaatccatgatctatacacata

SEQ ID NO: 5752957 - DNA, 13 bp, Homo sapiens
gcaatccatttat

SEQ ID NO: 5752958 - DNA, 14 bp, Homo sapiens
gcaatcccagcacc

SEQ ID NO: 5752959 - DNA, 10 bp, Homo sapiens
gcaatcctaa

SEQ ID NO: 5752960 - DNA, 18 bp, Homo sapiens
gcaatcctcctacctcag

SEQ ID NO: 5752961 - DNA, 20 bp, Homo sapiens
gcaatcctcctacctcagcc

SEQ ID NO: 5752962 - DNA, 12 bp, Homo sapiens
gcaatcctcctg

SEQ ID NO: 5752963 - DNA, 13 bp, Homo sapiens
gcaatcctcctga

SEQ ID NO: 5752964 - DNA, 15 bp, Homo sapiens
gcaatcctcctgcct

SEQ ID NO: 5752965 - DNA, 19 bp, Homo sapiens
gcaatccttacaaatgatt

SEQ ID NO: 5752966 - DNA, 20 bp, Homo sapiens
gcaatcgtggatgtctctga

SEQ ID NO: 5752967 - DNA, 14 bp, Homo sapiens
gcaatctataatat

SEQ ID NO: 5752968 - DNA, 21 bp, Homo sapiens
gcaatctattaatagctgcct

SEQ ID NO: 5752969 - DNA, 23 bp, Homo sapiens
gcaatctattaatagctgcctta

SEQ ID NO: 5752970 - DNA, 13 bp, Homo sapiens
gcaatctccaggg

SEQ ID NO: 5752971 - DNA, 20 bp, Homo sapiens
gcaatctccagggctgcccc

SEQ ID NO: 5752972 - DNA, 17 bp, Homo sapiens
gcaatctcgccttcctg

SEQ ID NO: 5752973 - DNA, 12 bp, Homo sapiens
gcaatctctctc

SEQ ID NO: 5752974 - DNA, 13 bp, Homo sapiens
gcaatctctctct

SEQ ID NO: 5752975 - DNA, 14 bp, Homo sapiens
gcaatctctctctg

SEQ ID NO: 5752976 - DNA, 17 bp, Homo sapiens
gcaatctggctcctcct

SEQ ID NO: 5752977 - DNA, 20 bp, Homo sapiens
gcaatctggctcctcctgga

SEQ ID NO: 5752978 - DNA, 22 bp, Homo sapiens
gcaatctgggtggtaactgcca

SEQ ID NO: 5752979 - DNA, 17 bp, Homo sapiens
gcaatctgtaactgctt

SEQ ID NO: 5752980 - DNA, 16 bp, Homo sapiens
gcaatctgtccagaca

SEQ ID NO: 5752981 - DNA, 14 bp, Homo sapiens
gcaatcttatgttg

SEQ ID NO: 5752982 - DNA, 12 bp, Homo sapiens
gcaatcttgctg

SEQ ID NO: 5752983 - DNA, 15 bp, Homo sapiens
gcaatcttgctgtga

SEQ ID NO: 5752984 - DNA, 17 bp, Homo sapiens
gcaatcttgctgtgaaa

SEQ ID NO: 5752985 - DNA, 19 bp, Homo sapiens
gcaatcttggctcactgca

SEQ ID NO: 5752986 - DNA, 17 bp, Homo sapiens
gcaatctttgaaagact

SEQ ID NO: 5752987 - DNA, 18 bp, Homo sapiens
gcaatctttgaaagactt

SEQ ID NO: 5752988 - DNA, 15 bp, Homo sapiens
gcaatgaaaaattct

SEQ ID NO: 5752989 - DNA, 15 bp, Homo sapiens
gcaatgaaaatttta

SEQ ID NO: 5752990 - DNA, 14 bp, Homo sapiens
gcaatgaaaccaaa

SEQ ID NO: 5752991 - DNA, 21 bp, Homo sapiens
gcaatgaaagtcaaatttact

SEQ ID NO: 5752992 - DNA, 14 bp, Homo sapiens
gcaatgaacactta

SEQ ID NO: 5752993 - DNA, 19 bp, Homo sapiens
gcaatgacatctcaggggc

SEQ ID NO: 5752994 - DNA, 21 bp, Homo sapiens
gcaatgacatctcaggggcca

SEQ ID NO: 5752995 - DNA, 20 bp, Homo sapiens
gcaatgacctttcaatagga

SEQ ID NO: 5752996 - DNA, 23 bp, Homo sapiens
gcaatgactcgttacctgccgcc

SEQ ID NO: 5752997 - DNA, 22 bp, Homo sapiens
gcaatgataatgagcagatgag

SEQ ID NO: 5752998 - DNA, 16 bp, Homo sapiens
gcaatgatcagacttg

SEQ ID NO: 5752999 - DNA, 16 bp, Homo sapiens
gcaatgatgaatgaga

SEQ ID NO: 5753000 - DNA, 17 bp, Homo sapiens
gcaatgatgacccacta

SEQ ID NO: 5753001 - DNA, 21 bp, Homo sapiens
gcaatgcaaatgtctaattgt

SEQ ID NO: 5753002 - DNA, 23 bp, Homo sapiens
gcaatgcatatctgtttattctg

SEQ ID NO: 5753003 - DNA, 13 bp, Homo sapiens
gcaatgccacagc

SEQ ID NO: 5753004 - DNA, 19 bp, Homo sapiens
gcaatgccatcagcccctg

SEQ ID NO: 5753005 - DNA, 20 bp, Homo sapiens
gcaatgccatcagcccctgg

SEQ ID NO: 5753006 - DNA, 23 bp, Homo sapiens
gcaatgccatcagcccctgggaa

SEQ ID NO: 5753007 - DNA, 18 bp, Homo sapiens
gcaatgccatcatctcct

SEQ ID NO: 5753008 - DNA, 19 bp, Homo sapiens
gcaatgccatcatctcctg

SEQ ID NO: 5753009 - DNA, 23 bp, Homo sapiens
gcaatgccatcctcaaacactgc

SEQ ID NO: 5753010 - DNA, 15 bp, Homo sapiens
gcaatgccccaaact

SEQ ID NO: 5753011 - DNA, 16 bp, Homo sapiens
gcaatgccccaaactt

SEQ ID NO: 5753012 - DNA, 19 bp, Homo sapiens
gcaatgccccctcccctcc

SEQ ID NO: 5753013 - DNA, 22 bp, Homo sapiens
gcaatgccccctcccctccttt

SEQ ID NO: 5753014 - DNA, 15 bp, Homo sapiens
gcaatgccctgcctt

SEQ ID NO: 5753015 - DNA, 21 bp, Homo sapiens
gcaatgccctgccttgctgcc

SEQ ID NO: 5753016 - DNA, 19 bp, Homo sapiens
gcaatgccctgcggctctg

SEQ ID NO: 5753017 - DNA, 20 bp, Homo sapiens
gcaatgccctgcggctctgg

SEQ ID NO: 5753018 - DNA, 21 bp, Homo sapiens
gcaatgccctgcggctctgga

SEQ ID NO: 5753019 - DNA, 22 bp, Homo sapiens
gcaatgccctgcggctctggaa

SEQ ID NO: 5753020 - DNA, 16 bp, Homo sapiens
gcaatgcgtcttgtga

SEQ ID NO: 5753021 - DNA, 19 bp, Homo sapiens
gcaatgctcaaacacccaa

SEQ ID NO: 5753022 - DNA, 20 bp, Homo sapiens
gcaatgctgatgaatcactg

SEQ ID NO: 5753023 - DNA, 16 bp, Homo sapiens
gcaatgctgtactttt

SEQ ID NO: 5753024 - DNA, 14 bp, Homo sapiens
gcaatgctgtgaat

SEQ ID NO: 5753025 - DNA, 20 bp, Homo sapiens
gcaatgcttcgttttctaaa

SEQ ID NO: 5753026 - DNA, 20 bp, Homo sapiens
gcaatgcttctgcctcagct

SEQ ID NO: 5753027 - DNA, 15 bp, Homo sapiens
gcaatgcttctgtag

SEQ ID NO: 5753028 - DNA, 15 bp, Homo sapiens
gcaatggaaactatt

SEQ ID NO: 5753029 - DNA, 20 bp, Homo sapiens
gcaatggcacgatctcagct

SEQ ID NO: 5753030 - DNA, 13 bp, Homo sapiens
gcaatggcagcct

SEQ ID NO: 5753031 - DNA, 14 bp, Homo sapiens
gcaatggcagcctt

SEQ ID NO: 5753032 - DNA, 18 bp, Homo sapiens
gcaatggccagagcctct

SEQ ID NO: 5753033 - DNA, 13 bp, Homo sapiens
gcaatggccaggg

SEQ ID NO: 5753034 - DNA, 19 bp, Homo sapiens
gcaatggccaggggccagg

SEQ ID NO: 5753035 - DNA, 13 bp, Homo sapiens
gcaatggcgcctg

SEQ ID NO: 5753036 - DNA, 20 bp, Homo sapiens
gcaatggcgcgatctcagct

SEQ ID NO: 5753037 - DNA, 11 bp, Homo sapiens
gcaatgggact

SEQ ID NO: 5753038 - DNA, 21 bp, Homo sapiens
gcaatgggactggagtcagat

SEQ ID NO: 5753039 - DNA, 19 bp, Homo sapiens
gcaatgggagctgaggcca

SEQ ID NO: 5753040 - DNA, 22 bp, Homo sapiens
gcaatgggagggggctccatgg

SEQ ID NO: 5753041 - DNA, 13 bp, Homo sapiens
gcaatggggagag

SEQ ID NO: 5753042 - DNA, 19 bp, Homo sapiens
gcaatgggggcctccgctt

SEQ ID NO: 5753043 - DNA, 16 bp, Homo sapiens
gcaatgggtaagggag

SEQ ID NO: 5753044 - DNA, 23 bp, Homo sapiens
gcaatggtaactgcacctgggca

SEQ ID NO: 5753045 - DNA, 17 bp, Homo sapiens
gcaatggtagtttctgt

SEQ ID NO: 5753046 - DNA, 23 bp, Homo sapiens
gcaatggtgttgccctgagtgga

SEQ ID NO: 5753047 - DNA, 18 bp, Homo sapiens
gcaatggtttgtgtcaaa

SEQ ID NO: 5753048 - DNA, 20 bp, Homo sapiens
gcaatgtactcttccgatgt

SEQ ID NO: 5753049 - DNA, 22 bp, Homo sapiens
gcaatgtatcccttctcacagc

SEQ ID NO: 5753050 - DNA, 22 bp, Homo sapiens
gcaatgtatttagctacagctt

SEQ ID NO: 5753051 - DNA, 22 bp, Homo sapiens
gcaatgtcaggaacagaaggat

SEQ ID NO: 5753052 - DNA, 16 bp, Homo sapiens
gcaatgtcctgcatgc

SEQ ID NO: 5753053 - DNA, 22 bp, Homo sapiens
gcaatgtcttaaataaaactat

SEQ ID NO: 5753054 - DNA, 16 bp, Homo sapiens
gcaatgtgattttgta

SEQ ID NO: 5753055 - DNA, 23 bp, Homo sapiens
gcaatgtggagcagcagccactg

SEQ ID NO: 5753056 - DNA, 16 bp, Homo sapiens
gcaatgtggcaaactg

SEQ ID NO: 5753057 - DNA, 16 bp, Homo sapiens
gcaatgtgtataaaca

SEQ ID NO: 5753058 - DNA, 16 bp, Homo sapiens
gcaatgtgtgtatatg

SEQ ID NO: 5753059 - DNA, 19 bp, Homo sapiens
gcaatgtgtgtatatggac

SEQ ID NO: 5753060 - DNA, 20 bp, Homo sapiens
gcaatgtgtgtatatggaca

SEQ ID NO: 5753061 - DNA, 15 bp, Homo sapiens
gcaatgtgttttttc

SEQ ID NO: 5753062 - DNA, 20 bp, Homo sapiens
gcaatgttaatttagtggaa

SEQ ID NO: 5753063 - DNA, 14 bp, Homo sapiens
gcaatgttatcttg

SEQ ID NO: 5753064 - DNA, 14 bp, Homo sapiens
gcaatgttccagga

SEQ ID NO: 5753065 - DNA, 20 bp, Homo sapiens
gcaatgttccgttcatctga

SEQ ID NO: 5753066 - DNA, 15 bp, Homo sapiens
gcaatgttggttttt

SEQ ID NO: 5753067 - DNA, 14 bp, Homo sapiens
gcaatgttttgctt

SEQ ID NO: 5753068 - DNA, 14 bp, Homo sapiens
gcaattaaaaataa

SEQ ID NO: 5753069 - DNA, 19 bp, Homo sapiens
gcaattaaagacatttaaa

SEQ ID NO: 5753070 - DNA, 14 bp, Homo sapiens
gcaattaactctgg

SEQ ID NO: 5753071 - DNA, 19 bp, Homo sapiens
gcaattactacaaatggat

SEQ ID NO: 5753072 - DNA, 16 bp, Homo sapiens
gcaattagcattctgt

SEQ ID NO: 5753073 - DNA, 16 bp, Homo sapiens
gcaattaggattttga

SEQ ID NO: 5753074 - DNA, 14 bp, Homo sapiens
gcaattatattgtc

SEQ ID NO: 5753075 - DNA, 14 bp, Homo sapiens
gcaattatgaaaat

SEQ ID NO: 5753076 - DNA, 15 bp, Homo sapiens
gcaattattctaatt

SEQ ID NO: 5753077 - DNA, 13 bp, Homo sapiens
gcaattcagtgtt

SEQ ID NO: 5753078 - DNA, 13 bp, Homo sapiens
gcaattcatggtt

SEQ ID NO: 5753079 - DNA, 15 bp, Homo sapiens
gcaattcatggttca

SEQ ID NO: 5753080 - DNA, 19 bp, Homo sapiens
gcaattcatggttcaagta

SEQ ID NO: 5753081 - DNA, 20 bp, Homo sapiens
gcaattcatggttcaagtat

SEQ ID NO: 5753082 - DNA, 18 bp, Homo sapiens
gcaattcatgtaacagtt

SEQ ID NO: 5753083 - DNA, 19 bp, Homo sapiens
gcaattccaagaaaatatc

SEQ ID NO: 5753084 - DNA, 22 bp, Homo sapiens
gcaattccaggctgagccatga

SEQ ID NO: 5753085 - DNA, 24 bp, Homo sapiens
gcaattccaggctgagccatgagg

SEQ ID NO: 5753086 - DNA, 15 bp, Homo sapiens
gcaattccgcattta

SEQ ID NO: 5753087 - DNA, 16 bp, Homo sapiens
gcaattcctgctccta

SEQ ID NO: 5753088 - DNA, 18 bp, Homo sapiens
gcaattctacagtttctt

SEQ ID NO: 5753089 - DNA, 13 bp, Homo sapiens
gcaattctgactg

SEQ ID NO: 5753090 - DNA, 15 bp, Homo sapiens
gcaattgaaatgcat

SEQ ID NO: 5753091 - DNA, 18 bp, Homo sapiens
gcaattgaattaaattag

SEQ ID NO: 5753092 - DNA, 14 bp, Homo sapiens
gcaattgccctgta

SEQ ID NO: 5753093 - DNA, 12 bp, Homo sapiens
gcaattgccttt

SEQ ID NO: 5753094 - DNA, 13 bp, Homo sapiens
gcaattgcctttt

SEQ ID NO: 5753095 - DNA, 21 bp, Homo sapiens
gcaattgcgaccttaatttaa

SEQ ID NO: 5753096 - DNA, 14 bp, Homo sapiens
gcaattgctcccat

SEQ ID NO: 5753097 - DNA, 18 bp, Homo sapiens
gcaattgggctccctttg

SEQ ID NO: 5753098 - DNA, 22 bp, Homo sapiens
gcaattgtatatatatgtgaac

SEQ ID NO: 5753099 - DNA, 12 bp, Homo sapiens
gcaattgtctga

SEQ ID NO: 5753100 - DNA, 13 bp, Homo sapiens
gcaattgttacaa

SEQ ID NO: 5753101 - DNA, 18 bp, Homo sapiens
gcaattgttacaagtgtt

SEQ ID NO: 5753102 - DNA, 17 bp, Homo sapiens
gcaatttaacaatgtct

SEQ ID NO: 5753103 - DNA, 19 bp, Homo sapiens
gcaatttaactagacacag

SEQ ID NO: 5753104 - DNA, 23 bp, Homo sapiens
gcaatttaatattttgcacagtt

SEQ ID NO: 5753105 - DNA, 22 bp, Homo sapiens
gcaatttactgatgagagaatg

SEQ ID NO: 5753106 - DNA, 23 bp, Homo sapiens
gcaatttactgatgagagaatgt

SEQ ID NO: 5753107 - DNA, 13 bp, Homo sapiens
gcaatttcaaggt

SEQ ID NO: 5753108 - DNA, 23 bp, Homo sapiens
gcaatttccattcttttaaatgg

SEQ ID NO: 5753109 - DNA, 20 bp, Homo sapiens
gcaatttcctggccctccac

SEQ ID NO: 5753110 - DNA, 17 bp, Homo sapiens
gcaatttctctgcacac

SEQ ID NO: 5753111 - DNA, 13 bp, Homo sapiens
gcaatttctgtac

SEQ ID NO: 5753112 - DNA, 12 bp, Homo sapiens
gcaatttgaagg

SEQ ID NO: 5753113 - DNA, 14 bp, Homo sapiens
gcaatttgagccat

SEQ ID NO: 5753114 - DNA, 23 bp, Homo sapiens
gcaatttgtctggactagaaaat

SEQ ID NO: 5753115 - DNA, 18 bp, Homo sapiens
gcaatttgtttgtgcttc

SEQ ID NO: 5753116 - DNA, 21 bp, Homo sapiens
gcaattttaacacacataaag

SEQ ID NO: 5753117 - DNA, 22 bp, Homo sapiens
gcaattttatcagtaatttgac

SEQ ID NO: 5753118 - DNA, 10 bp, Homo sapiens
gcaattttcc

SEQ ID NO: 5753119 - DNA, 13 bp, Homo sapiens
gcaattttccttg

SEQ ID NO: 5753120 - DNA, 14 bp, Homo sapiens
gcaattttccttga

SEQ ID NO: 5753121 - DNA, 15 bp, Homo sapiens
gcaattttccttgaa

SEQ ID NO: 5753122 - DNA, 19 bp, Homo sapiens
gcaattttccttgaagccg

SEQ ID NO: 5753123 - DNA, 20 bp, Homo sapiens
gcaatttttaaactagtaat

SEQ ID NO: 5753124 - DNA, 15 bp, Homo sapiens
gcaatttttttatac

SEQ ID NO: 5753125 - DNA, 19 bp, Homo sapiens
gcacaaaaaatttaagaga

SEQ ID NO: 5753126 - DNA, 13 bp, Homo sapiens
gcacaaaaagcac

SEQ ID NO: 5753127 - DNA, 13 bp, Homo sapiens
gcacaaaacccag

SEQ ID NO: 5753128 - DNA, 11 bp, Homo sapiens
gcacaaaatga

SEQ ID NO: 5753129 - DNA, 23 bp, Homo sapiens
gcacaaaatgatggacccaatgc

SEQ ID NO: 5753130 - DNA, 20 bp, Homo sapiens
gcacaaaatgatggcagtgg

SEQ ID NO: 5753131 - DNA, 19 bp, Homo sapiens
gcacaaaatggattttagt

SEQ ID NO: 5753132 - DNA, 23 bp, Homo sapiens
gcacaaaattctagaagcagaag

SEQ ID NO: 5753133 - DNA, 14 bp, Homo sapiens
gcacaaacagaggc

SEQ ID NO: 5753134 - DNA, 18 bp, Homo sapiens
gcacaaacatagacagat

SEQ ID NO: 5753135 - DNA, 21 bp, Homo sapiens
gcacaaacattgctgcctttg

SEQ ID NO: 5753136 - DNA, 13 bp, Homo sapiens
gcacaaaccctgg

SEQ ID NO: 5753137 - DNA, 17 bp, Homo sapiens
gcacaaaccctggggac

SEQ ID NO: 5753138 - DNA, 15 bp, Homo sapiens
gcacaaaccttcttt

SEQ ID NO: 5753139 - DNA, 19 bp, Homo sapiens
gcacaaaccttcttttcaa

SEQ ID NO: 5753140 - DNA, 17 bp, Homo sapiens
gcacaaactgcagctgt

SEQ ID NO: 5753141 - DNA, 14 bp, Homo sapiens
gcacaaacttcaga

SEQ ID NO: 5753142 - DNA, 13 bp, Homo sapiens
gcacaaagaagaa

SEQ ID NO: 5753143 - DNA, 14 bp, Homo sapiens
gcacaaagaagaaa

SEQ ID NO: 5753144 - DNA, 16 bp, Homo sapiens
gcacaaagaagaaagc

SEQ ID NO: 5753145 - DNA, 17 bp, Homo sapiens
gcacaaagctcaagatg

SEQ ID NO: 5753146 - DNA, 20 bp, Homo sapiens
gcacaaagggcaggcctgtt

SEQ ID NO: 5753147 - DNA, 21 bp, Homo sapiens
gcacaaagttggtgccaagct

SEQ ID NO: 5753148 - DNA, 12 bp, Homo sapiens
gcacaaatacaa

SEQ ID NO: 5753149 - DNA, 14 bp, Homo sapiens
gcacaaatatttat

SEQ ID NO: 5753150 - DNA, 15 bp, Homo sapiens
gcacaaatcactgtg

SEQ ID NO: 5753151 - DNA, 14 bp, Homo sapiens
gcacaacagccctg

SEQ ID NO: 5753152 - DNA, 15 bp, Homo sapiens
gcacaacagccctgc

SEQ ID NO: 5753153 - DNA, 21 bp, Homo sapiens
gcacaacagccctgcctgaga

SEQ ID NO: 5753154 - DNA, 24 bp, Homo sapiens
gcacaacagccctgcctgagaagc

SEQ ID NO: 5753155 - DNA, 15 bp, Homo sapiens
gcacaacatgcacat

SEQ ID NO: 5753156 - DNA, 18 bp, Homo sapiens
gcacaacccccagctccc

SEQ ID NO: 5753157 - DNA, 18 bp, Homo sapiens
gcacaacccccaggaaac

SEQ ID NO: 5753158 - DNA, 18 bp, Homo sapiens
gcacaaccttcaagctgc

SEQ ID NO: 5753159 - DNA, 19 bp, Homo sapiens
gcacaactcagtctgtggg

SEQ ID NO: 5753160 - DNA, 15 bp, Homo sapiens
gcacaactctccaaa

SEQ ID NO: 5753161 - DNA, 22 bp, Homo sapiens
gcacaactgcaataacttctga

SEQ ID NO: 5753162 - DNA, 23 bp, Homo sapiens
gcacaactgctgtttagtgaaca

SEQ ID NO: 5753163 - DNA, 23 bp, Homo sapiens
gcacaactgttgatggtaggctg

SEQ ID NO: 5753164 - DNA, 11 bp, Homo sapiens
gcacaagaagc

SEQ ID NO: 5753165 - DNA, 16 bp, Homo sapiens
gcacaagaaggccagc

SEQ ID NO: 5753166 - DNA, 18 bp, Homo sapiens
gcacaagaaggccagccc

SEQ ID NO: 5753167 - DNA, 17 bp, Homo sapiens
gcacaagaagtgggagt

SEQ ID NO: 5753168 - DNA, 23 bp, Homo sapiens
gcacaagaagtgggagtgggaga

SEQ ID NO: 5753169 - DNA, 18 bp, Homo sapiens
gcacaagaatcacttgaa

SEQ ID NO: 5753170 - DNA, 19 bp, Homo sapiens
gcacaagaatcacttgaac

SEQ ID NO: 5753171 - DNA, 17 bp, Homo sapiens
gcacaagacccctgctc

SEQ ID NO: 5753172 - DNA, 12 bp, Homo sapiens
gcacaagactga

SEQ ID NO: 5753173 - DNA, 21 bp, Homo sapiens
gcacaagactggcccagtgcc

SEQ ID NO: 5753174 - DNA, 23 bp, Homo sapiens
gcacaagcaaaagggtgtctgag

SEQ ID NO: 5753175 - DNA, 14 bp, Homo sapiens
gcacaagcgtgttt

SEQ ID NO: 5753176 - DNA, 18 bp, Homo sapiens
gcacaagctcagaataga

SEQ ID NO: 5753177 - DNA, 22 bp, Homo sapiens
gcacaagctcagaatagatctg

SEQ ID NO: 5753178 - DNA, 22 bp, Homo sapiens
gcacaagctcaggtcctgctgc

SEQ ID NO: 5753179 - DNA, 22 bp, Homo sapiens
gcacaagctccaagctcccagg

SEQ ID NO: 5753180 - DNA, 16 bp, Homo sapiens
gcacaaggagtgcccg

SEQ ID NO: 5753181 - DNA, 15 bp, Homo sapiens
gcacaaggattgaaa

SEQ ID NO: 5753182 - DNA, 21 bp, Homo sapiens
gcacaaggccttgcctggcct

SEQ ID NO: 5753183 - DNA, 17 bp, Homo sapiens
gcacaaggtggcagcaa

SEQ ID NO: 5753184 - DNA, 21 bp, Homo sapiens
gcacaagtgtaatgaatacct

SEQ ID NO: 5753185 - DNA, 14 bp, Homo sapiens
gcacaagttccctg

SEQ ID NO: 5753186 - DNA, 19 bp, Homo sapiens
gcacaagtttttttgttca

SEQ ID NO: 5753187 - DNA, 17 bp, Homo sapiens
gcacaataaaaatgttt

SEQ ID NO: 5753188 - DNA, 19 bp, Homo sapiens
gcacaataaaaccaagcct

SEQ ID NO: 5753189 - DNA, 12 bp, Homo sapiens
gcacaataaaca

SEQ ID NO: 5753190 - DNA, 20 bp, Homo sapiens
gcacaataactcctcccagg

SEQ ID NO: 5753191 - DNA, 13 bp, Homo sapiens
gcacaatatttct

SEQ ID NO: 5753192 - DNA, 15 bp, Homo sapiens
gcacaatatttcttt

SEQ ID NO: 5753193 - DNA, 20 bp, Homo sapiens
gcacaatcatggctcactgc

SEQ ID NO: 5753194 - DNA, 23 bp, Homo sapiens
gcacaatctacactgccttacct

SEQ ID NO: 5753195 - DNA, 21 bp, Homo sapiens
gcacaatctcggctcactgca

SEQ ID NO: 5753196 - DNA, 19 bp, Homo sapiens
gcacaatctgttctactct

SEQ ID NO: 5753197 - DNA, 22 bp, Homo sapiens
gcacaatctgttctactcttaa

SEQ ID NO: 5753198 - DNA, 21 bp, Homo sapiens
gcacaatgcataatgtcttta

SEQ ID NO: 5753199 - DNA, 19 bp, Homo sapiens
gcacaatgggcaattctga

SEQ ID NO: 5753200 - DNA, 23 bp, Homo sapiens
gcacaatggtttcaaagaaagac

SEQ ID NO: 5753201 - DNA, 19 bp, Homo sapiens
gcacaatgtagataagtgt

SEQ ID NO: 5753202 - DNA, 14 bp, Homo sapiens
gcacaattcattgt

SEQ ID NO: 5753203 - DNA, 18 bp, Homo sapiens
gcacaattcctgtgctca

SEQ ID NO: 5753204 - DNA, 14 bp, Homo sapiens
gcacaattctgtcc

SEQ ID NO: 5753205 - DNA, 16 bp, Homo sapiens
gcacaattctgtccct

SEQ ID NO: 5753206 - DNA, 19 bp, Homo sapiens
gcacaattgatctcttttt

SEQ ID NO: 5753207 - DNA, 19 bp, Homo sapiens
gcacaatttagaaaacatt

SEQ ID NO: 5753208 - DNA, 14 bp, Homo sapiens
gcacaatttatatt

SEQ ID NO: 5753209 - DNA, 22 bp, Homo sapiens
gcacaatttgagactgaaattt

SEQ ID NO: 5753210 - DNA, 19 bp, Homo sapiens
gcacaatttgcactaaatc

SEQ ID NO: 5753211 - DNA, 12 bp, Homo sapiens
gcacacaaaaat

SEQ ID NO: 5753212 - DNA, 15 bp, Homo sapiens
gcacacaaaacatct

SEQ ID NO: 5753213 - DNA, 17 bp, Homo sapiens
gcacacaaacacctcct

SEQ ID NO: 5753214 - DNA, 18 bp, Homo sapiens
gcacacaacaggctgtgt

SEQ ID NO: 5753215 - DNA, 21 bp, Homo sapiens
gcacacaaggggcccttggag

SEQ ID NO: 5753216 - DNA, 22 bp, Homo sapiens
gcacacaatgctattgaaatta

SEQ ID NO: 5753217 - DNA, 16 bp, Homo sapiens
gcacacacacacacag

SEQ ID NO: 5753218 - DNA, 17 bp, Homo sapiens
gcacacacacacacagg

SEQ ID NO: 5753219 - DNA, 21 bp, Homo sapiens
gcacacacacacacatgcaca

SEQ ID NO: 5753220 - DNA, 16 bp, Homo sapiens
gcacacacacacagtc

SEQ ID NO: 5753221 - DNA, 14 bp, Homo sapiens
gcacacacacagag

SEQ ID NO: 5753222 - DNA, 20 bp, Homo sapiens
gcacacacacataagcactg

SEQ ID NO: 5753223 - DNA, 15 bp, Homo sapiens
gcacacacactagcc

SEQ ID NO: 5753224 - DNA, 20 bp, Homo sapiens
gcacacacactagccttctt

SEQ ID NO: 5753225 - DNA, 18 bp, Homo sapiens
gcacacacagatgcacac

SEQ ID NO: 5753226 - DNA, 13 bp, Homo sapiens
gcacacacagctc

SEQ ID NO: 5753227 - DNA, 16 bp, Homo sapiens
gcacacacagtctgtt

SEQ ID NO: 5753228 - DNA, 13 bp, Homo sapiens
gcacacacatctg

SEQ ID NO: 5753229 - DNA, 14 bp, Homo sapiens
gcacacacatgcat

SEQ ID NO: 5753230 - DNA, 22 bp, Homo sapiens
gcacacaccaccacgcctggct

SEQ ID NO: 5753231 - DNA, 16 bp, Homo sapiens
gcacacaccagagccc

SEQ ID NO: 5753232 - DNA, 17 bp, Homo sapiens
gcacacacctccgagac

SEQ ID NO: 5753233 - DNA, 18 bp, Homo sapiens
gcacacacctgcacaccg

SEQ ID NO: 5753234 - DNA, 19 bp, Homo sapiens
gcacacacctgcacaccgt

SEQ ID NO: 5753235 - DNA, 15 bp, Homo sapiens
gcacacacctgcctg

SEQ ID NO: 5753236 - DNA, 19 bp, Homo sapiens
gcacacacgccttcatgcc

SEQ ID NO: 5753237 - DNA, 18 bp, Homo sapiens
gcacacacggttttggca

SEQ ID NO: 5753238 - DNA, 15 bp, Homo sapiens
gcacacactcagtgc

SEQ ID NO: 5753239 - DNA, 11 bp, Homo sapiens
gcacacactgt

SEQ ID NO: 5753240 - DNA, 14 bp, Homo sapiens
gcacacactgtgcc

SEQ ID NO: 5753241 - DNA, 18 bp, Homo sapiens
gcacacagaatgctcagg

SEQ ID NO: 5753242 - DNA, 19 bp, Homo sapiens
gcacacagaatgctcaggg

SEQ ID NO: 5753243 - DNA, 18 bp, Homo sapiens
gcacacagagattctgga

SEQ ID NO: 5753244 - DNA, 18 bp, Homo sapiens
gcacacagaggggagtca

SEQ ID NO: 5753245 - DNA, 21 bp, Homo sapiens
gcacacagagtgagggaggag

SEQ ID NO: 5753246 - DNA, 22 bp, Homo sapiens
gcacacagagtgagggaggagg

SEQ ID NO: 5753247 - DNA, 14 bp, Homo sapiens
gcacacagcagccc

SEQ ID NO: 5753248 - DNA, 16 bp, Homo sapiens
gcacacagcagccccc

SEQ ID NO: 5753249 - DNA, 19 bp, Homo sapiens
gcacacagcagccccccag

SEQ ID NO: 5753250 - DNA, 21 bp, Homo sapiens
gcacacagcagccccccagca

SEQ ID NO: 5753251 - DNA, 16 bp, Homo sapiens
gcacacagcggctgcc

SEQ ID NO: 5753252 - DNA, 19 bp, Homo sapiens
gcacacagcggctgcctcc

SEQ ID NO: 5753253 - DNA, 18 bp, Homo sapiens
gcacacagctactctccc

SEQ ID NO: 5753254 - DNA, 23 bp, Homo sapiens
gcacacagctgagcacttagcag

SEQ ID NO: 5753255 - DNA, 14 bp, Homo sapiens
gcacacaggatggc

SEQ ID NO: 5753256 - DNA, 13 bp, Homo sapiens
gcacacaggcagc

SEQ ID NO: 5753257 - DNA, 17 bp, Homo sapiens
gcacacagggaggctgt

SEQ ID NO: 5753258 - DNA, 13 bp, Homo sapiens
gcacacagggccc

SEQ ID NO: 5753259 - DNA, 14 bp, Homo sapiens
gcacacagggcccg

SEQ ID NO: 5753260 - DNA, 20 bp, Homo sapiens
gcacacagggctcacagggc

SEQ ID NO: 5753261 - DNA, 21 bp, Homo sapiens
gcacacagggctcacagggca

SEQ ID NO: 5753262 - DNA, 19 bp, Homo sapiens
gcacacaggtacagcaaca

SEQ ID NO: 5753263 - DNA, 22 bp, Homo sapiens
gcacacaggtacagcaacagga

SEQ ID NO: 5753264 - DNA, 22 bp, Homo sapiens
gcacacagtacacaccagaaga

SEQ ID NO: 5753265 - DNA, 14 bp, Homo sapiens
gcacacataacaca

SEQ ID NO: 5753266 - DNA, 18 bp, Homo sapiens
gcacacatcaccaggtgc

SEQ ID NO: 5753267 - DNA, 17 bp, Homo sapiens
gcacacatccaagaggg

SEQ ID NO: 5753268 - DNA, 19 bp, Homo sapiens
gcacacatcttacctctca

SEQ ID NO: 5753269 - DNA, 18 bp, Homo sapiens
gcacacatgcatcctccc

SEQ ID NO: 5753270 - DNA, 17 bp, Homo sapiens
gcacacatggacacaga

SEQ ID NO: 5753271 - DNA, 13 bp, Homo sapiens
gcacacattattt

SEQ ID NO: 5753272 - DNA, 16 bp, Homo sapiens
gcacacatttaaaaat

SEQ ID NO: 5753273 - DNA, 11 bp, Homo sapiens
gcacacatttt

SEQ ID NO: 5753274 - DNA, 13 bp, Homo sapiens
gcacaccaaaaaa

SEQ ID NO: 5753275 - DNA, 21 bp, Homo sapiens
gcacaccaaattgctgagatg

SEQ ID NO: 5753276 - DNA, 14 bp, Homo sapiens
gcacaccaaggccc

SEQ ID NO: 5753277 - DNA, 15 bp, Homo sapiens
gcacaccaaggccct

SEQ ID NO: 5753278 - DNA, 16 bp, Homo sapiens
gcacaccaagtggctg

SEQ ID NO: 5753279 - DNA, 18 bp, Homo sapiens
gcacaccaagtggctggg

SEQ ID NO: 5753280 - DNA, 21 bp, Homo sapiens
gcacaccaatcttactttgta

SEQ ID NO: 5753281 - DNA, 15 bp, Homo sapiens
gcacaccacaattct

SEQ ID NO: 5753282 - DNA, 15 bp, Homo sapiens
gcacaccaccctccc

SEQ ID NO: 5753283 - DNA, 12 bp, Homo sapiens
gcacaccactgc

SEQ ID NO: 5753284 - DNA, 19 bp, Homo sapiens
gcacaccactgccctgcct

SEQ ID NO: 5753285 - DNA, 13 bp, Homo sapiens
gcacaccagccgc

SEQ ID NO: 5753286 - DNA, 15 bp, Homo sapiens
gcacacccactgccc

SEQ ID NO: 5753287 - DNA, 15 bp, Homo sapiens
gcacaccccaaggga

SEQ ID NO: 5753288 - DNA, 23 bp, Homo sapiens
gcacaccccaagggacaacccca

SEQ ID NO: 5753289 - DNA, 13 bp, Homo sapiens
gcacacccctgca

SEQ ID NO: 5753290 - DNA, 15 bp, Homo sapiens
gcacacccctgcaca

SEQ ID NO: 5753291 - DNA, 20 bp, Homo sapiens
gcacacccctgcacacacct

SEQ ID NO: 5753292 - DNA, 14 bp, Homo sapiens
gcacacccgtgtgc

SEQ ID NO: 5753293 - DNA, 17 bp, Homo sapiens
gcacaccctcactctgc

SEQ ID NO: 5753294 - DNA, 19 bp, Homo sapiens
gcacaccctcactctgcca

SEQ ID NO: 5753295 - DNA, 19 bp, Homo sapiens
gcacaccctctctgtccaa

SEQ ID NO: 5753296 - DNA, 24 bp, Homo sapiens
gcacaccgccatcctctgcctcaa

SEQ ID NO: 5753297 - DNA, 14 bp, Homo sapiens
gcacaccgggcact

SEQ ID NO: 5753298 - DNA, 20 bp, Homo sapiens
gcacaccgggcactcagaag

SEQ ID NO: 5753299 - DNA, 17 bp, Homo sapiens
gcacaccgtccctctcc

SEQ ID NO: 5753300 - DNA, 19 bp, Homo sapiens
gcacaccgtccctctcccc

SEQ ID NO: 5753301 - DNA, 15 bp, Homo sapiens
gcacacctcagcccc

SEQ ID NO: 5753302 - DNA, 16 bp, Homo sapiens
gcacacctcagcccca

SEQ ID NO: 5753303 - DNA, 19 bp, Homo sapiens
gcacacctgaatcagctgg

SEQ ID NO: 5753304 - DNA, 20 bp, Homo sapiens
gcacacctgaatcagctgga

SEQ ID NO: 5753305 - DNA, 14 bp, Homo sapiens
gcacacctgtgtcc

SEQ ID NO: 5753306 - DNA, 19 bp, Homo sapiens
gcacaccttaggttgacat

SEQ ID NO: 5753307 - DNA, 17 bp, Homo sapiens
gcacacgcacaaacaca

SEQ ID NO: 5753308 - DNA, 21 bp, Homo sapiens
gcacacgcacaaacacacaca

SEQ ID NO: 5753309 - DNA, 17 bp, Homo sapiens
gcacacgcctcccactg

SEQ ID NO: 5753310 - DNA, 18 bp, Homo sapiens
gcacacgcctgtaatccc

SEQ ID NO: 5753311 - DNA, 22 bp, Homo sapiens
gcacacgcctgtaatctcagct

SEQ ID NO: 5753312 - DNA, 12 bp, Homo sapiens
gcacacgctgct

SEQ ID NO: 5753313 - DNA, 13 bp, Homo sapiens
gcacacgctgctc

SEQ ID NO: 5753314 - DNA, 15 bp, Homo sapiens
gcacacggccctgcc

SEQ ID NO: 5753315 - DNA, 16 bp, Homo sapiens
gcacacggccctgccc

SEQ ID NO: 5753316 - DNA, 21 bp, Homo sapiens
gcacacggctggtcactctgc

SEQ ID NO: 5753317 - DNA, 13 bp, Homo sapiens
gcacacggtgagg

SEQ ID NO: 5753318 - DNA, 23 bp, Homo sapiens
gcacacggtgagggtgcggggcc

SEQ ID NO: 5753319 - DNA, 17 bp, Homo sapiens
gcacacgtcatgtttct

SEQ ID NO: 5753320 - DNA, 19 bp, Homo sapiens
gcacacgtccatgtttatc

SEQ ID NO: 5753321 - DNA, 16 bp, Homo sapiens
gcacacgtgtgtatga

SEQ ID NO: 5753322 - DNA, 15 bp, Homo sapiens
gcacactaaaccaag

SEQ ID NO: 5753323 - DNA, 13 bp, Homo sapiens
gcacactaagaaa

SEQ ID NO: 5753324 - DNA, 12 bp, Homo sapiens
gcacactacaga

SEQ ID NO: 5753325 - DNA, 15 bp, Homo sapiens
gcacactccatctcc

SEQ ID NO: 5753326 - DNA, 20 bp, Homo sapiens
gcacactcttctcttgagca

SEQ ID NO: 5753327 - DNA, 22 bp, Homo sapiens
gcacactgagtttgaacacaga

SEQ ID NO: 5753328 - DNA, 22 bp, Homo sapiens
gcacactgccaaataaacagct

SEQ ID NO: 5753329 - DNA, 17 bp, Homo sapiens
gcacactgctaaattta

SEQ ID NO: 5753330 - DNA, 13 bp, Homo sapiens
gcacactggctca

SEQ ID NO: 5753331 - DNA, 19 bp, Homo sapiens
gcacactggctcacccagt

SEQ ID NO: 5753332 - DNA, 13 bp, Homo sapiens
gcacactgtctgc

SEQ ID NO: 5753333 - DNA, 21 bp, Homo sapiens
gcacacttccccatctttgat

SEQ ID NO: 5753334 - DNA, 22 bp, Homo sapiens
gcacactttacacaagaatcta

SEQ ID NO: 5753335 - DNA, 16 bp, Homo sapiens
gcacactttctggcaa

SEQ ID NO: 5753336 - DNA, 12 bp, Homo sapiens
gcacagaaaacc

SEQ ID NO: 5753337 - DNA, 17 bp, Homo sapiens
gcacagaaagggcagct

SEQ ID NO: 5753338 - DNA, 21 bp, Homo sapiens
gcacagaaagggcagcttcag

SEQ ID NO: 5753339 - DNA, 16 bp, Homo sapiens
gcacagaacaggaggt

SEQ ID NO: 5753340 - DNA, 14 bp, Homo sapiens
gcacagaagaggag

SEQ ID NO: 5753341 - DNA, 12 bp, Homo sapiens
gcacagaaggag

SEQ ID NO: 5753342 - DNA, 16 bp, Homo sapiens
gcacagaagggctctt

SEQ ID NO: 5753343 - DNA, 13 bp, Homo sapiens
gcacagaagtcct

SEQ ID NO: 5753344 - DNA, 16 bp, Homo sapiens
gcacagaagtcctgta

SEQ ID NO: 5753345 - DNA, 12 bp, Homo sapiens
gcacagaatatg

SEQ ID NO: 5753346 - DNA, 15 bp, Homo sapiens
gcacagaatttgtat

SEQ ID NO: 5753347 - DNA, 15 bp, Homo sapiens
gcacagacaagcagc

SEQ ID NO: 5753348 - DNA, 16 bp, Homo sapiens
gcacagacaagcagcc

SEQ ID NO: 5753349 - DNA, 17 bp, Homo sapiens
gcacagacaattctaat

SEQ ID NO: 5753350 - DNA, 22 bp, Homo sapiens
gcacagacaattctaatggtaa

SEQ ID NO: 5753351 - DNA, 22 bp, Homo sapiens
gcacagacacgctcgcgggcag

SEQ ID NO: 5753352 - DNA, 20 bp, Homo sapiens
gcacagacatctcctcaccc

SEQ ID NO: 5753353 - DNA, 15 bp, Homo sapiens
gcacagaccaggcct

SEQ ID NO: 5753354 - DNA, 15 bp, Homo sapiens
gcacagaccctgccc

SEQ ID NO: 5753355 - DNA, 17 bp, Homo sapiens
gcacagaccctgccctg

SEQ ID NO: 5753356 - DNA, 16 bp, Homo sapiens
gcacagacctcagaga

SEQ ID NO: 5753357 - DNA, 16 bp, Homo sapiens
gcacagacctctccca

SEQ ID NO: 5753358 - DNA, 18 bp, Homo sapiens
gcacagacgtccctccac

SEQ ID NO: 5753359 - DNA, 19 bp, Homo sapiens
gcacagacttctggaaggc

SEQ ID NO: 5753360 - DNA, 23 bp, Homo sapiens
gcacagacttctggaaggctggc

SEQ ID NO: 5753361 - DNA, 14 bp, Homo sapiens
gcacagagagggac

SEQ ID NO: 5753362 - DNA, 15 bp, Homo sapiens
gcacagagagggaca

SEQ ID NO: 5753363 - DNA, 22 bp, Homo sapiens
gcacagagagggacacatgccc

SEQ ID NO: 5753364 - DNA, 16 bp, Homo sapiens
gcacagagagtctgga

SEQ ID NO: 5753365 - DNA, 13 bp, Homo sapiens
gcacagagcaagt

SEQ ID NO: 5753366 - DNA, 19 bp, Homo sapiens
gcacagagcacacttattt

SEQ ID NO: 5753367 - DNA, 12 bp, Homo sapiens
gcacagagccct

SEQ ID NO: 5753368 - DNA, 16 bp, Homo sapiens
gcacagagccctgagg

SEQ ID NO: 5753369 - DNA, 21 bp, Homo sapiens
gcacagagccctgaggggctg

SEQ ID NO: 5753370 - DNA, 22 bp, Homo sapiens
gcacagagccctgaggggctgg

SEQ ID NO: 5753371 - DNA, 14 bp, Homo sapiens
gcacagagcctggc

SEQ ID NO: 5753372 - DNA, 15 bp, Homo sapiens
gcacagagcctggcc

SEQ ID NO: 5753373 - DNA, 19 bp, Homo sapiens
gcacagagcctggccccag

SEQ ID NO: 5753374 - DNA, 22 bp, Homo sapiens
gcacagagcgtccttccccctg

SEQ ID NO: 5753375 - DNA, 18 bp, Homo sapiens
gcacagagctctccagct

SEQ ID NO: 5753376 - DNA, 20 bp, Homo sapiens
gcacagaggatggcttcccc

SEQ ID NO: 5753377 - DNA, 16 bp, Homo sapiens
gcacagaggatttctt

SEQ ID NO: 5753378 - DNA, 19 bp, Homo sapiens
gcacagaggcagctgtgtg

SEQ ID NO: 5753379 - DNA, 16 bp, Homo sapiens
gcacagaggcctgact

SEQ ID NO: 5753380 - DNA, 18 bp, Homo sapiens
gcacagaggcctgactga

SEQ ID NO: 5753381 - DNA, 13 bp, Homo sapiens
gcacagagggcgc

SEQ ID NO: 5753382 - DNA, 18 bp, Homo sapiens
gcacagagggcgctcctg

SEQ ID NO: 5753383 - DNA, 20 bp, Homo sapiens
gcacagagtcgatgctcaat

SEQ ID NO: 5753384 - DNA, 19 bp, Homo sapiens
gcacagagttgttacattt

SEQ ID NO: 5753385 - DNA, 17 bp, Homo sapiens
gcacagatacacataca

SEQ ID NO: 5753386 - DNA, 16 bp, Homo sapiens
gcacagatacctcatc

SEQ ID NO: 5753387 - DNA, 22 bp, Homo sapiens
gcacagatacctcatcatccac

SEQ ID NO: 5753388 - DNA, 16 bp, Homo sapiens
gcacagatatttccat

SEQ ID NO: 5753389 - DNA, 13 bp, Homo sapiens
gcacagatggatt

SEQ ID NO: 5753390 - DNA, 15 bp, Homo sapiens
gcacagatggatttg

SEQ ID NO: 5753391 - DNA, 22 bp, Homo sapiens
gcacagatggatttgcctgtgc

SEQ ID NO: 5753392 - DNA, 20 bp, Homo sapiens
gcacagatgtgaaggacatg

SEQ ID NO: 5753393 - DNA, 16 bp, Homo sapiens
gcacagattcccaggc

SEQ ID NO: 5753394 - DNA, 16 bp, Homo sapiens
gcacagattgaagaat

SEQ ID NO: 5753395 - DNA, 20 bp, Homo sapiens
gcacagattgctgaaactgt

SEQ ID NO: 5753396 - DNA, 13 bp, Homo sapiens
gcacagcaagaaa

SEQ ID NO: 5753397 - DNA, 17 bp, Homo sapiens
gcacagcaaggaggctg

SEQ ID NO: 5753398 - DNA, 19 bp, Homo sapiens
gcacagcaccgggggagag

SEQ ID NO: 5753399 - DNA, 17 bp, Homo sapiens
gcacagcactgcctgcc

SEQ ID NO: 5753400 - DNA, 12 bp, Homo sapiens
gcacagcagcct

SEQ ID NO: 5753401 - DNA, 14 bp, Homo sapiens
gcacagcagcctgc

SEQ ID NO: 5753402 - DNA, 23 bp, Homo sapiens
gcacagcaggacctgtgctttga

SEQ ID NO: 5753403 - DNA, 22 bp, Homo sapiens
gcacagcagtggagagtgttcc

SEQ ID NO: 5753404 - DNA, 13 bp, Homo sapiens
gcacagcagttcc

SEQ ID NO: 5753405 - DNA, 14 bp, Homo sapiens
gcacagcatgaggc

SEQ ID NO: 5753406 - DNA, 18 bp, Homo sapiens
gcacagccaatctccagg

SEQ ID NO: 5753407 - DNA, 12 bp, Homo sapiens
gcacagccacct

SEQ ID NO: 5753408 - DNA, 11 bp, Homo sapiens
gcacagccaga

SEQ ID NO: 5753409 - DNA, 11 bp, Homo sapiens
gcacagccagc

SEQ ID NO: 5753410 - DNA, 13 bp, Homo sapiens
gcacagccagccc

SEQ ID NO: 5753411 - DNA, 12 bp, Homo sapiens
gcacagcccagg

SEQ ID NO: 5753412 - DNA, 14 bp, Homo sapiens
gcacagcccagggc

SEQ ID NO: 5753413 - DNA, 11 bp, Homo sapiens
gcacagccctc

SEQ ID NO: 5753414 - DNA, 12 bp, Homo sapiens
gcacagccctcc

SEQ ID NO: 5753415 - DNA, 14 bp, Homo sapiens
gcacagccctccga

SEQ ID NO: 5753416 - DNA, 19 bp, Homo sapiens
gcacagccctgagtgtccc

SEQ ID NO: 5753417 - DNA, 24 bp, Homo sapiens
gcacagccctgagtgtcccaagcc

SEQ ID NO: 5753418 - DNA, 14 bp, Homo sapiens
gcacagccctggga

SEQ ID NO: 5753419 - DNA, 11 bp, Homo sapiens
gcacagccctt

SEQ ID NO: 5753420 - DNA, 22 bp, Homo sapiens
gcacagccgcgggccaggaggc

SEQ ID NO: 5753421 - DNA, 16 bp, Homo sapiens
gcacagccggggcctg

SEQ ID NO: 5753422 - DNA, 19 bp, Homo sapiens
gcacagcgcgggcggaggc

SEQ ID NO: 5753423 - DNA, 21 bp, Homo sapiens
gcacagcggggccccagggct

SEQ ID NO: 5753424 - DNA, 19 bp, Homo sapiens
gcacagcgttatgtgtctg

SEQ ID NO: 5753425 - DNA, 15 bp, Homo sapiens
gcacagcgtttacat

SEQ ID NO: 5753426 - DNA, 19 bp, Homo sapiens
gcacagctaacatggaagt

SEQ ID NO: 5753427 - DNA, 18 bp, Homo sapiens
gcacagctactcagatct

SEQ ID NO: 5753428 - DNA, 13 bp, Homo sapiens
gcacagctatgaa

SEQ ID NO: 5753429 - DNA, 15 bp, Homo sapiens
gcacagctcaggagg

SEQ ID NO: 5753430 - DNA, 14 bp, Homo sapiens
gcacagctcccggc

SEQ ID NO: 5753431 - DNA, 16 bp, Homo sapiens
gcacagctccctgcca

SEQ ID NO: 5753432 - DNA, 13 bp, Homo sapiens
gcacagctcctcc

SEQ ID NO: 5753433 - DNA, 14 bp, Homo sapiens
gcacagctcctccc

SEQ ID NO: 5753434 - DNA, 22 bp, Homo sapiens
gcacagctcctcccctgccgcc

SEQ ID NO: 5753435 - DNA, 10 bp, Homo sapiens
gcacagctct

SEQ ID NO: 5753436 - DNA, 19 bp, Homo sapiens
gcacagctctcactggcca

SEQ ID NO: 5753437 - DNA, 14 bp, Homo sapiens
gcacagctctcctc

SEQ ID NO: 5753438 - DNA, 19 bp, Homo sapiens
gcacagctgaaagttcttg

SEQ ID NO: 5753439 - DNA, 12 bp, Homo sapiens
gcacagctgccc

SEQ ID NO: 5753440 - DNA, 13 bp, Homo sapiens
gcacagctgccct

SEQ ID NO: 5753441 - DNA, 14 bp, Homo sapiens
gcacagctgccctg

SEQ ID NO: 5753442 - DNA, 16 bp, Homo sapiens
gcacagctgccctgct

SEQ ID NO: 5753443 - DNA, 18 bp, Homo sapiens
gcacagctgccctgctgc

SEQ ID NO: 5753444 - DNA, 16 bp, Homo sapiens
gcacagctgctgtgcc

SEQ ID NO: 5753445 - DNA, 14 bp, Homo sapiens
gcacagctgcttgt

SEQ ID NO: 5753446 - DNA, 14 bp, Homo sapiens
gcacagctgggagc

SEQ ID NO: 5753447 - DNA, 13 bp, Homo sapiens
gcacagctgggat

SEQ ID NO: 5753448 - DNA, 16 bp, Homo sapiens
gcacagctgtagtggg

SEQ ID NO: 5753449 - DNA, 22 bp, Homo sapiens
gcacagctgtctgccaggcact

SEQ ID NO: 5753450 - DNA, 14 bp, Homo sapiens
gcacagctgtggtg

SEQ ID NO: 5753451 - DNA, 15 bp, Homo sapiens
gcacagcttagattt

SEQ ID NO: 5753452 - DNA, 23 bp, Homo sapiens
gcacagcttcatttcctgtgtct

SEQ ID NO: 5753453 - DNA, 12 bp, Homo sapiens
gcacagcttcct

SEQ ID NO: 5753454 - DNA, 16 bp, Homo sapiens
gcacagcttcctgagt

SEQ ID NO: 5753455 - DNA, 14 bp, Homo sapiens
gcacagcttgacct

SEQ ID NO: 5753456 - DNA, 19 bp, Homo sapiens
gcacagcttgacctgaggc

SEQ ID NO: 5753457 - DNA, 13 bp, Homo sapiens
gcacagcttgggt

SEQ ID NO: 5753458 - DNA, 13 bp, Homo sapiens
gcacagcttttcc

SEQ ID NO: 5753459 - DNA, 21 bp, Homo sapiens
gcacaggactgattctgggat

SEQ ID NO: 5753460 - DNA, 21 bp, Homo sapiens
gcacaggagctacctgtgtgg

SEQ ID NO: 5753461 - DNA, 13 bp, Homo sapiens
gcacaggaggagg

SEQ ID NO: 5753462 - DNA, 20 bp, Homo sapiens
gcacaggaggcaggcatggc

SEQ ID NO: 5753463 - DNA, 21 bp, Homo sapiens
gcacaggaggcaggcatggcc

SEQ ID NO: 5753464 - DNA, 22 bp, Homo sapiens
gcacaggaggcaggcatggccc

SEQ ID NO: 5753465 - DNA, 23 bp, Homo sapiens
gcacaggaggctccgtgagccct

SEQ ID NO: 5753466 - DNA, 12 bp, Homo sapiens
gcacaggagggg

SEQ ID NO: 5753467 - DNA, 15 bp, Homo sapiens
gcacaggatgctggc

SEQ ID NO: 5753468 - DNA, 17 bp, Homo sapiens
gcacaggatgctggcct

SEQ ID NO: 5753469 - DNA, 12 bp, Homo sapiens
gcacaggcactg

SEQ ID NO: 5753470 - DNA, 14 bp, Homo sapiens
gcacaggcagctgg

SEQ ID NO: 5753471 - DNA, 19 bp, Homo sapiens
gcacaggcaggaagagaga

SEQ ID NO: 5753472 - DNA, 12 bp, Homo sapiens
gcacaggcaggg

SEQ ID NO: 5753473 - DNA, 20 bp, Homo sapiens
gcacaggcagggcaggacca

SEQ ID NO: 5753474 - DNA, 14 bp, Homo sapiens
gcacaggccccctt

SEQ ID NO: 5753475 - DNA, 18 bp, Homo sapiens
gcacaggccccgaggagc

SEQ ID NO: 5753476 - DNA, 15 bp, Homo sapiens
gcacaggccctgggg

SEQ ID NO: 5753477 - DNA, 16 bp, Homo sapiens
gcacaggcctctgcct

SEQ ID NO: 5753478 - DNA, 19 bp, Homo sapiens
gcacaggcctctgcctgct

SEQ ID NO: 5753479 - DNA, 15 bp, Homo sapiens
gcacaggctaatttt

SEQ ID NO: 5753480 - DNA, 17 bp, Homo sapiens
gcacaggctgagtgcag

SEQ ID NO: 5753481 - DNA, 18 bp, Homo sapiens
gcacaggctgagtgcagg

SEQ ID NO: 5753482 - DNA, 15 bp, Homo sapiens
gcacagggaggctgc

SEQ ID NO: 5753483 - DNA, 15 bp, Homo sapiens
gcacagggcaccaga

SEQ ID NO: 5753484 - DNA, 16 bp, Homo sapiens
gcacagggcaccagag

SEQ ID NO: 5753485 - DNA, 16 bp, Homo sapiens
gcacagggcaggggtg

SEQ ID NO: 5753486 - DNA, 15 bp, Homo sapiens
gcacagggcatgcct

SEQ ID NO: 5753487 - DNA, 17 bp, Homo sapiens
gcacagggcctggccca

SEQ ID NO: 5753488 - DNA, 19 bp, Homo sapiens
gcacagggcctggcccatg

SEQ ID NO: 5753489 - DNA, 20 bp, Homo sapiens
gcacaggggccccagatctg

SEQ ID NO: 5753490 - DNA, 20 bp, Homo sapiens
gcacagggtgtggtatgagg

SEQ ID NO: 5753491 - DNA, 18 bp, Homo sapiens
gcacagggtttggcccaa

SEQ ID NO: 5753492 - DNA, 13 bp, Homo sapiens
gcacaggtcaggc

SEQ ID NO: 5753493 - DNA, 21 bp, Homo sapiens
gcacaggtccaaggctggtcc

SEQ ID NO: 5753494 - DNA, 19 bp, Homo sapiens
gcacaggtcccacctccag

SEQ ID NO: 5753495 - DNA, 22 bp, Homo sapiens
gcacaggtcccacctccagccc

SEQ ID NO: 5753496 - DNA, 12 bp, Homo sapiens
gcacaggtctct

SEQ ID NO: 5753497 - DNA, 15 bp, Homo sapiens
gcacaggtctctgtt

SEQ ID NO: 5753498 - DNA, 23 bp, Homo sapiens
gcacaggtggctgtttcttgtct

SEQ ID NO: 5753499 - DNA, 20 bp, Homo sapiens
gcacaggtgggcttcccagt

SEQ ID NO: 5753500 - DNA, 14 bp, Homo sapiens
gcacaggtgtaaat

SEQ ID NO: 5753501 - DNA, 16 bp, Homo sapiens
gcacaggtgtaaatat

SEQ ID NO: 5753502 - DNA, 16 bp, Homo sapiens
gcacaggttttcagca

SEQ ID NO: 5753503 - DNA, 18 bp, Homo sapiens
gcacagtaaaagtaaaga

SEQ ID NO: 5753504 - DNA, 23 bp, Homo sapiens
gcacagtacaataatgtactcac

SEQ ID NO: 5753505 - DNA, 15 bp, Homo sapiens
gcacagtatttgtaa

SEQ ID NO: 5753506 - DNA, 16 bp, Homo sapiens
gcacagtcaggggctg

SEQ ID NO: 5753507 - DNA, 14 bp, Homo sapiens
gcacagtccacagc

SEQ ID NO: 5753508 - DNA, 15 bp, Homo sapiens
gcacagtccacagct

SEQ ID NO: 5753509 - DNA, 13 bp, Homo sapiens
gcacagtccagga

SEQ ID NO: 5753510 - DNA, 17 bp, Homo sapiens
gcacagtctccatgtgt

SEQ ID NO: 5753511 - DNA, 23 bp, Homo sapiens
gcacagtgatgccgggcgccagg

SEQ ID NO: 5753512 - DNA, 17 bp, Homo sapiens
gcacagtgcagcaagcc

SEQ ID NO: 5753513 - DNA, 18 bp, Homo sapiens
gcacagtgcagcaagcct

SEQ ID NO: 5753514 - DNA, 18 bp, Homo sapiens
gcacagtgcatctcagcc

SEQ ID NO: 5753515 - DNA, 20 bp, Homo sapiens
gcacagtgcatctcagccca

SEQ ID NO: 5753516 - DNA, 14 bp, Homo sapiens
gcacagtgcctgat

SEQ ID NO: 5753517 - DNA, 13 bp, Homo sapiens
gcacagtgctgcc

SEQ ID NO: 5753518 - DNA, 17 bp, Homo sapiens
gcacagtgctgcccctt

SEQ ID NO: 5753519 - DNA, 22 bp, Homo sapiens
gcacagtgctgccccttgcaag

SEQ ID NO: 5753520 - DNA, 14 bp, Homo sapiens
gcacagtggaaagt

SEQ ID NO: 5753521 - DNA, 22 bp, Homo sapiens
gcacagtggctcacgcctgtaa

SEQ ID NO: 5753522 - DNA, 21 bp, Homo sapiens
gcacagtgggagctgagctgg

SEQ ID NO: 5753523 - DNA, 22 bp, Homo sapiens
gcacagtggtggcagggcctag

SEQ ID NO: 5753524 - DNA, 18 bp, Homo sapiens
gcacagtgtaatccaggg

SEQ ID NO: 5753525 - DNA, 22 bp, Homo sapiens
gcacagtgtaatccaggggtgt

SEQ ID NO: 5753526 - DNA, 16 bp, Homo sapiens
gcacagtgtcccccag

SEQ ID NO: 5753527 - DNA, 18 bp, Homo sapiens
gcacagtgtctgggctga

SEQ ID NO: 5753528 - DNA, 23 bp, Homo sapiens
gcacagtgtctgggctgactggg

SEQ ID NO: 5753529 - DNA, 17 bp, Homo sapiens
gcacagtgttaaatgaa

SEQ ID NO: 5753530 - DNA, 15 bp, Homo sapiens
gcacagttcatggtt

SEQ ID NO: 5753531 - DNA, 22 bp, Homo sapiens
gcacagttgtctattctgagcc

SEQ ID NO: 5753532 - DNA, 23 bp, Homo sapiens
gcacagttgtctattctgagcct

SEQ ID NO: 5753533 - DNA, 21 bp, Homo sapiens
gcacagtttagaacagaggga

SEQ ID NO: 5753534 - DNA, 22 bp, Homo sapiens
gcacagtttgcaatcttatgtt

SEQ ID NO: 5753535 - DNA, 23 bp, Homo sapiens
gcacagttttagaataaggagga

SEQ ID NO: 5753536 - DNA, 17 bp, Homo sapiens
gcacagttttctgagaa

SEQ ID NO: 5753537 - DNA, 22 bp, Homo sapiens
gcacatacacctcgtcaagagc

SEQ ID NO: 5753538 - DNA, 15 bp, Homo sapiens
gcacatacagatggt

SEQ ID NO: 5753539 - DNA, 19 bp, Homo sapiens
gcacatacattaaaactag

SEQ ID NO: 5753540 - DNA, 15 bp, Homo sapiens
gcacataccaaagct

SEQ ID NO: 5753541 - DNA, 18 bp, Homo sapiens
gcacatacggcagacctc

SEQ ID NO: 5753542 - DNA, 19 bp, Homo sapiens
gcacatacggcagacctct

SEQ ID NO: 5753543 - DNA, 16 bp, Homo sapiens
gcacatactacctaga

SEQ ID NO: 5753544 - DNA, 23 bp, Homo sapiens
gcacatactacctagaagtaaga

SEQ ID NO: 5753545 - DNA, 16 bp, Homo sapiens
gcacatactgtgttcc

SEQ ID NO: 5753546 - DNA, 19 bp, Homo sapiens
gcacatagagatatgcaca

SEQ ID NO: 5753547 - DNA, 21 bp, Homo sapiens
gcacatagagctttttaatag

SEQ ID NO: 5753548 - DNA, 19 bp, Homo sapiens
gcacatagatgttgtagaa

SEQ ID NO: 5753549 - DNA, 19 bp, Homo sapiens
gcacatagcataggctggg

SEQ ID NO: 5753550 - DNA, 17 bp, Homo sapiens
gcacatagtagaacgct

SEQ ID NO: 5753551 - DNA, 20 bp, Homo sapiens
gcacatagtgggccttcatt

SEQ ID NO: 5753552 - DNA, 20 bp, Homo sapiens
gcacatagtgtcctgcccac

SEQ ID NO: 5753553 - DNA, 16 bp, Homo sapiens
gcacatatacacacac

SEQ ID NO: 5753554 - DNA, 18 bp, Homo sapiens
gcacatatattttttaca

SEQ ID NO: 5753555 - DNA, 23 bp, Homo sapiens
gcacatatggaattttgcaaaga

SEQ ID NO: 5753556 - DNA, 20 bp, Homo sapiens
gcacatatgggtgctggcag

SEQ ID NO: 5753557 - DNA, 22 bp, Homo sapiens
gcacatattggagggaaatctt

SEQ ID NO: 5753558 - DNA, 13 bp, Homo sapiens
gcacatcacctct

SEQ ID NO: 5753559 - DNA, 14 bp, Homo sapiens
gcacatcactgaga

SEQ ID NO: 5753560 - DNA, 18 bp, Homo sapiens
gcacatcatggcagtggg

SEQ ID NO: 5753561 - DNA, 15 bp, Homo sapiens
gcacatccattccca

SEQ ID NO: 5753562 - DNA, 13 bp, Homo sapiens
gcacatccctgga

SEQ ID NO: 5753563 - DNA, 20 bp, Homo sapiens
gcacatccgcgtgtgcctgt

SEQ ID NO: 5753564 - DNA, 23 bp, Homo sapiens
gcacatccttcttggcttcctgg

SEQ ID NO: 5753565 - DNA, 15 bp, Homo sapiens
gcacatcgccagccc

SEQ ID NO: 5753566 - DNA, 20 bp, Homo sapiens
gcacatcgccagccctgggc

SEQ ID NO: 5753567 - DNA, 19 bp, Homo sapiens
gcacatctaaattgatcat

SEQ ID NO: 5753568 - DNA, 23 bp, Homo sapiens
gcacatctacatgccatgcctat

SEQ ID NO: 5753569 - DNA, 13 bp, Homo sapiens
gcacatctctctg

SEQ ID NO: 5753570 - DNA, 14 bp, Homo sapiens
gcacatctctctgc

SEQ ID NO: 5753571 - DNA, 15 bp, Homo sapiens
gcacatctctctgcc

SEQ ID NO: 5753572 - DNA, 20 bp, Homo sapiens
gcacatctctctgccctctc

SEQ ID NO: 5753573 - DNA, 21 bp, Homo sapiens
gcacatctgcattttcacccc

SEQ ID NO: 5753574 - DNA, 21 bp, Homo sapiens
gcacatctggtctcggagctc

SEQ ID NO: 5753575 - DNA, 13 bp, Homo sapiens
gcacatctgtcct

SEQ ID NO: 5753576 - DNA, 17 bp, Homo sapiens
gcacatctgtgtcttgt

SEQ ID NO: 5753577 - DNA, 16 bp, Homo sapiens
gcacatgaagaaatac

SEQ ID NO: 5753578 - DNA, 19 bp, Homo sapiens
gcacatgactacatagtaa

SEQ ID NO: 5753579 - DNA, 15 bp, Homo sapiens
gcacatgagtggaaa

SEQ ID NO: 5753580 - DNA, 15 bp, Homo sapiens
gcacatgatttcaca

SEQ ID NO: 5753581 - DNA, 22 bp, Homo sapiens
gcacatgatttcacaaatatta

SEQ ID NO: 5753582 - DNA, 14 bp, Homo sapiens
gcacatgattttct

SEQ ID NO: 5753583 - DNA, 20 bp, Homo sapiens
gcacatgccaatgcacgcac

SEQ ID NO: 5753584 - DNA, 16 bp, Homo sapiens
gcacatgccagggaaa

SEQ ID NO: 5753585 - DNA, 13 bp, Homo sapiens
gcacatgcctctc

SEQ ID NO: 5753586 - DNA, 14 bp, Homo sapiens
gcacatgcctctct

SEQ ID NO: 5753587 - DNA, 20 bp, Homo sapiens
gcacatgcctctctcaggcc

SEQ ID NO: 5753588 - DNA, 21 bp, Homo sapiens
gcacatgcctctctcaggcca

SEQ ID NO: 5753589 - DNA, 23 bp, Homo sapiens
gcacatgcggcttccgagggcac

SEQ ID NO: 5753590 - DNA, 22 bp, Homo sapiens
gcacatgctgagtctcccaagg

SEQ ID NO: 5753591 - DNA, 13 bp, Homo sapiens
gcacatgctggcc

SEQ ID NO: 5753592 - DNA, 16 bp, Homo sapiens
gcacatgctggccagc

SEQ ID NO: 5753593 - DNA, 19 bp, Homo sapiens
gcacatgctggccagcctg

SEQ ID NO: 5753594 - DNA, 21 bp, Homo sapiens
gcacatgctggccagcctggg

SEQ ID NO: 5753595 - DNA, 23 bp, Homo sapiens
gcacatgctggccagcctggggc

SEQ ID NO: 5753596 - DNA, 22 bp, Homo sapiens
gcacatggaggagcttggggga

SEQ ID NO: 5753597 - DNA, 14 bp, Homo sapiens
gcacatggccatag

SEQ ID NO: 5753598 - DNA, 21 bp, Homo sapiens
gcacatggccatagaggccca

SEQ ID NO: 5753599 - DNA, 23 bp, Homo sapiens
gcacatggctgggggagggactg

SEQ ID NO: 5753600 - DNA, 14 bp, Homo sapiens
gcacatgggattgc

SEQ ID NO: 5753601 - DNA, 15 bp, Homo sapiens
gcacatgggattgct

SEQ ID NO: 5753602 - DNA, 15 bp, Homo sapiens
gcacatggtgtgggg

SEQ ID NO: 5753603 - DNA, 23 bp, Homo sapiens
gcacatggttcaccatgcagtgg

SEQ ID NO: 5753604 - DNA, 14 bp, Homo sapiens
gcacatgtaataaa

SEQ ID NO: 5753605 - DNA, 13 bp, Homo sapiens
gcacatgtattct

SEQ ID NO: 5753606 - DNA, 21 bp, Homo sapiens
gcacatgtctgtcctcagagc

SEQ ID NO: 5753607 - DNA, 17 bp, Homo sapiens
gcacatgtcttaatgaa

SEQ ID NO: 5753608 - DNA, 13 bp, Homo sapiens
gcacatgtcttgt

SEQ ID NO: 5753609 - DNA, 17 bp, Homo sapiens
gcacatgtgccactgtt

SEQ ID NO: 5753610 - DNA, 18 bp, Homo sapiens
gcacatgtgtctgtgtgg

SEQ ID NO: 5753611 - DNA, 12 bp, Homo sapiens
gcacatgtgtgc

SEQ ID NO: 5753612 - DNA, 15 bp, Homo sapiens
gcacatgttcatata

SEQ ID NO: 5753613 - DNA, 19 bp, Homo sapiens
gcacatgttggaggagaga

SEQ ID NO: 5753614 - DNA, 13 bp, Homo sapiens
gcacatgttttac

SEQ ID NO: 5753615 - DNA, 12 bp, Homo sapiens
gcacattaaatg

SEQ ID NO: 5753616 - DNA, 16 bp, Homo sapiens
gcacattaaatgactc

SEQ ID NO: 5753617 - DNA, 13 bp, Homo sapiens
gcacattaactgt

SEQ ID NO: 5753618 - DNA, 21 bp, Homo sapiens
gcacattaggaacagagtata

SEQ ID NO: 5753619 - DNA, 15 bp, Homo sapiens
gcacattcctttggg

SEQ ID NO: 5753620 - DNA, 19 bp, Homo sapiens
gcacattcttaaaggaaaa

SEQ ID NO: 5753621 - DNA, 20 bp, Homo sapiens
gcacattcttaaaggaaaag

SEQ ID NO: 5753622 - DNA, 17 bp, Homo sapiens
gcacattgcccatggct

SEQ ID NO: 5753623 - DNA, 18 bp, Homo sapiens
gcacattgcccatggctg

SEQ ID NO: 5753624 - DNA, 13 bp, Homo sapiens
gcacattgccctg

SEQ ID NO: 5753625 - DNA, 15 bp, Homo sapiens
gcacattgccctgag

SEQ ID NO: 5753626 - DNA, 18 bp, Homo sapiens
gcacattgccctgagggg

SEQ ID NO: 5753627 - DNA, 23 bp, Homo sapiens
gcacattgccctgaggggcctgc

SEQ ID NO: 5753628 - DNA, 13 bp, Homo sapiens
gcacattgcctgt

SEQ ID NO: 5753629 - DNA, 20 bp, Homo sapiens
gcacattgcctgttctgctt

SEQ ID NO: 5753630 - DNA, 21 bp, Homo sapiens
gcacattgcctgttctgcttc

SEQ ID NO: 5753631 - DNA, 17 bp, Homo sapiens
gcacattggaaagcaca

SEQ ID NO: 5753632 - DNA, 18 bp, Homo sapiens
gcacattggaagctccca

SEQ ID NO: 5753633 - DNA, 16 bp, Homo sapiens
gcacatttatatatat

SEQ ID NO: 5753634 - DNA, 12 bp, Homo sapiens
gcacatttgaat

SEQ ID NO: 5753635 - DNA, 21 bp, Homo sapiens
gcacatttgtcactgaataat

SEQ ID NO: 5753636 - DNA, 20 bp, Homo sapiens
gcacatttgtgcataaattt

SEQ ID NO: 5753637 - DNA, 18 bp, Homo sapiens
gcacatttgttaatgatt

SEQ ID NO: 5753638 - DNA, 21 bp, Homo sapiens
gcacatttgttaatgattctt

SEQ ID NO: 5753639 - DNA, 23 bp, Homo sapiens
gcacatttgttaatgattcttgt

SEQ ID NO: 5753640 - DNA, 16 bp, Homo sapiens
gcaccaaaaaactaaa

SEQ ID NO: 5753641 - DNA, 23 bp, Homo sapiens
gcaccaaacctaagtccttccac

SEQ ID NO: 5753642 - DNA, 23 bp, Homo sapiens
gcaccaaagatgcagccgccttc

SEQ ID NO: 5753643 - DNA, 20 bp, Homo sapiens
gcaccaaatcaaaatctctc

SEQ ID NO: 5753644 - DNA, 23 bp, Homo sapiens
gcaccaaatcaaaatctctccac

SEQ ID NO: 5753645 - DNA, 15 bp, Homo sapiens
gcaccaacccagccg

SEQ ID NO: 5753646 - DNA, 17 bp, Homo sapiens
gcaccaacccagccgct

SEQ ID NO: 5753647 - DNA, 15 bp, Homo sapiens
gcaccaacctcactg

SEQ ID NO: 5753648 - DNA, 15 bp, Homo sapiens
gcaccaacctccaga

SEQ ID NO: 5753649 - DNA, 16 bp, Homo sapiens
gcaccaacctccagac

SEQ ID NO: 5753650 - DNA, 17 bp, Homo sapiens
gcaccaagcccacaggt

SEQ ID NO: 5753651 - DNA, 22 bp, Homo sapiens
gcaccaagggacaggagaagag

SEQ ID NO: 5753652 - DNA, 17 bp, Homo sapiens
gcaccaatcagcactct

SEQ ID NO: 5753653 - DNA, 19 bp, Homo sapiens
gcaccaatcagcactctgt

SEQ ID NO: 5753654 - DNA, 18 bp, Homo sapiens
gcaccaatcttgtttata

SEQ ID NO: 5753655 - DNA, 12 bp, Homo sapiens
gcaccaatgccc

SEQ ID NO: 5753656 - DNA, 16 bp, Homo sapiens
gcaccaattatcatct

SEQ ID NO: 5753657 - DNA, 22 bp, Homo sapiens
gcaccaattgtacattccctgc

SEQ ID NO: 5753658 - DNA, 13 bp, Homo sapiens
gcaccacactggg

SEQ ID NO: 5753659 - DNA, 15 bp, Homo sapiens
gcaccacactgggtg

SEQ ID NO: 5753660 - DNA, 21 bp, Homo sapiens
gcaccacagccggtcagagga

SEQ ID NO: 5753661 - DNA, 15 bp, Homo sapiens
gcaccacagcctcca

SEQ ID NO: 5753662 - DNA, 15 bp, Homo sapiens
gcaccacaggctgcc

SEQ ID NO: 5753663 - DNA, 15 bp, Homo sapiens
gcaccacattgcctc

SEQ ID NO: 5753664 - DNA, 16 bp, Homo sapiens
gcaccacattgcctca

SEQ ID NO: 5753665 - DNA, 18 bp, Homo sapiens
gcaccacattgcctcatt

SEQ ID NO: 5753666 - DNA, 22 bp, Homo sapiens
gcaccaccacacagtcacccct

SEQ ID NO: 5753667 - DNA, 13 bp, Homo sapiens
gcaccaccaggag

SEQ ID NO: 5753668 - DNA, 14 bp, Homo sapiens
gcaccaccaggagc

SEQ ID NO: 5753669 - DNA, 15 bp, Homo sapiens
gcaccaccaggagca

SEQ ID NO: 5753670 - DNA, 16 bp, Homo sapiens
gcaccaccaggagcag

SEQ ID NO: 5753671 - DNA, 20 bp, Homo sapiens
gcaccaccaggagcagcagc

SEQ ID NO: 5753672 - DNA, 16 bp, Homo sapiens
gcaccaccagggctcc

SEQ ID NO: 5753673 - DNA, 19 bp, Homo sapiens
gcaccaccagggctccagg

SEQ ID NO: 5753674 - DNA, 15 bp, Homo sapiens
gcaccaccagggtgg

SEQ ID NO: 5753675 - DNA, 19 bp, Homo sapiens
gcaccaccatgccaggcta

SEQ ID NO: 5753676 - DNA, 15 bp, Homo sapiens
gcaccaccatgccca

SEQ ID NO: 5753677 - DNA, 16 bp, Homo sapiens
gcaccacccccagtcc

SEQ ID NO: 5753678 - DNA, 23 bp, Homo sapiens
gcaccaccctagtcccttcccct

SEQ ID NO: 5753679 - DNA, 19 bp, Homo sapiens
gcaccaccctttgaacaaa

SEQ ID NO: 5753680 - DNA, 22 bp, Homo sapiens
gcaccaccgagagaggctggga

SEQ ID NO: 5753681 - DNA, 20 bp, Homo sapiens
gcaccacctacacaggagtc

SEQ ID NO: 5753682 - DNA, 15 bp, Homo sapiens
gcaccacgtgccaag

SEQ ID NO: 5753683 - DNA, 18 bp, Homo sapiens
gcaccactcaagaccaaa

SEQ ID NO: 5753684 - DNA, 15 bp, Homo sapiens
gcaccactctgggca

SEQ ID NO: 5753685 - DNA, 16 bp, Homo sapiens
gcaccactgcactcca

SEQ ID NO: 5753686 - DNA, 17 bp, Homo sapiens
gcaccactgcactccag

SEQ ID NO: 5753687 - DNA, 19 bp, Homo sapiens
gcaccactgcactccagcc

SEQ ID NO: 5753688 - DNA, 20 bp, Homo sapiens
gcaccactgcactccagcct

SEQ ID NO: 5753689 - DNA, 21 bp, Homo sapiens
gcaccactgcactccagcctg

SEQ ID NO: 5753690 - DNA, 12 bp, Homo sapiens
gcaccactgcca

SEQ ID NO: 5753691 - DNA, 14 bp, Homo sapiens
gcaccactgctgag

SEQ ID NO: 5753692 - DNA, 15 bp, Homo sapiens
gcaccactgctgagg

SEQ ID NO: 5753693 - DNA, 17 bp, Homo sapiens
gcaccactgctgaggag

SEQ ID NO: 5753694 - DNA, 17 bp, Homo sapiens
gcaccactgcttcccac

SEQ ID NO: 5753695 - DNA, 21 bp, Homo sapiens
gcaccactgcttcccactggg

SEQ ID NO: 5753696 - DNA, 14 bp, Homo sapiens
gcaccactgttctg

SEQ ID NO: 5753697 - DNA, 16 bp, Homo sapiens
gcaccagaatgtatat

SEQ ID NO: 5753698 - DNA, 18 bp, Homo sapiens
gcaccagagcaacctctc

SEQ ID NO: 5753699 - DNA, 19 bp, Homo sapiens
gcaccagagcaacctctca

SEQ ID NO: 5753700 - DNA, 23 bp, Homo sapiens
gcaccagagtgaaagggctatgg

SEQ ID NO: 5753701 - DNA, 20 bp, Homo sapiens
gcaccagatgcaacctcact

SEQ ID NO: 5753702 - DNA, 18 bp, Homo sapiens
gcaccagcaattctcttt

SEQ ID NO: 5753703 - DNA, 14 bp, Homo sapiens
gcaccagcagcctg

SEQ ID NO: 5753704 - DNA, 15 bp, Homo sapiens
gcaccagcagcctgg

SEQ ID NO: 5753705 - DNA, 12 bp, Homo sapiens
gcaccagcaggc

SEQ ID NO: 5753706 - DNA, 13 bp, Homo sapiens
gcaccagcaggca

SEQ ID NO: 5753707 - DNA, 21 bp, Homo sapiens
gcaccagcaggtgccatcacg

SEQ ID NO: 5753708 - DNA, 12 bp, Homo sapiens
gcaccagcatcc

SEQ ID NO: 5753709 - DNA, 19 bp, Homo sapiens
gcaccagccagcgtagcag

SEQ ID NO: 5753710 - DNA, 19 bp, Homo sapiens
gcaccagcccagaagtgca

SEQ ID NO: 5753711 - DNA, 19 bp, Homo sapiens
gcaccagccccctggatgg

SEQ ID NO: 5753712 - DNA, 19 bp, Homo sapiens
gcaccagcccgaacaccat

SEQ ID NO: 5753713 - DNA, 18 bp, Homo sapiens
gcaccagcccttccctgc

SEQ ID NO: 5753714 - DNA, 22 bp, Homo sapiens
gcaccagcccttccctgctttg

SEQ ID NO: 5753715 - DNA, 17 bp, Homo sapiens
gcaccagccggggaaga

SEQ ID NO: 5753716 - DNA, 15 bp, Homo sapiens
gcaccagcctgagcc

SEQ ID NO: 5753717 - DNA, 15 bp, Homo sapiens
gcaccagcgccccca

SEQ ID NO: 5753718 - DNA, 18 bp, Homo sapiens
gcaccagcgcccccagaa

SEQ ID NO: 5753719 - DNA, 14 bp, Homo sapiens
gcaccagctctgtg

SEQ ID NO: 5753720 - DNA, 12 bp, Homo sapiens
gcaccagctgct

SEQ ID NO: 5753721 - DNA, 19 bp, Homo sapiens
gcaccagctgctctgcccc

SEQ ID NO: 5753722 - DNA, 20 bp, Homo sapiens
gcaccagctgctctgcccct

SEQ ID NO: 5753723 - DNA, 17 bp, Homo sapiens
gcaccagcttctccagg

SEQ ID NO: 5753724 - DNA, 18 bp, Homo sapiens
gcaccagcttctccaggc

SEQ ID NO: 5753725 - DNA, 13 bp, Homo sapiens
gcaccaggaagcc

SEQ ID NO: 5753726 - DNA, 18 bp, Homo sapiens
gcaccaggaagtgtttat

SEQ ID NO: 5753727 - DNA, 20 bp, Homo sapiens
gcaccaggcacgaacccacc

SEQ ID NO: 5753728 - DNA, 15 bp, Homo sapiens
gcaccaggccgggct

SEQ ID NO: 5753729 - DNA, 15 bp, Homo sapiens
gcaccaggctgagcc

SEQ ID NO: 5753730 - DNA, 22 bp, Homo sapiens
gcaccaggctgagccgaagctg

SEQ ID NO: 5753731 - DNA, 13 bp, Homo sapiens
gcaccagggactc

SEQ ID NO: 5753732 - DNA, 13 bp, Homo sapiens
gcaccagggagag

SEQ ID NO: 5753733 - DNA, 23 bp, Homo sapiens
gcaccagggcattcgggccacag

SEQ ID NO: 5753734 - DNA, 21 bp, Homo sapiens
gcaccaggggccaacctcagg

SEQ ID NO: 5753735 - DNA, 18 bp, Homo sapiens
gcaccaggggtgcacaat

SEQ ID NO: 5753736 - DNA, 16 bp, Homo sapiens
gcaccaggggtttctc

SEQ ID NO: 5753737 - DNA, 22 bp, Homo sapiens
gcaccagttatgtttgaatgaa

SEQ ID NO: 5753738 - DNA, 19 bp, Homo sapiens
gcaccataaccaagaaata

SEQ ID NO: 5753739 - DNA, 13 bp, Homo sapiens
gcaccatactcat

SEQ ID NO: 5753740 - DNA, 23 bp, Homo sapiens
gcaccatactccttgcttcctga

SEQ ID NO: 5753741 - DNA, 15 bp, Homo sapiens
gcaccatcagcctgt

SEQ ID NO: 5753742 - DNA, 13 bp, Homo sapiens
gcaccatcatgtt

SEQ ID NO: 5753743 - DNA, 22 bp, Homo sapiens
gcaccatccaccctgcaggctt

SEQ ID NO: 5753744 - DNA, 22 bp, Homo sapiens
gcaccatccctttttgaagtgt

SEQ ID NO: 5753745 - DNA, 13 bp, Homo sapiens
gcaccatccgcca

SEQ ID NO: 5753746 - DNA, 18 bp, Homo sapiens
gcaccatccgccagggcc

SEQ ID NO: 5753747 - DNA, 14 bp, Homo sapiens
gcaccatctctcct

SEQ ID NO: 5753748 - DNA, 14 bp, Homo sapiens
gcaccatctgccaa

SEQ ID NO: 5753749 - DNA, 19 bp, Homo sapiens
gcaccatgcaaatgtcttc

SEQ ID NO: 5753750 - DNA, 22 bp, Homo sapiens
gcaccatgcaaatgtcttccag

SEQ ID NO: 5753751 - DNA, 23 bp, Homo sapiens
gcaccatgctgctggggaagaca

SEQ ID NO: 5753752 - DNA, 15 bp, Homo sapiens
gcaccatggaggcag

SEQ ID NO: 5753753 - DNA, 20 bp, Homo sapiens
gcaccatggtatcatatatt

SEQ ID NO: 5753754 - DNA, 19 bp, Homo sapiens
gcaccatgtgggcacggag

SEQ ID NO: 5753755 - DNA, 17 bp, Homo sapiens
gcaccattctgactcgg

SEQ ID NO: 5753756 - DNA, 22 bp, Homo sapiens
gcaccattttcaatttggagca

SEQ ID NO: 5753757 - DNA, 17 bp, Homo sapiens
gcacccaaaactcaagc

SEQ ID NO: 5753758 - DNA, 24 bp, Homo sapiens
gcacccaaatcacatctcacctcc

SEQ ID NO: 5753759 - DNA, 17 bp, Homo sapiens
gcacccaagacctcagg

SEQ ID NO: 5753760 - DNA, 21 bp, Homo sapiens
gcacccaagacctcagggcac

SEQ ID NO: 5753761 - DNA, 13 bp, Homo sapiens
gcacccacaccct

SEQ ID NO: 5753762 - DNA, 16 bp, Homo sapiens
gcacccacaccctaca

SEQ ID NO: 5753763 - DNA, 20 bp, Homo sapiens
gcacccacaccctacagcag

SEQ ID NO: 5753764 - DNA, 22 bp, Homo sapiens
gcacccacaccctacagcagat

SEQ ID NO: 5753765 - DNA, 23 bp, Homo sapiens
gcacccaccaccatgcccagcta

SEQ ID NO: 5753766 - DNA, 16 bp, Homo sapiens
gcacccacccatgcac

SEQ ID NO: 5753767 - DNA, 14 bp, Homo sapiens
gcacccacccctgc

SEQ ID NO: 5753768 - DNA, 17 bp, Homo sapiens
gcacccaccctgggacc

SEQ ID NO: 5753769 - DNA, 20 bp, Homo sapiens
gcacccaccgtctcggccct

SEQ ID NO: 5753770 - DNA, 21 bp, Homo sapiens
gcacccaccgtctcggccctg

SEQ ID NO: 5753771 - DNA, 18 bp, Homo sapiens
gcacccaccgtggaggag

SEQ ID NO: 5753772 - DNA, 17 bp, Homo sapiens
gcacccacctccacccc

SEQ ID NO: 5753773 - DNA, 18 bp, Homo sapiens
gcacccacctccaccccc

SEQ ID NO: 5753774 - DNA, 13 bp, Homo sapiens
gcacccacctgtt

SEQ ID NO: 5753775 - DNA, 18 bp, Homo sapiens
gcacccacctgttttctg

SEQ ID NO: 5753776 - DNA, 21 bp, Homo sapiens
gcacccacctgttttctgaaa

SEQ ID NO: 5753777 - DNA, 22 bp, Homo sapiens
gcacccacctgttttctgaaac

SEQ ID NO: 5753778 - DNA, 23 bp, Homo sapiens
gcacccacctgttttctgaaaca

SEQ ID NO: 5753779 - DNA, 17 bp, Homo sapiens
gcacccactcaccaggg

SEQ ID NO: 5753780 - DNA, 11 bp, Homo sapiens
gcacccagaac

SEQ ID NO: 5753781 - DNA, 14 bp, Homo sapiens
gcacccagaacagt

SEQ ID NO: 5753782 - DNA, 19 bp, Homo sapiens
gcacccagcctctagggac

SEQ ID NO: 5753783 - DNA, 16 bp, Homo sapiens
gcacccagctccaggg

SEQ ID NO: 5753784 - DNA, 20 bp, Homo sapiens
gcacccaggaggggaacact

SEQ ID NO: 5753785 - DNA, 18 bp, Homo sapiens
gcacccaggcctccctgc

SEQ ID NO: 5753786 - DNA, 19 bp, Homo sapiens
gcacccaggtactgagtgg

SEQ ID NO: 5753787 - DNA, 23 bp, Homo sapiens
gcacccatatctgtgtgccctag

SEQ ID NO: 5753788 - DNA, 21 bp, Homo sapiens
gcacccatctgtctgccaacc

SEQ ID NO: 5753789 - DNA, 20 bp, Homo sapiens
gcacccatgacaatcacctt

SEQ ID NO: 5753790 - DNA, 14 bp, Homo sapiens
gcacccatgcccca

SEQ ID NO: 5753791 - DNA, 20 bp, Homo sapiens
gcacccatgccccactctgc

SEQ ID NO: 5753792 - DNA, 23 bp, Homo sapiens
gcacccattatgcgctgtggcca

SEQ ID NO: 5753793 - DNA, 13 bp, Homo sapiens
gcaccccacagct

SEQ ID NO: 5753794 - DNA, 18 bp, Homo sapiens
gcaccccacagctggggc

SEQ ID NO: 5753795 - DNA, 19 bp, Homo sapiens
gcaccccacagctggggcc

SEQ ID NO: 5753796 - DNA, 16 bp, Homo sapiens
gcaccccaccacacac

SEQ ID NO: 5753797 - DNA, 19 bp, Homo sapiens
gcaccccagcattccagct

SEQ ID NO: 5753798 - DNA, 18 bp, Homo sapiens
gcaccccatcccaccagc

SEQ ID NO: 5753799 - DNA, 22 bp, Homo sapiens
gcaccccatcccaccagccccg

SEQ ID NO: 5753800 - DNA, 23 bp, Homo sapiens
gcaccccatgagtagtgcccact

SEQ ID NO: 5753801 - DNA, 15 bp, Homo sapiens
gcaccccatgctgtt

SEQ ID NO: 5753802 - DNA, 16 bp, Homo sapiens
gcacccccaagcctgg

SEQ ID NO: 5753803 - DNA, 15 bp, Homo sapiens
gcacccccacccacc

SEQ ID NO: 5753804 - DNA, 21 bp, Homo sapiens
gcacccccacccacctccacc

SEQ ID NO: 5753805 - DNA, 21 bp, Homo sapiens
gcacccccactttcgcctcct

SEQ ID NO: 5753806 - DNA, 13 bp, Homo sapiens
gcacccccagaat

SEQ ID NO: 5753807 - DNA, 14 bp, Homo sapiens
gcacccccagcctc

SEQ ID NO: 5753808 - DNA, 17 bp, Homo sapiens
gcacccccagcctcccc

SEQ ID NO: 5753809 - DNA, 21 bp, Homo sapiens
gcacccccagcctgggcctat

SEQ ID NO: 5753810 - DNA, 23 bp, Homo sapiens
gcacccccagcctgggcctatgg

SEQ ID NO: 5753811 - DNA, 14 bp, Homo sapiens
gcacccccatgctg

SEQ ID NO: 5753812 - DNA, 13 bp, Homo sapiens
gcacccccctggg

SEQ ID NO: 5753813 - DNA, 18 bp, Homo sapiens
gcacccccctgtgcctgc

SEQ ID NO: 5753814 - DNA, 20 bp, Homo sapiens
gcacccccctgttctaaggg

SEQ ID NO: 5753815 - DNA, 21 bp, Homo sapiens
gcacccccctgttctaagggg

SEQ ID NO: 5753816 - DNA, 13 bp, Homo sapiens
gcacccccgcacc

SEQ ID NO: 5753817 - DNA, 12 bp, Homo sapiens
gcacccccgcca

SEQ ID NO: 5753818 - DNA, 15 bp, Homo sapiens
gcacccccggacgcc

SEQ ID NO: 5753819 - DNA, 21 bp, Homo sapiens
gcacccccggcccagtgcccc

SEQ ID NO: 5753820 - DNA, 17 bp, Homo sapiens
gcaccccctcattcccc

SEQ ID NO: 5753821 - DNA, 20 bp, Homo sapiens
gcaccccctcattcccctcg

SEQ ID NO: 5753822 - DNA, 23 bp, Homo sapiens
gcaccccctcccttctgggaaac

SEQ ID NO: 5753823 - DNA, 18 bp, Homo sapiens
gcaccccctcctgctgca

SEQ ID NO: 5753824 - DNA, 19 bp, Homo sapiens
gcaccccctcctgctgcag

SEQ ID NO: 5753825 - DNA, 23 bp, Homo sapiens
gcaccccctgctccaccagcagc

SEQ ID NO: 5753826 - DNA, 14 bp, Homo sapiens
gcaccccctggaga

SEQ ID NO: 5753827 - DNA, 18 bp, Homo sapiens
gcaccccgccggaggaag

SEQ ID NO: 5753828 - DNA, 21 bp, Homo sapiens
gcacccctccgtgtggagcac

SEQ ID NO: 5753829 - DNA, 13 bp, Homo sapiens
gcacccctcctcc

SEQ ID NO: 5753830 - DNA, 14 bp, Homo sapiens
gcacccctcctcct

SEQ ID NO: 5753831 - DNA, 19 bp, Homo sapiens
gcacccctgagccagcagg

SEQ ID NO: 5753832 - DNA, 13 bp, Homo sapiens
gcacccctgcccc

SEQ ID NO: 5753833 - DNA, 18 bp, Homo sapiens
gcacccctgcctcctgcc

SEQ ID NO: 5753834 - DNA, 12 bp, Homo sapiens
gcacccctggaa

SEQ ID NO: 5753835 - DNA, 13 bp, Homo sapiens
gcacccctgggcc

SEQ ID NO: 5753836 - DNA, 14 bp, Homo sapiens
gcacccctgggcca

SEQ ID NO: 5753837 - DNA, 15 bp, Homo sapiens
gcaccccttcctggg

SEQ ID NO: 5753838 - DNA, 21 bp, Homo sapiens
gcaccccttctctcctcccca

SEQ ID NO: 5753839 - DNA, 16 bp, Homo sapiens
gcacccgcatgtacaa

SEQ ID NO: 5753840 - DNA, 20 bp, Homo sapiens
gcacccgcatgtacaaaaac

SEQ ID NO: 5753841 - DNA, 15 bp, Homo sapiens
gcacccgccctttcc

SEQ ID NO: 5753842 - DNA, 13 bp, Homo sapiens
gcacccgcctctc

SEQ ID NO: 5753843 - DNA, 15 bp, Homo sapiens
gcacccggcagcccc

SEQ ID NO: 5753844 - DNA, 22 bp, Homo sapiens
gcacccggcagccccccagtgt

SEQ ID NO: 5753845 - DNA, 14 bp, Homo sapiens
gcacccggcccctg

SEQ ID NO: 5753846 - DNA, 17 bp, Homo sapiens
gcacccgggctcaggga

SEQ ID NO: 5753847 - DNA, 22 bp, Homo sapiens
gcacccgggctcagggaccaca

SEQ ID NO: 5753848 - DNA, 23 bp, Homo sapiens
gcacccgggctcagggaccacag

SEQ ID NO: 5753849 - DNA, 20 bp, Homo sapiens
gcacccggggccagagacat

SEQ ID NO: 5753850 - DNA, 22 bp, Homo sapiens
gcacccgtacccccgtggtctt

SEQ ID NO: 5753851 - DNA, 23 bp, Homo sapiens
gcacccgtgccacgcgctctgca

SEQ ID NO: 5753852 - DNA, 18 bp, Homo sapiens
gcacccgtggtgcatggt

SEQ ID NO: 5753853 - DNA, 23 bp, Homo sapiens
gcacccgtgtttgtaaaaatgta

SEQ ID NO: 5753854 - DNA, 21 bp, Homo sapiens
gcaccctagttctacctcagg

SEQ ID NO: 5753855 - DNA, 15 bp, Homo sapiens
gcaccctcaggcagg

SEQ ID NO: 5753856 - DNA, 16 bp, Homo sapiens
gcaccctcaggcaggt

SEQ ID NO: 5753857 - DNA, 22 bp, Homo sapiens
gcaccctcagggagcctcccca

SEQ ID NO: 5753858 - DNA, 19 bp, Homo sapiens
gcaccctccaaacactggg

SEQ ID NO: 5753859 - DNA, 19 bp, Homo sapiens
gcaccctccacaggagccg

SEQ ID NO: 5753860 - DNA, 17 bp, Homo sapiens
gcaccctccaccctgtc

SEQ ID NO: 5753861 - DNA, 14 bp, Homo sapiens
gcaccctcccctcc

SEQ ID NO: 5753862 - DNA, 13 bp, Homo sapiens
gcaccctccctcc

SEQ ID NO: 5753863 - DNA, 16 bp, Homo sapiens
gcaccctccgccttca

SEQ ID NO: 5753864 - DNA, 19 bp, Homo sapiens
gcaccctcgatgaagccca

SEQ ID NO: 5753865 - DNA, 15 bp, Homo sapiens
gcaccctctatccca

SEQ ID NO: 5753866 - DNA, 16 bp, Homo sapiens
gcaccctctcctgggg

SEQ ID NO: 5753867 - DNA, 18 bp, Homo sapiens
gcaccctctcctgggggt

SEQ ID NO: 5753868 - DNA, 20 bp, Homo sapiens
gcaccctctgctatgtctgt

SEQ ID NO: 5753869 - DNA, 23 bp, Homo sapiens
gcaccctctgctatgtctgtgat

SEQ ID NO: 5753870 - DNA, 21 bp, Homo sapiens
gcaccctcttctcctctggct

SEQ ID NO: 5753871 - DNA, 15 bp, Homo sapiens
gcaccctgagggcgg

SEQ ID NO: 5753872 - DNA, 18 bp, Homo sapiens
gcaccctgcacctgctgc

SEQ ID NO: 5753873 - DNA, 19 bp, Homo sapiens
gcaccctgcacctgctgcg

SEQ ID NO: 5753874 - DNA, 24 bp, Homo sapiens
gcaccctgcagagcacacaggtac

SEQ ID NO: 5753875 - DNA, 14 bp, Homo sapiens
gcaccctgcaggca

SEQ ID NO: 5753876 - DNA, 16 bp, Homo sapiens
gcaccctgcaggcagg

SEQ ID NO: 5753877 - DNA, 21 bp, Homo sapiens
gcaccctgccccaccccacct

SEQ ID NO: 5753878 - DNA, 15 bp, Homo sapiens
gcaccctgcctacgc

SEQ ID NO: 5753879 - DNA, 19 bp, Homo sapiens
gcaccctgcctacgccagg

SEQ ID NO: 5753880 - DNA, 15 bp, Homo sapiens
gcaccctgcgcctcc

SEQ ID NO: 5753881 - DNA, 16 bp, Homo sapiens
gcaccctgcgcctcca

SEQ ID NO: 5753882 - DNA, 19 bp, Homo sapiens
gcaccctgcgcctccagag

SEQ ID NO: 5753883 - DNA, 20 bp, Homo sapiens
gcaccctgcgcctccagagg

SEQ ID NO: 5753884 - DNA, 19 bp, Homo sapiens
gcaccctggagagtgcaca

SEQ ID NO: 5753885 - DNA, 16 bp, Homo sapiens
gcaccctggcctggtc

SEQ ID NO: 5753886 - DNA, 13 bp, Homo sapiens
gcaccctggctgg

SEQ ID NO: 5753887 - DNA, 15 bp, Homo sapiens
gcaccctggggcctg

SEQ ID NO: 5753888 - DNA, 17 bp, Homo sapiens
gcaccctggggcctgga

SEQ ID NO: 5753889 - DNA, 20 bp, Homo sapiens
gcaccctggggcctggacct

SEQ ID NO: 5753890 - DNA, 15 bp, Homo sapiens
gcaccctgggtgcca

SEQ ID NO: 5753891 - DNA, 22 bp, Homo sapiens
gcaccctgggtgccattcccag

SEQ ID NO: 5753892 - DNA, 20 bp, Homo sapiens
gcaccctgtagatgttctag

SEQ ID NO: 5753893 - DNA, 21 bp, Homo sapiens
gcaccctgtagatgttctagg

SEQ ID NO: 5753894 - DNA, 19 bp, Homo sapiens
gcaccctgtggccctggct

SEQ ID NO: 5753895 - DNA, 19 bp, Homo sapiens
gcacccttccacagctggc

SEQ ID NO: 5753896 - DNA, 20 bp, Homo sapiens
gcacccttccatctgattcc

SEQ ID NO: 5753897 - DNA, 22 bp, Homo sapiens
gcacccttccctcttccctctc

SEQ ID NO: 5753898 - DNA, 21 bp, Homo sapiens
gcacccttctttcctcttccc

SEQ ID NO: 5753899 - DNA, 18 bp, Homo sapiens
gcacccttcttttctcat

SEQ ID NO: 5753900 - DNA, 18 bp, Homo sapiens
gcacccttgactgttggg

SEQ ID NO: 5753901 - DNA, 17 bp, Homo sapiens
gcacccttgcccggctg

SEQ ID NO: 5753902 - DNA, 16 bp, Homo sapiens
gcaccgaagcccagag

SEQ ID NO: 5753903 - DNA, 23 bp, Homo sapiens
gcaccgaagcccagagggtctgg

SEQ ID NO: 5753904 - DNA, 17 bp, Homo sapiens
gcaccgaccccgggccg

SEQ ID NO: 5753905 - DNA, 18 bp, Homo sapiens
gcaccgacccgaggccca

SEQ ID NO: 5753906 - DNA, 23 bp, Homo sapiens
gcaccgacttcaatttcccaccc

SEQ ID NO: 5753907 - DNA, 22 bp, Homo sapiens
gcaccgagtgatttccatctct

SEQ ID NO: 5753908 - DNA, 20 bp, Homo sapiens
gcaccgcccaacccccacct

SEQ ID NO: 5753909 - DNA, 13 bp, Homo sapiens
gcaccgcccaccc

SEQ ID NO: 5753910 - DNA, 15 bp, Homo sapiens
gcaccgcccacccac

SEQ ID NO: 5753911 - DNA, 13 bp, Homo sapiens
gcaccgccgcaga

SEQ ID NO: 5753912 - DNA, 20 bp, Homo sapiens
gcaccgccgcagaagcagcc

SEQ ID NO: 5753913 - DNA, 21 bp, Homo sapiens
gcaccgccgcagaagcagccc

SEQ ID NO: 5753914 - DNA, 12 bp, Homo sapiens
gcaccgccgcca

SEQ ID NO: 5753915 - DNA, 15 bp, Homo sapiens
gcaccgccgccaccc

SEQ ID NO: 5753916 - DNA, 22 bp, Homo sapiens
gcaccgccgccaccctgcccct

SEQ ID NO: 5753917 - DNA, 17 bp, Homo sapiens
gcaccgcctcttcccgc

SEQ ID NO: 5753918 - DNA, 19 bp, Homo sapiens
gcaccgcctgaaggcacag

SEQ ID NO: 5753919 - DNA, 15 bp, Homo sapiens
gcaccgcctgccctc

SEQ ID NO: 5753920 - DNA, 13 bp, Homo sapiens
gcaccgccttctc

SEQ ID NO: 5753921 - DNA, 20 bp, Homo sapiens
gcaccgcttctcagccacaa

SEQ ID NO: 5753922 - DNA, 14 bp, Homo sapiens
gcaccggaccagcc

SEQ ID NO: 5753923 - DNA, 16 bp, Homo sapiens
gcaccggaccagcctg

SEQ ID NO: 5753924 - DNA, 17 bp, Homo sapiens
gcaccggaccagcctgg

SEQ ID NO: 5753925 - DNA, 19 bp, Homo sapiens
gcaccggaccagcctggcc

SEQ ID NO: 5753926 - DNA, 17 bp, Homo sapiens
gcaccggcctggctgca

SEQ ID NO: 5753927 - DNA, 17 bp, Homo sapiens
gcaccggcgctgcaggt

SEQ ID NO: 5753928 - DNA, 22 bp, Homo sapiens
gcaccggctcaggagagggcct

SEQ ID NO: 5753929 - DNA, 17 bp, Homo sapiens
gcaccggctggcctggc

SEQ ID NO: 5753930 - DNA, 21 bp, Homo sapiens
gcaccggctggcctggcccct

SEQ ID NO: 5753931 - DNA, 23 bp, Homo sapiens
gcaccggctggcctggcccctca

SEQ ID NO: 5753932 - DNA, 21 bp, Homo sapiens
gcaccgggaccccctcaccat

SEQ ID NO: 5753933 - DNA, 23 bp, Homo sapiens
gcaccgggaccccctcaccatcc

SEQ ID NO: 5753934 - DNA, 14 bp, Homo sapiens
gcaccgggccacag

SEQ ID NO: 5753935 - DNA, 23 bp, Homo sapiens
gcaccgggccacagagaaagtac

SEQ ID NO: 5753936 - DNA, 14 bp, Homo sapiens
gcaccgggctggcc

SEQ ID NO: 5753937 - DNA, 21 bp, Homo sapiens
gcaccgggctggcctgacaca

SEQ ID NO: 5753938 - DNA, 19 bp, Homo sapiens
gcaccgggctggctgcttg

SEQ ID NO: 5753939 - DNA, 19 bp, Homo sapiens
gcaccggggcctgggcagg

SEQ ID NO: 5753940 - DNA, 13 bp, Homo sapiens
gcaccgtccaggc

SEQ ID NO: 5753941 - DNA, 15 bp, Homo sapiens
gcaccgtcctcagca

SEQ ID NO: 5753942 - DNA, 19 bp, Homo sapiens
gcaccgtctcactgtgtgt

SEQ ID NO: 5753943 - DNA, 24 bp, Homo sapiens
gcaccgtgatggagaggacagagc

SEQ ID NO: 5753944 - DNA, 14 bp, Homo sapiens
gcaccgtgctgggc

SEQ ID NO: 5753945 - DNA, 16 bp, Homo sapiens
gcaccgtgctgggctc

SEQ ID NO: 5753946 - DNA, 19 bp, Homo sapiens
gcaccgtgtcaagctgctc

SEQ ID NO: 5753947 - DNA, 20 bp, Homo sapiens
gcaccgtgtcaagctgctct

SEQ ID NO: 5753948 - DNA, 21 bp, Homo sapiens
gcaccgtgtcaagctgctctg

SEQ ID NO: 5753949 - DNA, 22 bp, Homo sapiens
gcaccgttgggaccaatgcctt

SEQ ID NO: 5753950 - DNA, 15 bp, Homo sapiens
gcacctaatccaggc

SEQ ID NO: 5753951 - DNA, 16 bp, Homo sapiens
gcacctaatccaggca

SEQ ID NO: 5753952 - DNA, 17 bp, Homo sapiens
gcacctaatccaggcag

SEQ ID NO: 5753953 - DNA, 18 bp, Homo sapiens
gcacctacagtgtacagt

SEQ ID NO: 5753954 - DNA, 19 bp, Homo sapiens
gcacctacagtgtacagtc

SEQ ID NO: 5753955 - DNA, 21 bp, Homo sapiens
gcacctacagtgtacagtctt

SEQ ID NO: 5753956 - DNA, 20 bp, Homo sapiens
gcacctacatccccaggtct

SEQ ID NO: 5753957 - DNA, 17 bp, Homo sapiens
gcacctaccaccacgcc

SEQ ID NO: 5753958 - DNA, 18 bp, Homo sapiens
gcacctaccaccacgccc

SEQ ID NO: 5753959 - DNA, 23 bp, Homo sapiens
gcacctaccaccagggccagcta

SEQ ID NO: 5753960 - DNA, 22 bp, Homo sapiens
gcacctaggtggggcctggggt

SEQ ID NO: 5753961 - DNA, 24 bp, Homo sapiens
gcacctaggtggggcctggggtag

SEQ ID NO: 5753962 - DNA, 23 bp, Homo sapiens
gcacctataaatactaaatatga

SEQ ID NO: 5753963 - DNA, 22 bp, Homo sapiens
gcacctatgagatggccatgct

SEQ ID NO: 5753964 - DNA, 23 bp, Homo sapiens
gcacctatgagatggccatgctc

SEQ ID NO: 5753965 - DNA, 18 bp, Homo sapiens
gcacctatggcccagcca

SEQ ID NO: 5753966 - DNA, 20 bp, Homo sapiens
gcacctatggcccagccact

SEQ ID NO: 5753967 - DNA, 23 bp, Homo sapiens
gcacctcaaggtcatcaaacatt

SEQ ID NO: 5753968 - DNA, 21 bp, Homo sapiens
gcacctcaagtgcaaggacca

SEQ ID NO: 5753969 - DNA, 21 bp, Homo sapiens
gcacctcacctgagacctcca

SEQ ID NO: 5753970 - DNA, 14 bp, Homo sapiens
gcacctcagacaat

SEQ ID NO: 5753971 - DNA, 20 bp, Homo sapiens
gcacctcagacaatccactc

SEQ ID NO: 5753972 - DNA, 16 bp, Homo sapiens
gcacctcagcctgcac

SEQ ID NO: 5753973 - DNA, 18 bp, Homo sapiens
gcacctccacatcctcca

SEQ ID NO: 5753974 - DNA, 15 bp, Homo sapiens
gcacctccacgccac

SEQ ID NO: 5753975 - DNA, 20 bp, Homo sapiens
gcacctccaggcaggccagg

SEQ ID NO: 5753976 - DNA, 13 bp, Homo sapiens
gcacctccaggcc

SEQ ID NO: 5753977 - DNA, 14 bp, Homo sapiens
gcacctcccatcct

SEQ ID NO: 5753978 - DNA, 14 bp, Homo sapiens
gcacctccccagac

SEQ ID NO: 5753979 - DNA, 13 bp, Homo sapiens
gcacctcccccca

SEQ ID NO: 5753980 - DNA, 17 bp, Homo sapiens
gcacctccccccactgc

SEQ ID NO: 5753981 - DNA, 13 bp, Homo sapiens
gcacctccccgct

SEQ ID NO: 5753982 - DNA, 14 bp, Homo sapiens
gcacctccccgctc

SEQ ID NO: 5753983 - DNA, 18 bp, Homo sapiens
gcacctccccgctctccc

SEQ ID NO: 5753984 - DNA, 21 bp, Homo sapiens
gcacctccccgctctccctgt

SEQ ID NO: 5753985 - DNA, 19 bp, Homo sapiens
gcacctcccttccctccct

SEQ ID NO: 5753986 - DNA, 17 bp, Homo sapiens
gcacctccgcttgccag

SEQ ID NO: 5753987 - DNA, 21 bp, Homo sapiens
gcacctccgcttgccagaggc

SEQ ID NO: 5753988 - DNA, 13 bp, Homo sapiens
gcacctccggctg

SEQ ID NO: 5753989 - DNA, 21 bp, Homo sapiens
gcacctcctaccctcccacca

SEQ ID NO: 5753990 - DNA, 14 bp, Homo sapiens
gcacctcctcagcc

SEQ ID NO: 5753991 - DNA, 13 bp, Homo sapiens
gcacctcctccgt

SEQ ID NO: 5753992 - DNA, 17 bp, Homo sapiens
gcacctcctctctgctg

SEQ ID NO: 5753993 - DNA, 19 bp, Homo sapiens
gcacctcctctctgctggg

SEQ ID NO: 5753994 - DNA, 20 bp, Homo sapiens
gcacctcctctctgctgggt

SEQ ID NO: 5753995 - DNA, 20 bp, Homo sapiens
gcacctcctgagaaggcgag

SEQ ID NO: 5753996 - DNA, 14 bp, Homo sapiens
gcacctcctgcctc

SEQ ID NO: 5753997 - DNA, 23 bp, Homo sapiens
gcacctcggggacaccagagctg

SEQ ID NO: 5753998 - DNA, 12 bp, Homo sapiens
gcacctctcaga

SEQ ID NO: 5753999 - DNA, 14 bp, Homo sapiens
gcacctctcagagc

SEQ ID NO: 5754000 - DNA, 20 bp, Homo sapiens
gcacctctgagccggagggc

SEQ ID NO: 5754001 - DNA, 12 bp, Homo sapiens
gcacctctgccc

SEQ ID NO: 5754002 - DNA, 14 bp, Homo sapiens
gcacctctgccctt

SEQ ID NO: 5754003 - DNA, 15 bp, Homo sapiens
gcacctctgcccttc

SEQ ID NO: 5754004 - DNA, 23 bp, Homo sapiens
gcacctctgctgtattgatatca

SEQ ID NO: 5754005 - DNA, 19 bp, Homo sapiens
gcacctctggctagagccg

SEQ ID NO: 5754006 - DNA, 13 bp, Homo sapiens
gcacctctgtgct

SEQ ID NO: 5754007 - DNA, 13 bp, Homo sapiens
gcacctcttgaag

SEQ ID NO: 5754008 - DNA, 17 bp, Homo sapiens
gcacctgaaccactgtg

SEQ ID NO: 5754009 - DNA, 23 bp, Homo sapiens
gcacctgaaccactgtggccttc

SEQ ID NO: 5754010 - DNA, 21 bp, Homo sapiens
gcacctgaccgctgcccaggt

SEQ ID NO: 5754011 - DNA, 22 bp, Homo sapiens
gcacctgaccgctgcccaggtg

SEQ ID NO: 5754012 - DNA, 12 bp, Homo sapiens
gcacctgagacc

SEQ ID NO: 5754013 - DNA, 13 bp, Homo sapiens
gcacctgaggccc

SEQ ID NO: 5754014 - DNA, 22 bp, Homo sapiens
gcacctgaggcccagcagagcc

SEQ ID NO: 5754015 - DNA, 23 bp, Homo sapiens
gcacctgaggcccagcagagccg

SEQ ID NO: 5754016 - DNA, 15 bp, Homo sapiens
gcacctgcacactcc

SEQ ID NO: 5754017 - DNA, 16 bp, Homo sapiens
gcacctgcacactcca

SEQ ID NO: 5754018 - DNA, 13 bp, Homo sapiens
gcacctgcagcca

SEQ ID NO: 5754019 - DNA, 22 bp, Homo sapiens
gcacctgcagcgcgcacacgca

SEQ ID NO: 5754020 - DNA, 14 bp, Homo sapiens
gcacctgcaggctt

SEQ ID NO: 5754021 - DNA, 15 bp, Homo sapiens
gcacctgcagggagc

SEQ ID NO: 5754022 - DNA, 17 bp, Homo sapiens
gcacctgcagggagcag

SEQ ID NO: 5754023 - DNA, 21 bp, Homo sapiens
gcacctgcagggagcagcacg

SEQ ID NO: 5754024 - DNA, 21 bp, Homo sapiens
gcacctgcaggttgggccata

SEQ ID NO: 5754025 - DNA, 12 bp, Homo sapiens
gcacctgccacc

SEQ ID NO: 5754026 - DNA, 17 bp, Homo sapiens
gcacctgccaccgccag

SEQ ID NO: 5754027 - DNA, 18 bp, Homo sapiens
gcacctgccagaggatgc

SEQ ID NO: 5754028 - DNA, 13 bp, Homo sapiens
gcacctgccagcc

SEQ ID NO: 5754029 - DNA, 14 bp, Homo sapiens
gcacctgccccagg

SEQ ID NO: 5754030 - DNA, 16 bp, Homo sapiens
gcacctgccccctggt

SEQ ID NO: 5754031 - DNA, 15 bp, Homo sapiens
gcacctgcctagctc

SEQ ID NO: 5754032 - DNA, 19 bp, Homo sapiens
gcacctgcctagctcttgg

SEQ ID NO: 5754033 - DNA, 14 bp, Homo sapiens
gcacctgcctcagc

SEQ ID NO: 5754034 - DNA, 15 bp, Homo sapiens
gcacctgcctcagga

SEQ ID NO: 5754035 - DNA, 15 bp, Homo sapiens
gcacctgcctccacc

SEQ ID NO: 5754036 - DNA, 21 bp, Homo sapiens
gcacctgcgagaggtccctgc

SEQ ID NO: 5754037 - DNA, 18 bp, Homo sapiens
gcacctgcgcctggctct

SEQ ID NO: 5754038 - DNA, 18 bp, Homo sapiens
  misc_feature (9)..(9): n is a, c, g or t
gcacctgcnttgtccctg

SEQ ID NO: 5754039 - DNA, 11 bp, Homo sapiens
gcacctgctgc

SEQ ID NO: 5754040 - DNA, 20 bp, Homo sapiens
gcacctgctgcgtccccact

SEQ ID NO: 5754041 - DNA, 21 bp, Homo sapiens
gcacctgctgcgtccccactc

SEQ ID NO: 5754042 - DNA, 23 bp, Homo sapiens
gcacctgctgcgtccccactccc

SEQ ID NO: 5754043 - DNA, 12 bp, Homo sapiens
gcacctgctgga

SEQ ID NO: 5754044 - DNA, 23 bp, Homo sapiens
gcacctgctggaaaccacacttc

SEQ ID NO: 5754045 - DNA, 20 bp, Homo sapiens
gcacctgctgtcagcctggc

SEQ ID NO: 5754046 - DNA, 20 bp, Homo sapiens
gcacctgcttcatgctcagc

SEQ ID NO: 5754047 - DNA, 18 bp, Homo sapiens
gcacctggaccccctgcc

SEQ ID NO: 5754048 - DNA, 19 bp, Homo sapiens
gcacctggagcccacagag

SEQ ID NO: 5754049 - DNA, 15 bp, Homo sapiens
gcacctggcctgctg

SEQ ID NO: 5754050 - DNA, 16 bp, Homo sapiens
gcacctggcctgctgg

SEQ ID NO: 5754051 - DNA, 17 bp, Homo sapiens
gcacctggcctgctggg

SEQ ID NO: 5754052 - DNA, 18 bp, Homo sapiens
gcacctggcctgctggga

SEQ ID NO: 5754053 - DNA, 20 bp, Homo sapiens
gcacctggcctgctgggaac

SEQ ID NO: 5754054 - DNA, 20 bp, Homo sapiens
gcacctggctgagcctggct

SEQ ID NO: 5754055 - DNA, 19 bp, Homo sapiens
gcacctgggaaaacagagg

SEQ ID NO: 5754056 - DNA, 14 bp, Homo sapiens
gcacctgggcagct

SEQ ID NO: 5754057 - DNA, 15 bp, Homo sapiens
gcacctgggcagctc

SEQ ID NO: 5754058 - DNA, 17 bp, Homo sapiens
gcacctgggcagctcct

SEQ ID NO: 5754059 - DNA, 18 bp, Homo sapiens
gcacctgggccccactgg

SEQ ID NO: 5754060 - DNA, 17 bp, Homo sapiens
gcacctgggccctgggg

SEQ ID NO: 5754061 - DNA, 15 bp, Homo sapiens
gcacctggggagtgg

SEQ ID NO: 5754062 - DNA, 16 bp, Homo sapiens
gcacctgggtgtgctc

SEQ ID NO: 5754063 - DNA, 12 bp, Homo sapiens
gcacctggtggg

SEQ ID NO: 5754064 - DNA, 22 bp, Homo sapiens
gcacctggtgggtggtgtcctg

SEQ ID NO: 5754065 - DNA, 19 bp, Homo sapiens
gcacctgtactcaggaggc

SEQ ID NO: 5754066 - DNA, 21 bp, Homo sapiens
gcacctgtactcaggaggctg

SEQ ID NO: 5754067 - DNA, 17 bp, Homo sapiens
gcacctgtagtcccagc

SEQ ID NO: 5754068 - DNA, 11 bp, Homo sapiens
gcacctgtccc

SEQ ID NO: 5754069 - DNA, 15 bp, Homo sapiens
gcacctgtcccagaa

SEQ ID NO: 5754070 - DNA, 18 bp, Homo sapiens
gcacctgtccccaccctc

SEQ ID NO: 5754071 - DNA, 12 bp, Homo sapiens
gcacctgtctgc

SEQ ID NO: 5754072 - DNA, 15 bp, Homo sapiens
gcacctgtctgctcc

SEQ ID NO: 5754073 - DNA, 16 bp, Homo sapiens
gcacctgtctgctcca

SEQ ID NO: 5754074 - DNA, 22 bp, Homo sapiens
gcacctgtgcccatggcttctg

SEQ ID NO: 5754075 - DNA, 21 bp, Homo sapiens
gcacctgtggccagagcacct

SEQ ID NO: 5754076 - DNA, 21 bp, Homo sapiens
gcacctgtggcctctcagtca

SEQ ID NO: 5754077 - DNA, 14 bp, Homo sapiens
gcaccttaactgga

SEQ ID NO: 5754078 - DNA, 16 bp, Homo sapiens
gcaccttaactggaga

SEQ ID NO: 5754079 - DNA, 15 bp, Homo sapiens
gcaccttacattcct

SEQ ID NO: 5754080 - DNA, 16 bp, Homo sapiens
gcaccttacattccta

SEQ ID NO: 5754081 - DNA, 18 bp, Homo sapiens
gcaccttacattcctaga

SEQ ID NO: 5754082 - DNA, 14 bp, Homo sapiens
gcaccttagacagt

SEQ ID NO: 5754083 - DNA, 18 bp, Homo sapiens
gcaccttagacagtccct

SEQ ID NO: 5754084 - DNA, 19 bp, Homo sapiens
gcaccttatatttctgtgt

SEQ ID NO: 5754085 - DNA, 19 bp, Homo sapiens
gcaccttcaagcgctccag

SEQ ID NO: 5754086 - DNA, 15 bp, Homo sapiens
gcaccttcagggctg

SEQ ID NO: 5754087 - DNA, 18 bp, Homo sapiens
gcaccttcccctgaggac

SEQ ID NO: 5754088 - DNA, 20 bp, Homo sapiens
gcaccttctgacgcagcctg

SEQ ID NO: 5754089 - DNA, 21 bp, Homo sapiens
gcaccttctgacgcagcctga

SEQ ID NO: 5754090 - DNA, 23 bp, Homo sapiens
gcaccttctgacgcagcctgaga

SEQ ID NO: 5754091 - DNA, 20 bp, Homo sapiens
gcaccttctttctggactgg

SEQ ID NO: 5754092 - DNA, 21 bp, Homo sapiens
gcaccttctttctggactggc

SEQ ID NO: 5754093 - DNA, 17 bp, Homo sapiens
gcaccttgctgcagtgt

SEQ ID NO: 5754094 - DNA, 15 bp, Homo sapiens
gcaccttggcccagg

SEQ ID NO: 5754095 - DNA, 18 bp, Homo sapiens
gcaccttggcccaggagc

SEQ ID NO: 5754096 - DNA, 21 bp, Homo sapiens
gcaccttgggcacgggagagc

SEQ ID NO: 5754097 - DNA, 21 bp, Homo sapiens
gcaccttgtgaaggaaaaaca

SEQ ID NO: 5754098 - DNA, 22 bp, Homo sapiens
gcaccttgtgaaggaaaaacat

SEQ ID NO: 5754099 - DNA, 22 bp, Homo sapiens
gcaccttgtgtctgtacacgtg

SEQ ID NO: 5754100 - DNA, 14 bp, Homo sapiens
gcacctttcaacca

SEQ ID NO: 5754101 - DNA, 22 bp, Homo sapiens
gcacctttccttcaagccagca

SEQ ID NO: 5754102 - DNA, 13 bp, Homo sapiens
gcacctttctagt

SEQ ID NO: 5754103 - DNA, 15 bp, Homo sapiens
gcacctttctctgag

SEQ ID NO: 5754104 - DNA, 21 bp, Homo sapiens
gcacctttctctgagaagagg

SEQ ID NO: 5754105 - DNA, 17 bp, Homo sapiens
gcacctttgagagaggg

SEQ ID NO: 5754106 - DNA, 23 bp, Homo sapiens
gcacctttgtctggatgcacact

SEQ ID NO: 5754107 - DNA, 23 bp, Homo sapiens
gcaccttttactgtgatgtttgt

SEQ ID NO: 5754108 - DNA, 11 bp, Homo sapiens
gcaccttttca

SEQ ID NO: 5754109 - DNA, 22 bp, Homo sapiens
gcaccttttcatggtctctgca

SEQ ID NO: 5754110 - DNA, 17 bp, Homo sapiens
gcacgaaatggctgaag

SEQ ID NO: 5754111 - DNA, 23 bp, Homo sapiens
gcacgaacccacctgctgagaga

SEQ ID NO: 5754112 - DNA, 16 bp, Homo sapiens
gcacgaccgccccagt

SEQ ID NO: 5754113 - DNA, 16 bp, Homo sapiens
gcacgacgccctctcc

SEQ ID NO: 5754114 - DNA, 13 bp, Homo sapiens
gcacgactgcggg

SEQ ID NO: 5754115 - DNA, 14 bp, Homo sapiens
gcacgatctcagct

SEQ ID NO: 5754116 - DNA, 12 bp, Homo sapiens
gcacgatttctg

SEQ ID NO: 5754117 - DNA, 16 bp, Homo sapiens
gcacgatttctgttta

SEQ ID NO: 5754118 - DNA, 15 bp, Homo sapiens
gcacgcaagcctcag

SEQ ID NO: 5754119 - DNA, 17 bp, Homo sapiens
gcacgcaagcctcagcc

SEQ ID NO: 5754120 - DNA, 20 bp, Homo sapiens
gcacgcacacgcacacatct

SEQ ID NO: 5754121 - DNA, 15 bp, Homo sapiens
gcacgcacactgtct

SEQ ID NO: 5754122 - DNA, 18 bp, Homo sapiens
gcacgcaccactgcttcc

SEQ ID NO: 5754123 - DNA, 17 bp, Homo sapiens
gcacgcacccacaccct

SEQ ID NO: 5754124 - DNA, 23 bp, Homo sapiens
gcacgcacccacaccctacagca

SEQ ID NO: 5754125 - DNA, 21 bp, Homo sapiens
gcacgcaccccgcccctgcat

SEQ ID NO: 5754126 - DNA, 22 bp, Homo sapiens
gcacgcacctgtagtcccagct

SEQ ID NO: 5754127 - DNA, 15 bp, Homo sapiens
gcacgcacttgcctg

SEQ ID NO: 5754128 - DNA, 17 bp, Homo sapiens
gcacgcatgtccctcca

SEQ ID NO: 5754129 - DNA, 23 bp, Homo sapiens
gcacgccaaccccagcagtcctg

SEQ ID NO: 5754130 - DNA, 17 bp, Homo sapiens
gcacgccaccacacctg

SEQ ID NO: 5754131 - DNA, 21 bp, Homo sapiens
gcacgccaccacacctggctt

SEQ ID NO: 5754132 - DNA, 18 bp, Homo sapiens
gcacgcccatgtgtgagt

SEQ ID NO: 5754133 - DNA, 18 bp, Homo sapiens
gcacgcctctccccacct

SEQ ID NO: 5754134 - DNA, 13 bp, Homo sapiens
gcacgcctgccat

SEQ ID NO: 5754135 - DNA, 14 bp, Homo sapiens
gcacgcctgccatc

SEQ ID NO: 5754136 - DNA, 16 bp, Homo sapiens
gcacgcctgctggccg

SEQ ID NO: 5754137 - DNA, 20 bp, Homo sapiens
gcacgcgccctttctaccat

SEQ ID NO: 5754138 - DNA, 15 bp, Homo sapiens
gcacgctaccaaatc

SEQ ID NO: 5754139 - DNA, 18 bp, Homo sapiens
gcacgctcaatgcccagt

SEQ ID NO: 5754140 - DNA, 16 bp, Homo sapiens
gcacgctcccctccat

SEQ ID NO: 5754141 - DNA, 17 bp, Homo sapiens
gcacgctgcccaggggc

SEQ ID NO: 5754142 - DNA, 20 bp, Homo sapiens
gcacgctgtgggcaggtggg

SEQ ID NO: 5754143 - DNA, 19 bp, Homo sapiens
gcacgcttgcgtatgtctg

SEQ ID NO: 5754144 - DNA, 20 bp, Homo sapiens
gcacgcttgcgtatgtctgt

SEQ ID NO: 5754145 - DNA, 21 bp, Homo sapiens
gcacggaccatgcgacactgg

SEQ ID NO: 5754146 - DNA, 17 bp, Homo sapiens
gcacggactgtccacct

SEQ ID NO: 5754147 - DNA, 23 bp, Homo sapiens
gcacggagtgttggggctggggg

SEQ ID NO: 5754148 - DNA, 13 bp, Homo sapiens
gcacggcagcttg

SEQ ID NO: 5754149 - DNA, 14 bp, Homo sapiens
gcacggcaggcgtg

SEQ ID NO: 5754150 - DNA, 23 bp, Homo sapiens
gcacggccccgaagggcccccac

SEQ ID NO: 5754151 - DNA, 20 bp, Homo sapiens
gcacggcgggatcctccaca

SEQ ID NO: 5754152 - DNA, 16 bp, Homo sapiens
gcacggctctggggta

SEQ ID NO: 5754153 - DNA, 19 bp, Homo sapiens
gcacggctctgtccccagc

SEQ ID NO: 5754154 - DNA, 20 bp, Homo sapiens
gcacggctctgtccccagcc

SEQ ID NO: 5754155 - DNA, 15 bp, Homo sapiens
gcacggctgctcggc

SEQ ID NO: 5754156 - DNA, 13 bp, Homo sapiens
gcacggctgctga

SEQ ID NO: 5754157 - DNA, 13 bp, Homo sapiens
gcacgggagagcg

SEQ ID NO: 5754158 - DNA, 19 bp, Homo sapiens
gcacgggatgcgtgggagg

SEQ ID NO: 5754159 - DNA, 19 bp, Homo sapiens
gcacgggcatgcacacggc

SEQ ID NO: 5754160 - DNA, 15 bp, Homo sapiens
gcacggggacctgga

SEQ ID NO: 5754161 - DNA, 15 bp, Homo sapiens
gcacgggtggtcccc

SEQ ID NO: 5754162 - DNA, 19 bp, Homo sapiens
gcacggtcacacggccacc

SEQ ID NO: 5754163 - DNA, 20 bp, Homo sapiens
gcacggtcccccaggaggca

SEQ ID NO: 5754164 - DNA, 22 bp, Homo sapiens
gcacggtcccccaggaggcagc

SEQ ID NO: 5754165 - DNA, 20 bp, Homo sapiens
gcacggtggacccagacaca

SEQ ID NO: 5754166 - DNA, 14 bp, Homo sapiens
gcacggtgggcctt

SEQ ID NO: 5754167 - DNA, 17 bp, Homo sapiens
gcacggtgggccttgct

SEQ ID NO: 5754168 - DNA, 14 bp, Homo sapiens
gcacggttcaatgg

SEQ ID NO: 5754169 - DNA, 18 bp, Homo sapiens
gcacggttcaatggtaga

SEQ ID NO: 5754170 - DNA, 17 bp, Homo sapiens
gcacggttgcctgaggt

SEQ ID NO: 5754171 - DNA, 18 bp, Homo sapiens
gcacggttgcctgaggtc

SEQ ID NO: 5754172 - DNA, 12 bp, Homo sapiens
gcacggtttgtg

SEQ ID NO: 5754173 - DNA, 14 bp, Homo sapiens
gcacggtttgtgag

SEQ ID NO: 5754174 - DNA, 21 bp, Homo sapiens
gcacgtaaagtacttgtagtt

SEQ ID NO: 5754175 - DNA, 18 bp, Homo sapiens
gcacgtaggttccccaga

SEQ ID NO: 5754176 - DNA, 23 bp, Homo sapiens
gcacgtagtttgcattccagcgt

SEQ ID NO: 5754177 - DNA, 17 bp, Homo sapiens
gcacgtatacacccaga

SEQ ID NO: 5754178 - DNA, 14 bp, Homo sapiens
gcacgtattgctgt

SEQ ID NO: 5754179 - DNA, 15 bp, Homo sapiens
gcacgtattttaata

SEQ ID NO: 5754180 - DNA, 15 bp, Homo sapiens
gcacgtcaccctcct

SEQ ID NO: 5754181 - DNA, 14 bp, Homo sapiens
gcacgtcccatgtg

SEQ ID NO: 5754182 - DNA, 14 bp, Homo sapiens
gcacgtctcagaga

SEQ ID NO: 5754183 - DNA, 16 bp, Homo sapiens
gcacgtctcagagatt

SEQ ID NO: 5754184 - DNA, 15 bp, Homo sapiens
gcacgtctcctgctg

SEQ ID NO: 5754185 - DNA, 16 bp, Homo sapiens
gcacgtcttgctattt

SEQ ID NO: 5754186 - DNA, 12 bp, Homo sapiens
gcacgtgcaata

SEQ ID NO: 5754187 - DNA, 15 bp, Homo sapiens
gcacgtgcacacacc

SEQ ID NO: 5754188 - DNA, 17 bp, Homo sapiens
gcacgtgcacacacctg

SEQ ID NO: 5754189 - DNA, 22 bp, Homo sapiens
gcacgtgcacacacctgcacac

SEQ ID NO: 5754190 - DNA, 20 bp, Homo sapiens
gcacgtggagagctggtgcc

SEQ ID NO: 5754191 - DNA, 23 bp, Homo sapiens
gcacgtggcatgtggcctgtggc

SEQ ID NO: 5754192 - DNA, 17 bp, Homo sapiens
gcacgtggccaggagcc

SEQ ID NO: 5754193 - DNA, 14 bp, Homo sapiens
gcacgtggcctctt

SEQ ID NO: 5754194 - DNA, 17 bp, Homo sapiens
gcacgtggcttctgatg

SEQ ID NO: 5754195 - DNA, 23 bp, Homo sapiens
gcacgtggcttctgatgaatctt

SEQ ID NO: 5754196 - DNA, 19 bp, Homo sapiens
gcacgtgtgggccgtggct

SEQ ID NO: 5754197 - DNA, 22 bp, Homo sapiens
gcacgttatggtgtttctccct

SEQ ID NO: 5754198 - DNA, 20 bp, Homo sapiens
gcacgttctatattgtgcca

SEQ ID NO: 5754199 - DNA, 13 bp, Homo sapiens
gcacgttgcccaa

SEQ ID NO: 5754200 - DNA, 16 bp, Homo sapiens
gcacgttgctgccagt

SEQ ID NO: 5754201 - DNA, 22 bp, Homo sapiens
gcactaaaagtgatgtgattta

SEQ ID NO: 5754202 - DNA, 19 bp, Homo sapiens
gcactaaaatgaggatcca

SEQ ID NO: 5754203 - DNA, 22 bp, Homo sapiens
gcactaaaatgaggatccaggg

SEQ ID NO: 5754204 - DNA, 21 bp, Homo sapiens
gcactaaaatgtttaattcat

SEQ ID NO: 5754205 - DNA, 14 bp, Homo sapiens
gcactaaagcagtg

SEQ ID NO: 5754206 - DNA, 19 bp, Homo sapiens
gcactaaagccagcctgac

SEQ ID NO: 5754207 - DNA, 21 bp, Homo sapiens
gcactaaagccagcctgacct

SEQ ID NO: 5754208 - DNA, 23 bp, Homo sapiens
gcactaaagccagcctgaccttc

SEQ ID NO: 5754209 - DNA, 19 bp, Homo sapiens
gcactaaagtatgtaaagt

SEQ ID NO: 5754210 - DNA, 20 bp, Homo sapiens
gcactaaccaatgccttttt

SEQ ID NO: 5754211 - DNA, 19 bp, Homo sapiens
gcactaacgttgagcccct

SEQ ID NO: 5754212 - DNA, 20 bp, Homo sapiens
gcactaacgttgagcccctg

SEQ ID NO: 5754213 - DNA, 20 bp, Homo sapiens
gcactaagaggggctggacc

SEQ ID NO: 5754214 - DNA, 23 bp, Homo sapiens
gcactaaggccgtgtctctgagg

SEQ ID NO: 5754215 - DNA, 18 bp, Homo sapiens
gcactaaggtgtgctctg

SEQ ID NO: 5754216 - DNA, 21 bp, Homo sapiens
gcactaagtcatggtcctggc

SEQ ID NO: 5754217 - DNA, 22 bp, Homo sapiens
gcactaagtcatggtcctggct

SEQ ID NO: 5754218 - DNA, 17 bp, Homo sapiens
gcactaatcaatacttt

SEQ ID NO: 5754219 - DNA, 17 bp, Homo sapiens
gcactaatgttttggtc

SEQ ID NO: 5754220 - DNA, 19 bp, Homo sapiens
gcactaatttgatgtttac

SEQ ID NO: 5754221 - DNA, 19 bp, Homo sapiens
gcactacataatctctgga

SEQ ID NO: 5754222 - DNA, 21 bp, Homo sapiens
gcactacatgtggtttataga

SEQ ID NO: 5754223 - DNA, 16 bp, Homo sapiens
gcactacattcattta

SEQ ID NO: 5754224 - DNA, 21 bp, Homo sapiens
gcactaccatagctacatcag

SEQ ID NO: 5754225 - DNA, 14 bp, Homo sapiens
gcactaccgggggc

SEQ ID NO: 5754226 - DNA, 22 bp, Homo sapiens
gcactacctgaacattgtaata

SEQ ID NO: 5754227 - DNA, 23 bp, Homo sapiens
gcactactaaaagtttagaactt

SEQ ID NO: 5754228 - DNA, 19 bp, Homo sapiens
gcactactcctctgcagtg

SEQ ID NO: 5754229 - DNA, 17 bp, Homo sapiens
gcactactctgtgccag

SEQ ID NO: 5754230 - DNA, 17 bp, Homo sapiens
gcactactgggtgtcat

SEQ ID NO: 5754231 - DNA, 19 bp, Homo sapiens
gcactactgggtgtcattt

SEQ ID NO: 5754232 - DNA, 19 bp, Homo sapiens
gcactacttacttagagat

SEQ ID NO: 5754233 - DNA, 16 bp, Homo sapiens
gcactacttgcttata

SEQ ID NO: 5754234 - DNA, 14 bp, Homo sapiens
gcactagaagatga

SEQ ID NO: 5754235 - DNA, 17 bp, Homo sapiens
gcactagaatgagaaat

SEQ ID NO: 5754236 - DNA, 24 bp, Homo sapiens
gcactagactggtggcaggggctt

SEQ ID NO: 5754237 - DNA, 19 bp, Homo sapiens
gcactagagaaaataaatt

SEQ ID NO: 5754238 - DNA, 22 bp, Homo sapiens
gcactagcattttcttgaacca

SEQ ID NO: 5754239 - DNA, 17 bp, Homo sapiens
gcactagccaaacctca

SEQ ID NO: 5754240 - DNA, 18 bp, Homo sapiens
gcactagccaaacctcac

SEQ ID NO: 5754241 - DNA, 23 bp, Homo sapiens
gcactagccaacccaactgactt

SEQ ID NO: 5754242 - DNA, 17 bp, Homo sapiens
gcactagcctccctctc

SEQ ID NO: 5754243 - DNA, 22 bp, Homo sapiens
gcactagcctccctctcctctg

SEQ ID NO: 5754244 - DNA, 16 bp, Homo sapiens
gcactagccttcccag

SEQ ID NO: 5754245 - DNA, 16 bp, Homo sapiens
gcactagcctttggct

SEQ ID NO: 5754246 - DNA, 18 bp, Homo sapiens
gcactagcctttggctct

SEQ ID NO: 5754247 - DNA, 21 bp, Homo sapiens
gcactagcctttggctctgga

SEQ ID NO: 5754248 - DNA, 22 bp, Homo sapiens
gcactagcctttggctctggag

SEQ ID NO: 5754249 - DNA, 12 bp, Homo sapiens
gcactaggcagg

SEQ ID NO: 5754250 - DNA, 21 bp, Homo sapiens
gcactaggggatataggagag

SEQ ID NO: 5754251 - DNA, 19 bp, Homo sapiens
gcactaggttcaattccct

SEQ ID NO: 5754252 - DNA, 18 bp, Homo sapiens
gcactagtaaaggaggaa

SEQ ID NO: 5754253 - DNA, 20 bp, Homo sapiens
gcactataatgtaagctcta

SEQ ID NO: 5754254 - DNA, 16 bp, Homo sapiens
gcactatagccatttg

SEQ ID NO: 5754255 - DNA, 20 bp, Homo sapiens
gcactatagccatttgcccc

SEQ ID NO: 5754256 - DNA, 22 bp, Homo sapiens
gcactatagccatttgccccaa

SEQ ID NO: 5754257 - DNA, 22 bp, Homo sapiens
gcactatagcctaggtgacaga

SEQ ID NO: 5754258 - DNA, 19 bp, Homo sapiens
gcactatatttgtatatat

SEQ ID NO: 5754259 - DNA, 15 bp, Homo sapiens
gcactatctttcagg

SEQ ID NO: 5754260 - DNA, 16 bp, Homo sapiens
gcactatctttcagga

SEQ ID NO: 5754261 - DNA, 23 bp, Homo sapiens
gcactatgcccttttatataagt

SEQ ID NO: 5754262 - DNA, 17 bp, Homo sapiens
gcactatgctttccttc

SEQ ID NO: 5754263 - DNA, 16 bp, Homo sapiens
gcactattggactttg

SEQ ID NO: 5754264 - DNA, 13 bp, Homo sapiens
gcactattttata

SEQ ID NO: 5754265 - DNA, 17 bp, Homo sapiens
gcactattttatattta

SEQ ID NO: 5754266 - DNA, 18 bp, Homo sapiens
gcactattttatatttaa

SEQ ID NO: 5754267 - DNA, 18 bp, Homo sapiens
gcactcaaatcttaagaa

SEQ ID NO: 5754268 - DNA, 22 bp, Homo sapiens
gcactcaacaatggttgaatga

SEQ ID NO: 5754269 - DNA, 20 bp, Homo sapiens
gcactcaaccaacctccccg

SEQ ID NO: 5754270 - DNA, 21 bp, Homo sapiens
gcactcaactctgagcccata

SEQ ID NO: 5754271 - DNA, 12 bp, Homo sapiens
gcactcaagttg

SEQ ID NO: 5754272 - DNA, 20 bp, Homo sapiens
gcactcaagttgtttaactg

SEQ ID NO: 5754273 - DNA, 13 bp, Homo sapiens
gcactcaataaag

SEQ ID NO: 5754274 - DNA, 21 bp, Homo sapiens
gcactcaataaagtgggcttt

SEQ ID NO: 5754275 - DNA, 16 bp, Homo sapiens
gcactcacagacctgg

SEQ ID NO: 5754276 - DNA, 17 bp, Homo sapiens
gcactcacagacctgga

SEQ ID NO: 5754277 - DNA, 19 bp, Homo sapiens
gcactcacccatgtgccaa

SEQ ID NO: 5754278 - DNA, 19 bp, Homo sapiens
gcactcacccctagccctg

SEQ ID NO: 5754279 - DNA, 20 bp, Homo sapiens
gcactcacccctagccctgg

SEQ ID NO: 5754280 - DNA, 14 bp, Homo sapiens
gcactcagaaaatg

SEQ ID NO: 5754281 - DNA, 16 bp, Homo sapiens
gcactcagaagacact

SEQ ID NO: 5754282 - DNA, 23 bp, Homo sapiens
gcactcagaagttgtgctaaacc

SEQ ID NO: 5754283 - DNA, 12 bp, Homo sapiens
gcactcagagct

SEQ ID NO: 5754284 - DNA, 22 bp, Homo sapiens
gcactcagccacgaccagcccc

SEQ ID NO: 5754285 - DNA, 23 bp, Homo sapiens
gcactcagccacgaccagcccct

SEQ ID NO: 5754286 - DNA, 19 bp, Homo sapiens
gcactcagccgtgggcccg

SEQ ID NO: 5754287 - DNA, 19 bp, Homo sapiens
gcactcaggagcacagcca

SEQ ID NO: 5754288 - DNA, 14 bp, Homo sapiens
gcactcaggctctc

SEQ ID NO: 5754289 - DNA, 23 bp, Homo sapiens
gcactcagtctagtgaagatgtt

SEQ ID NO: 5754290 - DNA, 16 bp, Homo sapiens
gcactcagtgagcctc

SEQ ID NO: 5754291 - DNA, 18 bp, Homo sapiens
gcactcagtgagcctcct

SEQ ID NO: 5754292 - DNA, 14 bp, Homo sapiens
gcactcagtgaggc

SEQ ID NO: 5754293 - DNA, 12 bp, Homo sapiens
gcactcatgtgg

SEQ ID NO: 5754294 - DNA, 20 bp, Homo sapiens
gcactcattttctataacag

SEQ ID NO: 5754295 - DNA, 14 bp, Homo sapiens
gcactccacacatc

SEQ ID NO: 5754296 - DNA, 11 bp, Homo sapiens
gcactccagcc

SEQ ID NO: 5754297 - DNA, 13 bp, Homo sapiens
gcactccagcctg

SEQ ID NO: 5754298 - DNA, 14 bp, Homo sapiens
gcactccagcctgg

SEQ ID NO: 5754299 - DNA, 16 bp, Homo sapiens
gcactccagcctgggc

SEQ ID NO: 5754300 - DNA, 17 bp, Homo sapiens
gcactccagcctgggca

SEQ ID NO: 5754301 - DNA, 18 bp, Homo sapiens
gcactccagcctgggcga

SEQ ID NO: 5754302 - DNA, 21 bp, Homo sapiens
gcactccagcctgggcgacag

SEQ ID NO: 5754303 - DNA, 16 bp, Homo sapiens
gcactccagcctgggt

SEQ ID NO: 5754304 - DNA, 23 bp, Homo sapiens
gcactccagcctgggtgacagag

SEQ ID NO: 5754305 - DNA, 12 bp, Homo sapiens
gcactccagctt

SEQ ID NO: 5754306 - DNA, 14 bp, Homo sapiens
gcactccagtctgg

SEQ ID NO: 5754307 - DNA, 18 bp, Homo sapiens
gcactccatccagctaca

SEQ ID NO: 5754308 - DNA, 13 bp, Homo sapiens
gcactccatggcc

SEQ ID NO: 5754309 - DNA, 16 bp, Homo sapiens
gcactccatggccacc

SEQ ID NO: 5754310 - DNA, 18 bp, Homo sapiens
gcactccatggccacccc

SEQ ID NO: 5754311 - DNA, 13 bp, Homo sapiens
gcactcccaaccc

SEQ ID NO: 5754312 - DNA, 15 bp, Homo sapiens
gcactcccaaccctg

SEQ ID NO: 5754313 - DNA, 17 bp, Homo sapiens
gcactcccacctgacac

SEQ ID NO: 5754314 - DNA, 14 bp, Homo sapiens
gcactcccagggcc

SEQ ID NO: 5754315 - DNA, 19 bp, Homo sapiens
gcactcccagggcccgagc

SEQ ID NO: 5754316 - DNA, 13 bp, Homo sapiens
gcactcccctgct

SEQ ID NO: 5754317 - DNA, 16 bp, Homo sapiens
gcactcccctgctggg

SEQ ID NO: 5754318 - DNA, 17 bp, Homo sapiens
gcactcccctgctgggt

SEQ ID NO: 5754319 - DNA, 17 bp, Homo sapiens
gcactccccttgccttc

SEQ ID NO: 5754320 - DNA, 17 bp, Homo sapiens
gcactcccgctgcacac

SEQ ID NO: 5754321 - DNA, 22 bp, Homo sapiens
gcactcccgctgcacacagacg

SEQ ID NO: 5754322 - DNA, 23 bp, Homo sapiens
gcactccctaaccaaatgctgtc

SEQ ID NO: 5754323 - DNA, 15 bp, Homo sapiens
gcactccctaagaaa

SEQ ID NO: 5754324 - DNA, 21 bp, Homo sapiens
gcactccctaagaaaccccag

SEQ ID NO: 5754325 - DNA, 22 bp, Homo sapiens
gcactccctaagaaaccccagg

SEQ ID NO: 5754326 - DNA, 18 bp, Homo sapiens
gcactccctccagcacaa

SEQ ID NO: 5754327 - DNA, 14 bp, Homo sapiens
gcactccctcctgg

SEQ ID NO: 5754328 - DNA, 17 bp, Homo sapiens
gcactccctggccttgc

SEQ ID NO: 5754329 - DNA, 13 bp, Homo sapiens
gcactcccttgag

SEQ ID NO: 5754330 - DNA, 15 bp, Homo sapiens
gcactcccttgagga

SEQ ID NO: 5754331 - DNA, 18 bp, Homo sapiens
gcactccgcgccgatgcc

SEQ ID NO: 5754332 - DNA, 22 bp, Homo sapiens
gcactccgcgccgatgccaccg

SEQ ID NO: 5754333 - DNA, 17 bp, Homo sapiens
gcactccggcctgatga

SEQ ID NO: 5754334 - DNA, 19 bp, Homo sapiens
gcactcctccctgatgtac

SEQ ID NO: 5754335 - DNA, 13 bp, Homo sapiens
gcactcctctgtc

SEQ ID NO: 5754336 - DNA, 19 bp, Homo sapiens
gcactcctctgtctctgct

SEQ ID NO: 5754337 - DNA, 15 bp, Homo sapiens
gcactcctttatctg

SEQ ID NO: 5754338 - DNA, 24 bp, Homo sapiens
gcactcctttatctgtaattgtaa

SEQ ID NO: 5754339 - DNA, 18 bp, Homo sapiens
gcactcggggtccctgga

SEQ ID NO: 5754340 - DNA, 19 bp, Homo sapiens
gcactcggggtccctggag

SEQ ID NO: 5754341 - DNA, 15 bp, Homo sapiens
gcactctaaactgca

SEQ ID NO: 5754342 - DNA, 16 bp, Homo sapiens
gcactctaaactgcaa

SEQ ID NO: 5754343 - DNA, 13 bp, Homo sapiens
gcactctagattc

SEQ ID NO: 5754344 - DNA, 14 bp, Homo sapiens
gcactctagccgga

SEQ ID NO: 5754345 - DNA, 15 bp, Homo sapiens
gcactctagcctggc

SEQ ID NO: 5754346 - DNA, 17 bp, Homo sapiens
gcactctcaccccaagc

SEQ ID NO: 5754347 - DNA, 22 bp, Homo sapiens
gcactctcaccccaagcggcct

SEQ ID NO: 5754348 - DNA, 19 bp, Homo sapiens
gcactctcatcaccccaga

SEQ ID NO: 5754349 - DNA, 22 bp, Homo sapiens
gcactctcatcaccccagaggc

SEQ ID NO: 5754350 - DNA, 19 bp, Homo sapiens
gcactctccaccctggctg

SEQ ID NO: 5754351 - DNA, 15 bp, Homo sapiens
gcactctccccgctc

SEQ ID NO: 5754352 - DNA, 24 bp, Homo sapiens
gcactctccccgctcaggggcctg

SEQ ID NO: 5754353 - DNA, 22 bp, Homo sapiens
gcactctctaaatcttccttgt

SEQ ID NO: 5754354 - DNA, 17 bp, Homo sapiens
gcactctctgccagctc

SEQ ID NO: 5754355 - DNA, 23 bp, Homo sapiens
gcactctgagtttaccatttgta

SEQ ID NO: 5754356 - DNA, 14 bp, Homo sapiens
gcactctgctggcg

SEQ ID NO: 5754357 - DNA, 15 bp, Homo sapiens
gcactctggactcca

SEQ ID NO: 5754358 - DNA, 21 bp, Homo sapiens
gcactctggcggtggccacag

SEQ ID NO: 5754359 - DNA, 18 bp, Homo sapiens
gcactctgggtctggcca

SEQ ID NO: 5754360 - DNA, 17 bp, Homo sapiens
gcactctgtagcaaatt

SEQ ID NO: 5754361 - DNA, 11 bp, Homo sapiens
gcactctgtgc

SEQ ID NO: 5754362 - DNA, 19 bp, Homo sapiens
gcactctgtgcccatgggc

SEQ ID NO: 5754363 - DNA, 22 bp, Homo sapiens
gcactctgtgtgggaaaatggc

SEQ ID NO: 5754364 - DNA, 16 bp, Homo sapiens
gcactctgttcccctc

SEQ ID NO: 5754365 - DNA, 21 bp, Homo sapiens
gcactctgttcccctccccct

SEQ ID NO: 5754366 - DNA, 19 bp, Homo sapiens
gcactcttgtacaaaagaa

SEQ ID NO: 5754367 - DNA, 23 bp, Homo sapiens
gcactcttgtttgctttgaaaat

SEQ ID NO: 5754368 - DNA, 20 bp, Homo sapiens
gcactctttaagggagtgta

SEQ ID NO: 5754369 - DNA, 12 bp, Homo sapiens
gcactgaaaacc

SEQ ID NO: 5754370 - DNA, 14 bp, Homo sapiens
gcactgaaaaggtt

SEQ ID NO: 5754371 - DNA, 11 bp, Homo sapiens
gcactgaaaca

SEQ ID NO: 5754372 - DNA, 16 bp, Homo sapiens
gcactgaaacctgaga

SEQ ID NO: 5754373 - DNA, 19 bp, Homo sapiens
gcactgaacaggctggggc

SEQ ID NO: 5754374 - DNA, 17 bp, Homo sapiens
gcactgaaccacattca

SEQ ID NO: 5754375 - DNA, 14 bp, Homo sapiens
gcactgaactgctt

SEQ ID NO: 5754376 - DNA, 14 bp, Homo sapiens
gcactgaagagctc

SEQ ID NO: 5754377 - DNA, 18 bp, Homo sapiens
gcactgaagagctcttgg

SEQ ID NO: 5754378 - DNA, 20 bp, Homo sapiens
gcactgaagccggacagctg

SEQ ID NO: 5754379 - DNA, 22 bp, Homo sapiens
gcactgaaggctttcagggcct

SEQ ID NO: 5754380 - DNA, 20 bp, Homo sapiens
gcactgaagtggccctccct

SEQ ID NO: 5754381 - DNA, 21 bp, Homo sapiens
gcactgaagtggccctccctc

SEQ ID NO: 5754382 - DNA, 22 bp, Homo sapiens
gcactgaagtggccctccctca

SEQ ID NO: 5754383 - DNA, 20 bp, Homo sapiens
gcactgaagtttttgaaata

SEQ ID NO: 5754384 - DNA, 21 bp, Homo sapiens
gcactgaagtttttgaaatac

SEQ ID NO: 5754385 - DNA, 19 bp, Homo sapiens
gcactgaatcgtttcatgt

SEQ ID NO: 5754386 - DNA, 21 bp, Homo sapiens
gcactgaatcgtttcatgtaa

SEQ ID NO: 5754387 - DNA, 21 bp, Homo sapiens
gcactgaatggctgacctgac

SEQ ID NO: 5754388 - DNA, 12 bp, Homo sapiens
gcactgacattg

SEQ ID NO: 5754389 - DNA, 16 bp, Homo sapiens
gcactgaccaggccca

SEQ ID NO: 5754390 - DNA, 20 bp, Homo sapiens
gcactgacccacagcctctg

SEQ ID NO: 5754391 - DNA, 14 bp, Homo sapiens
gcactgacccttcc

SEQ ID NO: 5754392 - DNA, 17 bp, Homo sapiens
gcactgacccttccaga

SEQ ID NO: 5754393 - DNA, 19 bp, Homo sapiens
gcactgacggactcatgat

SEQ ID NO: 5754394 - DNA, 13 bp, Homo sapiens
gcactgactctgg

SEQ ID NO: 5754395 - DNA, 14 bp, Homo sapiens
gcactgactctgga

SEQ ID NO: 5754396 - DNA, 17 bp, Homo sapiens
gcactgactctggaaaa

SEQ ID NO: 5754397 - DNA, 18 bp, Homo sapiens
gcactgactctggaaaag

SEQ ID NO: 5754398 - DNA, 16 bp, Homo sapiens
gcactgactgggcata

SEQ ID NO: 5754399 - DNA, 18 bp, Homo sapiens
gcactgacttctaagtaa

SEQ ID NO: 5754400 - DNA, 15 bp, Homo sapiens
gcactgagagggcaa

SEQ ID NO: 5754401 - DNA, 21 bp, Homo sapiens
gcactgagataccagcgagga

SEQ ID NO: 5754402 - DNA, 15 bp, Homo sapiens
gcactgagatattta

SEQ ID NO: 5754403 - DNA, 11 bp, Homo sapiens
gcactgaggaa

SEQ ID NO: 5754404 - DNA, 18 bp, Homo sapiens
gcactgaggatttctttt

SEQ ID NO: 5754405 - DNA, 11 bp, Homo sapiens
gcactgagggc

SEQ ID NO: 5754406 - DNA, 13 bp, Homo sapiens
gcactgagggcca

SEQ ID NO: 5754407 - DNA, 20 bp, Homo sapiens
gcactgaggtccacagacct

SEQ ID NO: 5754408 - DNA, 18 bp, Homo sapiens
gcactgaggtttttttgc

SEQ ID NO: 5754409 - DNA, 17 bp, Homo sapiens
gcactgatctttgcaaa

SEQ ID NO: 5754410 - DNA, 12 bp, Homo sapiens
gcactgatttca

SEQ ID NO: 5754411 - DNA, 15 bp, Homo sapiens
gcactgatttcacaa

SEQ ID NO: 5754412 - DNA, 20 bp, Homo sapiens
gcactgatttcacaacagat

SEQ ID NO: 5754413 - DNA, 18 bp, Homo sapiens
gcactgcacataatttgc

SEQ ID NO: 5754414 - DNA, 20 bp, Homo sapiens
gcactgcacataatttgcat

SEQ ID NO: 5754415 - DNA, 15 bp, Homo sapiens
gcactgcagacggga

SEQ ID NO: 5754416 - DNA, 20 bp, Homo sapiens
gcactgcagccacaggggat

SEQ ID NO: 5754417 - DNA, 15 bp, Homo sapiens
gcactgcatgggaaa

SEQ ID NO: 5754418 - DNA, 18 bp, Homo sapiens
gcactgcatgtcagagca

SEQ ID NO: 5754419 - DNA, 14 bp, Homo sapiens
gcactgccaccagc

SEQ ID NO: 5754420 - DNA, 13 bp, Homo sapiens
gcactgccactgg

SEQ ID NO: 5754421 - DNA, 12 bp, Homo sapiens
gcactgccagcc

SEQ ID NO: 5754422 - DNA, 15 bp, Homo sapiens
gcactgccagcccac

SEQ ID NO: 5754423 - DNA, 18 bp, Homo sapiens
gcactgccaggagggaca

SEQ ID NO: 5754424 - DNA, 23 bp, Homo sapiens
gcactgccaggagggacaaagga

SEQ ID NO: 5754425 - DNA, 17 bp, Homo sapiens
gcactgccatgcagggc

SEQ ID NO: 5754426 - DNA, 22 bp, Homo sapiens
gcactgcccacatgggacctgg

SEQ ID NO: 5754427 - DNA, 18 bp, Homo sapiens
gcactgcccatcagtgac

SEQ ID NO: 5754428 - DNA, 14 bp, Homo sapiens
gcactgcccatccc

SEQ ID NO: 5754429 - DNA, 21 bp, Homo sapiens
gcactgcccatcccaccccat

SEQ ID NO: 5754430 - DNA, 21 bp, Homo sapiens
gcactgcccatggacaggctg

SEQ ID NO: 5754431 - DNA, 16 bp, Homo sapiens
gcactgccccacatgc

SEQ ID NO: 5754432 - DNA, 12 bp, Homo sapiens
gcactgccccct

SEQ ID NO: 5754433 - DNA, 21 bp, Homo sapiens
gcactgccccctgcttggcca

SEQ ID NO: 5754434 - DNA, 11 bp, Homo sapiens
gcactgccctc

SEQ ID NO: 5754435 - DNA, 20 bp, Homo sapiens
gcactgccctccgcccttcc

SEQ ID NO: 5754436 - DNA, 13 bp, Homo sapiens
gcactgccctggt

SEQ ID NO: 5754437 - DNA, 13 bp, Homo sapiens
gcactgcctcctg

SEQ ID NO: 5754438 - DNA, 14 bp, Homo sapiens
gcactgcctcctgt

SEQ ID NO: 5754439 - DNA, 20 bp, Homo sapiens
gcactgcctcctgttttctc

SEQ ID NO: 5754440 - DNA, 19 bp, Homo sapiens
gcactgcctctcacagctg

SEQ ID NO: 5754441 - DNA, 21 bp, Homo sapiens
gcactgcctgcatgagctggc

SEQ ID NO: 5754442 - DNA, 13 bp, Homo sapiens
gcactgccttctc

SEQ ID NO: 5754443 - DNA, 14 bp, Homo sapiens
gcactgccttctcc

SEQ ID NO: 5754444 - DNA, 23 bp, Homo sapiens
gcactgccttctcctctctgggc

SEQ ID NO: 5754445 - DNA, 13 bp, Homo sapiens
gcactgcgcctgt

SEQ ID NO: 5754446 - DNA, 21 bp, Homo sapiens
gcactgcgcgctatcccctca

SEQ ID NO: 5754447 - DNA, 16 bp, Homo sapiens
gcactgcgtacaaaca

SEQ ID NO: 5754448 - DNA, 22 bp, Homo sapiens
gcactgcgtagagcctggaagg

SEQ ID NO: 5754449 - DNA, 20 bp, Homo sapiens
gcactgctcacgtctctgcc

SEQ ID NO: 5754450 - DNA, 23 bp, Homo sapiens
gcactgctcacgtctctgccgcc

SEQ ID NO: 5754451 - DNA, 19 bp, Homo sapiens
gcactgctccaagggacag

SEQ ID NO: 5754452 - DNA, 20 bp, Homo sapiens
gcactgctccaagggacagg

SEQ ID NO: 5754453 - DNA, 15 bp, Homo sapiens
gcactgctctcacct

SEQ ID NO: 5754454 - DNA, 12 bp, Homo sapiens
gcactgctgccc

SEQ ID NO: 5754455 - DNA, 14 bp, Homo sapiens
gcactgctgcccag

SEQ ID NO: 5754456 - DNA, 18 bp, Homo sapiens
gcactgctgcccagcctc

SEQ ID NO: 5754457 - DNA, 20 bp, Homo sapiens
gcactgctgcccagcctcca

SEQ ID NO: 5754458 - DNA, 13 bp, Homo sapiens
gcactgctgggtg

SEQ ID NO: 5754459 - DNA, 15 bp, Homo sapiens
gcactgctgggtggc

SEQ ID NO: 5754460 - DNA, 21 bp, Homo sapiens
gcactgctgggtggcccatcc

SEQ ID NO: 5754461 - DNA, 22 bp, Homo sapiens
gcactgctgggtggcccatccc

SEQ ID NO: 5754462 - DNA, 11 bp, Homo sapiens
gcactgctgtg

SEQ ID NO: 5754463 - DNA, 11 bp, Homo sapiens
gcactgctgtt

SEQ ID NO: 5754464 - DNA, 12 bp, Homo sapiens
gcactgctgttc

SEQ ID NO: 5754465 - DNA, 16 bp, Homo sapiens
gcactgcttgaggagg

SEQ ID NO: 5754466 - DNA, 22 bp, Homo sapiens
gcactgcttgaggaggggcacc

SEQ ID NO: 5754467 - DNA, 17 bp, Homo sapiens
gcactgctttattttag

SEQ ID NO: 5754468 - DNA, 17 bp, Homo sapiens
gcactgctttctccttc

SEQ ID NO: 5754469 - DNA, 22 bp, Homo sapiens
gcactggaaaacatagagtaga

SEQ ID NO: 5754470 - DNA, 18 bp, Homo sapiens
gcactggaaccacctgga

SEQ ID NO: 5754471 - DNA, 18 bp, Homo sapiens
gcactggaatatctgaga

SEQ ID NO: 5754472 - DNA, 18 bp, Homo sapiens
gcactggagccacaggca

SEQ ID NO: 5754473 - DNA, 15 bp, Homo sapiens
gcactggagctggga

SEQ ID NO: 5754474 - DNA, 16 bp, Homo sapiens
gcactggagctgggag

SEQ ID NO: 5754475 - DNA, 20 bp, Homo sapiens
gcactggaggcctctgcaag

SEQ ID NO: 5754476 - DNA, 15 bp, Homo sapiens
gcactggagtgcagg

SEQ ID NO: 5754477 - DNA, 16 bp, Homo sapiens
gcactggagtgcaggg

SEQ ID NO: 5754478 - DNA, 20 bp, Homo sapiens
gcactggatggagctggagg

SEQ ID NO: 5754479 - DNA, 17 bp, Homo sapiens
gcactggcaaacagggc

SEQ ID NO: 5754480 - DNA, 13 bp, Homo sapiens
gcactggccaccc

SEQ ID NO: 5754481 - DNA, 15 bp, Homo sapiens
gcactggccagagag

SEQ ID NO: 5754482 - DNA, 20 bp, Homo sapiens
gcactggccagagagggccc

SEQ ID NO: 5754483 - DNA, 21 bp, Homo sapiens
gcactggccagagagggccca

SEQ ID NO: 5754484 - DNA, 23 bp, Homo sapiens
gcactggccagagagggcccagc

SEQ ID NO: 5754485 - DNA, 12 bp, Homo sapiens
gcactggcccag

SEQ ID NO: 5754486 - DNA, 14 bp, Homo sapiens
gcactggccccacc

SEQ ID NO: 5754487 - DNA, 16 bp, Homo sapiens
gcactggcgaggagag

SEQ ID NO: 5754488 - DNA, 12 bp, Homo sapiens
gcactggctgct

SEQ ID NO: 5754489 - DNA, 14 bp, Homo sapiens
gcactggctgctct

SEQ ID NO: 5754490 - DNA, 16 bp, Homo sapiens
gcactgggaagctgga

SEQ ID NO: 5754491 - DNA, 19 bp, Homo sapiens
gcactgggcactagctaga

SEQ ID NO: 5754492 - DNA, 12 bp, Homo sapiens
gcactgggcagg

SEQ ID NO: 5754493 - DNA, 19 bp, Homo sapiens
gcactgggcaggttcctgg

SEQ ID NO: 5754494 - DNA, 20 bp, Homo sapiens
gcactgggcaggttcctggg

SEQ ID NO: 5754495 - DNA, 14 bp, Homo sapiens
gcactgggccacgg

SEQ ID NO: 5754496 - DNA, 19 bp, Homo sapiens
gcactgggcgtctgactcc

SEQ ID NO: 5754497 - DNA, 18 bp, Homo sapiens
gcactgggctcccgggcc

SEQ ID NO: 5754498 - DNA, 12 bp, Homo sapiens
gcactgggcttg

SEQ ID NO: 5754499 - DNA, 22 bp, Homo sapiens
gcactgggcttggggaccagag

SEQ ID NO: 5754500 - DNA, 23 bp, Homo sapiens
gcactgggcttggggaccagagc

SEQ ID NO: 5754501 - DNA, 15 bp, Homo sapiens
gcactggggagcccg

SEQ ID NO: 5754502 - DNA, 19 bp, Homo sapiens
gcactggggagcccgtctc

SEQ ID NO: 5754503 - DNA, 22 bp, Homo sapiens
gcactggggagcccgtctcagt

SEQ ID NO: 5754504 - DNA, 19 bp, Homo sapiens
gcactggggcgtttcctac

SEQ ID NO: 5754505 - DNA, 16 bp, Homo sapiens
gcactgggggcagcgg

SEQ ID NO: 5754506 - DNA, 16 bp, Homo sapiens
gcactggggtaccaca

SEQ ID NO: 5754507 - DNA, 14 bp, Homo sapiens
gcactggggtgggg

SEQ ID NO: 5754508 - DNA, 18 bp, Homo sapiens
gcactgggttgcagggga

SEQ ID NO: 5754509 - DNA, 13 bp, Homo sapiens
gcactggtgccaa

SEQ ID NO: 5754510 - DNA, 22 bp, Homo sapiens
gcactggtggcccgacagcctg

SEQ ID NO: 5754511 - DNA, 24 bp, Homo sapiens
gcactggtggcccgacagcctggc

SEQ ID NO: 5754512 - DNA, 17 bp, Homo sapiens
gcactggtttgttccct

SEQ ID NO: 5754513 - DNA, 19 bp, Homo sapiens
gcactggtttgtttctcaa

SEQ ID NO: 5754514 - DNA, 14 bp, Homo sapiens
gcactgtaaatatc

SEQ ID NO: 5754515 - DNA, 20 bp, Homo sapiens
gcactgtaagacgtatgtaa

SEQ ID NO: 5754516 - DNA, 18 bp, Homo sapiens
gcactgtaaggtgcttgc

SEQ ID NO: 5754517 - DNA, 19 bp, Homo sapiens
gcactgtaatgaggaaaaa

SEQ ID NO: 5754518 - DNA, 21 bp, Homo sapiens
gcactgtacaaaaaaatcttc

SEQ ID NO: 5754519 - DNA, 19 bp, Homo sapiens
gcactgtatcatttcatgc

SEQ ID NO: 5754520 - DNA, 16 bp, Homo sapiens
gcactgtatgctggac

SEQ ID NO: 5754521 - DNA, 16 bp, Homo sapiens
gcactgtcatgcccag

SEQ ID NO: 5754522 - DNA, 18 bp, Homo sapiens
gcactgtcatgcccagct

SEQ ID NO: 5754523 - DNA, 19 bp, Homo sapiens
gcactgtcatgcccagctt

SEQ ID NO: 5754524 - DNA, 20 bp, Homo sapiens
gcactgtcatgcccagcttg

SEQ ID NO: 5754525 - DNA, 21 bp, Homo sapiens
gcactgtcatgcccagcttgg

SEQ ID NO: 5754526 - DNA, 13 bp, Homo sapiens
gcactgtccaggg

SEQ ID NO: 5754527 - DNA, 18 bp, Homo sapiens
gcactgtcccttgcctca

SEQ ID NO: 5754528 - DNA, 12 bp, Homo sapiens
gcactgtcctgc

SEQ ID NO: 5754529 - DNA, 17 bp, Homo sapiens
gcactgtctcagccaac

SEQ ID NO: 5754530 - DNA, 20 bp, Homo sapiens
gcactgtctcagtttcactt

SEQ ID NO: 5754531 - DNA, 10 bp, Homo sapiens
gcactgtctg

SEQ ID NO: 5754532 - DNA, 11 bp, Homo sapiens
gcactgtctgt

SEQ ID NO: 5754533 - DNA, 17 bp, Homo sapiens
gcactgtctgtacctaa

SEQ ID NO: 5754534 - DNA, 22 bp, Homo sapiens
gcactgtctgtacctaaagcaa

SEQ ID NO: 5754535 - DNA, 16 bp, Homo sapiens
gcactgtcttaaggca

SEQ ID NO: 5754536 - DNA, 17 bp, Homo sapiens
gcactgtgaactatttt

SEQ ID NO: 5754537 - DNA, 20 bp, Homo sapiens
gcactgtgaactattttgaa

SEQ ID NO: 5754538 - DNA, 17 bp, Homo sapiens
gcactgtgaaggaccct

SEQ ID NO: 5754539 - DNA, 18 bp, Homo sapiens
gcactgtgaaggaccctt

SEQ ID NO: 5754540 - DNA, 18 bp, Homo sapiens
gcactgtgaatcctggca

SEQ ID NO: 5754541 - DNA, 19 bp, Homo sapiens
gcactgtgacccccagctc

SEQ ID NO: 5754542 - DNA, 14 bp, Homo sapiens
gcactgtgcagccg

SEQ ID NO: 5754543 - DNA, 18 bp, Homo sapiens
gcactgtgccaagattta

SEQ ID NO: 5754544 - DNA, 14 bp, Homo sapiens
gcactgtgctaata

SEQ ID NO: 5754545 - DNA, 14 bp, Homo sapiens
gcactgtgctcagg

SEQ ID NO: 5754546 - DNA, 11 bp, Homo sapiens
gcactgtgctt

SEQ ID NO: 5754547 - DNA, 19 bp, Homo sapiens
gcactgtggaactgccacc

SEQ ID NO: 5754548 - DNA, 21 bp, Homo sapiens
gcactgtggcactgccaccag

SEQ ID NO: 5754549 - DNA, 16 bp, Homo sapiens
gcactgtgggggctgg

SEQ ID NO: 5754550 - DNA, 19 bp, Homo sapiens
gcactgtgggtagacacac

SEQ ID NO: 5754551 - DNA, 18 bp, Homo sapiens
gcactgtggtcaggccca

SEQ ID NO: 5754552 - DNA, 17 bp, Homo sapiens
gcactgtggtttcagat

SEQ ID NO: 5754553 - DNA, 21 bp, Homo sapiens
gcactgttacaagaggccatt

SEQ ID NO: 5754554 - DNA, 16 bp, Homo sapiens
gcactgttacttttta

SEQ ID NO: 5754555 - DNA, 16 bp, Homo sapiens
gcactgttcacatcat

SEQ ID NO: 5754556 - DNA, 16 bp, Homo sapiens
gcactgttccagcctg

SEQ ID NO: 5754557 - DNA, 17 bp, Homo sapiens
gcactgttgatgtatct

SEQ ID NO: 5754558 - DNA, 21 bp, Homo sapiens
gcactgttgtcatttccaaat

SEQ ID NO: 5754559 - DNA, 18 bp, Homo sapiens
gcactgtttatggaaata

SEQ ID NO: 5754560 - DNA, 19 bp, Homo sapiens
gcactgttttctagtgtat

SEQ ID NO: 5754561 - DNA, 14 bp, Homo sapiens
gcacttaaacagaa

SEQ ID NO: 5754562 - DNA, 23 bp, Homo sapiens
gcacttaaacagaagcagaggct

SEQ ID NO: 5754563 - DNA, 22 bp, Homo sapiens
gcacttaacaagctcccaggcc

SEQ ID NO: 5754564 - DNA, 13 bp, Homo sapiens
gcacttaatatta

SEQ ID NO: 5754565 - DNA, 16 bp, Homo sapiens
gcacttaatttgtaaa

SEQ ID NO: 5754566 - DNA, 17 bp, Homo sapiens
gcacttaatttgtaaac

SEQ ID NO: 5754567 - DNA, 21 bp, Homo sapiens
gcacttaatttgtaaacttct

SEQ ID NO: 5754568 - DNA, 20 bp, Homo sapiens
gcacttacacttataaaata

SEQ ID NO: 5754569 - DNA, 17 bp, Homo sapiens
gcacttacctgcttgag

SEQ ID NO: 5754570 - DNA, 22 bp, Homo sapiens
gcacttactggtaggaccaagc

SEQ ID NO: 5754571 - DNA, 16 bp, Homo sapiens
gcacttactggtcctt

SEQ ID NO: 5754572 - DNA, 16 bp, Homo sapiens
gcacttagacctgcca

SEQ ID NO: 5754573 - DNA, 20 bp, Homo sapiens
gcacttagacctgccagcca

SEQ ID NO: 5754574 - DNA, 23 bp, Homo sapiens
gcacttagacctgccagccactg

SEQ ID NO: 5754575 - DNA, 17 bp, Homo sapiens
gcacttagctatcagaa

SEQ ID NO: 5754576 - DNA, 21 bp, Homo sapiens
gcacttagtagtttttacaaa

SEQ ID NO: 5754577 - DNA, 14 bp, Homo sapiens
gcacttatatagca

SEQ ID NO: 5754578 - DNA, 16 bp, Homo sapiens
gcacttatatagcacc

SEQ ID NO: 5754579 - DNA, 20 bp, Homo sapiens
gcacttatcagcatgaagaa

SEQ ID NO: 5754580 - DNA, 13 bp, Homo sapiens
gcacttatgtact

SEQ ID NO: 5754581 - DNA, 17 bp, Homo sapiens
gcacttatgtacttgat

SEQ ID NO: 5754582 - DNA, 21 bp, Homo sapiens
gcacttatgtacttgatactg

SEQ ID NO: 5754583 - DNA, 19 bp, Homo sapiens
gcacttcaaataattaaat

SEQ ID NO: 5754584 - DNA, 14 bp, Homo sapiens
gcacttcacagagt

SEQ ID NO: 5754585 - DNA, 15 bp, Homo sapiens
gcacttcacagagtg

SEQ ID NO: 5754586 - DNA, 21 bp, Homo sapiens
gcacttcagaattccatatct

SEQ ID NO: 5754587 - DNA, 19 bp, Homo sapiens
gcacttcagggcagatttt

SEQ ID NO: 5754588 - DNA, 18 bp, Homo sapiens
gcacttcatctggctgcc

SEQ ID NO: 5754589 - DNA, 15 bp, Homo sapiens
gcacttcatgtaaag

SEQ ID NO: 5754590 - DNA, 18 bp, Homo sapiens
gcacttcatgtaaagtgt

SEQ ID NO: 5754591 - DNA, 11 bp, Homo sapiens
gcacttccaaa

SEQ ID NO: 5754592 - DNA, 12 bp, Homo sapiens
gcacttccaaaa

SEQ ID NO: 5754593 - DNA, 18 bp, Homo sapiens
gcacttccaaaattctta

SEQ ID NO: 5754594 - DNA, 17 bp, Homo sapiens
gcacttccacctccagc

SEQ ID NO: 5754595 - DNA, 21 bp, Homo sapiens
gcacttccacctccagcctct

SEQ ID NO: 5754596 - DNA, 14 bp, Homo sapiens
gcacttcccaggat

SEQ ID NO: 5754597 - DNA, 22 bp, Homo sapiens
gcacttcccaggatctgctcca

SEQ ID NO: 5754598 - DNA, 11 bp, Homo sapiens
gcacttccctg

SEQ ID NO: 5754599 - DNA, 16 bp, Homo sapiens
gcacttcctccacagt

SEQ ID NO: 5754600 - DNA, 19 bp, Homo sapiens
gcacttcctccacagtccc

SEQ ID NO: 5754601 - DNA, 20 bp, Homo sapiens
gcacttcctctcgcggccct

SEQ ID NO: 5754602 - DNA, 20 bp, Homo sapiens
gcacttcggataattttcat

SEQ ID NO: 5754603 - DNA, 17 bp, Homo sapiens
gcacttctatttagcca

SEQ ID NO: 5754604 - DNA, 21 bp, Homo sapiens
gcacttctgccatgagcagag

SEQ ID NO: 5754605 - DNA, 14 bp, Homo sapiens
gcacttctgcctga

SEQ ID NO: 5754606 - DNA, 21 bp, Homo sapiens
gcacttctgcctgaggggcag

SEQ ID NO: 5754607 - DNA, 13 bp, Homo sapiens
gcacttctgcctt

SEQ ID NO: 5754608 - DNA, 16 bp, Homo sapiens
gcacttctgctgcatc

SEQ ID NO: 5754609 - DNA, 17 bp, Homo sapiens
gcacttctggggccagc

SEQ ID NO: 5754610 - DNA, 22 bp, Homo sapiens
gcacttgagaaccagtctcctc

SEQ ID NO: 5754611 - DNA, 21 bp, Homo sapiens
gcacttgcacgcccatgtgtg

SEQ ID NO: 5754612 - DNA, 16 bp, Homo sapiens
gcacttgcagaggagc

SEQ ID NO: 5754613 - DNA, 17 bp, Homo sapiens
gcacttgcagaggagcc

SEQ ID NO: 5754614 - DNA, 21 bp, Homo sapiens
gcacttgcagaggagcccagt

SEQ ID NO: 5754615 - DNA, 23 bp, Homo sapiens
gcacttgcagaggagcccagtgg

SEQ ID NO: 5754616 - DNA, 15 bp, Homo sapiens
gcacttgcctgctgc

SEQ ID NO: 5754617 - DNA, 21 bp, Homo sapiens
gcacttgcctgttggctgctg

SEQ ID NO: 5754618 - DNA, 23 bp, Homo sapiens
gcacttgcctgttggctgctgcg

SEQ ID NO: 5754619 - DNA, 17 bp, Homo sapiens
gcacttgcgtcctgcag

SEQ ID NO: 5754620 - DNA, 18 bp, Homo sapiens
gcacttgcgtcctgcaga

SEQ ID NO: 5754621 - DNA, 13 bp, Homo sapiens
gcacttggactct

SEQ ID NO: 5754622 - DNA, 22 bp, Homo sapiens
gcacttggagccaagggttcag

SEQ ID NO: 5754623 - DNA, 23 bp, Homo sapiens
gcacttggagcgtttttgctggc

SEQ ID NO: 5754624 - DNA, 18 bp, Homo sapiens
gcacttgggggctcagca

SEQ ID NO: 5754625 - DNA, 22 bp, Homo sapiens
gcacttgggggttcaggcccgg

SEQ ID NO: 5754626 - DNA, 16 bp, Homo sapiens
gcacttggtgctgcgc

SEQ ID NO: 5754627 - DNA, 16 bp, Homo sapiens
gcacttggtgctgctt

SEQ ID NO: 5754628 - DNA, 17 bp, Homo sapiens
gcacttggtgctgcttt

SEQ ID NO: 5754629 - DNA, 18 bp, Homo sapiens
gcacttggtgctgctttg

SEQ ID NO: 5754630 - DNA, 14 bp, Homo sapiens
gcacttgtatttaa

SEQ ID NO: 5754631 - DNA, 13 bp, Homo sapiens
gcactttaaaaca

SEQ ID NO: 5754632 - DNA, 20 bp, Homo sapiens
gcactttaaccctctcttcc

SEQ ID NO: 5754633 - DNA, 23 bp, Homo sapiens
gcactttaaccctctcttcccta

SEQ ID NO: 5754634 - DNA, 16 bp, Homo sapiens
gcactttaagctcctt

SEQ ID NO: 5754635 - DNA, 16 bp, Homo sapiens
gcactttaatggcctg

SEQ ID NO: 5754636 - DNA, 16 bp, Homo sapiens
gcactttaattgaaga

SEQ ID NO: 5754637 - DNA, 18 bp, Homo sapiens
gcactttagtgattgctt

SEQ ID NO: 5754638 - DNA, 22 bp, Homo sapiens
gcactttatacacttctggctc

SEQ ID NO: 5754639 - DNA, 21 bp, Homo sapiens
gcactttcattgccagtgtct

SEQ ID NO: 5754640 - DNA, 16 bp, Homo sapiens
gcactttccaatgcca

SEQ ID NO: 5754641 - DNA, 18 bp, Homo sapiens
gcactttccaatgccaca

SEQ ID NO: 5754642 - DNA, 19 bp, Homo sapiens
gcactttccaatgccacag

SEQ ID NO: 5754643 - DNA, 21 bp, Homo sapiens
gcactttccaatgccacagac

SEQ ID NO: 5754644 - DNA, 22 bp, Homo sapiens
gcactttccaatgccacagaca

SEQ ID NO: 5754645 - DNA, 16 bp, Homo sapiens
gcactttcccccttcc

SEQ ID NO: 5754646 - DNA, 17 bp, Homo sapiens
gcactttcccccttccc

SEQ ID NO: 5754647 - DNA, 14 bp, Homo sapiens
gcactttcctttca

SEQ ID NO: 5754648 - DNA, 22 bp, Homo sapiens
gcactttcctttcaataaagtt

SEQ ID NO: 5754649 - DNA, 23 bp, Homo sapiens
gcactttcctttcaataaagttg

SEQ ID NO: 5754650 - DNA, 18 bp, Homo sapiens
gcactttcttcttcccat

SEQ ID NO: 5754651 - DNA, 15 bp, Homo sapiens
gcactttgaaaatat

SEQ ID NO: 5754652 - DNA, 13 bp, Homo sapiens
gcactttgaaata

SEQ ID NO: 5754653 - DNA, 16 bp, Homo sapiens
gcactttgaaatacct

SEQ ID NO: 5754654 - DNA, 19 bp, Homo sapiens
gcactttgagaggctgagg

SEQ ID NO: 5754655 - DNA, 15 bp, Homo sapiens
gcactttgcacttaa

SEQ ID NO: 5754656 - DNA, 17 bp, Homo sapiens
gcactttgctttaatat

SEQ ID NO: 5754657 - DNA, 16 bp, Homo sapiens
gcactttggcttataa

SEQ ID NO: 5754658 - DNA, 21 bp, Homo sapiens
gcactttggcttataattctt

SEQ ID NO: 5754659 - DNA, 17 bp, Homo sapiens
gcactttgggaggcagg

SEQ ID NO: 5754660 - DNA, 17 bp, Homo sapiens
gcactttgggaggccaa

SEQ ID NO: 5754661 - DNA, 16 bp, Homo sapiens
gcactttgggaggcct

SEQ ID NO: 5754662 - DNA, 20 bp, Homo sapiens
gcactttgggaggctgaagt

SEQ ID NO: 5754663 - DNA, 20 bp, Homo sapiens
gcactttgggaggctgaggc

SEQ ID NO: 5754664 - DNA, 21 bp, Homo sapiens
gcactttgggaggctgaggtg

SEQ ID NO: 5754665 - DNA, 11 bp, Homo sapiens
gcactttgtag

SEQ ID NO: 5754666 - DNA, 19 bp, Homo sapiens
gcactttgttctggctctt

SEQ ID NO: 5754667 - DNA, 16 bp, Homo sapiens
gcactttgtttagaaa

SEQ ID NO: 5754668 - DNA, 18 bp, Homo sapiens
gcactttgtttagaaaaa

SEQ ID NO: 5754669 - DNA, 20 bp, Homo sapiens
gcactttgtttagaaaaaaa

SEQ ID NO: 5754670 - DNA, 14 bp, Homo sapiens
gcacttttaaaaaa

SEQ ID NO: 5754671 - DNA, 19 bp, Homo sapiens
gcacttttattttcattgt

SEQ ID NO: 5754672 - DNA, 15 bp, Homo sapiens
gcacttttcattact

SEQ ID NO: 5754673 - DNA, 23 bp, Homo sapiens
gcacttttctaaactaggctcct

SEQ ID NO: 5754674 - DNA, 21 bp, Homo sapiens
gcacttttgagctcctaagct

SEQ ID NO: 5754675 - DNA, 16 bp, Homo sapiens
gcacttttgatgaaat

SEQ ID NO: 5754676 - DNA, 14 bp, Homo sapiens
gcacttttgggcct

SEQ ID NO: 5754677 - DNA, 20 bp, Homo sapiens
gcacttttgttattccatca

SEQ ID NO: 5754678 - DNA, 14 bp, Homo sapiens
gcactttttcattt

SEQ ID NO: 5754679 - DNA, 20 bp, Homo sapiens
gcacttttttatgaagaaaa

SEQ ID NO: 5754680 - DNA, 18 bp, Homo sapiens
gcacttttttgtttgaat

SEQ ID NO: 5754681 - DNA, 21 bp, Homo sapiens
gcacttttttgtttgaatgtt

SEQ ID NO: 5754682 - DNA, 11 bp, Homo sapiens
gcagaaaaaaa

SEQ ID NO: 5754683 - DNA, 20 bp, Homo sapiens
gcagaaaaaaaaaaagaaac

SEQ ID NO: 5754684 - DNA, 21 bp, Homo sapiens
gcagaaaaaaaagaaaaaagt

SEQ ID NO: 5754685 - DNA, 13 bp, Homo sapiens
gcagaaaaagaaa

SEQ ID NO: 5754686 - DNA, 22 bp, Homo sapiens
gcagaaaaagaatgtgtcttgc

SEQ ID NO: 5754687 - DNA, 16 bp, Homo sapiens
gcagaaaacagagcct

SEQ ID NO: 5754688 - DNA, 19 bp, Homo sapiens
gcagaaaacagagcctgcc

SEQ ID NO: 5754689 - DNA, 20 bp, Homo sapiens
gcagaaaacagagcctgcct

SEQ ID NO: 5754690 - DNA, 12 bp, Homo sapiens
gcagaaaacatt

SEQ ID NO: 5754691 - DNA, 13 bp, Homo sapiens
gcagaaaacattg

SEQ ID NO: 5754692 - DNA, 22 bp, Homo sapiens
gcagaaaacccttgggccagaa

SEQ ID NO: 5754693 - DNA, 21 bp, Homo sapiens
gcagaaaagcacctgccgacc

SEQ ID NO: 5754694 - DNA, 17 bp, Homo sapiens
gcagaaaagctcagagt

SEQ ID NO: 5754695 - DNA, 12 bp, Homo sapiens
gcagaaaagtgc

SEQ ID NO: 5754696 - DNA, 15 bp, Homo sapiens
gcagaaaagtgctta

SEQ ID NO: 5754697 - DNA, 21 bp, Homo sapiens
gcagaaaagtgcttagaaagt

SEQ ID NO: 5754698 - DNA, 17 bp, Homo sapiens
gcagaaaattctgtgcc

SEQ ID NO: 5754699 - DNA, 19 bp, Homo sapiens
gcagaaacacaaccactca

SEQ ID NO: 5754700 - DNA, 16 bp, Homo sapiens
gcagaaaccttgtttg

SEQ ID NO: 5754701 - DNA, 14 bp, Homo sapiens
gcagaaagattaaa

SEQ ID NO: 5754702 - DNA, 17 bp, Homo sapiens
gcagaaagatttggaaa

SEQ ID NO: 5754703 - DNA, 18 bp, Homo sapiens
gcagaaagatttggaaaa

SEQ ID NO: 5754704 - DNA, 21 bp, Homo sapiens
gcagaaagatttggaaaattc

SEQ ID NO: 5754705 - DNA, 16 bp, Homo sapiens
gcagaaagcagaggct

SEQ ID NO: 5754706 - DNA, 19 bp, Homo sapiens
gcagaaagcatccctcacc

SEQ ID NO: 5754707 - DNA, 17 bp, Homo sapiens
gcagaaagctttatatg

SEQ ID NO: 5754708 - DNA, 15 bp, Homo sapiens
gcagaaagggaaagt

SEQ ID NO: 5754709 - DNA, 17 bp, Homo sapiens
gcagaaagggagcagag

SEQ ID NO: 5754710 - DNA, 19 bp, Homo sapiens
gcagaaagggccacccatg

SEQ ID NO: 5754711 - DNA, 17 bp, Homo sapiens
gcagaaagggccttgaa

SEQ ID NO: 5754712 - DNA, 18 bp, Homo sapiens
gcagaaaggttctgcccg

SEQ ID NO: 5754713 - DNA, 18 bp, Homo sapiens
gcagaaagtaagcatttc

SEQ ID NO: 5754714 - DNA, 14 bp, Homo sapiens
gcagaaagtgcctt

SEQ ID NO: 5754715 - DNA, 19 bp, Homo sapiens
gcagaaagtgcctttcagg

SEQ ID NO: 5754716 - DNA, 20 bp, Homo sapiens
gcagaaagtgcctttcagga

SEQ ID NO: 5754717 - DNA, 16 bp, Homo sapiens
gcagaaatagacaaaa

SEQ ID NO: 5754718 - DNA, 18 bp, Homo sapiens
gcagaaatagttgtctgt

SEQ ID NO: 5754719 - DNA, 15 bp, Homo sapiens
gcagaaatataaaca

SEQ ID NO: 5754720 - DNA, 18 bp, Homo sapiens
gcagaaatcccagttcat

SEQ ID NO: 5754721 - DNA, 14 bp, Homo sapiens
gcagaaatctagaa

SEQ ID NO: 5754722 - DNA, 16 bp, Homo sapiens
gcagaaatctgaggaa

SEQ ID NO: 5754723 - DNA, 20 bp, Homo sapiens
gcagaaatgtggatgctctt

SEQ ID NO: 5754724 - DNA, 16 bp, Homo sapiens
gcagaaattctgtttt

SEQ ID NO: 5754725 - DNA, 21 bp, Homo sapiens
gcagaacaaactcagatctca

SEQ ID NO: 5754726 - DNA, 12 bp, Homo sapiens
gcagaacaaatg

SEQ ID NO: 5754727 - DNA, 15 bp, Homo sapiens
gcagaacaaatgaag

SEQ ID NO: 5754728 - DNA, 18 bp, Homo sapiens
gcagaacaaatgtgtttt

SEQ ID NO: 5754729 - DNA, 14 bp, Homo sapiens
gcagaacactaacc

SEQ ID NO: 5754730 - DNA, 15 bp, Homo sapiens
gcagaacactaacct

SEQ ID NO: 5754731 - DNA, 16 bp, Homo sapiens
gcagaacactgcagtc

SEQ ID NO: 5754732 - DNA, 20 bp, Homo sapiens
gcagaacactgcagtcagat

SEQ ID NO: 5754733 - DNA, 18 bp, Homo sapiens
gcagaacacttcagcctg

SEQ ID NO: 5754734 - DNA, 22 bp, Homo sapiens
gcagaacacttcagcctgtgca

SEQ ID NO: 5754735 - DNA, 18 bp, Homo sapiens
gcagaacagccgctcctg

SEQ ID NO: 5754736 - DNA, 21 bp, Homo sapiens
gcagaacagccgctcctgtct

SEQ ID NO: 5754737 - DNA, 23 bp, Homo sapiens
gcagaacaggtagtattacacca

SEQ ID NO: 5754738 - DNA, 12 bp, Homo sapiens
gcagaacagtga

SEQ ID NO: 5754739 - DNA, 18 bp, Homo sapiens
gcagaacagtgattacca

SEQ ID NO: 5754740 - DNA, 22 bp, Homo sapiens
gcagaacagtgattaccaggga

SEQ ID NO: 5754741 - DNA, 16 bp, Homo sapiens
gcagaacatactgttc

SEQ ID NO: 5754742 - DNA, 20 bp, Homo sapiens
gcagaaccaagaacataaac

SEQ ID NO: 5754743 - DNA, 15 bp, Homo sapiens
gcagaaccagctcta

SEQ ID NO: 5754744 - DNA, 19 bp, Homo sapiens
gcagaacccaccaaccaga

SEQ ID NO: 5754745 - DNA, 19 bp, Homo sapiens
gcagaacccccaggtggcc

SEQ ID NO: 5754746 - DNA, 20 bp, Homo sapiens
gcagaacccccaggtggcct

SEQ ID NO: 5754747 - DNA, 14 bp, Homo sapiens
gcagaaccctggtg

SEQ ID NO: 5754748 - DNA, 19 bp, Homo sapiens
gcagaaccggagagccagc

SEQ ID NO: 5754749 - DNA, 19 bp, Homo sapiens
gcagaaccggtcccagcct

SEQ ID NO: 5754750 - DNA, 15 bp, Homo sapiens
gcagaacctgcacac

SEQ ID NO: 5754751 - DNA, 18 bp, Homo sapiens
gcagaacctgcacacagg

SEQ ID NO: 5754752 - DNA, 14 bp, Homo sapiens
gcagaacctggtgg

SEQ ID NO: 5754753 - DNA, 16 bp, Homo sapiens
gcagaacctggtggct

SEQ ID NO: 5754754 - DNA, 21 bp, Homo sapiens
gcagaacctggtggctggagg

SEQ ID NO: 5754755 - DNA, 16 bp, Homo sapiens
gcagaaccttctttgg

SEQ ID NO: 5754756 - DNA, 21 bp, Homo sapiens
gcagaacgaaccttggcctgg

SEQ ID NO: 5754757 - DNA, 22 bp, Homo sapiens
gcagaacgaaccttggcctggg

SEQ ID NO: 5754758 - DNA, 16 bp, Homo sapiens
gcagaacgatgcctgc

SEQ ID NO: 5754759 - DNA, 24 bp, Homo sapiens
gcagaacggagccccaggcctctg

SEQ ID NO: 5754760 - DNA, 21 bp, Homo sapiens
gcagaacgtattggtccagct

SEQ ID NO: 5754761 - DNA, 21 bp, Homo sapiens
gcagaactcccacaaccacat

SEQ ID NO: 5754762 - DNA, 18 bp, Homo sapiens
gcagaactgagctcctct

SEQ ID NO: 5754763 - DNA, 12 bp, Homo sapiens
gcagaactgcca

SEQ ID NO: 5754764 - DNA, 19 bp, Homo sapiens
gcagaactgccattatttt

SEQ ID NO: 5754765 - DNA, 14 bp, Homo sapiens
gcagaactgctggg

SEQ ID NO: 5754766 - DNA, 23 bp, Homo sapiens
gcagaacttccctccatccaccc

SEQ ID NO: 5754767 - DNA, 23 bp, Homo sapiens
gcagaactttccagggatccagg

SEQ ID NO: 5754768 - DNA, 18 bp, Homo sapiens
gcagaagaagctgggagg

SEQ ID NO: 5754769 - DNA, 15 bp, Homo sapiens
gcagaagaatctttc

SEQ ID NO: 5754770 - DNA, 17 bp, Homo sapiens
gcagaagaatctttctt

SEQ ID NO: 5754771 - DNA, 22 bp, Homo sapiens
gcagaagaatgggaatatttta

SEQ ID NO: 5754772 - DNA, 18 bp, Homo sapiens
gcagaagacgggagggga

SEQ ID NO: 5754773 - DNA, 20 bp, Homo sapiens
gcagaagacgggaggggagg

SEQ ID NO: 5754774 - DNA, 23 bp, Homo sapiens
gcagaagacgtctccccttctct

SEQ ID NO: 5754775 - DNA, 18 bp, Homo sapiens
gcagaagactctccactg

SEQ ID NO: 5754776 - DNA, 24 bp, Homo sapiens
gcagaagagagtggggcctgccct

SEQ ID NO: 5754777 - DNA, 17 bp, Homo sapiens
gcagaagagggggaggg

SEQ ID NO: 5754778 - DNA, 14 bp, Homo sapiens
gcagaagatagaga

SEQ ID NO: 5754779 - DNA, 21 bp, Homo sapiens
gcagaagcaagggggtgatgt

SEQ ID NO: 5754780 - DNA, 15 bp, Homo sapiens
gcagaagcaataata

SEQ ID NO: 5754781 - DNA, 16 bp, Homo sapiens
gcagaagcagcaactt

SEQ ID NO: 5754782 - DNA, 13 bp, Homo sapiens
gcagaagcagccc

SEQ ID NO: 5754783 - DNA, 15 bp, Homo sapiens
gcagaagcagcccct

SEQ ID NO: 5754784 - DNA, 22 bp, Homo sapiens
gcagaagcagcccctcgaggcc

SEQ ID NO: 5754785 - DNA, 19 bp, Homo sapiens
gcagaagcattgcctggac

SEQ ID NO: 5754786 - DNA, 19 bp, Homo sapiens
gcagaagccccacagcctg

SEQ ID NO: 5754787 - DNA, 16 bp, Homo sapiens
gcagaagcgtctccct

SEQ ID NO: 5754788 - DNA, 17 bp, Homo sapiens
gcagaagcgtctccctt

SEQ ID NO: 5754789 - DNA, 21 bp, Homo sapiens
gcagaaggaaagaagggggcc

SEQ ID NO: 5754790 - DNA, 14 bp, Homo sapiens
gcagaaggaaatga

SEQ ID NO: 5754791 - DNA, 14 bp, Homo sapiens
gcagaaggaagact

SEQ ID NO: 5754792 - DNA, 12 bp, Homo sapiens
gcagaaggaagg

SEQ ID NO: 5754793 - DNA, 15 bp, Homo sapiens
gcagaaggaaggcag

SEQ ID NO: 5754794 - DNA, 16 bp, Homo sapiens
gcagaaggaaggcagg

SEQ ID NO: 5754795 - DNA, 22 bp, Homo sapiens
gcagaaggacaggtctctgaga

SEQ ID NO: 5754796 - DNA, 12 bp, Homo sapiens
gcagaaggagag

SEQ ID NO: 5754797 - DNA, 20 bp, Homo sapiens
gcagaaggccttgccttgtg

SEQ ID NO: 5754798 - DNA, 16 bp, Homo sapiens
gcagaaggctttttta

SEQ ID NO: 5754799 - DNA, 13 bp, Homo sapiens
gcagaagggagaa

SEQ ID NO: 5754800 - DNA, 22 bp, Homo sapiens
gcagaaggggaatgtgtcctcc

SEQ ID NO: 5754801 - DNA, 22 bp, Homo sapiens
gcagaagggggtggtgtctcca

SEQ ID NO: 5754802 - DNA, 20 bp, Homo sapiens
gcagaagtaggggaagaata

SEQ ID NO: 5754803 - DNA, 16 bp, Homo sapiens
gcagaagtcagcccga

SEQ ID NO: 5754804 - DNA, 14 bp, Homo sapiens
gcagaagtctggct

SEQ ID NO: 5754805 - DNA, 17 bp, Homo sapiens
gcagaagtgctctttgt

SEQ ID NO: 5754806 - DNA, 17 bp, Homo sapiens
gcagaagtgtcaccctg

SEQ ID NO: 5754807 - DNA, 14 bp, Homo sapiens
gcagaagtgtttca

SEQ ID NO: 5754808 - DNA, 18 bp, Homo sapiens
gcagaataaagcaatttt

SEQ ID NO: 5754809 - DNA, 13 bp, Homo sapiens
gcagaataaatgt

SEQ ID NO: 5754810 - DNA, 18 bp, Homo sapiens
gcagaataaatgttttac

SEQ ID NO: 5754811 - DNA, 14 bp, Homo sapiens
gcagaatagtattt

SEQ ID NO: 5754812 - DNA, 14 bp, Homo sapiens
gcagaatcctgggc

SEQ ID NO: 5754813 - DNA, 15 bp, Homo sapiens
gcagaatcctgggcc

SEQ ID NO: 5754814 - DNA, 16 bp, Homo sapiens
gcagaatcctgggccc

SEQ ID NO: 5754815 - DNA, 12 bp, Homo sapiens
gcagaatgaaga

SEQ ID NO: 5754816 - DNA, 15 bp, Homo sapiens
gcagaatgaagacct

SEQ ID NO: 5754817 - DNA, 16 bp, Homo sapiens
gcagaatgaagaccta

SEQ ID NO: 5754818 - DNA, 15 bp, Homo sapiens
gcagaatgactctgg

SEQ ID NO: 5754819 - DNA, 18 bp, Homo sapiens
gcagaatggagaaagtaa

SEQ ID NO: 5754820 - DNA, 20 bp, Homo sapiens
gcagaatggagaaagtaagt

SEQ ID NO: 5754821 - DNA, 13 bp, Homo sapiens
gcagaatgggcca

SEQ ID NO: 5754822 - DNA, 19 bp, Homo sapiens
gcagaatggtgggctccag

SEQ ID NO: 5754823 - DNA, 21 bp, Homo sapiens
gcagaatggtgggctccagag

SEQ ID NO: 5754824 - DNA, 22 bp, Homo sapiens
gcagaatggtgggctccagagt

SEQ ID NO: 5754825 - DNA, 21 bp, Homo sapiens
gcagaattcattcatacttaa

SEQ ID NO: 5754826 - DNA, 13 bp, Homo sapiens
gcagaattggaaa

SEQ ID NO: 5754827 - DNA, 14 bp, Homo sapiens
gcagaattggaaaa

SEQ ID NO: 5754828 - DNA, 23 bp, Homo sapiens
gcagaattgtttagattttgtgt

SEQ ID NO: 5754829 - DNA, 17 bp, Homo sapiens
gcagaattttaatgtga

SEQ ID NO: 5754830 - DNA, 19 bp, Homo sapiens
gcagaattttaatgtgaag

SEQ ID NO: 5754831 - DNA, 23 bp, Homo sapiens
gcagaattttatgtgactgcttt

SEQ ID NO: 5754832 - DNA, 20 bp, Homo sapiens
gcagacaaagccctgtcctt

SEQ ID NO: 5754833 - DNA, 24 bp, Homo sapiens
gcagacaacaccttcctcctgcag

SEQ ID NO: 5754834 - DNA, 16 bp, Homo sapiens
gcagacaagagctgct

SEQ ID NO: 5754835 - DNA, 20 bp, Homo sapiens
gcagacaagagggcaagcct

SEQ ID NO: 5754836 - DNA, 21 bp, Homo sapiens
gcagacaagtcttgctgtgct

SEQ ID NO: 5754837 - DNA, 23 bp, Homo sapiens
gcagacaagtcttgctgtgcttt

SEQ ID NO: 5754838 - DNA, 17 bp, Homo sapiens
gcagacaataaaccctc

SEQ ID NO: 5754839 - DNA, 15 bp, Homo sapiens
gcagacaatcttctg

SEQ ID NO: 5754840 - DNA, 12 bp, Homo sapiens
gcagacacacaa

SEQ ID NO: 5754841 - DNA, 17 bp, Homo sapiens
gcagacacacaacatca

SEQ ID NO: 5754842 - DNA, 19 bp, Homo sapiens
gcagacacacaacatcaag

SEQ ID NO: 5754843 - DNA, 18 bp, Homo sapiens
gcagacacacacatatat

SEQ ID NO: 5754844 - DNA, 13 bp, Homo sapiens
gcagacacacatg

SEQ ID NO: 5754845 - DNA, 15 bp, Homo sapiens
gcagacacacatggg

SEQ ID NO: 5754846 - DNA, 19 bp, Homo sapiens
gcagacacacatgggcagc

SEQ ID NO: 5754847 - DNA, 20 bp, Homo sapiens
gcagacacacatgggcagcc

SEQ ID NO: 5754848 - DNA, 12 bp, Homo sapiens
gcagacacaccg

SEQ ID NO: 5754849 - DNA, 13 bp, Homo sapiens
gcagacacatgct

SEQ ID NO: 5754850 - DNA, 19 bp, Homo sapiens
gcagacaccattcattcca

SEQ ID NO: 5754851 - DNA, 20 bp, Homo sapiens
gcagacacctggactgagcc

SEQ ID NO: 5754852 - DNA, 21 bp, Homo sapiens
gcagacacctggactgagcca

SEQ ID NO: 5754853 - DNA, 16 bp, Homo sapiens
gcagacacctgtgcac

SEQ ID NO: 5754854 - DNA, 19 bp, Homo sapiens
gcagacactcaagagccct

SEQ ID NO: 5754855 - DNA, 16 bp, Homo sapiens
gcagacagaaactgga

SEQ ID NO: 5754856 - DNA, 17 bp, Homo sapiens
gcagacagaaactggat

SEQ ID NO: 5754857 - DNA, 13 bp, Homo sapiens
gcagacagacaat

SEQ ID NO: 5754858 - DNA, 12 bp, Homo sapiens
gcagacagagcc

SEQ ID NO: 5754859 - DNA, 13 bp, Homo sapiens
gcagacagagcca

SEQ ID NO: 5754860 - DNA, 15 bp, Homo sapiens
gcagacagagccagg

SEQ ID NO: 5754861 - DNA, 17 bp, Homo sapiens
gcagacagagccaggag

SEQ ID NO: 5754862 - DNA, 18 bp, Homo sapiens
gcagacagagccaggaga

SEQ ID NO: 5754863 - DNA, 23 bp, Homo sapiens
gcagacagagccaggagaagctc

SEQ ID NO: 5754864 - DNA, 18 bp, Homo sapiens
gcagacagcagctcaggc

SEQ ID NO: 5754865 - DNA, 19 bp, Homo sapiens
gcagacagcaggcagcgcc

SEQ ID NO: 5754866 - DNA, 20 bp, Homo sapiens
gcagacagcaggcagcgcca

SEQ ID NO: 5754867 - DNA, 19 bp, Homo sapiens
gcagacagccatgcgtggc

SEQ ID NO: 5754868 - DNA, 16 bp, Homo sapiens
gcagacagccctggca

SEQ ID NO: 5754869 - DNA, 15 bp, Homo sapiens
gcagacagctccacc

SEQ ID NO: 5754870 - DNA, 17 bp, Homo sapiens
gcagacaggaaggaagc

SEQ ID NO: 5754871 - DNA, 12 bp, Homo sapiens
gcagacaggacc

SEQ ID NO: 5754872 - DNA, 15 bp, Homo sapiens
gcagacaggaccagg

SEQ ID NO: 5754873 - DNA, 18 bp, Homo sapiens
gcagacaggaccagggat

SEQ ID NO: 5754874 - DNA, 14 bp, Homo sapiens
gcagacaggcaagc

SEQ ID NO: 5754875 - DNA, 23 bp, Homo sapiens
gcagacaggcggggcccagcgct

SEQ ID NO: 5754876 - DNA, 23 bp, Homo sapiens
gcagacaggctggtatttaacag

SEQ ID NO: 5754877 - DNA, 17 bp, Homo sapiens
gcagacagtcaaggaga

SEQ ID NO: 5754878 - DNA, 18 bp, Homo sapiens
gcagacagtgtcagagtc

SEQ ID NO: 5754879 - DNA, 20 bp, Homo sapiens
gcagacatagaagagccaag

SEQ ID NO: 5754880 - DNA, 22 bp, Homo sapiens
gcagacatcaagctcaaggcaa

SEQ ID NO: 5754881 - DNA, 16 bp, Homo sapiens
gcagacatctctggag

SEQ ID NO: 5754882 - DNA, 16 bp, Homo sapiens
gcagacatgccttggt

SEQ ID NO: 5754883 - DNA, 21 bp, Homo sapiens
gcagacatgccttggtgccgg

SEQ ID NO: 5754884 - DNA, 20 bp, Homo sapiens
gcagacatggtggggtctcc

SEQ ID NO: 5754885 - DNA, 22 bp, Homo sapiens
gcagacattatgtaaaagaaag

SEQ ID NO: 5754886 - DNA, 19 bp, Homo sapiens
gcagacattctcaaagcct

SEQ ID NO: 5754887 - DNA, 21 bp, Homo sapiens
gcagacatttatctttgtatt

SEQ ID NO: 5754888 - DNA, 20 bp, Homo sapiens
gcagaccacgcccgtcctgc

SEQ ID NO: 5754889 - DNA, 20 bp, Homo sapiens
gcagaccacggtgtgggggg

SEQ ID NO: 5754890 - DNA, 16 bp, Homo sapiens
gcagaccaggaaggaa

SEQ ID NO: 5754891 - DNA, 24 bp, Homo sapiens
gcagaccaggaaggaagagcaagc

SEQ ID NO: 5754892 - DNA, 20 bp, Homo sapiens
gcagaccattggggctccca

SEQ ID NO: 5754893 - DNA, 21 bp, Homo sapiens
gcagaccattggggctcccag

SEQ ID NO: 5754894 - DNA, 20 bp, Homo sapiens
gcagacccatacctttccag

SEQ ID NO: 5754895 - DNA, 18 bp, Homo sapiens
gcagacccgaaaatccag

SEQ ID NO: 5754896 - DNA, 16 bp, Homo sapiens
gcagaccctgaaccca

SEQ ID NO: 5754897 - DNA, 14 bp, Homo sapiens
gcagaccctgccct

SEQ ID NO: 5754898 - DNA, 16 bp, Homo sapiens
gcagaccgggggccag

SEQ ID NO: 5754899 - DNA, 22 bp, Homo sapiens
gcagaccgggggccagacacag

SEQ ID NO: 5754900 - DNA, 23 bp, Homo sapiens
gcagaccgggggccagacacaga

SEQ ID NO: 5754901 - DNA, 12 bp, Homo sapiens
gcagacctcaag

SEQ ID NO: 5754902 - DNA, 22 bp, Homo sapiens
gcagacctcactgtcagggtct

SEQ ID NO: 5754903 - DNA, 13 bp, Homo sapiens
gcagacctcatgc

SEQ ID NO: 5754904 - DNA, 15 bp, Homo sapiens
gcagacctccccagc

SEQ ID NO: 5754905 - DNA, 19 bp, Homo sapiens
gcagacctcttagagtcct

SEQ ID NO: 5754906 - DNA, 16 bp, Homo sapiens
gcagacctggagcttc

SEQ ID NO: 5754907 - DNA, 23 bp, Homo sapiens
gcagacgaggcctttgctttaca

SEQ ID NO: 5754908 - DNA, 22 bp, Homo sapiens
gcagacgcaagaggtttcagca

SEQ ID NO: 5754909 - DNA, 22 bp, Homo sapiens
gcagacgggcaagaagctgctt

SEQ ID NO: 5754910 - DNA, 15 bp, Homo sapiens
gcagacgggcacaga

SEQ ID NO: 5754911 - DNA, 14 bp, Homo sapiens
gcagacgtccatca

SEQ ID NO: 5754912 - DNA, 16 bp, Homo sapiens
gcagacgtctggccct

SEQ ID NO: 5754913 - DNA, 20 bp, Homo sapiens
gcagacgtctggccctggcg

SEQ ID NO: 5754914 - DNA, 21 bp, Homo sapiens
gcagactagaattctagtgct

SEQ ID NO: 5754915 - DNA, 16 bp, Homo sapiens
gcagactcagctctga

SEQ ID NO: 5754916 - DNA, 17 bp, Homo sapiens
gcagactcagtttgtca

SEQ ID NO: 5754917 - DNA, 14 bp, Homo sapiens
gcagactccagccc

SEQ ID NO: 5754918 - DNA, 16 bp, Homo sapiens
gcagactcctcagatc

SEQ ID NO: 5754919 - DNA, 21 bp, Homo sapiens
gcagactcctcagatctgaac

SEQ ID NO: 5754920 - DNA, 18 bp, Homo sapiens
gcagactcgttctcgtga

SEQ ID NO: 5754921 - DNA, 16 bp, Homo sapiens
gcagactgcttggcca

SEQ ID NO: 5754922 - DNA, 19 bp, Homo sapiens
gcagactggcggagaagga

SEQ ID NO: 5754923 - DNA, 13 bp, Homo sapiens
gcagactggtggg

SEQ ID NO: 5754924 - DNA, 17 bp, Homo sapiens
gcagactgtgaacttga

SEQ ID NO: 5754925 - DNA, 22 bp, Homo sapiens
gcagactttcccaaatgtattg

SEQ ID NO: 5754926 - DNA, 21 bp, Homo sapiens
gcagactttctacatgcaaat

SEQ ID NO: 5754927 - DNA, 20 bp, Homo sapiens
gcagagaaacttaagcaaag

SEQ ID NO: 5754928 - DNA, 21 bp, Homo sapiens
gcagagaaacttaagcaaagg

SEQ ID NO: 5754929 - DNA, 22 bp, Homo sapiens
gcagagaaagaagagacaggag

SEQ ID NO: 5754930 - DNA, 17 bp, Homo sapiens
gcagagaaatgccccag

SEQ ID NO: 5754931 - DNA, 22 bp, Homo sapiens
gcagagaacagaactggaggca

SEQ ID NO: 5754932 - DNA, 13 bp, Homo sapiens
gcagagaagctgg

SEQ ID NO: 5754933 - DNA, 14 bp, Homo sapiens
gcagagaaggcttc

SEQ ID NO: 5754934 - DNA, 19 bp, Homo sapiens
gcagagaagtggagtgact

SEQ ID NO: 5754935 - DNA, 17 bp, Homo sapiens
gcagagaatctcttggg

SEQ ID NO: 5754936 - DNA, 21 bp, Homo sapiens
gcagagaatgaaagggcccag

SEQ ID NO: 5754937 - DNA, 22 bp, Homo sapiens
gcagagaatggctgggtcaggg

SEQ ID NO: 5754938 - DNA, 21 bp, Homo sapiens
gcagagacaataaaacattcc

SEQ ID NO: 5754939 - DNA, 13 bp, Homo sapiens
gcagagacactaa

SEQ ID NO: 5754940 - DNA, 15 bp, Homo sapiens
gcagagacactttgt

SEQ ID NO: 5754941 - DNA, 16 bp, Homo sapiens
gcagagacagctgttt

SEQ ID NO: 5754942 - DNA, 20 bp, Homo sapiens
gcagagaccaccgcgcccct

SEQ ID NO: 5754943 - DNA, 20 bp, Homo sapiens
gcagagaccataagagaaac

SEQ ID NO: 5754944 - DNA, 20 bp, Homo sapiens
gcagagaccatccctgaagg

SEQ ID NO: 5754945 - DNA, 19 bp, Homo sapiens
gcagagacctcctgatgtc

SEQ ID NO: 5754946 - DNA, 17 bp, Homo sapiens
gcagagacggcagcccc

SEQ ID NO: 5754947 - DNA, 13 bp, Homo sapiens
gcagagagaagcc

SEQ ID NO: 5754948 - DNA, 10 bp, Homo sapiens
gcagagagag

SEQ ID NO: 5754949 - DNA, 17 bp, Homo sapiens
gcagagagagagaaaga

SEQ ID NO: 5754950 - DNA, 21 bp, Homo sapiens
gcagagagagagagagagaaa

SEQ ID NO: 5754951 - DNA, 18 bp, Homo sapiens
gcagagagagaggacaga

SEQ ID NO: 5754952 - DNA, 15 bp, Homo sapiens
gcagagagatcttcc

SEQ ID NO: 5754953 - DNA, 17 bp, Homo sapiens
gcagagagatcttccca

SEQ ID NO: 5754954 - DNA, 17 bp, Homo sapiens
gcagagagcacctggtg

SEQ ID NO: 5754955 - DNA, 14 bp, Homo sapiens
gcagagagccaaat

SEQ ID NO: 5754956 - DNA, 16 bp, Homo sapiens
gcagagagccaaatct

SEQ ID NO: 5754957 - DNA, 21 bp, Homo sapiens
gcagagagccattttgtgaat

SEQ ID NO: 5754958 - DNA, 15 bp, Homo sapiens
gcagagaggccaggt

SEQ ID NO: 5754959 - DNA, 13 bp, Homo sapiens
gcagagaggctgt

SEQ ID NO: 5754960 - DNA, 14 bp, Homo sapiens
gcagagaggctgtg

SEQ ID NO: 5754961 - DNA, 16 bp, Homo sapiens
gcagagaggtggagaa

SEQ ID NO: 5754962 - DNA, 17 bp, Homo sapiens
gcagagaggtggccacc

SEQ ID NO: 5754963 - DNA, 16 bp, Homo sapiens
gcagagataaataaaa

SEQ ID NO: 5754964 - DNA, 21 bp, Homo sapiens
gcagagatcgacagacagcca

SEQ ID NO: 5754965 - DNA, 17 bp, Homo sapiens
gcagagatgcctccctg

SEQ ID NO: 5754966 - DNA, 15 bp, Homo sapiens
gcagagatgtactgc

SEQ ID NO: 5754967 - DNA, 22 bp, Homo sapiens
gcagagatgtactgcaaagtcg

SEQ ID NO: 5754968 - DNA, 14 bp, Homo sapiens
gcagagatgtatta

SEQ ID NO: 5754969 - DNA, 20 bp, Homo sapiens
gcagagatgtgcccccaccc

SEQ ID NO: 5754970 - DNA, 23 bp, Homo sapiens
gcagagattggaatgggcagctc

SEQ ID NO: 5754971 - DNA, 20 bp, Homo sapiens
gcagagattgggggggcttg

SEQ ID NO: 5754972 - DNA, 18 bp, Homo sapiens
gcagagcaaatgagggag

SEQ ID NO: 5754973 - DNA, 17 bp, Homo sapiens
gcagagcaagtctgcag

SEQ ID NO: 5754974 - DNA, 18 bp, Homo sapiens
gcagagcaagtctgcagg

SEQ ID NO: 5754975 - DNA, 17 bp, Homo sapiens
gcagagcaattccaggc

SEQ ID NO: 5754976 - DNA, 21 bp, Homo sapiens
gcagagcaattccaggctgag

SEQ ID NO: 5754977 - DNA, 20 bp, Homo sapiens
gcagagcacaaacttcagaa

SEQ ID NO: 5754978 - DNA, 24 bp, Homo sapiens
gcagagcaccttagacagtccctg

SEQ ID NO: 5754979 - DNA, 14 bp, Homo sapiens
gcagagcagacagg

SEQ ID NO: 5754980 - DNA, 16 bp, Homo sapiens
gcagagcagacaggct

SEQ ID NO: 5754981 - DNA, 15 bp, Homo sapiens
gcagagcagagacca

SEQ ID NO: 5754982 - DNA, 19 bp, Homo sapiens
gcagagcagcacaaagaaa

SEQ ID NO: 5754983 - DNA, 13 bp, Homo sapiens
gcagagccaaggc

SEQ ID NO: 5754984 - DNA, 16 bp, Homo sapiens
gcagagccaaggccac

SEQ ID NO: 5754985 - DNA, 18 bp, Homo sapiens
gcagagccaccagggcac

SEQ ID NO: 5754986 - DNA, 14 bp, Homo sapiens
gcagagccaggaag

SEQ ID NO: 5754987 - DNA, 19 bp, Homo sapiens
gcagagccaggctgttgga

SEQ ID NO: 5754988 - DNA, 17 bp, Homo sapiens
gcagagccagggcaggg

SEQ ID NO: 5754989 - DNA, 18 bp, Homo sapiens
gcagagccagggcagggc

SEQ ID NO: 5754990 - DNA, 22 bp, Homo sapiens
gcagagccagggcagggcgagc

SEQ ID NO: 5754991 - DNA, 22 bp, Homo sapiens
gcagagccatctgcgacaccac

SEQ ID NO: 5754992 - DNA, 14 bp, Homo sapiens
gcagagccatgggc

SEQ ID NO: 5754993 - DNA, 18 bp, Homo sapiens
gcagagccatgggcctgg

SEQ ID NO: 5754994 - DNA, 20 bp, Homo sapiens
gcagagccatgggcctgggc

SEQ ID NO: 5754995 - DNA, 18 bp, Homo sapiens
gcagagcccaccagccag

SEQ ID NO: 5754996 - DNA, 19 bp, Homo sapiens
gcagagcccaccagccagc

SEQ ID NO: 5754997 - DNA, 17 bp, Homo sapiens
gcagagcccccaggaag

SEQ ID NO: 5754998 - DNA, 17 bp, Homo sapiens
gcagagcccccatggcc

SEQ ID NO: 5754999 - DNA, 11 bp, Homo sapiens
gcagagccccg

SEQ ID NO: 5755000 - DNA, 13 bp, Homo sapiens
gcagagccccgga

SEQ ID NO: 5755001 - DNA, 20 bp, Homo sapiens
gcagagccccggagcaccac

SEQ ID NO: 5755002 - DNA, 11 bp, Homo sapiens
gcagagccctg

SEQ ID NO: 5755003 - DNA, 15 bp, Homo sapiens
gcagagcctcctggg

SEQ ID NO: 5755004 - DNA, 14 bp, Homo sapiens
gcagagcctctgag

SEQ ID NO: 5755005 - DNA, 15 bp, Homo sapiens
gcagagcctctgaga

SEQ ID NO: 5755006 - DNA, 19 bp, Homo sapiens
gcagagcctttttacctgg

SEQ ID NO: 5755007 - DNA, 21 bp, Homo sapiens
gcagagcctttttacctggcc

SEQ ID NO: 5755008 - DNA, 14 bp, Homo sapiens
gcagagcgcagccc

SEQ ID NO: 5755009 - DNA, 20 bp, Homo sapiens
gcagagcgccgtgagttctc

SEQ ID NO: 5755010 - DNA, 22 bp, Homo sapiens
gcagagcgccgtgagttctcag

SEQ ID NO: 5755011 - DNA, 14 bp, Homo sapiens
gcagagcgggaggg

SEQ ID NO: 5755012 - DNA, 17 bp, Homo sapiens
gcagagcgggagggagt

SEQ ID NO: 5755013 - DNA, 21 bp, Homo sapiens
gcagagcggggtcccctctgt

SEQ ID NO: 5755014 - DNA, 14 bp, Homo sapiens
gcagagctcagagg

SEQ ID NO: 5755015 - DNA, 14 bp, Homo sapiens
gcagagctctacag

SEQ ID NO: 5755016 - DNA, 20 bp, Homo sapiens
gcagagctctcccctcctgc

SEQ ID NO: 5755017 - DNA, 20 bp, Homo sapiens
gcagagctgacgggaggccc

SEQ ID NO: 5755018 - DNA, 18 bp, Homo sapiens
gcagagctgagggccctg

SEQ ID NO: 5755019 - DNA, 13 bp, Homo sapiens
gcagagctgagtc

SEQ ID NO: 5755020 - DNA, 18 bp, Homo sapiens
gcagagctgcacttggcc

SEQ ID NO: 5755021 - DNA, 14 bp, Homo sapiens
gcagagctggagcc

SEQ ID NO: 5755022 - DNA, 13 bp, Homo sapiens
gcagagctggctc

SEQ ID NO: 5755023 - DNA, 11 bp, Homo sapiens
gcagagctggg

SEQ ID NO: 5755024 - DNA, 13 bp, Homo sapiens
gcagagctggggc

SEQ ID NO: 5755025 - DNA, 19 bp, Homo sapiens
gcagagctggggggaaggc

SEQ ID NO: 5755026 - DNA, 11 bp, Homo sapiens
gcagagcttct

SEQ ID NO: 5755027 - DNA, 16 bp, Homo sapiens
gcagagcttcttccag

SEQ ID NO: 5755028 - DNA, 22 bp, Homo sapiens
gcagagcttcttccaggtgccc

SEQ ID NO: 5755029 - DNA, 16 bp, Homo sapiens
gcagagcttttcagat

SEQ ID NO: 5755030 - DNA, 18 bp, Homo sapiens
gcagagcttttgcatttc

SEQ ID NO: 5755031 - DNA, 12 bp, Homo sapiens
gcagaggaaaaa

SEQ ID NO: 5755032 - DNA, 16 bp, Homo sapiens
gcagaggaaaaagaaa

SEQ ID NO: 5755033 - DNA, 17 bp, Homo sapiens
gcagaggaaaaagaaaa

SEQ ID NO: 5755034 - DNA, 15 bp, Homo sapiens
gcagaggaaagacag

SEQ ID NO: 5755035 - DNA, 16 bp, Homo sapiens
gcagaggaacccccac

SEQ ID NO: 5755036 - DNA, 18 bp, Homo sapiens
gcagaggaacccccacca

SEQ ID NO: 5755037 - DNA, 15 bp, Homo sapiens
gcagaggaaggaaac

SEQ ID NO: 5755038 - DNA, 18 bp, Homo sapiens
gcagaggaatgtgggcta

SEQ ID NO: 5755039 - DNA, 11 bp, Homo sapiens
gcagaggacag

SEQ ID NO: 5755040 - DNA, 19 bp, Homo sapiens
gcagaggacagtctggaga

SEQ ID NO: 5755041 - DNA, 20 bp, Homo sapiens
gcagaggacgcacgctcgct

SEQ ID NO: 5755042 - DNA, 19 bp, Homo sapiens
gcagaggagccacctgggc

SEQ ID NO: 5755043 - DNA, 21 bp, Homo sapiens
gcagaggagccacctgggctg

SEQ ID NO: 5755044 - DNA, 14 bp, Homo sapiens
gcagaggagctgag

SEQ ID NO: 5755045 - DNA, 21 bp, Homo sapiens
gcagaggaggggccgctgcca

SEQ ID NO: 5755046 - DNA, 17 bp, Homo sapiens
gcagaggcaaggatggt

SEQ ID NO: 5755047 - DNA, 14 bp, Homo sapiens
gcagaggcagacag

SEQ ID NO: 5755048 - DNA, 15 bp, Homo sapiens
gcagaggcagacagg

SEQ ID NO: 5755049 - DNA, 20 bp, Homo sapiens
gcagaggcaggaccagaagg

SEQ ID NO: 5755050 - DNA, 17 bp, Homo sapiens
gcagaggcaggctggga

SEQ ID NO: 5755051 - DNA, 14 bp, Homo sapiens
gcagaggcagggcc

SEQ ID NO: 5755052 - DNA, 15 bp, Homo sapiens
gcagaggcagggccc

SEQ ID NO: 5755053 - DNA, 14 bp, Homo sapiens
gcagaggcagtggc

SEQ ID NO: 5755054 - DNA, 21 bp, Homo sapiens
gcagaggcccacattggaaga

SEQ ID NO: 5755055 - DNA, 15 bp, Homo sapiens
gcagaggcccgaggc

SEQ ID NO: 5755056 - DNA, 14 bp, Homo sapiens
gcagaggccctgcc

SEQ ID NO: 5755057 - DNA, 15 bp, Homo sapiens
gcagaggccctgccc

SEQ ID NO: 5755058 - DNA, 19 bp, Homo sapiens
gcagaggccctgcccccac

SEQ ID NO: 5755059 - DNA, 23 bp, Homo sapiens
gcagaggccctgcccccacccct

SEQ ID NO: 5755060 - DNA, 16 bp, Homo sapiens
gcagaggcctgaggag

SEQ ID NO: 5755061 - DNA, 13 bp, Homo sapiens
gcagaggcctgca

SEQ ID NO: 5755062 - DNA, 17 bp, Homo sapiens
gcagaggcctgcagggc

SEQ ID NO: 5755063 - DNA, 13 bp, Homo sapiens
gcagaggcctggg

SEQ ID NO: 5755064 - DNA, 19 bp, Homo sapiens
gcagaggcggaaaccttgc

SEQ ID NO: 5755065 - DNA, 21 bp, Homo sapiens
gcagaggcggaaaccttgcag

SEQ ID NO: 5755066 - DNA, 16 bp, Homo sapiens
gcagaggctgagcagg

SEQ ID NO: 5755067 - DNA, 11 bp, Homo sapiens
gcagaggctgg

SEQ ID NO: 5755068 - DNA, 21 bp, Homo sapiens
gcagaggctggaggcagggcc

SEQ ID NO: 5755069 - DNA, 15 bp, Homo sapiens
gcagaggctggcacc

SEQ ID NO: 5755070 - DNA, 16 bp, Homo sapiens
gcagaggctggcacca

SEQ ID NO: 5755071 - DNA, 22 bp, Homo sapiens
gcagaggctggcaccatggtga

SEQ ID NO: 5755072 - DNA, 11 bp, Homo sapiens
gcagaggctgt

SEQ ID NO: 5755073 - DNA, 19 bp, Homo sapiens
gcagaggctgtggctggtg

SEQ ID NO: 5755074 - DNA, 17 bp, Homo sapiens
gcagaggcttttccagt

SEQ ID NO: 5755075 - DNA, 16 bp, Homo sapiens
gcagagggagaatcca

SEQ ID NO: 5755076 - DNA, 21 bp, Homo sapiens
gcagagggagaatccaagggt

SEQ ID NO: 5755077 - DNA, 17 bp, Homo sapiens
gcagagggataacccaa

SEQ ID NO: 5755078 - DNA, 18 bp, Homo sapiens
gcagagggatgaaatgcc

SEQ ID NO: 5755079 - DNA, 19 bp, Homo sapiens
gcagagggcatcggggcca

SEQ ID NO: 5755080 - DNA, 16 bp, Homo sapiens
gcagagggctggaggc

SEQ ID NO: 5755081 - DNA, 19 bp, Homo sapiens
gcagagggctggaggccca

SEQ ID NO: 5755082 - DNA, 20 bp, Homo sapiens
gcagagggctggaggcccag

SEQ ID NO: 5755083 - DNA, 16 bp, Homo sapiens
gcagaggggagaggaa

SEQ ID NO: 5755084 - DNA, 17 bp, Homo sapiens
gcagaggggagcttgag

SEQ ID NO: 5755085 - DNA, 13 bp, Homo sapiens
gcagaggggcaga

SEQ ID NO: 5755086 - DNA, 17 bp, Homo sapiens
gcagaggggcagccgct

SEQ ID NO: 5755087 - DNA, 20 bp, Homo sapiens
gcagaggggcaggccctgca

SEQ ID NO: 5755088 - DNA, 13 bp, Homo sapiens
gcagaggggccag

SEQ ID NO: 5755089 - DNA, 17 bp, Homo sapiens
gcagaggggccaggccc

SEQ ID NO: 5755090 - DNA, 19 bp, Homo sapiens
gcagaggggccaggcccag

SEQ ID NO: 5755091 - DNA, 22 bp, Homo sapiens
gcagaggggccaggcccaggca

SEQ ID NO: 5755092 - DNA, 16 bp, Homo sapiens
gcagaggggctttctg

SEQ ID NO: 5755093 - DNA, 20 bp, Homo sapiens
gcagaggggctttctggaga

SEQ ID NO: 5755094 - DNA, 23 bp, Homo sapiens
gcagagggggagtagccaagctg

SEQ ID NO: 5755095 - DNA, 19 bp, Homo sapiens
gcagaggggtgctgctcct

SEQ ID NO: 5755096 - DNA, 18 bp, Homo sapiens
gcagagggtcactttaca

SEQ ID NO: 5755097 - DNA, 20 bp, Homo sapiens
gcagaggtaaaagtgtgagc

SEQ ID NO: 5755098 - DNA, 15 bp, Homo sapiens
gcagaggtaccctgg

SEQ ID NO: 5755099 - DNA, 15 bp, Homo sapiens
gcagaggtctgtgct

SEQ ID NO: 5755100 - DNA, 18 bp, Homo sapiens
gcagaggtctgtgctgag

SEQ ID NO: 5755101 - DNA, 15 bp, Homo sapiens
gcagaggtgagcaga

SEQ ID NO: 5755102 - DNA, 19 bp, Homo sapiens
gcagaggtgagcagaggag

SEQ ID NO: 5755103 - DNA, 16 bp, Homo sapiens
gcagaggtgattctta

SEQ ID NO: 5755104 - DNA, 14 bp, Homo sapiens
gcagaggtggaaaa

SEQ ID NO: 5755105 - DNA, 14 bp, Homo sapiens
gcagaggtggccag

SEQ ID NO: 5755106 - DNA, 18 bp, Homo sapiens
gcagaggtggggtgctgg

SEQ ID NO: 5755107 - DNA, 23 bp, Homo sapiens
gcagaggtggggtgctggggctg

SEQ ID NO: 5755108 - DNA, 20 bp, Homo sapiens
gcagaggtggtctggtgcca

SEQ ID NO: 5755109 - DNA, 22 bp, Homo sapiens
gcagaggttgcagtgagctgag

SEQ ID NO: 5755110 - DNA, 16 bp, Homo sapiens
gcagaggtttcttgaa

SEQ ID NO: 5755111 - DNA, 18 bp, Homo sapiens
gcagaggtttgctgacag

SEQ ID NO: 5755112 - DNA, 23 bp, Homo sapiens
gcagagtaaattgctctgttccc

SEQ ID NO: 5755113 - DNA, 16 bp, Homo sapiens
gcagagtaacaggatc

SEQ ID NO: 5755114 - DNA, 21 bp, Homo sapiens
gcagagtagctgcttcctgga

SEQ ID NO: 5755115 - DNA, 22 bp, Homo sapiens
gcagagtatacaagtgtttcta

SEQ ID NO: 5755116 - DNA, 12 bp, Homo sapiens
gcagagtatttg

SEQ ID NO: 5755117 - DNA, 16 bp, Homo sapiens
gcagagtcaagctgat

SEQ ID NO: 5755118 - DNA, 22 bp, Homo sapiens
gcagagtcaagctgatgaagtt

SEQ ID NO: 5755119 - DNA, 18 bp, Homo sapiens
gcagagtcacaagcctcg

SEQ ID NO: 5755120 - DNA, 13 bp, Homo sapiens
gcagagtcagcag

SEQ ID NO: 5755121 - DNA, 14 bp, Homo sapiens
gcagagtcagcaga

SEQ ID NO: 5755122 - DNA, 14 bp, Homo sapiens
gcagagtctgggcc

SEQ ID NO: 5755123 - DNA, 15 bp, Homo sapiens
gcagagtctgggcct

SEQ ID NO: 5755124 - DNA, 13 bp, Homo sapiens
gcagagtctgtct

SEQ ID NO: 5755125 - DNA, 19 bp, Homo sapiens
gcagagtgaaattcaattc

SEQ ID NO: 5755126 - DNA, 17 bp, Homo sapiens
gcagagtgagcaagggg

SEQ ID NO: 5755127 - DNA, 22 bp, Homo sapiens
gcagagtgagcaagggggccca

SEQ ID NO: 5755128 - DNA, 22 bp, Homo sapiens
gcagagtgagggggtaaagcag

SEQ ID NO: 5755129 - DNA, 17 bp, Homo sapiens
gcagagtgccccacctg

SEQ ID NO: 5755130 - DNA, 19 bp, Homo sapiens
gcagagtggaaactcagcc

SEQ ID NO: 5755131 - DNA, 14 bp, Homo sapiens
gcagagtggactgc

SEQ ID NO: 5755132 - DNA, 15 bp, Homo sapiens
gcagagtggagccca

SEQ ID NO: 5755133 - DNA, 21 bp, Homo sapiens
gcagagtggagcccagggtgc

SEQ ID NO: 5755134 - DNA, 13 bp, Homo sapiens
gcagagtggcagt

SEQ ID NO: 5755135 - DNA, 18 bp, Homo sapiens
gcagagtggcctagagca

SEQ ID NO: 5755136 - DNA, 13 bp, Homo sapiens
gcagagtggcctg

SEQ ID NO: 5755137 - DNA, 19 bp, Homo sapiens
gcagagtggcctgtgagca

SEQ ID NO: 5755138 - DNA, 21 bp, Homo sapiens
gcagagtgggacttggagagc

SEQ ID NO: 5755139 - DNA, 14 bp, Homo sapiens
gcagagtgggctgc

SEQ ID NO: 5755140 - DNA, 17 bp, Homo sapiens
gcagagtgggctgcctg

SEQ ID NO: 5755141 - DNA, 19 bp, Homo sapiens
gcagagtgggctgcctggg

SEQ ID NO: 5755142 - DNA, 22 bp, Homo sapiens
gcagagtgggctgcctggggat

SEQ ID NO: 5755143 - DNA, 20 bp, Homo sapiens
gcagagttacagttctgtgg

SEQ ID NO: 5755144 - DNA, 13 bp, Homo sapiens
gcagagttacttg

SEQ ID NO: 5755145 - DNA, 14 bp, Homo sapiens
gcagagttcaggga

SEQ ID NO: 5755146 - DNA, 23 bp, Homo sapiens
gcagagttctcctggaggcaggg

SEQ ID NO: 5755147 - DNA, 19 bp, Homo sapiens
gcagagttgaagacagagc

SEQ ID NO: 5755148 - DNA, 21 bp, Homo sapiens
gcagagttgaagacagagcta

SEQ ID NO: 5755149 - DNA, 13 bp, Homo sapiens
gcagagttgtaaa

SEQ ID NO: 5755150 - DNA, 17 bp, Homo sapiens
gcagagttgtaaatata

SEQ ID NO: 5755151 - DNA, 14 bp, Homo sapiens
gcagagttttcatt

SEQ ID NO: 5755152 - DNA, 18 bp, Homo sapiens
gcagataaacagtagtga

SEQ ID NO: 5755153 - DNA, 15 bp, Homo sapiens
gcagataaatacatt

SEQ ID NO: 5755154 - DNA, 18 bp, Homo sapiens
gcagataaatacatttat

SEQ ID NO: 5755155 - DNA, 20 bp, Homo sapiens
gcagataacatttgtgtgtt

SEQ ID NO: 5755156 - DNA, 19 bp, Homo sapiens
gcagataagttggagcagg

SEQ ID NO: 5755157 - DNA, 16 bp, Homo sapiens
gcagataattctggac

SEQ ID NO: 5755158 - DNA, 18 bp, Homo sapiens
gcagataattctggacca

SEQ ID NO: 5755159 - DNA, 22 bp, Homo sapiens
gcagatacaggaaaagctgctg

SEQ ID NO: 5755160 - DNA, 18 bp, Homo sapiens
gcagatacctcaccctgc

SEQ ID NO: 5755161 - DNA, 17 bp, Homo sapiens
gcagatactactgacca

SEQ ID NO: 5755162 - DNA, 22 bp, Homo sapiens
gcagatagaatttggcccagag

SEQ ID NO: 5755163 - DNA, 23 bp, Homo sapiens
gcagatagaatttggcccagaga

SEQ ID NO: 5755164 - DNA, 17 bp, Homo sapiens
gcagatagccagacaca

SEQ ID NO: 5755165 - DNA, 15 bp, Homo sapiens
gcagatagcccagga

SEQ ID NO: 5755166 - DNA, 16 bp, Homo sapiens
gcagatagtgcctctg

SEQ ID NO: 5755167 - DNA, 18 bp, Homo sapiens
gcagatagtgcctctgca

SEQ ID NO: 5755168 - DNA, 23 bp, Homo sapiens
gcagatatagcattaataaaact

SEQ ID NO: 5755169 - DNA, 16 bp, Homo sapiens
gcagatcacctgaggt

SEQ ID NO: 5755170 - DNA, 18 bp, Homo sapiens
gcagatccacctgcacaa

SEQ ID NO: 5755171 - DNA, 22 bp, Homo sapiens
gcagatccacctgcacaaacat

SEQ ID NO: 5755172 - DNA, 23 bp, Homo sapiens
gcagatccacctgcacaaacata

SEQ ID NO: 5755173 - DNA, 12 bp, Homo sapiens
gcagatcccagc

SEQ ID NO: 5755174 - DNA, 15 bp, Homo sapiens
gcagatcccagccca

SEQ ID NO: 5755175 - DNA, 19 bp, Homo sapiens
gcagatcccagcccaccct

SEQ ID NO: 5755176 - DNA, 20 bp, Homo sapiens
gcagatcccagcccaccctg

SEQ ID NO: 5755177 - DNA, 14 bp, Homo sapiens
gcagatcccagctc

SEQ ID NO: 5755178 - DNA, 16 bp, Homo sapiens
gcagatcctctggaca

SEQ ID NO: 5755179 - DNA, 15 bp, Homo sapiens
gcagatcctgtccca

SEQ ID NO: 5755180 - DNA, 16 bp, Homo sapiens
gcagatcgtgccgtgg

SEQ ID NO: 5755181 - DNA, 19 bp, Homo sapiens
gcagatctacatgtctaga

SEQ ID NO: 5755182 - DNA, 14 bp, Homo sapiens
gcagatctagccag

SEQ ID NO: 5755183 - DNA, 18 bp, Homo sapiens
gcagatctagccaggcct

SEQ ID NO: 5755184 - DNA, 12 bp, Homo sapiens
gcagatctcatg

SEQ ID NO: 5755185 - DNA, 23 bp, Homo sapiens
gcagatctgaaaggcacactttg

SEQ ID NO: 5755186 - DNA, 15 bp, Homo sapiens
gcagatctgtgcctg

SEQ ID NO: 5755187 - DNA, 22 bp, Homo sapiens
gcagatcttccgtggtcagagt

SEQ ID NO: 5755188 - DNA, 21 bp, Homo sapiens
gcagatctttaaatacagtca

SEQ ID NO: 5755189 - DNA, 12 bp, Homo sapiens
gcagatcttttc

SEQ ID NO: 5755190 - DNA, 15 bp, Homo sapiens
gcagatcttttcttt

SEQ ID NO: 5755191 - DNA, 18 bp, Homo sapiens
gcagatcttttctttaaa

SEQ ID NO: 5755192 - DNA, 16 bp, Homo sapiens
gcagatgaaaagctac

SEQ ID NO: 5755193 - DNA, 14 bp, Homo sapiens
gcagatgacaagat

SEQ ID NO: 5755194 - DNA, 15 bp, Homo sapiens
gcagatgacagaggt

SEQ ID NO: 5755195 - DNA, 20 bp, Homo sapiens
gcagatgacctcgtactcag

SEQ ID NO: 5755196 - DNA, 22 bp, Homo sapiens
gcagatgacctcgtactcagga

SEQ ID NO: 5755197 - DNA, 17 bp, Homo sapiens
gcagatgagagtttctg

SEQ ID NO: 5755198 - DNA, 23 bp, Homo sapiens
gcagatgaggtgaaaaggccaag

SEQ ID NO: 5755199 - DNA, 14 bp, Homo sapiens
gcagatgaggttgc

SEQ ID NO: 5755200 - DNA, 16 bp, Homo sapiens
gcagatgataaaagga

SEQ ID NO: 5755201 - DNA, 19 bp, Homo sapiens
gcagatgatttgggcagag

SEQ ID NO: 5755202 - DNA, 15 bp, Homo sapiens
gcagatgcaaagagg

SEQ ID NO: 5755203 - DNA, 19 bp, Homo sapiens
gcagatgcaaagaggcaag

SEQ ID NO: 5755204 - DNA, 19 bp, Homo sapiens
gcagatgcaatgactcagg

SEQ ID NO: 5755205 - DNA, 18 bp, Homo sapiens
gcagatgcagagagccat

SEQ ID NO: 5755206 - DNA, 14 bp, Homo sapiens
gcagatgcagctct

SEQ ID NO: 5755207 - DNA, 19 bp, Homo sapiens
gcagatgcagctcttcctg

SEQ ID NO: 5755208 - DNA, 17 bp, Homo sapiens
gcagatgccaccctagc

SEQ ID NO: 5755209 - DNA, 18 bp, Homo sapiens
gcagatgccaccctagcc

SEQ ID NO: 5755210 - DNA, 14 bp, Homo sapiens
gcagatgccagagc

SEQ ID NO: 5755211 - DNA, 16 bp, Homo sapiens
gcagatgccagtgaag

SEQ ID NO: 5755212 - DNA, 23 bp, Homo sapiens
gcagatgccattttgtacatgta

SEQ ID NO: 5755213 - DNA, 16 bp, Homo sapiens
gcagatgcccttgctg

SEQ ID NO: 5755214 - DNA, 17 bp, Homo sapiens
gcagatgcccttgctgg

SEQ ID NO: 5755215 - DNA, 18 bp, Homo sapiens
gcagatgcccttgctggg

SEQ ID NO: 5755216 - DNA, 21 bp, Homo sapiens
gcagatgctgctgaagagagg

SEQ ID NO: 5755217 - DNA, 15 bp, Homo sapiens
gcagatgctggtcat

SEQ ID NO: 5755218 - DNA, 23 bp, Homo sapiens
gcagatgctgtcactggcagagc

SEQ ID NO: 5755219 - DNA, 24 bp, Homo sapiens
gcagatgctgtcactggcagagca

SEQ ID NO: 5755220 - DNA, 21 bp, Homo sapiens
gcagatgctgttgtgaagcta

SEQ ID NO: 5755221 - DNA, 15 bp, Homo sapiens
gcagatgctttgccc

SEQ ID NO: 5755222 - DNA, 23 bp, Homo sapiens
gcagatggacagcgatgagggga

SEQ ID NO: 5755223 - DNA, 13 bp, Homo sapiens
gcagatgggacaa

SEQ ID NO: 5755224 - DNA, 12 bp, Homo sapiens
gcagatgggctg

SEQ ID NO: 5755225 - DNA, 19 bp, Homo sapiens
gcagatgggggcctctctg

SEQ ID NO: 5755226 - DNA, 14 bp, Homo sapiens
gcagatgtaggagg

SEQ ID NO: 5755227 - DNA, 16 bp, Homo sapiens
gcagatgtaggaggga

SEQ ID NO: 5755228 - DNA, 19 bp, Homo sapiens
gcagatgtcccccactgct

SEQ ID NO: 5755229 - DNA, 18 bp, Homo sapiens
gcagatgtccttgatgct

SEQ ID NO: 5755230 - DNA, 16 bp, Homo sapiens
gcagatgtcttccctg

SEQ ID NO: 5755231 - DNA, 17 bp, Homo sapiens
gcagatgtcttccctgg

SEQ ID NO: 5755232 - DNA, 18 bp, Homo sapiens
gcagatgtcttccctggg

SEQ ID NO: 5755233 - DNA, 23 bp, Homo sapiens
gcagatgtgagccaccgtgcctg

SEQ ID NO: 5755234 - DNA, 13 bp, Homo sapiens
gcagatgttcaaa

SEQ ID NO: 5755235 - DNA, 19 bp, Homo sapiens
gcagatgttcaaatattgt

SEQ ID NO: 5755236 - DNA, 18 bp, Homo sapiens
gcagatgtttaatgaagt

SEQ ID NO: 5755237 - DNA, 19 bp, Homo sapiens
gcagatgttttgggggaac

SEQ ID NO: 5755238 - DNA, 13 bp, Homo sapiens
gcagattaataac

SEQ ID NO: 5755239 - DNA, 19 bp, Homo sapiens
gcagattaataacagaaat

SEQ ID NO: 5755240 - DNA, 21 bp, Homo sapiens
gcagattaataacagaaatac

SEQ ID NO: 5755241 - DNA, 13 bp, Homo sapiens
gcagattagcagg

SEQ ID NO: 5755242 - DNA, 16 bp, Homo sapiens
gcagattattcactga

SEQ ID NO: 5755243 - DNA, 19 bp, Homo sapiens
gcagattcagaaatgaggc

SEQ ID NO: 5755244 - DNA, 12 bp, Homo sapiens
gcagattccaca

SEQ ID NO: 5755245 - DNA, 15 bp, Homo sapiens
gcagattcctgggcc

SEQ ID NO: 5755246 - DNA, 22 bp, Homo sapiens
gcagattcctgggcctgtcccc

SEQ ID NO: 5755247 - DNA, 12 bp, Homo sapiens
gcagattccttt

SEQ ID NO: 5755248 - DNA, 21 bp, Homo sapiens
gcagattcggaccactaggcc

SEQ ID NO: 5755249 - DNA, 21 bp, Homo sapiens
gcagattctaggacctgtgtc

SEQ ID NO: 5755250 - DNA, 21 bp, Homo sapiens
gcagattctcccttgctctgc

SEQ ID NO: 5755251 - DNA, 23 bp, Homo sapiens
gcagattctgagcaaaggccctg

SEQ ID NO: 5755252 - DNA, 16 bp, Homo sapiens
gcagattgaagcattt

SEQ ID NO: 5755253 - DNA, 22 bp, Homo sapiens
gcagattgaatatatatgatga

SEQ ID NO: 5755254 - DNA, 19 bp, Homo sapiens
gcagattgagacctacagg

SEQ ID NO: 5755255 - DNA, 14 bp, Homo sapiens
gcagattggaagga

SEQ ID NO: 5755256 - DNA, 16 bp, Homo sapiens
gcagattggaaggaga

SEQ ID NO: 5755257 - DNA, 22 bp, Homo sapiens
gcagattggaaggagacacaga

SEQ ID NO: 5755258 - DNA, 20 bp, Homo sapiens
gcagattgggctggctctga

SEQ ID NO: 5755259 - DNA, 22 bp, Homo sapiens
gcagattggttcatgcctgggg

SEQ ID NO: 5755260 - DNA, 23 bp, Homo sapiens
gcagatttagtgaaagctagaga

SEQ ID NO: 5755261 - DNA, 15 bp, Homo sapiens
gcagatttcctgtgt

SEQ ID NO: 5755262 - DNA, 15 bp, Homo sapiens
gcagatttctcacct

SEQ ID NO: 5755263 - DNA, 13 bp, Homo sapiens
gcagatttgcaac

SEQ ID NO: 5755264 - DNA, 15 bp, Homo sapiens
gcagatttgcaacag

SEQ ID NO: 5755265 - DNA, 20 bp, Homo sapiens
gcagattttacaaaagatgt

SEQ ID NO: 5755266 - DNA, 16 bp, Homo sapiens
gcagattttacagagc

SEQ ID NO: 5755267 - DNA, 21 bp, Homo sapiens
gcagattttggttggttttta

SEQ ID NO: 5755268 - DNA, 14 bp, Homo sapiens
gcagcaaaataata

SEQ ID NO: 5755269 - DNA, 22 bp, Homo sapiens
gcagcaaacactccaccctcca

SEQ ID NO: 5755270 - DNA, 15 bp, Homo sapiens
gcagcaaagcagctg

SEQ ID NO: 5755271 - DNA, 14 bp, Homo sapiens
gcagcaaagtgtca

SEQ ID NO: 5755272 - DNA, 18 bp, Homo sapiens
gcagcaaatgccactctg

SEQ ID NO: 5755273 - DNA, 22 bp, Homo sapiens
gcagcaacaactgtcagttcat

SEQ ID NO: 5755274 - DNA, 15 bp, Homo sapiens
gcagcaacacccaag

SEQ ID NO: 5755275 - DNA, 16 bp, Homo sapiens
gcagcaacacccaagt

SEQ ID NO: 5755276 - DNA, 15 bp, Homo sapiens
gcagcaaccagagca

SEQ ID NO: 5755277 - DNA, 12 bp, Homo sapiens
gcagcaactccc

SEQ ID NO: 5755278 - DNA, 17 bp, Homo sapiens
gcagcaactgaaaatga

SEQ ID NO: 5755279 - DNA, 19 bp, Homo sapiens
gcagcaactgaaaatgaat

SEQ ID NO: 5755280 - DNA, 18 bp, Homo sapiens
gcagcaacttgtcctagc

SEQ ID NO: 5755281 - DNA, 19 bp, Homo sapiens
gcagcaacttgtcctagca

SEQ ID NO: 5755282 - DNA, 14 bp, Homo sapiens
gcagcaagaaaaaa

SEQ ID NO: 5755283 - DNA, 19 bp, Homo sapiens
gcagcaagaaaaaaaaatg

SEQ ID NO: 5755284 - DNA, 15 bp, Homo sapiens
gcagcaagaagcagc

SEQ ID NO: 5755285 - DNA, 18 bp, Homo sapiens
gcagcaagaagcagcctg

SEQ ID NO: 5755286 - DNA, 19 bp, Homo sapiens
gcagcaagaagcagcctgt

SEQ ID NO: 5755287 - DNA, 14 bp, Homo sapiens
gcagcaagcaattc

SEQ ID NO: 5755288 - DNA, 17 bp, Homo sapiens
gcagcaagcctggcccc

SEQ ID NO: 5755289 - DNA, 16 bp, Homo sapiens
gcagcaaggcccgagc

SEQ ID NO: 5755290 - DNA, 15 bp, Homo sapiens
gcagcaagggacctg

SEQ ID NO: 5755291 - DNA, 15 bp, Homo sapiens
gcagcaaggtcatgg

SEQ ID NO: 5755292 - DNA, 21 bp, Homo sapiens
gcagcaaggtcttgctctcct

SEQ ID NO: 5755293 - DNA, 17 bp, Homo sapiens
gcagcaaggtgggggtc

SEQ ID NO: 5755294 - DNA, 22 bp, Homo sapiens
gcagcaagtacaaaaggagaag

SEQ ID NO: 5755295 - DNA, 20 bp, Homo sapiens
gcagcaagttcatacaacat

SEQ ID NO: 5755296 - DNA, 17 bp, Homo sapiens
gcagcaatctgtcttta

SEQ ID NO: 5755297 - DNA, 12 bp, Homo sapiens
gcagcaatttaa

SEQ ID NO: 5755298 - DNA, 23 bp, Homo sapiens
gcagcacaaacattgctgccttt

SEQ ID NO: 5755299 - DNA, 18 bp, Homo sapiens
gcagcacacctctggggg

SEQ ID NO: 5755300 - DNA, 14 bp, Homo sapiens
gcagcacagcccag

SEQ ID NO: 5755301 - DNA, 19 bp, Homo sapiens
gcagcacagcccagggcct

SEQ ID NO: 5755302 - DNA, 22 bp, Homo sapiens
gcagcacagctactcagatctg

SEQ ID NO: 5755303 - DNA, 15 bp, Homo sapiens
gcagcacaggaggct

SEQ ID NO: 5755304 - DNA, 15 bp, Homo sapiens
gcagcacaggagggc

SEQ ID NO: 5755305 - DNA, 16 bp, Homo sapiens
gcagcacatttccgct

SEQ ID NO: 5755306 - DNA, 14 bp, Homo sapiens
gcagcaccaaccac

SEQ ID NO: 5755307 - DNA, 14 bp, Homo sapiens
gcagcaccacactg

SEQ ID NO: 5755308 - DNA, 14 bp, Homo sapiens
gcagcaccaccaca

SEQ ID NO: 5755309 - DNA, 13 bp, Homo sapiens
gcagcaccagcct

SEQ ID NO: 5755310 - DNA, 14 bp, Homo sapiens
gcagcaccagcctg

SEQ ID NO: 5755311 - DNA, 15 bp, Homo sapiens
gcagcaccagcctga

SEQ ID NO: 5755312 - DNA, 20 bp, Homo sapiens
gcagcaccagcctgagccac

SEQ ID NO: 5755313 - DNA, 22 bp, Homo sapiens
gcagcaccagcctgagccacag

SEQ ID NO: 5755314 - DNA, 17 bp, Homo sapiens
gcagcacccacagcacc

SEQ ID NO: 5755315 - DNA, 19 bp, Homo sapiens
gcagcaccctataaatcaa

SEQ ID NO: 5755316 - DNA, 21 bp, Homo sapiens
gcagcacccttctcggagacc

SEQ ID NO: 5755317 - DNA, 20 bp, Homo sapiens
gcagcaccctttcaccccca

SEQ ID NO: 5755318 - DNA, 16 bp, Homo sapiens
gcagcaccgaggggcc

SEQ ID NO: 5755319 - DNA, 15 bp, Homo sapiens
gcagcacctccaggc

SEQ ID NO: 5755320 - DNA, 17 bp, Homo sapiens
gcagcacctccaggcct

SEQ ID NO: 5755321 - DNA, 14 bp, Homo sapiens
gcagcacctccggg

SEQ ID NO: 5755322 - DNA, 22 bp, Homo sapiens
gcagcacctccgggactgacct

SEQ ID NO: 5755323 - DNA, 19 bp, Homo sapiens
gcagcacctcctcagcctg

SEQ ID NO: 5755324 - DNA, 14 bp, Homo sapiens
gcagcacctgccct

SEQ ID NO: 5755325 - DNA, 13 bp, Homo sapiens
gcagcacctttct

SEQ ID NO: 5755326 - DNA, 18 bp, Homo sapiens
gcagcacctttctctgag

SEQ ID NO: 5755327 - DNA, 20 bp, Homo sapiens
gcagcacgcaggcggggcag

SEQ ID NO: 5755328 - DNA, 15 bp, Homo sapiens
gcagcacgcatgtcc

SEQ ID NO: 5755329 - DNA, 21 bp, Homo sapiens
gcagcacgcatgtccctccaa

SEQ ID NO: 5755330 - DNA, 22 bp, Homo sapiens
gcagcacgcatgtccctccaag

SEQ ID NO: 5755331 - DNA, 16 bp, Homo sapiens
gcagcacgcctctccc

SEQ ID NO: 5755332 - DNA, 21 bp, Homo sapiens
gcagcacgcctctccccacct

SEQ ID NO: 5755333 - DNA, 21 bp, Homo sapiens
gcagcacggcccggcccctca

SEQ ID NO: 5755334 - DNA, 22 bp, Homo sapiens
gcagcacggcccggcccctcac

SEQ ID NO: 5755335 - DNA, 16 bp, Homo sapiens
gcagcactcacacagg

SEQ ID NO: 5755336 - DNA, 15 bp, Homo sapiens
gcagcactcccgctg

SEQ ID NO: 5755337 - DNA, 20 bp, Homo sapiens
gcagcactcccgctgcacac

SEQ ID NO: 5755338 - DNA, 15 bp, Homo sapiens
gcagcactgctgcct

SEQ ID NO: 5755339 - DNA, 22 bp, Homo sapiens
gcagcactggaaccacctggac

SEQ ID NO: 5755340 - DNA, 18 bp, Homo sapiens
gcagcactgggaagctgg

SEQ ID NO: 5755341 - DNA, 21 bp, Homo sapiens
gcagcactgggaagctggagt

SEQ ID NO: 5755342 - DNA, 17 bp, Homo sapiens
gcagcacttagacctgc

SEQ ID NO: 5755343 - DNA, 19 bp, Homo sapiens
gcagcacttagacctgcca

SEQ ID NO: 5755344 - DNA, 20 bp, Homo sapiens
gcagcacttagacctgccag

SEQ ID NO: 5755345 - DNA, 21 bp, Homo sapiens
gcagcacttagacctgccagc

SEQ ID NO: 5755346 - DNA, 22 bp, Homo sapiens
gcagcacttagacctgccagcc

SEQ ID NO: 5755347 - DNA, 21 bp, Homo sapiens
gcagcactttaaccctctctt

SEQ ID NO: 5755348 - DNA, 14 bp, Homo sapiens
gcagcagaaaactt

SEQ ID NO: 5755349 - DNA, 16 bp, Homo sapiens
gcagcagaaccttggc

SEQ ID NO: 5755350 - DNA, 15 bp, Homo sapiens
gcagcagaagggggt

SEQ ID NO: 5755351 - DNA, 13 bp, Homo sapiens
gcagcagacacat

SEQ ID NO: 5755352 - DNA, 15 bp, Homo sapiens
gcagcagagaaccat

SEQ ID NO: 5755353 - DNA, 11 bp, Homo sapiens
gcagcagagag

SEQ ID NO: 5755354 - DNA, 20 bp, Homo sapiens
gcagcagagagaaataaaac

SEQ ID NO: 5755355 - DNA, 15 bp, Homo sapiens
gcagcagagagagag

SEQ ID NO: 5755356 - DNA, 17 bp, Homo sapiens
gcagcagagagccctgg

SEQ ID NO: 5755357 - DNA, 22 bp, Homo sapiens
gcagcagagagccctgggtgac

SEQ ID NO: 5755358 - DNA, 12 bp, Homo sapiens
gcagcagaggag

SEQ ID NO: 5755359 - DNA, 15 bp, Homo sapiens
gcagcagaggtgaga

SEQ ID NO: 5755360 - DNA, 21 bp, Homo sapiens
gcagcagagtgagcaaggggg

SEQ ID NO: 5755361 - DNA, 15 bp, Homo sapiens
gcagcagataacttt

SEQ ID NO: 5755362 - DNA, 19 bp, Homo sapiens
gcagcagcacctttctctg

SEQ ID NO: 5755363 - DNA, 12 bp, Homo sapiens
gcagcagcactt

SEQ ID NO: 5755364 - DNA, 21 bp, Homo sapiens
gcagcagcacttagacctgcc

SEQ ID NO: 5755365 - DNA, 22 bp, Homo sapiens
gcagcagcacttagacctgcca

SEQ ID NO: 5755366 - DNA, 15 bp, Homo sapiens
gcagcagcagcagca

SEQ ID NO: 5755367 - DNA, 17 bp, Homo sapiens
gcagcagcagcagcagt

SEQ ID NO: 5755368 - DNA, 13 bp, Homo sapiens
gcagcagcaggtg

SEQ ID NO: 5755369 - DNA, 15 bp, Homo sapiens
gcagcagcaggtgat

SEQ ID NO: 5755370 - DNA, 21 bp, Homo sapiens
gcagcagccactgcacaggag

SEQ ID NO: 5755371 - DNA, 19 bp, Homo sapiens
gcagcagccagcaccacct

SEQ ID NO: 5755372 - DNA, 14 bp, Homo sapiens
gcagcagccagccc

SEQ ID NO: 5755373 - DNA, 15 bp, Homo sapiens
gcagcagccagccct

SEQ ID NO: 5755374 - DNA, 17 bp, Homo sapiens
gcagcagccagccctgc

SEQ ID NO: 5755375 - DNA, 18 bp, Homo sapiens
gcagcagccagccctgcc

SEQ ID NO: 5755376 - DNA, 21 bp, Homo sapiens
gcagcagccagccctgcctgg

SEQ ID NO: 5755377 - DNA, 14 bp, Homo sapiens
gcagcagccatcat

SEQ ID NO: 5755378 - DNA, 14 bp, Homo sapiens
gcagcagcccaagc

SEQ ID NO: 5755379 - DNA, 13 bp, Homo sapiens
gcagcagcccagc

SEQ ID NO: 5755380 - DNA, 19 bp, Homo sapiens
gcagcagcccagcttcctg

SEQ ID NO: 5755381 - DNA, 22 bp, Homo sapiens
gcagcagcccccagctcccacc

SEQ ID NO: 5755382 - DNA, 11 bp, Homo sapiens
gcagcagccct

SEQ ID NO: 5755383 - DNA, 13 bp, Homo sapiens
gcagcagccctgc

SEQ ID NO: 5755384 - DNA, 14 bp, Homo sapiens
gcagcagccctgcc

SEQ ID NO: 5755385 - DNA, 22 bp, Homo sapiens
gcagcagcctcgcccctggcag

SEQ ID NO: 5755386 - DNA, 12 bp, Homo sapiens
gcagcagcctgc

SEQ ID NO: 5755387 - DNA, 13 bp, Homo sapiens
gcagcagcctgca

SEQ ID NO: 5755388 - DNA, 15 bp, Homo sapiens
gcagcagcctgcacc

SEQ ID NO: 5755389 - DNA, 16 bp, Homo sapiens
gcagcagcctgcacct

SEQ ID NO: 5755390 - DNA, 19 bp, Homo sapiens
gcagcagcctgcacctgcc

SEQ ID NO: 5755391 - DNA, 21 bp, Homo sapiens
gcagcagcctgcacctgcccc

SEQ ID NO: 5755392 - DNA, 22 bp, Homo sapiens
gcagcagcgctcggcccggagc

SEQ ID NO: 5755393 - DNA, 23 bp, Homo sapiens
gcagcagcgctcggcccggagca

SEQ ID NO: 5755394 - DNA, 12 bp, Homo sapiens
gcagcagctcag

SEQ ID NO: 5755395 - DNA, 21 bp, Homo sapiens
gcagcagctccgcctggcacc

SEQ ID NO: 5755396 - DNA, 17 bp, Homo sapiens
gcagcagctctgagcca

SEQ ID NO: 5755397 - DNA, 18 bp, Homo sapiens
gcagcagctctgagccag

SEQ ID NO: 5755398 - DNA, 19 bp, Homo sapiens
gcagcagctctgagccaga

SEQ ID NO: 5755399 - DNA, 20 bp, Homo sapiens
gcagcagctgaggccccagg

SEQ ID NO: 5755400 - DNA, 15 bp, Homo sapiens
gcagcagctgggacc

SEQ ID NO: 5755401 - DNA, 12 bp, Homo sapiens
gcagcagcttgc

SEQ ID NO: 5755402 - DNA, 23 bp, Homo sapiens
gcagcagcttttaatacagggta

SEQ ID NO: 5755403 - DNA, 13 bp, Homo sapiens
gcagcaggaaggc

SEQ ID NO: 5755404 - DNA, 15 bp, Homo sapiens
gcagcaggaggcttt

SEQ ID NO: 5755405 - DNA, 13 bp, Homo sapiens
gcagcaggagggg

SEQ ID NO: 5755406 - DNA, 20 bp, Homo sapiens
gcagcaggatgggctgagct

SEQ ID NO: 5755407 - DNA, 16 bp, Homo sapiens
gcagcaggcagaggag

SEQ ID NO: 5755408 - DNA, 12 bp, Homo sapiens
gcagcaggcatt

SEQ ID NO: 5755409 - DNA, 16 bp, Homo sapiens
gcagcaggccagagaa

SEQ ID NO: 5755410 - DNA, 23 bp, Homo sapiens
gcagcaggccagagaaagcaaag

SEQ ID NO: 5755411 - DNA, 23 bp, Homo sapiens
gcagcaggcctctgggacccaca

SEQ ID NO: 5755412 - DNA, 14 bp, Homo sapiens
gcagcaggcctgtt

SEQ ID NO: 5755413 - DNA, 20 bp, Homo sapiens
gcagcaggcctgttgctttt

SEQ ID NO: 5755414 - DNA, 14 bp, Homo sapiens
gcagcagggaagct

SEQ ID NO: 5755415 - DNA, 18 bp, Homo sapiens
gcagcagggagggcttct

SEQ ID NO: 5755416 - DNA, 15 bp, Homo sapiens
gcagcagggatgccc

SEQ ID NO: 5755417 - DNA, 12 bp, Homo sapiens
gcagcagggcag

SEQ ID NO: 5755418 - DNA, 21 bp, Homo sapiens
gcagcagggcaggaaggggaa

SEQ ID NO: 5755419 - DNA, 14 bp, Homo sapiens
gcagcaggggttgg

SEQ ID NO: 5755420 - DNA, 18 bp, Homo sapiens
gcagcaggtagcctgctg

SEQ ID NO: 5755421 - DNA, 16 bp, Homo sapiens
gcagcaggtgcaagag

SEQ ID NO: 5755422 - DNA, 13 bp, Homo sapiens
gcagcaggtgctg

SEQ ID NO: 5755423 - DNA, 20 bp, Homo sapiens
gcagcaggtgctgctaccct

SEQ ID NO: 5755424 - DNA, 16 bp, Homo sapiens
gcagcaggtgctgggc

SEQ ID NO: 5755425 - DNA, 20 bp, Homo sapiens
gcagcaggtggcagaatggg

SEQ ID NO: 5755426 - DNA, 15 bp, Homo sapiens
gcagcaggtgtggcc

SEQ ID NO: 5755427 - DNA, 19 bp, Homo sapiens
gcagcagtaatttgtggca

SEQ ID NO: 5755428 - DNA, 20 bp, Homo sapiens
gcagcagtaccatcccactg

SEQ ID NO: 5755429 - DNA, 13 bp, Homo sapiens
gcagcagtagctt

SEQ ID NO: 5755430 - DNA, 17 bp, Homo sapiens
gcagcagtcgcccaagc

SEQ ID NO: 5755431 - DNA, 14 bp, Homo sapiens
gcagcagtgaaaac

SEQ ID NO: 5755432 - DNA, 17 bp, Homo sapiens
gcagcagtgagtctctt

SEQ ID NO: 5755433 - DNA, 21 bp, Homo sapiens
gcagcagtgagtctcttcaga

SEQ ID NO: 5755434 - DNA, 14 bp, Homo sapiens
gcagcagtggggtg

SEQ ID NO: 5755435 - DNA, 15 bp, Homo sapiens
gcagcagtgtctgta

SEQ ID NO: 5755436 - DNA, 22 bp, Homo sapiens
gcagcagtgtgaggccagggca

SEQ ID NO: 5755437 - DNA, 15 bp, Homo sapiens
gcagcagttccatga

SEQ ID NO: 5755438 - DNA, 21 bp, Homo sapiens
gcagcagttccatgaagacac

SEQ ID NO: 5755439 - DNA, 12 bp, Homo sapiens
gcagcataaagg

SEQ ID NO: 5755440 - DNA, 15 bp, Homo sapiens
gcagcataaaggcct

SEQ ID NO: 5755441 - DNA, 17 bp, Homo sapiens
gcagcatatacaataat

SEQ ID NO: 5755442 - DNA, 19 bp, Homo sapiens
gcagcatatacaataatgt

SEQ ID NO: 5755443 - DNA, 20 bp, Homo sapiens
gcagcatcaacctaggagca

SEQ ID NO: 5755444 - DNA, 15 bp, Homo sapiens
gcagcatcccagcct

SEQ ID NO: 5755445 - DNA, 23 bp, Homo sapiens
gcagcatcggacaagacccccag

SEQ ID NO: 5755446 - DNA, 22 bp, Homo sapiens
gcagcatcggggtggcccactg

SEQ ID NO: 5755447 - DNA, 22 bp, Homo sapiens
gcagcatctactactctgtctt

SEQ ID NO: 5755448 - DNA, 14 bp, Homo sapiens
gcagcatctctacc

SEQ ID NO: 5755449 - DNA, 20 bp, Homo sapiens
gcagcatctctaccttctcc

SEQ ID NO: 5755450 - DNA, 18 bp, Homo sapiens
gcagcatgcttgggctga

SEQ ID NO: 5755451 - DNA, 23 bp, Homo sapiens
gcagcatgcttgggctgacccag

SEQ ID NO: 5755452 - DNA, 17 bp, Homo sapiens
gcagcatggaaaaatgg

SEQ ID NO: 5755453 - DNA, 14 bp, Homo sapiens
gcagcatggcatag

SEQ ID NO: 5755454 - DNA, 16 bp, Homo sapiens
gcagcatggcatagcc

SEQ ID NO: 5755455 - DNA, 20 bp, Homo sapiens
gcagcatggtccctgcctta

SEQ ID NO: 5755456 - DNA, 17 bp, Homo sapiens
gcagcatgtggggaagc

SEQ ID NO: 5755457 - DNA, 19 bp, Homo sapiens
gcagcatgtggggaagcaa

SEQ ID NO: 5755458 - DNA, 15 bp, Homo sapiens
gcagcattcagcaca

SEQ ID NO: 5755459 - DNA, 16 bp, Homo sapiens
gcagcattcagcacac

SEQ ID NO: 5755460 - DNA, 19 bp, Homo sapiens
gcagcattccatgaccaga

SEQ ID NO: 5755461 - DNA, 16 bp, Homo sapiens
gcagcattcccaggga

SEQ ID NO: 5755462 - DNA, 18 bp, Homo sapiens
gcagcattgaagtatggt

SEQ ID NO: 5755463 - DNA, 15 bp, Homo sapiens
gcagcattgactggt

SEQ ID NO: 5755464 - DNA, 20 bp, Homo sapiens
gcagcatttactatgcacaa

SEQ ID NO: 5755465 - DNA, 14 bp, Homo sapiens
gcagcatttcactt

SEQ ID NO: 5755466 - DNA, 20 bp, Homo sapiens
gcagcatttttaattttcac

SEQ ID NO: 5755467 - DNA, 21 bp, Homo sapiens
gcagcatttttaattttcaca

SEQ ID NO: 5755468 - DNA, 23 bp, Homo sapiens
gcagcatttttaattttcacaaa

SEQ ID NO: 5755469 - DNA, 16 bp, Homo sapiens
gcagccaaacagagcc

SEQ ID NO: 5755470 - DNA, 14 bp, Homo sapiens
gcagccaagagcca

SEQ ID NO: 5755471 - DNA, 13 bp, Homo sapiens
gcagccaagctcc

SEQ ID NO: 5755472 - DNA, 20 bp, Homo sapiens
gcagccaaggaatgtgtcca

SEQ ID NO: 5755473 - DNA, 23 bp, Homo sapiens
gcagccaaggccgaagctctggc

SEQ ID NO: 5755474 - DNA, 17 bp, Homo sapiens
gcagccaagtagcctct

SEQ ID NO: 5755475 - DNA, 20 bp, Homo sapiens
gcagccaagtagcctctcct

SEQ ID NO: 5755476 - DNA, 18 bp, Homo sapiens
gcagccacacagtggccg

SEQ ID NO: 5755477 - DNA, 16 bp, Homo sapiens
gcagccacaccgctgg

SEQ ID NO: 5755478 - DNA, 18 bp, Homo sapiens
gcagccacaccgctggct

SEQ ID NO: 5755479 - DNA, 14 bp, Homo sapiens
gcagccacacgcag

SEQ ID NO: 5755480 - DNA, 16 bp, Homo sapiens
gcagccacacttcctt

SEQ ID NO: 5755481 - DNA, 13 bp, Homo sapiens
gcagccacaggac

SEQ ID NO: 5755482 - DNA, 16 bp, Homo sapiens
gcagccacattcctga

SEQ ID NO: 5755483 - DNA, 13 bp, Homo sapiens
gcagccaccagcg

SEQ ID NO: 5755484 - DNA, 19 bp, Homo sapiens
gcagccaccagtggaccta

SEQ ID NO: 5755485 - DNA, 19 bp, Homo sapiens
gcagccacccaagcctgct

SEQ ID NO: 5755486 - DNA, 12 bp, Homo sapiens
gcagccaccctg

SEQ ID NO: 5755487 - DNA, 16 bp, Homo sapiens
gcagccaccctgagga

SEQ ID NO: 5755488 - DNA, 13 bp, Homo sapiens
gcagccaccctgc

SEQ ID NO: 5755489 - DNA, 19 bp, Homo sapiens
gcagccacgattggagaat

SEQ ID NO: 5755490 - DNA, 22 bp, Homo sapiens
gcagccacggccccgggtccag

SEQ ID NO: 5755491 - DNA, 22 bp, Homo sapiens
gcagccactgcacaggaggagg

SEQ ID NO: 5755492 - DNA, 18 bp, Homo sapiens
gcagccacttaggacaaa

SEQ ID NO: 5755493 - DNA, 13 bp, Homo sapiens
gcagccagaaagg

SEQ ID NO: 5755494 - DNA, 19 bp, Homo sapiens
gcagccagaccagcaggct

SEQ ID NO: 5755495 - DNA, 23 bp, Homo sapiens
gcagccagacctattcctcctgg

SEQ ID NO: 5755496 - DNA, 12 bp, Homo sapiens
gcagccagaggc

SEQ ID NO: 5755497 - DNA, 19 bp, Homo sapiens
gcagccagatccccagggc

SEQ ID NO: 5755498 - DNA, 15 bp, Homo sapiens
gcagccagcaccacc

SEQ ID NO: 5755499 - DNA, 23 bp, Homo sapiens
gcagccagcaccacctacacagg

SEQ ID NO: 5755500 - DNA, 20 bp, Homo sapiens
gcagccagcagttgtaaaat

SEQ ID NO: 5755501 - DNA, 14 bp, Homo sapiens
gcagccagcatctg

SEQ ID NO: 5755502 - DNA, 17 bp, Homo sapiens
gcagccagccagtcttg

SEQ ID NO: 5755503 - DNA, 21 bp, Homo sapiens
gcagccagcccagcccagctg

SEQ ID NO: 5755504 - DNA, 23 bp, Homo sapiens
gcagccagcccagcccagctggt

SEQ ID NO: 5755505 - DNA, 13 bp, Homo sapiens
gcagccagccctg

SEQ ID NO: 5755506 - DNA, 19 bp, Homo sapiens
gcagccagccctggcttcc

SEQ ID NO: 5755507 - DNA, 18 bp, Homo sapiens
gcagccagccggtgcctg

SEQ ID NO: 5755508 - DNA, 20 bp, Homo sapiens
gcagccagccggtgcctggc

SEQ ID NO: 5755509 - DNA, 22 bp, Homo sapiens
gcagccagccgtgagtgcagac

SEQ ID NO: 5755510 - DNA, 18 bp, Homo sapiens
gcagccagccgtggccag

SEQ ID NO: 5755511 - DNA, 17 bp, Homo sapiens
gcagccagctctcagcc

SEQ ID NO: 5755512 - DNA, 19 bp, Homo sapiens
gcagccaggacaccgggca

SEQ ID NO: 5755513 - DNA, 21 bp, Homo sapiens
gcagccaggagtgcccccggg

SEQ ID NO: 5755514 - DNA, 23 bp, Homo sapiens
gcagccaggatgactagatcctg

SEQ ID NO: 5755515 - DNA, 16 bp, Homo sapiens
gcagccaggcctcgcc

SEQ ID NO: 5755516 - DNA, 18 bp, Homo sapiens
gcagccaggcctcgcctg

SEQ ID NO: 5755517 - DNA, 23 bp, Homo sapiens
gcagccaggcctcgcctgccctc

SEQ ID NO: 5755518 - DNA, 14 bp, Homo sapiens
gcagccaggctgcc

SEQ ID NO: 5755519 - DNA, 16 bp, Homo sapiens
gcagccaggctgggcc

SEQ ID NO: 5755520 - DNA, 15 bp, Homo sapiens
gcagccagggacccc

SEQ ID NO: 5755521 - DNA, 18 bp, Homo sapiens
gcagccagggacccccag

SEQ ID NO: 5755522 - DNA, 19 bp, Homo sapiens
gcagccagggacccccaga

SEQ ID NO: 5755523 - DNA, 17 bp, Homo sapiens
gcagccagggctggggt

SEQ ID NO: 5755524 - DNA, 14 bp, Homo sapiens
gcagccaggggctg

SEQ ID NO: 5755525 - DNA, 18 bp, Homo sapiens
gcagccaggggctgctca

SEQ ID NO: 5755526 - DNA, 16 bp, Homo sapiens
gcagccagtgccctga

SEQ ID NO: 5755527 - DNA, 17 bp, Homo sapiens
gcagccagtgccctgag

SEQ ID NO: 5755528 - DNA, 16 bp, Homo sapiens
gcagccatcccaaggc

SEQ ID NO: 5755529 - DNA, 15 bp, Homo sapiens
gcagccatgagaaca

SEQ ID NO: 5755530 - DNA, 13 bp, Homo sapiens
gcagccatgcctc

SEQ ID NO: 5755531 - DNA, 17 bp, Homo sapiens
gcagccatttctccatg

SEQ ID NO: 5755532 - DNA, 21 bp, Homo sapiens
gcagcccaaaacccagggcaa

SEQ ID NO: 5755533 - DNA, 16 bp, Homo sapiens
gcagcccaacagcact

SEQ ID NO: 5755534 - DNA, 21 bp, Homo sapiens
gcagcccaagcttccctccat

SEQ ID NO: 5755535 - DNA, 15 bp, Homo sapiens
gcagcccacagagga

SEQ ID NO: 5755536 - DNA, 20 bp, Homo sapiens
gcagcccacagaggacagtg

SEQ ID NO: 5755537 - DNA, 11 bp, Homo sapiens
gcagcccacca

SEQ ID NO: 5755538 - DNA, 14 bp, Homo sapiens
gcagcccaccagga

SEQ ID NO: 5755539 - DNA, 17 bp, Homo sapiens
gcagcccaccctgctgc

SEQ ID NO: 5755540 - DNA, 20 bp, Homo sapiens
gcagcccaccctgctgctgg

SEQ ID NO: 5755541 - DNA, 11 bp, Homo sapiens
gcagcccagag

SEQ ID NO: 5755542 - DNA, 18 bp, Homo sapiens
gcagcccagagactttgt

SEQ ID NO: 5755543 - DNA, 22 bp, Homo sapiens
gcagcccagagactttgtagat

SEQ ID NO: 5755544 - DNA, 12 bp, Homo sapiens
gcagcccagcca

SEQ ID NO: 5755545 - DNA, 14 bp, Homo sapiens
gcagcccagctcct

SEQ ID NO: 5755546 - DNA, 20 bp, Homo sapiens
gcagcccagctcctgaataa

SEQ ID NO: 5755547 - DNA, 17 bp, Homo sapiens
gcagcccagcttcctgg

SEQ ID NO: 5755548 - DNA, 14 bp, Homo sapiens
gcagcccaggccag

SEQ ID NO: 5755549 - DNA, 17 bp, Homo sapiens
gcagcccaggccggggt

SEQ ID NO: 5755550 - DNA, 12 bp, Homo sapiens
gcagcccagggc

SEQ ID NO: 5755551 - DNA, 20 bp, Homo sapiens
gcagcccagggtagggagaa

SEQ ID NO: 5755552 - DNA, 15 bp, Homo sapiens
gcagcccatgcccac

SEQ ID NO: 5755553 - DNA, 20 bp, Homo sapiens
gcagcccatgcccacctgcc

SEQ ID NO: 5755554 - DNA, 14 bp, Homo sapiens
gcagccccacagtc

SEQ ID NO: 5755555 - DNA, 14 bp, Homo sapiens
gcagccccacccag

SEQ ID NO: 5755556 - DNA, 19 bp, Homo sapiens
gcagccccaccccaccctg

SEQ ID NO: 5755557 - DNA, 13 bp, Homo sapiens
gcagccccacgga

SEQ ID NO: 5755558 - DNA, 20 bp, Homo sapiens
gcagccccacttcaccccca

SEQ ID NO: 5755559 - DNA, 23 bp, Homo sapiens
gcagccccacttcacccccaact

SEQ ID NO: 5755560 - DNA, 23 bp, Homo sapiens
gcagccccagcaccaccaggtct

SEQ ID NO: 5755561 - DNA, 16 bp, Homo sapiens
gcagccccagcctgct

SEQ ID NO: 5755562 - DNA, 14 bp, Homo sapiens
gcagccccaggacc

SEQ ID NO: 5755563 - DNA, 12 bp, Homo sapiens
gcagccccaggc

SEQ ID NO: 5755564 - DNA, 14 bp, Homo sapiens
gcagccccaggcct

SEQ ID NO: 5755565 - DNA, 17 bp, Homo sapiens
gcagccccatccttccc

SEQ ID NO: 5755566 - DNA, 21 bp, Homo sapiens
gcagccccatccttcccgcag

SEQ ID NO: 5755567 - DNA, 24 bp, Homo sapiens
gcagccccattctgcctgcccagg

SEQ ID NO: 5755568 - DNA, 18 bp, Homo sapiens
gcagcccccaaagagctg

SEQ ID NO: 5755569 - DNA, 21 bp, Homo sapiens
gcagcccccaaagagctgtgg

SEQ ID NO: 5755570 - DNA, 23 bp, Homo sapiens
gcagcctgctttggcctttcctt

SEQ ID NO: 5755571 - DNA, 18 bp, Homo sapiens
gcagcctggacatagaga

SEQ ID NO: 5755572 - DNA, 14 bp, Homo sapiens
gcagcctggaccct

SEQ ID NO: 5755573 - DNA, 15 bp, Homo sapiens
gcagcctggagccct

SEQ ID NO: 5755574 - DNA, 13 bp, Homo sapiens
gcagcctggaggc

SEQ ID NO: 5755575 - DNA, 19 bp, Homo sapiens
gcagcctggcggggcagga

SEQ ID NO: 5755576 - DNA, 20 bp, Homo sapiens
gcagcctggcggggcaggag

SEQ ID NO: 5755577 - DNA, 13 bp, Homo sapiens
gcagcctggctcc

SEQ ID NO: 5755578 - DNA, 17 bp, Homo sapiens
gcagcctggctcccctg

SEQ ID NO: 5755579 - DNA, 21 bp, Homo sapiens
gcagcctggctcccctggggt

SEQ ID NO: 5755580 - DNA, 12 bp, Homo sapiens
gcagcctggctg

SEQ ID NO: 5755581 - DNA, 22 bp, Homo sapiens
gcagcctggctggtcctcccat

SEQ ID NO: 5755582 - DNA, 10 bp, Homo sapiens
gcagcctggg

SEQ ID NO: 5755583 - DNA, 16 bp, Homo sapiens
gcagcctgggctccct

SEQ ID NO: 5755584 - DNA, 14 bp, Homo sapiens
gcagcctggggctg

SEQ ID NO: 5755585 - DNA, 13 bp, Homo sapiens
gcagcctgggtct

SEQ ID NO: 5755586 - DNA, 16 bp, Homo sapiens
gcagcctgggtctgga

SEQ ID NO: 5755587 - DNA, 18 bp, Homo sapiens
gcagcctgggtggctatg

SEQ ID NO: 5755588 - DNA, 24 bp, Homo sapiens
gcagcctggtcactaggcatcacc

SEQ ID NO: 5755589 - DNA, 18 bp, Homo sapiens
gcagcctggttccctctt

SEQ ID NO: 5755590 - DNA, 19 bp, Homo sapiens
gcagcctgtcctgggctgg

SEQ ID NO: 5755591 - DNA, 13 bp, Homo sapiens
gcagcctgtgagg

SEQ ID NO: 5755592 - DNA, 18 bp, Homo sapiens
gcagcctgtgagggagtg

SEQ ID NO: 5755593 - DNA, 19 bp, Homo sapiens
gcagcctgtgagggagtgc

SEQ ID NO: 5755594 - DNA, 14 bp, Homo sapiens
gcagcctgtgcctg

SEQ ID NO: 5755595 - DNA, 15 bp, Homo sapiens
gcagcctgtgcctgc

SEQ ID NO: 5755596 - DNA, 12 bp, Homo sapiens
gcagcctgtggc

SEQ ID NO: 5755597 - DNA, 22 bp, Homo sapiens
gcagcctgtggcatctttgcct

SEQ ID NO: 5755598 - DNA, 13 bp, Homo sapiens
gcagcctgtggga

SEQ ID NO: 5755599 - DNA, 15 bp, Homo sapiens
gcagcctgtgggaga

SEQ ID NO: 5755600 - DNA, 16 bp, Homo sapiens
gcagcctgtgggagaa

SEQ ID NO: 5755601 - DNA, 19 bp, Homo sapiens
gcagcctgtgggagaaggg

SEQ ID NO: 5755602 - DNA, 11 bp, Homo sapiens
gcagcctgttt

SEQ ID NO: 5755603 - DNA, 13 bp, Homo sapiens
gcagccttccagt

SEQ ID NO: 5755604 - DNA, 17 bp, Homo sapiens
gcagccttgcccattct

SEQ ID NO: 5755605 - DNA, 21 bp, Homo sapiens
gcagccttgcgctgtcccagg

SEQ ID NO: 5755606 - DNA, 23 bp, Homo sapiens
gcagccttgcgctgtcccaggca

SEQ ID NO: 5755607 - DNA, 13 bp, Homo sapiens
gcagccttgggga

SEQ ID NO: 5755608 - DNA, 15 bp, Homo sapiens
gcagccttggggaac

SEQ ID NO: 5755609 - DNA, 19 bp, Homo sapiens
gcagccttgggggggctgc

SEQ ID NO: 5755610 - DNA, 20 bp, Homo sapiens
gcagccttgggggggctgcc

SEQ ID NO: 5755611 - DNA, 22 bp, Homo sapiens
gcagccttgggggggctgcctt

SEQ ID NO: 5755612 - DNA, 15 bp, Homo sapiens
gcagcctttctgtgg

SEQ ID NO: 5755613 - DNA, 17 bp, Homo sapiens
gcagcctttgcctcccc

SEQ ID NO: 5755614 - DNA, 22 bp, Homo sapiens
gcagcctttttcaccatggcaa

SEQ ID NO: 5755615 - DNA, 19 bp, Homo sapiens
gcagcctttttctggcctt

SEQ ID NO: 5755616 - DNA, 14 bp, Homo sapiens
gcagcgaccacccc

SEQ ID NO: 5755617 - DNA, 15 bp, Homo sapiens
gcagcgaccacccct

SEQ ID NO: 5755618 - DNA, 22 bp, Homo sapiens
gcagcgaccacccctgcctcca

SEQ ID NO: 5755619 - DNA, 13 bp, Homo sapiens
gcagcgaccccag

SEQ ID NO: 5755620 - DNA, 14 bp, Homo sapiens
gcagcgaccccagg

SEQ ID NO: 5755621 - DNA, 14 bp, Homo sapiens
gcagcgaccgcccc

SEQ ID NO: 5755622 - DNA, 16 bp, Homo sapiens
gcagcgaccgccccct

SEQ ID NO: 5755623 - DNA, 15 bp, Homo sapiens
gcagcgcagggctgg

SEQ ID NO: 5755624 - DNA, 16 bp, Homo sapiens
gcagcgcatgtgtgca

SEQ ID NO: 5755625 - DNA, 15 bp, Homo sapiens
gcagcgccaagcaac

SEQ ID NO: 5755626 - DNA, 18 bp, Homo sapiens
gcagcgccaagcaacctg

SEQ ID NO: 5755627 - DNA, 14 bp, Homo sapiens
gcagcgccaggctg

SEQ ID NO: 5755628 - DNA, 14 bp, Homo sapiens
gcagcgccagggct

SEQ ID NO: 5755629 - DNA, 15 bp, Homo sapiens
gcagcgcccagcctg

SEQ ID NO: 5755630 - DNA, 14 bp, Homo sapiens
gcagcgcccaggcc

SEQ ID NO: 5755631 - DNA, 22 bp, Homo sapiens
gcagcgcccaggcctgctggca

SEQ ID NO: 5755632 - DNA, 19 bp, Homo sapiens
gcagcgcccccatctgtct

SEQ ID NO: 5755633 - DNA, 20 bp, Homo sapiens
gcagcgcccgaggccagggc

SEQ ID NO: 5755634 - DNA, 16 bp, Homo sapiens
gcagcgcccggtgctc

SEQ ID NO: 5755635 - DNA, 20 bp, Homo sapiens
gcagcgcctccaccctgccc

SEQ ID NO: 5755636 - DNA, 21 bp, Homo sapiens
gcagcgcctccaccctgccct

SEQ ID NO: 5755637 - DNA, 12 bp, Homo sapiens
gcagcgcctccc

SEQ ID NO: 5755638 - DNA, 15 bp, Homo sapiens
gcagcgcctcccgcc

SEQ ID NO: 5755639 - DNA, 14 bp, Homo sapiens
gcagcgcctcctgg

SEQ ID NO: 5755640 - DNA, 16 bp, Homo sapiens
gcagcgcctcctggac

SEQ ID NO: 5755641 - DNA, 18 bp, Homo sapiens
gcagcgcctcctggacac

SEQ ID NO: 5755642 - DNA, 16 bp, Homo sapiens
gcagcgcctcgcccca

SEQ ID NO: 5755643 - DNA, 14 bp, Homo sapiens
gcagcgcctgtccc

SEQ ID NO: 5755644 - DNA, 18 bp, Homo sapiens
gcagcgcctgtcccctca

SEQ ID NO: 5755645 - DNA, 14 bp, Homo sapiens
gcagcgcgcaggcc

SEQ ID NO: 5755646 - DNA, 17 bp, Homo sapiens
gcagcgcggggagcccg

SEQ ID NO: 5755647 - DNA, 16 bp, Homo sapiens
gcagcgctagtggagg

SEQ ID NO: 5755648 - DNA, 20 bp, Homo sapiens
gcagcggaagggactctggg

SEQ ID NO: 5755649 - DNA, 17 bp, Homo sapiens
gcagcggattgctctgg

SEQ ID NO: 5755650 - DNA, 16 bp, Homo sapiens
gcagcggcagagcaat

SEQ ID NO: 5755651 - DNA, 21 bp, Homo sapiens
gcagcggcagagcaattccag

SEQ ID NO: 5755652 - DNA, 14 bp, Homo sapiens
gcagcggcccagat

SEQ ID NO: 5755653 - DNA, 17 bp, Homo sapiens
gcagcggccccgcaccc

SEQ ID NO: 5755654 - DNA, 14 bp, Homo sapiens
gcagcggctccact

SEQ ID NO: 5755655 - DNA, 13 bp, Homo sapiens
gcagcggctcctg

SEQ ID NO: 5755656 - DNA, 13 bp, Homo sapiens
gcagcggctctgg

SEQ ID NO: 5755657 - DNA, 14 bp, Homo sapiens
gcagcggctctggt

SEQ ID NO: 5755658 - DNA, 17 bp, Homo sapiens
gcagcggctctggtcct

SEQ ID NO: 5755659 - DNA, 23 bp, Homo sapiens
gcagcggctctggtcctcggagc

SEQ ID NO: 5755660 - DNA, 22 bp, Homo sapiens
gcagcgggcaaagagctcccga

SEQ ID NO: 5755661 - DNA, 12 bp, Homo sapiens
gcagcgggccag

SEQ ID NO: 5755662 - DNA, 15 bp, Homo sapiens
gcagcgggccaggcc

SEQ ID NO: 5755663 - DNA, 22 bp, Homo sapiens
gcagcgggcggaggggatccag

SEQ ID NO: 5755664 - DNA, 22 bp, Homo sapiens
gcagcgggggcggcccagcctc

SEQ ID NO: 5755665 - DNA, 24 bp, Homo sapiens
gcagcgggggcggcccagcctctg

SEQ ID NO: 5755666 - DNA, 22 bp, Homo sapiens
gcagcggggtggggggggagag

SEQ ID NO: 5755667 - DNA, 12 bp, Homo sapiens
gcagcgtccccc

SEQ ID NO: 5755668 - DNA, 20 bp, Homo sapiens
gcagcgtcccccgccgcgcc

SEQ ID NO: 5755669 - DNA, 16 bp, Homo sapiens
gcagcgtgggctctgc

SEQ ID NO: 5755670 - DNA, 17 bp, Homo sapiens
gcagcgtgggctctgcc

SEQ ID NO: 5755671 - DNA, 18 bp, Homo sapiens
gcagcgtgggctctgcca

SEQ ID NO: 5755672 - DNA, 20 bp, Homo sapiens
gcagcgtgggctctgccaat

SEQ ID NO: 5755673 - DNA, 13 bp, Homo sapiens
gcagctaaaacct

SEQ ID NO: 5755674 - DNA, 15 bp, Homo sapiens
gcagctaactccgag

SEQ ID NO: 5755675 - DNA, 19 bp, Homo sapiens
gcagctaactccgagagca

SEQ ID NO: 5755676 - DNA, 23 bp, Homo sapiens
gcagctaagatagaaagctggac

SEQ ID NO: 5755677 - DNA, 24 bp, Homo sapiens
gcagctaagatagaaagctggact

SEQ ID NO: 5755678 - DNA, 19 bp, Homo sapiens
gcagctaatttgtgaaagt

SEQ ID NO: 5755679 - DNA, 17 bp, Homo sapiens
gcagctaccctcagcct

SEQ ID NO: 5755680 - DNA, 20 bp, Homo sapiens
gcagctaccctcagcctcca

SEQ ID NO: 5755681 - DNA, 17 bp, Homo sapiens
gcagctactcccctttc

SEQ ID NO: 5755682 - DNA, 13 bp, Homo sapiens
gcagctactggaa

SEQ ID NO: 5755683 - DNA, 14 bp, Homo sapiens
gcagctactggaat

SEQ ID NO: 5755684 - DNA, 15 bp, Homo sapiens
gcagctactggaatg

SEQ ID NO: 5755685 - DNA, 15 bp, Homo sapiens
gcagctactgtaact

SEQ ID NO: 5755686 - DNA, 21 bp, Homo sapiens
gcagctactgtaactttttta

SEQ ID NO: 5755687 - DNA, 14 bp, Homo sapiens
gcagctagctgctt

SEQ ID NO: 5755688 - DNA, 15 bp, Homo sapiens
gcagctagctgcttt

SEQ ID NO: 5755689 - DNA, 14 bp, Homo sapiens
gcagctaggcaggg

SEQ ID NO: 5755690 - DNA, 18 bp, Homo sapiens
gcagctaggcagggaggg

SEQ ID NO: 5755691 - DNA, 21 bp, Homo sapiens
gcagctaggcagggagggggc

SEQ ID NO: 5755692 - DNA, 13 bp, Homo sapiens
gcagctagtgcct

SEQ ID NO: 5755693 - DNA, 15 bp, Homo sapiens
gcagctagtgccttt

SEQ ID NO: 5755694 - DNA, 17 bp, Homo sapiens
gcagctatatatttccc

SEQ ID NO: 5755695 - DNA, 15 bp, Homo sapiens
gcagctatttcagcc

SEQ ID NO: 5755696 - DNA, 20 bp, Homo sapiens
gcagctatttcagcctcctg

SEQ ID NO: 5755697 - DNA, 14 bp, Homo sapiens
gcagctcaaaggca

SEQ ID NO: 5755698 - DNA, 23 bp, Homo sapiens
gcagctcaagcagcgaccgcccc

SEQ ID NO: 5755699 - DNA, 20 bp, Homo sapiens
gcagctcaagggctggcact

SEQ ID NO: 5755700 - DNA, 16 bp, Homo sapiens
gcagctcacccctggg

SEQ ID NO: 5755701 - DNA, 17 bp, Homo sapiens
gcagctcacctctccct

SEQ ID NO: 5755702 - DNA, 16 bp, Homo sapiens
gcagctcactacccta

SEQ ID NO: 5755703 - DNA, 14 bp, Homo sapiens
gcagctcactgctg

SEQ ID NO: 5755704 - DNA, 18 bp, Homo sapiens
gcagctcagagagggtgg

SEQ ID NO: 5755705 - DNA, 12 bp, Homo sapiens
gcagctcaggcg

SEQ ID NO: 5755706 - DNA, 19 bp, Homo sapiens
gcagctcaggcgcagccct

SEQ ID NO: 5755707 - DNA, 21 bp, Homo sapiens
gcagctcaggcgcagccctag

SEQ ID NO: 5755708 - DNA, 13 bp, Homo sapiens
gcagctcatgttt

SEQ ID NO: 5755709 - DNA, 12 bp, Homo sapiens
gcagctccaaca

SEQ ID NO: 5755710 - DNA, 14 bp, Homo sapiens
gcagctccaacagc

SEQ ID NO: 5755711 - DNA, 15 bp, Homo sapiens
gcagctccaacagct

SEQ ID NO: 5755712 - DNA, 24 bp, Homo sapiens
gcagctccaacagcttgaccagac

SEQ ID NO: 5755713 - DNA, 16 bp, Homo sapiens
gcagctccaacctgga

SEQ ID NO: 5755714 - DNA, 15 bp, Homo sapiens
gcagctccaccactg

SEQ ID NO: 5755715 - DNA, 19 bp, Homo sapiens
gcagctccaccactgtgca

SEQ ID NO: 5755716 - DNA, 15 bp, Homo sapiens
gcagctcccaggttt

SEQ ID NO: 5755717 - DNA, 13 bp, Homo sapiens
gcagctccccagg

SEQ ID NO: 5755718 - DNA, 19 bp, Homo sapiens
gcagctccctcctcaggga

SEQ ID NO: 5755719 - DNA, 21 bp, Homo sapiens
gcagctccctggcttctgtgg

SEQ ID NO: 5755720 - DNA, 18 bp, Homo sapiens
gcagctccctttctcagg

SEQ ID NO: 5755721 - DNA, 21 bp, Homo sapiens
gcagctccggaaggacacagt

SEQ ID NO: 5755722 - DNA, 14 bp, Homo sapiens
gcagctcctcagcg

SEQ ID NO: 5755723 - DNA, 16 bp, Homo sapiens
gcagctcctccctgtg

SEQ ID NO: 5755724 - DNA, 17 bp, Homo sapiens
gcagctcctccctgtgc

SEQ ID NO: 5755725 - DNA, 15 bp, Homo sapiens
gcagctcctgaccaa

SEQ ID NO: 5755726 - DNA, 16 bp, Homo sapiens
gcagctcctgaccaaa

SEQ ID NO: 5755727 - DNA, 17 bp, Homo sapiens
gcagctcctgaccaaag

SEQ ID NO: 5755728 - DNA, 16 bp, Homo sapiens
gcagctctagctttgc

SEQ ID NO: 5755729 - DNA, 12 bp, Homo sapiens
gcagctctgagc

SEQ ID NO: 5755730 - DNA, 15 bp, Homo sapiens
gcagctctgagccag

SEQ ID NO: 5755731 - DNA, 14 bp, Homo sapiens
gcagctctggctct

SEQ ID NO: 5755732 - DNA, 17 bp, Homo sapiens
gcagctctggctctgcc

SEQ ID NO: 5755733 - DNA, 14 bp, Homo sapiens
gcagctctgtcgtg

SEQ ID NO: 5755734 - DNA, 12 bp, Homo sapiens
gcagctcttcct

SEQ ID NO: 5755735 - DNA, 13 bp, Homo sapiens
gcagctcttcctg

SEQ ID NO: 5755736 - DNA, 13 bp, Homo sapiens
gcagctcttctgg

SEQ ID NO: 5755737 - DNA, 14 bp, Homo sapiens
gcagctcttctgga

SEQ ID NO: 5755738 - DNA, 19 bp, Homo sapiens
gcagctcttctgggcagag

SEQ ID NO: 5755739 - DNA, 24 bp, Homo sapiens
gcagctcttctgggcagagcctgt

SEQ ID NO: 5755740 - DNA, 17 bp, Homo sapiens
gcagctcttgcccttcc

SEQ ID NO: 5755741 - DNA, 19 bp, Homo sapiens
gcagctcttgcccttccct

SEQ ID NO: 5755742 - DNA, 22 bp, Homo sapiens
gcagctcttgctaatcagtgtc

SEQ ID NO: 5755743 - DNA, 17 bp, Homo sapiens
gcagctgaagaaaaaat

SEQ ID NO: 5755744 - DNA, 14 bp, Homo sapiens
gcagctgaagccag

SEQ ID NO: 5755745 - DNA, 14 bp, Homo sapiens
gcagctgaagcctg

SEQ ID NO: 5755746 - DNA, 12 bp, Homo sapiens
gcagctgaaggg

SEQ ID NO: 5755747 - DNA, 23 bp, Homo sapiens
gcagctgaataacctgcacaggc

SEQ ID NO: 5755748 - DNA, 14 bp, Homo sapiens
gcagctgacctctg

SEQ ID NO: 5755749 - DNA, 15 bp, Homo sapiens
gcagctgagagccct

SEQ ID NO: 5755750 - DNA, 16 bp, Homo sapiens
gcaggaactgagccag

SEQ ID NO: 5755751 - DNA, 18 bp, Homo sapiens
gcaggaactgggctgggc

SEQ ID NO: 5755752 - DNA, 19 bp, Homo sapiens
gcaggaactgggctgggcc

SEQ ID NO: 5755753 - DNA, 20 bp, Homo sapiens
gcaggaactgggctgggcct

SEQ ID NO: 5755754 - DNA, 15 bp, Homo sapiens
gcaggaagaccacat

SEQ ID NO: 5755755 - DNA, 17 bp, Homo sapiens
gcaggaagacttccagc

SEQ ID NO: 5755756 - DNA, 15 bp, Homo sapiens
gcaggaagagagaga

SEQ ID NO: 5755757 - DNA, 15 bp, Homo sapiens
gcaggaagaggccca

SEQ ID NO: 5755758 - DNA, 21 bp, Homo sapiens
gcaggaagaggcccactagag

SEQ ID NO: 5755759 - DNA, 18 bp, Homo sapiens
gcaggaagcaacgaaggg

SEQ ID NO: 5755760 - DNA, 21 bp, Homo sapiens
gcaggaagcattcagagagca

SEQ ID NO: 5755761 - DNA, 13 bp, Homo sapiens
gcaggaagccagg

SEQ ID NO: 5755762 - DNA, 16 bp, Homo sapiens
gcaggaagccaggctg

SEQ ID NO: 5755763 - DNA, 20 bp, Homo sapiens
gcaggaagcgagcagaggct

SEQ ID NO: 5755764 - DNA, 22 bp, Homo sapiens
gcaggaaggaacaaagacaggc

SEQ ID NO: 5755765 - DNA, 14 bp, Homo sapiens
gcaggaaggacccc

SEQ ID NO: 5755766 - DNA, 22 bp, Homo sapiens
gcaggaaggactgtcccagacg

SEQ ID NO: 5755767 - DNA, 12 bp, Homo sapiens
gcaggaaggaga

SEQ ID NO: 5755768 - DNA, 16 bp, Homo sapiens
gcaggaaggagagcct

SEQ ID NO: 5755769 - DNA, 17 bp, Homo sapiens
gcaggaaggagagcctg

SEQ ID NO: 5755770 - DNA, 15 bp, Homo sapiens
gcaggaaggagctgc

SEQ ID NO: 5755771 - DNA, 17 bp, Homo sapiens
gcaggaaggagctgcct

SEQ ID NO: 5755772 - DNA, 23 bp, Homo sapiens
gcaggaaggagctgcctggaccc

SEQ ID NO: 5755773 - DNA, 17 bp, Homo sapiens
gcaggaaggcctgggtg

SEQ ID NO: 5755774 - DNA, 20 bp, Homo sapiens
gcaggaaggtctcatgcctg

SEQ ID NO: 5755775 - DNA, 22 bp, Homo sapiens
gcaggaaggtctcatgcctgag

SEQ ID NO: 5755776 - DNA, 16 bp, Homo sapiens
gcaggaagtcaggagc

SEQ ID NO: 5755777 - DNA, 19 bp, Homo sapiens
gcaggaagtcaggagccag

SEQ ID NO: 5755778 - DNA, 23 bp, Homo sapiens
gcaggaagtcaggagccagcagg

SEQ ID NO: 5755779 - DNA, 23 bp, Homo sapiens
gcaggaagtccctgagaagcctc

SEQ ID NO: 5755780 - DNA, 16 bp, Homo sapiens
gcaggaagtctctccc

SEQ ID NO: 5755781 - DNA, 18 bp, Homo sapiens
gcaggaagtctctcccga

SEQ ID NO: 5755782 - DNA, 13 bp, Homo sapiens
gcaggaataaaga

SEQ ID NO: 5755783 - DNA, 14 bp, Homo sapiens
gcaggaataaagac

SEQ ID NO: 5755784 - DNA, 20 bp, Homo sapiens
gcaggaatcaaggagcctcc

SEQ ID NO: 5755785 - DNA, 17 bp, Homo sapiens
gcaggaatcacccctct

SEQ ID NO: 5755786 - DNA, 18 bp, Homo sapiens
gcaggaatcacccctctg

SEQ ID NO: 5755787 - DNA, 22 bp, Homo sapiens
gcaggaatcacccctctgcccc

SEQ ID NO: 5755788 - DNA, 19 bp, Homo sapiens
gcaggaatcccggctccag

SEQ ID NO: 5755789 - DNA, 14 bp, Homo sapiens
gcaggaattatgtc

SEQ ID NO: 5755790 - DNA, 19 bp, Homo sapiens
gcaggacaacgaggaagcc

SEQ ID NO: 5755791 - DNA, 22 bp, Homo sapiens
gcaggacacatcccggcctctt

SEQ ID NO: 5755792 - DNA, 19 bp, Homo sapiens
gcaggacactgcagaacag

SEQ ID NO: 5755793 - DNA, 13 bp, Homo sapiens
gcaggacaggaaa

SEQ ID NO: 5755794 - DNA, 14 bp, Homo sapiens
gcaggacaggaggc

SEQ ID NO: 5755795 - DNA, 22 bp, Homo sapiens
gcaggacaggaggcggcccggc

SEQ ID NO: 5755796 - DNA, 23 bp, Homo sapiens
gcaggacaggaggcggcccggcc

SEQ ID NO: 5755797 - DNA, 18 bp, Homo sapiens
gcaggacagtcaaggtga

SEQ ID NO: 5755798 - DNA, 22 bp, Homo sapiens
gcaggaccactagctaagcaag

SEQ ID NO: 5755799 - DNA, 22 bp, Homo sapiens
gcaggaccagccagcagcagcc

SEQ ID NO: 5755800 - DNA, 19 bp, Homo sapiens
gcaggaccagcccacgctg

SEQ ID NO: 5755801 - DNA, 13 bp, Homo sapiens
gcaggaccaggac

SEQ ID NO: 5755802 - DNA, 15 bp, Homo sapiens
gcaggaccaggacta

SEQ ID NO: 5755803 - DNA, 17 bp, Homo sapiens
gcaggaccaggtggcac

SEQ ID NO: 5755804 - DNA, 14 bp, Homo sapiens
gcaggaccctgctg

SEQ ID NO: 5755805 - DNA, 18 bp, Homo sapiens
gcaggaccctgtcaggat

SEQ ID NO: 5755806 - DNA, 20 bp, Homo sapiens
gcaggacctactaggagagg

SEQ ID NO: 5755807 - DNA, 16 bp, Homo sapiens
gcaggacctcagagtc

SEQ ID NO: 5755808 - DNA, 21 bp, Homo sapiens
gcaggacctcccttccgaccc

SEQ ID NO: 5755809 - DNA, 12 bp, Homo sapiens
gcaggacctgcc

SEQ ID NO: 5755810 - DNA, 15 bp, Homo sapiens
gcaggacctgccaag

SEQ ID NO: 5755811 - DNA, 14 bp, Homo sapiens
gcaggacctgccta

SEQ ID NO: 5755812 - DNA, 20 bp, Homo sapiens
gcaggacctggcatcatggt

SEQ ID NO: 5755813 - DNA, 15 bp, Homo sapiens
gcaggacctgtgctt

SEQ ID NO: 5755814 - DNA, 16 bp, Homo sapiens
gcaggacctgtgcttt

SEQ ID NO: 5755815 - DNA, 21 bp, Homo sapiens
gcaggacctgtgctttgagat

SEQ ID NO: 5755816 - DNA, 13 bp, Homo sapiens
gcaggacgactgt

SEQ ID NO: 5755817 - DNA, 18 bp, Homo sapiens
gcaggacgagactcctcg

SEQ ID NO: 5755818 - DNA, 13 bp, Homo sapiens
gcaggacgatgat

SEQ ID NO: 5755819 - DNA, 17 bp, Homo sapiens
gcaggacgtgggctggg

SEQ ID NO: 5755820 - DNA, 17 bp, Homo sapiens
gcaggactaacaactgg

SEQ ID NO: 5755821 - DNA, 23 bp, Homo sapiens
gcaggactcacaggttggaagag

SEQ ID NO: 5755822 - DNA, 19 bp, Homo sapiens
gcaggactcagctccccag

SEQ ID NO: 5755823 - DNA, 18 bp, Homo sapiens
gcaggactccaggcccaa

SEQ ID NO: 5755824 - DNA, 23 bp, Homo sapiens
gcaggactccaggcccaaggctc

SEQ ID NO: 5755825 - DNA, 14 bp, Homo sapiens
gcaggactcctggc

SEQ ID NO: 5755826 - DNA, 17 bp, Homo sapiens
gcaggactcctggcagg

SEQ ID NO: 5755827 - DNA, 23 bp, Homo sapiens
gcaggactcggaattctcgggaa

SEQ ID NO: 5755828 - DNA, 22 bp, Homo sapiens
gcaggactgagtcccctccagg

SEQ ID NO: 5755829 - DNA, 18 bp, Homo sapiens
gcaggactgatgtctcct

SEQ ID NO: 5755830 - DNA, 19 bp, Homo sapiens
gcaggactgatgtctccta

SEQ ID NO: 5755831 - DNA, 19 bp, Homo sapiens
gcaggactgcacagcgtcc

SEQ ID NO: 5755832 - DNA, 16 bp, Homo sapiens
gcaggactgcagagca

SEQ ID NO: 5755833 - DNA, 19 bp, Homo sapiens
gcaggacttgctaaagcac

SEQ ID NO: 5755834 - DNA, 16 bp, Homo sapiens
gcaggagaatcactgc

SEQ ID NO: 5755835 - DNA, 16 bp, Homo sapiens
gcaggagaatcagcct

SEQ ID NO: 5755836 - DNA, 23 bp, Homo sapiens
gcaggagaatttctactgagcga

SEQ ID NO: 5755837 - DNA, 18 bp, Homo sapiens
gcaggagacactggtctc

SEQ ID NO: 5755838 - DNA, 23 bp, Homo sapiens
gcaggagacactggtctcagagg

SEQ ID NO: 5755839 - DNA, 12 bp, Homo sapiens
gcaggagagaga

SEQ ID NO: 5755840 - DNA, 13 bp, Homo sapiens
gcaggagagagag

SEQ ID NO: 5755841 - DNA, 14 bp, Homo sapiens
gcaggagagagaga

SEQ ID NO: 5755842 - DNA, 15 bp, Homo sapiens
gcaggagagcagtga

SEQ ID NO: 5755843 - DNA, 16 bp, Homo sapiens
gcaggagaggagagcc

SEQ ID NO: 5755844 - DNA, 22 bp, Homo sapiens
gcaggagaggagagccagagaa

SEQ ID NO: 5755845 - DNA, 23 bp, Homo sapiens
gcaggagaggagagccagagaag

SEQ ID NO: 5755846 - DNA, 21 bp, Homo sapiens
gcaggagattgagaaggagag

SEQ ID NO: 5755847 - DNA, 13 bp, Homo sapiens
gcaggagcagctg

SEQ ID NO: 5755848 - DNA, 15 bp, Homo sapiens
gcaggagcagctgtg

SEQ ID NO: 5755849 - DNA, 16 bp, Homo sapiens
gcaggagcagctgtgc

SEQ ID NO: 5755850 - DNA, 20 bp, Homo sapiens
gcaggagcagctgtgctgca

SEQ ID NO: 5755851 - DNA, 14 bp, Homo sapiens
gcaggagcaggaac

SEQ ID NO: 5755852 - DNA, 17 bp, Homo sapiens
gcaggagcagtatcatg

SEQ ID NO: 5755853 - DNA, 13 bp, Homo sapiens
gcaggagcagttt

SEQ ID NO: 5755854 - DNA, 20 bp, Homo sapiens
gcaggagcatcctctgctgg

SEQ ID NO: 5755855 - DNA, 19 bp, Homo sapiens
gcaggagcccccagctgcc

SEQ ID NO: 5755856 - DNA, 16 bp, Homo sapiens
gcaggagccccgccac

SEQ ID NO: 5755857 - DNA, 19 bp, Homo sapiens
gcaggagccccgccacagc

SEQ ID NO: 5755858 - DNA, 16 bp, Homo sapiens
gcaggagcctccctgc

SEQ ID NO: 5755859 - DNA, 24 bp, Homo sapiens
gcaggagcctcgtgtcctgctagc

SEQ ID NO: 5755860 - DNA, 12 bp, Homo sapiens
gcaggagcgtga

SEQ ID NO: 5755861 - DNA, 11 bp, Homo sapiens
gcaggagctca

SEQ ID NO: 5755862 - DNA, 14 bp, Homo sapiens
gcaggagctcagat

SEQ ID NO: 5755863 - DNA, 15 bp, Homo sapiens
gcaggagctcctgga

SEQ ID NO: 5755864 - DNA, 21 bp, Homo sapiens
gcaggagcttggcagagagat

SEQ ID NO: 5755865 - DNA, 14 bp, Homo sapiens
gcaggagcttgggt

SEQ ID NO: 5755866 - DNA, 11 bp, Homo sapiens
gcaggaggaag

SEQ ID NO: 5755867 - DNA, 21 bp, Homo sapiens
gcaggaggacagagtgccctg

SEQ ID NO: 5755868 - DNA, 13 bp, Homo sapiens
gcaggaggagccc

SEQ ID NO: 5755869 - DNA, 21 bp, Homo sapiens
gcaggaggaggaaaggtagcc

SEQ ID NO: 5755870 - DNA, 14 bp, Homo sapiens
gcaggaggagtgga

SEQ ID NO: 5755871 - DNA, 18 bp, Homo sapiens
gcaggaggatcacttgag

SEQ ID NO: 5755872 - DNA, 23 bp, Homo sapiens
gcaggaggatcacttgagtccag

SEQ ID NO: 5755873 - DNA, 15 bp, Homo sapiens
gcaggaggcacagca

SEQ ID NO: 5755874 - DNA, 12 bp, Homo sapiens
gcaggaggcagg

SEQ ID NO: 5755875 - DNA, 16 bp, Homo sapiens
gcaggaggccaaactg

SEQ ID NO: 5755876 - DNA, 15 bp, Homo sapiens
gcaggaggccaataa

SEQ ID NO: 5755877 - DNA, 17 bp, Homo sapiens
gcaggaggccaggccgg

SEQ ID NO: 5755878 - DNA, 18 bp, Homo sapiens
gcaggaggccccaggctg

SEQ ID NO: 5755879 - DNA, 23 bp, Homo sapiens
gcaggaggccccaggctgagagc

SEQ ID NO: 5755880 - DNA, 18 bp, Homo sapiens
gcaggaggcccctggccc

SEQ ID NO: 5755881 - DNA, 22 bp, Homo sapiens
gcaggaggcccctggcccagcg

SEQ ID NO: 5755882 - DNA, 22 bp, Homo sapiens
gcaggaggcccttgtcgtggga

SEQ ID NO: 5755883 - DNA, 14 bp, Homo sapiens
gcaggaggcctggg

SEQ ID NO: 5755884 - DNA, 15 bp, Homo sapiens
gcaggaggcctggga

SEQ ID NO: 5755885 - DNA, 18 bp, Homo sapiens
gcaggaggctagcaaagc

SEQ ID NO: 5755886 - DNA, 19 bp, Homo sapiens
gcaggaggctttctgggct

SEQ ID NO: 5755887 - DNA, 21 bp, Homo sapiens
gcaggagggacagtctcacca

SEQ ID NO: 5755888 - DNA, 21 bp, Homo sapiens
gcaggagggactctgtctggc

SEQ ID NO: 5755889 - DNA, 16 bp, Homo sapiens
gcaggagggaggcggg

SEQ ID NO: 5755890 - DNA, 21 bp, Homo sapiens
gcaggagggaggcggggagga

SEQ ID NO: 5755891 - DNA, 22 bp, Homo sapiens
gcaggagggagggtttctctcc

SEQ ID NO: 5755892 - DNA, 15 bp, Homo sapiens
gcaggagggaggtgc

SEQ ID NO: 5755893 - DNA, 15 bp, Homo sapiens
gcaggagggcatgtg

SEQ ID NO: 5755894 - DNA, 14 bp, Homo sapiens
gcaggaggggggag

SEQ ID NO: 5755895 - DNA, 15 bp, Homo sapiens
gcaggaggggggagg

SEQ ID NO: 5755896 - DNA, 17 bp, Homo sapiens
gcaggaggggggctggg

SEQ ID NO: 5755897 - DNA, 18 bp, Homo sapiens
gcaggagggtgaggaggt

SEQ ID NO: 5755898 - DNA, 21 bp, Homo sapiens
gcaggaggttctgggcctctg

SEQ ID NO: 5755899 - DNA, 22 bp, Homo sapiens
gcaggaggttctgggcctctga

SEQ ID NO: 5755900 - DNA, 19 bp, Homo sapiens
gcaggagtagctgagctca

SEQ ID NO: 5755901 - DNA, 20 bp, Homo sapiens
gcaggagtcaccatgcaagg

SEQ ID NO: 5755902 - DNA, 17 bp, Homo sapiens
gcaggagtctctgccac

SEQ ID NO: 5755903 - DNA, 21 bp, Homo sapiens
gcaggagtctctgccagttac

SEQ ID NO: 5755904 - DNA, 14 bp, Homo sapiens
gcaggagtgccagg

SEQ ID NO: 5755905 - DNA, 15 bp, Homo sapiens
gcaggagtgccagga

SEQ ID NO: 5755906 - DNA, 22 bp, Homo sapiens
gcaggagtgccaggaccagcct

SEQ ID NO: 5755907 - DNA, 16 bp, Homo sapiens
gcaggagtgctgccct

SEQ ID NO: 5755908 - DNA, 13 bp, Homo sapiens
gcaggagtgctgg

SEQ ID NO: 5755909 - DNA, 12 bp, Homo sapiens
gcaggagtggaa

SEQ ID NO: 5755910 - DNA, 17 bp, Homo sapiens
gcaggagtggaaggtga

SEQ ID NO: 5755911 - DNA, 21 bp, Homo sapiens
gcaggagtggaaggtgaggcg

SEQ ID NO: 5755912 - DNA, 24 bp, Homo sapiens
gcaggagtggaaggtgaggcgttc

SEQ ID NO: 5755913 - DNA, 15 bp, Homo sapiens
gcaggagtggtgcag

SEQ ID NO: 5755914 - DNA, 15 bp, Homo sapiens
gcaggagtgtcctgc

SEQ ID NO: 5755915 - DNA, 20 bp, Homo sapiens
gcaggagtttcgttttcaaa

SEQ ID NO: 5755916 - DNA, 21 bp, Homo sapiens
gcaggagtttcgttttcaaaa

SEQ ID NO: 5755917 - DNA, 21 bp, Homo sapiens
gcaggatagttgctccgcctc

SEQ ID NO: 5755918 - DNA, 15 bp, Homo sapiens
gcaggatcagatgac

SEQ ID NO: 5755919 - DNA, 14 bp, Homo sapiens
gcaggatccctcct

SEQ ID NO: 5755920 - DNA, 16 bp, Homo sapiens
gcaggatccctcctga

SEQ ID NO: 5755921 - DNA, 22 bp, Homo sapiens
gcaggatccctcctgagctcgg

SEQ ID NO: 5755922 - DNA, 20 bp, Homo sapiens
gcaggatcgaagggttttta

SEQ ID NO: 5755923 - DNA, 19 bp, Homo sapiens
gcaggatcggcttcctcag

SEQ ID NO: 5755924 - DNA, 21 bp, Homo sapiens
gcaggatctcaccaggcagcc

SEQ ID NO: 5755925 - DNA, 19 bp, Homo sapiens
gcaggatctgtctgtgcac

SEQ ID NO: 5755926 - DNA, 14 bp, Homo sapiens
gcaggatgccctgt

SEQ ID NO: 5755927 - DNA, 14 bp, Homo sapiens
gcaggctgcagtgg

SEQ ID NO: 5755928 - DNA, 20 bp, Homo sapiens
gcaggctggaggtaaggcct

SEQ ID NO: 5755929 - DNA, 16 bp, Homo sapiens
gcaggctggcaccgcc

SEQ ID NO: 5755930 - DNA, 18 bp, Homo sapiens
gcaggctggcagctctcc

SEQ ID NO: 5755931 - DNA, 23 bp, Homo sapiens
gcaggctggcagctctccagtca

SEQ ID NO: 5755932 - DNA, 15 bp, Homo sapiens
gcaggctggccagcc

SEQ ID NO: 5755933 - DNA, 17 bp, Homo sapiens
gcaggctggccctgccc

SEQ ID NO: 5755934 - DNA, 18 bp, Homo sapiens
gcaggctggccctgccct

SEQ ID NO: 5755935 - DNA, 11 bp, Homo sapiens
gcaggctgggc

SEQ ID NO: 5755936 - DNA, 14 bp, Homo sapiens
gcaggctggggagg

SEQ ID NO: 5755937 - DNA, 17 bp, Homo sapiens
gcaggctgtctggccag

SEQ ID NO: 5755938 - DNA, 18 bp, Homo sapiens
gcaggcttaataaaaatg

SEQ ID NO: 5755939 - DNA, 21 bp, Homo sapiens
gcaggcttctcagtctctgtc

SEQ ID NO: 5755940 - DNA, 16 bp, Homo sapiens
gcaggcttgggaactg

SEQ ID NO: 5755941 - DNA, 21 bp, Homo sapiens
gcaggcttggggaaaatggcc

SEQ ID NO: 5755942 - DNA, 23 bp, Homo sapiens
gcaggctttgccattgtgaacca

SEQ ID NO: 5755943 - DNA, 19 bp, Homo sapiens
gcaggctttgtgagagagg

SEQ ID NO: 5755944 - DNA, 21 bp, Homo sapiens
gcaggctttgtgagagaggac

SEQ ID NO: 5755945 - DNA, 22 bp, Homo sapiens
gcaggctttgtttatagcttgc

SEQ ID NO: 5755946 - DNA, 17 bp, Homo sapiens
gcagggaaagctccacg

SEQ ID NO: 5755947 - DNA, 22 bp, Homo sapiens
gcagggaaagggatggtcaggc

SEQ ID NO: 5755948 - DNA, 14 bp, Homo sapiens
gcagggaagagggc

SEQ ID NO: 5755949 - DNA, 15 bp, Homo sapiens
gcagggaagctttca

SEQ ID NO: 5755950 - DNA, 16 bp, Homo sapiens
gcagggaaggcctgac

SEQ ID NO: 5755951 - DNA, 20 bp, Homo sapiens
gcagggaagggtgcctggct

SEQ ID NO: 5755952 - DNA, 23 bp, Homo sapiens
gcagggaagggtgcctggctggg

SEQ ID NO: 5755953 - DNA, 21 bp, Homo sapiens
gcagggaagtgtaagaaacac

SEQ ID NO: 5755954 - DNA, 19 bp, Homo sapiens
gcagggaattgggggggtg

SEQ ID NO: 5755955 - DNA, 15 bp, Homo sapiens
gcagggaatttctat

SEQ ID NO: 5755956 - DNA, 20 bp, Homo sapiens
gcagggacaagtctttctcc

SEQ ID NO: 5755957 - DNA, 18 bp, Homo sapiens
gcagggacacgggcagcc

SEQ ID NO: 5755958 - DNA, 15 bp, Homo sapiens
gcagggacagagatg

SEQ ID NO: 5755959 - DNA, 16 bp, Homo sapiens
gcagggacagttgggt

SEQ ID NO: 5755960 - DNA, 20 bp, Homo sapiens
gcagggacatggggcaagcc

SEQ ID NO: 5755961 - DNA, 21 bp, Homo sapiens
gcagggacatggggcaagcca

SEQ ID NO: 5755962 - DNA, 23 bp, Homo sapiens
gcagggaccaagatgtcaagctg

SEQ ID NO: 5755963 - DNA, 17 bp, Homo sapiens
gcagggacctgagagca

SEQ ID NO: 5755964 - DNA, 20 bp, Homo sapiens
gcagggactgtaaacacaga

SEQ ID NO: 5755965 - DNA, 19 bp, Homo sapiens
gcagggacttgaacccata

SEQ ID NO: 5755966 - DNA, 18 bp, Homo sapiens
gcagggacttgcctccac

SEQ ID NO: 5755967 - DNA, 16 bp, Homo sapiens
gcagggagaccctggg

SEQ ID NO: 5755968 - DNA, 20 bp, Homo sapiens
gcagggagcaccacggccag

SEQ ID NO: 5755969 - DNA, 15 bp, Homo sapiens
gcagggagcagcacg

SEQ ID NO: 5755970 - DNA, 17 bp, Homo sapiens
gcagggagcgcggcagc

SEQ ID NO: 5755971 - DNA, 22 bp, Homo sapiens
gcagggagctgggcccgacatg

SEQ ID NO: 5755972 - DNA, 16 bp, Homo sapiens
gcagggaggatgccac

SEQ ID NO: 5755973 - DNA, 14 bp, Homo sapiens
gcagggaggcagcc

SEQ ID NO: 5755974 - DNA, 12 bp, Homo sapiens
gcagggaggcca

SEQ ID NO: 5755975 - DNA, 13 bp, Homo sapiens
gcagggaggccac

SEQ ID NO: 5755976 - DNA, 14 bp, Homo sapiens
gcagggagggcctg

SEQ ID NO: 5755977 - DNA, 13 bp, Homo sapiens
gcagggagggctt

SEQ ID NO: 5755978 - DNA, 16 bp, Homo sapiens
gcagggagggcttctg

SEQ ID NO: 5755979 - DNA, 14 bp, Homo sapiens
gcagggaggggact

SEQ ID NO: 5755980 - DNA, 14 bp, Homo sapiens
gcagggaggggagg

SEQ ID NO: 5755981 - DNA, 12 bp, Homo sapiens
gcagggaggggc

SEQ ID NO: 5755982 - DNA, 16 bp, Homo sapiens
gcagggaggggcatgg

SEQ ID NO: 5755983 - DNA, 13 bp, Homo sapiens
gcagggaggggct

SEQ ID NO: 5755984 - DNA, 16 bp, Homo sapiens
gcagggagggggctgg

SEQ ID NO: 5755985 - DNA, 18 bp, Homo sapiens
gcagggagggggctggga

SEQ ID NO: 5755986 - DNA, 16 bp, Homo sapiens
gcagggaggtcaggcc

SEQ ID NO: 5755987 - DNA, 18 bp, Homo sapiens
gcagggaggtcaggccct

SEQ ID NO: 5755988 - DNA, 20 bp, Homo sapiens
gcagggaggtcaggccctgg

SEQ ID NO: 5755989 - DNA, 22 bp, Homo sapiens
gcagggaggtgggggcctcctc

SEQ ID NO: 5755990 - DNA, 14 bp, Homo sapiens
gcagggagtgtctg

SEQ ID NO: 5755991 - DNA, 15 bp, Homo sapiens
gcagggagtgtctgc

SEQ ID NO: 5755992 - DNA, 16 bp, Homo sapiens
gcagggagtgtctgca

SEQ ID NO: 5755993 - DNA, 22 bp, Homo sapiens
gcagggagtgtctgcagtcctg

SEQ ID NO: 5755994 - DNA, 18 bp, Homo sapiens
gcagggagttagcactga

SEQ ID NO: 5755995 - DNA, 22 bp, Homo sapiens
gcagggatgatggcagagccag

SEQ ID NO: 5755996 - DNA, 19 bp, Homo sapiens
gcagggatgggggtggctg

SEQ ID NO: 5755997 - DNA, 20 bp, Homo sapiens
gcagggatgggggtggctgg

SEQ ID NO: 5755998 - DNA, 15 bp, Homo sapiens
gcagggattgctgcc

SEQ ID NO: 5755999 - DNA, 22 bp, Homo sapiens
gcagggattgctgccacttttt

SEQ ID NO: 5756000 - DNA, 14 bp, Homo sapiens
gcagggatttgagg

SEQ ID NO: 5756001 - DNA, 23 bp, Homo sapiens
gcagggcaaatgacatgcactga

SEQ ID NO: 5756002 - DNA, 18 bp, Homo sapiens
gcagggcacagaaggctg

SEQ ID NO: 5756003 - DNA, 17 bp, Homo sapiens
gcagggcacagatgacc

SEQ ID NO: 5756004 - DNA, 14 bp, Homo sapiens
gcagggcagaggga

SEQ ID NO: 5756005 - DNA, 12 bp, Homo sapiens
gcagggcagcag

SEQ ID NO: 5756006 - DNA, 14 bp, Homo sapiens
gcagggcagcaggc

SEQ ID NO: 5756007 - DNA, 12 bp, Homo sapiens
gcagggcagccc

SEQ ID NO: 5756008 - DNA, 12 bp, Homo sapiens
gcagggcagcct

SEQ ID NO: 5756009 - DNA, 13 bp, Homo sapiens
gcagggcagcctg

SEQ ID NO: 5756010 - DNA, 14 bp, Homo sapiens
gcagggcagcctgt

SEQ ID NO: 5756011 - DNA, 16 bp, Homo sapiens
gcagggcagcctgtgg

SEQ ID NO: 5756012 - DNA, 20 bp, Homo sapiens
gcagggcagcctgtgggaga

SEQ ID NO: 5756013 - DNA, 23 bp, Homo sapiens
gcagggcagcctgtgggagaagg

SEQ ID NO: 5756014 - DNA, 14 bp, Homo sapiens
gcagggcaggacca

SEQ ID NO: 5756015 - DNA, 18 bp, Homo sapiens
gcagggcaggaccagccc

SEQ ID NO: 5756016 - DNA, 13 bp, Homo sapiens
gcagggcaggccc

SEQ ID NO: 5756017 - DNA, 16 bp, Homo sapiens
gcagggcagggcggct

SEQ ID NO: 5756018 - DNA, 18 bp, Homo sapiens
gcagggccacctgcagga

SEQ ID NO: 5756019 - DNA, 21 bp, Homo sapiens
gcagggccacctgcaggaccc

SEQ ID NO: 5756020 - DNA, 14 bp, Homo sapiens
gcagggccaggact

SEQ ID NO: 5756021 - DNA, 15 bp, Homo sapiens
gcagggccaggactg

SEQ ID NO: 5756022 - DNA, 13 bp, Homo sapiens
gcagggccaggcc

SEQ ID NO: 5756023 - DNA, 14 bp, Homo sapiens
gcagggccaggcct

SEQ ID NO: 5756024 - DNA, 15 bp, Homo sapiens
gcagggccaggcctc

SEQ ID NO: 5756025 - DNA, 15 bp, Homo sapiens
gcagggccaggctgg

SEQ ID NO: 5756026 - DNA, 13 bp, Homo sapiens
gcagggccagggc

SEQ ID NO: 5756027 - DNA, 16 bp, Homo sapiens
gcagggccagggcaat

SEQ ID NO: 5756028 - DNA, 17 bp, Homo sapiens
gcagggccagggcaatg

SEQ ID NO: 5756029 - DNA, 21 bp, Homo sapiens
gcagggccagggcaatgccat

SEQ ID NO: 5756030 - DNA, 16 bp, Homo sapiens
gcagggccatccactg

SEQ ID NO: 5756031 - DNA, 19 bp, Homo sapiens
gcagggccatccactgtga

SEQ ID NO: 5756032 - DNA, 15 bp, Homo sapiens
gcagggccatgcaga

SEQ ID NO: 5756033 - DNA, 16 bp, Homo sapiens
gcagggcccagggagg

SEQ ID NO: 5756034 - DNA, 23 bp, Homo sapiens
gcagggcccagggaggtggcagg

SEQ ID NO: 5756035 - DNA, 14 bp, Homo sapiens
gcagggcccatctg

SEQ ID NO: 5756036 - DNA, 12 bp, Homo sapiens
gcagggcccctg

SEQ ID NO: 5756037 - DNA, 19 bp, Homo sapiens
gcagggcccctgaccctcc

SEQ ID NO: 5756038 - DNA, 15 bp, Homo sapiens
gcagggccctcagag

SEQ ID NO: 5756039 - DNA, 17 bp, Homo sapiens
gcagggccctcagagga

SEQ ID NO: 5756040 - DNA, 20 bp, Homo sapiens
gcagggccctcagaggaaag

SEQ ID NO: 5756041 - DNA, 24 bp, Homo sapiens
gcagggccctctggggctcagccc

SEQ ID NO: 5756042 - DNA, 15 bp, Homo sapiens
gcagggccctggggt

SEQ ID NO: 5756043 - DNA, 23 bp, Homo sapiens
gcagggccctggggtctctgagc

SEQ ID NO: 5756044 - DNA, 12 bp, Homo sapiens
gcagggccctgt

SEQ ID NO: 5756045 - DNA, 19 bp, Homo sapiens
gcagggccctgtggctcca

SEQ ID NO: 5756046 - DNA, 21 bp, Homo sapiens
gcagggccctgtggctccagg

SEQ ID NO: 5756047 - DNA, 20 bp, Homo sapiens
gcagggcccttggggctggg

SEQ ID NO: 5756048 - DNA, 17 bp, Homo sapiens
gcagggccgcagggcgc

SEQ ID NO: 5756049 - DNA, 23 bp, Homo sapiens
gcagggccgccagggagacctgg

SEQ ID NO: 5756050 - DNA, 22 bp, Homo sapiens
gcagggccgcgagaggccgagc

SEQ ID NO: 5756051 - DNA, 22 bp, Homo sapiens
gcagggccgggcagggggacag

SEQ ID NO: 5756052 - DNA, 23 bp, Homo sapiens
gcagggccggggaactggccaag

SEQ ID NO: 5756053 - DNA, 22 bp, Homo sapiens
gcagggcctatatgccagcgcc

SEQ ID NO: 5756054 - DNA, 16 bp, Homo sapiens
gcagggcctcacacgg

SEQ ID NO: 5756055 - DNA, 14 bp, Homo sapiens
gcagggcctctgtc

SEQ ID NO: 5756056 - DNA, 14 bp, Homo sapiens
gcagggcctgctac

SEQ ID NO: 5756057 - DNA, 11 bp, Homo sapiens
gcagggcctgg

SEQ ID NO: 5756058 - DNA, 14 bp, Homo sapiens
gcagggcctggcat

SEQ ID NO: 5756059 - DNA, 13 bp, Homo sapiens
gcagggcctggcg

SEQ ID NO: 5756060 - DNA, 13 bp, Homo sapiens
gcagggcctggct

SEQ ID NO: 5756061 - DNA, 14 bp, Homo sapiens
gcagggcctggctc

SEQ ID NO: 5756062 - DNA, 17 bp, Homo sapiens
gcagggcctggctccag

SEQ ID NO: 5756063 - DNA, 18 bp, Homo sapiens
gcagggcctggctccagt

SEQ ID NO: 5756064 - DNA, 19 bp, Homo sapiens
gcagggccttctgcctgct

SEQ ID NO: 5756065 - DNA, 15 bp, Homo sapiens
gcagggcgagctgca

SEQ ID NO: 5756066 - DNA, 16 bp, Homo sapiens
gcagggcgagctgcag

SEQ ID NO: 5756067 - DNA, 17 bp, Homo sapiens
gcagggcgcccctggga

SEQ ID NO: 5756068 - DNA, 14 bp, Homo sapiens
gcagggcgctccgg

SEQ ID NO: 5756069 - DNA, 20 bp, Homo sapiens
gcagggcgctccggcagagg

SEQ ID NO: 5756070 - DNA, 19 bp, Homo sapiens
gcagggcggctaggccggc

SEQ ID NO: 5756071 - DNA, 13 bp, Homo sapiens
gcagggcggctgc

SEQ ID NO: 5756072 - DNA, 17 bp, Homo sapiens
gcagggcgggcagaggg

SEQ ID NO: 5756073 - DNA, 20 bp, Homo sapiens
gcagggcgggcagagggctg

SEQ ID NO: 5756074 - DNA, 17 bp, Homo sapiens
gcagggcgggccaggag

SEQ ID NO: 5756075 - DNA, 20 bp, Homo sapiens
gcagggcgtgaggaactctc

SEQ ID NO: 5756076 - DNA, 18 bp, Homo sapiens
gcagggctaaataaagag

SEQ ID NO: 5756077 - DNA, 20 bp, Homo sapiens
gcagggctaccctgagctga

SEQ ID NO: 5756078 - DNA, 21 bp, Homo sapiens
gcagggctcacactcctgggc

SEQ ID NO: 5756079 - DNA, 14 bp, Homo sapiens
gcagggctcagcgg

SEQ ID NO: 5756080 - DNA, 12 bp, Homo sapiens
gcagggctcagg

SEQ ID NO: 5756081 - DNA, 14 bp, Homo sapiens
gcagggctcaggat

SEQ ID NO: 5756082 - DNA, 15 bp, Homo sapiens
gcagggctctcctgg

SEQ ID NO: 5756083 - DNA, 16 bp, Homo sapiens
gcagggctctcctggc

SEQ ID NO: 5756084 - DNA, 12 bp, Homo sapiens
gcagggctctga

SEQ ID NO: 5756085 - DNA, 19 bp, Homo sapiens
gcagggctctgccccagag

SEQ ID NO: 5756086 - DNA, 13 bp, Homo sapiens
gcagggctgagga

SEQ ID NO: 5756087 - DNA, 21 bp, Homo sapiens
gcagggctggccccagggcac

SEQ ID NO: 5756088 - DNA, 12 bp, Homo sapiens
gcagggctggga

SEQ ID NO: 5756089 - DNA, 14 bp, Homo sapiens
gcagggctgggcca

SEQ ID NO: 5756090 - DNA, 20 bp, Homo sapiens
gcagggctgggccaggtctc

SEQ ID NO: 5756091 - DNA, 16 bp, Homo sapiens
gcagggctgggcctgc

SEQ ID NO: 5756092 - DNA, 13 bp, Homo sapiens
gcagggctgggtc

SEQ ID NO: 5756093 - DNA, 15 bp, Homo sapiens
gcagggctgggtcag

SEQ ID NO: 5756094 - DNA, 19 bp, Homo sapiens
gcagggctggtcacctccc

SEQ ID NO: 5756095 - DNA, 13 bp, Homo sapiens
gcagggctgtgct

SEQ ID NO: 5756096 - DNA, 21 bp, Homo sapiens
gcagggctgttccctccaggc

SEQ ID NO: 5756097 - DNA, 20 bp, Homo sapiens
gcaggggaattccctccccc

SEQ ID NO: 5756098 - DNA, 13 bp, Homo sapiens
gcaggggactggg

SEQ ID NO: 5756099 - DNA, 13 bp, Homo sapiens
gcaggggagaagc

SEQ ID NO: 5756100 - DNA, 20 bp, Homo sapiens
gcaggggagacaggagccta

SEQ ID NO: 5756101 - DNA, 15 bp, Homo sapiens
gcaggggagccaggg

SEQ ID NO: 5756102 - DNA, 21 bp, Homo sapiens
gcaggggagcttgggactcag

SEQ ID NO: 5756103 - DNA, 21 bp, Homo sapiens
gcaggggaggccatctggaga

SEQ ID NO: 5756104 - DNA, 24 bp, Homo sapiens
gcaggggatggcgtggtcaagcac

SEQ ID NO: 5756105 - DNA, 14 bp, Homo sapiens
gcaggggcagaagg

SEQ ID NO: 5756106 - DNA, 16 bp, Homo sapiens
gcaggttgataaatca

SEQ ID NO: 5756107 - DNA, 19 bp, Homo sapiens
gcaggttgataaatcattt

SEQ ID NO: 5756108 - DNA, 14 bp, Homo sapiens
gcaggttggacccc

SEQ ID NO: 5756109 - DNA, 23 bp, Homo sapiens
gcaggttgggccatactggcctc

SEQ ID NO: 5756110 - DNA, 22 bp, Homo sapiens
gcaggtttatattgggaagctg

SEQ ID NO: 5756111 - DNA, 16 bp, Homo sapiens
gcaggtttcatttctt

SEQ ID NO: 5756112 - DNA, 19 bp, Homo sapiens
gcaggtttcatttcttatc

SEQ ID NO: 5756113 - DNA, 19 bp, Homo sapiens
gcaggtttgaccaggaaag

SEQ ID NO: 5756114 - DNA, 20 bp, Homo sapiens
gcaggtttgttttcagcact

SEQ ID NO: 5756115 - DNA, 19 bp, Homo sapiens
gcagtaaaaaatggtgttt

SEQ ID NO: 5756116 - DNA, 22 bp, Homo sapiens
gcagtaaaaaatggtgttttat

SEQ ID NO: 5756117 - DNA, 15 bp, Homo sapiens
gcagtaaaacacatt

SEQ ID NO: 5756118 - DNA, 20 bp, Homo sapiens
gcagtaaaagataaatttgt

SEQ ID NO: 5756119 - DNA, 15 bp, Homo sapiens
gcagtaaatttgcta

SEQ ID NO: 5756120 - DNA, 16 bp, Homo sapiens
gcagtaacactggcct

SEQ ID NO: 5756121 - DNA, 13 bp, Homo sapiens
gcagtaacttggg

SEQ ID NO: 5756122 - DNA, 13 bp, Homo sapiens
gcagtaagcaggc

SEQ ID NO: 5756123 - DNA, 18 bp, Homo sapiens
gcagtaagtcttttttga

SEQ ID NO: 5756124 - DNA, 21 bp, Homo sapiens
gcagtaatattttaagatgga

SEQ ID NO: 5756125 - DNA, 18 bp, Homo sapiens
gcagtaatgatatttatt

SEQ ID NO: 5756126 - DNA, 16 bp, Homo sapiens
gcagtaattcaactgg

SEQ ID NO: 5756127 - DNA, 14 bp, Homo sapiens
gcagtacagagtgc

SEQ ID NO: 5756128 - DNA, 18 bp, Homo sapiens
gcagtacatcttgtgcat

SEQ ID NO: 5756129 - DNA, 14 bp, Homo sapiens
gcagtacctgaggg

SEQ ID NO: 5756130 - DNA, 19 bp, Homo sapiens
gcagtacctgggcaagctg

SEQ ID NO: 5756131 - DNA, 17 bp, Homo sapiens
gcagtactcctccctgg

SEQ ID NO: 5756132 - DNA, 20 bp, Homo sapiens
gcagtactcctccctggggg

SEQ ID NO: 5756133 - DNA, 23 bp, Homo sapiens
gcagtactcctccctgggggcgg

SEQ ID NO: 5756134 - DNA, 20 bp, Homo sapiens
gcagtagaaataatatgcat

SEQ ID NO: 5756135 - DNA, 17 bp, Homo sapiens
gcagtagaactccaggc

SEQ ID NO: 5756136 - DNA, 22 bp, Homo sapiens
gcagtagaaggtcggaggcttg

SEQ ID NO: 5756137 - DNA, 16 bp, Homo sapiens
gcagtagacattttaa

SEQ ID NO: 5756138 - DNA, 20 bp, Homo sapiens
gcagtagagtcatctccatc

SEQ ID NO: 5756139 - DNA, 17 bp, Homo sapiens
gcagtagcctcctcctg

SEQ ID NO: 5756140 - DNA, 22 bp, Homo sapiens
gcagtagctttggggaaaggga

SEQ ID NO: 5756141 - DNA, 20 bp, Homo sapiens
gcagtaggccggtgtgcctg

SEQ ID NO: 5756142 - DNA, 22 bp, Homo sapiens
gcagtagtgccaaaaggcccct

SEQ ID NO: 5756143 - DNA, 17 bp, Homo sapiens
gcagtataaaatgtaaa

SEQ ID NO: 5756144 - DNA, 16 bp, Homo sapiens
gcagtataattttcta

SEQ ID NO: 5756145 - DNA, 16 bp, Homo sapiens
gcagtatataataact

SEQ ID NO: 5756146 - DNA, 19 bp, Homo sapiens
gcagtatataataacttta

SEQ ID NO: 5756147 - DNA, 21 bp, Homo sapiens
gcagtatatcacagagccact

SEQ ID NO: 5756148 - DNA, 12 bp, Homo sapiens
gcagtatatttc

SEQ ID NO: 5756149 - DNA, 15 bp, Homo sapiens
gcagtatcacaggcc

SEQ ID NO: 5756150 - DNA, 16 bp, Homo sapiens
gcagtatcacaggcca

SEQ ID NO: 5756151 - DNA, 14 bp, Homo sapiens
gcagtatcatctga

SEQ ID NO: 5756152 - DNA, 21 bp, Homo sapiens
gcagtatcatgccctgtgcaa

SEQ ID NO: 5756153 - DNA, 16 bp, Homo sapiens
gcagtatctctctgcc

SEQ ID NO: 5756154 - DNA, 19 bp, Homo sapiens
gcagtatctcttgctggga

SEQ ID NO: 5756155 - DNA, 17 bp, Homo sapiens
gcagtatgaatgatgtt

SEQ ID NO: 5756156 - DNA, 16 bp, Homo sapiens
gcagtatggccagacg

SEQ ID NO: 5756157 - DNA, 17 bp, Homo sapiens
gcagtatggcggaggcc

SEQ ID NO: 5756158 - DNA, 17 bp, Homo sapiens
gcagtatggtacatttt

SEQ ID NO: 5756159 - DNA, 16 bp, Homo sapiens
gcagtatgtgtgctct

SEQ ID NO: 5756160 - DNA, 17 bp, Homo sapiens
gcagtattacagaggtc

SEQ ID NO: 5756161 - DNA, 21 bp, Homo sapiens
gcagtattccatgggatgtta

SEQ ID NO: 5756162 - DNA, 13 bp, Homo sapiens
gcagtattgagtt

SEQ ID NO: 5756163 - DNA, 23 bp, Homo sapiens
gcagtatttcatttcttgtcaat

SEQ ID NO: 5756164 - DNA, 14 bp, Homo sapiens
gcagtattttctgt

SEQ ID NO: 5756165 - DNA, 18 bp, Homo sapiens
gcagtcacaacagagtga

SEQ ID NO: 5756166 - DNA, 18 bp, Homo sapiens
gcagtcacactgctggga

SEQ ID NO: 5756167 - DNA, 18 bp, Homo sapiens
gcagtcacaggcccagga

SEQ ID NO: 5756168 - DNA, 22 bp, Homo sapiens
gcagtcacaggcccaggaaggc

SEQ ID NO: 5756169 - DNA, 23 bp, Homo sapiens
gcagtcacaggcccaggaaggcg

SEQ ID NO: 5756170 - DNA, 20 bp, Homo sapiens
gcagtcacaggtcttttctt

SEQ ID NO: 5756171 - DNA, 18 bp, Homo sapiens
gcagtcacatcacaatat

SEQ ID NO: 5756172 - DNA, 13 bp, Homo sapiens
gcagtcaccgccg

SEQ ID NO: 5756173 - DNA, 22 bp, Homo sapiens
gcagtcactctagtcaatgaca

SEQ ID NO: 5756174 - DNA, 14 bp, Homo sapiens
gcagtcactggagg

SEQ ID NO: 5756175 - DNA, 13 bp, Homo sapiens
gcagtcactgtga

SEQ ID NO: 5756176 - DNA, 14 bp, Homo sapiens
gcagtcactttgac

SEQ ID NO: 5756177 - DNA, 11 bp, Homo sapiens
gcagtcagact

SEQ ID NO: 5756178 - DNA, 16 bp, Homo sapiens
gcagtcagcacagaga

SEQ ID NO: 5756179 - DNA, 18 bp, Homo sapiens
gcagtcagcacagagagc

SEQ ID NO: 5756180 - DNA, 23 bp, Homo sapiens
gcagtcagcagatgctgttgtga

SEQ ID NO: 5756181 - DNA, 13 bp, Homo sapiens
gcagtcagccctg

SEQ ID NO: 5756182 - DNA, 14 bp, Homo sapiens
gcagtcagcggaga

SEQ ID NO: 5756183 - DNA, 20 bp, Homo sapiens
gcagtcaggggtcaggtgtc

SEQ ID NO: 5756184 - DNA, 17 bp, Homo sapiens
gcagtcagggtgggaag

SEQ ID NO: 5756185 - DNA, 22 bp, Homo sapiens
gcagtcagtcacaaaccagcct

SEQ ID NO: 5756186 - DNA, 15 bp, Homo sapiens
gcagtcagtggaggg

SEQ ID NO: 5756187 - DNA, 15 bp, Homo sapiens
gcagtcagtgtttct

SEQ ID NO: 5756188 - DNA, 15 bp, Homo sapiens
gcagtcatcaacaaa

SEQ ID NO: 5756189 - DNA, 17 bp, Homo sapiens
gcagtcatcaacaatga

SEQ ID NO: 5756190 - DNA, 18 bp, Homo sapiens
gcagtcatcaacaatgat

SEQ ID NO: 5756191 - DNA, 17 bp, Homo sapiens
gcagtcatctacttttt

SEQ ID NO: 5756192 - DNA, 22 bp, Homo sapiens
gcagtcatcttgaccaagcagg

SEQ ID NO: 5756193 - DNA, 19 bp, Homo sapiens
gcagtccacttctgacagc

SEQ ID NO: 5756194 - DNA, 20 bp, Homo sapiens
gcagtccacttctgacagcc

SEQ ID NO: 5756195 - DNA, 23 bp, Homo sapiens
gcagtccacttctgacagcctca

SEQ ID NO: 5756196 - DNA, 19 bp, Homo sapiens
gcagtccagaataagtgct

SEQ ID NO: 5756197 - DNA, 14 bp, Homo sapiens
gcagtccagccagc

SEQ ID NO: 5756198 - DNA, 17 bp, Homo sapiens
gcagtccagccagctcc

SEQ ID NO: 5756199 - DNA, 18 bp, Homo sapiens
gcagtccagccagctcct

SEQ ID NO: 5756200 - DNA, 16 bp, Homo sapiens
gcagtcccaagcggtg

SEQ ID NO: 5756201 - DNA, 15 bp, Homo sapiens
gcagtcccacactgt

SEQ ID NO: 5756202 - DNA, 20 bp, Homo sapiens
gcagtcccacactgtgcaga

SEQ ID NO: 5756203 - DNA, 21 bp, Homo sapiens
gcagtcccagtattctcagag

SEQ ID NO: 5756204 - DNA, 13 bp, Homo sapiens
gcagtccccagcc

SEQ ID NO: 5756205 - DNA, 14 bp, Homo sapiens
gcagtccccttccc

SEQ ID NO: 5756206 - DNA, 15 bp, Homo sapiens
gcagtcccgtggagg

SEQ ID NO: 5756207 - DNA, 18 bp, Homo sapiens
gcagtcccgtggagggta

SEQ ID NO: 5756208 - DNA, 20 bp, Homo sapiens
gcagtcccgtggagggtagg

SEQ ID NO: 5756209 - DNA, 16 bp, Homo sapiens
gcagtcctcaggaagg

SEQ ID NO: 5756210 - DNA, 21 bp, Homo sapiens
gcagtcctcccaccttggcct

SEQ ID NO: 5756211 - DNA, 17 bp, Homo sapiens
gcagtcctgaggagagg

SEQ ID NO: 5756212 - DNA, 18 bp, Homo sapiens
gcagtcctgcctcagcct

SEQ ID NO: 5756213 - DNA, 15 bp, Homo sapiens
gcagtcctggaggca

SEQ ID NO: 5756214 - DNA, 17 bp, Homo sapiens
gcagtcctggaggcagg

SEQ ID NO: 5756215 - DNA, 22 bp, Homo sapiens
gcagtcctggaggcagggggtg

SEQ ID NO: 5756216 - DNA, 20 bp, Homo sapiens
gcagtcctggtggggctgag

SEQ ID NO: 5756217 - DNA, 23 bp, Homo sapiens
gcagtcctggtggggctgagcct

SEQ ID NO: 5756218 - DNA, 15 bp, Homo sapiens
gcagtcctgttcaaa

SEQ ID NO: 5756219 - DNA, 14 bp, Homo sapiens
gcagtccttactcc

SEQ ID NO: 5756220 - DNA, 22 bp, Homo sapiens
gcagtcctttgtaaacagtgtt

SEQ ID NO: 5756221 - DNA, 12 bp, Homo sapiens
gcagtcgcagga

SEQ ID NO: 5756222 - DNA, 15 bp, Homo sapiens
gcagtcgcaggatcc

SEQ ID NO: 5756223 - DNA, 23 bp, Homo sapiens
gcagtcgcaggatccgctgccac

SEQ ID NO: 5756224 - DNA, 23 bp, Homo sapiens
gcagtcgcctgcctgcagcaggc

SEQ ID NO: 5756225 - DNA, 17 bp, Homo sapiens
gcagtcgggggctggcc

SEQ ID NO: 5756226 - DNA, 20 bp, Homo sapiens
gcagtcgggggctggcctag

SEQ ID NO: 5756227 - DNA, 14 bp, Homo sapiens
gcagtcgtcagcct

SEQ ID NO: 5756228 - DNA, 15 bp, Homo sapiens
gcagtcgtcagcctc

SEQ ID NO: 5756229 - DNA, 15 bp, Homo sapiens
gcagtcgtcgcacag

SEQ ID NO: 5756230 - DNA, 20 bp, Homo sapiens
gcagtcgtcgcacagtctct

SEQ ID NO: 5756231 - DNA, 16 bp, Homo sapiens
gcagtcgtgcctgtgt

SEQ ID NO: 5756232 - DNA, 23 bp, Homo sapiens
gcagtcgtggggaacggaggagg

SEQ ID NO: 5756233 - DNA, 15 bp, Homo sapiens
gcagtctaccctgtc

SEQ ID NO: 5756234 - DNA, 18 bp, Homo sapiens
gcagtctaccctgtcctt

SEQ ID NO: 5756235 - DNA, 19 bp, Homo sapiens
gcagtctaccctgtccttt

SEQ ID NO: 5756236 - DNA, 15 bp, Homo sapiens
gcagtctagtcctgg

SEQ ID NO: 5756237 - DNA, 15 bp, Homo sapiens
gcagtctcagaaagc

SEQ ID NO: 5756238 - DNA, 21 bp, Homo sapiens
gcagtctcagaaagccttcca

SEQ ID NO: 5756239 - DNA, 20 bp, Homo sapiens
gcagtctccccttcctggca

SEQ ID NO: 5756240 - DNA, 14 bp, Homo sapiens
gcagtctccgctcc

SEQ ID NO: 5756241 - DNA, 17 bp, Homo sapiens
gcagtctccgctcccgc

SEQ ID NO: 5756242 - DNA, 18 bp, Homo sapiens
gcagtctcctctttaaaa

SEQ ID NO: 5756243 - DNA, 20 bp, Homo sapiens
gcagtctcctctttaaaaca

SEQ ID NO: 5756244 - DNA, 16 bp, Homo sapiens
gcagtctccttcagca

SEQ ID NO: 5756245 - DNA, 20 bp, Homo sapiens
gcagtctctataccaataaa

SEQ ID NO: 5756246 - DNA, 14 bp, Homo sapiens
gcagtctctatatt

SEQ ID NO: 5756247 - DNA, 17 bp, Homo sapiens
gcagtctgatccaggag

SEQ ID NO: 5756248 - DNA, 20 bp, Homo sapiens
gcagtctgcccacgcagagg

SEQ ID NO: 5756249 - DNA, 22 bp, Homo sapiens
gcagtctgcccacgcagaggac

SEQ ID NO: 5756250 - DNA, 22 bp, Homo sapiens
gcagtctgcttcagtgcagtga

SEQ ID NO: 5756251 - DNA, 13 bp, Homo sapiens
gcagtctggaggg

SEQ ID NO: 5756252 - DNA, 17 bp, Homo sapiens
gcagtctgtccaggctc

SEQ ID NO: 5756253 - DNA, 21 bp, Homo sapiens
gcagtcttatgcttccagaaa

SEQ ID NO: 5756254 - DNA, 14 bp, Homo sapiens
gcagtcttcagttt

SEQ ID NO: 5756255 - DNA, 23 bp, Homo sapiens
gcagtcttctctctggctcaggt

SEQ ID NO: 5756256 - DNA, 21 bp, Homo sapiens
gcagtcttctgggctgcggga

SEQ ID NO: 5756257 - DNA, 14 bp, Homo sapiens
gcagtctttccccc

SEQ ID NO: 5756258 - DNA, 18 bp, Homo sapiens
gcagtctttcccccagga

SEQ ID NO: 5756259 - DNA, 21 bp, Homo sapiens
gcagtctttgctcagtggatc

SEQ ID NO: 5756260 - DNA, 18 bp, Homo sapiens
gcagtcttttgctgtgct

SEQ ID NO: 5756261 - DNA, 21 bp, Homo sapiens
gcagtgaaaacaagtgctggc

SEQ ID NO: 5756262 - DNA, 12 bp, Homo sapiens
gcagtgaaactt

SEQ ID NO: 5756263 - DNA, 18 bp, Homo sapiens
gcagtgaaagacaagctg

SEQ ID NO: 5756264 - DNA, 15 bp, Homo sapiens
gcagtgaactgagac

SEQ ID NO: 5756265 - DNA, 18 bp, Homo sapiens
gcagtgaagatgtgtaaa

SEQ ID NO: 5756266 - DNA, 19 bp, Homo sapiens
gcagtgaagatgtgtaaat

SEQ ID NO: 5756267 - DNA, 14 bp, Homo sapiens
gcagtgaagtgttc

SEQ ID NO: 5756268 - DNA, 17 bp, Homo sapiens
gcagtgacgtgagtggg

SEQ ID NO: 5756269 - DNA, 19 bp, Homo sapiens
gcagtgactccccagccca

SEQ ID NO: 5756270 - DNA, 18 bp, Homo sapiens
gcagtgagagttcctctt

SEQ ID NO: 5756271 - DNA, 13 bp, Homo sapiens
gcagtgagcagag

SEQ ID NO: 5756272 - DNA, 16 bp, Homo sapiens
gcagtgagcagggtgg

SEQ ID NO: 5756273 - DNA, 18 bp, Homo sapiens
gcagtgagcagggtgggg

SEQ ID NO: 5756274 - DNA, 16 bp, Homo sapiens
gcagtgagcagggttc

SEQ ID NO: 5756275 - DNA, 19 bp, Homo sapiens
gcagtgagcagggttcctg

SEQ ID NO: 5756276 - DNA, 17 bp, Homo sapiens
gcagtgagcttctatta

SEQ ID NO: 5756277 - DNA, 15 bp, Homo sapiens
gcagtgagtgagcct

SEQ ID NO: 5756278 - DNA, 19 bp, Homo sapiens
gcagtgagttacagcgaga

SEQ ID NO: 5756279 - DNA, 15 bp, Homo sapiens
gcagtgatgtggtgg

SEQ ID NO: 5756280 - DNA, 13 bp, Homo sapiens
gcagtgattttta

SEQ ID NO: 5756281 - DNA, 14 bp, Homo sapiens
gcagtgatttttat

SEQ ID NO: 5756282 - DNA, 16 bp, Homo sapiens
gcagtgcacctctcat

SEQ ID NO: 5756283 - DNA, 18 bp, Homo sapiens
gcagtgcaggcacagtat

SEQ ID NO: 5756284 - DNA, 12 bp, Homo sapiens
gcagtgcagtgc

SEQ ID NO: 5756285 - DNA, 15 bp, Homo sapiens
gcagtgcatgctgtc

SEQ ID NO: 5756286 - DNA, 16 bp, Homo sapiens
gcagtgcatgctgtcc

SEQ ID NO: 5756287 - DNA, 20 bp, Homo sapiens
gcagtgcatgtgaagcatgc

SEQ ID NO: 5756288 - DNA, 12 bp, Homo sapiens
gcagtgccacag

SEQ ID NO: 5756289 - DNA, 24 bp, Homo sapiens
gcagtgccacagcctgctggcagg

SEQ ID NO: 5756290 - DNA, 12 bp, Homo sapiens
gcagtgccaccc

SEQ ID NO: 5756291 - DNA, 15 bp, Homo sapiens
gcagtgcccaggtgg

SEQ ID NO: 5756292 - DNA, 16 bp, Homo sapiens
gcagtgcccagtgatg

SEQ ID NO: 5756293 - DNA, 15 bp, Homo sapiens
gcagtgccccaggga

SEQ ID NO: 5756294 - DNA, 17 bp, Homo sapiens
gcagtgcccccacccag

SEQ ID NO: 5756295 - DNA, 23 bp, Homo sapiens
gcagtgcccctagcttagagcct

SEQ ID NO: 5756296 - DNA, 13 bp, Homo sapiens
gcagtgccctttg

SEQ ID NO: 5756297 - DNA, 16 bp, Homo sapiens
gcagtgcctaaaaccc

SEQ ID NO: 5756298 - DNA, 16 bp, Homo sapiens
gcagtgcctcctggga

SEQ ID NO: 5756299 - DNA, 22 bp, Homo sapiens
gcagtgccttccataattatga

SEQ ID NO: 5756300 - DNA, 15 bp, Homo sapiens
gcagtgccttgggga

SEQ ID NO: 5756301 - DNA, 14 bp, Homo sapiens
gcagtgctcaccca

SEQ ID NO: 5756302 - DNA, 15 bp, Homo sapiens
gcagtgctcattcat

SEQ ID NO: 5756303 - DNA, 21 bp, Homo sapiens
gcagtgctcgctgttgctgaa

SEQ ID NO: 5756304 - DNA, 17 bp, Homo sapiens
gcagtgctgaagggggc

SEQ ID NO: 5756305 - DNA, 18 bp, Homo sapiens
gcagtgctgatccggctg

SEQ ID NO: 5756306 - DNA, 19 bp, Homo sapiens
gcagtgctgattcagcctg

SEQ ID NO: 5756307 - DNA, 13 bp, Homo sapiens
gcagtgctgggcc

SEQ ID NO: 5756308 - DNA, 15 bp, Homo sapiens
gcagtgctgggccca

SEQ ID NO: 5756309 - DNA, 17 bp, Homo sapiens
gcagtgctgggcccagc

SEQ ID NO: 5756310 - DNA, 17 bp, Homo sapiens
gcagtgcttggcccagg

SEQ ID NO: 5756311 - DNA, 18 bp, Homo sapiens
gcagtgcttggcccagga

SEQ ID NO: 5756312 - DNA, 19 bp, Homo sapiens
gcagtgcttggcccaggag

SEQ ID NO: 5756313 - DNA, 22 bp, Homo sapiens
gcagtggactcagaaagccaac

SEQ ID NO: 5756314 - DNA, 13 bp, Homo sapiens
gcagtggagaggg

SEQ ID NO: 5756315 - DNA, 14 bp, Homo sapiens
gcagtggagaggga

SEQ ID NO: 5756316 - DNA, 15 bp, Homo sapiens
gcagtggagagggac

SEQ ID NO: 5756317 - DNA, 15 bp, Homo sapiens
gcagtggagagggga

SEQ ID NO: 5756318 - DNA, 21 bp, Homo sapiens
gcagtggagaggggacttgga

SEQ ID NO: 5756319 - DNA, 19 bp, Homo sapiens
gcagtggagcagaaggcag

SEQ ID NO: 5756320 - DNA, 17 bp, Homo sapiens
gcagtggagcccaggag

SEQ ID NO: 5756321 - DNA, 14 bp, Homo sapiens
gcagtggagctggc

SEQ ID NO: 5756322 - DNA, 23 bp, Homo sapiens
gcagtggagctggcaccattcag

SEQ ID NO: 5756323 - DNA, 14 bp, Homo sapiens
gcagtggaggctgc

SEQ ID NO: 5756324 - DNA, 19 bp, Homo sapiens
gcagtggagggggcaagct

SEQ ID NO: 5756325 - DNA, 22 bp, Homo sapiens
gcagtggcaaaatattatgtta

SEQ ID NO: 5756326 - DNA, 12 bp, Homo sapiens
gcagtggcacaa

SEQ ID NO: 5756327 - DNA, 19 bp, Homo sapiens
gcagtggccaagcctgctg

SEQ ID NO: 5756328 - DNA, 12 bp, Homo sapiens
gcagtggccacg

SEQ ID NO: 5756329 - DNA, 20 bp, Homo sapiens
gcagtggccatcatcctccc

SEQ ID NO: 5756330 - DNA, 21 bp, Homo sapiens
gcagtggccccttaggccagt

SEQ ID NO: 5756331 - DNA, 16 bp, Homo sapiens
gcagtggcctggatgc

SEQ ID NO: 5756332 - DNA, 20 bp, Homo sapiens
gcagtggcctggatgcacag

SEQ ID NO: 5756333 - DNA, 13 bp, Homo sapiens
gcagtggcctggc

SEQ ID NO: 5756334 - DNA, 19 bp, Homo sapiens
gcagtggcgcaatctcggc

SEQ ID NO: 5756335 - DNA, 18 bp, Homo sapiens
gcagtggcgcgatctcag

SEQ ID NO: 5756336 - DNA, 12 bp, Homo sapiens
gcagtggctccc

SEQ ID NO: 5756337 - DNA, 12 bp, Homo sapiens
gcagtggctggg

SEQ ID NO: 5756338 - DNA, 15 bp, Homo sapiens
gcagtggctggggga

SEQ ID NO: 5756339 - DNA, 17 bp, Homo sapiens
gcagtggctgggggact

SEQ ID NO: 5756340 - DNA, 14 bp, Homo sapiens
gcagtggctggtcc

SEQ ID NO: 5756341 - DNA, 13 bp, Homo sapiens
gcagtggctggtg

SEQ ID NO: 5756342 - DNA, 20 bp, Homo sapiens
gcagtggctggtgcccatga

SEQ ID NO: 5756343 - DNA, 16 bp, Homo sapiens
gcagtggcttctttcc

SEQ ID NO: 5756344 - DNA, 14 bp, Homo sapiens
gcagtggcttttca

SEQ ID NO: 5756345 - DNA, 17 bp, Homo sapiens
gcagtgggaaaaatgta

SEQ ID NO: 5756346 - DNA, 15 bp, Homo sapiens
gcagtgggagctgcc

SEQ ID NO: 5756347 - DNA, 16 bp, Homo sapiens
gcagtgggagctgcct

SEQ ID NO: 5756348 - DNA, 14 bp, Homo sapiens
gcagtgggcaggtg

SEQ ID NO: 5756349 - DNA, 15 bp, Homo sapiens
gcagtgggccctggc

SEQ ID NO: 5756350 - DNA, 17 bp, Homo sapiens
gcagtgggccctggctc

SEQ ID NO: 5756351 - DNA, 16 bp, Homo sapiens
gcagtgggcctgctga

SEQ ID NO: 5756352 - DNA, 19 bp, Homo sapiens
gcagtgggcctgctgaggc

SEQ ID NO: 5756353 - DNA, 16 bp, Homo sapiens
gcagtgggctcctggc

SEQ ID NO: 5756354 - DNA, 18 bp, Homo sapiens
gcagtgggctcctggcag

SEQ ID NO: 5756355 - DNA, 21 bp, Homo sapiens
gcagtgggtcccacttcccct

SEQ ID NO: 5756356 - DNA, 23 bp, Homo sapiens
gcagtgggtcccacttcccctcc

SEQ ID NO: 5756357 - DNA, 17 bp, Homo sapiens
gcagtgggtggggctgt

SEQ ID NO: 5756358 - DNA, 19 bp, Homo sapiens
gcagtggtgcgatctgggt

SEQ ID NO: 5756359 - DNA, 21 bp, Homo sapiens
gcagtggtgcgatctgggttc

SEQ ID NO: 5756360 - DNA, 20 bp, Homo sapiens
gcagtggtggttttctgttc

SEQ ID NO: 5756361 - DNA, 23 bp, Homo sapiens
gcagtggtggttttctgttcttt

SEQ ID NO: 5756362 - DNA, 18 bp, Homo sapiens
gcagtgtagcccacactt

SEQ ID NO: 5756363 - DNA, 16 bp, Homo sapiens
gcagtgtcccctgccc

SEQ ID NO: 5756364 - DNA, 17 bp, Homo sapiens
gcagtgtcccctgcccc

SEQ ID NO: 5756365 - DNA, 23 bp, Homo sapiens
gcagtgtcccctgccccagaggt

SEQ ID NO: 5756366 - DNA, 22 bp, Homo sapiens
gcagtgtcctgtgctttctgca

SEQ ID NO: 5756367 - DNA, 14 bp, Homo sapiens
gcagtgtctccacc

SEQ ID NO: 5756368 - DNA, 14 bp, Homo sapiens
gcagtgtctgtcag

SEQ ID NO: 5756369 - DNA, 15 bp, Homo sapiens
gcagtgtcttaagga

SEQ ID NO: 5756370 - DNA, 20 bp, Homo sapiens
gcagtgtcttaaggagactg

SEQ ID NO: 5756371 - DNA, 21 bp, Homo sapiens
gcagtgtcttaaggagactgg

SEQ ID NO: 5756372 - DNA, 12 bp, Homo sapiens
gcagtgtcttag

SEQ ID NO: 5756373 - DNA, 20 bp, Homo sapiens
gcagtgtgaatagcctggcc

SEQ ID NO: 5756374 - DNA, 20 bp, Homo sapiens
gcagtgtgacctcctgtgac

SEQ ID NO: 5756375 - DNA, 20 bp, Homo sapiens
gcagtgtgaggacctccctg

SEQ ID NO: 5756376 - DNA, 15 bp, Homo sapiens
gcagtgtgaggccag

SEQ ID NO: 5756377 - DNA, 19 bp, Homo sapiens
gcagtgtgaggccagggca

SEQ ID NO: 5756378 - DNA, 12 bp, Homo sapiens
gcagtgtgaggg

SEQ ID NO: 5756379 - DNA, 20 bp, Homo sapiens
gcagtgtgagggtgcaggga

SEQ ID NO: 5756380 - DNA, 16 bp, Homo sapiens
gcagtgtgcagggtgg

SEQ ID NO: 5756381 - DNA, 13 bp, Homo sapiens
gcagtgtgccccc

SEQ ID NO: 5756382 - DNA, 22 bp, Homo sapiens
gcagtgtgccccccagccccgg

SEQ ID NO: 5756383 - DNA, 18 bp, Homo sapiens
gcagtgtgcttacctgtt

SEQ ID NO: 5756384 - DNA, 22 bp, Homo sapiens
gcagtgtggtctcttacatggc

SEQ ID NO: 5756385 - DNA, 22 bp, Homo sapiens
gcagtgtgtccatcatattaaa

SEQ ID NO: 5756386 - DNA, 20 bp, Homo sapiens
gcagtgtgtctcctgcatgc

SEQ ID NO: 5756387 - DNA, 21 bp, Homo sapiens
gcagtgttcctatttggggct

SEQ ID NO: 5756388 - DNA, 19 bp, Homo sapiens
gcagtgttctcacagtgtg

SEQ ID NO: 5756389 - DNA, 16 bp, Homo sapiens
gcagtgttctgtgaat

SEQ ID NO: 5756390 - DNA, 16 bp, Homo sapiens
gcagtgttgctcagct

SEQ ID NO: 5756391 - DNA, 18 bp, Homo sapiens
gcagtgtttaaaaaatga

SEQ ID NO: 5756392 - DNA, 20 bp, Homo sapiens
gcagtgttttcacctcatat

SEQ ID NO: 5756393 - DNA, 22 bp, Homo sapiens
gcagtgttttgcaagtgctgga

SEQ ID NO: 5756394 - DNA, 16 bp, Homo sapiens
gcagttaatttatata

SEQ ID NO: 5756395 - DNA, 18 bp, Homo sapiens
gcagttacatgcatactt

SEQ ID NO: 5756396 - DNA, 15 bp, Homo sapiens
gcagttaccattaaa

SEQ ID NO: 5756397 - DNA, 19 bp, Homo sapiens
gcagttagagatgcctccc

SEQ ID NO: 5756398 - DNA, 11 bp, Homo sapiens
gcagttagagc

SEQ ID NO: 5756399 - DNA, 17 bp, Homo sapiens
gcagttagagcagcctc

SEQ ID NO: 5756400 - DNA, 14 bp, Homo sapiens
gcagttaggcacct

SEQ ID NO: 5756401 - DNA, 17 bp, Homo sapiens
gcagttataacagatgt

SEQ ID NO: 5756402 - DNA, 11 bp, Homo sapiens
gcagttatatt

SEQ ID NO: 5756403 - DNA, 13 bp, Homo sapiens
gcagttatatttt

SEQ ID NO: 5756404 - DNA, 19 bp, Homo sapiens
gcagttatggtgatgactt

SEQ ID NO: 5756405 - DNA, 17 bp, Homo sapiens
gcagttattaacactaa

SEQ ID NO: 5756406 - DNA, 18 bp, Homo sapiens
gcagttcaaatcctcacc

SEQ ID NO: 5756407 - DNA, 22 bp, Homo sapiens
gcagttcagaatggcagtcctg

SEQ ID NO: 5756408 - DNA, 23 bp, Homo sapiens
gcagttcagagctgccctctcct

SEQ ID NO: 5756409 - DNA, 17 bp, Homo sapiens
gcagttcagcaccaccc

SEQ ID NO: 5756410 - DNA, 19 bp, Homo sapiens
gcagttcagcaccacccta

SEQ ID NO: 5756411 - DNA, 14 bp, Homo sapiens
gcagttcattctac

SEQ ID NO: 5756412 - DNA, 20 bp, Homo sapiens
gcagttcattctaccaagct

SEQ ID NO: 5756413 - DNA, 15 bp, Homo sapiens
gcagttccatgaaga

SEQ ID NO: 5756414 - DNA, 22 bp, Homo sapiens
gcagttcccacattaaagaaga

SEQ ID NO: 5756415 - DNA, 13 bp, Homo sapiens
gcagttcctgagt

SEQ ID NO: 5756416 - DNA, 14 bp, Homo sapiens
gcagttcctggcat

SEQ ID NO: 5756417 - DNA, 18 bp, Homo sapiens
gcagttcctgtcccacat

SEQ ID NO: 5756418 - DNA, 16 bp, Homo sapiens
gcagttcgaccagcca

SEQ ID NO: 5756419 - DNA, 22 bp, Homo sapiens
gcagttcgcagccaccctgagg

SEQ ID NO: 5756420 - DNA, 23 bp, Homo sapiens
gcagttcgcagccaccctgagga

SEQ ID NO: 5756421 - DNA, 18 bp, Homo sapiens
gcagttctactcaggctg

SEQ ID NO: 5756422 - DNA, 19 bp, Homo sapiens
gcagttctactcaggctgg

SEQ ID NO: 5756423 - DNA, 13 bp, Homo sapiens
gcagttctagaag

SEQ ID NO: 5756424 - DNA, 13 bp, Homo sapiens
gcagttctcccag

SEQ ID NO: 5756425 - DNA, 18 bp, Homo sapiens
gcagttctcccagggagt

SEQ ID NO: 5756426 - DNA, 20 bp, Homo sapiens
gcagttctcccagggagtga

SEQ ID NO: 5756427 - DNA, 13 bp, Homo sapiens
gcagttctgaaga

SEQ ID NO: 5756428 - DNA, 17 bp, Homo sapiens
gcagttctgaagaagat

SEQ ID NO: 5756429 - DNA, 14 bp, Homo sapiens
gcagttcttgagtt

SEQ ID NO: 5756430 - DNA, 13 bp, Homo sapiens
gcagttctttcca

SEQ ID NO: 5756431 - DNA, 14 bp, Homo sapiens
gcagttctttccat

SEQ ID NO: 5756432 - DNA, 22 bp, Homo sapiens
gcagttgaaaagactccaaaga

SEQ ID NO: 5756433 - DNA, 22 bp, Homo sapiens
gcagttgaatgacaacagaagc

SEQ ID NO: 5756434 - DNA, 15 bp, Homo sapiens
gcagttgacagcagg

SEQ ID NO: 5756435 - DNA, 17 bp, Homo sapiens
gcagttgacagcaggtg

SEQ ID NO: 5756436 - DNA, 21 bp, Homo sapiens
gcagttgagaaaatttgaatg

SEQ ID NO: 5756437 - DNA, 17 bp, Homo sapiens
gcagttgagacaagaaa

SEQ ID NO: 5756438 - DNA, 16 bp, Homo sapiens
gcagttgatgtgtctt

SEQ ID NO: 5756439 - DNA, 14 bp, Homo sapiens
gcagttgcccagcc

SEQ ID NO: 5756440 - DNA, 23 bp, Homo sapiens
gcagttgcccagcctctttccct

SEQ ID NO: 5756441 - DNA, 16 bp, Homo sapiens
gcagttgccgcttctg

SEQ ID NO: 5756442 - DNA, 19 bp, Homo sapiens
gcagttgctggtaaaatga

SEQ ID NO: 5756443 - DNA, 17 bp, Homo sapiens
gcagttggactctcagg

SEQ ID NO: 5756444 - DNA, 19 bp, Homo sapiens
gcagttggactctcaggga

SEQ ID NO: 5756445 - DNA, 15 bp, Homo sapiens
gcagttggcctcagc

SEQ ID NO: 5756446 - DNA, 16 bp, Homo sapiens
gcagttggcctcagca

SEQ ID NO: 5756447 - DNA, 17 bp, Homo sapiens
gcagttggcctcagcag

SEQ ID NO: 5756448 - DNA, 17 bp, Homo sapiens
gcagttgggagtacata

SEQ ID NO: 5756449 - DNA, 14 bp, Homo sapiens
gcagttggggccct

SEQ ID NO: 5756450 - DNA, 16 bp, Homo sapiens
gcagttggggccctct

SEQ ID NO: 5756451 - DNA, 20 bp, Homo sapiens
gcagttgtgatttctgtgga

SEQ ID NO: 5756452 - DNA, 17 bp, Homo sapiens
gcagttgtgtggcccag

SEQ ID NO: 5756453 - DNA, 18 bp, Homo sapiens
gcagttgtgtggcccagc

SEQ ID NO: 5756454 - DNA, 19 bp, Homo sapiens
gcagttgtgtggcccagca

SEQ ID NO: 5756455 - DNA, 20 bp, Homo sapiens
gcagttgtgtggcccagcac

SEQ ID NO: 5756456 - DNA, 13 bp, Homo sapiens
gcagtttaaagca

SEQ ID NO: 5756457 - DNA, 12 bp, Homo sapiens
gcagtttacagt

SEQ ID NO: 5756458 - DNA, 20 bp, Homo sapiens
gcagtttatcattcaagtgt

SEQ ID NO: 5756459 - DNA, 22 bp, Homo sapiens
gcagtttattgtaatatatggg

SEQ ID NO: 5756460 - DNA, 21 bp, Homo sapiens
gcagtttcagagatggacaga

SEQ ID NO: 5756461 - DNA, 11 bp, Homo sapiens
gcatatatttt

SEQ ID NO: 5756462 - DNA, 20 bp, Homo sapiens
gcatatatttttatatttac

SEQ ID NO: 5756463 - DNA, 17 bp, Homo sapiens
gcatatcacccttccct

SEQ ID NO: 5756464 - DNA, 21 bp, Homo sapiens
gcatatcagtctctgagggct

SEQ ID NO: 5756465 - DNA, 22 bp, Homo sapiens
gcatatcagtctctgagggctt

SEQ ID NO: 5756466 - DNA, 13 bp, Homo sapiens
gcatatcataatg

SEQ ID NO: 5756467 - DNA, 18 bp, Homo sapiens
gcatatcatgctttgaaa

SEQ ID NO: 5756468 - DNA, 20 bp, Homo sapiens
gcatatcatgctttgaaaaa

SEQ ID NO: 5756469 - DNA, 14 bp, Homo sapiens
gcatatctgccttt

SEQ ID NO: 5756470 - DNA, 15 bp, Homo sapiens
gcatatctgccttta

SEQ ID NO: 5756471 - DNA, 20 bp, Homo sapiens
gcatatctggtatatgtcat

SEQ ID NO: 5756472 - DNA, 22 bp, Homo sapiens
gcatatctggtatatgtcatta

SEQ ID NO: 5756473 - DNA, 23 bp, Homo sapiens
gcatatctggtatatgtcattat

SEQ ID NO: 5756474 - DNA, 21 bp, Homo sapiens
gcatatctggtcagaactgca

SEQ ID NO: 5756475 - DNA, 16 bp, Homo sapiens
gcatatctgtttattc

SEQ ID NO: 5756476 - DNA, 14 bp, Homo sapiens
gcatatgacaaatg

SEQ ID NO: 5756477 - DNA, 20 bp, Homo sapiens
gcatatgacaaatgtttcta

SEQ ID NO: 5756478 - DNA, 19 bp, Homo sapiens
gcatatgagtaagggcact

SEQ ID NO: 5756479 - DNA, 18 bp, Homo sapiens
gcatatgcatgccaggct

SEQ ID NO: 5756480 - DNA, 22 bp, Homo sapiens
gcatatgcctgtaatcccaact

SEQ ID NO: 5756481 - DNA, 21 bp, Homo sapiens
gcatatggagtgcctgtacaa

SEQ ID NO: 5756482 - DNA, 15 bp, Homo sapiens
gcatatgtatgactc

SEQ ID NO: 5756483 - DNA, 12 bp, Homo sapiens
gcatatgttaaa

SEQ ID NO: 5756484 - DNA, 17 bp, Homo sapiens
gcatatgttccatgcct

SEQ ID NO: 5756485 - DNA, 12 bp, Homo sapiens
gcatatgttgaa

SEQ ID NO: 5756486 - DNA, 22 bp, Homo sapiens
gcatattaatgcgatttcttcc

SEQ ID NO: 5756487 - DNA, 23 bp, Homo sapiens
gcatattataaaggataaagaag

SEQ ID NO: 5756488 - DNA, 18 bp, Homo sapiens
gcatattattttatgttg

SEQ ID NO: 5756489 - DNA, 14 bp, Homo sapiens
gcatattcaacaca

SEQ ID NO: 5756490 - DNA, 17 bp, Homo sapiens
gcatattcaacacactg

SEQ ID NO: 5756491 - DNA, 21 bp, Homo sapiens
gcatattcatggttgtttttt

SEQ ID NO: 5756492 - DNA, 17 bp, Homo sapiens
gcatattccctgcacac

SEQ ID NO: 5756493 - DNA, 16 bp, Homo sapiens
gcatattcctttctat

SEQ ID NO: 5756494 - DNA, 20 bp, Homo sapiens
gcatattctctattttactt

SEQ ID NO: 5756495 - DNA, 19 bp, Homo sapiens
gcatattgctttttctaat

SEQ ID NO: 5756496 - DNA, 12 bp, Homo sapiens
gcatattgtaca

SEQ ID NO: 5756497 - DNA, 17 bp, Homo sapiens
gcatattgtaccccctc

SEQ ID NO: 5756498 - DNA, 17 bp, Homo sapiens
gcatatttaacaaaatt

SEQ ID NO: 5756499 - DNA, 21 bp, Homo sapiens
gcatatttatagagttattat

SEQ ID NO: 5756500 - DNA, 22 bp, Homo sapiens
gcatatttattgcattgctggt

SEQ ID NO: 5756501 - DNA, 23 bp, Homo sapiens
gcatatttattgcattgctggta

SEQ ID NO: 5756502 - DNA, 19 bp, Homo sapiens
gcatatttgccaataaagc

SEQ ID NO: 5756503 - DNA, 13 bp, Homo sapiens
gcatattttctct

SEQ ID NO: 5756504 - DNA, 20 bp, Homo sapiens
gcatattttcttacttttat

SEQ ID NO: 5756505 - DNA, 16 bp, Homo sapiens
gcatatttttcacata

SEQ ID NO: 5756506 - DNA, 14 bp, Homo sapiens
gcatcaaaagacaa

SEQ ID NO: 5756507 - DNA, 14 bp, Homo sapiens
gcatcaaacatgaa

SEQ ID NO: 5756508 - DNA, 15 bp, Homo sapiens
gcatcaaacatgaaa

SEQ ID NO: 5756509 - DNA, 20 bp, Homo sapiens
gcatcaaacatgaaaacatt

SEQ ID NO: 5756510 - DNA, 12 bp, Homo sapiens
gcatcaaataat

SEQ ID NO: 5756511 - DNA, 17 bp, Homo sapiens
gcatcaacctaggagca

SEQ ID NO: 5756512 - DNA, 23 bp, Homo sapiens
gcatcaacctaggagcagtgggc

SEQ ID NO: 5756513 - DNA, 16 bp, Homo sapiens
gcatcaagaactattg

SEQ ID NO: 5756514 - DNA, 12 bp, Homo sapiens
gcatcaagccac

SEQ ID NO: 5756515 - DNA, 13 bp, Homo sapiens
gcatcaatacaac

SEQ ID NO: 5756516 - DNA, 20 bp, Homo sapiens
gcatcacacgcaggttacct

SEQ ID NO: 5756517 - DNA, 19 bp, Homo sapiens
gcatcacactcaaggacag

SEQ ID NO: 5756518 - DNA, 19 bp, Homo sapiens
gcatcacacttatatttta

SEQ ID NO: 5756519 - DNA, 14 bp, Homo sapiens
gcatcacagacccc

SEQ ID NO: 5756520 - DNA, 17 bp, Homo sapiens
gcatcacagaccccagc

SEQ ID NO: 5756521 - DNA, 22 bp, Homo sapiens
gcatcacagggcagagccggga

SEQ ID NO: 5756522 - DNA, 21 bp, Homo sapiens
gcatcacatctgcacactctc

SEQ ID NO: 5756523 - DNA, 17 bp, Homo sapiens
gcatcacatgatgaaaa

SEQ ID NO: 5756524 - DNA, 16 bp, Homo sapiens
gcatcaccatgcatgg

SEQ ID NO: 5756525 - DNA, 15 bp, Homo sapiens
gcatcacccaggctg

SEQ ID NO: 5756526 - DNA, 21 bp, Homo sapiens
gcatcacctagaaacttgtta

SEQ ID NO: 5756527 - DNA, 20 bp, Homo sapiens
gcatcaccttaggcagggaa

SEQ ID NO: 5756528 - DNA, 22 bp, Homo sapiens
gcatcaccttaggcagggaagt

SEQ ID NO: 5756529 - DNA, 15 bp, Homo sapiens
gcatcacgctgcatc

SEQ ID NO: 5756530 - DNA, 23 bp, Homo sapiens
gcatcacggatggtgcatgggct

SEQ ID NO: 5756531 - DNA, 17 bp, Homo sapiens
gcatcactagtgacaag

SEQ ID NO: 5756532 - DNA, 19 bp, Homo sapiens
gcatcactattcagaagac

SEQ ID NO: 5756533 - DNA, 15 bp, Homo sapiens
gcatcactgatcatt

SEQ ID NO: 5756534 - DNA, 20 bp, Homo sapiens
gcatcactgatcattagaga

SEQ ID NO: 5756535 - DNA, 13 bp, Homo sapiens
gcatcactgatgg

SEQ ID NO: 5756536 - DNA, 20 bp, Homo sapiens
gcatcactgccttggcccct

SEQ ID NO: 5756537 - DNA, 22 bp, Homo sapiens
gcatcactttcctggatccagg

SEQ ID NO: 5756538 - DNA, 13 bp, Homo sapiens
gcatcagaaagag

SEQ ID NO: 5756539 - DNA, 16 bp, Homo sapiens
gcatcagaaagggagg

SEQ ID NO: 5756540 - DNA, 21 bp, Homo sapiens
gcatcagaaagggagggctct

SEQ ID NO: 5756541 - DNA, 22 bp, Homo sapiens
gcatcagactgtgaaccccacg

SEQ ID NO: 5756542 - DNA, 12 bp, Homo sapiens
gcatcagagggc

SEQ ID NO: 5756543 - DNA, 19 bp, Homo sapiens
gcatcagaggtttgcttcc

SEQ ID NO: 5756544 - DNA, 12 bp, Homo sapiens
gcatcagctgct

SEQ ID NO: 5756545 - DNA, 19 bp, Homo sapiens
gcatcagctgctcagatcc

SEQ ID NO: 5756546 - DNA, 23 bp, Homo sapiens
gcatcagctgctgaaacaacaaa

SEQ ID NO: 5756547 - DNA, 22 bp, Homo sapiens
gcatcagctgtctgtcatctgc

SEQ ID NO: 5756548 - DNA, 23 bp, Homo sapiens
gcatcagctgtctgtcatctgct

SEQ ID NO: 5756549 - DNA, 20 bp, Homo sapiens
gcatcagctttccctggctc

SEQ ID NO: 5756550 - DNA, 24 bp, Homo sapiens
gcatcagctttccctggctcaggg

SEQ ID NO: 5756551 - DNA, 18 bp, Homo sapiens
gcatcaggatactcaaag

SEQ ID NO: 5756552 - DNA, 21 bp, Homo sapiens
gcatcaggatactcaaagtgg

SEQ ID NO: 5756553 - DNA, 13 bp, Homo sapiens
gcatcaggcactg

SEQ ID NO: 5756554 - DNA, 16 bp, Homo sapiens
gcatcaggccaggccc

SEQ ID NO: 5756555 - DNA, 18 bp, Homo sapiens
gcatcaggccaggccctc

SEQ ID NO: 5756556 - DNA, 19 bp, Homo sapiens
gcatcaggcctagaggcct

SEQ ID NO: 5756557 - DNA, 22 bp, Homo sapiens
gcatcaggctaagaccctgtgt

SEQ ID NO: 5756558 - DNA, 19 bp, Homo sapiens
gcatcagggcctttctcct

SEQ ID NO: 5756559 - DNA, 23 bp, Homo sapiens
gcatcagggcctttctcctcccc

SEQ ID NO: 5756560 - DNA, 21 bp, Homo sapiens
gcatcagggggaagaagcaga

SEQ ID NO: 5756561 - DNA, 15 bp, Homo sapiens
gcatcagtgccctcc

SEQ ID NO: 5756562 - DNA, 16 bp, Homo sapiens
gcatcagttcactgct

SEQ ID NO: 5756563 - DNA, 14 bp, Homo sapiens
gcatcatctcttcc

SEQ ID NO: 5756564 - DNA, 16 bp, Homo sapiens
gcatcatctcttcctc

SEQ ID NO: 5756565 - DNA, 15 bp, Homo sapiens
gcatcatgcctctga

SEQ ID NO: 5756566 - DNA, 17 bp, Homo sapiens
gcatcatggatcaacca

SEQ ID NO: 5756567 - DNA, 13 bp, Homo sapiens
gcatcatggctat

SEQ ID NO: 5756568 - DNA, 15 bp, Homo sapiens
gcatcattataagct

SEQ ID NO: 5756569 - DNA, 17 bp, Homo sapiens
gcatcattatttatgta

SEQ ID NO: 5756570 - DNA, 19 bp, Homo sapiens
gcatcattatttatgtatt

SEQ ID NO: 5756571 - DNA, 18 bp, Homo sapiens
gcatcattccaccatggc

SEQ ID NO: 5756572 - DNA, 15 bp, Homo sapiens
gcatcattccaggcc

SEQ ID NO: 5756573 - DNA, 20 bp, Homo sapiens
gcatcattcttgttaattat

SEQ ID NO: 5756574 - DNA, 11 bp, Homo sapiens
gcatcattgca

SEQ ID NO: 5756575 - DNA, 14 bp, Homo sapiens
gcatcattgcagat

SEQ ID NO: 5756576 - DNA, 15 bp, Homo sapiens
gcatcattgcagatg

SEQ ID NO: 5756577 - DNA, 13 bp, Homo sapiens
gcatcattgtaaa

SEQ ID NO: 5756578 - DNA, 19 bp, Homo sapiens
gcatcattgtaaattattt

SEQ ID NO: 5756579 - DNA, 20 bp, Homo sapiens
gcatcatttcccctcccgct

SEQ ID NO: 5756580 - DNA, 22 bp, Homo sapiens
gcatcatttcccctcccgcttc

SEQ ID NO: 5756581 - DNA, 21 bp, Homo sapiens
gcatccaaaggctcctgagac

SEQ ID NO: 5756582 - DNA, 17 bp, Homo sapiens
gcatccaaatggctgct

SEQ ID NO: 5756583 - DNA, 12 bp, Homo sapiens
gcatccaactga

SEQ ID NO: 5756584 - DNA, 18 bp, Homo sapiens
gcatccaatctcaaggaa

SEQ ID NO: 5756585 - DNA, 19 bp, Homo sapiens
gcatccaatctcaaggaat

SEQ ID NO: 5756586 - DNA, 15 bp, Homo sapiens
gcatccacccagtgc

SEQ ID NO: 5756587 - DNA, 17 bp, Homo sapiens
gcatccacccagtgctg

SEQ ID NO: 5756588 - DNA, 12 bp, Homo sapiens
gcatccaccgcc

SEQ ID NO: 5756589 - DNA, 16 bp, Homo sapiens
gcatccaccgccaccc

SEQ ID NO: 5756590 - DNA, 15 bp, Homo sapiens
gcatccacctccttc

SEQ ID NO: 5756591 - DNA, 16 bp, Homo sapiens
gcatccaccttcctgc

SEQ ID NO: 5756592 - DNA, 17 bp, Homo sapiens
gcatccaccttcctgcc

SEQ ID NO: 5756593 - DNA, 19 bp, Homo sapiens
gcatccaccttcctgccca

SEQ ID NO: 5756594 - DNA, 23 bp, Homo sapiens
gcatccacttctttcagcagact

SEQ ID NO: 5756595 - DNA, 21 bp, Homo sapiens
gcatccagagtccctgcctgg

SEQ ID NO: 5756596 - DNA, 12 bp, Homo sapiens
gcatccagcagc

SEQ ID NO: 5756597 - DNA, 17 bp, Homo sapiens
gcatccagcagcagcac

SEQ ID NO: 5756598 - DNA, 12 bp, Homo sapiens
gcatccagcctg

SEQ ID NO: 5756599 - DNA, 12 bp, Homo sapiens
gcatccaggcac

SEQ ID NO: 5756600 - DNA, 20 bp, Homo sapiens
gcatccaggccagggctcct

SEQ ID NO: 5756601 - DNA, 14 bp, Homo sapiens
gcatccaggctggc

SEQ ID NO: 5756602 - DNA, 17 bp, Homo sapiens
gcatccagtatcttgaa

SEQ ID NO: 5756603 - DNA, 23 bp, Homo sapiens
gcatccatactgtttaatattta

SEQ ID NO: 5756604 - DNA, 17 bp, Homo sapiens
gcatccatctgggctac

SEQ ID NO: 5756605 - DNA, 22 bp, Homo sapiens
gcatccatggatgcagaaatga

SEQ ID NO: 5756606 - DNA, 12 bp, Homo sapiens
gcatccatgggg

SEQ ID NO: 5756607 - DNA, 17 bp, Homo sapiens
gcatccatgtgtggact

SEQ ID NO: 5756608 - DNA, 14 bp, Homo sapiens
gcatccattcctca

SEQ ID NO: 5756609 - DNA, 15 bp, Homo sapiens
gcatccattcctcag

SEQ ID NO: 5756610 - DNA, 16 bp, Homo sapiens
gcatccattctcctga

SEQ ID NO: 5756611 - DNA, 19 bp, Homo sapiens
gcatccattctcctgagga

SEQ ID NO: 5756612 - DNA, 15 bp, Homo sapiens
gcatccatttgaata

SEQ ID NO: 5756613 - DNA, 23 bp, Homo sapiens
gcatcccaagacctcatctgcct

SEQ ID NO: 5756614 - DNA, 16 bp, Homo sapiens
gcatcccacagccagt

SEQ ID NO: 5756615 - DNA, 22 bp, Homo sapiens
gcatcccagcctcagaagcctt

SEQ ID NO: 5756616 - DNA, 15 bp, Homo sapiens
gcatcccagcctggg

SEQ ID NO: 5756617 - DNA, 16 bp, Homo sapiens
gcatcccagcctgggg

SEQ ID NO: 5756618 - DNA, 21 bp, Homo sapiens
gcatcccagcctgggggccag

SEQ ID NO: 5756619 - DNA, 13 bp, Homo sapiens
gcatcccagcctt

SEQ ID NO: 5756620 - DNA, 13 bp, Homo sapiens
gcatcccagcttg

SEQ ID NO: 5756621 - DNA, 20 bp, Homo sapiens
gcatcccaggatgctgggtg

SEQ ID NO: 5756622 - DNA, 14 bp, Homo sapiens
gcatcccaggggac

SEQ ID NO: 5756623 - DNA, 15 bp, Homo sapiens
gcatcccagtggcct

SEQ ID NO: 5756624 - DNA, 16 bp, Homo sapiens
gcatcccagtggcctc

SEQ ID NO: 5756625 - DNA, 15 bp, Homo sapiens
gcatcccatcccttg

SEQ ID NO: 5756626 - DNA, 21 bp, Homo sapiens
gcatcccatctctcccacttc

SEQ ID NO: 5756627 - DNA, 23 bp, Homo sapiens
gcatcccatctctcccacttcct

SEQ ID NO: 5756628 - DNA, 19 bp, Homo sapiens
gcatccccagccccctggc

SEQ ID NO: 5756629 - DNA, 16 bp, Homo sapiens
gcatccccagtgccag

SEQ ID NO: 5756630 - DNA, 12 bp, Homo sapiens
gcatcccccaaa

SEQ ID NO: 5756631 - DNA, 16 bp, Homo sapiens
gcatcccccaaagttc

SEQ ID NO: 5756632 - DNA, 20 bp, Homo sapiens
gcatcccccaaagttcacaa

SEQ ID NO: 5756633 - DNA, 18 bp, Homo sapiens
gcatcccccacctactct

SEQ ID NO: 5756634 - DNA, 21 bp, Homo sapiens
gcatccccctcctctccctgt

SEQ ID NO: 5756635 - DNA, 15 bp, Homo sapiens
gcatcccctgtgaac

SEQ ID NO: 5756636 - DNA, 17 bp, Homo sapiens
gcatccccttccagctc

SEQ ID NO: 5756637 - DNA, 22 bp, Homo sapiens
gcatccccttccagctccctcc

SEQ ID NO: 5756638 - DNA, 16 bp, Homo sapiens
gcatctgtctgaatgg

SEQ ID NO: 5756639 - DNA, 16 bp, Homo sapiens
gcatctgtctgctctg

SEQ ID NO: 5756640 - DNA, 18 bp, Homo sapiens
gcatctgtctgctctgca

SEQ ID NO: 5756641 - DNA, 12 bp, Homo sapiens
gcatctgtctgt

SEQ ID NO: 5756642 - DNA, 15 bp, Homo sapiens
gcatctgtctgtctg

SEQ ID NO: 5756643 - DNA, 14 bp, Homo sapiens
gcatctgtgatggg

SEQ ID NO: 5756644 - DNA, 18 bp, Homo sapiens
gcatctgtgatgggagcg

SEQ ID NO: 5756645 - DNA, 20 bp, Homo sapiens
gcatctgtgtaacctccaca

SEQ ID NO: 5756646 - DNA, 14 bp, Homo sapiens
gcatctgtgtgcgt

SEQ ID NO: 5756647 - DNA, 23 bp, Homo sapiens
gcatctgttacggttaatgagag

SEQ ID NO: 5756648 - DNA, 16 bp, Homo sapiens
gcatctgttagcagag

SEQ ID NO: 5756649 - DNA, 13 bp, Homo sapiens
gcatctgttctgg

SEQ ID NO: 5756650 - DNA, 13 bp, Homo sapiens
gcatcttaacatg

SEQ ID NO: 5756651 - DNA, 23 bp, Homo sapiens
gcatcttactgaaggtaaaattg

SEQ ID NO: 5756652 - DNA, 11 bp, Homo sapiens
gcatcttcagt

SEQ ID NO: 5756653 - DNA, 22 bp, Homo sapiens
gcatcttcagtcgtctgtccca

SEQ ID NO: 5756654 - DNA, 23 bp, Homo sapiens
gcatcttcagtcgtctgtcccaa

SEQ ID NO: 5756655 - DNA, 15 bp, Homo sapiens
gcatcttccactgga

SEQ ID NO: 5756656 - DNA, 18 bp, Homo sapiens
gcatcttccactggaacg

SEQ ID NO: 5756657 - DNA, 17 bp, Homo sapiens
gcatcttccagaagtgt

SEQ ID NO: 5756658 - DNA, 17 bp, Homo sapiens
gcatcttctcactccct

SEQ ID NO: 5756659 - DNA, 14 bp, Homo sapiens
gcatcttctggaga

SEQ ID NO: 5756660 - DNA, 15 bp, Homo sapiens
gcatcttgccagcct

SEQ ID NO: 5756661 - DNA, 19 bp, Homo sapiens
gcatcttgctctgtggcct

SEQ ID NO: 5756662 - DNA, 20 bp, Homo sapiens
gcatcttgctctgtggcctt

SEQ ID NO: 5756663 - DNA, 15 bp, Homo sapiens
gcatcttgctggcta

SEQ ID NO: 5756664 - DNA, 22 bp, Homo sapiens
gcatcttgggggggtggccgct

SEQ ID NO: 5756665 - DNA, 12 bp, Homo sapiens
gcatctttcata

SEQ ID NO: 5756666 - DNA, 22 bp, Homo sapiens
gcatctttcatatggtaggaac

SEQ ID NO: 5756667 - DNA, 11 bp, Homo sapiens
gcatctttgat

SEQ ID NO: 5756668 - DNA, 13 bp, Homo sapiens
gcatctttgcctt

SEQ ID NO: 5756669 - DNA, 22 bp, Homo sapiens
gcatctttgccttgggctgctc

SEQ ID NO: 5756670 - DNA, 20 bp, Homo sapiens
gcatcttttccatcctgagg

SEQ ID NO: 5756671 - DNA, 19 bp, Homo sapiens
gcatcttttctagagacac

SEQ ID NO: 5756672 - DNA, 21 bp, Homo sapiens
gcatcttttctagagacacat

SEQ ID NO: 5756673 - DNA, 23 bp, Homo sapiens
gcatcttttgtattaagaaagga

SEQ ID NO: 5756674 - DNA, 18 bp, Homo sapiens
gcatctttttttcatttt

SEQ ID NO: 5756675 - DNA, 22 bp, Homo sapiens
gcatgaaaaaagcaagattgaa

SEQ ID NO: 5756676 - DNA, 22 bp, Homo sapiens
gcatgaaaaaccatttttgaac

SEQ ID NO: 5756677 - DNA, 16 bp, Homo sapiens
gcatgaaaattgtgtt

SEQ ID NO: 5756678 - DNA, 20 bp, Homo sapiens
gcatgaaactatgcacctat

SEQ ID NO: 5756679 - DNA, 18 bp, Homo sapiens
gcatgaaaggcttttaaa

SEQ ID NO: 5756680 - DNA, 11 bp, Homo sapiens
gcatgaaaggt

SEQ ID NO: 5756681 - DNA, 14 bp, Homo sapiens
gcatgaaataaaat

SEQ ID NO: 5756682 - DNA, 16 bp, Homo sapiens
gcatgaaatgaacaca

SEQ ID NO: 5756683 - DNA, 19 bp, Homo sapiens
gcatgaaatgaatgtctga

SEQ ID NO: 5756684 - DNA, 20 bp, Homo sapiens
gcatgaaatgtgaattttta

SEQ ID NO: 5756685 - DNA, 20 bp, Homo sapiens
gcatgaaattgtatctcagt

SEQ ID NO: 5756686 - DNA, 15 bp, Homo sapiens
gcatgaacagtgcac

SEQ ID NO: 5756687 - DNA, 18 bp, Homo sapiens
gcatgaaccctcttgcca

SEQ ID NO: 5756688 - DNA, 23 bp, Homo sapiens
gcatgaacttgtgggatggtggg

SEQ ID NO: 5756689 - DNA, 14 bp, Homo sapiens
gcatgaagagaagc

SEQ ID NO: 5756690 - DNA, 13 bp, Homo sapiens
gcatgaagataaa

SEQ ID NO: 5756691 - DNA, 18 bp, Homo sapiens
gcatgaaggaaactgaac

SEQ ID NO: 5756692 - DNA, 13 bp, Homo sapiens
gcatgaaggtttc

SEQ ID NO: 5756693 - DNA, 23 bp, Homo sapiens
gcatgaagtaatatgcacacatt

SEQ ID NO: 5756694 - DNA, 14 bp, Homo sapiens
gcatgaataaaaca

SEQ ID NO: 5756695 - DNA, 21 bp, Homo sapiens
gcatgaataaaacactcatcc

SEQ ID NO: 5756696 - DNA, 14 bp, Homo sapiens
gcatgaataaaatt

SEQ ID NO: 5756697 - DNA, 22 bp, Homo sapiens
gcatgaatcactgtgctcagcc

SEQ ID NO: 5756698 - DNA, 15 bp, Homo sapiens
gcatgaatgttttta

SEQ ID NO: 5756699 - DNA, 19 bp, Homo sapiens
gcatgaattggaactgcaa

SEQ ID NO: 5756700 - DNA, 22 bp, Homo sapiens
gcatgaatttgtaatgtcttga

SEQ ID NO: 5756701 - DNA, 17 bp, Homo sapiens
gcatgaatttgtgaagg

SEQ ID NO: 5756702 - DNA, 17 bp, Homo sapiens
gcatgacaaaaataaca

SEQ ID NO: 5756703 - DNA, 19 bp, Homo sapiens
gcatgacaactactttaag

SEQ ID NO: 5756704 - DNA, 21 bp, Homo sapiens
gcatgacaagccccaggcagg

SEQ ID NO: 5756705 - DNA, 16 bp, Homo sapiens
gcatgacaagtactgt

SEQ ID NO: 5756706 - DNA, 14 bp, Homo sapiens
gcatgacagcctct

SEQ ID NO: 5756707 - DNA, 15 bp, Homo sapiens
gcatgacagcctcta

SEQ ID NO: 5756708 - DNA, 14 bp, Homo sapiens
gcatgacagctgtt

SEQ ID NO: 5756709 - DNA, 13 bp, Homo sapiens
gcatgaccacata

SEQ ID NO: 5756710 - DNA, 15 bp, Homo sapiens
gcatgaccacataga

SEQ ID NO: 5756711 - DNA, 11 bp, Homo sapiens
gcatgacccag

SEQ ID NO: 5756712 - DNA, 12 bp, Homo sapiens
gcatgacccagt

SEQ ID NO: 5756713 - DNA, 22 bp, Homo sapiens
gcatgacctgtgaccagcactg

SEQ ID NO: 5756714 - DNA, 21 bp, Homo sapiens
gcatgactaatgctttttaga

SEQ ID NO: 5756715 - DNA, 15 bp, Homo sapiens
gcatgactgtcgcca

SEQ ID NO: 5756716 - DNA, 20 bp, Homo sapiens
gcatgactgtcgccacacgc

SEQ ID NO: 5756717 - DNA, 15 bp, Homo sapiens
gcatgactttcctta

SEQ ID NO: 5756718 - DNA, 17 bp, Homo sapiens
gcatgagaaatacaaaa

SEQ ID NO: 5756719 - DNA, 15 bp, Homo sapiens
gcatgagaactaaat

SEQ ID NO: 5756720 - DNA, 15 bp, Homo sapiens
gcatgagaatgtcat

SEQ ID NO: 5756721 - DNA, 22 bp, Homo sapiens
gcatgagaatgtcatttgctaa

SEQ ID NO: 5756722 - DNA, 18 bp, Homo sapiens
gcatgagactcagtgcag

SEQ ID NO: 5756723 - DNA, 15 bp, Homo sapiens
gcatgagattttgga

SEQ ID NO: 5756724 - DNA, 18 bp, Homo sapiens
gcatgagctattgctaga

SEQ ID NO: 5756725 - DNA, 20 bp, Homo sapiens
gcatgagctcactccatcac

SEQ ID NO: 5756726 - DNA, 17 bp, Homo sapiens
gcatgaggcaaaaatgt

SEQ ID NO: 5756727 - DNA, 18 bp, Homo sapiens
gcatgaggcaaaaatgtc

SEQ ID NO: 5756728 - DNA, 14 bp, Homo sapiens
gcatgaggccccga

SEQ ID NO: 5756729 - DNA, 20 bp, Homo sapiens
gcatgagggatcacagggcc

SEQ ID NO: 5756730 - DNA, 17 bp, Homo sapiens
gcatgaggggttcctcc

SEQ ID NO: 5756731 - DNA, 17 bp, Homo sapiens
gcatgagtatctgtggg

SEQ ID NO: 5756732 - DNA, 14 bp, Homo sapiens
gcatgagtctgttt

SEQ ID NO: 5756733 - DNA, 16 bp, Homo sapiens
gcatgagtctgtttcc

SEQ ID NO: 5756734 - DNA, 21 bp, Homo sapiens
gcatgagtctgtttcccaagc

SEQ ID NO: 5756735 - DNA, 22 bp, Homo sapiens
gcatgagtctgtttcccaagct

SEQ ID NO: 5756736 - DNA, 23 bp, Homo sapiens
gcatgagtctgtttcccaagcta

SEQ ID NO: 5756737 - DNA, 22 bp, Homo sapiens
gcatgagtggacgtcagaagaa

SEQ ID NO: 5756738 - DNA, 11 bp, Homo sapiens
gcatgagtggc

SEQ ID NO: 5756739 - DNA, 13 bp, Homo sapiens
gcatgagttctgc

SEQ ID NO: 5756740 - DNA, 17 bp, Homo sapiens
gcatgagttctgcacat

SEQ ID NO: 5756741 - DNA, 17 bp, Homo sapiens
gcatgataaacattcat

SEQ ID NO: 5756742 - DNA, 20 bp, Homo sapiens
gcatgataagccgaggaggc

SEQ ID NO: 5756743 - DNA, 22 bp, Homo sapiens
gcatgatccaagcaagactgag

SEQ ID NO: 5756744 - DNA, 16 bp, Homo sapiens
gcatgatccagctgtg

SEQ ID NO: 5756745 - DNA, 18 bp, Homo sapiens
gcatgatctgaaaaatac

SEQ ID NO: 5756746 - DNA, 14 bp, Homo sapiens
gcatgatcttgtta

SEQ ID NO: 5756747 - DNA, 15 bp, Homo sapiens
gcatgatgggaaaat

SEQ ID NO: 5756748 - DNA, 16 bp, Homo sapiens
gcatgatgggaaaata

SEQ ID NO: 5756749 - DNA, 21 bp, Homo sapiens
gcatgatgggaaaatatttcc

SEQ ID NO: 5756750 - DNA, 22 bp, Homo sapiens
gcatgatgggaggtgtgccaga

SEQ ID NO: 5756751 - DNA, 13 bp, Homo sapiens
gcatgatgtttgc

SEQ ID NO: 5756752 - DNA, 22 bp, Homo sapiens
gcatgatgtttgcccaaaattt

SEQ ID NO: 5756753 - DNA, 15 bp, Homo sapiens
gcatgattcttctct

SEQ ID NO: 5756754 - DNA, 22 bp, Homo sapiens
gcatgattcttctcttgtgatt

SEQ ID NO: 5756755 - DNA, 18 bp, Homo sapiens
gcatgattgcagaattgt

SEQ ID NO: 5756756 - DNA, 17 bp, Homo sapiens
gcatgatttatatatgg

SEQ ID NO: 5756757 - DNA, 14 bp, Homo sapiens
gcatgatttgaaaa

SEQ ID NO: 5756758 - DNA, 19 bp, Homo sapiens
gcatgattttatacatagt

SEQ ID NO: 5756759 - DNA, 15 bp, Homo sapiens
gcatgcaaaaatgaa

SEQ ID NO: 5756760 - DNA, 13 bp, Homo sapiens
gcatgcaatttga

SEQ ID NO: 5756761 - DNA, 11 bp, Homo sapiens
gcatgcacatc

SEQ ID NO: 5756762 - DNA, 14 bp, Homo sapiens
gcatgcaccacggg

SEQ ID NO: 5756763 - DNA, 15 bp, Homo sapiens
gcatgcaccacgggc

SEQ ID NO: 5756764 - DNA, 14 bp, Homo sapiens
gcatgcacctgcaa

SEQ ID NO: 5756765 - DNA, 19 bp, Homo sapiens
gcatgcacgggcatgcaca

SEQ ID NO: 5756766 - DNA, 14 bp, Homo sapiens
gcatgcactgtctc

SEQ ID NO: 5756767 - DNA, 21 bp, Homo sapiens
gcatgcactgttccccctgtg

SEQ ID NO: 5756768 - DNA, 16 bp, Homo sapiens
gcatgcagcaacaccc

SEQ ID NO: 5756769 - DNA, 16 bp, Homo sapiens
gcatgcagcgccacct

SEQ ID NO: 5756770 - DNA, 13 bp, Homo sapiens
gcatgcagctgcc

SEQ ID NO: 5756771 - DNA, 16 bp, Homo sapiens
gcatgcagctgcctgg

SEQ ID NO: 5756772 - DNA, 21 bp, Homo sapiens
gcatgcagctgcctggggccc

SEQ ID NO: 5756773 - DNA, 21 bp, Homo sapiens
gcatgcagcttgtccttgctc

SEQ ID NO: 5756774 - DNA, 13 bp, Homo sapiens
gcatgcagggccc

SEQ ID NO: 5756775 - DNA, 22 bp, Homo sapiens
gcatgcagggcccccatgcagg

SEQ ID NO: 5756776 - DNA, 14 bp, Homo sapiens
gcatgcatgcaaat

SEQ ID NO: 5756777 - DNA, 19 bp, Homo sapiens
gcatgcatggaggactctc

SEQ ID NO: 5756778 - DNA, 16 bp, Homo sapiens
gcatgcattgaaaaat

SEQ ID NO: 5756779 - DNA, 15 bp, Homo sapiens
gcatgcattgagctg

SEQ ID NO: 5756780 - DNA, 22 bp, Homo sapiens
gcatgcattgagctgcctccag

SEQ ID NO: 5756781 - DNA, 20 bp, Homo sapiens
gcatgccaacaagaatgcat

SEQ ID NO: 5756782 - DNA, 23 bp, Homo sapiens
gcatgccaacaagaatgcattga

SEQ ID NO: 5756783 - DNA, 11 bp, Homo sapiens
gcatgccaccc

SEQ ID NO: 5756784 - DNA, 13 bp, Homo sapiens
gcatgccaccctc

SEQ ID NO: 5756785 - DNA, 16 bp, Homo sapiens
gcatgccaccctcaca

SEQ ID NO: 5756786 - DNA, 18 bp, Homo sapiens
gcatgccaccctcacaca

SEQ ID NO: 5756787 - DNA, 21 bp, Homo sapiens
gcatgccacgccccgtgtctg

SEQ ID NO: 5756788 - DNA, 22 bp, Homo sapiens
gcatgccacgccccgtgtctgg

SEQ ID NO: 5756789 - DNA, 20 bp, Homo sapiens
gcatgccagagcctggggca

SEQ ID NO: 5756790 - DNA, 19 bp, Homo sapiens
gcatgccaggacccgccag

SEQ ID NO: 5756791 - DNA, 16 bp, Homo sapiens
gcatgcccaaatataa

SEQ ID NO: 5756792 - DNA, 12 bp, Homo sapiens
gcatgcccagag

SEQ ID NO: 5756793 - DNA, 18 bp, Homo sapiens
gcatgcccagagacccag

SEQ ID NO: 5756794 - DNA, 19 bp, Homo sapiens
gcatgcccagattcccaga

SEQ ID NO: 5756795 - DNA, 15 bp, Homo sapiens
gcatgccccacccac

SEQ ID NO: 5756796 - DNA, 19 bp, Homo sapiens
gcatgccccacccacccct

SEQ ID NO: 5756797 - DNA, 12 bp, Homo sapiens
gcatgccccctc

SEQ ID NO: 5756798 - DNA, 20 bp, Homo sapiens
gcatgccccctcgtgccagt

SEQ ID NO: 5756799 - DNA, 22 bp, Homo sapiens
gcatgccccggccacctctgcg

SEQ ID NO: 5756800 - DNA, 16 bp, Homo sapiens
gcatgccctctcaggc

SEQ ID NO: 5756801 - DNA, 18 bp, Homo sapiens
gcatgccgagtgccccag

SEQ ID NO: 5756802 - DNA, 15 bp, Homo sapiens
gcatgcctcccaggc

SEQ ID NO: 5756803 - DNA, 19 bp, Homo sapiens
gcatgcctctgatatggga

SEQ ID NO: 5756804 - DNA, 21 bp, Homo sapiens
gcatgcctctgatatgggact

SEQ ID NO: 5756805 - DNA, 13 bp, Homo sapiens
gcatgcctgagag

SEQ ID NO: 5756806 - DNA, 12 bp, Homo sapiens
gcatgcctggcc

SEQ ID NO: 5756807 - DNA, 19 bp, Homo sapiens
gcatgcctggcccctcctc

SEQ ID NO: 5756808 - DNA, 17 bp, Homo sapiens
gcatgcctggcctgagg

SEQ ID NO: 5756809 - DNA, 19 bp, Homo sapiens
gcatgcctggcctgaggac

SEQ ID NO: 5756810 - DNA, 22 bp, Homo sapiens
gcatgcctgtagtctcagctag

SEQ ID NO: 5756811 - DNA, 15 bp, Homo sapiens
gcatgccttcaaatc

SEQ ID NO: 5756812 - DNA, 13 bp, Homo sapiens
gcatgccttgtgc

SEQ ID NO: 5756813 - DNA, 14 bp, Homo sapiens
gcatgcgaaatgtt

SEQ ID NO: 5756814 - DNA, 19 bp, Homo sapiens
gcatgcgaatgagctgggc

SEQ ID NO: 5756815 - DNA, 12 bp, Homo sapiens
gcatgcgacagc

SEQ ID NO: 5756816 - DNA, 18 bp, Homo sapiens
gcatgcgcagaggccagt

SEQ ID NO: 5756817 - DNA, 19 bp, Homo sapiens
gcatgtaaatgtaaactca

SEQ ID NO: 5756818 - DNA, 15 bp, Homo sapiens
gcatgtaagaaataa

SEQ ID NO: 5756819 - DNA, 17 bp, Homo sapiens
gcatgtaatattaaatt

SEQ ID NO: 5756820 - DNA, 19 bp, Homo sapiens
gcatgtacaaaaacacaaa

SEQ ID NO: 5756821 - DNA, 18 bp, Homo sapiens
gcatgtacaaaaattatg

SEQ ID NO: 5756822 - DNA, 19 bp, Homo sapiens
gcatgtacaaaagtaccat

SEQ ID NO: 5756823 - DNA, 22 bp, Homo sapiens
gcatgtacaaaagtaccataga

SEQ ID NO: 5756824 - DNA, 23 bp, Homo sapiens
gcatgtacttgaaggatggatga

SEQ ID NO: 5756825 - DNA, 18 bp, Homo sapiens
gcatgtagaggcttgttt

SEQ ID NO: 5756826 - DNA, 20 bp, Homo sapiens
gcatgtagaggcttgtttac

SEQ ID NO: 5756827 - DNA, 21 bp, Homo sapiens
gcatgtagccagttaaggaaa

SEQ ID NO: 5756828 - DNA, 14 bp, Homo sapiens
gcatgtaggaccct

SEQ ID NO: 5756829 - DNA, 15 bp, Homo sapiens
gcatgtaggagaatc

SEQ ID NO: 5756830 - DNA, 16 bp, Homo sapiens
gcatgtagtaacacta

SEQ ID NO: 5756831 - DNA, 19 bp, Homo sapiens
gcatgtatagttgcttttg

SEQ ID NO: 5756832 - DNA, 14 bp, Homo sapiens
gcatgtatgaatgt

SEQ ID NO: 5756833 - DNA, 19 bp, Homo sapiens
gcatgtatgccatgtatgt

SEQ ID NO: 5756834 - DNA, 20 bp, Homo sapiens
gcatgtatgtgcacatgtgt

SEQ ID NO: 5756835 - DNA, 19 bp, Homo sapiens
gcatgtattagctcactga

SEQ ID NO: 5756836 - DNA, 17 bp, Homo sapiens
gcatgtattggcctgga

SEQ ID NO: 5756837 - DNA, 20 bp, Homo sapiens
gcatgtattgtgtcttttgc

SEQ ID NO: 5756838 - DNA, 14 bp, Homo sapiens
gcatgtcacatgac

SEQ ID NO: 5756839 - DNA, 18 bp, Homo sapiens
gcatgtcacatgccacaa

SEQ ID NO: 5756840 - DNA, 15 bp, Homo sapiens
gcatgtcactcccag

SEQ ID NO: 5756841 - DNA, 14 bp, Homo sapiens
gcatgtcagagcac

SEQ ID NO: 5756842 - DNA, 20 bp, Homo sapiens
gcatgtcagaggaccccagg

SEQ ID NO: 5756843 - DNA, 15 bp, Homo sapiens
gcatgtcatttgcac

SEQ ID NO: 5756844 - DNA, 19 bp, Homo sapiens
gcatgtccccagtgtggac

SEQ ID NO: 5756845 - DNA, 18 bp, Homo sapiens
gcatgtccctccaaggct

SEQ ID NO: 5756846 - DNA, 17 bp, Homo sapiens
gcatgtcctcatccttt

SEQ ID NO: 5756847 - DNA, 19 bp, Homo sapiens
gcatgtcctgtaaaggtta

SEQ ID NO: 5756848 - DNA, 14 bp, Homo sapiens
gcatgtcgcacaat

SEQ ID NO: 5756849 - DNA, 16 bp, Homo sapiens
gcatgtcgcacaatgt

SEQ ID NO: 5756850 - DNA, 16 bp, Homo sapiens
gcatgtcggggcccct

SEQ ID NO: 5756851 - DNA, 20 bp, Homo sapiens
gcatgtctcagattgacctt

SEQ ID NO: 5756852 - DNA, 13 bp, Homo sapiens
gcatgtctgcacc

SEQ ID NO: 5756853 - DNA, 14 bp, Homo sapiens
gcatgtctgcctgg

SEQ ID NO: 5756854 - DNA, 15 bp, Homo sapiens
gcatgtctgcctgga

SEQ ID NO: 5756855 - DNA, 22 bp, Homo sapiens
gcatgtctgggtcgtcttttga

SEQ ID NO: 5756856 - DNA, 13 bp, Homo sapiens
gcatgtcttaaat

SEQ ID NO: 5756857 - DNA, 16 bp, Homo sapiens
gcatgtcttatttaaa

SEQ ID NO: 5756858 - DNA, 12 bp, Homo sapiens
gcatgtgaagaa

SEQ ID NO: 5756859 - DNA, 16 bp, Homo sapiens
gcatgtgaagcatgct

SEQ ID NO: 5756860 - DNA, 17 bp, Homo sapiens
gcatgtgaagcatgctt

SEQ ID NO: 5756861 - DNA, 21 bp, Homo sapiens
gcatgtgaagcatgctttgct

SEQ ID NO: 5756862 - DNA, 13 bp, Homo sapiens
gcatgtgaattct

SEQ ID NO: 5756863 - DNA, 22 bp, Homo sapiens
gcatgtgaattctgtgaagaat

SEQ ID NO: 5756864 - DNA, 20 bp, Homo sapiens
gcatgtgattggcagcttca

SEQ ID NO: 5756865 - DNA, 12 bp, Homo sapiens
gcatgtgcaggt

SEQ ID NO: 5756866 - DNA, 16 bp, Homo sapiens
gcatgtgcatgcatac

SEQ ID NO: 5756867 - DNA, 11 bp, Homo sapiens
gcatgtgccaa

SEQ ID NO: 5756868 - DNA, 23 bp, Homo sapiens
gcatgtgccaagattctactctt

SEQ ID NO: 5756869 - DNA, 16 bp, Homo sapiens
gcatgtgccagttggg

SEQ ID NO: 5756870 - DNA, 14 bp, Homo sapiens
gcatgtgccctcct

SEQ ID NO: 5756871 - DNA, 19 bp, Homo sapiens
gcatgtgcggctgaactga

SEQ ID NO: 5756872 - DNA, 21 bp, Homo sapiens
gcatgtgctgtgtgagtgagc

SEQ ID NO: 5756873 - DNA, 17 bp, Homo sapiens
gcatgtggcctgtggcc

SEQ ID NO: 5756874 - DNA, 13 bp, Homo sapiens
gcatgtggcttct

SEQ ID NO: 5756875 - DNA, 23 bp, Homo sapiens
gcatgtgggggaaggccttgctg

SEQ ID NO: 5756876 - DNA, 23 bp, Homo sapiens
gcatgtgtaggatgtatgctgtt

SEQ ID NO: 5756877 - DNA, 14 bp, Homo sapiens
gcatgtgtatatat

SEQ ID NO: 5756878 - DNA, 19 bp, Homo sapiens
gcatgtgtatatatgtcaa

SEQ ID NO: 5756879 - DNA, 12 bp, Homo sapiens
gcatgtgtatgt

SEQ ID NO: 5756880 - DNA, 20 bp, Homo sapiens
gcatgtgtatttccagtgca

SEQ ID NO: 5756881 - DNA, 13 bp, Homo sapiens
gcatgtgtcagag

SEQ ID NO: 5756882 - DNA, 15 bp, Homo sapiens
gcatgtgtcagagtg

SEQ ID NO: 5756883 - DNA, 15 bp, Homo sapiens
gcatgtgtcatgcat

SEQ ID NO: 5756884 - DNA, 15 bp, Homo sapiens
gcatgtgtcccttcc

SEQ ID NO: 5756885 - DNA, 17 bp, Homo sapiens
gcatgtgtctgtattca

SEQ ID NO: 5756886 - DNA, 18 bp, Homo sapiens
gcatgtgtgactttcagg

SEQ ID NO: 5756887 - DNA, 11 bp, Homo sapiens
gcatgtgtgcc

SEQ ID NO: 5756888 - DNA, 16 bp, Homo sapiens
gcatgtgtgcctgtgg

SEQ ID NO: 5756889 - DNA, 17 bp, Homo sapiens
gcatgtgtgcctgtggc

SEQ ID NO: 5756890 - DNA, 20 bp, Homo sapiens
gcatgtgtgcctgtggcaga

SEQ ID NO: 5756891 - DNA, 15 bp, Homo sapiens
gcatgtgtgtataag

SEQ ID NO: 5756892 - DNA, 24 bp, Homo sapiens
gcatgtgtgtatcaccctcagctg

SEQ ID NO: 5756893 - DNA, 15 bp, Homo sapiens
gcatgtgtgtgtctg

SEQ ID NO: 5756894 - DNA, 14 bp, Homo sapiens
gcatgtgtgtgtgt

SEQ ID NO: 5756895 - DNA, 22 bp, Homo sapiens
gcatgtgttaatcttaatgtat

SEQ ID NO: 5756896 - DNA, 19 bp, Homo sapiens
gcatgtgtttggttctggg

SEQ ID NO: 5756897 - DNA, 20 bp, Homo sapiens
gcatgtgtttggttctgggg

SEQ ID NO: 5756898 - DNA, 15 bp, Homo sapiens
gcatgttaactttat

SEQ ID NO: 5756899 - DNA, 16 bp, Homo sapiens
gcatgttactgccaaa

SEQ ID NO: 5756900 - DNA, 13 bp, Homo sapiens
gcatgttatgttt

SEQ ID NO: 5756901 - DNA, 14 bp, Homo sapiens
gcatgttatgttta

SEQ ID NO: 5756902 - DNA, 19 bp, Homo sapiens
gcatgttatgtttaataag

SEQ ID NO: 5756903 - DNA, 14 bp, Homo sapiens
gcatgttcagggat

SEQ ID NO: 5756904 - DNA, 16 bp, Homo sapiens
gcatgttccactaacc

SEQ ID NO: 5756905 - DNA, 15 bp, Homo sapiens
gcatgttctctgagg

SEQ ID NO: 5756906 - DNA, 16 bp, Homo sapiens
gcatgttctgtgtgcc

SEQ ID NO: 5756907 - DNA, 23 bp, Homo sapiens
gcatgttctgtgtgccctgaaaa

SEQ ID NO: 5756908 - DNA, 21 bp, Homo sapiens
gcatgttcttgttttgttata

SEQ ID NO: 5756909 - DNA, 18 bp, Homo sapiens
gcatgttgaccatgtcta

SEQ ID NO: 5756910 - DNA, 18 bp, Homo sapiens
gcatgttgagccaggcct

SEQ ID NO: 5756911 - DNA, 16 bp, Homo sapiens
gcatgttgctgaggag

SEQ ID NO: 5756912 - DNA, 23 bp, Homo sapiens
gcatgttgggataaatagctaaa

SEQ ID NO: 5756913 - DNA, 20 bp, Homo sapiens
gcatgttgtaacatttcaca

SEQ ID NO: 5756914 - DNA, 19 bp, Homo sapiens
gcatgtttaataatatgta

SEQ ID NO: 5756915 - DNA, 12 bp, Homo sapiens
gcatgtttactt

SEQ ID NO: 5756916 - DNA, 15 bp, Homo sapiens
gcatgtttcatgttt

SEQ ID NO: 5756917 - DNA, 12 bp, Homo sapiens
gcatgtttgctg

SEQ ID NO: 5756918 - DNA, 15 bp, Homo sapiens
gcatgtttgctgttc

SEQ ID NO: 5756919 - DNA, 17 bp, Homo sapiens
gcatgtttgtgattgac

SEQ ID NO: 5756920 - DNA, 11 bp, Homo sapiens
gcatgttttcc

SEQ ID NO: 5756921 - DNA, 12 bp, Homo sapiens
gcatgttttcca

SEQ ID NO: 5756922 - DNA, 17 bp, Homo sapiens
gcatgttttccagggtg

SEQ ID NO: 5756923 - DNA, 15 bp, Homo sapiens
gcatgttttctgctt

SEQ ID NO: 5756924 - DNA, 14 bp, Homo sapiens
gcatgttttgtata

SEQ ID NO: 5756925 - DNA, 15 bp, Homo sapiens
gcatgttttgtatac

SEQ ID NO: 5756926 - DNA, 16 bp, Homo sapiens
gcatgttttgtataca

SEQ ID NO: 5756927 - DNA, 18 bp, Homo sapiens
gcatgttttgtatacaaa

SEQ ID NO: 5756928 - DNA, 14 bp, Homo sapiens
gcatgtttttgaaa

SEQ ID NO: 5756929 - DNA, 19 bp, Homo sapiens
gcattaaaaataagccaaa

SEQ ID NO: 5756930 - DNA, 17 bp, Homo sapiens
gcattaaaacttgggca

SEQ ID NO: 5756931 - DNA, 18 bp, Homo sapiens
gcattaaaacttgggcac

SEQ ID NO: 5756932 - DNA, 13 bp, Homo sapiens
gcattaaaagaaa

SEQ ID NO: 5756933 - DNA, 14 bp, Homo sapiens
gcattaaaagaaaa

SEQ ID NO: 5756934 - DNA, 15 bp, Homo sapiens
gcattaaaataacta

SEQ ID NO: 5756935 - DNA, 17 bp, Homo sapiens
gcattaaaataactatc

SEQ ID NO: 5756936 - DNA, 22 bp, Homo sapiens
gcattaaaataactatcaggca

SEQ ID NO: 5756937 - DNA, 13 bp, Homo sapiens
gcattaaaattaa

SEQ ID NO: 5756938 - DNA, 15 bp, Homo sapiens
gcattaaaattaaat

SEQ ID NO: 5756939 - DNA, 13 bp, Homo sapiens
gcattaaaccaca

SEQ ID NO: 5756940 - DNA, 13 bp, Homo sapiens
gcattaaacctgt

SEQ ID NO: 5756941 - DNA, 14 bp, Homo sapiens
gcattaaacctgtc

SEQ ID NO: 5756942 - DNA, 19 bp, Homo sapiens
gcattaaatataatatgca

SEQ ID NO: 5756943 - DNA, 13 bp, Homo sapiens
gcattaaatgcaa

SEQ ID NO: 5756944 - DNA, 14 bp, Homo sapiens
gcattaaatgcaaa

SEQ ID NO: 5756945 - DNA, 22 bp, Homo sapiens
gcattaaattcacaaactttta

SEQ ID NO: 5756946 - DNA, 23 bp, Homo sapiens
gcattaaattttagcaaagatat

SEQ ID NO: 5756947 - DNA, 16 bp, Homo sapiens
gcattaacaataaagc

SEQ ID NO: 5756948 - DNA, 13 bp, Homo sapiens
gcattaacacaaa

SEQ ID NO: 5756949 - DNA, 22 bp, Homo sapiens
gcattaactaatctattgggtt

SEQ ID NO: 5756950 - DNA, 18 bp, Homo sapiens
gcattaagggcctgctgg

SEQ ID NO: 5756951 - DNA, 23 bp, Homo sapiens
gcattaaggtatttcgaaactgc

SEQ ID NO: 5756952 - DNA, 14 bp, Homo sapiens
gcattaataaaact

SEQ ID NO: 5756953 - DNA, 15 bp, Homo sapiens
gcattaataaaactg

SEQ ID NO: 5756954 - DNA, 18 bp, Homo sapiens
gcattaataatagctaat

SEQ ID NO: 5756955 - DNA, 22 bp, Homo sapiens
gcattaataatagctaataata

SEQ ID NO: 5756956 - DNA, 18 bp, Homo sapiens
gcattaataatccttcca

SEQ ID NO: 5756957 - DNA, 19 bp, Homo sapiens
gcattaatattcttttgtt

SEQ ID NO: 5756958 - DNA, 16 bp, Homo sapiens
gcattaattgtgctgt

SEQ ID NO: 5756959 - DNA, 19 bp, Homo sapiens
gcattacagagaggagaaa

SEQ ID NO: 5756960 - DNA, 13 bp, Homo sapiens
gcattacatgtgt

SEQ ID NO: 5756961 - DNA, 15 bp, Homo sapiens
gcattacccccaacc

SEQ ID NO: 5756962 - DNA, 19 bp, Homo sapiens
gcattacgataaacattaa

SEQ ID NO: 5756963 - DNA, 17 bp, Homo sapiens
gcattacgtgagccagg

SEQ ID NO: 5756964 - DNA, 14 bp, Homo sapiens
gcattactgcatgc

SEQ ID NO: 5756965 - DNA, 21 bp, Homo sapiens
gcattacttactgttaaaact

SEQ ID NO: 5756966 - DNA, 19 bp, Homo sapiens
gcattacttgctttcaatt

SEQ ID NO: 5756967 - DNA, 15 bp, Homo sapiens
gcattactttatagc

SEQ ID NO: 5756968 - DNA, 15 bp, Homo sapiens
gcattagaattattt

SEQ ID NO: 5756969 - DNA, 20 bp, Homo sapiens
gcattagatttctcatttgc

SEQ ID NO: 5756970 - DNA, 13 bp, Homo sapiens
gcattagcaaggc

SEQ ID NO: 5756971 - DNA, 21 bp, Homo sapiens
gcattagcaaggcagagcctt

SEQ ID NO: 5756972 - DNA, 14 bp, Homo sapiens
gcattagcacagat

SEQ ID NO: 5756973 - DNA, 16 bp, Homo sapiens
gcattagcacatattt

SEQ ID NO: 5756974 - DNA, 22 bp, Homo sapiens
gcattaggcttttaagaaacac

SEQ ID NO: 5756975 - DNA, 17 bp, Homo sapiens
gcattagtgtcccccct

SEQ ID NO: 5756976 - DNA, 20 bp, Homo sapiens
gcattataatcaccagggcc

SEQ ID NO: 5756977 - DNA, 18 bp, Homo sapiens
gcattatataccctggtg

SEQ ID NO: 5756978 - DNA, 13 bp, Homo sapiens
gcattatatttat

SEQ ID NO: 5756979 - DNA, 19 bp, Homo sapiens
gcattatctagatactgta

SEQ ID NO: 5756980 - DNA, 22 bp, Homo sapiens
gcattatctagatactgtatca

SEQ ID NO: 5756981 - DNA, 17 bp, Homo sapiens
gcattatctatgcagca

SEQ ID NO: 5756982 - DNA, 14 bp, Homo sapiens
gcattatcttgctc

SEQ ID NO: 5756983 - DNA, 24 bp, Homo sapiens
gcattatgatcccttccccctgct

SEQ ID NO: 5756984 - DNA, 14 bp, Homo sapiens
gcattatgcaatta

SEQ ID NO: 5756985 - DNA, 18 bp, Homo sapiens
gcattatgcaatttttat

SEQ ID NO: 5756986 - DNA, 19 bp, Homo sapiens
gcattatggtctaatgatt

SEQ ID NO: 5756987 - DNA, 16 bp, Homo sapiens
gcattattcatttagt

SEQ ID NO: 5756988 - DNA, 16 bp, Homo sapiens
gcattattcctccagg

SEQ ID NO: 5756989 - DNA, 14 bp, Homo sapiens
gcattattctcttt

SEQ ID NO: 5756990 - DNA, 16 bp, Homo sapiens
gcattattctctttta

SEQ ID NO: 5756991 - DNA, 21 bp, Homo sapiens
gcattattctcttttatctgt

SEQ ID NO: 5756992 - DNA, 21 bp, Homo sapiens
gcattattgacgaactggcta

SEQ ID NO: 5756993 - DNA, 15 bp, Homo sapiens
gcattattgcattat

SEQ ID NO: 5756994 - DNA, 16 bp, Homo sapiens
gcattatttacaaaaa

SEQ ID NO: 5756995 - DNA, 11 bp, Homo sapiens
gcattatttga

SEQ ID NO: 5756996 - DNA, 22 bp, Homo sapiens
gcattatttgaaaacactgctg

SEQ ID NO: 5756997 - DNA, 16 bp, Homo sapiens
gcatttcaatttcaat

SEQ ID NO: 5756998 - DNA, 23 bp, Homo sapiens
gcatttcacctgtgacaaaggat

SEQ ID NO: 5756999 - DNA, 21 bp, Homo sapiens
gcatttcacgaactgttcaca

SEQ ID NO: 5757000 - DNA, 22 bp, Homo sapiens
gcatttcactttcccggtgttc

SEQ ID NO: 5757001 - DNA, 12 bp, Homo sapiens
gcatttcagaaa

SEQ ID NO: 5757002 - DNA, 16 bp, Homo sapiens
gcatttcataaactaa

SEQ ID NO: 5757003 - DNA, 12 bp, Homo sapiens
gcatttcatatt

SEQ ID NO: 5757004 - DNA, 18 bp, Homo sapiens
gcatttcatgctatcaga

SEQ ID NO: 5757005 - DNA, 22 bp, Homo sapiens
gcatttcattcttctctagctg

SEQ ID NO: 5757006 - DNA, 21 bp, Homo sapiens
gcatttccaacaccacagaca

SEQ ID NO: 5757007 - DNA, 18 bp, Homo sapiens
gcatttccagctgtgcag

SEQ ID NO: 5757008 - DNA, 18 bp, Homo sapiens
gcatttcctgctggtcaa

SEQ ID NO: 5757009 - DNA, 21 bp, Homo sapiens
gcatttcctgtgtttgtcctg

SEQ ID NO: 5757010 - DNA, 17 bp, Homo sapiens
gcatttccttccagccc

SEQ ID NO: 5757011 - DNA, 18 bp, Homo sapiens
gcatttccttccagccca

SEQ ID NO: 5757012 - DNA, 16 bp, Homo sapiens
gcatttccttgtcccg

SEQ ID NO: 5757013 - DNA, 22 bp, Homo sapiens
gcatttcggttgagaatggaaa

SEQ ID NO: 5757014 - DNA, 13 bp, Homo sapiens
gcatttctaaaat

SEQ ID NO: 5757015 - DNA, 22 bp, Homo sapiens
gcatttctaaaatgttaaaaca

SEQ ID NO: 5757016 - DNA, 17 bp, Homo sapiens
gcatttctcttctcagc

SEQ ID NO: 5757017 - DNA, 16 bp, Homo sapiens
gcatttctctttaaac

SEQ ID NO: 5757018 - DNA, 12 bp, Homo sapiens
gcatttctgaag

SEQ ID NO: 5757019 - DNA, 13 bp, Homo sapiens
gcatttctgaagt

SEQ ID NO: 5757020 - DNA, 19 bp, Homo sapiens
gcatttctgggccttatgt

SEQ ID NO: 5757021 - DNA, 20 bp, Homo sapiens
gcatttcttgatgttgctta

SEQ ID NO: 5757022 - DNA, 24 bp, Homo sapiens
gcatttctttatttctgtctcata

SEQ ID NO: 5757023 - DNA, 16 bp, Homo sapiens
gcatttgaaaattttg

SEQ ID NO: 5757024 - DNA, 16 bp, Homo sapiens
gcatttgaatgcattt

SEQ ID NO: 5757025 - DNA, 14 bp, Homo sapiens
gcatttgagcagct

SEQ ID NO: 5757026 - DNA, 21 bp, Homo sapiens
gcatttgataatgataaaaca

SEQ ID NO: 5757027 - DNA, 21 bp, Homo sapiens
gcatttgatctgttgcaagcc

SEQ ID NO: 5757028 - DNA, 15 bp, Homo sapiens
gcatttgcacctctg

SEQ ID NO: 5757029 - DNA, 23 bp, Homo sapiens
gcatttgcacctctgttcatttc

SEQ ID NO: 5757030 - DNA, 17 bp, Homo sapiens
gcatttgcagattttta

SEQ ID NO: 5757031 - DNA, 19 bp, Homo sapiens
gcatttgccctgtggattc

SEQ ID NO: 5757032 - DNA, 13 bp, Homo sapiens
gcatttgcctgct

SEQ ID NO: 5757033 - DNA, 20 bp, Homo sapiens
gcatttgctgaataacaaca

SEQ ID NO: 5757034 - DNA, 17 bp, Homo sapiens
gcatttgctgaatacag

SEQ ID NO: 5757035 - DNA, 12 bp, Homo sapiens
gcatttgctgat

SEQ ID NO: 5757036 - DNA, 14 bp, Homo sapiens
gcatttgctgcatg

SEQ ID NO: 5757037 - DNA, 16 bp, Homo sapiens
gcatttggaaccaaag

SEQ ID NO: 5757038 - DNA, 16 bp, Homo sapiens
gcatttggattggggt

SEQ ID NO: 5757039 - DNA, 23 bp, Homo sapiens
gcatttggattggggtccctcta

SEQ ID NO: 5757040 - DNA, 16 bp, Homo sapiens
gcatttggctggagcc

SEQ ID NO: 5757041 - DNA, 18 bp, Homo sapiens
gcatttggcttcctctgc

SEQ ID NO: 5757042 - DNA, 20 bp, Homo sapiens
gcatttggcttcctctgctg

SEQ ID NO: 5757043 - DNA, 23 bp, Homo sapiens
gcatttggggtggggggcaggat

SEQ ID NO: 5757044 - DNA, 15 bp, Homo sapiens
gcatttgggtccagg

SEQ ID NO: 5757045 - DNA, 22 bp, Homo sapiens
gcatttggtaaaggtatgtaaa

SEQ ID NO: 5757046 - DNA, 13 bp, Homo sapiens
gcatttggtctca

SEQ ID NO: 5757047 - DNA, 21 bp, Homo sapiens
gcatttggtgagagtcaaagc

SEQ ID NO: 5757048 - DNA, 22 bp, Homo sapiens
gcatttggtgagagtcaaagct

SEQ ID NO: 5757049 - DNA, 13 bp, Homo sapiens
gcatttggtgcct

SEQ ID NO: 5757050 - DNA, 23 bp, Homo sapiens
gcatttggtggtttcagaaatgt

SEQ ID NO: 5757051 - DNA, 15 bp, Homo sapiens
gcatttgtataaaga

SEQ ID NO: 5757052 - DNA, 22 bp, Homo sapiens
gcatttgtataaagaaactggt

SEQ ID NO: 5757053 - DNA, 16 bp, Homo sapiens
gcatttgtattttgtg

SEQ ID NO: 5757054 - DNA, 11 bp, Homo sapiens
gcatttgtcta

SEQ ID NO: 5757055 - DNA, 12 bp, Homo sapiens
gcatttgtgaaa

SEQ ID NO: 5757056 - DNA, 21 bp, Homo sapiens
gcatttgtgctagaaattttc

SEQ ID NO: 5757057 - DNA, 15 bp, Homo sapiens
gcatttgtgtcatct

SEQ ID NO: 5757058 - DNA, 15 bp, Homo sapiens
gcatttgtgtgttac

SEQ ID NO: 5757059 - DNA, 16 bp, Homo sapiens
gcatttgtgttgaaga

SEQ ID NO: 5757060 - DNA, 19 bp, Homo sapiens
gcatttgttcagctccccc

SEQ ID NO: 5757061 - DNA, 19 bp, Homo sapiens
gcatttgttccattaaaaa

SEQ ID NO: 5757062 - DNA, 16 bp, Homo sapiens
gcatttgttctttgcc

SEQ ID NO: 5757063 - DNA, 18 bp, Homo sapiens
gcatttgttctttgccag

SEQ ID NO: 5757064 - DNA, 19 bp, Homo sapiens
gcatttgtttatgtaattt

SEQ ID NO: 5757065 - DNA, 17 bp, Homo sapiens
gcatttgttttgtttac

SEQ ID NO: 5757066 - DNA, 15 bp, Homo sapiens
gcattttaaaaatga

SEQ ID NO: 5757067 - DNA, 17 bp, Homo sapiens
gcattttaaaaatgaaa

SEQ ID NO: 5757068 - DNA, 23 bp, Homo sapiens
gcattttaaacaaaatagaaagt

SEQ ID NO: 5757069 - DNA, 15 bp, Homo sapiens
gcattttaaatgtct

SEQ ID NO: 5757070 - DNA, 22 bp, Homo sapiens
gcattttaagcataattaattt

SEQ ID NO: 5757071 - DNA, 14 bp, Homo sapiens
gcattttaaggttc

SEQ ID NO: 5757072 - DNA, 14 bp, Homo sapiens
gcattttacacatt

SEQ ID NO: 5757073 - DNA, 18 bp, Homo sapiens
gcattttaccttcaaaat

SEQ ID NO: 5757074 - DNA, 18 bp, Homo sapiens
gcattttactacttgtta

SEQ ID NO: 5757075 - DNA, 22 bp, Homo sapiens
gcattttactacttgttacctt

SEQ ID NO: 5757076 - DNA, 12 bp, Homo sapiens
gcattttataaa

SEQ ID NO: 5757077 - DNA, 16 bp, Homo sapiens
gcattttattaaactt

SEQ ID NO: 5757078 - DNA, 16 bp, Homo sapiens
gcattttattgcttga

SEQ ID NO: 5757079 - DNA, 13 bp, Homo sapiens
gcattttcaagat

SEQ ID NO: 5757080 - DNA, 14 bp, Homo sapiens
gcattttcccagat

SEQ ID NO: 5757081 - DNA, 20 bp, Homo sapiens
gcattttcccccttggctct

SEQ ID NO: 5757082 - DNA, 21 bp, Homo sapiens
gcattttctgaaactaatgaa

SEQ ID NO: 5757083 - DNA, 17 bp, Homo sapiens
gcattttctgatgtatt

SEQ ID NO: 5757084 - DNA, 13 bp, Homo sapiens
gcattttgaaaca

SEQ ID NO: 5757085 - DNA, 12 bp, Homo sapiens
gcattttgaatg

SEQ ID NO: 5757086 - DNA, 16 bp, Homo sapiens
gcattttgagaatggt

SEQ ID NO: 5757087 - DNA, 22 bp, Homo sapiens
gcattttgctaaatgtgaatga

SEQ ID NO: 5757088 - DNA, 19 bp, Homo sapiens
gcattttgctattgtaaat

SEQ ID NO: 5757089 - DNA, 19 bp, Homo sapiens
gcattttggctcagagtcc

SEQ ID NO: 5757090 - DNA, 20 bp, Homo sapiens
gcattttgggttgtttaaaa

SEQ ID NO: 5757091 - DNA, 18 bp, Homo sapiens
gcattttggtttttcctc

SEQ ID NO: 5757092 - DNA, 22 bp, Homo sapiens
gcattttgtaagttgaagcaaa

SEQ ID NO: 5757093 - DNA, 12 bp, Homo sapiens
gcattttgtaat

SEQ ID NO: 5757094 - DNA, 16 bp, Homo sapiens
gcattttgtgtacagt

SEQ ID NO: 5757095 - DNA, 18 bp, Homo sapiens
gcattttgtgtacagtaa

SEQ ID NO: 5757096 - DNA, 14 bp, Homo sapiens
gcattttgtgtctt

SEQ ID NO: 5757097 - DNA, 18 bp, Homo sapiens
gcattttgtttctgtata

SEQ ID NO: 5757098 - DNA, 19 bp, Homo sapiens
gcattttgtttctgtatat

SEQ ID NO: 5757099 - DNA, 23 bp, Homo sapiens
gcatttttactactattctgtta

SEQ ID NO: 5757100 - DNA, 16 bp, Homo sapiens
gcatttttatgcagac

SEQ ID NO: 5757101 - DNA, 18 bp, Homo sapiens
gcatttttattaaagcat

SEQ ID NO: 5757102 - DNA, 19 bp, Homo sapiens
gcatttttattaaagcatt

SEQ ID NO: 5757103 - DNA, 21 bp, Homo sapiens
gcatttttcaatatattgaac

SEQ ID NO: 5757104 - DNA, 13 bp, Homo sapiens
gcatttttcagag

SEQ ID NO: 5757105 - DNA, 20 bp, Homo sapiens
gcatttttgatttatgcatg

SEQ ID NO: 5757106 - DNA, 15 bp, Homo sapiens
gcatttttgcttcct

SEQ ID NO: 5757107 - DNA, 15 bp, Homo sapiens
gcatttttgtatttt

SEQ ID NO: 5757108 - DNA, 20 bp, Homo sapiens
gcatttttgttttgaaagtt

SEQ ID NO: 5757109 - DNA, 17 bp, Homo sapiens
gcattttttaaaacaag

SEQ ID NO: 5757110 - DNA, 19 bp, Homo sapiens
gcattttttaacctcctaa

SEQ ID NO: 5757111 - DNA, 20 bp, Homo sapiens
gcattttttatcaggcagga

SEQ ID NO: 5757112 - DNA, 14 bp, Homo sapiens
gcatttttttcctt

SEQ ID NO: 5757113 - DNA, 18 bp, Homo sapiens
gccaaaaaaaaaagaagt

SEQ ID NO: 5757114 - DNA, 23 bp, Homo sapiens
gccaaaaaaaaaagaagttactt

SEQ ID NO: 5757115 - DNA, 16 bp, Homo sapiens
gccaaaaaggatacat

SEQ ID NO: 5757116 - DNA, 19 bp, Homo sapiens
gccaaaaaggatacataat

SEQ ID NO: 5757117 - DNA, 17 bp, Homo sapiens
gccaaaaagtgaaataa

SEQ ID NO: 5757118 - DNA, 13 bp, Homo sapiens
gccaaaaatacag

SEQ ID NO: 5757119 - DNA, 14 bp, Homo sapiens
gccaaaacatttat

SEQ ID NO: 5757120 - DNA, 20 bp, Homo sapiens
gccaaaaccaatgctgatga

SEQ ID NO: 5757121 - DNA, 13 bp, Homo sapiens
gccaaaaccacat

SEQ ID NO: 5757122 - DNA, 16 bp, Homo sapiens
gccaaaaccacatggg

SEQ ID NO: 5757123 - DNA, 14 bp, Homo sapiens
gccaaaaccaggcc

SEQ ID NO: 5757124 - DNA, 19 bp, Homo sapiens
gccaaaacccagctgcacc

SEQ ID NO: 5757125 - DNA, 15 bp, Homo sapiens
gccaaaagcttccct

SEQ ID NO: 5757126 - DNA, 14 bp, Homo sapiens
gccaaaaggaaaaa

SEQ ID NO: 5757127 - DNA, 18 bp, Homo sapiens
gccaaaaggaaaaagctc

SEQ ID NO: 5757128 - DNA, 17 bp, Homo sapiens
gccaaaaggccccttcc

SEQ ID NO: 5757129 - DNA, 23 bp, Homo sapiens
gccaaaaggccccttcccacgtc

SEQ ID NO: 5757130 - DNA, 18 bp, Homo sapiens
gccaaaagggcagccagg

SEQ ID NO: 5757131 - DNA, 19 bp, Homo sapiens
gccaaaagggcagccaggg

SEQ ID NO: 5757132 - DNA, 23 bp, Homo sapiens
gccaaaagtccctccctgcctga

SEQ ID NO: 5757133 - DNA, 13 bp, Homo sapiens
gccaaaataaagt

SEQ ID NO: 5757134 - DNA, 11 bp, Homo sapiens
gccaaaataat

SEQ ID NO: 5757135 - DNA, 23 bp, Homo sapiens
gccaaaataatgtcttgttaata

SEQ ID NO: 5757136 - DNA, 15 bp, Homo sapiens
gccaaaatcaagagt

SEQ ID NO: 5757137 - DNA, 16 bp, Homo sapiens
gccaaaatgtcaattt

SEQ ID NO: 5757138 - DNA, 22 bp, Homo sapiens
gccaaaatgtcaatttttaact

SEQ ID NO: 5757139 - DNA, 18 bp, Homo sapiens
gccaaaatgttggctgcg

SEQ ID NO: 5757140 - DNA, 23 bp, Homo sapiens
gccaaaattaaggtgtttgaaaa

SEQ ID NO: 5757141 - DNA, 23 bp, Homo sapiens
gccaaacaaaaaggttctcaggt

SEQ ID NO: 5757142 - DNA, 13 bp, Homo sapiens
gccaaacacagag

SEQ ID NO: 5757143 - DNA, 14 bp, Homo sapiens
gccaaacacagagc

SEQ ID NO: 5757144 - DNA, 15 bp, Homo sapiens
gccaaacaccacttt

SEQ ID NO: 5757145 - DNA, 22 bp, Homo sapiens
gccaaacagttgtaccactgct

SEQ ID NO: 5757146 - DNA, 20 bp, Homo sapiens
gccaaacatcagacctgtct

SEQ ID NO: 5757147 - DNA, 12 bp, Homo sapiens
gccaaacattaa

SEQ ID NO: 5757148 - DNA, 22 bp, Homo sapiens
gccaaacattaatgttgatttc

SEQ ID NO: 5757149 - DNA, 21 bp, Homo sapiens
gccaaacattcttattttaga

SEQ ID NO: 5757150 - DNA, 14 bp, Homo sapiens
gccaaaccagcagg

SEQ ID NO: 5757151 - DNA, 18 bp, Homo sapiens
gccaaaccaggaccctgt

SEQ ID NO: 5757152 - DNA, 15 bp, Homo sapiens
gccaaacccagcccc

SEQ ID NO: 5757153 - DNA, 17 bp, Homo sapiens
gccaaacccagcccctg

SEQ ID NO: 5757154 - DNA, 13 bp, Homo sapiens
gccaaacccctag

SEQ ID NO: 5757155 - DNA, 14 bp, Homo sapiens
gccaaacctcctgt

SEQ ID NO: 5757156 - DNA, 15 bp, Homo sapiens
gccaaacctcctgtc

SEQ ID NO: 5757157 - DNA, 14 bp, Homo sapiens
gccaaacctctgtt

SEQ ID NO: 5757158 - DNA, 19 bp, Homo sapiens
gccaaacctctgttcagtg

SEQ ID NO: 5757159 - DNA, 16 bp, Homo sapiens
gccaaactcacctgcc

SEQ ID NO: 5757160 - DNA, 19 bp, Homo sapiens
gccaaactgtagatgaaga

SEQ ID NO: 5757161 - DNA, 15 bp, Homo sapiens
gccaaactgtccctc

SEQ ID NO: 5757162 - DNA, 16 bp, Homo sapiens
gccaaactgtccctcc

SEQ ID NO: 5757163 - DNA, 23 bp, Homo sapiens
gccaaagaaacaagctgtgcagg

SEQ ID NO: 5757164 - DNA, 22 bp, Homo sapiens
gccaaagaaatgaacattccaa

SEQ ID NO: 5757165 - DNA, 23 bp, Homo sapiens
gccaaagaaatgggcctgcctgc

SEQ ID NO: 5757166 - DNA, 17 bp, Homo sapiens
gccaaagaaggcaggga

SEQ ID NO: 5757167 - DNA, 17 bp, Homo sapiens
gccaaagacctcccaag

SEQ ID NO: 5757168 - DNA, 19 bp, Homo sapiens
gccaaagacttagtatatt

SEQ ID NO: 5757169 - DNA, 15 bp, Homo sapiens
gccaaagagcctttc

SEQ ID NO: 5757170 - DNA, 12 bp, Homo sapiens
gccaaagagctc

SEQ ID NO: 5757171 - DNA, 15 bp, Homo sapiens
gccaaagataaaagg

SEQ ID NO: 5757172 - DNA, 20 bp, Homo sapiens
gccaaagatagcagaagagt

SEQ ID NO: 5757173 - DNA, 14 bp, Homo sapiens
gccaaagatcactt

SEQ ID NO: 5757174 - DNA, 20 bp, Homo sapiens
gccaaagatgtttgaaaatg

SEQ ID NO: 5757175 - DNA, 21 bp, Homo sapiens
gccaagcacagtggtggcagg

SEQ ID NO: 5757176 - DNA, 14 bp, Homo sapiens
gccaagcactgctc

SEQ ID NO: 5757177 - DNA, 15 bp, Homo sapiens
gccaagcactgctca

SEQ ID NO: 5757178 - DNA, 16 bp, Homo sapiens
gccaagcactgctcac

SEQ ID NO: 5757179 - DNA, 23 bp, Homo sapiens
gccaagcactgctcacgtctctg

SEQ ID NO: 5757180 - DNA, 15 bp, Homo sapiens
gccaagcactgtgct

SEQ ID NO: 5757181 - DNA, 18 bp, Homo sapiens
gccaagcactgtgctcag

SEQ ID NO: 5757182 - DNA, 12 bp, Homo sapiens
gccaagcagcca

SEQ ID NO: 5757183 - DNA, 13 bp, Homo sapiens
gccaagcaggcac

SEQ ID NO: 5757184 - DNA, 13 bp, Homo sapiens
gccaagcaggctg

SEQ ID NO: 5757185 - DNA, 16 bp, Homo sapiens
gccaagcaggctggtt

SEQ ID NO: 5757186 - DNA, 14 bp, Homo sapiens
gccaagccagctgc

SEQ ID NO: 5757187 - DNA, 22 bp, Homo sapiens
gccaagccagggttccagacag

SEQ ID NO: 5757188 - DNA, 21 bp, Homo sapiens
gccaagccccatcctgccgcc

SEQ ID NO: 5757189 - DNA, 13 bp, Homo sapiens
gccaagccccccg

SEQ ID NO: 5757190 - DNA, 22 bp, Homo sapiens
gccaagcccctgccctggggag

SEQ ID NO: 5757191 - DNA, 21 bp, Homo sapiens
gccaagccctccccatcccat

SEQ ID NO: 5757192 - DNA, 13 bp, Homo sapiens
gccaagccctggc

SEQ ID NO: 5757193 - DNA, 13 bp, Homo sapiens
gccaagccctttg

SEQ ID NO: 5757194 - DNA, 16 bp, Homo sapiens
gccaagccctttgctg

SEQ ID NO: 5757195 - DNA, 19 bp, Homo sapiens
gccaagccctttgctgttc

SEQ ID NO: 5757196 - DNA, 10 bp, Homo sapiens
gccaagcctg

SEQ ID NO: 5757197 - DNA, 11 bp, Homo sapiens
gccaagcctgc

SEQ ID NO: 5757198 - DNA, 14 bp, Homo sapiens
gccaagcctgcccc

SEQ ID NO: 5757199 - DNA, 17 bp, Homo sapiens
gccaagcctgccccggc

SEQ ID NO: 5757200 - DNA, 14 bp, Homo sapiens
gccaagcctggagc

SEQ ID NO: 5757201 - DNA, 18 bp, Homo sapiens
gccaagcctggagcccct

SEQ ID NO: 5757202 - DNA, 19 bp, Homo sapiens
gccaagcctggagcccctg

SEQ ID NO: 5757203 - DNA, 14 bp, Homo sapiens
gccaagcctggagt

SEQ ID NO: 5757204 - DNA, 21 bp, Homo sapiens
gccaagcctggagtaggcctg

SEQ ID NO: 5757205 - DNA, 22 bp, Homo sapiens
gccaagcctggagtaggcctgg

SEQ ID NO: 5757206 - DNA, 15 bp, Homo sapiens
gccaagcctggccct

SEQ ID NO: 5757207 - DNA, 22 bp, Homo sapiens
gccaagcgagaatgcaggcccc

SEQ ID NO: 5757208 - DNA, 19 bp, Homo sapiens
gccaagcgggggcgtggct

SEQ ID NO: 5757209 - DNA, 13 bp, Homo sapiens
gccaagctagaat

SEQ ID NO: 5757210 - DNA, 17 bp, Homo sapiens
gccaagctcacacagca

SEQ ID NO: 5757211 - DNA, 15 bp, Homo sapiens
gccaagctccctgga

SEQ ID NO: 5757212 - DNA, 17 bp, Homo sapiens
gccaagctccctggagc

SEQ ID NO: 5757213 - DNA, 20 bp, Homo sapiens
gccaagctccctggagccct

SEQ ID NO: 5757214 - DNA, 21 bp, Homo sapiens
gccaagctccctggagccctg

SEQ ID NO: 5757215 - DNA, 16 bp, Homo sapiens
gccaagctccttggga

SEQ ID NO: 5757216 - DNA, 19 bp, Homo sapiens
gccaagctccttgggaggc

SEQ ID NO: 5757217 - DNA, 17 bp, Homo sapiens
gccaagctgaagtgaag

SEQ ID NO: 5757218 - DNA, 21 bp, Homo sapiens
gccaagctgaggaggtgctgc

SEQ ID NO: 5757219 - DNA, 22 bp, Homo sapiens
gccaagctgaggtgcccaggag

SEQ ID NO: 5757220 - DNA, 12 bp, Homo sapiens
gccaagctgcac

SEQ ID NO: 5757221 - DNA, 13 bp, Homo sapiens
gccaagctgcaca

SEQ ID NO: 5757222 - DNA, 14 bp, Homo sapiens
gccaagctggggca

SEQ ID NO: 5757223 - DNA, 22 bp, Homo sapiens
gccaagctggggcaaggggcag

SEQ ID NO: 5757224 - DNA, 16 bp, Homo sapiens
gccaagctttcttcta

SEQ ID NO: 5757225 - DNA, 14 bp, Homo sapiens
gccaaggaaaggca

SEQ ID NO: 5757226 - DNA, 16 bp, Homo sapiens
gccaaggaatgatcca

SEQ ID NO: 5757227 - DNA, 20 bp, Homo sapiens
gccaaggacactgatgggtc

SEQ ID NO: 5757228 - DNA, 12 bp, Homo sapiens
gccaaggacagg

SEQ ID NO: 5757229 - DNA, 21 bp, Homo sapiens
gccaaggacagggctggctcc

SEQ ID NO: 5757230 - DNA, 15 bp, Homo sapiens
gccaaggacccaggc

SEQ ID NO: 5757231 - DNA, 19 bp, Homo sapiens
gccaaggacccaggcgctg

SEQ ID NO: 5757232 - DNA, 17 bp, Homo sapiens
gccaaggactgactgag

SEQ ID NO: 5757233 - DNA, 20 bp, Homo sapiens
gccaaggactgactttgcca

SEQ ID NO: 5757234 - DNA, 14 bp, Homo sapiens
gccaaggactgccg

SEQ ID NO: 5757235 - DNA, 23 bp, Homo sapiens
gccaaggagaggagttctttggc

SEQ ID NO: 5757236 - DNA, 16 bp, Homo sapiens
gccaaggagcatcctt

SEQ ID NO: 5757237 - DNA, 10 bp, Homo sapiens
gccaaggagg

SEQ ID NO: 5757238 - DNA, 15 bp, Homo sapiens
gccaaggaggcctgg

SEQ ID NO: 5757239 - DNA, 20 bp, Homo sapiens
gccaaggagggtgagtgcaa

SEQ ID NO: 5757240 - DNA, 18 bp, Homo sapiens
gccaaggaggtcccagga

SEQ ID NO: 5757241 - DNA, 21 bp, Homo sapiens
gccaaggaggtcccaggaagt

SEQ ID NO: 5757242 - DNA, 23 bp, Homo sapiens
gccaaggagtcagatggcaatgg

SEQ ID NO: 5757243 - DNA, 22 bp, Homo sapiens
gccaaggataccggacacacct

SEQ ID NO: 5757244 - DNA, 20 bp, Homo sapiens
gccaaggcagcgaccccagg

SEQ ID NO: 5757245 - DNA, 19 bp, Homo sapiens
gccaaggcagctcttctgg

SEQ ID NO: 5757246 - DNA, 22 bp, Homo sapiens
gccaaggcagctcttctggagt

SEQ ID NO: 5757247 - DNA, 23 bp, Homo sapiens
gccaaggcagctcttctggagtt

SEQ ID NO: 5757248 - DNA, 14 bp, Homo sapiens
gccaaggcatcccc

SEQ ID NO: 5757249 - DNA, 17 bp, Homo sapiens
gccaaggccaaaggaag

SEQ ID NO: 5757250 - DNA, 24 bp, Homo sapiens
gccaaggccaaaggaagcacatgc

SEQ ID NO: 5757251 - DNA, 17 bp, Homo sapiens
gccaaggccgccagcgt

SEQ ID NO: 5757252 - DNA, 19 bp, Homo sapiens
gccaaggccgccagcgtgt

SEQ ID NO: 5757253 - DNA, 18 bp, Homo sapiens
gccaaggccgcccacctg

SEQ ID NO: 5757254 - DNA, 11 bp, Homo sapiens
gccaaggccta

SEQ ID NO: 5757255 - DNA, 12 bp, Homo sapiens
gccaaggcctag

SEQ ID NO: 5757256 - DNA, 13 bp, Homo sapiens
gccaaggcctagg

SEQ ID NO: 5757257 - DNA, 16 bp, Homo sapiens
gccaaggcctcaggag

SEQ ID NO: 5757258 - DNA, 19 bp, Homo sapiens
gccaaggcctcaggagagc

SEQ ID NO: 5757259 - DNA, 17 bp, Homo sapiens
gccaaggctctcccctc

SEQ ID NO: 5757260 - DNA, 16 bp, Homo sapiens
gccaaggctgagagct

SEQ ID NO: 5757261 - DNA, 21 bp, Homo sapiens
gccaaggctgggggaagaagc

SEQ ID NO: 5757262 - DNA, 12 bp, Homo sapiens
gccaagggaaag

SEQ ID NO: 5757263 - DNA, 22 bp, Homo sapiens
gccaagggaaaggggtgctttt

SEQ ID NO: 5757264 - DNA, 18 bp, Homo sapiens
gccaagggaacctgtgtc

SEQ ID NO: 5757265 - DNA, 16 bp, Homo sapiens
gccaagggacacagga

SEQ ID NO: 5757266 - DNA, 18 bp, Homo sapiens
gccaagggagggaagggc

SEQ ID NO: 5757267 - DNA, 20 bp, Homo sapiens
gccaagggcccaaagaaaga

SEQ ID NO: 5757268 - DNA, 18 bp, Homo sapiens
gccaagggccccaggggc

SEQ ID NO: 5757269 - DNA, 19 bp, Homo sapiens
gccaagggccccaggggca

SEQ ID NO: 5757270 - DNA, 16 bp, Homo sapiens
gccaaggggctgcgct

SEQ ID NO: 5757271 - DNA, 21 bp, Homo sapiens
gccaaggggctgcgctagcag

SEQ ID NO: 5757272 - DNA, 18 bp, Homo sapiens
gccaagggggcagagggc

SEQ ID NO: 5757273 - DNA, 19 bp, Homo sapiens
gccaagggggtgactggaa

SEQ ID NO: 5757274 - DNA, 22 bp, Homo sapiens
gccaaggtagccatcccatgaa

SEQ ID NO: 5757275 - DNA, 20 bp, Homo sapiens
gccaaggtgcatatagaaaa

SEQ ID NO: 5757276 - DNA, 19 bp, Homo sapiens
gccaaggtggagggaagga

SEQ ID NO: 5757277 - DNA, 14 bp, Homo sapiens
gccaaggtgggcgg

SEQ ID NO: 5757278 - DNA, 19 bp, Homo sapiens
gccaaggtgggctgagccc

SEQ ID NO: 5757279 - DNA, 14 bp, Homo sapiens
gccaaggtgtccag

SEQ ID NO: 5757280 - DNA, 16 bp, Homo sapiens
gccaaggtgtcctaca

SEQ ID NO: 5757281 - DNA, 19 bp, Homo sapiens
gccaaggtgtcctacagaa

SEQ ID NO: 5757282 - DNA, 23 bp, Homo sapiens
gccaaggtttcccagtgagcctc

SEQ ID NO: 5757283 - DNA, 22 bp, Homo sapiens
gccaagtaaaatgttttttaaa

SEQ ID NO: 5757284 - DNA, 19 bp, Homo sapiens
gccaagtaagagtggtggc

SEQ ID NO: 5757285 - DNA, 22 bp, Homo sapiens
gccaagtataattttttgtaat

SEQ ID NO: 5757286 - DNA, 16 bp, Homo sapiens
gccaagtccactgtcc

SEQ ID NO: 5757287 - DNA, 16 bp, Homo sapiens
gccaagtccaggtcct

SEQ ID NO: 5757288 - DNA, 23 bp, Homo sapiens
gccaagtcccaccggttgcttct

SEQ ID NO: 5757289 - DNA, 16 bp, Homo sapiens
gccaagtctggcacca

SEQ ID NO: 5757290 - DNA, 20 bp, Homo sapiens
gccaagtgcaggctggcacc

SEQ ID NO: 5757291 - DNA, 18 bp, Homo sapiens
gccaagtgccaaatgctc

SEQ ID NO: 5757292 - DNA, 14 bp, Homo sapiens
gccaagtgccttcc

SEQ ID NO: 5757293 - DNA, 18 bp, Homo sapiens
gccaagtgcgtgccgtgt

SEQ ID NO: 5757294 - DNA, 13 bp, Homo sapiens
gccaagtgctctt

SEQ ID NO: 5757295 - DNA, 22 bp, Homo sapiens
gccaagtggacagtctggccac

SEQ ID NO: 5757296 - DNA, 16 bp, Homo sapiens
gccaagtggccctcag

SEQ ID NO: 5757297 - DNA, 18 bp, Homo sapiens
gccaagtggggtgctggg

SEQ ID NO: 5757298 - DNA, 17 bp, Homo sapiens
gccaagtggtccagcgt

SEQ ID NO: 5757299 - DNA, 13 bp, Homo sapiens
gccaagtgtcttt

SEQ ID NO: 5757300 - DNA, 17 bp, Homo sapiens
gccaagtgtcttttaaa

SEQ ID NO: 5757301 - DNA, 12 bp, Homo sapiens
gccaagttcctc

SEQ ID NO: 5757302 - DNA, 15 bp, Homo sapiens
gccaagttcctctag

SEQ ID NO: 5757303 - DNA, 12 bp, Homo sapiens
gccaagttctta

SEQ ID NO: 5757304 - DNA, 18 bp, Homo sapiens
gccaagttgctgtcactg

SEQ ID NO: 5757305 - DNA, 17 bp, Homo sapiens
gccaagtttatatacaa

SEQ ID NO: 5757306 - DNA, 10 bp, Homo sapiens
gccaataaaa

SEQ ID NO: 5757307 - DNA, 13 bp, Homo sapiens
gccaataaaaagt

SEQ ID NO: 5757308 - DNA, 14 bp, Homo sapiens
gccaataaaaagtt

SEQ ID NO: 5757309 - DNA, 17 bp, Homo sapiens
gccaataaaatgtatct

SEQ ID NO: 5757310 - DNA, 17 bp, Homo sapiens
gccaataaagctcacac

SEQ ID NO: 5757311 - DNA, 21 bp, Homo sapiens
gccaataaagctcacacttgg

SEQ ID NO: 5757312 - DNA, 21 bp, Homo sapiens
gccaataggtgcctagtaaat

SEQ ID NO: 5757313 - DNA, 15 bp, Homo sapiens
gccaatatcctaata

SEQ ID NO: 5757314 - DNA, 15 bp, Homo sapiens
gccaatatgacacag

SEQ ID NO: 5757315 - DNA, 17 bp, Homo sapiens
gccaatatgccagcttg

SEQ ID NO: 5757316 - DNA, 17 bp, Homo sapiens
gccaatatgtattgtaa

SEQ ID NO: 5757317 - DNA, 17 bp, Homo sapiens
gccaatattgagatgta

SEQ ID NO: 5757318 - DNA, 23 bp, Homo sapiens
gccaatcactgagtttgtggtga

SEQ ID NO: 5757319 - DNA, 13 bp, Homo sapiens
gccaatcccctcc

SEQ ID NO: 5757320 - DNA, 19 bp, Homo sapiens
gccaatcccctccttgggc

SEQ ID NO: 5757321 - DNA, 21 bp, Homo sapiens
gccaatcccctccttgggcac

SEQ ID NO: 5757322 - DNA, 22 bp, Homo sapiens
gccaatccctcaccttctgagt

SEQ ID NO: 5757323 - DNA, 20 bp, Homo sapiens
gccaatcccttctccactta

SEQ ID NO: 5757324 - DNA, 15 bp, Homo sapiens
gccaatctaaaatgg

SEQ ID NO: 5757325 - DNA, 23 bp, Homo sapiens
gccaatctattctcaaagttaaa

SEQ ID NO: 5757326 - DNA, 16 bp, Homo sapiens
gccaatctccaggctc

SEQ ID NO: 5757327 - DNA, 22 bp, Homo sapiens
gccaatctccaggctccctccc

SEQ ID NO: 5757328 - DNA, 23 bp, Homo sapiens
gccaatctcttctaaaaaaaaac

SEQ ID NO: 5757329 - DNA, 15 bp, Homo sapiens
gccaatcttgtttta

SEQ ID NO: 5757330 - DNA, 21 bp, Homo sapiens
gccaatctttcctactttcta

SEQ ID NO: 5757331 - DNA, 17 bp, Homo sapiens
gccaatgaacagctcct

SEQ ID NO: 5757332 - DNA, 18 bp, Homo sapiens
gccaatgaacagctcctc

SEQ ID NO: 5757333 - DNA, 20 bp, Homo sapiens
gccaatgaatcaatgtgctc

SEQ ID NO: 5757334 - DNA, 13 bp, Homo sapiens
gccaatgactaac

SEQ ID NO: 5757335 - DNA, 12 bp, Homo sapiens
gccaatgaggtc

SEQ ID NO: 5757336 - DNA, 22 bp, Homo sapiens
gccaatgaggtctgaaatggag

SEQ ID NO: 5757337 - DNA, 18 bp, Homo sapiens
gccaatgagtctgtaatt

SEQ ID NO: 5757338 - DNA, 23 bp, Homo sapiens
gccaatgagtctgtaattttacg

SEQ ID NO: 5757339 - DNA, 15 bp, Homo sapiens
gccaatgatgtgacc

SEQ ID NO: 5757340 - DNA, 18 bp, Homo sapiens
gccaatgatgtgaccctc

SEQ ID NO: 5757341 - DNA, 16 bp, Homo sapiens
gccaatgccacagcca

SEQ ID NO: 5757342 - DNA, 22 bp, Homo sapiens
gccaatgccacagccaagccca

SEQ ID NO: 5757343 - DNA, 17 bp, Homo sapiens
gccaatgccatgactgc

SEQ ID NO: 5757344 - DNA, 20 bp, Homo sapiens
gccaatgccatgactgctca

SEQ ID NO: 5757345 - DNA, 18 bp, Homo sapiens
gccaatggaacctccttt

SEQ ID NO: 5757346 - DNA, 20 bp, Homo sapiens
gccaatggaacctcctttct

SEQ ID NO: 5757347 - DNA, 16 bp, Homo sapiens
gccaatggagaaaatg

SEQ ID NO: 5757348 - DNA, 18 bp, Homo sapiens
gccaatggagaaaatgaa

SEQ ID NO: 5757349 - DNA, 16 bp, Homo sapiens
gccaatggagactgtc

SEQ ID NO: 5757350 - DNA, 19 bp, Homo sapiens
gccaatggagactgtctca

SEQ ID NO: 5757351 - DNA, 21 bp, Homo sapiens
gccaatggaggggggtgctgg

SEQ ID NO: 5757352 - DNA, 21 bp, Homo sapiens
gccacagggtgagcactctgg

SEQ ID NO: 5757353 - DNA, 18 bp, Homo sapiens
gccacagtacatatgtaa

SEQ ID NO: 5757354 - DNA, 14 bp, Homo sapiens
gccacagtcatggt

SEQ ID NO: 5757355 - DNA, 22 bp, Homo sapiens
gccacagtgagctgatgtgccc

SEQ ID NO: 5757356 - DNA, 15 bp, Homo sapiens
gccacagtggcactt

SEQ ID NO: 5757357 - DNA, 18 bp, Homo sapiens
gccacagtggggcccatg

SEQ ID NO: 5757358 - DNA, 21 bp, Homo sapiens
gccacagtgttatgctctgtg

SEQ ID NO: 5757359 - DNA, 14 bp, Homo sapiens
gccacagttcccct

SEQ ID NO: 5757360 - DNA, 14 bp, Homo sapiens
gccacatacctctc

SEQ ID NO: 5757361 - DNA, 20 bp, Homo sapiens
gccacatagctcataagctg

SEQ ID NO: 5757362 - DNA, 14 bp, Homo sapiens
gccacatcagcccc

SEQ ID NO: 5757363 - DNA, 23 bp, Homo sapiens
gccacatccacagtctcccccac

SEQ ID NO: 5757364 - DNA, 13 bp, Homo sapiens
gccacatccagct

SEQ ID NO: 5757365 - DNA, 13 bp, Homo sapiens
gccacatccccaa

SEQ ID NO: 5757366 - DNA, 13 bp, Homo sapiens
gccacatccctct

SEQ ID NO: 5757367 - DNA, 19 bp, Homo sapiens
gccacatcctcatggccca

SEQ ID NO: 5757368 - DNA, 16 bp, Homo sapiens
gccacatcgcagcccc

SEQ ID NO: 5757369 - DNA, 21 bp, Homo sapiens
gccacatcgttgagacatcag

SEQ ID NO: 5757370 - DNA, 22 bp, Homo sapiens
gccacatcgttgagacatcagg

SEQ ID NO: 5757371 - DNA, 23 bp, Homo sapiens
gccacatctgtgtctctggaacc

SEQ ID NO: 5757372 - DNA, 16 bp, Homo sapiens
gccacatcttgaaaat

SEQ ID NO: 5757373 - DNA, 18 bp, Homo sapiens
gccacatcttgaaaatgc

SEQ ID NO: 5757374 - DNA, 23 bp, Homo sapiens
gccacatcttgaaaatgccacca

SEQ ID NO: 5757375 - DNA, 14 bp, Homo sapiens
gccacatcttgctc

SEQ ID NO: 5757376 - DNA, 16 bp, Homo sapiens
gccacatgccccaggc

SEQ ID NO: 5757377 - DNA, 17 bp, Homo sapiens
gccacatgccccaggct

SEQ ID NO: 5757378 - DNA, 18 bp, Homo sapiens
gccacatgccccaggctc

SEQ ID NO: 5757379 - DNA, 15 bp, Homo sapiens
gccacatggccgctg

SEQ ID NO: 5757380 - DNA, 21 bp, Homo sapiens
gccacatggcttcctcctgcg

SEQ ID NO: 5757381 - DNA, 16 bp, Homo sapiens
gccacatggtgtctcc

SEQ ID NO: 5757382 - DNA, 20 bp, Homo sapiens
gccacatggtgtctcccaac

SEQ ID NO: 5757383 - DNA, 19 bp, Homo sapiens
gccacatgtgaaaacctgt

SEQ ID NO: 5757384 - DNA, 16 bp, Homo sapiens
gccacattagaacttc

SEQ ID NO: 5757385 - DNA, 23 bp, Homo sapiens
gccacattagaacttctccgtcc

SEQ ID NO: 5757386 - DNA, 14 bp, Homo sapiens
gccacattgctggc

SEQ ID NO: 5757387 - DNA, 17 bp, Homo sapiens
gccacattgctggctgc

SEQ ID NO: 5757388 - DNA, 12 bp, Homo sapiens
gccacatttctg

SEQ ID NO: 5757389 - DNA, 11 bp, Homo sapiens
gccacattttc

SEQ ID NO: 5757390 - DNA, 16 bp, Homo sapiens
gccacattttgcttta

SEQ ID NO: 5757391 - DNA, 17 bp, Homo sapiens
gccacattttgctttat

SEQ ID NO: 5757392 - DNA, 17 bp, Homo sapiens
gccaccaaagctgccca

SEQ ID NO: 5757393 - DNA, 19 bp, Homo sapiens
gccaccaaagctgcccact

SEQ ID NO: 5757394 - DNA, 16 bp, Homo sapiens
gccaccaaaggccagg

SEQ ID NO: 5757395 - DNA, 16 bp, Homo sapiens
gccaccaacactgctc

SEQ ID NO: 5757396 - DNA, 22 bp, Homo sapiens
gccaccaacataaaacaaaacc

SEQ ID NO: 5757397 - DNA, 14 bp, Homo sapiens
gccaccaagaggga

SEQ ID NO: 5757398 - DNA, 19 bp, Homo sapiens
gccaccaagagggacgcct

SEQ ID NO: 5757399 - DNA, 16 bp, Homo sapiens
gccaccaagctgctct

SEQ ID NO: 5757400 - DNA, 17 bp, Homo sapiens
gccaccaaggctgcctg

SEQ ID NO: 5757401 - DNA, 22 bp, Homo sapiens
gccaccaaggctgcctgcccca

SEQ ID NO: 5757402 - DNA, 12 bp, Homo sapiens
gccaccaataaa

SEQ ID NO: 5757403 - DNA, 14 bp, Homo sapiens
gccaccaataaaaa

SEQ ID NO: 5757404 - DNA, 15 bp, Homo sapiens
gccaccacacctggc

SEQ ID NO: 5757405 - DNA, 16 bp, Homo sapiens
gccaccacacctggct

SEQ ID NO: 5757406 - DNA, 21 bp, Homo sapiens
gccaccaccacctgacggctg

SEQ ID NO: 5757407 - DNA, 20 bp, Homo sapiens
gccaccaccacgcagccgcc

SEQ ID NO: 5757408 - DNA, 13 bp, Homo sapiens
gccaccacccccc

SEQ ID NO: 5757409 - DNA, 22 bp, Homo sapiens
gccaccaccccccactctgtgc

SEQ ID NO: 5757410 - DNA, 22 bp, Homo sapiens
gccaccacccctccctctgctc

SEQ ID NO: 5757411 - DNA, 15 bp, Homo sapiens
gccaccaccctcagg

SEQ ID NO: 5757412 - DNA, 16 bp, Homo sapiens
gccaccaccctcaggt

SEQ ID NO: 5757413 - DNA, 19 bp, Homo sapiens
gccaccaccctcaggtgcc

SEQ ID NO: 5757414 - DNA, 20 bp, Homo sapiens
gccaccaccctcaggtgcct

SEQ ID NO: 5757415 - DNA, 13 bp, Homo sapiens
gccaccaccctgc

SEQ ID NO: 5757416 - DNA, 20 bp, Homo sapiens
gccaccaccctgtcttcctc

SEQ ID NO: 5757417 - DNA, 16 bp, Homo sapiens
gccaccacctctgtgg

SEQ ID NO: 5757418 - DNA, 18 bp, Homo sapiens
gccaccacctctgtggca

SEQ ID NO: 5757419 - DNA, 19 bp, Homo sapiens
gccaccacctttggctggt

SEQ ID NO: 5757420 - DNA, 14 bp, Homo sapiens
gccaccacgtccag

SEQ ID NO: 5757421 - DNA, 15 bp, Homo sapiens
gccaccacgtccagc

SEQ ID NO: 5757422 - DNA, 18 bp, Homo sapiens
gccaccacgtctgccagg

SEQ ID NO: 5757423 - DNA, 14 bp, Homo sapiens
gccaccactcctgc

SEQ ID NO: 5757424 - DNA, 16 bp, Homo sapiens
gccaccactcctgcct

SEQ ID NO: 5757425 - DNA, 18 bp, Homo sapiens
gccaccactcctgcctgc

SEQ ID NO: 5757426 - DNA, 13 bp, Homo sapiens
gccaccacttcca

SEQ ID NO: 5757427 - DNA, 20 bp, Homo sapiens
gccaccacttccagagccag

SEQ ID NO: 5757428 - DNA, 14 bp, Homo sapiens
gccaccagcaatgc

SEQ ID NO: 5757429 - DNA, 16 bp, Homo sapiens
gccaccagcaatgccc

SEQ ID NO: 5757430 - DNA, 20 bp, Homo sapiens
gccaccagcaatgccctgcc

SEQ ID NO: 5757431 - DNA, 22 bp, Homo sapiens
gccaccagcaatgccctgcctt

SEQ ID NO: 5757432 - DNA, 14 bp, Homo sapiens
gccaccagcatcca

SEQ ID NO: 5757433 - DNA, 10 bp, Homo sapiens
gccaccagcg

SEQ ID NO: 5757434 - DNA, 19 bp, Homo sapiens
gccaccagcgcccccactc

SEQ ID NO: 5757435 - DNA, 17 bp, Homo sapiens
gccaccagctccactgg

SEQ ID NO: 5757436 - DNA, 16 bp, Homo sapiens
gccaccagctgctgga

SEQ ID NO: 5757437 - DNA, 14 bp, Homo sapiens
gccaccaggaagca

SEQ ID NO: 5757438 - DNA, 17 bp, Homo sapiens
gccaccaggatggccct

SEQ ID NO: 5757439 - DNA, 15 bp, Homo sapiens
gccaccaggccacct

SEQ ID NO: 5757440 - DNA, 14 bp, Homo sapiens
gccaccaggctggc

SEQ ID NO: 5757441 - DNA, 13 bp, Homo sapiens
gccaccagggagc

SEQ ID NO: 5757442 - DNA, 19 bp, Homo sapiens
gccaccagggagcttcctg

SEQ ID NO: 5757443 - DNA, 22 bp, Homo sapiens
gccaccagggagcttcctggct

SEQ ID NO: 5757444 - DNA, 16 bp, Homo sapiens
gccaccagggcactgt

SEQ ID NO: 5757445 - DNA, 19 bp, Homo sapiens
gccaccagggcactgtctg

SEQ ID NO: 5757446 - DNA, 21 bp, Homo sapiens
gccaccagggcactgtctgcg

SEQ ID NO: 5757447 - DNA, 15 bp, Homo sapiens
gccaccagtggacct

SEQ ID NO: 5757448 - DNA, 13 bp, Homo sapiens
gccaccagttctc

SEQ ID NO: 5757449 - DNA, 15 bp, Homo sapiens
gccaccatccccacc

SEQ ID NO: 5757450 - DNA, 18 bp, Homo sapiens
gccaccatcctattgcaa

SEQ ID NO: 5757451 - DNA, 17 bp, Homo sapiens
gccaccatcctgcagcc

SEQ ID NO: 5757452 - DNA, 19 bp, Homo sapiens
gccaccatgaccccttctc

SEQ ID NO: 5757453 - DNA, 22 bp, Homo sapiens
gccaccatgcccagctcagagg

SEQ ID NO: 5757454 - DNA, 22 bp, Homo sapiens
gccaccatgcctcactaatttt

SEQ ID NO: 5757455 - DNA, 17 bp, Homo sapiens
gccaccatgcttgcctg

SEQ ID NO: 5757456 - DNA, 16 bp, Homo sapiens
gccaccatggccagcc

SEQ ID NO: 5757457 - DNA, 16 bp, Homo sapiens
gccaccattcctggaa

SEQ ID NO: 5757458 - DNA, 16 bp, Homo sapiens
gccacccaagcctgct

SEQ ID NO: 5757459 - DNA, 17 bp, Homo sapiens
gccacccaagcctgctg

SEQ ID NO: 5757460 - DNA, 18 bp, Homo sapiens
gccacccaagcctgctgg

SEQ ID NO: 5757461 - DNA, 22 bp, Homo sapiens
gccacccaagcctgctggctgc

SEQ ID NO: 5757462 - DNA, 22 bp, Homo sapiens
gccacccaccagggctcagctc

SEQ ID NO: 5757463 - DNA, 16 bp, Homo sapiens
gccacccactgaccca

SEQ ID NO: 5757464 - DNA, 24 bp, Homo sapiens
gccacccactgtggggcaagcctg

SEQ ID NO: 5757465 - DNA, 14 bp, Homo sapiens
gccacccagcccca

SEQ ID NO: 5757466 - DNA, 17 bp, Homo sapiens
gccacccaggaggcagg

SEQ ID NO: 5757467 - DNA, 20 bp, Homo sapiens
gccacccatcgtccacccca

SEQ ID NO: 5757468 - DNA, 16 bp, Homo sapiens
gccacccatgaggctt

SEQ ID NO: 5757469 - DNA, 14 bp, Homo sapiens
gccaccccaaccca

SEQ ID NO: 5757470 - DNA, 18 bp, Homo sapiens
gccaccccaccctccctg

SEQ ID NO: 5757471 - DNA, 21 bp, Homo sapiens
gccaccccaccctccctggag

SEQ ID NO: 5757472 - DNA, 22 bp, Homo sapiens
gccaccccaccctccctggagt

SEQ ID NO: 5757473 - DNA, 17 bp, Homo sapiens
gccaccccactgagagc

SEQ ID NO: 5757474 - DNA, 19 bp, Homo sapiens
gccaccccatgagctcggg

SEQ ID NO: 5757475 - DNA, 16 bp, Homo sapiens
gccaccccatgtgcct

SEQ ID NO: 5757476 - DNA, 12 bp, Homo sapiens
gccacccccagc

SEQ ID NO: 5757477 - DNA, 20 bp, Homo sapiens
gccacccccagccctggccc

SEQ ID NO: 5757478 - DNA, 22 bp, Homo sapiens
gccacccccagccctggcccct

SEQ ID NO: 5757479 - DNA, 16 bp, Homo sapiens
gccacccccaggtctt

SEQ ID NO: 5757480 - DNA, 17 bp, Homo sapiens
gccacccccagttccta

SEQ ID NO: 5757481 - DNA, 14 bp, Homo sapiens
gccacccccatctt

SEQ ID NO: 5757482 - DNA, 14 bp, Homo sapiens
gccacccccatgga

SEQ ID NO: 5757483 - DNA, 17 bp, Homo sapiens
gccacccccccacccca

SEQ ID NO: 5757484 - DNA, 23 bp, Homo sapiens
gccaccccccgccggcaggggcc

SEQ ID NO: 5757485 - DNA, 21 bp, Homo sapiens
gccacccccgcccccaccggg

SEQ ID NO: 5757486 - DNA, 22 bp, Homo sapiens
gccaccccgctgatggagcccc

SEQ ID NO: 5757487 - DNA, 15 bp, Homo sapiens
gccaccccgtgccac

SEQ ID NO: 5757488 - DNA, 16 bp, Homo sapiens
gccaccccgtgccacc

SEQ ID NO: 5757489 - DNA, 13 bp, Homo sapiens
gccacccctcccc

SEQ ID NO: 5757490 - DNA, 15 bp, Homo sapiens
gccacccctcttctg

SEQ ID NO: 5757491 - DNA, 20 bp, Homo sapiens
gccacccctgccactcaccc

SEQ ID NO: 5757492 - DNA, 21 bp, Homo sapiens
gccacccctgccactcaccct

SEQ ID NO: 5757493 - DNA, 20 bp, Homo sapiens
gccaccccttcctcagcctg

SEQ ID NO: 5757494 - DNA, 22 bp, Homo sapiens
gccaccccttcctcagcctggg

SEQ ID NO: 5757495 - DNA, 17 bp, Homo sapiens
gccaccccttcctcccc

SEQ ID NO: 5757496 - DNA, 18 bp, Homo sapiens
gccaccccttcctcccca

SEQ ID NO: 5757497 - DNA, 20 bp, Homo sapiens
gccaccccttgctctctgtt

SEQ ID NO: 5757498 - DNA, 13 bp, Homo sapiens
gccaccccttggc

SEQ ID NO: 5757499 - DNA, 17 bp, Homo sapiens
gccacccgcccgccccc

SEQ ID NO: 5757500 - DNA, 19 bp, Homo sapiens
gccacccgcctccctctca

SEQ ID NO: 5757501 - DNA, 21 bp, Homo sapiens
gccacccgttctgctggcctg

SEQ ID NO: 5757502 - DNA, 22 bp, Homo sapiens
gccacccgttctgctggcctgg

SEQ ID NO: 5757503 - DNA, 17 bp, Homo sapiens
gccaccctaactgagct

SEQ ID NO: 5757504 - DNA, 18 bp, Homo sapiens
gccaccctaactgagctg

SEQ ID NO: 5757505 - DNA, 18 bp, Homo sapiens
gccaccctacctgttcag

SEQ ID NO: 5757506 - DNA, 13 bp, Homo sapiens
gccaccctcatgc

SEQ ID NO: 5757507 - DNA, 16 bp, Homo sapiens
gccaccctcccagctc

SEQ ID NO: 5757508 - DNA, 21 bp, Homo sapiens
gccaccctcccctatgctggt

SEQ ID NO: 5757509 - DNA, 23 bp, Homo sapiens
gccaccctcctccctccaagcct

SEQ ID NO: 5757510 - DNA, 14 bp, Homo sapiens
gccaccctctccat

SEQ ID NO: 5757511 - DNA, 13 bp, Homo sapiens
gccaccctctgca

SEQ ID NO: 5757512 - DNA, 17 bp, Homo sapiens
gccaccctctgcagggc

SEQ ID NO: 5757513 - DNA, 21 bp, Homo sapiens
gccaccctctgcagggcagcc

SEQ ID NO: 5757514 - DNA, 14 bp, Homo sapiens
gccaccctctggga

SEQ ID NO: 5757515 - DNA, 13 bp, Homo sapiens
gccaccctgagca

SEQ ID NO: 5757516 - DNA, 13 bp, Homo sapiens
gccaccctgagga

SEQ ID NO: 5757517 - DNA, 16 bp, Homo sapiens
gccaccctgaggagtc

SEQ ID NO: 5757518 - DNA, 22 bp, Homo sapiens
gccaccctgaggagtctgaggt

SEQ ID NO: 5757519 - DNA, 17 bp, Homo sapiens
gccaccctgcccctaag

SEQ ID NO: 5757520 - DNA, 15 bp, Homo sapiens
gccaccctgctgcac

SEQ ID NO: 5757521 - DNA, 22 bp, Homo sapiens
gccaccctgctgcactaggact

SEQ ID NO: 5757522 - DNA, 17 bp, Homo sapiens
gccaccctgggctctgt

SEQ ID NO: 5757523 - DNA, 19 bp, Homo sapiens
gccaccctgggctctgtgg

SEQ ID NO: 5757524 - DNA, 14 bp, Homo sapiens
gccaccctgtctca

SEQ ID NO: 5757525 - DNA, 12 bp, Homo sapiens
gccaccctgtgc

SEQ ID NO: 5757526 - DNA, 15 bp, Homo sapiens
gccacccttccctgc

SEQ ID NO: 5757527 - DNA, 16 bp, Homo sapiens
gccacccttccctgcc

SEQ ID NO: 5757528 - DNA, 21 bp, Homo sapiens
gccacccttgcccacttctcc

SEQ ID NO: 5757529 - DNA, 13 bp, Homo sapiens
gccacccttggcc

SEQ ID NO: 5757530 - DNA, 21 bp, Homo sapiens
gccactcaggaggctgaggca

SEQ ID NO: 5757531 - DNA, 16 bp, Homo sapiens
gccactcattcctgta

SEQ ID NO: 5757532 - DNA, 18 bp, Homo sapiens
gccactcatttcatctca

SEQ ID NO: 5757533 - DNA, 16 bp, Homo sapiens
gccactccagacccct

SEQ ID NO: 5757534 - DNA, 20 bp, Homo sapiens
gccactccagacccctggct

SEQ ID NO: 5757535 - DNA, 16 bp, Homo sapiens
gccactccagtcctgc

SEQ ID NO: 5757536 - DNA, 22 bp, Homo sapiens
gccactcccctaaactccagga

SEQ ID NO: 5757537 - DNA, 16 bp, Homo sapiens
gccactcccctccact

SEQ ID NO: 5757538 - DNA, 15 bp, Homo sapiens
gccactccctgagct

SEQ ID NO: 5757539 - DNA, 19 bp, Homo sapiens
gccactccctgagctttgg

SEQ ID NO: 5757540 - DNA, 13 bp, Homo sapiens
gccactccctgcc

SEQ ID NO: 5757541 - DNA, 13 bp, Homo sapiens
gccactcctctga

SEQ ID NO: 5757542 - DNA, 14 bp, Homo sapiens
gccactcctctgac

SEQ ID NO: 5757543 - DNA, 12 bp, Homo sapiens
gccactcctctt

SEQ ID NO: 5757544 - DNA, 15 bp, Homo sapiens
gccactcctcttcac

SEQ ID NO: 5757545 - DNA, 15 bp, Homo sapiens
gccactcctgaaccc

SEQ ID NO: 5757546 - DNA, 14 bp, Homo sapiens
gccactcctgtccc

SEQ ID NO: 5757547 - DNA, 18 bp, Homo sapiens
gccactcctgtcccgcct

SEQ ID NO: 5757548 - DNA, 22 bp, Homo sapiens
gccactcctgtcccgccttcct

SEQ ID NO: 5757549 - DNA, 13 bp, Homo sapiens
gccactccttcct

SEQ ID NO: 5757550 - DNA, 18 bp, Homo sapiens
gccactcgccttcttaga

SEQ ID NO: 5757551 - DNA, 19 bp, Homo sapiens
gccactcgccttcttagag

SEQ ID NO: 5757552 - DNA, 23 bp, Homo sapiens
gccactctaccagtgcaggctgg

SEQ ID NO: 5757553 - DNA, 22 bp, Homo sapiens
gccactctcccctccctcttcc

SEQ ID NO: 5757554 - DNA, 18 bp, Homo sapiens
gccactctcctgaggagc

SEQ ID NO: 5757555 - DNA, 19 bp, Homo sapiens
gccactctcctgaggagca

SEQ ID NO: 5757556 - DNA, 15 bp, Homo sapiens
gccactctctgccca

SEQ ID NO: 5757557 - DNA, 22 bp, Homo sapiens
gccactctctgggactctcctc

SEQ ID NO: 5757558 - DNA, 12 bp, Homo sapiens
gccactctgcct

SEQ ID NO: 5757559 - DNA, 21 bp, Homo sapiens
gccactctgtttgctcaccca

SEQ ID NO: 5757560 - DNA, 15 bp, Homo sapiens
gccactgaaatctgt

SEQ ID NO: 5757561 - DNA, 14 bp, Homo sapiens
gccactgaagctgg

SEQ ID NO: 5757562 - DNA, 17 bp, Homo sapiens
gccactgaagctgggat

SEQ ID NO: 5757563 - DNA, 12 bp, Homo sapiens
gccactgaccca

SEQ ID NO: 5757564 - DNA, 19 bp, Homo sapiens
gccactgacctcaccggca

SEQ ID NO: 5757565 - DNA, 19 bp, Homo sapiens
gccactgactgcagggaca

SEQ ID NO: 5757566 - DNA, 20 bp, Homo sapiens
gccactgacttgctgtgtga

SEQ ID NO: 5757567 - DNA, 14 bp, Homo sapiens
gccactgagctggc

SEQ ID NO: 5757568 - DNA, 15 bp, Homo sapiens
gccactgagctggct

SEQ ID NO: 5757569 - DNA, 16 bp, Homo sapiens
gccactgagctggctg

SEQ ID NO: 5757570 - DNA, 14 bp, Homo sapiens
gccactgaggagac

SEQ ID NO: 5757571 - DNA, 17 bp, Homo sapiens
gccactgaggagacaga

SEQ ID NO: 5757572 - DNA, 16 bp, Homo sapiens
gccactgatattcaga

SEQ ID NO: 5757573 - DNA, 18 bp, Homo sapiens
gccactgcaaaccctgct

SEQ ID NO: 5757574 - DNA, 15 bp, Homo sapiens
gccactgcacagagc

SEQ ID NO: 5757575 - DNA, 18 bp, Homo sapiens
gccactgcaccgggccac

SEQ ID NO: 5757576 - DNA, 20 bp, Homo sapiens
gccactgcaccgggccacag

SEQ ID NO: 5757577 - DNA, 21 bp, Homo sapiens
gccactgcaccgggccacaga

SEQ ID NO: 5757578 - DNA, 22 bp, Homo sapiens
gccactgcaccgggccacagag

SEQ ID NO: 5757579 - DNA, 23 bp, Homo sapiens
gccactgcaccgggccacagaga

SEQ ID NO: 5757580 - DNA, 18 bp, Homo sapiens
gccactgcacctgcccag

SEQ ID NO: 5757581 - DNA, 19 bp, Homo sapiens
gccactgcactccagcctg

SEQ ID NO: 5757582 - DNA, 21 bp, Homo sapiens
gccactgcactccagcctggg

SEQ ID NO: 5757583 - DNA, 12 bp, Homo sapiens
gccactgcagca

SEQ ID NO: 5757584 - DNA, 21 bp, Homo sapiens
gccactgcagtcacccctgtc

SEQ ID NO: 5757585 - DNA, 22 bp, Homo sapiens
gccactgcagtcacccctgtct

SEQ ID NO: 5757586 - DNA, 12 bp, Homo sapiens
gccactgccact

SEQ ID NO: 5757587 - DNA, 16 bp, Homo sapiens
gccactgccactccag

SEQ ID NO: 5757588 - DNA, 15 bp, Homo sapiens
gccactgccagcagc

SEQ ID NO: 5757589 - DNA, 14 bp, Homo sapiens
gccactgccaggca

SEQ ID NO: 5757590 - DNA, 21 bp, Homo sapiens
gccactgccaggcacctggcc

SEQ ID NO: 5757591 - DNA, 22 bp, Homo sapiens
gccactgccaggcacctggcct

SEQ ID NO: 5757592 - DNA, 19 bp, Homo sapiens
gccactgccattaaagaat

SEQ ID NO: 5757593 - DNA, 19 bp, Homo sapiens
gccactgcccgagctggtg

SEQ ID NO: 5757594 - DNA, 18 bp, Homo sapiens
gccactgccctctccaca

SEQ ID NO: 5757595 - DNA, 22 bp, Homo sapiens
gccactgccgcctactggacgc

SEQ ID NO: 5757596 - DNA, 13 bp, Homo sapiens
gccactgcctccc

SEQ ID NO: 5757597 - DNA, 12 bp, Homo sapiens
gccactgcctct

SEQ ID NO: 5757598 - DNA, 16 bp, Homo sapiens
gccactgcctctccct

SEQ ID NO: 5757599 - DNA, 17 bp, Homo sapiens
gccactgcctcttcctc

SEQ ID NO: 5757600 - DNA, 15 bp, Homo sapiens
gccactgcctgcacc

SEQ ID NO: 5757601 - DNA, 17 bp, Homo sapiens
gccactgcctttcagaa

SEQ ID NO: 5757602 - DNA, 18 bp, Homo sapiens
gccactgcgccactgcca

SEQ ID NO: 5757603 - DNA, 14 bp, Homo sapiens
gccactgcgcccag

SEQ ID NO: 5757604 - DNA, 17 bp, Homo sapiens
gccactgcgctcttggg

SEQ ID NO: 5757605 - DNA, 19 bp, Homo sapiens
gccactgctctccagcctg

SEQ ID NO: 5757606 - DNA, 22 bp, Homo sapiens
gccactggaaatgcatgacttc

SEQ ID NO: 5757607 - DNA, 16 bp, Homo sapiens
gccactggatcctgct

SEQ ID NO: 5757608 - DNA, 19 bp, Homo sapiens
gccactggatcctgctgct

SEQ ID NO: 5757609 - DNA, 23 bp, Homo sapiens
gccactggcacttgcctgctgct

SEQ ID NO: 5757610 - DNA, 16 bp, Homo sapiens
gccactggcatctctg

SEQ ID NO: 5757611 - DNA, 17 bp, Homo sapiens
gccactggcatctctgg

SEQ ID NO: 5757612 - DNA, 21 bp, Homo sapiens
gccactggcatctctggagtg

SEQ ID NO: 5757613 - DNA, 12 bp, Homo sapiens
gccactggccat

SEQ ID NO: 5757614 - DNA, 14 bp, Homo sapiens
gccactggccctgt

SEQ ID NO: 5757615 - DNA, 15 bp, Homo sapiens
gccactggccctgtt

SEQ ID NO: 5757616 - DNA, 19 bp, Homo sapiens
gccactggctgtgcctccc

SEQ ID NO: 5757617 - DNA, 15 bp, Homo sapiens
gccactgggacagct

SEQ ID NO: 5757618 - DNA, 18 bp, Homo sapiens
gccactgggacagctggc

SEQ ID NO: 5757619 - DNA, 22 bp, Homo sapiens
gccactgggacggctcctgctt

SEQ ID NO: 5757620 - DNA, 21 bp, Homo sapiens
gccactgggagggggacccgt

SEQ ID NO: 5757621 - DNA, 14 bp, Homo sapiens
gccactgggcccca

SEQ ID NO: 5757622 - DNA, 15 bp, Homo sapiens
gccactgggcccctg

SEQ ID NO: 5757623 - DNA, 20 bp, Homo sapiens
gccactgggccctgagccag

SEQ ID NO: 5757624 - DNA, 14 bp, Homo sapiens
gccactgggctctg

SEQ ID NO: 5757625 - DNA, 23 bp, Homo sapiens
gccactgggctctggacctcagg

SEQ ID NO: 5757626 - DNA, 18 bp, Homo sapiens
gccactggggactttatt

SEQ ID NO: 5757627 - DNA, 12 bp, Homo sapiens
gccactggggct

SEQ ID NO: 5757628 - DNA, 14 bp, Homo sapiens
gccactggggctca

SEQ ID NO: 5757629 - DNA, 15 bp, Homo sapiens
gccactggggctcag

SEQ ID NO: 5757630 - DNA, 17 bp, Homo sapiens
gccactggggctcagag

SEQ ID NO: 5757631 - DNA, 20 bp, Homo sapiens
gccactggggtgccttcact

SEQ ID NO: 5757632 - DNA, 20 bp, Homo sapiens
gccactggggtgggaggggg

SEQ ID NO: 5757633 - DNA, 19 bp, Homo sapiens
gccactgggtctcactcct

SEQ ID NO: 5757634 - DNA, 20 bp, Homo sapiens
gccactgggtctcactcctg

SEQ ID NO: 5757635 - DNA, 16 bp, Homo sapiens
gccactggtttctcag

SEQ ID NO: 5757636 - DNA, 17 bp, Homo sapiens
gccactggtttctcaga

SEQ ID NO: 5757637 - DNA, 18 bp, Homo sapiens
gccactggtttctcagaa

SEQ ID NO: 5757638 - DNA, 13 bp, Homo sapiens
gccactgtatttg

SEQ ID NO: 5757639 - DNA, 14 bp, Homo sapiens
gccactgtccctgt

SEQ ID NO: 5757640 - DNA, 17 bp, Homo sapiens
gccactgtccctgtcct

SEQ ID NO: 5757641 - DNA, 19 bp, Homo sapiens
gccactgtccctgtccttc

SEQ ID NO: 5757642 - DNA, 15 bp, Homo sapiens
gccactgtccgctgt

SEQ ID NO: 5757643 - DNA, 22 bp, Homo sapiens
gccactgtccgctgtctccctc

SEQ ID NO: 5757644 - DNA, 16 bp, Homo sapiens
gccactgtgcccagca

SEQ ID NO: 5757645 - DNA, 12 bp, Homo sapiens
gccactgtggcc

SEQ ID NO: 5757646 - DNA, 16 bp, Homo sapiens
gccactgtggccagag

SEQ ID NO: 5757647 - DNA, 17 bp, Homo sapiens
gccactgtggccagagc

SEQ ID NO: 5757648 - DNA, 20 bp, Homo sapiens
gccactgtggccagagctgg

SEQ ID NO: 5757649 - DNA, 21 bp, Homo sapiens
gccactgtggccagagctgga

SEQ ID NO: 5757650 - DNA, 16 bp, Homo sapiens
gccactgtggtggcag

SEQ ID NO: 5757651 - DNA, 18 bp, Homo sapiens
gccactgtgttccttccg

SEQ ID NO: 5757652 - DNA, 16 bp, Homo sapiens
gccactgttgttttgg

SEQ ID NO: 5757653 - DNA, 12 bp, Homo sapiens
gccactgttttg

SEQ ID NO: 5757654 - DNA, 18 bp, Homo sapiens
gccacttaaaatgttcac

SEQ ID NO: 5757655 - DNA, 16 bp, Homo sapiens
gccacttaatgtatgt

SEQ ID NO: 5757656 - DNA, 23 bp, Homo sapiens
gccacttaccttcaataaagtat

SEQ ID NO: 5757657 - DNA, 22 bp, Homo sapiens
gccacttagacactttacctct

SEQ ID NO: 5757658 - DNA, 13 bp, Homo sapiens
gccacttatttca

SEQ ID NO: 5757659 - DNA, 14 bp, Homo sapiens
gccacttcattcca

SEQ ID NO: 5757660 - DNA, 21 bp, Homo sapiens
gccacttcattccagcagctg

SEQ ID NO: 5757661 - DNA, 22 bp, Homo sapiens
gccacttcattccagcagctgc

SEQ ID NO: 5757662 - DNA, 15 bp, Homo sapiens
gccacttctccccag

SEQ ID NO: 5757663 - DNA, 12 bp, Homo sapiens
gccacttctggc

SEQ ID NO: 5757664 - DNA, 20 bp, Homo sapiens
gccacttctggcttcagccc

SEQ ID NO: 5757665 - DNA, 23 bp, Homo sapiens
gccacttctgggtggggcagtgg

SEQ ID NO: 5757666 - DNA, 19 bp, Homo sapiens
gccacttcttaaaggcctg

SEQ ID NO: 5757667 - DNA, 20 bp, Homo sapiens
gccacttcttaaaggcctgg

SEQ ID NO: 5757668 - DNA, 21 bp, Homo sapiens
gccacttgatgacccccaacc

SEQ ID NO: 5757669 - DNA, 19 bp, Homo sapiens
gccacttgcactgtgcttg

SEQ ID NO: 5757670 - DNA, 12 bp, Homo sapiens
gccacttgctca

SEQ ID NO: 5757671 - DNA, 15 bp, Homo sapiens
gccacttgctcagac

SEQ ID NO: 5757672 - DNA, 13 bp, Homo sapiens
gccacttggagtg

SEQ ID NO: 5757673 - DNA, 16 bp, Homo sapiens
gccacttggcccagaa

SEQ ID NO: 5757674 - DNA, 21 bp, Homo sapiens
gccacttgtgtgtgcgtgtca

SEQ ID NO: 5757675 - DNA, 20 bp, Homo sapiens
gccactttaagagagaaatc

SEQ ID NO: 5757676 - DNA, 20 bp, Homo sapiens
gccactttacccacctagaa

SEQ ID NO: 5757677 - DNA, 14 bp, Homo sapiens
gccactttatttct

SEQ ID NO: 5757678 - DNA, 17 bp, Homo sapiens
gccactttcaagctgca

SEQ ID NO: 5757679 - DNA, 21 bp, Homo sapiens
gccactttcaagctgcactga

SEQ ID NO: 5757680 - DNA, 18 bp, Homo sapiens
gccactttccaagtcact

SEQ ID NO: 5757681 - DNA, 19 bp, Homo sapiens
gccactttgactcagaggc

SEQ ID NO: 5757682 - DNA, 19 bp, Homo sapiens
gccactttgcaaaggagct

SEQ ID NO: 5757683 - DNA, 16 bp, Homo sapiens
gccactttgcagacct

SEQ ID NO: 5757684 - DNA, 15 bp, Homo sapiens
gccactttggcttct

SEQ ID NO: 5757685 - DNA, 20 bp, Homo sapiens
gccactttggcttctcctgt

SEQ ID NO: 5757686 - DNA, 22 bp, Homo sapiens
gccactttggcttctcctgtga

SEQ ID NO: 5757687 - DNA, 23 bp, Homo sapiens
gccactttggtacatggccagtg

SEQ ID NO: 5757688 - DNA, 20 bp, Homo sapiens
gccacttttgaagtcttccc

SEQ ID NO: 5757689 - DNA, 22 bp, Homo sapiens
gccacttttgaagtcttccctc

SEQ ID NO: 5757690 - DNA, 22 bp, Homo sapiens
gccactttttcagaggtgaatt

SEQ ID NO: 5757691 - DNA, 15 bp, Homo sapiens
gccagaaaaagaaga

SEQ ID NO: 5757692 - DNA, 18 bp, Homo sapiens
gccagaaaaagatctttc

SEQ ID NO: 5757693 - DNA, 16 bp, Homo sapiens
gccagaaaaggcagcc

SEQ ID NO: 5757694 - DNA, 18 bp, Homo sapiens
gccagaaaaggcagccag

SEQ ID NO: 5757695 - DNA, 21 bp, Homo sapiens
gccagaaacagtgggagccct

SEQ ID NO: 5757696 - DNA, 23 bp, Homo sapiens
gccagaaactccttttgctgtct

SEQ ID NO: 5757697 - DNA, 17 bp, Homo sapiens
gccagaaaggaactctg

SEQ ID NO: 5757698 - DNA, 15 bp, Homo sapiens
gccagaaaggtgtga

SEQ ID NO: 5757699 - DNA, 12 bp, Homo sapiens
gccagaaataaa

SEQ ID NO: 5757700 - DNA, 16 bp, Homo sapiens
gccagaacagtttgta

SEQ ID NO: 5757701 - DNA, 14 bp, Homo sapiens
gccagaaccccgag

SEQ ID NO: 5757702 - DNA, 18 bp, Homo sapiens
gccagaacgtggctctgc

SEQ ID NO: 5757703 - DNA, 14 bp, Homo sapiens
gccagaagactcct

SEQ ID NO: 5757704 - DNA, 20 bp, Homo sapiens
gccagaagagcttgtcagca

SEQ ID NO: 5757705 - DNA, 18 bp, Homo sapiens
gccagaagatcccctcag

SEQ ID NO: 5757706 - DNA, 14 bp, Homo sapiens
gccagaagcccatg

SEQ ID NO: 5757707 - DNA, 23 bp, Homo sapiens
gccagaagcctctgcctccctag

SEQ ID NO: 5757708 - DNA, 14 bp, Homo sapiens
gccagcaataaaaa

SEQ ID NO: 5757709 - DNA, 23 bp, Homo sapiens
gccagcaataaaaactgtctgtc

SEQ ID NO: 5757710 - DNA, 13 bp, Homo sapiens
gccagcacacagg

SEQ ID NO: 5757711 - DNA, 20 bp, Homo sapiens
gccagcacaccaagtggctg

SEQ ID NO: 5757712 - DNA, 21 bp, Homo sapiens
gccagcacaccaagtggctgg

SEQ ID NO: 5757713 - DNA, 20 bp, Homo sapiens
gccagcacagaaacagagga

SEQ ID NO: 5757714 - DNA, 15 bp, Homo sapiens
gccagcacagctgag

SEQ ID NO: 5757715 - DNA, 20 bp, Homo sapiens
gccagcacagctgaggaccc

SEQ ID NO: 5757716 - DNA, 23 bp, Homo sapiens
gccagcacagtaggtcccggcca

SEQ ID NO: 5757717 - DNA, 22 bp, Homo sapiens
gccagcaccacctacacaggag

SEQ ID NO: 5757718 - DNA, 18 bp, Homo sapiens
gccagcacccaaagggtt

SEQ ID NO: 5757719 - DNA, 12 bp, Homo sapiens
gccagcaccctc

SEQ ID NO: 5757720 - DNA, 13 bp, Homo sapiens
gccagcaccctct

SEQ ID NO: 5757721 - DNA, 16 bp, Homo sapiens
gccagcaccctctcct

SEQ ID NO: 5757722 - DNA, 20 bp, Homo sapiens
gccagcaccctctcctgggg

SEQ ID NO: 5757723 - DNA, 20 bp, Homo sapiens
gccagcaccggaccagcctg

SEQ ID NO: 5757724 - DNA, 21 bp, Homo sapiens
gccagcaccggaccagcctgg

SEQ ID NO: 5757725 - DNA, 15 bp, Homo sapiens
gccagcacgcctggc

SEQ ID NO: 5757726 - DNA, 20 bp, Homo sapiens
gccagcacgttctccagact

SEQ ID NO: 5757727 - DNA, 16 bp, Homo sapiens
gccagcacttgtatat

SEQ ID NO: 5757728 - DNA, 14 bp, Homo sapiens
gccagcacttgtcc

SEQ ID NO: 5757729 - DNA, 19 bp, Homo sapiens
gccagcagaactgaagtgt

SEQ ID NO: 5757730 - DNA, 14 bp, Homo sapiens
gccagcagacattg

SEQ ID NO: 5757731 - DNA, 15 bp, Homo sapiens
gccagcagacattgt

SEQ ID NO: 5757732 - DNA, 15 bp, Homo sapiens
gccagcagagccagg

SEQ ID NO: 5757733 - DNA, 17 bp, Homo sapiens
gccagcagagccagggc

SEQ ID NO: 5757734 - DNA, 20 bp, Homo sapiens
gccagcagagccagggcagg

SEQ ID NO: 5757735 - DNA, 22 bp, Homo sapiens
gccagcagagccagggcagggc

SEQ ID NO: 5757736 - DNA, 11 bp, Homo sapiens
gccagcagagg

SEQ ID NO: 5757737 - DNA, 13 bp, Homo sapiens
gccagcagagggc

SEQ ID NO: 5757738 - DNA, 19 bp, Homo sapiens
gccagcagcacctgcccta

SEQ ID NO: 5757739 - DNA, 13 bp, Homo sapiens
gccagcagcagca

SEQ ID NO: 5757740 - DNA, 17 bp, Homo sapiens
gccagcagccagctctc

SEQ ID NO: 5757741 - DNA, 18 bp, Homo sapiens
gccagcagccagctctca

SEQ ID NO: 5757742 - DNA, 19 bp, Homo sapiens
gccagcagccagctctcag

SEQ ID NO: 5757743 - DNA, 22 bp, Homo sapiens
gccagcagccagctctcagcca

SEQ ID NO: 5757744 - DNA, 11 bp, Homo sapiens
gccagcagcct

SEQ ID NO: 5757745 - DNA, 14 bp, Homo sapiens
gccagcagcctcgc

SEQ ID NO: 5757746 - DNA, 22 bp, Homo sapiens
gccagcagcctcgcacaggccc

SEQ ID NO: 5757747 - DNA, 15 bp, Homo sapiens
gccagcagcgcgcag

SEQ ID NO: 5757748 - DNA, 20 bp, Homo sapiens
gccagcagcgcgcaggcctg

SEQ ID NO: 5757749 - DNA, 15 bp, Homo sapiens
gccagcagctgaagt

SEQ ID NO: 5757750 - DNA, 16 bp, Homo sapiens
gccagcagctgatgct

SEQ ID NO: 5757751 - DNA, 20 bp, Homo sapiens
gccagcagctgatgctgtac

SEQ ID NO: 5757752 - DNA, 13 bp, Homo sapiens
gccagcaggcagc

SEQ ID NO: 5757753 - DNA, 15 bp, Homo sapiens
gccagcaggcagcgc

SEQ ID NO: 5757754 - DNA, 13 bp, Homo sapiens
gccagcaggctcc

SEQ ID NO: 5757755 - DNA, 16 bp, Homo sapiens
gccagcaggctcctgg

SEQ ID NO: 5757756 - DNA, 13 bp, Homo sapiens
gccagcaggctct

SEQ ID NO: 5757757 - DNA, 16 bp, Homo sapiens
gccagcaggctctcag

SEQ ID NO: 5757758 - DNA, 19 bp, Homo sapiens
gccagcaggctctcaggcc

SEQ ID NO: 5757759 - DNA, 21 bp, Homo sapiens
gccagcaggctctcaggccag

SEQ ID NO: 5757760 - DNA, 14 bp, Homo sapiens
gccagcagggcggg

SEQ ID NO: 5757761 - DNA, 18 bp, Homo sapiens
gccagcagggcgggccag

SEQ ID NO: 5757762 - DNA, 20 bp, Homo sapiens
gccagcagggcgggccagga

SEQ ID NO: 5757763 - DNA, 18 bp, Homo sapiens
gccagcaggggctgcccg

SEQ ID NO: 5757764 - DNA, 20 bp, Homo sapiens
gccagcaggggctgcccgag

SEQ ID NO: 5757765 - DNA, 14 bp, Homo sapiens
gccagcaggggggc

SEQ ID NO: 5757766 - DNA, 19 bp, Homo sapiens
gccagcaggggggctgtgc

SEQ ID NO: 5757767 - DNA, 13 bp, Homo sapiens
gccagcagttcag

SEQ ID NO: 5757768 - DNA, 19 bp, Homo sapiens
gccagcagttcagagctgc

SEQ ID NO: 5757769 - DNA, 20 bp, Homo sapiens
gccagcagttcagagctgcc

SEQ ID NO: 5757770 - DNA, 22 bp, Homo sapiens
gccagcagttcagagctgccct

SEQ ID NO: 5757771 - DNA, 23 bp, Homo sapiens
gccagcagttcagagctgccctc

SEQ ID NO: 5757772 - DNA, 14 bp, Homo sapiens
gccagcataggggg

SEQ ID NO: 5757773 - DNA, 19 bp, Homo sapiens
gccagcataggggggaggg

SEQ ID NO: 5757774 - DNA, 18 bp, Homo sapiens
gccagcattcagcacaca

SEQ ID NO: 5757775 - DNA, 19 bp, Homo sapiens
gccagcattcagcacacac

SEQ ID NO: 5757776 - DNA, 16 bp, Homo sapiens
gccagcattccagact

SEQ ID NO: 5757777 - DNA, 18 bp, Homo sapiens
gccagcattccagacttc

SEQ ID NO: 5757778 - DNA, 20 bp, Homo sapiens
gccagccaaacacacagaag

SEQ ID NO: 5757779 - DNA, 21 bp, Homo sapiens
gccagccaaacacacagaagg

SEQ ID NO: 5757780 - DNA, 22 bp, Homo sapiens
gccagccaaacacacagaaggg

SEQ ID NO: 5757781 - DNA, 18 bp, Homo sapiens
gccagccaaatccatcct

SEQ ID NO: 5757782 - DNA, 15 bp, Homo sapiens
gccagccaagctctg

SEQ ID NO: 5757783 - DNA, 20 bp, Homo sapiens
gccagccaatttcccggagc

SEQ ID NO: 5757784 - DNA, 21 bp, Homo sapiens
gccagccaatttcccggagcc

SEQ ID NO: 5757785 - DNA, 14 bp, Homo sapiens
gccagccacagacc

SEQ ID NO: 5757786 - DNA, 23 bp, Homo sapiens
gccagccacagacccctgggagc

SEQ ID NO: 5757787 - DNA, 12 bp, Homo sapiens
gccagccacagg

SEQ ID NO: 5757788 - DNA, 19 bp, Homo sapiens
gccagccacaggaccacct

SEQ ID NO: 5757789 - DNA, 12 bp, Homo sapiens
gccagccacccc

SEQ ID NO: 5757790 - DNA, 17 bp, Homo sapiens
gccagccaccctaactg

SEQ ID NO: 5757791 - DNA, 22 bp, Homo sapiens
gccagccaccctaactgagctg

SEQ ID NO: 5757792 - DNA, 16 bp, Homo sapiens
gccagccactctacca

SEQ ID NO: 5757793 - DNA, 21 bp, Homo sapiens
gccagccactctaccagtgca

SEQ ID NO: 5757794 - DNA, 13 bp, Homo sapiens
gccagccagaagc

SEQ ID NO: 5757795 - DNA, 12 bp, Homo sapiens
gccagccagcag

SEQ ID NO: 5757796 - DNA, 11 bp, Homo sapiens
gccagccaggc

SEQ ID NO: 5757797 - DNA, 16 bp, Homo sapiens
gccagccaggccctgc

SEQ ID NO: 5757798 - DNA, 13 bp, Homo sapiens
gccagccaggcgg

SEQ ID NO: 5757799 - DNA, 10 bp, Homo sapiens
gccagccagt

SEQ ID NO: 5757800 - DNA, 21 bp, Homo sapiens
gccagccagtcttgcctaggc

SEQ ID NO: 5757801 - DNA, 14 bp, Homo sapiens
gccagccagtgcca

SEQ ID NO: 5757802 - DNA, 21 bp, Homo sapiens
gccagccagtgccattccact

SEQ ID NO: 5757803 - DNA, 14 bp, Homo sapiens
gccagccagtggcc

SEQ ID NO: 5757804 - DNA, 23 bp, Homo sapiens
gccagccatcggaagagagggct

SEQ ID NO: 5757805 - DNA, 17 bp, Homo sapiens
gccagccatctttggca

SEQ ID NO: 5757806 - DNA, 19 bp, Homo sapiens
gccagccatgcccacgccc

SEQ ID NO: 5757807 - DNA, 22 bp, Homo sapiens
gccagcccaaaccttgggccct

SEQ ID NO: 5757808 - DNA, 16 bp, Homo sapiens
gccagcccaaagctgg

SEQ ID NO: 5757809 - DNA, 19 bp, Homo sapiens
gccagcccaaagctggagc

SEQ ID NO: 5757810 - DNA, 20 bp, Homo sapiens
gccagcccaaagctggagcc

SEQ ID NO: 5757811 - DNA, 13 bp, Homo sapiens
gccagcccacccc

SEQ ID NO: 5757812 - DNA, 19 bp, Homo sapiens
gccagcccactgcctcctg

SEQ ID NO: 5757813 - DNA, 15 bp, Homo sapiens
gccagcccactgggc

SEQ ID NO: 5757814 - DNA, 17 bp, Homo sapiens
gccagcccactgggccc

SEQ ID NO: 5757815 - DNA, 21 bp, Homo sapiens
gccagcccactgggccctggg

SEQ ID NO: 5757816 - DNA, 22 bp, Homo sapiens
gccagcccactgggccctgggg

SEQ ID NO: 5757817 - DNA, 23 bp, Homo sapiens
gccagcccactgggccctggggc

SEQ ID NO: 5757818 - DNA, 15 bp, Homo sapiens
gccagcccagaacac

SEQ ID NO: 5757819 - DNA, 16 bp, Homo sapiens
gccagcccagaacacc

SEQ ID NO: 5757820 - DNA, 14 bp, Homo sapiens
gccagcccagatgg

SEQ ID NO: 5757821 - DNA, 17 bp, Homo sapiens
gccagcccagccaggcc

SEQ ID NO: 5757822 - DNA, 23 bp, Homo sapiens
gccagcccagctccactcagggc

SEQ ID NO: 5757823 - DNA, 20 bp, Homo sapiens
gccagcccagctggccggaa

SEQ ID NO: 5757824 - DNA, 17 bp, Homo sapiens
gccagcccatggccccc

SEQ ID NO: 5757825 - DNA, 17 bp, Homo sapiens
gccagcccatttgggca

SEQ ID NO: 5757826 - DNA, 18 bp, Homo sapiens
gccagcccatttgggcag

SEQ ID NO: 5757827 - DNA, 19 bp, Homo sapiens
gccagcccatttgggcaga

SEQ ID NO: 5757828 - DNA, 22 bp, Homo sapiens
gccagcccatttgggcagagag

SEQ ID NO: 5757829 - DNA, 18 bp, Homo sapiens
gccagccccaagctgggc

SEQ ID NO: 5757830 - DNA, 17 bp, Homo sapiens
gccagccccacacagct

SEQ ID NO: 5757831 - DNA, 17 bp, Homo sapiens
gccagccccacagccca

SEQ ID NO: 5757832 - DNA, 18 bp, Homo sapiens
gccagccccacagcccac

SEQ ID NO: 5757833 - DNA, 19 bp, Homo sapiens
gccagccccacagcccacg

SEQ ID NO: 5757834 - DNA, 13 bp, Homo sapiens
gccagccccaccc

SEQ ID NO: 5757835 - DNA, 21 bp, Homo sapiens
gccagccccacccccagccag

SEQ ID NO: 5757836 - DNA, 13 bp, Homo sapiens
gccagccccccca

SEQ ID NO: 5757837 - DNA, 19 bp, Homo sapiens
gccagcccccccacccacc

SEQ ID NO: 5757838 - DNA, 19 bp, Homo sapiens
gccagccccctccagctca

SEQ ID NO: 5757839 - DNA, 21 bp, Homo sapiens
gccagccccctccagctcatg

SEQ ID NO: 5757840 - DNA, 17 bp, Homo sapiens
gccagccccggccctgg

SEQ ID NO: 5757841 - DNA, 16 bp, Homo sapiens
gccagcccctcccacc

SEQ ID NO: 5757842 - DNA, 17 bp, Homo sapiens
gccagcccctcccacca

SEQ ID NO: 5757843 - DNA, 20 bp, Homo sapiens
gccagcccctcccaccacag

SEQ ID NO: 5757844 - DNA, 23 bp, Homo sapiens
gccagcccctccccgcctcctcc

SEQ ID NO: 5757845 - DNA, 20 bp, Homo sapiens
gccagcccctcttccccaat

SEQ ID NO: 5757846 - DNA, 13 bp, Homo sapiens
gccagcccctgcc

SEQ ID NO: 5757847 - DNA, 15 bp, Homo sapiens
gccagcccctgcctg

SEQ ID NO: 5757848 - DNA, 15 bp, Homo sapiens
gccagcccctgctgg

SEQ ID NO: 5757849 - DNA, 19 bp, Homo sapiens
gccagcccctggccccagg

SEQ ID NO: 5757850 - DNA, 15 bp, Homo sapiens
gccagcccctggggc

SEQ ID NO: 5757851 - DNA, 13 bp, Homo sapiens
gccagcccgcaga

SEQ ID NO: 5757852 - DNA, 21 bp, Homo sapiens
gccagcccggccgctccacca

SEQ ID NO: 5757853 - DNA, 20 bp, Homo sapiens
gccagcccggctcggcccag

SEQ ID NO: 5757854 - DNA, 14 bp, Homo sapiens
gccagccctacatc

SEQ ID NO: 5757855 - DNA, 23 bp, Homo sapiens
gccagccctacatcttcagctcc

SEQ ID NO: 5757856 - DNA, 21 bp, Homo sapiens
gccagccctccctggctgtga

SEQ ID NO: 5757857 - DNA, 20 bp, Homo sapiens
gccagccctccctgtcctcc

SEQ ID NO: 5757858 - DNA, 21 bp, Homo sapiens
gccagccctccctgtcctcct

SEQ ID NO: 5757859 - DNA, 11 bp, Homo sapiens
gccagccctct

SEQ ID NO: 5757860 - DNA, 21 bp, Homo sapiens
gccagccctcttctgacacta

SEQ ID NO: 5757861 - DNA, 16 bp, Homo sapiens
gccagccctgcagccc

SEQ ID NO: 5757862 - DNA, 17 bp, Homo sapiens
gccagccctgcagccca

SEQ ID NO: 5757863 - DNA, 18 bp, Homo sapiens
gccagccctgcctggagg

SEQ ID NO: 5757864 - DNA, 14 bp, Homo sapiens
gccagccctggagg

SEQ ID NO: 5757865 - DNA, 15 bp, Homo sapiens
gccagccctggaggc

SEQ ID NO: 5757866 - DNA, 19 bp, Homo sapiens
gccagccctggaggctgga

SEQ ID NO: 5757867 - DNA, 14 bp, Homo sapiens
gccagccctgggcc

SEQ ID NO: 5757868 - DNA, 16 bp, Homo sapiens
gccagccctgggcctg

SEQ ID NO: 5757869 - DNA, 12 bp, Homo sapiens
gccagccctgtt

SEQ ID NO: 5757870 - DNA, 20 bp, Homo sapiens
gccagccctgttccgcctca

SEQ ID NO: 5757871 - DNA, 19 bp, Homo sapiens
gccagcccttcatatctgt

SEQ ID NO: 5757872 - DNA, 17 bp, Homo sapiens
gccagcccttcccaggc

SEQ ID NO: 5757873 - DNA, 18 bp, Homo sapiens
gccagcccttcccaggcc

SEQ ID NO: 5757874 - DNA, 17 bp, Homo sapiens
gccagcccttcctctca

SEQ ID NO: 5757875 - DNA, 19 bp, Homo sapiens
gccagcccttcctctcact

SEQ ID NO: 5757876 - DNA, 18 bp, Homo sapiens
gccagcccttgctctacc

SEQ ID NO: 5757877 - DNA, 23 bp, Homo sapiens
gccagcccttgctctacctggcc

SEQ ID NO: 5757878 - DNA, 17 bp, Homo sapiens
gccagccgaccctcctg

SEQ ID NO: 5757879 - DNA, 20 bp, Homo sapiens
gccagccgagatagccaagg

SEQ ID NO: 5757880 - DNA, 20 bp, Homo sapiens
gccagccgctctcctgccac

SEQ ID NO: 5757881 - DNA, 23 bp, Homo sapiens
gccagccggacacaagcggccct

SEQ ID NO: 5757882 - DNA, 23 bp, Homo sapiens
gccagccggggcgagtggcacgt

SEQ ID NO: 5757883 - DNA, 15 bp, Homo sapiens
gccagccggtgcctg

SEQ ID NO: 5757884 - DNA, 20 bp, Homo sapiens
gccagccgtgatgctcaggc

SEQ ID NO: 5757885 - DNA, 22 bp, Homo sapiens
gccaggagaagctcagctgcat

SEQ ID NO: 5757886 - DNA, 22 bp, Homo sapiens
gccaggagaagttgaggggagc

SEQ ID NO: 5757887 - DNA, 10 bp, Homo sapiens
gccaggagac

SEQ ID NO: 5757888 - DNA, 10 bp, Homo sapiens
gccaggagag

SEQ ID NO: 5757889 - DNA, 13 bp, Homo sapiens
gccaggagagctt

SEQ ID NO: 5757890 - DNA, 15 bp, Homo sapiens
gccaggagcaaatgt

SEQ ID NO: 5757891 - DNA, 16 bp, Homo sapiens
gccaggagcaatggga

SEQ ID NO: 5757892 - DNA, 15 bp, Homo sapiens
gccaggagcagcctc

SEQ ID NO: 5757893 - DNA, 17 bp, Homo sapiens
gccaggagcagcctcca

SEQ ID NO: 5757894 - DNA, 13 bp, Homo sapiens
gccaggagccctg

SEQ ID NO: 5757895 - DNA, 15 bp, Homo sapiens
gccaggagccgggcc

SEQ ID NO: 5757896 - DNA, 18 bp, Homo sapiens
gccaggagccgggcctcc

SEQ ID NO: 5757897 - DNA, 14 bp, Homo sapiens
gccaggagcctcct

SEQ ID NO: 5757898 - DNA, 16 bp, Homo sapiens
gccaggagcctcctga

SEQ ID NO: 5757899 - DNA, 16 bp, Homo sapiens
gccaggagcgcatctc

SEQ ID NO: 5757900 - DNA, 20 bp, Homo sapiens
gccaggagctcttcaggcct

SEQ ID NO: 5757901 - DNA, 13 bp, Homo sapiens
gccaggagctgga

SEQ ID NO: 5757902 - DNA, 17 bp, Homo sapiens
gccaggagctggaggag

SEQ ID NO: 5757903 - DNA, 23 bp, Homo sapiens
gccaggagctgggcagaaggcca

SEQ ID NO: 5757904 - DNA, 15 bp, Homo sapiens
gccaggaggacccag

SEQ ID NO: 5757905 - DNA, 17 bp, Homo sapiens
gccaggaggacccaggg

SEQ ID NO: 5757906 - DNA, 19 bp, Homo sapiens
gccaggaggacccagggct

SEQ ID NO: 5757907 - DNA, 22 bp, Homo sapiens
gccaggaggacccagggctctg

SEQ ID NO: 5757908 - DNA, 17 bp, Homo sapiens
gccaggaggcggcagct

SEQ ID NO: 5757909 - DNA, 19 bp, Homo sapiens
gccaggaggcggcagctct

SEQ ID NO: 5757910 - DNA, 21 bp, Homo sapiens
gccaggaggctgcggcctagg

SEQ ID NO: 5757911 - DNA, 23 bp, Homo sapiens
gccaggagggcacagcaggggag

SEQ ID NO: 5757912 - DNA, 22 bp, Homo sapiens
gccaggagggcgttcttaggct

SEQ ID NO: 5757913 - DNA, 23 bp, Homo sapiens
gccaggaggttggtgactgaaac

SEQ ID NO: 5757914 - DNA, 19 bp, Homo sapiens
gccaggagtaagcccaagc

SEQ ID NO: 5757915 - DNA, 15 bp, Homo sapiens
gccaggagtctgtgc

SEQ ID NO: 5757916 - DNA, 17 bp, Homo sapiens
gccaggagtctgtgctc

SEQ ID NO: 5757917 - DNA, 19 bp, Homo sapiens
gccaggagtgcccccggga

SEQ ID NO: 5757918 - DNA, 15 bp, Homo sapiens
gccaggagtggggag

SEQ ID NO: 5757919 - DNA, 19 bp, Homo sapiens
gccaggagtgggtgggaca

SEQ ID NO: 5757920 - DNA, 14 bp, Homo sapiens
gccaggagttccca

SEQ ID NO: 5757921 - DNA, 20 bp, Homo sapiens
gccaggagttcccaaatgtg

SEQ ID NO: 5757922 - DNA, 23 bp, Homo sapiens
gccaggagttgacgcatcctgca

SEQ ID NO: 5757923 - DNA, 19 bp, Homo sapiens
gccaggagtttgagaccag

SEQ ID NO: 5757924 - DNA, 17 bp, Homo sapiens
gccaggataaagcttcc

SEQ ID NO: 5757925 - DNA, 21 bp, Homo sapiens
gccaggatccccctctttgca

SEQ ID NO: 5757926 - DNA, 12 bp, Homo sapiens
gccaggatgccc

SEQ ID NO: 5757927 - DNA, 14 bp, Homo sapiens
gccaggatgcccag

SEQ ID NO: 5757928 - DNA, 20 bp, Homo sapiens
gccaggatggaacacggcca

SEQ ID NO: 5757929 - DNA, 17 bp, Homo sapiens
gccaggatggcgtgtcc

SEQ ID NO: 5757930 - DNA, 22 bp, Homo sapiens
gccaggatggcgtgtcccctgc

SEQ ID NO: 5757931 - DNA, 23 bp, Homo sapiens
gccaggatgggtctccattctgt

SEQ ID NO: 5757932 - DNA, 16 bp, Homo sapiens
gccaggattcaggcct

SEQ ID NO: 5757933 - DNA, 17 bp, Homo sapiens
gccaggattcaggcctc

SEQ ID NO: 5757934 - DNA, 19 bp, Homo sapiens
gccaggcaacttcagtcct

SEQ ID NO: 5757935 - DNA, 20 bp, Homo sapiens
gccaggcacacacagcccct

SEQ ID NO: 5757936 - DNA, 15 bp, Homo sapiens
gccaggcacacactg

SEQ ID NO: 5757937 - DNA, 22 bp, Homo sapiens
gccaggcacacactgtgctttc

SEQ ID NO: 5757938 - DNA, 23 bp, Homo sapiens
gccaggcacacactgtgctttct

SEQ ID NO: 5757939 - DNA, 15 bp, Homo sapiens
gccaggcacaggcag

SEQ ID NO: 5757940 - DNA, 17 bp, Homo sapiens
gccaggcacaggcaggg

SEQ ID NO: 5757941 - DNA, 18 bp, Homo sapiens
gccaggcacagggcccgc

SEQ ID NO: 5757942 - DNA, 14 bp, Homo sapiens
gccaggcacccatg

SEQ ID NO: 5757943 - DNA, 17 bp, Homo sapiens
gccaggcacccatgtgg

SEQ ID NO: 5757944 - DNA, 19 bp, Homo sapiens
gccaggcaccccctggaga

SEQ ID NO: 5757945 - DNA, 21 bp, Homo sapiens
gccaggcaccccctggagaga

SEQ ID NO: 5757946 - DNA, 14 bp, Homo sapiens
gccaggcacctggc

SEQ ID NO: 5757947 - DNA, 18 bp, Homo sapiens
gccaggcacctggcctgc

SEQ ID NO: 5757948 - DNA, 19 bp, Homo sapiens
gccaggcacctggcctgct

SEQ ID NO: 5757949 - DNA, 21 bp, Homo sapiens
gccaggcacctggcctgctgg

SEQ ID NO: 5757950 - DNA, 13 bp, Homo sapiens
gccaggcactgcc

SEQ ID NO: 5757951 - DNA, 16 bp, Homo sapiens
gccaggcactgccctt

SEQ ID NO: 5757952 - DNA, 17 bp, Homo sapiens
gccaggcagaatggctg

SEQ ID NO: 5757953 - DNA, 17 bp, Homo sapiens
gccaggcagagaacaga

SEQ ID NO: 5757954 - DNA, 15 bp, Homo sapiens
gccaggcagagctga

SEQ ID NO: 5757955 - DNA, 22 bp, Homo sapiens
gccaggcagagctgagggccct

SEQ ID NO: 5757956 - DNA, 23 bp, Homo sapiens
gccaggcagagctgagggccctg

SEQ ID NO: 5757957 - DNA, 12 bp, Homo sapiens
gccaggcagagg

SEQ ID NO: 5757958 - DNA, 22 bp, Homo sapiens
gccaggcagatcctctggacac

SEQ ID NO: 5757959 - DNA, 15 bp, Homo sapiens
gccaggcagatctgt

SEQ ID NO: 5757960 - DNA, 23 bp, Homo sapiens
gccaggcagatctgtgccccatg

SEQ ID NO: 5757961 - DNA, 10 bp, Homo sapiens
gccaggcagg

SEQ ID NO: 5757962 - DNA, 20 bp, Homo sapiens
gccaggcagggagtgtctgc

SEQ ID NO: 5757963 - DNA, 20 bp, Homo sapiens
gccaggcaggggtgggagag

SEQ ID NO: 5757964 - DNA, 19 bp, Homo sapiens
gccaggcaggtagccaggg

SEQ ID NO: 5757965 - DNA, 19 bp, Homo sapiens
gccaggcatggcccagcct

SEQ ID NO: 5757966 - DNA, 21 bp, Homo sapiens
gccaggcatggcccagcctgg

SEQ ID NO: 5757967 - DNA, 22 bp, Homo sapiens
gccaggcatggcccagcctgga

SEQ ID NO: 5757968 - DNA, 21 bp, Homo sapiens
gccaggccacaagacccttgt

SEQ ID NO: 5757969 - DNA, 20 bp, Homo sapiens
gccaggccacctccagaaac

SEQ ID NO: 5757970 - DNA, 23 bp, Homo sapiens
gccaggccactgggccctgagcc

SEQ ID NO: 5757971 - DNA, 13 bp, Homo sapiens
gccaggccagagg

SEQ ID NO: 5757972 - DNA, 12 bp, Homo sapiens
gccaggccagcc

SEQ ID NO: 5757973 - DNA, 12 bp, Homo sapiens
gccaggccagct

SEQ ID NO: 5757974 - DNA, 18 bp, Homo sapiens
gccaggccagcttcccct

SEQ ID NO: 5757975 - DNA, 21 bp, Homo sapiens
gccaggccagcttcccctcac

SEQ ID NO: 5757976 - DNA, 13 bp, Homo sapiens
gccaggccaggac

SEQ ID NO: 5757977 - DNA, 14 bp, Homo sapiens
gccaggccaggacc

SEQ ID NO: 5757978 - DNA, 15 bp, Homo sapiens
gccaggccaggacca

SEQ ID NO: 5757979 - DNA, 23 bp, Homo sapiens
gccaggccaggaccacacagtcc

SEQ ID NO: 5757980 - DNA, 14 bp, Homo sapiens
gccaggccatggcc

SEQ ID NO: 5757981 - DNA, 12 bp, Homo sapiens
gccaggcccagg

SEQ ID NO: 5757982 - DNA, 14 bp, Homo sapiens
gccaggcccaggcc

SEQ ID NO: 5757983 - DNA, 16 bp, Homo sapiens
gccaggcccaggccag

SEQ ID NO: 5757984 - DNA, 17 bp, Homo sapiens
gccaggcccaggccagc

SEQ ID NO: 5757985 - DNA, 16 bp, Homo sapiens
gccaggcccaggcctc

SEQ ID NO: 5757986 - DNA, 10 bp, Homo sapiens
gccaggcccc

SEQ ID NO: 5757987 - DNA, 11 bp, Homo sapiens
gccaggcccca

SEQ ID NO: 5757988 - DNA, 14 bp, Homo sapiens
gccaggccccaccc

SEQ ID NO: 5757989 - DNA, 14 bp, Homo sapiens
gccaggccccaggc

SEQ ID NO: 5757990 - DNA, 13 bp, Homo sapiens
gccaggccccatg

SEQ ID NO: 5757991 - DNA, 14 bp, Homo sapiens
gccaggccccatgg

SEQ ID NO: 5757992 - DNA, 19 bp, Homo sapiens
gccaggcccccaccacaca

SEQ ID NO: 5757993 - DNA, 20 bp, Homo sapiens
gccaggcccccaccacacat

SEQ ID NO: 5757994 - DNA, 21 bp, Homo sapiens
gccaggcccccaccacacatc

SEQ ID NO: 5757995 - DNA, 16 bp, Homo sapiens
gccaggcccggggctg

SEQ ID NO: 5757996 - DNA, 17 bp, Homo sapiens
gccaggcccggggctgg

SEQ ID NO: 5757997 - DNA, 13 bp, Homo sapiens
gccaggccctcag

SEQ ID NO: 5757998 - DNA, 16 bp, Homo sapiens
gccaggccctccagca

SEQ ID NO: 5757999 - DNA, 16 bp, Homo sapiens
gccaggccctcctgct

SEQ ID NO: 5758000 - DNA, 19 bp, Homo sapiens
gccaggccctcctgctggc

SEQ ID NO: 5758001 - DNA, 20 bp, Homo sapiens
gccaggccctcctgctggct

SEQ ID NO: 5758002 - DNA, 21 bp, Homo sapiens
gccaggccctcctgctggctg

SEQ ID NO: 5758003 - DNA, 13 bp, Homo sapiens
gccaggccctctg

SEQ ID NO: 5758004 - DNA, 14 bp, Homo sapiens
gccaggccctctgc

SEQ ID NO: 5758005 - DNA, 12 bp, Homo sapiens
gccaggccctgg

SEQ ID NO: 5758006 - DNA, 15 bp, Homo sapiens
gccaggccctgggtc

SEQ ID NO: 5758007 - DNA, 23 bp, Homo sapiens
gccaggccggcgagccctgtgga

SEQ ID NO: 5758008 - DNA, 15 bp, Homo sapiens
gccaggccgggcctg

SEQ ID NO: 5758009 - DNA, 15 bp, Homo sapiens
gccaggcctcatcct

SEQ ID NO: 5758010 - DNA, 21 bp, Homo sapiens
gccaggcctcgcctgccctcc

SEQ ID NO: 5758011 - DNA, 14 bp, Homo sapiens
gccaggcctgcaga

SEQ ID NO: 5758012 - DNA, 17 bp, Homo sapiens
gccaggcctgccagccc

SEQ ID NO: 5758013 - DNA, 17 bp, Homo sapiens
gccaggcgcatgtctgc

SEQ ID NO: 5758014 - DNA, 22 bp, Homo sapiens
gccaggcgcggtggctcacgcc

SEQ ID NO: 5758015 - DNA, 16 bp, Homo sapiens
gccaggcggccctggg

SEQ ID NO: 5758016 - DNA, 20 bp, Homo sapiens
gccaggcggccctggggagg

SEQ ID NO: 5758017 - DNA, 23 bp, Homo sapiens
gccaggcgggagatggacccctc

SEQ ID NO: 5758018 - DNA, 22 bp, Homo sapiens
gccaggcggggcgccccaagag

SEQ ID NO: 5758019 - DNA, 15 bp, Homo sapiens
gccaggcgttggtgc

SEQ ID NO: 5758020 - DNA, 17 bp, Homo sapiens
gccaggcgttggtgcca

SEQ ID NO: 5758021 - DNA, 21 bp, Homo sapiens
gccaggctatggttgccaccc

SEQ ID NO: 5758022 - DNA, 22 bp, Homo sapiens
gccaggctatggttgccacccc

SEQ ID NO: 5758023 - DNA, 14 bp, Homo sapiens
gccaggctcaggag

SEQ ID NO: 5758024 - DNA, 16 bp, Homo sapiens
gccaggctccctgacc

SEQ ID NO: 5758025 - DNA, 19 bp, Homo sapiens
gccaggctccctgaccacc

SEQ ID NO: 5758026 - DNA, 21 bp, Homo sapiens
gccaggctcctacctgtctgc

SEQ ID NO: 5758027 - DNA, 21 bp, Homo sapiens
gccaggctctgtgctgaccct

SEQ ID NO: 5758028 - DNA, 20 bp, Homo sapiens
gccaggctgaccacagcaca

SEQ ID NO: 5758029 - DNA, 15 bp, Homo sapiens
gccaggctgatctcg

SEQ ID NO: 5758030 - DNA, 13 bp, Homo sapiens
gccaggctgcagg

SEQ ID NO: 5758031 - DNA, 17 bp, Homo sapiens
gccaggctgcagggaca

SEQ ID NO: 5758032 - DNA, 15 bp, Homo sapiens
gccaggctgcctcct

SEQ ID NO: 5758033 - DNA, 20 bp, Homo sapiens
gccaggctgcctcctgccct

SEQ ID NO: 5758034 - DNA, 18 bp, Homo sapiens
gccaggctgcctggcctt

SEQ ID NO: 5758035 - DNA, 21 bp, Homo sapiens
gccaggctgcggtgggcagcc

SEQ ID NO: 5758036 - DNA, 13 bp, Homo sapiens
gccaggctggaga

SEQ ID NO: 5758037 - DNA, 16 bp, Homo sapiens
gccaggctggagtgca

SEQ ID NO: 5758038 - DNA, 19 bp, Homo sapiens
gccaggctgggaggctcgg

SEQ ID NO: 5758039 - DNA, 14 bp, Homo sapiens
gccaggctgggcac

SEQ ID NO: 5758040 - DNA, 15 bp, Homo sapiens
gccaggctgggccgc

SEQ ID NO: 5758041 - DNA, 16 bp, Homo sapiens
gccaggctgggccgca

SEQ ID NO: 5758042 - DNA, 17 bp, Homo sapiens
gccaggctgggtcgccc

SEQ ID NO: 5758043 - DNA, 13 bp, Homo sapiens
gccaggctggtct

SEQ ID NO: 5758044 - DNA, 17 bp, Homo sapiens
gccaggctggtctaaaa

SEQ ID NO: 5758045 - DNA, 23 bp, Homo sapiens
gccaggctggtcttgaactcctg

SEQ ID NO: 5758046 - DNA, 13 bp, Homo sapiens
gccaggctggttt

SEQ ID NO: 5758047 - DNA, 18 bp, Homo sapiens
gccaggctgtcagcgcct

SEQ ID NO: 5758048 - DNA, 13 bp, Homo sapiens
gccaggctgtgct

SEQ ID NO: 5758049 - DNA, 13 bp, Homo sapiens
gccaggcttgcct

SEQ ID NO: 5758050 - DNA, 14 bp, Homo sapiens
gccaggcttgcctg

SEQ ID NO: 5758051 - DNA, 18 bp, Homo sapiens
gccaggcttgcctgggct

SEQ ID NO: 5758052 - DNA, 19 bp, Homo sapiens
gccaggcttgcctgggctg

SEQ ID NO: 5758053 - DNA, 17 bp, Homo sapiens
gccaggcttttctcagg

SEQ ID NO: 5758054 - DNA, 21 bp, Homo sapiens
gccaggcttttctcaggagct

SEQ ID NO: 5758055 - DNA, 18 bp, Homo sapiens
gccagggaacagccccag

SEQ ID NO: 5758056 - DNA, 19 bp, Homo sapiens
gccagggaactggcctgct

SEQ ID NO: 5758057 - DNA, 18 bp, Homo sapiens
gccagggaagacagagca

SEQ ID NO: 5758058 - DNA, 21 bp, Homo sapiens
gccagggaagacagagcaggc

SEQ ID NO: 5758059 - DNA, 22 bp, Homo sapiens
gccagggaaggctgtgcaggga

SEQ ID NO: 5758060 - DNA, 18 bp, Homo sapiens
gccagggaagtccccgag

SEQ ID NO: 5758061 - DNA, 16 bp, Homo sapiens
gccagggacagagggg

SEQ ID NO: 5758062 - DNA, 20 bp, Homo sapiens
gccagggacccaggtgtgcc

SEQ ID NO: 5758063 - DNA, 21 bp, Homo sapiens
gccagtgaaatgtgaaggaaa

SEQ ID NO: 5758064 - DNA, 23 bp, Homo sapiens
gccagtgaagggttttgtgtgtt

SEQ ID NO: 5758065 - DNA, 16 bp, Homo sapiens
gccagtgaagtccttc

SEQ ID NO: 5758066 - DNA, 21 bp, Homo sapiens
gccagtgaagtccttcagtga

SEQ ID NO: 5758067 - DNA, 14 bp, Homo sapiens
gccagtgacagaca

SEQ ID NO: 5758068 - DNA, 18 bp, Homo sapiens
gccagtgacctgaggaag

SEQ ID NO: 5758069 - DNA, 13 bp, Homo sapiens
gccagtgactcca

SEQ ID NO: 5758070 - DNA, 18 bp, Homo sapiens
gccagtgactttttctga

SEQ ID NO: 5758071 - DNA, 15 bp, Homo sapiens
gccagtgagggcagt

SEQ ID NO: 5758072 - DNA, 14 bp, Homo sapiens
gccagtgagggctg

SEQ ID NO: 5758073 - DNA, 21 bp, Homo sapiens
gccagtgagggctgggcccac

SEQ ID NO: 5758074 - DNA, 18 bp, Homo sapiens
gccagtgataagagcagt

SEQ ID NO: 5758075 - DNA, 19 bp, Homo sapiens
gccagtgatgatgttttga

SEQ ID NO: 5758076 - DNA, 17 bp, Homo sapiens
gccagtgcacagggaag

SEQ ID NO: 5758077 - DNA, 22 bp, Homo sapiens
gccagtgcacagggaagggctt

SEQ ID NO: 5758078 - DNA, 13 bp, Homo sapiens
gccagtgcagcca

SEQ ID NO: 5758079 - DNA, 12 bp, Homo sapiens
gccagtgccagg

SEQ ID NO: 5758080 - DNA, 14 bp, Homo sapiens
gccagtgccaggac

SEQ ID NO: 5758081 - DNA, 15 bp, Homo sapiens
gccagtgccaggaca

SEQ ID NO: 5758082 - DNA, 20 bp, Homo sapiens
gccagtgccaggacagctgg

SEQ ID NO: 5758083 - DNA, 17 bp, Homo sapiens
gccagtgccctgagcca

SEQ ID NO: 5758084 - DNA, 12 bp, Homo sapiens
gccagtgcctgg

SEQ ID NO: 5758085 - DNA, 17 bp, Homo sapiens
gccagtgccttacctcc

SEQ ID NO: 5758086 - DNA, 15 bp, Homo sapiens
gccagtgcggctgcc

SEQ ID NO: 5758087 - DNA, 18 bp, Homo sapiens
gccagtgcgggtgcagac

SEQ ID NO: 5758088 - DNA, 20 bp, Homo sapiens
gccagtgctaagctgccctg

SEQ ID NO: 5758089 - DNA, 16 bp, Homo sapiens
gccagtgctccaggca

SEQ ID NO: 5758090 - DNA, 14 bp, Homo sapiens
gccagtgctgtctg

SEQ ID NO: 5758091 - DNA, 15 bp, Homo sapiens
gccagtgctgtgagc

SEQ ID NO: 5758092 - DNA, 14 bp, Homo sapiens
gccagtggaagaaa

SEQ ID NO: 5758093 - DNA, 20 bp, Homo sapiens
gccagtggacagagggagaa

SEQ ID NO: 5758094 - DNA, 16 bp, Homo sapiens
gccagtggagctggtc

SEQ ID NO: 5758095 - DNA, 17 bp, Homo sapiens
gccagtggcccccgggc

SEQ ID NO: 5758096 - DNA, 21 bp, Homo sapiens
gccagtggcccccgggcctgc

SEQ ID NO: 5758097 - DNA, 21 bp, Homo sapiens
gccagtggccttccccagcat

SEQ ID NO: 5758098 - DNA, 13 bp, Homo sapiens
gccagtggctggg

SEQ ID NO: 5758099 - DNA, 15 bp, Homo sapiens
gccagtggctggggg

SEQ ID NO: 5758100 - DNA, 13 bp, Homo sapiens
gccagtgggcctg

SEQ ID NO: 5758101 - DNA, 19 bp, Homo sapiens
gccagtggggcctgtggaa

SEQ ID NO: 5758102 - DNA, 19 bp, Homo sapiens
gccagtggtgatgtaaaaa

SEQ ID NO: 5758103 - DNA, 17 bp, Homo sapiens
gccagtggtggaggtgg

SEQ ID NO: 5758104 - DNA, 17 bp, Homo sapiens
gccagtgtaaggcatag

SEQ ID NO: 5758105 - DNA, 17 bp, Homo sapiens
gccagtgtaatccccca

SEQ ID NO: 5758106 - DNA, 20 bp, Homo sapiens
gccagtgtaatcccccagga

SEQ ID NO: 5758107 - DNA, 16 bp, Homo sapiens
gccagtgtcctgagcc

SEQ ID NO: 5758108 - DNA, 14 bp, Homo sapiens
gccagtgtctaggc

SEQ ID NO: 5758109 - DNA, 18 bp, Homo sapiens
gccagtgtctaggcactg

SEQ ID NO: 5758110 - DNA, 16 bp, Homo sapiens
gccagtgtctgtcccg

SEQ ID NO: 5758111 - DNA, 12 bp, Homo sapiens
gccagtgtcttt

SEQ ID NO: 5758112 - DNA, 13 bp, Homo sapiens
gccagtgtgacaa

SEQ ID NO: 5758113 - DNA, 22 bp, Homo sapiens
gccagtgtgcccaaaagccatg

SEQ ID NO: 5758114 - DNA, 17 bp, Homo sapiens
gccagtgtgctgatggg

SEQ ID NO: 5758115 - DNA, 18 bp, Homo sapiens
gccagtgtgctgatgggc

SEQ ID NO: 5758116 - DNA, 21 bp, Homo sapiens
gccagtgtgttactcatcttt

SEQ ID NO: 5758117 - DNA, 16 bp, Homo sapiens
gccagtgttgcctaag

SEQ ID NO: 5758118 - DNA, 19 bp, Homo sapiens
gccagtgttgtgggcttcc

SEQ ID NO: 5758119 - DNA, 22 bp, Homo sapiens
gccagtgttgtgggcttcctgc

SEQ ID NO: 5758120 - DNA, 18 bp, Homo sapiens
gccagtgtttagaagagc

SEQ ID NO: 5758121 - DNA, 20 bp, Homo sapiens
gccagtgtttagaagagcct

SEQ ID NO: 5758122 - DNA, 21 bp, Homo sapiens
gccagtgtttagaagagcctg

SEQ ID NO: 5758123 - DNA, 22 bp, Homo sapiens
gccagtgtttagaagagcctga

SEQ ID NO: 5758124 - DNA, 12 bp, Homo sapiens
gccagtgtttct

SEQ ID NO: 5758125 - DNA, 17 bp, Homo sapiens
gccagtgtttctgaatg

SEQ ID NO: 5758126 - DNA, 18 bp, Homo sapiens
gccagtgtttctgaatgt

SEQ ID NO: 5758127 - DNA, 22 bp, Homo sapiens
gccagtgtttctgaatgtttgt

SEQ ID NO: 5758128 - DNA, 21 bp, Homo sapiens
gccagttaaagtagatcacct

SEQ ID NO: 5758129 - DNA, 23 bp, Homo sapiens
gccagttaaagtagatcacctcc

SEQ ID NO: 5758130 - DNA, 20 bp, Homo sapiens
gccagttacctttgctgtca

SEQ ID NO: 5758131 - DNA, 22 bp, Homo sapiens
gccagttatggctataggtgct

SEQ ID NO: 5758132 - DNA, 13 bp, Homo sapiens
gccagttgaatat

SEQ ID NO: 5758133 - DNA, 15 bp, Homo sapiens
gccagttgatctgct

SEQ ID NO: 5758134 - DNA, 16 bp, Homo sapiens
gccagttgatctgctc

SEQ ID NO: 5758135 - DNA, 14 bp, Homo sapiens
gccagttgcccaga

SEQ ID NO: 5758136 - DNA, 17 bp, Homo sapiens
gccagttgcccagagca

SEQ ID NO: 5758137 - DNA, 14 bp, Homo sapiens
gccagttggaacca

SEQ ID NO: 5758138 - DNA, 16 bp, Homo sapiens
gccagttggcttctgt

SEQ ID NO: 5758139 - DNA, 20 bp, Homo sapiens
gccagttggcttctgtgcct

SEQ ID NO: 5758140 - DNA, 18 bp, Homo sapiens
gccagttggtcccccttc

SEQ ID NO: 5758141 - DNA, 20 bp, Homo sapiens
gccagttggtcccccttcca

SEQ ID NO: 5758142 - DNA, 22 bp, Homo sapiens
gccagttggtcccccttccatg

SEQ ID NO: 5758143 - DNA, 20 bp, Homo sapiens
gccagttggtggggccaggc

SEQ ID NO: 5758144 - DNA, 14 bp, Homo sapiens
gccagttgtcctcc

SEQ ID NO: 5758145 - DNA, 15 bp, Homo sapiens
gccagtttagagttc

SEQ ID NO: 5758146 - DNA, 17 bp, Homo sapiens
gccagtttcaccatttc

SEQ ID NO: 5758147 - DNA, 16 bp, Homo sapiens
gccagtttgaagcctg

SEQ ID NO: 5758148 - DNA, 19 bp, Homo sapiens
gccagtttgaagcctgtgc

SEQ ID NO: 5758149 - DNA, 18 bp, Homo sapiens
gccagttttaccagcgca

SEQ ID NO: 5758150 - DNA, 19 bp, Homo sapiens
gccagttttccctggaact

SEQ ID NO: 5758151 - DNA, 23 bp, Homo sapiens
gccagttttccgaagtctctgat

SEQ ID NO: 5758152 - DNA, 14 bp, Homo sapiens
gccagttttctgtt

SEQ ID NO: 5758153 - DNA, 15 bp, Homo sapiens
gccagttttctgttc

SEQ ID NO: 5758154 - DNA, 21 bp, Homo sapiens
gccagtttttaaaatgctgct

SEQ ID NO: 5758155 - DNA, 13 bp, Homo sapiens
gccataaaacatt

SEQ ID NO: 5758156 - DNA, 14 bp, Homo sapiens
gccataaaacatta

SEQ ID NO: 5758157 - DNA, 16 bp, Homo sapiens
gccataaaagcattgt

SEQ ID NO: 5758158 - DNA, 22 bp, Homo sapiens
gccataaaattgcagtttcatg

SEQ ID NO: 5758159 - DNA, 17 bp, Homo sapiens
gccataaacggttcctg

SEQ ID NO: 5758160 - DNA, 19 bp, Homo sapiens
gccataaacggttcctggt

SEQ ID NO: 5758161 - DNA, 20 bp, Homo sapiens
gccataaacggttcctggtg

SEQ ID NO: 5758162 - DNA, 22 bp, Homo sapiens
gccataaacggttcctggtgac

SEQ ID NO: 5758163 - DNA, 21 bp, Homo sapiens
gccataacagattatgtatta

SEQ ID NO: 5758164 - DNA, 20 bp, Homo sapiens
gccataaccacatttaatgg

SEQ ID NO: 5758165 - DNA, 14 bp, Homo sapiens
gccataacgtgccc

SEQ ID NO: 5758166 - DNA, 17 bp, Homo sapiens
gccataacgtgccccca

SEQ ID NO: 5758167 - DNA, 13 bp, Homo sapiens
gccataacttgaa

SEQ ID NO: 5758168 - DNA, 15 bp, Homo sapiens
gccataacttgaaaa

SEQ ID NO: 5758169 - DNA, 13 bp, Homo sapiens
gccataacttgtt

SEQ ID NO: 5758170 - DNA, 14 bp, Homo sapiens
gccataacttgttt

SEQ ID NO: 5758171 - DNA, 19 bp, Homo sapiens
gccataagatctgtatcta

SEQ ID NO: 5758172 - DNA, 20 bp, Homo sapiens
gccataagcaacaattttca

SEQ ID NO: 5758173 - DNA, 23 bp, Homo sapiens
gccataagcaacaattttcagat

SEQ ID NO: 5758174 - DNA, 20 bp, Homo sapiens
gccataataataatttgcac

SEQ ID NO: 5758175 - DNA, 15 bp, Homo sapiens
gccataatacaaaag

SEQ ID NO: 5758176 - DNA, 13 bp, Homo sapiens
gccataatatgat

SEQ ID NO: 5758177 - DNA, 17 bp, Homo sapiens
gccataatatgatgcaa

SEQ ID NO: 5758178 - DNA, 17 bp, Homo sapiens
gccataatcagaacaca

SEQ ID NO: 5758179 - DNA, 19 bp, Homo sapiens
gccataattatgaaaactc

SEQ ID NO: 5758180 - DNA, 19 bp, Homo sapiens
gccatacataaaagaaata

SEQ ID NO: 5758181 - DNA, 22 bp, Homo sapiens
gccatacataatatatgacttc

SEQ ID NO: 5758182 - DNA, 18 bp, Homo sapiens
gccatacattaaggagca

SEQ ID NO: 5758183 - DNA, 22 bp, Homo sapiens
gccataccgaccatcgtccagc

SEQ ID NO: 5758184 - DNA, 17 bp, Homo sapiens
gccataccgctggggaa

SEQ ID NO: 5758185 - DNA, 15 bp, Homo sapiens
gccatacctcagata

SEQ ID NO: 5758186 - DNA, 19 bp, Homo sapiens
gccataccttctcccaggc

SEQ ID NO: 5758187 - DNA, 16 bp, Homo sapiens
gccataccttgagacc

SEQ ID NO: 5758188 - DNA, 13 bp, Homo sapiens
gccatactgcgcc

SEQ ID NO: 5758189 - DNA, 22 bp, Homo sapiens
gccatactgcgtccaccctgag

SEQ ID NO: 5758190 - DNA, 13 bp, Homo sapiens
gccatactggcct

SEQ ID NO: 5758191 - DNA, 20 bp, Homo sapiens
gccatacttatctctctgtg

SEQ ID NO: 5758192 - DNA, 21 bp, Homo sapiens
gccatacttatctctctgtgc

SEQ ID NO: 5758193 - DNA, 13 bp, Homo sapiens
gccatacttccag

SEQ ID NO: 5758194 - DNA, 15 bp, Homo sapiens
gccatacttgttctg

SEQ ID NO: 5758195 - DNA, 16 bp, Homo sapiens
gccatagacctacaga

SEQ ID NO: 5758196 - DNA, 18 bp, Homo sapiens
gccatagacctacagacc

SEQ ID NO: 5758197 - DNA, 23 bp, Homo sapiens
gccatagacctacagacctggct

SEQ ID NO: 5758198 - DNA, 18 bp, Homo sapiens
gccatagagtacactgcc

SEQ ID NO: 5758199 - DNA, 18 bp, Homo sapiens
gccatagatgctggctgg

SEQ ID NO: 5758200 - DNA, 19 bp, Homo sapiens
gccatagatgctggctggg

SEQ ID NO: 5758201 - DNA, 16 bp, Homo sapiens
gccatagccaggagcg

SEQ ID NO: 5758202 - DNA, 13 bp, Homo sapiens
gccatagccccat

SEQ ID NO: 5758203 - DNA, 21 bp, Homo sapiens
gccatagggggctgcacggga

SEQ ID NO: 5758204 - DNA, 19 bp, Homo sapiens
gccatagggtctgcagcct

SEQ ID NO: 5758205 - DNA, 15 bp, Homo sapiens
gccataggtgcagtt

SEQ ID NO: 5758206 - DNA, 16 bp, Homo sapiens
gccatagtcacatggc

SEQ ID NO: 5758207 - DNA, 17 bp, Homo sapiens
gccatagtcattctgcc

SEQ ID NO: 5758208 - DNA, 19 bp, Homo sapiens
gccatagtcattctgcctg

SEQ ID NO: 5758209 - DNA, 16 bp, Homo sapiens
gccatataagtttgaa

SEQ ID NO: 5758210 - DNA, 19 bp, Homo sapiens
gccatataagtttgaagga

SEQ ID NO: 5758211 - DNA, 23 bp, Homo sapiens
gccatatataacagatacatttc

SEQ ID NO: 5758212 - DNA, 14 bp, Homo sapiens
gccatatatgctgt

SEQ ID NO: 5758213 - DNA, 22 bp, Homo sapiens
gccatatgacaagcctttgtgc

SEQ ID NO: 5758214 - DNA, 17 bp, Homo sapiens
gccatatgatttacatt

SEQ ID NO: 5758215 - DNA, 16 bp, Homo sapiens
gccatatggacactgt

SEQ ID NO: 5758216 - DNA, 17 bp, Homo sapiens
gccatatggacactgtg

SEQ ID NO: 5758217 - DNA, 22 bp, Homo sapiens
gccatatggaggactgtgacag

SEQ ID NO: 5758218 - DNA, 23 bp, Homo sapiens
gccatatggaggactgtgacaga

SEQ ID NO: 5758219 - DNA, 20 bp, Homo sapiens
gccatattaaattttttgtt

SEQ ID NO: 5758220 - DNA, 22 bp, Homo sapiens
gccatattaattgcctgttaaa

SEQ ID NO: 5758221 - DNA, 14 bp, Homo sapiens
gccatattgtgtaa

SEQ ID NO: 5758222 - DNA, 18 bp, Homo sapiens
gccatattgtgtaattta

SEQ ID NO: 5758223 - DNA, 17 bp, Homo sapiens
gccatatttacctcagc

SEQ ID NO: 5758224 - DNA, 20 bp, Homo sapiens
gccatatttacctcagcctg

SEQ ID NO: 5758225 - DNA, 14 bp, Homo sapiens
gccatatttactac

SEQ ID NO: 5758226 - DNA, 17 bp, Homo sapiens
gccatatttactacctt

SEQ ID NO: 5758227 - DNA, 23 bp, Homo sapiens
gccatatttagtataccagagaa

SEQ ID NO: 5758228 - DNA, 14 bp, Homo sapiens
gccatatttgtaaa

SEQ ID NO: 5758229 - DNA, 20 bp, Homo sapiens
gccatatttttttctgtaaa

SEQ ID NO: 5758230 - DNA, 18 bp, Homo sapiens
gccatcaaaatgcttttt

SEQ ID NO: 5758231 - DNA, 14 bp, Homo sapiens
gccatcaaactgta

SEQ ID NO: 5758232 - DNA, 16 bp, Homo sapiens
gccatcaagagactga

SEQ ID NO: 5758233 - DNA, 19 bp, Homo sapiens
gccatcaagcacttcccag

SEQ ID NO: 5758234 - DNA, 21 bp, Homo sapiens
gccatcaagcacttcccagga

SEQ ID NO: 5758235 - DNA, 16 bp, Homo sapiens
gccatcaaggtccagt

SEQ ID NO: 5758236 - DNA, 20 bp, Homo sapiens
gccatcacaggatgccagcc

SEQ ID NO: 5758237 - DNA, 23 bp, Homo sapiens
gccatcacaggatgccagcccct

SEQ ID NO: 5758238 - DNA, 22 bp, Homo sapiens
gccatcaccacggctcactgca

SEQ ID NO: 5758239 - DNA, 12 bp, Homo sapiens
gccatcaccctc

SEQ ID NO: 5758240 - DNA, 17 bp, Homo sapiens
gccatcaccgctgggtg

SEQ ID NO: 5758241 - DNA, 15 bp, Homo sapiens
gccatcactcagccc

SEQ ID NO: 5758242 - DNA, 17 bp, Homo sapiens
gccatcactcagcccct

SEQ ID NO: 5758243 - DNA, 21 bp, Homo sapiens
gccatcactcagcccctaccc

SEQ ID NO: 5758244 - DNA, 20 bp, Homo sapiens
gccatcagatgaggctcctt

SEQ ID NO: 5758245 - DNA, 17 bp, Homo sapiens
gccatcagcccctgctg

SEQ ID NO: 5758246 - DNA, 18 bp, Homo sapiens
gccatcagcccctgctgc

SEQ ID NO: 5758247 - DNA, 19 bp, Homo sapiens
gccatcagcccctgctgct

SEQ ID NO: 5758248 - DNA, 20 bp, Homo sapiens
gccatcagcccctgctgctc

SEQ ID NO: 5758249 - DNA, 18 bp, Homo sapiens
gccatcaggactttccct

SEQ ID NO: 5758250 - DNA, 23 bp, Homo sapiens
gccatcagggtgggccactctcc

SEQ ID NO: 5758251 - DNA, 12 bp, Homo sapiens
gccatcatcctc

SEQ ID NO: 5758252 - DNA, 15 bp, Homo sapiens
gccatcatgccttga

SEQ ID NO: 5758253 - DNA, 23 bp, Homo sapiens
gccatcatgcggtgggtgctgcc

SEQ ID NO: 5758254 - DNA, 16 bp, Homo sapiens
gccatcatgtgcctgg

SEQ ID NO: 5758255 - DNA, 19 bp, Homo sapiens
gccatcatgtgcctggaaa

SEQ ID NO: 5758256 - DNA, 17 bp, Homo sapiens
gccatcatgtttacaga

SEQ ID NO: 5758257 - DNA, 23 bp, Homo sapiens
gccatcattgatgatcactgtga

SEQ ID NO: 5758258 - DNA, 14 bp, Homo sapiens
gccatcattgctgt

SEQ ID NO: 5758259 - DNA, 18 bp, Homo sapiens
gccatcattgctgtctgc

SEQ ID NO: 5758260 - DNA, 19 bp, Homo sapiens
gccatcattgctgtctgca

SEQ ID NO: 5758261 - DNA, 13 bp, Homo sapiens
gccatccaaaagg

SEQ ID NO: 5758262 - DNA, 15 bp, Homo sapiens
gccatccacatttta

SEQ ID NO: 5758263 - DNA, 14 bp, Homo sapiens
gccatccaccctga

SEQ ID NO: 5758264 - DNA, 18 bp, Homo sapiens
gccatccaccctgaggag

SEQ ID NO: 5758265 - DNA, 13 bp, Homo sapiens
gccatccactgtg

SEQ ID NO: 5758266 - DNA, 15 bp, Homo sapiens
gccatccagggtctg

SEQ ID NO: 5758267 - DNA, 20 bp, Homo sapiens
gccatccaggttcagcttgt

SEQ ID NO: 5758268 - DNA, 17 bp, Homo sapiens
gccatcccaagcccagt

SEQ ID NO: 5758269 - DNA, 13 bp, Homo sapiens
gccatcccagccc

SEQ ID NO: 5758270 - DNA, 16 bp, Homo sapiens
gccatcccagccttgg

SEQ ID NO: 5758271 - DNA, 20 bp, Homo sapiens
gccatccccctctcacgcca

SEQ ID NO: 5758272 - DNA, 19 bp, Homo sapiens
gccatcccgcttagcctgc

SEQ ID NO: 5758273 - DNA, 20 bp, Homo sapiens
gccatcccgcttagcctgcc

SEQ ID NO: 5758274 - DNA, 23 bp, Homo sapiens
gccatcccgcttagcctgcctca

SEQ ID NO: 5758275 - DNA, 13 bp, Homo sapiens
gccatccctccct

SEQ ID NO: 5758276 - DNA, 21 bp, Homo sapiens
gccatccctcgtggtccccaa

SEQ ID NO: 5758277 - DNA, 13 bp, Homo sapiens
gccatccctgaga

SEQ ID NO: 5758278 - DNA, 13 bp, Homo sapiens
gccatccctgggc

SEQ ID NO: 5758279 - DNA, 18 bp, Homo sapiens
gccatccctgggcccctc

SEQ ID NO: 5758280 - DNA, 20 bp, Homo sapiens
gccatccctgggcccctcca

SEQ ID NO: 5758281 - DNA, 17 bp, Homo sapiens
gccatcccttcggagcc

SEQ ID NO: 5758282 - DNA, 18 bp, Homo sapiens
gccatcccttcggagcca

SEQ ID NO: 5758283 - DNA, 18 bp, Homo sapiens
gccatccctttttttaca

SEQ ID NO: 5758284 - DNA, 16 bp, Homo sapiens
gccatccgcagactgc

SEQ ID NO: 5758285 - DNA, 19 bp, Homo sapiens
gccatccgggacgcttcca

SEQ ID NO: 5758286 - DNA, 21 bp, Homo sapiens
gccatccgggacgcttccaga

SEQ ID NO: 5758287 - DNA, 19 bp, Homo sapiens
gccatcctaaaagccaccc

SEQ ID NO: 5758288 - DNA, 14 bp, Homo sapiens
gccatcctacccag

SEQ ID NO: 5758289 - DNA, 16 bp, Homo sapiens
gccatcctacccagcg

SEQ ID NO: 5758290 - DNA, 23 bp, Homo sapiens
gccatcctaggcttaaatgcaat

SEQ ID NO: 5758291 - DNA, 19 bp, Homo sapiens
gccatcctcaaacactgca

SEQ ID NO: 5758292 - DNA, 23 bp, Homo sapiens
gccatcctcaaacgacagaggag

SEQ ID NO: 5758293 - DNA, 24 bp, Homo sapiens
gccatcctcaaacgacagaggagc

SEQ ID NO: 5758294 - DNA, 12 bp, Homo sapiens
gccatcctccct

SEQ ID NO: 5758295 - DNA, 13 bp, Homo sapiens
gccatcctccctc

SEQ ID NO: 5758296 - DNA, 15 bp, Homo sapiens
gccatcctccctcca

SEQ ID NO: 5758297 - DNA, 15 bp, Homo sapiens
gccatcctctgcctc

SEQ ID NO: 5758298 - DNA, 14 bp, Homo sapiens
gccatcctggccca

SEQ ID NO: 5758299 - DNA, 20 bp, Homo sapiens
gccatcctggcccagggcat

SEQ ID NO: 5758300 - DNA, 22 bp, Homo sapiens
gccatccttcaccagagcccat

SEQ ID NO: 5758301 - DNA, 23 bp, Homo sapiens
gccatccttcaccagagcccatg

SEQ ID NO: 5758302 - DNA, 19 bp, Homo sapiens
gccatccttccgccaatct

SEQ ID NO: 5758303 - DNA, 17 bp, Homo sapiens
gccatccttctgtgtac

SEQ ID NO: 5758304 - DNA, 23 bp, Homo sapiens
gccatcgccgggactccagaacc

SEQ ID NO: 5758305 - DNA, 22 bp, Homo sapiens
gccatcgcgggatggtgcagac

SEQ ID NO: 5758306 - DNA, 14 bp, Homo sapiens
gccatcggaagaga

SEQ ID NO: 5758307 - DNA, 23 bp, Homo sapiens
gccatcggaagagagggctgagc

SEQ ID NO: 5758308 - DNA, 16 bp, Homo sapiens
gccatcgggtgccaaa

SEQ ID NO: 5758309 - DNA, 18 bp, Homo sapiens
gccatcggtcctgtctcc

SEQ ID NO: 5758310 - DNA, 22 bp, Homo sapiens
gccatcgtaaactgacacagtg

SEQ ID NO: 5758311 - DNA, 18 bp, Homo sapiens
gccatcgtcctgggactc

SEQ ID NO: 5758312 - DNA, 19 bp, Homo sapiens
gccatctaatgcttgttta

SEQ ID NO: 5758313 - DNA, 15 bp, Homo sapiens
gccatctagccagcc

SEQ ID NO: 5758314 - DNA, 16 bp, Homo sapiens
gccatctagccagccc

SEQ ID NO: 5758315 - DNA, 22 bp, Homo sapiens
gccatctcaattgtgctttgta

SEQ ID NO: 5758316 - DNA, 21 bp, Homo sapiens
gccatctcacctcctgctggg

SEQ ID NO: 5758317 - DNA, 16 bp, Homo sapiens
gccatctcagattctg

SEQ ID NO: 5758318 - DNA, 15 bp, Homo sapiens
gccatctcaggagat

SEQ ID NO: 5758319 - DNA, 22 bp, Homo sapiens
gccatctcaggagatggagggc

SEQ ID NO: 5758320 - DNA, 19 bp, Homo sapiens
gccatctcatgaggggaga

SEQ ID NO: 5758321 - DNA, 20 bp, Homo sapiens
gccatctcatgaggggagag

SEQ ID NO: 5758322 - DNA, 15 bp, Homo sapiens
gccatctccaccctg

SEQ ID NO: 5758323 - DNA, 15 bp, Homo sapiens
gccatctccctcccc

SEQ ID NO: 5758324 - DNA, 22 bp, Homo sapiens
gccatctccctccccagaaaca

SEQ ID NO: 5758325 - DNA, 13 bp, Homo sapiens
gccatctcctccc

SEQ ID NO: 5758326 - DNA, 17 bp, Homo sapiens
gccatctgactgccaag

SEQ ID NO: 5758327 - DNA, 22 bp, Homo sapiens
gccatctgcacacacctccgag

SEQ ID NO: 5758328 - DNA, 17 bp, Homo sapiens
gccatctgcccaggggt

SEQ ID NO: 5758329 - DNA, 18 bp, Homo sapiens
gccatctgcgcagggtgg

SEQ ID NO: 5758330 - DNA, 21 bp, Homo sapiens
gccatctggaaatccagctgg

SEQ ID NO: 5758331 - DNA, 13 bp, Homo sapiens
gccatctggagag

SEQ ID NO: 5758332 - DNA, 12 bp, Homo sapiens
gccatctggggt

SEQ ID NO: 5758333 - DNA, 17 bp, Homo sapiens
gccatctgtaaatatcc

SEQ ID NO: 5758334 - DNA, 13 bp, Homo sapiens
gccatctgtgggc

SEQ ID NO: 5758335 - DNA, 15 bp, Homo sapiens
gccatctgtgggcac

SEQ ID NO: 5758336 - DNA, 17 bp, Homo sapiens
gccatctgtgggcacgc

SEQ ID NO: 5758337 - DNA, 13 bp, Homo sapiens
gccatctgttcat

SEQ ID NO: 5758338 - DNA, 14 bp, Homo sapiens
gccatctgttcatt

SEQ ID NO: 5758339 - DNA, 14 bp, Homo sapiens
gccatctgttttca

SEQ ID NO: 5758340 - DNA, 17 bp, Homo sapiens
gccatcttccaggtggg

SEQ ID NO: 5758341 - DNA, 20 bp, Homo sapiens
gccatcttcccgcctcagcc

SEQ ID NO: 5758342 - DNA, 13 bp, Homo sapiens
gccatcttctccc

SEQ ID NO: 5758343 - DNA, 14 bp, Homo sapiens
gccatcttctttct

SEQ ID NO: 5758344 - DNA, 22 bp, Homo sapiens
gccatcttggtaaatttcccca

SEQ ID NO: 5758345 - DNA, 12 bp, Homo sapiens
gccatgaacaaa

SEQ ID NO: 5758346 - DNA, 13 bp, Homo sapiens
gccatgaactttg

SEQ ID NO: 5758347 - DNA, 16 bp, Homo sapiens
gccatgaaggcacctg

SEQ ID NO: 5758348 - DNA, 19 bp, Homo sapiens
gccatgaaggcacctgccc

SEQ ID NO: 5758349 - DNA, 20 bp, Homo sapiens
gccatgaaggcacctgcccc

SEQ ID NO: 5758350 - DNA, 19 bp, Homo sapiens
gccatgaatctctgcctct

SEQ ID NO: 5758351 - DNA, 21 bp, Homo sapiens
gccatgaatctctgcctctcc

SEQ ID NO: 5758352 - DNA, 18 bp, Homo sapiens
gccatgacagaggctgca

SEQ ID NO: 5758353 - DNA, 20 bp, Homo sapiens
gccatgaccagttctggcca

SEQ ID NO: 5758354 - DNA, 18 bp, Homo sapiens
gccatgaccctgcctctc

SEQ ID NO: 5758355 - DNA, 22 bp, Homo sapiens
gccatgaccctgcctctcccag

SEQ ID NO: 5758356 - DNA, 24 bp, Homo sapiens
gccatgactagggtcctcaggcag

SEQ ID NO: 5758357 - DNA, 17 bp, Homo sapiens
gccatgactgctcaggc

SEQ ID NO: 5758358 - DNA, 21 bp, Homo sapiens
gccatgactgctcaggcctca

SEQ ID NO: 5758359 - DNA, 15 bp, Homo sapiens
gccatgacttttctg

SEQ ID NO: 5758360 - DNA, 18 bp, Homo sapiens
gccatgagccgcccaagg

SEQ ID NO: 5758361 - DNA, 19 bp, Homo sapiens
gccatgagccgcccaaggc

SEQ ID NO: 5758362 - DNA, 17 bp, Homo sapiens
gccatgagctccagacc

SEQ ID NO: 5758363 - DNA, 19 bp, Homo sapiens
gccatgagctccagacccc

SEQ ID NO: 5758364 - DNA, 18 bp, Homo sapiens
gccatgaggaggcagaga

SEQ ID NO: 5758365 - DNA, 16 bp, Homo sapiens
gccatgaggcctcagt

SEQ ID NO: 5758366 - DNA, 13 bp, Homo sapiens
gccatgagggctg

SEQ ID NO: 5758367 - DNA, 16 bp, Homo sapiens
gccatgagtccatgtc

SEQ ID NO: 5758368 - DNA, 19 bp, Homo sapiens
gccatgagtccatgtccta

SEQ ID NO: 5758369 - DNA, 19 bp, Homo sapiens
gccatgagttttcagatga

SEQ ID NO: 5758370 - DNA, 21 bp, Homo sapiens
gccatgataagaacagagtgc

SEQ ID NO: 5758371 - DNA, 22 bp, Homo sapiens
gccatgataataggtcatatgt

SEQ ID NO: 5758372 - DNA, 20 bp, Homo sapiens
gccatgatcgagccactgca

SEQ ID NO: 5758373 - DNA, 22 bp, Homo sapiens
gccatgatctgcaggggtctgg

SEQ ID NO: 5758374 - DNA, 18 bp, Homo sapiens
gccatgatgcctctgtct

SEQ ID NO: 5758375 - DNA, 22 bp, Homo sapiens
gccatgatggcaacagaaacca

SEQ ID NO: 5758376 - DNA, 15 bp, Homo sapiens
gccatgatggcctta

SEQ ID NO: 5758377 - DNA, 14 bp, Homo sapiens
gccatgatgtatat

SEQ ID NO: 5758378 - DNA, 13 bp, Homo sapiens
gccatgatgtcct

SEQ ID NO: 5758379 - DNA, 20 bp, Homo sapiens
gccatgatgtcgttcatttt

SEQ ID NO: 5758380 - DNA, 15 bp, Homo sapiens
gccatgatgtggagt

SEQ ID NO: 5758381 - DNA, 22 bp, Homo sapiens
gccatgatgtggagtggggcag

SEQ ID NO: 5758382 - DNA, 20 bp, Homo sapiens
gccatgattcgcccaaagcc

SEQ ID NO: 5758383 - DNA, 16 bp, Homo sapiens
gccatgatttgtccca

SEQ ID NO: 5758384 - DNA, 22 bp, Homo sapiens
gccatgattttggccactttgc

SEQ ID NO: 5758385 - DNA, 19 bp, Homo sapiens
gccatgcaactccatgcct

SEQ ID NO: 5758386 - DNA, 20 bp, Homo sapiens
gccatgcaactccatgccta

SEQ ID NO: 5758387 - DNA, 22 bp, Homo sapiens
gccatgcaccaggactggctgt

SEQ ID NO: 5758388 - DNA, 14 bp, Homo sapiens
gccatgcagacctc

SEQ ID NO: 5758389 - DNA, 20 bp, Homo sapiens
gccatgcagacctcatgccc

SEQ ID NO: 5758390 - DNA, 19 bp, Homo sapiens
gccatgcaggaagaggccc

SEQ ID NO: 5758391 - DNA, 21 bp, Homo sapiens
gccatgcaggaagaggcccac

SEQ ID NO: 5758392 - DNA, 13 bp, Homo sapiens
gccatgcaggagg

SEQ ID NO: 5758393 - DNA, 14 bp, Homo sapiens
gccatgccaataaa

SEQ ID NO: 5758394 - DNA, 15 bp, Homo sapiens
gccatgccaataaag

SEQ ID NO: 5758395 - DNA, 13 bp, Homo sapiens
gccatgccactgc

SEQ ID NO: 5758396 - DNA, 17 bp, Homo sapiens
gccatgccactgccagg

SEQ ID NO: 5758397 - DNA, 20 bp, Homo sapiens
gccatgccactgccaggcac

SEQ ID NO: 5758398 - DNA, 22 bp, Homo sapiens
gccatgccactgccaggcacct

SEQ ID NO: 5758399 - DNA, 23 bp, Homo sapiens
gccatgccactgccaggcacctg

SEQ ID NO: 5758400 - DNA, 15 bp, Homo sapiens
gccatgccagctggc

SEQ ID NO: 5758401 - DNA, 18 bp, Homo sapiens
gccatgccagcttatctc

SEQ ID NO: 5758402 - DNA, 14 bp, Homo sapiens
gccatgcccaaggc

SEQ ID NO: 5758403 - DNA, 20 bp, Homo sapiens
gccatgcccaaggcctaggt

SEQ ID NO: 5758404 - DNA, 15 bp, Homo sapiens
gccatgcccacgccc

SEQ ID NO: 5758405 - DNA, 20 bp, Homo sapiens
gccatgcccacgcccctccc

SEQ ID NO: 5758406 - DNA, 22 bp, Homo sapiens
gccatgcccacgcccctcccca

SEQ ID NO: 5758407 - DNA, 14 bp, Homo sapiens
gccatgcccaggac

SEQ ID NO: 5758408 - DNA, 15 bp, Homo sapiens
gccatgcccaggacg

SEQ ID NO: 5758409 - DNA, 23 bp, Homo sapiens
gccatgcccttacacgtgcgtgt

SEQ ID NO: 5758410 - DNA, 13 bp, Homo sapiens
gccatgcctcagc

SEQ ID NO: 5758411 - DNA, 12 bp, Homo sapiens
gccatgcctccc

SEQ ID NO: 5758412 - DNA, 13 bp, Homo sapiens
gccatgcctgctc

SEQ ID NO: 5758413 - DNA, 16 bp, Homo sapiens
gccatgcctgctccct

SEQ ID NO: 5758414 - DNA, 18 bp, Homo sapiens
gccatgcctgctccctgt

SEQ ID NO: 5758415 - DNA, 16 bp, Homo sapiens
gccatgctacagttag

SEQ ID NO: 5758416 - DNA, 19 bp, Homo sapiens
gccatgctcaacccccctc

SEQ ID NO: 5758417 - DNA, 18 bp, Homo sapiens
gccattggagagctgtct

SEQ ID NO: 5758418 - DNA, 12 bp, Homo sapiens
gccattggagtc

SEQ ID NO: 5758419 - DNA, 17 bp, Homo sapiens
gccattggcctctgtct

SEQ ID NO: 5758420 - DNA, 14 bp, Homo sapiens
gccattggcctctt

SEQ ID NO: 5758421 - DNA, 13 bp, Homo sapiens
gccattggcctta

SEQ ID NO: 5758422 - DNA, 16 bp, Homo sapiens
gccattggctactgac

SEQ ID NO: 5758423 - DNA, 16 bp, Homo sapiens
gccattgggaccctcc

SEQ ID NO: 5758424 - DNA, 18 bp, Homo sapiens
gccattgggaccctccag

SEQ ID NO: 5758425 - DNA, 22 bp, Homo sapiens
gccattgggtttggggccatgg

SEQ ID NO: 5758426 - DNA, 18 bp, Homo sapiens
gccattggtccacccttt

SEQ ID NO: 5758427 - DNA, 15 bp, Homo sapiens
gccattgtaatttga

SEQ ID NO: 5758428 - DNA, 15 bp, Homo sapiens
gccattgtactccag

SEQ ID NO: 5758429 - DNA, 18 bp, Homo sapiens
gccattgtactccagcct

SEQ ID NO: 5758430 - DNA, 20 bp, Homo sapiens
gccattgtactccagcctgg

SEQ ID NO: 5758431 - DNA, 18 bp, Homo sapiens
gccattgtcgtttcattc

SEQ ID NO: 5758432 - DNA, 23 bp, Homo sapiens
gccattgtcttcggaaaccttgg

SEQ ID NO: 5758433 - DNA, 13 bp, Homo sapiens
gccattgtcttta

SEQ ID NO: 5758434 - DNA, 19 bp, Homo sapiens
gccattgtgaaccaatgca

SEQ ID NO: 5758435 - DNA, 21 bp, Homo sapiens
gccatttaatttttaaatgtt

SEQ ID NO: 5758436 - DNA, 22 bp, Homo sapiens
gccatttaatttttaaatgttt

SEQ ID NO: 5758437 - DNA, 18 bp, Homo sapiens
gccatttagcaataaata

SEQ ID NO: 5758438 - DNA, 21 bp, Homo sapiens
gccatttagccaccatctttg

SEQ ID NO: 5758439 - DNA, 18 bp, Homo sapiens
gccatttaggcaaataag

SEQ ID NO: 5758440 - DNA, 16 bp, Homo sapiens
gccatttatttattga

SEQ ID NO: 5758441 - DNA, 14 bp, Homo sapiens
gccatttatttcct

SEQ ID NO: 5758442 - DNA, 15 bp, Homo sapiens
gccatttatttcctc

SEQ ID NO: 5758443 - DNA, 18 bp, Homo sapiens
gccatttcagtggcttcc

SEQ ID NO: 5758444 - DNA, 14 bp, Homo sapiens
gccatttcatgtcc

SEQ ID NO: 5758445 - DNA, 20 bp, Homo sapiens
gccatttccaagaggctgta

SEQ ID NO: 5758446 - DNA, 14 bp, Homo sapiens
gccatttccctgaa

SEQ ID NO: 5758447 - DNA, 22 bp, Homo sapiens
gccatttcctcacgtgcaggac

SEQ ID NO: 5758448 - DNA, 15 bp, Homo sapiens
gccatttcctgtctg

SEQ ID NO: 5758449 - DNA, 18 bp, Homo sapiens
gccatttccttttcacat

SEQ ID NO: 5758450 - DNA, 21 bp, Homo sapiens
gccatttccttttctctgccc

SEQ ID NO: 5758451 - DNA, 23 bp, Homo sapiens
gccatttccttttctctgccctt

SEQ ID NO: 5758452 - DNA, 12 bp, Homo sapiens
gccatttctaaa

SEQ ID NO: 5758453 - DNA, 14 bp, Homo sapiens
gccatttcttatat

SEQ ID NO: 5758454 - DNA, 16 bp, Homo sapiens
gccatttcttcccaag

SEQ ID NO: 5758455 - DNA, 12 bp, Homo sapiens
gccatttcttct

SEQ ID NO: 5758456 - DNA, 20 bp, Homo sapiens
gccatttcttctctctgttc

SEQ ID NO: 5758457 - DNA, 15 bp, Homo sapiens
gccatttctttatat

SEQ ID NO: 5758458 - DNA, 17 bp, Homo sapiens
gccatttgatttttcta

SEQ ID NO: 5758459 - DNA, 17 bp, Homo sapiens
gccatttgcaataacag

SEQ ID NO: 5758460 - DNA, 20 bp, Homo sapiens
gccatttgctgccctggggc

SEQ ID NO: 5758461 - DNA, 15 bp, Homo sapiens
gccatttgctttttc

SEQ ID NO: 5758462 - DNA, 14 bp, Homo sapiens
gccatttgtactga

SEQ ID NO: 5758463 - DNA, 12 bp, Homo sapiens
gccattttaata

SEQ ID NO: 5758464 - DNA, 14 bp, Homo sapiens
gccattttcttgcc

SEQ ID NO: 5758465 - DNA, 16 bp, Homo sapiens
gccattttcttgcctg

SEQ ID NO: 5758466 - DNA, 13 bp, Homo sapiens
gccattttggaaa

SEQ ID NO: 5758467 - DNA, 15 bp, Homo sapiens
gccattttggtgctt

SEQ ID NO: 5758468 - DNA, 16 bp, Homo sapiens
gccattttggtgctta

SEQ ID NO: 5758469 - DNA, 17 bp, Homo sapiens
gccattttgtaaactaa

SEQ ID NO: 5758470 - DNA, 15 bp, Homo sapiens
gccattttgtaactg

SEQ ID NO: 5758471 - DNA, 23 bp, Homo sapiens
gccattttgtaactgcctaccag

SEQ ID NO: 5758472 - DNA, 18 bp, Homo sapiens
gccattttgtgaatggat

SEQ ID NO: 5758473 - DNA, 15 bp, Homo sapiens
gccatttttacatct

SEQ ID NO: 5758474 - DNA, 18 bp, Homo sapiens
gccatttttcaaagcaat

SEQ ID NO: 5758475 - DNA, 19 bp, Homo sapiens
gccatttttcaaagcaatt

SEQ ID NO: 5758476 - DNA, 17 bp, Homo sapiens
gcccaaaacccagggca

SEQ ID NO: 5758477 - DNA, 14 bp, Homo sapiens
gcccaaaagccatg

SEQ ID NO: 5758478 - DNA, 15 bp, Homo sapiens
gcccaaaatttattt

SEQ ID NO: 5758479 - DNA, 19 bp, Homo sapiens
gcccaaacaccctcctggc

SEQ ID NO: 5758480 - DNA, 22 bp, Homo sapiens
gcccaaacagctgtatttatat

SEQ ID NO: 5758481 - DNA, 21 bp, Homo sapiens
gcccaaaccaccagaagccca

SEQ ID NO: 5758482 - DNA, 21 bp, Homo sapiens
gcccaaaccagggggaagcac

SEQ ID NO: 5758483 - DNA, 14 bp, Homo sapiens
gcccaaacccttaa

SEQ ID NO: 5758484 - DNA, 16 bp, Homo sapiens
gcccaaacctgggaag

SEQ ID NO: 5758485 - DNA, 20 bp, Homo sapiens
gcccaaaccttgggccctgg

SEQ ID NO: 5758486 - DNA, 19 bp, Homo sapiens
gcccaaacctttcccccat

SEQ ID NO: 5758487 - DNA, 14 bp, Homo sapiens
gcccaaactcccct

SEQ ID NO: 5758488 - DNA, 21 bp, Homo sapiens
gcccaaactccccttccctgg

SEQ ID NO: 5758489 - DNA, 15 bp, Homo sapiens
gcccaaactcctttc

SEQ ID NO: 5758490 - DNA, 21 bp, Homo sapiens
gcccaaagagcacaaacattt

SEQ ID NO: 5758491 - DNA, 16 bp, Homo sapiens
gcccaaagatgcagcc

SEQ ID NO: 5758492 - DNA, 19 bp, Homo sapiens
gcccaaagcctgaggacag

SEQ ID NO: 5758493 - DNA, 17 bp, Homo sapiens
gcccaaagctggagcca

SEQ ID NO: 5758494 - DNA, 19 bp, Homo sapiens
gcccaaaggacgcactgag

SEQ ID NO: 5758495 - DNA, 19 bp, Homo sapiens
gcccaaaggcccagggagg

SEQ ID NO: 5758496 - DNA, 19 bp, Homo sapiens
gcccaaaggggacaggcct

SEQ ID NO: 5758497 - DNA, 14 bp, Homo sapiens
gcccaaaggggagc

SEQ ID NO: 5758498 - DNA, 13 bp, Homo sapiens
gcccaaagtgggg

SEQ ID NO: 5758499 - DNA, 16 bp, Homo sapiens
gcccaaatcccctccc

SEQ ID NO: 5758500 - DNA, 14 bp, Homo sapiens
gcccaaatctgcct

SEQ ID NO: 5758501 - DNA, 14 bp, Homo sapiens
gcccaaatgatgga

SEQ ID NO: 5758502 - DNA, 15 bp, Homo sapiens
gcccaaatgctggct

SEQ ID NO: 5758503 - DNA, 19 bp, Homo sapiens
gcccaaatttaatttgcaa

SEQ ID NO: 5758504 - DNA, 14 bp, Homo sapiens
gcccaaatttttct

SEQ ID NO: 5758505 - DNA, 19 bp, Homo sapiens
gcccaacaagttgaagaag

SEQ ID NO: 5758506 - DNA, 10 bp, Homo sapiens
gcccaacaca

SEQ ID NO: 5758507 - DNA, 18 bp, Homo sapiens
gcccaacaccagcccctg

SEQ ID NO: 5758508 - DNA, 22 bp, Homo sapiens
gcccaacaccagcccctgcccc

SEQ ID NO: 5758509 - DNA, 14 bp, Homo sapiens
gcccaacaggccct

SEQ ID NO: 5758510 - DNA, 22 bp, Homo sapiens
gcccaacaggggctccatgcca

SEQ ID NO: 5758511 - DNA, 21 bp, Homo sapiens
gcccaaccaatgcacacagta

SEQ ID NO: 5758512 - DNA, 14 bp, Homo sapiens
gcccaaccaggagg

SEQ ID NO: 5758513 - DNA, 15 bp, Homo sapiens
gcccaaccaggaggg

SEQ ID NO: 5758514 - DNA, 13 bp, Homo sapiens
gcccaacccaacc

SEQ ID NO: 5758515 - DNA, 22 bp, Homo sapiens
gcccaacccactgtcttgcagt

SEQ ID NO: 5758516 - DNA, 14 bp, Homo sapiens
gcccaacccccacc

SEQ ID NO: 5758517 - DNA, 16 bp, Homo sapiens
gcccaacccccacctc

SEQ ID NO: 5758518 - DNA, 19 bp, Homo sapiens
gcccaaccctgcccacttc

SEQ ID NO: 5758519 - DNA, 16 bp, Homo sapiens
gcccaaccctgtctgt

SEQ ID NO: 5758520 - DNA, 22 bp, Homo sapiens
gcccaacctacattccaccctg

SEQ ID NO: 5758521 - DNA, 13 bp, Homo sapiens
gcccaacctcagc

SEQ ID NO: 5758522 - DNA, 17 bp, Homo sapiens
gcccaacctcagcaacc

SEQ ID NO: 5758523 - DNA, 17 bp, Homo sapiens
gcccaacctcgccctct

SEQ ID NO: 5758524 - DNA, 19 bp, Homo sapiens
gcccaacctcgccctctct

SEQ ID NO: 5758525 - DNA, 23 bp, Homo sapiens
gcccaacctcgccctctctcacc

SEQ ID NO: 5758526 - DNA, 13 bp, Homo sapiens
gcccaacctctgt

SEQ ID NO: 5758527 - DNA, 23 bp, Homo sapiens
gcccaacctctgtggtcacccat

SEQ ID NO: 5758528 - DNA, 14 bp, Homo sapiens
gcccaacctgctct

SEQ ID NO: 5758529 - DNA, 19 bp, Homo sapiens
gcccaactaacagtcaaga

SEQ ID NO: 5758530 - DNA, 21 bp, Homo sapiens
gcccaactaacagtcaagaaa

SEQ ID NO: 5758531 - DNA, 12 bp, Homo sapiens
gcccaactccca

SEQ ID NO: 5758532 - DNA, 17 bp, Homo sapiens
gcccaactggttcaggc

SEQ ID NO: 5758533 - DNA, 16 bp, Homo sapiens
gcccaagagagacagc

SEQ ID NO: 5758534 - DNA, 22 bp, Homo sapiens
gcccaagagagacagcacaggc

SEQ ID NO: 5758535 - DNA, 19 bp, Homo sapiens
gcccaagagcagagtctgg

SEQ ID NO: 5758536 - DNA, 22 bp, Homo sapiens
gcccaagagcagagtctgggcc

SEQ ID NO: 5758537 - DNA, 13 bp, Homo sapiens
gcccaagagcccg

SEQ ID NO: 5758538 - DNA, 20 bp, Homo sapiens
gcccaagaggactgagactg

SEQ ID NO: 5758539 - DNA, 15 bp, Homo sapiens
gcccaagattattca

SEQ ID NO: 5758540 - DNA, 18 bp, Homo sapiens
gcccaagcatgccccacc

SEQ ID NO: 5758541 - DNA, 18 bp, Homo sapiens
gcccaagccagaggctgg

SEQ ID NO: 5758542 - DNA, 21 bp, Homo sapiens
gcccaagccagaggctgggtt

SEQ ID NO: 5758543 - DNA, 16 bp, Homo sapiens
gcccaagccctccaca

SEQ ID NO: 5758544 - DNA, 18 bp, Homo sapiens
gcccaagctaagccatca

SEQ ID NO: 5758545 - DNA, 20 bp, Homo sapiens
gcccaagctaagctgcaggc

SEQ ID NO: 5758546 - DNA, 21 bp, Homo sapiens
gcccaagctaagctgcaggca

SEQ ID NO: 5758547 - DNA, 16 bp, Homo sapiens
gcccaagctgggctcc

SEQ ID NO: 5758548 - DNA, 18 bp, Homo sapiens
gcccaagctgggctccct

SEQ ID NO: 5758549 - DNA, 15 bp, Homo sapiens
gcccaagcttccctc

SEQ ID NO: 5758550 - DNA, 15 bp, Homo sapiens
gcccaaggacagttc

SEQ ID NO: 5758551 - DNA, 21 bp, Homo sapiens
gcccaaggagcttacccaagc

SEQ ID NO: 5758552 - DNA, 23 bp, Homo sapiens
gcccaaggagcttacccaagctg

SEQ ID NO: 5758553 - DNA, 17 bp, Homo sapiens
gcccaaggcccccacct

SEQ ID NO: 5758554 - DNA, 20 bp, Homo sapiens
gcccaaggcccccacctctg

SEQ ID NO: 5758555 - DNA, 21 bp, Homo sapiens
gcccaaggcccccacctctgt

SEQ ID NO: 5758556 - DNA, 22 bp, Homo sapiens
gcccaaggcccccacctctgtg

SEQ ID NO: 5758557 - DNA, 18 bp, Homo sapiens
gcccaaggcctaccccag

SEQ ID NO: 5758558 - DNA, 17 bp, Homo sapiens
gcccaaggcggcccctc

SEQ ID NO: 5758559 - DNA, 15 bp, Homo sapiens
gcccaaggctcccgg

SEQ ID NO: 5758560 - DNA, 15 bp, Homo sapiens
gcccaagggatctgg

SEQ ID NO: 5758561 - DNA, 18 bp, Homo sapiens
gcccaagggatggcacca

SEQ ID NO: 5758562 - DNA, 20 bp, Homo sapiens
gcccaagggcctcccaccag

SEQ ID NO: 5758563 - DNA, 13 bp, Homo sapiens
gcccaaggggact

SEQ ID NO: 5758564 - DNA, 12 bp, Homo sapiens
gcccaagggtgg

SEQ ID NO: 5758565 - DNA, 16 bp, Homo sapiens
gcccaaggtcccctcc

SEQ ID NO: 5758566 - DNA, 18 bp, Homo sapiens
gcccaaggttgcacagca

SEQ ID NO: 5758567 - DNA, 16 bp, Homo sapiens
gcccaagtcattgttt

SEQ ID NO: 5758568 - DNA, 19 bp, Homo sapiens
gcccaagtccaaatgttta

SEQ ID NO: 5758569 - DNA, 14 bp, Homo sapiens
gcccaagtccctgt

SEQ ID NO: 5758570 - DNA, 17 bp, Homo sapiens
gcccaagtccctgtttt

SEQ ID NO: 5758571 - DNA, 17 bp, Homo sapiens
gcccaagtgccatccca

SEQ ID NO: 5758572 - DNA, 17 bp, Homo sapiens
gcccaagtggctcttgg

SEQ ID NO: 5758573 - DNA, 14 bp, Homo sapiens
gcccaagtgggcag

SEQ ID NO: 5758574 - DNA, 23 bp, Homo sapiens
gcccaagtgggcagtcaccaccc

SEQ ID NO: 5758575 - DNA, 20 bp, Homo sapiens
gcccaagttcatgcagctgt

SEQ ID NO: 5758576 - DNA, 10 bp, Homo sapiens
gcccaataaa

SEQ ID NO: 5758577 - DNA, 19 bp, Homo sapiens
gcccaatatgcagttctgc

SEQ ID NO: 5758578 - DNA, 16 bp, Homo sapiens
gcccaatccaggcccg

SEQ ID NO: 5758579 - DNA, 15 bp, Homo sapiens
gcccaatcctccctg

SEQ ID NO: 5758580 - DNA, 19 bp, Homo sapiens
gcccaatcctccctggaga

SEQ ID NO: 5758581 - DNA, 20 bp, Homo sapiens
gcccaatcctccctggagaa

SEQ ID NO: 5758582 - DNA, 22 bp, Homo sapiens
gcccaatcctccctggagaagg

SEQ ID NO: 5758583 - DNA, 18 bp, Homo sapiens
gcccaatgaggtggctca

SEQ ID NO: 5758584 - DNA, 21 bp, Homo sapiens
gcccaatgcactttgttctgg

SEQ ID NO: 5758585 - DNA, 23 bp, Homo sapiens
gcccaatgcatagagccctggcc

SEQ ID NO: 5758586 - DNA, 18 bp, Homo sapiens
gcccaatgctgcttttgg

SEQ ID NO: 5758587 - DNA, 20 bp, Homo sapiens
gcccaatgctttgggaggcc

SEQ ID NO: 5758588 - DNA, 21 bp, Homo sapiens
gcccaatgctttgggaggcca

SEQ ID NO: 5758589 - DNA, 18 bp, Homo sapiens
gcccaatggagaaatgaa

SEQ ID NO: 5758590 - DNA, 20 bp, Homo sapiens
gcccaattggaggaaagcaa

SEQ ID NO: 5758591 - DNA, 18 bp, Homo sapiens
gcccaattttaatctgaa

SEQ ID NO: 5758592 - DNA, 23 bp, Homo sapiens
gcccacaaaggcaaagggtccag

SEQ ID NO: 5758593 - DNA, 15 bp, Homo sapiens
gcccacaaaggggag

SEQ ID NO: 5758594 - DNA, 23 bp, Homo sapiens
gcccacaacgtcccctcaagccc

SEQ ID NO: 5758595 - DNA, 19 bp, Homo sapiens
gcccacgcagaggacgcac

SEQ ID NO: 5758596 - DNA, 15 bp, Homo sapiens
gcccacgccagctgg

SEQ ID NO: 5758597 - DNA, 14 bp, Homo sapiens
gcccacgcccccac

SEQ ID NO: 5758598 - DNA, 17 bp, Homo sapiens
gcccacgcccccactgg

SEQ ID NO: 5758599 - DNA, 18 bp, Homo sapiens
gcccacgcccctccccag

SEQ ID NO: 5758600 - DNA, 21 bp, Homo sapiens
gcccacgcccctccccagccc

SEQ ID NO: 5758601 - DNA, 21 bp, Homo sapiens
gcccacgcccgactagcaggc

SEQ ID NO: 5758602 - DNA, 23 bp, Homo sapiens
gcccacgcccttggagccttcca

SEQ ID NO: 5758603 - DNA, 15 bp, Homo sapiens
gcccacgccggcctc

SEQ ID NO: 5758604 - DNA, 17 bp, Homo sapiens
gcccacgccggcctctg

SEQ ID NO: 5758605 - DNA, 19 bp, Homo sapiens
gcccacgcgcttccctggg

SEQ ID NO: 5758606 - DNA, 14 bp, Homo sapiens
gcccacgctcctgc

SEQ ID NO: 5758607 - DNA, 22 bp, Homo sapiens
gcccacgctgactacagggccg

SEQ ID NO: 5758608 - DNA, 21 bp, Homo sapiens
gcccacgctggagtgcagtga

SEQ ID NO: 5758609 - DNA, 18 bp, Homo sapiens
gcccacggccacccaccc

SEQ ID NO: 5758610 - DNA, 19 bp, Homo sapiens
gcccacggctaagaggctg

SEQ ID NO: 5758611 - DNA, 17 bp, Homo sapiens
gcccacgggccggccag

SEQ ID NO: 5758612 - DNA, 16 bp, Homo sapiens
gcccacggggcaaagc

SEQ ID NO: 5758613 - DNA, 23 bp, Homo sapiens
gcccacggttcggggcttctgcg

SEQ ID NO: 5758614 - DNA, 17 bp, Homo sapiens
gcccacggtttcagcta

SEQ ID NO: 5758615 - DNA, 21 bp, Homo sapiens
gcccacggtttcagctagaca

SEQ ID NO: 5758616 - DNA, 20 bp, Homo sapiens
gcccacgtacccaggtctgg

SEQ ID NO: 5758617 - DNA, 22 bp, Homo sapiens
gcccacgtacccaggtctgggt

SEQ ID NO: 5758618 - DNA, 15 bp, Homo sapiens
gcccacgtagggcgg

SEQ ID NO: 5758619 - DNA, 20 bp, Homo sapiens
gcccacgtagggggctctgg

SEQ ID NO: 5758620 - DNA, 22 bp, Homo sapiens
gcccacgtagggggctctgggc

SEQ ID NO: 5758621 - DNA, 19 bp, Homo sapiens
gcccacgtcaggcctggcc

SEQ ID NO: 5758622 - DNA, 21 bp, Homo sapiens
gcccacgtcaggcctggcctc

SEQ ID NO: 5758623 - DNA, 16 bp, Homo sapiens
gcccacgtcctgggtg

SEQ ID NO: 5758624 - DNA, 17 bp, Homo sapiens
gcccacgtcctgggtgc

SEQ ID NO: 5758625 - DNA, 22 bp, Homo sapiens
gcccacgtcctgggtgctgtca

SEQ ID NO: 5758626 - DNA, 13 bp, Homo sapiens
gcccacgtgcagc

SEQ ID NO: 5758627 - DNA, 19 bp, Homo sapiens
gcccacgtgtgcagactgt

SEQ ID NO: 5758628 - DNA, 23 bp, Homo sapiens
gcccacgttctctctgcctgtga

SEQ ID NO: 5758629 - DNA, 16 bp, Homo sapiens
gcccactcccatccct

SEQ ID NO: 5758630 - DNA, 12 bp, Homo sapiens
gcccactcccca

SEQ ID NO: 5758631 - DNA, 15 bp, Homo sapiens
gcccactccccagcc

SEQ ID NO: 5758632 - DNA, 19 bp, Homo sapiens
gcccactccccagccccag

SEQ ID NO: 5758633 - DNA, 13 bp, Homo sapiens
gcccactccccca

SEQ ID NO: 5758634 - DNA, 22 bp, Homo sapiens
gcccactcccccaggagcagct

SEQ ID NO: 5758635 - DNA, 23 bp, Homo sapiens
gcccactccctatctccttccca

SEQ ID NO: 5758636 - DNA, 14 bp, Homo sapiens
gcccactccctgca

SEQ ID NO: 5758637 - DNA, 15 bp, Homo sapiens
gcccactccctgcct

SEQ ID NO: 5758638 - DNA, 14 bp, Homo sapiens
gcccactccgccag

SEQ ID NO: 5758639 - DNA, 17 bp, Homo sapiens
gcccactccgccagcca

SEQ ID NO: 5758640 - DNA, 18 bp, Homo sapiens
gcccactccgccagccac

SEQ ID NO: 5758641 - DNA, 19 bp, Homo sapiens
gcccactccgccagccaca

SEQ ID NO: 5758642 - DNA, 20 bp, Homo sapiens
gcccactccgccagccacag

SEQ ID NO: 5758643 - DNA, 15 bp, Homo sapiens
gcccactcctgctct

SEQ ID NO: 5758644 - DNA, 13 bp, Homo sapiens
gcccactcctggg

SEQ ID NO: 5758645 - DNA, 14 bp, Homo sapiens
gcccactcctggga

SEQ ID NO: 5758646 - DNA, 15 bp, Homo sapiens
gcccactctactgcc

SEQ ID NO: 5758647 - DNA, 22 bp, Homo sapiens
gcccactctactgccccagctc

SEQ ID NO: 5758648 - DNA, 23 bp, Homo sapiens
gcccactctactgccccagctcc

SEQ ID NO: 5758649 - DNA, 19 bp, Homo sapiens
gcccactctccacctcact

SEQ ID NO: 5758650 - DNA, 20 bp, Homo sapiens
gcccactctccacctcacta

SEQ ID NO: 5758651 - DNA, 13 bp, Homo sapiens
gcccactctgggg

SEQ ID NO: 5758652 - DNA, 18 bp, Homo sapiens
gcccactgaacatgctca

SEQ ID NO: 5758653 - DNA, 19 bp, Homo sapiens
gcccactgaggggccaggg

SEQ ID NO: 5758654 - DNA, 20 bp, Homo sapiens
gcccactgaggggccaggga

SEQ ID NO: 5758655 - DNA, 16 bp, Homo sapiens
gcccactgcccacccc

SEQ ID NO: 5758656 - DNA, 19 bp, Homo sapiens
gcccactgcccaccccctc

SEQ ID NO: 5758657 - DNA, 23 bp, Homo sapiens
gcccactgcccaccccctcaagc

SEQ ID NO: 5758658 - DNA, 13 bp, Homo sapiens
gcccactgcctcc

SEQ ID NO: 5758659 - DNA, 16 bp, Homo sapiens
gcccactgcctcctgc

SEQ ID NO: 5758660 - DNA, 22 bp, Homo sapiens
gcccactgctcgtggactgtgc

SEQ ID NO: 5758661 - DNA, 11 bp, Homo sapiens
gcccactgctg

SEQ ID NO: 5758662 - DNA, 13 bp, Homo sapiens
gcccactggatca

SEQ ID NO: 5758663 - DNA, 19 bp, Homo sapiens
gcccactggccagctctgg

SEQ ID NO: 5758664 - DNA, 17 bp, Homo sapiens
gcccactggccgctgag

SEQ ID NO: 5758665 - DNA, 20 bp, Homo sapiens
gcccactggccgctgagcgc

SEQ ID NO: 5758666 - DNA, 21 bp, Homo sapiens
gcccactggccgctgagcgcc

SEQ ID NO: 5758667 - DNA, 22 bp, Homo sapiens
gcccactggccgctgagcgccc

SEQ ID NO: 5758668 - DNA, 19 bp, Homo sapiens
gcccactgggccctggggc

SEQ ID NO: 5758669 - DNA, 13 bp, Homo sapiens
gcccactgtcctg

SEQ ID NO: 5758670 - DNA, 17 bp, Homo sapiens
gcccactgtcctgggcg

SEQ ID NO: 5758671 - DNA, 19 bp, Homo sapiens
gcccactgtcctgggcgcc

SEQ ID NO: 5758672 - DNA, 21 bp, Homo sapiens
gcccactgtcctgggcgccct

SEQ ID NO: 5758673 - DNA, 13 bp, Homo sapiens
gcccactgtgcag

SEQ ID NO: 5758674 - DNA, 16 bp, Homo sapiens
gcccactgtgcctcag

SEQ ID NO: 5758675 - DNA, 20 bp, Homo sapiens
gcccactgtgcctcagagac

SEQ ID NO: 5758676 - DNA, 19 bp, Homo sapiens
gcccacttacatttacaaa

SEQ ID NO: 5758677 - DNA, 20 bp, Homo sapiens
gcccacttaccctgggctgg

SEQ ID NO: 5758678 - DNA, 16 bp, Homo sapiens
gcccacttccctgggt

SEQ ID NO: 5758679 - DNA, 23 bp, Homo sapiens
gcccacttctccttcgctttcct

SEQ ID NO: 5758680 - DNA, 16 bp, Homo sapiens
gcccacttgaggctgg

SEQ ID NO: 5758681 - DNA, 22 bp, Homo sapiens
gcccacttgaggctggcactcc

SEQ ID NO: 5758682 - DNA, 20 bp, Homo sapiens
gcccacttgattgagaaaga

SEQ ID NO: 5758683 - DNA, 15 bp, Homo sapiens
gcccacttggggcct

SEQ ID NO: 5758684 - DNA, 16 bp, Homo sapiens
gcccactttcctgagc

SEQ ID NO: 5758685 - DNA, 18 bp, Homo sapiens
gcccagaaaaggacagaa

SEQ ID NO: 5758686 - DNA, 12 bp, Homo sapiens
gcccagaaagcc

SEQ ID NO: 5758687 - DNA, 22 bp, Homo sapiens
gcccagaaagctgcggattggg

SEQ ID NO: 5758688 - DNA, 16 bp, Homo sapiens
gcccagaaccacagat

SEQ ID NO: 5758689 - DNA, 17 bp, Homo sapiens
gcccagaacgggcctcc

SEQ ID NO: 5758690 - DNA, 20 bp, Homo sapiens
gcccagaacgggcctccccg

SEQ ID NO: 5758691 - DNA, 20 bp, Homo sapiens
gcccagaactgcccccactg

SEQ ID NO: 5758692 - DNA, 18 bp, Homo sapiens
gcccagaagaaaattctc

SEQ ID NO: 5758693 - DNA, 17 bp, Homo sapiens
gcccagaagggtagctg

SEQ ID NO: 5758694 - DNA, 16 bp, Homo sapiens
gcccagaataagttat

SEQ ID NO: 5758695 - DNA, 23 bp, Homo sapiens
gcccagaataagttattgcagtt

SEQ ID NO: 5758696 - DNA, 17 bp, Homo sapiens
gcccagaatactgatgg

SEQ ID NO: 5758697 - DNA, 16 bp, Homo sapiens
gcccagaatccccaag

SEQ ID NO: 5758698 - DNA, 23 bp, Homo sapiens
gcccagacagcaaggtgtggagg

SEQ ID NO: 5758699 - DNA, 18 bp, Homo sapiens
gcccagacccactctgcg

SEQ ID NO: 5758700 - DNA, 22 bp, Homo sapiens
gcccagacccagcccagcctga

SEQ ID NO: 5758701 - DNA, 23 bp, Homo sapiens
gcccagacccagcccgcggcctg

SEQ ID NO: 5758702 - DNA, 16 bp, Homo sapiens
gcccagacccccagtg

SEQ ID NO: 5758703 - DNA, 18 bp, Homo sapiens
gcccagaccctggaggaa

SEQ ID NO: 5758704 - DNA, 20 bp, Homo sapiens
gcccagaccggcttctcggc

SEQ ID NO: 5758705 - DNA, 23 bp, Homo sapiens
gcccagacctcccctcttcctgg

SEQ ID NO: 5758706 - DNA, 17 bp, Homo sapiens
gcccagacctggcctct

SEQ ID NO: 5758707 - DNA, 14 bp, Homo sapiens
gcccagactacagg

SEQ ID NO: 5758708 - DNA, 15 bp, Homo sapiens
gcccagactctgagc

SEQ ID NO: 5758709 - DNA, 22 bp, Homo sapiens
gcccagactgatgagcacatct

SEQ ID NO: 5758710 - DNA, 21 bp, Homo sapiens
gcccagacttgcggggggtgg

SEQ ID NO: 5758711 - DNA, 14 bp, Homo sapiens
gcccagactttagt

SEQ ID NO: 5758712 - DNA, 19 bp, Homo sapiens
gcccagactttagtgccct

SEQ ID NO: 5758713 - DNA, 13 bp, Homo sapiens
gcccagagaagcc

SEQ ID NO: 5758714 - DNA, 10 bp, Homo sapiens
gcccagagac

SEQ ID NO: 5758715 - DNA, 23 bp, Homo sapiens
gcccagagacatacttgaagggc

SEQ ID NO: 5758716 - DNA, 16 bp, Homo sapiens
gcccagagaccccttc

SEQ ID NO: 5758717 - DNA, 12 bp, Homo sapiens
gcccagagactt

SEQ ID NO: 5758718 - DNA, 22 bp, Homo sapiens
gcccagagagaagagccccact

SEQ ID NO: 5758719 - DNA, 23 bp, Homo sapiens
gcccagagagaagagccccactc

SEQ ID NO: 5758720 - DNA, 16 bp, Homo sapiens
gcccagagagaccctg

SEQ ID NO: 5758721 - DNA, 21 bp, Homo sapiens
gcccagagagaggcgtcctgg

SEQ ID NO: 5758722 - DNA, 22 bp, Homo sapiens
gcccagagagaggcgtcctggt

SEQ ID NO: 5758723 - DNA, 15 bp, Homo sapiens
gcccagagagggaag

SEQ ID NO: 5758724 - DNA, 21 bp, Homo sapiens
gcccagagagggtggtgacct

SEQ ID NO: 5758725 - DNA, 21 bp, Homo sapiens
gcccagagatgggactgggag

SEQ ID NO: 5758726 - DNA, 22 bp, Homo sapiens
gcccagagatgggactgggagg

SEQ ID NO: 5758727 - DNA, 18 bp, Homo sapiens
gcccagagcaggaagcat

SEQ ID NO: 5758728 - DNA, 16 bp, Homo sapiens
gcccagagcagggtct

SEQ ID NO: 5758729 - DNA, 12 bp, Homo sapiens
gcccagagccac

SEQ ID NO: 5758730 - DNA, 14 bp, Homo sapiens
gcccagagccacct

SEQ ID NO: 5758731 - DNA, 22 bp, Homo sapiens
gcccagagccatactgcgtcca

SEQ ID NO: 5758732 - DNA, 14 bp, Homo sapiens
gcccagagcccagc

SEQ ID NO: 5758733 - DNA, 15 bp, Homo sapiens
gcccagagcccagct

SEQ ID NO: 5758734 - DNA, 16 bp, Homo sapiens
gcccagagcccagctc

SEQ ID NO: 5758735 - DNA, 17 bp, Homo sapiens
gcccagagcccagctcc

SEQ ID NO: 5758736 - DNA, 14 bp, Homo sapiens
gcccagagcccggt

SEQ ID NO: 5758737 - DNA, 14 bp, Homo sapiens
gcccagagcccttg

SEQ ID NO: 5758738 - DNA, 19 bp, Homo sapiens
gcccagagcctctgctgga

SEQ ID NO: 5758739 - DNA, 13 bp, Homo sapiens
gcccagagcctgg

SEQ ID NO: 5758740 - DNA, 18 bp, Homo sapiens
gcccagagctgctggtct

SEQ ID NO: 5758741 - DNA, 15 bp, Homo sapiens
gcccagagctgggtg

SEQ ID NO: 5758742 - DNA, 21 bp, Homo sapiens
gcccagaggactcccaaccct

SEQ ID NO: 5758743 - DNA, 16 bp, Homo sapiens
gcccagaggagaggag

SEQ ID NO: 5758744 - DNA, 16 bp, Homo sapiens
gcccagaggagcccag

SEQ ID NO: 5758745 - DNA, 22 bp, Homo sapiens
gcccagaggagcccagcggccc

SEQ ID NO: 5758746 - DNA, 23 bp, Homo sapiens
gcccagaggagggcagcagaagg

SEQ ID NO: 5758747 - DNA, 21 bp, Homo sapiens
gcccagaggccaacactgtgg

SEQ ID NO: 5758748 - DNA, 12 bp, Homo sapiens
gcccagagggcc

SEQ ID NO: 5758749 - DNA, 15 bp, Homo sapiens
gcccagagggcccag

SEQ ID NO: 5758750 - DNA, 20 bp, Homo sapiens
gcccagagggcctgcaaggg

SEQ ID NO: 5758751 - DNA, 22 bp, Homo sapiens
gcccagaggggcggggccagga

SEQ ID NO: 5758752 - DNA, 18 bp, Homo sapiens
gcccagagggtctggggg

SEQ ID NO: 5758753 - DNA, 18 bp, Homo sapiens
gcccagagggtggcaaga

SEQ ID NO: 5758754 - DNA, 20 bp, Homo sapiens
gcccagagtatgggcactca

SEQ ID NO: 5758755 - DNA, 23 bp, Homo sapiens
gcccagagtccccccactcccag

SEQ ID NO: 5758756 - DNA, 20 bp, Homo sapiens
gcccagagtgagctttagct

SEQ ID NO: 5758757 - DNA, 19 bp, Homo sapiens
gcccagagttgctgtgccg

SEQ ID NO: 5758758 - DNA, 17 bp, Homo sapiens
gcccagataaggcttta

SEQ ID NO: 5758759 - DNA, 12 bp, Homo sapiens
gcccagatagag

SEQ ID NO: 5758760 - DNA, 16 bp, Homo sapiens
gcccagatcagccaga

SEQ ID NO: 5758761 - DNA, 18 bp, Homo sapiens
gcccagatcagccagaag

SEQ ID NO: 5758762 - DNA, 16 bp, Homo sapiens
gcccagatcatgccgc

SEQ ID NO: 5758763 - DNA, 15 bp, Homo sapiens
gcccagatcccagaa

SEQ ID NO: 5758764 - DNA, 22 bp, Homo sapiens
gcccagatggctccctgggctg

SEQ ID NO: 5758765 - DNA, 22 bp, Homo sapiens
gcccagattatgagacacagga

SEQ ID NO: 5758766 - DNA, 23 bp, Homo sapiens
gcccagattcccagaccttaaga

SEQ ID NO: 5758767 - DNA, 18 bp, Homo sapiens
gcccagattgtgccactg

SEQ ID NO: 5758768 - DNA, 22 bp, Homo sapiens
gcccagcacaacccccaggaaa

SEQ ID NO: 5758769 - DNA, 17 bp, Homo sapiens
gcccagcacaggtattt

SEQ ID NO: 5758770 - DNA, 18 bp, Homo sapiens
gcccaggaagcccacact

SEQ ID NO: 5758771 - DNA, 18 bp, Homo sapiens
gcccaggaaggcctaggc

SEQ ID NO: 5758772 - DNA, 20 bp, Homo sapiens
gcccaggaaggcggcaggca

SEQ ID NO: 5758773 - DNA, 19 bp, Homo sapiens
gcccaggaattagagaagc

SEQ ID NO: 5758774 - DNA, 16 bp, Homo sapiens
gcccaggacactgcct

SEQ ID NO: 5758775 - DNA, 21 bp, Homo sapiens
gcccaggacactgcctttgct

SEQ ID NO: 5758776 - DNA, 17 bp, Homo sapiens
gcccaggaccagctggg

SEQ ID NO: 5758777 - DNA, 18 bp, Homo sapiens
gcccaggaccagctgggg

SEQ ID NO: 5758778 - DNA, 19 bp, Homo sapiens
gcccaggaccagctggggc

SEQ ID NO: 5758779 - DNA, 21 bp, Homo sapiens
gcccaggaccccatggcagtg

SEQ ID NO: 5758780 - DNA, 19 bp, Homo sapiens
gcccaggacggggccggcc

SEQ ID NO: 5758781 - DNA, 21 bp, Homo sapiens
gcccaggacggggccggccag

SEQ ID NO: 5758782 - DNA, 10 bp, Homo sapiens
gcccaggaga

SEQ ID NO: 5758783 - DNA, 12 bp, Homo sapiens
gcccaggagaat

SEQ ID NO: 5758784 - DNA, 17 bp, Homo sapiens
gcccaggagaatgctgc

SEQ ID NO: 5758785 - DNA, 11 bp, Homo sapiens
gcccaggagac

SEQ ID NO: 5758786 - DNA, 21 bp, Homo sapiens
gcccaggagaccacggggagc

SEQ ID NO: 5758787 - DNA, 12 bp, Homo sapiens
gcccaggagaga

SEQ ID NO: 5758788 - DNA, 16 bp, Homo sapiens
gcccaggagagagaaa

SEQ ID NO: 5758789 - DNA, 22 bp, Homo sapiens
gcccaggagagagaaagccagg

SEQ ID NO: 5758790 - DNA, 16 bp, Homo sapiens
gcccaggagagagcta

SEQ ID NO: 5758791 - DNA, 18 bp, Homo sapiens
gcccaggagagccagccc

SEQ ID NO: 5758792 - DNA, 19 bp, Homo sapiens
gcccaggagagccagccct

SEQ ID NO: 5758793 - DNA, 20 bp, Homo sapiens
gcccaggagagccagccctc

SEQ ID NO: 5758794 - DNA, 18 bp, Homo sapiens
gcccaggagcaacagcct

SEQ ID NO: 5758795 - DNA, 18 bp, Homo sapiens
gcccaggagcaagtgagg

SEQ ID NO: 5758796 - DNA, 14 bp, Homo sapiens
gcccaggagcccat

SEQ ID NO: 5758797 - DNA, 15 bp, Homo sapiens
gcccaggagcctcac

SEQ ID NO: 5758798 - DNA, 18 bp, Homo sapiens
gcccaggagcctcactgg

SEQ ID NO: 5758799 - DNA, 14 bp, Homo sapiens
gcccaggagctccc

SEQ ID NO: 5758800 - DNA, 21 bp, Homo sapiens
gcccaggagctcccctcccca

SEQ ID NO: 5758801 - DNA, 24 bp, Homo sapiens
gcccaggagctcccctccccaact

SEQ ID NO: 5758802 - DNA, 16 bp, Homo sapiens
gcccaggagctctgcg

SEQ ID NO: 5758803 - DNA, 21 bp, Homo sapiens
gcccaggagctctgcgccagg

SEQ ID NO: 5758804 - DNA, 20 bp, Homo sapiens
gcccaggagctgagtcacct

SEQ ID NO: 5758805 - DNA, 22 bp, Homo sapiens
gcccaggagctgagtcacctcc

SEQ ID NO: 5758806 - DNA, 20 bp, Homo sapiens
gcccaggaggaccgcctgcc

SEQ ID NO: 5758807 - DNA, 13 bp, Homo sapiens
gcccaggagggag

SEQ ID NO: 5758808 - DNA, 20 bp, Homo sapiens
gcccaggagggcatccatac

SEQ ID NO: 5758809 - DNA, 20 bp, Homo sapiens
gcccaggagtttgaggctgc

SEQ ID NO: 5758810 - DNA, 20 bp, Homo sapiens
gcccaggagtttggccagaa

SEQ ID NO: 5758811 - DNA, 20 bp, Homo sapiens
gcccaggatactggcacaga

SEQ ID NO: 5758812 - DNA, 24 bp, Homo sapiens
gcccaggatatttctgagagtgaa

SEQ ID NO: 5758813 - DNA, 14 bp, Homo sapiens
gcccaggatgctgc

SEQ ID NO: 5758814 - DNA, 15 bp, Homo sapiens
gcccaggatggcttt

SEQ ID NO: 5758815 - DNA, 17 bp, Homo sapiens
gcccaggcaaggaacag

SEQ ID NO: 5758816 - DNA, 18 bp, Homo sapiens
gcccaggcaaggaacaga

SEQ ID NO: 5758817 - DNA, 17 bp, Homo sapiens
gcccaggcacaacttca

SEQ ID NO: 5758818 - DNA, 22 bp, Homo sapiens
gcccaggcacaacttcagcagg

SEQ ID NO: 5758819 - DNA, 18 bp, Homo sapiens
gcccaggcaccaccagga

SEQ ID NO: 5758820 - DNA, 22 bp, Homo sapiens
gcccaggcagagagcgaccagc

SEQ ID NO: 5758821 - DNA, 20 bp, Homo sapiens
gcccaggcagcacctggagc

SEQ ID NO: 5758822 - DNA, 14 bp, Homo sapiens
gcccaggcagcctc

SEQ ID NO: 5758823 - DNA, 15 bp, Homo sapiens
gcccaggcagcctca

SEQ ID NO: 5758824 - DNA, 16 bp, Homo sapiens
gcccaggcagcctcaa

SEQ ID NO: 5758825 - DNA, 19 bp, Homo sapiens
gcccaggcagcctcaaggc

SEQ ID NO: 5758826 - DNA, 14 bp, Homo sapiens
gcccaggcaggccc

SEQ ID NO: 5758827 - DNA, 21 bp, Homo sapiens
gcccaggcaggcccagcctct

SEQ ID NO: 5758828 - DNA, 14 bp, Homo sapiens
gcccaggcaggtct

SEQ ID NO: 5758829 - DNA, 19 bp, Homo sapiens
gcccaggcaggtctgcaag

SEQ ID NO: 5758830 - DNA, 16 bp, Homo sapiens
gcccaggcaggtcttg

SEQ ID NO: 5758831 - DNA, 17 bp, Homo sapiens
gcccaggccacagagaa

SEQ ID NO: 5758832 - DNA, 16 bp, Homo sapiens
gcccaggccacagccg

SEQ ID NO: 5758833 - DNA, 14 bp, Homo sapiens
gcccaggccagccc

SEQ ID NO: 5758834 - DNA, 21 bp, Homo sapiens
gcccaggccagcccccccacc

SEQ ID NO: 5758835 - DNA, 16 bp, Homo sapiens
gcccaggccaggactc

SEQ ID NO: 5758836 - DNA, 19 bp, Homo sapiens
gcccaggccaggtgcccag

SEQ ID NO: 5758837 - DNA, 16 bp, Homo sapiens
gcccaggccagtgctg

SEQ ID NO: 5758838 - DNA, 18 bp, Homo sapiens
gcccaggccatcttccag

SEQ ID NO: 5758839 - DNA, 22 bp, Homo sapiens
gcccaggccatcttccaggtgg

SEQ ID NO: 5758840 - DNA, 22 bp, Homo sapiens
gcccaggccatgtggcctgccc

SEQ ID NO: 5758841 - DNA, 14 bp, Homo sapiens
gcccaggcccagcc

SEQ ID NO: 5758842 - DNA, 18 bp, Homo sapiens
gcccaggcccagcctctt

SEQ ID NO: 5758843 - DNA, 23 bp, Homo sapiens
gcccaggcccccggctttcctcc

SEQ ID NO: 5758844 - DNA, 18 bp, Homo sapiens
gcccaggcccctgccacc

SEQ ID NO: 5758845 - DNA, 22 bp, Homo sapiens
gcccaggcccctgccaccctgg

SEQ ID NO: 5758846 - DNA, 13 bp, Homo sapiens
gcccaggcccgga

SEQ ID NO: 5758847 - DNA, 22 bp, Homo sapiens
gcccaggcccggatgcagaggc

SEQ ID NO: 5758848 - DNA, 14 bp, Homo sapiens
gcccaggcccttgg

SEQ ID NO: 5758849 - DNA, 20 bp, Homo sapiens
gcccaggcccttggctgcag

SEQ ID NO: 5758850 - DNA, 15 bp, Homo sapiens
gcccaggccggccag

SEQ ID NO: 5758851 - DNA, 19 bp, Homo sapiens
gcccaggccggggctggag

SEQ ID NO: 5758852 - DNA, 23 bp, Homo sapiens
gcccaggccgttccccttggctt

SEQ ID NO: 5758853 - DNA, 15 bp, Homo sapiens
gcccaggcctcacca

SEQ ID NO: 5758854 - DNA, 17 bp, Homo sapiens
gcccaggcctcaccacc

SEQ ID NO: 5758855 - DNA, 18 bp, Homo sapiens
gcccaggcctcaccacct

SEQ ID NO: 5758856 - DNA, 18 bp, Homo sapiens
gcccaggcctccagctca

SEQ ID NO: 5758857 - DNA, 13 bp, Homo sapiens
gcccaggcctcct

SEQ ID NO: 5758858 - DNA, 17 bp, Homo sapiens
gcccaggcctgcctgtt

SEQ ID NO: 5758859 - DNA, 15 bp, Homo sapiens
gcccaggcctgctgg

SEQ ID NO: 5758860 - DNA, 18 bp, Homo sapiens
gcccaggcctgctggcat

SEQ ID NO: 5758861 - DNA, 20 bp, Homo sapiens
gcccaggcctgctggcatca

SEQ ID NO: 5758862 - DNA, 13 bp, Homo sapiens
gcccaggcctggt

SEQ ID NO: 5758863 - DNA, 20 bp, Homo sapiens
gcccaggctagagtgcagtg

SEQ ID NO: 5758864 - DNA, 12 bp, Homo sapiens
gcccaggctccc

SEQ ID NO: 5758865 - DNA, 21 bp, Homo sapiens
gcccaggctcccctgcccgcc

SEQ ID NO: 5758866 - DNA, 16 bp, Homo sapiens
gcccaggctctgctga

SEQ ID NO: 5758867 - DNA, 17 bp, Homo sapiens
gcccaggctctgctgac

SEQ ID NO: 5758868 - DNA, 15 bp, Homo sapiens
gcccaggctctggga

SEQ ID NO: 5758869 - DNA, 16 bp, Homo sapiens
gcccaggctctgggaa

SEQ ID NO: 5758870 - DNA, 13 bp, Homo sapiens
gcccaggctgaag

SEQ ID NO: 5758871 - DNA, 15 bp, Homo sapiens
gcccaggctgaagag

SEQ ID NO: 5758872 - DNA, 12 bp, Homo sapiens
gcccaggctgga

SEQ ID NO: 5758873 - DNA, 17 bp, Homo sapiens
gcccaggctggactgca

SEQ ID NO: 5758874 - DNA, 22 bp, Homo sapiens
gcccaggctggactgcagtggc

SEQ ID NO: 5758875 - DNA, 14 bp, Homo sapiens
gcccaggctggaga

SEQ ID NO: 5758876 - DNA, 19 bp, Homo sapiens
gcccaggctggagctggcc

SEQ ID NO: 5758877 - DNA, 19 bp, Homo sapiens
gcccaggctggagggcagt

SEQ ID NO: 5758878 - DNA, 20 bp, Homo sapiens
gcccaggctggagtgcaatg

SEQ ID NO: 5758879 - DNA, 20 bp, Homo sapiens
gcccaggctggagtgcagtg

SEQ ID NO: 5758880 - DNA, 20 bp, Homo sapiens
gcccaggctggagtgtagtg

SEQ ID NO: 5758881 - DNA, 18 bp, Homo sapiens
gcccaggctggccagccc

SEQ ID NO: 5758882 - DNA, 20 bp, Homo sapiens
gcccaggctggccagcccca

SEQ ID NO: 5758883 - DNA, 23 bp, Homo sapiens
gcccaggctggccagccccacag

SEQ ID NO: 5758884 - DNA, 14 bp, Homo sapiens
gcccaggctggccc

SEQ ID NO: 5758885 - DNA, 19 bp, Homo sapiens
gcccaggctggcccccacc

SEQ ID NO: 5758886 - DNA, 15 bp, Homo sapiens
gcccaggctggcgtg

SEQ ID NO: 5758887 - DNA, 12 bp, Homo sapiens
gcccaggctggt

SEQ ID NO: 5758888 - DNA, 14 bp, Homo sapiens
gcccaggctggtct

SEQ ID NO: 5758889 - DNA, 16 bp, Homo sapiens
gcccaggctggtcttg

SEQ ID NO: 5758890 - DNA, 22 bp, Homo sapiens
gcccaggctgtgcagcgcagct

SEQ ID NO: 5758891 - DNA, 19 bp, Homo sapiens
gcccaggcttcctgggtcc

SEQ ID NO: 5758892 - DNA, 20 bp, Homo sapiens
gcccaggcttcctgggtcct

SEQ ID NO: 5758893 - DNA, 14 bp, Homo sapiens
gcccaggcttctca

SEQ ID NO: 5758894 - DNA, 19 bp, Homo sapiens
gcccagggaagacacatga

SEQ ID NO: 5758895 - DNA, 15 bp, Homo sapiens
gcccagggaagcctg

SEQ ID NO: 5758896 - DNA, 17 bp, Homo sapiens
gcccagggaagcctggg

SEQ ID NO: 5758897 - DNA, 19 bp, Homo sapiens
gcccagggaagcctgggtg

SEQ ID NO: 5758898 - DNA, 14 bp, Homo sapiens
gcccagggaataag

SEQ ID NO: 5758899 - DNA, 21 bp, Homo sapiens
gcccagggacaccagccaggc

SEQ ID NO: 5758900 - DNA, 18 bp, Homo sapiens
gcccagggagaggccatg

SEQ ID NO: 5758901 - DNA, 17 bp, Homo sapiens
gcccagggagcggaaag

SEQ ID NO: 5758902 - DNA, 23 bp, Homo sapiens
gcccagggaggcagcgtgggctc

SEQ ID NO: 5758903 - DNA, 17 bp, Homo sapiens
gcccagggagggaagtg

SEQ ID NO: 5758904 - DNA, 16 bp, Homo sapiens
gcccagggaggtggca

SEQ ID NO: 5758905 - DNA, 20 bp, Homo sapiens
gcccagggaggtggcaggga

SEQ ID NO: 5758906 - DNA, 16 bp, Homo sapiens
gcccagggagtccttg

SEQ ID NO: 5758907 - DNA, 18 bp, Homo sapiens
gcccagggcaagctccgc

SEQ ID NO: 5758908 - DNA, 23 bp, Homo sapiens
gcccagggcaagctccgcaggac

SEQ ID NO: 5758909 - DNA, 15 bp, Homo sapiens
gcccagggcatctgg

SEQ ID NO: 5758910 - DNA, 18 bp, Homo sapiens
gcccagggcatcttgctg

SEQ ID NO: 5758911 - DNA, 15 bp, Homo sapiens
gcccagggccactct

SEQ ID NO: 5758912 - DNA, 18 bp, Homo sapiens
gcccagggccactctgcc

SEQ ID NO: 5758913 - DNA, 19 bp, Homo sapiens
gcccagggccactctgcct

SEQ ID NO: 5758914 - DNA, 16 bp, Homo sapiens
gcccagggcccagagc

SEQ ID NO: 5758915 - DNA, 18 bp, Homo sapiens
gcccagggcccagagccc

SEQ ID NO: 5758916 - DNA, 17 bp, Homo sapiens
gcccagggcctctggct

SEQ ID NO: 5758917 - DNA, 17 bp, Homo sapiens
gcccagggcctgaaacc

SEQ ID NO: 5758918 - DNA, 13 bp, Homo sapiens
gcccagggctcag

SEQ ID NO: 5758919 - DNA, 17 bp, Homo sapiens
gcccagggctcagcctg

SEQ ID NO: 5758920 - DNA, 12 bp, Homo sapiens
gcccagggctcc

SEQ ID NO: 5758921 - DNA, 14 bp, Homo sapiens
gcccagggctcctg

SEQ ID NO: 5758922 - DNA, 16 bp, Homo sapiens
gcccagggctcctgca

SEQ ID NO: 5758923 - DNA, 18 bp, Homo sapiens
gcccaggggacgtggcgc

SEQ ID NO: 5758924 - DNA, 20 bp, Homo sapiens
gcccaggggagaatgcagcc

SEQ ID NO: 5758925 - DNA, 23 bp, Homo sapiens
gcccaggggagaatgcagcccac

SEQ ID NO: 5758926 - DNA, 16 bp, Homo sapiens
gcccaggggagccctc

SEQ ID NO: 5758927 - DNA, 20 bp, Homo sapiens
gcccaggggagcgtgttcct

SEQ ID NO: 5758928 - DNA, 18 bp, Homo sapiens
gcccaggggaggcacaaa

SEQ ID NO: 5758929 - DNA, 22 bp, Homo sapiens
gcccaggggaggcggcactcca

SEQ ID NO: 5758930 - DNA, 23 bp, Homo sapiens
gcccaggggctgtggccgtctcc

SEQ ID NO: 5758931 - DNA, 18 bp, Homo sapiens
gcccagggggcctggagc

SEQ ID NO: 5758932 - DNA, 18 bp, Homo sapiens
gcccaggggtgccccctc

SEQ ID NO: 5758933 - DNA, 23 bp, Homo sapiens
gcccaggggtggggcccatgggg

SEQ ID NO: 5758934 - DNA, 15 bp, Homo sapiens
gcccagggtcctgtg

SEQ ID NO: 5758935 - DNA, 17 bp, Homo sapiens
gcccagggtcctgtgcc

SEQ ID NO: 5758936 - DNA, 18 bp, Homo sapiens
gcccagggtcctgtgcct

SEQ ID NO: 5758937 - DNA, 18 bp, Homo sapiens
gcccagggtgctgggatg

SEQ ID NO: 5758938 - DNA, 15 bp, Homo sapiens
gcccagggtggccac

SEQ ID NO: 5758939 - DNA, 19 bp, Homo sapiens
gcccagggtggctgccagc

SEQ ID NO: 5758940 - DNA, 21 bp, Homo sapiens
gcccagggtggctgccagccc

SEQ ID NO: 5758941 - DNA, 16 bp, Homo sapiens
gcccagggttccccca

SEQ ID NO: 5758942 - DNA, 17 bp, Homo sapiens
gcccagggttcccccag

SEQ ID NO: 5758943 - DNA, 18 bp, Homo sapiens
gcccaggtatcctggggg

SEQ ID NO: 5758944 - DNA, 20 bp, Homo sapiens
gcccaggtatcctgggggaa

SEQ ID NO: 5758945 - DNA, 16 bp, Homo sapiens
gcccaggtcccagtgc

SEQ ID NO: 5758946 - DNA, 19 bp, Homo sapiens
gccccaaacaaatatgcaa

SEQ ID NO: 5758947 - DNA, 14 bp, Homo sapiens
gccccaaaccaggg

SEQ ID NO: 5758948 - DNA, 16 bp, Homo sapiens
gccccaaagcccagcc

SEQ ID NO: 5758949 - DNA, 17 bp, Homo sapiens
gccccaaagcccagccc

SEQ ID NO: 5758950 - DNA, 15 bp, Homo sapiens
gccccaaaggaagct

SEQ ID NO: 5758951 - DNA, 20 bp, Homo sapiens
gccccaaataacttcagtcc

SEQ ID NO: 5758952 - DNA, 21 bp, Homo sapiens
gccccaaatatagcgttccca

SEQ ID NO: 5758953 - DNA, 17 bp, Homo sapiens
gccccaacccgtggagg

SEQ ID NO: 5758954 - DNA, 16 bp, Homo sapiens
gccccaacccttcttc

SEQ ID NO: 5758955 - DNA, 13 bp, Homo sapiens
gccccaacctgct

SEQ ID NO: 5758956 - DNA, 14 bp, Homo sapiens
gccccaacctgctg

SEQ ID NO: 5758957 - DNA, 18 bp, Homo sapiens
gccccaactcctggaagc

SEQ ID NO: 5758958 - DNA, 14 bp, Homo sapiens
gccccaactccttc

SEQ ID NO: 5758959 - DNA, 20 bp, Homo sapiens
gccccaactccttccagcta

SEQ ID NO: 5758960 - DNA, 21 bp, Homo sapiens
gccccaactcgggctcccggg

SEQ ID NO: 5758961 - DNA, 21 bp, Homo sapiens
gccccaactctcccctgacct

SEQ ID NO: 5758962 - DNA, 21 bp, Homo sapiens
gccccaagaaggctggggcta

SEQ ID NO: 5758963 - DNA, 17 bp, Homo sapiens
gccccaagactctgctc

SEQ ID NO: 5758964 - DNA, 18 bp, Homo sapiens
gccccaagactctgctct

SEQ ID NO: 5758965 - DNA, 20 bp, Homo sapiens
gccccaagactctgctctcc

SEQ ID NO: 5758966 - DNA, 22 bp, Homo sapiens
gccccaagactctgctctcctc

SEQ ID NO: 5758967 - DNA, 23 bp, Homo sapiens
gccccaagagcaggaggtgcctg

SEQ ID NO: 5758968 - DNA, 13 bp, Homo sapiens
gccccaagagccc

SEQ ID NO: 5758969 - DNA, 13 bp, Homo sapiens
gccccaagaggct

SEQ ID NO: 5758970 - DNA, 18 bp, Homo sapiens
gccccaagaggctagccc

SEQ ID NO: 5758971 - DNA, 23 bp, Homo sapiens
gccccaagaggctagccccaggg

SEQ ID NO: 5758972 - DNA, 19 bp, Homo sapiens
gccccaagataggggcaca

SEQ ID NO: 5758973 - DNA, 20 bp, Homo sapiens
gccccaagataggggcacac

SEQ ID NO: 5758974 - DNA, 13 bp, Homo sapiens
gccccaagcagcc

SEQ ID NO: 5758975 - DNA, 15 bp, Homo sapiens
gccccaagcagccag

SEQ ID NO: 5758976 - DNA, 17 bp, Homo sapiens
gccccaagcagccagcc

SEQ ID NO: 5758977 - DNA, 21 bp, Homo sapiens
gccccaagcagccagccagtc

SEQ ID NO: 5758978 - DNA, 23 bp, Homo sapiens
gccccaagcagccagccagtctt

SEQ ID NO: 5758979 - DNA, 19 bp, Homo sapiens
gccccaaggccccagggac

SEQ ID NO: 5758980 - DNA, 13 bp, Homo sapiens
gccccaagggctg

SEQ ID NO: 5758981 - DNA, 15 bp, Homo sapiens
gccccaagggctggg

SEQ ID NO: 5758982 - DNA, 17 bp, Homo sapiens
gccccaaggggcccaca

SEQ ID NO: 5758983 - DNA, 22 bp, Homo sapiens
gccccaaggggtttctgtttct

SEQ ID NO: 5758984 - DNA, 19 bp, Homo sapiens
gccccaaggttccagaggc

SEQ ID NO: 5758985 - DNA, 14 bp, Homo sapiens
gccccaagtcctca

SEQ ID NO: 5758986 - DNA, 13 bp, Homo sapiens
gccccaagtcctg

SEQ ID NO: 5758987 - DNA, 16 bp, Homo sapiens
gccccaagtcctgaag

SEQ ID NO: 5758988 - DNA, 19 bp, Homo sapiens
gccccaagtcctgaagagg

SEQ ID NO: 5758989 - DNA, 21 bp, Homo sapiens
gccccaatatggtggccctgg

SEQ ID NO: 5758990 - DNA, 23 bp, Homo sapiens
gccccaatccagagaagcgctgt

SEQ ID NO: 5758991 - DNA, 21 bp, Homo sapiens
gccccaatcgggtccagagac

SEQ ID NO: 5758992 - DNA, 18 bp, Homo sapiens
gccccaatcttgcccact

SEQ ID NO: 5758993 - DNA, 13 bp, Homo sapiens
gccccaattttct

SEQ ID NO: 5758994 - DNA, 22 bp, Homo sapiens
gccccacaaaacttcagtgtgg

SEQ ID NO: 5758995 - DNA, 17 bp, Homo sapiens
gccccacaaggcccagc

SEQ ID NO: 5758996 - DNA, 21 bp, Homo sapiens
gccccacaaggcccagccctg

SEQ ID NO: 5758997 - DNA, 14 bp, Homo sapiens
gccccacaaggcct

SEQ ID NO: 5758998 - DNA, 17 bp, Homo sapiens
gccccacacaggcctgg

SEQ ID NO: 5758999 - DNA, 15 bp, Homo sapiens
gccccacaccagccc

SEQ ID NO: 5759000 - DNA, 15 bp, Homo sapiens
gccccacacccagcc

SEQ ID NO: 5759001 - DNA, 20 bp, Homo sapiens
gccccacacggaggcatctg

SEQ ID NO: 5759002 - DNA, 12 bp, Homo sapiens
gccccacactcc

SEQ ID NO: 5759003 - DNA, 14 bp, Homo sapiens
gccccacactcccc

SEQ ID NO: 5759004 - DNA, 19 bp, Homo sapiens
gccccacactggggtgccg

SEQ ID NO: 5759005 - DNA, 23 bp, Homo sapiens
gccccacactggggtgccgcctg

SEQ ID NO: 5759006 - DNA, 10 bp, Homo sapiens
gccccacagc

SEQ ID NO: 5759007 - DNA, 12 bp, Homo sapiens
gccccacagcac

SEQ ID NO: 5759008 - DNA, 11 bp, Homo sapiens
gccccacagcc

SEQ ID NO: 5759009 - DNA, 13 bp, Homo sapiens
gccccacagccca

SEQ ID NO: 5759010 - DNA, 18 bp, Homo sapiens
gccccacagccccatctg

SEQ ID NO: 5759011 - DNA, 15 bp, Homo sapiens
gccccacagccctgc

SEQ ID NO: 5759012 - DNA, 20 bp, Homo sapiens
gccccacagctacctgagac

SEQ ID NO: 5759013 - DNA, 13 bp, Homo sapiens
gccccacaggact

SEQ ID NO: 5759014 - DNA, 23 bp, Homo sapiens
gccccacaggagttgtgagccct

SEQ ID NO: 5759015 - DNA, 19 bp, Homo sapiens
gccccacaggccacacgct

SEQ ID NO: 5759016 - DNA, 14 bp, Homo sapiens
gccccacagttgtg

SEQ ID NO: 5759017 - DNA, 17 bp, Homo sapiens
gccccacatccccacct

SEQ ID NO: 5759018 - DNA, 13 bp, Homo sapiens
gccccacatgcat

SEQ ID NO: 5759019 - DNA, 23 bp, Homo sapiens
gccccaccacctaggccactcct

SEQ ID NO: 5759020 - DNA, 21 bp, Homo sapiens
gccccaccacgcatgctcagt

SEQ ID NO: 5759021 - DNA, 21 bp, Homo sapiens
gccccaccagccacagcctcc

SEQ ID NO: 5759022 - DNA, 17 bp, Homo sapiens
gccccaccagccacctc

SEQ ID NO: 5759023 - DNA, 18 bp, Homo sapiens
gccccaccagccacctct

SEQ ID NO: 5759024 - DNA, 13 bp, Homo sapiens
gccccaccagtgc

SEQ ID NO: 5759025 - DNA, 14 bp, Homo sapiens
gccccaccagtgcc

SEQ ID NO: 5759026 - DNA, 17 bp, Homo sapiens
gccccaccagtgcctct

SEQ ID NO: 5759027 - DNA, 13 bp, Homo sapiens
gccccacccaagc

SEQ ID NO: 5759028 - DNA, 16 bp, Homo sapiens
gccccacccaagccca

SEQ ID NO: 5759029 - DNA, 20 bp, Homo sapiens
gccccacccaagcccaaact

SEQ ID NO: 5759030 - DNA, 18 bp, Homo sapiens
gccccacccacccctcct

SEQ ID NO: 5759031 - DNA, 15 bp, Homo sapiens
gccccacccagaggt

SEQ ID NO: 5759032 - DNA, 22 bp, Homo sapiens
gccccacccagatgggggaaag

SEQ ID NO: 5759033 - DNA, 12 bp, Homo sapiens
gccccacccagg

SEQ ID NO: 5759034 - DNA, 16 bp, Homo sapiens
gccccaccccacctcc

SEQ ID NO: 5759035 - DNA, 17 bp, Homo sapiens
gccccaccccacctcca

SEQ ID NO: 5759036 - DNA, 17 bp, Homo sapiens
gccccaccccagggcag

SEQ ID NO: 5759037 - DNA, 19 bp, Homo sapiens
gccccaccccagggcagcc

SEQ ID NO: 5759038 - DNA, 20 bp, Homo sapiens
gccccaccccagggcagcca

SEQ ID NO: 5759039 - DNA, 21 bp, Homo sapiens
gccccaccccagggcagccag

SEQ ID NO: 5759040 - DNA, 21 bp, Homo sapiens
gccccaccccatccagccaga

SEQ ID NO: 5759041 - DNA, 13 bp, Homo sapiens
gccccacccccag

SEQ ID NO: 5759042 - DNA, 15 bp, Homo sapiens
gccccacccccagcc

SEQ ID NO: 5759043 - DNA, 16 bp, Homo sapiens
gccccacccccagcca

SEQ ID NO: 5759044 - DNA, 17 bp, Homo sapiens
gccccacccccagccag

SEQ ID NO: 5759045 - DNA, 18 bp, Homo sapiens
gccccacccccagccagg

SEQ ID NO: 5759046 - DNA, 17 bp, Homo sapiens
gccccacccccctcctc

SEQ ID NO: 5759047 - DNA, 20 bp, Homo sapiens
gccccacccccctcctcccc

SEQ ID NO: 5759048 - DNA, 21 bp, Homo sapiens
gccccacccccctcctccccc

SEQ ID NO: 5759049 - DNA, 16 bp, Homo sapiens
gccccaccccctgggc

SEQ ID NO: 5759050 - DNA, 17 bp, Homo sapiens
gccccaccccctgggca

SEQ ID NO: 5759051 - DNA, 20 bp, Homo sapiens
gccccaccccctgggcagat

SEQ ID NO: 5759052 - DNA, 22 bp, Homo sapiens
gccccaccccctgggcagatgt

SEQ ID NO: 5759053 - DNA, 15 bp, Homo sapiens
gccccacccctccat

SEQ ID NO: 5759054 - DNA, 15 bp, Homo sapiens
gccccacccctgtaa

SEQ ID NO: 5759055 - DNA, 15 bp, Homo sapiens
gccccaccctcagat

SEQ ID NO: 5759056 - DNA, 22 bp, Homo sapiens
gccccaccctccttgagactgg

SEQ ID NO: 5759057 - DNA, 12 bp, Homo sapiens
gccccaccctcg

SEQ ID NO: 5759058 - DNA, 12 bp, Homo sapiens
gccccaccctgg

SEQ ID NO: 5759059 - DNA, 14 bp, Homo sapiens
gccccaccctgggc

SEQ ID NO: 5759060 - DNA, 17 bp, Homo sapiens
gccccaccgccgtggag

SEQ ID NO: 5759061 - DNA, 21 bp, Homo sapiens
gccccaccggcgcgctcttcg

SEQ ID NO: 5759062 - DNA, 17 bp, Homo sapiens
gccccacctacttgtga

SEQ ID NO: 5759063 - DNA, 23 bp, Homo sapiens
gccccacctacttgtgactgaag

SEQ ID NO: 5759064 - DNA, 11 bp, Homo sapiens
gccccacctcc

SEQ ID NO: 5759065 - DNA, 19 bp, Homo sapiens
gccccacctccacctgtga

SEQ ID NO: 5759066 - DNA, 21 bp, Homo sapiens
gccccacctccacctgtgaga

SEQ ID NO: 5759067 - DNA, 14 bp, Homo sapiens
gccccacctcccca

SEQ ID NO: 5759068 - DNA, 15 bp, Homo sapiens
gccccacctccccac

SEQ ID NO: 5759069 - DNA, 23 bp, Homo sapiens
gccccacctccccacacacaggc

SEQ ID NO: 5759070 - DNA, 18 bp, Homo sapiens
gccccacctccccagagc

SEQ ID NO: 5759071 - DNA, 19 bp, Homo sapiens
gccccacctccccagagcc

SEQ ID NO: 5759072 - DNA, 23 bp, Homo sapiens
gccccacctccccagagccctgc

SEQ ID NO: 5759073 - DNA, 19 bp, Homo sapiens
gccccacctcccccttccc

SEQ ID NO: 5759074 - DNA, 21 bp, Homo sapiens
gccccacctcccccttcccct

SEQ ID NO: 5759075 - DNA, 18 bp, Homo sapiens
gccccacctcccgccctc

SEQ ID NO: 5759076 - DNA, 15 bp, Homo sapiens
gccccacctcggcac

SEQ ID NO: 5759077 - DNA, 16 bp, Homo sapiens
gccccacctgcagctc

SEQ ID NO: 5759078 - DNA, 14 bp, Homo sapiens
gccccacctgccac

SEQ ID NO: 5759079 - DNA, 23 bp, Homo sapiens
gccccacctgccactaggctggg

SEQ ID NO: 5759080 - DNA, 13 bp, Homo sapiens
gccccacctgcct

SEQ ID NO: 5759081 - DNA, 14 bp, Homo sapiens
gccccacctgcctg

SEQ ID NO: 5759082 - DNA, 19 bp, Homo sapiens
gccccaccttgccagggca

SEQ ID NO: 5759083 - DNA, 22 bp, Homo sapiens
gccccaccttgccagggcaggg

SEQ ID NO: 5759084 - DNA, 17 bp, Homo sapiens
gccccaccttgtctgct

SEQ ID NO: 5759085 - DNA, 15 bp, Homo sapiens
gccccacctttatta

SEQ ID NO: 5759086 - DNA, 21 bp, Homo sapiens
gccccacctttattaaaatct

SEQ ID NO: 5759087 - DNA, 19 bp, Homo sapiens
gccccacgccctctcctcc

SEQ ID NO: 5759088 - DNA, 20 bp, Homo sapiens
gccccacggagacagaggaa

SEQ ID NO: 5759089 - DNA, 16 bp, Homo sapiens
gccccacgtccctgcg

SEQ ID NO: 5759090 - DNA, 10 bp, Homo sapiens
gccccactcc

SEQ ID NO: 5759091 - DNA, 15 bp, Homo sapiens
gccccactccagcct

SEQ ID NO: 5759092 - DNA, 18 bp, Homo sapiens
gccccactccagcctggg

SEQ ID NO: 5759093 - DNA, 19 bp, Homo sapiens
gccccactcctctccacca

SEQ ID NO: 5759094 - DNA, 20 bp, Homo sapiens
gccccactcctctgctgacc

SEQ ID NO: 5759095 - DNA, 18 bp, Homo sapiens
gccccactctcagaggcc

SEQ ID NO: 5759096 - DNA, 19 bp, Homo sapiens
gccccactctcagaggccc

SEQ ID NO: 5759097 - DNA, 14 bp, Homo sapiens
gccccactctgcct

SEQ ID NO: 5759098 - DNA, 17 bp, Homo sapiens
gccccactctgcctgcc

SEQ ID NO: 5759099 - DNA, 20 bp, Homo sapiens
gccccactctgctgaggcca

SEQ ID NO: 5759100 - DNA, 16 bp, Homo sapiens
gccccactgccagcag

SEQ ID NO: 5759101 - DNA, 21 bp, Homo sapiens
gccccactgccctccagggcc

SEQ ID NO: 5759102 - DNA, 18 bp, Homo sapiens
gccccactgcccttctca

SEQ ID NO: 5759103 - DNA, 18 bp, Homo sapiens
gccccactggacaacact

SEQ ID NO: 5759104 - DNA, 14 bp, Homo sapiens
gccccactggctgg

SEQ ID NO: 5759105 - DNA, 16 bp, Homo sapiens
gccccactgggagagt

SEQ ID NO: 5759106 - DNA, 13 bp, Homo sapiens
gccccactgggga

SEQ ID NO: 5759107 - DNA, 14 bp, Homo sapiens
gccccacttcaccc

SEQ ID NO: 5759108 - DNA, 16 bp, Homo sapiens
gccccacttctggcat

SEQ ID NO: 5759109 - DNA, 14 bp, Homo sapiens
gccccacttgtcct

SEQ ID NO: 5759110 - DNA, 17 bp, Homo sapiens
gccccacttgtccttag

SEQ ID NO: 5759111 - DNA, 16 bp, Homo sapiens
gccccagaaagcctca

SEQ ID NO: 5759112 - DNA, 22 bp, Homo sapiens
gccccagaaatgccgctgtgtc

SEQ ID NO: 5759113 - DNA, 23 bp, Homo sapiens
gccccagaaatgccgctgtgtcc

SEQ ID NO: 5759114 - DNA, 24 bp, Homo sapiens
gccccagaaatgccgctgtgtccc

SEQ ID NO: 5759115 - DNA, 22 bp, Homo sapiens
gccccagaaccccaactcccag

SEQ ID NO: 5759116 - DNA, 22 bp, Homo sapiens
gccccagactcctttcctctga

SEQ ID NO: 5759117 - DNA, 15 bp, Homo sapiens
gccccagactgagct

SEQ ID NO: 5759118 - DNA, 20 bp, Homo sapiens
gccccagactgagctctcca

SEQ ID NO: 5759119 - DNA, 21 bp, Homo sapiens
gccccagactgagctctccag

SEQ ID NO: 5759120 - DNA, 23 bp, Homo sapiens
gccccagactgagctctccaggc

SEQ ID NO: 5759121 - DNA, 16 bp, Homo sapiens
gccccagactgggccc

SEQ ID NO: 5759122 - DNA, 22 bp, Homo sapiens
gccccagactgggcccaggcag

SEQ ID NO: 5759123 - DNA, 16 bp, Homo sapiens
gccccattcctaagag

SEQ ID NO: 5759124 - DNA, 19 bp, Homo sapiens
gccccattccttgcgcctc

SEQ ID NO: 5759125 - DNA, 20 bp, Homo sapiens
gccccattctgcctgcccag

SEQ ID NO: 5759126 - DNA, 21 bp, Homo sapiens
gccccattctgcctgcccagg

SEQ ID NO: 5759127 - DNA, 23 bp, Homo sapiens
gccccattcttttgtaatttaaa

SEQ ID NO: 5759128 - DNA, 23 bp, Homo sapiens
gccccattgagatcttcctgctg

SEQ ID NO: 5759129 - DNA, 16 bp, Homo sapiens
gccccattttctttac

SEQ ID NO: 5759130 - DNA, 15 bp, Homo sapiens
gcccccaaagagctg

SEQ ID NO: 5759131 - DNA, 18 bp, Homo sapiens
gcccccaaagagctgtgg

SEQ ID NO: 5759132 - DNA, 19 bp, Homo sapiens
gcccccaaagagctgtggc

SEQ ID NO: 5759133 - DNA, 22 bp, Homo sapiens
gcccccaaagagctgtggctgg

SEQ ID NO: 5759134 - DNA, 19 bp, Homo sapiens
gcccccaaattgccttcag

SEQ ID NO: 5759135 - DNA, 20 bp, Homo sapiens
gcccccaacacaggcaagtc

SEQ ID NO: 5759136 - DNA, 15 bp, Homo sapiens
gcccccaacactcca

SEQ ID NO: 5759137 - DNA, 17 bp, Homo sapiens
gcccccaacactccagg

SEQ ID NO: 5759138 - DNA, 22 bp, Homo sapiens
gcccccaaccatttcctcagac

SEQ ID NO: 5759139 - DNA, 19 bp, Homo sapiens
gcccccaacccctccttcc

SEQ ID NO: 5759140 - DNA, 17 bp, Homo sapiens
gcccccaacctcagggc

SEQ ID NO: 5759141 - DNA, 20 bp, Homo sapiens
gcccccaactccgcccagcc

SEQ ID NO: 5759142 - DNA, 15 bp, Homo sapiens
gcccccaagcctctg

SEQ ID NO: 5759143 - DNA, 17 bp, Homo sapiens
gcccccaaggaggcagc

SEQ ID NO: 5759144 - DNA, 12 bp, Homo sapiens
gcccccaataaa

SEQ ID NO: 5759145 - DNA, 18 bp, Homo sapiens
gcccccaataaaccagtg

SEQ ID NO: 5759146 - DNA, 19 bp, Homo sapiens
gcccccaataaaccagtgt

SEQ ID NO: 5759147 - DNA, 21 bp, Homo sapiens
gcccccaataaaccagtgtga

SEQ ID NO: 5759148 - DNA, 14 bp, Homo sapiens
gcccccaataaagg

SEQ ID NO: 5759149 - DNA, 17 bp, Homo sapiens
gcccccaataaaggcag

SEQ ID NO: 5759150 - DNA, 23 bp, Homo sapiens
gcccccacacctggccctggggc

SEQ ID NO: 5759151 - DNA, 12 bp, Homo sapiens
gcccccacagat

SEQ ID NO: 5759152 - DNA, 11 bp, Homo sapiens
gcccccacagc

SEQ ID NO: 5759153 - DNA, 13 bp, Homo sapiens
gcccccacagccc

SEQ ID NO: 5759154 - DNA, 14 bp, Homo sapiens
gcccccacagccct

SEQ ID NO: 5759155 - DNA, 16 bp, Homo sapiens
gcccccacagccctgg

SEQ ID NO: 5759156 - DNA, 12 bp, Homo sapiens
gcccccacagct

SEQ ID NO: 5759157 - DNA, 13 bp, Homo sapiens
gcccccacagctc

SEQ ID NO: 5759158 - DNA, 22 bp, Homo sapiens
gcccccacagctccttgcaaac

SEQ ID NO: 5759159 - DNA, 21 bp, Homo sapiens
gcccccacaggagcgtgtcct

SEQ ID NO: 5759160 - DNA, 12 bp, Homo sapiens
gcccccacaggc

SEQ ID NO: 5759161 - DNA, 18 bp, Homo sapiens
gcccccacagttgctcta

SEQ ID NO: 5759162 - DNA, 9 bp, Homo sapiens
gcccccacc

SEQ ID NO: 5759163 - DNA, 15 bp, Homo sapiens
gcccccaccacacat

SEQ ID NO: 5759164 - DNA, 20 bp, Homo sapiens
gcccccaccacacatcccag

SEQ ID NO: 5759165 - DNA, 21 bp, Homo sapiens
gcccccaccacacatcccagc

SEQ ID NO: 5759166 - DNA, 23 bp, Homo sapiens
gcccccaccacacatcccagccc

SEQ ID NO: 5759167 - DNA, 14 bp, Homo sapiens
gcccccaccagcag

SEQ ID NO: 5759168 - DNA, 17 bp, Homo sapiens
gcccccacccacttccc

SEQ ID NO: 5759169 - DNA, 12 bp, Homo sapiens
gcccccacccag

SEQ ID NO: 5759170 - DNA, 14 bp, Homo sapiens
gcccccacccatgc

SEQ ID NO: 5759171 - DNA, 12 bp, Homo sapiens
gcccccacccca

SEQ ID NO: 5759172 - DNA, 15 bp, Homo sapiens
gcccccaccccaggc

SEQ ID NO: 5759173 - DNA, 12 bp, Homo sapiens
gcccccacccct

SEQ ID NO: 5759174 - DNA, 13 bp, Homo sapiens
gcccccaccccta

SEQ ID NO: 5759175 - DNA, 14 bp, Homo sapiens
gcccccacccctgg

SEQ ID NO: 5759176 - DNA, 16 bp, Homo sapiens
gcccccacccctggct

SEQ ID NO: 5759177 - DNA, 21 bp, Homo sapiens
gcccccaccccttccccaggc

SEQ ID NO: 5759178 - DNA, 23 bp, Homo sapiens
gcccccaccccttccccaggccc

SEQ ID NO: 5759179 - DNA, 16 bp, Homo sapiens
gcccccaccccttcct

SEQ ID NO: 5759180 - DNA, 11 bp, Homo sapiens
gcccccaccct

SEQ ID NO: 5759181 - DNA, 16 bp, Homo sapiens
gcccccaccctgcttc

SEQ ID NO: 5759182 - DNA, 19 bp, Homo sapiens
gcccccaccctgcttctgc

SEQ ID NO: 5759183 - DNA, 18 bp, Homo sapiens
gcccccaccctgttcctg

SEQ ID NO: 5759184 - DNA, 22 bp, Homo sapiens
gcccccaccctgttcctgctgc

SEQ ID NO: 5759185 - DNA, 23 bp, Homo sapiens
gcccccaccctgttcctgctgct

SEQ ID NO: 5759186 - DNA, 10 bp, Homo sapiens
gcccccaccg

SEQ ID NO: 5759187 - DNA, 21 bp, Homo sapiens
gcccccaccggaactgggctg

SEQ ID NO: 5759188 - DNA, 20 bp, Homo sapiens
gcccccacctccgccccaga

SEQ ID NO: 5759189 - DNA, 16 bp, Homo sapiens
gcccccacctctggtc

SEQ ID NO: 5759190 - DNA, 16 bp, Homo sapiens
gcccccacctggctca

SEQ ID NO: 5759191 - DNA, 22 bp, Homo sapiens
gcccccacgggacgcggcaggc

SEQ ID NO: 5759192 - DNA, 23 bp, Homo sapiens
gcccccactccagtccactcctg

SEQ ID NO: 5759193 - DNA, 13 bp, Homo sapiens
gcccccactcctc

SEQ ID NO: 5759194 - DNA, 14 bp, Homo sapiens
gcccccactcctcc

SEQ ID NO: 5759195 - DNA, 15 bp, Homo sapiens
gcccccactcctcct

SEQ ID NO: 5759196 - DNA, 17 bp, Homo sapiens
gcccccactgacctgcc

SEQ ID NO: 5759197 - DNA, 20 bp, Homo sapiens
gcccccactgacctgcccat

SEQ ID NO: 5759198 - DNA, 21 bp, Homo sapiens
gcccccactgacctgcccatg

SEQ ID NO: 5759199 - DNA, 21 bp, Homo sapiens
gcccccacttctctccaggct

SEQ ID NO: 5759200 - DNA, 14 bp, Homo sapiens
gcccccacttgcct

SEQ ID NO: 5759201 - DNA, 16 bp, Homo sapiens
gcccccacttgcctct

SEQ ID NO: 5759202 - DNA, 17 bp, Homo sapiens
gcccccacttgcctctt

SEQ ID NO: 5759203 - DNA, 22 bp, Homo sapiens
gcccccactttcaccagtttct

SEQ ID NO: 5759204 - DNA, 17 bp, Homo sapiens
gcccccacttttctagt

SEQ ID NO: 5759205 - DNA, 11 bp, Homo sapiens
gcccccagaaa

SEQ ID NO: 5759206 - DNA, 18 bp, Homo sapiens
gcccccagacagctgctc

SEQ ID NO: 5759207 - DNA, 17 bp, Homo sapiens
gcccccagaccccatcc

SEQ ID NO: 5759208 - DNA, 17 bp, Homo sapiens
gcccccagagcccaggc

SEQ ID NO: 5759209 - DNA, 19 bp, Homo sapiens
gcccccagagcccaggctc

SEQ ID NO: 5759210 - DNA, 19 bp, Homo sapiens
gcccccagagtgtaggggg

SEQ ID NO: 5759211 - DNA, 19 bp, Homo sapiens
gcccccagatagagctggg

SEQ ID NO: 5759212 - DNA, 21 bp, Homo sapiens
gcccccagatagagctgggtg

SEQ ID NO: 5759213 - DNA, 17 bp, Homo sapiens
gcccccagcagaggcag

SEQ ID NO: 5759214 - DNA, 15 bp, Homo sapiens
gcccccagcccaaag

SEQ ID NO: 5759215 - DNA, 18 bp, Homo sapiens
gcccccagcccagggctc

SEQ ID NO: 5759216 - DNA, 15 bp, Homo sapiens
gcccccagcccctcc

SEQ ID NO: 5759217 - DNA, 20 bp, Homo sapiens
gcccccagcccctcctccct

SEQ ID NO: 5759218 - DNA, 14 bp, Homo sapiens
gcccccagccctgg

SEQ ID NO: 5759219 - DNA, 14 bp, Homo sapiens
gcccccagcctatg

SEQ ID NO: 5759220 - DNA, 23 bp, Homo sapiens
gcccccagcctatgagcatcctg

SEQ ID NO: 5759221 - DNA, 13 bp, Homo sapiens
gcccccagcctgt

SEQ ID NO: 5759222 - DNA, 14 bp, Homo sapiens
gcccccagcctgtc

SEQ ID NO: 5759223 - DNA, 17 bp, Homo sapiens
gcccccagcgtgggggt

SEQ ID NO: 5759224 - DNA, 18 bp, Homo sapiens
gcccccagctgctcctcg

SEQ ID NO: 5759225 - DNA, 13 bp, Homo sapiens
gcccccagctggc

SEQ ID NO: 5759226 - DNA, 14 bp, Homo sapiens
gcccccagctggcc

SEQ ID NO: 5759227 - DNA, 18 bp, Homo sapiens
gcccccagctgtgggtac

SEQ ID NO: 5759228 - DNA, 10 bp, Homo sapiens
gcccccagga

SEQ ID NO: 5759229 - DNA, 13 bp, Homo sapiens
gcccccaggaaga

SEQ ID NO: 5759230 - DNA, 18 bp, Homo sapiens
gcccccaggaagacatta

SEQ ID NO: 5759231 - DNA, 13 bp, Homo sapiens
gcccccaggactg

SEQ ID NO: 5759232 - DNA, 14 bp, Homo sapiens
gcccccaggactgg

SEQ ID NO: 5759233 - DNA, 15 bp, Homo sapiens
gcccccaggatctgg

SEQ ID NO: 5759234 - DNA, 18 bp, Homo sapiens
gcccccaggattccccca

SEQ ID NO: 5759235 - DNA, 12 bp, Homo sapiens
gcccccaggcca

SEQ ID NO: 5759236 - DNA, 12 bp, Homo sapiens
gcccccaggcct

SEQ ID NO: 5759237 - DNA, 20 bp, Homo sapiens
gcccccaggcctgccctgct

SEQ ID NO: 5759238 - DNA, 21 bp, Homo sapiens
gcccccaggcctgccctgcta

SEQ ID NO: 5759239 - DNA, 16 bp, Homo sapiens
gcccccaggctgctgg

SEQ ID NO: 5759240 - DNA, 11 bp, Homo sapiens
gcccccagggc

SEQ ID NO: 5759241 - DNA, 21 bp, Homo sapiens
gcccccagggcctccagggcc

SEQ ID NO: 5759242 - DNA, 22 bp, Homo sapiens
gcccccaggtctgatctgggtt

SEQ ID NO: 5759243 - DNA, 23 bp, Homo sapiens
gcccccaggtgacacgcttctga

SEQ ID NO: 5759244 - DNA, 22 bp, Homo sapiens
gcccccagtccccacccctgcc

SEQ ID NO: 5759245 - DNA, 20 bp, Homo sapiens
gcccccagtggggacaggga

SEQ ID NO: 5759246 - DNA, 19 bp, Homo sapiens
gcccccatcacactcggcc

SEQ ID NO: 5759247 - DNA, 18 bp, Homo sapiens
gcccccatcatcctctgg

SEQ ID NO: 5759248 - DNA, 15 bp, Homo sapiens
gcccccatccagcca

SEQ ID NO: 5759249 - DNA, 14 bp, Homo sapiens
gcccccatccctcg

SEQ ID NO: 5759250 - DNA, 21 bp, Homo sapiens
gcccccatccctcggacccac

SEQ ID NO: 5759251 - DNA, 17 bp, Homo sapiens
gcccccatctccccagg

SEQ ID NO: 5759252 - DNA, 19 bp, Homo sapiens
gcccccatctgtcttcagc

SEQ ID NO: 5759253 - DNA, 20 bp, Homo sapiens
gcccccatgggctcctgccc

SEQ ID NO: 5759254 - DNA, 20 bp, Homo sapiens
gcccccattcccagcctgac

SEQ ID NO: 5759255 - DNA, 16 bp, Homo sapiens
gcccccattctcccag

SEQ ID NO: 5759256 - DNA, 18 bp, Homo sapiens
gcccccattctcccagtc

SEQ ID NO: 5759257 - DNA, 15 bp, Homo sapiens
gccccccaaggatgg

SEQ ID NO: 5759258 - DNA, 19 bp, Homo sapiens
gccccccacacgcgtgtgt

SEQ ID NO: 5759259 - DNA, 16 bp, Homo sapiens
gccccccacacttccc

SEQ ID NO: 5759260 - DNA, 21 bp, Homo sapiens
gccccccacacttccctggcg

SEQ ID NO: 5759261 - DNA, 13 bp, Homo sapiens
gccccccacccca

SEQ ID NO: 5759262 - DNA, 20 bp, Homo sapiens
gccccccaccccacagatca

SEQ ID NO: 5759263 - DNA, 21 bp, Homo sapiens
gccccccacccctggaagagc

SEQ ID NO: 5759264 - DNA, 19 bp, Homo sapiens
gccccccacgcttctggag

SEQ ID NO: 5759265 - DNA, 18 bp, Homo sapiens
gccccccagaaagctgcc

SEQ ID NO: 5759266 - DNA, 20 bp, Homo sapiens
gccccccagaaagctgccag

SEQ ID NO: 5759267 - DNA, 12 bp, Homo sapiens
gccccccagagc

SEQ ID NO: 5759268 - DNA, 15 bp, Homo sapiens
gccccccagagccag

SEQ ID NO: 5759269 - DNA, 16 bp, Homo sapiens
gccccccagagccagg

SEQ ID NO: 5759270 - DNA, 18 bp, Homo sapiens
gccccccagagccagggc

SEQ ID NO: 5759271 - DNA, 19 bp, Homo sapiens
gccccccagagccagggct

SEQ ID NO: 5759272 - DNA, 21 bp, Homo sapiens
gccccccagagccagggctgt

SEQ ID NO: 5759273 - DNA, 24 bp, Homo sapiens
gccccccagagccagggctgtcct

SEQ ID NO: 5759274 - DNA, 14 bp, Homo sapiens
gccccccagcgcag

SEQ ID NO: 5759275 - DNA, 16 bp, Homo sapiens
gccccccagctcaggg

SEQ ID NO: 5759276 - DNA, 14 bp, Homo sapiens
gccccccagctccc

SEQ ID NO: 5759277 - DNA, 15 bp, Homo sapiens
gccccccagctccca

SEQ ID NO: 5759278 - DNA, 18 bp, Homo sapiens
gccccccagctcccacac

SEQ ID NO: 5759279 - DNA, 19 bp, Homo sapiens
gccccccagctcccacacc

SEQ ID NO: 5759280 - DNA, 13 bp, Homo sapiens
gccccccagtctc

SEQ ID NO: 5759281 - DNA, 17 bp, Homo sapiens
gccccccatcctggccc

SEQ ID NO: 5759282 - DNA, 18 bp, Homo sapiens
gccccccatcctggccca

SEQ ID NO: 5759283 - DNA, 19 bp, Homo sapiens
gccccccatcctggcccat

SEQ ID NO: 5759284 - DNA, 16 bp, Homo sapiens
gccccccatgccctcc

SEQ ID NO: 5759285 - DNA, 21 bp, Homo sapiens
gccccccatgccctccctgct

SEQ ID NO: 5759286 - DNA, 17 bp, Homo sapiens
gcccccccaacactgtg

SEQ ID NO: 5759287 - DNA, 19 bp, Homo sapiens
gcccccccaacactgtgcc

SEQ ID NO: 5759288 - DNA, 19 bp, Homo sapiens
gcccccccactccagcccg

SEQ ID NO: 5759289 - DNA, 16 bp, Homo sapiens
gcccccccccacccct

SEQ ID NO: 5759290 - DNA, 16 bp, Homo sapiens
gcccccccctcaaggg

SEQ ID NO: 5759291 - DNA, 21 bp, Homo sapiens
gccccccctatctcttcctgt

SEQ ID NO: 5759292 - DNA, 16 bp, Homo sapiens
gccccccgaggctgct

SEQ ID NO: 5759293 - DNA, 17 bp, Homo sapiens
gccccccgcacagccac

SEQ ID NO: 5759294 - DNA, 15 bp, Homo sapiens
gccccccgcagcacc

SEQ ID NO: 5759295 - DNA, 19 bp, Homo sapiens
gccccccgcagcaccctgc

SEQ ID NO: 5759296 - DNA, 14 bp, Homo sapiens
gccccccgcccctc

SEQ ID NO: 5759297 - DNA, 19 bp, Homo sapiens
gccccccgcccggcctcct

SEQ ID NO: 5759298 - DNA, 19 bp, Homo sapiens
gccccccgcgcgcccaccc

SEQ ID NO: 5759299 - DNA, 20 bp, Homo sapiens
gccccccgcgcgcccaccct

SEQ ID NO: 5759300 - DNA, 18 bp, Homo sapiens
gccccccgcgctcgccca

SEQ ID NO: 5759301 - DNA, 19 bp, Homo sapiens
gccccgccccccagagcca

SEQ ID NO: 5759302 - DNA, 23 bp, Homo sapiens
gccccgccccccagagccagggc

SEQ ID NO: 5759303 - DNA, 19 bp, Homo sapiens
gccccgcccccgccccgcg

SEQ ID NO: 5759304 - DNA, 22 bp, Homo sapiens
gccccgccccctccctgctccc

SEQ ID NO: 5759305 - DNA, 22 bp, Homo sapiens
gccccgccccctcggcccctca

SEQ ID NO: 5759306 - DNA, 13 bp, Homo sapiens
gccccgccctcag

SEQ ID NO: 5759307 - DNA, 14 bp, Homo sapiens
gccccgccctcagg

SEQ ID NO: 5759308 - DNA, 15 bp, Homo sapiens
gccccgccctcttcc

SEQ ID NO: 5759309 - DNA, 16 bp, Homo sapiens
gccccgccctcttcct

SEQ ID NO: 5759310 - DNA, 22 bp, Homo sapiens
gccccgccctcttcctgacgaa

SEQ ID NO: 5759311 - DNA, 15 bp, Homo sapiens
gccccgccggccgcg

SEQ ID NO: 5759312 - DNA, 23 bp, Homo sapiens
gccccgcctcaaggaagagccag

SEQ ID NO: 5759313 - DNA, 12 bp, Homo sapiens
gccccgcctccc

SEQ ID NO: 5759314 - DNA, 15 bp, Homo sapiens
gccccgcctccccat

SEQ ID NO: 5759315 - DNA, 14 bp, Homo sapiens
gccccgcctccccg

SEQ ID NO: 5759316 - DNA, 22 bp, Homo sapiens
gccccgcctcccggggtgcccg

SEQ ID NO: 5759317 - DNA, 20 bp, Homo sapiens
gccccgcctgtcacaataaa

SEQ ID NO: 5759318 - DNA, 22 bp, Homo sapiens
gccccgccttcgtgtgctgctg

SEQ ID NO: 5759319 - DNA, 23 bp, Homo sapiens
gccccgccttcgtgtgctgctgc

SEQ ID NO: 5759320 - DNA, 22 bp, Homo sapiens
gccccgccttttcccccaccct

SEQ ID NO: 5759321 - DNA, 16 bp, Homo sapiens
gccccgcgcaccccac

SEQ ID NO: 5759322 - DNA, 17 bp, Homo sapiens
gccccgcgcctccttcc

SEQ ID NO: 5759323 - DNA, 15 bp, Homo sapiens
gccccgcgcgtgccc

SEQ ID NO: 5759324 - DNA, 17 bp, Homo sapiens
gccccgcgcgtgccccc

SEQ ID NO: 5759325 - DNA, 15 bp, Homo sapiens
gccccgcggagcccc

SEQ ID NO: 5759326 - DNA, 19 bp, Homo sapiens
gccccgcggagcccccgcc

SEQ ID NO: 5759327 - DNA, 21 bp, Homo sapiens
gccccgcggatcaaccaggca

SEQ ID NO: 5759328 - DNA, 12 bp, Homo sapiens
gccccgctagcg

SEQ ID NO: 5759329 - DNA, 13 bp, Homo sapiens
gccccgctcaggc

SEQ ID NO: 5759330 - DNA, 21 bp, Homo sapiens
gccccgctcaggtagccacca

SEQ ID NO: 5759331 - DNA, 22 bp, Homo sapiens
gccccgctcaggtagccaccac

SEQ ID NO: 5759332 - DNA, 23 bp, Homo sapiens
gccccgctcaggtagccaccacc

SEQ ID NO: 5759333 - DNA, 18 bp, Homo sapiens
gccccgctcccacctagt

SEQ ID NO: 5759334 - DNA, 16 bp, Homo sapiens
gccccgctgagcttgg

SEQ ID NO: 5759335 - DNA, 18 bp, Homo sapiens
gccccgctgagcttggag

SEQ ID NO: 5759336 - DNA, 14 bp, Homo sapiens
gccccgctgctccc

SEQ ID NO: 5759337 - DNA, 13 bp, Homo sapiens
gccccgctgggat

SEQ ID NO: 5759338 - DNA, 20 bp, Homo sapiens
gccccgcttccccacagaac

SEQ ID NO: 5759339 - DNA, 16 bp, Homo sapiens
gccccgcttgtccagc

SEQ ID NO: 5759340 - DNA, 19 bp, Homo sapiens
gccccgcttgtccagcgcc

SEQ ID NO: 5759341 - DNA, 21 bp, Homo sapiens
gccccggacagggtggcaccc

SEQ ID NO: 5759342 - DNA, 16 bp, Homo sapiens
gccccggacctacctc

SEQ ID NO: 5759343 - DNA, 14 bp, Homo sapiens
gccccggagcacca

SEQ ID NO: 5759344 - DNA, 18 bp, Homo sapiens
gccccggaggaagcttgg

SEQ ID NO: 5759345 - DNA, 16 bp, Homo sapiens
gccccggatcagagca

SEQ ID NO: 5759346 - DNA, 15 bp, Homo sapiens
gccccggcaagccac

SEQ ID NO: 5759347 - DNA, 18 bp, Homo sapiens
gccccggccacctctgcg

SEQ ID NO: 5759348 - DNA, 15 bp, Homo sapiens
gccccggccactccc

SEQ ID NO: 5759349 - DNA, 17 bp, Homo sapiens
gccccggccactccctg

SEQ ID NO: 5759350 - DNA, 12 bp, Homo sapiens
gccccggcccaa

SEQ ID NO: 5759351 - DNA, 21 bp, Homo sapiens
gccccggcccaacctcgccct

SEQ ID NO: 5759352 - DNA, 17 bp, Homo sapiens
gccccggccccagccag

SEQ ID NO: 5759353 - DNA, 18 bp, Homo sapiens
gccccggccccagccaga

SEQ ID NO: 5759354 - DNA, 13 bp, Homo sapiens
gccccggccccgg

SEQ ID NO: 5759355 - DNA, 15 bp, Homo sapiens
gccccggccctgggc

SEQ ID NO: 5759356 - DNA, 21 bp, Homo sapiens
gccccggccctgggctcggag

SEQ ID NO: 5759357 - DNA, 14 bp, Homo sapiens
gccccggcctcctc

SEQ ID NO: 5759358 - DNA, 14 bp, Homo sapiens
gccccggctcccac

SEQ ID NO: 5759359 - DNA, 16 bp, Homo sapiens
gccccggcttgcctgt

SEQ ID NO: 5759360 - DNA, 18 bp, Homo sapiens
gccccgggacccacggag

SEQ ID NO: 5759361 - DNA, 17 bp, Homo sapiens
gccccgggacttggagg

SEQ ID NO: 5759362 - DNA, 18 bp, Homo sapiens
gccccgggacttggaggg

SEQ ID NO: 5759363 - DNA, 22 bp, Homo sapiens
gccccgggatattatagaaaat

SEQ ID NO: 5759364 - DNA, 14 bp, Homo sapiens
gccccgggcctgcc

SEQ ID NO: 5759365 - DNA, 18 bp, Homo sapiens
gccccgggcctgcctctg

SEQ ID NO: 5759366 - DNA, 19 bp, Homo sapiens
gccccgggcctgcctctga

SEQ ID NO: 5759367 - DNA, 18 bp, Homo sapiens
gccccgggctctggccac

SEQ ID NO: 5759368 - DNA, 19 bp, Homo sapiens
gccccgggctctggccacc

SEQ ID NO: 5759369 - DNA, 14 bp, Homo sapiens
gccccgggctggcc

SEQ ID NO: 5759370 - DNA, 16 bp, Homo sapiens
gccccgggctggccct

SEQ ID NO: 5759371 - DNA, 20 bp, Homo sapiens
gccccgggctggccctgtgc

SEQ ID NO: 5759372 - DNA, 15 bp, Homo sapiens
gccccgggcttccct

SEQ ID NO: 5759373 - DNA, 17 bp, Homo sapiens
gccccgggcttcccttc

SEQ ID NO: 5759374 - DNA, 20 bp, Homo sapiens
gccccgggtccccagctccc

SEQ ID NO: 5759375 - DNA, 23 bp, Homo sapiens
gccccgggtccccagctccccag

SEQ ID NO: 5759376 - DNA, 19 bp, Homo sapiens
gccccgggtgcctcagagc

SEQ ID NO: 5759377 - DNA, 20 bp, Homo sapiens
gccccgggtgcctcagagca

SEQ ID NO: 5759378 - DNA, 16 bp, Homo sapiens
gccccgggttcagcct

SEQ ID NO: 5759379 - DNA, 18 bp, Homo sapiens
gccccgggttcagcctgg

SEQ ID NO: 5759380 - DNA, 20 bp, Homo sapiens
gccccgggttcagcctggcc

SEQ ID NO: 5759381 - DNA, 21 bp, Homo sapiens
gccccgggttcagcctggcct

SEQ ID NO: 5759382 - DNA, 16 bp, Homo sapiens
gccccggtcccccaga

SEQ ID NO: 5759383 - DNA, 19 bp, Homo sapiens
gccccggtcccccagagca

SEQ ID NO: 5759384 - DNA, 19 bp, Homo sapiens
gccccggtcctggccccag

SEQ ID NO: 5759385 - DNA, 15 bp, Homo sapiens
gccccgtagagaatg

SEQ ID NO: 5759386 - DNA, 21 bp, Homo sapiens
gccccgtcaccatctcaggcc

SEQ ID NO: 5759387 - DNA, 16 bp, Homo sapiens
gccccgtcccagaggc

SEQ ID NO: 5759388 - DNA, 15 bp, Homo sapiens
gccccgtcccctggg

SEQ ID NO: 5759389 - DNA, 21 bp, Homo sapiens
gccccgtcccctgggccaccc

SEQ ID NO: 5759390 - DNA, 19 bp, Homo sapiens
gccccgtcggactgccccc

SEQ ID NO: 5759391 - DNA, 22 bp, Homo sapiens
gccccgtcggactgcccccaga

SEQ ID NO: 5759392 - DNA, 14 bp, Homo sapiens
gccccgtctcaggt

SEQ ID NO: 5759393 - DNA, 23 bp, Homo sapiens
gccccgtctctcttggacccacc

SEQ ID NO: 5759394 - DNA, 14 bp, Homo sapiens
gccccgtctctgtt

SEQ ID NO: 5759395 - DNA, 23 bp, Homo sapiens
gccccgtctgaccccagcccaga

SEQ ID NO: 5759396 - DNA, 16 bp, Homo sapiens
gccccgtctgcccacc

SEQ ID NO: 5759397 - DNA, 18 bp, Homo sapiens
gccccgtctgcccaccat

SEQ ID NO: 5759398 - DNA, 20 bp, Homo sapiens
gccccgtgcagactggaggg

SEQ ID NO: 5759399 - DNA, 22 bp, Homo sapiens
gccccgtgcagactggagggga

SEQ ID NO: 5759400 - DNA, 16 bp, Homo sapiens
gccccgtgctcctctg

SEQ ID NO: 5759401 - DNA, 23 bp, Homo sapiens
gccccgtgggtgggcctggccct

SEQ ID NO: 5759402 - DNA, 22 bp, Homo sapiens
gccccgtggtgacatttcccaa

SEQ ID NO: 5759403 - DNA, 19 bp, Homo sapiens
gccccgtgtcctgcctgtc

SEQ ID NO: 5759404 - DNA, 16 bp, Homo sapiens
gccccgttccctgtca

SEQ ID NO: 5759405 - DNA, 21 bp, Homo sapiens
gccccgttgtgagctggatag

SEQ ID NO: 5759406 - DNA, 20 bp, Homo sapiens
gcccctaaagagcatcctga

SEQ ID NO: 5759407 - DNA, 18 bp, Homo sapiens
gcccctaaagatgggagg

SEQ ID NO: 5759408 - DNA, 23 bp, Homo sapiens
gcccctaagtgcaaacacagcat

SEQ ID NO: 5759409 - DNA, 19 bp, Homo sapiens
gcccctaatctctgtagga

SEQ ID NO: 5759410 - DNA, 21 bp, Homo sapiens
gcccctacccctgccctgctc

SEQ ID NO: 5759411 - DNA, 21 bp, Homo sapiens
gcccctagaaaccacctgggt

SEQ ID NO: 5759412 - DNA, 18 bp, Homo sapiens
gcccctagaaacccaagc

SEQ ID NO: 5759413 - DNA, 20 bp, Homo sapiens
gcccctagaatcagcctagg

SEQ ID NO: 5759414 - DNA, 14 bp, Homo sapiens
gcccctagcccagg

SEQ ID NO: 5759415 - DNA, 20 bp, Homo sapiens
gcccctaggactcaggcctg

SEQ ID NO: 5759416 - DNA, 15 bp, Homo sapiens
gcccctaggctgctg

SEQ ID NO: 5759417 - DNA, 17 bp, Homo sapiens
gcccctaggtgcccagg

SEQ ID NO: 5759418 - DNA, 15 bp, Homo sapiens
gcccctatcctgcac

SEQ ID NO: 5759419 - DNA, 17 bp, Homo sapiens
gcccctatcctgcaccc

SEQ ID NO: 5759420 - DNA, 20 bp, Homo sapiens
gcccctatcctgcaccctct

SEQ ID NO: 5759421 - DNA, 20 bp, Homo sapiens
gcccctatgtagtccgtgct

SEQ ID NO: 5759422 - DNA, 17 bp, Homo sapiens
gcccctattagctcttt

SEQ ID NO: 5759423 - DNA, 18 bp, Homo sapiens
gcccctcaacagccaagt

SEQ ID NO: 5759424 - DNA, 15 bp, Homo sapiens
gcccctcaaccctcc

SEQ ID NO: 5759425 - DNA, 16 bp, Homo sapiens
gcccctcaacctcctg

SEQ ID NO: 5759426 - DNA, 14 bp, Homo sapiens
gcccctcacactgc

SEQ ID NO: 5759427 - DNA, 15 bp, Homo sapiens
gcccctcacactgca

SEQ ID NO: 5759428 - DNA, 15 bp, Homo sapiens
gcccctcacatcctc

SEQ ID NO: 5759429 - DNA, 17 bp, Homo sapiens
gcccctcacatcctctc

SEQ ID NO: 5759430 - DNA, 14 bp, Homo sapiens
gcccctcaccacct

SEQ ID NO: 5759431 - DNA, 16 bp, Homo sapiens
gcccctcaccacctct

SEQ ID NO: 5759432 - DNA, 15 bp, Homo sapiens
gcccctcacccacca

SEQ ID NO: 5759433 - DNA, 22 bp, Homo sapiens
gcccctcacccaccatggacca

SEQ ID NO: 5759434 - DNA, 14 bp, Homo sapiens
gcccctcaccccaa

SEQ ID NO: 5759435 - DNA, 15 bp, Homo sapiens
gcccctcaccccaag

SEQ ID NO: 5759436 - DNA, 14 bp, Homo sapiens
gcccctcaccctct

SEQ ID NO: 5759437 - DNA, 15 bp, Homo sapiens
gcccctcaccctctg

SEQ ID NO: 5759438 - DNA, 14 bp, Homo sapiens
gcccctcacctact

SEQ ID NO: 5759439 - DNA, 17 bp, Homo sapiens
gcccctcacctcaggac

SEQ ID NO: 5759440 - DNA, 20 bp, Homo sapiens
gcccctcacctgcctgccct

SEQ ID NO: 5759441 - DNA, 20 bp, Homo sapiens
gcccctcacctgggcctttc

SEQ ID NO: 5759442 - DNA, 18 bp, Homo sapiens
gcccctcaccttgggctg

SEQ ID NO: 5759443 - DNA, 20 bp, Homo sapiens
gcccctcaccttgggctggg

SEQ ID NO: 5759444 - DNA, 16 bp, Homo sapiens
gcccctcactcctgcg

SEQ ID NO: 5759445 - DNA, 13 bp, Homo sapiens
gcccctcactggc

SEQ ID NO: 5759446 - DNA, 16 bp, Homo sapiens
gcccctcactggctgg

SEQ ID NO: 5759447 - DNA, 20 bp, Homo sapiens
gcccctcactggctggactg

SEQ ID NO: 5759448 - DNA, 15 bp, Homo sapiens
gcccctcagagactg

SEQ ID NO: 5759449 - DNA, 16 bp, Homo sapiens
gcccctcagagaggca

SEQ ID NO: 5759450 - DNA, 17 bp, Homo sapiens
gcccctcagagaggcat

SEQ ID NO: 5759451 - DNA, 15 bp, Homo sapiens
gcccctcagagcatg

SEQ ID NO: 5759452 - DNA, 13 bp, Homo sapiens
gcccctcagagcc

SEQ ID NO: 5759453 - DNA, 13 bp, Homo sapiens
gcccctcagccct

SEQ ID NO: 5759454 - DNA, 15 bp, Homo sapiens
gcccctcagcccttg

SEQ ID NO: 5759455 - DNA, 18 bp, Homo sapiens
gcccctcagcccttgccc

SEQ ID NO: 5759456 - DNA, 16 bp, Homo sapiens
gcccctcagcctctgc

SEQ ID NO: 5759457 - DNA, 17 bp, Homo sapiens
gcccctcagcctctgcc

SEQ ID NO: 5759458 - DNA, 18 bp, Homo sapiens
gcccctcagcctgcctga

SEQ ID NO: 5759459 - DNA, 17 bp, Homo sapiens
gcccctcagcgccccca

SEQ ID NO: 5759460 - DNA, 19 bp, Homo sapiens
gcccctcagcgcccccaga

SEQ ID NO: 5759461 - DNA, 18 bp, Homo sapiens
gcccctcagggggccagc

SEQ ID NO: 5759462 - DNA, 20 bp, Homo sapiens
gcccctcagggggccagctg

SEQ ID NO: 5759463 - DNA, 23 bp, Homo sapiens
gcccctcagggggccagctgggg

SEQ ID NO: 5759464 - DNA, 14 bp, Homo sapiens
gcccctcagggtcc

SEQ ID NO: 5759465 - DNA, 21 bp, Homo sapiens
gcccctcatctctctgcccaa

SEQ ID NO: 5759466 - DNA, 20 bp, Homo sapiens
gcccctcatggcgggactgg

SEQ ID NO: 5759467 - DNA, 21 bp, Homo sapiens
gcccctcatgtgtgctgtgct

SEQ ID NO: 5759468 - DNA, 20 bp, Homo sapiens
gcccctcatttatcactctg

SEQ ID NO: 5759469 - DNA, 19 bp, Homo sapiens
gcccctccaaacctccagc

SEQ ID NO: 5759470 - DNA, 13 bp, Homo sapiens
gcccctccaagtc

SEQ ID NO: 5759471 - DNA, 17 bp, Homo sapiens
gcccctccacgcctcct

SEQ ID NO: 5759472 - DNA, 15 bp, Homo sapiens
gcccctccacgtgat

SEQ ID NO: 5759473 - DNA, 18 bp, Homo sapiens
gcccctccagaccctgcc

SEQ ID NO: 5759474 - DNA, 11 bp, Homo sapiens
gcccctccagc

SEQ ID NO: 5759475 - DNA, 14 bp, Homo sapiens
gcccctccagcaca

SEQ ID NO: 5759476 - DNA, 15 bp, Homo sapiens
gcccctccagcacac

SEQ ID NO: 5759477 - DNA, 16 bp, Homo sapiens
gcccctccagcacaca

SEQ ID NO: 5759478 - DNA, 12 bp, Homo sapiens
gcccctccagga

SEQ ID NO: 5759479 - DNA, 14 bp, Homo sapiens
gcccctccagtgtt

SEQ ID NO: 5759480 - DNA, 23 bp, Homo sapiens
gcccctccagtgttgcctcctcc

SEQ ID NO: 5759481 - DNA, 14 bp, Homo sapiens
gcccctccatccac

SEQ ID NO: 5759482 - DNA, 16 bp, Homo sapiens
gcccctccatccaccc

SEQ ID NO: 5759483 - DNA, 13 bp, Homo sapiens
gcccctcccacca

SEQ ID NO: 5759484 - DNA, 16 bp, Homo sapiens
gcccctcccaccacag

SEQ ID NO: 5759485 - DNA, 15 bp, Homo sapiens
gcccctcccagccta

SEQ ID NO: 5759486 - DNA, 14 bp, Homo sapiens
gcccctcccatggc

SEQ ID NO: 5759487 - DNA, 18 bp, Homo sapiens
gcccctcccatggcccag

SEQ ID NO: 5759488 - DNA, 20 bp, Homo sapiens
gcccctcccatggcccagca

SEQ ID NO: 5759489 - DNA, 23 bp, Homo sapiens
gcccctcccatggcccagcagct

SEQ ID NO: 5759490 - DNA, 17 bp, Homo sapiens
gcccctccccaaaagaa

SEQ ID NO: 5759491 - DNA, 19 bp, Homo sapiens
gcccctccccaaaagaaac

SEQ ID NO: 5759492 - DNA, 15 bp, Homo sapiens
gcccctccccacacc

SEQ ID NO: 5759493 - DNA, 20 bp, Homo sapiens
gcccctccccacccctgcct

SEQ ID NO: 5759494 - DNA, 22 bp, Homo sapiens
gcccctccccagactctcaggt

SEQ ID NO: 5759495 - DNA, 15 bp, Homo sapiens
gcccctccccagcca

SEQ ID NO: 5759496 - DNA, 12 bp, Homo sapiens
gcccctccccca

SEQ ID NO: 5759497 - DNA, 14 bp, Homo sapiens
gcccctcccccagc

SEQ ID NO: 5759498 - DNA, 14 bp, Homo sapiens
gcccctcccccatc

SEQ ID NO: 5759499 - DNA, 19 bp, Homo sapiens
gcccctcccccgtcctgga

SEQ ID NO: 5759500 - DNA, 16 bp, Homo sapiens
gcccctccccctaccg

SEQ ID NO: 5759501 - DNA, 22 bp, Homo sapiens
gcccctccccctaccgcatggc

SEQ ID NO: 5759502 - DNA, 13 bp, Homo sapiens
gcccctccccgcc

SEQ ID NO: 5759503 - DNA, 15 bp, Homo sapiens
gcccctccccgcctc

SEQ ID NO: 5759504 - DNA, 22 bp, Homo sapiens
gcccctccccgcctcctccctg

SEQ ID NO: 5759505 - DNA, 15 bp, Homo sapiens
gcccctccccgtccc

SEQ ID NO: 5759506 - DNA, 12 bp, Homo sapiens
gcccctcccctc

SEQ ID NO: 5759507 - DNA, 13 bp, Homo sapiens
gcccctcccctca

SEQ ID NO: 5759508 - DNA, 14 bp, Homo sapiens
gcccctcccctcag

SEQ ID NO: 5759509 - DNA, 15 bp, Homo sapiens
gcccctcccctcaga

SEQ ID NO: 5759510 - DNA, 17 bp, Homo sapiens
gcccctcccctcagagc

SEQ ID NO: 5759511 - DNA, 18 bp, Homo sapiens
gcccctcccctcagagcc

SEQ ID NO: 5759512 - DNA, 20 bp, Homo sapiens
gcccctcccctcagagccca

SEQ ID NO: 5759513 - DNA, 21 bp, Homo sapiens
gcccctcccctcagagcccat

SEQ ID NO: 5759514 - DNA, 23 bp, Homo sapiens
gcccctcccctcagagcccatgg

SEQ ID NO: 5759515 - DNA, 16 bp, Homo sapiens
gcccctcccctcagcc

SEQ ID NO: 5759516 - DNA, 15 bp, Homo sapiens
gcccctcccctcccc

SEQ ID NO: 5759517 - DNA, 16 bp, Homo sapiens
gcccctcccctgcaga

SEQ ID NO: 5759518 - DNA, 16 bp, Homo sapiens
gcccctcccgcccctt

SEQ ID NO: 5759519 - DNA, 16 bp, Homo sapiens
gcccctccctacctca

SEQ ID NO: 5759520 - DNA, 17 bp, Homo sapiens
gcccctccctagatcca

SEQ ID NO: 5759521 - DNA, 21 bp, Homo sapiens
gcccctccctagatccaggct

SEQ ID NO: 5759522 - DNA, 13 bp, Homo sapiens
gcccctccctcag

SEQ ID NO: 5759523 - DNA, 16 bp, Homo sapiens
gcccctccctcccaga

SEQ ID NO: 5759524 - DNA, 18 bp, Homo sapiens
gcccctccctcccagagc

SEQ ID NO: 5759525 - DNA, 19 bp, Homo sapiens
gcccctccctcccggctgc

SEQ ID NO: 5759526 - DNA, 13 bp, Homo sapiens
gcccctccctcct

SEQ ID NO: 5759527 - DNA, 20 bp, Homo sapiens
gcccctccctctccagcagg

SEQ ID NO: 5759528 - DNA, 14 bp, Homo sapiens
gcccctccctctgc

SEQ ID NO: 5759529 - DNA, 15 bp, Homo sapiens
gcccctccctgcctc

SEQ ID NO: 5759530 - DNA, 12 bp, Homo sapiens
gcccctcccttc

SEQ ID NO: 5759531 - DNA, 20 bp, Homo sapiens
gcccctccgatgctgaggcc

SEQ ID NO: 5759532 - DNA, 20 bp, Homo sapiens
gcccctccgggcagagacca

SEQ ID NO: 5759533 - DNA, 14 bp, Homo sapiens
gcccctccgtcccc

SEQ ID NO: 5759534 - DNA, 17 bp, Homo sapiens
gcccctccgtccccagg

SEQ ID NO: 5759535 - DNA, 18 bp, Homo sapiens
gcccctccgtccccaggg

SEQ ID NO: 5759536 - DNA, 19 bp, Homo sapiens
gcccctccgtccccagggt

SEQ ID NO: 5759537 - DNA, 20 bp, Homo sapiens
gcccctccgtccccagggtg

SEQ ID NO: 5759538 - DNA, 17 bp, Homo sapiens
gcccctcctaacccagc

SEQ ID NO: 5759539 - DNA, 14 bp, Homo sapiens
gcccctcctccaga

SEQ ID NO: 5759540 - DNA, 14 bp, Homo sapiens
gcccctcctcccct

SEQ ID NO: 5759541 - DNA, 16 bp, Homo sapiens
gcccctcctccctcaa

SEQ ID NO: 5759542 - DNA, 14 bp, Homo sapiens
gcccctcctccctg

SEQ ID NO: 5759543 - DNA, 11 bp, Homo sapiens
gcccctcctcg

SEQ ID NO: 5759544 - DNA, 19 bp, Homo sapiens
gcccctcctcgggcgcctg

SEQ ID NO: 5759545 - DNA, 21 bp, Homo sapiens
gcccctcctcgggcgcctgcg

SEQ ID NO: 5759546 - DNA, 17 bp, Homo sapiens
gcccctcctctcctcgt

SEQ ID NO: 5759547 - DNA, 16 bp, Homo sapiens
gcccctcctctgagca

SEQ ID NO: 5759548 - DNA, 13 bp, Homo sapiens
gcccctcctctgc

SEQ ID NO: 5759549 - DNA, 15 bp, Homo sapiens
gcccctcctctgcca

SEQ ID NO: 5759550 - DNA, 16 bp, Homo sapiens
gcccctcctctgccac

SEQ ID NO: 5759551 - DNA, 18 bp, Homo sapiens
gcccctcctctgccacct

SEQ ID NO: 5759552 - DNA, 15 bp, Homo sapiens
gcccctcctctgtgc

SEQ ID NO: 5759553 - DNA, 19 bp, Homo sapiens
gcccctcctctgtgctccc

SEQ ID NO: 5759554 - DNA, 17 bp, Homo sapiens
gcccctcctgactcatc

SEQ ID NO: 5759555 - DNA, 14 bp, Homo sapiens
gcccctcctggagc

SEQ ID NO: 5759556 - DNA, 13 bp, Homo sapiens
gcccctcctgggt

SEQ ID NO: 5759557 - DNA, 13 bp, Homo sapiens
gcccctccttctc

SEQ ID NO: 5759558 - DNA, 20 bp, Homo sapiens
gcccctccttctcccctcca

SEQ ID NO: 5759559 - DNA, 23 bp, Homo sapiens
gcccctccttctcccctgccggt

SEQ ID NO: 5759560 - DNA, 13 bp, Homo sapiens
gcccctccttgca

SEQ ID NO: 5759561 - DNA, 23 bp, Homo sapiens
gcccctccttgcaaccaggcagc

SEQ ID NO: 5759562 - DNA, 18 bp, Homo sapiens
gcccctccttttggcctg

SEQ ID NO: 5759563 - DNA, 17 bp, Homo sapiens
gcccctcgaccctgtgc

SEQ ID NO: 5759564 - DNA, 15 bp, Homo sapiens
gcccctcgaggccta

SEQ ID NO: 5759565 - DNA, 16 bp, Homo sapiens
gcccctcgcacacagg

SEQ ID NO: 5759566 - DNA, 23 bp, Homo sapiens
gcccctcgccagcttctcctgcg

SEQ ID NO: 5759567 - DNA, 22 bp, Homo sapiens
gcccctcggcattcacacacag

SEQ ID NO: 5759568 - DNA, 15 bp, Homo sapiens
gcccctcggctaccc

SEQ ID NO: 5759569 - DNA, 21 bp, Homo sapiens
gcccctcggctaccccccgtc

SEQ ID NO: 5759570 - DNA, 19 bp, Homo sapiens
gcccctcggctctggaggc

SEQ ID NO: 5759571 - DNA, 22 bp, Homo sapiens
gcccctctactgttgcacagcc

SEQ ID NO: 5759572 - DNA, 15 bp, Homo sapiens
gcccctctcagccct

SEQ ID NO: 5759573 - DNA, 14 bp, Homo sapiens
gcccctctcatcac

SEQ ID NO: 5759574 - DNA, 22 bp, Homo sapiens
gcccctctccaaacaccggcag

SEQ ID NO: 5759575 - DNA, 20 bp, Homo sapiens
gcccctctccccgcagtgtt

SEQ ID NO: 5759576 - DNA, 15 bp, Homo sapiens
gcccctctcccctct

SEQ ID NO: 5759577 - DNA, 18 bp, Homo sapiens
gcccctctcccctctctg

SEQ ID NO: 5759578 - DNA, 19 bp, Homo sapiens
gcccctctcccctctctgc

SEQ ID NO: 5759579 - DNA, 20 bp, Homo sapiens
gcccctctcccttgggctct

SEQ ID NO: 5759580 - DNA, 14 bp, Homo sapiens
gcccctctctcaca

SEQ ID NO: 5759581 - DNA, 14 bp, Homo sapiens
gcccctctctgggc

SEQ ID NO: 5759582 - DNA, 13 bp, Homo sapiens
gcccctctgattg

SEQ ID NO: 5759583 - DNA, 15 bp, Homo sapiens
gcccctctgcccagc

SEQ ID NO: 5759584 - DNA, 20 bp, Homo sapiens
gcccctctgcccagcttggg

SEQ ID NO: 5759585 - DNA, 13 bp, Homo sapiens
gcccctctgctgt

SEQ ID NO: 5759586 - DNA, 22 bp, Homo sapiens
gcccctctgttctctcccctca

SEQ ID NO: 5759587 - DNA, 22 bp, Homo sapiens
gcccctctgttctggtggcccc

SEQ ID NO: 5759588 - DNA, 20 bp, Homo sapiens
gcccctcttattcctctagg

SEQ ID NO: 5759589 - DNA, 18 bp, Homo sapiens
gcccctcttccaaaggca

SEQ ID NO: 5759590 - DNA, 18 bp, Homo sapiens
gcccctcttgccccccac

SEQ ID NO: 5759591 - DNA, 15 bp, Homo sapiens
gcccctctttctctt

SEQ ID NO: 5759592 - DNA, 17 bp, Homo sapiens
gcccctctttctctttc

SEQ ID NO: 5759593 - DNA, 16 bp, Homo sapiens
gcccctgaaagcctca

SEQ ID NO: 5759594 - DNA, 16 bp, Homo sapiens
gcccctgaacaagaat

SEQ ID NO: 5759595 - DNA, 18 bp, Homo sapiens
gcccctgaagtgacccca

SEQ ID NO: 5759596 - DNA, 15 bp, Homo sapiens
gcccctgacccaggg

SEQ ID NO: 5759597 - DNA, 15 bp, Homo sapiens
gcccctgagagcctg

SEQ ID NO: 5759598 - DNA, 15 bp, Homo sapiens
gcccctgaggactgg

SEQ ID NO: 5759599 - DNA, 16 bp, Homo sapiens
gcccctgaggactgga

SEQ ID NO: 5759600 - DNA, 18 bp, Homo sapiens
gcccctgaggactggaga

SEQ ID NO: 5759601 - DNA, 17 bp, Homo sapiens
gcccctgaggcagccca

SEQ ID NO: 5759602 - DNA, 18 bp, Homo sapiens
gcccctgaggcagcccag

SEQ ID NO: 5759603 - DNA, 18 bp, Homo sapiens
gcccctgagtccgcctgc

SEQ ID NO: 5759604 - DNA, 19 bp, Homo sapiens
gcccctgagtccgcctgcg

SEQ ID NO: 5759605 - DNA, 17 bp, Homo sapiens
gcccctgatcactccca

SEQ ID NO: 5759606 - DNA, 23 bp, Homo sapiens
gcccctgatcactcccagcactc

SEQ ID NO: 5759607 - DNA, 19 bp, Homo sapiens
gcccctgatctctgacctc

SEQ ID NO: 5759608 - DNA, 20 bp, Homo sapiens
gcccctgatctctgacctct

SEQ ID NO: 5759609 - DNA, 22 bp, Homo sapiens
gcccctgatctctgacctctgc

SEQ ID NO: 5759610 - DNA, 18 bp, Homo sapiens
gcccctgatgcagcctgt

SEQ ID NO: 5759611 - DNA, 17 bp, Homo sapiens
gcccctgcacaggcaca

SEQ ID NO: 5759612 - DNA, 19 bp, Homo sapiens
gcccctgcactccagcctg

SEQ ID NO: 5759613 - DNA, 20 bp, Homo sapiens
gcccctgcagacgtctggcc

SEQ ID NO: 5759614 - DNA, 22 bp, Homo sapiens
gcccctgcagacgtctggccct

SEQ ID NO: 5759615 - DNA, 12 bp, Homo sapiens
gcccctgcaggg

SEQ ID NO: 5759616 - DNA, 14 bp, Homo sapiens
gcccctgcagggga

SEQ ID NO: 5759617 - DNA, 13 bp, Homo sapiens
gcccctgcagttg

SEQ ID NO: 5759618 - DNA, 20 bp, Homo sapiens
gcccctgcagtttggccctg

SEQ ID NO: 5759619 - DNA, 21 bp, Homo sapiens
gcccctgcagtttggccctgg

SEQ ID NO: 5759620 - DNA, 23 bp, Homo sapiens
gcccctgcatccccttggctgtg

SEQ ID NO: 5759621 - DNA, 16 bp, Homo sapiens
gcccctgcatgcctgg

SEQ ID NO: 5759622 - DNA, 20 bp, Homo sapiens
gcccctgccaaggccggaga

SEQ ID NO: 5759623 - DNA, 16 bp, Homo sapiens
gcccctgccaccctgg

SEQ ID NO: 5759624 - DNA, 18 bp, Homo sapiens
gcccctgcccagcacctc

SEQ ID NO: 5759625 - DNA, 21 bp, Homo sapiens
gcccctgccccagcccaagtc

SEQ ID NO: 5759626 - DNA, 12 bp, Homo sapiens
gcccctgccccg

SEQ ID NO: 5759627 - DNA, 18 bp, Homo sapiens
gcccctgccccggaggaa

SEQ ID NO: 5759628 - DNA, 22 bp, Homo sapiens
gcccctgccccgtcaccatctc

SEQ ID NO: 5759629 - DNA, 15 bp, Homo sapiens
gcccctgcccctgcc

SEQ ID NO: 5759630 - DNA, 13 bp, Homo sapiens
gcccctgccctga

SEQ ID NO: 5759631 - DNA, 17 bp, Homo sapiens
gcccctgccctggggag

SEQ ID NO: 5759632 - DNA, 19 bp, Homo sapiens
gcccctgccgcctgtgccc

SEQ ID NO: 5759633 - DNA, 20 bp, Homo sapiens
gcccctgcctctctgcaggt

SEQ ID NO: 5759634 - DNA, 23 bp, Homo sapiens
gcccctgcctctctgcaggtccc

SEQ ID NO: 5759635 - DNA, 15 bp, Homo sapiens
gcccctgcctgagac

SEQ ID NO: 5759636 - DNA, 14 bp, Homo sapiens
gcccctgcctgcca

SEQ ID NO: 5759637 - DNA, 15 bp, Homo sapiens
gcccctgcctgcctt

SEQ ID NO: 5759638 - DNA, 19 bp, Homo sapiens
gcccctgcgtggcctgagt

SEQ ID NO: 5759639 - DNA, 17 bp, Homo sapiens
gcccctgctcactgggc

SEQ ID NO: 5759640 - DNA, 12 bp, Homo sapiens
gcccctgctccc

SEQ ID NO: 5759641 - DNA, 17 bp, Homo sapiens
gcccctgctccctctgg

SEQ ID NO: 5759642 - DNA, 13 bp, Homo sapiens
gcccctgctgcct

SEQ ID NO: 5759643 - DNA, 19 bp, Homo sapiens
gcccctgctgcctccccaa

SEQ ID NO: 5759644 - DNA, 13 bp, Homo sapiens
gcccctgctgctc

SEQ ID NO: 5759645 - DNA, 23 bp, Homo sapiens
gcccctgctgcttaagtgcatgc

SEQ ID NO: 5759646 - DNA, 12 bp, Homo sapiens
gcccctgctggt

SEQ ID NO: 5759647 - DNA, 14 bp, Homo sapiens
gcccctgcttctcc

SEQ ID NO: 5759648 - DNA, 23 bp, Homo sapiens
gcccctggaacctttcccttgtg

SEQ ID NO: 5759649 - DNA, 17 bp, Homo sapiens
gcccctggacaggcttc

SEQ ID NO: 5759650 - DNA, 22 bp, Homo sapiens
gcccctggacaggcttcgtctc

SEQ ID NO: 5759651 - DNA, 14 bp, Homo sapiens
gcccctggacatgc

SEQ ID NO: 5759652 - DNA, 16 bp, Homo sapiens
gcccctggacatgcct

SEQ ID NO: 5759653 - DNA, 17 bp, Homo sapiens
gcccctggacccctggg

SEQ ID NO: 5759654 - DNA, 21 bp, Homo sapiens
gcccctggacccctggggtgg

SEQ ID NO: 5759655 - DNA, 13 bp, Homo sapiens
gcccctggagcca

SEQ ID NO: 5759656 - DNA, 14 bp, Homo sapiens
gcccctggagccag

SEQ ID NO: 5759657 - DNA, 19 bp, Homo sapiens
gcccgaggtcgctgcagcc

SEQ ID NO: 5759658 - DNA, 18 bp, Homo sapiens
gcccgaggtggctgcctg

SEQ ID NO: 5759659 - DNA, 19 bp, Homo sapiens
gcccgaggtggctgcctgg

SEQ ID NO: 5759660 - DNA, 21 bp, Homo sapiens
gcccgagtggtctcctctcag

SEQ ID NO: 5759661 - DNA, 14 bp, Homo sapiens
gcccgataaagacg

SEQ ID NO: 5759662 - DNA, 21 bp, Homo sapiens
gcccgatattctccctgacct

SEQ ID NO: 5759663 - DNA, 16 bp, Homo sapiens
gcccgcaagagggaca

SEQ ID NO: 5759664 - DNA, 23 bp, Homo sapiens
gcccgcacaccctcactctgcca

SEQ ID NO: 5759665 - DNA, 24 bp, Homo sapiens
gcccgcacaccctcactctgccag

SEQ ID NO: 5759666 - DNA, 15 bp, Homo sapiens
gcccgcacagcagcc

SEQ ID NO: 5759667 - DNA, 16 bp, Homo sapiens
gcccgcacagcagcct

SEQ ID NO: 5759668 - DNA, 18 bp, Homo sapiens
gcccgcacagcagcctgc

SEQ ID NO: 5759669 - DNA, 17 bp, Homo sapiens
gcccgcacccccaccct

SEQ ID NO: 5759670 - DNA, 17 bp, Homo sapiens
gcccgcacccctccctg

SEQ ID NO: 5759671 - DNA, 19 bp, Homo sapiens
gcccgcacccctccctgct

SEQ ID NO: 5759672 - DNA, 21 bp, Homo sapiens
gcccgcacccctccctgcttg

SEQ ID NO: 5759673 - DNA, 19 bp, Homo sapiens
gcccgcaccctggcctggt

SEQ ID NO: 5759674 - DNA, 16 bp, Homo sapiens
gcccgcactcaggagc

SEQ ID NO: 5759675 - DNA, 23 bp, Homo sapiens
gcccgcactcaggagcacagcca

SEQ ID NO: 5759676 - DNA, 12 bp, Homo sapiens
gcccgcagagcc

SEQ ID NO: 5759677 - DNA, 23 bp, Homo sapiens
gcccgcagagcgcgcccctagcc

SEQ ID NO: 5759678 - DNA, 15 bp, Homo sapiens
gcccgcagaggtggg

SEQ ID NO: 5759679 - DNA, 23 bp, Homo sapiens
gcccgcaggaactgggctgggcc

SEQ ID NO: 5759680 - DNA, 17 bp, Homo sapiens
gcccgcagtgctgggac

SEQ ID NO: 5759681 - DNA, 18 bp, Homo sapiens
gcccgcagtgctgggacc

SEQ ID NO: 5759682 - DNA, 20 bp, Homo sapiens
gcccgcatcagctgctcaga

SEQ ID NO: 5759683 - DNA, 14 bp, Homo sapiens
gcccgcatgcagca

SEQ ID NO: 5759684 - DNA, 22 bp, Homo sapiens
gcccgcatgcagcagcttgctg

SEQ ID NO: 5759685 - DNA, 12 bp, Homo sapiens
gcccgcatgtgt

SEQ ID NO: 5759686 - DNA, 19 bp, Homo sapiens
gcccgcatgtgtgcctggc

SEQ ID NO: 5759687 - DNA, 15 bp, Homo sapiens
gcccgccacacagac

SEQ ID NO: 5759688 - DNA, 12 bp, Homo sapiens
gcccgccacctt

SEQ ID NO: 5759689 - DNA, 15 bp, Homo sapiens
gcccgccagccagtg

SEQ ID NO: 5759690 - DNA, 16 bp, Homo sapiens
gcccgccagccagtgg

SEQ ID NO: 5759691 - DNA, 13 bp, Homo sapiens
gcccgccagcctc

SEQ ID NO: 5759692 - DNA, 14 bp, Homo sapiens
gcccgccagcctca

SEQ ID NO: 5759693 - DNA, 16 bp, Homo sapiens
gcccgccagcctcagt

SEQ ID NO: 5759694 - DNA, 15 bp, Homo sapiens
gcccgcccaccccgc

SEQ ID NO: 5759695 - DNA, 17 bp, Homo sapiens
gcccgcccaccccgctg

SEQ ID NO: 5759696 - DNA, 22 bp, Homo sapiens
gcccgcccacctctgctgccca

SEQ ID NO: 5759697 - DNA, 13 bp, Homo sapiens
gcccgcccacctg

SEQ ID NO: 5759698 - DNA, 14 bp, Homo sapiens
gcccgcccacctgg

SEQ ID NO: 5759699 - DNA, 15 bp, Homo sapiens
gcccgcccactgtcc

SEQ ID NO: 5759700 - DNA, 14 bp, Homo sapiens
gcccgccccaggcc

SEQ ID NO: 5759701 - DNA, 14 bp, Homo sapiens
gcccgcccctcagt

SEQ ID NO: 5759702 - DNA, 15 bp, Homo sapiens
gcccgcccctgcagc

SEQ ID NO: 5759703 - DNA, 17 bp, Homo sapiens
gcccgccctcacctctg

SEQ ID NO: 5759704 - DNA, 15 bp, Homo sapiens
gcccgccctccctcc

SEQ ID NO: 5759705 - DNA, 18 bp, Homo sapiens
gcccgccctctgcctcct

SEQ ID NO: 5759706 - DNA, 13 bp, Homo sapiens
gcccgccctgccc

SEQ ID NO: 5759707 - DNA, 13 bp, Homo sapiens
gcccgccctgggc

SEQ ID NO: 5759708 - DNA, 16 bp, Homo sapiens
gcccgccctgggctgg

SEQ ID NO: 5759709 - DNA, 14 bp, Homo sapiens
gcccgccgccctgg

SEQ ID NO: 5759710 - DNA, 18 bp, Homo sapiens
gcccgccggttggccggc

SEQ ID NO: 5759711 - DNA, 16 bp, Homo sapiens
gcccgccgtctgcagg

SEQ ID NO: 5759712 - DNA, 17 bp, Homo sapiens
gcccgccgtctgcaggg

SEQ ID NO: 5759713 - DNA, 17 bp, Homo sapiens
gcccgccgtgcctgcat

SEQ ID NO: 5759714 - DNA, 16 bp, Homo sapiens
gcccgcctctgcctcc

SEQ ID NO: 5759715 - DNA, 12 bp, Homo sapiens
gcccgcctgcca

SEQ ID NO: 5759716 - DNA, 21 bp, Homo sapiens
gcccgcgatgtggaactgctg

SEQ ID NO: 5759717 - DNA, 17 bp, Homo sapiens
gcccgcgcagctgccta

SEQ ID NO: 5759718 - DNA, 14 bp, Homo sapiens
gcccgcgccaggcc

SEQ ID NO: 5759719 - DNA, 13 bp, Homo sapiens
gcccgcgcccgcg

SEQ ID NO: 5759720 - DNA, 15 bp, Homo sapiens
gcccgcgctctttct

SEQ ID NO: 5759721 - DNA, 13 bp, Homo sapiens
gcccgcggcctgc

SEQ ID NO: 5759722 - DNA, 16 bp, Homo sapiens
gcccgcggcctggacc

SEQ ID NO: 5759723 - DNA, 18 bp, Homo sapiens
gcccgcggcgcgaccctc

SEQ ID NO: 5759724 - DNA, 22 bp, Homo sapiens
gcccgcgggagacagcttctct

SEQ ID NO: 5759725 - DNA, 19 bp, Homo sapiens
gcccgcgggcacagccagc

SEQ ID NO: 5759726 - DNA, 18 bp, Homo sapiens
gcccgcggggacattggg

SEQ ID NO: 5759727 - DNA, 22 bp, Homo sapiens
gcccgcgggtggctggagcccc

SEQ ID NO: 5759728 - DNA, 15 bp, Homo sapiens
gcccgcgtgctggag

SEQ ID NO: 5759729 - DNA, 15 bp, Homo sapiens
gcccgctcaacctct

SEQ ID NO: 5759730 - DNA, 17 bp, Homo sapiens
gcccgctcaacctctca

SEQ ID NO: 5759731 - DNA, 16 bp, Homo sapiens
gcccgctcccaacccc

SEQ ID NO: 5759732 - DNA, 19 bp, Homo sapiens
gcccgctcccaacccccct

SEQ ID NO: 5759733 - DNA, 14 bp, Homo sapiens
gcccgctcccacag

SEQ ID NO: 5759734 - DNA, 12 bp, Homo sapiens
gcccgctcccag

SEQ ID NO: 5759735 - DNA, 19 bp, Homo sapiens
gcccgctcctgccgcagac

SEQ ID NO: 5759736 - DNA, 15 bp, Homo sapiens
gcccgctctgcagac

SEQ ID NO: 5759737 - DNA, 14 bp, Homo sapiens
gcccgctgcagcct

SEQ ID NO: 5759738 - DNA, 22 bp, Homo sapiens
gcccgctgcagcctctgcctct

SEQ ID NO: 5759739 - DNA, 16 bp, Homo sapiens
gcccgctgcctcttgg

SEQ ID NO: 5759740 - DNA, 21 bp, Homo sapiens
gcccgctgcctcttggcttct

SEQ ID NO: 5759741 - DNA, 13 bp, Homo sapiens
gcccgctgcgctg

SEQ ID NO: 5759742 - DNA, 19 bp, Homo sapiens
gcccgctgcgctgccctgc

SEQ ID NO: 5759743 - DNA, 16 bp, Homo sapiens
gcccgctgctcacttt

SEQ ID NO: 5759744 - DNA, 15 bp, Homo sapiens
gcccgctgggctgag

SEQ ID NO: 5759745 - DNA, 16 bp, Homo sapiens
gcccgctgggctgagc

SEQ ID NO: 5759746 - DNA, 14 bp, Homo sapiens
gcccgctggggacc

SEQ ID NO: 5759747 - DNA, 16 bp, Homo sapiens
gcccgctgtcccaggg

SEQ ID NO: 5759748 - DNA, 14 bp, Homo sapiens
gcccgcttcaagct

SEQ ID NO: 5759749 - DNA, 17 bp, Homo sapiens
gcccgcttccctccttc

SEQ ID NO: 5759750 - DNA, 18 bp, Homo sapiens
gcccgcttccctccttca

SEQ ID NO: 5759751 - DNA, 14 bp, Homo sapiens
gcccgcttgcctcg

SEQ ID NO: 5759752 - DNA, 21 bp, Homo sapiens
gcccgcttgcctcggctcctg

SEQ ID NO: 5759753 - DNA, 22 bp, Homo sapiens
gcccgcttgcctcggctcctgc

SEQ ID NO: 5759754 - DNA, 23 bp, Homo sapiens
gcccgcttgcctcggctcctgct

SEQ ID NO: 5759755 - DNA, 19 bp, Homo sapiens
gcccggaagcgccaggctg

SEQ ID NO: 5759756 - DNA, 20 bp, Homo sapiens
gcccggaagcgccaggctgg

SEQ ID NO: 5759757 - DNA, 19 bp, Homo sapiens
gcccggaagttgctgtgcc

SEQ ID NO: 5759758 - DNA, 14 bp, Homo sapiens
gcccggaccttggc

SEQ ID NO: 5759759 - DNA, 18 bp, Homo sapiens
gcccggagaaacctgatg

SEQ ID NO: 5759760 - DNA, 21 bp, Homo sapiens
gcccggagcagcagcttctcc

SEQ ID NO: 5759761 - DNA, 16 bp, Homo sapiens
gcccggaggccgggcc

SEQ ID NO: 5759762 - DNA, 23 bp, Homo sapiens
gcccggatgcagaggcctgcagg

SEQ ID NO: 5759763 - DNA, 16 bp, Homo sapiens
gcccggatgcccaccc

SEQ ID NO: 5759764 - DNA, 19 bp, Homo sapiens
gcccggatgcccacccctg

SEQ ID NO: 5759765 - DNA, 16 bp, Homo sapiens
gcccggcagccccttc

SEQ ID NO: 5759766 - DNA, 18 bp, Homo sapiens
gcccggcagccccttctg

SEQ ID NO: 5759767 - DNA, 18 bp, Homo sapiens
gcccggcagtgcaccccc

SEQ ID NO: 5759768 - DNA, 18 bp, Homo sapiens
gcccggccagccatgtct

SEQ ID NO: 5759769 - DNA, 17 bp, Homo sapiens
gcccggccagcgggcac

SEQ ID NO: 5759770 - DNA, 22 bp, Homo sapiens
gcccggccagcgggcacagggc

SEQ ID NO: 5759771 - DNA, 13 bp, Homo sapiens
gcccggcccagga

SEQ ID NO: 5759772 - DNA, 14 bp, Homo sapiens
gcccggcccaggag

SEQ ID NO: 5759773 - DNA, 23 bp, Homo sapiens
gcccggccccaccccctgggcag

SEQ ID NO: 5759774 - DNA, 23 bp, Homo sapiens
gcccggccccacctccctgcgcc

SEQ ID NO: 5759775 - DNA, 13 bp, Homo sapiens
gcccggcccctca

SEQ ID NO: 5759776 - DNA, 17 bp, Homo sapiens
gcccggcccctcctgac

SEQ ID NO: 5759777 - DNA, 12 bp, Homo sapiens
gcccggccggcc

SEQ ID NO: 5759778 - DNA, 18 bp, Homo sapiens
gcccggcctattgcttgg

SEQ ID NO: 5759779 - DNA, 16 bp, Homo sapiens
gcccggcctcctagcc

SEQ ID NO: 5759780 - DNA, 22 bp, Homo sapiens
gcccggcctcctagcctctccg

SEQ ID NO: 5759781 - DNA, 15 bp, Homo sapiens
gcccggcctgctccc

SEQ ID NO: 5759782 - DNA, 17 bp, Homo sapiens
gcccggcgcccctgcca

SEQ ID NO: 5759783 - DNA, 15 bp, Homo sapiens
gcccggcgccctctg

SEQ ID NO: 5759784 - DNA, 18 bp, Homo sapiens
gcccggcgccctctgtcc

SEQ ID NO: 5759785 - DNA, 21 bp, Homo sapiens
gcccggcgcggtggctcacgc

SEQ ID NO: 5759786 - DNA, 20 bp, Homo sapiens
gcccggctacatcagccttc

SEQ ID NO: 5759787 - DNA, 14 bp, Homo sapiens
gcccggctccaggc

SEQ ID NO: 5759788 - DNA, 15 bp, Homo sapiens
gcccggctcctggtc

SEQ ID NO: 5759789 - DNA, 15 bp, Homo sapiens
gcccggctgagcccc

SEQ ID NO: 5759790 - DNA, 19 bp, Homo sapiens
gcccggctgagccccccat

SEQ ID NO: 5759791 - DNA, 15 bp, Homo sapiens
gcccggctgagccct

SEQ ID NO: 5759792 - DNA, 17 bp, Homo sapiens
gcccgggaactcctgcc

SEQ ID NO: 5759793 - DNA, 20 bp, Homo sapiens
gcccgggaactcctgccaca

SEQ ID NO: 5759794 - DNA, 22 bp, Homo sapiens
gcccgggaactcctgccacaac

SEQ ID NO: 5759795 - DNA, 23 bp, Homo sapiens
gcccgggaaggtcaccagcacca

SEQ ID NO: 5759796 - DNA, 21 bp, Homo sapiens
gcccgggagatccgccctggg

SEQ ID NO: 5759797 - DNA, 22 bp, Homo sapiens
gcccgggagatccgccctgggc

SEQ ID NO: 5759798 - DNA, 19 bp, Homo sapiens
gcccgggagctcaggaacc

SEQ ID NO: 5759799 - DNA, 19 bp, Homo sapiens
gcccgggagctgctgccct

SEQ ID NO: 5759800 - DNA, 18 bp, Homo sapiens
gcccgggatcctgatggc

SEQ ID NO: 5759801 - DNA, 13 bp, Homo sapiens
gcccgggcaccca

SEQ ID NO: 5759802 - DNA, 20 bp, Homo sapiens
gcccgggcacccacaagccc

SEQ ID NO: 5759803 - DNA, 16 bp, Homo sapiens
gcccgggcaggccagc

SEQ ID NO: 5759804 - DNA, 13 bp, Homo sapiens
gcccgggcccaga

SEQ ID NO: 5759805 - DNA, 16 bp, Homo sapiens
gcccgggcccaggcag

SEQ ID NO: 5759806 - DNA, 21 bp, Homo sapiens
gcccgggcccaggcagagagc

SEQ ID NO: 5759807 - DNA, 16 bp, Homo sapiens
gcccgggcccccgccc

SEQ ID NO: 5759808 - DNA, 17 bp, Homo sapiens
gcccgggcccccgcccc

SEQ ID NO: 5759809 - DNA, 18 bp, Homo sapiens
gcccgggcccccgccccg

SEQ ID NO: 5759810 - DNA, 13 bp, Homo sapiens
gcccgggccgacc

SEQ ID NO: 5759811 - DNA, 18 bp, Homo sapiens
gcccgggccgaccctgcg

SEQ ID NO: 5759812 - DNA, 23 bp, Homo sapiens
gcccgggccgaccctgcggcctc

SEQ ID NO: 5759813 - DNA, 18 bp, Homo sapiens
gcccgggcgcggccagcc

SEQ ID NO: 5759814 - DNA, 17 bp, Homo sapiens
gcccgggctcccacacc

SEQ ID NO: 5759815 - DNA, 12 bp, Homo sapiens
gcccgggctctg

SEQ ID NO: 5759816 - DNA, 19 bp, Homo sapiens
gcccgggctctgcctccca

SEQ ID NO: 5759817 - DNA, 20 bp, Homo sapiens
gcccgggctctgcctcccat

SEQ ID NO: 5759818 - DNA, 21 bp, Homo sapiens
gcccgggctctgcctcccatc

SEQ ID NO: 5759819 - DNA, 23 bp, Homo sapiens
gcccgggctgcctgggctgttgg

SEQ ID NO: 5759820 - DNA, 15 bp, Homo sapiens
gcccggggaggaact

SEQ ID NO: 5759821 - DNA, 19 bp, Homo sapiens
gcccggggcagagctcaga

SEQ ID NO: 5759822 - DNA, 21 bp, Homo sapiens
gcccggggcagagctcagagg

SEQ ID NO: 5759823 - DNA, 13 bp, Homo sapiens
gcccggggcagca

SEQ ID NO: 5759824 - DNA, 20 bp, Homo sapiens
gcccggggcagcagcagccc

SEQ ID NO: 5759825 - DNA, 14 bp, Homo sapiens
gcccggggcagctg

SEQ ID NO: 5759826 - DNA, 18 bp, Homo sapiens
gcccggggcagctgccag

SEQ ID NO: 5759827 - DNA, 17 bp, Homo sapiens
gcccggggcccttcctc

SEQ ID NO: 5759828 - DNA, 22 bp, Homo sapiens
gcccggggctgtcccgtgcatg

SEQ ID NO: 5759829 - DNA, 19 bp, Homo sapiens
gcccgggggacgcctgccc

SEQ ID NO: 5759830 - DNA, 18 bp, Homo sapiens
gcccggtccacaggtcca

SEQ ID NO: 5759831 - DNA, 22 bp, Homo sapiens
gcccggtccacaggtccaagga

SEQ ID NO: 5759832 - DNA, 23 bp, Homo sapiens
gcccggtcccagtccggtgcctt

SEQ ID NO: 5759833 - DNA, 12 bp, Homo sapiens
gcccggtgcagc

SEQ ID NO: 5759834 - DNA, 16 bp, Homo sapiens
gcccggtgcagcctct

SEQ ID NO: 5759835 - DNA, 15 bp, Homo sapiens
gccctccaaaagcac

SEQ ID NO: 5759836 - DNA, 12 bp, Homo sapiens
gccctccaaaga

SEQ ID NO: 5759837 - DNA, 13 bp, Homo sapiens
gccctccacacct

SEQ ID NO: 5759838 - DNA, 14 bp, Homo sapiens
gccctccacacctg

SEQ ID NO: 5759839 - DNA, 19 bp, Homo sapiens
gccctccacacctgcggcc

SEQ ID NO: 5759840 - DNA, 17 bp, Homo sapiens
gccctccacatccctga

SEQ ID NO: 5759841 - DNA, 22 bp, Homo sapiens
gccctccacattttcaatccag

SEQ ID NO: 5759842 - DNA, 13 bp, Homo sapiens
gccctccacccac

SEQ ID NO: 5759843 - DNA, 16 bp, Homo sapiens
gccctccactgccctc

SEQ ID NO: 5759844 - DNA, 18 bp, Homo sapiens
gccctccactgccctctg

SEQ ID NO: 5759845 - DNA, 23 bp, Homo sapiens
gccctccactgccctctgttcag

SEQ ID NO: 5759846 - DNA, 15 bp, Homo sapiens
gccctccagagcagg

SEQ ID NO: 5759847 - DNA, 14 bp, Homo sapiens
gccctccagctgct

SEQ ID NO: 5759848 - DNA, 12 bp, Homo sapiens
gccctccaggcc

SEQ ID NO: 5759849 - DNA, 13 bp, Homo sapiens
gccctccaggcct

SEQ ID NO: 5759850 - DNA, 16 bp, Homo sapiens
gccctccaggcctgca

SEQ ID NO: 5759851 - DNA, 17 bp, Homo sapiens
gccctccaggcctgcag

SEQ ID NO: 5759852 - DNA, 19 bp, Homo sapiens
gccctccaggcctgcaggg

SEQ ID NO: 5759853 - DNA, 20 bp, Homo sapiens
gccctccaggcctgcagggg

SEQ ID NO: 5759854 - DNA, 12 bp, Homo sapiens
gccctccagggc

SEQ ID NO: 5759855 - DNA, 17 bp, Homo sapiens
gccctccagggccagga

SEQ ID NO: 5759856 - DNA, 16 bp, Homo sapiens
gccctccatccgtgct

SEQ ID NO: 5759857 - DNA, 17 bp, Homo sapiens
gccctccatccgtgctg

SEQ ID NO: 5759858 - DNA, 14 bp, Homo sapiens
gccctccatgggct

SEQ ID NO: 5759859 - DNA, 17 bp, Homo sapiens
gccctccatggtcctgt

SEQ ID NO: 5759860 - DNA, 21 bp, Homo sapiens
gccctccatggtcctgtctgt

SEQ ID NO: 5759861 - DNA, 16 bp, Homo sapiens
gccctcccaccacccc

SEQ ID NO: 5759862 - DNA, 17 bp, Homo sapiens
gccctcccaccacccca

SEQ ID NO: 5759863 - DNA, 14 bp, Homo sapiens
gccctcccaccccc

SEQ ID NO: 5759864 - DNA, 21 bp, Homo sapiens
gccctcccaccccctccccgg

SEQ ID NO: 5759865 - DNA, 14 bp, Homo sapiens
gccctcccactttg

SEQ ID NO: 5759866 - DNA, 12 bp, Homo sapiens
gccctcccagcc

SEQ ID NO: 5759867 - DNA, 19 bp, Homo sapiens
gccctcccagcccattgct

SEQ ID NO: 5759868 - DNA, 15 bp, Homo sapiens
gccctcccagctggt

SEQ ID NO: 5759869 - DNA, 16 bp, Homo sapiens
gccctcccagctggtg

SEQ ID NO: 5759870 - DNA, 12 bp, Homo sapiens
gccctcccaggc

SEQ ID NO: 5759871 - DNA, 21 bp, Homo sapiens
gccctcccaggcgatcttgtg

SEQ ID NO: 5759872 - DNA, 12 bp, Homo sapiens
gccctccccaca

SEQ ID NO: 5759873 - DNA, 16 bp, Homo sapiens
gccctccccacctgct

SEQ ID NO: 5759874 - DNA, 20 bp, Homo sapiens
gccctccccacctgctcacc

SEQ ID NO: 5759875 - DNA, 21 bp, Homo sapiens
gccctccccacctgctcacca

SEQ ID NO: 5759876 - DNA, 19 bp, Homo sapiens
gccctccccagagcactgg

SEQ ID NO: 5759877 - DNA, 14 bp, Homo sapiens
gccctccccaggaa

SEQ ID NO: 5759878 - DNA, 17 bp, Homo sapiens
gccctccccatcccatg

SEQ ID NO: 5759879 - DNA, 15 bp, Homo sapiens
gccctcccccagctc

SEQ ID NO: 5759880 - DNA, 18 bp, Homo sapiens
gccctcccccagctcctt

SEQ ID NO: 5759881 - DNA, 21 bp, Homo sapiens
gccctcccccagctccttggc

SEQ ID NO: 5759882 - DNA, 14 bp, Homo sapiens
gccctccccccagc

SEQ ID NO: 5759883 - DNA, 13 bp, Homo sapiens
gccctccccctca

SEQ ID NO: 5759884 - DNA, 14 bp, Homo sapiens
gccctccccctcaa

SEQ ID NO: 5759885 - DNA, 17 bp, Homo sapiens
gccctccccctcaacct

SEQ ID NO: 5759886 - DNA, 14 bp, Homo sapiens
gccctccccctcct

SEQ ID NO: 5759887 - DNA, 20 bp, Homo sapiens
gccctccccctgccagaggc

SEQ ID NO: 5759888 - DNA, 15 bp, Homo sapiens
gccctcccccttccc

SEQ ID NO: 5759889 - DNA, 20 bp, Homo sapiens
gccctcccccttccccttct

SEQ ID NO: 5759890 - DNA, 16 bp, Homo sapiens
gccctcccctcagcgc

SEQ ID NO: 5759891 - DNA, 17 bp, Homo sapiens
gccctcccctcagcgca

SEQ ID NO: 5759892 - DNA, 16 bp, Homo sapiens
gccctcccctcccctg

SEQ ID NO: 5759893 - DNA, 20 bp, Homo sapiens
gccctcccctcccctgctgc

SEQ ID NO: 5759894 - DNA, 23 bp, Homo sapiens
gccctcccctccggactggtgcc

SEQ ID NO: 5759895 - DNA, 19 bp, Homo sapiens
gccctcccctctctgcacc

SEQ ID NO: 5759896 - DNA, 14 bp, Homo sapiens
gccctcccctgctc

SEQ ID NO: 5759897 - DNA, 15 bp, Homo sapiens
gccctcccctgctcc

SEQ ID NO: 5759898 - DNA, 16 bp, Homo sapiens
gccctcccctgctccc

SEQ ID NO: 5759899 - DNA, 14 bp, Homo sapiens
gccctccccttccc

SEQ ID NO: 5759900 - DNA, 16 bp, Homo sapiens
gccctccccttcccct

SEQ ID NO: 5759901 - DNA, 20 bp, Homo sapiens
gccctcccgcaccttcctcc

SEQ ID NO: 5759902 - DNA, 15 bp, Homo sapiens
gccctcccgcccctt

SEQ ID NO: 5759903 - DNA, 14 bp, Homo sapiens
gccctccctcagcg

SEQ ID NO: 5759904 - DNA, 19 bp, Homo sapiens
gccctccctcagcggaggg

SEQ ID NO: 5759905 - DNA, 22 bp, Homo sapiens
gccctccctcccagcgctctgg

SEQ ID NO: 5759906 - DNA, 19 bp, Homo sapiens
gccctccctccccagctcc

SEQ ID NO: 5759907 - DNA, 21 bp, Homo sapiens
gccctccctccctagcccttc

SEQ ID NO: 5759908 - DNA, 14 bp, Homo sapiens
gccctccctccctc

SEQ ID NO: 5759909 - DNA, 17 bp, Homo sapiens
gccctccctccctccac

SEQ ID NO: 5759910 - DNA, 23 bp, Homo sapiens
gccctccctcggccccacccacc

SEQ ID NO: 5759911 - DNA, 22 bp, Homo sapiens
gccctccctctactcttcctgt

SEQ ID NO: 5759912 - DNA, 14 bp, Homo sapiens
gccctccctctccc

SEQ ID NO: 5759913 - DNA, 16 bp, Homo sapiens
gccctccctctcccag

SEQ ID NO: 5759914 - DNA, 21 bp, Homo sapiens
gccctccctctcccaggcccg

SEQ ID NO: 5759915 - DNA, 19 bp, Homo sapiens
gccctccctcttcccagca

SEQ ID NO: 5759916 - DNA, 19 bp, Homo sapiens
gccctccctgactccctgt

SEQ ID NO: 5759917 - DNA, 15 bp, Homo sapiens
gccctccctgcccct

SEQ ID NO: 5759918 - DNA, 21 bp, Homo sapiens
gccctccctgcgcttcctgag

SEQ ID NO: 5759919 - DNA, 17 bp, Homo sapiens
gccctccctggcatgtc

SEQ ID NO: 5759920 - DNA, 15 bp, Homo sapiens
gccctccctggcctc

SEQ ID NO: 5759921 - DNA, 13 bp, Homo sapiens
gccctccctggct

SEQ ID NO: 5759922 - DNA, 13 bp, Homo sapiens
gccctccctgggg

SEQ ID NO: 5759923 - DNA, 20 bp, Homo sapiens
gccctcccttctccctggat

SEQ ID NO: 5759924 - DNA, 16 bp, Homo sapiens
gccctcccttcttgtg

SEQ ID NO: 5759925 - DNA, 14 bp, Homo sapiens
gccctccgacagcc

SEQ ID NO: 5759926 - DNA, 14 bp, Homo sapiens
gccctccgccagcc

SEQ ID NO: 5759927 - DNA, 16 bp, Homo sapiens
gccctccgccagccct

SEQ ID NO: 5759928 - DNA, 21 bp, Homo sapiens
gccctccgccccgtcccccca

SEQ ID NO: 5759929 - DNA, 14 bp, Homo sapiens
gccctccgcctaga

SEQ ID NO: 5759930 - DNA, 18 bp, Homo sapiens
gccctccgcgaaaatagt

SEQ ID NO: 5759931 - DNA, 17 bp, Homo sapiens
gccctccgcgggggaca

SEQ ID NO: 5759932 - DNA, 19 bp, Homo sapiens
gccctccggaggagcagcc

SEQ ID NO: 5759933 - DNA, 15 bp, Homo sapiens
gccctccgtcctggc

SEQ ID NO: 5759934 - DNA, 19 bp, Homo sapiens
gccctccgtcctggcaggg

SEQ ID NO: 5759935 - DNA, 21 bp, Homo sapiens
gccctccgtcctggcagggca

SEQ ID NO: 5759936 - DNA, 17 bp, Homo sapiens
gccctcctaccctgcgc

SEQ ID NO: 5759937 - DNA, 19 bp, Homo sapiens
gccctcctaccctgcgccc

SEQ ID NO: 5759938 - DNA, 24 bp, Homo sapiens
gccctcctaccctgcgcccagtcc

SEQ ID NO: 5759939 - DNA, 11 bp, Homo sapiens
gccctcctcag

SEQ ID NO: 5759940 - DNA, 13 bp, Homo sapiens
gccctcctcagct

SEQ ID NO: 5759941 - DNA, 15 bp, Homo sapiens
gccctcctcagctcc

SEQ ID NO: 5759942 - DNA, 19 bp, Homo sapiens
gccctcctcagctccctgc

SEQ ID NO: 5759943 - DNA, 17 bp, Homo sapiens
gccctcctccccagagc

SEQ ID NO: 5759944 - DNA, 22 bp, Homo sapiens
gccctcctccctcccagctcca

SEQ ID NO: 5759945 - DNA, 15 bp, Homo sapiens
gccctcctccctccg

SEQ ID NO: 5759946 - DNA, 14 bp, Homo sapiens
gccctcctcgctgt

SEQ ID NO: 5759947 - DNA, 18 bp, Homo sapiens
gccctcctcgctgtgcca

SEQ ID NO: 5759948 - DNA, 14 bp, Homo sapiens
gccctcctcgggcc

SEQ ID NO: 5759949 - DNA, 18 bp, Homo sapiens
gccctcctcgggccgagg

SEQ ID NO: 5759950 - DNA, 22 bp, Homo sapiens
gccctcctcgggccgaggccca

SEQ ID NO: 5759951 - DNA, 12 bp, Homo sapiens
gccctcctctcc

SEQ ID NO: 5759952 - DNA, 13 bp, Homo sapiens
gccctcctctccc

SEQ ID NO: 5759953 - DNA, 17 bp, Homo sapiens
gccctcctctcccattg

SEQ ID NO: 5759954 - DNA, 14 bp, Homo sapiens
gccctcctctcccg

SEQ ID NO: 5759955 - DNA, 22 bp, Homo sapiens
gccctcctctcccgtctcgcct

SEQ ID NO: 5759956 - DNA, 16 bp, Homo sapiens
gccctcctctgcactc

SEQ ID NO: 5759957 - DNA, 14 bp, Homo sapiens
gccctcctctgccc

SEQ ID NO: 5759958 - DNA, 18 bp, Homo sapiens
gccctcctctgccccctc

SEQ ID NO: 5759959 - DNA, 12 bp, Homo sapiens
gccctcctctgg

SEQ ID NO: 5759960 - DNA, 12 bp, Homo sapiens
gccctcctgccc

SEQ ID NO: 5759961 - DNA, 16 bp, Homo sapiens
gccctcctgctggctg

SEQ ID NO: 5759962 - DNA, 12 bp, Homo sapiens
gccctcctggac

SEQ ID NO: 5759963 - DNA, 19 bp, Homo sapiens
gccctcctgggcaccccag

SEQ ID NO: 5759964 - DNA, 23 bp, Homo sapiens
gccctcctgggcaccccaggcag

SEQ ID NO: 5759965 - DNA, 13 bp, Homo sapiens
gccctcctggtga

SEQ ID NO: 5759966 - DNA, 19 bp, Homo sapiens
gccctcctgtgctcagccc

SEQ ID NO: 5759967 - DNA, 21 bp, Homo sapiens
gccctcctgtgctcagccctg

SEQ ID NO: 5759968 - DNA, 12 bp, Homo sapiens
gccctccttccc

SEQ ID NO: 5759969 - DNA, 22 bp, Homo sapiens
gccctccttcccaatcttcttt

SEQ ID NO: 5759970 - DNA, 22 bp, Homo sapiens
gccctccttccctcctgtgccc

SEQ ID NO: 5759971 - DNA, 17 bp, Homo sapiens
gccctccttcctaaatt

SEQ ID NO: 5759972 - DNA, 14 bp, Homo sapiens
gccctccttgccac

SEQ ID NO: 5759973 - DNA, 17 bp, Homo sapiens
gccctccttgtccaccc

SEQ ID NO: 5759974 - DNA, 13 bp, Homo sapiens
gccctcctttctg

SEQ ID NO: 5759975 - DNA, 17 bp, Homo sapiens
gccctcctttctgtgcc

SEQ ID NO: 5759976 - DNA, 20 bp, Homo sapiens
gccctcctttctgtgcccta

SEQ ID NO: 5759977 - DNA, 11 bp, Homo sapiens
gccctcctttg

SEQ ID NO: 5759978 - DNA, 17 bp, Homo sapiens
gccctcgaaccaaggca

SEQ ID NO: 5759979 - DNA, 19 bp, Homo sapiens
gccctcgaaccaaggcagc

SEQ ID NO: 5759980 - DNA, 22 bp, Homo sapiens
gccctcgaaccaaggcagcctc

SEQ ID NO: 5759981 - DNA, 13 bp, Homo sapiens
gccctcgacactc

SEQ ID NO: 5759982 - DNA, 23 bp, Homo sapiens
gccctcgacactcaccatgaagc

SEQ ID NO: 5759983 - DNA, 14 bp, Homo sapiens
gccctcgcctcctc

SEQ ID NO: 5759984 - DNA, 14 bp, Homo sapiens
gccctcgctgccag

SEQ ID NO: 5759985 - DNA, 15 bp, Homo sapiens
gccctcgctgcttct

SEQ ID NO: 5759986 - DNA, 20 bp, Homo sapiens
gccctcggaggtccagctgg

SEQ ID NO: 5759987 - DNA, 16 bp, Homo sapiens
gccctcggcctccaga

SEQ ID NO: 5759988 - DNA, 19 bp, Homo sapiens
gccctcggcctccagactg

SEQ ID NO: 5759989 - DNA, 16 bp, Homo sapiens
gccctcgggcccagcc

SEQ ID NO: 5759990 - DNA, 18 bp, Homo sapiens
gccctcgggcccagcccc

SEQ ID NO: 5759991 - DNA, 22 bp, Homo sapiens
gccctcgggcccagcccccaca

SEQ ID NO: 5759992 - DNA, 17 bp, Homo sapiens
gccctcgggtggggctg

SEQ ID NO: 5759993 - DNA, 19 bp, Homo sapiens
gccctcgggtggggctggt

SEQ ID NO: 5759994 - DNA, 20 bp, Homo sapiens
gccctcgggtggggctggtg

SEQ ID NO: 5759995 - DNA, 15 bp, Homo sapiens
gccctcggtcagcga

SEQ ID NO: 5759996 - DNA, 16 bp, Homo sapiens
gccctcggtggctgca

SEQ ID NO: 5759997 - DNA, 19 bp, Homo sapiens
gccctcggtggctgcacag

SEQ ID NO: 5759998 - DNA, 20 bp, Homo sapiens
gccctcggtggctgcacaga

SEQ ID NO: 5759999 - DNA, 16 bp, Homo sapiens
gccctcgtggccagcc

SEQ ID NO: 5760000 - DNA, 17 bp, Homo sapiens
gccctcgtggccagccc

SEQ ID NO: 5760001 - DNA, 20 bp, Homo sapiens
gccctcgtggccagcccggc

SEQ ID NO: 5760002 - DNA, 17 bp, Homo sapiens
gccctctagggagggac

SEQ ID NO: 5760003 - DNA, 22 bp, Homo sapiens
gccctctatttattagccaact

SEQ ID NO: 5760004 - DNA, 16 bp, Homo sapiens
gccctctatttctctc

SEQ ID NO: 5760005 - DNA, 13 bp, Homo sapiens
gccctctcactcc

SEQ ID NO: 5760006 - DNA, 18 bp, Homo sapiens
gccctctcactccagcca

SEQ ID NO: 5760007 - DNA, 17 bp, Homo sapiens
gccctctcactgacttc

SEQ ID NO: 5760008 - DNA, 11 bp, Homo sapiens
gccctctcaga

SEQ ID NO: 5760009 - DNA, 19 bp, Homo sapiens
gccctctcaggccggcagc

SEQ ID NO: 5760010 - DNA, 19 bp, Homo sapiens
gccctctcatcgtctttta

SEQ ID NO: 5760011 - DNA, 23 bp, Homo sapiens
gccctctccacccagaggtctcc

SEQ ID NO: 5760012 - DNA, 15 bp, Homo sapiens
gccctctccccaccc

SEQ ID NO: 5760013 - DNA, 20 bp, Homo sapiens
gccctctccccacccctacc

SEQ ID NO: 5760014 - DNA, 23 bp, Homo sapiens
gccctctccccacccctacccct

SEQ ID NO: 5760015 - DNA, 17 bp, Homo sapiens
gccctgccagctgcagc

SEQ ID NO: 5760016 - DNA, 14 bp, Homo sapiens
gccctgccaggagg

SEQ ID NO: 5760017 - DNA, 22 bp, Homo sapiens
gccctgccaggaggctgcggcc

SEQ ID NO: 5760018 - DNA, 14 bp, Homo sapiens
gccctgccaggctg

SEQ ID NO: 5760019 - DNA, 15 bp, Homo sapiens
gccctgccaggctgt

SEQ ID NO: 5760020 - DNA, 19 bp, Homo sapiens
gccctgccatcttcccagc

SEQ ID NO: 5760021 - DNA, 17 bp, Homo sapiens
gccctgccattggcctc

SEQ ID NO: 5760022 - DNA, 18 bp, Homo sapiens
gccctgccattggcctct

SEQ ID NO: 5760023 - DNA, 22 bp, Homo sapiens
gccctgccattggcctcttgtc

SEQ ID NO: 5760024 - DNA, 20 bp, Homo sapiens
gccctgcccaagtgaccagg

SEQ ID NO: 5760025 - DNA, 13 bp, Homo sapiens
gccctgcccacac

SEQ ID NO: 5760026 - DNA, 14 bp, Homo sapiens
gccctgcccacaga

SEQ ID NO: 5760027 - DNA, 15 bp, Homo sapiens
gccctgcccacctgg

SEQ ID NO: 5760028 - DNA, 17 bp, Homo sapiens
gccctgcccacctggcc

SEQ ID NO: 5760029 - DNA, 11 bp, Homo sapiens
gccctgcccag

SEQ ID NO: 5760030 - DNA, 21 bp, Homo sapiens
gccctgcccaggtggcctcct

SEQ ID NO: 5760031 - DNA, 10 bp, Homo sapiens
gccctgcccc

SEQ ID NO: 5760032 - DNA, 11 bp, Homo sapiens
gccctgcccca

SEQ ID NO: 5760033 - DNA, 13 bp, Homo sapiens
gccctgccccaca

SEQ ID NO: 5760034 - DNA, 13 bp, Homo sapiens
gccctgccccacc

SEQ ID NO: 5760035 - DNA, 13 bp, Homo sapiens
gccctgccccagc

SEQ ID NO: 5760036 - DNA, 14 bp, Homo sapiens
gccctgccccagcc

SEQ ID NO: 5760037 - DNA, 18 bp, Homo sapiens
gccctgccccagccccta

SEQ ID NO: 5760038 - DNA, 15 bp, Homo sapiens
gccctgccccaggcc

SEQ ID NO: 5760039 - DNA, 22 bp, Homo sapiens
gccctgccccatcctgggcctt

SEQ ID NO: 5760040 - DNA, 15 bp, Homo sapiens
gccctgcccccaccc

SEQ ID NO: 5760041 - DNA, 21 bp, Homo sapiens
gccctgcccccaccccttcct

SEQ ID NO: 5760042 - DNA, 20 bp, Homo sapiens
gccctgcccccatctcccca

SEQ ID NO: 5760043 - DNA, 23 bp, Homo sapiens
gccctgcccccatctccccaggc

SEQ ID NO: 5760044 - DNA, 15 bp, Homo sapiens
gccctgccccccaca

SEQ ID NO: 5760045 - DNA, 16 bp, Homo sapiens
gccctgccccccacat

SEQ ID NO: 5760046 - DNA, 21 bp, Homo sapiens
gccctgccccccacattctgg

SEQ ID NO: 5760047 - DNA, 11 bp, Homo sapiens
gccctgcccct

SEQ ID NO: 5760048 - DNA, 12 bp, Homo sapiens
gccctgcccctc

SEQ ID NO: 5760049 - DNA, 23 bp, Homo sapiens
gccctgcccctccctagatccag

SEQ ID NO: 5760050 - DNA, 13 bp, Homo sapiens
gccctgcccctgc

SEQ ID NO: 5760051 - DNA, 21 bp, Homo sapiens
gccctgcccctgccccaaccc

SEQ ID NO: 5760052 - DNA, 17 bp, Homo sapiens
gccctgcccgggctccc

SEQ ID NO: 5760053 - DNA, 18 bp, Homo sapiens
gccctgcccgggctccca

SEQ ID NO: 5760054 - DNA, 22 bp, Homo sapiens
gccctgcccggggagctgcaga

SEQ ID NO: 5760055 - DNA, 23 bp, Homo sapiens
gccctgcccggggagctgcagag

SEQ ID NO: 5760056 - DNA, 10 bp, Homo sapiens
gccctgccct

SEQ ID NO: 5760057 - DNA, 14 bp, Homo sapiens
gccctgccctcact

SEQ ID NO: 5760058 - DNA, 17 bp, Homo sapiens
gccctgccctcactcca

SEQ ID NO: 5760059 - DNA, 14 bp, Homo sapiens
gccctgccctcagc

SEQ ID NO: 5760060 - DNA, 15 bp, Homo sapiens
gccctgccctcccaa

SEQ ID NO: 5760061 - DNA, 14 bp, Homo sapiens
gccctgccctcccc

SEQ ID NO: 5760062 - DNA, 17 bp, Homo sapiens
gccctgccctcccccac

SEQ ID NO: 5760063 - DNA, 19 bp, Homo sapiens
gccctgccctcccccacgg

SEQ ID NO: 5760064 - DNA, 15 bp, Homo sapiens
gccctgccctgagga

SEQ ID NO: 5760065 - DNA, 13 bp, Homo sapiens
gccctgccctgca

SEQ ID NO: 5760066 - DNA, 13 bp, Homo sapiens
gccctgccctgcc

SEQ ID NO: 5760067 - DNA, 13 bp, Homo sapiens
gccctgccctggc

SEQ ID NO: 5760068 - DNA, 13 bp, Homo sapiens
gccctgccctgta

SEQ ID NO: 5760069 - DNA, 14 bp, Homo sapiens
gccctgccctgtac

SEQ ID NO: 5760070 - DNA, 11 bp, Homo sapiens
gccctgccctt

SEQ ID NO: 5760071 - DNA, 15 bp, Homo sapiens
gccctgcccttcagc

SEQ ID NO: 5760072 - DNA, 16 bp, Homo sapiens
gccctgcccttggcac

SEQ ID NO: 5760073 - DNA, 12 bp, Homo sapiens
gccctgcctcac

SEQ ID NO: 5760074 - DNA, 13 bp, Homo sapiens
gccctgcctcact

SEQ ID NO: 5760075 - DNA, 16 bp, Homo sapiens
gccctgcctcagccag

SEQ ID NO: 5760076 - DNA, 22 bp, Homo sapiens
gccctgcctccaccgagccagc

SEQ ID NO: 5760077 - DNA, 14 bp, Homo sapiens
gccctgcctccctt

SEQ ID NO: 5760078 - DNA, 16 bp, Homo sapiens
gccctgcctccctttc

SEQ ID NO: 5760079 - DNA, 20 bp, Homo sapiens
gccctgcctcctgggaagat

SEQ ID NO: 5760080 - DNA, 16 bp, Homo sapiens
gccctgcctcctttgt

SEQ ID NO: 5760081 - DNA, 13 bp, Homo sapiens
gccctgcctctcc

SEQ ID NO: 5760082 - DNA, 17 bp, Homo sapiens
gccctgcctctccgccc

SEQ ID NO: 5760083 - DNA, 13 bp, Homo sapiens
gccctgcctctgt

SEQ ID NO: 5760084 - DNA, 15 bp, Homo sapiens
gccctgcctctgtgt

SEQ ID NO: 5760085 - DNA, 13 bp, Homo sapiens
gccctgcctgaga

SEQ ID NO: 5760086 - DNA, 14 bp, Homo sapiens
gccctgcctgaggg

SEQ ID NO: 5760087 - DNA, 22 bp, Homo sapiens
gccctgcctgcagccagggctg

SEQ ID NO: 5760088 - DNA, 14 bp, Homo sapiens
gccctgcctgccca

SEQ ID NO: 5760089 - DNA, 17 bp, Homo sapiens
gccctgcctgcccactt

SEQ ID NO: 5760090 - DNA, 13 bp, Homo sapiens
gccctgcctgcct

SEQ ID NO: 5760091 - DNA, 16 bp, Homo sapiens
gccctgcctgcctctt

SEQ ID NO: 5760092 - DNA, 23 bp, Homo sapiens
gccctgcctgcctcttggcctca

SEQ ID NO: 5760093 - DNA, 12 bp, Homo sapiens
gccctgcctgga

SEQ ID NO: 5760094 - DNA, 15 bp, Homo sapiens
gccctgcctggagga

SEQ ID NO: 5760095 - DNA, 19 bp, Homo sapiens
gccctgccttgccgctccc

SEQ ID NO: 5760096 - DNA, 19 bp, Homo sapiens
gccctgccttgtccctctc

SEQ ID NO: 5760097 - DNA, 14 bp, Homo sapiens
gccctgcgccctgt

SEQ ID NO: 5760098 - DNA, 17 bp, Homo sapiens
gccctgcgccctgtgca

SEQ ID NO: 5760099 - DNA, 16 bp, Homo sapiens
gccctgcggctctgga

SEQ ID NO: 5760100 - DNA, 13 bp, Homo sapiens
gccctgcgggcca

SEQ ID NO: 5760101 - DNA, 16 bp, Homo sapiens
gccctgcgggccacag

SEQ ID NO: 5760102 - DNA, 20 bp, Homo sapiens
gccctgcgggccacagggca

SEQ ID NO: 5760103 - DNA, 17 bp, Homo sapiens
gccctgcgttggagcca

SEQ ID NO: 5760104 - DNA, 10 bp, Homo sapiens
gccctgctac

SEQ ID NO: 5760105 - DNA, 22 bp, Homo sapiens
gccctgctactaacttttcaac

SEQ ID NO: 5760106 - DNA, 19 bp, Homo sapiens
gccctgctatttcaggccc

SEQ ID NO: 5760107 - DNA, 20 bp, Homo sapiens
gccctgctatttcaggccct

SEQ ID NO: 5760108 - DNA, 17 bp, Homo sapiens
gccctgctcaggcctca

SEQ ID NO: 5760109 - DNA, 13 bp, Homo sapiens
gccctgctccctc

SEQ ID NO: 5760110 - DNA, 20 bp, Homo sapiens
gccctgctccctctccccct

SEQ ID NO: 5760111 - DNA, 14 bp, Homo sapiens
gccctgctccctgc

SEQ ID NO: 5760112 - DNA, 15 bp, Homo sapiens
gccctgctccctgcc

SEQ ID NO: 5760113 - DNA, 17 bp, Homo sapiens
gccctgctccctgcctc

SEQ ID NO: 5760114 - DNA, 21 bp, Homo sapiens
gccctgctccctgcctcctgc

SEQ ID NO: 5760115 - DNA, 23 bp, Homo sapiens
gccctgctccctgcctcctgcct

SEQ ID NO: 5760116 - DNA, 18 bp, Homo sapiens
gccctgctcctccctggc

SEQ ID NO: 5760117 - DNA, 21 bp, Homo sapiens
gccctgctcctccctggctgc

SEQ ID NO: 5760118 - DNA, 23 bp, Homo sapiens
gccctgctcctccctggctgccc

SEQ ID NO: 5760119 - DNA, 14 bp, Homo sapiens
gccctgctcctgca

SEQ ID NO: 5760120 - DNA, 16 bp, Homo sapiens
gccctgctctggggat

SEQ ID NO: 5760121 - DNA, 21 bp, Homo sapiens
gccctgctcttctctccccag

SEQ ID NO: 5760122 - DNA, 17 bp, Homo sapiens
gccctgctctttctctg

SEQ ID NO: 5760123 - DNA, 17 bp, Homo sapiens
gccctgctgagcacaga

SEQ ID NO: 5760124 - DNA, 12 bp, Homo sapiens
gccctgctgagg

SEQ ID NO: 5760125 - DNA, 21 bp, Homo sapiens
gccctgctgcccctccctgcc

SEQ ID NO: 5760126 - DNA, 21 bp, Homo sapiens
gccctgctgccgcctcccagc

SEQ ID NO: 5760127 - DNA, 18 bp, Homo sapiens
gccctgctgcttcctaac

SEQ ID NO: 5760128 - DNA, 14 bp, Homo sapiens
gccctgctggccgc

SEQ ID NO: 5760129 - DNA, 18 bp, Homo sapiens
gccctgctggccgcctca

SEQ ID NO: 5760130 - DNA, 13 bp, Homo sapiens
gccctgctggcct

SEQ ID NO: 5760131 - DNA, 14 bp, Homo sapiens
gccctgctggcctg

SEQ ID NO: 5760132 - DNA, 17 bp, Homo sapiens
gccctgctgtgggagag

SEQ ID NO: 5760133 - DNA, 22 bp, Homo sapiens
gccctgctgtgggagagcgaag

SEQ ID NO: 5760134 - DNA, 19 bp, Homo sapiens
gccctgcttacctctgttt

SEQ ID NO: 5760135 - DNA, 15 bp, Homo sapiens
gccctgcttcctgct

SEQ ID NO: 5760136 - DNA, 15 bp, Homo sapiens
gccctgctttgcaaa

SEQ ID NO: 5760137 - DNA, 16 bp, Homo sapiens
gccctgctttgggctg

SEQ ID NO: 5760138 - DNA, 16 bp, Homo sapiens
gccctggaaagggggt

SEQ ID NO: 5760139 - DNA, 18 bp, Homo sapiens
gccctggaacctaccaga

SEQ ID NO: 5760140 - DNA, 21 bp, Homo sapiens
gccctggaactctatctgggc

SEQ ID NO: 5760141 - DNA, 17 bp, Homo sapiens
gccctggaagagtcctc

SEQ ID NO: 5760142 - DNA, 15 bp, Homo sapiens
gccctggacacagcc

SEQ ID NO: 5760143 - DNA, 21 bp, Homo sapiens
gccctggacacagcccaccct

SEQ ID NO: 5760144 - DNA, 22 bp, Homo sapiens
gccctggacacagcccaccctc

SEQ ID NO: 5760145 - DNA, 18 bp, Homo sapiens
gccctggacacccctgct

SEQ ID NO: 5760146 - DNA, 16 bp, Homo sapiens
gccctggaccagccgc

SEQ ID NO: 5760147 - DNA, 19 bp, Homo sapiens
gccctggaccccaggctct

SEQ ID NO: 5760148 - DNA, 14 bp, Homo sapiens
gccctggacttggt

SEQ ID NO: 5760149 - DNA, 14 bp, Homo sapiens
gccctggagagccc

SEQ ID NO: 5760150 - DNA, 17 bp, Homo sapiens
gccctggagagccccat

SEQ ID NO: 5760151 - DNA, 20 bp, Homo sapiens
gccctggagccaactgctgc

SEQ ID NO: 5760152 - DNA, 13 bp, Homo sapiens
gccctggagccag

SEQ ID NO: 5760153 - DNA, 14 bp, Homo sapiens
gccctggagccagg

SEQ ID NO: 5760154 - DNA, 16 bp, Homo sapiens
gccctggagccagggc

SEQ ID NO: 5760155 - DNA, 18 bp, Homo sapiens
gccctggagccagggcag

SEQ ID NO: 5760156 - DNA, 19 bp, Homo sapiens
gccctggagccagggcaga

SEQ ID NO: 5760157 - DNA, 23 bp, Homo sapiens
gccctggagccagggcagaggaa

SEQ ID NO: 5760158 - DNA, 20 bp, Homo sapiens
gccctggagcctcagcagca

SEQ ID NO: 5760159 - DNA, 13 bp, Homo sapiens
gccctggaggaag

SEQ ID NO: 5760160 - DNA, 19 bp, Homo sapiens
gccctggagggaaggacag

SEQ ID NO: 5760161 - DNA, 15 bp, Homo sapiens
gccctggagggcaga

SEQ ID NO: 5760162 - DNA, 16 bp, Homo sapiens
gccctggagggcagag

SEQ ID NO: 5760163 - DNA, 12 bp, Homo sapiens
gccctggagggg

SEQ ID NO: 5760164 - DNA, 14 bp, Homo sapiens
gccctggaggtctc

SEQ ID NO: 5760165 - DNA, 20 bp, Homo sapiens
gccctggaggtctccagggg

SEQ ID NO: 5760166 - DNA, 20 bp, Homo sapiens
gccctggaggtgccagcaaa

SEQ ID NO: 5760167 - DNA, 13 bp, Homo sapiens
gccctggaggtgg

SEQ ID NO: 5760168 - DNA, 14 bp, Homo sapiens
gccctggaggtggc

SEQ ID NO: 5760169 - DNA, 20 bp, Homo sapiens
gccctggaggtggctgagcc

SEQ ID NO: 5760170 - DNA, 20 bp, Homo sapiens
gccctggagtcccctgggcc

SEQ ID NO: 5760171 - DNA, 20 bp, Homo sapiens
gccctggatggcctctgggg

SEQ ID NO: 5760172 - DNA, 22 bp, Homo sapiens
gccctggatggcctctggggca

SEQ ID NO: 5760173 - DNA, 19 bp, Homo sapiens
gccctggatgtgcccacag

SEQ ID NO: 5760174 - DNA, 23 bp, Homo sapiens
gccctggattggttggcaaacta

SEQ ID NO: 5760175 - DNA, 17 bp, Homo sapiens
gccctggcacccccaca

SEQ ID NO: 5760176 - DNA, 14 bp, Homo sapiens
gccctggcagcagc

SEQ ID NO: 5760177 - DNA, 15 bp, Homo sapiens
gccctggcagcagca

SEQ ID NO: 5760178 - DNA, 12 bp, Homo sapiens
gccctggcagcc

SEQ ID NO: 5760179 - DNA, 19 bp, Homo sapiens
gccctggcaggatgaccct

SEQ ID NO: 5760180 - DNA, 15 bp, Homo sapiens
gccctggcaggcagg

SEQ ID NO: 5760181 - DNA, 17 bp, Homo sapiens
gccctggcagggggcat

SEQ ID NO: 5760182 - DNA, 20 bp, Homo sapiens
gccctggccactaaagcttc

SEQ ID NO: 5760183 - DNA, 17 bp, Homo sapiens
gccctggccactggccc

SEQ ID NO: 5760184 - DNA, 19 bp, Homo sapiens
gccctggccactggccctg

SEQ ID NO: 5760185 - DNA, 14 bp, Homo sapiens
gccctggccagagg

SEQ ID NO: 5760186 - DNA, 14 bp, Homo sapiens
gccctggccagccc

SEQ ID NO: 5760187 - DNA, 18 bp, Homo sapiens
gccctggccagcccttcc

SEQ ID NO: 5760188 - DNA, 19 bp, Homo sapiens
gccctggccagccgggagc

SEQ ID NO: 5760189 - DNA, 15 bp, Homo sapiens
gccctggccagggac

SEQ ID NO: 5760190 - DNA, 14 bp, Homo sapiens
gccctggcccagcc

SEQ ID NO: 5760191 - DNA, 16 bp, Homo sapiens
gccctggcccaggtgc

SEQ ID NO: 5760192 - DNA, 17 bp, Homo sapiens
gccctggcccccacagc

SEQ ID NO: 5760193 - DNA, 19 bp, Homo sapiens
gccctggcccccacagcgc

SEQ ID NO: 5760194 - DNA, 13 bp, Homo sapiens
gccctggccctga

SEQ ID NO: 5760195 - DNA, 20 bp, Homo sapiens
gccctggccctgcccagccc

SEQ ID NO: 5760196 - DNA, 22 bp, Homo sapiens
gccctgttccgcctcactgggt

SEQ ID NO: 5760197 - DNA, 17 bp, Homo sapiens
gccctgttgggggcttc

SEQ ID NO: 5760198 - DNA, 17 bp, Homo sapiens
gccctgttgtgccacag

SEQ ID NO: 5760199 - DNA, 20 bp, Homo sapiens
gccctgttgtgccacagagt

SEQ ID NO: 5760200 - DNA, 15 bp, Homo sapiens
gccctgttgtggggg

SEQ ID NO: 5760201 - DNA, 14 bp, Homo sapiens
gccctgtttccaat

SEQ ID NO: 5760202 - DNA, 20 bp, Homo sapiens
gccctgtttctccccacacc

SEQ ID NO: 5760203 - DNA, 14 bp, Homo sapiens
gccctgtttctgtt

SEQ ID NO: 5760204 - DNA, 18 bp, Homo sapiens
gcccttaaacaactgcag

SEQ ID NO: 5760205 - DNA, 20 bp, Homo sapiens
gcccttaaggatcaccccag

SEQ ID NO: 5760206 - DNA, 14 bp, Homo sapiens
gcccttacacactc

SEQ ID NO: 5760207 - DNA, 21 bp, Homo sapiens
gcccttacacactcaggcctg

SEQ ID NO: 5760208 - DNA, 23 bp, Homo sapiens
gcccttacagccctaagtggctg

SEQ ID NO: 5760209 - DNA, 20 bp, Homo sapiens
gcccttacctgccaggaagc

SEQ ID NO: 5760210 - DNA, 21 bp, Homo sapiens
gcccttacctgccaggaagcc

SEQ ID NO: 5760211 - DNA, 19 bp, Homo sapiens
gcccttacttcttgccctg

SEQ ID NO: 5760212 - DNA, 13 bp, Homo sapiens
gcccttagaggga

SEQ ID NO: 5760213 - DNA, 20 bp, Homo sapiens
gcccttagcagggaaacagc

SEQ ID NO: 5760214 - DNA, 22 bp, Homo sapiens
gcccttagcagggaaacagcta

SEQ ID NO: 5760215 - DNA, 17 bp, Homo sapiens
gcccttagccttgctgt

SEQ ID NO: 5760216 - DNA, 20 bp, Homo sapiens
gcccttagggagagcacctg

SEQ ID NO: 5760217 - DNA, 15 bp, Homo sapiens
gcccttagtccccca

SEQ ID NO: 5760218 - DNA, 18 bp, Homo sapiens
gcccttatctgtgctcag

SEQ ID NO: 5760219 - DNA, 18 bp, Homo sapiens
gcccttattttcaagaaa

SEQ ID NO: 5760220 - DNA, 22 bp, Homo sapiens
gcccttcacattttttatgggc

SEQ ID NO: 5760221 - DNA, 21 bp, Homo sapiens
gcccttcaccccagtggccac

SEQ ID NO: 5760222 - DNA, 14 bp, Homo sapiens
gcccttcactgcca

SEQ ID NO: 5760223 - DNA, 20 bp, Homo sapiens
gcccttcactgcctttgctc

SEQ ID NO: 5760224 - DNA, 18 bp, Homo sapiens
gcccttcactttctcctg

SEQ ID NO: 5760225 - DNA, 22 bp, Homo sapiens
gcccttcagacgagatcctgtt

SEQ ID NO: 5760226 - DNA, 15 bp, Homo sapiens
gcccttcagattgtt

SEQ ID NO: 5760227 - DNA, 17 bp, Homo sapiens
gcccttcaggacccttc

SEQ ID NO: 5760228 - DNA, 18 bp, Homo sapiens
gcccttcagtctgctcca

SEQ ID NO: 5760229 - DNA, 14 bp, Homo sapiens
gcccttccaggagt

SEQ ID NO: 5760230 - DNA, 16 bp, Homo sapiens
gcccttccaggagtgg

SEQ ID NO: 5760231 - DNA, 14 bp, Homo sapiens
gcccttccagtggg

SEQ ID NO: 5760232 - DNA, 12 bp, Homo sapiens
gcccttccatgt

SEQ ID NO: 5760233 - DNA, 14 bp, Homo sapiens
gcccttcccaacct

SEQ ID NO: 5760234 - DNA, 18 bp, Homo sapiens
gcccttcccaacctcccc

SEQ ID NO: 5760235 - DNA, 16 bp, Homo sapiens
gcccttcccaggccag

SEQ ID NO: 5760236 - DNA, 17 bp, Homo sapiens
gcccttcccaggccagc

SEQ ID NO: 5760237 - DNA, 13 bp, Homo sapiens
gcccttccccctg

SEQ ID NO: 5760238 - DNA, 22 bp, Homo sapiens
gcccttccccctttctctgcct

SEQ ID NO: 5760239 - DNA, 14 bp, Homo sapiens
gcccttcccctccc

SEQ ID NO: 5760240 - DNA, 19 bp, Homo sapiens
gcccttccctctgggcacg

SEQ ID NO: 5760241 - DNA, 14 bp, Homo sapiens
gcccttccctgagt

SEQ ID NO: 5760242 - DNA, 14 bp, Homo sapiens
gcccttccctgctt

SEQ ID NO: 5760243 - DNA, 14 bp, Homo sapiens
gcccttcctccagg

SEQ ID NO: 5760244 - DNA, 17 bp, Homo sapiens
gcccttcctccaggaga

SEQ ID NO: 5760245 - DNA, 16 bp, Homo sapiens
gcccttcctccctgtc

SEQ ID NO: 5760246 - DNA, 19 bp, Homo sapiens
gcccttcctcctccaccac

SEQ ID NO: 5760247 - DNA, 20 bp, Homo sapiens
gcccttcctcctccaccacc

SEQ ID NO: 5760248 - DNA, 21 bp, Homo sapiens
gcccttcctcctgaagcctct

SEQ ID NO: 5760249 - DNA, 22 bp, Homo sapiens
gcccttcctcctgaagcctctg

SEQ ID NO: 5760250 - DNA, 12 bp, Homo sapiens
gcccttcctcgc

SEQ ID NO: 5760251 - DNA, 19 bp, Homo sapiens
gcccttcctctcactcctg

SEQ ID NO: 5760252 - DNA, 23 bp, Homo sapiens
gcccttcctctccaccctcccag

SEQ ID NO: 5760253 - DNA, 18 bp, Homo sapiens
gcccttcctctccactgc

SEQ ID NO: 5760254 - DNA, 13 bp, Homo sapiens
gcccttcctctgc

SEQ ID NO: 5760255 - DNA, 14 bp, Homo sapiens
gcccttcctgaccc

SEQ ID NO: 5760256 - DNA, 12 bp, Homo sapiens
gcccttcctgga

SEQ ID NO: 5760257 - DNA, 13 bp, Homo sapiens
gcccttcctggac

SEQ ID NO: 5760258 - DNA, 13 bp, Homo sapiens
gcccttccttcac

SEQ ID NO: 5760259 - DNA, 16 bp, Homo sapiens
gcccttccttcaccca

SEQ ID NO: 5760260 - DNA, 20 bp, Homo sapiens
gcccttccttcacccaccac

SEQ ID NO: 5760261 - DNA, 21 bp, Homo sapiens
gcccttccttccatttttgat

SEQ ID NO: 5760262 - DNA, 15 bp, Homo sapiens
gcccttccttcccga

SEQ ID NO: 5760263 - DNA, 16 bp, Homo sapiens
gcccttccttggggaa

SEQ ID NO: 5760264 - DNA, 14 bp, Homo sapiens
gcccttcgctgcca

SEQ ID NO: 5760265 - DNA, 15 bp, Homo sapiens
gcccttcgctgccag

SEQ ID NO: 5760266 - DNA, 16 bp, Homo sapiens
gcccttcgctgccagg

SEQ ID NO: 5760267 - DNA, 17 bp, Homo sapiens
gcccttcgctgccagga

SEQ ID NO: 5760268 - DNA, 20 bp, Homo sapiens
gcccttcgctgccaggacac

SEQ ID NO: 5760269 - DNA, 20 bp, Homo sapiens
gcccttctatacccacccag

SEQ ID NO: 5760270 - DNA, 22 bp, Homo sapiens
gcccttctatacccacccagaa

SEQ ID NO: 5760271 - DNA, 20 bp, Homo sapiens
gcccttctcacgggctctat

SEQ ID NO: 5760272 - DNA, 14 bp, Homo sapiens
gcccttctcccggc

SEQ ID NO: 5760273 - DNA, 20 bp, Homo sapiens
gcccttctcccggccctcac

SEQ ID NO: 5760274 - DNA, 17 bp, Homo sapiens
gcccttctgactgttta

SEQ ID NO: 5760275 - DNA, 19 bp, Homo sapiens
gcccttctgattcccctcc

SEQ ID NO: 5760276 - DNA, 15 bp, Homo sapiens
gcccttctgtccacc

SEQ ID NO: 5760277 - DNA, 16 bp, Homo sapiens
gcccttcttccattcc

SEQ ID NO: 5760278 - DNA, 15 bp, Homo sapiens
gcccttcttgctgcc

SEQ ID NO: 5760279 - DNA, 19 bp, Homo sapiens
gcccttctttccacagaag

SEQ ID NO: 5760280 - DNA, 20 bp, Homo sapiens
gcccttcttttgaccccttc

SEQ ID NO: 5760281 - DNA, 19 bp, Homo sapiens
gcccttgactgtacagaga

SEQ ID NO: 5760282 - DNA, 17 bp, Homo sapiens
gcccttgaggggcccca

SEQ ID NO: 5760283 - DNA, 17 bp, Homo sapiens
gcccttgagtccccatt

SEQ ID NO: 5760284 - DNA, 16 bp, Homo sapiens
gcccttgcacaggcca

SEQ ID NO: 5760285 - DNA, 17 bp, Homo sapiens
gcccttgcacaggccac

SEQ ID NO: 5760286 - DNA, 13 bp, Homo sapiens
gcccttgcactcc

SEQ ID NO: 5760287 - DNA, 16 bp, Homo sapiens
gcccttgcagggtggg

SEQ ID NO: 5760288 - DNA, 12 bp, Homo sapiens
gcccttgcccaa

SEQ ID NO: 5760289 - DNA, 15 bp, Homo sapiens
gcccttgcccaactc

SEQ ID NO: 5760290 - DNA, 20 bp, Homo sapiens
gcccttgcccaactcccagc

SEQ ID NO: 5760291 - DNA, 13 bp, Homo sapiens
gcccttgccctga

SEQ ID NO: 5760292 - DNA, 18 bp, Homo sapiens
gcccttgccctgacctcc

SEQ ID NO: 5760293 - DNA, 19 bp, Homo sapiens
gcccttgcccttggagctg

SEQ ID NO: 5760294 - DNA, 18 bp, Homo sapiens
gcccttgccggggcctgg

SEQ ID NO: 5760295 - DNA, 22 bp, Homo sapiens
gcccttgccggggcctggactg

SEQ ID NO: 5760296 - DNA, 22 bp, Homo sapiens
gcccttgcctttgtggccttcc

SEQ ID NO: 5760297 - DNA, 17 bp, Homo sapiens
gcccttgctccagcctg

SEQ ID NO: 5760298 - DNA, 18 bp, Homo sapiens
gcccttgctccagcctga

SEQ ID NO: 5760299 - DNA, 17 bp, Homo sapiens
gcccttgctctacctgg

SEQ ID NO: 5760300 - DNA, 19 bp, Homo sapiens
gcccttgctctacctggcc

SEQ ID NO: 5760301 - DNA, 20 bp, Homo sapiens
gcccttgctctacctggccg

SEQ ID NO: 5760302 - DNA, 21 bp, Homo sapiens
gcccttgctctacctggccgg

SEQ ID NO: 5760303 - DNA, 16 bp, Homo sapiens
gcccttgctgggcctg

SEQ ID NO: 5760304 - DNA, 17 bp, Homo sapiens
gcccttgctgggcctgg

SEQ ID NO: 5760305 - DNA, 18 bp, Homo sapiens
gcccttggaacaccctgg

SEQ ID NO: 5760306 - DNA, 17 bp, Homo sapiens
gcccttggaataaagtt

SEQ ID NO: 5760307 - DNA, 14 bp, Homo sapiens
gcccttggagcctt

SEQ ID NO: 5760308 - DNA, 15 bp, Homo sapiens
gcccttggagccttc

SEQ ID NO: 5760309 - DNA, 16 bp, Homo sapiens
gcccttggagccttcc

SEQ ID NO: 5760310 - DNA, 21 bp, Homo sapiens
gcccttggagcgtggactggt

SEQ ID NO: 5760311 - DNA, 14 bp, Homo sapiens
gcccttggcaccac

SEQ ID NO: 5760312 - DNA, 12 bp, Homo sapiens
gcccttggccag

SEQ ID NO: 5760313 - DNA, 16 bp, Homo sapiens
gcccttggccatgggt

SEQ ID NO: 5760314 - DNA, 15 bp, Homo sapiens
gcccttggccccaga

SEQ ID NO: 5760315 - DNA, 15 bp, Homo sapiens
gcccttggctgcagg

SEQ ID NO: 5760316 - DNA, 17 bp, Homo sapiens
gcccttggctgcaggca

SEQ ID NO: 5760317 - DNA, 15 bp, Homo sapiens
gcccttggcttctgt

SEQ ID NO: 5760318 - DNA, 16 bp, Homo sapiens
gcccttgggacagcca

SEQ ID NO: 5760319 - DNA, 17 bp, Homo sapiens
gcccttgggacagccag

SEQ ID NO: 5760320 - DNA, 21 bp, Homo sapiens
gcccttgggacagccagagct

SEQ ID NO: 5760321 - DNA, 13 bp, Homo sapiens
gcccttgggccac

SEQ ID NO: 5760322 - DNA, 16 bp, Homo sapiens
gcccttggggcctggc

SEQ ID NO: 5760323 - DNA, 20 bp, Homo sapiens
gcccttggggcctggcttgc

SEQ ID NO: 5760324 - DNA, 14 bp, Homo sapiens
gcccttggggctgg

SEQ ID NO: 5760325 - DNA, 15 bp, Homo sapiens
gcccttggggctggg

SEQ ID NO: 5760326 - DNA, 22 bp, Homo sapiens
gcccttgggggtcctcctccag

SEQ ID NO: 5760327 - DNA, 21 bp, Homo sapiens
gcccttggggtaagccagagc

SEQ ID NO: 5760328 - DNA, 20 bp, Homo sapiens
gcccttggggttcccccaga

SEQ ID NO: 5760329 - DNA, 19 bp, Homo sapiens
gcccttggtagcagcctgg

SEQ ID NO: 5760330 - DNA, 19 bp, Homo sapiens
gcccttggtttctgggggc

SEQ ID NO: 5760331 - DNA, 22 bp, Homo sapiens
gcccttggtttctgggggctgg

SEQ ID NO: 5760332 - DNA, 21 bp, Homo sapiens
gcccttgtcccactcaagcca

SEQ ID NO: 5760333 - DNA, 18 bp, Homo sapiens
gcccttgtcctgccagct

SEQ ID NO: 5760334 - DNA, 13 bp, Homo sapiens
gcccttgtctgag

SEQ ID NO: 5760335 - DNA, 13 bp, Homo sapiens
gcccttgtgccct

SEQ ID NO: 5760336 - DNA, 15 bp, Homo sapiens
gcccttgtgccctgc

SEQ ID NO: 5760337 - DNA, 18 bp, Homo sapiens
gcccttgtgtgtgccctg

SEQ ID NO: 5760338 - DNA, 19 bp, Homo sapiens
gcccttgtgtgtgccctgg

SEQ ID NO: 5760339 - DNA, 16 bp, Homo sapiens
gcccttgttgcctgca

SEQ ID NO: 5760340 - DNA, 17 bp, Homo sapiens
gcccttgtttacagtga

SEQ ID NO: 5760341 - DNA, 13 bp, Homo sapiens
gcccttgtttata

SEQ ID NO: 5760342 - DNA, 19 bp, Homo sapiens
gcccttgtttggggcagga

SEQ ID NO: 5760343 - DNA, 17 bp, Homo sapiens
gccctttacttgtcttt

SEQ ID NO: 5760344 - DNA, 20 bp, Homo sapiens
gccctttacttgtctttctg

SEQ ID NO: 5760345 - DNA, 21 bp, Homo sapiens
gccctttacttgtctttctgg

SEQ ID NO: 5760346 - DNA, 20 bp, Homo sapiens
gccctttagggctgttgcta

SEQ ID NO: 5760347 - DNA, 18 bp, Homo sapiens
gccctttcacccctcttc

SEQ ID NO: 5760348 - DNA, 21 bp, Homo sapiens
gccctttcacccctcttccca

SEQ ID NO: 5760349 - DNA, 20 bp, Homo sapiens
gccctttccacgaaatccta

SEQ ID NO: 5760350 - DNA, 11 bp, Homo sapiens
gccctttccat

SEQ ID NO: 5760351 - DNA, 15 bp, Homo sapiens
gccctttccccactc

SEQ ID NO: 5760352 - DNA, 21 bp, Homo sapiens
gccctttccccgacgcccacc

SEQ ID NO: 5760353 - DNA, 21 bp, Homo sapiens
gccctttccccttcccctccc

SEQ ID NO: 5760354 - DNA, 15 bp, Homo sapiens
gccctttcctaggcc

SEQ ID NO: 5760355 - DNA, 15 bp, Homo sapiens
gccctttcctcctca

SEQ ID NO: 5760356 - DNA, 19 bp, Homo sapiens
gccctttcggatccaggga

SEQ ID NO: 5760357 - DNA, 22 bp, Homo sapiens
gccctttcggatccagggaggc

SEQ ID NO: 5760358 - DNA, 22 bp, Homo sapiens
gccctttctgtaccatttattt

SEQ ID NO: 5760359 - DNA, 16 bp, Homo sapiens
gccctttgaagcctca

SEQ ID NO: 5760360 - DNA, 19 bp, Homo sapiens
gccctttgaagcctcagct

SEQ ID NO: 5760361 - DNA, 21 bp, Homo sapiens
gccctttgagatctggggagg

SEQ ID NO: 5760362 - DNA, 13 bp, Homo sapiens
gccctttgcctgt

SEQ ID NO: 5760363 - DNA, 15 bp, Homo sapiens
gccctttgcctgtag

SEQ ID NO: 5760364 - DNA, 13 bp, Homo sapiens
gccctttgctgtc

SEQ ID NO: 5760365 - DNA, 15 bp, Homo sapiens
gccctttggcttctg

SEQ ID NO: 5760366 - DNA, 21 bp, Homo sapiens
gccctttggggttgcccagcc

SEQ ID NO: 5760367 - DNA, 21 bp, Homo sapiens
gccctttgggtactactgctg

SEQ ID NO: 5760368 - DNA, 18 bp, Homo sapiens
gccctttgtcctcctgct

SEQ ID NO: 5760369 - DNA, 22 bp, Homo sapiens
gccctttgtcctcctgctgcca

SEQ ID NO: 5760370 - DNA, 17 bp, Homo sapiens
gcccttttaaatggcat

SEQ ID NO: 5760371 - DNA, 20 bp, Homo sapiens
gcccttttacagctcttggc

SEQ ID NO: 5760372 - DNA, 21 bp, Homo sapiens
gcccttttcaggaagctctct

SEQ ID NO: 5760373 - DNA, 17 bp, Homo sapiens
gcccttttcatatactt

SEQ ID NO: 5760374 - DNA, 12 bp, Homo sapiens
gccgccccagcc

SEQ ID NO: 5760375 - DNA, 14 bp, Homo sapiens
gccgccccagcccc

SEQ ID NO: 5760376 - DNA, 20 bp, Homo sapiens
gccgccccatctgccccaca

SEQ ID NO: 5760377 - DNA, 18 bp, Homo sapiens
gccgcccccgcctgggca

SEQ ID NO: 5760378 - DNA, 15 bp, Homo sapiens
gccgccccctcctga

SEQ ID NO: 5760379 - DNA, 16 bp, Homo sapiens
gccgccccctcctgaa

SEQ ID NO: 5760380 - DNA, 24 bp, Homo sapiens
gccgccccgtgtccccccaggtgc

SEQ ID NO: 5760381 - DNA, 14 bp, Homo sapiens
gccgcccctgaggc

SEQ ID NO: 5760382 - DNA, 15 bp, Homo sapiens
gccgcccgctgggga

SEQ ID NO: 5760383 - DNA, 16 bp, Homo sapiens
gccgcccggcagtgca

SEQ ID NO: 5760384 - DNA, 19 bp, Homo sapiens
gccgccctcaccctgccct

SEQ ID NO: 5760385 - DNA, 14 bp, Homo sapiens
gccgccctccatcc

SEQ ID NO: 5760386 - DNA, 17 bp, Homo sapiens
gccgccctgtaccctct

SEQ ID NO: 5760387 - DNA, 15 bp, Homo sapiens
gccgccgaagggcag

SEQ ID NO: 5760388 - DNA, 15 bp, Homo sapiens
gccgccgccgctgcc

SEQ ID NO: 5760389 - DNA, 13 bp, Homo sapiens
gccgccgccgtgg

SEQ ID NO: 5760390 - DNA, 13 bp, Homo sapiens
gccgccgcctcgc

SEQ ID NO: 5760391 - DNA, 14 bp, Homo sapiens
gccgccgcctcgcc

SEQ ID NO: 5760392 - DNA, 24 bp, Homo sapiens
gccgccgcctcgcccaccgcatgc

SEQ ID NO: 5760393 - DNA, 21 bp, Homo sapiens
gccgccgctgaccctgggcct

SEQ ID NO: 5760394 - DNA, 17 bp, Homo sapiens
gccgccgggcaggcctg

SEQ ID NO: 5760395 - DNA, 14 bp, Homo sapiens
gccgcctagtgcag

SEQ ID NO: 5760396 - DNA, 16 bp, Homo sapiens
gccgcctagtgcagag

SEQ ID NO: 5760397 - DNA, 16 bp, Homo sapiens
gccgcctcccacggca

SEQ ID NO: 5760398 - DNA, 15 bp, Homo sapiens
gccgcctcccagcct

SEQ ID NO: 5760399 - DNA, 17 bp, Homo sapiens
gccgcctcccagcctgg

SEQ ID NO: 5760400 - DNA, 16 bp, Homo sapiens
gccgcctccctcaccc

SEQ ID NO: 5760401 - DNA, 18 bp, Homo sapiens
gccgcctccgggaccccc

SEQ ID NO: 5760402 - DNA, 13 bp, Homo sapiens
gccgcctcctcca

SEQ ID NO: 5760403 - DNA, 16 bp, Homo sapiens
gccgcctcgcccaccg

SEQ ID NO: 5760404 - DNA, 20 bp, Homo sapiens
gccgcctcgcccccgggccc

SEQ ID NO: 5760405 - DNA, 13 bp, Homo sapiens
gccgcctcgggcc

SEQ ID NO: 5760406 - DNA, 16 bp, Homo sapiens
gccgcctcgggccgcc

SEQ ID NO: 5760407 - DNA, 13 bp, Homo sapiens
gccgcctgcactc

SEQ ID NO: 5760408 - DNA, 22 bp, Homo sapiens
gccgcctgcactcctcagggca

SEQ ID NO: 5760409 - DNA, 19 bp, Homo sapiens
gccgcctgcagcccgtgtc

SEQ ID NO: 5760410 - DNA, 21 bp, Homo sapiens
gccgcctgccataccgctggg

SEQ ID NO: 5760411 - DNA, 14 bp, Homo sapiens
gccgcctgccctgc

SEQ ID NO: 5760412 - DNA, 15 bp, Homo sapiens
gccgcctgctccctg

SEQ ID NO: 5760413 - DNA, 17 bp, Homo sapiens
gccgcctgctccctgca

SEQ ID NO: 5760414 - DNA, 18 bp, Homo sapiens
gccgcctgctcctcactg

SEQ ID NO: 5760415 - DNA, 13 bp, Homo sapiens
gccgcctggcagg

SEQ ID NO: 5760416 - DNA, 13 bp, Homo sapiens
gccgcctgtcctt

SEQ ID NO: 5760417 - DNA, 16 bp, Homo sapiens
gccgccttctcccctc

SEQ ID NO: 5760418 - DNA, 22 bp, Homo sapiens
gccgccttctcccctctcccag

SEQ ID NO: 5760419 - DNA, 17 bp, Homo sapiens
gccgccttggccttgca

SEQ ID NO: 5760420 - DNA, 22 bp, Homo sapiens
gccgccttggccttgcagctgg

SEQ ID NO: 5760421 - DNA, 13 bp, Homo sapiens
gccgcctttgggt

SEQ ID NO: 5760422 - DNA, 23 bp, Homo sapiens
gccgcgaactgggttctttggaa

SEQ ID NO: 5760423 - DNA, 22 bp, Homo sapiens
gccgcgccagtccccgctagtg

SEQ ID NO: 5760424 - DNA, 15 bp, Homo sapiens
gccgcgcccagcaga

SEQ ID NO: 5760425 - DNA, 15 bp, Homo sapiens
gccgcgcctggctta

SEQ ID NO: 5760426 - DNA, 21 bp, Homo sapiens
gccgcgctccgaaccccgggc

SEQ ID NO: 5760427 - DNA, 15 bp, Homo sapiens
gccgcgctctgcccc

SEQ ID NO: 5760428 - DNA, 16 bp, Homo sapiens
gccgcgctctgcccct

SEQ ID NO: 5760429 - DNA, 22 bp, Homo sapiens
gccgcggccgacatcagcccgg

SEQ ID NO: 5760430 - DNA, 17 bp, Homo sapiens
gccgcggccgcccgcac

SEQ ID NO: 5760431 - DNA, 19 bp, Homo sapiens
gccgcggccgcccgcacgt

SEQ ID NO: 5760432 - DNA, 21 bp, Homo sapiens
gccgcggccgcccgcacgtcc

SEQ ID NO: 5760433 - DNA, 13 bp, Homo sapiens
gccgcggcctccc

SEQ ID NO: 5760434 - DNA, 16 bp, Homo sapiens
gccgcggcctccccga

SEQ ID NO: 5760435 - DNA, 15 bp, Homo sapiens
gccgcgggacagcca

SEQ ID NO: 5760436 - DNA, 24 bp, Homo sapiens
gccgcgggcgagaagggcgcagga

SEQ ID NO: 5760437 - DNA, 18 bp, Homo sapiens
gccgcgggcggccaggca

SEQ ID NO: 5760438 - DNA, 15 bp, Homo sapiens
gccgcgtgccgggcc

SEQ ID NO: 5760439 - DNA, 13 bp, Homo sapiens
gccgcgtggacag

SEQ ID NO: 5760440 - DNA, 19 bp, Homo sapiens
gccgcgtggacagccggag

SEQ ID NO: 5760441 - DNA, 16 bp, Homo sapiens
gccgcgtggtgccatc

SEQ ID NO: 5760442 - DNA, 20 bp, Homo sapiens
gccgcgtggtgccatcccca

SEQ ID NO: 5760443 - DNA, 21 bp, Homo sapiens
gccgcgtggtgccatccccag

SEQ ID NO: 5760444 - DNA, 17 bp, Homo sapiens
gccgctagaggcctgag

SEQ ID NO: 5760445 - DNA, 13 bp, Homo sapiens
gccgctaggagag

SEQ ID NO: 5760446 - DNA, 19 bp, Homo sapiens
gccgctaggagagactgaa

SEQ ID NO: 5760447 - DNA, 20 bp, Homo sapiens
gccgctatgcagggtagcac

SEQ ID NO: 5760448 - DNA, 11 bp, Homo sapiens
gccgctccaga

SEQ ID NO: 5760449 - DNA, 12 bp, Homo sapiens
gccgctccagag

SEQ ID NO: 5760450 - DNA, 13 bp, Homo sapiens
gccgctccagagt

SEQ ID NO: 5760451 - DNA, 21 bp, Homo sapiens
gccgctccgtgttcctcggtg

SEQ ID NO: 5760452 - DNA, 15 bp, Homo sapiens
gccgctcctccctgc

SEQ ID NO: 5760453 - DNA, 16 bp, Homo sapiens
gccgctcctctctaga

SEQ ID NO: 5760454 - DNA, 15 bp, Homo sapiens
gccgctcctgcttcc

SEQ ID NO: 5760455 - DNA, 23 bp, Homo sapiens
gccgctcctgtctgccagccagc

SEQ ID NO: 5760456 - DNA, 15 bp, Homo sapiens
gccgctcggaggccc

SEQ ID NO: 5760457 - DNA, 16 bp, Homo sapiens
gccgctcggaggcccc

SEQ ID NO: 5760458 - DNA, 22 bp, Homo sapiens
gccgctcggaggccccaaagga

SEQ ID NO: 5760459 - DNA, 11 bp, Homo sapiens
gccgctgcagg

SEQ ID NO: 5760460 - DNA, 13 bp, Homo sapiens
gccgctgcagggt

SEQ ID NO: 5760461 - DNA, 22 bp, Homo sapiens
gccgctgcagtcagcacagaga

SEQ ID NO: 5760462 - DNA, 16 bp, Homo sapiens
gccgctgccacccgcc

SEQ ID NO: 5760463 - DNA, 12 bp, Homo sapiens
gccgctgccatg

SEQ ID NO: 5760464 - DNA, 14 bp, Homo sapiens
gccgctgcccccac

SEQ ID NO: 5760465 - DNA, 15 bp, Homo sapiens
gccgctgcccccacc

SEQ ID NO: 5760466 - DNA, 16 bp, Homo sapiens
gccgctgcccccaccc

SEQ ID NO: 5760467 - DNA, 13 bp, Homo sapiens
gccgctgcccctg

SEQ ID NO: 5760468 - DNA, 19 bp, Homo sapiens
gccgctgcccggcgccctc

SEQ ID NO: 5760469 - DNA, 23 bp, Homo sapiens
gccgctgcccttgggtccccccg

SEQ ID NO: 5760470 - DNA, 18 bp, Homo sapiens
gccgctgctgtgacaggc

SEQ ID NO: 5760471 - DNA, 17 bp, Homo sapiens
gccgctgctttgcgctg

SEQ ID NO: 5760472 - DNA, 12 bp, Homo sapiens
gccgctggccca

SEQ ID NO: 5760473 - DNA, 13 bp, Homo sapiens
gccgctggctggt

SEQ ID NO: 5760474 - DNA, 22 bp, Homo sapiens
gccgctggctggtgggccccca

SEQ ID NO: 5760475 - DNA, 12 bp, Homo sapiens
gccgctgggaga

SEQ ID NO: 5760476 - DNA, 21 bp, Homo sapiens
gccgctgggagaaaagccaga

SEQ ID NO: 5760477 - DNA, 13 bp, Homo sapiens
gccgctgggagag

SEQ ID NO: 5760478 - DNA, 17 bp, Homo sapiens
gccgctgggagagccaa

SEQ ID NO: 5760479 - DNA, 22 bp, Homo sapiens
gccgctggggtccgtcttcaca

SEQ ID NO: 5760480 - DNA, 12 bp, Homo sapiens
gccgctggtgcc

SEQ ID NO: 5760481 - DNA, 16 bp, Homo sapiens
gccgctgtcaaggccg

SEQ ID NO: 5760482 - DNA, 21 bp, Homo sapiens
gccgctgtccaggttctgtct

SEQ ID NO: 5760483 - DNA, 12 bp, Homo sapiens
gccgctgtctct

SEQ ID NO: 5760484 - DNA, 15 bp, Homo sapiens
gccgctgtctctgag

SEQ ID NO: 5760485 - DNA, 17 bp, Homo sapiens
gccgctgtgagcccctg

SEQ ID NO: 5760486 - DNA, 13 bp, Homo sapiens
gccgctgtgccag

SEQ ID NO: 5760487 - DNA, 22 bp, Homo sapiens
gccgctgtgcccccctcctccc

SEQ ID NO: 5760488 - DNA, 18 bp, Homo sapiens
gccgctgtgtagggacca

SEQ ID NO: 5760489 - DNA, 16 bp, Homo sapiens
gccgcttccagcttcc

SEQ ID NO: 5760490 - DNA, 23 bp, Homo sapiens
gccgcttccctacccacagggcc

SEQ ID NO: 5760491 - DNA, 18 bp, Homo sapiens
gccgcttctccccagagc

SEQ ID NO: 5760492 - DNA, 23 bp, Homo sapiens
gccgcttctccccagagctgcct

SEQ ID NO: 5760493 - DNA, 14 bp, Homo sapiens
gccgctttgatgga

SEQ ID NO: 5760494 - DNA, 20 bp, Homo sapiens
gccgctttgtgattccatgg

SEQ ID NO: 5760495 - DNA, 15 bp, Homo sapiens
gccggaaagagagct

SEQ ID NO: 5760496 - DNA, 18 bp, Homo sapiens
gccggaaagagagctgga

SEQ ID NO: 5760497 - DNA, 19 bp, Homo sapiens
gccggaaagagagctggag

SEQ ID NO: 5760498 - DNA, 16 bp, Homo sapiens
gccggaaccacagggc

SEQ ID NO: 5760499 - DNA, 18 bp, Homo sapiens
gccggaaccacagggcca

SEQ ID NO: 5760500 - DNA, 13 bp, Homo sapiens
gccggacaccaag

SEQ ID NO: 5760501 - DNA, 22 bp, Homo sapiens
gccggacacccgactccagtcc

SEQ ID NO: 5760502 - DNA, 20 bp, Homo sapiens
gccggacacttctcaggaaa

SEQ ID NO: 5760503 - DNA, 15 bp, Homo sapiens
gccggacagctgccc

SEQ ID NO: 5760504 - DNA, 22 bp, Homo sapiens
gccggacagctgcccagacaca

SEQ ID NO: 5760505 - DNA, 15 bp, Homo sapiens
gccggaccaagatgg

SEQ ID NO: 5760506 - DNA, 19 bp, Homo sapiens
gccggaccaagatgggcac

SEQ ID NO: 5760507 - DNA, 20 bp, Homo sapiens
gccggaccaagatgggcaca

SEQ ID NO: 5760508 - DNA, 23 bp, Homo sapiens
gccggaccgcgtagagagccggg

SEQ ID NO: 5760509 - DNA, 13 bp, Homo sapiens
gccggacctctga

SEQ ID NO: 5760510 - DNA, 16 bp, Homo sapiens
gccggacctctgagca

SEQ ID NO: 5760511 - DNA, 22 bp, Homo sapiens
gccggacgcaggtgctgcggcg

SEQ ID NO: 5760512 - DNA, 16 bp, Homo sapiens
gccggagacccacagc

SEQ ID NO: 5760513 - DNA, 21 bp, Homo sapiens
gccggagacccacagccctga

SEQ ID NO: 5760514 - DNA, 14 bp, Homo sapiens
gccggagagctggt

SEQ ID NO: 5760515 - DNA, 13 bp, Homo sapiens
gccggagaggaag

SEQ ID NO: 5760516 - DNA, 20 bp, Homo sapiens
gccggagcagttggcctgtg

SEQ ID NO: 5760517 - DNA, 15 bp, Homo sapiens
gccggaggccagcta

SEQ ID NO: 5760518 - DNA, 23 bp, Homo sapiens
gccggaggccagctatctgcctg

SEQ ID NO: 5760519 - DNA, 21 bp, Homo sapiens
gccggagggagccctgagcct

SEQ ID NO: 5760520 - DNA, 16 bp, Homo sapiens
gccggagtcagtgcca

SEQ ID NO: 5760521 - DNA, 19 bp, Homo sapiens
gccggagtccactcccagt

SEQ ID NO: 5760522 - DNA, 15 bp, Homo sapiens
gccggatctgaggga

SEQ ID NO: 5760523 - DNA, 15 bp, Homo sapiens
gccggatcttggaga

SEQ ID NO: 5760524 - DNA, 15 bp, Homo sapiens
gccggatgtgctttt

SEQ ID NO: 5760525 - DNA, 20 bp, Homo sapiens
gccggcaaccccagttctgc

SEQ ID NO: 5760526 - DNA, 15 bp, Homo sapiens
gccggcaagcgagca

SEQ ID NO: 5760527 - DNA, 23 bp, Homo sapiens
gccggcacctacatccccaggtc

SEQ ID NO: 5760528 - DNA, 13 bp, Homo sapiens
gccggcaggggcc

SEQ ID NO: 5760529 - DNA, 15 bp, Homo sapiens
gccggcaggggcccc

SEQ ID NO: 5760530 - DNA, 19 bp, Homo sapiens
gccggccaatggaaacctc

SEQ ID NO: 5760531 - DNA, 11 bp, Homo sapiens
gccggccagcc

SEQ ID NO: 5760532 - DNA, 14 bp, Homo sapiens
gccggccagccagc

SEQ ID NO: 5760533 - DNA, 17 bp, Homo sapiens
gccggccagccagccac

SEQ ID NO: 5760534 - DNA, 12 bp, Homo sapiens
gccggccagccc

SEQ ID NO: 5760535 - DNA, 16 bp, Homo sapiens
gccggccagccttgca

SEQ ID NO: 5760536 - DNA, 12 bp, Homo sapiens
gccggccagctc

SEQ ID NO: 5760537 - DNA, 14 bp, Homo sapiens
gccggccagctccc

SEQ ID NO: 5760538 - DNA, 18 bp, Homo sapiens
gccggcccaacccaacca

SEQ ID NO: 5760539 - DNA, 22 bp, Homo sapiens
gccggcccaacccaaccactcg

SEQ ID NO: 5760540 - DNA, 16 bp, Homo sapiens
gccggcccacgtcctg

SEQ ID NO: 5760541 - DNA, 20 bp, Homo sapiens
gccggcccacgtcctgggtg

SEQ ID NO: 5760542 - DNA, 23 bp, Homo sapiens
gccggcccacgtcctgggtgctg

SEQ ID NO: 5760543 - DNA, 12 bp, Homo sapiens
gccggcccagat

SEQ ID NO: 5760544 - DNA, 17 bp, Homo sapiens
gccggcccccttcctgg

SEQ ID NO: 5760545 - DNA, 16 bp, Homo sapiens
gccggcccgcctctcc

SEQ ID NO: 5760546 - DNA, 17 bp, Homo sapiens
gccggccctgcccccca

SEQ ID NO: 5760547 - DNA, 15 bp, Homo sapiens
gccggccctgcccct

SEQ ID NO: 5760548 - DNA, 13 bp, Homo sapiens
gccggccctggct

SEQ ID NO: 5760549 - DNA, 13 bp, Homo sapiens
gccggccctgggg

SEQ ID NO: 5760550 - DNA, 20 bp, Homo sapiens
gccggccctggggctaggct

SEQ ID NO: 5760551 - DNA, 15 bp, Homo sapiens
gccggccctgtgtgc

SEQ ID NO: 5760552 - DNA, 16 bp, Homo sapiens
gccggccgcccagaca

SEQ ID NO: 5760553 - DNA, 22 bp, Homo sapiens
gccggccgccttctcccctctc

SEQ ID NO: 5760554 - DNA, 19 bp, Homo sapiens
gccgtcccgcgttcaagac

SEQ ID NO: 5760555 - DNA, 14 bp, Homo sapiens
gccgtcctcccggg

SEQ ID NO: 5760556 - DNA, 18 bp, Homo sapiens
gccgtcctcccgggccct

SEQ ID NO: 5760557 - DNA, 19 bp, Homo sapiens
gccgtcctcccgggccctc

SEQ ID NO: 5760558 - DNA, 13 bp, Homo sapiens
gccgtcctgctgg

SEQ ID NO: 5760559 - DNA, 17 bp, Homo sapiens
gccgtctacctgagggg

SEQ ID NO: 5760560 - DNA, 18 bp, Homo sapiens
gccgtctacctgaggggc

SEQ ID NO: 5760561 - DNA, 20 bp, Homo sapiens
gccgtctacctgaggggcct

SEQ ID NO: 5760562 - DNA, 22 bp, Homo sapiens
gccgtctacctgaggggcctct

SEQ ID NO: 5760563 - DNA, 17 bp, Homo sapiens
gccgtctcatcttctct

SEQ ID NO: 5760564 - DNA, 14 bp, Homo sapiens
gccgtctccagggg

SEQ ID NO: 5760565 - DNA, 21 bp, Homo sapiens
gccgtctccaggggctgcttc

SEQ ID NO: 5760566 - DNA, 23 bp, Homo sapiens
gccgtctccaggggctgcttcct

SEQ ID NO: 5760567 - DNA, 22 bp, Homo sapiens
gccgtctcccttggcccagaga

SEQ ID NO: 5760568 - DNA, 13 bp, Homo sapiens
gccgtctcctccc

SEQ ID NO: 5760569 - DNA, 15 bp, Homo sapiens
gccgtctctggcccc

SEQ ID NO: 5760570 - DNA, 16 bp, Homo sapiens
gccgtctgactccaga

SEQ ID NO: 5760571 - DNA, 21 bp, Homo sapiens
gccgtctgactccagagtctg

SEQ ID NO: 5760572 - DNA, 12 bp, Homo sapiens
gccgtctgcagg

SEQ ID NO: 5760573 - DNA, 19 bp, Homo sapiens
gccgtctgcaggggcctgg

SEQ ID NO: 5760574 - DNA, 19 bp, Homo sapiens
gccgtctggcgagccctta

SEQ ID NO: 5760575 - DNA, 23 bp, Homo sapiens
gccgtctggcgagcccttagcct

SEQ ID NO: 5760576 - DNA, 13 bp, Homo sapiens
gccgtctgtcctc

SEQ ID NO: 5760577 - DNA, 22 bp, Homo sapiens
gccgtcttcactcgcccccggg

SEQ ID NO: 5760578 - DNA, 18 bp, Homo sapiens
gccgtgacgtctgggtgg

SEQ ID NO: 5760579 - DNA, 23 bp, Homo sapiens
gccgtgagttctcagggctcctg

SEQ ID NO: 5760580 - DNA, 20 bp, Homo sapiens
gccgtgcacggggccagcat

SEQ ID NO: 5760581 - DNA, 16 bp, Homo sapiens
gccgtgcattagcaca

SEQ ID NO: 5760582 - DNA, 15 bp, Homo sapiens
gccgtgcccaggggc

SEQ ID NO: 5760583 - DNA, 15 bp, Homo sapiens
gccgtgcccgcccac

SEQ ID NO: 5760584 - DNA, 21 bp, Homo sapiens
gccgtgcccgcccacctctgc

SEQ ID NO: 5760585 - DNA, 13 bp, Homo sapiens
gccgtgcctggtg

SEQ ID NO: 5760586 - DNA, 15 bp, Homo sapiens
gccgtgccttcagct

SEQ ID NO: 5760587 - DNA, 17 bp, Homo sapiens
gccgtgccttcagctct

SEQ ID NO: 5760588 - DNA, 19 bp, Homo sapiens
gccgtgccttcagctctac

SEQ ID NO: 5760589 - DNA, 14 bp, Homo sapiens
gccgtgcgggcgag

SEQ ID NO: 5760590 - DNA, 20 bp, Homo sapiens
gccgtgctcgccccagcagg

SEQ ID NO: 5760591 - DNA, 16 bp, Homo sapiens
gccgtgctgggcagcc

SEQ ID NO: 5760592 - DNA, 14 bp, Homo sapiens
gccgtggagcttgg

SEQ ID NO: 5760593 - DNA, 16 bp, Homo sapiens
gccgtggagcttggag

SEQ ID NO: 5760594 - DNA, 19 bp, Homo sapiens
gccgtggagcttggagccc

SEQ ID NO: 5760595 - DNA, 23 bp, Homo sapiens
gccgtggagcttggagccccctg

SEQ ID NO: 5760596 - DNA, 23 bp, Homo sapiens
gccgtggagtcggagtggacacc

SEQ ID NO: 5760597 - DNA, 12 bp, Homo sapiens
gccgtggatgcg

SEQ ID NO: 5760598 - DNA, 14 bp, Homo sapiens
gccgtggcacagct

SEQ ID NO: 5760599 - DNA, 16 bp, Homo sapiens
gccgtggcacagctgg

SEQ ID NO: 5760600 - DNA, 13 bp, Homo sapiens
gccgtggccagag

SEQ ID NO: 5760601 - DNA, 13 bp, Homo sapiens
gccgtggctccag

SEQ ID NO: 5760602 - DNA, 15 bp, Homo sapiens
gccgtggctgcggca

SEQ ID NO: 5760603 - DNA, 18 bp, Homo sapiens
gccgtggctgcggcaccc

SEQ ID NO: 5760604 - DNA, 16 bp, Homo sapiens
gccgtggctgctgtgg

SEQ ID NO: 5760605 - DNA, 20 bp, Homo sapiens
gccgtggctgctgtgggaaa

SEQ ID NO: 5760606 - DNA, 13 bp, Homo sapiens
gccgtggcttccc

SEQ ID NO: 5760607 - DNA, 22 bp, Homo sapiens
gccgtggcttcccgctcagccc

SEQ ID NO: 5760608 - DNA, 22 bp, Homo sapiens
gccgtgggacccaggctcccag

SEQ ID NO: 5760609 - DNA, 15 bp, Homo sapiens
gccgtggggctccgg

SEQ ID NO: 5760610 - DNA, 16 bp, Homo sapiens
gccgtggtcctttggg

SEQ ID NO: 5760611 - DNA, 23 bp, Homo sapiens
gccgtggtgatttagcaggaagc

SEQ ID NO: 5760612 - DNA, 18 bp, Homo sapiens
gccgtgtcccctgacagg

SEQ ID NO: 5760613 - DNA, 14 bp, Homo sapiens
gccgtgtccccttg

SEQ ID NO: 5760614 - DNA, 23 bp, Homo sapiens
gccgtgtcccgcggtgctgactg

SEQ ID NO: 5760615 - DNA, 15 bp, Homo sapiens
gccgtgtctcagcct

SEQ ID NO: 5760616 - DNA, 18 bp, Homo sapiens
gccgtgtctcagcctctg

SEQ ID NO: 5760617 - DNA, 15 bp, Homo sapiens
gccgtgtctgtggcc

SEQ ID NO: 5760618 - DNA, 22 bp, Homo sapiens
gccgtgtgagtgtgacagggcc

SEQ ID NO: 5760619 - DNA, 15 bp, Homo sapiens
gccgtgtgtgcatgt

SEQ ID NO: 5760620 - DNA, 18 bp, Homo sapiens
gccgtgtgttgcatgcag

SEQ ID NO: 5760621 - DNA, 20 bp, Homo sapiens
gccgtgtgtttagaagccta

SEQ ID NO: 5760622 - DNA, 13 bp, Homo sapiens
gccgttcagcctg

SEQ ID NO: 5760623 - DNA, 14 bp, Homo sapiens
gccgttccctgcgc

SEQ ID NO: 5760624 - DNA, 13 bp, Homo sapiens
gccgttcctggga

SEQ ID NO: 5760625 - DNA, 14 bp, Homo sapiens
gccgttgaatctgg

SEQ ID NO: 5760626 - DNA, 20 bp, Homo sapiens
gccgttgaatctgggaggga

SEQ ID NO: 5760627 - DNA, 18 bp, Homo sapiens
gccgttgccgctgatgtt

SEQ ID NO: 5760628 - DNA, 18 bp, Homo sapiens
gccgttgcctctctgcca

SEQ ID NO: 5760629 - DNA, 19 bp, Homo sapiens
gccgttgctgacttagaat

SEQ ID NO: 5760630 - DNA, 12 bp, Homo sapiens
gccgttggccac

SEQ ID NO: 5760631 - DNA, 14 bp, Homo sapiens
gccgttggccacgt

SEQ ID NO: 5760632 - DNA, 23 bp, Homo sapiens
gccgtttgagaagaaaacatcta

SEQ ID NO: 5760633 - DNA, 14 bp, Homo sapiens
gcctaaaaatgcaa

SEQ ID NO: 5760634 - DNA, 20 bp, Homo sapiens
gcctaaaaattcccttcctg

SEQ ID NO: 5760635 - DNA, 22 bp, Homo sapiens
gcctaaaaattcccttcctgtt

SEQ ID NO: 5760636 - DNA, 18 bp, Homo sapiens
gcctaaaactggcctgac

SEQ ID NO: 5760637 - DNA, 22 bp, Homo sapiens
gcctaaaagattttgtgaaatt

SEQ ID NO: 5760638 - DNA, 23 bp, Homo sapiens
gcctaaaagtgggcttgattctg

SEQ ID NO: 5760639 - DNA, 12 bp, Homo sapiens
gcctaaaatctt

SEQ ID NO: 5760640 - DNA, 13 bp, Homo sapiens
gcctaaagcccat

SEQ ID NO: 5760641 - DNA, 20 bp, Homo sapiens
gcctaaagcccattgctgca

SEQ ID NO: 5760642 - DNA, 18 bp, Homo sapiens
gcctaaagctaaaaatat

SEQ ID NO: 5760643 - DNA, 19 bp, Homo sapiens
gcctaaagctaaaaatatt

SEQ ID NO: 5760644 - DNA, 21 bp, Homo sapiens
gcctaaagggcagggcccacg

SEQ ID NO: 5760645 - DNA, 19 bp, Homo sapiens
gcctaaagtacagcctgga

SEQ ID NO: 5760646 - DNA, 19 bp, Homo sapiens
gcctaaatccatttggaaa

SEQ ID NO: 5760647 - DNA, 13 bp, Homo sapiens
gcctaaatctaat

SEQ ID NO: 5760648 - DNA, 12 bp, Homo sapiens
gcctaaatgatg

SEQ ID NO: 5760649 - DNA, 20 bp, Homo sapiens
gcctaaattaaattgggctt

SEQ ID NO: 5760650 - DNA, 15 bp, Homo sapiens
gcctaaatttgtgct

SEQ ID NO: 5760651 - DNA, 20 bp, Homo sapiens
gcctaaccaggcccagccag

SEQ ID NO: 5760652 - DNA, 21 bp, Homo sapiens
gcctaaccaggcccagccagt

SEQ ID NO: 5760653 - DNA, 17 bp, Homo sapiens
gcctaacctgccgagag

SEQ ID NO: 5760654 - DNA, 13 bp, Homo sapiens
gcctaacctggga

SEQ ID NO: 5760655 - DNA, 18 bp, Homo sapiens
gcctaactaactggcagg

SEQ ID NO: 5760656 - DNA, 18 bp, Homo sapiens
gcctaagaagaaggccag

SEQ ID NO: 5760657 - DNA, 19 bp, Homo sapiens
gcctaagaagaaggccaga

SEQ ID NO: 5760658 - DNA, 22 bp, Homo sapiens
gcctaagaagaaggccagagag

SEQ ID NO: 5760659 - DNA, 18 bp, Homo sapiens
gcctaaggccagccattt

SEQ ID NO: 5760660 - DNA, 12 bp, Homo sapiens
gcctaaggctgc

SEQ ID NO: 5760661 - DNA, 16 bp, Homo sapiens
gcctaagggagacagg

SEQ ID NO: 5760662 - DNA, 17 bp, Homo sapiens
gcctaagtgcagccccg

SEQ ID NO: 5760663 - DNA, 11 bp, Homo sapiens
gcctaataaaa

SEQ ID NO: 5760664 - DNA, 16 bp, Homo sapiens
gcctaataaaactgat

SEQ ID NO: 5760665 - DNA, 18 bp, Homo sapiens
gcctaataaaactgatgt

SEQ ID NO: 5760666 - DNA, 17 bp, Homo sapiens
gcctaatacattaaagc

SEQ ID NO: 5760667 - DNA, 18 bp, Homo sapiens
gcctaatacattaaagca

SEQ ID NO: 5760668 - DNA, 20 bp, Homo sapiens
gcctaatacattaaagcagt

SEQ ID NO: 5760669 - DNA, 17 bp, Homo sapiens
gcctaatattcatgctg

SEQ ID NO: 5760670 - DNA, 20 bp, Homo sapiens
gcctaatattgaaaatgtca

SEQ ID NO: 5760671 - DNA, 17 bp, Homo sapiens
gcctaatcactctgagt

SEQ ID NO: 5760672 - DNA, 22 bp, Homo sapiens
gcctaatctcatacctctgacc

SEQ ID NO: 5760673 - DNA, 15 bp, Homo sapiens
gcctaatggagaaga

SEQ ID NO: 5760674 - DNA, 16 bp, Homo sapiens
gcctaatgtgtttgag

SEQ ID NO: 5760675 - DNA, 23 bp, Homo sapiens
gcctaattacgataaggaagaaa

SEQ ID NO: 5760676 - DNA, 15 bp, Homo sapiens
gcctaattttttaaa

SEQ ID NO: 5760677 - DNA, 21 bp, Homo sapiens
gcctacaaaacctcaaaccag

SEQ ID NO: 5760678 - DNA, 16 bp, Homo sapiens
gcctacaaatcagtaa

SEQ ID NO: 5760679 - DNA, 20 bp, Homo sapiens
gcctacaaccatccctgcca

SEQ ID NO: 5760680 - DNA, 22 bp, Homo sapiens
gcctacaagctggcacttgcta

SEQ ID NO: 5760681 - DNA, 17 bp, Homo sapiens
gcctacaatgggaaaac

SEQ ID NO: 5760682 - DNA, 18 bp, Homo sapiens
gcctacaatgggaaaact

SEQ ID NO: 5760683 - DNA, 15 bp, Homo sapiens
gcctacagaggaggc

SEQ ID NO: 5760684 - DNA, 18 bp, Homo sapiens
gcctacagaggaggcctc

SEQ ID NO: 5760685 - DNA, 16 bp, Homo sapiens
gcctacagcagtgtgg

SEQ ID NO: 5760686 - DNA, 13 bp, Homo sapiens
gcctacagccaca

SEQ ID NO: 5760687 - DNA, 12 bp, Homo sapiens
gcctacagccag

SEQ ID NO: 5760688 - DNA, 14 bp, Homo sapiens
gcctacagccaggt

SEQ ID NO: 5760689 - DNA, 16 bp, Homo sapiens
gcctacaggagtgagc

SEQ ID NO: 5760690 - DNA, 21 bp, Homo sapiens
gcctacatcccgggcctcagt

SEQ ID NO: 5760691 - DNA, 19 bp, Homo sapiens
gcctacatgctttgtgaac

SEQ ID NO: 5760692 - DNA, 21 bp, Homo sapiens
gcctacattccctggcctggc

SEQ ID NO: 5760693 - DNA, 15 bp, Homo sapiens
gcctacattctttat

SEQ ID NO: 5760694 - DNA, 20 bp, Homo sapiens
gcctacattttagtttctaa

SEQ ID NO: 5760695 - DNA, 15 bp, Homo sapiens
gcctaccaatattta

SEQ ID NO: 5760696 - DNA, 19 bp, Homo sapiens
gcctaccacagctgcctcc

SEQ ID NO: 5760697 - DNA, 23 bp, Homo sapiens
gcctaccagtcgccctctgtgcc

SEQ ID NO: 5760698 - DNA, 17 bp, Homo sapiens
gcctaccccgcagacac

SEQ ID NO: 5760699 - DNA, 16 bp, Homo sapiens
gcctacccctcctgcg

SEQ ID NO: 5760700 - DNA, 15 bp, Homo sapiens
gcctacccctttctc

SEQ ID NO: 5760701 - DNA, 19 bp, Homo sapiens
gcctacccttgtaccccat

SEQ ID NO: 5760702 - DNA, 22 bp, Homo sapiens
gcctacccttgtaccccatccc

SEQ ID NO: 5760703 - DNA, 17 bp, Homo sapiens
gcctacctcaagttctt

SEQ ID NO: 5760704 - DNA, 21 bp, Homo sapiens
gcctacctcaagttcttggac

SEQ ID NO: 5760705 - DNA, 11 bp, Homo sapiens
gcctacctctc

SEQ ID NO: 5760706 - DNA, 12 bp, Homo sapiens
gcctacctctcc

SEQ ID NO: 5760707 - DNA, 15 bp, Homo sapiens
gcctacctctccaca

SEQ ID NO: 5760708 - DNA, 23 bp, Homo sapiens
gcctacctctcgtttctgcccag

SEQ ID NO: 5760709 - DNA, 16 bp, Homo sapiens
gcctacctgctcccct

SEQ ID NO: 5760710 - DNA, 13 bp, Homo sapiens
gcctacctgctct

SEQ ID NO: 5760711 - DNA, 14 bp, Homo sapiens
gcctacctgctctc

SEQ ID NO: 5760712 - DNA, 14 bp, Homo sapiens
gcctacctgtatgt

SEQ ID NO: 5760713 - DNA, 18 bp, Homo sapiens
gcctactagggacctggg

SEQ ID NO: 5760714 - DNA, 22 bp, Homo sapiens
gcctactagggacctggggaag

SEQ ID NO: 5760715 - DNA, 14 bp, Homo sapiens
gcctactatacatt

SEQ ID NO: 5760716 - DNA, 15 bp, Homo sapiens
gcctactcctgtctt

SEQ ID NO: 5760717 - DNA, 16 bp, Homo sapiens
gcctactcctgtcttc

SEQ ID NO: 5760718 - DNA, 19 bp, Homo sapiens
gcctactcgcttgctagaa

SEQ ID NO: 5760719 - DNA, 22 bp, Homo sapiens
gcctactctttgttttctttcc

SEQ ID NO: 5760720 - DNA, 17 bp, Homo sapiens
gcctactgagtagcttt

SEQ ID NO: 5760721 - DNA, 19 bp, Homo sapiens
gcctactgagtagctttca

SEQ ID NO: 5760722 - DNA, 20 bp, Homo sapiens
gcctactgagtagctttcat

SEQ ID NO: 5760723 - DNA, 22 bp, Homo sapiens
gcctactgcccctgccctgagg

SEQ ID NO: 5760724 - DNA, 18 bp, Homo sapiens
gcctactggacgctgccc

SEQ ID NO: 5760725 - DNA, 14 bp, Homo sapiens
gcctactgtccctc

SEQ ID NO: 5760726 - DNA, 12 bp, Homo sapiens
gcctactgtctc

SEQ ID NO: 5760727 - DNA, 19 bp, Homo sapiens
gcctactgtctccttccca

SEQ ID NO: 5760728 - DNA, 20 bp, Homo sapiens
gcctactgtctccttcccac

SEQ ID NO: 5760729 - DNA, 16 bp, Homo sapiens
gcctacttaattctga

SEQ ID NO: 5760730 - DNA, 16 bp, Homo sapiens
gcctacttttctttat

SEQ ID NO: 5760731 - DNA, 16 bp, Homo sapiens
gcctagaaacaacact

SEQ ID NO: 5760732 - DNA, 16 bp, Homo sapiens
gcctcacaaatgctgt

SEQ ID NO: 5760733 - DNA, 15 bp, Homo sapiens
gcctcacacccagag

SEQ ID NO: 5760734 - DNA, 17 bp, Homo sapiens
gcctcacagatgctggc

SEQ ID NO: 5760735 - DNA, 19 bp, Homo sapiens
gcctcacagatgctggcct

SEQ ID NO: 5760736 - DNA, 21 bp, Homo sapiens
gcctcacagatgctggcctct

SEQ ID NO: 5760737 - DNA, 15 bp, Homo sapiens
gcctcacatctccct

SEQ ID NO: 5760738 - DNA, 17 bp, Homo sapiens
gcctcaccacacccagg

SEQ ID NO: 5760739 - DNA, 19 bp, Homo sapiens
gcctcaccacacccaggtc

SEQ ID NO: 5760740 - DNA, 14 bp, Homo sapiens
gcctcaccacctga

SEQ ID NO: 5760741 - DNA, 14 bp, Homo sapiens
gcctcaccagcccc

SEQ ID NO: 5760742 - DNA, 19 bp, Homo sapiens
gcctcaccagccctggcaa

SEQ ID NO: 5760743 - DNA, 18 bp, Homo sapiens
gcctcacccacccctgca

SEQ ID NO: 5760744 - DNA, 19 bp, Homo sapiens
gcctcacccacccctgcac

SEQ ID NO: 5760745 - DNA, 17 bp, Homo sapiens
gcctcacccctcccctg

SEQ ID NO: 5760746 - DNA, 18 bp, Homo sapiens
gcctcacccctcccctgg

SEQ ID NO: 5760747 - DNA, 18 bp, Homo sapiens
gcctcacccctgcaggcg

SEQ ID NO: 5760748 - DNA, 17 bp, Homo sapiens
gcctcacctcccagggc

SEQ ID NO: 5760749 - DNA, 16 bp, Homo sapiens
gcctcacctctaccca

SEQ ID NO: 5760750 - DNA, 16 bp, Homo sapiens
gcctcacctgcccctc

SEQ ID NO: 5760751 - DNA, 20 bp, Homo sapiens
gcctcacctgcccctctgtt

SEQ ID NO: 5760752 - DNA, 22 bp, Homo sapiens
gcctcacctggtcgccaatcca

SEQ ID NO: 5760753 - DNA, 15 bp, Homo sapiens
gcctcacctttccca

SEQ ID NO: 5760754 - DNA, 19 bp, Homo sapiens
gcctcacctttcctgccgt

SEQ ID NO: 5760755 - DNA, 16 bp, Homo sapiens
gcctcacgcccagcct

SEQ ID NO: 5760756 - DNA, 15 bp, Homo sapiens
gcctcacgcccccag

SEQ ID NO: 5760757 - DNA, 18 bp, Homo sapiens
gcctcacgcccccaggaa

SEQ ID NO: 5760758 - DNA, 22 bp, Homo sapiens
gcctcacggggttggctgttcc

SEQ ID NO: 5760759 - DNA, 17 bp, Homo sapiens
gcctcacgtgtctcaga

SEQ ID NO: 5760760 - DNA, 20 bp, Homo sapiens
gcctcactactcgagcccac

SEQ ID NO: 5760761 - DNA, 17 bp, Homo sapiens
gcctcactcagctctga

SEQ ID NO: 5760762 - DNA, 22 bp, Homo sapiens
gcctcactgatatattttccag

SEQ ID NO: 5760763 - DNA, 14 bp, Homo sapiens
gcctcactggctca

SEQ ID NO: 5760764 - DNA, 20 bp, Homo sapiens
gcctcactggctcatgcccc

SEQ ID NO: 5760765 - DNA, 15 bp, Homo sapiens
gcctcactggctggg

SEQ ID NO: 5760766 - DNA, 20 bp, Homo sapiens
gcctcactgtgacctgctcc

SEQ ID NO: 5760767 - DNA, 21 bp, Homo sapiens
gcctcactgtgacctgctcct

SEQ ID NO: 5760768 - DNA, 14 bp, Homo sapiens
gcctcacttccctg

SEQ ID NO: 5760769 - DNA, 16 bp, Homo sapiens
gcctcacttccctggg

SEQ ID NO: 5760770 - DNA, 17 bp, Homo sapiens
gcctcacttccctggga

SEQ ID NO: 5760771 - DNA, 20 bp, Homo sapiens
gcctcacttctagggtatgg

SEQ ID NO: 5760772 - DNA, 18 bp, Homo sapiens
gcctcacttgaatgtgtc

SEQ ID NO: 5760773 - DNA, 19 bp, Homo sapiens
gcctcacttggtctgccag

SEQ ID NO: 5760774 - DNA, 20 bp, Homo sapiens
gcctcacttggtctgccagg

SEQ ID NO: 5760775 - DNA, 22 bp, Homo sapiens
gcctcacttttaatgaacaaat

SEQ ID NO: 5760776 - DNA, 9 bp, Homo sapiens
gcctcagaa

SEQ ID NO: 5760777 - DNA, 23 bp, Homo sapiens
gcctcagaaggccccagagagac

SEQ ID NO: 5760778 - DNA, 15 bp, Homo sapiens
gcctcagaccccagg

SEQ ID NO: 5760779 - DNA, 20 bp, Homo sapiens
gcctcagaccccctcagcct

SEQ ID NO: 5760780 - DNA, 20 bp, Homo sapiens
gcctcagacgttgcctgaga

SEQ ID NO: 5760781 - DNA, 15 bp, Homo sapiens
gcctcagactccgcc

SEQ ID NO: 5760782 - DNA, 20 bp, Homo sapiens
gcctcagactgcacccagga

SEQ ID NO: 5760783 - DNA, 21 bp, Homo sapiens
gcctcagactgcacccaggag

SEQ ID NO: 5760784 - DNA, 21 bp, Homo sapiens
gcctcagactggagggcaagg

SEQ ID NO: 5760785 - DNA, 12 bp, Homo sapiens
gcctcagagaca

SEQ ID NO: 5760786 - DNA, 13 bp, Homo sapiens
gcctcagagacag

SEQ ID NO: 5760787 - DNA, 12 bp, Homo sapiens
gcctcagagacc

SEQ ID NO: 5760788 - DNA, 15 bp, Homo sapiens
gcctcagagaccagg

SEQ ID NO: 5760789 - DNA, 22 bp, Homo sapiens
gcctcagagcctgacctgagag

SEQ ID NO: 5760790 - DNA, 14 bp, Homo sapiens
gcctcagagcttcc

SEQ ID NO: 5760791 - DNA, 20 bp, Homo sapiens
gcctcagagcttcctgggga

SEQ ID NO: 5760792 - DNA, 23 bp, Homo sapiens
gcctcagaggccccttgctgctg

SEQ ID NO: 5760793 - DNA, 19 bp, Homo sapiens
gcctcagaggccttgggag

SEQ ID NO: 5760794 - DNA, 22 bp, Homo sapiens
gcctcagattccttcccatgga

SEQ ID NO: 5760795 - DNA, 15 bp, Homo sapiens
gcctcagcagaaggc

SEQ ID NO: 5760796 - DNA, 16 bp, Homo sapiens
gcctcagcagaaggcc

SEQ ID NO: 5760797 - DNA, 18 bp, Homo sapiens
gcctcagcagcaaatgcc

SEQ ID NO: 5760798 - DNA, 14 bp, Homo sapiens
gcctcagcatccca

SEQ ID NO: 5760799 - DNA, 21 bp, Homo sapiens
gcctcagcatcctggcacccg

SEQ ID NO: 5760800 - DNA, 16 bp, Homo sapiens
gcctcagccactccca

SEQ ID NO: 5760801 - DNA, 18 bp, Homo sapiens
gcctcagccactcccagg

SEQ ID NO: 5760802 - DNA, 16 bp, Homo sapiens
gcctcagccagagaag

SEQ ID NO: 5760803 - DNA, 13 bp, Homo sapiens
gcctcagccagcc

SEQ ID NO: 5760804 - DNA, 22 bp, Homo sapiens
gcctcagccagctgcccacaag

SEQ ID NO: 5760805 - DNA, 21 bp, Homo sapiens
gcctcagccagtggcacagga

SEQ ID NO: 5760806 - DNA, 22 bp, Homo sapiens
gcctcagcccaacttcttaccc

SEQ ID NO: 5760807 - DNA, 13 bp, Homo sapiens
gcctcagccctca

SEQ ID NO: 5760808 - DNA, 17 bp, Homo sapiens
gcctcagccctcagttc

SEQ ID NO: 5760809 - DNA, 20 bp, Homo sapiens
gcctcagccctgctccctgc

SEQ ID NO: 5760810 - DNA, 15 bp, Homo sapiens
gcctcagcctactcc

SEQ ID NO: 5760811 - DNA, 15 bp, Homo sapiens
gcctcagcctccagg

SEQ ID NO: 5760812 - DNA, 22 bp, Homo sapiens
gcctcagcctcccaaagtgctg

SEQ ID NO: 5760813 - DNA, 20 bp, Homo sapiens
gcctcagcctcccatagctg

SEQ ID NO: 5760814 - DNA, 14 bp, Homo sapiens
gcctcagcctcccg

SEQ ID NO: 5760815 - DNA, 15 bp, Homo sapiens
gcctcagcctcctga

SEQ ID NO: 5760816 - DNA, 16 bp, Homo sapiens
gcctcagcctcctgag

SEQ ID NO: 5760817 - DNA, 22 bp, Homo sapiens
gcctcagcctgctttcctgcag

SEQ ID NO: 5760818 - DNA, 15 bp, Homo sapiens
gcctcagcctggggc

SEQ ID NO: 5760819 - DNA, 19 bp, Homo sapiens
gcctcagcctggggctctc

SEQ ID NO: 5760820 - DNA, 22 bp, Homo sapiens
gcctcagcctggggctctctga

SEQ ID NO: 5760821 - DNA, 13 bp, Homo sapiens
gcctcagccttcc

SEQ ID NO: 5760822 - DNA, 18 bp, Homo sapiens
gcctcagcgcggccctcc

SEQ ID NO: 5760823 - DNA, 16 bp, Homo sapiens
gcctcagcgctgccca

SEQ ID NO: 5760824 - DNA, 19 bp, Homo sapiens
gcctcagcgctgcccacac

SEQ ID NO: 5760825 - DNA, 21 bp, Homo sapiens
gcctcagcggaccactcttct

SEQ ID NO: 5760826 - DNA, 15 bp, Homo sapiens
gcctcagcgtcctgg

SEQ ID NO: 5760827 - DNA, 20 bp, Homo sapiens
gcctcagctacccactatcc

SEQ ID NO: 5760828 - DNA, 14 bp, Homo sapiens
gcctcagctatgta

SEQ ID NO: 5760829 - DNA, 12 bp, Homo sapiens
gcctcagctcag

SEQ ID NO: 5760830 - DNA, 14 bp, Homo sapiens
gcctcagctcagcc

SEQ ID NO: 5760831 - DNA, 16 bp, Homo sapiens
gcctcagctcagcctc

SEQ ID NO: 5760832 - DNA, 15 bp, Homo sapiens
gcctcagctcccaca

SEQ ID NO: 5760833 - DNA, 17 bp, Homo sapiens
gcctcagctcccacaag

SEQ ID NO: 5760834 - DNA, 18 bp, Homo sapiens
gcctcagctgacccggcc

SEQ ID NO: 5760835 - DNA, 15 bp, Homo sapiens
gcctcagctgcctca

SEQ ID NO: 5760836 - DNA, 19 bp, Homo sapiens
gcctcagctgcctcacttc

SEQ ID NO: 5760837 - DNA, 20 bp, Homo sapiens
gcctcagctgctcgcacaga

SEQ ID NO: 5760838 - DNA, 12 bp, Homo sapiens
gcctcagctggc

SEQ ID NO: 5760839 - DNA, 14 bp, Homo sapiens
gcctcagcttctgg

SEQ ID NO: 5760840 - DNA, 12 bp, Homo sapiens
gcctcaggaccc

SEQ ID NO: 5760841 - DNA, 13 bp, Homo sapiens
gcctcaggaccca

SEQ ID NO: 5760842 - DNA, 14 bp, Homo sapiens
gcctcaggacccat

SEQ ID NO: 5760843 - DNA, 19 bp, Homo sapiens
gcctcaggacccatccctg

SEQ ID NO: 5760844 - DNA, 23 bp, Homo sapiens
gcctcaggacccatccctgcctg

SEQ ID NO: 5760845 - DNA, 18 bp, Homo sapiens
gcctcaggactgggagcc

SEQ ID NO: 5760846 - DNA, 23 bp, Homo sapiens
gcctcaggactgggagcccccag

SEQ ID NO: 5760847 - DNA, 14 bp, Homo sapiens
gcctcaggcctggc

SEQ ID NO: 5760848 - DNA, 18 bp, Homo sapiens
gcctcaggcctggccctt

SEQ ID NO: 5760849 - DNA, 21 bp, Homo sapiens
gcctcaggcgtttctgaagtg

SEQ ID NO: 5760850 - DNA, 13 bp, Homo sapiens
gcctcaggctccg

SEQ ID NO: 5760851 - DNA, 12 bp, Homo sapiens
gcctcaggctct

SEQ ID NO: 5760852 - DNA, 21 bp, Homo sapiens
gcctcaggctctgcacagaca

SEQ ID NO: 5760853 - DNA, 19 bp, Homo sapiens
gcctcagggccaagccggc

SEQ ID NO: 5760854 - DNA, 23 bp, Homo sapiens
gcctcagggccaagccggcccaa

SEQ ID NO: 5760855 - DNA, 14 bp, Homo sapiens
gcctcagggccagg

SEQ ID NO: 5760856 - DNA, 17 bp, Homo sapiens
gcctcagggccaggccc

SEQ ID NO: 5760857 - DNA, 20 bp, Homo sapiens
gcctcagggccaggcccagg

SEQ ID NO: 5760858 - DNA, 17 bp, Homo sapiens
gcctcagggcgctcaga

SEQ ID NO: 5760859 - DNA, 19 bp, Homo sapiens
gcctcagggcgctcagacg

SEQ ID NO: 5760860 - DNA, 14 bp, Homo sapiens
gcctcagggctcct

SEQ ID NO: 5760861 - DNA, 12 bp, Homo sapiens
gcctcagggctt

SEQ ID NO: 5760862 - DNA, 16 bp, Homo sapiens
gcctcagggcttcctt

SEQ ID NO: 5760863 - DNA, 19 bp, Homo sapiens
gcctcagggtcctgccctc

SEQ ID NO: 5760864 - DNA, 19 bp, Homo sapiens
gcctcagggtctaaggagc

SEQ ID NO: 5760865 - DNA, 22 bp, Homo sapiens
gcctcagggttttggggtcctg

SEQ ID NO: 5760866 - DNA, 12 bp, Homo sapiens
gcctcaggtgct

SEQ ID NO: 5760867 - DNA, 13 bp, Homo sapiens
gcctcaggttcct

SEQ ID NO: 5760868 - DNA, 22 bp, Homo sapiens
gcctcagtaagtatctggagga

SEQ ID NO: 5760869 - DNA, 23 bp, Homo sapiens
gcctcagtcctcccctcacagcc

SEQ ID NO: 5760870 - DNA, 18 bp, Homo sapiens
gcctcagtctccctccct

SEQ ID NO: 5760871 - DNA, 23 bp, Homo sapiens
gcctcagtgagatcagtcagctc

SEQ ID NO: 5760872 - DNA, 13 bp, Homo sapiens
gcctcagtgcccc

SEQ ID NO: 5760873 - DNA, 11 bp, Homo sapiens
gcctcagtgga

SEQ ID NO: 5760874 - DNA, 15 bp, Homo sapiens
gcctcagtggcagca

SEQ ID NO: 5760875 - DNA, 17 bp, Homo sapiens
gcctcagtggccagagg

SEQ ID NO: 5760876 - DNA, 14 bp, Homo sapiens
gcctcagtgtattt

SEQ ID NO: 5760877 - DNA, 18 bp, Homo sapiens
gcctcagttaaatctcct

SEQ ID NO: 5760878 - DNA, 13 bp, Homo sapiens
gcctcagttccca

SEQ ID NO: 5760879 - DNA, 14 bp, Homo sapiens
gcctcagttcccag

SEQ ID NO: 5760880 - DNA, 15 bp, Homo sapiens
gcctcagttcccagc

SEQ ID NO: 5760881 - DNA, 18 bp, Homo sapiens
gcctcagttcccagctcc

SEQ ID NO: 5760882 - DNA, 22 bp, Homo sapiens
gcctcagttcccagctcccccc

SEQ ID NO: 5760883 - DNA, 23 bp, Homo sapiens
gcctcagttcccagctccccccg

SEQ ID NO: 5760884 - DNA, 12 bp, Homo sapiens
gcctcagtttcc

SEQ ID NO: 5760885 - DNA, 15 bp, Homo sapiens
gcctcagtttcccca

SEQ ID NO: 5760886 - DNA, 20 bp, Homo sapiens
gcctcagtttccctatctgc

SEQ ID NO: 5760887 - DNA, 21 bp, Homo sapiens
gcctcatacgtttaaaataaa

SEQ ID NO: 5760888 - DNA, 16 bp, Homo sapiens
gcctcatactcctggg

SEQ ID NO: 5760889 - DNA, 17 bp, Homo sapiens
gcctcatactcctgggc

SEQ ID NO: 5760890 - DNA, 17 bp, Homo sapiens
gcctcatagcatagcca

SEQ ID NO: 5760891 - DNA, 21 bp, Homo sapiens
gcctcatagcatagccagcat

SEQ ID NO: 5760892 - DNA, 20 bp, Homo sapiens
gcctcatcagtatttggact

SEQ ID NO: 5760893 - DNA, 13 bp, Homo sapiens
gcctcatccagcc

SEQ ID NO: 5760894 - DNA, 16 bp, Homo sapiens
gcctcatccagcctca

SEQ ID NO: 5760895 - DNA, 19 bp, Homo sapiens
gcctcatccagcctcagag

SEQ ID NO: 5760896 - DNA, 13 bp, Homo sapiens
gcctcatccaggg

SEQ ID NO: 5760897 - DNA, 19 bp, Homo sapiens
gcctcatccagggcccagc

SEQ ID NO: 5760898 - DNA, 12 bp, Homo sapiens
gcctcatccctc

SEQ ID NO: 5760899 - DNA, 14 bp, Homo sapiens
gcctcatccctcgg

SEQ ID NO: 5760900 - DNA, 16 bp, Homo sapiens
gcctcatccgaggcag

SEQ ID NO: 5760901 - DNA, 18 bp, Homo sapiens
gcctcatccgaggcaggg

SEQ ID NO: 5760902 - DNA, 22 bp, Homo sapiens
gcctcatccgaggcagggtcag

SEQ ID NO: 5760903 - DNA, 15 bp, Homo sapiens
gcctcatcctcctcc

SEQ ID NO: 5760904 - DNA, 13 bp, Homo sapiens
gcctcatcctgag

SEQ ID NO: 5760905 - DNA, 14 bp, Homo sapiens
gcctcatctcagac

SEQ ID NO: 5760906 - DNA, 16 bp, Homo sapiens
gcctcatctcagaccc

SEQ ID NO: 5760907 - DNA, 17 bp, Homo sapiens
gcctcatctcagaccct

SEQ ID NO: 5760908 - DNA, 18 bp, Homo sapiens
gcctcatctcagaccctg

SEQ ID NO: 5760909 - DNA, 21 bp, Homo sapiens
gcctcatctcagaccctgctt

SEQ ID NO: 5760910 - DNA, 23 bp, Homo sapiens
gcctcatctgctcctagcccagc

SEQ ID NO: 5760911 - DNA, 24 bp, Homo sapiens
gcctcatctgctcctagcccagca

SEQ ID NO: 5760912 - DNA, 19 bp, Homo sapiens
gcctcatcttccccagccc

SEQ ID NO: 5760913 - DNA, 20 bp, Homo sapiens
gcctcatcttccccagccct

SEQ ID NO: 5760914 - DNA, 22 bp, Homo sapiens
gcctcatcttccccagccctcc

SEQ ID NO: 5760915 - DNA, 21 bp, Homo sapiens
gcctcatgaacactggctgca

SEQ ID NO: 5760916 - DNA, 19 bp, Homo sapiens
gcctcatgaccctcctgtc

SEQ ID NO: 5760917 - DNA, 13 bp, Homo sapiens
gcctcatgccaca

SEQ ID NO: 5760918 - DNA, 14 bp, Homo sapiens
gcctcatgccacac

SEQ ID NO: 5760919 - DNA, 14 bp, Homo sapiens
gcctcatgcctgct

SEQ ID NO: 5760920 - DNA, 19 bp, Homo sapiens
gcctcatgctaagactcag

SEQ ID NO: 5760921 - DNA, 19 bp, Homo sapiens
gcctcatgctctctataga

SEQ ID NO: 5760922 - DNA, 14 bp, Homo sapiens
gcctcatgctctga

SEQ ID NO: 5760923 - DNA, 20 bp, Homo sapiens
gcctcatggcttttgctttc

SEQ ID NO: 5760924 - DNA, 19 bp, Homo sapiens
gcctcatgtcaaatattta

SEQ ID NO: 5760925 - DNA, 19 bp, Homo sapiens
gcctcatgtggctggaaga

SEQ ID NO: 5760926 - DNA, 16 bp, Homo sapiens
gcctcatgttctcttc

SEQ ID NO: 5760927 - DNA, 23 bp, Homo sapiens
gcctcatgttctcttcccaggcc

SEQ ID NO: 5760928 - DNA, 16 bp, Homo sapiens
gcctcatgttctgtgg

SEQ ID NO: 5760929 - DNA, 16 bp, Homo sapiens
gcctcattcagcagaa

SEQ ID NO: 5760930 - DNA, 17 bp, Homo sapiens
gcctcattgtgtctccc

SEQ ID NO: 5760931 - DNA, 21 bp, Homo sapiens
gcctcatttagagaggaaaag

SEQ ID NO: 5760932 - DNA, 21 bp, Homo sapiens
gcctcatttcactagagacaa

SEQ ID NO: 5760933 - DNA, 14 bp, Homo sapiens
gcctcatttctttg

SEQ ID NO: 5760934 - DNA, 15 bp, Homo sapiens
gcctcatttctttgt

SEQ ID NO: 5760935 - DNA, 23 bp, Homo sapiens
gcctcattttgcttcccatctga

SEQ ID NO: 5760936 - DNA, 15 bp, Homo sapiens
gcctcatttttttcc

SEQ ID NO: 5760937 - DNA, 19 bp, Homo sapiens
gcctcatttttttccttgc

SEQ ID NO: 5760938 - DNA, 21 bp, Homo sapiens
gcctccaaaatattaacattc

SEQ ID NO: 5760939 - DNA, 17 bp, Homo sapiens
gcctccaaccttctgcc

SEQ ID NO: 5760940 - DNA, 19 bp, Homo sapiens
gcctccaaccttctgccct

SEQ ID NO: 5760941 - DNA, 23 bp, Homo sapiens
gcctccaaccttctgccctcctg

SEQ ID NO: 5760942 - DNA, 19 bp, Homo sapiens
gcctccaacgcccctgtgg

SEQ ID NO: 5760943 - DNA, 21 bp, Homo sapiens
gcctccaacgcccctgtggcc

SEQ ID NO: 5760944 - DNA, 22 bp, Homo sapiens
gcctccaacgcccctgtggcca

SEQ ID NO: 5760945 - DNA, 23 bp, Homo sapiens
gcctccaacgcccctgtggccaa

SEQ ID NO: 5760946 - DNA, 21 bp, Homo sapiens
gcctccaagatttaacctgca

SEQ ID NO: 5760947 - DNA, 19 bp, Homo sapiens
gcctccaagtcatgggaga

SEQ ID NO: 5760948 - DNA, 21 bp, Homo sapiens
gcctccaagtcatgggagaag

SEQ ID NO: 5760949 - DNA, 22 bp, Homo sapiens
gcctccaatgcattggcctctg

SEQ ID NO: 5760950 - DNA, 16 bp, Homo sapiens
gcctccaattggtgct

SEQ ID NO: 5760951 - DNA, 22 bp, Homo sapiens
gcctccaattggtgcttcagcc

SEQ ID NO: 5760952 - DNA, 22 bp, Homo sapiens
gcctccaattttttaagtgaaa

SEQ ID NO: 5760953 - DNA, 20 bp, Homo sapiens
gcctccacaccagctgctgc

SEQ ID NO: 5760954 - DNA, 21 bp, Homo sapiens
gcctccacaccagctgctgct

SEQ ID NO: 5760955 - DNA, 12 bp, Homo sapiens
gcctccacactg

SEQ ID NO: 5760956 - DNA, 22 bp, Homo sapiens
gcctccacacttgctcttctga

SEQ ID NO: 5760957 - DNA, 15 bp, Homo sapiens
gcctccacagcgagg

SEQ ID NO: 5760958 - DNA, 20 bp, Homo sapiens
gcctccacagcgagggcagc

SEQ ID NO: 5760959 - DNA, 21 bp, Homo sapiens
gcctccacagcgagggcagct

SEQ ID NO: 5760960 - DNA, 22 bp, Homo sapiens
gcctccacagcgagggcagctg

SEQ ID NO: 5760961 - DNA, 23 bp, Homo sapiens
gcctccacagcgagggcagctgc

SEQ ID NO: 5760962 - DNA, 22 bp, Homo sapiens
gcctccacatgctgcctggcac

SEQ ID NO: 5760963 - DNA, 15 bp, Homo sapiens
gcctccaccaccact

SEQ ID NO: 5760964 - DNA, 23 bp, Homo sapiens
gcctccaccaccactggccacca

SEQ ID NO: 5760965 - DNA, 21 bp, Homo sapiens
gcctccacccacagtggagag

SEQ ID NO: 5760966 - DNA, 18 bp, Homo sapiens
gcctccaccccccagaac

SEQ ID NO: 5760967 - DNA, 23 bp, Homo sapiens
gcctccacccgtcctccctcagc

SEQ ID NO: 5760968 - DNA, 12 bp, Homo sapiens
gcctccaccctc

SEQ ID NO: 5760969 - DNA, 13 bp, Homo sapiens
gcctccaccctcc

SEQ ID NO: 5760970 - DNA, 16 bp, Homo sapiens
gcctccaccctcctcc

SEQ ID NO: 5760971 - DNA, 15 bp, Homo sapiens
gcctccaccctctga

SEQ ID NO: 5760972 - DNA, 17 bp, Homo sapiens
gcctccaccgagccagc

SEQ ID NO: 5760973 - DNA, 18 bp, Homo sapiens
gcctccaccgctgcctaa

SEQ ID NO: 5760974 - DNA, 23 bp, Homo sapiens
gcctccacctctgtgcagggcac

SEQ ID NO: 5760975 - DNA, 20 bp, Homo sapiens
gcctccacctgcagccccag

SEQ ID NO: 5760976 - DNA, 18 bp, Homo sapiens
gcctccacgggggcggca

SEQ ID NO: 5760977 - DNA, 14 bp, Homo sapiens
gcctccactcccac

SEQ ID NO: 5760978 - DNA, 21 bp, Homo sapiens
gcctccactcccacttccctg

SEQ ID NO: 5760979 - DNA, 13 bp, Homo sapiens
gcctccactcccc

SEQ ID NO: 5760980 - DNA, 21 bp, Homo sapiens
gcctccactcccccacctgac

SEQ ID NO: 5760981 - DNA, 12 bp, Homo sapiens
gcctccactcta

SEQ ID NO: 5760982 - DNA, 22 bp, Homo sapiens
gcctccactctagttctagatg

SEQ ID NO: 5760983 - DNA, 17 bp, Homo sapiens
gcctccacttccctcgt

SEQ ID NO: 5760984 - DNA, 22 bp, Homo sapiens
gcctccagaaccttactggcac

SEQ ID NO: 5760985 - DNA, 12 bp, Homo sapiens
gcctccagaact

SEQ ID NO: 5760986 - DNA, 17 bp, Homo sapiens
gcctccagaactcactg

SEQ ID NO: 5760987 - DNA, 18 bp, Homo sapiens
gcctccagaagctgctcc

SEQ ID NO: 5760988 - DNA, 20 bp, Homo sapiens
gcctccagaagctgctcctt

SEQ ID NO: 5760989 - DNA, 21 bp, Homo sapiens
gcctccagaagctgctccttt

SEQ ID NO: 5760990 - DNA, 17 bp, Homo sapiens
gcctccagactgcggag

SEQ ID NO: 5760991 - DNA, 22 bp, Homo sapiens
gcctccagactgcggagcagcc

SEQ ID NO: 5760992 - DNA, 14 bp, Homo sapiens
gcctccagagccag

SEQ ID NO: 5760993 - DNA, 15 bp, Homo sapiens
gcctccagagccagc

SEQ ID NO: 5760994 - DNA, 17 bp, Homo sapiens
gcctccagagccagcct

SEQ ID NO: 5760995 - DNA, 19 bp, Homo sapiens
gcctccagagccagcctgg

SEQ ID NO: 5760996 - DNA, 22 bp, Homo sapiens
gcctccagagccagcctgggac

SEQ ID NO: 5760997 - DNA, 23 bp, Homo sapiens
gcctccagagccagcctgggact

SEQ ID NO: 5760998 - DNA, 22 bp, Homo sapiens
gcctccagaggggctcaggtca

SEQ ID NO: 5760999 - DNA, 17 bp, Homo sapiens
gcctccagaggtcctcc

SEQ ID NO: 5761000 - DNA, 22 bp, Homo sapiens
gcctccagccaaacgggagctt

SEQ ID NO: 5761001 - DNA, 20 bp, Homo sapiens
gcctccagccgccggctgtg

SEQ ID NO: 5761002 - DNA, 23 bp, Homo sapiens
gcctccagcctctcccggctgcc

SEQ ID NO: 5761003 - DNA, 17 bp, Homo sapiens
gcctccagcctggtggc

SEQ ID NO: 5761004 - DNA, 18 bp, Homo sapiens
gcctccagcctggtggcc

SEQ ID NO: 5761005 - DNA, 22 bp, Homo sapiens
gcctccagcctggtggcccagc

SEQ ID NO: 5761006 - DNA, 12 bp, Homo sapiens
gcctccagctca

SEQ ID NO: 5761007 - DNA, 15 bp, Homo sapiens
gcctccagctcagca

SEQ ID NO: 5761008 - DNA, 16 bp, Homo sapiens
gcctccagctcagcag

SEQ ID NO: 5761009 - DNA, 12 bp, Homo sapiens
gcctccagctcc

SEQ ID NO: 5761010 - DNA, 13 bp, Homo sapiens
gcctccagctccc

SEQ ID NO: 5761011 - DNA, 16 bp, Homo sapiens
gcctccagctcccact

SEQ ID NO: 5761012 - DNA, 12 bp, Homo sapiens
gcctccagctgt

SEQ ID NO: 5761013 - DNA, 18 bp, Homo sapiens
gcctccaggaccaggggc

SEQ ID NO: 5761014 - DNA, 21 bp, Homo sapiens
gcctccaggaccttgcttcct

SEQ ID NO: 5761015 - DNA, 13 bp, Homo sapiens
gcctccaggagcc

SEQ ID NO: 5761016 - DNA, 18 bp, Homo sapiens
gcctccaggagcctaccc

SEQ ID NO: 5761017 - DNA, 13 bp, Homo sapiens
gcctccaggaggg

SEQ ID NO: 5761018 - DNA, 16 bp, Homo sapiens
gcctccaggaggggcc

SEQ ID NO: 5761019 - DNA, 18 bp, Homo sapiens
gcctccaggaggggcctg

SEQ ID NO: 5761020 - DNA, 22 bp, Homo sapiens
gcctccaggaggggcctgggca

SEQ ID NO: 5761021 - DNA, 12 bp, Homo sapiens
gcctccaggcca

SEQ ID NO: 5761022 - DNA, 22 bp, Homo sapiens
gcctccaggccacatggggctg

SEQ ID NO: 5761023 - DNA, 21 bp, Homo sapiens
gcctccaggcccccaactccg

SEQ ID NO: 5761024 - DNA, 20 bp, Homo sapiens
gcctccaggcccgtctgtcc

SEQ ID NO: 5761025 - DNA, 17 bp, Homo sapiens
gcctccaggctggggcc

SEQ ID NO: 5761026 - DNA, 18 bp, Homo sapiens
gcctccaggctggggcct

SEQ ID NO: 5761027 - DNA, 21 bp, Homo sapiens
gcctccaggctggggcctggc

SEQ ID NO: 5761028 - DNA, 15 bp, Homo sapiens
gcctccagggcattg

SEQ ID NO: 5761029 - DNA, 18 bp, Homo sapiens
gcctccagggcccaggtt

SEQ ID NO: 5761030 - DNA, 18 bp, Homo sapiens
gcctccaggtgcagaggt

SEQ ID NO: 5761031 - DNA, 13 bp, Homo sapiens
gcctccaggtgtg

SEQ ID NO: 5761032 - DNA, 16 bp, Homo sapiens
gcctccagtcatggta

SEQ ID NO: 5761033 - DNA, 19 bp, Homo sapiens
gcctccagtctgctctcag

SEQ ID NO: 5761034 - DNA, 15 bp, Homo sapiens
gcctccagtgcagtc

SEQ ID NO: 5761035 - DNA, 14 bp, Homo sapiens
gcctccagtgctgg

SEQ ID NO: 5761036 - DNA, 18 bp, Homo sapiens
gcctccagtgctggctgc

SEQ ID NO: 5761037 - DNA, 20 bp, Homo sapiens
gcctccagtgctggctgctg

SEQ ID NO: 5761038 - DNA, 21 bp, Homo sapiens
gcctccagtgctggctgctgg

SEQ ID NO: 5761039 - DNA, 15 bp, Homo sapiens
gcctccatccaaggc

SEQ ID NO: 5761040 - DNA, 16 bp, Homo sapiens
gcctccatccaaggcc

SEQ ID NO: 5761041 - DNA, 14 bp, Homo sapiens
gcctccatccacac

SEQ ID NO: 5761042 - DNA, 19 bp, Homo sapiens
gcctccatccacacacagc

SEQ ID NO: 5761043 - DNA, 21 bp, Homo sapiens
gcctccatccacacacagcag

SEQ ID NO: 5761044 - DNA, 13 bp, Homo sapiens
gcctccatccatc

SEQ ID NO: 5761045 - DNA, 23 bp, Homo sapiens
gcctccatcctaccccctgtgcc

SEQ ID NO: 5761046 - DNA, 14 bp, Homo sapiens
gcctccatcctagt

SEQ ID NO: 5761047 - DNA, 20 bp, Homo sapiens
gcctccatcctcatctctct

SEQ ID NO: 5761048 - DNA, 22 bp, Homo sapiens
gcctccatcctcatctctcttg

SEQ ID NO: 5761049 - DNA, 12 bp, Homo sapiens
gcctccatcctg

SEQ ID NO: 5761050 - DNA, 13 bp, Homo sapiens
gcctccatcctga

SEQ ID NO: 5761051 - DNA, 16 bp, Homo sapiens
gcctccatcctgaggc

SEQ ID NO: 5761052 - DNA, 12 bp, Homo sapiens
gcctccatcttt

SEQ ID NO: 5761053 - DNA, 17 bp, Homo sapiens
gcctccatctttttctt

SEQ ID NO: 5761054 - DNA, 20 bp, Homo sapiens
gcctccatctttttcttggg

SEQ ID NO: 5761055 - DNA, 22 bp, Homo sapiens
gcctccatgatgcaagccagct

SEQ ID NO: 5761056 - DNA, 14 bp, Homo sapiens
gcctccatgcccca

SEQ ID NO: 5761057 - DNA, 21 bp, Homo sapiens
gcctccatgccccagctctgg

SEQ ID NO: 5761058 - DNA, 11 bp, Homo sapiens
gcctccatgct

SEQ ID NO: 5761059 - DNA, 20 bp, Homo sapiens
gcctccatggcagcagccag

SEQ ID NO: 5761060 - DNA, 15 bp, Homo sapiens
gcctccatgggcccc

SEQ ID NO: 5761061 - DNA, 14 bp, Homo sapiens
gcctccatggtgcc

SEQ ID NO: 5761062 - DNA, 16 bp, Homo sapiens
gcctccatggtgcctc

SEQ ID NO: 5761063 - DNA, 17 bp, Homo sapiens
gcctccatggtgcctct

SEQ ID NO: 5761064 - DNA, 19 bp, Homo sapiens
gcctccatggtgcctctgg

SEQ ID NO: 5761065 - DNA, 13 bp, Homo sapiens
gcctccatgtaga

SEQ ID NO: 5761066 - DNA, 20 bp, Homo sapiens
gcctccattatccattccca

SEQ ID NO: 5761067 - DNA, 17 bp, Homo sapiens
gcctccattcctggagc

SEQ ID NO: 5761068 - DNA, 23 bp, Homo sapiens
gcctccattcctggagcccgagg

SEQ ID NO: 5761069 - DNA, 16 bp, Homo sapiens
gcctccattctgacca

SEQ ID NO: 5761070 - DNA, 23 bp, Homo sapiens
gcctccatttctggcttctagtc

SEQ ID NO: 5761071 - DNA, 14 bp, Homo sapiens
gcctccatttctgt

SEQ ID NO: 5761072 - DNA, 16 bp, Homo sapiens
gcctcccaaagtgctg

SEQ ID NO: 5761073 - DNA, 18 bp, Homo sapiens
gcctcccaactcacccca

SEQ ID NO: 5761074 - DNA, 21 bp, Homo sapiens
gcctcccaactcaccccagcc

SEQ ID NO: 5761075 - DNA, 22 bp, Homo sapiens
gcctcccaactcaccccagccc

SEQ ID NO: 5761076 - DNA, 23 bp, Homo sapiens
gcctcccaactcaccccagcccc

SEQ ID NO: 5761077 - DNA, 11 bp, Homo sapiens
gcctcccaagc

SEQ ID NO: 5761078 - DNA, 15 bp, Homo sapiens
gcctcccaagcagct

SEQ ID NO: 5761079 - DNA, 22 bp, Homo sapiens
gcctcccaagcagctgaagggt

SEQ ID NO: 5761080 - DNA, 12 bp, Homo sapiens
gcctcccaagct

SEQ ID NO: 5761081 - DNA, 16 bp, Homo sapiens
gcctcccaagctgatg

SEQ ID NO: 5761082 - DNA, 19 bp, Homo sapiens
gcctcccaagctgatggac

SEQ ID NO: 5761083 - DNA, 21 bp, Homo sapiens
gcctcccaaggagaacaaata

SEQ ID NO: 5761084 - DNA, 21 bp, Homo sapiens
gcctcccaaggtcctctcagt

SEQ ID NO: 5761085 - DNA, 19 bp, Homo sapiens
gcctcctaagcagctggga

SEQ ID NO: 5761086 - DNA, 21 bp, Homo sapiens
gcctcctaaggctccccaccc

SEQ ID NO: 5761087 - DNA, 20 bp, Homo sapiens
gcctcctacagcccacctgg

SEQ ID NO: 5761088 - DNA, 14 bp, Homo sapiens
gcctcctactccag

SEQ ID NO: 5761089 - DNA, 21 bp, Homo sapiens
gcctcctactccagtatgaca

SEQ ID NO: 5761090 - DNA, 17 bp, Homo sapiens
gcctcctagcctctccg

SEQ ID NO: 5761091 - DNA, 17 bp, Homo sapiens
gcctcctaggctccctg

SEQ ID NO: 5761092 - DNA, 18 bp, Homo sapiens
gcctcctaggctccctga

SEQ ID NO: 5761093 - DNA, 20 bp, Homo sapiens
gcctcctaggctccctgagg

SEQ ID NO: 5761094 - DNA, 19 bp, Homo sapiens
gcctcctaggggaaggggg

SEQ ID NO: 5761095 - DNA, 20 bp, Homo sapiens
gcctcctaggggaagggggt

SEQ ID NO: 5761096 - DNA, 23 bp, Homo sapiens
gcctcctcacccaccctgtggct

SEQ ID NO: 5761097 - DNA, 14 bp, Homo sapiens
gcctcctcaccccc

SEQ ID NO: 5761098 - DNA, 13 bp, Homo sapiens
gcctcctcagggg

SEQ ID NO: 5761099 - DNA, 23 bp, Homo sapiens
gcctcctcagggggtaggagagc

SEQ ID NO: 5761100 - DNA, 19 bp, Homo sapiens
gcctcctcagtgaaggtgg

SEQ ID NO: 5761101 - DNA, 13 bp, Homo sapiens
gcctcctccagac

SEQ ID NO: 5761102 - DNA, 14 bp, Homo sapiens
gcctcctccagact

SEQ ID NO: 5761103 - DNA, 15 bp, Homo sapiens
gcctcctccagactc

SEQ ID NO: 5761104 - DNA, 12 bp, Homo sapiens
gcctcctccagc

SEQ ID NO: 5761105 - DNA, 14 bp, Homo sapiens
gcctcctccagctc

SEQ ID NO: 5761106 - DNA, 19 bp, Homo sapiens
gcctcctccagctcctgcc

SEQ ID NO: 5761107 - DNA, 20 bp, Homo sapiens
gcctcctccagctcctgccc

SEQ ID NO: 5761108 - DNA, 16 bp, Homo sapiens
gcctcctcccactggg

SEQ ID NO: 5761109 - DNA, 11 bp, Homo sapiens
gcctcctcccc

SEQ ID NO: 5761110 - DNA, 13 bp, Homo sapiens
gcctcctccccca

SEQ ID NO: 5761111 - DNA, 11 bp, Homo sapiens
gcctcctccct

SEQ ID NO: 5761112 - DNA, 13 bp, Homo sapiens
gcctcctccctcc

SEQ ID NO: 5761113 - DNA, 19 bp, Homo sapiens
gcctcctccctcccagctg

SEQ ID NO: 5761114 - DNA, 23 bp, Homo sapiens
gcctcctccctcccagctgcact

SEQ ID NO: 5761115 - DNA, 12 bp, Homo sapiens
gcctcctccctg

SEQ ID NO: 5761116 - DNA, 14 bp, Homo sapiens
gcctcctccctgcc

SEQ ID NO: 5761117 - DNA, 15 bp, Homo sapiens
gcctcctccctgcct

SEQ ID NO: 5761118 - DNA, 13 bp, Homo sapiens
gcctcctccctgg

SEQ ID NO: 5761119 - DNA, 14 bp, Homo sapiens
gcctcctccctggc

SEQ ID NO: 5761120 - DNA, 19 bp, Homo sapiens
gcctcctccctggctgcag

SEQ ID NO: 5761121 - DNA, 23 bp, Homo sapiens
gcctcctccctggctgcagcctc

SEQ ID NO: 5761122 - DNA, 17 bp, Homo sapiens
gcctcctcccttagctc

SEQ ID NO: 5761123 - DNA, 19 bp, Homo sapiens
gcctcctcctagctggagt

SEQ ID NO: 5761124 - DNA, 11 bp, Homo sapiens
gcctcctcctc

SEQ ID NO: 5761125 - DNA, 18 bp, Homo sapiens
gcctcctcctcacccttc

SEQ ID NO: 5761126 - DNA, 14 bp, Homo sapiens
gcctcctcctcctg

SEQ ID NO: 5761127 - DNA, 16 bp, Homo sapiens
gcctcctcctcctgcc

SEQ ID NO: 5761128 - DNA, 17 bp, Homo sapiens
gcctcctcctcctgccc

SEQ ID NO: 5761129 - DNA, 22 bp, Homo sapiens
gcctcctcctcctgccctcctc

SEQ ID NO: 5761130 - DNA, 17 bp, Homo sapiens
gcctcctcctgagagct

SEQ ID NO: 5761131 - DNA, 21 bp, Homo sapiens
gcctcctcctgagagctgttc

SEQ ID NO: 5761132 - DNA, 12 bp, Homo sapiens
gcctcctcctgc

SEQ ID NO: 5761133 - DNA, 14 bp, Homo sapiens
gcctcctcctgcat

SEQ ID NO: 5761134 - DNA, 16 bp, Homo sapiens
gcctcctcctgcatgt

SEQ ID NO: 5761135 - DNA, 14 bp, Homo sapiens
gcctcctcctgccc

SEQ ID NO: 5761136 - DNA, 16 bp, Homo sapiens
gcctcctcctgccctc

SEQ ID NO: 5761137 - DNA, 18 bp, Homo sapiens
gcctcctcctgccctccg

SEQ ID NO: 5761138 - DNA, 17 bp, Homo sapiens
gcctcctcggagagcag

SEQ ID NO: 5761139 - DNA, 21 bp, Homo sapiens
gcctcctcggagagcagcagc

SEQ ID NO: 5761140 - DNA, 15 bp, Homo sapiens
gcctcctcgttcctt

SEQ ID NO: 5761141 - DNA, 22 bp, Homo sapiens
gcctcctctaacaggggctggt

SEQ ID NO: 5761142 - DNA, 23 bp, Homo sapiens
gcctcctctctccctgcctcaca

SEQ ID NO: 5761143 - DNA, 14 bp, Homo sapiens
gcctcctctggact

SEQ ID NO: 5761144 - DNA, 13 bp, Homo sapiens
gcctcctctgtcc

SEQ ID NO: 5761145 - DNA, 20 bp, Homo sapiens
gcctcctcttcaccccggca

SEQ ID NO: 5761146 - DNA, 21 bp, Homo sapiens
gcctcctcttcaccccggcag

SEQ ID NO: 5761147 - DNA, 22 bp, Homo sapiens
gcctcctgaaagtcatttaaaa

SEQ ID NO: 5761148 - DNA, 16 bp, Homo sapiens
gcctcctgacctgagg

SEQ ID NO: 5761149 - DNA, 21 bp, Homo sapiens
gcctcctgacctgaggctcct

SEQ ID NO: 5761150 - DNA, 16 bp, Homo sapiens
gcctcctgaggctgtt

SEQ ID NO: 5761151 - DNA, 23 bp, Homo sapiens
gcctcctgagtagatgggactac

SEQ ID NO: 5761152 - DNA, 19 bp, Homo sapiens
gcctcctgagtagctggga

SEQ ID NO: 5761153 - DNA, 20 bp, Homo sapiens
gcctcctgcagtttgggaga

SEQ ID NO: 5761154 - DNA, 12 bp, Homo sapiens
gcctcctgccac

SEQ ID NO: 5761155 - DNA, 18 bp, Homo sapiens
gcctcctgccaccccttc

SEQ ID NO: 5761156 - DNA, 12 bp, Homo sapiens
gcctcctgccca

SEQ ID NO: 5761157 - DNA, 12 bp, Homo sapiens
gcctcctgctct

SEQ ID NO: 5761158 - DNA, 14 bp, Homo sapiens
gcctcctgctctct

SEQ ID NO: 5761159 - DNA, 18 bp, Homo sapiens
gcctcctgctctctggag

SEQ ID NO: 5761160 - DNA, 13 bp, Homo sapiens
gcctcctgctctg

SEQ ID NO: 5761161 - DNA, 14 bp, Homo sapiens
gcctcctgctctgc

SEQ ID NO: 5761162 - DNA, 16 bp, Homo sapiens
gcctcctggaggacca

SEQ ID NO: 5761163 - DNA, 18 bp, Homo sapiens
gcctcctggaggaccaga

SEQ ID NO: 5761164 - DNA, 22 bp, Homo sapiens
gcctcctggccaagcaggctgg

SEQ ID NO: 5761165 - DNA, 19 bp, Homo sapiens
gcctcctggcccaggtgag

SEQ ID NO: 5761166 - DNA, 15 bp, Homo sapiens
gcctcctggctcagg

SEQ ID NO: 5761167 - DNA, 21 bp, Homo sapiens
gcctcctggctgtctgaggct

SEQ ID NO: 5761168 - DNA, 12 bp, Homo sapiens
gcctcctgggaa

SEQ ID NO: 5761169 - DNA, 14 bp, Homo sapiens
gcctcctgggaaca

SEQ ID NO: 5761170 - DNA, 17 bp, Homo sapiens
gcctcctgggaagatga

SEQ ID NO: 5761171 - DNA, 23 bp, Homo sapiens
gcctcctgggaaggagggagctg

SEQ ID NO: 5761172 - DNA, 12 bp, Homo sapiens
gcctcctgggca

SEQ ID NO: 5761173 - DNA, 17 bp, Homo sapiens
gcctcctgggggcccat

SEQ ID NO: 5761174 - DNA, 21 bp, Homo sapiens
gcctcctggtttcctttctca

SEQ ID NO: 5761175 - DNA, 13 bp, Homo sapiens
gcctcctgtacct

SEQ ID NO: 5761176 - DNA, 14 bp, Homo sapiens
gcctcctgtgcctg

SEQ ID NO: 5761177 - DNA, 18 bp, Homo sapiens
gcctcctgtgcctggccc

SEQ ID NO: 5761178 - DNA, 20 bp, Homo sapiens
gcctcctgtgcctggcccca

SEQ ID NO: 5761179 - DNA, 21 bp, Homo sapiens
gcctcctgtgcctggccccag

SEQ ID NO: 5761180 - DNA, 13 bp, Homo sapiens
gcctcctgtgggg

SEQ ID NO: 5761181 - DNA, 18 bp, Homo sapiens
gcctcctgtggggaaagg

SEQ ID NO: 5761182 - DNA, 16 bp, Homo sapiens
gcctcctgtgtactgt

SEQ ID NO: 5761183 - DNA, 18 bp, Homo sapiens
gcctcctgtgtactgtgt

SEQ ID NO: 5761184 - DNA, 18 bp, Homo sapiens
gcctcctgtgtagctggg

SEQ ID NO: 5761185 - DNA, 12 bp, Homo sapiens
gcctcctgtgtg

SEQ ID NO: 5761186 - DNA, 17 bp, Homo sapiens
gcctcctgtgtgtctgc

SEQ ID NO: 5761187 - DNA, 19 bp, Homo sapiens
gcctcctgtgtgtctgcag

SEQ ID NO: 5761188 - DNA, 15 bp, Homo sapiens
gcctcctgttttctc

SEQ ID NO: 5761189 - DNA, 20 bp, Homo sapiens
gcctcctgttttctccctct

SEQ ID NO: 5761190 - DNA, 22 bp, Homo sapiens
gcctcctgttttctccctctca

SEQ ID NO: 5761191 - DNA, 19 bp, Homo sapiens
gcctccttagaaaaaaaat

SEQ ID NO: 5761192 - DNA, 17 bp, Homo sapiens
gcctccttatttatcaa

SEQ ID NO: 5761193 - DNA, 19 bp, Homo sapiens
gcctccttccacctccctc

SEQ ID NO: 5761194 - DNA, 20 bp, Homo sapiens
gcctccttccacctccctcc

SEQ ID NO: 5761195 - DNA, 15 bp, Homo sapiens
gcctccttcccatgc

SEQ ID NO: 5761196 - DNA, 18 bp, Homo sapiens
gcctccttcccatgcctg

SEQ ID NO: 5761197 - DNA, 21 bp, Homo sapiens
gcctccttctgagctcctgtc

SEQ ID NO: 5761198 - DNA, 22 bp, Homo sapiens
gcctccttctgagctcctgtcc

SEQ ID NO: 5761199 - DNA, 14 bp, Homo sapiens
gcctccttctgttt

SEQ ID NO: 5761200 - DNA, 13 bp, Homo sapiens
gcctccttcttca

SEQ ID NO: 5761201 - DNA, 15 bp, Homo sapiens
gcctccttcttccac

SEQ ID NO: 5761202 - DNA, 22 bp, Homo sapiens
gcctccttgccagccccacccc

SEQ ID NO: 5761203 - DNA, 15 bp, Homo sapiens
gcctccttgctgacc

SEQ ID NO: 5761204 - DNA, 17 bp, Homo sapiens
gcctccttgctgacccc

SEQ ID NO: 5761205 - DNA, 15 bp, Homo sapiens
gcctccttgtgagag

SEQ ID NO: 5761206 - DNA, 15 bp, Homo sapiens
gcctccttgtgcaat

SEQ ID NO: 5761207 - DNA, 22 bp, Homo sapiens
gcctccttgtgcaattgtcttt

SEQ ID NO: 5761208 - DNA, 23 bp, Homo sapiens
gcctccttgtgcaattgtctttt

SEQ ID NO: 5761209 - DNA, 10 bp, Homo sapiens
gcctccttta

SEQ ID NO: 5761210 - DNA, 21 bp, Homo sapiens
gcctcctttgtgaggaagccg

SEQ ID NO: 5761211 - DNA, 22 bp, Homo sapiens
gcctcctttgtgaggaagccgc

SEQ ID NO: 5761212 - DNA, 16 bp, Homo sapiens
gcctcgaaacacagaa

SEQ ID NO: 5761213 - DNA, 19 bp, Homo sapiens
gcctcgaactcctgggctc

SEQ ID NO: 5761214 - DNA, 22 bp, Homo sapiens
gcctcgaactggctgcaaaggg

SEQ ID NO: 5761215 - DNA, 18 bp, Homo sapiens
gcctcgaatatcttaatt

SEQ ID NO: 5761216 - DNA, 19 bp, Homo sapiens
gcctcgacacccccccaac

SEQ ID NO: 5761217 - DNA, 22 bp, Homo sapiens
gcctcgacacgtgggctcccct

SEQ ID NO: 5761218 - DNA, 15 bp, Homo sapiens
gcctcgacctccctg

SEQ ID NO: 5761219 - DNA, 17 bp, Homo sapiens
gcctcgacctccctggc

SEQ ID NO: 5761220 - DNA, 18 bp, Homo sapiens
gcctcgacgtcccttgga

SEQ ID NO: 5761221 - DNA, 20 bp, Homo sapiens
gcctcgagccatagagcctg

SEQ ID NO: 5761222 - DNA, 21 bp, Homo sapiens
gcctcgaggctggtggttttc

SEQ ID NO: 5761223 - DNA, 14 bp, Homo sapiens
gcctcgagggccgc

SEQ ID NO: 5761224 - DNA, 21 bp, Homo sapiens
gcctcgagggccgcctgcctt

SEQ ID NO: 5761225 - DNA, 19 bp, Homo sapiens
gcctcgaggggcccaggga

SEQ ID NO: 5761226 - DNA, 19 bp, Homo sapiens
gcctcgaggtgccttcttc

SEQ ID NO: 5761227 - DNA, 16 bp, Homo sapiens
gcctcgagtcccccca

SEQ ID NO: 5761228 - DNA, 22 bp, Homo sapiens
gcctcgagtccccccacccctc

SEQ ID NO: 5761229 - DNA, 20 bp, Homo sapiens
gcctcgcaacccgtgccaag

SEQ ID NO: 5761230 - DNA, 13 bp, Homo sapiens
gcctcgcacaggc

SEQ ID NO: 5761231 - DNA, 23 bp, Homo sapiens
gcctcgcacttgcagaggagccc

SEQ ID NO: 5761232 - DNA, 14 bp, Homo sapiens
gcctcgcaggaaga

SEQ ID NO: 5761233 - DNA, 14 bp, Homo sapiens
gcctcgcatcctat

SEQ ID NO: 5761234 - DNA, 13 bp, Homo sapiens
gcctcgcatgcca

SEQ ID NO: 5761235 - DNA, 14 bp, Homo sapiens
gcctcgcccaccgc

SEQ ID NO: 5761236 - DNA, 16 bp, Homo sapiens
gcctcgcccaccgcat

SEQ ID NO: 5761237 - DNA, 19 bp, Homo sapiens
gcctcgccccagccaagcc

SEQ ID NO: 5761238 - DNA, 16 bp, Homo sapiens
gcctcgcccccacttt

SEQ ID NO: 5761239 - DNA, 21 bp, Homo sapiens
gcctcgcccctccagtgttgc

SEQ ID NO: 5761240 - DNA, 14 bp, Homo sapiens
gcctcgcccctggc

SEQ ID NO: 5761241 - DNA, 14 bp, Homo sapiens
gcctcgcctgccct

SEQ ID NO: 5761242 - DNA, 22 bp, Homo sapiens
gcctcgcctgccctcctctccc

SEQ ID NO: 5761243 - DNA, 13 bp, Homo sapiens
gcctcgcctggcc

SEQ ID NO: 5761244 - DNA, 13 bp, Homo sapiens
gcctcgcctgggc

SEQ ID NO: 5761245 - DNA, 14 bp, Homo sapiens
gcctcgcctgggcc

SEQ ID NO: 5761246 - DNA, 21 bp, Homo sapiens
gcctcgcctgggcccaggctc

SEQ ID NO: 5761247 - DNA, 15 bp, Homo sapiens
gcctcgcctgtcacc

SEQ ID NO: 5761248 - DNA, 15 bp, Homo sapiens
gcctcgccttgtgtt

SEQ ID NO: 5761249 - DNA, 17 bp, Homo sapiens
gcctcgccttgtgttac

SEQ ID NO: 5761250 - DNA, 14 bp, Homo sapiens
gcctcgctccccac

SEQ ID NO: 5761251 - DNA, 18 bp, Homo sapiens
gcctcgctccccactctg

SEQ ID NO: 5761252 - DNA, 19 bp, Homo sapiens
gcctcgctccccactctgc

SEQ ID NO: 5761253 - DNA, 23 bp, Homo sapiens
gcctcgctccccactctgctctg

SEQ ID NO: 5761254 - DNA, 13 bp, Homo sapiens
gcctcgctccctt

SEQ ID NO: 5761255 - DNA, 14 bp, Homo sapiens
gcctcgctttttca

SEQ ID NO: 5761256 - DNA, 23 bp, Homo sapiens
gcctcgctttttcatccttcttt

SEQ ID NO: 5761257 - DNA, 19 bp, Homo sapiens
gcctcggaggctcctccct

SEQ ID NO: 5761258 - DNA, 14 bp, Homo sapiens
gcctcggagtgtgg

SEQ ID NO: 5761259 - DNA, 18 bp, Homo sapiens
gcctcggagtgtggcctg

SEQ ID NO: 5761260 - DNA, 19 bp, Homo sapiens
gcctcggagtgtggcctgg

SEQ ID NO: 5761261 - DNA, 18 bp, Homo sapiens
gcctcggatccccttcct

SEQ ID NO: 5761262 - DNA, 13 bp, Homo sapiens
gcctcggcccctc

SEQ ID NO: 5761263 - DNA, 13 bp, Homo sapiens
gcctcggcctccc

SEQ ID NO: 5761264 - DNA, 15 bp, Homo sapiens
gcctctgccatgccc

SEQ ID NO: 5761265 - DNA, 10 bp, Homo sapiens
gcctctgccc

SEQ ID NO: 5761266 - DNA, 22 bp, Homo sapiens
gcctctgcccaagcagcctgga

SEQ ID NO: 5761267 - DNA, 14 bp, Homo sapiens
gcctctgcccagcc

SEQ ID NO: 5761268 - DNA, 22 bp, Homo sapiens
gcctctgcccagcctgccccag

SEQ ID NO: 5761269 - DNA, 21 bp, Homo sapiens
gcctctgcccaggcactgcta

SEQ ID NO: 5761270 - DNA, 17 bp, Homo sapiens
gcctctgccccaagggg

SEQ ID NO: 5761271 - DNA, 19 bp, Homo sapiens
gcctctgccccaaggggcc

SEQ ID NO: 5761272 - DNA, 16 bp, Homo sapiens
gcctctgccccaccca

SEQ ID NO: 5761273 - DNA, 14 bp, Homo sapiens
gcctctgcccctct

SEQ ID NO: 5761274 - DNA, 13 bp, Homo sapiens
gcctctgcccgca

SEQ ID NO: 5761275 - DNA, 16 bp, Homo sapiens
gcctctgcccgcagag

SEQ ID NO: 5761276 - DNA, 17 bp, Homo sapiens
gcctctgcccgcagagc

SEQ ID NO: 5761277 - DNA, 18 bp, Homo sapiens
gcctctgcccgcagagcc

SEQ ID NO: 5761278 - DNA, 11 bp, Homo sapiens
gcctctgccct

SEQ ID NO: 5761279 - DNA, 15 bp, Homo sapiens
gcctctgccctgcct

SEQ ID NO: 5761280 - DNA, 17 bp, Homo sapiens
gcctctgccctgcctcc

SEQ ID NO: 5761281 - DNA, 13 bp, Homo sapiens
gcctctgccctgg

SEQ ID NO: 5761282 - DNA, 21 bp, Homo sapiens
gcctctgccgctgccatgctt

SEQ ID NO: 5761283 - DNA, 23 bp, Homo sapiens
gcctctgccgctgccatgctttg

SEQ ID NO: 5761284 - DNA, 11 bp, Homo sapiens
gcctctgcctc

SEQ ID NO: 5761285 - DNA, 17 bp, Homo sapiens
gcctctgcctccaggag

SEQ ID NO: 5761286 - DNA, 18 bp, Homo sapiens
gcctctgcctccaggagg

SEQ ID NO: 5761287 - DNA, 21 bp, Homo sapiens
gcctctgcctccaggagggca

SEQ ID NO: 5761288 - DNA, 15 bp, Homo sapiens
gcctctgcctgacag

SEQ ID NO: 5761289 - DNA, 12 bp, Homo sapiens
gcctctgcctgc

SEQ ID NO: 5761290 - DNA, 15 bp, Homo sapiens
gcctctgcctgggac

SEQ ID NO: 5761291 - DNA, 20 bp, Homo sapiens
gcctctgcctggggcctcca

SEQ ID NO: 5761292 - DNA, 19 bp, Homo sapiens
gcctctgccttagaggagc

SEQ ID NO: 5761293 - DNA, 21 bp, Homo sapiens
gcctctgcgagaatgaacata

SEQ ID NO: 5761294 - DNA, 19 bp, Homo sapiens
gcctctgcggagcacactg

SEQ ID NO: 5761295 - DNA, 17 bp, Homo sapiens
gcctctgctactgaggc

SEQ ID NO: 5761296 - DNA, 14 bp, Homo sapiens
gcctctgctccctc

SEQ ID NO: 5761297 - DNA, 12 bp, Homo sapiens
gcctctgctgaa

SEQ ID NO: 5761298 - DNA, 13 bp, Homo sapiens
gcctctgctgccc

SEQ ID NO: 5761299 - DNA, 14 bp, Homo sapiens
gcctctgctgcccc

SEQ ID NO: 5761300 - DNA, 15 bp, Homo sapiens
gcctctgctgccccc

SEQ ID NO: 5761301 - DNA, 16 bp, Homo sapiens
gcctctgctgccccct

SEQ ID NO: 5761302 - DNA, 18 bp, Homo sapiens
gcctctgctgcccccttc

SEQ ID NO: 5761303 - DNA, 22 bp, Homo sapiens
gcctctgctggaaggggcagca

SEQ ID NO: 5761304 - DNA, 12 bp, Homo sapiens
gcctctgctggc

SEQ ID NO: 5761305 - DNA, 12 bp, Homo sapiens
gcctctgctggt

SEQ ID NO: 5761306 - DNA, 14 bp, Homo sapiens
gcctctgctggtct

SEQ ID NO: 5761307 - DNA, 16 bp, Homo sapiens
gcctctgcttactttt

SEQ ID NO: 5761308 - DNA, 18 bp, Homo sapiens
gcctctgcttgccagcca

SEQ ID NO: 5761309 - DNA, 15 bp, Homo sapiens
gcctctggacctcgg

SEQ ID NO: 5761310 - DNA, 22 bp, Homo sapiens
gcctctggacctcggtgatgcc

SEQ ID NO: 5761311 - DNA, 17 bp, Homo sapiens
gcctctggactggaaag

SEQ ID NO: 5761312 - DNA, 21 bp, Homo sapiens
gcctctggactggcctgtctg

SEQ ID NO: 5761313 - DNA, 14 bp, Homo sapiens
gcctctggaggcct

SEQ ID NO: 5761314 - DNA, 18 bp, Homo sapiens
gcctctggaggcctctgg

SEQ ID NO: 5761315 - DNA, 22 bp, Homo sapiens
gcctctggaggcctctggccct

SEQ ID NO: 5761316 - DNA, 21 bp, Homo sapiens
gcctctggaggcctctgggcc

SEQ ID NO: 5761317 - DNA, 17 bp, Homo sapiens
gcctctggattgtggga

SEQ ID NO: 5761318 - DNA, 15 bp, Homo sapiens
gcctctggccaggca

SEQ ID NO: 5761319 - DNA, 12 bp, Homo sapiens
gcctctggcccc

SEQ ID NO: 5761320 - DNA, 14 bp, Homo sapiens
gcctctggcccctc

SEQ ID NO: 5761321 - DNA, 14 bp, Homo sapiens
gcctctggccgcca

SEQ ID NO: 5761322 - DNA, 17 bp, Homo sapiens
gcctctggccgccaccc

SEQ ID NO: 5761323 - DNA, 19 bp, Homo sapiens
gcctctggccgccaccccc

SEQ ID NO: 5761324 - DNA, 14 bp, Homo sapiens
gcctctggcctggg

SEQ ID NO: 5761325 - DNA, 15 bp, Homo sapiens
gcctctggcctggga

SEQ ID NO: 5761326 - DNA, 16 bp, Homo sapiens
gcctctggcctgggaa

SEQ ID NO: 5761327 - DNA, 21 bp, Homo sapiens
gcctctggctagaggccagcc

SEQ ID NO: 5761328 - DNA, 13 bp, Homo sapiens
gcctctggctgcc

SEQ ID NO: 5761329 - DNA, 14 bp, Homo sapiens
gcctctggctgcct

SEQ ID NO: 5761330 - DNA, 16 bp, Homo sapiens
gcctctggctgcctgg

SEQ ID NO: 5761331 - DNA, 20 bp, Homo sapiens
gcctctggctgcctggccca

SEQ ID NO: 5761332 - DNA, 21 bp, Homo sapiens
gcctctggcttccctaaactg

SEQ ID NO: 5761333 - DNA, 17 bp, Homo sapiens
gcctctggcttccctgc

SEQ ID NO: 5761334 - DNA, 20 bp, Homo sapiens
gcctctggcttccctgccca

SEQ ID NO: 5761335 - DNA, 21 bp, Homo sapiens
gcctctggcttccctgcccaa

SEQ ID NO: 5761336 - DNA, 14 bp, Homo sapiens
gcctctgggactgg

SEQ ID NO: 5761337 - DNA, 19 bp, Homo sapiens
gcctctgggatctgccaac

SEQ ID NO: 5761338 - DNA, 12 bp, Homo sapiens
gcctctgggcag

SEQ ID NO: 5761339 - DNA, 13 bp, Homo sapiens
gcctctgggcagc

SEQ ID NO: 5761340 - DNA, 22 bp, Homo sapiens
gcctctgggcagcctgctttgg

SEQ ID NO: 5761341 - DNA, 16 bp, Homo sapiens
gcctctgggcagtgtg

SEQ ID NO: 5761342 - DNA, 17 bp, Homo sapiens
gcctctgggcagtgtgg

SEQ ID NO: 5761343 - DNA, 13 bp, Homo sapiens
gcctctgggcctc

SEQ ID NO: 5761344 - DNA, 21 bp, Homo sapiens
gcctctgggctcacaccagcc

SEQ ID NO: 5761345 - DNA, 23 bp, Homo sapiens
gcctctgggctcacaccagccct

SEQ ID NO: 5761346 - DNA, 20 bp, Homo sapiens
gcctctggggcaggaccact

SEQ ID NO: 5761347 - DNA, 20 bp, Homo sapiens
gcctctggggggtggccagg

SEQ ID NO: 5761348 - DNA, 22 bp, Homo sapiens
gcctctgggtcagtggtccaca

SEQ ID NO: 5761349 - DNA, 12 bp, Homo sapiens
gcctctgggtga

SEQ ID NO: 5761350 - DNA, 17 bp, Homo sapiens
gcctctggtctgggtgc

SEQ ID NO: 5761351 - DNA, 17 bp, Homo sapiens
gcctctggttccactca

SEQ ID NO: 5761352 - DNA, 19 bp, Homo sapiens
gcctctggttccactcagc

SEQ ID NO: 5761353 - DNA, 19 bp, Homo sapiens
gcctctggttgcctccccc

SEQ ID NO: 5761354 - DNA, 22 bp, Homo sapiens
gcctctggttgcctcccccgcc

SEQ ID NO: 5761355 - DNA, 21 bp, Homo sapiens
gcctctgtaccgcccggcagc

SEQ ID NO: 5761356 - DNA, 11 bp, Homo sapiens
gcctctgtcca

SEQ ID NO: 5761357 - DNA, 16 bp, Homo sapiens
gcctctgtccaaacat

SEQ ID NO: 5761358 - DNA, 15 bp, Homo sapiens
gcctctgtccccttc

SEQ ID NO: 5761359 - DNA, 19 bp, Homo sapiens
gcctctgtccccttctctc

SEQ ID NO: 5761360 - DNA, 22 bp, Homo sapiens
gcctctgtccccttctctcatc

SEQ ID NO: 5761361 - DNA, 22 bp, Homo sapiens
gcctctgtccctctttgcctgt

SEQ ID NO: 5761362 - DNA, 17 bp, Homo sapiens
gcctctgtcctcccatc

SEQ ID NO: 5761363 - DNA, 15 bp, Homo sapiens
gcctctgtcctcgct

SEQ ID NO: 5761364 - DNA, 15 bp, Homo sapiens
gcctctgtctagcat

SEQ ID NO: 5761365 - DNA, 16 bp, Homo sapiens
gcctctgtctagcatg

SEQ ID NO: 5761366 - DNA, 19 bp, Homo sapiens
gcctctgtcttctggactg

SEQ ID NO: 5761367 - DNA, 13 bp, Homo sapiens
gcctctgtctttt

SEQ ID NO: 5761368 - DNA, 20 bp, Homo sapiens
gcctctgtgattacatagat

SEQ ID NO: 5761369 - DNA, 19 bp, Homo sapiens
gcctctgtgcacagtggct

SEQ ID NO: 5761370 - DNA, 12 bp, Homo sapiens
gcctctgtgcct

SEQ ID NO: 5761371 - DNA, 12 bp, Homo sapiens
gcctctgtgctg

SEQ ID NO: 5761372 - DNA, 14 bp, Homo sapiens
gcctctgtgctgtg

SEQ ID NO: 5761373 - DNA, 17 bp, Homo sapiens
gcctctgtgctgtgtgt

SEQ ID NO: 5761374 - DNA, 18 bp, Homo sapiens
gcctctgtgctgtgtgtg

SEQ ID NO: 5761375 - DNA, 20 bp, Homo sapiens
gcctctgtggaagagattcc

SEQ ID NO: 5761376 - DNA, 19 bp, Homo sapiens
gcctctgtgtacatgtgtg

SEQ ID NO: 5761377 - DNA, 19 bp, Homo sapiens
gcctctgtgtagccgccct

SEQ ID NO: 5761378 - DNA, 15 bp, Homo sapiens
gcctctgtgtccttc

SEQ ID NO: 5761379 - DNA, 21 bp, Homo sapiens
gcctctgtgtccttccctgca

SEQ ID NO: 5761380 - DNA, 22 bp, Homo sapiens
gcctctgttcctttctctgggc

SEQ ID NO: 5761381 - DNA, 17 bp, Homo sapiens
gcctctgtttgacaaac

SEQ ID NO: 5761382 - DNA, 22 bp, Homo sapiens
gcctctgttttgtaaactaagg

SEQ ID NO: 5761383 - DNA, 14 bp, Homo sapiens
gcctcttaaaaatt

SEQ ID NO: 5761384 - DNA, 15 bp, Homo sapiens
gcctcttagatgcag

SEQ ID NO: 5761385 - DNA, 20 bp, Homo sapiens
gcctcttagtgattgtgtct

SEQ ID NO: 5761386 - DNA, 16 bp, Homo sapiens
gcctcttatgggctgg

SEQ ID NO: 5761387 - DNA, 18 bp, Homo sapiens
gcctcttatgggctgggt

SEQ ID NO: 5761388 - DNA, 21 bp, Homo sapiens
gcctcttatgggctgggttct

SEQ ID NO: 5761389 - DNA, 21 bp, Homo sapiens
gcctcttattccaggagaagg

SEQ ID NO: 5761390 - DNA, 16 bp, Homo sapiens
gcctcttcagcagcat

SEQ ID NO: 5761391 - DNA, 16 bp, Homo sapiens
gcctcttcaggcctgc

SEQ ID NO: 5761392 - DNA, 14 bp, Homo sapiens
gcctcttccaccca

SEQ ID NO: 5761393 - DNA, 17 bp, Homo sapiens
gcctcttccattccctt

SEQ ID NO: 5761394 - DNA, 16 bp, Homo sapiens
gcctcttccccctgct

SEQ ID NO: 5761395 - DNA, 15 bp, Homo sapiens
gcctcttccctctga

SEQ ID NO: 5761396 - DNA, 22 bp, Homo sapiens
gcctcttcctccccatgtcacc

SEQ ID NO: 5761397 - DNA, 23 bp, Homo sapiens
gcctcttcctccctccctgcagg

SEQ ID NO: 5761398 - DNA, 14 bp, Homo sapiens
gcctcttcctctgg

SEQ ID NO: 5761399 - DNA, 15 bp, Homo sapiens
gcctcttcgggaaga

SEQ ID NO: 5761400 - DNA, 17 bp, Homo sapiens
gcctcttctacttgtaa

SEQ ID NO: 5761401 - DNA, 21 bp, Homo sapiens
gcctcttctcaacttttttcc

SEQ ID NO: 5761402 - DNA, 17 bp, Homo sapiens
gcctcttctcctgcagc

SEQ ID NO: 5761403 - DNA, 15 bp, Homo sapiens
gcctcttctctcaga

SEQ ID NO: 5761404 - DNA, 14 bp, Homo sapiens
gcctcttctgggct

SEQ ID NO: 5761405 - DNA, 16 bp, Homo sapiens
gcctcttctgggctac

SEQ ID NO: 5761406 - DNA, 15 bp, Homo sapiens
gcctcttcttcttca

SEQ ID NO: 5761407 - DNA, 21 bp, Homo sapiens
gcctcttcttcttcagaagac

SEQ ID NO: 5761408 - DNA, 19 bp, Homo sapiens
gcctcttctttgtgccttt

SEQ ID NO: 5761409 - DNA, 20 bp, Homo sapiens
gcctcttctttttcttcttg

SEQ ID NO: 5761410 - DNA, 17 bp, Homo sapiens
gcctcttgaatttttga

SEQ ID NO: 5761411 - DNA, 15 bp, Homo sapiens
gcctcttgaccaggc

SEQ ID NO: 5761412 - DNA, 18 bp, Homo sapiens
gcctcttgagttcctctg

SEQ ID NO: 5761413 - DNA, 16 bp, Homo sapiens
gcctcttgcaggctga

SEQ ID NO: 5761414 - DNA, 20 bp, Homo sapiens
gcctcttgcccgtcggccct

SEQ ID NO: 5761415 - DNA, 23 bp, Homo sapiens
gcctcttgcccgtcggccctgcg

SEQ ID NO: 5761416 - DNA, 18 bp, Homo sapiens
gcctcttgcgtattggct

SEQ ID NO: 5761417 - DNA, 14 bp, Homo sapiens
gcctcttgctggtg

SEQ ID NO: 5761418 - DNA, 15 bp, Homo sapiens
gcctcttgctggtgc

SEQ ID NO: 5761419 - DNA, 21 bp, Homo sapiens
gcctcttggataccagctcag

SEQ ID NO: 5761420 - DNA, 22 bp, Homo sapiens
gcctcttggataccagctcagg

SEQ ID NO: 5761421 - DNA, 19 bp, Homo sapiens
gcctcttggcacctgccta

SEQ ID NO: 5761422 - DNA, 23 bp, Homo sapiens
gcctcttggcacctgcctagctc

SEQ ID NO: 5761423 - DNA, 14 bp, Homo sapiens
gcctcttggcttct

SEQ ID NO: 5761424 - DNA, 19 bp, Homo sapiens
gcctcttggcttctcagcc

SEQ ID NO: 5761425 - DNA, 23 bp, Homo sapiens
gcctcttggcttctcagcccctt

SEQ ID NO: 5761426 - DNA, 16 bp, Homo sapiens
gcctcttgtacagtta

SEQ ID NO: 5761427 - DNA, 14 bp, Homo sapiens
gcctcttgtagtct

SEQ ID NO: 5761428 - DNA, 15 bp, Homo sapiens
gcctcttgtcccttg

SEQ ID NO: 5761429 - DNA, 17 bp, Homo sapiens
gcctcttgtcccttggc

SEQ ID NO: 5761430 - DNA, 16 bp, Homo sapiens
gcctcttgtgctcacg

SEQ ID NO: 5761431 - DNA, 22 bp, Homo sapiens
gcctcttgtgctcacgctcccc

SEQ ID NO: 5761432 - DNA, 22 bp, Homo sapiens
gcctcttgtgtaactaatttgt

SEQ ID NO: 5761433 - DNA, 16 bp, Homo sapiens
gcctcttgtttctgtg

SEQ ID NO: 5761434 - DNA, 14 bp, Homo sapiens
gcctctttaaatta

SEQ ID NO: 5761435 - DNA, 16 bp, Homo sapiens
gcctctttcatccact

SEQ ID NO: 5761436 - DNA, 18 bp, Homo sapiens
gcctcttttacctgctgc

SEQ ID NO: 5761437 - DNA, 20 bp, Homo sapiens
gcctcttttacctgctgctt

SEQ ID NO: 5761438 - DNA, 19 bp, Homo sapiens
gcctcttttcaattatttc

SEQ ID NO: 5761439 - DNA, 22 bp, Homo sapiens
gcctcttttcagtagtgagcag

SEQ ID NO: 5761440 - DNA, 17 bp, Homo sapiens
gcctcttttcctgaaga

SEQ ID NO: 5761441 - DNA, 12 bp, Homo sapiens
gcctcttttctc

SEQ ID NO: 5761442 - DNA, 12 bp, Homo sapiens
gcctgagtcagg

SEQ ID NO: 5761443 - DNA, 20 bp, Homo sapiens
gcctgagtcagggcccagag

SEQ ID NO: 5761444 - DNA, 15 bp, Homo sapiens
gcctgagtcctggtc

SEQ ID NO: 5761445 - DNA, 22 bp, Homo sapiens
gcctgagtcgtgacctgctagg

SEQ ID NO: 5761446 - DNA, 13 bp, Homo sapiens
gcctgagtctcct

SEQ ID NO: 5761447 - DNA, 16 bp, Homo sapiens
gcctgagtctcctgtg

SEQ ID NO: 5761448 - DNA, 18 bp, Homo sapiens
gcctgagtgacagagcga

SEQ ID NO: 5761449 - DNA, 16 bp, Homo sapiens
gcctgagttagctgtt

SEQ ID NO: 5761450 - DNA, 17 bp, Homo sapiens
gcctgagttagctgttt

SEQ ID NO: 5761451 - DNA, 17 bp, Homo sapiens
gcctgatactttagcca

SEQ ID NO: 5761452 - DNA, 21 bp, Homo sapiens
gcctgatactttagccatcat

SEQ ID NO: 5761453 - DNA, 16 bp, Homo sapiens
gcctgatcagaccacg

SEQ ID NO: 5761454 - DNA, 18 bp, Homo sapiens
gcctgatcaggcttcctg

SEQ ID NO: 5761455 - DNA, 20 bp, Homo sapiens
gcctgatcaggcttcctggt

SEQ ID NO: 5761456 - DNA, 14 bp, Homo sapiens
gcctgatccagcct

SEQ ID NO: 5761457 - DNA, 18 bp, Homo sapiens
gcctgatccagcctctcc

SEQ ID NO: 5761458 - DNA, 21 bp, Homo sapiens
gcctgatccctgaacccctgg

SEQ ID NO: 5761459 - DNA, 22 bp, Homo sapiens
gcctgatccctgaacccctggc

SEQ ID NO: 5761460 - DNA, 13 bp, Homo sapiens
gcctgatctctgc

SEQ ID NO: 5761461 - DNA, 14 bp, Homo sapiens
gcctgatctcttcc

SEQ ID NO: 5761462 - DNA, 16 bp, Homo sapiens
gcctgatctcttcctg

SEQ ID NO: 5761463 - DNA, 21 bp, Homo sapiens
gcctgatcttgcctgtctggc

SEQ ID NO: 5761464 - DNA, 19 bp, Homo sapiens
gcctgatgacaataaagct

SEQ ID NO: 5761465 - DNA, 17 bp, Homo sapiens
gcctgatgacagagcga

SEQ ID NO: 5761466 - DNA, 19 bp, Homo sapiens
gcctgatgaccaattttaa

SEQ ID NO: 5761467 - DNA, 20 bp, Homo sapiens
gcctgatgagactccactca

SEQ ID NO: 5761468 - DNA, 17 bp, Homo sapiens
gcctgatgctccctccc

SEQ ID NO: 5761469 - DNA, 17 bp, Homo sapiens
gcctgatgctgccccgt

SEQ ID NO: 5761470 - DNA, 13 bp, Homo sapiens
gcctgatggacct

SEQ ID NO: 5761471 - DNA, 15 bp, Homo sapiens
gcctgatggagagga

SEQ ID NO: 5761472 - DNA, 13 bp, Homo sapiens
gcctgatggccaa

SEQ ID NO: 5761473 - DNA, 16 bp, Homo sapiens
gcctgatggccaaggg

SEQ ID NO: 5761474 - DNA, 14 bp, Homo sapiens
gcctgatggccagg

SEQ ID NO: 5761475 - DNA, 21 bp, Homo sapiens
gcctgatgggagtaggctcca

SEQ ID NO: 5761476 - DNA, 23 bp, Homo sapiens
gcctgatgggagtaggctccaga

SEQ ID NO: 5761477 - DNA, 19 bp, Homo sapiens
gcctgatggtgctgctcag

SEQ ID NO: 5761478 - DNA, 23 bp, Homo sapiens
gcctgatgtcttaacgaataaag

SEQ ID NO: 5761479 - DNA, 18 bp, Homo sapiens
gcctgattcactggcctg

SEQ ID NO: 5761480 - DNA, 19 bp, Homo sapiens
gcctgattcggggctgacc

SEQ ID NO: 5761481 - DNA, 20 bp, Homo sapiens
gcctgattcggggctgacct

SEQ ID NO: 5761482 - DNA, 21 bp, Homo sapiens
gcctgattgccaagctcagga

SEQ ID NO: 5761483 - DNA, 21 bp, Homo sapiens
gcctgatttggggtttcttca

SEQ ID NO: 5761484 - DNA, 16 bp, Homo sapiens
gcctgatttgttcctt

SEQ ID NO: 5761485 - DNA, 18 bp, Homo sapiens
gcctgatttgttgggacc

SEQ ID NO: 5761486 - DNA, 13 bp, Homo sapiens
gcctgattttaaa

SEQ ID NO: 5761487 - DNA, 17 bp, Homo sapiens
gcctgcaaacctgctgg

SEQ ID NO: 5761488 - DNA, 23 bp, Homo sapiens
gcctgcaaacctgctggtggggc

SEQ ID NO: 5761489 - DNA, 20 bp, Homo sapiens
gcctgcaaacgctgcctgcc

SEQ ID NO: 5761490 - DNA, 21 bp, Homo sapiens
gcctgcaaacgctgcctgccc

SEQ ID NO: 5761491 - DNA, 13 bp, Homo sapiens
gcctgcaaactgg

SEQ ID NO: 5761492 - DNA, 14 bp, Homo sapiens
gcctgcaaactggg

SEQ ID NO: 5761493 - DNA, 16 bp, Homo sapiens
gcctgcaaactgggaa

SEQ ID NO: 5761494 - DNA, 17 bp, Homo sapiens
gcctgcaaactgggaac

SEQ ID NO: 5761495 - DNA, 13 bp, Homo sapiens
gcctgcaagggag

SEQ ID NO: 5761496 - DNA, 15 bp, Homo sapiens
gcctgcaagggagtg

SEQ ID NO: 5761497 - DNA, 18 bp, Homo sapiens
gcctgcaatctgagccag

SEQ ID NO: 5761498 - DNA, 10 bp, Homo sapiens
gcctgcacac

SEQ ID NO: 5761499 - DNA, 13 bp, Homo sapiens
gcctgcacacaag

SEQ ID NO: 5761500 - DNA, 12 bp, Homo sapiens
gcctgcacacac

SEQ ID NO: 5761501 - DNA, 15 bp, Homo sapiens
gcctgcacacacctg

SEQ ID NO: 5761502 - DNA, 17 bp, Homo sapiens
gcctgcacatcatgagc

SEQ ID NO: 5761503 - DNA, 14 bp, Homo sapiens
gcctgcacccctcc

SEQ ID NO: 5761504 - DNA, 17 bp, Homo sapiens
gcctgcacccctccggc

SEQ ID NO: 5761505 - DNA, 17 bp, Homo sapiens
gcctgcacccttccctc

SEQ ID NO: 5761506 - DNA, 21 bp, Homo sapiens
gcctgcaccgacccgaggccc

SEQ ID NO: 5761507 - DNA, 14 bp, Homo sapiens
gcctgcacctctcc

SEQ ID NO: 5761508 - DNA, 21 bp, Homo sapiens
gcctgcacctgcgcctggctc

SEQ ID NO: 5761509 - DNA, 22 bp, Homo sapiens
gcctgcacctgcgcctggctct

SEQ ID NO: 5761510 - DNA, 21 bp, Homo sapiens
gcctgcacggtgggccttgct

SEQ ID NO: 5761511 - DNA, 22 bp, Homo sapiens
gcctgcacggtgggccttgctg

SEQ ID NO: 5761512 - DNA, 21 bp, Homo sapiens
gcctgcactccctggccttgc

SEQ ID NO: 5761513 - DNA, 11 bp, Homo sapiens
gcctgcagaag

SEQ ID NO: 5761514 - DNA, 19 bp, Homo sapiens
gcctgcagaagtaagcctc

SEQ ID NO: 5761515 - DNA, 19 bp, Homo sapiens
gcctgcagaccctgccagg

SEQ ID NO: 5761516 - DNA, 12 bp, Homo sapiens
gcctgcagagag

SEQ ID NO: 5761517 - DNA, 16 bp, Homo sapiens
gcctgcagagagaagc

SEQ ID NO: 5761518 - DNA, 12 bp, Homo sapiens
gcctgcagagct

SEQ ID NO: 5761519 - DNA, 21 bp, Homo sapiens
gcctgcagaggtctgtgctga

SEQ ID NO: 5761520 - DNA, 14 bp, Homo sapiens
gcctgcagcacatg

SEQ ID NO: 5761521 - DNA, 13 bp, Homo sapiens
gcctgcagcagga

SEQ ID NO: 5761522 - DNA, 13 bp, Homo sapiens
gcctgcagcatct

SEQ ID NO: 5761523 - DNA, 17 bp, Homo sapiens
gcctgcagccagggctg

SEQ ID NO: 5761524 - DNA, 11 bp, Homo sapiens
gcctgcagccc

SEQ ID NO: 5761525 - DNA, 23 bp, Homo sapiens
gcctgcagcccgtgtccaggagc

SEQ ID NO: 5761526 - DNA, 14 bp, Homo sapiens
gcctgcagcctccc

SEQ ID NO: 5761527 - DNA, 15 bp, Homo sapiens
gcctgcagcctcccc

SEQ ID NO: 5761528 - DNA, 15 bp, Homo sapiens
gcctgcagcgcctcc

SEQ ID NO: 5761529 - DNA, 10 bp, Homo sapiens
gcctgcagct

SEQ ID NO: 5761530 - DNA, 19 bp, Homo sapiens
gcctgcaggacctgcctgt

SEQ ID NO: 5761531 - DNA, 16 bp, Homo sapiens
gcctgcaggagagagc

SEQ ID NO: 5761532 - DNA, 20 bp, Homo sapiens
gcctgcaggagagagcagca

SEQ ID NO: 5761533 - DNA, 16 bp, Homo sapiens
gcctgcaggatctcac

SEQ ID NO: 5761534 - DNA, 13 bp, Homo sapiens
gcctgcaggcaga

SEQ ID NO: 5761535 - DNA, 17 bp, Homo sapiens
gcctgcaggcagagctg

SEQ ID NO: 5761536 - DNA, 19 bp, Homo sapiens
gcctgcaggccccagccaa

SEQ ID NO: 5761537 - DNA, 18 bp, Homo sapiens
gcctgcagggccatggct

SEQ ID NO: 5761538 - DNA, 14 bp, Homo sapiens
gcctgcagggcctc

SEQ ID NO: 5761539 - DNA, 22 bp, Homo sapiens
gcctgcagggtgacctgcttcc

SEQ ID NO: 5761540 - DNA, 19 bp, Homo sapiens
gcctgcagggtggtgctgg

SEQ ID NO: 5761541 - DNA, 20 bp, Homo sapiens
gcctgcagggtggtgctggg

SEQ ID NO: 5761542 - DNA, 22 bp, Homo sapiens
gcctgcaggtccggggaggagg

SEQ ID NO: 5761543 - DNA, 14 bp, Homo sapiens
gcctgcaggtgctg

SEQ ID NO: 5761544 - DNA, 15 bp, Homo sapiens
gcctgcagtcttctg

SEQ ID NO: 5761545 - DNA, 16 bp, Homo sapiens
gcctgcagtcttctgg

SEQ ID NO: 5761546 - DNA, 20 bp, Homo sapiens
gcctgcagtcttctgggctg

SEQ ID NO: 5761547 - DNA, 22 bp, Homo sapiens
gcctgcataggagtttggagga

SEQ ID NO: 5761548 - DNA, 14 bp, Homo sapiens
gcctgcatcttctt

SEQ ID NO: 5761549 - DNA, 15 bp, Homo sapiens
gcctgcatgagctgg

SEQ ID NO: 5761550 - DNA, 16 bp, Homo sapiens
gcctgcatgagctggc

SEQ ID NO: 5761551 - DNA, 17 bp, Homo sapiens
gcctgcatgagctggca

SEQ ID NO: 5761552 - DNA, 19 bp, Homo sapiens
gcctgcatgagctggcaac

SEQ ID NO: 5761553 - DNA, 12 bp, Homo sapiens
gcctgcatgctg

SEQ ID NO: 5761554 - DNA, 21 bp, Homo sapiens
gcctgcatgctgggttctgca

SEQ ID NO: 5761555 - DNA, 13 bp, Homo sapiens
gcctgcatggaga

SEQ ID NO: 5761556 - DNA, 16 bp, Homo sapiens
gcctgcatgtaaacac

SEQ ID NO: 5761557 - DNA, 14 bp, Homo sapiens
gcctgcattcgcag

SEQ ID NO: 5761558 - DNA, 21 bp, Homo sapiens
gcctgcatttcctcgcagcct

SEQ ID NO: 5761559 - DNA, 20 bp, Homo sapiens
gcctgccaaagtagtcctgg

SEQ ID NO: 5761560 - DNA, 21 bp, Homo sapiens
gcctgccaaagtagtcctggc

SEQ ID NO: 5761561 - DNA, 22 bp, Homo sapiens
gcctgccaaagtagtcctggca

SEQ ID NO: 5761562 - DNA, 21 bp, Homo sapiens
gcctgccaaagtgcctgggaa

SEQ ID NO: 5761563 - DNA, 18 bp, Homo sapiens
gcctgccaatgccacagc

SEQ ID NO: 5761564 - DNA, 19 bp, Homo sapiens
gcctgccaatgccacagcc

SEQ ID NO: 5761565 - DNA, 20 bp, Homo sapiens
gcctgccaatgccacagcca

SEQ ID NO: 5761566 - DNA, 16 bp, Homo sapiens
gcctgccaccacgctg

SEQ ID NO: 5761567 - DNA, 18 bp, Homo sapiens
gcctgccaccctcctgcg

SEQ ID NO: 5761568 - DNA, 12 bp, Homo sapiens
gcctgccacctc

SEQ ID NO: 5761569 - DNA, 19 bp, Homo sapiens
gcctgccacctctcccagc

SEQ ID NO: 5761570 - DNA, 13 bp, Homo sapiens
gcctgccacctgg

SEQ ID NO: 5761571 - DNA, 14 bp, Homo sapiens
gcctgccacctgga

SEQ ID NO: 5761572 - DNA, 13 bp, Homo sapiens
gcctgccaccttc

SEQ ID NO: 5761573 - DNA, 24 bp, Homo sapiens
gcctgccactctcctgaggagcag

SEQ ID NO: 5761574 - DNA, 15 bp, Homo sapiens
gcctgccactctctg

SEQ ID NO: 5761575 - DNA, 15 bp, Homo sapiens
gcctgccagctgcac

SEQ ID NO: 5761576 - DNA, 12 bp, Homo sapiens
gcctgccaggag

SEQ ID NO: 5761577 - DNA, 13 bp, Homo sapiens
gcctgccaggagg

SEQ ID NO: 5761578 - DNA, 23 bp, Homo sapiens
gcctgccaggccctccagcagga

SEQ ID NO: 5761579 - DNA, 14 bp, Homo sapiens
gcctgccagggccc

SEQ ID NO: 5761580 - DNA, 15 bp, Homo sapiens
gcctgccagggcccc

SEQ ID NO: 5761581 - DNA, 16 bp, Homo sapiens
gcctgccagtcctagc

SEQ ID NO: 5761582 - DNA, 18 bp, Homo sapiens
gcctgccagtcctagctg

SEQ ID NO: 5761583 - DNA, 23 bp, Homo sapiens
gcctgccagtcctagctgcacag

SEQ ID NO: 5761584 - DNA, 13 bp, Homo sapiens
gcctgccagtctg

SEQ ID NO: 5761585 - DNA, 17 bp, Homo sapiens
gcctgccataccgctgg

SEQ ID NO: 5761586 - DNA, 19 bp, Homo sapiens
gcctgccataccgctgggg

SEQ ID NO: 5761587 - DNA, 21 bp, Homo sapiens
gcctgccataccgctggggaa

SEQ ID NO: 5761588 - DNA, 15 bp, Homo sapiens
gcctgccatcttctc

SEQ ID NO: 5761589 - DNA, 14 bp, Homo sapiens
gcctgccatggctg

SEQ ID NO: 5761590 - DNA, 13 bp, Homo sapiens
gcctgccatgggc

SEQ ID NO: 5761591 - DNA, 21 bp, Homo sapiens
gcctgccatgggccagcctag

SEQ ID NO: 5761592 - DNA, 21 bp, Homo sapiens
gcctgccatgtagttggggca

SEQ ID NO: 5761593 - DNA, 22 bp, Homo sapiens
gcctgccatgtgtgagtcactt

SEQ ID NO: 5761594 - DNA, 21 bp, Homo sapiens
gcctgcccaagcccaggccac

SEQ ID NO: 5761595 - DNA, 13 bp, Homo sapiens
gcctgcccacccg

SEQ ID NO: 5761596 - DNA, 13 bp, Homo sapiens
gcctgcccacctg

SEQ ID NO: 5761597 - DNA, 14 bp, Homo sapiens
gcctgcccacctgc

SEQ ID NO: 5761598 - DNA, 15 bp, Homo sapiens
gcctgcccacctgcc

SEQ ID NO: 5761599 - DNA, 17 bp, Homo sapiens
gcctgcccacctgcctg

SEQ ID NO: 5761600 - DNA, 16 bp, Homo sapiens
gcctgcccagacaaga

SEQ ID NO: 5761601 - DNA, 15 bp, Homo sapiens
gcctgcccagactga

SEQ ID NO: 5761602 - DNA, 16 bp, Homo sapiens
gcctgcccagcctcaa

SEQ ID NO: 5761603 - DNA, 20 bp, Homo sapiens
gcctgcccagcctcaatgtc

SEQ ID NO: 5761604 - DNA, 22 bp, Homo sapiens
gcctgcccagcctcgcatgcca

SEQ ID NO: 5761605 - DNA, 16 bp, Homo sapiens
gcctgcccagctgccg

SEQ ID NO: 5761606 - DNA, 19 bp, Homo sapiens
gcctgcccagctgccgccc

SEQ ID NO: 5761607 - DNA, 17 bp, Homo sapiens
gcctgcccaggcccctg

SEQ ID NO: 5761608 - DNA, 19 bp, Homo sapiens
gcctgcccagttgcactca

SEQ ID NO: 5761609 - DNA, 15 bp, Homo sapiens
gcctgccccacccac

SEQ ID NO: 5761610 - DNA, 19 bp, Homo sapiens
gcctgccccacccacccca

SEQ ID NO: 5761611 - DNA, 22 bp, Homo sapiens
gcctgccccacccaccccacag

SEQ ID NO: 5761612 - DNA, 23 bp, Homo sapiens
gcctgccccacccaccccacaga

SEQ ID NO: 5761613 - DNA, 15 bp, Homo sapiens
gcctgccccagctct

SEQ ID NO: 5761614 - DNA, 20 bp, Homo sapiens
gcctgccccatcccatccct

SEQ ID NO: 5761615 - DNA, 18 bp, Homo sapiens
gcctgcccccagcactcc

SEQ ID NO: 5761616 - DNA, 23 bp, Homo sapiens
gcctgcccccagcactcctctgt

SEQ ID NO: 5761617 - DNA, 14 bp, Homo sapiens
gcctgcccccagcg

SEQ ID NO: 5761618 - DNA, 23 bp, Homo sapiens
gcctgccccccagtctccccact

SEQ ID NO: 5761619 - DNA, 22 bp, Homo sapiens
gcctgccccctatcttgtcctg

SEQ ID NO: 5761620 - DNA, 21 bp, Homo sapiens
gcctgctggccgacccactga

SEQ ID NO: 5761621 - DNA, 13 bp, Homo sapiens
gcctgctggctgc

SEQ ID NO: 5761622 - DNA, 21 bp, Homo sapiens
gcctgctggctgcggccccct

SEQ ID NO: 5761623 - DNA, 13 bp, Homo sapiens
gcctgctgggaac

SEQ ID NO: 5761624 - DNA, 21 bp, Homo sapiens
gcctgctgggaaccccgcagc

SEQ ID NO: 5761625 - DNA, 23 bp, Homo sapiens
gcctgctgggaaccccgcagccc

SEQ ID NO: 5761626 - DNA, 21 bp, Homo sapiens
gcctgctgggaagagctcccc

SEQ ID NO: 5761627 - DNA, 14 bp, Homo sapiens
gcctgctgggcact

SEQ ID NO: 5761628 - DNA, 16 bp, Homo sapiens
gcctgctgggcactgg

SEQ ID NO: 5761629 - DNA, 19 bp, Homo sapiens
gcctgctgggctcccccca

SEQ ID NO: 5761630 - DNA, 14 bp, Homo sapiens
gcctgctgggctct

SEQ ID NO: 5761631 - DNA, 19 bp, Homo sapiens
gcctgctgggctctccacc

SEQ ID NO: 5761632 - DNA, 20 bp, Homo sapiens
gcctgctgggctctccacct

SEQ ID NO: 5761633 - DNA, 15 bp, Homo sapiens
gcctgctgggctctt

SEQ ID NO: 5761634 - DNA, 18 bp, Homo sapiens
gcctgctgggtgccaggt

SEQ ID NO: 5761635 - DNA, 21 bp, Homo sapiens
gcctgctgggtgccaggtgct

SEQ ID NO: 5761636 - DNA, 21 bp, Homo sapiens
gcctgctggtcacagcctcct

SEQ ID NO: 5761637 - DNA, 22 bp, Homo sapiens
gcctgctggtcacagcctcctc

SEQ ID NO: 5761638 - DNA, 23 bp, Homo sapiens
gcctgctggttttatctgagtga

SEQ ID NO: 5761639 - DNA, 14 bp, Homo sapiens
gcctgctgtcacct

SEQ ID NO: 5761640 - DNA, 19 bp, Homo sapiens
gcctgctgtcacctcgctg

SEQ ID NO: 5761641 - DNA, 12 bp, Homo sapiens
gcctgctgtggg

SEQ ID NO: 5761642 - DNA, 13 bp, Homo sapiens
gcctgctgtgggt

SEQ ID NO: 5761643 - DNA, 18 bp, Homo sapiens
gcctgctgtgtccttcct

SEQ ID NO: 5761644 - DNA, 23 bp, Homo sapiens
gcctgctgtgtccttcctccaca

SEQ ID NO: 5761645 - DNA, 21 bp, Homo sapiens
gcctgctgttggtcctctctc

SEQ ID NO: 5761646 - DNA, 22 bp, Homo sapiens
gcctgctgttggtcctctctct

SEQ ID NO: 5761647 - DNA, 12 bp, Homo sapiens
gcctgcttcaca

SEQ ID NO: 5761648 - DNA, 15 bp, Homo sapiens
gcctgcttcccacaa

SEQ ID NO: 5761649 - DNA, 17 bp, Homo sapiens
gcctgcttcccacaact

SEQ ID NO: 5761650 - DNA, 22 bp, Homo sapiens
gcctgcttcccacctccctgcc

SEQ ID NO: 5761651 - DNA, 16 bp, Homo sapiens
gcctgcttcctggacc

SEQ ID NO: 5761652 - DNA, 22 bp, Homo sapiens
gcctgcttcttctctccacatg

SEQ ID NO: 5761653 - DNA, 22 bp, Homo sapiens
gcctgcttgactttccagaatg

SEQ ID NO: 5761654 - DNA, 15 bp, Homo sapiens
gcctgcttggcccgg

SEQ ID NO: 5761655 - DNA, 23 bp, Homo sapiens
gcctgcttggcccggccggcctg

SEQ ID NO: 5761656 - DNA, 15 bp, Homo sapiens
gcctgctttcctgca

SEQ ID NO: 5761657 - DNA, 21 bp, Homo sapiens
gcctgcttttcactgctgcaa

SEQ ID NO: 5761658 - DNA, 15 bp, Homo sapiens
gcctgcttttccagg

SEQ ID NO: 5761659 - DNA, 18 bp, Homo sapiens
gcctgcttttccaggatc

SEQ ID NO: 5761660 - DNA, 23 bp, Homo sapiens
gcctgcttttccaggatcctgca

SEQ ID NO: 5761661 - DNA, 16 bp, Homo sapiens
gcctgcttttgcaaat

SEQ ID NO: 5761662 - DNA, 18 bp, Homo sapiens
gcctgcttttgtgtccca

SEQ ID NO: 5761663 - DNA, 19 bp, Homo sapiens
gcctgcttttgtgtcccat

SEQ ID NO: 5761664 - DNA, 18 bp, Homo sapiens
gcctggaaacagaggtaa

SEQ ID NO: 5761665 - DNA, 15 bp, Homo sapiens
gcctggaaccaggga

SEQ ID NO: 5761666 - DNA, 19 bp, Homo sapiens
gcctggaaccagggaggag

SEQ ID NO: 5761667 - DNA, 21 bp, Homo sapiens
gcctggaactggctgtgaaga

SEQ ID NO: 5761668 - DNA, 22 bp, Homo sapiens
gcctggaagacagagacctcct

SEQ ID NO: 5761669 - DNA, 21 bp, Homo sapiens
gcctggaagagctgagacctt

SEQ ID NO: 5761670 - DNA, 10 bp, Homo sapiens
gcctggaagc

SEQ ID NO: 5761671 - DNA, 12 bp, Homo sapiens
gcctggaagcac

SEQ ID NO: 5761672 - DNA, 12 bp, Homo sapiens
gcctggaagcca

SEQ ID NO: 5761673 - DNA, 21 bp, Homo sapiens
gcctggaagggaagtgagaaa

SEQ ID NO: 5761674 - DNA, 19 bp, Homo sapiens
gcctggaatttgggcagat

SEQ ID NO: 5761675 - DNA, 16 bp, Homo sapiens
gcctggacaaaccctt

SEQ ID NO: 5761676 - DNA, 14 bp, Homo sapiens
gcctggacaggcgg

SEQ ID NO: 5761677 - DNA, 15 bp, Homo sapiens
gcctggacaggcggg

SEQ ID NO: 5761678 - DNA, 13 bp, Homo sapiens
gcctggaccccca

SEQ ID NO: 5761679 - DNA, 20 bp, Homo sapiens
gcctggaccgcttcccagag

SEQ ID NO: 5761680 - DNA, 21 bp, Homo sapiens
gcctggacctatgcagggagg

SEQ ID NO: 5761681 - DNA, 14 bp, Homo sapiens
gcctggacctgcct

SEQ ID NO: 5761682 - DNA, 15 bp, Homo sapiens
gcctggacctgcctc

SEQ ID NO: 5761683 - DNA, 17 bp, Homo sapiens
gcctggacctgcctcct

SEQ ID NO: 5761684 - DNA, 18 bp, Homo sapiens
gcctggacctgcctcctg

SEQ ID NO: 5761685 - DNA, 19 bp, Homo sapiens
gcctggacctgcctcctgc

SEQ ID NO: 5761686 - DNA, 19 bp, Homo sapiens
gcctggacgcagccacaca

SEQ ID NO: 5761687 - DNA, 21 bp, Homo sapiens
gcctggacgggccctccttcc

SEQ ID NO: 5761688 - DNA, 13 bp, Homo sapiens
gcctggactctgc

SEQ ID NO: 5761689 - DNA, 17 bp, Homo sapiens
gcctggactctgcccca

SEQ ID NO: 5761690 - DNA, 14 bp, Homo sapiens
gcctggactgacca

SEQ ID NO: 5761691 - DNA, 20 bp, Homo sapiens
gcctggactgactgcagccc

SEQ ID NO: 5761692 - DNA, 19 bp, Homo sapiens
gcctggactgcacaggcag

SEQ ID NO: 5761693 - DNA, 20 bp, Homo sapiens
gcctggactgcacaggcagc

SEQ ID NO: 5761694 - DNA, 13 bp, Homo sapiens
gcctggactgcta

SEQ ID NO: 5761695 - DNA, 23 bp, Homo sapiens
gcctggactgtcctaggtgaccc

SEQ ID NO: 5761696 - DNA, 15 bp, Homo sapiens
gcctggactgtttca

SEQ ID NO: 5761697 - DNA, 13 bp, Homo sapiens
gcctggagaaagg

SEQ ID NO: 5761698 - DNA, 12 bp, Homo sapiens
gcctggagaagc

SEQ ID NO: 5761699 - DNA, 15 bp, Homo sapiens
gcctggagaagctga

SEQ ID NO: 5761700 - DNA, 23 bp, Homo sapiens
gcctggagaagggttcagcccaa

SEQ ID NO: 5761701 - DNA, 16 bp, Homo sapiens
gcctggagacagatac

SEQ ID NO: 5761702 - DNA, 15 bp, Homo sapiens
gcctggagagcgagg

SEQ ID NO: 5761703 - DNA, 21 bp, Homo sapiens
gcctggagaggacggccctgc

SEQ ID NO: 5761704 - DNA, 23 bp, Homo sapiens
gcctggagaggacggccctgcct

SEQ ID NO: 5761705 - DNA, 14 bp, Homo sapiens
gcctggagaggcct

SEQ ID NO: 5761706 - DNA, 12 bp, Homo sapiens
gcctggagaggg

SEQ ID NO: 5761707 - DNA, 16 bp, Homo sapiens
gcctggagaggggcct

SEQ ID NO: 5761708 - DNA, 21 bp, Homo sapiens
gcctggagaggggcctgggaa

SEQ ID NO: 5761709 - DNA, 15 bp, Homo sapiens
gcctggagagggtct

SEQ ID NO: 5761710 - DNA, 16 bp, Homo sapiens
gcctggagatcctcct

SEQ ID NO: 5761711 - DNA, 22 bp, Homo sapiens
gcctggagatcctcctgcagac

SEQ ID NO: 5761712 - DNA, 21 bp, Homo sapiens
gcctggagatgacttgaggcc

SEQ ID NO: 5761713 - DNA, 15 bp, Homo sapiens
gcctggagcaggccc

SEQ ID NO: 5761714 - DNA, 17 bp, Homo sapiens
gcctggagcaggcccaa

SEQ ID NO: 5761715 - DNA, 14 bp, Homo sapiens
gcctggagcatgga

SEQ ID NO: 5761716 - DNA, 19 bp, Homo sapiens
gcctggagccccactgccc

SEQ ID NO: 5761717 - DNA, 13 bp, Homo sapiens
gcctggagcccct

SEQ ID NO: 5761718 - DNA, 18 bp, Homo sapiens
gcctggagcccctgtgtt

SEQ ID NO: 5761719 - DNA, 12 bp, Homo sapiens
gcctggagccct

SEQ ID NO: 5761720 - DNA, 20 bp, Homo sapiens
gcctggagccctccgccttc

SEQ ID NO: 5761721 - DNA, 17 bp, Homo sapiens
gcctggagccctggaga

SEQ ID NO: 5761722 - DNA, 19 bp, Homo sapiens
gcctggagccctgggcgga

SEQ ID NO: 5761723 - DNA, 12 bp, Homo sapiens
gcctggagcctg

SEQ ID NO: 5761724 - DNA, 15 bp, Homo sapiens
gcctggagcctgggc

SEQ ID NO: 5761725 - DNA, 17 bp, Homo sapiens
gcctggagcctgggcag

SEQ ID NO: 5761726 - DNA, 19 bp, Homo sapiens
gcctggagcctgggcagca

SEQ ID NO: 5761727 - DNA, 20 bp, Homo sapiens
gcctggagcggagcttgcct

SEQ ID NO: 5761728 - DNA, 14 bp, Homo sapiens
gcctggagcgtttg

SEQ ID NO: 5761729 - DNA, 14 bp, Homo sapiens
gcctggagctcctg

SEQ ID NO: 5761730 - DNA, 15 bp, Homo sapiens
gcctggagctcctgg

SEQ ID NO: 5761731 - DNA, 16 bp, Homo sapiens
gcctggagctcctggg

SEQ ID NO: 5761732 - DNA, 15 bp, Homo sapiens
gcctggagctttcct

SEQ ID NO: 5761733 - DNA, 13 bp, Homo sapiens
gcctggaggacct

SEQ ID NO: 5761734 - DNA, 14 bp, Homo sapiens
gcctggaggacctg

SEQ ID NO: 5761735 - DNA, 19 bp, Homo sapiens
gcctggaggacctgagcct

SEQ ID NO: 5761736 - DNA, 20 bp, Homo sapiens
gcctggaggacctgagcctg

SEQ ID NO: 5761737 - DNA, 13 bp, Homo sapiens
gcctggaggagaa

SEQ ID NO: 5761738 - DNA, 21 bp, Homo sapiens
gcctggaggatccctccatcc

SEQ ID NO: 5761739 - DNA, 15 bp, Homo sapiens
gcctggagggatgcc

SEQ ID NO: 5761740 - DNA, 17 bp, Homo sapiens
gcctggagggatgccac

SEQ ID NO: 5761741 - DNA, 18 bp, Homo sapiens
gcctggagggatgccccc

SEQ ID NO: 5761742 - DNA, 13 bp, Homo sapiens
gcctggagggcac

SEQ ID NO: 5761743 - DNA, 22 bp, Homo sapiens
gcctggagggcacttcctccac

SEQ ID NO: 5761744 - DNA, 20 bp, Homo sapiens
gcctggaggtctggctgagc

SEQ ID NO: 5761745 - DNA, 21 bp, Homo sapiens
gcctggaggtctggctgagcc

SEQ ID NO: 5761746 - DNA, 15 bp, Homo sapiens
gcctggagtgtcgga

SEQ ID NO: 5761747 - DNA, 23 bp, Homo sapiens
gcctggagtgtcggatcctgtga

SEQ ID NO: 5761748 - DNA, 19 bp, Homo sapiens
gcctggagttgactgactg

SEQ ID NO: 5761749 - DNA, 18 bp, Homo sapiens
gcctggatccatcctgct

SEQ ID NO: 5761750 - DNA, 13 bp, Homo sapiens
gcctggatgccag

SEQ ID NO: 5761751 - DNA, 22 bp, Homo sapiens
gcctggatgccagctgtgtcct

SEQ ID NO: 5761752 - DNA, 20 bp, Homo sapiens
gcctggatgcggatggccgg

SEQ ID NO: 5761753 - DNA, 17 bp, Homo sapiens
gcctggatgtgggccaa

SEQ ID NO: 5761754 - DNA, 18 bp, Homo sapiens
gcctggatgtgggccaag

SEQ ID NO: 5761755 - DNA, 21 bp, Homo sapiens
gcctggattcatttcctgccc

SEQ ID NO: 5761756 - DNA, 18 bp, Homo sapiens
gcctggattccagcagtg

SEQ ID NO: 5761757 - DNA, 16 bp, Homo sapiens
gcctggatttctggtt

SEQ ID NO: 5761758 - DNA, 22 bp, Homo sapiens
gcctggatttctggttctgatg

SEQ ID NO: 5761759 - DNA, 12 bp, Homo sapiens
gcctggcaaggc

SEQ ID NO: 5761760 - DNA, 20 bp, Homo sapiens
gcctggcaaggcattcctca

SEQ ID NO: 5761761 - DNA, 22 bp, Homo sapiens
gcctggcaaggcattcctcatc

SEQ ID NO: 5761762 - DNA, 20 bp, Homo sapiens
gcctggcaatagaccgagac

SEQ ID NO: 5761763 - DNA, 16 bp, Homo sapiens
gcctggcacaggactg

SEQ ID NO: 5761764 - DNA, 13 bp, Homo sapiens
gcctggcacaggg

SEQ ID NO: 5761765 - DNA, 18 bp, Homo sapiens
gcctggcacagggcagtg

SEQ ID NO: 5761766 - DNA, 16 bp, Homo sapiens
gcctggcacagtgtct

SEQ ID NO: 5761767 - DNA, 21 bp, Homo sapiens
gcctggcacagtgtctgggct

SEQ ID NO: 5761768 - DNA, 11 bp, Homo sapiens
gcctggcaccc

SEQ ID NO: 5761769 - DNA, 12 bp, Homo sapiens
gcctggcaccca

SEQ ID NO: 5761770 - DNA, 13 bp, Homo sapiens
gcctggcacgaag

SEQ ID NO: 5761771 - DNA, 12 bp, Homo sapiens
gcctggcagccg

SEQ ID NO: 5761772 - DNA, 21 bp, Homo sapiens
gcctggcagccgtgccttcag

SEQ ID NO: 5761773 - DNA, 14 bp, Homo sapiens
gcctggcaggccag

SEQ ID NO: 5761774 - DNA, 15 bp, Homo sapiens
gcctggcaggccagt

SEQ ID NO: 5761775 - DNA, 19 bp, Homo sapiens
gcctggcaggccagtgtct

SEQ ID NO: 5761776 - DNA, 23 bp, Homo sapiens
gcctggcagggaggtcaggccct

SEQ ID NO: 5761777 - DNA, 12 bp, Homo sapiens
gcctggcagggg

SEQ ID NO: 5761778 - DNA, 14 bp, Homo sapiens
gcctggcaggggat

SEQ ID NO: 5761779 - DNA, 13 bp, Homo sapiens
gcctggcaggtgg

SEQ ID NO: 5761780 - DNA, 20 bp, Homo sapiens
gcctggcagttgaacagagg

SEQ ID NO: 5761781 - DNA, 11 bp, Homo sapiens
gcctggcatct

SEQ ID NO: 5761782 - DNA, 16 bp, Homo sapiens
gcctggcatctgtgcg

SEQ ID NO: 5761783 - DNA, 16 bp, Homo sapiens
gcctggcatctgtgtg

SEQ ID NO: 5761784 - DNA, 17 bp, Homo sapiens
gcctggcatctgtgtgc

SEQ ID NO: 5761785 - DNA, 22 bp, Homo sapiens
gcctggcattcttgtacagtgt

SEQ ID NO: 5761786 - DNA, 9 bp, Homo sapiens
gcctggcca

SEQ ID NO: 5761787 - DNA, 11 bp, Homo sapiens
gcctggccacc

SEQ ID NO: 5761788 - DNA, 14 bp, Homo sapiens
gcctggccacctct

SEQ ID NO: 5761789 - DNA, 17 bp, Homo sapiens
gcctggccacctctctc

SEQ ID NO: 5761790 - DNA, 19 bp, Homo sapiens
gcctggccacctctctcct

SEQ ID NO: 5761791 - DNA, 22 bp, Homo sapiens
gcctggccacgcagccaggaca

SEQ ID NO: 5761792 - DNA, 14 bp, Homo sapiens
gcctggccagacac

SEQ ID NO: 5761793 - DNA, 16 bp, Homo sapiens
gcctggccagacacag

SEQ ID NO: 5761794 - DNA, 20 bp, Homo sapiens
gcctggccagacacaggccc

SEQ ID NO: 5761795 - DNA, 23 bp, Homo sapiens
gcctggccagaccaggtgacctt

SEQ ID NO: 5761796 - DNA, 20 bp, Homo sapiens
gcctggccagatgcaccagc

SEQ ID NO: 5761797 - DNA, 23 bp, Homo sapiens
gcctggccagcaggtccccagct

SEQ ID NO: 5761798 - DNA, 21 bp, Homo sapiens
gcctgggcccaggcccagcct

SEQ ID NO: 5761799 - DNA, 16 bp, Homo sapiens
gcctgggcccaggctc

SEQ ID NO: 5761800 - DNA, 22 bp, Homo sapiens
gcctgggcccaggctctgggaa

SEQ ID NO: 5761801 - DNA, 20 bp, Homo sapiens
gcctgggcccctcagccacc

SEQ ID NO: 5761802 - DNA, 21 bp, Homo sapiens
gcctgggcccctcccctcaga

SEQ ID NO: 5761803 - DNA, 22 bp, Homo sapiens
gcctgggcccctcccctcagag

SEQ ID NO: 5761804 - DNA, 23 bp, Homo sapiens
gcctgggcccctcccctcagagc

SEQ ID NO: 5761805 - DNA, 16 bp, Homo sapiens
gcctgggccgctgcca

SEQ ID NO: 5761806 - DNA, 16 bp, Homo sapiens
gcctgggccggcgagg

SEQ ID NO: 5761807 - DNA, 21 bp, Homo sapiens
gcctgggccgtagcttgtctg

SEQ ID NO: 5761808 - DNA, 22 bp, Homo sapiens
gcctgggccgtatctccggctc

SEQ ID NO: 5761809 - DNA, 15 bp, Homo sapiens
gcctgggccgtggca

SEQ ID NO: 5761810 - DNA, 18 bp, Homo sapiens
gcctgggccgtggcacag

SEQ ID NO: 5761811 - DNA, 20 bp, Homo sapiens
gcctgggccgtggcacagct

SEQ ID NO: 5761812 - DNA, 21 bp, Homo sapiens
gcctgggccgtggcacagctg

SEQ ID NO: 5761813 - DNA, 18 bp, Homo sapiens
gcctgggcctatggagag

SEQ ID NO: 5761814 - DNA, 19 bp, Homo sapiens
gcctgggcctatggagagc

SEQ ID NO: 5761815 - DNA, 21 bp, Homo sapiens
gcctgggcctatggagagccc

SEQ ID NO: 5761816 - DNA, 12 bp, Homo sapiens
gcctgggcctcc

SEQ ID NO: 5761817 - DNA, 14 bp, Homo sapiens
gcctgggcctccca

SEQ ID NO: 5761818 - DNA, 20 bp, Homo sapiens
gcctgggcctcctcctagct

SEQ ID NO: 5761819 - DNA, 17 bp, Homo sapiens
gcctgggcctctgcccc

SEQ ID NO: 5761820 - DNA, 14 bp, Homo sapiens
gcctgggcctgctt

SEQ ID NO: 5761821 - DNA, 22 bp, Homo sapiens
gcctgggcctgcttttccagga

SEQ ID NO: 5761822 - DNA, 14 bp, Homo sapiens
gcctgggcctggct

SEQ ID NO: 5761823 - DNA, 17 bp, Homo sapiens
gcctgggcctgtgcagc

SEQ ID NO: 5761824 - DNA, 23 bp, Homo sapiens
gcctgggcctgtgcagcagccca

SEQ ID NO: 5761825 - DNA, 20 bp, Homo sapiens
gcctgggccttggctgggcc

SEQ ID NO: 5761826 - DNA, 18 bp, Homo sapiens
gcctgggcgacagagcaa

SEQ ID NO: 5761827 - DNA, 12 bp, Homo sapiens
gcctgggctagg

SEQ ID NO: 5761828 - DNA, 15 bp, Homo sapiens
gcctgggctcactgt

SEQ ID NO: 5761829 - DNA, 20 bp, Homo sapiens
gcctgggctccctcttgtgg

SEQ ID NO: 5761830 - DNA, 15 bp, Homo sapiens
gcctgggctcctctg

SEQ ID NO: 5761831 - DNA, 16 bp, Homo sapiens
gcctgggctcctctgc

SEQ ID NO: 5761832 - DNA, 21 bp, Homo sapiens
gcctgggctgaccccggtggc

SEQ ID NO: 5761833 - DNA, 18 bp, Homo sapiens
gcctgggctgggcagcct

SEQ ID NO: 5761834 - DNA, 19 bp, Homo sapiens
gcctgggctgggcagcctt

SEQ ID NO: 5761835 - DNA, 20 bp, Homo sapiens
gcctgggctgggcagccttg

SEQ ID NO: 5761836 - DNA, 14 bp, Homo sapiens
gcctgggctgttgt

SEQ ID NO: 5761837 - DNA, 15 bp, Homo sapiens
gcctgggcttggccc

SEQ ID NO: 5761838 - DNA, 20 bp, Homo sapiens
gcctgggcttggcccgcggc

SEQ ID NO: 5761839 - DNA, 18 bp, Homo sapiens
gcctggggacggagcact

SEQ ID NO: 5761840 - DNA, 14 bp, Homo sapiens
gcctggggagccca

SEQ ID NO: 5761841 - DNA, 14 bp, Homo sapiens
gcctggggaggccc

SEQ ID NO: 5761842 - DNA, 21 bp, Homo sapiens
gcctggggatgtaaccaagct

SEQ ID NO: 5761843 - DNA, 21 bp, Homo sapiens
gcctggggcaaacctagccgg

SEQ ID NO: 5761844 - DNA, 20 bp, Homo sapiens
gcctggggcctccagaagct

SEQ ID NO: 5761845 - DNA, 13 bp, Homo sapiens
gcctggggcctga

SEQ ID NO: 5761846 - DNA, 19 bp, Homo sapiens
gcctggggccttcctggct

SEQ ID NO: 5761847 - DNA, 22 bp, Homo sapiens
gcctggggccttcctggctttg

SEQ ID NO: 5761848 - DNA, 15 bp, Homo sapiens
gcctggggctccctc

SEQ ID NO: 5761849 - DNA, 18 bp, Homo sapiens
gcctggggctccctctct

SEQ ID NO: 5761850 - DNA, 15 bp, Homo sapiens
gcctggggctccggt

SEQ ID NO: 5761851 - DNA, 20 bp, Homo sapiens
gcctggggctctaacgcctg

SEQ ID NO: 5761852 - DNA, 22 bp, Homo sapiens
gcctggggctctaacgcctgag

SEQ ID NO: 5761853 - DNA, 13 bp, Homo sapiens
gcctggggctctc

SEQ ID NO: 5761854 - DNA, 18 bp, Homo sapiens
gcctggggctctctgacc

SEQ ID NO: 5761855 - DNA, 13 bp, Homo sapiens
gcctggggctggc

SEQ ID NO: 5761856 - DNA, 14 bp, Homo sapiens
gcctggggcttgaa

SEQ ID NO: 5761857 - DNA, 20 bp, Homo sapiens
gcctggggcttgaatttgca

SEQ ID NO: 5761858 - DNA, 20 bp, Homo sapiens
gcctgggggacagaaagaga

SEQ ID NO: 5761859 - DNA, 20 bp, Homo sapiens
gcctgggggacagagcaaga

SEQ ID NO: 5761860 - DNA, 20 bp, Homo sapiens
gcctgggggacccctggctc

SEQ ID NO: 5761861 - DNA, 21 bp, Homo sapiens
gcctgggggagttttcctcta

SEQ ID NO: 5761862 - DNA, 14 bp, Homo sapiens
gcctgggggcagtg

SEQ ID NO: 5761863 - DNA, 23 bp, Homo sapiens
gcctgggggcagtgactggcagg

SEQ ID NO: 5761864 - DNA, 13 bp, Homo sapiens
gcctgggggccag

SEQ ID NO: 5761865 - DNA, 13 bp, Homo sapiens
gcctgggggcctg

SEQ ID NO: 5761866 - DNA, 19 bp, Homo sapiens
gcctgggggcctggctggc

SEQ ID NO: 5761867 - DNA, 17 bp, Homo sapiens
gcctgggggtgccagga

SEQ ID NO: 5761868 - DNA, 22 bp, Homo sapiens
gcctgggggttttccaagccct

SEQ ID NO: 5761869 - DNA, 23 bp, Homo sapiens
gcctgggggttttccaagccctc

SEQ ID NO: 5761870 - DNA, 16 bp, Homo sapiens
gcctggggtaggagga

SEQ ID NO: 5761871 - DNA, 19 bp, Homo sapiens
gcctggggtgacccggcac

SEQ ID NO: 5761872 - DNA, 17 bp, Homo sapiens
gcctggggtgcatctcc

SEQ ID NO: 5761873 - DNA, 21 bp, Homo sapiens
gcctggggtggcctggccctc

SEQ ID NO: 5761874 - DNA, 14 bp, Homo sapiens
gcctggggtggggt

SEQ ID NO: 5761875 - DNA, 16 bp, Homo sapiens
gcctggggtggggtca

SEQ ID NO: 5761876 - DNA, 20 bp, Homo sapiens
gcctgggtcacagagtgaga

SEQ ID NO: 5761877 - DNA, 18 bp, Homo sapiens
gcctgggtccccctcctg

SEQ ID NO: 5761878 - DNA, 12 bp, Homo sapiens
gcctgggtcctc

SEQ ID NO: 5761879 - DNA, 17 bp, Homo sapiens
gcctgggtcctcggccc

SEQ ID NO: 5761880 - DNA, 20 bp, Homo sapiens
gcctgggtcctcggccctgt

SEQ ID NO: 5761881 - DNA, 23 bp, Homo sapiens
gcctgggtctgtgtctcttttct

SEQ ID NO: 5761882 - DNA, 20 bp, Homo sapiens
gcctgggtgacaagagcgaa

SEQ ID NO: 5761883 - DNA, 22 bp, Homo sapiens
gcctgggtgacagagcaagact

SEQ ID NO: 5761884 - DNA, 18 bp, Homo sapiens
gcctgggtgacagagtga

SEQ ID NO: 5761885 - DNA, 21 bp, Homo sapiens
gcctgggtgagaatcctgcct

SEQ ID NO: 5761886 - DNA, 23 bp, Homo sapiens
gcctgggtggatcggcctcctct

SEQ ID NO: 5761887 - DNA, 16 bp, Homo sapiens
gcctgggtgggacagc

SEQ ID NO: 5761888 - DNA, 20 bp, Homo sapiens
gcctgggtgggacagcctct

SEQ ID NO: 5761889 - DNA, 21 bp, Homo sapiens
gcctgggtggggcagggcctg

SEQ ID NO: 5761890 - DNA, 16 bp, Homo sapiens
gcctgggtggggctgc

SEQ ID NO: 5761891 - DNA, 19 bp, Homo sapiens
gcctgggtggggctgctcc

SEQ ID NO: 5761892 - DNA, 22 bp, Homo sapiens
gcctgggtgtaaaacctggaga

SEQ ID NO: 5761893 - DNA, 21 bp, Homo sapiens
gcctgggtgtcaagtgcctgc

SEQ ID NO: 5761894 - DNA, 22 bp, Homo sapiens
gcctgggttccccactggtctg

SEQ ID NO: 5761895 - DNA, 20 bp, Homo sapiens
gcctgggtttggtgtatggt

SEQ ID NO: 5761896 - DNA, 15 bp, Homo sapiens
gcctgggttttctaa

SEQ ID NO: 5761897 - DNA, 23 bp, Homo sapiens
gcctgggttttctaactgtaaat

SEQ ID NO: 5761898 - DNA, 22 bp, Homo sapiens
gcctgggttttgtggtcatcta

SEQ ID NO: 5761899 - DNA, 15 bp, Homo sapiens
gcctggtagagacta

SEQ ID NO: 5761900 - DNA, 15 bp, Homo sapiens
gcctggtaggtctgg

SEQ ID NO: 5761901 - DNA, 16 bp, Homo sapiens
gcctggtaggtctgga

SEQ ID NO: 5761902 - DNA, 15 bp, Homo sapiens
gcctggtattttcaa

SEQ ID NO: 5761903 - DNA, 19 bp, Homo sapiens
gcctggtcccagagtggct

SEQ ID NO: 5761904 - DNA, 14 bp, Homo sapiens
gcctggtccctggg

SEQ ID NO: 5761905 - DNA, 21 bp, Homo sapiens
gcctggtccttccctgatggc

SEQ ID NO: 5761906 - DNA, 16 bp, Homo sapiens
gcctggtctcctccca

SEQ ID NO: 5761907 - DNA, 16 bp, Homo sapiens
gcctggtctcctgccc

SEQ ID NO: 5761908 - DNA, 13 bp, Homo sapiens
gcctggtctggga

SEQ ID NO: 5761909 - DNA, 16 bp, Homo sapiens
gcctggtgacaggcag

SEQ ID NO: 5761910 - DNA, 19 bp, Homo sapiens
gcctggtgacaggcagaca

SEQ ID NO: 5761911 - DNA, 18 bp, Homo sapiens
gcctggtgcattgctgtg

SEQ ID NO: 5761912 - DNA, 19 bp, Homo sapiens
gcctggtgcattgctgtgt

SEQ ID NO: 5761913 - DNA, 20 bp, Homo sapiens
gcctggtgcccagcacatgt

SEQ ID NO: 5761914 - DNA, 17 bp, Homo sapiens
gcctggtgccctggccc

SEQ ID NO: 5761915 - DNA, 15 bp, Homo sapiens
gcctggtgcgctgtg

SEQ ID NO: 5761916 - DNA, 18 bp, Homo sapiens
gcctggtgcgctgtgctc

SEQ ID NO: 5761917 - DNA, 20 bp, Homo sapiens
gcctggtggaaggaggcgca

SEQ ID NO: 5761918 - DNA, 14 bp, Homo sapiens
gcctggtggcagct

SEQ ID NO: 5761919 - DNA, 15 bp, Homo sapiens
gcctggtggcagctg

SEQ ID NO: 5761920 - DNA, 18 bp, Homo sapiens
gcctggtggcagctgcgg

SEQ ID NO: 5761921 - DNA, 16 bp, Homo sapiens
gcctggtggcccagct

SEQ ID NO: 5761922 - DNA, 17 bp, Homo sapiens
gcctggtgggggaaggg

SEQ ID NO: 5761923 - DNA, 20 bp, Homo sapiens
gcctggtgggggaaggggag

SEQ ID NO: 5761924 - DNA, 14 bp, Homo sapiens
gcctggtggttttc

SEQ ID NO: 5761925 - DNA, 21 bp, Homo sapiens
gcctggtgtgaggaggacaaa

SEQ ID NO: 5761926 - DNA, 18 bp, Homo sapiens
gcctggtgtgaggctggg

SEQ ID NO: 5761927 - DNA, 16 bp, Homo sapiens
gcctggtgttctgaag

SEQ ID NO: 5761928 - DNA, 21 bp, Homo sapiens
gcctggttccctctttcctgt

SEQ ID NO: 5761929 - DNA, 17 bp, Homo sapiens
gcctggttcgtgccatg

SEQ ID NO: 5761930 - DNA, 13 bp, Homo sapiens
gcctggttgaaga

SEQ ID NO: 5761931 - DNA, 17 bp, Homo sapiens
gcctggtttctgggtgc

SEQ ID NO: 5761932 - DNA, 13 bp, Homo sapiens
gcctggtttttct

SEQ ID NO: 5761933 - DNA, 13 bp, Homo sapiens
gcctgtaaacttt

SEQ ID NO: 5761934 - DNA, 13 bp, Homo sapiens
gcctgtaacatat

SEQ ID NO: 5761935 - DNA, 22 bp, Homo sapiens
gcctgtaagaaaaaaaatgtac

SEQ ID NO: 5761936 - DNA, 18 bp, Homo sapiens
gcctgtaatcacagctac

SEQ ID NO: 5761937 - DNA, 18 bp, Homo sapiens
gcctgtaatcccagctac

SEQ ID NO: 5761938 - DNA, 22 bp, Homo sapiens
gcctgtaatcccagctacccag

SEQ ID NO: 5761939 - DNA, 16 bp, Homo sapiens
gcctgtaatctcagct

SEQ ID NO: 5761940 - DNA, 22 bp, Homo sapiens
gcctgtaatctcagctactcag

SEQ ID NO: 5761941 - DNA, 19 bp, Homo sapiens
gcctgtaattccagccact

SEQ ID NO: 5761942 - DNA, 13 bp, Homo sapiens
gcctgtacagtct

SEQ ID NO: 5761943 - DNA, 17 bp, Homo sapiens
gcctgtacagtctgtct

SEQ ID NO: 5761944 - DNA, 18 bp, Homo sapiens
gcctgtaccttgctgtgg

SEQ ID NO: 5761945 - DNA, 23 bp, Homo sapiens
gcctgtactaggattagaaaatt

SEQ ID NO: 5761946 - DNA, 19 bp, Homo sapiens
gcctgtactcgcttgtgca

SEQ ID NO: 5761947 - DNA, 20 bp, Homo sapiens
gcctgtactcgcttgtgcag

SEQ ID NO: 5761948 - DNA, 20 bp, Homo sapiens
gcctgtagaatagcctgtgg

SEQ ID NO: 5761949 - DNA, 22 bp, Homo sapiens
gcctgtagaatagcctgtggcc

SEQ ID NO: 5761950 - DNA, 16 bp, Homo sapiens
gcctgtagagccagcc

SEQ ID NO: 5761951 - DNA, 13 bp, Homo sapiens
gcctgtagagttg

SEQ ID NO: 5761952 - DNA, 19 bp, Homo sapiens
gcctgtagagttgctgaga

SEQ ID NO: 5761953 - DNA, 19 bp, Homo sapiens
gcctgtagcaatggccaga

SEQ ID NO: 5761954 - DNA, 20 bp, Homo sapiens
gcctgtagccccagtgacag

SEQ ID NO: 5761955 - DNA, 21 bp, Homo sapiens
gcctgtagccccagtgacagc

SEQ ID NO: 5761956 - DNA, 15 bp, Homo sapiens
gcctgtagggaactt

SEQ ID NO: 5761957 - DNA, 19 bp, Homo sapiens
gcctgtagtcccagccact

SEQ ID NO: 5761958 - DNA, 15 bp, Homo sapiens
gcctgtagtctcagc

SEQ ID NO: 5761959 - DNA, 17 bp, Homo sapiens
gcctgtagttaggaaat

SEQ ID NO: 5761960 - DNA, 16 bp, Homo sapiens
gcctgtataagtagat

SEQ ID NO: 5761961 - DNA, 22 bp, Homo sapiens
gcctgtataagtagatctgctt

SEQ ID NO: 5761962 - DNA, 18 bp, Homo sapiens
gcctgtatactttagtat

SEQ ID NO: 5761963 - DNA, 19 bp, Homo sapiens
gcctgtatactttagtatg

SEQ ID NO: 5761964 - DNA, 22 bp, Homo sapiens
gcctgtatcctccctggcagac

SEQ ID NO: 5761965 - DNA, 19 bp, Homo sapiens
gcctgtatgtggtgtgggg

SEQ ID NO: 5761966 - DNA, 17 bp, Homo sapiens
gcctgtattcccagcta

SEQ ID NO: 5761967 - DNA, 20 bp, Homo sapiens
gcctgtatttccaacaaact

SEQ ID NO: 5761968 - DNA, 14 bp, Homo sapiens
gcctgtcaagaggc

SEQ ID NO: 5761969 - DNA, 23 bp, Homo sapiens
gcctgtcaataaatgttgaaaag

SEQ ID NO: 5761970 - DNA, 13 bp, Homo sapiens
gcctgtcacaata

SEQ ID NO: 5761971 - DNA, 13 bp, Homo sapiens
gcctgtcaccaga

SEQ ID NO: 5761972 - DNA, 14 bp, Homo sapiens
gcctgtcaccagag

SEQ ID NO: 5761973 - DNA, 13 bp, Homo sapiens
gcctgtttaagag

SEQ ID NO: 5761974 - DNA, 18 bp, Homo sapiens
gcctgtttctgcagccct

SEQ ID NO: 5761975 - DNA, 21 bp, Homo sapiens
gcctgtttctgcagcccttgg

SEQ ID NO: 5761976 - DNA, 13 bp, Homo sapiens
gcctgtttcttcc

SEQ ID NO: 5761977 - DNA, 12 bp, Homo sapiens
gcctgtttgatg

SEQ ID NO: 5761978 - DNA, 14 bp, Homo sapiens
gcctgtttgatgta

SEQ ID NO: 5761979 - DNA, 18 bp, Homo sapiens
gcctgtttgatgtatgtg

SEQ ID NO: 5761980 - DNA, 22 bp, Homo sapiens
gcctgtttggcgtttcccagag

SEQ ID NO: 5761981 - DNA, 21 bp, Homo sapiens
gcctgtttgggaggctggagt

SEQ ID NO: 5761982 - DNA, 16 bp, Homo sapiens
gcctgtttggggaggg

SEQ ID NO: 5761983 - DNA, 17 bp, Homo sapiens
gcctgtttggggagggg

SEQ ID NO: 5761984 - DNA, 21 bp, Homo sapiens
gcctgtttggggaggggggcg

SEQ ID NO: 5761985 - DNA, 15 bp, Homo sapiens
gcctgtttggtgagg

SEQ ID NO: 5761986 - DNA, 19 bp, Homo sapiens
gcctgtttggtgaggacct

SEQ ID NO: 5761987 - DNA, 16 bp, Homo sapiens
gccttaaaacatcatt

SEQ ID NO: 5761988 - DNA, 19 bp, Homo sapiens
gccttaaaaggggcccaag

SEQ ID NO: 5761989 - DNA, 20 bp, Homo sapiens
gccttaaaaggggcccaagc

SEQ ID NO: 5761990 - DNA, 14 bp, Homo sapiens
gccttaaaatgcat

SEQ ID NO: 5761991 - DNA, 21 bp, Homo sapiens
gccttaaaattacttggcttt

SEQ ID NO: 5761992 - DNA, 19 bp, Homo sapiens
gccttaaacagtgtccagg

SEQ ID NO: 5761993 - DNA, 20 bp, Homo sapiens
gccttaaacctacctcccac

SEQ ID NO: 5761994 - DNA, 16 bp, Homo sapiens
gccttaaacctgaaga

SEQ ID NO: 5761995 - DNA, 20 bp, Homo sapiens
gccttaaactgtacagaatt

SEQ ID NO: 5761996 - DNA, 14 bp, Homo sapiens
gccttaaagaggga

SEQ ID NO: 5761997 - DNA, 19 bp, Homo sapiens
gccttaacacactggccat

SEQ ID NO: 5761998 - DNA, 15 bp, Homo sapiens
gccttaacctgggac

SEQ ID NO: 5761999 - DNA, 16 bp, Homo sapiens
gccttaacctgggacc

SEQ ID NO: 5762000 - DNA, 17 bp, Homo sapiens
gccttaacctgggacca

SEQ ID NO: 5762001 - DNA, 19 bp, Homo sapiens
gccttaactatttcacatg

SEQ ID NO: 5762002 - DNA, 16 bp, Homo sapiens
gccttaactggccctc

SEQ ID NO: 5762003 - DNA, 19 bp, Homo sapiens
gccttaactggccctcggg

SEQ ID NO: 5762004 - DNA, 22 bp, Homo sapiens
gccttaactggccctcgggccc

SEQ ID NO: 5762005 - DNA, 21 bp, Homo sapiens
gccttaacttcttaaaccatt

SEQ ID NO: 5762006 - DNA, 14 bp, Homo sapiens
gccttaactttccc

SEQ ID NO: 5762007 - DNA, 15 bp, Homo sapiens
gccttaagaactgtg

SEQ ID NO: 5762008 - DNA, 13 bp, Homo sapiens
gccttaagcaaat

SEQ ID NO: 5762009 - DNA, 14 bp, Homo sapiens
gccttaagcaaatt

SEQ ID NO: 5762010 - DNA, 14 bp, Homo sapiens
gccttaagcagaac

SEQ ID NO: 5762011 - DNA, 16 bp, Homo sapiens
gccttaagcagaacaa

SEQ ID NO: 5762012 - DNA, 19 bp, Homo sapiens
gccttaagcagaacaaatg

SEQ ID NO: 5762013 - DNA, 18 bp, Homo sapiens
gccttaaggccacactgg

SEQ ID NO: 5762014 - DNA, 22 bp, Homo sapiens
gccttaaggccctcattctcat

SEQ ID NO: 5762015 - DNA, 16 bp, Homo sapiens
gccttaagtcttactg

SEQ ID NO: 5762016 - DNA, 22 bp, Homo sapiens
gccttaagtctttttgaagtgt

SEQ ID NO: 5762017 - DNA, 13 bp, Homo sapiens
gccttaagtttcc

SEQ ID NO: 5762018 - DNA, 13 bp, Homo sapiens
gccttaataaata

SEQ ID NO: 5762019 - DNA, 16 bp, Homo sapiens
gccttaataaatatgt

SEQ ID NO: 5762020 - DNA, 16 bp, Homo sapiens
gccttaatggatgctc

SEQ ID NO: 5762021 - DNA, 17 bp, Homo sapiens
gccttaatggatgctca

SEQ ID NO: 5762022 - DNA, 19 bp, Homo sapiens
gccttaattaaagaattta

SEQ ID NO: 5762023 - DNA, 15 bp, Homo sapiens
gccttaatttagaaa

SEQ ID NO: 5762024 - DNA, 19 bp, Homo sapiens
gccttaatttcctttttga

SEQ ID NO: 5762025 - DNA, 21 bp, Homo sapiens
gccttaatttcctttttgaca

SEQ ID NO: 5762026 - DNA, 15 bp, Homo sapiens
gccttacaaagggaa

SEQ ID NO: 5762027 - DNA, 16 bp, Homo sapiens
gccttacaaagggaaa

SEQ ID NO: 5762028 - DNA, 23 bp, Homo sapiens
gccttacaaagggaaagcctctg

SEQ ID NO: 5762029 - DNA, 14 bp, Homo sapiens
gccttacagaaaat

SEQ ID NO: 5762030 - DNA, 19 bp, Homo sapiens
gccttacagttatcctgca

SEQ ID NO: 5762031 - DNA, 14 bp, Homo sapiens
gccttacccctgcc

SEQ ID NO: 5762032 - DNA, 15 bp, Homo sapiens
gccttacctcccctg

SEQ ID NO: 5762033 - DNA, 19 bp, Homo sapiens
gccttacctcccctgccag

SEQ ID NO: 5762034 - DNA, 20 bp, Homo sapiens
gccttacctcccctgccagg

SEQ ID NO: 5762035 - DNA, 21 bp, Homo sapiens
gccttacctcccctgccaggg

SEQ ID NO: 5762036 - DNA, 13 bp, Homo sapiens
gccttacctcctg

SEQ ID NO: 5762037 - DNA, 15 bp, Homo sapiens
gccttacctcctgcc

SEQ ID NO: 5762038 - DNA, 17 bp, Homo sapiens
gccttacctcctgccca

SEQ ID NO: 5762039 - DNA, 21 bp, Homo sapiens
gccttacctcctgcccaggag

SEQ ID NO: 5762040 - DNA, 18 bp, Homo sapiens
gccttaccttggggctgg

SEQ ID NO: 5762041 - DNA, 20 bp, Homo sapiens
gccttaccttggggctgggg

SEQ ID NO: 5762042 - DNA, 23 bp, Homo sapiens
gccttacggtcatgatgtctgca

SEQ ID NO: 5762043 - DNA, 16 bp, Homo sapiens
gccttacttcaaagtg

SEQ ID NO: 5762044 - DNA, 19 bp, Homo sapiens
gccttactttgtatgatat

SEQ ID NO: 5762045 - DNA, 20 bp, Homo sapiens
gccttactttgtatgatatt

SEQ ID NO: 5762046 - DNA, 16 bp, Homo sapiens
gccttagaacctttct

SEQ ID NO: 5762047 - DNA, 17 bp, Homo sapiens
gccttagaacctttctt

SEQ ID NO: 5762048 - DNA, 13 bp, Homo sapiens
gccttagagtatg

SEQ ID NO: 5762049 - DNA, 13 bp, Homo sapiens
gccttagcacttc

SEQ ID NO: 5762050 - DNA, 16 bp, Homo sapiens
gccttagcatgtgact

SEQ ID NO: 5762051 - DNA, 20 bp, Homo sapiens
gccttagcatgtgttgcagc

SEQ ID NO: 5762052 - DNA, 20 bp, Homo sapiens
gccttagcatgtttgctgaa

SEQ ID NO: 5762053 - DNA, 14 bp, Homo sapiens
gccttagccatgat

SEQ ID NO: 5762054 - DNA, 22 bp, Homo sapiens
gccttagccatgatctgcaggg

SEQ ID NO: 5762055 - DNA, 21 bp, Homo sapiens
gccttagccgcccatgcactg

SEQ ID NO: 5762056 - DNA, 12 bp, Homo sapiens
gccttagcttca

SEQ ID NO: 5762057 - DNA, 17 bp, Homo sapiens
gccttagcttcaggaac

SEQ ID NO: 5762058 - DNA, 19 bp, Homo sapiens
gccttagcttcaggaacct

SEQ ID NO: 5762059 - DNA, 20 bp, Homo sapiens
gccttagggtttgcagagtg

SEQ ID NO: 5762060 - DNA, 19 bp, Homo sapiens
gccttagtacggctgctgc

SEQ ID NO: 5762061 - DNA, 20 bp, Homo sapiens
gccttagtacggctgctgca

SEQ ID NO: 5762062 - DNA, 21 bp, Homo sapiens
gccttagtagtcaaaaacaaa

SEQ ID NO: 5762063 - DNA, 20 bp, Homo sapiens
gccttagtcaataaacttgt

SEQ ID NO: 5762064 - DNA, 15 bp, Homo sapiens
gccttagtctcagtt

SEQ ID NO: 5762065 - DNA, 12 bp, Homo sapiens
gccttagtgggc

SEQ ID NO: 5762066 - DNA, 17 bp, Homo sapiens
gccttatcaagtgtctt

SEQ ID NO: 5762067 - DNA, 15 bp, Homo sapiens
gccttatccaggttg

SEQ ID NO: 5762068 - DNA, 16 bp, Homo sapiens
gccttatcctctgatc

SEQ ID NO: 5762069 - DNA, 14 bp, Homo sapiens
gccttatctgaaag

SEQ ID NO: 5762070 - DNA, 13 bp, Homo sapiens
gccttatgagaac

SEQ ID NO: 5762071 - DNA, 10 bp, Homo sapiens
gccttatgga

SEQ ID NO: 5762072 - DNA, 18 bp, Homo sapiens
gccttatggaacactctg

SEQ ID NO: 5762073 - DNA, 20 bp, Homo sapiens
gccttatggaacactctgag

SEQ ID NO: 5762074 - DNA, 21 bp, Homo sapiens
gccttatggaacactctgaga

SEQ ID NO: 5762075 - DNA, 22 bp, Homo sapiens
gccttatgtaattattttcttt

SEQ ID NO: 5762076 - DNA, 23 bp, Homo sapiens
gccttatgtgttacattattcca

SEQ ID NO: 5762077 - DNA, 17 bp, Homo sapiens
gccttatgttgaaaaaa

SEQ ID NO: 5762078 - DNA, 19 bp, Homo sapiens
gccttattacccaggaaga

SEQ ID NO: 5762079 - DNA, 18 bp, Homo sapiens
gccttattcaccttttta

SEQ ID NO: 5762080 - DNA, 21 bp, Homo sapiens
gccttattcacctttttaata

SEQ ID NO: 5762081 - DNA, 16 bp, Homo sapiens
gccttattcagggaag

SEQ ID NO: 5762082 - DNA, 18 bp, Homo sapiens
gccttattcagggaagga

SEQ ID NO: 5762083 - DNA, 14 bp, Homo sapiens
gccttatttcccta

SEQ ID NO: 5762084 - DNA, 15 bp, Homo sapiens
gccttatttgtctgt

SEQ ID NO: 5762085 - DNA, 15 bp, Homo sapiens
gccttattttgaact

SEQ ID NO: 5762086 - DNA, 14 bp, Homo sapiens
gccttatttttgaa

SEQ ID NO: 5762087 - DNA, 15 bp, Homo sapiens
gccttatttttgaat

SEQ ID NO: 5762088 - DNA, 13 bp, Homo sapiens
gccttcaaatcaa

SEQ ID NO: 5762089 - DNA, 11 bp, Homo sapiens
gccttcaagct

SEQ ID NO: 5762090 - DNA, 14 bp, Homo sapiens
gccttcaagctctg

SEQ ID NO: 5762091 - DNA, 16 bp, Homo sapiens
gccttcaagctctgag

SEQ ID NO: 5762092 - DNA, 23 bp, Homo sapiens
gccttcaaggactgtttcagtgt

SEQ ID NO: 5762093 - DNA, 14 bp, Homo sapiens
gccttcaagtgcca

SEQ ID NO: 5762094 - DNA, 21 bp, Homo sapiens
gccttcacaaccagccacaca

SEQ ID NO: 5762095 - DNA, 22 bp, Homo sapiens
gccttcacaaccagccacacag

SEQ ID NO: 5762096 - DNA, 23 bp, Homo sapiens
gccttcacaaccagccacacaga

SEQ ID NO: 5762097 - DNA, 17 bp, Homo sapiens
gccttcacaatctgtca

SEQ ID NO: 5762098 - DNA, 14 bp, Homo sapiens
gccttcactgtgct

SEQ ID NO: 5762099 - DNA, 17 bp, Homo sapiens
gccttcactgtgctcca

SEQ ID NO: 5762100 - DNA, 17 bp, Homo sapiens
gccttcagaaaagacac

SEQ ID NO: 5762101 - DNA, 17 bp, Homo sapiens
gccttcagaaccatcca

SEQ ID NO: 5762102 - DNA, 18 bp, Homo sapiens
gccttcagacacatgcta

SEQ ID NO: 5762103 - DNA, 16 bp, Homo sapiens
gccttcagatgttctc

SEQ ID NO: 5762104 - DNA, 12 bp, Homo sapiens
gccttcagccct

SEQ ID NO: 5762105 - DNA, 14 bp, Homo sapiens
gccttcagctccag

SEQ ID NO: 5762106 - DNA, 18 bp, Homo sapiens
gccttcaggcaccacaga

SEQ ID NO: 5762107 - DNA, 16 bp, Homo sapiens
gccttcaggccagctg

SEQ ID NO: 5762108 - DNA, 14 bp, Homo sapiens
gccttcaggcttct

SEQ ID NO: 5762109 - DNA, 21 bp, Homo sapiens
gccttcaggcttctgtcaatt

SEQ ID NO: 5762110 - DNA, 23 bp, Homo sapiens
gccttcagggttcagcagtacag

SEQ ID NO: 5762111 - DNA, 18 bp, Homo sapiens
gccttcaggttcctccta

SEQ ID NO: 5762112 - DNA, 22 bp, Homo sapiens
gccttcagtaggaacaagctgg

SEQ ID NO: 5762113 - DNA, 20 bp, Homo sapiens
gccttcagtatcaaggctgc

SEQ ID NO: 5762114 - DNA, 21 bp, Homo sapiens
gccttcagtatcaaggctgcc

SEQ ID NO: 5762115 - DNA, 23 bp, Homo sapiens
gccttcagtatcaaggctgcctg

SEQ ID NO: 5762116 - DNA, 15 bp, Homo sapiens
gccttcagtttattt

SEQ ID NO: 5762117 - DNA, 21 bp, Homo sapiens
gccttcataggcggtcatgtg

SEQ ID NO: 5762118 - DNA, 22 bp, Homo sapiens
gccttcataggcggtcatgtgt

SEQ ID NO: 5762119 - DNA, 19 bp, Homo sapiens
gccttcatcctcctcccca

SEQ ID NO: 5762120 - DNA, 20 bp, Homo sapiens
gccttcatcctcctccccag

SEQ ID NO: 5762121 - DNA, 21 bp, Homo sapiens
gccttcatctgggacaaaact

SEQ ID NO: 5762122 - DNA, 20 bp, Homo sapiens
gccttcatgccagtgcatgc

SEQ ID NO: 5762123 - DNA, 20 bp, Homo sapiens
gccttcattaaatgtttgtt

SEQ ID NO: 5762124 - DNA, 24 bp, Homo sapiens
gccttccaaaacctgcttccttca

SEQ ID NO: 5762125 - DNA, 17 bp, Homo sapiens
gccttccacccaggggc

SEQ ID NO: 5762126 - DNA, 20 bp, Homo sapiens
gccttccaccctgccctggc

SEQ ID NO: 5762127 - DNA, 22 bp, Homo sapiens
gccttccaccctgccctggcct

SEQ ID NO: 5762128 - DNA, 15 bp, Homo sapiens
gccttccaccggcac

SEQ ID NO: 5762129 - DNA, 14 bp, Homo sapiens
gccttccacctcac

SEQ ID NO: 5762130 - DNA, 22 bp, Homo sapiens
gccttccacgctgtctccagac

SEQ ID NO: 5762131 - DNA, 23 bp, Homo sapiens
gccttccacgctgtctccagacc

SEQ ID NO: 5762132 - DNA, 12 bp, Homo sapiens
gccttccagatc

SEQ ID NO: 5762133 - DNA, 21 bp, Homo sapiens
gccttccagatcctctctggg

SEQ ID NO: 5762134 - DNA, 15 bp, Homo sapiens
gccttccagcccaga

SEQ ID NO: 5762135 - DNA, 23 bp, Homo sapiens
gccttccagcccagacccccagt

SEQ ID NO: 5762136 - DNA, 17 bp, Homo sapiens
gccttccagctgctgtc

SEQ ID NO: 5762137 - DNA, 12 bp, Homo sapiens
gccttccagggg

SEQ ID NO: 5762138 - DNA, 15 bp, Homo sapiens
gccttccaggggtgg

SEQ ID NO: 5762139 - DNA, 19 bp, Homo sapiens
gccttccaggtggcgtgag

SEQ ID NO: 5762140 - DNA, 18 bp, Homo sapiens
gccttccagtggcttctc

SEQ ID NO: 5762141 - DNA, 13 bp, Homo sapiens
gccttccataatt

SEQ ID NO: 5762142 - DNA, 15 bp, Homo sapiens
gccttccataattat

SEQ ID NO: 5762143 - DNA, 16 bp, Homo sapiens
gccttccataattatg

SEQ ID NO: 5762144 - DNA, 16 bp, Homo sapiens
gccttccatgacctcc

SEQ ID NO: 5762145 - DNA, 17 bp, Homo sapiens
gccttccatgacctccc

SEQ ID NO: 5762146 - DNA, 19 bp, Homo sapiens
gccttccatgtcggcctct

SEQ ID NO: 5762147 - DNA, 20 bp, Homo sapiens
gccttcccaagttgtgcttg

SEQ ID NO: 5762148 - DNA, 17 bp, Homo sapiens
gccttcccatggccatt

SEQ ID NO: 5762149 - DNA, 17 bp, Homo sapiens
gccttccccaccaagtc

SEQ ID NO: 5762150 - DNA, 18 bp, Homo sapiens
gccttgcccagcctggat

SEQ ID NO: 5762151 - DNA, 16 bp, Homo sapiens
gccttgcccgccagcc

SEQ ID NO: 5762152 - DNA, 18 bp, Homo sapiens
gccttgcccgccagcctc

SEQ ID NO: 5762153 - DNA, 22 bp, Homo sapiens
gccttgcccggattctgggagg

SEQ ID NO: 5762154 - DNA, 15 bp, Homo sapiens
gccttgccctcctgg

SEQ ID NO: 5762155 - DNA, 13 bp, Homo sapiens
gccttgccgctcc

SEQ ID NO: 5762156 - DNA, 13 bp, Homo sapiens
gccttgcctccag

SEQ ID NO: 5762157 - DNA, 12 bp, Homo sapiens
gccttgcggaag

SEQ ID NO: 5762158 - DNA, 19 bp, Homo sapiens
gccttgcggaagccatagg

SEQ ID NO: 5762159 - DNA, 20 bp, Homo sapiens
gccttgcggaagccataggg

SEQ ID NO: 5762160 - DNA, 16 bp, Homo sapiens
gccttgcggctcctca

SEQ ID NO: 5762161 - DNA, 18 bp, Homo sapiens
gccttgcggctcctcagg

SEQ ID NO: 5762162 - DNA, 22 bp, Homo sapiens
gccttgcggtatccgcccccaa

SEQ ID NO: 5762163 - DNA, 14 bp, Homo sapiens
gccttgctcactca

SEQ ID NO: 5762164 - DNA, 23 bp, Homo sapiens
gccttgctcctagcagacagaaa

SEQ ID NO: 5762165 - DNA, 14 bp, Homo sapiens
gccttgctctcttc

SEQ ID NO: 5762166 - DNA, 22 bp, Homo sapiens
gccttgctctcttcaataaacc

SEQ ID NO: 5762167 - DNA, 13 bp, Homo sapiens
gccttgctctgag

SEQ ID NO: 5762168 - DNA, 18 bp, Homo sapiens
gccttgctctgagcacag

SEQ ID NO: 5762169 - DNA, 18 bp, Homo sapiens
gccttgctgagacttacg

SEQ ID NO: 5762170 - DNA, 14 bp, Homo sapiens
gccttgctgagtgg

SEQ ID NO: 5762171 - DNA, 22 bp, Homo sapiens
gccttgctgatggcttgacatg

SEQ ID NO: 5762172 - DNA, 17 bp, Homo sapiens
gccttgctgcataaaat

SEQ ID NO: 5762173 - DNA, 19 bp, Homo sapiens
gccttgctgcataaaattc

SEQ ID NO: 5762174 - DNA, 12 bp, Homo sapiens
gccttgctgcca

SEQ ID NO: 5762175 - DNA, 14 bp, Homo sapiens
gccttgctgccaag

SEQ ID NO: 5762176 - DNA, 14 bp, Homo sapiens
gccttgctgctctg

SEQ ID NO: 5762177 - DNA, 19 bp, Homo sapiens
gccttgctgctgctgcacc

SEQ ID NO: 5762178 - DNA, 14 bp, Homo sapiens
gccttgctggacgg

SEQ ID NO: 5762179 - DNA, 13 bp, Homo sapiens
gccttgctgggcc

SEQ ID NO: 5762180 - DNA, 17 bp, Homo sapiens
gccttgctgggccaggg

SEQ ID NO: 5762181 - DNA, 13 bp, Homo sapiens
gccttgctggggt

SEQ ID NO: 5762182 - DNA, 15 bp, Homo sapiens
gccttgctgtagaga

SEQ ID NO: 5762183 - DNA, 18 bp, Homo sapiens
gccttgctgtagagactt

SEQ ID NO: 5762184 - DNA, 12 bp, Homo sapiens
gccttgcttctc

SEQ ID NO: 5762185 - DNA, 22 bp, Homo sapiens
gccttgcttctcccatttcctg

SEQ ID NO: 5762186 - DNA, 23 bp, Homo sapiens
gccttgcttctcccatttcctga

SEQ ID NO: 5762187 - DNA, 12 bp, Homo sapiens
gccttgcttctt

SEQ ID NO: 5762188 - DNA, 19 bp, Homo sapiens
gccttggaaatagaaagaa

SEQ ID NO: 5762189 - DNA, 14 bp, Homo sapiens
gccttggaaattcc

SEQ ID NO: 5762190 - DNA, 19 bp, Homo sapiens
gccttggagaactcggttt

SEQ ID NO: 5762191 - DNA, 13 bp, Homo sapiens
gccttggagaggg

SEQ ID NO: 5762192 - DNA, 18 bp, Homo sapiens
gccttggagcagaaagcc

SEQ ID NO: 5762193 - DNA, 21 bp, Homo sapiens
gccttggagggtcccaagctg

SEQ ID NO: 5762194 - DNA, 21 bp, Homo sapiens
gccttggataatgctgttgcc

SEQ ID NO: 5762195 - DNA, 23 bp, Homo sapiens
gccttggataatgctgttgcctc

SEQ ID NO: 5762196 - DNA, 23 bp, Homo sapiens
gccttggcatgggcgcaggccca

SEQ ID NO: 5762197 - DNA, 24 bp, Homo sapiens
gccttggcatgggcgcaggcccag

SEQ ID NO: 5762198 - DNA, 12 bp, Homo sapiens
gccttggccctg

SEQ ID NO: 5762199 - DNA, 15 bp, Homo sapiens
gccttggccctgacc

SEQ ID NO: 5762200 - DNA, 16 bp, Homo sapiens
gccttggccctgaccc

SEQ ID NO: 5762201 - DNA, 15 bp, Homo sapiens
gccttggcctcagag

SEQ ID NO: 5762202 - DNA, 15 bp, Homo sapiens
gccttggcctcccaa

SEQ ID NO: 5762203 - DNA, 17 bp, Homo sapiens
gccttggcctcccaaag

SEQ ID NO: 5762204 - DNA, 15 bp, Homo sapiens
gccttggcctgacct

SEQ ID NO: 5762205 - DNA, 13 bp, Homo sapiens
gccttggcctgga

SEQ ID NO: 5762206 - DNA, 14 bp, Homo sapiens
gccttggcctggag

SEQ ID NO: 5762207 - DNA, 16 bp, Homo sapiens
gccttggcctggagca

SEQ ID NO: 5762208 - DNA, 15 bp, Homo sapiens
gccttggcctgtgtt

SEQ ID NO: 5762209 - DNA, 14 bp, Homo sapiens
gccttggccttgca

SEQ ID NO: 5762210 - DNA, 12 bp, Homo sapiens
gccttggctcag

SEQ ID NO: 5762211 - DNA, 15 bp, Homo sapiens
gccttggctcagaca

SEQ ID NO: 5762212 - DNA, 16 bp, Homo sapiens
gccttggctcagacat

SEQ ID NO: 5762213 - DNA, 13 bp, Homo sapiens
gccttggctgggc

SEQ ID NO: 5762214 - DNA, 15 bp, Homo sapiens
gccttggctgggcct

SEQ ID NO: 5762215 - DNA, 13 bp, Homo sapiens
gccttgggagcca

SEQ ID NO: 5762216 - DNA, 22 bp, Homo sapiens
gccttgggatagcaaactccag

SEQ ID NO: 5762217 - DNA, 23 bp, Homo sapiens
gccttgggatagcaaactccagg

SEQ ID NO: 5762218 - DNA, 14 bp, Homo sapiens
gccttgggatgggg

SEQ ID NO: 5762219 - DNA, 18 bp, Homo sapiens
gccttgggccggtgctgg

SEQ ID NO: 5762220 - DNA, 22 bp, Homo sapiens
gccttgggccggtgctgggggc

SEQ ID NO: 5762221 - DNA, 17 bp, Homo sapiens
gccttgggctccgtgtg

SEQ ID NO: 5762222 - DNA, 14 bp, Homo sapiens
gccttgggctctgc

SEQ ID NO: 5762223 - DNA, 16 bp, Homo sapiens
gccttgggctctgctg

SEQ ID NO: 5762224 - DNA, 21 bp, Homo sapiens
gccttggggaggacaaaactt

SEQ ID NO: 5762225 - DNA, 16 bp, Homo sapiens
gccttggggccagact

SEQ ID NO: 5762226 - DNA, 21 bp, Homo sapiens
gccttggggccagactggctg

SEQ ID NO: 5762227 - DNA, 18 bp, Homo sapiens
gccttggggctgatgcag

SEQ ID NO: 5762228 - DNA, 14 bp, Homo sapiens
gccttgggggtctg

SEQ ID NO: 5762229 - DNA, 17 bp, Homo sapiens
gccttggggtgggggcc

SEQ ID NO: 5762230 - DNA, 16 bp, Homo sapiens
gccttggtatgtgcca

SEQ ID NO: 5762231 - DNA, 19 bp, Homo sapiens
gccttggtatgtgccaggc

SEQ ID NO: 5762232 - DNA, 20 bp, Homo sapiens
gccttggtatgtgccaggct

SEQ ID NO: 5762233 - DNA, 20 bp, Homo sapiens
gccttggtggagcagccaga

SEQ ID NO: 5762234 - DNA, 21 bp, Homo sapiens
gccttggtgggggagcctctg

SEQ ID NO: 5762235 - DNA, 15 bp, Homo sapiens
gccttggttcctcca

SEQ ID NO: 5762236 - DNA, 13 bp, Homo sapiens
gccttggttcctg

SEQ ID NO: 5762237 - DNA, 18 bp, Homo sapiens
gccttggttcttcctagt

SEQ ID NO: 5762238 - DNA, 22 bp, Homo sapiens
gccttggtttttactgctctga

SEQ ID NO: 5762239 - DNA, 20 bp, Homo sapiens
gccttgtacagtctgctcct

SEQ ID NO: 5762240 - DNA, 21 bp, Homo sapiens
gccttgtacagtctgctcctc

SEQ ID NO: 5762241 - DNA, 20 bp, Homo sapiens
gccttgtagatggagcaagt

SEQ ID NO: 5762242 - DNA, 22 bp, Homo sapiens
gccttgtataatattgaaaatt

SEQ ID NO: 5762243 - DNA, 16 bp, Homo sapiens
gccttgtcacgccaga

SEQ ID NO: 5762244 - DNA, 21 bp, Homo sapiens
gccttgtcagtgtgtcagttt

SEQ ID NO: 5762245 - DNA, 15 bp, Homo sapiens
gccttgtccaggaac

SEQ ID NO: 5762246 - DNA, 22 bp, Homo sapiens
gccttgtcctacgtccaaggtg

SEQ ID NO: 5762247 - DNA, 18 bp, Homo sapiens
gccttgtcctcagccagt

SEQ ID NO: 5762248 - DNA, 14 bp, Homo sapiens
gccttgtctgggtg

SEQ ID NO: 5762249 - DNA, 17 bp, Homo sapiens
gccttgtgacattcact

SEQ ID NO: 5762250 - DNA, 23 bp, Homo sapiens
gccttgtgatgtcatacagagaa

SEQ ID NO: 5762251 - DNA, 13 bp, Homo sapiens
gccttgtgccctg

SEQ ID NO: 5762252 - DNA, 15 bp, Homo sapiens
gccttgtgccctgcc

SEQ ID NO: 5762253 - DNA, 12 bp, Homo sapiens
gccttgtgtaca

SEQ ID NO: 5762254 - DNA, 20 bp, Homo sapiens
gccttgtgtatgtgactcca

SEQ ID NO: 5762255 - DNA, 21 bp, Homo sapiens
gccttgtgtcctcctgttccg

SEQ ID NO: 5762256 - DNA, 18 bp, Homo sapiens
gccttgtgtggcttggag

SEQ ID NO: 5762257 - DNA, 22 bp, Homo sapiens
gccttgtgtggcttggaggaaa

SEQ ID NO: 5762258 - DNA, 21 bp, Homo sapiens
gccttgtgtgtcaggccctct

SEQ ID NO: 5762259 - DNA, 16 bp, Homo sapiens
gccttgttctgtcacc

SEQ ID NO: 5762260 - DNA, 18 bp, Homo sapiens
gccttgttgtgacacatc

SEQ ID NO: 5762261 - DNA, 17 bp, Homo sapiens
gccttgtttaatgttaa

SEQ ID NO: 5762262 - DNA, 15 bp, Homo sapiens
gccttgtttctgatg

SEQ ID NO: 5762263 - DNA, 14 bp, Homo sapiens
gccttgttttattc

SEQ ID NO: 5762264 - DNA, 22 bp, Homo sapiens
gccttgttttattcaaagacag

SEQ ID NO: 5762265 - DNA, 14 bp, Homo sapiens
gccttgttttctct

SEQ ID NO: 5762266 - DNA, 15 bp, Homo sapiens
gccttgtttttttct

SEQ ID NO: 5762267 - DNA, 16 bp, Homo sapiens
gccttgtttttttcta

SEQ ID NO: 5762268 - DNA, 23 bp, Homo sapiens
gcctttaaaaccagtaacgtgct

SEQ ID NO: 5762269 - DNA, 24 bp, Homo sapiens
gcctttaaaacgcgtctgcctggg

SEQ ID NO: 5762270 - DNA, 13 bp, Homo sapiens
gcctttaaaattt

SEQ ID NO: 5762271 - DNA, 21 bp, Homo sapiens
gcctttaaaatttttttagaa

SEQ ID NO: 5762272 - DNA, 17 bp, Homo sapiens
gcctttaaatctgtgat

SEQ ID NO: 5762273 - DNA, 19 bp, Homo sapiens
gcctttaaatctgtgatga

SEQ ID NO: 5762274 - DNA, 18 bp, Homo sapiens
gcctttaagaaccttaat

SEQ ID NO: 5762275 - DNA, 16 bp, Homo sapiens
gcctttaagccaaaga

SEQ ID NO: 5762276 - DNA, 21 bp, Homo sapiens
gcctttaatggacttatttct

SEQ ID NO: 5762277 - DNA, 23 bp, Homo sapiens
gcctttaccctcctctatttctt

SEQ ID NO: 5762278 - DNA, 20 bp, Homo sapiens
gcctttacgttcatcacctg

SEQ ID NO: 5762279 - DNA, 20 bp, Homo sapiens
gcctttagcaaaactggaca

SEQ ID NO: 5762280 - DNA, 19 bp, Homo sapiens
gcctttagcttaagaggcc

SEQ ID NO: 5762281 - DNA, 14 bp, Homo sapiens
gcctttaggcagga

SEQ ID NO: 5762282 - DNA, 22 bp, Homo sapiens
gcctttagggcttatggccagg

SEQ ID NO: 5762283 - DNA, 20 bp, Homo sapiens
gcctttaggggtgtgtattc

SEQ ID NO: 5762284 - DNA, 21 bp, Homo sapiens
gcctttagtgatcacagcagc

SEQ ID NO: 5762285 - DNA, 14 bp, Homo sapiens
gcctttatacaatt

SEQ ID NO: 5762286 - DNA, 22 bp, Homo sapiens
gcctttatgttttttgtaagat

SEQ ID NO: 5762287 - DNA, 14 bp, Homo sapiens
gcctttattgtgtt

SEQ ID NO: 5762288 - DNA, 23 bp, Homo sapiens
gcctttattgtgtttgtcattag

SEQ ID NO: 5762289 - DNA, 13 bp, Homo sapiens
gcctttcaggaag

SEQ ID NO: 5762290 - DNA, 20 bp, Homo sapiens
gcctttcaggaagggagagg

SEQ ID NO: 5762291 - DNA, 22 bp, Homo sapiens
gcctttcaggaagggagaggag

SEQ ID NO: 5762292 - DNA, 23 bp, Homo sapiens
gcctttcaggaagggagaggagg

SEQ ID NO: 5762293 - DNA, 19 bp, Homo sapiens
gcctttcataccagtcagt

SEQ ID NO: 5762294 - DNA, 15 bp, Homo sapiens
gcctttcattttgct

SEQ ID NO: 5762295 - DNA, 22 bp, Homo sapiens
gcctttcattttgctttaattt

SEQ ID NO: 5762296 - DNA, 14 bp, Homo sapiens
gcctttccagcctc

SEQ ID NO: 5762297 - DNA, 21 bp, Homo sapiens
gcctttccatccatggccagc

SEQ ID NO: 5762298 - DNA, 21 bp, Homo sapiens
gcctttcccaccctcctgccc

SEQ ID NO: 5762299 - DNA, 14 bp, Homo sapiens
gcctttccccagtg

SEQ ID NO: 5762300 - DNA, 18 bp, Homo sapiens
gcctttccccagtgtggc

SEQ ID NO: 5762301 - DNA, 20 bp, Homo sapiens
gcctttcccgggccctcagc

SEQ ID NO: 5762302 - DNA, 18 bp, Homo sapiens
gcctttccctaagccagc

SEQ ID NO: 5762303 - DNA, 14 bp, Homo sapiens
gcctttccctgccg

SEQ ID NO: 5762304 - DNA, 20 bp, Homo sapiens
gcctttcctcaaaactggag

SEQ ID NO: 5762305 - DNA, 15 bp, Homo sapiens
gcctttcctctgcac

SEQ ID NO: 5762306 - DNA, 12 bp, Homo sapiens
gcctttcctgga

SEQ ID NO: 5762307 - DNA, 13 bp, Homo sapiens
gcctttcctggaa

SEQ ID NO: 5762308 - DNA, 17 bp, Homo sapiens
gcctttcctgtagcctt

SEQ ID NO: 5762309 - DNA, 21 bp, Homo sapiens
gcctttcctgtgccaacctga

SEQ ID NO: 5762310 - DNA, 16 bp, Homo sapiens
gcctttcctgttcagc

SEQ ID NO: 5762311 - DNA, 20 bp, Homo sapiens
gcctttcctgttcagcattc

SEQ ID NO: 5762312 - DNA, 13 bp, Homo sapiens
gcctttccttccc

SEQ ID NO: 5762313 - DNA, 16 bp, Homo sapiens
gcctttccttccctct

SEQ ID NO: 5762314 - DNA, 20 bp, Homo sapiens
gcctttccttccctctctga

SEQ ID NO: 5762315 - DNA, 16 bp, Homo sapiens
gcctttcgaggcctga

SEQ ID NO: 5762316 - DNA, 22 bp, Homo sapiens
gcctttcgttctgctgaccaaa

SEQ ID NO: 5762317 - DNA, 19 bp, Homo sapiens
gcctttctaaggctcagcc

SEQ ID NO: 5762318 - DNA, 22 bp, Homo sapiens
gcctttctacaactgattgcaa

SEQ ID NO: 5762319 - DNA, 22 bp, Homo sapiens
gcctttctcccaggccaggctc

SEQ ID NO: 5762320 - DNA, 23 bp, Homo sapiens
gcctttctcccaggccaggctcc

SEQ ID NO: 5762321 - DNA, 14 bp, Homo sapiens
gcctttctcccccg

SEQ ID NO: 5762322 - DNA, 20 bp, Homo sapiens
gcctttctcctccccacctg

SEQ ID NO: 5762323 - DNA, 23 bp, Homo sapiens
gcctttctcgtggtagaagccag

SEQ ID NO: 5762324 - DNA, 17 bp, Homo sapiens
gcctttctctggctcca

SEQ ID NO: 5762325 - DNA, 20 bp, Homo sapiens
gcctttctctggctccagaa

SEQ ID NO: 5762326 - DNA, 12 bp, Homo sapiens
gcctttctggga

SEQ ID NO: 5762327 - DNA, 11 bp, Homo sapiens
gcctttctgta

SEQ ID NO: 5762328 - DNA, 18 bp, Homo sapiens
gcctttctgtatcaagcc

SEQ ID NO: 5762329 - DNA, 21 bp, Homo sapiens
gcctttctgtatcaagcccct

SEQ ID NO: 5762330 - DNA, 19 bp, Homo sapiens
gcctttcttatttgcaata

SEQ ID NO: 5762331 - DNA, 22 bp, Homo sapiens
gcctttcttatttgcaataaaa

SEQ ID NO: 5762332 - DNA, 20 bp, Homo sapiens
gcctttcttccatcagctct

SEQ ID NO: 5762333 - DNA, 12 bp, Homo sapiens
gcctttcttcct

SEQ ID NO: 5762334 - DNA, 11 bp, Homo sapiens
gcctttcttct

SEQ ID NO: 5762335 - DNA, 16 bp, Homo sapiens
gcctttcttctgtgtt

SEQ ID NO: 5762336 - DNA, 16 bp, Homo sapiens
gcctttcttggggaga

SEQ ID NO: 5762337 - DNA, 15 bp, Homo sapiens
gcctttctttgcctc

SEQ ID NO: 5762338 - DNA, 17 bp, Homo sapiens
gcctttctttgcctctg

SEQ ID NO: 5762339 - DNA, 17 bp, Homo sapiens
gcctttcttttctttct

SEQ ID NO: 5762340 - DNA, 20 bp, Homo sapiens
gcctttgaagagtgaaatac

SEQ ID NO: 5762341 - DNA, 18 bp, Homo sapiens
gcctttgaagtgcctctg

SEQ ID NO: 5762342 - DNA, 17 bp, Homo sapiens
gcctttgaatgtaacca

SEQ ID NO: 5762343 - DNA, 14 bp, Homo sapiens
gcctttgaatgtta

SEQ ID NO: 5762344 - DNA, 15 bp, Homo sapiens
gcctttgaatgttaa

SEQ ID NO: 5762345 - DNA, 12 bp, Homo sapiens
gcctttgacatt

SEQ ID NO: 5762346 - DNA, 20 bp, Homo sapiens
gcctttgagacagtttctta

SEQ ID NO: 5762347 - DNA, 23 bp, Homo sapiens
gcctttgagacagtttcttagct

SEQ ID NO: 5762348 - DNA, 18 bp, Homo sapiens
gcctttgagcccacaaag

SEQ ID NO: 5762349 - DNA, 14 bp, Homo sapiens
gcctttgcaagatg

SEQ ID NO: 5762350 - DNA, 23 bp, Homo sapiens
gcctttgcagttggactctcagg

SEQ ID NO: 5762351 - DNA, 14 bp, Homo sapiens
gcctttgcatttat

SEQ ID NO: 5762352 - DNA, 23 bp, Homo sapiens
gcctttgccaccaactggccctc

SEQ ID NO: 5762353 - DNA, 15 bp, Homo sapiens
gcctttgccagcaga

SEQ ID NO: 5762354 - DNA, 16 bp, Homo sapiens
gcctttgccagcagag

SEQ ID NO: 5762355 - DNA, 22 bp, Homo sapiens
gcctttgccagcagagccaggg

SEQ ID NO: 5762356 - DNA, 16 bp, Homo sapiens
gcctttgcgctcctgg

SEQ ID NO: 5762357 - DNA, 18 bp, Homo sapiens
gcctttgcgctcctggcc

SEQ ID NO: 5762358 - DNA, 21 bp, Homo sapiens
gcctttgcgctcctggcccag

SEQ ID NO: 5762359 - DNA, 12 bp, Homo sapiens
gcctttgctgcc

SEQ ID NO: 5762360 - DNA, 13 bp, Homo sapiens
gcctttgctgcct

SEQ ID NO: 5762361 - DNA, 15 bp, Homo sapiens
gcctttgctgccttc

SEQ ID NO: 5762362 - DNA, 22 bp, Homo sapiens
gcctttgctgccttctgtctct

SEQ ID NO: 5762363 - DNA, 23 bp, Homo sapiens
gcctttgctgtttagcttcctcc

SEQ ID NO: 5762364 - DNA, 21 bp, Homo sapiens
gcctttggaagtctgcgccct

SEQ ID NO: 5762365 - DNA, 14 bp, Homo sapiens
gcctttggagggga

SEQ ID NO: 5762366 - DNA, 15 bp, Homo sapiens
gcctttggcaggtgc

SEQ ID NO: 5762367 - DNA, 16 bp, Homo sapiens
gcctttggccttggct

SEQ ID NO: 5762368 - DNA, 13 bp, Homo sapiens
gcctttggctctg

SEQ ID NO: 5762369 - DNA, 16 bp, Homo sapiens
gcctttggctctggag

SEQ ID NO: 5762370 - DNA, 13 bp, Homo sapiens
gcctttgggaaat

SEQ ID NO: 5762371 - DNA, 14 bp, Homo sapiens
gcctttgggatttg

SEQ ID NO: 5762372 - DNA, 15 bp, Homo sapiens
gcctttggggctggt

SEQ ID NO: 5762373 - DNA, 16 bp, Homo sapiens
gcctttgggtcctggg

SEQ ID NO: 5762374 - DNA, 22 bp, Homo sapiens
gcctttgggtgctgttttgcca

SEQ ID NO: 5762375 - DNA, 22 bp, Homo sapiens
gcctttgtaaccacaactttca

SEQ ID NO: 5762376 - DNA, 11 bp, Homo sapiens
gcctttgtaag

SEQ ID NO: 5762377 - DNA, 17 bp, Homo sapiens
gcctttgtaagtgcagg

SEQ ID NO: 5762378 - DNA, 11 bp, Homo sapiens
gcctttgtagg

SEQ ID NO: 5762379 - DNA, 16 bp, Homo sapiens
gcctttgtatgtggaa

SEQ ID NO: 5762380 - DNA, 15 bp, Homo sapiens
gcctttgtattataa

SEQ ID NO: 5762381 - DNA, 13 bp, Homo sapiens
gcctttgtcccca

SEQ ID NO: 5762382 - DNA, 15 bp, Homo sapiens
gcctttgtgcttttt

SEQ ID NO: 5762383 - DNA, 13 bp, Homo sapiens
gcctttgttaacc

SEQ ID NO: 5762384 - DNA, 17 bp, Homo sapiens
gcctttgttcactgtga

SEQ ID NO: 5762385 - DNA, 23 bp, Homo sapiens
gcctttgtttcggtgccctgtgt

SEQ ID NO: 5762386 - DNA, 14 bp, Homo sapiens
gcctttgtttctaa

SEQ ID NO: 5762387 - DNA, 14 bp, Homo sapiens
gccttttaacattt

SEQ ID NO: 5762388 - DNA, 20 bp, Homo sapiens
gccttttaacattttgttct

SEQ ID NO: 5762389 - DNA, 21 bp, Homo sapiens
gccttttaacattttgttctt

SEQ ID NO: 5762390 - DNA, 14 bp, Homo sapiens
gccttttaattttt

SEQ ID NO: 5762391 - DNA, 20 bp, Homo sapiens
gccttttacccctgcacagt

SEQ ID NO: 5762392 - DNA, 19 bp, Homo sapiens
gccttttagaaacctcatt

SEQ ID NO: 5762393 - DNA, 20 bp, Homo sapiens
gccttttagttcctgtgcac

SEQ ID NO: 5762394 - DNA, 21 bp, Homo sapiens
gccttttatgtaaatttttta

SEQ ID NO: 5762395 - DNA, 22 bp, Homo sapiens
gccttttatgtaaattttttac

SEQ ID NO: 5762396 - DNA, 16 bp, Homo sapiens
gccttttatgtaattt

SEQ ID NO: 5762397 - DNA, 12 bp, Homo sapiens
gccttttcaaat

SEQ ID NO: 5762398 - DNA, 12 bp, Homo sapiens
gccttttcagcc

SEQ ID NO: 5762399 - DNA, 23 bp, Homo sapiens
gccttttccaaatgcccaaggat

SEQ ID NO: 5762400 - DNA, 21 bp, Homo sapiens
gccttttccacacgcattaat

SEQ ID NO: 5762401 - DNA, 16 bp, Homo sapiens
gccttttcccccaccc

SEQ ID NO: 5762402 - DNA, 17 bp, Homo sapiens
gccttttcccccaccct

SEQ ID NO: 5762403 - DNA, 20 bp, Homo sapiens
gccttttccctctttggctc

SEQ ID NO: 5762404 - DNA, 13 bp, Homo sapiens
gccttttccctta

SEQ ID NO: 5762405 - DNA, 12 bp, Homo sapiens
gccttttctatt

SEQ ID NO: 5762406 - DNA, 16 bp, Homo sapiens
gccttttctggcaccg

SEQ ID NO: 5762407 - DNA, 19 bp, Homo sapiens
gccttttctggtccctctt

SEQ ID NO: 5762408 - DNA, 21 bp, Homo sapiens
gccttttctggtccctcttct

SEQ ID NO: 5762409 - DNA, 13 bp, Homo sapiens
gccttttgacagc

SEQ ID NO: 5762410 - DNA, 20 bp, Homo sapiens
gccttttgacggccttcttg

SEQ ID NO: 5762411 - DNA, 14 bp, Homo sapiens
gccttttgcccgga

SEQ ID NO: 5762412 - DNA, 14 bp, Homo sapiens
gccttttgctctct

SEQ ID NO: 5762413 - DNA, 15 bp, Homo sapiens
gccttttgctgcgca

SEQ ID NO: 5762414 - DNA, 17 bp, Homo sapiens
gccttttgctgcgcacc

SEQ ID NO: 5762415 - DNA, 14 bp, Homo sapiens
gccttttgtataca

SEQ ID NO: 5762416 - DNA, 11 bp, Homo sapiens
gccttttgtgt

SEQ ID NO: 5762417 - DNA, 13 bp, Homo sapiens
gccttttgtgtga

SEQ ID NO: 5762418 - DNA, 21 bp, Homo sapiens
gccttttgttaatgcattgtt

SEQ ID NO: 5762419 - DNA, 18 bp, Homo sapiens
gcctttttaaaacacatg

SEQ ID NO: 5762420 - DNA, 15 bp, Homo sapiens
gcctttttacagcca

SEQ ID NO: 5762421 - DNA, 20 bp, Homo sapiens
gcctttttagatgtattttt

SEQ ID NO: 5762422 - DNA, 18 bp, Homo sapiens
gcctttttcaaccagatt

SEQ ID NO: 5762423 - DNA, 18 bp, Homo sapiens
gcctttttcaccatggca

SEQ ID NO: 5762424 - DNA, 20 bp, Homo sapiens
gcctttttcattattttatt

SEQ ID NO: 5762425 - DNA, 17 bp, Homo sapiens
gcctttttcatttatct

SEQ ID NO: 5762426 - DNA, 18 bp, Homo sapiens
gcctttttcatttatcta

SEQ ID NO: 5762427 - DNA, 19 bp, Homo sapiens
gcctttttcatttatctat

SEQ ID NO: 5762428 - DNA, 21 bp, Homo sapiens
gcctttttcctagcctgtttc

SEQ ID NO: 5762429 - DNA, 22 bp, Homo sapiens
gcctttttctgagatgctcact

SEQ ID NO: 5762430 - DNA, 15 bp, Homo sapiens
gcctttttctggcct

SEQ ID NO: 5762431 - DNA, 17 bp, Homo sapiens
gcctttttgtttcaatg

SEQ ID NO: 5762432 - DNA, 21 bp, Homo sapiens
gccttttttagcttcatatct

SEQ ID NO: 5762433 - DNA, 14 bp, Homo sapiens
gccttttttataac

SEQ ID NO: 5762434 - DNA, 16 bp, Homo sapiens
gccttttttcacagcc

SEQ ID NO: 5762435 - DNA, 19 bp, Homo sapiens
gccttttttcacagcccgg

SEQ ID NO: 5762436 - DNA, 15 bp, Homo sapiens
gccttttttctgtat

SEQ ID NO: 5762437 - DNA, 17 bp, Homo sapiens
gccttttttgccagact

SEQ ID NO: 5762438 - DNA, 23 bp, Homo sapiens
gcctttttttaaaattcaccccc

SEQ ID NO: 5762439 - DNA, 19 bp, Homo sapiens
gcgaaaacgttgacccctt

SEQ ID NO: 5762440 - DNA, 21 bp, Homo sapiens
gcgaaaacgttgacccctttc

SEQ ID NO: 5762441 - DNA, 17 bp, Homo sapiens
gcgaaacaggtctgttt

SEQ ID NO: 5762442 - DNA, 23 bp, Homo sapiens
gcgaaaccccgtctctactaaac

SEQ ID NO: 5762443 - DNA, 11 bp, Homo sapiens
gcgaacacagt

SEQ ID NO: 5762444 - DNA, 12 bp, Homo sapiens
gcgaacacagtg

SEQ ID NO: 5762445 - DNA, 14 bp, Homo sapiens
gcgaacatcttcat

SEQ ID NO: 5762446 - DNA, 21 bp, Homo sapiens
gcgaacatgcctgattttaaa

SEQ ID NO: 5762447 - DNA, 15 bp, Homo sapiens
gcgaaccaatatttg

SEQ ID NO: 5762448 - DNA, 17 bp, Homo sapiens
gcgaaccctttatttga

SEQ ID NO: 5762449 - DNA, 22 bp, Homo sapiens
gcgaactctcagaaataaatca

SEQ ID NO: 5762450 - DNA, 13 bp, Homo sapiens
gcgaagcctgagc

SEQ ID NO: 5762451 - DNA, 19 bp, Homo sapiens
gcgaagcctgagcaggcag

SEQ ID NO: 5762452 - DNA, 20 bp, Homo sapiens
gcgaagcctgagcaggcagg

SEQ ID NO: 5762453 - DNA, 18 bp, Homo sapiens
gcgaagccttctgcagca

SEQ ID NO: 5762454 - DNA, 15 bp, Homo sapiens
gcgaaggggccctgg

SEQ ID NO: 5762455 - DNA, 20 bp, Homo sapiens
gcgaagtccgaggcctggct

SEQ ID NO: 5762456 - DNA, 21 bp, Homo sapiens
gcgaagtccgaggcctggctc

SEQ ID NO: 5762457 - DNA, 19 bp, Homo sapiens
gcgaagtctttgccttctc

SEQ ID NO: 5762458 - DNA, 14 bp, Homo sapiens
gcgaataaatgttc

SEQ ID NO: 5762459 - DNA, 18 bp, Homo sapiens
gcgaatccaagctccctg

SEQ ID NO: 5762460 - DNA, 21 bp, Homo sapiens
gcgaatctagaggagggggca

SEQ ID NO: 5762461 - DNA, 15 bp, Homo sapiens
gcgaatgcactcagg

SEQ ID NO: 5762462 - DNA, 22 bp, Homo sapiens
gcgaatggactttggaagcagg

SEQ ID NO: 5762463 - DNA, 22 bp, Homo sapiens
gcgaatggtagtctaaccaaat

SEQ ID NO: 5762464 - DNA, 15 bp, Homo sapiens
gcgaattcagaaaga

SEQ ID NO: 5762465 - DNA, 14 bp, Homo sapiens
gcgaattcttgctt

SEQ ID NO: 5762466 - DNA, 17 bp, Homo sapiens
gcgaattgtgtggagaa

SEQ ID NO: 5762467 - DNA, 14 bp, Homo sapiens
gcgaattttaaaag

SEQ ID NO: 5762468 - DNA, 13 bp, Homo sapiens
gcgacaaagatga

SEQ ID NO: 5762469 - DNA, 15 bp, Homo sapiens
gcgacaagagtgaga

SEQ ID NO: 5762470 - DNA, 13 bp, Homo sapiens
gcgacaagtagtt

SEQ ID NO: 5762471 - DNA, 17 bp, Homo sapiens
gcgacacaggctgccgc

SEQ ID NO: 5762472 - DNA, 13 bp, Homo sapiens
gcgacactcaggg

SEQ ID NO: 5762473 - DNA, 18 bp, Homo sapiens
gcgacactcagggcagct

SEQ ID NO: 5762474 - DNA, 19 bp, Homo sapiens
gcgacactcagggcagctg

SEQ ID NO: 5762475 - DNA, 18 bp, Homo sapiens
gcgacactgggaggccag

SEQ ID NO: 5762476 - DNA, 14 bp, Homo sapiens
gcgacagagcaaga

SEQ ID NO: 5762477 - DNA, 17 bp, Homo sapiens
gcgacagcattttaagg

SEQ ID NO: 5762478 - DNA, 22 bp, Homo sapiens
gcgacagtgagactctgtctca

SEQ ID NO: 5762479 - DNA, 18 bp, Homo sapiens
gcgacatctctgactttc

SEQ ID NO: 5762480 - DNA, 16 bp, Homo sapiens
gcgacatttctccaag

SEQ ID NO: 5762481 - DNA, 12 bp, Homo sapiens
gcgaccaaggat

SEQ ID NO: 5762482 - DNA, 19 bp, Homo sapiens
gcgaccaccaacacacagg

SEQ ID NO: 5762483 - DNA, 15 bp, Homo sapiens
gcgaccacccctgcc

SEQ ID NO: 5762484 - DNA, 19 bp, Homo sapiens
gcgaccacccctgcctcca

SEQ ID NO: 5762485 - DNA, 17 bp, Homo sapiens
gcgaccacccctgtgcg

SEQ ID NO: 5762486 - DNA, 12 bp, Homo sapiens
gcgaccaccgcc

SEQ ID NO: 5762487 - DNA, 15 bp, Homo sapiens
gcgaccagcaggctc

SEQ ID NO: 5762488 - DNA, 16 bp, Homo sapiens
gcgaccccatctgccc

SEQ ID NO: 5762489 - DNA, 17 bp, Homo sapiens
gcgaccccatctgccca

SEQ ID NO: 5762490 - DNA, 18 bp, Homo sapiens
gcgaccccatctgcccag

SEQ ID NO: 5762491 - DNA, 20 bp, Homo sapiens
gcgaccccatctgcccagga

SEQ ID NO: 5762492 - DNA, 13 bp, Homo sapiens
gcgaccctggctc

SEQ ID NO: 5762493 - DNA, 13 bp, Homo sapiens
gcgaccctggggg

SEQ ID NO: 5762494 - DNA, 16 bp, Homo sapiens
gcgaccgaggccctcc

SEQ ID NO: 5762495 - DNA, 15 bp, Homo sapiens
gcgaccgccccctcc

SEQ ID NO: 5762496 - DNA, 13 bp, Homo sapiens
gcgaccgggcctc

SEQ ID NO: 5762497 - DNA, 14 bp, Homo sapiens
gcgaccgggcctcc

SEQ ID NO: 5762498 - DNA, 15 bp, Homo sapiens
gcgacctctctgcct

SEQ ID NO: 5762499 - DNA, 20 bp, Homo sapiens
gcgacctctctgcctctctt

SEQ ID NO: 5762500 - DNA, 17 bp, Homo sapiens
gcgacgtcttcagagtc

SEQ ID NO: 5762501 - DNA, 23 bp, Homo sapiens
gcgactaatttcaaaatgctttt

SEQ ID NO: 5762502 - DNA, 12 bp, Homo sapiens
gcgactctcctg

SEQ ID NO: 5762503 - DNA, 19 bp, Homo sapiens
gcgactctcctgcctcagc

SEQ ID NO: 5762504 - DNA, 20 bp, Homo sapiens
gcgactctcctgcctcagcc

SEQ ID NO: 5762505 - DNA, 19 bp, Homo sapiens
gcgactctgcagagtcact

SEQ ID NO: 5762506 - DNA, 12 bp, Homo sapiens
gcgactgagaac

SEQ ID NO: 5762507 - DNA, 15 bp, Homo sapiens
gcgcagtgcctctgg

SEQ ID NO: 5762508 - DNA, 18 bp, Homo sapiens
gcgcagtgcttctctaca

SEQ ID NO: 5762509 - DNA, 18 bp, Homo sapiens
gcgcagtggccctgagca

SEQ ID NO: 5762510 - DNA, 17 bp, Homo sapiens
gcgcagtgttttgcaag

SEQ ID NO: 5762511 - DNA, 20 bp, Homo sapiens
gcgcatccaatctcaaggaa

SEQ ID NO: 5762512 - DNA, 22 bp, Homo sapiens
gcgcatcctgcagggcttctcc

SEQ ID NO: 5762513 - DNA, 18 bp, Homo sapiens
gcgcatcttgcctccagg

SEQ ID NO: 5762514 - DNA, 14 bp, Homo sapiens
gcgcatgcctccca

SEQ ID NO: 5762515 - DNA, 18 bp, Homo sapiens
gcgcatggcgccccgggc

SEQ ID NO: 5762516 - DNA, 16 bp, Homo sapiens
gcgcatgtctgcacct

SEQ ID NO: 5762517 - DNA, 18 bp, Homo sapiens
gcgcatgtctgcacctcc

SEQ ID NO: 5762518 - DNA, 16 bp, Homo sapiens
gcgcatgtgccagttg

SEQ ID NO: 5762519 - DNA, 19 bp, Homo sapiens
gcgcattctaacctggagg

SEQ ID NO: 5762520 - DNA, 20 bp, Homo sapiens
gcgcatttgatttctccagg

SEQ ID NO: 5762521 - DNA, 21 bp, Homo sapiens
gcgccaaaacaagccaaagag

SEQ ID NO: 5762522 - DNA, 21 bp, Homo sapiens
gcgccaacgttcgatttctac

SEQ ID NO: 5762523 - DNA, 14 bp, Homo sapiens
gcgccaagcaacct

SEQ ID NO: 5762524 - DNA, 17 bp, Homo sapiens
gcgccaagtctggcacc

SEQ ID NO: 5762525 - DNA, 13 bp, Homo sapiens
gcgccaccatgcc

SEQ ID NO: 5762526 - DNA, 14 bp, Homo sapiens
gcgccaccgtgcct

SEQ ID NO: 5762527 - DNA, 22 bp, Homo sapiens
gcgccactacactccagcctgg

SEQ ID NO: 5762528 - DNA, 23 bp, Homo sapiens
gcgccactcgcttcccccatagc

SEQ ID NO: 5762529 - DNA, 22 bp, Homo sapiens
gcgccactgagacggcagagac

SEQ ID NO: 5762530 - DNA, 21 bp, Homo sapiens
gcgccactgccatcggacagg

SEQ ID NO: 5762531 - DNA, 18 bp, Homo sapiens
gcgccactgtccgctgtc

SEQ ID NO: 5762532 - DNA, 23 bp, Homo sapiens
gcgccactgtgctccagcctggg

SEQ ID NO: 5762533 - DNA, 19 bp, Homo sapiens
gcgccacttcctttgtgtt

SEQ ID NO: 5762534 - DNA, 16 bp, Homo sapiens
gcgccagccctaggct

SEQ ID NO: 5762535 - DNA, 18 bp, Homo sapiens
gcgccagccctaggctac

SEQ ID NO: 5762536 - DNA, 15 bp, Homo sapiens
gcgccagcgacctct

SEQ ID NO: 5762537 - DNA, 23 bp, Homo sapiens
gcgccagcgacctctctgcctct

SEQ ID NO: 5762538 - DNA, 14 bp, Homo sapiens
gcgccaggaagcca

SEQ ID NO: 5762539 - DNA, 17 bp, Homo sapiens
gcgccaggaagccagag

SEQ ID NO: 5762540 - DNA, 18 bp, Homo sapiens
gcgccaggaagccagagc

SEQ ID NO: 5762541 - DNA, 20 bp, Homo sapiens
gcgccaggaagccagagccc

SEQ ID NO: 5762542 - DNA, 14 bp, Homo sapiens
gcgccaggacagca

SEQ ID NO: 5762543 - DNA, 21 bp, Homo sapiens
gcgccaggatggaacacggcc

SEQ ID NO: 5762544 - DNA, 17 bp, Homo sapiens
gcgccaggcagagctga

SEQ ID NO: 5762545 - DNA, 22 bp, Homo sapiens
gcgccaggctgaccacagcaca

SEQ ID NO: 5762546 - DNA, 15 bp, Homo sapiens
gcgccaggctggaga

SEQ ID NO: 5762547 - DNA, 16 bp, Homo sapiens
gcgccaggggcaggca

SEQ ID NO: 5762548 - DNA, 19 bp, Homo sapiens
gcgccagtccccgctagtg

SEQ ID NO: 5762549 - DNA, 16 bp, Homo sapiens
gcgccatctcggctca

SEQ ID NO: 5762550 - DNA, 16 bp, Homo sapiens
gcgccatcttccattg

SEQ ID NO: 5762551 - DNA, 20 bp, Homo sapiens
gcgccattgcactccagcct

SEQ ID NO: 5762552 - DNA, 16 bp, Homo sapiens
gcgcccacccaggtcc

SEQ ID NO: 5762553 - DNA, 17 bp, Homo sapiens
gcgcccacccaggtccc

SEQ ID NO: 5762554 - DNA, 12 bp, Homo sapiens
gcgcccaccctg

SEQ ID NO: 5762555 - DNA, 13 bp, Homo sapiens
gcgcccaccctgg

SEQ ID NO: 5762556 - DNA, 15 bp, Homo sapiens
gcgcccaccctgggc

SEQ ID NO: 5762557 - DNA, 17 bp, Homo sapiens
gcgcccaccctgggctc

SEQ ID NO: 5762558 - DNA, 20 bp, Homo sapiens
gcgcccaccctgggctccac

SEQ ID NO: 5762559 - DNA, 14 bp, Homo sapiens
gcgcccacctgccc

SEQ ID NO: 5762560 - DNA, 14 bp, Homo sapiens
gcgcccagcagcct

SEQ ID NO: 5762561 - DNA, 16 bp, Homo sapiens
gcgcccagcagcctgc

SEQ ID NO: 5762562 - DNA, 20 bp, Homo sapiens
gcgcccagcagcctgccagc

SEQ ID NO: 5762563 - DNA, 13 bp, Homo sapiens
gcgcccagcccag

SEQ ID NO: 5762564 - DNA, 17 bp, Homo sapiens
gcgcccagcgctcgcca

SEQ ID NO: 5762565 - DNA, 18 bp, Homo sapiens
gcgcccaggccagtgctg

SEQ ID NO: 5762566 - DNA, 12 bp, Homo sapiens
gcgcccaggcct

SEQ ID NO: 5762567 - DNA, 13 bp, Homo sapiens
gcgcccagggctg

SEQ ID NO: 5762568 - DNA, 23 bp, Homo sapiens
gcgcccagttgggtggatgcctg

SEQ ID NO: 5762569 - DNA, 22 bp, Homo sapiens
gcgccccaacccgtggaggctg

SEQ ID NO: 5762570 - DNA, 13 bp, Homo sapiens
gcgccccagtcac

SEQ ID NO: 5762571 - DNA, 17 bp, Homo sapiens
gcgcccccactcctcct

SEQ ID NO: 5762572 - DNA, 18 bp, Homo sapiens
gcgcccccactcctcctc

SEQ ID NO: 5762573 - DNA, 13 bp, Homo sapiens
gcgcccccaggac

SEQ ID NO: 5762574 - DNA, 16 bp, Homo sapiens
gcgccccccagtggac

SEQ ID NO: 5762575 - DNA, 20 bp, Homo sapiens
gcgccccccagtggactcgc

SEQ ID NO: 5762576 - DNA, 19 bp, Homo sapiens
gcgcccccccctccccatg

SEQ ID NO: 5762577 - DNA, 14 bp, Homo sapiens
gcgcccccctccca

SEQ ID NO: 5762578 - DNA, 15 bp, Homo sapiens
gcgcccccctcccag

SEQ ID NO: 5762579 - DNA, 20 bp, Homo sapiens
gcgcccccgccccaggcttc

SEQ ID NO: 5762580 - DNA, 12 bp, Homo sapiens
gcgcccccttct

SEQ ID NO: 5762581 - DNA, 18 bp, Homo sapiens
gcgccccgcacccccgcc

SEQ ID NO: 5762582 - DNA, 20 bp, Homo sapiens
gcgccccgcacgactgcggg

SEQ ID NO: 5762583 - DNA, 21 bp, Homo sapiens
gcgccccgcacgactgcggga

SEQ ID NO: 5762584 - DNA, 12 bp, Homo sapiens
gcgccccgccca

SEQ ID NO: 5762585 - DNA, 12 bp, Homo sapiens
gcgccccgcccc

SEQ ID NO: 5762586 - DNA, 17 bp, Homo sapiens
gcgccccgcccccaccc

SEQ ID NO: 5762587 - DNA, 18 bp, Homo sapiens
gcgccccgcccccacccc

SEQ ID NO: 5762588 - DNA, 19 bp, Homo sapiens
gcgccccgcccccacccct

SEQ ID NO: 5762589 - DNA, 13 bp, Homo sapiens
gcgcccctagccg

SEQ ID NO: 5762590 - DNA, 22 bp, Homo sapiens
gcgcccctagccggttcctgtc

SEQ ID NO: 5762591 - DNA, 17 bp, Homo sapiens
gcgcccctctgcgcccc

SEQ ID NO: 5762592 - DNA, 20 bp, Homo sapiens
gcgcccctctgcgccccagc

SEQ ID NO: 5762593 - DNA, 15 bp, Homo sapiens
gcgcccctgcccagc

SEQ ID NO: 5762594 - DNA, 16 bp, Homo sapiens
gcgcccctgcccagca

SEQ ID NO: 5762595 - DNA, 17 bp, Homo sapiens
gcgcccctgcccagcac

SEQ ID NO: 5762596 - DNA, 13 bp, Homo sapiens
gcgcccctgctgt

SEQ ID NO: 5762597 - DNA, 12 bp, Homo sapiens
gcgcccctggga

SEQ ID NO: 5762598 - DNA, 14 bp, Homo sapiens
gcgcccgaggcaga

SEQ ID NO: 5762599 - DNA, 17 bp, Homo sapiens
gcgcccgaggccagggc

SEQ ID NO: 5762600 - DNA, 18 bp, Homo sapiens
gcgcccgccaacacgcct

SEQ ID NO: 5762601 - DNA, 20 bp, Homo sapiens
gcgcccgcggcgcgaccctc

SEQ ID NO: 5762602 - DNA, 22 bp, Homo sapiens
gcgcccgcggcgcgaccctccc

SEQ ID NO: 5762603 - DNA, 15 bp, Homo sapiens
gcgcccgctgggctg

SEQ ID NO: 5762604 - DNA, 13 bp, Homo sapiens
gcgccctccctcc

SEQ ID NO: 5762605 - DNA, 14 bp, Homo sapiens
gcgccctctctgct

SEQ ID NO: 5762606 - DNA, 13 bp, Homo sapiens
gcgccctctgtcc

SEQ ID NO: 5762607 - DNA, 15 bp, Homo sapiens
gcgccctctgtcctg

SEQ ID NO: 5762608 - DNA, 16 bp, Homo sapiens
gcgccctctgtcctga

SEQ ID NO: 5762609 - DNA, 13 bp, Homo sapiens
gcgccctgcagac

SEQ ID NO: 5762610 - DNA, 19 bp, Homo sapiens
gcgccctgcagggccgggc

SEQ ID NO: 5762611 - DNA, 14 bp, Homo sapiens
gcgccctgtgcagg

SEQ ID NO: 5762612 - DNA, 15 bp, Homo sapiens
gcgccctgtgcaggg

SEQ ID NO: 5762613 - DNA, 22 bp, Homo sapiens
gcgcccttaactgcatccagcc

SEQ ID NO: 5762614 - DNA, 20 bp, Homo sapiens
gcgcccttggcttctgtgat

SEQ ID NO: 5762615 - DNA, 12 bp, Homo sapiens
gcgccctttccc

SEQ ID NO: 5762616 - DNA, 23 bp, Homo sapiens
gcgccctttccccgacgcccacc

SEQ ID NO: 5762617 - DNA, 23 bp, Homo sapiens
gcgccgactccctgagtctggac

SEQ ID NO: 5762618 - DNA, 20 bp, Homo sapiens
gcgccgagaccgcagaggga

SEQ ID NO: 5762619 - DNA, 17 bp, Homo sapiens
gcgccgagtctgtctct

SEQ ID NO: 5762620 - DNA, 13 bp, Homo sapiens
gcgccgatgccac

SEQ ID NO: 5762621 - DNA, 17 bp, Homo sapiens
gcgccgatgccaccggc

SEQ ID NO: 5762622 - DNA, 18 bp, Homo sapiens
gcgccgatgccaccggcc

SEQ ID NO: 5762623 - DNA, 17 bp, Homo sapiens
gcgccgcaaaccacact

SEQ ID NO: 5762624 - DNA, 15 bp, Homo sapiens
gcgccgcctcgcccc

SEQ ID NO: 5762625 - DNA, 16 bp, Homo sapiens
gcgccgcctcgccccc

SEQ ID NO: 5762626 - DNA, 20 bp, Homo sapiens
gcgccgcctcgcccccgggc

SEQ ID NO: 5762627 - DNA, 23 bp, Homo sapiens
gcgccgcctcgcccccgggccct

SEQ ID NO: 5762628 - DNA, 16 bp, Homo sapiens
gcgccggcgccccgga

SEQ ID NO: 5762629 - DNA, 17 bp, Homo sapiens
gcgccggcgggcgggcc

SEQ ID NO: 5762630 - DNA, 20 bp, Homo sapiens
gcgccggggggagggaggag

SEQ ID NO: 5762631 - DNA, 16 bp, Homo sapiens
gcgccggtccggcgcc

SEQ ID NO: 5762632 - DNA, 20 bp, Homo sapiens
gcgccgtgagttctcagggc

SEQ ID NO: 5762633 - DNA, 15 bp, Homo sapiens
gcgcctacaggagtg

SEQ ID NO: 5762634 - DNA, 20 bp, Homo sapiens
gcgcctacaggagtgagcac

SEQ ID NO: 5762635 - DNA, 15 bp, Homo sapiens
gcgcctagagcgcgg

SEQ ID NO: 5762636 - DNA, 21 bp, Homo sapiens
gcgcctagagcgcggctggct

SEQ ID NO: 5762637 - DNA, 21 bp, Homo sapiens
gcgcctagtggggtctccctc

SEQ ID NO: 5762638 - DNA, 14 bp, Homo sapiens
gcgcctcacctgca

SEQ ID NO: 5762639 - DNA, 11 bp, Homo sapiens
gcgcctcagcc

SEQ ID NO: 5762640 - DNA, 12 bp, Homo sapiens
gcgcctcagccc

SEQ ID NO: 5762641 - DNA, 14 bp, Homo sapiens
gcgcctcagccctc

SEQ ID NO: 5762642 - DNA, 18 bp, Homo sapiens
gcgcctccaaccctagca

SEQ ID NO: 5762643 - DNA, 13 bp, Homo sapiens
gcgcctccagagg

SEQ ID NO: 5762644 - DNA, 19 bp, Homo sapiens
gcgcctccatccaaggcca

SEQ ID NO: 5762645 - DNA, 21 bp, Homo sapiens
gcgcctcccgccgcctcgggc

SEQ ID NO: 5762646 - DNA, 16 bp, Homo sapiens
gcgcctccctccaccc

SEQ ID NO: 5762647 - DNA, 17 bp, Homo sapiens
gcgcctccctccacccc

SEQ ID NO: 5762648 - DNA, 13 bp, Homo sapiens
gcgcctcctcctg

SEQ ID NO: 5762649 - DNA, 15 bp, Homo sapiens
gcgcctcctcctgca

SEQ ID NO: 5762650 - DNA, 20 bp, Homo sapiens
gcgcctccttaggagtgggg

SEQ ID NO: 5762651 - DNA, 22 bp, Homo sapiens
gcgcctccttccttgctgtcct

SEQ ID NO: 5762652 - DNA, 18 bp, Homo sapiens
gcgcctcggtatctggct

SEQ ID NO: 5762653 - DNA, 16 bp, Homo sapiens
gcgcctctcctggggc

SEQ ID NO: 5762654 - DNA, 12 bp, Homo sapiens
gcgcctctgcaa

SEQ ID NO: 5762655 - DNA, 16 bp, Homo sapiens
gcgcctcttcctctgg

SEQ ID NO: 5762656 - DNA, 20 bp, Homo sapiens
gcgcctcttcctctgggcag

SEQ ID NO: 5762657 - DNA, 23 bp, Homo sapiens
gcgcctcttcctctgggcagcgc

SEQ ID NO: 5762658 - DNA, 23 bp, Homo sapiens
gcgcctgaaaagggcggaagagt

SEQ ID NO: 5762659 - DNA, 21 bp, Homo sapiens
gcgcctgagatacaaggccca

SEQ ID NO: 5762660 - DNA, 15 bp, Homo sapiens
gcgcctgcacctgcg

SEQ ID NO: 5762661 - DNA, 14 bp, Homo sapiens
gcgcctgcccgccc

SEQ ID NO: 5762662 - DNA, 14 bp, Homo sapiens
gcgcctgccttggg

SEQ ID NO: 5762663 - DNA, 16 bp, Homo sapiens
gcgcctgccttttcta

SEQ ID NO: 5762664 - DNA, 15 bp, Homo sapiens
gcgcctgcgcctcct

SEQ ID NO: 5762665 - DNA, 21 bp, Homo sapiens
gcgcctgcgcctcctcctgca

SEQ ID NO: 5762666 - DNA, 16 bp, Homo sapiens
gcgcctgcgctcctct

SEQ ID NO: 5762667 - DNA, 21 bp, Homo sapiens
gcgcctgcgctcctctgcagc

SEQ ID NO: 5762668 - DNA, 12 bp, Homo sapiens
gcgcctgctgcc

SEQ ID NO: 5762669 - DNA, 14 bp, Homo sapiens
gcgcctgctgcctg

SEQ ID NO: 5762670 - DNA, 20 bp, Homo sapiens
gcgcctgctgcctgctgaga

SEQ ID NO: 5762671 - DNA, 23 bp, Homo sapiens
gcgcctggagagcgaggaggcgc

SEQ ID NO: 5762672 - DNA, 17 bp, Homo sapiens
gcgcctggagggatgcc

SEQ ID NO: 5762673 - DNA, 18 bp, Homo sapiens
gcgcctggagggatgccc

SEQ ID NO: 5762674 - DNA, 21 bp, Homo sapiens
gcgcctggagggatgccccca

SEQ ID NO: 5762675 - DNA, 22 bp, Homo sapiens
gcgcctggcctccaggcccgtc

SEQ ID NO: 5762676 - DNA, 22 bp, Homo sapiens
gcgcctggcttacctatctgtg

SEQ ID NO: 5762677 - DNA, 11 bp, Homo sapiens
gcgcctgggtc

SEQ ID NO: 5762678 - DNA, 14 bp, Homo sapiens
gcgccttcctgggt

SEQ ID NO: 5762679 - DNA, 15 bp, Homo sapiens
gcgccttcctgggtt

SEQ ID NO: 5762680 - DNA, 16 bp, Homo sapiens
gcgccttcgtgcctga

SEQ ID NO: 5762681 - DNA, 20 bp, Homo sapiens
gcgccttctacctgcaggac

SEQ ID NO: 5762682 - DNA, 13 bp, Homo sapiens
gcgccttctcccc

SEQ ID NO: 5762683 - DNA, 23 bp, Homo sapiens
gcgccttctcggagctggcccag

SEQ ID NO: 5762684 - DNA, 21 bp, Homo sapiens
gcgccttgtctcctactcctg

SEQ ID NO: 5762685 - DNA, 16 bp, Homo sapiens
gcggaattcaagttac

SEQ ID NO: 5762686 - DNA, 21 bp, Homo sapiens
gcggaattcaccagtgttcct

SEQ ID NO: 5762687 - DNA, 13 bp, Homo sapiens
gcggacaccatgt

SEQ ID NO: 5762688 - DNA, 21 bp, Homo sapiens
gcggacaccatgttcccagct

SEQ ID NO: 5762689 - DNA, 11 bp, Homo sapiens
gcggacagcca

SEQ ID NO: 5762690 - DNA, 19 bp, Homo sapiens
gcggacagccacggccagg

SEQ ID NO: 5762691 - DNA, 16 bp, Homo sapiens
gcggacagtggcagga

SEQ ID NO: 5762692 - DNA, 19 bp, Homo sapiens
gcggacagtggcaggacag

SEQ ID NO: 5762693 - DNA, 14 bp, Homo sapiens
gcggaccccagctg

SEQ ID NO: 5762694 - DNA, 19 bp, Homo sapiens
gcggacccttcccagccct

SEQ ID NO: 5762695 - DNA, 18 bp, Homo sapiens
gcggacccttctgggtcc

SEQ ID NO: 5762696 - DNA, 14 bp, Homo sapiens
gcggacgtgctggc

SEQ ID NO: 5762697 - DNA, 15 bp, Homo sapiens
gcggacgtgctggcc

SEQ ID NO: 5762698 - DNA, 17 bp, Homo sapiens
gcggactcctcctttct

SEQ ID NO: 5762699 - DNA, 19 bp, Homo sapiens
gcggagaaccttgtgcctg

SEQ ID NO: 5762700 - DNA, 23 bp, Homo sapiens
gcggagaaccttgtgcctggctc

SEQ ID NO: 5762701 - DNA, 19 bp, Homo sapiens
gcggagaggaagccagctg

SEQ ID NO: 5762702 - DNA, 13 bp, Homo sapiens
gcggagaggaccc

SEQ ID NO: 5762703 - DNA, 14 bp, Homo sapiens
gcggagaggacccc

SEQ ID NO: 5762704 - DNA, 19 bp, Homo sapiens
gcggagagggctagccctg

SEQ ID NO: 5762705 - DNA, 16 bp, Homo sapiens
gcggagagtacagtga

SEQ ID NO: 5762706 - DNA, 22 bp, Homo sapiens
gcggagagtacagtgagccaag

SEQ ID NO: 5762707 - DNA, 17 bp, Homo sapiens
gcggagcaagaggaggc

SEQ ID NO: 5762708 - DNA, 17 bp, Homo sapiens
gcggagcacactggctc

SEQ ID NO: 5762709 - DNA, 13 bp, Homo sapiens
gcggagcccagcc

SEQ ID NO: 5762710 - DNA, 12 bp, Homo sapiens
gcggagcccccg

SEQ ID NO: 5762711 - DNA, 18 bp, Homo sapiens
gcggagccggcacctaca

SEQ ID NO: 5762712 - DNA, 23 bp, Homo sapiens
gcggagccttcccgggcgggcgt

SEQ ID NO: 5762713 - DNA, 13 bp, Homo sapiens
gcggagcgggagg

SEQ ID NO: 5762714 - DNA, 16 bp, Homo sapiens
gcggagctctggcttt

SEQ ID NO: 5762715 - DNA, 23 bp, Homo sapiens
gcggagctggggtctgggcagtg

SEQ ID NO: 5762716 - DNA, 16 bp, Homo sapiens
gcggagcttgcctgcc

SEQ ID NO: 5762717 - DNA, 18 bp, Homo sapiens
gcggaggagaccagctca

SEQ ID NO: 5762718 - DNA, 16 bp, Homo sapiens
gcggaggagctccgct

SEQ ID NO: 5762719 - DNA, 21 bp, Homo sapiens
gcggaggaggaagtcatggga

SEQ ID NO: 5762720 - DNA, 18 bp, Homo sapiens
gcggaggaggctggtgac

SEQ ID NO: 5762721 - DNA, 14 bp, Homo sapiens
gcggaggcgcaggc

SEQ ID NO: 5762722 - DNA, 18 bp, Homo sapiens
gcggaggcggctccaggt

SEQ ID NO: 5762723 - DNA, 15 bp, Homo sapiens
gcggagggagcggca

SEQ ID NO: 5762724 - DNA, 14 bp, Homo sapiens
gcggagggatgcag

SEQ ID NO: 5762725 - DNA, 18 bp, Homo sapiens
gcggaggggatccagcca

SEQ ID NO: 5762726 - DNA, 20 bp, Homo sapiens
gcggaggggcttggagcaga

SEQ ID NO: 5762727 - DNA, 21 bp, Homo sapiens
gcggaggggcttggagcagag

SEQ ID NO: 5762728 - DNA, 23 bp, Homo sapiens
gcggaggggcttggagcagagac

SEQ ID NO: 5762729 - DNA, 15 bp, Homo sapiens
gcggaggttgcaggg

SEQ ID NO: 5762730 - DNA, 21 bp, Homo sapiens
gcggagtgaagaggggcagcc

SEQ ID NO: 5762731 - DNA, 20 bp, Homo sapiens
gcggatactcttggagagtt

SEQ ID NO: 5762732 - DNA, 16 bp, Homo sapiens
gcggatcaaccaggca

SEQ ID NO: 5762733 - DNA, 17 bp, Homo sapiens
gcggatcaaccaggcag

SEQ ID NO: 5762734 - DNA, 14 bp, Homo sapiens
gcggatcacttgag

SEQ ID NO: 5762735 - DNA, 15 bp, Homo sapiens
gcggatggatggaag

SEQ ID NO: 5762736 - DNA, 21 bp, Homo sapiens
gcggatggatggaaggttgga

SEQ ID NO: 5762737 - DNA, 13 bp, Homo sapiens
gcggatgtagcat

SEQ ID NO: 5762738 - DNA, 15 bp, Homo sapiens
gcggattgctctgga

SEQ ID NO: 5762739 - DNA, 16 bp, Homo sapiens
gcggcaaaaggaaagc

SEQ ID NO: 5762740 - DNA, 22 bp, Homo sapiens
gcggcaatcaataaacagcagg

SEQ ID NO: 5762741 - DNA, 12 bp, Homo sapiens
gcggcacagcct

SEQ ID NO: 5762742 - DNA, 18 bp, Homo sapiens
gcggcacccaggcctccc

SEQ ID NO: 5762743 - DNA, 15 bp, Homo sapiens
gcggcaccctggtct

SEQ ID NO: 5762744 - DNA, 12 bp, Homo sapiens
gcggcaccgccc

SEQ ID NO: 5762745 - DNA, 17 bp, Homo sapiens
gcggcaccgcccaccca

SEQ ID NO: 5762746 - DNA, 18 bp, Homo sapiens
gcggcaccgcccacccac

SEQ ID NO: 5762747 - DNA, 12 bp, Homo sapiens
gcggcagacaca

SEQ ID NO: 5762748 - DNA, 21 bp, Homo sapiens
gcggcagacgggaggggaaag

SEQ ID NO: 5762749 - DNA, 19 bp, Homo sapiens
gcggcagagcaattccagg

SEQ ID NO: 5762750 - DNA, 14 bp, Homo sapiens
gcggcagcagccat

SEQ ID NO: 5762751 - DNA, 23 bp, Homo sapiens
gcggcagccccacttcaccccca

SEQ ID NO: 5762752 - DNA, 12 bp, Homo sapiens
gcggcaggactg

SEQ ID NO: 5762753 - DNA, 13 bp, Homo sapiens
gcggcaggactgc

SEQ ID NO: 5762754 - DNA, 13 bp, Homo sapiens
gcggcaggagcag

SEQ ID NO: 5762755 - DNA, 14 bp, Homo sapiens
gcggcaggagcagg

SEQ ID NO: 5762756 - DNA, 14 bp, Homo sapiens
gcggcaggcagaga

SEQ ID NO: 5762757 - DNA, 20 bp, Homo sapiens
gcggcagggcaggagcttgg

SEQ ID NO: 5762758 - DNA, 21 bp, Homo sapiens
gcggcaggggttggcagcgcc

SEQ ID NO: 5762759 - DNA, 14 bp, Homo sapiens
gcggcagggtgggg

SEQ ID NO: 5762760 - DNA, 15 bp, Homo sapiens
gcggcagtgggcctg

SEQ ID NO: 5762761 - DNA, 16 bp, Homo sapiens
gcggcagtgttccttg

SEQ ID NO: 5762762 - DNA, 19 bp, Homo sapiens
gcggcatccgagcccctgt

SEQ ID NO: 5762763 - DNA, 17 bp, Homo sapiens
gcggcatgaaccctctt

SEQ ID NO: 5762764 - DNA, 18 bp, Homo sapiens
gcggcatgaaccctcttg

SEQ ID NO: 5762765 - DNA, 19 bp, Homo sapiens
gcggccacgcactgggcca

SEQ ID NO: 5762766 - DNA, 11 bp, Homo sapiens
gcggccagccc

SEQ ID NO: 5762767 - DNA, 13 bp, Homo sapiens
gcggccagccccg

SEQ ID NO: 5762768 - DNA, 16 bp, Homo sapiens
gcggccaggcacccat

SEQ ID NO: 5762769 - DNA, 22 bp, Homo sapiens
gcggccaggcacccatgtgggc

SEQ ID NO: 5762770 - DNA, 10 bp, Homo sapiens
gcggccaggg

SEQ ID NO: 5762771 - DNA, 14 bp, Homo sapiens
gcggccagggaccc

SEQ ID NO: 5762772 - DNA, 20 bp, Homo sapiens
gcggcccacgccagctggcc

SEQ ID NO: 5762773 - DNA, 21 bp, Homo sapiens
gcggcccacgccagctggccc

SEQ ID NO: 5762774 - DNA, 22 bp, Homo sapiens
gcggcccacgccagctggccca

SEQ ID NO: 5762775 - DNA, 19 bp, Homo sapiens
gcggcccactttcctgagc

SEQ ID NO: 5762776 - DNA, 21 bp, Homo sapiens
gcggcccactttcctgagctg

SEQ ID NO: 5762777 - DNA, 16 bp, Homo sapiens
gcggcccagacccagc

SEQ ID NO: 5762778 - DNA, 19 bp, Homo sapiens
gcggcccagacccagcccg

SEQ ID NO: 5762779 - DNA, 13 bp, Homo sapiens
gcggcccagcccg

SEQ ID NO: 5762780 - DNA, 14 bp, Homo sapiens
gcggccccaggagg

SEQ ID NO: 5762781 - DNA, 15 bp, Homo sapiens
gcggccccaggaggg

SEQ ID NO: 5762782 - DNA, 18 bp, Homo sapiens
gcggccccaggaggggaa

SEQ ID NO: 5762783 - DNA, 17 bp, Homo sapiens
gcggccccgcggagccc

SEQ ID NO: 5762784 - DNA, 18 bp, Homo sapiens
gcggcccgcgcagctgcc

SEQ ID NO: 5762785 - DNA, 13 bp, Homo sapiens
gcggcccggccag

SEQ ID NO: 5762786 - DNA, 14 bp, Homo sapiens
gcggcccggccagc

SEQ ID NO: 5762787 - DNA, 21 bp, Homo sapiens
gcggcccggccagcgggcaca

SEQ ID NO: 5762788 - DNA, 23 bp, Homo sapiens
gcggcccggcccacgcagagccc

SEQ ID NO: 5762789 - DNA, 22 bp, Homo sapiens
gcggcccgtgcgcagccgcgct

SEQ ID NO: 5762790 - DNA, 15 bp, Homo sapiens
gcggccctcccaggc

SEQ ID NO: 5762791 - DNA, 12 bp, Homo sapiens
gcggccctggag

SEQ ID NO: 5762792 - DNA, 14 bp, Homo sapiens
gcggccctggagga

SEQ ID NO: 5762793 - DNA, 14 bp, Homo sapiens
gcggccctggggag

SEQ ID NO: 5762794 - DNA, 15 bp, Homo sapiens
gcggccgatgggagt

SEQ ID NO: 5762795 - DNA, 17 bp, Homo sapiens
gcggccgcattccctga

SEQ ID NO: 5762796 - DNA, 16 bp, Homo sapiens
gcggccgccccccgcc

SEQ ID NO: 5762797 - DNA, 20 bp, Homo sapiens
gcggccgccccccgcccctc

SEQ ID NO: 5762798 - DNA, 15 bp, Homo sapiens
gcggccgcctgtcct

SEQ ID NO: 5762799 - DNA, 15 bp, Homo sapiens
gcggccggccgagct

SEQ ID NO: 5762800 - DNA, 21 bp, Homo sapiens
gcggccggccgcactgggagc

SEQ ID NO: 5762801 - DNA, 14 bp, Homo sapiens
gcggccggcctggg

SEQ ID NO: 5762802 - DNA, 17 bp, Homo sapiens
gcggccggcctggggcc

SEQ ID NO: 5762803 - DNA, 19 bp, Homo sapiens
gcggccggcctggggccgg

SEQ ID NO: 5762804 - DNA, 15 bp, Homo sapiens
gcggccgggctgccc

SEQ ID NO: 5762805 - DNA, 18 bp, Homo sapiens
gcggcctatgacttgggc

SEQ ID NO: 5762806 - DNA, 14 bp, Homo sapiens
gcggcctcaccagg

SEQ ID NO: 5762807 - DNA, 13 bp, Homo sapiens
gcggcctcagagt

SEQ ID NO: 5762808 - DNA, 15 bp, Homo sapiens
gcggcctcagggtct

SEQ ID NO: 5762809 - DNA, 15 bp, Homo sapiens
gcggcctccttctga

SEQ ID NO: 5762810 - DNA, 14 bp, Homo sapiens
gcggcctgcaccga

SEQ ID NO: 5762811 - DNA, 21 bp, Homo sapiens
gcggcctgcaccgaccccggg

SEQ ID NO: 5762812 - DNA, 18 bp, Homo sapiens
gcggcctgcagaccctgc

SEQ ID NO: 5762813 - DNA, 18 bp, Homo sapiens
gcggcctggggacggagc

SEQ ID NO: 5762814 - DNA, 19 bp, Homo sapiens
gcggcctggggacggagca

SEQ ID NO: 5762815 - DNA, 12 bp, Homo sapiens
gcggcctgtggg

SEQ ID NO: 5762816 - DNA, 16 bp, Homo sapiens
gcggccttccgggtct

SEQ ID NO: 5762817 - DNA, 23 bp, Homo sapiens
gcggccttccgggtctcgcagcc

SEQ ID NO: 5762818 - DNA, 20 bp, Homo sapiens
gcggccttgaagacagagca

SEQ ID NO: 5762819 - DNA, 16 bp, Homo sapiens
gcggcctttggcttca

SEQ ID NO: 5762820 - DNA, 21 bp, Homo sapiens
gcggcgaagaagagaaagatg

SEQ ID NO: 5762821 - DNA, 16 bp, Homo sapiens
gcggcgaccgccctcc

SEQ ID NO: 5762822 - DNA, 18 bp, Homo sapiens
gcggcgaccgccctccgc

SEQ ID NO: 5762823 - DNA, 22 bp, Homo sapiens
gcggcgaccgccgcagggacgg

SEQ ID NO: 5762824 - DNA, 17 bp, Homo sapiens
gcggcgccctggacttg

SEQ ID NO: 5762825 - DNA, 16 bp, Homo sapiens
gcggcgcgccctgcag

SEQ ID NO: 5762826 - DNA, 14 bp, Homo sapiens
gcggcggccaggga

SEQ ID NO: 5762827 - DNA, 14 bp, Homo sapiens
gcggcgggcggctg

SEQ ID NO: 5762828 - DNA, 22 bp, Homo sapiens
gcggcggtggactgcgctggac

SEQ ID NO: 5762829 - DNA, 17 bp, Homo sapiens
gcggcgtacaggctggc

SEQ ID NO: 5762830 - DNA, 20 bp, Homo sapiens
gcggcgtggagactggcagg

SEQ ID NO: 5762831 - DNA, 22 bp, Homo sapiens
gcggcgtggagactggcaggcg

SEQ ID NO: 5762832 - DNA, 16 bp, Homo sapiens
gcggcgtgggcgaggc

SEQ ID NO: 5762833 - DNA, 13 bp, Homo sapiens
gcggctactcagc

SEQ ID NO: 5762834 - DNA, 19 bp, Homo sapiens
gcggctactcagcagccct

SEQ ID NO: 5762835 - DNA, 14 bp, Homo sapiens
gcggctaggccggc

SEQ ID NO: 5762836 - DNA, 19 bp, Homo sapiens
gcggctcaaaaggaaacca

SEQ ID NO: 5762837 - DNA, 22 bp, Homo sapiens
gcggctcaaaaggaaaccaagt

SEQ ID NO: 5762838 - DNA, 22 bp, Homo sapiens
gcggctcaagaataaaatatga

SEQ ID NO: 5762839 - DNA, 18 bp, Homo sapiens
gcggctcaagcccaggag

SEQ ID NO: 5762840 - DNA, 15 bp, Homo sapiens
gcggctcagccttgc

SEQ ID NO: 5762841 - DNA, 14 bp, Homo sapiens
gcggctccagccca

SEQ ID NO: 5762842 - DNA, 13 bp, Homo sapiens
gcggctccccctg

SEQ ID NO: 5762843 - DNA, 15 bp, Homo sapiens
gcggctcccggggca

SEQ ID NO: 5762844 - DNA, 22 bp, Homo sapiens
gcggctcccggggcagggcagc

SEQ ID NO: 5762845 - DNA, 14 bp, Homo sapiens
gcggctcctcaggg

SEQ ID NO: 5762846 - DNA, 14 bp, Homo sapiens
gcggctcctcgccc

SEQ ID NO: 5762847 - DNA, 13 bp, Homo sapiens
gcggctcctggtg

SEQ ID NO: 5762848 - DNA, 15 bp, Homo sapiens
gcggctctgagcagg

SEQ ID NO: 5762849 - DNA, 17 bp, Homo sapiens
gcggctctgagcagggg

SEQ ID NO: 5762850 - DNA, 19 bp, Homo sapiens
gcggctctggtcctcggag

SEQ ID NO: 5762851 - DNA, 18 bp, Homo sapiens
gcggctctggttcctcca

SEQ ID NO: 5762852 - DNA, 19 bp, Homo sapiens
gcggctctggttcctccag

SEQ ID NO: 5762853 - DNA, 15 bp, Homo sapiens
gcggctgaactgaga

SEQ ID NO: 5762854 - DNA, 20 bp, Homo sapiens
gcggctgaactgagaaggca

SEQ ID NO: 5762855 - DNA, 22 bp, Homo sapiens
gcggctgagagccccagctgac

SEQ ID NO: 5762856 - DNA, 12 bp, Homo sapiens
gcggctgaggac

SEQ ID NO: 5762857 - DNA, 14 bp, Homo sapiens
gcggctgccctctg

SEQ ID NO: 5762858 - DNA, 14 bp, Homo sapiens
gcggctgccgactc

SEQ ID NO: 5762859 - DNA, 21 bp, Homo sapiens
gcggctgccgactcccccaac

SEQ ID NO: 5762860 - DNA, 11 bp, Homo sapiens
gcggctgcctc

SEQ ID NO: 5762861 - DNA, 13 bp, Homo sapiens
gcggctgcctcca

SEQ ID NO: 5762862 - DNA, 18 bp, Homo sapiens
gcggctgctcgcccagga

SEQ ID NO: 5762863 - DNA, 15 bp, Homo sapiens
gcggctggacttgga

SEQ ID NO: 5762864 - DNA, 12 bp, Homo sapiens
gcggctggagaa

SEQ ID NO: 5762865 - DNA, 18 bp, Homo sapiens
gcggtccaacgccgcctt

SEQ ID NO: 5762866 - DNA, 16 bp, Homo sapiens
gcggtccacccaggag

SEQ ID NO: 5762867 - DNA, 19 bp, Homo sapiens
gcggtccacccaggagccc

SEQ ID NO: 5762868 - DNA, 22 bp, Homo sapiens
gcggtccagaaggagcaggccc

SEQ ID NO: 5762869 - DNA, 14 bp, Homo sapiens
gcggtcccagctcc

SEQ ID NO: 5762870 - DNA, 18 bp, Homo sapiens
gcggtcccagctccctgg

SEQ ID NO: 5762871 - DNA, 20 bp, Homo sapiens
gcggtccccatccccaccag

SEQ ID NO: 5762872 - DNA, 22 bp, Homo sapiens
gcggtccccatccccaccagct

SEQ ID NO: 5762873 - DNA, 18 bp, Homo sapiens
gcggtccctgtccctcta

SEQ ID NO: 5762874 - DNA, 23 bp, Homo sapiens
gcggtcttcaacatcctgccagc

SEQ ID NO: 5762875 - DNA, 11 bp, Homo sapiens
gcggtgaccag

SEQ ID NO: 5762876 - DNA, 21 bp, Homo sapiens
gcggtgccatgtctgcagtgt

SEQ ID NO: 5762877 - DNA, 18 bp, Homo sapiens
gcggtgcccaaccacact

SEQ ID NO: 5762878 - DNA, 14 bp, Homo sapiens
gcggtgcctaagaa

SEQ ID NO: 5762879 - DNA, 15 bp, Homo sapiens
gcggtgcggcaggga

SEQ ID NO: 5762880 - DNA, 14 bp, Homo sapiens
gcggtgctgactga

SEQ ID NO: 5762881 - DNA, 17 bp, Homo sapiens
gcggtggaaggagcctg

SEQ ID NO: 5762882 - DNA, 18 bp, Homo sapiens
gcggtggaaggagcctgc

SEQ ID NO: 5762883 - DNA, 21 bp, Homo sapiens
gcggtggaggaaggctctgtc

SEQ ID NO: 5762884 - DNA, 14 bp, Homo sapiens
gcggtggcatgcat

SEQ ID NO: 5762885 - DNA, 14 bp, Homo sapiens
gcggtggccctgtc

SEQ ID NO: 5762886 - DNA, 21 bp, Homo sapiens
gcggtggctgccccggcctcc

SEQ ID NO: 5762887 - DNA, 14 bp, Homo sapiens
gcggtgggggagga

SEQ ID NO: 5762888 - DNA, 21 bp, Homo sapiens
gcggtgtcaggtcccagcgag

SEQ ID NO: 5762889 - DNA, 14 bp, Homo sapiens
gcggttgggaggca

SEQ ID NO: 5762890 - DNA, 15 bp, Homo sapiens
gcggttgtaaataca

SEQ ID NO: 5762891 - DNA, 19 bp, Homo sapiens
gcggtttcacgccccacac

SEQ ID NO: 5762892 - DNA, 15 bp, Homo sapiens
gcggtttgctcagcc

SEQ ID NO: 5762893 - DNA, 14 bp, Homo sapiens
gcggtttggggagc

SEQ ID NO: 5762894 - DNA, 21 bp, Homo sapiens
gcggtttggtttgcagcgact

SEQ ID NO: 5762895 - DNA, 14 bp, Homo sapiens
gcgtaagtacagag

SEQ ID NO: 5762896 - DNA, 23 bp, Homo sapiens
gcgtaagtacagagaagccatca

SEQ ID NO: 5762897 - DNA, 15 bp, Homo sapiens
gcgtaatgggcctgc

SEQ ID NO: 5762898 - DNA, 14 bp, Homo sapiens
gcgtaatttaatgg

SEQ ID NO: 5762899 - DNA, 15 bp, Homo sapiens
gcgtacacagagaag

SEQ ID NO: 5762900 - DNA, 16 bp, Homo sapiens
gcgtacacagagaagg

SEQ ID NO: 5762901 - DNA, 18 bp, Homo sapiens
gcgtagagggtgctgccc

SEQ ID NO: 5762902 - DNA, 18 bp, Homo sapiens
gcgtagctctcaaatgtg

SEQ ID NO: 5762903 - DNA, 12 bp, Homo sapiens
gcgtaggagaga

SEQ ID NO: 5762904 - DNA, 16 bp, Homo sapiens
gcgtaggctacagaga

SEQ ID NO: 5762905 - DNA, 13 bp, Homo sapiens
gcgtagggccagg

SEQ ID NO: 5762906 - DNA, 20 bp, Homo sapiens
gcgtagggccagggctctgg

SEQ ID NO: 5762907 - DNA, 14 bp, Homo sapiens
gcgtagttccctgg

SEQ ID NO: 5762908 - DNA, 11 bp, Homo sapiens
gcgtattctgt

SEQ ID NO: 5762909 - DNA, 16 bp, Homo sapiens
gcgtattctgtggccg

SEQ ID NO: 5762910 - DNA, 17 bp, Homo sapiens
gcgtattttgtatttaa

SEQ ID NO: 5762911 - DNA, 18 bp, Homo sapiens
gcgtattttgtatttaaa

SEQ ID NO: 5762912 - DNA, 13 bp, Homo sapiens
gcgtcactccagt

SEQ ID NO: 5762913 - DNA, 15 bp, Homo sapiens
gcgtcactccagtgc

SEQ ID NO: 5762914 - DNA, 12 bp, Homo sapiens
gcgtcactgccc

SEQ ID NO: 5762915 - DNA, 12 bp, Homo sapiens
gcgtcagcctcc

SEQ ID NO: 5762916 - DNA, 21 bp, Homo sapiens
gcgtcagcctccagcctctgt

SEQ ID NO: 5762917 - DNA, 22 bp, Homo sapiens
gcgtcagctgctccctggcatt

SEQ ID NO: 5762918 - DNA, 15 bp, Homo sapiens
gcgtcaggagcagca

SEQ ID NO: 5762919 - DNA, 19 bp, Homo sapiens
gcgtcaggcacgtctcctg

SEQ ID NO: 5762920 - DNA, 23 bp, Homo sapiens
gcgtcaggcacgtctcctgctgc

SEQ ID NO: 5762921 - DNA, 18 bp, Homo sapiens
gcgtcaggggtgcacagt

SEQ ID NO: 5762922 - DNA, 19 bp, Homo sapiens
gcgtcaggggtgcacagtc

SEQ ID NO: 5762923 - DNA, 19 bp, Homo sapiens
gcgtcagtctttttctgtt

SEQ ID NO: 5762924 - DNA, 21 bp, Homo sapiens
gcgtcatggctcaaggattca

SEQ ID NO: 5762925 - DNA, 16 bp, Homo sapiens
gcgtcattacagggca

SEQ ID NO: 5762926 - DNA, 15 bp, Homo sapiens
gcgtccaaccccggg

SEQ ID NO: 5762927 - DNA, 15 bp, Homo sapiens
gcgtccaccaggcct

SEQ ID NO: 5762928 - DNA, 18 bp, Homo sapiens
gcgtccaccaggcctcac

SEQ ID NO: 5762929 - DNA, 13 bp, Homo sapiens
gcgtccaccctga

SEQ ID NO: 5762930 - DNA, 18 bp, Homo sapiens
gcgtccaccctgagctcg

SEQ ID NO: 5762931 - DNA, 19 bp, Homo sapiens
gcgtccaccctgagctcgg

SEQ ID NO: 5762932 - DNA, 19 bp, Homo sapiens
gcgtccagctcagccctgg

SEQ ID NO: 5762933 - DNA, 20 bp, Homo sapiens
gcgtccagctcagccctggc

SEQ ID NO: 5762934 - DNA, 14 bp, Homo sapiens
gcgtcccaagatgt

SEQ ID NO: 5762935 - DNA, 15 bp, Homo sapiens
gcgtcccagctcccc

SEQ ID NO: 5762936 - DNA, 14 bp, Homo sapiens
gcgtcccagctgaa

SEQ ID NO: 5762937 - DNA, 23 bp, Homo sapiens
gcgtcccagctgaaggcagtggc

SEQ ID NO: 5762938 - DNA, 19 bp, Homo sapiens
gcgtcccagtctctggcag

SEQ ID NO: 5762939 - DNA, 16 bp, Homo sapiens
gcgtcccatgaggtct

SEQ ID NO: 5762940 - DNA, 13 bp, Homo sapiens
gcgtcccccagcc

SEQ ID NO: 5762941 - DNA, 19 bp, Homo sapiens
gcgtcccccgttgtgcctg

SEQ ID NO: 5762942 - DNA, 21 bp, Homo sapiens
gcgtcccccgttgtgcctggt

SEQ ID NO: 5762943 - DNA, 16 bp, Homo sapiens
gcgtccctagcagtga

SEQ ID NO: 5762944 - DNA, 19 bp, Homo sapiens
gcgtccctgagggcccttc

SEQ ID NO: 5762945 - DNA, 20 bp, Homo sapiens
gcgtccctgagggcccttcc

SEQ ID NO: 5762946 - DNA, 15 bp, Homo sapiens
gcgtccctgctcagc

SEQ ID NO: 5762947 - DNA, 12 bp, Homo sapiens
gcgtccctggcg

SEQ ID NO: 5762948 - DNA, 14 bp, Homo sapiens
gcgtccctggcgca

SEQ ID NO: 5762949 - DNA, 18 bp, Homo sapiens
gcgtcccttggtgagaaa

SEQ ID NO: 5762950 - DNA, 14 bp, Homo sapiens
gcgtccgagaaggc

SEQ ID NO: 5762951 - DNA, 20 bp, Homo sapiens
gcgtccgccgcgtgtgcgtg

SEQ ID NO: 5762952 - DNA, 16 bp, Homo sapiens
gcgtccgcgcgccagc

SEQ ID NO: 5762953 - DNA, 19 bp, Homo sapiens
gcgtccgcgcgccagcaca

SEQ ID NO: 5762954 - DNA, 20 bp, Homo sapiens
gcgtccgcgcgccagcacag

SEQ ID NO: 5762955 - DNA, 23 bp, Homo sapiens
gcgtcctaaggcatgttgggata

SEQ ID NO: 5762956 - DNA, 13 bp, Homo sapiens
gcgtcctcatttc

SEQ ID NO: 5762957 - DNA, 14 bp, Homo sapiens
gcgtcctcctctgt

SEQ ID NO: 5762958 - DNA, 16 bp, Homo sapiens
gcgtcctcctctgtga

SEQ ID NO: 5762959 - DNA, 15 bp, Homo sapiens
gcgtcctctccctcc

SEQ ID NO: 5762960 - DNA, 23 bp, Homo sapiens
gcgtcctctccctcctggccaga

SEQ ID NO: 5762961 - DNA, 17 bp, Homo sapiens
gcgtcctgacgccctgc

SEQ ID NO: 5762962 - DNA, 18 bp, Homo sapiens
gcgtcctgacgccctgcg

SEQ ID NO: 5762963 - DNA, 22 bp, Homo sapiens
gcgtcctgtcggagccctgtct

SEQ ID NO: 5762964 - DNA, 17 bp, Homo sapiens
gcgtccttccccctgta

SEQ ID NO: 5762965 - DNA, 16 bp, Homo sapiens
gcgtcctttcctctcc

SEQ ID NO: 5762966 - DNA, 23 bp, Homo sapiens
gcgtcctttcctctcctctctgg

SEQ ID NO: 5762967 - DNA, 24 bp, Homo sapiens
gcgtcctttcctctcctctctgga

SEQ ID NO: 5762968 - DNA, 15 bp, Homo sapiens
gcgtcgccccagtgg

SEQ ID NO: 5762969 - DNA, 17 bp, Homo sapiens
gcgtcgccccagtggca

SEQ ID NO: 5762970 - DNA, 17 bp, Homo sapiens
gcgtcgccctcccaggc

SEQ ID NO: 5762971 - DNA, 20 bp, Homo sapiens
gcgtcgctggacaacccaga

SEQ ID NO: 5762972 - DNA, 12 bp, Homo sapiens
gcgtctcccatc

SEQ ID NO: 5762973 - DNA, 14 bp, Homo sapiens
gcgtctcccatcct

SEQ ID NO: 5762974 - DNA, 16 bp, Homo sapiens
gcgtctccccatgctg

SEQ ID NO: 5762975 - DNA, 21 bp, Homo sapiens
gcgtctccccatgctgggctc

SEQ ID NO: 5762976 - DNA, 17 bp, Homo sapiens
gcgtctcccccagagtg

SEQ ID NO: 5762977 - DNA, 21 bp, Homo sapiens
gcgtctcccccagagtgctgt

SEQ ID NO: 5762978 - DNA, 23 bp, Homo sapiens
gcgtctcccccagagtgctgtcg

SEQ ID NO: 5762979 - DNA, 17 bp, Homo sapiens
gcgtctcccttggccac

SEQ ID NO: 5762980 - DNA, 20 bp, Homo sapiens
gcgtctcctcgtcccgaggg

SEQ ID NO: 5762981 - DNA, 11 bp, Homo sapiens
gcgtctcctgt

SEQ ID NO: 5762982 - DNA, 22 bp, Homo sapiens
gcgtctctctttctccctcacc

SEQ ID NO: 5762983 - DNA, 14 bp, Homo sapiens
gcgtctctggccct

SEQ ID NO: 5762984 - DNA, 19 bp, Homo sapiens
gcgtctgagcggccgcctg

SEQ ID NO: 5762985 - DNA, 21 bp, Homo sapiens
gcgtctgagcggccgcctgtc

SEQ ID NO: 5762986 - DNA, 22 bp, Homo sapiens
gcgtctgagcggccgcctgtcc

SEQ ID NO: 5762987 - DNA, 14 bp, Homo sapiens
gcgtctgagctggg

SEQ ID NO: 5762988 - DNA, 12 bp, Homo sapiens
gcgtctgcaggg

SEQ ID NO: 5762989 - DNA, 14 bp, Homo sapiens
gcgtctgcagggtg

SEQ ID NO: 5762990 - DNA, 15 bp, Homo sapiens
gcgtctgccccaccc

SEQ ID NO: 5762991 - DNA, 17 bp, Homo sapiens
gcgtctgccccaccctc

SEQ ID NO: 5762992 - DNA, 16 bp, Homo sapiens
gcgtctgctctggtgg

SEQ ID NO: 5762993 - DNA, 20 bp, Homo sapiens
gcgtctggacgccgagggca

SEQ ID NO: 5762994 - DNA, 18 bp, Homo sapiens
gcgtctggactgttctgt

SEQ ID NO: 5762995 - DNA, 14 bp, Homo sapiens
gcgtctgttttgtg

SEQ ID NO: 5762996 - DNA, 17 bp, Homo sapiens
gcgtcttcatctccctg

SEQ ID NO: 5762997 - DNA, 21 bp, Homo sapiens
gcgtcttcatctccctgccat

SEQ ID NO: 5762998 - DNA, 21 bp, Homo sapiens
gcgtcttccgcccctgcctgc

SEQ ID NO: 5762999 - DNA, 21 bp, Homo sapiens
gcgtcttcctgagtggtgcca

SEQ ID NO: 5763000 - DNA, 16 bp, Homo sapiens
gcgtcttgtattttct

SEQ ID NO: 5763001 - DNA, 14 bp, Homo sapiens
gcgtcttgtgaaat

SEQ ID NO: 5763002 - DNA, 16 bp, Homo sapiens
gcgtcttgtgaaattg

SEQ ID NO: 5763003 - DNA, 19 bp, Homo sapiens
gcgtcttgtgaaattgtgt

SEQ ID NO: 5763004 - DNA, 16 bp, Homo sapiens
gcgtctttaagagact

SEQ ID NO: 5763005 - DNA, 21 bp, Homo sapiens
gcgtctttaagagactcactg

SEQ ID NO: 5763006 - DNA, 23 bp, Homo sapiens
gcgtgaacccgggaggcggagct

SEQ ID NO: 5763007 - DNA, 14 bp, Homo sapiens
gcgtgaaggacctg

SEQ ID NO: 5763008 - DNA, 19 bp, Homo sapiens
gcgtgacactctccttgca

SEQ ID NO: 5763009 - DNA, 21 bp, Homo sapiens
gcgtgacactctccttgcagt

SEQ ID NO: 5763010 - DNA, 19 bp, Homo sapiens
gcgtgacatgtgcagtgct

SEQ ID NO: 5763011 - DNA, 22 bp, Homo sapiens
gcgtgacatgtgcagtgctgta

SEQ ID NO: 5763012 - DNA, 12 bp, Homo sapiens
gcgtgacggagc

SEQ ID NO: 5763013 - DNA, 22 bp, Homo sapiens
gcgtgactcagcagcctgcgct

SEQ ID NO: 5763014 - DNA, 21 bp, Homo sapiens
gcgtgacttcagactctctcc

SEQ ID NO: 5763015 - DNA, 16 bp, Homo sapiens
gcgtgagacctgcccc

SEQ ID NO: 5763016 - DNA, 23 bp, Homo sapiens
gcgtgagccactgcaccgggcca

SEQ ID NO: 5763017 - DNA, 15 bp, Homo sapiens
gcgtgagccactgcg

SEQ ID NO: 5763018 - DNA, 21 bp, Homo sapiens
gcgtgagccactgctcgtggc

SEQ ID NO: 5763019 - DNA, 18 bp, Homo sapiens
gcgtgaggatgggaagga

SEQ ID NO: 5763020 - DNA, 21 bp, Homo sapiens
gcgtgatggctatgccttgca

SEQ ID NO: 5763021 - DNA, 18 bp, Homo sapiens
gcgtgattcctgctgcct

SEQ ID NO: 5763022 - DNA, 23 bp, Homo sapiens
gcgtgcacagcgcgggcggaggc

SEQ ID NO: 5763023 - DNA, 22 bp, Homo sapiens
gcgtgcacatatgggtgctggc

SEQ ID NO: 5763024 - DNA, 18 bp, Homo sapiens
gcgtgcagggacaaagag

SEQ ID NO: 5763025 - DNA, 16 bp, Homo sapiens
gcgtgcccggggcagc

SEQ ID NO: 5763026 - DNA, 15 bp, Homo sapiens
gcgtgccgcctgctc

SEQ ID NO: 5763027 - DNA, 17 bp, Homo sapiens
gcgtgccgcctgctcct

SEQ ID NO: 5763028 - DNA, 19 bp, Homo sapiens
gcgtgccgcctgctcctca

SEQ ID NO: 5763029 - DNA, 15 bp, Homo sapiens
gcgtgccgggccccc

SEQ ID NO: 5763030 - DNA, 16 bp, Homo sapiens
gcgtgccgggccccca

SEQ ID NO: 5763031 - DNA, 21 bp, Homo sapiens
gcgtgccgggcccccaccgcc

SEQ ID NO: 5763032 - DNA, 17 bp, Homo sapiens
gcgtgccgtggcaccag

SEQ ID NO: 5763033 - DNA, 20 bp, Homo sapiens
gcgtgccgtgtgagtgtgac

SEQ ID NO: 5763034 - DNA, 18 bp, Homo sapiens
gcgtgcgcactgcatggg

SEQ ID NO: 5763035 - DNA, 19 bp, Homo sapiens
gcgtgcgcactgcatggga

SEQ ID NO: 5763036 - DNA, 20 bp, Homo sapiens
gcgtgcgtgtaactgtagtg

SEQ ID NO: 5763037 - DNA, 23 bp, Homo sapiens
gcgtgcgtgttagtgtgtgtgca

SEQ ID NO: 5763038 - DNA, 21 bp, Homo sapiens
gcgtgctcagttcagaatcac

SEQ ID NO: 5763039 - DNA, 18 bp, Homo sapiens
gcgtgctccagcctggct

SEQ ID NO: 5763040 - DNA, 20 bp, Homo sapiens
gcgtgcttgcatgtgctgca

SEQ ID NO: 5763041 - DNA, 17 bp, Homo sapiens
gcgtgctttatttatgg

SEQ ID NO: 5763042 - DNA, 18 bp, Homo sapiens
gctaaccagttctctttg

SEQ ID NO: 5763043 - DNA, 22 bp, Homo sapiens
gctaacccccagcccacagagc

SEQ ID NO: 5763044 - DNA, 14 bp, Homo sapiens
gctaaccccgtctg

SEQ ID NO: 5763045 - DNA, 19 bp, Homo sapiens
gctaacctgttacactggg

SEQ ID NO: 5763046 - DNA, 19 bp, Homo sapiens
gctaaccttatcctgcatt

SEQ ID NO: 5763047 - DNA, 20 bp, Homo sapiens
gctaaccttatcctgcattg

SEQ ID NO: 5763048 - DNA, 21 bp, Homo sapiens
gctaaccttatcctgcattgt

SEQ ID NO: 5763049 - DNA, 22 bp, Homo sapiens
gctaaccttatcctgcattgtt

SEQ ID NO: 5763050 - DNA, 19 bp, Homo sapiens
gctaaccttttcacctcca

SEQ ID NO: 5763051 - DNA, 13 bp, Homo sapiens
gctaacgtttttt

SEQ ID NO: 5763052 - DNA, 23 bp, Homo sapiens
gctaacgttttttcttcttttaa

SEQ ID NO: 5763053 - DNA, 15 bp, Homo sapiens
gctaactaattctgt

SEQ ID NO: 5763054 - DNA, 16 bp, Homo sapiens
gctaactacatgaaca

SEQ ID NO: 5763055 - DNA, 21 bp, Homo sapiens
gctaactccagtctcctgaca

SEQ ID NO: 5763056 - DNA, 14 bp, Homo sapiens
gctaactccgagag

SEQ ID NO: 5763057 - DNA, 15 bp, Homo sapiens
gctaactccgagagc

SEQ ID NO: 5763058 - DNA, 22 bp, Homo sapiens
gctaactccgagagcagtgggc

SEQ ID NO: 5763059 - DNA, 11 bp, Homo sapiens
gctaactgaac

SEQ ID NO: 5763060 - DNA, 17 bp, Homo sapiens
gctaactgaactttgaa

SEQ ID NO: 5763061 - DNA, 12 bp, Homo sapiens
gctaactggtta

SEQ ID NO: 5763062 - DNA, 16 bp, Homo sapiens
gctaactgtaaatcat

SEQ ID NO: 5763063 - DNA, 18 bp, Homo sapiens
gctaacttgcttaaatgt

SEQ ID NO: 5763064 - DNA, 22 bp, Homo sapiens
gctaacttgcttaaatgtgaat

SEQ ID NO: 5763065 - DNA, 18 bp, Homo sapiens
gctaacttggagccccag

SEQ ID NO: 5763066 - DNA, 16 bp, Homo sapiens
gctaagaaagcaaata

SEQ ID NO: 5763067 - DNA, 16 bp, Homo sapiens
gctaagaacctggaac

SEQ ID NO: 5763068 - DNA, 17 bp, Homo sapiens
gctaagaacctggaact

SEQ ID NO: 5763069 - DNA, 18 bp, Homo sapiens
gctaagaagttcaccagc

SEQ ID NO: 5763070 - DNA, 17 bp, Homo sapiens
gctaagaatatttgaat

SEQ ID NO: 5763071 - DNA, 14 bp, Homo sapiens
gctaagaatttttt

SEQ ID NO: 5763072 - DNA, 15 bp, Homo sapiens
gctaagacacactcc

SEQ ID NO: 5763073 - DNA, 15 bp, Homo sapiens
gctaagaccctgtgt

SEQ ID NO: 5763074 - DNA, 18 bp, Homo sapiens
gctaagacctccccaccc

SEQ ID NO: 5763075 - DNA, 14 bp, Homo sapiens
gctaagacttccta

SEQ ID NO: 5763076 - DNA, 19 bp, Homo sapiens
gctaagagcctctggaagg

SEQ ID NO: 5763077 - DNA, 20 bp, Homo sapiens
gctaagagggagggagggct

SEQ ID NO: 5763078 - DNA, 18 bp, Homo sapiens
gctaagagggtgaacaaa

SEQ ID NO: 5763079 - DNA, 19 bp, Homo sapiens
gctaagagtgtcctaggag

SEQ ID NO: 5763080 - DNA, 12 bp, Homo sapiens
gctaagatgctc

SEQ ID NO: 5763081 - DNA, 13 bp, Homo sapiens
gctaagcaagcca

SEQ ID NO: 5763082 - DNA, 16 bp, Homo sapiens
gctaagcaagccagga

SEQ ID NO: 5763083 - DNA, 17 bp, Homo sapiens
gctaagcaagccaggag

SEQ ID NO: 5763084 - DNA, 18 bp, Homo sapiens
gctaagcaagccaggaga

SEQ ID NO: 5763085 - DNA, 16 bp, Homo sapiens
gctaagcatggcctgg

SEQ ID NO: 5763086 - DNA, 14 bp, Homo sapiens
gctaagcattccaa

SEQ ID NO: 5763087 - DNA, 18 bp, Homo sapiens
gctaagccccagcaagca

SEQ ID NO: 5763088 - DNA, 12 bp, Homo sapiens
gctaagcctctg

SEQ ID NO: 5763089 - DNA, 14 bp, Homo sapiens
gctaagcctggaag

SEQ ID NO: 5763090 - DNA, 15 bp, Homo sapiens
gctaagcctggaagc

SEQ ID NO: 5763091 - DNA, 17 bp, Homo sapiens
gctaagcctggaagcca

SEQ ID NO: 5763092 - DNA, 21 bp, Homo sapiens
gctaagcggaacatgtgcttc

SEQ ID NO: 5763093 - DNA, 15 bp, Homo sapiens
gctaagctaaagaaa

SEQ ID NO: 5763094 - DNA, 19 bp, Homo sapiens
gctaagctaggaatgaaat

SEQ ID NO: 5763095 - DNA, 14 bp, Homo sapiens
gctaagctcaaatg

SEQ ID NO: 5763096 - DNA, 17 bp, Homo sapiens
gctaagctcaaatgtat

SEQ ID NO: 5763097 - DNA, 20 bp, Homo sapiens
gctaagctcacgtcctgaga

SEQ ID NO: 5763098 - DNA, 12 bp, Homo sapiens
gctaagctgcag

SEQ ID NO: 5763099 - DNA, 21 bp, Homo sapiens
gctaagctgcaggcacacacg

SEQ ID NO: 5763100 - DNA, 19 bp, Homo sapiens
gctaagctggctctgtttg

SEQ ID NO: 5763101 - DNA, 11 bp, Homo sapiens
gctaaggaaag

SEQ ID NO: 5763102 - DNA, 17 bp, Homo sapiens
gctaaggaacaatgccg

SEQ ID NO: 5763103 - DNA, 21 bp, Homo sapiens
gctaaggaagtatcagcacta

SEQ ID NO: 5763104 - DNA, 15 bp, Homo sapiens
gctaaggcaccagcc

SEQ ID NO: 5763105 - DNA, 13 bp, Homo sapiens
gctaaggccagct

SEQ ID NO: 5763106 - DNA, 18 bp, Homo sapiens
gctaaggccagctagagc

SEQ ID NO: 5763107 - DNA, 22 bp, Homo sapiens
gctaaggcgtggagctgcctga

SEQ ID NO: 5763108 - DNA, 12 bp, Homo sapiens
gctaaggctgct

SEQ ID NO: 5763109 - DNA, 14 bp, Homo sapiens
gctaaggctgctgg

SEQ ID NO: 5763110 - DNA, 17 bp, Homo sapiens
gctaaggcttccggctg

SEQ ID NO: 5763111 - DNA, 18 bp, Homo sapiens
gctaaggcttccggctga

SEQ ID NO: 5763112 - DNA, 21 bp, Homo sapiens
gctaaggggctagggctgagc

SEQ ID NO: 5763113 - DNA, 22 bp, Homo sapiens
gctaagggtaagggagagggag

SEQ ID NO: 5763114 - DNA, 21 bp, Homo sapiens
gctaagggtgggtgctcagaa

SEQ ID NO: 5763115 - DNA, 12 bp, Homo sapiens
gctaaggtccct

SEQ ID NO: 5763116 - DNA, 19 bp, Homo sapiens
gctaaggtttccagtcaga

SEQ ID NO: 5763117 - DNA, 21 bp, Homo sapiens
gctaaggtttccagtcagatg

SEQ ID NO: 5763118 - DNA, 16 bp, Homo sapiens
gctaagtaaaaatatt

SEQ ID NO: 5763119 - DNA, 18 bp, Homo sapiens
gctaagtaaatctcttct

SEQ ID NO: 5763120 - DNA, 19 bp, Homo sapiens
gctaagtaaatctcttctg

SEQ ID NO: 5763121 - DNA, 20 bp, Homo sapiens
gctaagtatcaggggaaaaa

SEQ ID NO: 5763122 - DNA, 21 bp, Homo sapiens
gctaagtcacccagagcacag

SEQ ID NO: 5763123 - DNA, 19 bp, Homo sapiens
gctaagtcattggcaaagt

SEQ ID NO: 5763124 - DNA, 21 bp, Homo sapiens
gctaagtccagctctcccctg

SEQ ID NO: 5763125 - DNA, 15 bp, Homo sapiens
gctaagtccatcacc

SEQ ID NO: 5763126 - DNA, 13 bp, Homo sapiens
gctaagtgaaaag

SEQ ID NO: 5763127 - DNA, 22 bp, Homo sapiens
gctaagtgatcctcccacctca

SEQ ID NO: 5763128 - DNA, 13 bp, Homo sapiens
gctaagttctaag

SEQ ID NO: 5763129 - DNA, 17 bp, Homo sapiens
gctaagttgtcttacac

SEQ ID NO: 5763130 - DNA, 13 bp, Homo sapiens
gctaataaaaatt

SEQ ID NO: 5763131 - DNA, 22 bp, Homo sapiens
gctaataaaagtcagagctcag

SEQ ID NO: 5763132 - DNA, 20 bp, Homo sapiens
gctaataaaattcgctttct

SEQ ID NO: 5763133 - DNA, 23 bp, Homo sapiens
gctaataaaattcgctttctaaa

SEQ ID NO: 5763134 - DNA, 22 bp, Homo sapiens
gctaataaacactggctctggg

SEQ ID NO: 5763135 - DNA, 23 bp, Homo sapiens
gctaataaacactggctctggga

SEQ ID NO: 5763136 - DNA, 11 bp, Homo sapiens
gctaataaacc

SEQ ID NO: 5763137 - DNA, 12 bp, Homo sapiens
gctaataaactg

SEQ ID NO: 5763138 - DNA, 21 bp, Homo sapiens
gctaataagtttgaaatatat

SEQ ID NO: 5763139 - DNA, 13 bp, Homo sapiens
gctaataataaat

SEQ ID NO: 5763140 - DNA, 18 bp, Homo sapiens
gctaataataaatgcata

SEQ ID NO: 5763141 - DNA, 20 bp, Homo sapiens
gctaatacaggaaacaagag

SEQ ID NO: 5763142 - DNA, 20 bp, Homo sapiens
gctaataccaactatttcaa

SEQ ID NO: 5763143 - DNA, 17 bp, Homo sapiens
gctaatacccagagcac

SEQ ID NO: 5763144 - DNA, 13 bp, Homo sapiens
gctaatattttat

SEQ ID NO: 5763145 - DNA, 20 bp, Homo sapiens
gctaatattttatttgaaaa

SEQ ID NO: 5763146 - DNA, 19 bp, Homo sapiens
gctaatcaaagccagggtc

SEQ ID NO: 5763147 - DNA, 17 bp, Homo sapiens
gctaatcaatacccttg

SEQ ID NO: 5763148 - DNA, 21 bp, Homo sapiens
gctaatcatgtgggtgagcca

SEQ ID NO: 5763149 - DNA, 14 bp, Homo sapiens
gctaatctcttcta

SEQ ID NO: 5763150 - DNA, 14 bp, Homo sapiens
gctaatctgcctgg

SEQ ID NO: 5763151 - DNA, 18 bp, Homo sapiens
gctaatctgtagggctgg

SEQ ID NO: 5763152 - DNA, 20 bp, Homo sapiens
gctaatctgtagggctggac

SEQ ID NO: 5763153 - DNA, 21 bp, Homo sapiens
gctaatctgtagggctggacc

SEQ ID NO: 5763154 - DNA, 22 bp, Homo sapiens
gctaatgaactctttcaaatta

SEQ ID NO: 5763155 - DNA, 21 bp, Homo sapiens
gctaatgaattttaaaagcat

SEQ ID NO: 5763156 - DNA, 22 bp, Homo sapiens
gctaatgaccaacctgtttcta

SEQ ID NO: 5763157 - DNA, 20 bp, Homo sapiens
gctaatgcaaattaaaacat

SEQ ID NO: 5763158 - DNA, 20 bp, Homo sapiens
gctaatgctatgcaaaaaat

SEQ ID NO: 5763159 - DNA, 21 bp, Homo sapiens
gctaatggagtgtttgaaaac

SEQ ID NO: 5763160 - DNA, 22 bp, Homo sapiens
gctaatggagtgtttgaaaact

SEQ ID NO: 5763161 - DNA, 15 bp, Homo sapiens
gctaatgggacacta

SEQ ID NO: 5763162 - DNA, 22 bp, Homo sapiens
gctaatgggctgctgtcatttt

SEQ ID NO: 5763163 - DNA, 22 bp, Homo sapiens
gctaatggtcctgttatgtcat

SEQ ID NO: 5763164 - DNA, 13 bp, Homo sapiens
gctaatgtaatca

SEQ ID NO: 5763165 - DNA, 19 bp, Homo sapiens
gctaatgtaggactgtata

SEQ ID NO: 5763166 - DNA, 14 bp, Homo sapiens
gctaatgtggtagt

SEQ ID NO: 5763167 - DNA, 18 bp, Homo sapiens
gctaatgtggtagtgaaa

SEQ ID NO: 5763168 - DNA, 11 bp, Homo sapiens
gctaatgtttg

SEQ ID NO: 5763169 - DNA, 19 bp, Homo sapiens
gctaatgtttgtattttta

SEQ ID NO: 5763170 - DNA, 15 bp, Homo sapiens
gctaattaaaaagtt

SEQ ID NO: 5763171 - DNA, 21 bp, Homo sapiens
gctaattaaggtttgccctgc

SEQ ID NO: 5763172 - DNA, 15 bp, Homo sapiens
gctaattacacacgt

SEQ ID NO: 5763173 - DNA, 21 bp, Homo sapiens
gctaattaggtctcatccttt

SEQ ID NO: 5763174 - DNA, 14 bp, Homo sapiens
gctaattattttaa

SEQ ID NO: 5763175 - DNA, 15 bp, Homo sapiens
gctaattctttgcaa

SEQ ID NO: 5763176 - DNA, 18 bp, Homo sapiens
gctaattgagaccacagg

SEQ ID NO: 5763177 - DNA, 22 bp, Homo sapiens
gctaattgctgttgaaagcaaa

SEQ ID NO: 5763178 - DNA, 21 bp, Homo sapiens
gctaattgtactaatctgaga

SEQ ID NO: 5763179 - DNA, 12 bp, Homo sapiens
gctaatttaaag

SEQ ID NO: 5763180 - DNA, 23 bp, Homo sapiens
gctaatttatttccccaggtgtg

SEQ ID NO: 5763181 - DNA, 16 bp, Homo sapiens
gctaatttctgtccag

SEQ ID NO: 5763182 - DNA, 13 bp, Homo sapiens
gctaatttgcatt

SEQ ID NO: 5763183 - DNA, 20 bp, Homo sapiens
gctaatttgttttggatata

SEQ ID NO: 5763184 - DNA, 22 bp, Homo sapiens
gctaattttctcaaaagcattt

SEQ ID NO: 5763185 - DNA, 18 bp, Homo sapiens
gctaattttgaaaaactg

SEQ ID NO: 5763186 - DNA, 15 bp, Homo sapiens
gctaatttttgtaat

SEQ ID NO: 5763187 - DNA, 16 bp, Homo sapiens
gctaatttttgtaatt

SEQ ID NO: 5763188 - DNA, 14 bp, Homo sapiens
gctacaaaaattga

SEQ ID NO: 5763189 - DNA, 22 bp, Homo sapiens
gctacaaagaagacatgtttta

SEQ ID NO: 5763190 - DNA, 20 bp, Homo sapiens
gctacaaatactcttaggaa

SEQ ID NO: 5763191 - DNA, 19 bp, Homo sapiens
gctacaaatagtgctaata

SEQ ID NO: 5763192 - DNA, 16 bp, Homo sapiens
gctacaaatttatgca

SEQ ID NO: 5763193 - DNA, 14 bp, Homo sapiens
gctacaacagcctc

SEQ ID NO: 5763194 - DNA, 19 bp, Homo sapiens
gctacaaccctaccctggc

SEQ ID NO: 5763195 - DNA, 15 bp, Homo sapiens
gctacaacttcagca

SEQ ID NO: 5763196 - DNA, 19 bp, Homo sapiens
gctacaagagggcaaagct

SEQ ID NO: 5763197 - DNA, 20 bp, Homo sapiens
gctacaaggggtgtgacttg

SEQ ID NO: 5763198 - DNA, 15 bp, Homo sapiens
gctacaagtgtttta

SEQ ID NO: 5763199 - DNA, 16 bp, Homo sapiens
gctacaagtgttttag

SEQ ID NO: 5763200 - DNA, 12 bp, Homo sapiens
gctacaataaat

SEQ ID NO: 5763201 - DNA, 13 bp, Homo sapiens
gctacaataaatg

SEQ ID NO: 5763202 - DNA, 14 bp, Homo sapiens
gctacaataaatgc

SEQ ID NO: 5763203 - DNA, 19 bp, Homo sapiens
gctacaatggaaaccattt

SEQ ID NO: 5763204 - DNA, 16 bp, Homo sapiens
gctacaatttgttaat

SEQ ID NO: 5763205 - DNA, 20 bp, Homo sapiens
gctacacactgcatgtttgt

SEQ ID NO: 5763206 - DNA, 14 bp, Homo sapiens
gctacacagaccct

SEQ ID NO: 5763207 - DNA, 20 bp, Homo sapiens
gctacacagaccctgcccac

SEQ ID NO: 5763208 - DNA, 14 bp, Homo sapiens
gctacacaggcagg

SEQ ID NO: 5763209 - DNA, 22 bp, Homo sapiens
gctacacaggggaaaagaggag

SEQ ID NO: 5763210 - DNA, 18 bp, Homo sapiens
gctacaccactctggcag

SEQ ID NO: 5763211 - DNA, 22 bp, Homo sapiens
gctacaccactctggcagccac

SEQ ID NO: 5763212 - DNA, 19 bp, Homo sapiens
gctacacccttttccagct

SEQ ID NO: 5763213 - DNA, 17 bp, Homo sapiens
gctacaccttagcagct

SEQ ID NO: 5763214 - DNA, 13 bp, Homo sapiens
gctacacctttct

SEQ ID NO: 5763215 - DNA, 16 bp, Homo sapiens
gctacacttacaagta

SEQ ID NO: 5763216 - DNA, 21 bp, Homo sapiens
gctacagaatagggtggcaga

SEQ ID NO: 5763217 - DNA, 12 bp, Homo sapiens
gctacagagaaa

SEQ ID NO: 5763218 - DNA, 23 bp, Homo sapiens
gctacagagaaaatcaaagcagt

SEQ ID NO: 5763219 - DNA, 15 bp, Homo sapiens
gctacttggcaggct

SEQ ID NO: 5763220 - DNA, 16 bp, Homo sapiens
gctacttggcaggctg

SEQ ID NO: 5763221 - DNA, 17 bp, Homo sapiens
gctacttggcaggctga

SEQ ID NO: 5763222 - DNA, 18 bp, Homo sapiens
gctacttgggagcctgag

SEQ ID NO: 5763223 - DNA, 23 bp, Homo sapiens
gctacttgggagcctgaggcagg

SEQ ID NO: 5763224 - DNA, 18 bp, Homo sapiens
gctacttgggccatagct

SEQ ID NO: 5763225 - DNA, 15 bp, Homo sapiens
gctactttccatttg

SEQ ID NO: 5763226 - DNA, 22 bp, Homo sapiens
gctactttggtttctgtctgta

SEQ ID NO: 5763227 - DNA, 16 bp, Homo sapiens
gctagaaaaaaagaat

SEQ ID NO: 5763228 - DNA, 13 bp, Homo sapiens
gctagaaaaatta

SEQ ID NO: 5763229 - DNA, 19 bp, Homo sapiens
gctagaaaatgaactgtat

SEQ ID NO: 5763230 - DNA, 23 bp, Homo sapiens
gctagaaaatgaactgtatatta

SEQ ID NO: 5763231 - DNA, 15 bp, Homo sapiens
gctagaaacaatcta

SEQ ID NO: 5763232 - DNA, 21 bp, Homo sapiens
gctagaaagagaaaaagccct

SEQ ID NO: 5763233 - DNA, 14 bp, Homo sapiens
gctagaacatggtt

SEQ ID NO: 5763234 - DNA, 20 bp, Homo sapiens
gctagaaccaagaagggcta

SEQ ID NO: 5763235 - DNA, 14 bp, Homo sapiens
gctagaaccctctg

SEQ ID NO: 5763236 - DNA, 20 bp, Homo sapiens
gctagaacctagaagggcta

SEQ ID NO: 5763237 - DNA, 15 bp, Homo sapiens
gctagaacctggaga

SEQ ID NO: 5763238 - DNA, 19 bp, Homo sapiens
gctagaacctggagggctg

SEQ ID NO: 5763239 - DNA, 12 bp, Homo sapiens
gctagaactccc

SEQ ID NO: 5763240 - DNA, 15 bp, Homo sapiens
gctagaactcccttt

SEQ ID NO: 5763241 - DNA, 18 bp, Homo sapiens
gctagaactccctttcaa

SEQ ID NO: 5763242 - DNA, 10 bp, Homo sapiens
gctagaactt

SEQ ID NO: 5763243 - DNA, 11 bp, Homo sapiens
gctagaacttt

SEQ ID NO: 5763244 - DNA, 21 bp, Homo sapiens
gctagaagaaagtaaaaagaa

SEQ ID NO: 5763245 - DNA, 15 bp, Homo sapiens
gctagaagctggagg

SEQ ID NO: 5763246 - DNA, 21 bp, Homo sapiens
gctagaagtgggccaggacag

SEQ ID NO: 5763247 - DNA, 20 bp, Homo sapiens
gctagaagttgggttgttct

SEQ ID NO: 5763248 - DNA, 21 bp, Homo sapiens
gctagaattgattttttttct

SEQ ID NO: 5763249 - DNA, 15 bp, Homo sapiens
gctagaatttctggt

SEQ ID NO: 5763250 - DNA, 21 bp, Homo sapiens
gctagacaatgatttggccag

SEQ ID NO: 5763251 - DNA, 19 bp, Homo sapiens
gctagacagaaaccaagcc

SEQ ID NO: 5763252 - DNA, 15 bp, Homo sapiens
gctagacccaaccct

SEQ ID NO: 5763253 - DNA, 20 bp, Homo sapiens
gctagactcctcaggagaga

SEQ ID NO: 5763254 - DNA, 14 bp, Homo sapiens
gctagactgggctg

SEQ ID NO: 5763255 - DNA, 18 bp, Homo sapiens
gctagactgggctggctg

SEQ ID NO: 5763256 - DNA, 15 bp, Homo sapiens
gctagactggtgact

SEQ ID NO: 5763257 - DNA, 19 bp, Homo sapiens
gctagactggtgactgatt

SEQ ID NO: 5763258 - DNA, 20 bp, Homo sapiens
gctagactggtgactgattc

SEQ ID NO: 5763259 - DNA, 12 bp, Homo sapiens
gctagactgtgt

SEQ ID NO: 5763260 - DNA, 13 bp, Homo sapiens
gctagactgtgtc

SEQ ID NO: 5763261 - DNA, 17 bp, Homo sapiens
gctagagacagatgctg

SEQ ID NO: 5763262 - DNA, 21 bp, Homo sapiens
gctagagacagatgctggtgg

SEQ ID NO: 5763263 - DNA, 18 bp, Homo sapiens
gctagagaggggcctctg

SEQ ID NO: 5763264 - DNA, 20 bp, Homo sapiens
gctagagcattctggggtgg

SEQ ID NO: 5763265 - DNA, 15 bp, Homo sapiens
gctagagcctctgcc

SEQ ID NO: 5763266 - DNA, 22 bp, Homo sapiens
gctagagcctctgcctgacagc

SEQ ID NO: 5763267 - DNA, 22 bp, Homo sapiens
gctagagcttcaagtctgtgcc

SEQ ID NO: 5763268 - DNA, 20 bp, Homo sapiens
gctagaggaaccaaccccca

SEQ ID NO: 5763269 - DNA, 22 bp, Homo sapiens
gctagaggaataaagctgtgag

SEQ ID NO: 5763270 - DNA, 18 bp, Homo sapiens
gctagaggccagccccac

SEQ ID NO: 5763271 - DNA, 19 bp, Homo sapiens
gctagaggccagccccacc

SEQ ID NO: 5763272 - DNA, 20 bp, Homo sapiens
gctagaggccagccccaccc

SEQ ID NO: 5763273 - DNA, 12 bp, Homo sapiens
gctagaggcttt

SEQ ID NO: 5763274 - DNA, 16 bp, Homo sapiens
gctagagggcccaaag

SEQ ID NO: 5763275 - DNA, 15 bp, Homo sapiens
gctagaggtggcatg

SEQ ID NO: 5763276 - DNA, 21 bp, Homo sapiens
gctagaggttcaaagatattt

SEQ ID NO: 5763277 - DNA, 19 bp, Homo sapiens
gctagaggttgcagcatga

SEQ ID NO: 5763278 - DNA, 13 bp, Homo sapiens
gctagagtcctca

SEQ ID NO: 5763279 - DNA, 18 bp, Homo sapiens
gctagagtcctcactccc

SEQ ID NO: 5763280 - DNA, 15 bp, Homo sapiens
gctagagttaaaagt

SEQ ID NO: 5763281 - DNA, 19 bp, Homo sapiens
gctagagtttgaaaaacta

SEQ ID NO: 5763282 - DNA, 20 bp, Homo sapiens
gctagataatagggttttca

SEQ ID NO: 5763283 - DNA, 23 bp, Homo sapiens
gctagatatcacttactcagtta

SEQ ID NO: 5763284 - DNA, 22 bp, Homo sapiens
gctagatgagaattcagctgcc

SEQ ID NO: 5763285 - DNA, 21 bp, Homo sapiens
gctagattaaaatatcctttc

SEQ ID NO: 5763286 - DNA, 13 bp, Homo sapiens
gctagatttctac

SEQ ID NO: 5763287 - DNA, 18 bp, Homo sapiens
gctagattttaatttatt

SEQ ID NO: 5763288 - DNA, 13 bp, Homo sapiens
gctagcaaagact

SEQ ID NO: 5763289 - DNA, 19 bp, Homo sapiens
gctagcaaatggcagaacc

SEQ ID NO: 5763290 - DNA, 14 bp, Homo sapiens
gctagcacagaggc

SEQ ID NO: 5763291 - DNA, 15 bp, Homo sapiens
gctagcacagaggcc

SEQ ID NO: 5763292 - DNA, 16 bp, Homo sapiens
gctagcacagaggcct

SEQ ID NO: 5763293 - DNA, 14 bp, Homo sapiens
gctagcacagctcc

SEQ ID NO: 5763294 - DNA, 15 bp, Homo sapiens
gctagcacctcccca

SEQ ID NO: 5763295 - DNA, 20 bp, Homo sapiens
gctagcacctccccagacag

SEQ ID NO: 5763296 - DNA, 13 bp, Homo sapiens
gctagcagaagta

SEQ ID NO: 5763297 - DNA, 11 bp, Homo sapiens
gctagcagccc

SEQ ID NO: 5763298 - DNA, 14 bp, Homo sapiens
gctagcagtggcag

SEQ ID NO: 5763299 - DNA, 22 bp, Homo sapiens
gctagcattaccacttccctgc

SEQ ID NO: 5763300 - DNA, 19 bp, Homo sapiens
gctagccaactcctccttg

SEQ ID NO: 5763301 - DNA, 15 bp, Homo sapiens
gctagccagaggact

SEQ ID NO: 5763302 - DNA, 13 bp, Homo sapiens
gctagccagaggg

SEQ ID NO: 5763303 - DNA, 13 bp, Homo sapiens
gctagccagccaa

SEQ ID NO: 5763304 - DNA, 14 bp, Homo sapiens
gctagccatatatt

SEQ ID NO: 5763305 - DNA, 19 bp, Homo sapiens
gctagcccagtccctggag

SEQ ID NO: 5763306 - DNA, 13 bp, Homo sapiens
gctagccccaggg

SEQ ID NO: 5763307 - DNA, 16 bp, Homo sapiens
gctagccccagggtga

SEQ ID NO: 5763308 - DNA, 19 bp, Homo sapiens
gctagccctgccctccacc

SEQ ID NO: 5763309 - DNA, 17 bp, Homo sapiens
gctagccctggggtggc

SEQ ID NO: 5763310 - DNA, 22 bp, Homo sapiens
gctagccctggggtggcgtctg

SEQ ID NO: 5763311 - DNA, 20 bp, Homo sapiens
gctagcctcacgaaactgga

SEQ ID NO: 5763312 - DNA, 12 bp, Homo sapiens
gctagcctgaag

SEQ ID NO: 5763313 - DNA, 13 bp, Homo sapiens
gctagcgagccgc

SEQ ID NO: 5763314 - DNA, 21 bp, Homo sapiens
gctagcgctgccgcaccccag

SEQ ID NO: 5763315 - DNA, 17 bp, Homo sapiens
gctagcggggccaggag

SEQ ID NO: 5763316 - DNA, 15 bp, Homo sapiens
gctagctagccagcc

SEQ ID NO: 5763317 - DNA, 17 bp, Homo sapiens
gctagctagctcaacta

SEQ ID NO: 5763318 - DNA, 19 bp, Homo sapiens
gctagctattgcaaatgag

SEQ ID NO: 5763319 - DNA, 18 bp, Homo sapiens
gctagctcccctcctctc

SEQ ID NO: 5763320 - DNA, 13 bp, Homo sapiens
gctagctgccact

SEQ ID NO: 5763321 - DNA, 17 bp, Homo sapiens
gctagctgtagaaatgt

SEQ ID NO: 5763322 - DNA, 15 bp, Homo sapiens
gctagcttctgcttt

SEQ ID NO: 5763323 - DNA, 23 bp, Homo sapiens
gctagctttcctttacagctgtt

SEQ ID NO: 5763324 - DNA, 13 bp, Homo sapiens
gctaggaaagagg

SEQ ID NO: 5763325 - DNA, 15 bp, Homo sapiens
gctaggaaaggcaga

SEQ ID NO: 5763326 - DNA, 16 bp, Homo sapiens
gctaggaaaggcagaa

SEQ ID NO: 5763327 - DNA, 17 bp, Homo sapiens
gctaggaaagggaagcc

SEQ ID NO: 5763328 - DNA, 19 bp, Homo sapiens
gctaggaaatccagggtgg

SEQ ID NO: 5763329 - DNA, 22 bp, Homo sapiens
gctaggaaatccagggtggtgg

SEQ ID NO: 5763330 - DNA, 15 bp, Homo sapiens
gctaggaacactcct

SEQ ID NO: 5763331 - DNA, 18 bp, Homo sapiens
gctaggaacactccttca

SEQ ID NO: 5763332 - DNA, 19 bp, Homo sapiens
gctaggaacactccttcac

SEQ ID NO: 5763333 - DNA, 11 bp, Homo sapiens
gctaggaaccc

SEQ ID NO: 5763334 - DNA, 12 bp, Homo sapiens
gctaggaagagg

SEQ ID NO: 5763335 - DNA, 21 bp, Homo sapiens
gctaggaagagtctacccgac

SEQ ID NO: 5763336 - DNA, 20 bp, Homo sapiens
gctaggacccctccatgtgg

SEQ ID NO: 5763337 - DNA, 22 bp, Homo sapiens
gctaggactgtggaggggagct

SEQ ID NO: 5763338 - DNA, 16 bp, Homo sapiens
gctaggagaagggctg

SEQ ID NO: 5763339 - DNA, 15 bp, Homo sapiens
gctaggagcaaagcc

SEQ ID NO: 5763340 - DNA, 16 bp, Homo sapiens
gctaggagcaggcttg

SEQ ID NO: 5763341 - DNA, 14 bp, Homo sapiens
gctaggagccccag

SEQ ID NO: 5763342 - DNA, 22 bp, Homo sapiens
gctaggagccccagcttcctgt

SEQ ID NO: 5763343 - DNA, 17 bp, Homo sapiens
gctaggaggagggggta

SEQ ID NO: 5763344 - DNA, 14 bp, Homo sapiens
gctaggatggttct

SEQ ID NO: 5763345 - DNA, 20 bp, Homo sapiens
gctaggcagggtgtctgccc

SEQ ID NO: 5763346 - DNA, 12 bp, Homo sapiens
gctaggcatgcc

SEQ ID NO: 5763347 - DNA, 15 bp, Homo sapiens
gctaggcatgcctgg

SEQ ID NO: 5763348 - DNA, 12 bp, Homo sapiens
gctaggccagag

SEQ ID NO: 5763349 - DNA, 16 bp, Homo sapiens
gctaggccagcagggg

SEQ ID NO: 5763350 - DNA, 18 bp, Homo sapiens
gctaggccagcaggggct

SEQ ID NO: 5763351 - DNA, 17 bp, Homo sapiens
gctaggccccagaggcc

SEQ ID NO: 5763352 - DNA, 15 bp, Homo sapiens
gctaggcccctgtgt

SEQ ID NO: 5763353 - DNA, 17 bp, Homo sapiens
gctaggcccctgtgtag

SEQ ID NO: 5763354 - DNA, 22 bp, Homo sapiens
gctaggcctccgttgtctggtt

SEQ ID NO: 5763355 - DNA, 18 bp, Homo sapiens
gctaggcgagtgccagga

SEQ ID NO: 5763356 - DNA, 20 bp, Homo sapiens
gctaggcgagtgccaggact

SEQ ID NO: 5763357 - DNA, 18 bp, Homo sapiens
gctaggcgctggggagac

SEQ ID NO: 5763358 - DNA, 19 bp, Homo sapiens
gctaggctgtggagtagag

SEQ ID NO: 5763359 - DNA, 17 bp, Homo sapiens
gctagggaaacttcccg

SEQ ID NO: 5763360 - DNA, 23 bp, Homo sapiens
gctagggagagggaagagggaga

SEQ ID NO: 5763361 - DNA, 22 bp, Homo sapiens
gctagggctgagcacctctcag

SEQ ID NO: 5763362 - DNA, 14 bp, Homo sapiens
gctagggctgctgc

SEQ ID NO: 5763363 - DNA, 18 bp, Homo sapiens
gctagggctgctgcttct

SEQ ID NO: 5763364 - DNA, 12 bp, Homo sapiens
gctagggctgga

SEQ ID NO: 5763365 - DNA, 23 bp, Homo sapiens
gctaggggaaggactggccgtgg

SEQ ID NO: 5763366 - DNA, 18 bp, Homo sapiens
gctaggggacttggggat

SEQ ID NO: 5763367 - DNA, 22 bp, Homo sapiens
gctaggggaggggggagccaga

SEQ ID NO: 5763368 - DNA, 23 bp, Homo sapiens
gctaggggggtcagccagccctc

SEQ ID NO: 5763369 - DNA, 14 bp, Homo sapiens
gctagggtgcctgc

SEQ ID NO: 5763370 - DNA, 15 bp, Homo sapiens
gctagggtgcctgct

SEQ ID NO: 5763371 - DNA, 18 bp, Homo sapiens
gctagggtgcctgctctc

SEQ ID NO: 5763372 - DNA, 17 bp, Homo sapiens
gctagggtggggagaga

SEQ ID NO: 5763373 - DNA, 18 bp, Homo sapiens
gctagggtggggagagac

SEQ ID NO: 5763374 - DNA, 20 bp, Homo sapiens
gctagggttccactggagaa

SEQ ID NO: 5763375 - DNA, 20 bp, Homo sapiens
gctaggtagaaaaagggtca

SEQ ID NO: 5763376 - DNA, 18 bp, Homo sapiens
gctaggtataaaaaataa

SEQ ID NO: 5763377 - DNA, 17 bp, Homo sapiens
gctaggtctgaccaaaa

SEQ ID NO: 5763378 - DNA, 22 bp, Homo sapiens
gctaggtgacatatacatactt

SEQ ID NO: 5763379 - DNA, 18 bp, Homo sapiens
gctaggtgggccagcccc

SEQ ID NO: 5763380 - DNA, 19 bp, Homo sapiens
gctaggtgggccagcccct

SEQ ID NO: 5763381 - DNA, 20 bp, Homo sapiens
gctaggtgggccagcccctc

SEQ ID NO: 5763382 - DNA, 16 bp, Homo sapiens
gctaggtgtctgggat

SEQ ID NO: 5763383 - DNA, 20 bp, Homo sapiens
gctaggttaataggaggaca

SEQ ID NO: 5763384 - DNA, 16 bp, Homo sapiens
gctagtaaattttcaa

SEQ ID NO: 5763385 - DNA, 14 bp, Homo sapiens
gctagtaatgcttt

SEQ ID NO: 5763386 - DNA, 14 bp, Homo sapiens
gctagtacctgtaa

SEQ ID NO: 5763387 - DNA, 19 bp, Homo sapiens
gctagtactggggagaaat

SEQ ID NO: 5763388 - DNA, 16 bp, Homo sapiens
gctagtagcaatgtgc

SEQ ID NO: 5763389 - DNA, 18 bp, Homo sapiens
gctagtagcaatgtgcct

SEQ ID NO: 5763390 - DNA, 21 bp, Homo sapiens
gctagtagcaatgtgccttga

SEQ ID NO: 5763391 - DNA, 16 bp, Homo sapiens
gctagtatcaaaagaa

SEQ ID NO: 5763392 - DNA, 17 bp, Homo sapiens
gctagtatcttcaaact

SEQ ID NO: 5763393 - DNA, 11 bp, Homo sapiens
gctagtatttg

SEQ ID NO: 5763394 - DNA, 16 bp, Homo sapiens
gctagtcaagctcctc

SEQ ID NO: 5763395 - DNA, 19 bp, Homo sapiens
gctagtcaagctcctcctc

SEQ ID NO: 5763396 - DNA, 14 bp, Homo sapiens
gctagtcagagaga

SEQ ID NO: 5763397 - DNA, 18 bp, Homo sapiens
gctattattttcactgta

SEQ ID NO: 5763398 - DNA, 14 bp, Homo sapiens
gctattcacctcag

SEQ ID NO: 5763399 - DNA, 20 bp, Homo sapiens
gctattcacctcagtagaaa

SEQ ID NO: 5763400 - DNA, 22 bp, Homo sapiens
gctattcacctcagtagaaaag

SEQ ID NO: 5763401 - DNA, 23 bp, Homo sapiens
gctattcacctcagtagaaaagg

SEQ ID NO: 5763402 - DNA, 19 bp, Homo sapiens
gctattccagctgtccccc

SEQ ID NO: 5763403 - DNA, 14 bp, Homo sapiens
gctattcccaggca

SEQ ID NO: 5763404 - DNA, 16 bp, Homo sapiens
gctattcccttctgat

SEQ ID NO: 5763405 - DNA, 17 bp, Homo sapiens
gctattcctttcccttc

SEQ ID NO: 5763406 - DNA, 19 bp, Homo sapiens
gctattcctttcccttcct

SEQ ID NO: 5763407 - DNA, 16 bp, Homo sapiens
gctattctagagcttt

SEQ ID NO: 5763408 - DNA, 18 bp, Homo sapiens
gctattctgtgaaactaa

SEQ ID NO: 5763409 - DNA, 12 bp, Homo sapiens
gctattgaaatt

SEQ ID NO: 5763410 - DNA, 16 bp, Homo sapiens
gctattgaaattactg

SEQ ID NO: 5763411 - DNA, 22 bp, Homo sapiens
gctattgaagatacacaagagg

SEQ ID NO: 5763412 - DNA, 16 bp, Homo sapiens
gctattgacaagtcat

SEQ ID NO: 5763413 - DNA, 21 bp, Homo sapiens
gctattgaccatgtggttcac

SEQ ID NO: 5763414 - DNA, 20 bp, Homo sapiens
gctattgatgtttccagaaa

SEQ ID NO: 5763415 - DNA, 14 bp, Homo sapiens
gctattgcagaatg

SEQ ID NO: 5763416 - DNA, 20 bp, Homo sapiens
gctattgcagaatgaagcca

SEQ ID NO: 5763417 - DNA, 15 bp, Homo sapiens
gctattgcatgtaaa

SEQ ID NO: 5763418 - DNA, 20 bp, Homo sapiens
gctattgcatgtaaaatgca

SEQ ID NO: 5763419 - DNA, 22 bp, Homo sapiens
gctattgcatgtaaaatgcagt

SEQ ID NO: 5763420 - DNA, 13 bp, Homo sapiens
gctattgctgtct

SEQ ID NO: 5763421 - DNA, 22 bp, Homo sapiens
gctattggcctcccaaaagact

SEQ ID NO: 5763422 - DNA, 16 bp, Homo sapiens
gctattgtcaccaggg

SEQ ID NO: 5763423 - DNA, 21 bp, Homo sapiens
gctattgtccttgtgtatcct

SEQ ID NO: 5763424 - DNA, 15 bp, Homo sapiens
gctattgttgtgggc

SEQ ID NO: 5763425 - DNA, 22 bp, Homo sapiens
gctattgttgtgggctttctcc

SEQ ID NO: 5763426 - DNA, 13 bp, Homo sapiens
gctatttaaaact

SEQ ID NO: 5763427 - DNA, 11 bp, Homo sapiens
gctatttaagt

SEQ ID NO: 5763428 - DNA, 22 bp, Homo sapiens
gctatttaagtggactgtattt

SEQ ID NO: 5763429 - DNA, 12 bp, Homo sapiens
gctatttatatt

SEQ ID NO: 5763430 - DNA, 11 bp, Homo sapiens
gctatttatgc

SEQ ID NO: 5763431 - DNA, 13 bp, Homo sapiens
gctatttatgcaa

SEQ ID NO: 5763432 - DNA, 19 bp, Homo sapiens
gctatttatgggcccctgg

SEQ ID NO: 5763433 - DNA, 21 bp, Homo sapiens
gctatttcaggcacatcattg

SEQ ID NO: 5763434 - DNA, 15 bp, Homo sapiens
gctatttcatctatt

SEQ ID NO: 5763435 - DNA, 17 bp, Homo sapiens
gctatttccattccaga

SEQ ID NO: 5763436 - DNA, 13 bp, Homo sapiens
gctatttccttcc

SEQ ID NO: 5763437 - DNA, 18 bp, Homo sapiens
gctatttccttccagcct

SEQ ID NO: 5763438 - DNA, 21 bp, Homo sapiens
gctatttctacctcactttgg

SEQ ID NO: 5763439 - DNA, 23 bp, Homo sapiens
gctatttctagtagaaagaaaat

SEQ ID NO: 5763440 - DNA, 16 bp, Homo sapiens
gctatttctatatttt

SEQ ID NO: 5763441 - DNA, 20 bp, Homo sapiens
gctatttctatattttcatt

SEQ ID NO: 5763442 - DNA, 22 bp, Homo sapiens
gctatttctatattttcattct

SEQ ID NO: 5763443 - DNA, 15 bp, Homo sapiens
gctatttctctcccc

SEQ ID NO: 5763444 - DNA, 13 bp, Homo sapiens
gctatttctgtgt

SEQ ID NO: 5763445 - DNA, 21 bp, Homo sapiens
gctatttgaaatactaaaagc

SEQ ID NO: 5763446 - DNA, 23 bp, Homo sapiens
gctatttgaaatactaaaagcaa

SEQ ID NO: 5763447 - DNA, 11 bp, Homo sapiens
gctatttgaag

SEQ ID NO: 5763448 - DNA, 23 bp, Homo sapiens
gctatttgaagaaaaaaatgtac

SEQ ID NO: 5763449 - DNA, 14 bp, Homo sapiens
gctatttgaagtgt

SEQ ID NO: 5763450 - DNA, 23 bp, Homo sapiens
gctatttgctttagagacaggga

SEQ ID NO: 5763451 - DNA, 16 bp, Homo sapiens
gctatttgtacaaata

SEQ ID NO: 5763452 - DNA, 19 bp, Homo sapiens
gctatttgtacaaataaac

SEQ ID NO: 5763453 - DNA, 18 bp, Homo sapiens
gctatttgtatttctctt

SEQ ID NO: 5763454 - DNA, 22 bp, Homo sapiens
gctatttgtcagtagccatttt

SEQ ID NO: 5763455 - DNA, 14 bp, Homo sapiens
gctatttgtcatct

SEQ ID NO: 5763456 - DNA, 16 bp, Homo sapiens
gctatttgtgtgtatg

SEQ ID NO: 5763457 - DNA, 17 bp, Homo sapiens
gctatttgttcagagag

SEQ ID NO: 5763458 - DNA, 18 bp, Homo sapiens
gctattttagaaagctaa

SEQ ID NO: 5763459 - DNA, 18 bp, Homo sapiens
gctattttcatcacagtt

SEQ ID NO: 5763460 - DNA, 22 bp, Homo sapiens
gctattttctaaagacttgtat

SEQ ID NO: 5763461 - DNA, 18 bp, Homo sapiens
gctattttctgaccaaaa

SEQ ID NO: 5763462 - DNA, 13 bp, Homo sapiens
gctattttgtgaa

SEQ ID NO: 5763463 - DNA, 23 bp, Homo sapiens
gctatttttaatttcctgtgagg

SEQ ID NO: 5763464 - DNA, 13 bp, Homo sapiens
gctatttttctaa

SEQ ID NO: 5763465 - DNA, 15 bp, Homo sapiens
gctatttttgtaaag

SEQ ID NO: 5763466 - DNA, 23 bp, Homo sapiens
gctattttttcccttctcttcta

SEQ ID NO: 5763467 - DNA, 14 bp, Homo sapiens
gctcaaaaggaaac

SEQ ID NO: 5763468 - DNA, 19 bp, Homo sapiens
gctcaaaaggaaaccaagt

SEQ ID NO: 5763469 - DNA, 12 bp, Homo sapiens
gctcaaaatctt

SEQ ID NO: 5763470 - DNA, 15 bp, Homo sapiens
gctcaaaatctttcc

SEQ ID NO: 5763471 - DNA, 16 bp, Homo sapiens
gctcaaagatgtactg

SEQ ID NO: 5763472 - DNA, 18 bp, Homo sapiens
gctcaaagcagcaggact

SEQ ID NO: 5763473 - DNA, 22 bp, Homo sapiens
gctcaaaggtttggaaggagca

SEQ ID NO: 5763474 - DNA, 14 bp, Homo sapiens
gctcaaataaaaat

SEQ ID NO: 5763475 - DNA, 14 bp, Homo sapiens
gctcaaataaaatt

SEQ ID NO: 5763476 - DNA, 20 bp, Homo sapiens
gctcaaatcatttaagaagg

SEQ ID NO: 5763477 - DNA, 14 bp, Homo sapiens
gctcaaatctattc

SEQ ID NO: 5763478 - DNA, 18 bp, Homo sapiens
gctcaaatctattcagac

SEQ ID NO: 5763479 - DNA, 22 bp, Homo sapiens
gctcaaatctattcagacaagc

SEQ ID NO: 5763480 - DNA, 16 bp, Homo sapiens
gctcaaatgatcctcc

SEQ ID NO: 5763481 - DNA, 15 bp, Homo sapiens
gctcaacataacata

SEQ ID NO: 5763482 - DNA, 22 bp, Homo sapiens
gctcaaccactgtggcgttctg

SEQ ID NO: 5763483 - DNA, 20 bp, Homo sapiens
gctcaacccccctcccagac

SEQ ID NO: 5763484 - DNA, 12 bp, Homo sapiens
gctcaacctaac

SEQ ID NO: 5763485 - DNA, 15 bp, Homo sapiens
gctcaacctctctcc

SEQ ID NO: 5763486 - DNA, 14 bp, Homo sapiens
gctcaacggtctgg

SEQ ID NO: 5763487 - DNA, 20 bp, Homo sapiens
gctcaacggtctggcagggc

SEQ ID NO: 5763488 - DNA, 22 bp, Homo sapiens
gctcaactcgggggcgcctgga

SEQ ID NO: 5763489 - DNA, 14 bp, Homo sapiens
gctcaactttctgt

SEQ ID NO: 5763490 - DNA, 13 bp, Homo sapiens
gctcaagaatgta

SEQ ID NO: 5763491 - DNA, 13 bp, Homo sapiens
gctcaagaggccc

SEQ ID NO: 5763492 - DNA, 16 bp, Homo sapiens
gctcaagaggcccagg

SEQ ID NO: 5763493 - DNA, 21 bp, Homo sapiens
gctcaagcaatcctcctgcct

SEQ ID NO: 5763494 - DNA, 21 bp, Homo sapiens
gctcaagcaatcctctcacct

SEQ ID NO: 5763495 - DNA, 24 bp, Homo sapiens
gctcaagcacttttcctgtctcag

SEQ ID NO: 5763496 - DNA, 21 bp, Homo sapiens
gctcaagcagcgaccgccccc

SEQ ID NO: 5763497 - DNA, 15 bp, Homo sapiens
gctcaagcagttctc

SEQ ID NO: 5763498 - DNA, 18 bp, Homo sapiens
gctcaagcagttctccca

SEQ ID NO: 5763499 - DNA, 21 bp, Homo sapiens
gctcaagccgcaagctctcag

SEQ ID NO: 5763500 - DNA, 13 bp, Homo sapiens
gctcaaggaagga

SEQ ID NO: 5763501 - DNA, 22 bp, Homo sapiens
gctcaaggcaccgcagcctgtc

SEQ ID NO: 5763502 - DNA, 18 bp, Homo sapiens
gctcaaggccaccttgga

SEQ ID NO: 5763503 - DNA, 16 bp, Homo sapiens
gctcaaggctgtgcag

SEQ ID NO: 5763504 - DNA, 16 bp, Homo sapiens
gctcaagggctggcac

SEQ ID NO: 5763505 - DNA, 18 bp, Homo sapiens
gctcaagggttctttcct

SEQ ID NO: 5763506 - DNA, 13 bp, Homo sapiens
gctcaagtagaaa

SEQ ID NO: 5763507 - DNA, 19 bp, Homo sapiens
gctcaagtcctcttttctg

SEQ ID NO: 5763508 - DNA, 22 bp, Homo sapiens
gctcaagtcctcttttctgaga

SEQ ID NO: 5763509 - DNA, 20 bp, Homo sapiens
gctcaagtcttccctgatca

SEQ ID NO: 5763510 - DNA, 16 bp, Homo sapiens
gctcaagtgatcttcc

SEQ ID NO: 5763511 - DNA, 21 bp, Homo sapiens
gctcaagtgttcacaacctgg

SEQ ID NO: 5763512 - DNA, 15 bp, Homo sapiens
gctcaagttcaccag

SEQ ID NO: 5763513 - DNA, 13 bp, Homo sapiens
gctcaataaactt

SEQ ID NO: 5763514 - DNA, 22 bp, Homo sapiens
gctcaataaacttgtgcctcca

SEQ ID NO: 5763515 - DNA, 17 bp, Homo sapiens
gctcaataaatatttgt

SEQ ID NO: 5763516 - DNA, 20 bp, Homo sapiens
gctcaataaggcagtgcagt

SEQ ID NO: 5763517 - DNA, 23 bp, Homo sapiens
gctcaatagattgctcaaatcag

SEQ ID NO: 5763518 - DNA, 17 bp, Homo sapiens
gctcaatcatgtgccag

SEQ ID NO: 5763519 - DNA, 20 bp, Homo sapiens
gctcaatccatgttctattt

SEQ ID NO: 5763520 - DNA, 16 bp, Homo sapiens
gctcaatccctgagga

SEQ ID NO: 5763521 - DNA, 17 bp, Homo sapiens
gctcaatgaaaccttcc

SEQ ID NO: 5763522 - DNA, 21 bp, Homo sapiens
gctcaatgaaaccttcctctt

SEQ ID NO: 5763523 - DNA, 23 bp, Homo sapiens
gctcaatgcattgtcttgtggag

SEQ ID NO: 5763524 - DNA, 13 bp, Homo sapiens
gctcaatgcccag

SEQ ID NO: 5763525 - DNA, 17 bp, Homo sapiens
gctcaatggactggaag

SEQ ID NO: 5763526 - DNA, 19 bp, Homo sapiens
gctcaatgtgctgttgatt

SEQ ID NO: 5763527 - DNA, 14 bp, Homo sapiens
gctcacaaattccg

SEQ ID NO: 5763528 - DNA, 14 bp, Homo sapiens
gctcacaactgttt

SEQ ID NO: 5763529 - DNA, 15 bp, Homo sapiens
gctcacaagccgtgt

SEQ ID NO: 5763530 - DNA, 13 bp, Homo sapiens
gctcacaaggcag

SEQ ID NO: 5763531 - DNA, 14 bp, Homo sapiens
gctcacaaggcagc

SEQ ID NO: 5763532 - DNA, 19 bp, Homo sapiens
gctcacaaggcagcaaggc

SEQ ID NO: 5763533 - DNA, 21 bp, Homo sapiens
gctcacaaggcagcaaggccc

SEQ ID NO: 5763534 - DNA, 17 bp, Homo sapiens
gctcacaaggcccagga

SEQ ID NO: 5763535 - DNA, 18 bp, Homo sapiens
gctcacaaggcccaggag

SEQ ID NO: 5763536 - DNA, 14 bp, Homo sapiens
gctcacaagtgaaa

SEQ ID NO: 5763537 - DNA, 15 bp, Homo sapiens
gctcacaagtgaaaa

SEQ ID NO: 5763538 - DNA, 23 bp, Homo sapiens
gctcacaataaaaatggctcaga

SEQ ID NO: 5763539 - DNA, 19 bp, Homo sapiens
gctcacaatgttctggcac

SEQ ID NO: 5763540 - DNA, 17 bp, Homo sapiens
gctcacacatcctgtca

SEQ ID NO: 5763541 - DNA, 19 bp, Homo sapiens
gctcacacatcctgtcagt

SEQ ID NO: 5763542 - DNA, 13 bp, Homo sapiens
gctcacaccagcc

SEQ ID NO: 5763543 - DNA, 16 bp, Homo sapiens
gctcacaccagccctg

SEQ ID NO: 5763544 - DNA, 21 bp, Homo sapiens
gctcacaccctaccttcccca

SEQ ID NO: 5763545 - DNA, 21 bp, Homo sapiens
gctcacaccgcaccgggctgg

SEQ ID NO: 5763546 - DNA, 23 bp, Homo sapiens
gctcacaccgcaccgggctggcc

SEQ ID NO: 5763547 - DNA, 21 bp, Homo sapiens
gctcacaccggcactgtgcac

SEQ ID NO: 5763548 - DNA, 13 bp, Homo sapiens
gctcacacctgca

SEQ ID NO: 5763549 - DNA, 17 bp, Homo sapiens
gctcacacctgcaatcc

SEQ ID NO: 5763550 - DNA, 15 bp, Homo sapiens
gctcacacctgtcct

SEQ ID NO: 5763551 - DNA, 14 bp, Homo sapiens
gctcacactccagt

SEQ ID NO: 5763552 - DNA, 17 bp, Homo sapiens
gctcacactcctgggct

SEQ ID NO: 5763553 - DNA, 13 bp, Homo sapiens
gctcacactgaga

SEQ ID NO: 5763554 - DNA, 14 bp, Homo sapiens
gctcacactgagaa

SEQ ID NO: 5763555 - DNA, 19 bp, Homo sapiens
gctcacactgatgggctgg

SEQ ID NO: 5763556 - DNA, 16 bp, Homo sapiens
gctcacacttgggctg

SEQ ID NO: 5763557 - DNA, 20 bp, Homo sapiens
gctcacacttgggctggcac

SEQ ID NO: 5763558 - DNA, 22 bp, Homo sapiens
gctcacagaacccttggagcca

SEQ ID NO: 5763559 - DNA, 12 bp, Homo sapiens
gctcacagactg

SEQ ID NO: 5763560 - DNA, 17 bp, Homo sapiens
gctcacagactggagac

SEQ ID NO: 5763561 - DNA, 12 bp, Homo sapiens
gctcacagccac

SEQ ID NO: 5763562 - DNA, 14 bp, Homo sapiens
gctcacagccacca

SEQ ID NO: 5763563 - DNA, 16 bp, Homo sapiens
gctcacagggatgctg

SEQ ID NO: 5763564 - DNA, 21 bp, Homo sapiens
gctcacagggatgctggtggc

SEQ ID NO: 5763565 - DNA, 18 bp, Homo sapiens
gctcacagggcaggcctt

SEQ ID NO: 5763566 - DNA, 21 bp, Homo sapiens
gctcacagggcaggccttgct

SEQ ID NO: 5763567 - DNA, 22 bp, Homo sapiens
gctcacagggcaggccttgctg

SEQ ID NO: 5763568 - DNA, 22 bp, Homo sapiens
gctcacagtacagcatgtgcct

SEQ ID NO: 5763569 - DNA, 19 bp, Homo sapiens
gctcacatccagccttgga

SEQ ID NO: 5763570 - DNA, 16 bp, Homo sapiens
gctcacattccctctc

SEQ ID NO: 5763571 - DNA, 20 bp, Homo sapiens
gctcacattccctctcatcc

SEQ ID NO: 5763572 - DNA, 16 bp, Homo sapiens
gctcaccaattccact

SEQ ID NO: 5763573 - DNA, 13 bp, Homo sapiens
gctcaccacctgc

SEQ ID NO: 5763574 - DNA, 20 bp, Homo sapiens
gctcaccagccccagtgccc

SEQ ID NO: 5763575 - DNA, 13 bp, Homo sapiens
gctcaccagccct

SEQ ID NO: 5763576 - DNA, 16 bp, Homo sapiens
gctcaccagccctgca

SEQ ID NO: 5763577 - DNA, 22 bp, Homo sapiens
gctcaccaggcctggcctctgg

SEQ ID NO: 5763578 - DNA, 18 bp, Homo sapiens
gctcacccagccccaggg

SEQ ID NO: 5763579 - DNA, 15 bp, Homo sapiens
gctcacccaggacct

SEQ ID NO: 5763580 - DNA, 19 bp, Homo sapiens
gctcacccagtcacctccc

SEQ ID NO: 5763581 - DNA, 15 bp, Homo sapiens
gctcacccagtcctg

SEQ ID NO: 5763582 - DNA, 13 bp, Homo sapiens
gctcacccagtgc

SEQ ID NO: 5763583 - DNA, 17 bp, Homo sapiens
gctcaccccatcatccc

SEQ ID NO: 5763584 - DNA, 19 bp, Homo sapiens
gctcaccccatcatccctt

SEQ ID NO: 5763585 - DNA, 17 bp, Homo sapiens
gctcaccccccacactc

SEQ ID NO: 5763586 - DNA, 20 bp, Homo sapiens
gctcaccccccacactcact

SEQ ID NO: 5763587 - DNA, 12 bp, Homo sapiens
gctcacccctgg

SEQ ID NO: 5763588 - DNA, 15 bp, Homo sapiens
gctcacccctggagg

SEQ ID NO: 5763589 - DNA, 13 bp, Homo sapiens
gctcacccctggg

SEQ ID NO: 5763590 - DNA, 15 bp, Homo sapiens
gctcacccctgggca

SEQ ID NO: 5763591 - DNA, 18 bp, Homo sapiens
gctcacccctgggcaggc

SEQ ID NO: 5763592 - DNA, 19 bp, Homo sapiens
gctcacccctgggcaggcg

SEQ ID NO: 5763593 - DNA, 18 bp, Homo sapiens
gctcacccgtaggcaaat

SEQ ID NO: 5763594 - DNA, 13 bp, Homo sapiens
gctcaccctctct

SEQ ID NO: 5763595 - DNA, 14 bp, Homo sapiens
gctcaccctctctt

SEQ ID NO: 5763596 - DNA, 18 bp, Homo sapiens
gctcaccctgcccgctcc

SEQ ID NO: 5763597 - DNA, 15 bp, Homo sapiens
gctcaccctgctcct

SEQ ID NO: 5763598 - DNA, 16 bp, Homo sapiens
gctcaccctgctccta

SEQ ID NO: 5763599 - DNA, 19 bp, Homo sapiens
gctcaccgactcacctgcg

SEQ ID NO: 5763600 - DNA, 14 bp, Homo sapiens
gctcaccgcctgct

SEQ ID NO: 5763601 - DNA, 17 bp, Homo sapiens
gctcacctagagccaga

SEQ ID NO: 5763602 - DNA, 15 bp, Homo sapiens
gctcacctcagagca

SEQ ID NO: 5763603 - DNA, 14 bp, Homo sapiens
gctcacctctccct

SEQ ID NO: 5763604 - DNA, 21 bp, Homo sapiens
gctcacctcttctttaccaga

SEQ ID NO: 5763605 - DNA, 13 bp, Homo sapiens
gctcacctgcagc

SEQ ID NO: 5763606 - DNA, 19 bp, Homo sapiens
gctcacctgcagcccctcc

SEQ ID NO: 5763607 - DNA, 22 bp, Homo sapiens
gctcacctggggtgtgggaggc

SEQ ID NO: 5763608 - DNA, 23 bp, Homo sapiens
gctcacctgttgcttacaatttt

SEQ ID NO: 5763609 - DNA, 20 bp, Homo sapiens
gctcacctttgggcaaaggc

SEQ ID NO: 5763610 - DNA, 23 bp, Homo sapiens
gctcacgactcttcctgcaaagg

SEQ ID NO: 5763611 - DNA, 20 bp, Homo sapiens
gctcacgccccgctgtgtcc

SEQ ID NO: 5763612 - DNA, 21 bp, Homo sapiens
gctcacgccccgctgtgtcct

SEQ ID NO: 5763613 - DNA, 22 bp, Homo sapiens
gctcacgcctataatcccagca

SEQ ID NO: 5763614 - DNA, 15 bp, Homo sapiens
gctcacgcctgtaat

SEQ ID NO: 5763615 - DNA, 21 bp, Homo sapiens
gctcacgcctgtaatcccagc

SEQ ID NO: 5763616 - DNA, 12 bp, Homo sapiens
gctcacgcctta

SEQ ID NO: 5763617 - DNA, 16 bp, Homo sapiens
gctcacgcgttctggg

SEQ ID NO: 5763618 - DNA, 19 bp, Homo sapiens
gctcacgctgacagcctcc

SEQ ID NO: 5763619 - DNA, 15 bp, Homo sapiens
gctcacggggcctcc

SEQ ID NO: 5763620 - DNA, 22 bp, Homo sapiens
gctcacggggcctccaacccat

SEQ ID NO: 5763621 - DNA, 15 bp, Homo sapiens
gctcacgtcacactt

SEQ ID NO: 5763622 - DNA, 16 bp, Homo sapiens
gctcacgtctctgccg

SEQ ID NO: 5763623 - DNA, 16 bp, Homo sapiens
gctcacgtctgtgagt

SEQ ID NO: 5763624 - DNA, 22 bp, Homo sapiens
gctcacgtctgtgagtctgtcc

SEQ ID NO: 5763625 - DNA, 22 bp, Homo sapiens
gctcacgtgagagtgtcttcac

SEQ ID NO: 5763626 - DNA, 14 bp, Homo sapiens
gctcacgtgtcctt

SEQ ID NO: 5763627 - DNA, 17 bp, Homo sapiens
gctcacgtgtccttaac

SEQ ID NO: 5763628 - DNA, 20 bp, Homo sapiens
gctcactacatgggccagcc

SEQ ID NO: 5763629 - DNA, 21 bp, Homo sapiens
gctcactacatgggccagccc

SEQ ID NO: 5763630 - DNA, 16 bp, Homo sapiens
gctcactacctcctca

SEQ ID NO: 5763631 - DNA, 17 bp, Homo sapiens
gctcactatgaatctat

SEQ ID NO: 5763632 - DNA, 18 bp, Homo sapiens
gctcactatggtgccaat

SEQ ID NO: 5763633 - DNA, 13 bp, Homo sapiens
gctcactcacccc

SEQ ID NO: 5763634 - DNA, 18 bp, Homo sapiens
gctcactcactcactcca

SEQ ID NO: 5763635 - DNA, 19 bp, Homo sapiens
gctcactcccaagggacag

SEQ ID NO: 5763636 - DNA, 22 bp, Homo sapiens
gctcactcccaagggacagcaa

SEQ ID NO: 5763637 - DNA, 12 bp, Homo sapiens
gctcactcccta

SEQ ID NO: 5763638 - DNA, 21 bp, Homo sapiens
gctcactcggacgacgccctg

SEQ ID NO: 5763639 - DNA, 13 bp, Homo sapiens
gctcactctggcc

SEQ ID NO: 5763640 - DNA, 14 bp, Homo sapiens
gctcactctggccc

SEQ ID NO: 5763641 - DNA, 17 bp, Homo sapiens
gctcactgaaacctctg

SEQ ID NO: 5763642 - DNA, 19 bp, Homo sapiens
gctcactgaaacctctgcc

SEQ ID NO: 5763643 - DNA, 20 bp, Homo sapiens
gctcactgagtgatacttta

SEQ ID NO: 5763644 - DNA, 18 bp, Homo sapiens
gctcactgcaacctccac

SEQ ID NO: 5763645 - DNA, 21 bp, Homo sapiens
gctcactgcaacctctgcctc

SEQ ID NO: 5763646 - DNA, 23 bp, Homo sapiens
gctcactgcaacctctgcctcct

SEQ ID NO: 5763647 - DNA, 18 bp, Homo sapiens
gctcactgcaagctctgc

SEQ ID NO: 5763648 - DNA, 16 bp, Homo sapiens
gctcactgcagcctca

SEQ ID NO: 5763649 - DNA, 17 bp, Homo sapiens
gctcactgcagcctcat

SEQ ID NO: 5763650 - DNA, 17 bp, Homo sapiens
gctcactgcagcctctg

SEQ ID NO: 5763651 - DNA, 18 bp, Homo sapiens
gctcactgcagcctctgc

SEQ ID NO: 5763652 - DNA, 16 bp, Homo sapiens
gctcactgcagccttg

SEQ ID NO: 5763653 - DNA, 21 bp, Homo sapiens
gctcactgcagcgcgctcctg

SEQ ID NO: 5763654 - DNA, 12 bp, Homo sapiens
gctcactgccag

SEQ ID NO: 5763655 - DNA, 13 bp, Homo sapiens
gctcactgccagg

SEQ ID NO: 5763656 - DNA, 15 bp, Homo sapiens
gctcactgccaggcc

SEQ ID NO: 5763657 - DNA, 20 bp, Homo sapiens
gctcactgccaggccagcct

SEQ ID NO: 5763658 - DNA, 23 bp, Homo sapiens
gctcactgccaggccagcctccg

SEQ ID NO: 5763659 - DNA, 17 bp, Homo sapiens
gctcactggctgggagt

SEQ ID NO: 5763660 - DNA, 13 bp, Homo sapiens
gctcactgtccac

SEQ ID NO: 5763661 - DNA, 15 bp, Homo sapiens
gctcactgtgctggg

SEQ ID NO: 5763662 - DNA, 18 bp, Homo sapiens
gctcactgtgctggggca

SEQ ID NO: 5763663 - DNA, 19 bp, Homo sapiens
gctcactgtgtataggaat

SEQ ID NO: 5763664 - DNA, 21 bp, Homo sapiens
gctcactgtgtataggaattt

SEQ ID NO: 5763665 - DNA, 22 bp, Homo sapiens
gctcacttaaacaatgtcctct

SEQ ID NO: 5763666 - DNA, 15 bp, Homo sapiens
gctcacttctgggct

SEQ ID NO: 5763667 - DNA, 20 bp, Homo sapiens
gctcacttttcatccttccc

SEQ ID NO: 5763668 - DNA, 10 bp, Homo sapiens
gctcagaaaa

SEQ ID NO: 5763669 - DNA, 12 bp, Homo sapiens
gctcagaacaca

SEQ ID NO: 5763670 - DNA, 21 bp, Homo sapiens
gctcagaacaccccgctctgg

SEQ ID NO: 5763671 - DNA, 23 bp, Homo sapiens
gctcagaacaccccgctctggca

SEQ ID NO: 5763672 - DNA, 15 bp, Homo sapiens
gctcagaacccaggg

SEQ ID NO: 5763673 - DNA, 16 bp, Homo sapiens
gctcagaacccagggc

SEQ ID NO: 5763674 - DNA, 22 bp, Homo sapiens
gctcagaacccagggctctgcc

SEQ ID NO: 5763675 - DNA, 19 bp, Homo sapiens
gctcagaagccagtctgcg

SEQ ID NO: 5763676 - DNA, 21 bp, Homo sapiens
gctcagaaggctcttctgact

SEQ ID NO: 5763677 - DNA, 16 bp, Homo sapiens
gctcagacatgttttc

SEQ ID NO: 5763678 - DNA, 18 bp, Homo sapiens
gctcagacccctcagccc

SEQ ID NO: 5763679 - DNA, 21 bp, Homo sapiens
gctcagacccctcagccccag

SEQ ID NO: 5763680 - DNA, 18 bp, Homo sapiens
gctcagacgagacaccct

SEQ ID NO: 5763681 - DNA, 14 bp, Homo sapiens
gctcagactgggca

SEQ ID NO: 5763682 - DNA, 21 bp, Homo sapiens
gctcagactgggcactggggc

SEQ ID NO: 5763683 - DNA, 22 bp, Homo sapiens
gctcagactgggcactggggcc

SEQ ID NO: 5763684 - DNA, 16 bp, Homo sapiens
gctcagagaggacaaa

SEQ ID NO: 5763685 - DNA, 19 bp, Homo sapiens
gctcagagagggcaggcat

SEQ ID NO: 5763686 - DNA, 14 bp, Homo sapiens
gctcagagagggtg

SEQ ID NO: 5763687 - DNA, 15 bp, Homo sapiens
gctcagagagggtgg

SEQ ID NO: 5763688 - DNA, 20 bp, Homo sapiens
gctcagagagtacactgtgt

SEQ ID NO: 5763689 - DNA, 21 bp, Homo sapiens
gctcagagagtacactgtgtc

SEQ ID NO: 5763690 - DNA, 22 bp, Homo sapiens
gctcagagagtacactgtgtct

SEQ ID NO: 5763691 - DNA, 20 bp, Homo sapiens
gctcagagccaagggggcag

SEQ ID NO: 5763692 - DNA, 12 bp, Homo sapiens
gctcagagcccc

SEQ ID NO: 5763693 - DNA, 15 bp, Homo sapiens
gctcagagctaggcc

SEQ ID NO: 5763694 - DNA, 20 bp, Homo sapiens
gctcagagctgctgagcagg

SEQ ID NO: 5763695 - DNA, 17 bp, Homo sapiens
gctcagagctttaaaag

SEQ ID NO: 5763696 - DNA, 18 bp, Homo sapiens
gctcagagctttaaaagt

SEQ ID NO: 5763697 - DNA, 16 bp, Homo sapiens
gctcagagctttgtca

SEQ ID NO: 5763698 - DNA, 16 bp, Homo sapiens
gctcagaggcccagga

SEQ ID NO: 5763699 - DNA, 18 bp, Homo sapiens
gctcagaggccttgctgt

SEQ ID NO: 5763700 - DNA, 19 bp, Homo sapiens
gctcagaggccttgctgtg

SEQ ID NO: 5763701 - DNA, 21 bp, Homo sapiens
gctcagaggcgcactgtgacc

SEQ ID NO: 5763702 - DNA, 16 bp, Homo sapiens
gctcagaggggccccg

SEQ ID NO: 5763703 - DNA, 14 bp, Homo sapiens
gctcagaggggcct

SEQ ID NO: 5763704 - DNA, 18 bp, Homo sapiens
gctcagagggtgtcctgc

SEQ ID NO: 5763705 - DNA, 19 bp, Homo sapiens
gctcagagggtgtcctgca

SEQ ID NO: 5763706 - DNA, 19 bp, Homo sapiens
gctcagagtgaagagtgaa

SEQ ID NO: 5763707 - DNA, 15 bp, Homo sapiens
gctcagagtgaccct

SEQ ID NO: 5763708 - DNA, 20 bp, Homo sapiens
gctcagagtgaccctcagct

SEQ ID NO: 5763709 - DNA, 18 bp, Homo sapiens
gctcagataatgcccaga

SEQ ID NO: 5763710 - DNA, 16 bp, Homo sapiens
gctcagatggactggg

SEQ ID NO: 5763711 - DNA, 18 bp, Homo sapiens
gctcagatggggcctggg

SEQ ID NO: 5763712 - DNA, 22 bp, Homo sapiens
gctcagcaaaagatgcttctca

SEQ ID NO: 5763713 - DNA, 14 bp, Homo sapiens
gctcagcaaggcca

SEQ ID NO: 5763714 - DNA, 18 bp, Homo sapiens
gctcagcaaggccacctc

SEQ ID NO: 5763715 - DNA, 21 bp, Homo sapiens
gctcagcacagcctcacccct

SEQ ID NO: 5763716 - DNA, 22 bp, Homo sapiens
gctcagcacagcctcacccctg

SEQ ID NO: 5763717 - DNA, 17 bp, Homo sapiens
gctcagcactgcctgct

SEQ ID NO: 5763718 - DNA, 18 bp, Homo sapiens
gctcagcactgcctgctc

SEQ ID NO: 5763719 - DNA, 19 bp, Homo sapiens
gctcagcactgcctgctcc

SEQ ID NO: 5763720 - DNA, 20 bp, Homo sapiens
gctcagcactgcctgctccc

SEQ ID NO: 5763721 - DNA, 22 bp, Homo sapiens
gctcagcactgcctgctcccat

SEQ ID NO: 5763722 - DNA, 12 bp, Homo sapiens
gctcagcagcca

SEQ ID NO: 5763723 - DNA, 12 bp, Homo sapiens
gctcagcagccc

SEQ ID NO: 5763724 - DNA, 12 bp, Homo sapiens
gctcagcagggc

SEQ ID NO: 5763725 - DNA, 18 bp, Homo sapiens
gctcagcagggctggtca

SEQ ID NO: 5763726 - DNA, 17 bp, Homo sapiens
gctcagcagtgactgtg

SEQ ID NO: 5763727 - DNA, 19 bp, Homo sapiens
gctcagcagttcacttcct

SEQ ID NO: 5763728 - DNA, 14 bp, Homo sapiens
gctcagcatcctcc

SEQ ID NO: 5763729 - DNA, 19 bp, Homo sapiens
gctcagccaaatttcctgt

SEQ ID NO: 5763730 - DNA, 13 bp, Homo sapiens
gctcagccagcac

SEQ ID NO: 5763731 - DNA, 15 bp, Homo sapiens
gctcagccagcactt

SEQ ID NO: 5763732 - DNA, 22 bp, Homo sapiens
gctcagccaggtgctgtgacac

SEQ ID NO: 5763733 - DNA, 11 bp, Homo sapiens
gctcagccagt

SEQ ID NO: 5763734 - DNA, 11 bp, Homo sapiens
gctcagcccac

SEQ ID NO: 5763735 - DNA, 14 bp, Homo sapiens
gctcagcccacccc

SEQ ID NO: 5763736 - DNA, 17 bp, Homo sapiens
gctcagcccacccccct

SEQ ID NO: 5763737 - DNA, 20 bp, Homo sapiens
gctcagcccatcccctgcct

SEQ ID NO: 5763738 - DNA, 22 bp, Homo sapiens
gctcagcccatcccctgcctct

SEQ ID NO: 5763739 - DNA, 21 bp, Homo sapiens
gctcagccccaccccagggca

SEQ ID NO: 5763740 - DNA, 20 bp, Homo sapiens
gctcagccccagcttatctc

SEQ ID NO: 5763741 - DNA, 22 bp, Homo sapiens
gctcagccccaggccagctgcg

SEQ ID NO: 5763742 - DNA, 18 bp, Homo sapiens
gctcagccccggccactc

SEQ ID NO: 5763743 - DNA, 22 bp, Homo sapiens
gctcagccccggccactccctg

SEQ ID NO: 5763744 - DNA, 17 bp, Homo sapiens
gctcagcccgcttggcc

SEQ ID NO: 5763745 - DNA, 11 bp, Homo sapiens
gctcagcccta

SEQ ID NO: 5763746 - DNA, 21 bp, Homo sapiens
gctcagccctagccctcagcc

SEQ ID NO: 5763747 - DNA, 12 bp, Homo sapiens
gctcagccctcc

SEQ ID NO: 5763748 - DNA, 16 bp, Homo sapiens
gctcagccctgactgg

SEQ ID NO: 5763749 - DNA, 14 bp, Homo sapiens
gctcagccctgagc

SEQ ID NO: 5763750 - DNA, 16 bp, Homo sapiens
gctcagccctgagcta

SEQ ID NO: 5763751 - DNA, 22 bp, Homo sapiens
gctcatccctggacttctggga

SEQ ID NO: 5763752 - DNA, 23 bp, Homo sapiens
gctcatccctggacttctgggag

SEQ ID NO: 5763753 - DNA, 20 bp, Homo sapiens
gctcatcctgtagggcaccc

SEQ ID NO: 5763754 - DNA, 17 bp, Homo sapiens
gctcatcggtggaagca

SEQ ID NO: 5763755 - DNA, 13 bp, Homo sapiens
gctcatctctgga

SEQ ID NO: 5763756 - DNA, 16 bp, Homo sapiens
gctcatctctggaagg

SEQ ID NO: 5763757 - DNA, 21 bp, Homo sapiens
gctcatctctggaaggggcag

SEQ ID NO: 5763758 - DNA, 16 bp, Homo sapiens
gctcatctctgtccca

SEQ ID NO: 5763759 - DNA, 16 bp, Homo sapiens
gctcatctgagccagc

SEQ ID NO: 5763760 - DNA, 23 bp, Homo sapiens
gctcatctgatattcaaacacac

SEQ ID NO: 5763761 - DNA, 18 bp, Homo sapiens
gctcatctgccaaaatgt

SEQ ID NO: 5763762 - DNA, 13 bp, Homo sapiens
gctcatctgctgg

SEQ ID NO: 5763763 - DNA, 16 bp, Homo sapiens
gctcatcttttcctgc

SEQ ID NO: 5763764 - DNA, 15 bp, Homo sapiens
gctcatgagggccca

SEQ ID NO: 5763765 - DNA, 16 bp, Homo sapiens
gctcatgccccttggg

SEQ ID NO: 5763766 - DNA, 21 bp, Homo sapiens
gctcatggcgtaatgggcctg

SEQ ID NO: 5763767 - DNA, 22 bp, Homo sapiens
gctcatggcgtaatgggcctgc

SEQ ID NO: 5763768 - DNA, 20 bp, Homo sapiens
gctcatggctgtgtccactg

SEQ ID NO: 5763769 - DNA, 20 bp, Homo sapiens
gctcatgtaggtgagcctgg

SEQ ID NO: 5763770 - DNA, 22 bp, Homo sapiens
gctcatgtccctgtccccaggc

SEQ ID NO: 5763771 - DNA, 17 bp, Homo sapiens
gctcatgtcctgtcctg

SEQ ID NO: 5763772 - DNA, 14 bp, Homo sapiens
gctcatgtctgaaa

SEQ ID NO: 5763773 - DNA, 21 bp, Homo sapiens
gctcatgtgtccctggcgctg

SEQ ID NO: 5763774 - DNA, 15 bp, Homo sapiens
gctcatgttgagcca

SEQ ID NO: 5763775 - DNA, 18 bp, Homo sapiens
gctcatgttgagccagtg

SEQ ID NO: 5763776 - DNA, 15 bp, Homo sapiens
gctcatgttggccaa

SEQ ID NO: 5763777 - DNA, 14 bp, Homo sapiens
gctcattaaacttt

SEQ ID NO: 5763778 - DNA, 15 bp, Homo sapiens
gctcattacagttct

SEQ ID NO: 5763779 - DNA, 21 bp, Homo sapiens
gctcattataatgtcattaaa

SEQ ID NO: 5763780 - DNA, 16 bp, Homo sapiens
gctcattatgccactt

SEQ ID NO: 5763781 - DNA, 16 bp, Homo sapiens
gctcattcagcatctg

SEQ ID NO: 5763782 - DNA, 19 bp, Homo sapiens
gctcattcatattcctgcc

SEQ ID NO: 5763783 - DNA, 20 bp, Homo sapiens
gctcattcatattcctgcct

SEQ ID NO: 5763784 - DNA, 16 bp, Homo sapiens
gctcattccatgactc

SEQ ID NO: 5763785 - DNA, 20 bp, Homo sapiens
gctcattccatgactctgcc

SEQ ID NO: 5763786 - DNA, 14 bp, Homo sapiens
gctcattctaatga

SEQ ID NO: 5763787 - DNA, 18 bp, Homo sapiens
gctcattctaatgatggc

SEQ ID NO: 5763788 - DNA, 16 bp, Homo sapiens
gctcattctgcacctt

SEQ ID NO: 5763789 - DNA, 18 bp, Homo sapiens
gctcattcttcagttctc

SEQ ID NO: 5763790 - DNA, 12 bp, Homo sapiens
gctcatttaagt

SEQ ID NO: 5763791 - DNA, 17 bp, Homo sapiens
gctcatttactgtttta

SEQ ID NO: 5763792 - DNA, 15 bp, Homo sapiens
gctcattttctggtt

SEQ ID NO: 5763793 - DNA, 23 bp, Homo sapiens
gctcattttgacaaagtgcctca

SEQ ID NO: 5763794 - DNA, 18 bp, Homo sapiens
gctcatttttgcacttat

SEQ ID NO: 5763795 - DNA, 14 bp, Homo sapiens
gctcatttttgctg

SEQ ID NO: 5763796 - DNA, 13 bp, Homo sapiens
gctccaaaccctc

SEQ ID NO: 5763797 - DNA, 17 bp, Homo sapiens
gctccaaagtcataatt

SEQ ID NO: 5763798 - DNA, 21 bp, Homo sapiens
gctccaacccccgccacctca

SEQ ID NO: 5763799 - DNA, 15 bp, Homo sapiens
gctccaacctgcaaa

SEQ ID NO: 5763800 - DNA, 18 bp, Homo sapiens
gctccaactccacaccct

SEQ ID NO: 5763801 - DNA, 20 bp, Homo sapiens
gctccaactcctttcagcca

SEQ ID NO: 5763802 - DNA, 21 bp, Homo sapiens
gctccaactcctttcagccac

SEQ ID NO: 5763803 - DNA, 23 bp, Homo sapiens
gctccaactgaattgctatcatt

SEQ ID NO: 5763804 - DNA, 14 bp, Homo sapiens
gctccaagaatttc

SEQ ID NO: 5763805 - DNA, 14 bp, Homo sapiens
gctccaagacctag

SEQ ID NO: 5763806 - DNA, 13 bp, Homo sapiens
gctccaagagaat

SEQ ID NO: 5763807 - DNA, 19 bp, Homo sapiens
gctccaagctcccaggcat

SEQ ID NO: 5763808 - DNA, 16 bp, Homo sapiens
gctccaagctgttaaa

SEQ ID NO: 5763809 - DNA, 15 bp, Homo sapiens
gctccaagggacagg

SEQ ID NO: 5763810 - DNA, 21 bp, Homo sapiens
gctccaagggacaggtgggcc

SEQ ID NO: 5763811 - DNA, 21 bp, Homo sapiens
gctccaaggggaatcagaact

SEQ ID NO: 5763812 - DNA, 17 bp, Homo sapiens
gctccaagttgagactc

SEQ ID NO: 5763813 - DNA, 23 bp, Homo sapiens
gctccaatgactgagcagcatcc

SEQ ID NO: 5763814 - DNA, 19 bp, Homo sapiens
gctccaatggggcggggct

SEQ ID NO: 5763815 - DNA, 15 bp, Homo sapiens
gctccacacagcagt

SEQ ID NO: 5763816 - DNA, 22 bp, Homo sapiens
gctccacacattccagccaggc

SEQ ID NO: 5763817 - DNA, 16 bp, Homo sapiens
gctccacaccctctcc

SEQ ID NO: 5763818 - DNA, 22 bp, Homo sapiens
gctccacaccctctcccaggac

SEQ ID NO: 5763819 - DNA, 14 bp, Homo sapiens
gctccacacgcccc

SEQ ID NO: 5763820 - DNA, 16 bp, Homo sapiens
gctccacacgccccgg

SEQ ID NO: 5763821 - DNA, 17 bp, Homo sapiens
gctccacacgccccggt

SEQ ID NO: 5763822 - DNA, 21 bp, Homo sapiens
gctccacagaaaccctgtttt

SEQ ID NO: 5763823 - DNA, 19 bp, Homo sapiens
gctccaccaagaaagcagg

SEQ ID NO: 5763824 - DNA, 14 bp, Homo sapiens
gctccaccactgtg

SEQ ID NO: 5763825 - DNA, 14 bp, Homo sapiens
gctccaccagcagc

SEQ ID NO: 5763826 - DNA, 15 bp, Homo sapiens
gctccaccagcagca

SEQ ID NO: 5763827 - DNA, 23 bp, Homo sapiens
gctccaccagcatcacctgcctg

SEQ ID NO: 5763828 - DNA, 15 bp, Homo sapiens
gctccaccccactca

SEQ ID NO: 5763829 - DNA, 16 bp, Homo sapiens
gctccaccccactcac

SEQ ID NO: 5763830 - DNA, 20 bp, Homo sapiens
gctccaccccactcacagag

SEQ ID NO: 5763831 - DNA, 14 bp, Homo sapiens
gctccaccctcccc

SEQ ID NO: 5763832 - DNA, 16 bp, Homo sapiens
gctccaccctcccctc

SEQ ID NO: 5763833 - DNA, 20 bp, Homo sapiens
gctccaccctcccctcttct

SEQ ID NO: 5763834 - DNA, 17 bp, Homo sapiens
gctccacccttggcctg

SEQ ID NO: 5763835 - DNA, 14 bp, Homo sapiens
gctccacctgttca

SEQ ID NO: 5763836 - DNA, 14 bp, Homo sapiens
gctccaccttgatg

SEQ ID NO: 5763837 - DNA, 17 bp, Homo sapiens
gctccacgccctgggga

SEQ ID NO: 5763838 - DNA, 15 bp, Homo sapiens
gctccacgggcaggg

SEQ ID NO: 5763839 - DNA, 17 bp, Homo sapiens
gctccacgggcaggggt

SEQ ID NO: 5763840 - DNA, 20 bp, Homo sapiens
gctccacgggggcctagtgg

SEQ ID NO: 5763841 - DNA, 19 bp, Homo sapiens
gctccacgtctgcgccgcc

SEQ ID NO: 5763842 - DNA, 18 bp, Homo sapiens
gctccactcagggctggc

SEQ ID NO: 5763843 - DNA, 21 bp, Homo sapiens
gctccactctgaagtcccttc

SEQ ID NO: 5763844 - DNA, 15 bp, Homo sapiens
gctccactctgcttc

SEQ ID NO: 5763845 - DNA, 19 bp, Homo sapiens
gctccactcttgatctctc

SEQ ID NO: 5763846 - DNA, 20 bp, Homo sapiens
gctccactcttgatctctct

SEQ ID NO: 5763847 - DNA, 21 bp, Homo sapiens
gctccactcttgatctctctt

SEQ ID NO: 5763848 - DNA, 18 bp, Homo sapiens
gctccactgtcaccctcc

SEQ ID NO: 5763849 - DNA, 15 bp, Homo sapiens
gctccacttggtctg

SEQ ID NO: 5763850 - DNA, 17 bp, Homo sapiens
gctccagaagatgccag

SEQ ID NO: 5763851 - DNA, 21 bp, Homo sapiens
gctccagaagatgccagcttc

SEQ ID NO: 5763852 - DNA, 23 bp, Homo sapiens
gctccagaagatgccagcttctc

SEQ ID NO: 5763853 - DNA, 17 bp, Homo sapiens
gctccagaatgtgctgc

SEQ ID NO: 5763854 - DNA, 21 bp, Homo sapiens
gctccagaatgtgctgccttt

SEQ ID NO: 5763855 - DNA, 19 bp, Homo sapiens
gctccagaatttggaaatc

SEQ ID NO: 5763856 - DNA, 9 bp, Homo sapiens
gctccagac

SEQ ID NO: 5763857 - DNA, 21 bp, Homo sapiens
gctccagacacatgtccaaga

SEQ ID NO: 5763858 - DNA, 17 bp, Homo sapiens
gctccagacccccagca

SEQ ID NO: 5763859 - DNA, 22 bp, Homo sapiens
gctccagacgtaggggaggggt

SEQ ID NO: 5763860 - DNA, 15 bp, Homo sapiens
gctccagaggacctg

SEQ ID NO: 5763861 - DNA, 21 bp, Homo sapiens
gctccagagggcactcagaag

SEQ ID NO: 5763862 - DNA, 21 bp, Homo sapiens
gctccagagggcactctgctt

SEQ ID NO: 5763863 - DNA, 19 bp, Homo sapiens
gctccagagtaggtgggtc

SEQ ID NO: 5763864 - DNA, 17 bp, Homo sapiens
gctccagatctgcactg

SEQ ID NO: 5763865 - DNA, 21 bp, Homo sapiens
gctccagatgcagggcagtca

SEQ ID NO: 5763866 - DNA, 22 bp, Homo sapiens
gctccagatgcagggcagtcat

SEQ ID NO: 5763867 - DNA, 23 bp, Homo sapiens
gctccagcaacacagcctgggcc

SEQ ID NO: 5763868 - DNA, 23 bp, Homo sapiens
gctccagcaagcaaacagggtgg

SEQ ID NO: 5763869 - DNA, 19 bp, Homo sapiens
gctccagcaccatccgcca

SEQ ID NO: 5763870 - DNA, 15 bp, Homo sapiens
gctccagcaccttct

SEQ ID NO: 5763871 - DNA, 16 bp, Homo sapiens
gctccagcagcacacc

SEQ ID NO: 5763872 - DNA, 19 bp, Homo sapiens
gctccagcaggaaggaccc

SEQ ID NO: 5763873 - DNA, 20 bp, Homo sapiens
gctccagcaggaaggacccc

SEQ ID NO: 5763874 - DNA, 21 bp, Homo sapiens
gctccagcaggaaggacccca

SEQ ID NO: 5763875 - DNA, 15 bp, Homo sapiens
gctccagcagtgctg

SEQ ID NO: 5763876 - DNA, 20 bp, Homo sapiens
gctccagcagtgctgggccc

SEQ ID NO: 5763877 - DNA, 18 bp, Homo sapiens
gctccagcatccagcctg

SEQ ID NO: 5763878 - DNA, 22 bp, Homo sapiens
gctccagcatccagcctgtgtg

SEQ ID NO: 5763879 - DNA, 14 bp, Homo sapiens
gctccagccaaccc

SEQ ID NO: 5763880 - DNA, 22 bp, Homo sapiens
gctccagccaacccctgtggag

SEQ ID NO: 5763881 - DNA, 23 bp, Homo sapiens
gctccagccaacccctgtggagc

SEQ ID NO: 5763882 - DNA, 12 bp, Homo sapiens
gctccagcccag

SEQ ID NO: 5763883 - DNA, 13 bp, Homo sapiens
gctccagcccctt

SEQ ID NO: 5763884 - DNA, 11 bp, Homo sapiens
gctccagcctg

SEQ ID NO: 5763885 - DNA, 13 bp, Homo sapiens
gctccagcctgac

SEQ ID NO: 5763886 - DNA, 15 bp, Homo sapiens
gctccagcctgacaa

SEQ ID NO: 5763887 - DNA, 22 bp, Homo sapiens
gctccagcctgacaacagcctg

SEQ ID NO: 5763888 - DNA, 15 bp, Homo sapiens
gctccagcctggctc

SEQ ID NO: 5763889 - DNA, 21 bp, Homo sapiens
gctccagcgatctctccactg

SEQ ID NO: 5763890 - DNA, 12 bp, Homo sapiens
gctccagcgttt

SEQ ID NO: 5763891 - DNA, 20 bp, Homo sapiens
gctccagctgctctgtcttc

SEQ ID NO: 5763892 - DNA, 17 bp, Homo sapiens
gctccagctggccggga

SEQ ID NO: 5763893 - DNA, 17 bp, Homo sapiens
gctccagctttctgcca

SEQ ID NO: 5763894 - DNA, 11 bp, Homo sapiens
gctccaggaca

SEQ ID NO: 5763895 - DNA, 19 bp, Homo sapiens
gctccaggactccactgga

SEQ ID NO: 5763896 - DNA, 21 bp, Homo sapiens
gctccaggactccactggaca

SEQ ID NO: 5763897 - DNA, 11 bp, Homo sapiens
gctccaggagc

SEQ ID NO: 5763898 - DNA, 16 bp, Homo sapiens
gctccaggatctttga

SEQ ID NO: 5763899 - DNA, 15 bp, Homo sapiens
gctccaggcacccag

SEQ ID NO: 5763900 - DNA, 15 bp, Homo sapiens
gctccaggcagaagg

SEQ ID NO: 5763901 - DNA, 17 bp, Homo sapiens
gctccaggccagggggc

SEQ ID NO: 5763902 - DNA, 15 bp, Homo sapiens
gctccaggcctgcag

SEQ ID NO: 5763903 - DNA, 22 bp, Homo sapiens
gctccaggcctgcagcaggagt

SEQ ID NO: 5763904 - DNA, 17 bp, Homo sapiens
gctccaggctccaggct

SEQ ID NO: 5763905 - DNA, 18 bp, Homo sapiens
gctccaggctccaggctg

SEQ ID NO: 5763906 - DNA, 24 bp, Homo sapiens
gctccaggctcctttagcgcccag

SEQ ID NO: 5763907 - DNA, 14 bp, Homo sapiens
gctccaggctggct

SEQ ID NO: 5763908 - DNA, 13 bp, Homo sapiens
gctccaggcttcc

SEQ ID NO: 5763909 - DNA, 20 bp, Homo sapiens
gctccagggaatccaagcct

SEQ ID NO: 5763910 - DNA, 21 bp, Homo sapiens
gctccagggaatccaagcctc

SEQ ID NO: 5763911 - DNA, 23 bp, Homo sapiens
gctccagggaatccaagcctcca

SEQ ID NO: 5763912 - DNA, 12 bp, Homo sapiens
gctccagggact

SEQ ID NO: 5763913 - DNA, 12 bp, Homo sapiens
gctccagggagt

SEQ ID NO: 5763914 - DNA, 21 bp, Homo sapiens
gctccagggagtggggaggag

SEQ ID NO: 5763915 - DNA, 19 bp, Homo sapiens
gctccagggatgattcaag

SEQ ID NO: 5763916 - DNA, 13 bp, Homo sapiens
gctccagggccag

SEQ ID NO: 5763917 - DNA, 23 bp, Homo sapiens
gctccaggggcccttgggacagc

SEQ ID NO: 5763918 - DNA, 19 bp, Homo sapiens
gctccagggggtgccctcc

SEQ ID NO: 5763919 - DNA, 23 bp, Homo sapiens
gctccagggggtgccctcccaga

SEQ ID NO: 5763920 - DNA, 21 bp, Homo sapiens
gctccaggtccggaggggttg

SEQ ID NO: 5763921 - DNA, 15 bp, Homo sapiens
gctccaggtggctct

SEQ ID NO: 5763922 - DNA, 21 bp, Homo sapiens
gctccaggtggctctgaggtg

SEQ ID NO: 5763923 - DNA, 14 bp, Homo sapiens
gctccagtataaat

SEQ ID NO: 5763924 - DNA, 21 bp, Homo sapiens
gctccagtcctgctctctacc

SEQ ID NO: 5763925 - DNA, 23 bp, Homo sapiens
gctccagtcctgctctctaccca

SEQ ID NO: 5763926 - DNA, 18 bp, Homo sapiens
gctccagtctgctgccct

SEQ ID NO: 5763927 - DNA, 18 bp, Homo sapiens
gctcccctaaagccaggc

SEQ ID NO: 5763928 - DNA, 18 bp, Homo sapiens
gctcccctagacatggcc

SEQ ID NO: 5763929 - DNA, 12 bp, Homo sapiens
gctcccctccaa

SEQ ID NO: 5763930 - DNA, 23 bp, Homo sapiens
gctcccctccatccccatcggcc

SEQ ID NO: 5763931 - DNA, 18 bp, Homo sapiens
gctcccctcccaggggag

SEQ ID NO: 5763932 - DNA, 18 bp, Homo sapiens
gctcccctcctctcccct

SEQ ID NO: 5763933 - DNA, 18 bp, Homo sapiens
gctcccctcgacagctct

SEQ ID NO: 5763934 - DNA, 20 bp, Homo sapiens
gctcccctcgacagctctct

SEQ ID NO: 5763935 - DNA, 19 bp, Homo sapiens
gctcccctctatttagcat

SEQ ID NO: 5763936 - DNA, 21 bp, Homo sapiens
gctcccctctatttagcatga

SEQ ID NO: 5763937 - DNA, 12 bp, Homo sapiens
gctcccctctgc

SEQ ID NO: 5763938 - DNA, 13 bp, Homo sapiens
gctcccctctgcc

SEQ ID NO: 5763939 - DNA, 18 bp, Homo sapiens
gctcccctctgcttctca

SEQ ID NO: 5763940 - DNA, 15 bp, Homo sapiens
gctcccctctggaat

SEQ ID NO: 5763941 - DNA, 16 bp, Homo sapiens
gctcccctcttcctct

SEQ ID NO: 5763942 - DNA, 12 bp, Homo sapiens
gctcccctgagg

SEQ ID NO: 5763943 - DNA, 23 bp, Homo sapiens
gctcccctgaggctggcatcctg

SEQ ID NO: 5763944 - DNA, 16 bp, Homo sapiens
gctcccctgcagccct

SEQ ID NO: 5763945 - DNA, 19 bp, Homo sapiens
gctcccctgcagccctggc

SEQ ID NO: 5763946 - DNA, 18 bp, Homo sapiens
gctcccctgcccagcctg

SEQ ID NO: 5763947 - DNA, 16 bp, Homo sapiens
gctcccctgcccgccc

SEQ ID NO: 5763948 - DNA, 23 bp, Homo sapiens
gctcccctgccttaacctgggac

SEQ ID NO: 5763949 - DNA, 15 bp, Homo sapiens
gctcccctgctcggc

SEQ ID NO: 5763950 - DNA, 18 bp, Homo sapiens
gctcccctgctgaggcag

SEQ ID NO: 5763951 - DNA, 13 bp, Homo sapiens
gctcccctggctg

SEQ ID NO: 5763952 - DNA, 16 bp, Homo sapiens
gctcccctggctggct

SEQ ID NO: 5763953 - DNA, 13 bp, Homo sapiens
gctccccttcccc

SEQ ID NO: 5763954 - DNA, 18 bp, Homo sapiens
gctccccttgcccttcct

SEQ ID NO: 5763955 - DNA, 19 bp, Homo sapiens
gctccccttgcccttcctg

SEQ ID NO: 5763956 - DNA, 19 bp, Homo sapiens
gctccccttggacctccag

SEQ ID NO: 5763957 - DNA, 22 bp, Homo sapiens
gctccccttggacctccagggg

SEQ ID NO: 5763958 - DNA, 20 bp, Homo sapiens
gctcccgagctactctcttg

SEQ ID NO: 5763959 - DNA, 15 bp, Homo sapiens
gctcccgccaccctc

SEQ ID NO: 5763960 - DNA, 15 bp, Homo sapiens
gctcccgccccaggg

SEQ ID NO: 5763961 - DNA, 23 bp, Homo sapiens
gctcccgccccagggtctgaaag

SEQ ID NO: 5763962 - DNA, 12 bp, Homo sapiens
gctcccgcccgt

SEQ ID NO: 5763963 - DNA, 19 bp, Homo sapiens
gctcccgcttgctctcctg

SEQ ID NO: 5763964 - DNA, 13 bp, Homo sapiens
gctcccggcatcc

SEQ ID NO: 5763965 - DNA, 16 bp, Homo sapiens
gctcccggcatcctga

SEQ ID NO: 5763966 - DNA, 17 bp, Homo sapiens
gctcccggcatcctgaa

SEQ ID NO: 5763967 - DNA, 16 bp, Homo sapiens
gctcccggggcctgga

SEQ ID NO: 5763968 - DNA, 13 bp, Homo sapiens
gctcccggttccc

SEQ ID NO: 5763969 - DNA, 15 bp, Homo sapiens
gctcccgtggcctgt

SEQ ID NO: 5763970 - DNA, 18 bp, Homo sapiens
gctccctaagccagcctg

SEQ ID NO: 5763971 - DNA, 23 bp, Homo sapiens
gctccctaccccagggccctggc

SEQ ID NO: 5763972 - DNA, 14 bp, Homo sapiens
gctccctagactgc

SEQ ID NO: 5763973 - DNA, 17 bp, Homo sapiens
gctccctcaaagaggca

SEQ ID NO: 5763974 - DNA, 19 bp, Homo sapiens
gctccctcaaagaggcagt

SEQ ID NO: 5763975 - DNA, 12 bp, Homo sapiens
gctccctcagac

SEQ ID NO: 5763976 - DNA, 12 bp, Homo sapiens
gctccctcagcc

SEQ ID NO: 5763977 - DNA, 17 bp, Homo sapiens
gctccctcagcctcaga

SEQ ID NO: 5763978 - DNA, 13 bp, Homo sapiens
gctccctccagaa

SEQ ID NO: 5763979 - DNA, 14 bp, Homo sapiens
gctccctcccagga

SEQ ID NO: 5763980 - DNA, 21 bp, Homo sapiens
gctccctcccaggactctgac

SEQ ID NO: 5763981 - DNA, 19 bp, Homo sapiens
gctccctcccctgccctgg

SEQ ID NO: 5763982 - DNA, 15 bp, Homo sapiens
gctccctcccctgct

SEQ ID NO: 5763983 - DNA, 18 bp, Homo sapiens
gctccctcccctgctcag

SEQ ID NO: 5763984 - DNA, 18 bp, Homo sapiens
gctccctccctcactgtg

SEQ ID NO: 5763985 - DNA, 16 bp, Homo sapiens
gctccctccctcccag

SEQ ID NO: 5763986 - DNA, 14 bp, Homo sapiens
gctccctcctcagg

SEQ ID NO: 5763987 - DNA, 14 bp, Homo sapiens
gctccctcctccca

SEQ ID NO: 5763988 - DNA, 17 bp, Homo sapiens
gctccctcctcccatct

SEQ ID NO: 5763989 - DNA, 21 bp, Homo sapiens
gctccctcctcccatctcctt

SEQ ID NO: 5763990 - DNA, 14 bp, Homo sapiens
gctccctcctctgg

SEQ ID NO: 5763991 - DNA, 16 bp, Homo sapiens
gctccctcctctggca

SEQ ID NO: 5763992 - DNA, 18 bp, Homo sapiens
gctccctcctctggcagg

SEQ ID NO: 5763993 - DNA, 19 bp, Homo sapiens
gctccctcctctggcaggc

SEQ ID NO: 5763994 - DNA, 15 bp, Homo sapiens
gctccctcctggagc

SEQ ID NO: 5763995 - DNA, 13 bp, Homo sapiens
gctccctcgccct

SEQ ID NO: 5763996 - DNA, 16 bp, Homo sapiens
gctccctcgctgtatg

SEQ ID NO: 5763997 - DNA, 12 bp, Homo sapiens
gctccctctcca

SEQ ID NO: 5763998 - DNA, 22 bp, Homo sapiens
gctccctctccaagacagcagc

SEQ ID NO: 5763999 - DNA, 12 bp, Homo sapiens
gctccctctctc

SEQ ID NO: 5764000 - DNA, 13 bp, Homo sapiens
gctccctctctcc

SEQ ID NO: 5764001 - DNA, 23 bp, Homo sapiens
gctccctctctccacacggagct

SEQ ID NO: 5764002 - DNA, 15 bp, Homo sapiens
gctccctctctcctg

SEQ ID NO: 5764003 - DNA, 18 bp, Homo sapiens
gctccctctctcctggac

SEQ ID NO: 5764004 - DNA, 21 bp, Homo sapiens
gctccctctctcctggactgg

SEQ ID NO: 5764005 - DNA, 13 bp, Homo sapiens
gctccctctctgg

SEQ ID NO: 5764006 - DNA, 23 bp, Homo sapiens
gctccctctgcctgaaccttcca

SEQ ID NO: 5764007 - DNA, 15 bp, Homo sapiens
gctccctctgggttc

SEQ ID NO: 5764008 - DNA, 13 bp, Homo sapiens
gctccctctgtta

SEQ ID NO: 5764009 - DNA, 15 bp, Homo sapiens
gctccctctgttagg

SEQ ID NO: 5764010 - DNA, 21 bp, Homo sapiens
gctccctctgttaggtccatt

SEQ ID NO: 5764011 - DNA, 17 bp, Homo sapiens
gctccctcttggtcttc

SEQ ID NO: 5764012 - DNA, 20 bp, Homo sapiens
gctccctgaagccagccttc

SEQ ID NO: 5764013 - DNA, 22 bp, Homo sapiens
gctccctgaatctgaccacaga

SEQ ID NO: 5764014 - DNA, 12 bp, Homo sapiens
gctccctgacca

SEQ ID NO: 5764015 - DNA, 19 bp, Homo sapiens
gctccctgaccaccctgcc

SEQ ID NO: 5764016 - DNA, 20 bp, Homo sapiens
gctccctgaccaccctgcct

SEQ ID NO: 5764017 - DNA, 13 bp, Homo sapiens
gctccctgacttc

SEQ ID NO: 5764018 - DNA, 13 bp, Homo sapiens
gctccctgagggc

SEQ ID NO: 5764019 - DNA, 22 bp, Homo sapiens
gctccctgaggtacctttccac

SEQ ID NO: 5764020 - DNA, 20 bp, Homo sapiens
gctccctgcaagctccgcct

SEQ ID NO: 5764021 - DNA, 21 bp, Homo sapiens
gctccctgcaccgccgcagaa

SEQ ID NO: 5764022 - DNA, 13 bp, Homo sapiens
gctccctgcccca

SEQ ID NO: 5764023 - DNA, 14 bp, Homo sapiens
gctccctgccccaa

SEQ ID NO: 5764024 - DNA, 21 bp, Homo sapiens
gctccctgcctcctgcctatg

SEQ ID NO: 5764025 - DNA, 14 bp, Homo sapiens
gctccctgcctgga

SEQ ID NO: 5764026 - DNA, 16 bp, Homo sapiens
gctccctgctcccagg

SEQ ID NO: 5764027 - DNA, 16 bp, Homo sapiens
gctccctgctccctcc

SEQ ID NO: 5764028 - DNA, 17 bp, Homo sapiens
gctccctgctccctccc

SEQ ID NO: 5764029 - DNA, 16 bp, Homo sapiens
gctccctgctttggct

SEQ ID NO: 5764030 - DNA, 20 bp, Homo sapiens
gctccctggaaagcaggcaa

SEQ ID NO: 5764031 - DNA, 19 bp, Homo sapiens
gctccctggaagctggaag

SEQ ID NO: 5764032 - DNA, 20 bp, Homo sapiens
gctccctggaagctggaaga

SEQ ID NO: 5764033 - DNA, 12 bp, Homo sapiens
gctccctggagc

SEQ ID NO: 5764034 - DNA, 16 bp, Homo sapiens
gctccctggagccctg

SEQ ID NO: 5764035 - DNA, 17 bp, Homo sapiens
gctccctggagccctgt

SEQ ID NO: 5764036 - DNA, 13 bp, Homo sapiens
gctccctggaggc

SEQ ID NO: 5764037 - DNA, 21 bp, Homo sapiens
gctccctggaggcacgcacca

SEQ ID NO: 5764038 - DNA, 13 bp, Homo sapiens
gctccctggcagg

SEQ ID NO: 5764039 - DNA, 14 bp, Homo sapiens
gctccctggcccag

SEQ ID NO: 5764040 - DNA, 17 bp, Homo sapiens
gctccctggcccagcca

SEQ ID NO: 5764041 - DNA, 15 bp, Homo sapiens
gctccctgggcagtg

SEQ ID NO: 5764042 - DNA, 12 bp, Homo sapiens
gctccctgggct

SEQ ID NO: 5764043 - DNA, 14 bp, Homo sapiens
gctccctgggctgg

SEQ ID NO: 5764044 - DNA, 17 bp, Homo sapiens
gctccctgtagctctgc

SEQ ID NO: 5764045 - DNA, 13 bp, Homo sapiens
gctccctgtctgt

SEQ ID NO: 5764046 - DNA, 15 bp, Homo sapiens
gctccctgtctgtgt

SEQ ID NO: 5764047 - DNA, 16 bp, Homo sapiens
gctccctgtctgtgtc

SEQ ID NO: 5764048 - DNA, 17 bp, Homo sapiens
gctccctgtctgtgtcc

SEQ ID NO: 5764049 - DNA, 22 bp, Homo sapiens
gctccctgtgacaaaattttat

SEQ ID NO: 5764050 - DNA, 22 bp, Homo sapiens
gctccctgtgtccacctgtggg

SEQ ID NO: 5764051 - DNA, 20 bp, Homo sapiens
gctcccttcagcccccagcc

SEQ ID NO: 5764052 - DNA, 16 bp, Homo sapiens
gctcccttcaggcccg

SEQ ID NO: 5764053 - DNA, 21 bp, Homo sapiens
gctcccttcatctccagggag

SEQ ID NO: 5764054 - DNA, 16 bp, Homo sapiens
gctcccttcccacctc

SEQ ID NO: 5764055 - DNA, 21 bp, Homo sapiens
gctcccttctacagcctcaga

SEQ ID NO: 5764056 - DNA, 15 bp, Homo sapiens
gctcccttctctgta

SEQ ID NO: 5764057 - DNA, 15 bp, Homo sapiens
gctcccttgatgggg

SEQ ID NO: 5764058 - DNA, 22 bp, Homo sapiens
gctcccttgggaaggacacagc

SEQ ID NO: 5764059 - DNA, 13 bp, Homo sapiens
gctccctttaagc

SEQ ID NO: 5764060 - DNA, 16 bp, Homo sapiens
gctccctttgctgctg

SEQ ID NO: 5764061 - DNA, 19 bp, Homo sapiens
gctccgacctctctcagcc

SEQ ID NO: 5764062 - DNA, 22 bp, Homo sapiens
gctccgacctctctcagcccca

SEQ ID NO: 5764063 - DNA, 17 bp, Homo sapiens
gctccgagctgtaggag

SEQ ID NO: 5764064 - DNA, 21 bp, Homo sapiens
gctccgaggactggactgttt

SEQ ID NO: 5764065 - DNA, 18 bp, Homo sapiens
gctccgaggagctggggc

SEQ ID NO: 5764066 - DNA, 17 bp, Homo sapiens
gctccgagggcggccag

SEQ ID NO: 5764067 - DNA, 20 bp, Homo sapiens
gctccgagggcggccaggga

SEQ ID NO: 5764068 - DNA, 14 bp, Homo sapiens
gctccgatgcccgc

SEQ ID NO: 5764069 - DNA, 13 bp, Homo sapiens
gctccgcaggact

SEQ ID NO: 5764070 - DNA, 22 bp, Homo sapiens
gctccgcagggcgcccagcgcc

SEQ ID NO: 5764071 - DNA, 14 bp, Homo sapiens
gctccgccaggaaa

SEQ ID NO: 5764072 - DNA, 23 bp, Homo sapiens
gctccgcccgctcctgccgcaga

SEQ ID NO: 5764073 - DNA, 12 bp, Homo sapiens
gctccgcctccc

SEQ ID NO: 5764074 - DNA, 13 bp, Homo sapiens
gctccgcctgctg

SEQ ID NO: 5764075 - DNA, 14 bp, Homo sapiens
gctccgcctggcac

SEQ ID NO: 5764076 - DNA, 15 bp, Homo sapiens
gctccgcctggcctg

SEQ ID NO: 5764077 - DNA, 17 bp, Homo sapiens
gctccgcgtgtctcatt

SEQ ID NO: 5764078 - DNA, 16 bp, Homo sapiens
gctccgctcccaccgc

SEQ ID NO: 5764079 - DNA, 14 bp, Homo sapiens
gctccgctgcctgg

SEQ ID NO: 5764080 - DNA, 17 bp, Homo sapiens
gctccgctgcctggaac

SEQ ID NO: 5764081 - DNA, 12 bp, Homo sapiens
gctccgctgctc

SEQ ID NO: 5764082 - DNA, 19 bp, Homo sapiens
gctccgctgctccttggct

SEQ ID NO: 5764083 - DNA, 13 bp, Homo sapiens
gctccgctgtgtg

SEQ ID NO: 5764084 - DNA, 23 bp, Homo sapiens
gctccgctttctacccagcgagc

SEQ ID NO: 5764085 - DNA, 24 bp, Homo sapiens
gctccgctttctacccagcgagcc

SEQ ID NO: 5764086 - DNA, 16 bp, Homo sapiens
gctccggcagaggcag

SEQ ID NO: 5764087 - DNA, 17 bp, Homo sapiens
gctccggcagaggcagg

SEQ ID NO: 5764088 - DNA, 21 bp, Homo sapiens
gctccggcctctgcctttgca

SEQ ID NO: 5764089 - DNA, 22 bp, Homo sapiens
gctccggcgtgtgttcagtgtt

SEQ ID NO: 5764090 - DNA, 19 bp, Homo sapiens
gctccgggggtacagccct

SEQ ID NO: 5764091 - DNA, 20 bp, Homo sapiens
gctccgggggtacagccctt

SEQ ID NO: 5764092 - DNA, 19 bp, Homo sapiens
gctccggtgcggtgcactg

SEQ ID NO: 5764093 - DNA, 16 bp, Homo sapiens
gctccggtttgggctg

SEQ ID NO: 5764094 - DNA, 15 bp, Homo sapiens
gctccgtagcttcta

SEQ ID NO: 5764095 - DNA, 14 bp, Homo sapiens
gctccgtcagcttc

SEQ ID NO: 5764096 - DNA, 15 bp, Homo sapiens
gctccgtcatctgcg

SEQ ID NO: 5764097 - DNA, 17 bp, Homo sapiens
gctccgtcatctgcggg

SEQ ID NO: 5764098 - DNA, 23 bp, Homo sapiens
gctccgtcatctgcggggcttct

SEQ ID NO: 5764099 - DNA, 17 bp, Homo sapiens
gctccgtctctgtcctc

SEQ ID NO: 5764100 - DNA, 16 bp, Homo sapiens
gctccgtgcctccacc

SEQ ID NO: 5764101 - DNA, 17 bp, Homo sapiens
gctccgtggactgcagt

SEQ ID NO: 5764102 - DNA, 13 bp, Homo sapiens
gctccgtggagga

SEQ ID NO: 5764103 - DNA, 22 bp, Homo sapiens
gctccgtggtggcggcggcact

SEQ ID NO: 5764104 - DNA, 15 bp, Homo sapiens
gctccgtgtgtctca

SEQ ID NO: 5764105 - DNA, 13 bp, Homo sapiens
gctccgtgtttct

SEQ ID NO: 5764106 - DNA, 15 bp, Homo sapiens
gctccgtgtttctct

SEQ ID NO: 5764107 - DNA, 23 bp, Homo sapiens
gctcctgcttcccctccctaccc

SEQ ID NO: 5764108 - DNA, 13 bp, Homo sapiens
gctcctgcttctc

SEQ ID NO: 5764109 - DNA, 20 bp, Homo sapiens
gctcctgcttctcctgatcc

SEQ ID NO: 5764110 - DNA, 19 bp, Homo sapiens
gctcctgcttttctgtcct

SEQ ID NO: 5764111 - DNA, 20 bp, Homo sapiens
gctcctgcttttctgtcctg

SEQ ID NO: 5764112 - DNA, 21 bp, Homo sapiens
gctcctgcttttctgtcctgg

SEQ ID NO: 5764113 - DNA, 18 bp, Homo sapiens
gctcctggaaaggctcag

SEQ ID NO: 5764114 - DNA, 11 bp, Homo sapiens
gctcctggacc

SEQ ID NO: 5764115 - DNA, 17 bp, Homo sapiens
gctcctggagccagcca

SEQ ID NO: 5764116 - DNA, 18 bp, Homo sapiens
gctcctggagcctttgaa

SEQ ID NO: 5764117 - DNA, 21 bp, Homo sapiens
gctcctggagggggcaagcct

SEQ ID NO: 5764118 - DNA, 18 bp, Homo sapiens
gctcctggcagaagggag

SEQ ID NO: 5764119 - DNA, 14 bp, Homo sapiens
gctcctggcccact

SEQ ID NO: 5764120 - DNA, 20 bp, Homo sapiens
gctcctggcccactgcatcg

SEQ ID NO: 5764121 - DNA, 16 bp, Homo sapiens
gctcctggcccagcct

SEQ ID NO: 5764122 - DNA, 12 bp, Homo sapiens
gctcctggctgc

SEQ ID NO: 5764123 - DNA, 16 bp, Homo sapiens
gctcctggctgtgccc

SEQ ID NO: 5764124 - DNA, 19 bp, Homo sapiens
gctcctggctgtgcccagc

SEQ ID NO: 5764125 - DNA, 22 bp, Homo sapiens
gctcctgggaaggctactcacc

SEQ ID NO: 5764126 - DNA, 12 bp, Homo sapiens
gctcctgggacc

SEQ ID NO: 5764127 - DNA, 17 bp, Homo sapiens
gctcctgggacccttgg

SEQ ID NO: 5764128 - DNA, 18 bp, Homo sapiens
gctcctgggaggccctgg

SEQ ID NO: 5764129 - DNA, 14 bp, Homo sapiens
gctcctgggcagct

SEQ ID NO: 5764130 - DNA, 21 bp, Homo sapiens
gctcctgggcattagcaaggc

SEQ ID NO: 5764131 - DNA, 12 bp, Homo sapiens
gctcctgggccg

SEQ ID NO: 5764132 - DNA, 12 bp, Homo sapiens
gctcctggggca

SEQ ID NO: 5764133 - DNA, 16 bp, Homo sapiens
gctcctggggcagaga

SEQ ID NO: 5764134 - DNA, 18 bp, Homo sapiens
gctcctggtggccttctg

SEQ ID NO: 5764135 - DNA, 19 bp, Homo sapiens
gctcctggtggccttctgc

SEQ ID NO: 5764136 - DNA, 20 bp, Homo sapiens
gctcctggtggccttctgct

SEQ ID NO: 5764137 - DNA, 23 bp, Homo sapiens
gctcctgtacgaacccctcccct

SEQ ID NO: 5764138 - DNA, 19 bp, Homo sapiens
gctcctgtcccctgctaca

SEQ ID NO: 5764139 - DNA, 12 bp, Homo sapiens
gctcctgtccct

SEQ ID NO: 5764140 - DNA, 13 bp, Homo sapiens
gctcctgtcccta

SEQ ID NO: 5764141 - DNA, 14 bp, Homo sapiens
gctcctgtccctac

SEQ ID NO: 5764142 - DNA, 18 bp, Homo sapiens
gctcctgtccctacccac

SEQ ID NO: 5764143 - DNA, 19 bp, Homo sapiens
gctcctgtccctacccact

SEQ ID NO: 5764144 - DNA, 15 bp, Homo sapiens
gctcctgtctggctc

SEQ ID NO: 5764145 - DNA, 11 bp, Homo sapiens
gctcctgtgct

SEQ ID NO: 5764146 - DNA, 21 bp, Homo sapiens
gctcctgtgctactttgcctt

SEQ ID NO: 5764147 - DNA, 12 bp, Homo sapiens
gctcctgtgctc

SEQ ID NO: 5764148 - DNA, 18 bp, Homo sapiens
gctcctgtgctcaccctc

SEQ ID NO: 5764149 - DNA, 16 bp, Homo sapiens
gctcctgtgctttccc

SEQ ID NO: 5764150 - DNA, 22 bp, Homo sapiens
gctcctgtgctttccctgaact

SEQ ID NO: 5764151 - DNA, 18 bp, Homo sapiens
gctcctgtggcagctgcc

SEQ ID NO: 5764152 - DNA, 16 bp, Homo sapiens
gctcctgttgttactg

SEQ ID NO: 5764153 - DNA, 22 bp, Homo sapiens
gctccttaaagttctgggcagc

SEQ ID NO: 5764154 - DNA, 17 bp, Homo sapiens
gctccttaaggctcttt

SEQ ID NO: 5764155 - DNA, 21 bp, Homo sapiens
gctccttaaggctcttttgta

SEQ ID NO: 5764156 - DNA, 18 bp, Homo sapiens
gctccttagctgccaagc

SEQ ID NO: 5764157 - DNA, 22 bp, Homo sapiens
gctccttagggttttctctcta

SEQ ID NO: 5764158 - DNA, 12 bp, Homo sapiens
gctccttcactg

SEQ ID NO: 5764159 - DNA, 19 bp, Homo sapiens
gctccttcagcagctagag

SEQ ID NO: 5764160 - DNA, 19 bp, Homo sapiens
gctccttcagttctgcttg

SEQ ID NO: 5764161 - DNA, 20 bp, Homo sapiens
gctccttcatgcttttctca

SEQ ID NO: 5764162 - DNA, 13 bp, Homo sapiens
gctccttccagac

SEQ ID NO: 5764163 - DNA, 14 bp, Homo sapiens
gctccttcccagga

SEQ ID NO: 5764164 - DNA, 13 bp, Homo sapiens
gctccttcccctg

SEQ ID NO: 5764165 - DNA, 13 bp, Homo sapiens
gctccttcctgtc

SEQ ID NO: 5764166 - DNA, 19 bp, Homo sapiens
gctccttcctgtcttcctg

SEQ ID NO: 5764167 - DNA, 15 bp, Homo sapiens
gctccttcctgtggg

SEQ ID NO: 5764168 - DNA, 21 bp, Homo sapiens
gctccttcctgtgggtggggc

SEQ ID NO: 5764169 - DNA, 13 bp, Homo sapiens
gctccttctgtcc

SEQ ID NO: 5764170 - DNA, 14 bp, Homo sapiens
gctccttgcagcag

SEQ ID NO: 5764171 - DNA, 19 bp, Homo sapiens
gctccttgcggaggtgaag

SEQ ID NO: 5764172 - DNA, 22 bp, Homo sapiens
gctccttgctgcattgatccag

SEQ ID NO: 5764173 - DNA, 17 bp, Homo sapiens
gctccttggagcaggca

SEQ ID NO: 5764174 - DNA, 21 bp, Homo sapiens
gctccttggcacccccatgct

SEQ ID NO: 5764175 - DNA, 22 bp, Homo sapiens
gctccttggcggacactggggg

SEQ ID NO: 5764176 - DNA, 17 bp, Homo sapiens
gctccttggctgcagcc

SEQ ID NO: 5764177 - DNA, 18 bp, Homo sapiens
gctccttgggaggaagca

SEQ ID NO: 5764178 - DNA, 22 bp, Homo sapiens
gctccttgggaggccccactgg

SEQ ID NO: 5764179 - DNA, 11 bp, Homo sapiens
gctccttgggc

SEQ ID NO: 5764180 - DNA, 19 bp, Homo sapiens
gctccttgggccctttgag

SEQ ID NO: 5764181 - DNA, 22 bp, Homo sapiens
gctccttgtcaatactgagcca

SEQ ID NO: 5764182 - DNA, 14 bp, Homo sapiens
gctccttgttccta

SEQ ID NO: 5764183 - DNA, 23 bp, Homo sapiens
gctcctttacaaaagaaatacct

SEQ ID NO: 5764184 - DNA, 15 bp, Homo sapiens
gctcctttaccctct

SEQ ID NO: 5764185 - DNA, 17 bp, Homo sapiens
gctcctttaccctcttg

SEQ ID NO: 5764186 - DNA, 17 bp, Homo sapiens
gctcctttacctaccac

SEQ ID NO: 5764187 - DNA, 17 bp, Homo sapiens
gctcctttagcgcccag

SEQ ID NO: 5764188 - DNA, 22 bp, Homo sapiens
gctcctttccatcagctttata

SEQ ID NO: 5764189 - DNA, 14 bp, Homo sapiens
gctcctttcccaca

SEQ ID NO: 5764190 - DNA, 17 bp, Homo sapiens
gctcctttccctggaag

SEQ ID NO: 5764191 - DNA, 17 bp, Homo sapiens
gctcctttctccagcca

SEQ ID NO: 5764192 - DNA, 17 bp, Homo sapiens
gctcctttctcctgtga

SEQ ID NO: 5764193 - DNA, 19 bp, Homo sapiens
gctcctttctgtcctggag

SEQ ID NO: 5764194 - DNA, 16 bp, Homo sapiens
gctcctttgcctctgc

SEQ ID NO: 5764195 - DNA, 18 bp, Homo sapiens
gctcctttgcctctgcta

SEQ ID NO: 5764196 - DNA, 19 bp, Homo sapiens
gctcctttgcctctgctac

SEQ ID NO: 5764197 - DNA, 22 bp, Homo sapiens
gctcctttgtgtgtgtgtcagc

SEQ ID NO: 5764198 - DNA, 18 bp, Homo sapiens
gctccttttccagagcat

SEQ ID NO: 5764199 - DNA, 21 bp, Homo sapiens
gctccttttccgttctgttct

SEQ ID NO: 5764200 - DNA, 23 bp, Homo sapiens
gctccttttccgttctgttctgc

SEQ ID NO: 5764201 - DNA, 15 bp, Homo sapiens
gctccttttctcttt

SEQ ID NO: 5764202 - DNA, 16 bp, Homo sapiens
gctccttttctctttg

SEQ ID NO: 5764203 - DNA, 15 bp, Homo sapiens
gctccttttctgtga

SEQ ID NO: 5764204 - DNA, 17 bp, Homo sapiens
gctccttttctgtgaag

SEQ ID NO: 5764205 - DNA, 17 bp, Homo sapiens
gctccttttgtccccag

SEQ ID NO: 5764206 - DNA, 20 bp, Homo sapiens
gctccttttgtccccagggc

SEQ ID NO: 5764207 - DNA, 23 bp, Homo sapiens
gctccttttgtccccagggcccc

SEQ ID NO: 5764208 - DNA, 19 bp, Homo sapiens
gctcgaatctctgtgcctt

SEQ ID NO: 5764209 - DNA, 16 bp, Homo sapiens
gctcgagcaaaattca

SEQ ID NO: 5764210 - DNA, 15 bp, Homo sapiens
gctcgagcatgccct

SEQ ID NO: 5764211 - DNA, 18 bp, Homo sapiens
gctcgagctcggggctgg

SEQ ID NO: 5764212 - DNA, 20 bp, Homo sapiens
gctcgagtcacattctgctt

SEQ ID NO: 5764213 - DNA, 15 bp, Homo sapiens
gctcgagtgcccctg

SEQ ID NO: 5764214 - DNA, 16 bp, Homo sapiens
gctcgagtgcccctgc

SEQ ID NO: 5764215 - DNA, 22 bp, Homo sapiens
gctcgatgtggtcacagctgta

SEQ ID NO: 5764216 - DNA, 14 bp, Homo sapiens
gctcgattttgtat

SEQ ID NO: 5764217 - DNA, 20 bp, Homo sapiens
gctcgcacccccctgttcta

SEQ ID NO: 5764218 - DNA, 21 bp, Homo sapiens
gctcgcacccccctgttctaa

SEQ ID NO: 5764219 - DNA, 12 bp, Homo sapiens
gctcgcagcctg

SEQ ID NO: 5764220 - DNA, 21 bp, Homo sapiens
gctcgcagcctggcggggcag

SEQ ID NO: 5764221 - DNA, 17 bp, Homo sapiens
gctcgcatccagacagt

SEQ ID NO: 5764222 - DNA, 12 bp, Homo sapiens
gctcgccaaggc

SEQ ID NO: 5764223 - DNA, 15 bp, Homo sapiens
gctcgccaaggccta

SEQ ID NO: 5764224 - DNA, 16 bp, Homo sapiens
gctcgccaaggcctag

SEQ ID NO: 5764225 - DNA, 18 bp, Homo sapiens
gctcgccacgctcagtgc

SEQ ID NO: 5764226 - DNA, 16 bp, Homo sapiens
gctcgcccacaaactg

SEQ ID NO: 5764227 - DNA, 13 bp, Homo sapiens
gctcgcccagcag

SEQ ID NO: 5764228 - DNA, 15 bp, Homo sapiens
gctcgcccaggaagg

SEQ ID NO: 5764229 - DNA, 16 bp, Homo sapiens
gctcgcccaggaaggc

SEQ ID NO: 5764230 - DNA, 16 bp, Homo sapiens
gctcgccccacctcca

SEQ ID NO: 5764231 - DNA, 17 bp, Homo sapiens
gctcgccccacctccac

SEQ ID NO: 5764232 - DNA, 19 bp, Homo sapiens
gctcgccccacctccacct

SEQ ID NO: 5764233 - DNA, 23 bp, Homo sapiens
gctcgccccacctccacctgtga

SEQ ID NO: 5764234 - DNA, 18 bp, Homo sapiens
gctcgcccctgttttttg

SEQ ID NO: 5764235 - DNA, 18 bp, Homo sapiens
gctcgcctctgcccagcc

SEQ ID NO: 5764236 - DNA, 15 bp, Homo sapiens
gctcgccttccctcc

SEQ ID NO: 5764237 - DNA, 21 bp, Homo sapiens
gctcgccttccctcctgcttt

SEQ ID NO: 5764238 - DNA, 22 bp, Homo sapiens
gctcgccttcggcctctcttgg

SEQ ID NO: 5764239 - DNA, 17 bp, Homo sapiens
gctcgcgagggcagcac

SEQ ID NO: 5764240 - DNA, 20 bp, Homo sapiens
gctcgcgggcagcgggccag

SEQ ID NO: 5764241 - DNA, 23 bp, Homo sapiens
gctcgcgggcagcgggccaggcc

SEQ ID NO: 5764242 - DNA, 13 bp, Homo sapiens
gctcgctcaggtg

SEQ ID NO: 5764243 - DNA, 19 bp, Homo sapiens
gctcgctcgctctcgctct

SEQ ID NO: 5764244 - DNA, 21 bp, Homo sapiens
gctcgctgccatcaccgctgg

SEQ ID NO: 5764245 - DNA, 23 bp, Homo sapiens
gctcgctgcccagggataggtat

SEQ ID NO: 5764246 - DNA, 22 bp, Homo sapiens
gctcgctgctgcgccctgggct

SEQ ID NO: 5764247 - DNA, 17 bp, Homo sapiens
gctcgcttgctggaaca

SEQ ID NO: 5764248 - DNA, 20 bp, Homo sapiens
gctcggagcacccttgcccg

SEQ ID NO: 5764249 - DNA, 16 bp, Homo sapiens
gctcggaggaccctgg

SEQ ID NO: 5764250 - DNA, 18 bp, Homo sapiens
gctcggaggccccaaagg

SEQ ID NO: 5764251 - DNA, 15 bp, Homo sapiens
gctcggaggctaccc

SEQ ID NO: 5764252 - DNA, 19 bp, Homo sapiens
gctcggaggctacccgctg

SEQ ID NO: 5764253 - DNA, 17 bp, Homo sapiens
gctcggaggctgccccc

SEQ ID NO: 5764254 - DNA, 11 bp, Homo sapiens
gctcggcagga

SEQ ID NO: 5764255 - DNA, 17 bp, Homo sapiens
gctcggcccggagcagc

SEQ ID NO: 5764256 - DNA, 22 bp, Homo sapiens
gctcggcgcccccacccctggc

SEQ ID NO: 5764257 - DNA, 21 bp, Homo sapiens
gctcggctactggttacctgg

SEQ ID NO: 5764258 - DNA, 16 bp, Homo sapiens
gctcggctcagctcgg

SEQ ID NO: 5764259 - DNA, 15 bp, Homo sapiens
gctcgggaaggcctg

SEQ ID NO: 5764260 - DNA, 18 bp, Homo sapiens
gctcgggaaggcctgagg

SEQ ID NO: 5764261 - DNA, 19 bp, Homo sapiens
gctcgggaaggcctgaggg

SEQ ID NO: 5764262 - DNA, 22 bp, Homo sapiens
gctcgggccgtaggggctcctg

SEQ ID NO: 5764263 - DNA, 20 bp, Homo sapiens
gctcgggcgctgtggctcct

SEQ ID NO: 5764264 - DNA, 15 bp, Homo sapiens
gctcggggaggcaga

SEQ ID NO: 5764265 - DNA, 20 bp, Homo sapiens
gctcggggctgggggctgca

SEQ ID NO: 5764266 - DNA, 20 bp, Homo sapiens
gctcggggggctctgccttc

SEQ ID NO: 5764267 - DNA, 21 bp, Homo sapiens
gctcggggtaaaaagtggctg

SEQ ID NO: 5764268 - DNA, 22 bp, Homo sapiens
gctcggggtaaaaagtggctgc

SEQ ID NO: 5764269 - DNA, 14 bp, Homo sapiens
gctcggggtccacc

SEQ ID NO: 5764270 - DNA, 18 bp, Homo sapiens
gctcggggtgcacaggag

SEQ ID NO: 5764271 - DNA, 19 bp, Homo sapiens
gctcggggtgcacaggagg

SEQ ID NO: 5764272 - DNA, 20 bp, Homo sapiens
gctcggggtgtgtcatttct

SEQ ID NO: 5764273 - DNA, 21 bp, Homo sapiens
gctcgggtctccctcctgcag

SEQ ID NO: 5764274 - DNA, 15 bp, Homo sapiens
gctcgggtgcccagg

SEQ ID NO: 5764275 - DNA, 14 bp, Homo sapiens
gctcgggtgctgcc

SEQ ID NO: 5764276 - DNA, 16 bp, Homo sapiens
gctcgggtgctgccag

SEQ ID NO: 5764277 - DNA, 13 bp, Homo sapiens
gctcggtctccac

SEQ ID NO: 5764278 - DNA, 14 bp, Homo sapiens
gctcggtctccacc

SEQ ID NO: 5764279 - DNA, 20 bp, Homo sapiens
gctcggtctccaccccaggg

SEQ ID NO: 5764280 - DNA, 13 bp, Homo sapiens
gctcggtgagtga

SEQ ID NO: 5764281 - DNA, 17 bp, Homo sapiens
gctcgtcagccacctgg

SEQ ID NO: 5764282 - DNA, 19 bp, Homo sapiens
gctcgtccccaagtgacct

SEQ ID NO: 5764283 - DNA, 14 bp, Homo sapiens
gctcgtcctcactg

SEQ ID NO: 5764284 - DNA, 20 bp, Homo sapiens
gctctcctaggtagccccct

SEQ ID NO: 5764285 - DNA, 17 bp, Homo sapiens
gctctcctccacctcaa

SEQ ID NO: 5764286 - DNA, 15 bp, Homo sapiens
gctctcctcccgccc

SEQ ID NO: 5764287 - DNA, 20 bp, Homo sapiens
gctctcctcccgccccgccc

SEQ ID NO: 5764288 - DNA, 15 bp, Homo sapiens
gctctcctcttctac

SEQ ID NO: 5764289 - DNA, 23 bp, Homo sapiens
gctctcctcttctactcactttt

SEQ ID NO: 5764290 - DNA, 12 bp, Homo sapiens
gctctcctgaca

SEQ ID NO: 5764291 - DNA, 18 bp, Homo sapiens
gctctcctgacagccaca

SEQ ID NO: 5764292 - DNA, 12 bp, Homo sapiens
gctctcctgccc

SEQ ID NO: 5764293 - DNA, 14 bp, Homo sapiens
gctctcctggccct

SEQ ID NO: 5764294 - DNA, 14 bp, Homo sapiens
gctctcctggctcc

SEQ ID NO: 5764295 - DNA, 15 bp, Homo sapiens
gctctcctggcttcc

SEQ ID NO: 5764296 - DNA, 16 bp, Homo sapiens
gctctcctgggccagg

SEQ ID NO: 5764297 - DNA, 20 bp, Homo sapiens
gctctcctgggccagggtct

SEQ ID NO: 5764298 - DNA, 17 bp, Homo sapiens
gctctcctgtgcattgt

SEQ ID NO: 5764299 - DNA, 21 bp, Homo sapiens
gctctccttgccctgggccag

SEQ ID NO: 5764300 - DNA, 18 bp, Homo sapiens
gctctcgaccggccctgc

SEQ ID NO: 5764301 - DNA, 16 bp, Homo sapiens
gctctcgaggaaagtg

SEQ ID NO: 5764302 - DNA, 19 bp, Homo sapiens
gctctcgcacacctctgca

SEQ ID NO: 5764303 - DNA, 15 bp, Homo sapiens
gctctcgctctcgct

SEQ ID NO: 5764304 - DNA, 15 bp, Homo sapiens
gctctcgctctctct

SEQ ID NO: 5764305 - DNA, 18 bp, Homo sapiens
gctctcgctctctctcgc

SEQ ID NO: 5764306 - DNA, 21 bp, Homo sapiens
gctctcgggtgggggagccag

SEQ ID NO: 5764307 - DNA, 13 bp, Homo sapiens
gctctcgtccctc

SEQ ID NO: 5764308 - DNA, 14 bp, Homo sapiens
gctctcgtccctct

SEQ ID NO: 5764309 - DNA, 18 bp, Homo sapiens
gctctcgttctccttccc

SEQ ID NO: 5764310 - DNA, 17 bp, Homo sapiens
gctctctaagaaaagag

SEQ ID NO: 5764311 - DNA, 21 bp, Homo sapiens
gctctctaagaaaagagagga

SEQ ID NO: 5764312 - DNA, 20 bp, Homo sapiens
gctctctaattccacttgtt

SEQ ID NO: 5764313 - DNA, 21 bp, Homo sapiens
gctctctacccagcccatctt

SEQ ID NO: 5764314 - DNA, 18 bp, Homo sapiens
gctctctaggcctctcca

SEQ ID NO: 5764315 - DNA, 17 bp, Homo sapiens
gctctctattccctcag

SEQ ID NO: 5764316 - DNA, 20 bp, Homo sapiens
gctctctattccctcagcct

SEQ ID NO: 5764317 - DNA, 16 bp, Homo sapiens
gctctctcacccagcc

SEQ ID NO: 5764318 - DNA, 15 bp, Homo sapiens
gctctctcacctgct

SEQ ID NO: 5764319 - DNA, 17 bp, Homo sapiens
gctctctcacctgctcc

SEQ ID NO: 5764320 - DNA, 22 bp, Homo sapiens
gctctctcagacccttgaagat

SEQ ID NO: 5764321 - DNA, 18 bp, Homo sapiens
gctctctccgaggggtgg

SEQ ID NO: 5764322 - DNA, 15 bp, Homo sapiens
gctctctcctctctc

SEQ ID NO: 5764323 - DNA, 20 bp, Homo sapiens
gctctctcgtactctctctc

SEQ ID NO: 5764324 - DNA, 23 bp, Homo sapiens
gctctctctacccggcccagaga

SEQ ID NO: 5764325 - DNA, 18 bp, Homo sapiens
gctctctctagaatgagc

SEQ ID NO: 5764326 - DNA, 10 bp, Homo sapiens
gctctctctc

SEQ ID NO: 5764327 - DNA, 17 bp, Homo sapiens
gctctctctccctgcct

SEQ ID NO: 5764328 - DNA, 19 bp, Homo sapiens
gctctctctccctgccttt

SEQ ID NO: 5764329 - DNA, 15 bp, Homo sapiens
gctctctctcgctgc

SEQ ID NO: 5764330 - DNA, 17 bp, Homo sapiens
gctctctctcgctgcgt

SEQ ID NO: 5764331 - DNA, 22 bp, Homo sapiens
gctctctctcgctgcgtcctca

SEQ ID NO: 5764332 - DNA, 20 bp, Homo sapiens
gctctctctctttctctctc

SEQ ID NO: 5764333 - DNA, 13 bp, Homo sapiens
gctctctctgagg

SEQ ID NO: 5764334 - DNA, 17 bp, Homo sapiens
gctctctgacgcttgtg

SEQ ID NO: 5764335 - DNA, 18 bp, Homo sapiens
gctctctgacgcttgtga

SEQ ID NO: 5764336 - DNA, 13 bp, Homo sapiens
gctctctgaggca

SEQ ID NO: 5764337 - DNA, 20 bp, Homo sapiens
gctctctgcatctactccca

SEQ ID NO: 5764338 - DNA, 15 bp, Homo sapiens
gctctctgccctgtg

SEQ ID NO: 5764339 - DNA, 12 bp, Homo sapiens
gctctctgctga

SEQ ID NO: 5764340 - DNA, 18 bp, Homo sapiens
gctctctgctgagcagcc

SEQ ID NO: 5764341 - DNA, 14 bp, Homo sapiens
gctctctgctgggt

SEQ ID NO: 5764342 - DNA, 18 bp, Homo sapiens
gctctctggacctgacca

SEQ ID NO: 5764343 - DNA, 17 bp, Homo sapiens
gctctctggaggtactg

SEQ ID NO: 5764344 - DNA, 13 bp, Homo sapiens
gctctctggcctt

SEQ ID NO: 5764345 - DNA, 20 bp, Homo sapiens
gctctctggccttcggcctc

SEQ ID NO: 5764346 - DNA, 19 bp, Homo sapiens
gctctctggccttttccta

SEQ ID NO: 5764347 - DNA, 11 bp, Homo sapiens
gctctctggga

SEQ ID NO: 5764348 - DNA, 17 bp, Homo sapiens
gctctctgggacctcct

SEQ ID NO: 5764349 - DNA, 13 bp, Homo sapiens
gctctctgggcct

SEQ ID NO: 5764350 - DNA, 16 bp, Homo sapiens
gctctctgggcctggg

SEQ ID NO: 5764351 - DNA, 21 bp, Homo sapiens
gctctctgtaggcacagagct

SEQ ID NO: 5764352 - DNA, 19 bp, Homo sapiens
gctctctgtgggctggcag

SEQ ID NO: 5764353 - DNA, 21 bp, Homo sapiens
gctctctgttgcgctcccgca

SEQ ID NO: 5764354 - DNA, 13 bp, Homo sapiens
gctctcttcaata

SEQ ID NO: 5764355 - DNA, 14 bp, Homo sapiens
gctctcttcaggag

SEQ ID NO: 5764356 - DNA, 22 bp, Homo sapiens
gctctcttccagaagatgccct

SEQ ID NO: 5764357 - DNA, 14 bp, Homo sapiens
gctctcttcctgcc

SEQ ID NO: 5764358 - DNA, 15 bp, Homo sapiens
gctctcttcctgccc

SEQ ID NO: 5764359 - DNA, 19 bp, Homo sapiens
gctctcttcctgcccctct

SEQ ID NO: 5764360 - DNA, 20 bp, Homo sapiens
gctctcttcctgcccctctt

SEQ ID NO: 5764361 - DNA, 13 bp, Homo sapiens
gctctcttcctgt

SEQ ID NO: 5764362 - DNA, 13 bp, Homo sapiens
gctctcttcttac

SEQ ID NO: 5764363 - DNA, 22 bp, Homo sapiens
gctctcttcttactcattactg

SEQ ID NO: 5764364 - DNA, 22 bp, Homo sapiens
gctctcttgccgaggagccagg

SEQ ID NO: 5764365 - DNA, 23 bp, Homo sapiens
gctctcttgccgaggagccaggc

SEQ ID NO: 5764366 - DNA, 18 bp, Homo sapiens
gctctcttttctgtactt

SEQ ID NO: 5764367 - DNA, 22 bp, Homo sapiens
gctctctttttctccagggtca

SEQ ID NO: 5764368 - DNA, 17 bp, Homo sapiens
gctctgaaagccagctg

SEQ ID NO: 5764369 - DNA, 17 bp, Homo sapiens
gctctgaaagctgcttc

SEQ ID NO: 5764370 - DNA, 19 bp, Homo sapiens
gctctgaaagctgcttctg

SEQ ID NO: 5764371 - DNA, 14 bp, Homo sapiens
gctctgaaaggtaa

SEQ ID NO: 5764372 - DNA, 14 bp, Homo sapiens
gctctgaaataaaa

SEQ ID NO: 5764373 - DNA, 13 bp, Homo sapiens
gctctgaaatctt

SEQ ID NO: 5764374 - DNA, 17 bp, Homo sapiens
gctctgaaatcttgggc

SEQ ID NO: 5764375 - DNA, 13 bp, Homo sapiens
gctctgaacacac

SEQ ID NO: 5764376 - DNA, 20 bp, Homo sapiens
gctctgaacacacacgccag

SEQ ID NO: 5764377 - DNA, 22 bp, Homo sapiens
gctctgaacacacacgccagct

SEQ ID NO: 5764378 - DNA, 23 bp, Homo sapiens
gctctgaacacacacgccagctc

SEQ ID NO: 5764379 - DNA, 17 bp, Homo sapiens
gctctgaactgcacaat

SEQ ID NO: 5764380 - DNA, 13 bp, Homo sapiens
gctctgaagggag

SEQ ID NO: 5764381 - DNA, 21 bp, Homo sapiens
gctctgaaggtccaaagagtt

SEQ ID NO: 5764382 - DNA, 16 bp, Homo sapiens
gctctgaatctctcaa

SEQ ID NO: 5764383 - DNA, 21 bp, Homo sapiens
gctctgaatctctcaaaatgt

SEQ ID NO: 5764384 - DNA, 15 bp, Homo sapiens
gctctgaatctgata

SEQ ID NO: 5764385 - DNA, 18 bp, Homo sapiens
gctctgaatctgtacatg

SEQ ID NO: 5764386 - DNA, 19 bp, Homo sapiens
gctctgaatgggagccaga

SEQ ID NO: 5764387 - DNA, 18 bp, Homo sapiens
gctctgaattcaggtccc

SEQ ID NO: 5764388 - DNA, 21 bp, Homo sapiens
gctctgaattcaggtcccagt

SEQ ID NO: 5764389 - DNA, 14 bp, Homo sapiens
gctctgacaaagct

SEQ ID NO: 5764390 - DNA, 16 bp, Homo sapiens
gctctgacagaaagca

SEQ ID NO: 5764391 - DNA, 16 bp, Homo sapiens
gctctgacagccctgc

SEQ ID NO: 5764392 - DNA, 19 bp, Homo sapiens
gctctgacatcccttcctg

SEQ ID NO: 5764393 - DNA, 20 bp, Homo sapiens
gctctgacatcccttcctgg

SEQ ID NO: 5764394 - DNA, 14 bp, Homo sapiens
gctctgaccacttg

SEQ ID NO: 5764395 - DNA, 22 bp, Homo sapiens
gctctgaccacttgaggcctga

SEQ ID NO: 5764396 - DNA, 16 bp, Homo sapiens
gctctgacccaagtgg

SEQ ID NO: 5764397 - DNA, 19 bp, Homo sapiens
gctctgacctcctctgggc

SEQ ID NO: 5764398 - DNA, 16 bp, Homo sapiens
gctctgacgtagaaag

SEQ ID NO: 5764399 - DNA, 14 bp, Homo sapiens
gctctgagaagagg

SEQ ID NO: 5764400 - DNA, 22 bp, Homo sapiens
gctctgagaagaggagccctca

SEQ ID NO: 5764401 - DNA, 14 bp, Homo sapiens
gctctgagacacac

SEQ ID NO: 5764402 - DNA, 16 bp, Homo sapiens
gctctgagaggccctg

SEQ ID NO: 5764403 - DNA, 18 bp, Homo sapiens
gctctgagaggccctgga

SEQ ID NO: 5764404 - DNA, 20 bp, Homo sapiens
gctctgagcaaatgtggctc

SEQ ID NO: 5764405 - DNA, 13 bp, Homo sapiens
gctctgagcacag

SEQ ID NO: 5764406 - DNA, 17 bp, Homo sapiens
gctctgagcacaggtga

SEQ ID NO: 5764407 - DNA, 23 bp, Homo sapiens
gctctgagcacaggtgacagatc

SEQ ID NO: 5764408 - DNA, 13 bp, Homo sapiens
gctctgagcaggg

SEQ ID NO: 5764409 - DNA, 14 bp, Homo sapiens
gctctgagcagggg

SEQ ID NO: 5764410 - DNA, 21 bp, Homo sapiens
gctctgagcaggggcaggcgc

SEQ ID NO: 5764411 - DNA, 17 bp, Homo sapiens
gctctgagcgcctccat

SEQ ID NO: 5764412 - DNA, 13 bp, Homo sapiens
gctctgagctgtc

SEQ ID NO: 5764413 - DNA, 18 bp, Homo sapiens
gctctgaggactgcacca

SEQ ID NO: 5764414 - DNA, 19 bp, Homo sapiens
gctctgaggcaaccccctc

SEQ ID NO: 5764415 - DNA, 23 bp, Homo sapiens
gctctgaggcgccccaacccgtg

SEQ ID NO: 5764416 - DNA, 17 bp, Homo sapiens
gctctgagggaaagggc

SEQ ID NO: 5764417 - DNA, 17 bp, Homo sapiens
gctctgaggggaggcac

SEQ ID NO: 5764418 - DNA, 23 bp, Homo sapiens
gctctgaggggaggcacctccag

SEQ ID NO: 5764419 - DNA, 15 bp, Homo sapiens
gctctgagggtctga

SEQ ID NO: 5764420 - DNA, 17 bp, Homo sapiens
gctctgaggtcaataaa

SEQ ID NO: 5764421 - DNA, 23 bp, Homo sapiens
gctctgaggtcccttcaaggcct

SEQ ID NO: 5764422 - DNA, 23 bp, Homo sapiens
gctctgatcacatcccctgtcta

SEQ ID NO: 5764423 - DNA, 20 bp, Homo sapiens
gctctgatcatccactgtgc

SEQ ID NO: 5764424 - DNA, 22 bp, Homo sapiens
gctctgatccctctacagagct

SEQ ID NO: 5764425 - DNA, 16 bp, Homo sapiens
gctctgatctaacaaa

SEQ ID NO: 5764426 - DNA, 18 bp, Homo sapiens
gctctgatctaacaaaat

SEQ ID NO: 5764427 - DNA, 21 bp, Homo sapiens
gctctgatctgaggctaagac

SEQ ID NO: 5764428 - DNA, 17 bp, Homo sapiens
gctctgatgcagaactt

SEQ ID NO: 5764429 - DNA, 14 bp, Homo sapiens
gctctgatgcagtg

SEQ ID NO: 5764430 - DNA, 15 bp, Homo sapiens
gctctgatgcagtgc

SEQ ID NO: 5764431 - DNA, 20 bp, Homo sapiens
gctctgatgcagtgccctag

SEQ ID NO: 5764432 - DNA, 20 bp, Homo sapiens
gctctgatttcaggcagcag

SEQ ID NO: 5764433 - DNA, 23 bp, Homo sapiens
gctctgattttttactggctgtg

SEQ ID NO: 5764434 - DNA, 23 bp, Homo sapiens
gctctgcaagaattgaagcagga

SEQ ID NO: 5764435 - DNA, 11 bp, Homo sapiens
gctctgcacag

SEQ ID NO: 5764436 - DNA, 12 bp, Homo sapiens
gctctgcacaga

SEQ ID NO: 5764437 - DNA, 17 bp, Homo sapiens
gctctgcacagacaagc

SEQ ID NO: 5764438 - DNA, 18 bp, Homo sapiens
gctctgcacccacgtgca

SEQ ID NO: 5764439 - DNA, 15 bp, Homo sapiens
gctctgcacccctct

SEQ ID NO: 5764440 - DNA, 17 bp, Homo sapiens
gctctgcacccctctgc

SEQ ID NO: 5764441 - DNA, 13 bp, Homo sapiens
gctctgcactaag

SEQ ID NO: 5764442 - DNA, 19 bp, Homo sapiens
gctctgcactaagagaaaa

SEQ ID NO: 5764443 - DNA, 18 bp, Homo sapiens
gctctgcagcacattgcc

SEQ ID NO: 5764444 - DNA, 21 bp, Homo sapiens
gctctgcagcccacagaggac

SEQ ID NO: 5764445 - DNA, 15 bp, Homo sapiens
gctctgcaggctggg

SEQ ID NO: 5764446 - DNA, 21 bp, Homo sapiens
gctctgcagtcctactcaagc

SEQ ID NO: 5764447 - DNA, 20 bp, Homo sapiens
gctctgcagtcctggccccc

SEQ ID NO: 5764448 - DNA, 21 bp, Homo sapiens
gctctgcatatatgtctcttt

SEQ ID NO: 5764449 - DNA, 16 bp, Homo sapiens
gctctgcatgcggccc

SEQ ID NO: 5764450 - DNA, 15 bp, Homo sapiens
gctctgcatgctcct

SEQ ID NO: 5764451 - DNA, 17 bp, Homo sapiens
gctctgcatgctcctct

SEQ ID NO: 5764452 - DNA, 19 bp, Homo sapiens
gctctgcatgctcctctgc

SEQ ID NO: 5764453 - DNA, 23 bp, Homo sapiens
gctctgcatgctcctctgcctgt

SEQ ID NO: 5764454 - DNA, 14 bp, Homo sapiens
gctctgcatgtgtg

SEQ ID NO: 5764455 - DNA, 21 bp, Homo sapiens
gctctgccaatgtgggctgcc

SEQ ID NO: 5764456 - DNA, 23 bp, Homo sapiens
gctctgccaccctacctgttcag

SEQ ID NO: 5764457 - DNA, 17 bp, Homo sapiens
gctctgccagtcctgtc

SEQ ID NO: 5764458 - DNA, 22 bp, Homo sapiens
gctctgccagtggatcccctgc

SEQ ID NO: 5764459 - DNA, 21 bp, Homo sapiens
gctctgccatcagcccctgct

SEQ ID NO: 5764460 - DNA, 22 bp, Homo sapiens
gctctgccatcagcccctgctg

SEQ ID NO: 5764461 - DNA, 22 bp, Homo sapiens
gctctgttatcagctgggcagt

SEQ ID NO: 5764462 - DNA, 16 bp, Homo sapiens
gctctgttcacagtct

SEQ ID NO: 5764463 - DNA, 22 bp, Homo sapiens
gctctgttcacagtctctggaa

SEQ ID NO: 5764464 - DNA, 18 bp, Homo sapiens
gctctgttcttcctcagc

SEQ ID NO: 5764465 - DNA, 19 bp, Homo sapiens
gctctgttcttcctcagcc

SEQ ID NO: 5764466 - DNA, 22 bp, Homo sapiens
gctctgttcttcctcagccagc

SEQ ID NO: 5764467 - DNA, 15 bp, Homo sapiens
gctctgttgcccagg

SEQ ID NO: 5764468 - DNA, 22 bp, Homo sapiens
gctctgttgcccaggctggagt

SEQ ID NO: 5764469 - DNA, 16 bp, Homo sapiens
gctcttaactgttgct

SEQ ID NO: 5764470 - DNA, 19 bp, Homo sapiens
gctcttaagtaccagaagc

SEQ ID NO: 5764471 - DNA, 13 bp, Homo sapiens
gctcttaattgcc

SEQ ID NO: 5764472 - DNA, 19 bp, Homo sapiens
gctcttaattgttcatttt

SEQ ID NO: 5764473 - DNA, 19 bp, Homo sapiens
gctcttacttcccccaccc

SEQ ID NO: 5764474 - DNA, 23 bp, Homo sapiens
gctcttacttcccccaccctggg

SEQ ID NO: 5764475 - DNA, 23 bp, Homo sapiens
gctcttagactcgcctatcttag

SEQ ID NO: 5764476 - DNA, 22 bp, Homo sapiens
gctcttagattgggccatggct

SEQ ID NO: 5764477 - DNA, 16 bp, Homo sapiens
gctcttagtcccaagc

SEQ ID NO: 5764478 - DNA, 21 bp, Homo sapiens
gctcttagtcctccctgctca

SEQ ID NO: 5764479 - DNA, 15 bp, Homo sapiens
gctcttagtctcttt

SEQ ID NO: 5764480 - DNA, 22 bp, Homo sapiens
gctcttagtgcccgcctaggag

SEQ ID NO: 5764481 - DNA, 16 bp, Homo sapiens
gctcttagtttttaaa

SEQ ID NO: 5764482 - DNA, 21 bp, Homo sapiens
gctcttatgtggattaaacga

SEQ ID NO: 5764483 - DNA, 14 bp, Homo sapiens
gctcttatttcatc

SEQ ID NO: 5764484 - DNA, 15 bp, Homo sapiens
gctcttatttcatca

SEQ ID NO: 5764485 - DNA, 14 bp, Homo sapiens
gctcttatttctga

SEQ ID NO: 5764486 - DNA, 21 bp, Homo sapiens
gctcttatttttgtaccatat

SEQ ID NO: 5764487 - DNA, 18 bp, Homo sapiens
gctcttcaacatgacatc

SEQ ID NO: 5764488 - DNA, 15 bp, Homo sapiens
gctcttcaagaaaca

SEQ ID NO: 5764489 - DNA, 16 bp, Homo sapiens
gctcttcaagctgtcc

SEQ ID NO: 5764490 - DNA, 24 bp, Homo sapiens
gctcttcaagctgtcccctctgtc

SEQ ID NO: 5764491 - DNA, 19 bp, Homo sapiens
gctcttcaatgctaccggg

SEQ ID NO: 5764492 - DNA, 14 bp, Homo sapiens
gctcttcaccagga

SEQ ID NO: 5764493 - DNA, 21 bp, Homo sapiens
gctcttcactcagccacaccc

SEQ ID NO: 5764494 - DNA, 14 bp, Homo sapiens
gctcttcacttcct

SEQ ID NO: 5764495 - DNA, 15 bp, Homo sapiens
gctcttcacttcctc

SEQ ID NO: 5764496 - DNA, 18 bp, Homo sapiens
gctcttcacttcctccag

SEQ ID NO: 5764497 - DNA, 12 bp, Homo sapiens
gctcttcaggcc

SEQ ID NO: 5764498 - DNA, 19 bp, Homo sapiens
gctcttcataattctaaga

SEQ ID NO: 5764499 - DNA, 20 bp, Homo sapiens
gctcttcatctgcctgcgct

SEQ ID NO: 5764500 - DNA, 14 bp, Homo sapiens
gctcttcatgtttc

SEQ ID NO: 5764501 - DNA, 22 bp, Homo sapiens
gctcttccaggagccaccttgc

SEQ ID NO: 5764502 - DNA, 12 bp, Homo sapiens
gctcttccaggc

SEQ ID NO: 5764503 - DNA, 18 bp, Homo sapiens
gctcttccaggctgggag

SEQ ID NO: 5764504 - DNA, 22 bp, Homo sapiens
gctcttccaggctgggagagcc

SEQ ID NO: 5764505 - DNA, 11 bp, Homo sapiens
gctcttcccac

SEQ ID NO: 5764506 - DNA, 21 bp, Homo sapiens
gctcttcccccatgtgcctgt

SEQ ID NO: 5764507 - DNA, 20 bp, Homo sapiens
gctcttcccctagacctccc

SEQ ID NO: 5764508 - DNA, 16 bp, Homo sapiens
gctcttcccttgctca

SEQ ID NO: 5764509 - DNA, 20 bp, Homo sapiens
gctcttccgaaaaccaggcc

SEQ ID NO: 5764510 - DNA, 14 bp, Homo sapiens
gctcttcctctggt

SEQ ID NO: 5764511 - DNA, 23 bp, Homo sapiens
gctcttcctctggtttctgtgtg

SEQ ID NO: 5764512 - DNA, 13 bp, Homo sapiens
gctcttcctggac

SEQ ID NO: 5764513 - DNA, 22 bp, Homo sapiens
gctcttcctggacaggccaggt

SEQ ID NO: 5764514 - DNA, 14 bp, Homo sapiens
gctcttcctggacc

SEQ ID NO: 5764515 - DNA, 20 bp, Homo sapiens
gctcttcctggacctgagtc

SEQ ID NO: 5764516 - DNA, 19 bp, Homo sapiens
gctcttccttgaatcttct

SEQ ID NO: 5764517 - DNA, 20 bp, Homo sapiens
gctcttccttgaatcttctc

SEQ ID NO: 5764518 - DNA, 21 bp, Homo sapiens
gctcttcgcgcccgcccctgc

SEQ ID NO: 5764519 - DNA, 13 bp, Homo sapiens
gctcttctaagga

SEQ ID NO: 5764520 - DNA, 22 bp, Homo sapiens
gctcttctatttaaaaaataaa

SEQ ID NO: 5764521 - DNA, 13 bp, Homo sapiens
gctcttctcagtg

SEQ ID NO: 5764522 - DNA, 12 bp, Homo sapiens
gctcttctcatt

SEQ ID NO: 5764523 - DNA, 14 bp, Homo sapiens
gctcttctcatttc

SEQ ID NO: 5764524 - DNA, 22 bp, Homo sapiens
gctcttctcatttcacccctcc

SEQ ID NO: 5764525 - DNA, 15 bp, Homo sapiens
gctcttctccacgtc

SEQ ID NO: 5764526 - DNA, 14 bp, Homo sapiens
gctcttctccaggc

SEQ ID NO: 5764527 - DNA, 17 bp, Homo sapiens
gctcttctccttggagg

SEQ ID NO: 5764528 - DNA, 19 bp, Homo sapiens
gctcttctccttggaggac

SEQ ID NO: 5764529 - DNA, 22 bp, Homo sapiens
gctcttctccttggaggacagt

SEQ ID NO: 5764530 - DNA, 21 bp, Homo sapiens
gctcttctcctttcacaacct

SEQ ID NO: 5764531 - DNA, 16 bp, Homo sapiens
gctcttctctccccag

SEQ ID NO: 5764532 - DNA, 18 bp, Homo sapiens
gctcttctctccccagcc

SEQ ID NO: 5764533 - DNA, 23 bp, Homo sapiens
gctcttctctccccagccccctc

SEQ ID NO: 5764534 - DNA, 21 bp, Homo sapiens
gctcttctgatcagtctgtct

SEQ ID NO: 5764535 - DNA, 21 bp, Homo sapiens
gctcttctggagtttctctaa

SEQ ID NO: 5764536 - DNA, 22 bp, Homo sapiens
gctcttctgggcagagcctgtc

SEQ ID NO: 5764537 - DNA, 19 bp, Homo sapiens
gctcttctgtatgtgacaa

SEQ ID NO: 5764538 - DNA, 17 bp, Homo sapiens
gctcttctgtgcccagg

SEQ ID NO: 5764539 - DNA, 16 bp, Homo sapiens
gctcttctgttctcaa

SEQ ID NO: 5764540 - DNA, 12 bp, Homo sapiens
gctcttcttcct

SEQ ID NO: 5764541 - DNA, 14 bp, Homo sapiens
gctcttcttgaaaa

SEQ ID NO: 5764542 - DNA, 14 bp, Homo sapiens
gctcttctttccca

SEQ ID NO: 5764543 - DNA, 16 bp, Homo sapiens
gctcttctttctgaga

SEQ ID NO: 5764544 - DNA, 15 bp, Homo sapiens
gctcttgaaatatgt

SEQ ID NO: 5764545 - DNA, 15 bp, Homo sapiens
gctcttgaacctgtg

SEQ ID NO: 5764546 - DNA, 16 bp, Homo sapiens
gctcttgaactcctga

SEQ ID NO: 5764547 - DNA, 19 bp, Homo sapiens
gctcttgacagaaagcagt

SEQ ID NO: 5764548 - DNA, 15 bp, Homo sapiens
gctcttgaggagctc

SEQ ID NO: 5764549 - DNA, 15 bp, Homo sapiens
gctcttgatgcctgg

SEQ ID NO: 5764550 - DNA, 18 bp, Homo sapiens
gctcttgcagagaagcct

SEQ ID NO: 5764551 - DNA, 22 bp, Homo sapiens
gctcttgcatagtaaatgtagt

SEQ ID NO: 5764552 - DNA, 17 bp, Homo sapiens
gctcttgcatctgggcc

SEQ ID NO: 5764553 - DNA, 18 bp, Homo sapiens
gctcttgcccttccctgt

SEQ ID NO: 5764554 - DNA, 11 bp, Homo sapiens
gctcttgcctg

SEQ ID NO: 5764555 - DNA, 19 bp, Homo sapiens
gctcttgctaatcagtgtc

SEQ ID NO: 5764556 - DNA, 19 bp, Homo sapiens
gctcttgctttggtcttct

SEQ ID NO: 5764557 - DNA, 17 bp, Homo sapiens
gctcttggaagagctct

SEQ ID NO: 5764558 - DNA, 17 bp, Homo sapiens
gctcttggagctgtgag

SEQ ID NO: 5764559 - DNA, 19 bp, Homo sapiens
gctcttggcaggtactcag

SEQ ID NO: 5764560 - DNA, 13 bp, Homo sapiens
gctcttggcattt

SEQ ID NO: 5764561 - DNA, 22 bp, Homo sapiens
gctcttggcattttcctcgcct

SEQ ID NO: 5764562 - DNA, 11 bp, Homo sapiens
gctcttggccc

SEQ ID NO: 5764563 - DNA, 12 bp, Homo sapiens
gctcttggcctt

SEQ ID NO: 5764564 - DNA, 16 bp, Homo sapiens
gctcttggctgacccc

SEQ ID NO: 5764565 - DNA, 13 bp, Homo sapiens
gctcttggctgga

SEQ ID NO: 5764566 - DNA, 18 bp, Homo sapiens
gctcttggctggacccag

SEQ ID NO: 5764567 - DNA, 21 bp, Homo sapiens
gctcttggctggacccagcca

SEQ ID NO: 5764568 - DNA, 19 bp, Homo sapiens
gctcttgggaccccagaga

SEQ ID NO: 5764569 - DNA, 21 bp, Homo sapiens
gctcttgggaccccagagaaa

SEQ ID NO: 5764570 - DNA, 23 bp, Homo sapiens
gctcttggggttcataggggcag

SEQ ID NO: 5764571 - DNA, 24 bp, Homo sapiens
gctcttggggttcataggggcagg

SEQ ID NO: 5764572 - DNA, 15 bp, Homo sapiens
gctcttggtacctgt

SEQ ID NO: 5764573 - DNA, 18 bp, Homo sapiens
gctcttggtacctgtggg

SEQ ID NO: 5764574 - DNA, 19 bp, Homo sapiens
gctcttggtgggcccaggg

SEQ ID NO: 5764575 - DNA, 23 bp, Homo sapiens
gctcttgtcctcagtccatttat

SEQ ID NO: 5764576 - DNA, 16 bp, Homo sapiens
gctcttgtcggggtgg

SEQ ID NO: 5764577 - DNA, 20 bp, Homo sapiens
gctcttgtgaggaaagtcat

SEQ ID NO: 5764578 - DNA, 22 bp, Homo sapiens
gctcttgtgctggatggagccc

SEQ ID NO: 5764579 - DNA, 22 bp, Homo sapiens
gctcttgtggtacacacagatt

SEQ ID NO: 5764580 - DNA, 18 bp, Homo sapiens
gctcttgttccgtgccag

SEQ ID NO: 5764581 - DNA, 16 bp, Homo sapiens
gctcttgttctgttcc

SEQ ID NO: 5764582 - DNA, 16 bp, Homo sapiens
gctcttgtttcactcc

SEQ ID NO: 5764583 - DNA, 18 bp, Homo sapiens
gctcttgtttctgtttag

SEQ ID NO: 5764584 - DNA, 22 bp, Homo sapiens
gctcttgtttttattaatttat

SEQ ID NO: 5764585 - DNA, 13 bp, Homo sapiens
gctctttcagaga

SEQ ID NO: 5764586 - DNA, 12 bp, Homo sapiens
gctctttcaggg

SEQ ID NO: 5764587 - DNA, 20 bp, Homo sapiens
gctctttccaaattaaaaca

SEQ ID NO: 5764588 - DNA, 22 bp, Homo sapiens
gctctttccacttgccctgtgt

SEQ ID NO: 5764589 - DNA, 23 bp, Homo sapiens
gctctttccacttgccctgtgtt

SEQ ID NO: 5764590 - DNA, 20 bp, Homo sapiens
gctctttcccacccagcctg

SEQ ID NO: 5764591 - DNA, 12 bp, Homo sapiens
gctctttcccag

SEQ ID NO: 5764592 - DNA, 16 bp, Homo sapiens
gctctttcccggcagc

SEQ ID NO: 5764593 - DNA, 20 bp, Homo sapiens
gctctttcccttttctgttt

SEQ ID NO: 5764594 - DNA, 16 bp, Homo sapiens
gctctttccttgctca

SEQ ID NO: 5764595 - DNA, 18 bp, Homo sapiens
gctctttccttgctcaac

SEQ ID NO: 5764596 - DNA, 22 bp, Homo sapiens
gctctttctacatgactgggcc

SEQ ID NO: 5764597 - DNA, 23 bp, Homo sapiens
gctctttctacatgactgggcct

SEQ ID NO: 5764598 - DNA, 14 bp, Homo sapiens
gctctttctctgag

SEQ ID NO: 5764599 - DNA, 15 bp, Homo sapiens
gctctttctctgcca

SEQ ID NO: 5764600 - DNA, 17 bp, Homo sapiens
gctctttctctgccagt

SEQ ID NO: 5764601 - DNA, 13 bp, Homo sapiens
gctctttgagaaa

SEQ ID NO: 5764602 - DNA, 23 bp, Homo sapiens
gctctttgagaactgcttctaag

SEQ ID NO: 5764603 - DNA, 20 bp, Homo sapiens
gctctttggggtcagccagg

SEQ ID NO: 5764604 - DNA, 21 bp, Homo sapiens
gctctttggggtcagccaggg

SEQ ID NO: 5764605 - DNA, 18 bp, Homo sapiens
gctctttggtctattttc

SEQ ID NO: 5764606 - DNA, 14 bp, Homo sapiens
gctctttgtggcag

SEQ ID NO: 5764607 - DNA, 21 bp, Homo sapiens
gctctttgttttgtgtctctt

SEQ ID NO: 5764608 - DNA, 15 bp, Homo sapiens
gctcttttaagcagt

SEQ ID NO: 5764609 - DNA, 13 bp, Homo sapiens
gctcttttccact

SEQ ID NO: 5764610 - DNA, 20 bp, Homo sapiens
gctcttttccactccaagat

SEQ ID NO: 5764611 - DNA, 13 bp, Homo sapiens
gctcttttcctgg

SEQ ID NO: 5764612 - DNA, 21 bp, Homo sapiens
gctcttttcctggtgctcttt

SEQ ID NO: 5764613 - DNA, 19 bp, Homo sapiens
gctcttttctaagtggcgt

SEQ ID NO: 5764614 - DNA, 13 bp, Homo sapiens
gctcttttgcaca

SEQ ID NO: 5764615 - DNA, 24 bp, Homo sapiens
gctcttttggtggggagcacttgc

SEQ ID NO: 5764616 - DNA, 21 bp, Homo sapiens
gctcttttttgtttgtttctt

SEQ ID NO: 5764617 - DNA, 22 bp, Homo sapiens
gctcttttttgtttgtttcttt

SEQ ID NO: 5764618 - DNA, 20 bp, Homo sapiens
gctgaaaaacacaacttgtg

SEQ ID NO: 5764619 - DNA, 20 bp, Homo sapiens
gctgaaaaagaaaaaaatga

SEQ ID NO: 5764620 - DNA, 12 bp, Homo sapiens
gctgaaaacaat

SEQ ID NO: 5764621 - DNA, 23 bp, Homo sapiens
gctgaaaaccatctggcctggcc

SEQ ID NO: 5764622 - DNA, 16 bp, Homo sapiens
gctgaaaacggagagg

SEQ ID NO: 5764623 - DNA, 20 bp, Homo sapiens
gctgaaaactaatgtactgt

SEQ ID NO: 5764624 - DNA, 14 bp, Homo sapiens
gctgaaaagtaaat

SEQ ID NO: 5764625 - DNA, 16 bp, Homo sapiens
gctgaaaagtaaattg

SEQ ID NO: 5764626 - DNA, 14 bp, Homo sapiens
gctgaaaagtgctt

SEQ ID NO: 5764627 - DNA, 12 bp, Homo sapiens
gctgaaaatata

SEQ ID NO: 5764628 - DNA, 15 bp, Homo sapiens
gctgaaaatataaaa

SEQ ID NO: 5764629 - DNA, 13 bp, Homo sapiens
gctgaaaatcact

SEQ ID NO: 5764630 - DNA, 19 bp, Homo sapiens
gctgaaaatgcaaagctga

SEQ ID NO: 5764631 - DNA, 16 bp, Homo sapiens
gctgaaacaacaaata

SEQ ID NO: 5764632 - DNA, 16 bp, Homo sapiens
gctgaaacaggagaga

SEQ ID NO: 5764633 - DNA, 18 bp, Homo sapiens
gctgaaacgcatctagtt

SEQ ID NO: 5764634 - DNA, 16 bp, Homo sapiens
gctgaaagacagtaaa

SEQ ID NO: 5764635 - DNA, 21 bp, Homo sapiens
gctgaaagatatgtatatttt

SEQ ID NO: 5764636 - DNA, 13 bp, Homo sapiens
gctgaaagccaag

SEQ ID NO: 5764637 - DNA, 20 bp, Homo sapiens
gctgactgatgttgagggaa

SEQ ID NO: 5764638 - DNA, 20 bp, Homo sapiens
gctgactgggaacaccccat

SEQ ID NO: 5764639 - DNA, 16 bp, Homo sapiens
gctgactggggctggg

SEQ ID NO: 5764640 - DNA, 22 bp, Homo sapiens
gctgactgggggcctctgcctc

SEQ ID NO: 5764641 - DNA, 19 bp, Homo sapiens
gctgactggtttctcctgg

SEQ ID NO: 5764642 - DNA, 22 bp, Homo sapiens
gctgactggtttctcctggtag

SEQ ID NO: 5764643 - DNA, 18 bp, Homo sapiens
gctgactgtactcctccc

SEQ ID NO: 5764644 - DNA, 20 bp, Homo sapiens
gctgactgtggccccctccg

SEQ ID NO: 5764645 - DNA, 17 bp, Homo sapiens
gctgactgttcttggta

SEQ ID NO: 5764646 - DNA, 17 bp, Homo sapiens
gctgactgtttcattca

SEQ ID NO: 5764647 - DNA, 14 bp, Homo sapiens
gctgactgtttttt

SEQ ID NO: 5764648 - DNA, 17 bp, Homo sapiens
gctgacttagcctcctc

SEQ ID NO: 5764649 - DNA, 13 bp, Homo sapiens
gctgacttcccaa

SEQ ID NO: 5764650 - DNA, 20 bp, Homo sapiens
gctgacttcccaagccctgg

SEQ ID NO: 5764651 - DNA, 23 bp, Homo sapiens
gctgacttcccaagccctggtga

SEQ ID NO: 5764652 - DNA, 14 bp, Homo sapiens
gctgacttggcact

SEQ ID NO: 5764653 - DNA, 15 bp, Homo sapiens
gctgacttggcactt

SEQ ID NO: 5764654 - DNA, 17 bp, Homo sapiens
gctgacttggcacttaa

SEQ ID NO: 5764655 - DNA, 17 bp, Homo sapiens
gctgacttggctggtgt

SEQ ID NO: 5764656 - DNA, 12 bp, Homo sapiens
gctgagaaaagt

SEQ ID NO: 5764657 - DNA, 16 bp, Homo sapiens
gctgagaacctggcct

SEQ ID NO: 5764658 - DNA, 17 bp, Homo sapiens
gctgagaacctggcctt

SEQ ID NO: 5764659 - DNA, 18 bp, Homo sapiens
gctgagaagaagctgagg

SEQ ID NO: 5764660 - DNA, 12 bp, Homo sapiens
gctgagaagact

SEQ ID NO: 5764661 - DNA, 16 bp, Homo sapiens
gctgagaagaggagga

SEQ ID NO: 5764662 - DNA, 16 bp, Homo sapiens
gctgagaaggacacct

SEQ ID NO: 5764663 - DNA, 19 bp, Homo sapiens
gctgagaaggccagccctc

SEQ ID NO: 5764664 - DNA, 13 bp, Homo sapiens
gctgagaatagaa

SEQ ID NO: 5764665 - DNA, 17 bp, Homo sapiens
gctgagaatagaaggaa

SEQ ID NO: 5764666 - DNA, 19 bp, Homo sapiens
gctgagaatagaaggaaac

SEQ ID NO: 5764667 - DNA, 22 bp, Homo sapiens
gctgagaatccccgtgctcaca

SEQ ID NO: 5764668 - DNA, 16 bp, Homo sapiens
gctgagaatgtggaat

SEQ ID NO: 5764669 - DNA, 17 bp, Homo sapiens
gctgagacacagcccag

SEQ ID NO: 5764670 - DNA, 14 bp, Homo sapiens
gctgagacaggaga

SEQ ID NO: 5764671 - DNA, 19 bp, Homo sapiens
gctgagacaggagaaacac

SEQ ID NO: 5764672 - DNA, 16 bp, Homo sapiens
gctgagacatccctca

SEQ ID NO: 5764673 - DNA, 15 bp, Homo sapiens
gctgagaccagggtc

SEQ ID NO: 5764674 - DNA, 19 bp, Homo sapiens
gctgagacccttatttaaa

SEQ ID NO: 5764675 - DNA, 14 bp, Homo sapiens
gctgagactgcggg

SEQ ID NO: 5764676 - DNA, 19 bp, Homo sapiens
gctgagactggatactgcc

SEQ ID NO: 5764677 - DNA, 13 bp, Homo sapiens
gctgagacttacg

SEQ ID NO: 5764678 - DNA, 21 bp, Homo sapiens
gctgagacttacgccctgttc

SEQ ID NO: 5764679 - DNA, 22 bp, Homo sapiens
gctgagagaccaggagggcact

SEQ ID NO: 5764680 - DNA, 14 bp, Homo sapiens
gctgagagactttt

SEQ ID NO: 5764681 - DNA, 13 bp, Homo sapiens
gctgagagccaga

SEQ ID NO: 5764682 - DNA, 16 bp, Homo sapiens
gctgagagccagatgc

SEQ ID NO: 5764683 - DNA, 14 bp, Homo sapiens
gctgagagccccag

SEQ ID NO: 5764684 - DNA, 17 bp, Homo sapiens
gctgagagcccccacct

SEQ ID NO: 5764685 - DNA, 12 bp, Homo sapiens
gctgagaggaag

SEQ ID NO: 5764686 - DNA, 14 bp, Homo sapiens
gctgagaggatgaa

SEQ ID NO: 5764687 - DNA, 16 bp, Homo sapiens
gctgagaggcaccagt

SEQ ID NO: 5764688 - DNA, 17 bp, Homo sapiens
gctgagaggctgcctcc

SEQ ID NO: 5764689 - DNA, 18 bp, Homo sapiens
gctgagagggctgtggct

SEQ ID NO: 5764690 - DNA, 21 bp, Homo sapiens
gctgagagggtgtgggtgccc

SEQ ID NO: 5764691 - DNA, 15 bp, Homo sapiens
gctgagagtggggct

SEQ ID NO: 5764692 - DNA, 16 bp, Homo sapiens
gctgagatcctggact

SEQ ID NO: 5764693 - DNA, 22 bp, Homo sapiens
gctgagatcctggactgagggg

SEQ ID NO: 5764694 - DNA, 20 bp, Homo sapiens
gctgagatcgtgccactgca

SEQ ID NO: 5764695 - DNA, 16 bp, Homo sapiens
gctgagatgcaccaag

SEQ ID NO: 5764696 - DNA, 19 bp, Homo sapiens
gctgagatgggaggatcac

SEQ ID NO: 5764697 - DNA, 13 bp, Homo sapiens
gctgagatgtgga

SEQ ID NO: 5764698 - DNA, 22 bp, Homo sapiens
gctgagattgcgccactgcact

SEQ ID NO: 5764699 - DNA, 23 bp, Homo sapiens
gctgagcacagacggaggaagcc

SEQ ID NO: 5764700 - DNA, 16 bp, Homo sapiens
gctgagcaccctctcc

SEQ ID NO: 5764701 - DNA, 16 bp, Homo sapiens
gctgagcacctctcag

SEQ ID NO: 5764702 - DNA, 17 bp, Homo sapiens
gctgagcacctctcaga

SEQ ID NO: 5764703 - DNA, 19 bp, Homo sapiens
gctgagcacctctcagagc

SEQ ID NO: 5764704 - DNA, 13 bp, Homo sapiens
gctgagcaccttt

SEQ ID NO: 5764705 - DNA, 22 bp, Homo sapiens
gctgagcacctttggaaacaac

SEQ ID NO: 5764706 - DNA, 14 bp, Homo sapiens
gctgagcagcctct

SEQ ID NO: 5764707 - DNA, 17 bp, Homo sapiens
gctgagcagcctctgga

SEQ ID NO: 5764708 - DNA, 14 bp, Homo sapiens
gctgagcaggccac

SEQ ID NO: 5764709 - DNA, 21 bp, Homo sapiens
gctgagcaggcccgacagaga

SEQ ID NO: 5764710 - DNA, 16 bp, Homo sapiens
gctgagcagggccggg

SEQ ID NO: 5764711 - DNA, 14 bp, Homo sapiens
gctgagccaaagcc

SEQ ID NO: 5764712 - DNA, 15 bp, Homo sapiens
gctgagccaaagcca

SEQ ID NO: 5764713 - DNA, 18 bp, Homo sapiens
gctgagccaaagccagag

SEQ ID NO: 5764714 - DNA, 23 bp, Homo sapiens
gctgagccaaagccagagtggcc

SEQ ID NO: 5764715 - DNA, 17 bp, Homo sapiens
gctgagccactcgcagt

SEQ ID NO: 5764716 - DNA, 14 bp, Homo sapiens
gctgagccagctgc

SEQ ID NO: 5764717 - DNA, 15 bp, Homo sapiens
gctgagccagctgca

SEQ ID NO: 5764718 - DNA, 13 bp, Homo sapiens
gctgagccaggct

SEQ ID NO: 5764719 - DNA, 14 bp, Homo sapiens
gctgagccatgagg

SEQ ID NO: 5764720 - DNA, 16 bp, Homo sapiens
gctgagccatgaggag

SEQ ID NO: 5764721 - DNA, 22 bp, Homo sapiens
gctgagccattgagtgctgggg

SEQ ID NO: 5764722 - DNA, 14 bp, Homo sapiens
gctgagcccactct

SEQ ID NO: 5764723 - DNA, 20 bp, Homo sapiens
gctgagcccactctactgcc

SEQ ID NO: 5764724 - DNA, 14 bp, Homo sapiens
gctgagcccagcca

SEQ ID NO: 5764725 - DNA, 21 bp, Homo sapiens
gctgagcccctcctctcctcg

SEQ ID NO: 5764726 - DNA, 14 bp, Homo sapiens
gctgagcccctggt

SEQ ID NO: 5764727 - DNA, 21 bp, Homo sapiens
gctgagcccctggtcttctct

SEQ ID NO: 5764728 - DNA, 15 bp, Homo sapiens
gctgagcccctgtct

SEQ ID NO: 5764729 - DNA, 23 bp, Homo sapiens
gctgagcccctgtctagagaggg

SEQ ID NO: 5764730 - DNA, 15 bp, Homo sapiens
gctgagccctcctga

SEQ ID NO: 5764731 - DNA, 12 bp, Homo sapiens
gctgagccctgg

SEQ ID NO: 5764732 - DNA, 20 bp, Homo sapiens
gctgagcctctgctccccag

SEQ ID NO: 5764733 - DNA, 16 bp, Homo sapiens
gctgagcctgaggcct

SEQ ID NO: 5764734 - DNA, 17 bp, Homo sapiens
gctgagcctgaggcctt

SEQ ID NO: 5764735 - DNA, 21 bp, Homo sapiens
gctgagcctgaggccttccag

SEQ ID NO: 5764736 - DNA, 19 bp, Homo sapiens
gctgagcctgcagggaagc

SEQ ID NO: 5764737 - DNA, 16 bp, Homo sapiens
gctgagccttctgagc

SEQ ID NO: 5764738 - DNA, 12 bp, Homo sapiens
gctgagcgcccc

SEQ ID NO: 5764739 - DNA, 21 bp, Homo sapiens
gctgagcgggtctagtggaaa

SEQ ID NO: 5764740 - DNA, 22 bp, Homo sapiens
gctgagcgtggaagggggagga

SEQ ID NO: 5764741 - DNA, 16 bp, Homo sapiens
gctgagctacctgggg

SEQ ID NO: 5764742 - DNA, 22 bp, Homo sapiens
gctgagctagcctccagctttg

SEQ ID NO: 5764743 - DNA, 16 bp, Homo sapiens
gctgagctcacaaggc

SEQ ID NO: 5764744 - DNA, 20 bp, Homo sapiens
gctgagctccagccaccccg

SEQ ID NO: 5764745 - DNA, 13 bp, Homo sapiens
gctgagctctgag

SEQ ID NO: 5764746 - DNA, 19 bp, Homo sapiens
gctgagctctgagaggccc

SEQ ID NO: 5764747 - DNA, 21 bp, Homo sapiens
gctgagctctgagaggccctg

SEQ ID NO: 5764748 - DNA, 14 bp, Homo sapiens
gctgagctgaagaa

SEQ ID NO: 5764749 - DNA, 22 bp, Homo sapiens
gctgagctgcccacagcaggcc

SEQ ID NO: 5764750 - DNA, 16 bp, Homo sapiens
gctgagctgcccctgc

SEQ ID NO: 5764751 - DNA, 18 bp, Homo sapiens
gctgagctgcccctgctg

SEQ ID NO: 5764752 - DNA, 22 bp, Homo sapiens
gctgagctgcccctgctgctta

SEQ ID NO: 5764753 - DNA, 14 bp, Homo sapiens
gctgagctggcttc

SEQ ID NO: 5764754 - DNA, 16 bp, Homo sapiens
gctgagctgggcccag

SEQ ID NO: 5764755 - DNA, 18 bp, Homo sapiens
gctgagctgggcccagcc

SEQ ID NO: 5764756 - DNA, 21 bp, Homo sapiens
gctgagctgggcccagcccct

SEQ ID NO: 5764757 - DNA, 17 bp, Homo sapiens
gctgagctgtgccagct

SEQ ID NO: 5764758 - DNA, 18 bp, Homo sapiens
gctgagctgtgccagctg

SEQ ID NO: 5764759 - DNA, 22 bp, Homo sapiens
gctgagctgtgccagctgcttc

SEQ ID NO: 5764760 - DNA, 14 bp, Homo sapiens
gctgagcttgagct

SEQ ID NO: 5764761 - DNA, 20 bp, Homo sapiens
gctgagcttgtcttttctgc

SEQ ID NO: 5764762 - DNA, 22 bp, Homo sapiens
gctgagcttgtcttttctgctg

SEQ ID NO: 5764763 - DNA, 12 bp, Homo sapiens
gctgaggaaagg

SEQ ID NO: 5764764 - DNA, 15 bp, Homo sapiens
gctgaggaaaggcca

SEQ ID NO: 5764765 - DNA, 21 bp, Homo sapiens
gctgaggaaaggccagctggc

SEQ ID NO: 5764766 - DNA, 22 bp, Homo sapiens
gctgaggaaaggccagctggca

SEQ ID NO: 5764767 - DNA, 23 bp, Homo sapiens
gctgaggaaaggccagctggcag

SEQ ID NO: 5764768 - DNA, 15 bp, Homo sapiens
gctgaggaacaggtt

SEQ ID NO: 5764769 - DNA, 21 bp, Homo sapiens
gctgaggaacaggttcctgtg

SEQ ID NO: 5764770 - DNA, 14 bp, Homo sapiens
gctgaggaccctca

SEQ ID NO: 5764771 - DNA, 17 bp, Homo sapiens
gctgaggaccctcagcc

SEQ ID NO: 5764772 - DNA, 13 bp, Homo sapiens
gctgaggacgaga

SEQ ID NO: 5764773 - DNA, 23 bp, Homo sapiens
gctgaggacgagacccccatcca

SEQ ID NO: 5764774 - DNA, 13 bp, Homo sapiens
gctgaggactccc

SEQ ID NO: 5764775 - DNA, 14 bp, Homo sapiens
gctgaggactccct

SEQ ID NO: 5764776 - DNA, 13 bp, Homo sapiens
gctgaggactctg

SEQ ID NO: 5764777 - DNA, 14 bp, Homo sapiens
gctgaggactctgc

SEQ ID NO: 5764778 - DNA, 18 bp, Homo sapiens
gctgaggagacaaccaga

SEQ ID NO: 5764779 - DNA, 14 bp, Homo sapiens
gctgaggagcagcc

SEQ ID NO: 5764780 - DNA, 18 bp, Homo sapiens
gctgaggagcagccagga

SEQ ID NO: 5764781 - DNA, 18 bp, Homo sapiens
gctgaggaggcacctaca

SEQ ID NO: 5764782 - DNA, 21 bp, Homo sapiens
gctgaggaggcctccatctca

SEQ ID NO: 5764783 - DNA, 16 bp, Homo sapiens
gctgaggagtctgagg

SEQ ID NO: 5764784 - DNA, 18 bp, Homo sapiens
gctgaggatcctcacagg

SEQ ID NO: 5764785 - DNA, 22 bp, Homo sapiens
gctgaggatcctcacaggagca

SEQ ID NO: 5764786 - DNA, 17 bp, Homo sapiens
gctgaggatgggctctg

SEQ ID NO: 5764787 - DNA, 19 bp, Homo sapiens
gctgaggatttcaagcctg

SEQ ID NO: 5764788 - DNA, 14 bp, Homo sapiens
gctgaggcaattct

SEQ ID NO: 5764789 - DNA, 14 bp, Homo sapiens
gctgaggcaccaga

SEQ ID NO: 5764790 - DNA, 14 bp, Homo sapiens
gctgaggcaggaga

SEQ ID NO: 5764791 - DNA, 15 bp, Homo sapiens
gctgaggcaggagaa

SEQ ID NO: 5764792 - DNA, 18 bp, Homo sapiens
gctgaggcaggagaattg

SEQ ID NO: 5764793 - DNA, 21 bp, Homo sapiens
gctgaggcaggagactggcgt

SEQ ID NO: 5764794 - DNA, 18 bp, Homo sapiens
gctgaggcaggaggatca

SEQ ID NO: 5764795 - DNA, 21 bp, Homo sapiens
gctgaggccacactcagcaca

SEQ ID NO: 5764796 - DNA, 15 bp, Homo sapiens
gctgaggccacccac

SEQ ID NO: 5764797 - DNA, 13 bp, Homo sapiens
gctgaggccagag

SEQ ID NO: 5764798 - DNA, 17 bp, Homo sapiens
gctgaggccagaggaag

SEQ ID NO: 5764799 - DNA, 19 bp, Homo sapiens
gctgaggccagaggaaggg

SEQ ID NO: 5764800 - DNA, 23 bp, Homo sapiens
gctgaggccagaggaagggaggc

SEQ ID NO: 5764801 - DNA, 15 bp, Homo sapiens
gctgaggccagagtc

SEQ ID NO: 5764802 - DNA, 22 bp, Homo sapiens
gctgaggccccagggctgtggg

SEQ ID NO: 5764803 - DNA, 22 bp, Homo sapiens
gctgaggccggatgcggtggct

SEQ ID NO: 5764804 - DNA, 12 bp, Homo sapiens
gctgaggcctcc

SEQ ID NO: 5764805 - DNA, 16 bp, Homo sapiens
gctgaggcctcccttg

SEQ ID NO: 5764806 - DNA, 14 bp, Homo sapiens
gctgaggcctggac

SEQ ID NO: 5764807 - DNA, 21 bp, Homo sapiens
gctgaggcctggactttcctg

SEQ ID NO: 5764808 - DNA, 16 bp, Homo sapiens
gctgaggcctgggccg

SEQ ID NO: 5764809 - DNA, 20 bp, Homo sapiens
gctgaggccttctcttgagg

SEQ ID NO: 5764810 - DNA, 17 bp, Homo sapiens
gctgaggctgagaaagc

SEQ ID NO: 5764811 - DNA, 14 bp, Homo sapiens
gctgaggctgctgc

SEQ ID NO: 5764812 - DNA, 17 bp, Homo sapiens
gctgaggctgctgccag

SEQ ID NO: 5764813 - DNA, 18 bp, Homo sapiens
gctgaggctgctgccagg

SEQ ID NO: 5764814 - DNA, 19 bp, Homo sapiens
gctgaggctgctgccaggc

SEQ ID NO: 5764815 - DNA, 14 bp, Homo sapiens
gctgcaagccaggg

SEQ ID NO: 5764816 - DNA, 15 bp, Homo sapiens
gctgcaagctgcagg

SEQ ID NO: 5764817 - DNA, 17 bp, Homo sapiens
gctgcaagctgctgaag

SEQ ID NO: 5764818 - DNA, 17 bp, Homo sapiens
gctgcaaggaagggtgg

SEQ ID NO: 5764819 - DNA, 14 bp, Homo sapiens
gctgcaaggccttt

SEQ ID NO: 5764820 - DNA, 18 bp, Homo sapiens
gctgcaaggtggcctctg

SEQ ID NO: 5764821 - DNA, 24 bp, Homo sapiens
gctgcaaggtggcctctgcctggg

SEQ ID NO: 5764822 - DNA, 21 bp, Homo sapiens
gctgcaaggtttaggctggtg

SEQ ID NO: 5764823 - DNA, 18 bp, Homo sapiens
gctgcaatccatttattt

SEQ ID NO: 5764824 - DNA, 16 bp, Homo sapiens
gctgcaatgagccatg

SEQ ID NO: 5764825 - DNA, 15 bp, Homo sapiens
gctgcaatgcctaga

SEQ ID NO: 5764826 - DNA, 16 bp, Homo sapiens
gctgcaattgagggct

SEQ ID NO: 5764827 - DNA, 17 bp, Homo sapiens
gctgcacaaaagcagat

SEQ ID NO: 5764828 - DNA, 22 bp, Homo sapiens
gctgcacaacagccctgcctga

SEQ ID NO: 5764829 - DNA, 22 bp, Homo sapiens
gctgcacaccaaggccctgcat

SEQ ID NO: 5764830 - DNA, 11 bp, Homo sapiens
gctgcacagcc

SEQ ID NO: 5764831 - DNA, 14 bp, Homo sapiens
gctgcacagcccaa

SEQ ID NO: 5764832 - DNA, 18 bp, Homo sapiens
gctgcacagtagtgttgg

SEQ ID NO: 5764833 - DNA, 14 bp, Homo sapiens
gctgcacatagcag

SEQ ID NO: 5764834 - DNA, 15 bp, Homo sapiens
gctgcacatagcaga

SEQ ID NO: 5764835 - DNA, 16 bp, Homo sapiens
gctgcacatggcctga

SEQ ID NO: 5764836 - DNA, 14 bp, Homo sapiens
gctgcacattcctg

SEQ ID NO: 5764837 - DNA, 13 bp, Homo sapiens
gctgcaccaaccc

SEQ ID NO: 5764838 - DNA, 18 bp, Homo sapiens
gctgcaccaacccagccg

SEQ ID NO: 5764839 - DNA, 21 bp, Homo sapiens
gctgcaccaacccagccgctg

SEQ ID NO: 5764840 - DNA, 22 bp, Homo sapiens
gctgcaccaacctcactgccct

SEQ ID NO: 5764841 - DNA, 22 bp, Homo sapiens
gctgcaccagagcaacctctca

SEQ ID NO: 5764842 - DNA, 19 bp, Homo sapiens
gctgcaccatcacacatgc

SEQ ID NO: 5764843 - DNA, 21 bp, Homo sapiens
gctgcaccccagcgtcaggcc

SEQ ID NO: 5764844 - DNA, 22 bp, Homo sapiens
gctgcaccccagcgtcaggcct

SEQ ID NO: 5764845 - DNA, 13 bp, Homo sapiens
gctgcaccctcag

SEQ ID NO: 5764846 - DNA, 16 bp, Homo sapiens
gctgcaccctcaggca

SEQ ID NO: 5764847 - DNA, 21 bp, Homo sapiens
gctgcaccctgcgcctccaga

SEQ ID NO: 5764848 - DNA, 23 bp, Homo sapiens
gctgcaccctgcgcctccagagg

SEQ ID NO: 5764849 - DNA, 17 bp, Homo sapiens
gctgcaccggctggcct

SEQ ID NO: 5764850 - DNA, 19 bp, Homo sapiens
gctgcaccggctggcctgg

SEQ ID NO: 5764851 - DNA, 19 bp, Homo sapiens
gctgcacctcctaccctcc

SEQ ID NO: 5764852 - DNA, 13 bp, Homo sapiens
gctgcacctctgg

SEQ ID NO: 5764853 - DNA, 18 bp, Homo sapiens
gctgcacctctggctaga

SEQ ID NO: 5764854 - DNA, 17 bp, Homo sapiens
gctgcacctgcagggag

SEQ ID NO: 5764855 - DNA, 18 bp, Homo sapiens
gctgcacctgcagggagc

SEQ ID NO: 5764856 - DNA, 12 bp, Homo sapiens
gctgcacctgcc

SEQ ID NO: 5764857 - DNA, 20 bp, Homo sapiens
gctgcacctgccagcctggc

SEQ ID NO: 5764858 - DNA, 16 bp, Homo sapiens
gctgcacgctcccctc

SEQ ID NO: 5764859 - DNA, 18 bp, Homo sapiens
gctgcacgctcccctcca

SEQ ID NO: 5764860 - DNA, 21 bp, Homo sapiens
gctgcacgtcaccctcctgag

SEQ ID NO: 5764861 - DNA, 22 bp, Homo sapiens
gctgcacgtcaccctcctgagc

SEQ ID NO: 5764862 - DNA, 23 bp, Homo sapiens
gctgcactctgtagcaaatttgt

SEQ ID NO: 5764863 - DNA, 14 bp, Homo sapiens
gctgcactctgtgc

SEQ ID NO: 5764864 - DNA, 17 bp, Homo sapiens
gctgcactctgtgccca

SEQ ID NO: 5764865 - DNA, 22 bp, Homo sapiens
gctgcactctgtgcccatgggc

SEQ ID NO: 5764866 - DNA, 23 bp, Homo sapiens
gctgcactctgtgcccatgggca

SEQ ID NO: 5764867 - DNA, 14 bp, Homo sapiens
gctgcactgcagtg

SEQ ID NO: 5764868 - DNA, 16 bp, Homo sapiens
gctgcactgccctccg

SEQ ID NO: 5764869 - DNA, 15 bp, Homo sapiens
gctgcactggagcca

SEQ ID NO: 5764870 - DNA, 11 bp, Homo sapiens
gctgcactgtg

SEQ ID NO: 5764871 - DNA, 14 bp, Homo sapiens
gctgcactgtttat

SEQ ID NO: 5764872 - DNA, 20 bp, Homo sapiens
gctgcacttgacaccaacca

SEQ ID NO: 5764873 - DNA, 22 bp, Homo sapiens
gctgcacttggcctcagctggc

SEQ ID NO: 5764874 - DNA, 17 bp, Homo sapiens
gctgcagaaccagtccc

SEQ ID NO: 5764875 - DNA, 23 bp, Homo sapiens
gctgcagaaccagtccctctgag

SEQ ID NO: 5764876 - DNA, 17 bp, Homo sapiens
gctgcagaaggccaaga

SEQ ID NO: 5764877 - DNA, 16 bp, Homo sapiens
gctgcagaccccaggt

SEQ ID NO: 5764878 - DNA, 18 bp, Homo sapiens
gctgcagagacagagagg

SEQ ID NO: 5764879 - DNA, 13 bp, Homo sapiens
gctgcagagccac

SEQ ID NO: 5764880 - DNA, 19 bp, Homo sapiens
gctgcagagccaccctgtg

SEQ ID NO: 5764881 - DNA, 22 bp, Homo sapiens
gctgcagagcccggccccacct

SEQ ID NO: 5764882 - DNA, 17 bp, Homo sapiens
gctgcagagctgaccca

SEQ ID NO: 5764883 - DNA, 15 bp, Homo sapiens
gctgcagaggccaga

SEQ ID NO: 5764884 - DNA, 18 bp, Homo sapiens
gctgcagaggccagaggc

SEQ ID NO: 5764885 - DNA, 15 bp, Homo sapiens
gctgcagagtcacaa

SEQ ID NO: 5764886 - DNA, 23 bp, Homo sapiens
gctgcagagtcacaagcctcgag

SEQ ID NO: 5764887 - DNA, 22 bp, Homo sapiens
gctgcagatactactgaccaga

SEQ ID NO: 5764888 - DNA, 17 bp, Homo sapiens
gctgcagatttgggctg

SEQ ID NO: 5764889 - DNA, 18 bp, Homo sapiens
gctgcagatttgggctgg

SEQ ID NO: 5764890 - DNA, 12 bp, Homo sapiens
gctgcagcagcg

SEQ ID NO: 5764891 - DNA, 12 bp, Homo sapiens
gctgcagcaggc

SEQ ID NO: 5764892 - DNA, 14 bp, Homo sapiens
gctgcagcaggcag

SEQ ID NO: 5764893 - DNA, 16 bp, Homo sapiens
gctgcagcaggcagag

SEQ ID NO: 5764894 - DNA, 22 bp, Homo sapiens
gctgcagcaggcagaggagagt

SEQ ID NO: 5764895 - DNA, 19 bp, Homo sapiens
gctgcagcaggtgctgggc

SEQ ID NO: 5764896 - DNA, 21 bp, Homo sapiens
gctgcagcaggtgctgggctg

SEQ ID NO: 5764897 - DNA, 16 bp, Homo sapiens
gctgcagccaaagaca

SEQ ID NO: 5764898 - DNA, 20 bp, Homo sapiens
gctgcagccagcagttgtaa

SEQ ID NO: 5764899 - DNA, 20 bp, Homo sapiens
gctgcagccaggcctcgcct

SEQ ID NO: 5764900 - DNA, 21 bp, Homo sapiens
gctgcagccaggcctcgcctg

SEQ ID NO: 5764901 - DNA, 21 bp, Homo sapiens
gctgcagccatcccgcttagc

SEQ ID NO: 5764902 - DNA, 12 bp, Homo sapiens
gctgcagcccct

SEQ ID NO: 5764903 - DNA, 14 bp, Homo sapiens
gctgcagcctcagg

SEQ ID NO: 5764904 - DNA, 12 bp, Homo sapiens
gctgcagcctcc

SEQ ID NO: 5764905 - DNA, 21 bp, Homo sapiens
gctgcagcctccacttccctc

SEQ ID NO: 5764906 - DNA, 13 bp, Homo sapiens
gctgcagcctctg

SEQ ID NO: 5764907 - DNA, 17 bp, Homo sapiens
gctgcagcctctgcctc

SEQ ID NO: 5764908 - DNA, 21 bp, Homo sapiens
gctgcagcctgcgccaccgcc

SEQ ID NO: 5764909 - DNA, 13 bp, Homo sapiens
gctgcagcctggc

SEQ ID NO: 5764910 - DNA, 22 bp, Homo sapiens
gctgcagccttcatcagaactc

SEQ ID NO: 5764911 - DNA, 22 bp, Homo sapiens
gctgcagcgcccggtgctctgt

SEQ ID NO: 5764912 - DNA, 17 bp, Homo sapiens
gctgcagcgcctcctgg

SEQ ID NO: 5764913 - DNA, 20 bp, Homo sapiens
gctgcagctaatttgtgaaa

SEQ ID NO: 5764914 - DNA, 15 bp, Homo sapiens
gctgcagctccctgg

SEQ ID NO: 5764915 - DNA, 17 bp, Homo sapiens
gctgcagctggacagag

SEQ ID NO: 5764916 - DNA, 18 bp, Homo sapiens
gctgcagctggacagagg

SEQ ID NO: 5764917 - DNA, 12 bp, Homo sapiens
gctgcagctggg

SEQ ID NO: 5764918 - DNA, 17 bp, Homo sapiens
gctgcagctgggcagca

SEQ ID NO: 5764919 - DNA, 14 bp, Homo sapiens
gctgcagctgggcc

SEQ ID NO: 5764920 - DNA, 15 bp, Homo sapiens
gctgcagctgggccc

SEQ ID NO: 5764921 - DNA, 16 bp, Homo sapiens
gctgcagctgggcccc

SEQ ID NO: 5764922 - DNA, 15 bp, Homo sapiens
gctgcagctgggctg

SEQ ID NO: 5764923 - DNA, 12 bp, Homo sapiens
gctgcagcttcc

SEQ ID NO: 5764924 - DNA, 14 bp, Homo sapiens
gctgcagcttcctg

SEQ ID NO: 5764925 - DNA, 12 bp, Homo sapiens
gctgcaggaaga

SEQ ID NO: 5764926 - DNA, 18 bp, Homo sapiens
gctgcaggaagaaacttt

SEQ ID NO: 5764927 - DNA, 15 bp, Homo sapiens
gctgcaggaatcaaa

SEQ ID NO: 5764928 - DNA, 17 bp, Homo sapiens
gctgcaggatccttgcc

SEQ ID NO: 5764929 - DNA, 18 bp, Homo sapiens
gctgcaggcacacacgcc

SEQ ID NO: 5764930 - DNA, 20 bp, Homo sapiens
gctgcaggcacacacgcctt

SEQ ID NO: 5764931 - DNA, 22 bp, Homo sapiens
gctgcaggcacacacgccttca

SEQ ID NO: 5764932 - DNA, 14 bp, Homo sapiens
gctgcaggccctcc

SEQ ID NO: 5764933 - DNA, 17 bp, Homo sapiens
gctgcaggccctccctc

SEQ ID NO: 5764934 - DNA, 20 bp, Homo sapiens
gctgcaggctttgccattgt

SEQ ID NO: 5764935 - DNA, 22 bp, Homo sapiens
gctgcagggcacggggacctgg

SEQ ID NO: 5764936 - DNA, 17 bp, Homo sapiens
gctgcagggccactgga

SEQ ID NO: 5764937 - DNA, 16 bp, Homo sapiens
gctgcagggctcccat

SEQ ID NO: 5764938 - DNA, 18 bp, Homo sapiens
gctgcagggctcccatgg

SEQ ID NO: 5764939 - DNA, 20 bp, Homo sapiens
gctgcagggctgggtcaggg

SEQ ID NO: 5764940 - DNA, 17 bp, Homo sapiens
gctgcagggctttaaaa

SEQ ID NO: 5764941 - DNA, 11 bp, Homo sapiens
gctgcaggggc

SEQ ID NO: 5764942 - DNA, 15 bp, Homo sapiens
gctgcaggggcagga

SEQ ID NO: 5764943 - DNA, 17 bp, Homo sapiens
gctgcaggggctctgga

SEQ ID NO: 5764944 - DNA, 13 bp, Homo sapiens
gctgcagggtggc

SEQ ID NO: 5764945 - DNA, 22 bp, Homo sapiens
gctgcaggtacttcctcctgat

SEQ ID NO: 5764946 - DNA, 12 bp, Homo sapiens
gctgcaggtgct

SEQ ID NO: 5764947 - DNA, 14 bp, Homo sapiens
gctgcaggtgggac

SEQ ID NO: 5764948 - DNA, 19 bp, Homo sapiens
gctgcaggtgttctgctga

SEQ ID NO: 5764949 - DNA, 20 bp, Homo sapiens
gctgcagtcaacagttcaaa

SEQ ID NO: 5764950 - DNA, 19 bp, Homo sapiens
gctgcagtcagcacagaga

SEQ ID NO: 5764951 - DNA, 14 bp, Homo sapiens
gctgcagtcatcta

SEQ ID NO: 5764952 - DNA, 23 bp, Homo sapiens
gctgcagtccgtgtggatccaat

SEQ ID NO: 5764953 - DNA, 14 bp, Homo sapiens
gctgcagtggctcc

SEQ ID NO: 5764954 - DNA, 17 bp, Homo sapiens
gctgcagtggctcccct

SEQ ID NO: 5764955 - DNA, 18 bp, Homo sapiens
gctgcagttaccacagca

SEQ ID NO: 5764956 - DNA, 22 bp, Homo sapiens
gctgcagttaccacagcaactg

SEQ ID NO: 5764957 - DNA, 19 bp, Homo sapiens
gctgcagttagcacagagg

SEQ ID NO: 5764958 - DNA, 18 bp, Homo sapiens
gctgcagttcgactctgt

SEQ ID NO: 5764959 - DNA, 21 bp, Homo sapiens
gctgcagttctactcaggctg

SEQ ID NO: 5764960 - DNA, 14 bp, Homo sapiens
gctgcagttcttgt

SEQ ID NO: 5764961 - DNA, 18 bp, Homo sapiens
gctgcagttgaagagcct

SEQ ID NO: 5764962 - DNA, 14 bp, Homo sapiens
gctgcagttgccag

SEQ ID NO: 5764963 - DNA, 17 bp, Homo sapiens
gctgcagttgccagtca

SEQ ID NO: 5764964 - DNA, 21 bp, Homo sapiens
gctgcagttgccagtcacccc

SEQ ID NO: 5764965 - DNA, 18 bp, Homo sapiens
gctgcagttgtgaaagca

SEQ ID NO: 5764966 - DNA, 16 bp, Homo sapiens
gctgcatacccgggca

SEQ ID NO: 5764967 - DNA, 16 bp, Homo sapiens
gctgcatactttgaca

SEQ ID NO: 5764968 - DNA, 14 bp, Homo sapiens
gctgcatatgccta

SEQ ID NO: 5764969 - DNA, 14 bp, Homo sapiens
gctgcatccagagg

SEQ ID NO: 5764970 - DNA, 22 bp, Homo sapiens
gctgcatcccaccagcctgagc

SEQ ID NO: 5764971 - DNA, 18 bp, Homo sapiens
gctgcatccccttccagc

SEQ ID NO: 5764972 - DNA, 14 bp, Homo sapiens
gctgcatcctcagc

SEQ ID NO: 5764973 - DNA, 17 bp, Homo sapiens
gctgcatcctcagcccc

SEQ ID NO: 5764974 - DNA, 22 bp, Homo sapiens
gctgcatcctcagccccagggc

SEQ ID NO: 5764975 - DNA, 23 bp, Homo sapiens
gctgcatcctcagccccagggcc

SEQ ID NO: 5764976 - DNA, 18 bp, Homo sapiens
gctgcatcgctgttctgg

SEQ ID NO: 5764977 - DNA, 23 bp, Homo sapiens
gctgcatcgctgttctgggcatg

SEQ ID NO: 5764978 - DNA, 17 bp, Homo sapiens
gctgcatcttatagcac

SEQ ID NO: 5764979 - DNA, 12 bp, Homo sapiens
gctgcatgaaag

SEQ ID NO: 5764980 - DNA, 19 bp, Homo sapiens
gctgcatgatgtttgccca

SEQ ID NO: 5764981 - DNA, 20 bp, Homo sapiens
gctgcatgatttttgccctg

SEQ ID NO: 5764982 - DNA, 22 bp, Homo sapiens
gctgcatgatttttgccctgcg

SEQ ID NO: 5764983 - DNA, 17 bp, Homo sapiens
gctgcatgccctctcag

SEQ ID NO: 5764984 - DNA, 20 bp, Homo sapiens
gctgcatgccctctcaggcc

SEQ ID NO: 5764985 - DNA, 15 bp, Homo sapiens
gctgcatgctctgga

SEQ ID NO: 5764986 - DNA, 13 bp, Homo sapiens
gctgcatggacgc

SEQ ID NO: 5764987 - DNA, 16 bp, Homo sapiens
gctgcatggacgcctg

SEQ ID NO: 5764988 - DNA, 18 bp, Homo sapiens
gctgcatggacgcctggc

SEQ ID NO: 5764989 - DNA, 20 bp, Homo sapiens
gctgcatggacgcctggctc

SEQ ID NO: 5764990 - DNA, 17 bp, Homo sapiens
gctgcatggagcctgga

SEQ ID NO: 5764991 - DNA, 19 bp, Homo sapiens
gctgcatgttgtttggaat

SEQ ID NO: 5764992 - DNA, 13 bp, Homo sapiens
gctgcattccaga

SEQ ID NO: 5764993 - DNA, 14 bp, Homo sapiens
gctgccctgaagaa

SEQ ID NO: 5764994 - DNA, 21 bp, Homo sapiens
gctgccctgagaagctgctcc

SEQ ID NO: 5764995 - DNA, 14 bp, Homo sapiens
gctgccctgagggg

SEQ ID NO: 5764996 - DNA, 15 bp, Homo sapiens
gctgccctgcaaacc

SEQ ID NO: 5764997 - DNA, 22 bp, Homo sapiens
gctgccctgcatgctgcccagc

SEQ ID NO: 5764998 - DNA, 12 bp, Homo sapiens
gctgccctgccc

SEQ ID NO: 5764999 - DNA, 21 bp, Homo sapiens
gctgccctgcccacctggcct

SEQ ID NO: 5765000 - DNA, 15 bp, Homo sapiens
gctgccctggccctg

SEQ ID NO: 5765001 - DNA, 23 bp, Homo sapiens
gctgccctggccctgaggtgtgg

SEQ ID NO: 5765002 - DNA, 17 bp, Homo sapiens
gctgccctgggtcctgc

SEQ ID NO: 5765003 - DNA, 21 bp, Homo sapiens
gctgccctgggtcctgcctgc

SEQ ID NO: 5765004 - DNA, 17 bp, Homo sapiens
gctgccctggtgctgcc

SEQ ID NO: 5765005 - DNA, 21 bp, Homo sapiens
gctgcccttcgctgccaggac

SEQ ID NO: 5765006 - DNA, 13 bp, Homo sapiens
gctgcccttgcag

SEQ ID NO: 5765007 - DNA, 18 bp, Homo sapiens
gctgcccttgcagggtgg

SEQ ID NO: 5765008 - DNA, 20 bp, Homo sapiens
gctgcccttgggccacccct

SEQ ID NO: 5765009 - DNA, 14 bp, Homo sapiens
gctgccctttctca

SEQ ID NO: 5765010 - DNA, 16 bp, Homo sapiens
gctgccgaccagagcc

SEQ ID NO: 5765011 - DNA, 17 bp, Homo sapiens
gctgccgaccagagccc

SEQ ID NO: 5765012 - DNA, 13 bp, Homo sapiens
gctgccgactccc

SEQ ID NO: 5765013 - DNA, 14 bp, Homo sapiens
gctgccgactcccc

SEQ ID NO: 5765014 - DNA, 18 bp, Homo sapiens
gctgccgacttggagact

SEQ ID NO: 5765015 - DNA, 21 bp, Homo sapiens
gctgccgagacagaccctctg

SEQ ID NO: 5765016 - DNA, 15 bp, Homo sapiens
gctgccgagggctgg

SEQ ID NO: 5765017 - DNA, 18 bp, Homo sapiens
gctgccgcaccccagagt

SEQ ID NO: 5765018 - DNA, 18 bp, Homo sapiens
gctgccgcatctgcctgg

SEQ ID NO: 5765019 - DNA, 20 bp, Homo sapiens
gctgccgcatctgcctggag

SEQ ID NO: 5765020 - DNA, 13 bp, Homo sapiens
gctgccgccactg

SEQ ID NO: 5765021 - DNA, 15 bp, Homo sapiens
gctgccgcctcccag

SEQ ID NO: 5765022 - DNA, 16 bp, Homo sapiens
gctgccgcctcccagc

SEQ ID NO: 5765023 - DNA, 19 bp, Homo sapiens
gctgccgcctcccagcctg

SEQ ID NO: 5765024 - DNA, 19 bp, Homo sapiens
gctgccgcgtgcgaccaga

SEQ ID NO: 5765025 - DNA, 14 bp, Homo sapiens
gctgccgctgcacc

SEQ ID NO: 5765026 - DNA, 17 bp, Homo sapiens
gctgccggagggagccc

SEQ ID NO: 5765027 - DNA, 22 bp, Homo sapiens
gctgccggagggagccctgagc

SEQ ID NO: 5765028 - DNA, 15 bp, Homo sapiens
gctgccggcacagct

SEQ ID NO: 5765029 - DNA, 15 bp, Homo sapiens
gctgccggctctggg

SEQ ID NO: 5765030 - DNA, 21 bp, Homo sapiens
gctgccggctctgggcctgag

SEQ ID NO: 5765031 - DNA, 13 bp, Homo sapiens
gctgccggctgca

SEQ ID NO: 5765032 - DNA, 14 bp, Homo sapiens
gctgccggctgcac

SEQ ID NO: 5765033 - DNA, 19 bp, Homo sapiens
gctgccgggcctgatttgg

SEQ ID NO: 5765034 - DNA, 17 bp, Homo sapiens
gctgccggggcagcccc

SEQ ID NO: 5765035 - DNA, 20 bp, Homo sapiens
gctgccgggtggggggaggg

SEQ ID NO: 5765036 - DNA, 20 bp, Homo sapiens
gctgccgtagcttcagccag

SEQ ID NO: 5765037 - DNA, 19 bp, Homo sapiens
gctgccgtctggccgggct

SEQ ID NO: 5765038 - DNA, 22 bp, Homo sapiens
gctgccgtgccgcctgcactcc

SEQ ID NO: 5765039 - DNA, 16 bp, Homo sapiens
gctgccgttttctggg

SEQ ID NO: 5765040 - DNA, 19 bp, Homo sapiens
gctgcctaataaagagact

SEQ ID NO: 5765041 - DNA, 19 bp, Homo sapiens
gctgcctagcaagctggcc

SEQ ID NO: 5765042 - DNA, 22 bp, Homo sapiens
gctgcctaggatgttctgggct

SEQ ID NO: 5765043 - DNA, 21 bp, Homo sapiens
gctgcctaggtcccccaagca

SEQ ID NO: 5765044 - DNA, 19 bp, Homo sapiens
gctgcctatgttggggggg

SEQ ID NO: 5765045 - DNA, 18 bp, Homo sapiens
gctgcctattgatttaag

SEQ ID NO: 5765046 - DNA, 19 bp, Homo sapiens
gctgcctcagccagtggca

SEQ ID NO: 5765047 - DNA, 16 bp, Homo sapiens
gctgcctcaggaccca

SEQ ID NO: 5765048 - DNA, 20 bp, Homo sapiens
gctgcctcaggacccatccc

SEQ ID NO: 5765049 - DNA, 21 bp, Homo sapiens
gctgcctcaggacccatccct

SEQ ID NO: 5765050 - DNA, 22 bp, Homo sapiens
gctgcctcaggacccatccctg

SEQ ID NO: 5765051 - DNA, 12 bp, Homo sapiens
gctgcctcaggc

SEQ ID NO: 5765052 - DNA, 22 bp, Homo sapiens
gctgcctcaggcactctcctgt

SEQ ID NO: 5765053 - DNA, 12 bp, Homo sapiens
gctgcctccaag

SEQ ID NO: 5765054 - DNA, 23 bp, Homo sapiens
gctgcctccaagtcatgggagaa

SEQ ID NO: 5765055 - DNA, 14 bp, Homo sapiens
gctgcctccactcc

SEQ ID NO: 5765056 - DNA, 21 bp, Homo sapiens
gctgcctccactcccacttcc

SEQ ID NO: 5765057 - DNA, 13 bp, Homo sapiens
gctgcctccagcc

SEQ ID NO: 5765058 - DNA, 14 bp, Homo sapiens
gctgcctccagcct

SEQ ID NO: 5765059 - DNA, 13 bp, Homo sapiens
gctgcctccatgg

SEQ ID NO: 5765060 - DNA, 17 bp, Homo sapiens
gctgcctccatggcagc

SEQ ID NO: 5765061 - DNA, 20 bp, Homo sapiens
gctgcctccatggcagcagc

SEQ ID NO: 5765062 - DNA, 22 bp, Homo sapiens
gctgcctccatggcagcagcca

SEQ ID NO: 5765063 - DNA, 22 bp, Homo sapiens
gctgcctcccaacagtggggaa

SEQ ID NO: 5765064 - DNA, 15 bp, Homo sapiens
gctgcctccccaacc

SEQ ID NO: 5765065 - DNA, 14 bp, Homo sapiens
gctgcctcccctcc

SEQ ID NO: 5765066 - DNA, 16 bp, Homo sapiens
gctgcctcccctcctc

SEQ ID NO: 5765067 - DNA, 21 bp, Homo sapiens
gctgcctcccctcctctgctt

SEQ ID NO: 5765068 - DNA, 18 bp, Homo sapiens
gctgcctccctctgctgt

SEQ ID NO: 5765069 - DNA, 19 bp, Homo sapiens
gctgcctccctgtccaccc

SEQ ID NO: 5765070 - DNA, 21 bp, Homo sapiens
gctgcctcctcctgagagctg

SEQ ID NO: 5765071 - DNA, 15 bp, Homo sapiens
gctgcctcctgatgt

SEQ ID NO: 5765072 - DNA, 13 bp, Homo sapiens
gctgcctcctgcg

SEQ ID NO: 5765073 - DNA, 15 bp, Homo sapiens
gctgcctcctgcgcc

SEQ ID NO: 5765074 - DNA, 17 bp, Homo sapiens
gctgcctcctgctctct

SEQ ID NO: 5765075 - DNA, 18 bp, Homo sapiens
gctgcctcggactccatg

SEQ ID NO: 5765076 - DNA, 19 bp, Homo sapiens
gctgcctcggatccccttc

SEQ ID NO: 5765077 - DNA, 20 bp, Homo sapiens
gctgcctcggatccccttcc

SEQ ID NO: 5765078 - DNA, 22 bp, Homo sapiens
gctgcctcggatccccttccta

SEQ ID NO: 5765079 - DNA, 16 bp, Homo sapiens
gctgcctctcccatca

SEQ ID NO: 5765080 - DNA, 17 bp, Homo sapiens
gctgcctctcttctgtg

SEQ ID NO: 5765081 - DNA, 13 bp, Homo sapiens
gctgcctctgctc

SEQ ID NO: 5765082 - DNA, 15 bp, Homo sapiens
gctgcctctgctccc

SEQ ID NO: 5765083 - DNA, 16 bp, Homo sapiens
gctgcctctgctccct

SEQ ID NO: 5765084 - DNA, 12 bp, Homo sapiens
gctgcctctggg

SEQ ID NO: 5765085 - DNA, 13 bp, Homo sapiens
gctgcctctgggc

SEQ ID NO: 5765086 - DNA, 13 bp, Homo sapiens
gctgcctctgggt

SEQ ID NO: 5765087 - DNA, 15 bp, Homo sapiens
gctgcctctgggtga

SEQ ID NO: 5765088 - DNA, 19 bp, Homo sapiens
gctgcctctgtggaagaga

SEQ ID NO: 5765089 - DNA, 18 bp, Homo sapiens
gctgcctcttccctcttc

SEQ ID NO: 5765090 - DNA, 13 bp, Homo sapiens
gctgcctcttctg

SEQ ID NO: 5765091 - DNA, 22 bp, Homo sapiens
gctgcctcttggcttctcagcc

SEQ ID NO: 5765092 - DNA, 20 bp, Homo sapiens
gctgcctctttgctgctttg

SEQ ID NO: 5765093 - DNA, 21 bp, Homo sapiens
gctgcctgaaacagccatgtc

SEQ ID NO: 5765094 - DNA, 22 bp, Homo sapiens
gctgcctgacactgagccccac

SEQ ID NO: 5765095 - DNA, 15 bp, Homo sapiens
gctgcctgagcacct

SEQ ID NO: 5765096 - DNA, 23 bp, Homo sapiens
gctgcctgagcacctcccagccc

SEQ ID NO: 5765097 - DNA, 20 bp, Homo sapiens
gctgcctgagtattactagt

SEQ ID NO: 5765098 - DNA, 17 bp, Homo sapiens
gctgcctgcagcacatg

SEQ ID NO: 5765099 - DNA, 12 bp, Homo sapiens
gctgcctgccaa

SEQ ID NO: 5765100 - DNA, 13 bp, Homo sapiens
gctgcctgccccc

SEQ ID NO: 5765101 - DNA, 15 bp, Homo sapiens
gctgcctgcccctgc

SEQ ID NO: 5765102 - DNA, 23 bp, Homo sapiens
gctgcctgcccgcacagcagcct

SEQ ID NO: 5765103 - DNA, 13 bp, Homo sapiens
gctgcctgcccgt

SEQ ID NO: 5765104 - DNA, 15 bp, Homo sapiens
gctgcctgccgccca

SEQ ID NO: 5765105 - DNA, 20 bp, Homo sapiens
gctgcctgccgcccaaagag

SEQ ID NO: 5765106 - DNA, 17 bp, Homo sapiens
gctgcctgcctccggcc

SEQ ID NO: 5765107 - DNA, 16 bp, Homo sapiens
gctgcctgcctgtctg

SEQ ID NO: 5765108 - DNA, 17 bp, Homo sapiens
gctgcctgctctgcagc

SEQ ID NO: 5765109 - DNA, 13 bp, Homo sapiens
gctgcctgctgag

SEQ ID NO: 5765110 - DNA, 16 bp, Homo sapiens
gctgcctgctgagatg

SEQ ID NO: 5765111 - DNA, 13 bp, Homo sapiens
gctgcctgcttgg

SEQ ID NO: 5765112 - DNA, 14 bp, Homo sapiens
gctgcctgcttggc

SEQ ID NO: 5765113 - DNA, 16 bp, Homo sapiens
gctgcctgcttggccc

SEQ ID NO: 5765114 - DNA, 21 bp, Homo sapiens
gctgcctgcttttcactgctg

SEQ ID NO: 5765115 - DNA, 15 bp, Homo sapiens
gctgcctggagaggg

SEQ ID NO: 5765116 - DNA, 13 bp, Homo sapiens
gctgcctggagcc

SEQ ID NO: 5765117 - DNA, 12 bp, Homo sapiens
gctgcctggagg

SEQ ID NO: 5765118 - DNA, 21 bp, Homo sapiens
gctgcctggagtcagtagcca

SEQ ID NO: 5765119 - DNA, 16 bp, Homo sapiens
gctgcctggatgagaa

SEQ ID NO: 5765120 - DNA, 20 bp, Homo sapiens
gctgcctggcacagaccagg

SEQ ID NO: 5765121 - DNA, 11 bp, Homo sapiens
gctgcctggcc

SEQ ID NO: 5765122 - DNA, 19 bp, Homo sapiens
gctgcctggccatgctgtc

SEQ ID NO: 5765123 - DNA, 15 bp, Homo sapiens
gctgcctggcccagg

SEQ ID NO: 5765124 - DNA, 18 bp, Homo sapiens
gctgcctggcgggcagcc

SEQ ID NO: 5765125 - DNA, 21 bp, Homo sapiens
gctgcctggcgggcagcccct

SEQ ID NO: 5765126 - DNA, 18 bp, Homo sapiens
gctgcctgggatccctca

SEQ ID NO: 5765127 - DNA, 19 bp, Homo sapiens
gctgcctgggatccctcat

SEQ ID NO: 5765128 - DNA, 20 bp, Homo sapiens
gctgcctgggatccctcatc

SEQ ID NO: 5765129 - DNA, 16 bp, Homo sapiens
gctgcctgggcccgga

SEQ ID NO: 5765130 - DNA, 14 bp, Homo sapiens
gctgcctgggctgt

SEQ ID NO: 5765131 - DNA, 17 bp, Homo sapiens
gctgcctggggcccaag

SEQ ID NO: 5765132 - DNA, 20 bp, Homo sapiens
gctgcctgggtaggccccac

SEQ ID NO: 5765133 - DNA, 12 bp, Homo sapiens
gctgcctggtct

SEQ ID NO: 5765134 - DNA, 13 bp, Homo sapiens
gctgcctggtctg

SEQ ID NO: 5765135 - DNA, 16 bp, Homo sapiens
gctgcctgtagttagg

SEQ ID NO: 5765136 - DNA, 19 bp, Homo sapiens
gctgcctgtatttgagaga

SEQ ID NO: 5765137 - DNA, 22 bp, Homo sapiens
gctgcctgtatttgagagactg

SEQ ID NO: 5765138 - DNA, 16 bp, Homo sapiens
gctgcctgtccccatg

SEQ ID NO: 5765139 - DNA, 12 bp, Homo sapiens
gctgcctgtgcc

SEQ ID NO: 5765140 - DNA, 13 bp, Homo sapiens
gctgcctgtgcca

SEQ ID NO: 5765141 - DNA, 19 bp, Homo sapiens
gctgcctgtgccatgccca

SEQ ID NO: 5765142 - DNA, 13 bp, Homo sapiens
gctgcctgtgcct

SEQ ID NO: 5765143 - DNA, 20 bp, Homo sapiens
gctgcctgtgcctgccatgg

SEQ ID NO: 5765144 - DNA, 20 bp, Homo sapiens
gctgcctgtggtgaggtcct

SEQ ID NO: 5765145 - DNA, 13 bp, Homo sapiens
gctgcctgtgtgg

SEQ ID NO: 5765146 - DNA, 12 bp, Homo sapiens
gctgcctgttca

SEQ ID NO: 5765147 - DNA, 17 bp, Homo sapiens
gctgcctgttcagctcc

SEQ ID NO: 5765148 - DNA, 20 bp, Homo sapiens
gctgcctgttcagctccagc

SEQ ID NO: 5765149 - DNA, 18 bp, Homo sapiens
gctgcctgtttggggagg

SEQ ID NO: 5765150 - DNA, 20 bp, Homo sapiens
gctgcctgtttggggagggg

SEQ ID NO: 5765151 - DNA, 22 bp, Homo sapiens
gctgcctgtttggggagggggg

SEQ ID NO: 5765152 - DNA, 12 bp, Homo sapiens
gctgccttagct

SEQ ID NO: 5765153 - DNA, 19 bp, Homo sapiens
gctgccttattcagggaag

SEQ ID NO: 5765154 - DNA, 15 bp, Homo sapiens
gctgccttccctagc

SEQ ID NO: 5765155 - DNA, 16 bp, Homo sapiens
gctgccttccctagct

SEQ ID NO: 5765156 - DNA, 19 bp, Homo sapiens
gctgccttctgacggccct

SEQ ID NO: 5765157 - DNA, 16 bp, Homo sapiens
gctgccttctgcggag

SEQ ID NO: 5765158 - DNA, 19 bp, Homo sapiens
gctgccttctggattcttg

SEQ ID NO: 5765159 - DNA, 15 bp, Homo sapiens
gctgccttctgtctc

SEQ ID NO: 5765160 - DNA, 18 bp, Homo sapiens
gctgccttctgtctcttg

SEQ ID NO: 5765161 - DNA, 15 bp, Homo sapiens
gctgccttgctgttc

SEQ ID NO: 5765162 - DNA, 14 bp, Homo sapiens
gctgccttgcttct

SEQ ID NO: 5765163 - DNA, 17 bp, Homo sapiens
gctgccttggctcagac

SEQ ID NO: 5765164 - DNA, 21 bp, Homo sapiens
gctgccttggctcagacatgt

SEQ ID NO: 5765165 - DNA, 20 bp, Homo sapiens
gctgcctttggacttgtccc

SEQ ID NO: 5765166 - DNA, 16 bp, Homo sapiens
gctgcctttgtcccca

SEQ ID NO: 5765167 - DNA, 22 bp, Homo sapiens
gctgcctttgtggtgggcgctg

SEQ ID NO: 5765168 - DNA, 23 bp, Homo sapiens
gctgcgaatctagaggagggggc

SEQ ID NO: 5765169 - DNA, 21 bp, Homo sapiens
gctgcgagatcgctggcagag

SEQ ID NO: 5765170 - DNA, 14 bp, Homo sapiens
gctgcgcagcctcc

SEQ ID NO: 5765171 - DNA, 14 bp, Homo sapiens
gctgcgccccaggc

SEQ ID NO: 5765172 - DNA, 16 bp, Homo sapiens
gctgcgcccccagctt

SEQ ID NO: 5765173 - DNA, 15 bp, Homo sapiens
gctgcgcccccttct

SEQ ID NO: 5765174 - DNA, 17 bp, Homo sapiens
gctgcgcccccttcttt

SEQ ID NO: 5765175 - DNA, 16 bp, Homo sapiens
gctgcgccctgggctc

SEQ ID NO: 5765176 - DNA, 14 bp, Homo sapiens
gctgcgcctgcccg

SEQ ID NO: 5765177 - DNA, 17 bp, Homo sapiens
gctgcgcctgcccgccc

SEQ ID NO: 5765178 - DNA, 16 bp, Homo sapiens
gctgcgctaaccccca

SEQ ID NO: 5765179 - DNA, 16 bp, Homo sapiens
gctgcgctagcagccc

SEQ ID NO: 5765180 - DNA, 20 bp, Homo sapiens
gctgcgctcccacctcggac

SEQ ID NO: 5765181 - DNA, 13 bp, Homo sapiens
gctgcgctgccct

SEQ ID NO: 5765182 - DNA, 17 bp, Homo sapiens
gctgcgctgccctgcaa

SEQ ID NO: 5765183 - DNA, 16 bp, Homo sapiens
gctgcgctgtgctggt

SEQ ID NO: 5765184 - DNA, 16 bp, Homo sapiens
gctgcgcttccctgca

SEQ ID NO: 5765185 - DNA, 15 bp, Homo sapiens
gctgcgcttgctttt

SEQ ID NO: 5765186 - DNA, 20 bp, Homo sapiens
gctgcggacaccgtggcctg

SEQ ID NO: 5765187 - DNA, 22 bp, Homo sapiens
gctgcggacaccgtggcctggg

SEQ ID NO: 5765188 - DNA, 15 bp, Homo sapiens
gctgcggagcaagag

SEQ ID NO: 5765189 - DNA, 17 bp, Homo sapiens
gctgcggcatccctgtg

SEQ ID NO: 5765190 - DNA, 15 bp, Homo sapiens
gctgcggcccctccc

SEQ ID NO: 5765191 - DNA, 14 bp, Homo sapiens
gctgcgggaggccc

SEQ ID NO: 5765192 - DNA, 16 bp, Homo sapiens
gctgcgggaggccctg

SEQ ID NO: 5765193 - DNA, 17 bp, Homo sapiens
gctgcgggaggccctgg

SEQ ID NO: 5765194 - DNA, 21 bp, Homo sapiens
gctgcgggaggccctggccct

SEQ ID NO: 5765195 - DNA, 16 bp, Homo sapiens
gctgcgggcccagctg

SEQ ID NO: 5765196 - DNA, 19 bp, Homo sapiens
gctgcgggctccctggcag

SEQ ID NO: 5765197 - DNA, 21 bp, Homo sapiens
gctgcgggctgagggcatctc

SEQ ID NO: 5765198 - DNA, 22 bp, Homo sapiens
gctgcgggggagccagttctgg

SEQ ID NO: 5765199 - DNA, 18 bp, Homo sapiens
gctgcggtcactcaggcc

SEQ ID NO: 5765200 - DNA, 17 bp, Homo sapiens
gctgcggtccacccagg

SEQ ID NO: 5765201 - DNA, 19 bp, Homo sapiens
gctgcggtccacccaggag

SEQ ID NO: 5765202 - DNA, 16 bp, Homo sapiens
gctgcgtactccactg

SEQ ID NO: 5765203 - DNA, 21 bp, Homo sapiens
gctgcgtcagaccagtactgg

SEQ ID NO: 5765204 - DNA, 19 bp, Homo sapiens
gctgcgtccctccgagctt

SEQ ID NO: 5765205 - DNA, 15 bp, Homo sapiens
gctgcgtccctgctc

SEQ ID NO: 5765206 - DNA, 21 bp, Homo sapiens
gctgcgtccctgctcagccca

SEQ ID NO: 5765207 - DNA, 22 bp, Homo sapiens
gctgcgtctggaggggcccctg

SEQ ID NO: 5765208 - DNA, 14 bp, Homo sapiens
gctgcgtgccatga

SEQ ID NO: 5765209 - DNA, 21 bp, Homo sapiens
gctgctaaaataaacctgttt

SEQ ID NO: 5765210 - DNA, 21 bp, Homo sapiens
gctgctaaatctcctattttt

SEQ ID NO: 5765211 - DNA, 16 bp, Homo sapiens
gctgctaacctggaaa

SEQ ID NO: 5765212 - DNA, 17 bp, Homo sapiens
gctgctaagctaaagaa

SEQ ID NO: 5765213 - DNA, 19 bp, Homo sapiens
gctgctaagtggaagacag

SEQ ID NO: 5765214 - DNA, 23 bp, Homo sapiens
gctgctaagtggaagacagagat

SEQ ID NO: 5765215 - DNA, 20 bp, Homo sapiens
gctgctaatattaaaccttt

SEQ ID NO: 5765216 - DNA, 23 bp, Homo sapiens
gctgctaatattttcctcctgag

SEQ ID NO: 5765217 - DNA, 17 bp, Homo sapiens
gctgctaattctttgca

SEQ ID NO: 5765218 - DNA, 20 bp, Homo sapiens
gctgctacaaagaagacatg

SEQ ID NO: 5765219 - DNA, 23 bp, Homo sapiens
gctgctacaaagaagacatgttt

SEQ ID NO: 5765220 - DNA, 18 bp, Homo sapiens
gctgctacatcagactct

SEQ ID NO: 5765221 - DNA, 15 bp, Homo sapiens
gctgctaccagcgcc

SEQ ID NO: 5765222 - DNA, 14 bp, Homo sapiens
gctgctacccagaa

SEQ ID NO: 5765223 - DNA, 17 bp, Homo sapiens
gctgctaccctccctgc

SEQ ID NO: 5765224 - DNA, 18 bp, Homo sapiens
gctgctaccgccctgggc

SEQ ID NO: 5765225 - DNA, 20 bp, Homo sapiens
gctgctaccgccctgggctg

SEQ ID NO: 5765226 - DNA, 23 bp, Homo sapiens
gctgctaccgccctgggctggac

SEQ ID NO: 5765227 - DNA, 17 bp, Homo sapiens
gctgctactacccgagc

SEQ ID NO: 5765228 - DNA, 13 bp, Homo sapiens
gctgctactgctg

SEQ ID NO: 5765229 - DNA, 23 bp, Homo sapiens
gctgctacttaattcctttctca

SEQ ID NO: 5765230 - DNA, 12 bp, Homo sapiens
gctgctagaact

SEQ ID NO: 5765231 - DNA, 13 bp, Homo sapiens
gctgctagaactt

SEQ ID NO: 5765232 - DNA, 13 bp, Homo sapiens
gctgctagagtga

SEQ ID NO: 5765233 - DNA, 20 bp, Homo sapiens
gctgctagagtgactcacta

SEQ ID NO: 5765234 - DNA, 23 bp, Homo sapiens
gctgctagcacttggagccaagg

SEQ ID NO: 5765235 - DNA, 22 bp, Homo sapiens
gctgctagctattggcctccca

SEQ ID NO: 5765236 - DNA, 19 bp, Homo sapiens
gctgctaggggaaggactg

SEQ ID NO: 5765237 - DNA, 20 bp, Homo sapiens
gctgctaggggaaggactgg

SEQ ID NO: 5765238 - DNA, 14 bp, Homo sapiens
gctgctagtgagcc

SEQ ID NO: 5765239 - DNA, 15 bp, Homo sapiens
gctgctatagcctgg

SEQ ID NO: 5765240 - DNA, 23 bp, Homo sapiens
gctgctatccccatctccctgcc

SEQ ID NO: 5765241 - DNA, 19 bp, Homo sapiens
gctgctatgaaaatgagca

SEQ ID NO: 5765242 - DNA, 14 bp, Homo sapiens
gctgctattgctgt

SEQ ID NO: 5765243 - DNA, 18 bp, Homo sapiens
gctgctattgctgtctgg

SEQ ID NO: 5765244 - DNA, 23 bp, Homo sapiens
gctgctattgctgtctggtgagg

SEQ ID NO: 5765245 - DNA, 18 bp, Homo sapiens
gctgctatttattttcct

SEQ ID NO: 5765246 - DNA, 19 bp, Homo sapiens
gctgctatttattttccta

SEQ ID NO: 5765247 - DNA, 14 bp, Homo sapiens
gctgctcaaatcat

SEQ ID NO: 5765248 - DNA, 20 bp, Homo sapiens
gctgctcaagccgcaagctc

SEQ ID NO: 5765249 - DNA, 23 bp, Homo sapiens
gctgctcaagccgcaagctctca

SEQ ID NO: 5765250 - DNA, 22 bp, Homo sapiens
gctgctcaaggaccaagagcaa

SEQ ID NO: 5765251 - DNA, 17 bp, Homo sapiens
gctgctcacccacctct

SEQ ID NO: 5765252 - DNA, 21 bp, Homo sapiens
gctgctcactgctcacacgct

SEQ ID NO: 5765253 - DNA, 21 bp, Homo sapiens
gctgctcacttaaacaatgtc

SEQ ID NO: 5765254 - DNA, 20 bp, Homo sapiens
gctgctcagaattcatctga

SEQ ID NO: 5765255 - DNA, 22 bp, Homo sapiens
gctgctcagaggggccccggtc

SEQ ID NO: 5765256 - DNA, 15 bp, Homo sapiens
gctgctcagcctcat

SEQ ID NO: 5765257 - DNA, 16 bp, Homo sapiens
gctgctcatcacccag

SEQ ID NO: 5765258 - DNA, 21 bp, Homo sapiens
gctgctcatcacccagtcctg

SEQ ID NO: 5765259 - DNA, 19 bp, Homo sapiens
gctgctcatctgatttttg

SEQ ID NO: 5765260 - DNA, 23 bp, Homo sapiens
gctgctcattacagttctttcct

SEQ ID NO: 5765261 - DNA, 18 bp, Homo sapiens
gctgctcattccacactg

SEQ ID NO: 5765262 - DNA, 22 bp, Homo sapiens
gctgctcattccacactgttga

SEQ ID NO: 5765263 - DNA, 15 bp, Homo sapiens
gctgctcatttcact

SEQ ID NO: 5765264 - DNA, 15 bp, Homo sapiens
gctgctccaccctcc

SEQ ID NO: 5765265 - DNA, 22 bp, Homo sapiens
gctgctccaggcctgcagcagg

SEQ ID NO: 5765266 - DNA, 23 bp, Homo sapiens
gctgctccatggatgcatgccct

SEQ ID NO: 5765267 - DNA, 14 bp, Homo sapiens
gctgctccatgttt

SEQ ID NO: 5765268 - DNA, 19 bp, Homo sapiens
gctgctcccaatgtgccga

SEQ ID NO: 5765269 - DNA, 11 bp, Homo sapiens
gctgctcccac

SEQ ID NO: 5765270 - DNA, 12 bp, Homo sapiens
gctgctcccaca

SEQ ID NO: 5765271 - DNA, 21 bp, Homo sapiens
gctgctcccacacttgtgcca

SEQ ID NO: 5765272 - DNA, 22 bp, Homo sapiens
gctgctcccacacttgtgccag

SEQ ID NO: 5765273 - DNA, 23 bp, Homo sapiens
gctgctcccacacttgtgccagc

SEQ ID NO: 5765274 - DNA, 23 bp, Homo sapiens
gctgctcccagattactccttcc

SEQ ID NO: 5765275 - DNA, 23 bp, Homo sapiens
gctgctcccagccacgttggtgg

SEQ ID NO: 5765276 - DNA, 14 bp, Homo sapiens
gctgctccccaccc

SEQ ID NO: 5765277 - DNA, 21 bp, Homo sapiens
gctgctccccacccctaccga

SEQ ID NO: 5765278 - DNA, 19 bp, Homo sapiens
gctgctccccagcagcgga

SEQ ID NO: 5765279 - DNA, 13 bp, Homo sapiens
gctgctccccagg

SEQ ID NO: 5765280 - DNA, 13 bp, Homo sapiens
gctgctcccctgg

SEQ ID NO: 5765281 - DNA, 13 bp, Homo sapiens
gctgctccctcag

SEQ ID NO: 5765282 - DNA, 21 bp, Homo sapiens
gctgctccctcagactggggc

SEQ ID NO: 5765283 - DNA, 19 bp, Homo sapiens
gctgctccctgctcccagg

SEQ ID NO: 5765284 - DNA, 12 bp, Homo sapiens
gctgctccgccc

SEQ ID NO: 5765285 - DNA, 16 bp, Homo sapiens
gctgctcctagaggga

SEQ ID NO: 5765286 - DNA, 21 bp, Homo sapiens
gctgctcctagagggaggggc

SEQ ID NO: 5765287 - DNA, 22 bp, Homo sapiens
gctgctcctaggacccgtctcc

SEQ ID NO: 5765288 - DNA, 12 bp, Homo sapiens
gctgctcctcca

SEQ ID NO: 5765289 - DNA, 17 bp, Homo sapiens
gctgctcctccagccct

SEQ ID NO: 5765290 - DNA, 19 bp, Homo sapiens
gctgctcctccctctgacc

SEQ ID NO: 5765291 - DNA, 13 bp, Homo sapiens
gctgctcctcgca

SEQ ID NO: 5765292 - DNA, 18 bp, Homo sapiens
gctgctcctctttcccct

SEQ ID NO: 5765293 - DNA, 13 bp, Homo sapiens
gctgctccttcag

SEQ ID NO: 5765294 - DNA, 14 bp, Homo sapiens
gctgctccttcagg

SEQ ID NO: 5765295 - DNA, 21 bp, Homo sapiens
gctgctcgcgaaggtcccaca

SEQ ID NO: 5765296 - DNA, 23 bp, Homo sapiens
gctgctcgcgaaggtcccacagc

SEQ ID NO: 5765297 - DNA, 18 bp, Homo sapiens
gctgctcgggaaggcctg

SEQ ID NO: 5765298 - DNA, 19 bp, Homo sapiens
gctgctcggggtgcacagg

SEQ ID NO: 5765299 - DNA, 19 bp, Homo sapiens
gctgctctaagcccaggat

SEQ ID NO: 5765300 - DNA, 18 bp, Homo sapiens
gctgctctagctggcagg

SEQ ID NO: 5765301 - DNA, 13 bp, Homo sapiens
gctgctctccatc

SEQ ID NO: 5765302 - DNA, 17 bp, Homo sapiens
gctgctctcccaagggt

SEQ ID NO: 5765303 - DNA, 23 bp, Homo sapiens
gctgctctcccctcccagtctct

SEQ ID NO: 5765304 - DNA, 15 bp, Homo sapiens
gctgctctcctgaca

SEQ ID NO: 5765305 - DNA, 16 bp, Homo sapiens
gctgctctcctgacag

SEQ ID NO: 5765306 - DNA, 18 bp, Homo sapiens
gctgctctctaagaattc

SEQ ID NO: 5765307 - DNA, 19 bp, Homo sapiens
gctgctctctaagaattca

SEQ ID NO: 5765308 - DNA, 21 bp, Homo sapiens
gctgctctctccgaggggtgg

SEQ ID NO: 5765309 - DNA, 22 bp, Homo sapiens
gctgctctctccgaggggtgga

SEQ ID NO: 5765310 - DNA, 15 bp, Homo sapiens
gctgctctctgaggg

SEQ ID NO: 5765311 - DNA, 14 bp, Homo sapiens
gctgctctgagcca

SEQ ID NO: 5765312 - DNA, 19 bp, Homo sapiens
gctgctctgcaggctgggg

SEQ ID NO: 5765313 - DNA, 14 bp, Homo sapiens
gctgctctgcccag

SEQ ID NO: 5765314 - DNA, 17 bp, Homo sapiens
gctgctctgcccagagc

SEQ ID NO: 5765315 - DNA, 18 bp, Homo sapiens
gctgctctgcccagagct

SEQ ID NO: 5765316 - DNA, 19 bp, Homo sapiens
gctgctctgcccagagctg

SEQ ID NO: 5765317 - DNA, 14 bp, Homo sapiens
gctgctctgcccct

SEQ ID NO: 5765318 - DNA, 12 bp, Homo sapiens
gctgctctgcta

SEQ ID NO: 5765319 - DNA, 18 bp, Homo sapiens
gctgctctggaatttgca

SEQ ID NO: 5765320 - DNA, 12 bp, Homo sapiens
gctgctctggga

SEQ ID NO: 5765321 - DNA, 19 bp, Homo sapiens
gctgctctggtgcacgcct

SEQ ID NO: 5765322 - DNA, 23 bp, Homo sapiens
gctgctcttgaactcctgacctc

SEQ ID NO: 5765323 - DNA, 13 bp, Homo sapiens
gctgctcttgcat

SEQ ID NO: 5765324 - DNA, 18 bp, Homo sapiens
gctgctcttggctggacc

SEQ ID NO: 5765325 - DNA, 22 bp, Homo sapiens
gctgctgaagaggcaagagaca

SEQ ID NO: 5765326 - DNA, 15 bp, Homo sapiens
gctgctgaagatgaa

SEQ ID NO: 5765327 - DNA, 18 bp, Homo sapiens
gctgctgaaggctcgagc

SEQ ID NO: 5765328 - DNA, 16 bp, Homo sapiens
gctgctgaagggaggg

SEQ ID NO: 5765329 - DNA, 18 bp, Homo sapiens
gctgctgaagttctgagc

SEQ ID NO: 5765330 - DNA, 20 bp, Homo sapiens
gctgctgaagttctgagccg

SEQ ID NO: 5765331 - DNA, 15 bp, Homo sapiens
gctgctgacaggatg

SEQ ID NO: 5765332 - DNA, 12 bp, Homo sapiens
gctgctgacagt

SEQ ID NO: 5765333 - DNA, 21 bp, Homo sapiens
gctgctgaccaattgtgctgc

SEQ ID NO: 5765334 - DNA, 22 bp, Homo sapiens
gctgctgaccagcactgacccc

SEQ ID NO: 5765335 - DNA, 20 bp, Homo sapiens
gctgctgagatcctggactg

SEQ ID NO: 5765336 - DNA, 23 bp, Homo sapiens
gctgctgagcaggaaccggaggg

SEQ ID NO: 5765337 - DNA, 14 bp, Homo sapiens
gctgctgagccgca

SEQ ID NO: 5765338 - DNA, 15 bp, Homo sapiens
gctgctgagccgcag

SEQ ID NO: 5765339 - DNA, 13 bp, Homo sapiens
gctgctgaggccc

SEQ ID NO: 5765340 - DNA, 16 bp, Homo sapiens
gctgctgagggtctgg

SEQ ID NO: 5765341 - DNA, 21 bp, Homo sapiens
gctgctgagggtctgggatct

SEQ ID NO: 5765342 - DNA, 22 bp, Homo sapiens
gctgctgatactgggtctgcga

SEQ ID NO: 5765343 - DNA, 20 bp, Homo sapiens
gctgctgatcgccttcccca

SEQ ID NO: 5765344 - DNA, 20 bp, Homo sapiens
gctgctgatgcgctgggatc

SEQ ID NO: 5765345 - DNA, 19 bp, Homo sapiens
gctgctgatgtaggagctg

SEQ ID NO: 5765346 - DNA, 16 bp, Homo sapiens
gctgctgatttaaaca

SEQ ID NO: 5765347 - DNA, 18 bp, Homo sapiens
gctggaagcactgctgtg

SEQ ID NO: 5765348 - DNA, 12 bp, Homo sapiens
gctggaagcaga

SEQ ID NO: 5765349 - DNA, 13 bp, Homo sapiens
gctggaagcagaa

SEQ ID NO: 5765350 - DNA, 14 bp, Homo sapiens
gctggaagcagaaa

SEQ ID NO: 5765351 - DNA, 12 bp, Homo sapiens
gctggaagccca

SEQ ID NO: 5765352 - DNA, 13 bp, Homo sapiens
gctggaagcccag

SEQ ID NO: 5765353 - DNA, 14 bp, Homo sapiens
gctggaagcctgcc

SEQ ID NO: 5765354 - DNA, 17 bp, Homo sapiens
gctggaagctgggaggt

SEQ ID NO: 5765355 - DNA, 16 bp, Homo sapiens
gctggaaggacaaata

SEQ ID NO: 5765356 - DNA, 12 bp, Homo sapiens
gctggaaggagg

SEQ ID NO: 5765357 - DNA, 16 bp, Homo sapiens
gctggaaggcagggca

SEQ ID NO: 5765358 - DNA, 17 bp, Homo sapiens
gctggaaggcagggcag

SEQ ID NO: 5765359 - DNA, 14 bp, Homo sapiens
gctggaaggggcca

SEQ ID NO: 5765360 - DNA, 20 bp, Homo sapiens
gctggaaggggccacgtgga

SEQ ID NO: 5765361 - DNA, 22 bp, Homo sapiens
gctggaaggtactgaaggcttc

SEQ ID NO: 5765362 - DNA, 24 bp, Homo sapiens
gctggaagtctacctgctggacag

SEQ ID NO: 5765363 - DNA, 19 bp, Homo sapiens
gctggaagtctccatgaag

SEQ ID NO: 5765364 - DNA, 19 bp, Homo sapiens
gctggaagtggctctgggg

SEQ ID NO: 5765365 - DNA, 19 bp, Homo sapiens
gctggaataagaggacact

SEQ ID NO: 5765366 - DNA, 22 bp, Homo sapiens
gctggaatcaatttcccagaag

SEQ ID NO: 5765367 - DNA, 23 bp, Homo sapiens
gctggaatcaatttcccagaagg

SEQ ID NO: 5765368 - DNA, 20 bp, Homo sapiens
gctggaatccagaaggaagc

SEQ ID NO: 5765369 - DNA, 17 bp, Homo sapiens
gctggaatgagggaggc

SEQ ID NO: 5765370 - DNA, 16 bp, Homo sapiens
gctggaatgtgccaca

SEQ ID NO: 5765371 - DNA, 17 bp, Homo sapiens
gctggaatgtgccacag

SEQ ID NO: 5765372 - DNA, 19 bp, Homo sapiens
gctggaatgtgccacagag

SEQ ID NO: 5765373 - DNA, 22 bp, Homo sapiens
gctggaatgtgccacagaggcc

SEQ ID NO: 5765374 - DNA, 23 bp, Homo sapiens
gctggaatgtgccacagaggccc

SEQ ID NO: 5765375 - DNA, 16 bp, Homo sapiens
gctggaattttttatt

SEQ ID NO: 5765376 - DNA, 20 bp, Homo sapiens
gctggaattttttattcttg

SEQ ID NO: 5765377 - DNA, 13 bp, Homo sapiens
gctggacaaccca

SEQ ID NO: 5765378 - DNA, 15 bp, Homo sapiens
gctggacaagaagct

SEQ ID NO: 5765379 - DNA, 16 bp, Homo sapiens
gctggacaagaagctg

SEQ ID NO: 5765380 - DNA, 17 bp, Homo sapiens
gctggacaagaagctgc

SEQ ID NO: 5765381 - DNA, 18 bp, Homo sapiens
gctggacaagaagctgct

SEQ ID NO: 5765382 - DNA, 20 bp, Homo sapiens
gctggacacctacagcagca

SEQ ID NO: 5765383 - DNA, 14 bp, Homo sapiens
gctggacagagggg

SEQ ID NO: 5765384 - DNA, 13 bp, Homo sapiens
gctggacagcact

SEQ ID NO: 5765385 - DNA, 13 bp, Homo sapiens
gctggacagcctc

SEQ ID NO: 5765386 - DNA, 15 bp, Homo sapiens
gctggacagcctccg

SEQ ID NO: 5765387 - DNA, 14 bp, Homo sapiens
gctggacaggtctg

SEQ ID NO: 5765388 - DNA, 20 bp, Homo sapiens
gctggacagtatcactgtct

SEQ ID NO: 5765389 - DNA, 13 bp, Homo sapiens
gctggacatactg

SEQ ID NO: 5765390 - DNA, 23 bp, Homo sapiens
gctggaccacgtctccctggccc

SEQ ID NO: 5765391 - DNA, 15 bp, Homo sapiens
gctggaccagctggc

SEQ ID NO: 5765392 - DNA, 17 bp, Homo sapiens
gctggaccagctggcct

SEQ ID NO: 5765393 - DNA, 20 bp, Homo sapiens
gctggaccagtggtgccttg

SEQ ID NO: 5765394 - DNA, 19 bp, Homo sapiens
gctggaccatctctgtagg

SEQ ID NO: 5765395 - DNA, 13 bp, Homo sapiens
gctggacccagcc

SEQ ID NO: 5765396 - DNA, 23 bp, Homo sapiens
gctggaccctgaccagctccccc

SEQ ID NO: 5765397 - DNA, 17 bp, Homo sapiens
gctggacctcaccaagc

SEQ ID NO: 5765398 - DNA, 19 bp, Homo sapiens
gctggacctggcggcagga

SEQ ID NO: 5765399 - DNA, 15 bp, Homo sapiens
gctggacctggggtc

SEQ ID NO: 5765400 - DNA, 15 bp, Homo sapiens
gctggaccttgaact

SEQ ID NO: 5765401 - DNA, 18 bp, Homo sapiens
gctggaccttgaactggg

SEQ ID NO: 5765402 - DNA, 21 bp, Homo sapiens
gctggacggggactggggatg

SEQ ID NO: 5765403 - DNA, 16 bp, Homo sapiens
gctggacgtctttctt

SEQ ID NO: 5765404 - DNA, 13 bp, Homo sapiens
gctggactagtgt

SEQ ID NO: 5765405 - DNA, 23 bp, Homo sapiens
gctggactccagatctgcaccgc

SEQ ID NO: 5765406 - DNA, 13 bp, Homo sapiens
gctggactgacca

SEQ ID NO: 5765407 - DNA, 15 bp, Homo sapiens
gctggactgaggacc

SEQ ID NO: 5765408 - DNA, 18 bp, Homo sapiens
gctggactgaggcctgag

SEQ ID NO: 5765409 - DNA, 19 bp, Homo sapiens
gctggactgaggcctgagc

SEQ ID NO: 5765410 - DNA, 21 bp, Homo sapiens
gctggactgcattgaaggcga

SEQ ID NO: 5765411 - DNA, 12 bp, Homo sapiens
gctggactggag

SEQ ID NO: 5765412 - DNA, 12 bp, Homo sapiens
gctggactggct

SEQ ID NO: 5765413 - DNA, 22 bp, Homo sapiens
gctggactgggtgggccccaca

SEQ ID NO: 5765414 - DNA, 21 bp, Homo sapiens
gctggactgttccaggccctc

SEQ ID NO: 5765415 - DNA, 22 bp, Homo sapiens
gctggacttctacctgccctca

SEQ ID NO: 5765416 - DNA, 19 bp, Homo sapiens
gctggacttttgcagcttc

SEQ ID NO: 5765417 - DNA, 15 bp, Homo sapiens
gctggagaaaccttc

SEQ ID NO: 5765418 - DNA, 17 bp, Homo sapiens
gctggagaaagagctgc

SEQ ID NO: 5765419 - DNA, 19 bp, Homo sapiens
gctggagaaagagctgcct

SEQ ID NO: 5765420 - DNA, 13 bp, Homo sapiens
gctggagaaagat

SEQ ID NO: 5765421 - DNA, 11 bp, Homo sapiens
gctggagaaat

SEQ ID NO: 5765422 - DNA, 16 bp, Homo sapiens
gctggagaagagagga

SEQ ID NO: 5765423 - DNA, 18 bp, Homo sapiens
gctggagaagagaggaga

SEQ ID NO: 5765424 - DNA, 16 bp, Homo sapiens
gctggagaagctcacc

SEQ ID NO: 5765425 - DNA, 15 bp, Homo sapiens
gctggagaccatgca

SEQ ID NO: 5765426 - DNA, 21 bp, Homo sapiens
gctggagaccatgcagagcgc

SEQ ID NO: 5765427 - DNA, 18 bp, Homo sapiens
gctggagaggaaaagcca

SEQ ID NO: 5765428 - DNA, 20 bp, Homo sapiens
gctggagaggaaaagccagt

SEQ ID NO: 5765429 - DNA, 15 bp, Homo sapiens
gctggagaggagccc

SEQ ID NO: 5765430 - DNA, 16 bp, Homo sapiens
gctggagaggagccct

SEQ ID NO: 5765431 - DNA, 17 bp, Homo sapiens
gctggagaggagccctg

SEQ ID NO: 5765432 - DNA, 18 bp, Homo sapiens
gctggagaggagccctgc

SEQ ID NO: 5765433 - DNA, 22 bp, Homo sapiens
gctggagaggagccctgcctct

SEQ ID NO: 5765434 - DNA, 13 bp, Homo sapiens
gctggagaggtta

SEQ ID NO: 5765435 - DNA, 13 bp, Homo sapiens
gctggagagtaga

SEQ ID NO: 5765436 - DNA, 16 bp, Homo sapiens
gctggagatcagcatg

SEQ ID NO: 5765437 - DNA, 15 bp, Homo sapiens
gctggagcactgggc

SEQ ID NO: 5765438 - DNA, 18 bp, Homo sapiens
gctggagcactgggctcc

SEQ ID NO: 5765439 - DNA, 12 bp, Homo sapiens
gctggagcagcg

SEQ ID NO: 5765440 - DNA, 14 bp, Homo sapiens
gctggagcagcgga

SEQ ID NO: 5765441 - DNA, 18 bp, Homo sapiens
gctggagccaatggtgag

SEQ ID NO: 5765442 - DNA, 15 bp, Homo sapiens
gctggagccactaac

SEQ ID NO: 5765443 - DNA, 16 bp, Homo sapiens
gctggagccactaact

SEQ ID NO: 5765444 - DNA, 14 bp, Homo sapiens
gctggagcccacag

SEQ ID NO: 5765445 - DNA, 16 bp, Homo sapiens
gctggagcccagggag

SEQ ID NO: 5765446 - DNA, 13 bp, Homo sapiens
gctggagccccca

SEQ ID NO: 5765447 - DNA, 12 bp, Homo sapiens
gctggagcccgc

SEQ ID NO: 5765448 - DNA, 22 bp, Homo sapiens
gctggagccctgttcctccctc

SEQ ID NO: 5765449 - DNA, 20 bp, Homo sapiens
gctggagcctcggtggccat

SEQ ID NO: 5765450 - DNA, 23 bp, Homo sapiens
gctggagcctgagtcagggccca

SEQ ID NO: 5765451 - DNA, 12 bp, Homo sapiens
gctggagcggct

SEQ ID NO: 5765452 - DNA, 15 bp, Homo sapiens
gctggagctcctccc

SEQ ID NO: 5765453 - DNA, 17 bp, Homo sapiens
gctggagctcttggaag

SEQ ID NO: 5765454 - DNA, 14 bp, Homo sapiens
gctggagctggctt

SEQ ID NO: 5765455 - DNA, 14 bp, Homo sapiens
gctggaggaaggaa

SEQ ID NO: 5765456 - DNA, 15 bp, Homo sapiens
gctggaggaaggaaa

SEQ ID NO: 5765457 - DNA, 23 bp, Homo sapiens
gctggaggactagaacctggagg

SEQ ID NO: 5765458 - DNA, 22 bp, Homo sapiens
gctggaggagcccaggccagga

SEQ ID NO: 5765459 - DNA, 17 bp, Homo sapiens
gctggaggagctggcct

SEQ ID NO: 5765460 - DNA, 18 bp, Homo sapiens
gctggaggagctggcctg

SEQ ID NO: 5765461 - DNA, 20 bp, Homo sapiens
gctggaggaggggaagctgg

SEQ ID NO: 5765462 - DNA, 22 bp, Homo sapiens
gctggaggaggggaagctgggc

SEQ ID NO: 5765463 - DNA, 20 bp, Homo sapiens
gctggaggatgtgggcagct

SEQ ID NO: 5765464 - DNA, 20 bp, Homo sapiens
gctggaggcaggggcttcct

SEQ ID NO: 5765465 - DNA, 21 bp, Homo sapiens
gctggaggcaggggcttcctg

SEQ ID NO: 5765466 - DNA, 15 bp, Homo sapiens
gctggaggcccaggc

SEQ ID NO: 5765467 - DNA, 20 bp, Homo sapiens
gctggaggcccaggctggga

SEQ ID NO: 5765468 - DNA, 14 bp, Homo sapiens
gctggaggcctcag

SEQ ID NO: 5765469 - DNA, 19 bp, Homo sapiens
gctggaggcctcaggtgct

SEQ ID NO: 5765470 - DNA, 17 bp, Homo sapiens
gctggaggctccaggac

SEQ ID NO: 5765471 - DNA, 18 bp, Homo sapiens
gctggaggctccaggact

SEQ ID NO: 5765472 - DNA, 22 bp, Homo sapiens
gctggaggctccaggactccac

SEQ ID NO: 5765473 - DNA, 19 bp, Homo sapiens
gctggagggaggggcggga

SEQ ID NO: 5765474 - DNA, 20 bp, Homo sapiens
gctggagggctgggcagggc

SEQ ID NO: 5765475 - DNA, 14 bp, Homo sapiens
gctggaggggctgt

SEQ ID NO: 5765476 - DNA, 14 bp, Homo sapiens
gctggaggggtggc

SEQ ID NO: 5765477 - DNA, 17 bp, Homo sapiens
gctggaggggtggccca

SEQ ID NO: 5765478 - DNA, 18 bp, Homo sapiens
gctggaggggtggcccag

SEQ ID NO: 5765479 - DNA, 24 bp, Homo sapiens
gctggaggggtggcccagagccat

SEQ ID NO: 5765480 - DNA, 12 bp, Homo sapiens
gctggaggtggc

SEQ ID NO: 5765481 - DNA, 14 bp, Homo sapiens
gctggaggtgggag

SEQ ID NO: 5765482 - DNA, 16 bp, Homo sapiens
gctggaggtggggcct

SEQ ID NO: 5765483 - DNA, 20 bp, Homo sapiens
gctggagtacagtggtgtga

SEQ ID NO: 5765484 - DNA, 16 bp, Homo sapiens
gctggagtcctctcca

SEQ ID NO: 5765485 - DNA, 22 bp, Homo sapiens
gctggagtctcagagcacagag

SEQ ID NO: 5765486 - DNA, 15 bp, Homo sapiens
gctggagtctggctt

SEQ ID NO: 5765487 - DNA, 20 bp, Homo sapiens
gctggagtgagggcctcaga

SEQ ID NO: 5765488 - DNA, 20 bp, Homo sapiens
gctggagtgcaatggtgtga

SEQ ID NO: 5765489 - DNA, 14 bp, Homo sapiens
gctggagtgcagtg

SEQ ID NO: 5765490 - DNA, 17 bp, Homo sapiens
gctggagtgcagtgagc

SEQ ID NO: 5765491 - DNA, 16 bp, Homo sapiens
gctggagtgcagtggc

SEQ ID NO: 5765492 - DNA, 20 bp, Homo sapiens
gctggagtgcagtggcacaa

SEQ ID NO: 5765493 - DNA, 15 bp, Homo sapiens
gctggagtgccatgg

SEQ ID NO: 5765494 - DNA, 13 bp, Homo sapiens
gctggagtgctgg

SEQ ID NO: 5765495 - DNA, 15 bp, Homo sapiens
gctggagtgctggct

SEQ ID NO: 5765496 - DNA, 21 bp, Homo sapiens
gctggagtgtgagggtcctgc

SEQ ID NO: 5765497 - DNA, 21 bp, Homo sapiens
gctggagttccggcctgggca

SEQ ID NO: 5765498 - DNA, 16 bp, Homo sapiens
gctggagtttcatgta

SEQ ID NO: 5765499 - DNA, 14 bp, Homo sapiens
gctggatagacttg

SEQ ID NO: 5765500 - DNA, 18 bp, Homo sapiens
gctggataggagaggaaa

SEQ ID NO: 5765501 - DNA, 14 bp, Homo sapiens
gctggatctcccag

SEQ ID NO: 5765502 - DNA, 13 bp, Homo sapiens
gctggatctgtga

SEQ ID NO: 5765503 - DNA, 20 bp, Homo sapiens
gctggatgagacttccaaac

SEQ ID NO: 5765504 - DNA, 14 bp, Homo sapiens
gctggatgagcaac

SEQ ID NO: 5765505 - DNA, 15 bp, Homo sapiens
gctggatgatggtct

SEQ ID NO: 5765506 - DNA, 21 bp, Homo sapiens
gctggatgctccttccaacag

SEQ ID NO: 5765507 - DNA, 22 bp, Homo sapiens
gctggatgctccttccaacagg

SEQ ID NO: 5765508 - DNA, 13 bp, Homo sapiens
gctggatgctgag

SEQ ID NO: 5765509 - DNA, 20 bp, Homo sapiens
gctggatgctgagagacctc

SEQ ID NO: 5765510 - DNA, 14 bp, Homo sapiens
gctggatggacaga

SEQ ID NO: 5765511 - DNA, 18 bp, Homo sapiens
gctggatggacagtgggc

SEQ ID NO: 5765512 - DNA, 14 bp, Homo sapiens
gctggatggagccc

SEQ ID NO: 5765513 - DNA, 16 bp, Homo sapiens
gctggatggctcccct

SEQ ID NO: 5765514 - DNA, 14 bp, Homo sapiens
gctggatgggactc

SEQ ID NO: 5765515 - DNA, 16 bp, Homo sapiens
gctggatggggcggcc

SEQ ID NO: 5765516 - DNA, 19 bp, Homo sapiens
gctggatgggggctctgca

SEQ ID NO: 5765517 - DNA, 17 bp, Homo sapiens
gctggatgtgcatctgg

SEQ ID NO: 5765518 - DNA, 20 bp, Homo sapiens
gctggatgtgcatctggcct

SEQ ID NO: 5765519 - DNA, 16 bp, Homo sapiens
gctggattggcaggtg

SEQ ID NO: 5765520 - DNA, 22 bp, Homo sapiens
gctggattggcaggtgtgggct

SEQ ID NO: 5765521 - DNA, 21 bp, Homo sapiens
gctggcaaaccctcccagaaa

SEQ ID NO: 5765522 - DNA, 15 bp, Homo sapiens
gctggcaaagacaga

SEQ ID NO: 5765523 - DNA, 20 bp, Homo sapiens
gctggcaaaggtggctctcc

SEQ ID NO: 5765524 - DNA, 14 bp, Homo sapiens
gctggcaaatccag

SEQ ID NO: 5765525 - DNA, 19 bp, Homo sapiens
gctggcaaatccaggctgg

SEQ ID NO: 5765526 - DNA, 13 bp, Homo sapiens
gctggctcaggag

SEQ ID NO: 5765527 - DNA, 18 bp, Homo sapiens
gctggctccacgccctgg

SEQ ID NO: 5765528 - DNA, 22 bp, Homo sapiens
gctggctccacgccctggggag

SEQ ID NO: 5765529 - DNA, 22 bp, Homo sapiens
gctggctccagatgcagggcag

SEQ ID NO: 5765530 - DNA, 15 bp, Homo sapiens
gctggctccagcctg

SEQ ID NO: 5765531 - DNA, 13 bp, Homo sapiens
gctggctcccagg

SEQ ID NO: 5765532 - DNA, 17 bp, Homo sapiens
gctggctcccagggcca

SEQ ID NO: 5765533 - DNA, 19 bp, Homo sapiens
gctggctcccagggccatg

SEQ ID NO: 5765534 - DNA, 16 bp, Homo sapiens
gctggctcccagggtg

SEQ ID NO: 5765535 - DNA, 22 bp, Homo sapiens
gctggctcccagggtggaggaa

SEQ ID NO: 5765536 - DNA, 17 bp, Homo sapiens
gctggctccccaaaggg

SEQ ID NO: 5765537 - DNA, 20 bp, Homo sapiens
gctggctccccctccccagg

SEQ ID NO: 5765538 - DNA, 22 bp, Homo sapiens
gctggctccccctccccaggct

SEQ ID NO: 5765539 - DNA, 23 bp, Homo sapiens
gctggctccccctccccaggctg

SEQ ID NO: 5765540 - DNA, 14 bp, Homo sapiens
gctggctcccctgc

SEQ ID NO: 5765541 - DNA, 17 bp, Homo sapiens
gctggctcccctgcagc

SEQ ID NO: 5765542 - DNA, 17 bp, Homo sapiens
gctggctccctgggcag

SEQ ID NO: 5765543 - DNA, 16 bp, Homo sapiens
gctggctcctacccca

SEQ ID NO: 5765544 - DNA, 19 bp, Homo sapiens
gctggctcctaggggaaga

SEQ ID NO: 5765545 - DNA, 23 bp, Homo sapiens
gctggctcctccaggcacgtccc

SEQ ID NO: 5765546 - DNA, 15 bp, Homo sapiens
gctggctcgtaggcc

SEQ ID NO: 5765547 - DNA, 18 bp, Homo sapiens
gctggctcgtaggcctgc

SEQ ID NO: 5765548 - DNA, 13 bp, Homo sapiens
gctggctctccac

SEQ ID NO: 5765549 - DNA, 16 bp, Homo sapiens
gctggctctgaagcca

SEQ ID NO: 5765550 - DNA, 13 bp, Homo sapiens
gctggctctgcag

SEQ ID NO: 5765551 - DNA, 14 bp, Homo sapiens
gctggctctgcagc

SEQ ID NO: 5765552 - DNA, 19 bp, Homo sapiens
gctggctctgtggaggggc

SEQ ID NO: 5765553 - DNA, 14 bp, Homo sapiens
gctggctcttctgc

SEQ ID NO: 5765554 - DNA, 18 bp, Homo sapiens
gctggctgaaaatcacta

SEQ ID NO: 5765555 - DNA, 21 bp, Homo sapiens
gctggctgaagaatgaagacc

SEQ ID NO: 5765556 - DNA, 16 bp, Homo sapiens
gctggctgacctgggc

SEQ ID NO: 5765557 - DNA, 13 bp, Homo sapiens
gctggctgagctg

SEQ ID NO: 5765558 - DNA, 16 bp, Homo sapiens
gctggctgaggcttgg

SEQ ID NO: 5765559 - DNA, 23 bp, Homo sapiens
gctggctgaggcttgggcccagt

SEQ ID NO: 5765560 - DNA, 16 bp, Homo sapiens
gctggctgagggcagt

SEQ ID NO: 5765561 - DNA, 22 bp, Homo sapiens
gctggctgatgggtggacctgt

SEQ ID NO: 5765562 - DNA, 14 bp, Homo sapiens
gctggctgcaattg

SEQ ID NO: 5765563 - DNA, 19 bp, Homo sapiens
gctggctgcccagacccct

SEQ ID NO: 5765564 - DNA, 13 bp, Homo sapiens
gctggctgcggcc

SEQ ID NO: 5765565 - DNA, 17 bp, Homo sapiens
gctggctgcggccccct

SEQ ID NO: 5765566 - DNA, 12 bp, Homo sapiens
gctggctgctga

SEQ ID NO: 5765567 - DNA, 19 bp, Homo sapiens
gctggctgctgacaggatg

SEQ ID NO: 5765568 - DNA, 20 bp, Homo sapiens
gctggctgctgacaggatgt

SEQ ID NO: 5765569 - DNA, 17 bp, Homo sapiens
gctggctgcttgcagcc

SEQ ID NO: 5765570 - DNA, 20 bp, Homo sapiens
gctggctgcttgcagccagg

SEQ ID NO: 5765571 - DNA, 21 bp, Homo sapiens
gctggctgcttgcagccagga

SEQ ID NO: 5765572 - DNA, 17 bp, Homo sapiens
gctggctggaggaagga

SEQ ID NO: 5765573 - DNA, 19 bp, Homo sapiens
gctggctggagtctcagag

SEQ ID NO: 5765574 - DNA, 20 bp, Homo sapiens
gctggctggagtctcagagc

SEQ ID NO: 5765575 - DNA, 13 bp, Homo sapiens
gctggctgggcct

SEQ ID NO: 5765576 - DNA, 19 bp, Homo sapiens
gctggctgggctggctgaa

SEQ ID NO: 5765577 - DNA, 14 bp, Homo sapiens
gctggctggggcct

SEQ ID NO: 5765578 - DNA, 10 bp, Homo sapiens
gctggctggt

SEQ ID NO: 5765579 - DNA, 20 bp, Homo sapiens
gctggctggtgcctgagccc

SEQ ID NO: 5765580 - DNA, 22 bp, Homo sapiens
gctggctgtactgccaaggtac

SEQ ID NO: 5765581 - DNA, 10 bp, Homo sapiens
gctggctgtc

SEQ ID NO: 5765582 - DNA, 14 bp, Homo sapiens
gctggctgtgaaac

SEQ ID NO: 5765583 - DNA, 16 bp, Homo sapiens
gctggctgtgaaacca

SEQ ID NO: 5765584 - DNA, 16 bp, Homo sapiens
gctggctgtgacaatg

SEQ ID NO: 5765585 - DNA, 19 bp, Homo sapiens
gctggctgtgcctgcttct

SEQ ID NO: 5765586 - DNA, 14 bp, Homo sapiens
gctggctgtgtcct

SEQ ID NO: 5765587 - DNA, 21 bp, Homo sapiens
gctggctgtgtcctctccagc

SEQ ID NO: 5765588 - DNA, 15 bp, Homo sapiens
gctggctgttggctg

SEQ ID NO: 5765589 - DNA, 16 bp, Homo sapiens
gctggctgttggctgg

SEQ ID NO: 5765590 - DNA, 18 bp, Homo sapiens
gctggctgttggctgggg

SEQ ID NO: 5765591 - DNA, 23 bp, Homo sapiens
gctggctgttggctgggggcctc

SEQ ID NO: 5765592 - DNA, 21 bp, Homo sapiens
gctggcttcattctcagactc

SEQ ID NO: 5765593 - DNA, 13 bp, Homo sapiens
gctggcttgcccg

SEQ ID NO: 5765594 - DNA, 16 bp, Homo sapiens
gctggctttctctctg

SEQ ID NO: 5765595 - DNA, 20 bp, Homo sapiens
gctggcttttcaccccagag

SEQ ID NO: 5765596 - DNA, 22 bp, Homo sapiens
gctggcttttcaccccagagga

SEQ ID NO: 5765597 - DNA, 14 bp, Homo sapiens
gctggcttttctgt

SEQ ID NO: 5765598 - DNA, 15 bp, Homo sapiens
gctggcttttctgtt

SEQ ID NO: 5765599 - DNA, 16 bp, Homo sapiens
gctgggaaacagggag

SEQ ID NO: 5765600 - DNA, 15 bp, Homo sapiens
gctgggaaagaactt

SEQ ID NO: 5765601 - DNA, 19 bp, Homo sapiens
gctgggaaagaacttggac

SEQ ID NO: 5765602 - DNA, 16 bp, Homo sapiens
gctgggaaatgcagaa

SEQ ID NO: 5765603 - DNA, 22 bp, Homo sapiens
gctgggaacagtgtgcaaggca

SEQ ID NO: 5765604 - DNA, 21 bp, Homo sapiens
gctgggaacatgacccagcct

SEQ ID NO: 5765605 - DNA, 17 bp, Homo sapiens
gctgggaaccagggagg

SEQ ID NO: 5765606 - DNA, 20 bp, Homo sapiens
gctgggaaccccgcagcccg

SEQ ID NO: 5765607 - DNA, 21 bp, Homo sapiens
gctgggaacgtgtgtccaggc

SEQ ID NO: 5765608 - DNA, 16 bp, Homo sapiens
gctgggaactcacctg

SEQ ID NO: 5765609 - DNA, 19 bp, Homo sapiens
gctgggaactgggccagca

SEQ ID NO: 5765610 - DNA, 15 bp, Homo sapiens
gctgggaagaatgta

SEQ ID NO: 5765611 - DNA, 20 bp, Homo sapiens
gctgggaagagaagagggcc

SEQ ID NO: 5765612 - DNA, 14 bp, Homo sapiens
gctgggaagagctc

SEQ ID NO: 5765613 - DNA, 16 bp, Homo sapiens
gctgggaagagctccc

SEQ ID NO: 5765614 - DNA, 23 bp, Homo sapiens
gctgggaagcccggactgaccaa

SEQ ID NO: 5765615 - DNA, 19 bp, Homo sapiens
gctgggaagggaaggaagc

SEQ ID NO: 5765616 - DNA, 16 bp, Homo sapiens
gctgggaagggagggt

SEQ ID NO: 5765617 - DNA, 19 bp, Homo sapiens
gctgggaaggggaacacag

SEQ ID NO: 5765618 - DNA, 24 bp, Homo sapiens
gctgggaaggggaacacagaccag

SEQ ID NO: 5765619 - DNA, 21 bp, Homo sapiens
gctgggaatggaggggcagag

SEQ ID NO: 5765620 - DNA, 18 bp, Homo sapiens
gctgggaatggggacacg

SEQ ID NO: 5765621 - DNA, 18 bp, Homo sapiens
gctgggaattacaggcgt

SEQ ID NO: 5765622 - DNA, 15 bp, Homo sapiens
gctgggacacagacc

SEQ ID NO: 5765623 - DNA, 20 bp, Homo sapiens
gctgggacatgggaaagggg

SEQ ID NO: 5765624 - DNA, 22 bp, Homo sapiens
gctgggaccacaggtgcacgcc

SEQ ID NO: 5765625 - DNA, 18 bp, Homo sapiens
gctgggaccagagccaga

SEQ ID NO: 5765626 - DNA, 20 bp, Homo sapiens
gctgggaccagagccagatg

SEQ ID NO: 5765627 - DNA, 18 bp, Homo sapiens
gctgggacccacctcccc

SEQ ID NO: 5765628 - DNA, 19 bp, Homo sapiens
gctgggacgtggctcagcc

SEQ ID NO: 5765629 - DNA, 22 bp, Homo sapiens
gctgggacgtggctcagccagc

SEQ ID NO: 5765630 - DNA, 20 bp, Homo sapiens
gctgggactacaggcaccca

SEQ ID NO: 5765631 - DNA, 18 bp, Homo sapiens
gctgggactacaggcgcc

SEQ ID NO: 5765632 - DNA, 16 bp, Homo sapiens
gctgggactacaggtg

SEQ ID NO: 5765633 - DNA, 17 bp, Homo sapiens
gctgggactacaggtgc

SEQ ID NO: 5765634 - DNA, 19 bp, Homo sapiens
gctgggactacaggtgcaa

SEQ ID NO: 5765635 - DNA, 17 bp, Homo sapiens
gctgggactacaggtgt

SEQ ID NO: 5765636 - DNA, 15 bp, Homo sapiens
gctgggactcagcct

SEQ ID NO: 5765637 - DNA, 23 bp, Homo sapiens
gctgggactcagccttcagacag

SEQ ID NO: 5765638 - DNA, 17 bp, Homo sapiens
gctgggactcctggtgc

SEQ ID NO: 5765639 - DNA, 18 bp, Homo sapiens
gctgggactcctggtgcc

SEQ ID NO: 5765640 - DNA, 14 bp, Homo sapiens
gctgggactgagcc

SEQ ID NO: 5765641 - DNA, 14 bp, Homo sapiens
gctgggactggcca

SEQ ID NO: 5765642 - DNA, 15 bp, Homo sapiens
gctgggactggccag

SEQ ID NO: 5765643 - DNA, 16 bp, Homo sapiens
gctgggactggccagg

SEQ ID NO: 5765644 - DNA, 14 bp, Homo sapiens
gctgggactgggaa

SEQ ID NO: 5765645 - DNA, 19 bp, Homo sapiens
gctgggagaaaagccagat

SEQ ID NO: 5765646 - DNA, 12 bp, Homo sapiens
gctgggagaagg

SEQ ID NO: 5765647 - DNA, 15 bp, Homo sapiens
gctgggagaaggtgc

SEQ ID NO: 5765648 - DNA, 10 bp, Homo sapiens
gctgggagag

SEQ ID NO: 5765649 - DNA, 11 bp, Homo sapiens
gctgggagagc

SEQ ID NO: 5765650 - DNA, 18 bp, Homo sapiens
gctgggagagccttccag

SEQ ID NO: 5765651 - DNA, 19 bp, Homo sapiens
gctgggagagccttccagg

SEQ ID NO: 5765652 - DNA, 14 bp, Homo sapiens
gctgggagaggcag

SEQ ID NO: 5765653 - DNA, 18 bp, Homo sapiens
gctgggagatgctctctg

SEQ ID NO: 5765654 - DNA, 22 bp, Homo sapiens
gctgggagatgctctctgaggc

SEQ ID NO: 5765655 - DNA, 13 bp, Homo sapiens
gctgggagccagg

SEQ ID NO: 5765656 - DNA, 16 bp, Homo sapiens
gctgggagccaggctc

SEQ ID NO: 5765657 - DNA, 13 bp, Homo sapiens
gctgggagccagt

SEQ ID NO: 5765658 - DNA, 20 bp, Homo sapiens
gctgggagccagtgtgccca

SEQ ID NO: 5765659 - DNA, 21 bp, Homo sapiens
gctgggagcctcgcccctcca

SEQ ID NO: 5765660 - DNA, 13 bp, Homo sapiens
gctgggagcctgg

SEQ ID NO: 5765661 - DNA, 23 bp, Homo sapiens
gctgggagcctggttcagacaca

SEQ ID NO: 5765662 - DNA, 13 bp, Homo sapiens
gctgggagctcca

SEQ ID NO: 5765663 - DNA, 22 bp, Homo sapiens
gctgggaggaaggacttccctg

SEQ ID NO: 5765664 - DNA, 14 bp, Homo sapiens
gctgggaggaaggg

SEQ ID NO: 5765665 - DNA, 22 bp, Homo sapiens
gctgggaggagcccctggacat

SEQ ID NO: 5765666 - DNA, 18 bp, Homo sapiens
gctgggaggagggagagg

SEQ ID NO: 5765667 - DNA, 21 bp, Homo sapiens
gctgggaggagggcaggcatc

SEQ ID NO: 5765668 - DNA, 20 bp, Homo sapiens
gctgggaggcatggccctgg

SEQ ID NO: 5765669 - DNA, 14 bp, Homo sapiens
gctgggagggctga

SEQ ID NO: 5765670 - DNA, 16 bp, Homo sapiens
gctgggagggggccct

SEQ ID NO: 5765671 - DNA, 15 bp, Homo sapiens
gctgggaggtcccag

SEQ ID NO: 5765672 - DNA, 18 bp, Homo sapiens
gctgggaggttgggaggc

SEQ ID NO: 5765673 - DNA, 21 bp, Homo sapiens
gctgggagtccctacctgctt

SEQ ID NO: 5765674 - DNA, 17 bp, Homo sapiens
gctgggagtccttacct

SEQ ID NO: 5765675 - DNA, 20 bp, Homo sapiens
gctgggagtccttacctcgg

SEQ ID NO: 5765676 - DNA, 15 bp, Homo sapiens
gctgggagttctaga

SEQ ID NO: 5765677 - DNA, 20 bp, Homo sapiens
gctgggatcagagcaggagc

SEQ ID NO: 5765678 - DNA, 15 bp, Homo sapiens
gctgggatcccacag

SEQ ID NO: 5765679 - DNA, 17 bp, Homo sapiens
gctgggatcccacagcc

SEQ ID NO: 5765680 - DNA, 20 bp, Homo sapiens
gctgggatcccacagcccta

SEQ ID NO: 5765681 - DNA, 17 bp, Homo sapiens
gctgggatctgactgca

SEQ ID NO: 5765682 - DNA, 18 bp, Homo sapiens
gctgggatctgactgcac

SEQ ID NO: 5765683 - DNA, 20 bp, Homo sapiens
gctgggatctgactgcacgt

SEQ ID NO: 5765684 - DNA, 19 bp, Homo sapiens
gctgggatgattggagggg

SEQ ID NO: 5765685 - DNA, 23 bp, Homo sapiens
gctgggatggtgggcttcagggc

SEQ ID NO: 5765686 - DNA, 18 bp, Homo sapiens
gctgggattacaggcgtg

SEQ ID NO: 5765687 - DNA, 21 bp, Homo sapiens
gctgggattacaggctcctgc

SEQ ID NO: 5765688 - DNA, 22 bp, Homo sapiens
gctgggattacaggctcctgcc

SEQ ID NO: 5765689 - DNA, 17 bp, Homo sapiens
gctgggattacagggat

SEQ ID NO: 5765690 - DNA, 16 bp, Homo sapiens
gctgggattacaggtg

SEQ ID NO: 5765691 - DNA, 22 bp, Homo sapiens
gctgggattataggcatgagcc

SEQ ID NO: 5765692 - DNA, 23 bp, Homo sapiens
gctgggattggggggtgggcttt

SEQ ID NO: 5765693 - DNA, 24 bp, Homo sapiens
gctgggatttcttcgctgctctag

SEQ ID NO: 5765694 - DNA, 14 bp, Homo sapiens
gctgggattttaaa

SEQ ID NO: 5765695 - DNA, 20 bp, Homo sapiens
gctgggcacacgcctcccac

SEQ ID NO: 5765696 - DNA, 20 bp, Homo sapiens
gctgggcacagaggtcagga

SEQ ID NO: 5765697 - DNA, 17 bp, Homo sapiens
gctgggcaccacaggct

SEQ ID NO: 5765698 - DNA, 16 bp, Homo sapiens
gctgggcacctgactt

SEQ ID NO: 5765699 - DNA, 20 bp, Homo sapiens
gctgggcacggctccgaggg

SEQ ID NO: 5765700 - DNA, 16 bp, Homo sapiens
gctgggcactgctcca

SEQ ID NO: 5765701 - DNA, 21 bp, Homo sapiens
gctgggcactgctccaaggga

SEQ ID NO: 5765702 - DNA, 19 bp, Homo sapiens
gctgggcactgctctcacc

SEQ ID NO: 5765703 - DNA, 14 bp, Homo sapiens
gctggtggcagagt

SEQ ID NO: 5765704 - DNA, 12 bp, Homo sapiens
gctggtggccca

SEQ ID NO: 5765705 - DNA, 17 bp, Homo sapiens
gctggtggccctgtgcc

SEQ ID NO: 5765706 - DNA, 19 bp, Homo sapiens
gctggtggccctgtgcctg

SEQ ID NO: 5765707 - DNA, 22 bp, Homo sapiens
gctggtggccctgtgcctgggc

SEQ ID NO: 5765708 - DNA, 23 bp, Homo sapiens
gctggtggccctgtgcctgggcc

SEQ ID NO: 5765709 - DNA, 15 bp, Homo sapiens
gctggtggccttggg

SEQ ID NO: 5765710 - DNA, 21 bp, Homo sapiens
gctggtgggaaggccggcagc

SEQ ID NO: 5765711 - DNA, 13 bp, Homo sapiens
gctggtgggcacc

SEQ ID NO: 5765712 - DNA, 19 bp, Homo sapiens
gctggtgggctggccgctg

SEQ ID NO: 5765713 - DNA, 21 bp, Homo sapiens
gctggtgggctggccgctgtg

SEQ ID NO: 5765714 - DNA, 12 bp, Homo sapiens
gctggtggggca

SEQ ID NO: 5765715 - DNA, 18 bp, Homo sapiens
gctggtgggtctgagctg

SEQ ID NO: 5765716 - DNA, 19 bp, Homo sapiens
gctggtgggtctgcagctg

SEQ ID NO: 5765717 - DNA, 18 bp, Homo sapiens
gctggtgggtgcctaggc

SEQ ID NO: 5765718 - DNA, 17 bp, Homo sapiens
gctggtggttgtgcctt

SEQ ID NO: 5765719 - DNA, 13 bp, Homo sapiens
gctggtggtttca

SEQ ID NO: 5765720 - DNA, 21 bp, Homo sapiens
gctggtggttttcagagcagg

SEQ ID NO: 5765721 - DNA, 22 bp, Homo sapiens
gctggtggttttcagagcagga

SEQ ID NO: 5765722 - DNA, 20 bp, Homo sapiens
gctggtgtactctaggactt

SEQ ID NO: 5765723 - DNA, 12 bp, Homo sapiens
gctggtgtagct

SEQ ID NO: 5765724 - DNA, 18 bp, Homo sapiens
gctggtgtagctacagag

SEQ ID NO: 5765725 - DNA, 23 bp, Homo sapiens
gctggtgtagctacagagaaacc

SEQ ID NO: 5765726 - DNA, 17 bp, Homo sapiens
gctggtgtatgcacagg

SEQ ID NO: 5765727 - DNA, 20 bp, Homo sapiens
gctggtgtcactctgcctct

SEQ ID NO: 5765728 - DNA, 13 bp, Homo sapiens
gctggtgtcccct

SEQ ID NO: 5765729 - DNA, 18 bp, Homo sapiens
gctggtgtccccttcccc

SEQ ID NO: 5765730 - DNA, 23 bp, Homo sapiens
gctggtgtccccttcccctgctg

SEQ ID NO: 5765731 - DNA, 16 bp, Homo sapiens
gctggtgtcctgacca

SEQ ID NO: 5765732 - DNA, 13 bp, Homo sapiens
gctggtgtggcca

SEQ ID NO: 5765733 - DNA, 15 bp, Homo sapiens
gctggtgtggtacag

SEQ ID NO: 5765734 - DNA, 16 bp, Homo sapiens
gctggtgttaacagaa

SEQ ID NO: 5765735 - DNA, 21 bp, Homo sapiens
gctggtgttaacagaagggag

SEQ ID NO: 5765736 - DNA, 22 bp, Homo sapiens
gctggtgttaacagaagggagg

SEQ ID NO: 5765737 - DNA, 21 bp, Homo sapiens
gctggtgttcaccaaaaccaa

SEQ ID NO: 5765738 - DNA, 15 bp, Homo sapiens
gctggttaatgggaa

SEQ ID NO: 5765739 - DNA, 17 bp, Homo sapiens
gctggttcagccttcgt

SEQ ID NO: 5765740 - DNA, 13 bp, Homo sapiens
gctggttcctctc

SEQ ID NO: 5765741 - DNA, 21 bp, Homo sapiens
gctggttcggatttggggtgg

SEQ ID NO: 5765742 - DNA, 13 bp, Homo sapiens
gctggttctgttt

SEQ ID NO: 5765743 - DNA, 13 bp, Homo sapiens
gctggttgctgta
